United States Patent 11,640,849 (METHODS FOR HISTOLOGICAL DIAGNOSIS AND TREATMENT OF DISEASES) - sequence listing, part 41

SEQ ID NO: 1575569 - protein, 19 aa, Staphylococcus aureus
MGRQPWIVRGYMRVAEAAT

SEQ ID NO: 1575570 - protein, 19 aa, Staphylococcus aureus
MLLSTSILILSSSSLGLAT

SEQ ID NO: 1575571 - protein, 21 aa, Staphylococcus aureus
PEHNYQFGGSLIKSKNLSTLL

SEQ ID NO: 1575572 - protein, 28 aa, Staphylococcus aureus
PILRKFKIATPVFKPLFAWQMSGILLWI

SEQ ID NO: 1575573 - protein, 29 aa, Staphylococcus aureus
PLVVYDIGFQFSFIISFFIMLLFPFLQQL

SEQ ID NO: 1575574 - protein, 17 aa, Staphylococcus aureus
PSGHAMGSTAYFGSGIY

SEQ ID NO: 1575575 - protein, 18 aa, Staphylococcus aureus
RLIVISMLLLLFWSTEKV

SEQ ID NO: 1575576 - protein, 19 aa, Staphylococcus aureus
RNTTLRNTLKGALPVGFLG

SEQ ID NO: 1575577 - protein, 22 aa, Staphylococcus aureus
RPYFHMIWHIFIVIASLLHLIA

SEQ ID NO: 1575578 - protein, 26 aa, Staphylococcus aureus
SGNEICQEWLYHLGVSTDKIEDLAKH

SEQ ID NO: 1575579 - protein, 17 aa, Staphylococcus aureus
SLVSMIIQIIVVILTAI

SEQ ID NO: 1575580 - protein, 25 aa, Staphylococcus aureus
SSTQSIYMSIPFLAPAIFIIGGIML

SEQ ID NO: 1575581 - protein, 19 aa, Staphylococcus aureus
SYIPFLAPFQLVVRAQTSG

SEQ ID NO: 1575582 - protein, 20 aa, Staphylococcus aureus
VCGYFAFSIFVGIYLSINDR

SEQ ID NO: 1575583 - protein, 23 aa, Staphylococcus aureus
VGFPRWASITTIMLALFAIIGLI

SEQ ID NO: 1575584 - protein, 22 aa, Staphylococcus aureus
VISGGILMAIVFLFGANSFNPK

SEQ ID NO: 1575585 - protein, 17 aa, Staphylococcus aureus
VIVCGYFAFSIFVGIYL

SEQ ID NO: 1575586 - protein, 19 aa, Staphylococcus aureus
VLVGAGFLSSLLMINKNKV

SEQ ID NO: 1575587 - protein, 19 aa, Staphylococcus aureus
VSGSLSIAASQSVSTSTSD

SEQ ID NO: 1575588 - protein, 22 aa, Staphylococcus aureus
WISLFFPFINWFIPKRYVKISR

SEQ ID NO: 1575589 - protein, 18 aa, Staphylococcus aureus
YIPLFFLFIALYPFLVFI

SEQ ID NO: 1575590 - protein, 21 aa, Staphylococcus aureus
AESLSAFRLILATIILLPFVI

SEQ ID NO: 1575591 - protein, 20 aa, Staphylococcus aureus
AMKRNSWLDITLMIIALIGL

SEQ ID NO: 1575592 - protein, 18 aa, Staphylococcus aureus
DSLMKLNPFWTILLSIVF

SEQ ID NO: 1575593 - protein, 18 aa, Staphylococcus aureus
EILPDTKYPIAVTDWNKK

SEQ ID NO: 1575594 - protein, 26 aa, Staphylococcus aureus
EKTFFPFFLCVAIMYLSIGLQYLLHI

SEQ ID NO: 1575595 - protein, 19 aa, Staphylococcus aureus
ELKGAKFIILYAYSMLVLL

SEQ ID NO: 1575596 - protein, 21 aa, Staphylococcus aureus
EVHVASEFVYNMPLLSEKPLF

SEQ ID NO: 1575597 - protein, 17 aa, Staphylococcus aureus
FANFGTVGIIVGSIKGI

SEQ ID NO: 1575598 - protein, 46 aa, Staphylococcus aureus
FHVGFVRYFSRMIIPNLFSLLASIIVLWLYFRKAIPKTFDDNNIKH

SEQ ID NO: 1575599 - protein, 17 aa, Staphylococcus aureus
GKDIKVLTSKFGQADRV

SEQ ID NO: 1575600 - protein, 18 aa, Staphylococcus aureus
GNPLGLQFANSVTSGIIS

SEQ ID NO: 1575601 - protein, 17 aa, Staphylococcus aureus
GSLPQLIFLIAVPNNSQ

SEQ ID NO: 1575602 - protein, 21 aa, Staphylococcus aureus
HHFKIARKSFFVENGSLVQIA

SEQ ID NO: 1575603 - protein, 24 aa, Staphylococcus aureus
HNIIIELILSFGLLGFFIIMICIL

SEQ ID NO: 1575604 - protein, 18 aa, Staphylococcus aureus
IPSLEIDNASVLDEFYWL

SEQ ID NO: 1575605 - protein, 23 aa, Staphylococcus aureus
ISLLITVILGFFIARTITKPITD

SEQ ID NO: 1575606 - protein, 28 aa, Staphylococcus aureus
ISQFYLYYIVSAFLFWLVILTFGIAGII

SEQ ID NO: 1575607 - protein, 19 aa, Staphylococcus aureus
KKQYMLFAAGIVLATILLI

SEQ ID NO: 1575608 - protein, 22 aa, Staphylococcus aureus
KKVPEGLDLIVVILFAPAIAFG

SEQ ID NO: 1575609 - protein, 17 aa, Staphylococcus aureus
KNKWTHFLISIPVIIGG

SEQ ID NO: 1575610 - protein, 33 aa, Staphylococcus aureus
KSYLPQVFKSMMVPLIIIIAMFFIHFNTALIML

SEQ ID NO: 1575611 - protein, 17 aa, Staphylococcus aureus
LEIDNASVLDEFYWLNK

SEQ ID NO: 1575612 - protein, 27 aa, Staphylococcus aureus
LGGIHEIYFPYVLMRPLLFIAVILGGM

SEQ ID NO: 1575613 - protein, 18 aa, Staphylococcus aureus
LGVGEGFNVIASDALAML

SEQ ID NO: 1575614 - protein, 17 aa, Staphylococcus aureus
LVLGLLISSAMVYINPT

SEQ ID NO: 1575615 - protein, 21 aa, Staphylococcus aureus
MPDKMIKRLNLSSGAGSVRIS

SEQ ID NO: 1575616 - protein, 26 aa, Staphylococcus aureus
NNAFNVRIGWLILRILAVVFAWMTFL

SEQ ID NO: 1575617 - protein, 23 aa, Staphylococcus aureus
NQMIEYGKSQGRDIHYQEGVPSY

SEQ ID NO: 1575618 - protein, 17 aa, Staphylococcus aureus
NSLIPIITFLGADIVSI

SEQ ID NO: 1575619 - protein, 20 aa, Staphylococcus aureus
PIMISGILFFKTNIDKTYIF

SEQ ID NO: 1575620 - protein, 23 aa, Staphylococcus aureus
PLSENTIIFGWIFYFFLGAYMGY

SEQ ID NO: 1575621 - protein, 17 aa, Staphylococcus aureus
PVEQGKVVTPVIEINEK

SEQ ID NO: 1575622 - protein, 36 aa, Staphylococcus aureus
QLIILGFLLHYIFKINDKWLLILCVLVIIINASWNT

SEQ ID NO: 1575623 - protein, 20 aa, Staphylococcus aureus
RCRNCRKRISLTHFLGETFA

SEQ ID NO: 1575624 - protein, 24 aa, Staphylococcus aureus
RYYLFEKRYHPFIAAIVIGLIALL

SEQ ID NO: 1575625 - protein, 17 aa, Staphylococcus aureus
SAWQMSFTINRQQQFKD

SEQ ID NO: 1575626 - protein, 38 aa, Staphylococcus aureus
SILTIVALLSFKLYRFYFYRLFAIVTWILFIGSLSQYF

SEQ ID NO: 1575627 - protein, 17 aa, Staphylococcus aureus
SMMIGSGIGGAIALGLG

SEQ ID NO: 1575628 - protein, 24 aa, Staphylococcus aureus
TFHASMTFGLIFLFSEEIGDLFSI

SEQ ID NO: 1575629 - protein, 18 aa, Staphylococcus aureus
TKHNGTPAQSEKRLPDTG

SEQ ID NO: 1575630 - protein, 17 aa, Staphylococcus aureus
TSLDFFVIEDFSYSPRL

SEQ ID NO: 1575631 - protein, 18 aa, Staphylococcus aureus
TVSRKVVVQLTKFEKVLY

SEQ ID NO: 1575632 - protein, 30 aa, Staphylococcus aureus
TYQNEPLPNRKDFVVSFITGALVGSALGLY

SEQ ID NO: 1575633 - protein, 17 aa, Staphylococcus aureus
VQYRTSFFIYKEETSRI

SEQ ID NO: 1575634 - protein, 25 aa, Staphylococcus aureus
VVSLCISIPLGIIAAKRFHKWTDKV

SEQ ID NO: 1575635 - protein, 36 aa, Staphylococcus aureus
VYYTKKKAEVELDINTASTWKKFEVYENNQKLPVRL

SEQ ID NO: 1575636 - protein, 19 aa, Staphylococcus aureus
WQYHCRFYKVDQLSVQYRT

SEQ ID NO: 1575637 - protein, 20 aa, Staphylococcus aureus
WRVPQHIVHPTWSLLTNVLL

SEQ ID NO: 1575638 - protein, 18 aa, Staphylococcus aureus
YSIFKSPLTYLAILVVSS

SEQ ID NO: 1575639 - protein, 19 aa, Staphylococcus aureus
AFTTFVFPLMILKLTGSAF

SEQ ID NO: 1575640 - protein, 23 aa, Staphylococcus aureus
AIGSAFGSTALWIGAGLMSLAVL

SEQ ID NO: 1575641 - protein, 33 aa, Staphylococcus aureus
AIYFYPRFKRSMIGISVAMIWVFLNDYIDYFHL

SEQ ID NO: 1575642 - protein, 17 aa, Staphylococcus aureus
AKGIFVVADVTIKNKGK

SEQ ID NO: 1575643 - protein, 27 aa, Staphylococcus aureus
DKNSRYGIAGPMPIVMVSIIKSMMHQK

SEQ ID NO: 1575644 - protein, 20 aa, Staphylococcus aureus
DLFFKYIVMSLFLWLMWSHQ

SEQ ID NO: 1575645 - protein, 21 aa, Staphylococcus aureus
EIIDFNMFINKIINRHEMSAK

SEQ ID NO: 1575646 - protein, 20 aa, Staphylococcus aureus
EMRKLKGLKPLKINSDLAHI

SEQ ID NO: 1575647 - protein, 25 aa, Staphylococcus aureus
ESNSMHPSDSMSMHHTHSTSTSRLS

SEQ ID NO: 1575648 - protein, 18 aa, Staphylococcus aureus
EVIWPKTGLIYFGMADIG

SEQ ID NO: 1575649 - protein, 23 aa, Staphylococcus aureus
EVPAEPGKPVPPAKEEPKKPSKP

SEQ ID NO: 1575650 - protein, 17 aa, Staphylococcus aureus
EWFKAHFNFNDLEVDDA

SEQ ID NO: 1575651 - protein, 18 aa, Staphylococcus aureus
FFVIRYPKLKNMDNDELS

SEQ ID NO: 1575652 - protein, 17 aa, Staphylococcus aureus
FRLILATIILLPFVIIK

SEQ ID NO: 1575653 - protein, 18 aa, Staphylococcus aureus
FSIVRMLISFAVIAGIIY

SEQ ID NO: 1575654 - protein, 19 aa, Staphylococcus aureus
FSKKCTYWVTLIITQILLT

SEQ ID NO: 1575655 - protein, 20 aa, Staphylococcus aureus
GEIQRLAITRMLLKDTASTW

SEQ ID NO: 1575656 - protein, 17 aa, Staphylococcus aureus
GILTGFILSLSRALGET

SEQ ID NO: 1575657 - protein, 20 aa, Staphylococcus aureus
GYWFLRFRAALVPVANLGSS

SEQ ID NO: 1575658 - protein, 27 aa, Staphylococcus aureus
IAQIDVKGSDVWTAFEHSLGAPTTQKD

SEQ ID NO: 1575659 - protein, 17 aa, Staphylococcus aureus
IDGEGGYVDGYIETIEE

SEQ ID NO: 1575660 - protein, 21 aa, Staphylococcus aureus
ILERRHLKKRITVSSSVNLQF

SEQ ID NO: 1575661 - protein, 26 aa, Staphylococcus aureus
ILIKSSRLNNILTILSIVLVIIHMGI

SEQ ID NO: 1575662 - protein, 20 aa, Staphylococcus aureus
KLSVLHGRFVTVKGICMVSL

SEQ ID NO: 1575663 - protein, 21 aa, Staphylococcus aureus
LEVLRLPRITLAILAGAALGM

SEQ ID NO: 1575664 - protein, 18 aa, Staphylococcus aureus
LFILRLVLLSCLFILTIS

SEQ ID NO: 1575665 - protein, 20 aa, Staphylococcus aureus
LKKIESRNCIVKGQFKVNDN

SEQ ID NO: 1575666 - protein, 20 aa, Staphylococcus aureus
LSGSISLSGSTSLSTSDSLS

SEQ ID NO: 1575667 - protein, 17 aa, Staphylococcus aureus
MFFIHFNTALIMLITAP

SEQ ID NO: 1575668 - protein, 19 aa, Staphylococcus aureus
MITPKGVKLFYPLPFNVKT

SEQ ID NO: 1575669 - protein, 19 aa, Staphylococcus aureus
MSGCNSGIFSASRMIYTLA

SEQ ID NO: 1575670 - protein, 19 aa, Staphylococcus aureus
NIFFARVALELGSKKFEKG

SEQ ID NO: 1575671 - protein, 27 aa, Staphylococcus aureus
NKLVVSEIFKIIGLLLLLYQNQYLILV

SEQ ID NO: 1575672 - protein, 17 aa, Staphylococcus aureus
PVVEFNRSITLVFITDL

SEQ ID NO: 1575673 - protein, 19 aa, Staphylococcus aureus
QNFVEWIFDFVRGIIEGNM

SEQ ID NO: 1575674 - protein, 39 aa, Staphylococcus aureus
QSISKKMTGYGLKTTAVIGGAFTVNMLHDQQAFAASDAP

SEQ ID NO: 1575675 - protein, 18 aa, Staphylococcus aureus
RGPMGDAVIEGYINENKE

SEQ ID NO: 1575676 - protein, 21 aa, Staphylococcus aureus
RMQREHVHMSLIIDEYGGTAG

SEQ ID NO: 1575677 - protein, 19 aa, Staphylococcus aureus
RVIPSMMIGSGIGGAIALG

SEQ ID NO: 1575678 - protein, 17 aa, Staphylococcus aureus
RYGDRLIVTGAKEYVDE

SEQ ID NO: 1575679 - protein, 17 aa, Staphylococcus aureus
SLYALIMTLCGVHGTIS

SEQ ID NO: 1575680 - protein, 26 aa, Staphylococcus aureus
SSMKWDEILTILPWIIGALIVTIFIG

SEQ ID NO: 1575681 - protein, 25 aa, Staphylococcus aureus
STSDSLRTSTSLSDSLSMSTSGSLS

SEQ ID NO: 1575682 - protein, 17 aa, Staphylococcus aureus
SVTLGTLLISGGVTPAA

SEQ ID NO: 1575683 - protein, 23 aa, Staphylococcus aureus
TELRRVKVPYGIYVFTIIILVPF

SEQ ID NO: 1575684 - protein, 19 aa, Staphylococcus aureus
VNHSHWITGMSIEGHKENI

SEQ ID NO: 1575685 - protein, 19 aa, Staphylococcus aureus
VSKKDYKAIAKELSISEDY

SEQ ID NO: 1575686 - protein, 18 aa, Staphylococcus aureus
WDSIDNICTVIWIVLVII

SEQ ID NO: 1575687 - protein, 29 aa, Staphylococcus aureus
WIFNLIRIVLPIIIIFIIFIVLYSVAPNV

SEQ ID NO: 1575688 - protein, 19 aa, Staphylococcus aureus
WKILIIACLMTWFCSDFYL

SEQ ID NO: 1575689 - protein, 24 aa, Staphylococcus aureus
ALLQLRIAIHKSPLDTAKVSHAWT

SEQ ID NO: 1575690 - protein, 29 aa, Staphylococcus aureus
ATDTKLRIFEVNDTSKLSDSYYADPNDSN

SEQ ID NO: 1575691 - protein, 23 aa, Staphylococcus aureus
EIDRRKKILSQYRVTSISEYRKL

SEQ ID NO: 1575692 - protein, 21 aa, Staphylococcus aureus
ESATESFLKFSHITGSDGVQA

SEQ ID NO: 1575693 - protein, 25 aa, Staphylococcus aureus
EVYGPKWLYIISVIVFSLSYLILVI

SEQ ID NO: 1575694 - protein, 19 aa, Staphylococcus aureus
EYISNYGLFSTILGMGFIS

SEQ ID NO: 1575695 - protein, 17 aa, Staphylococcus aureus
FALCTISSMIIMMSMVG

SEQ ID NO: 1575696 - protein, 21 aa, Staphylococcus aureus
FCQNIPKKSWFVSATSTTNNK

SEQ ID NO: 1575697 - protein, 17 aa, Staphylococcus aureus
FVLFWKNYVNFKGRSRR

SEQ ID NO: 1575698 - protein, 18 aa, Staphylococcus aureus
FVTTDSYGVATTYTSSST

SEQ ID NO: 1575699 - protein, 19 aa, Staphylococcus aureus
GALVGSIFLFIIIVIFLMY

SEQ ID NO: 1575700 - protein, 24 aa, Staphylococcus aureus
GDSNVFLLNWDIRGLTSYIFSFLI

SEQ ID NO: 1575701 - protein, 18 aa, Staphylococcus aureus
GLQINWSSIKGLKENIGK

SEQ ID NO: 1575702 - protein, 24 aa, Staphylococcus aureus
GLVCLFMMKLVLAITFFAVSLSIS

SEQ ID NO: 1575703 - protein, 23 aa, Staphylococcus aureus
GTAIGGWKIIKTVGGNIMKIRPA

SEQ ID NO: 1575704 - protein, 26 aa, Staphylococcus aureus
GTVQLIWNLIQLWFVGKILGVVRYFG

SEQ ID NO: 1575705 - protein, 55 aa, Staphylococcus aureus
HDSLANEKTRVRLYKSGKNWVKSGIKEIEMFKIMGLPFISHSLVSQDNQSISKKM

SEQ ID NO: 1575706 - protein, 19 aa, Staphylococcus aureus
IKVPASILNKSVKGIKLEQ

SEQ ID NO: 1575707 - protein, 21 aa, Staphylococcus aureus
KDIKSGASSAFNWTKDQIGKG

SEQ ID NO: 1575708 - protein, 17 aa, Staphylococcus aureus
KKRITVSSSVNLQFIHI

SEQ ID NO: 1575709 - protein, 28 aa, Staphylococcus aureus
KNIRDIKMWILGLIGTILSTFVIALLKT

SEQ ID NO: 1575710 - protein, 20 aa, Staphylococcus aureus
KTKRLEVVIFMHFLNNLLAL

SEQ ID NO: 1575711 - protein, 18 aa, Staphylococcus aureus
KVLSTFLFILLLYITYRK

SEQ ID NO: 1575712 - protein, 18 aa, Staphylococcus aureus
LGIASLLMSLIMGLLSEK

SEQ ID NO: 1575713 - protein, 24 aa, Staphylococcus aureus
LGTAIGGWKIIKTVGGNIMKIRPA

SEQ ID NO: 1575714 - protein, 25 aa, Staphylococcus aureus
LILIVVVVGFGIYFYASKDKEINNT

SEQ ID NO: 1575715 - protein, 23 aa, Staphylococcus aureus
LLQLRIAIHKSPLDTAKVSHAWT

SEQ ID NO: 1575716 - protein, 20 aa, Staphylococcus aureus
LPLAGSIVGLFLFYLLLQFK

SEQ ID NO: 1575717 - protein, 20 aa, Staphylococcus aureus
LRYYPFDSVAMFITLIIIAV

SEQ ID NO: 1575718 - protein, 17 aa, Staphylococcus aureus
LTICIIGKLLYESLETI

SEQ ID NO: 1575719 - protein, 18 aa, Staphylococcus aureus
LYWYCKKIKNDPKASYSY

SEQ ID NO: 1575720 - protein, 23 aa, Staphylococcus aureus
MKQGETGRQIGWFISYDKDNPNM

SEQ ID NO: 1575721 - protein, 17 aa, Staphylococcus aureus
MLMPKIGVMTWKHVENK

SEQ ID NO: 1575722 - protein, 19 aa, Staphylococcus aureus
MLPKARRLGISWMAVGLLG

SEQ ID NO: 1575723 - protein, 23 aa, Staphylococcus aureus
NHSGGSKNGGTWNPNASDGSNQG

SEQ ID NO: 1575724 - protein, 19 aa, Staphylococcus aureus
NKPDHPFVFWATLKNAASL

SEQ ID NO: 1575725 - protein, 24 aa, Staphylococcus aureus
NSIVLKSILSLGIIYGGTFGIYPK

SEQ ID NO: 1575726 - protein, 20 aa, Staphylococcus aureus
RLSLKNEIYPFFLTDKKNFD

SEQ ID NO: 1575727 - protein, 17 aa, Staphylococcus aureus
RSVAFFLTALPSYWIAS

SEQ ID NO: 1575728 - protein, 21 aa, Staphylococcus aureus
SKEIPFIIIIQFACILINTGL

SEQ ID NO: 1575729 - protein, 18 aa, Staphylococcus aureus
SLLGLFQFILGGAVAPLV

SEQ ID NO: 1575730 - protein, 21 aa, Staphylococcus aureus
SSWFLTFGYVCVVALNATAFS

SEQ ID NO: 1575731 - protein, 19 aa, Staphylococcus aureus
STSTSRLSSEATTSTSESQ

SEQ ID NO: 1575732 - protein, 23 aa, Staphylococcus aureus
TFLPEVWYIISSIVGYLLFGTGL

SEQ ID NO: 1575733 - protein, 18 aa, Staphylococcus aureus
TRYTFVLAPDELFFTRDG

SEQ ID NO: 1575734 - protein, 24 aa, Staphylococcus aureus
TSTSNRMSTIASLSTSVSTSESGS

SEQ ID NO: 1575735 - protein, 17 aa, Staphylococcus aureus
TTVRLIFPLQNEIVERM

SEQ ID NO: 1575736 - protein, 22 aa, Staphylococcus aureus
TWLPIEIKLALITTLIALFSTL

SEQ ID NO: 1575737 - protein, 18 aa, Staphylococcus aureus
VIVWIAWIKPLAHINEIF

SEQ ID NO: 1575738 - protein, 29 aa, Staphylococcus aureus
VYVIFYFIWLRFEWPHYLLYILLVLGALS

SEQ ID NO: 1575739 - protein, 17 aa, Staphylococcus aureus
WQMSFTINRQQQFKDQP

SEQ ID NO: 1575740 - protein, 35 aa, Staphylococcus aureus
YGQKKSKKGWFWGCGGCLVLFILIIIGISACTAGI

SEQ ID NO: 1575741 - protein, 24 aa, Staphylococcus aureus
YIVRRYGWGGFKRAGDYAYATGGK

SEQ ID NO: 1575742 - protein, 19 aa, Staphylococcus aureus
YYLCYIPLFFLFIALYPFL

SEQ ID NO: 1575743 - protein, 23 aa, Staphylococcus aureus
AERQRALSYWSIGSWGGSGICSL

SEQ ID NO: 1575744 - protein, 20 aa, Staphylococcus aureus
AKAFLLRQIEDTFKSKQTEM

SEQ ID NO: 1575745 - protein, 17 aa, Staphylococcus aureus
AMLIPSMGYIVGLLIGL

SEQ ID NO: 1575746 - protein, 18 aa, Staphylococcus aureus
AMLIPSMGYIVGLLIGLY

SEQ ID NO: 1575747 - protein, 25 aa, Staphylococcus aureus
AQGDVKVYLPNGAVRDDAWLQKKLN

SEQ ID NO: 1575748 - protein, 17 aa, Staphylococcus aureus
ATIHDFNLIKAIGVLLL

SEQ ID NO: 1575749 - protein, 19 aa, Staphylococcus aureus
CIVASVIYLKVKYDEKEKQ

SEQ ID NO: 1575750 - protein, 18 aa, Staphylococcus aureus
CVLLLLKYIGFKLFIYEG

SEQ ID NO: 1575751 - protein, 17 aa, Staphylococcus aureus
DALPSLDRMASIFEEGF

SEQ ID NO: 1575752 - protein, 17 aa, Staphylococcus aureus
EEQRNGFIQSLKDDPSQ

SEQ ID NO: 1575753 - protein, 17 aa, Staphylococcus aureus
FDLKKIESRNCIVKGQF

SEQ ID NO: 1575754 - protein, 18 aa, Staphylococcus aureus
FPIDSLFYIVSLNLSLTM

SEQ ID NO: 1575755 - protein, 23 aa, Staphylococcus aureus
GSLRYIHDIWGYIAPNTKKEKQP

SEQ ID NO: 1575756 - protein, 18 aa, Staphylococcus aureus
GTEMSPILLAWIVAAVLR

SEQ ID NO: 1575757 - protein, 17 aa, Staphylococcus aureus
HEIAHVVLAGGFGGSDA

SEQ ID NO: 1575758 - protein, 19 aa, Staphylococcus aureus
HLKILQRLSKALMNDETRQ

SEQ ID NO: 1575759 - protein, 20 aa, Staphylococcus aureus
HLKILQRLSKALMNDETRQS

SEQ ID NO: 1575760 - protein, 18 aa, Staphylococcus aureus
IIDDVKLPSFIEEIDSIR

SEQ ID NO: 1575761 - protein, 23 aa, Staphylococcus aureus
ILYMGSLFYAWMAIRNLWNRPLL

SEQ ID NO: 1575762 - protein, 17 aa, Staphylococcus aureus
INLPSYLGFFAGKRFVP

SEQ ID NO: 1575763 - protein, 26 aa, Staphylococcus aureus
IYHSFLLKKWYLIIYLLFILAALLIT

SEQ ID NO: 1575764 - protein, 19 aa, Staphylococcus aureus
KPVEQGKVVTPVIEINEKV

SEQ ID NO: 1575765 - protein, 22 aa, Staphylococcus aureus
KQKEAKFENGVITRKADEKTTN

SEQ ID NO: 1575766 - protein, 25 aa, Staphylococcus aureus
KVLLMLLLYRFAYYFVPVIIALILS

SEQ ID NO: 1575767 - protein, 24 aa, Staphylococcus aureus
LFIMRLAKIQLWFLIKGLTPIFFF

SEQ ID NO: 1575768 - protein, 22 aa, Staphylococcus aureus
LNQELREAIKNPAIKDKDHSAP

SEQ ID NO: 1575769 - protein, 18 aa, Staphylococcus aureus
LPLYPVLPAITFVLVLLV

SEQ ID NO: 1575770 - protein, 18 aa, Staphylococcus aureus
LPLYPVLPAVTFVLVLLV

SEQ ID NO: 1575771 - protein, 20 aa, Staphylococcus aureus
LSAYILWGILPIYWQFVDAI

SEQ ID NO: 1575772 - protein, 23 aa, Staphylococcus aureus
LSTSISTSMSMSASTSSSQSTSV

SEQ ID NO: 1575773 - protein, 24 aa, Staphylococcus aureus
LTMIICTIITYLLYNNYFVAMMVY

SEQ ID NO: 1575774 - protein, 17 aa, Staphylococcus aureus
NGKVFLNKGYGYQDVDK

SEQ ID NO: 1575775 - protein, 17 aa, Staphylococcus aureus
PAAMFVLVAGIGLIATV

SEQ ID NO: 1575776 - protein, 20 aa, Staphylococcus aureus
PSLIARIAAIFSKEPDTFNL

SEQ ID NO: 1575777 - protein, 23 aa, Staphylococcus aureus
QAKERRSMYIFKKDLLPKMYWYG

SEQ ID NO: 1575778 - protein, 24 aa, Staphylococcus aureus
RQSYIRRLFGYTAIHFIITSDFEN

SEQ ID NO: 1575779 - protein, 17 aa, Staphylococcus aureus
SSVSLIFKTLKKSKNGR

SEQ ID NO: 1575780 - protein, 22 aa, Staphylococcus aureus
SSWFLTFGYVCVVALNATAFSL

SEQ ID NO: 1575781 - protein, 18 aa, Staphylococcus aureus
SVKHKWIYVLFTIIDIPI

SEQ ID NO: 1575782 - protein, 17 aa, Staphylococcus aureus
TEMSPILLAWIVAAVLR

SEQ ID NO: 1575783 - protein, 18 aa, Staphylococcus aureus
TLVAFNFISGVLTLPGLA

SEQ ID NO: 1575784 - protein, 23 aa, Staphylococcus aureus
VFFICSILLFLGFIFNALLKYTN

SEQ ID NO: 1575785 - protein, 17 aa, Staphylococcus aureus
VIFGELFNAIKGNRIVA

SEQ ID NO: 1575786 - protein, 25 aa, Staphylococcus aureus
VQWWHWMNHLLHFNLGKSFESKEPV

SEQ ID NO: 1575787 - protein, 18 aa, Staphylococcus aureus
AALFILKTIDSHGITDQF

SEQ ID NO: 1575788 - protein, 26 aa, Staphylococcus aureus
AQGDVKVYLPNGAVRDDAWLQKKLNY

SEQ ID NO: 1575789 - protein, 24 aa, Staphylococcus aureus
ATHCVTRLRLVLKDESKVDKDALS

SEQ ID NO: 1575790 - protein, 25 aa, Staphylococcus aureus
DAEKGVYAHYMLKEIHEQPAVMRRI

SEQ ID NO: 1575791 - protein, 25 aa, Staphylococcus aureus
DSGFYKPTYNLGDYVWEDTNKNGVQ

SEQ ID NO: 1575792 - protein, 26 aa, Staphylococcus aureus
EETVAYTKERVEGFLNKSKNEQAALK

SEQ ID NO: 1575793 - protein, 21 aa, Staphylococcus aureus
EIEQAKAQLAQALQDIKDLVK

SEQ ID NO: 1575794 - protein, 17 aa, Staphylococcus aureus
FHEGVDFPFVYQEVRTP

SEQ ID NO: 1575795 - protein, 26 aa, Staphylococcus aureus
FIALMLKWWLLLVISIIVLIIITVAM

SEQ ID NO: 1575796 - protein, 18 aa, Staphylococcus aureus
FIKIGLYFQIAYIVLMAI

SEQ ID NO: 1575797 - protein, 17 aa, Staphylococcus aureus
GASLSFIKLFKVDPIEA

SEQ ID NO: 1575798 - protein, 18 aa, Staphylococcus aureus
GRMARLVGMILIAIVTFI

SEQ ID NO: 1575799 - protein, 37 aa, Staphylococcus aureus
GSAWWSWVICSGIIGCLYGWIGLKLNLSSGRFSRKSM

SEQ ID NO: 1575800 - protein, 21 aa, Staphylococcus aureus
IGISACTAGITGNLGGNSSKE

SEQ ID NO: 1575801 - protein, 18 aa, Staphylococcus aureus
ILTICIIGKLLYESLETI

SEQ ID NO: 1575802 - protein, 19 aa, Staphylococcus aureus
IPFNLLHLLSLKVVSIMIV

SEQ ID NO: 1575803 - protein, 21 aa, Staphylococcus aureus
IRRANGLSGNNIRNGQQIVIP

SEQ ID NO: 1575804 - protein, 20 aa, Staphylococcus aureus
KGALVGSIFLFIIIVIFLMY

SEQ ID NO: 1575805 - protein, 19 aa, Staphylococcus aureus
KKYIIPWALLGFALVMIYQ

SEQ ID NO: 1575806 - protein, 19 aa, Staphylococcus aureus
KNMFENYGLISLKDDHIEV

SEQ ID NO: 1575807 - protein, 22 aa, Staphylococcus aureus
LIMLFILDWKMTLLTFITIPIF

SEQ ID NO: 1575808 - protein, 25 aa, Staphylococcus aureus
LNGTLPRFSLGTMWKDIKSGASSAF

SEQ ID NO: 1575809 - protein, 24 aa, Staphylococcus aureus
LTFLPEMWYIVSSIVGYLLFGTGL

SEQ ID NO: 1575810 - protein, 23 aa, Staphylococcus aureus
MELPWVSFIVHFSFSIVIAIIYC

SEQ ID NO: 1575811 - protein, 20 aa, Staphylococcus aureus
MLPKARRLGISWMAVGLLGA

SEQ ID NO: 1575812 - protein, 20 aa, Staphylococcus aureus
MSGCNSGIFSASRMIYTLAH

SEQ ID NO: 1575813 - protein, 17 aa, Staphylococcus aureus
NAIKGNRIVAFIIATTV

SEQ ID NO: 1575814 - protein, 18 aa, Staphylococcus aureus
NFVEWIFDFVRGIIEGNM

SEQ ID NO: 1575815 - protein, 20 aa, Staphylococcus aureus
PKKYIIPWALLGFALVMIYQ

SEQ ID NO: 1575816 - protein, 22 aa, Staphylococcus aureus
PNTFELYNWPTLAIHLSYYVTF

SEQ ID NO: 1575817 - protein, 24 aa, Staphylococcus aureus
PTLKRMKFGQSIREEGPQSHMKKT

SEQ ID NO: 1575818 - protein, 44 aa, Staphylococcus aureus
QDAYSQKGAITLGTRIDSNKSFHFSGKVNLGNKYEGHGNGGDGI

SEQ ID NO: 1575819 - protein, 32 aa, Staphylococcus aureus
QFNFVKEDGMWKLDWDHSVIIPGMQKDQSIHI

SEQ ID NO: 1575820 - protein, 25 aa, Staphylococcus aureus
QIIARVGPIKVLRIILIINAIALII

SEQ ID NO: 1575821 - protein, 18 aa, Staphylococcus aureus
RATNPLIDFKLFKNKAYT

SEQ ID NO: 1575822 - protein, 25 aa, Staphylococcus aureus
RQSYIRRLFGYTAIHFIITSDFENK

SEQ ID NO: 1575823 - protein, 22 aa, Staphylococcus aureus
SDADAALTHFIEIWPYVEGQIQ

SEQ ID NO: 1575824 - protein, 18 aa, Staphylococcus aureus
SFANFGTVGIIVGSIKGI

SEQ ID NO: 1575825 - protein, 24 aa, Staphylococcus aureus
SLADKAIDVIIQFVAQNRGKFSDE

SEQ ID NO: 1575826 - protein, 22 aa, Staphylococcus aureus
SRRDGFNPMRIILAGAAVSAML

SEQ ID NO: 1575827 - protein, 19 aa, Staphylococcus aureus
SSHNINAYYALSRSLPLFL

SEQ ID NO: 1575828 - protein, 20 aa, Staphylococcus aureus
SVWLVLLFSVMGLWQVSNAA

SEQ ID NO: 1575829 - protein, 17 aa, Staphylococcus aureus
TLVAFNFISGVLTLPGL

SEQ ID NO: 1575830 - protein, 21 aa, Staphylococcus aureus
TNNTFQDFDINYNGDTKVMTV

SEQ ID NO: 1575831 - protein, 23 aa, Staphylococcus aureus
TWLTAEEALSFGLIDEILGANEI

SEQ ID NO: 1575832 - protein, 18 aa, Staphylococcus aureus
VLYIVIMVMSVFIIGCDK

SEQ ID NO: 1575833 - protein, 27 aa, Staphylococcus aureus
VNGQENLYRIAIQYYGSGSPENVEKIR

SEQ ID NO: 1575834 - protein, 19 aa, Staphylococcus aureus
VVIVWIAWIKPLAHINEIF

SEQ ID NO: 1575835 - protein, 20 aa, Staphylococcus aureus
VYRYKHCRYAFEKHHLRVRN

SEQ ID NO: 1575836 - protein, 17 aa, Staphylococcus aureus
WLEVSFLSMLWSVVQVV

SEQ ID NO: 1575837 - protein, 18 aa, Staphylococcus aureus
WNATKSIFGFLFNSVKSI

SEQ ID NO: 1575838 - protein, 18 aa, Staphylococcus aureus
YISNYGLFSTILGMGFIS

SEQ ID NO: 1575839 - protein, 18 aa, Staphylococcus aureus
YKQTVFVNPKQRVLGNTW

SEQ ID NO: 1575840 - protein, 26 aa, Staphylococcus aureus
YSPVPEDHAYIRFPVSDGTQELKIVS

SEQ ID NO: 1575841 - protein, 19 aa, Staphylococcus aureus
AIGSAFGSTALWIGAGLMS

SEQ ID NO: 1575842 - protein, 19 aa, Staphylococcus aureus
AMETLKHLVDNEIPNAEQT

SEQ ID NO: 1575843 - protein, 19 aa, Staphylococcus aureus
ARYPGRFNININVEDKYRD

SEQ ID NO: 1575844 - protein, 19 aa, Staphylococcus aureus
DLFFKYIVMSLFLWLMWSH

SEQ ID NO: 1575845 - protein, 22 aa, Staphylococcus aureus
ELRRVKVPYGIYVFTIIILVPF

SEQ ID NO: 1575846 - protein, 20 aa, Staphylococcus aureus
FALFVAFLFSFDRKNIDFKK

SEQ ID NO: 1575847 - protein, 18 aa, Staphylococcus aureus
FTTPEGYTPTTVTSGSDI

SEQ ID NO: 1575848 - protein, 19 aa, Staphylococcus aureus
GPSEVLGGSASEFSPTQLA

SEQ ID NO: 1575849 - protein, 21 aa, Staphylococcus aureus
GQIITFKAFELVGSSRAMPVT

SEQ ID NO: 1575850 - protein, 17 aa, Staphylococcus aureus
GTLLGGLSPHFATLLVA

SEQ ID NO: 1575851 - protein, 24 aa, Staphylococcus aureus
IAAKRAALVHVIFNLIGVIIFTIF

SEQ ID NO: 1575852 - protein, 18 aa, Staphylococcus aureus
IAQIDVKGSDVWTAFEHS

SEQ ID NO: 1575853 - protein, 18 aa, Staphylococcus aureus
IDNMFFNYLNAEHPIGLA

SEQ ID NO: 1575854 - protein, 24 aa, Staphylococcus aureus
IGIIAILVGFVWFKLYQYTTNPKA

SEQ ID NO: 1575855 - protein, 18 aa, Staphylococcus aureus
IINTVSFFVLLFIVNTIV

SEQ ID NO: 1575856 - protein, 18 aa, Staphylococcus aureus
IIVFLPLVFVSGSVGEMF

SEQ ID NO: 1575857 - protein, 19 aa, Staphylococcus aureus
ILISLGISIVYWIGSVILV

SEQ ID NO: 1575858 - protein, 24 aa, Staphylococcus aureus
KIDGKGWQKDKSWGGYNVTRYEVV

SEQ ID NO: 1575859 - protein, 17 aa, Staphylococcus aureus
KNGKLYVQITVNHSHWI

SEQ ID NO: 1575860 - protein, 20 aa, Staphylococcus aureus
KQHAVTDLNQLNGLNNPQRQ

SEQ ID NO: 1575861 - protein, 19 aa, Staphylococcus aureus
KTLQLPLILKIILNLALIG

SEQ ID NO: 1575862 - protein, 18 aa, Staphylococcus aureus
KVIFGELFNAIKGNRIVA

SEQ ID NO: 1575863 - protein, 17 aa, Staphylococcus aureus
LDNAMGAVQQYIDEQHL

SEQ ID NO: 1575864 - protein, 24 aa, Staphylococcus aureus
LFLTFPIMFIFAIAIVIDSPGNPI

SEQ ID NO: 1575865 - protein, 17 aa, Staphylococcus aureus
LLGLFQFILGGAVAPLV

SEQ ID NO: 1575866 - protein, 17 aa, Staphylococcus aureus
LVFCIATPIASWFLGKN

SEQ ID NO: 1575867 - protein, 18 aa, Staphylococcus aureus
NCATFPNQMIEYGKSQGR

SEQ ID NO: 1575868 - protein, 31 aa, Staphylococcus aureus
QFGTFEYTESAVTQVRYVDVTTGKDIIPPKT

SEQ ID NO: 1575869 - protein, 24 aa, Staphylococcus aureus
QWWHWMNHLLHFNLGKSFESKEPV

SEQ ID NO: 1575870 - protein, 17 aa, Staphylococcus aureus
RATNPLIDFKLFKNKAY

SEQ ID NO: 1575871 - protein, 20 aa, Staphylococcus aureus
RMQREHVHMSLIIDEYGGTA

SEQ ID NO: 1575872 - protein, 23 aa, Staphylococcus aureus
RQVCNFYPERIILLGHGENSIYL

SEQ ID NO: 1575873 - protein, 17 aa, Staphylococcus aureus
RVKKPASISLIICLIVL

SEQ ID NO: 1575874 - protein, 22 aa, Staphylococcus aureus
SALTAKGYNYTSVDSSYASTYN

SEQ ID NO: 1575875 - protein, 18 aa, Staphylococcus aureus
SFVLFWKNYVNFKGRSRR

SEQ ID NO: 1575876 - protein, 29 aa, Staphylococcus aureus
WIFNLIRIVLPIIIIFIVFIVLYSVAPNV

SEQ ID NO: 1575877 - protein, 24 aa, Staphylococcus aureus
WYNLGEDGHPEWIIPTDPARRNDA

SEQ ID NO: 1575878 - protein, 17 aa, Staphylococcus aureus
YDFPIDSLFYIVSLNLS

SEQ ID NO: 1575879 - protein, 22 aa, Staphylococcus aureus
YSKVIGIPKWIQFLFIVIVAMV

SEQ ID NO: 1575880 - protein, 18 aa, Staphylococcus aureus
YWFLRFRAALVPVANLGS

SEQ ID NO: 1575881 - protein, 22 aa, Staphylococcus aureus
ARVGPIKVLRIILIINAIALII

SEQ ID NO: 1575882 - protein, 17 aa, Staphylococcus aureus
ELVNILLGHSWVDAITV

SEQ ID NO: 1575883 - protein, 20 aa, Staphylococcus aureus
EMGRQPWIVRGYMRVAEAAT

SEQ ID NO: 1575884 - protein, 18 aa, Staphylococcus aureus
FSKIVYDVLGFLRLVFIP

SEQ ID NO: 1575885 - protein, 29 aa, Staphylococcus aureus
GCSHPNCPLRAAIVIPLEMHGSIVGTLKM

SEQ ID NO: 1575886 - protein, 17 aa, Staphylococcus aureus
GKKHVIPKSQYRRKRRE

SEQ ID NO: 1575887 - protein, 22 aa, Staphylococcus aureus
GKKSLLKRRLINIKEANLKKQS

SEQ ID NO: 1575888 - protein, 17 aa, Staphylococcus aureus
HMIPEVIGNLLLSAAIF

SEQ ID NO: 1575889 - protein, 22 aa, Staphylococcus aureus
HTDFIFAIICEELGLIGGLLVI

SEQ ID NO: 1575890 - protein, 19 aa, Staphylococcus aureus
IALMFDFEKAYWIPLSAHT

SEQ ID NO: 1575891 - protein, 28 aa, Staphylococcus aureus
IKCGGAPMKIMYLAEDYFRKHKIRSNAN

SEQ ID NO: 1575892 - protein, 19 aa, Staphylococcus aureus
ILLFSIPTPVAVILMGIAA

SEQ ID NO: 1575893 - protein, 17 aa, Staphylococcus aureus
ILMFIVGVWMHKRSNAK

SEQ ID NO: 1575894 - protein, 27 aa, Staphylococcus aureus
KDFLTQWKLYIISAVVLIMVLIGFIFW

SEQ ID NO: 1575895 - protein, 21 aa, Staphylococcus aureus
KEQQARITLYLKHNTKEPNTI

SEQ ID NO: 1575896 - protein, 21 aa, Staphylococcus aureus
KNEPSSFVISPFSAVQQQIKR

SEQ ID NO: 1575897 - protein, 20 aa, Staphylococcus aureus
KRNTTLRNTLKGALPVGFLG

SEQ ID NO: 1575898 - protein, 25 aa, Staphylococcus aureus
KTFFPFFLCVAIMYLSIGLQYLLHI

SEQ ID NO: 1575899 - protein, 22 aa, Staphylococcus aureus
LEVLRLPRITLAILAGAALGMS

SEQ ID NO: 1575900 - protein, 23 aa, Staphylococcus aureus
LLHIRTGLDYGDKRTCQAFASVA

SEQ ID NO: 1575901 - protein, 17 aa, Staphylococcus aureus
LLVTWMFPVGVAIISYG

SEQ ID NO: 1575902 - protein, 18 aa, Staphylococcus aureus
LPTTLAIIGGIITLLGVS

SEQ ID NO: 1575903 - protein, 23 aa, Staphylococcus aureus
LVFCIATPIASWFLGKNFFTHVT

SEQ ID NO: 1575904 - protein, 17 aa, Staphylococcus aureus
METYKPYAVYHAAAHKH

SEQ ID NO: 1575905 - protein, 21 aa, Staphylococcus aureus
NEMRKLKGLKPLKINSDLAHI

SEQ ID NO: 1575906 - protein, 35 aa, Staphylococcus aureus
NGKDDMSLDTGFYKEPKYNLGDYVWEDTNKDGIQD

SEQ ID NO: 1575907 - protein, 20 aa, Staphylococcus aureus
NKPDHPFVFWATLKNAASLL

SEQ ID NO: 1575908 - protein, 22 aa, Staphylococcus aureus
NSLSFSVVVFFIGILYTNTEVG

SEQ ID NO: 1575909 - protein, 24 aa, Staphylococcus aureus
PLSENTIIFGWIFYFFLGAYMGYN

SEQ ID NO: 1575910 - protein, 18 aa, Staphylococcus aureus
PNANAYASGWFTNNDEHL

SEQ ID NO: 1575911 - protein, 17 aa, Staphylococcus aureus
RFHDISRTMLFPMIMTV

SEQ ID NO: 1575912 - protein, 26 aa, Staphylococcus aureus
SCVVGYLCFGLGLGIYATPSTDTAIS

SEQ ID NO: 1575913 - protein, 18 aa, Staphylococcus aureus
SGSMSVSISLSDSTSTST

SEQ ID NO: 1575914 - protein, 17 aa, Staphylococcus aureus
SSFKLQIIFVILKMSET

SEQ ID NO: 1575915 - protein, 24 aa, Staphylococcus aureus
SSTQSIYMSIPFLAPAIFIIGGIM

SEQ ID NO: 1575916 - protein, 17 aa, Staphylococcus aureus
STTTFTINVVDTTAPTV

SEQ ID NO: 1575917 - protein, 18 aa, Staphylococcus aureus
TFALCTISSMIIMMSMVG

SEQ ID NO: 1575918 - protein, 32 aa, Staphylococcus aureus
TSTAPVKLRTFSRLAMSTFASAATTTAVTANT

SEQ ID NO: 1575919 - protein, 18 aa, Staphylococcus aureus
VADWTAPMMSEFFDLPGV

SEQ ID NO: 1575920 - protein, 18 aa, Staphylococcus aureus
VGISNLWTNGGFMPNGIV

SEQ ID NO: 1575921 - protein, 20 aa, Staphylococcus aureus
VGLILLRLFKINLFSFKKLT

SEQ ID NO: 1575922 - protein, 17 aa, Staphylococcus aureus
VLVGLILLRLFKINLFS

SEQ ID NO: 1575923 - protein, 17 aa, Staphylococcus aureus
VNLGLKDKIFFKDSANY

SEQ ID NO: 1575924 - protein, 18 aa, Staphylococcus aureus
YGWFLASSVAAFFVGVTE

SEQ ID NO: 1575925 - protein, 26 aa, Staphylococcus aureus
YIIRKSHSLEVIFIGTYIYMRLITSI

SEQ ID NO: 1575926 - protein, 20 aa, Staphylococcus aureus
YKLGLKQAKIAAVVQPISGI

SEQ ID NO: 1575927 - protein, 22 aa, Staphylococcus aureus
YLCGNFQFGLLVATGTLAHIYV

SEQ ID NO: 1575928 - protein, 17 aa, Staphylococcus aureus
YQNLTLDSIVFRNTLRY

SEQ ID NO: 1575929 - protein, 23 aa, Staphylococcus aureus
AKRKSNVTLIDWYKRSQGHSEYF

SEQ ID NO: 1575930 - protein, 17 aa, Staphylococcus aureus
ATIIATITLVFVALALY

SEQ ID NO: 1575931 - protein, 25 aa, Staphylococcus aureus
ATWIAKRVGLTWQDLEKGIAERLNT

SEQ ID NO: 1575932 - protein, 24 aa, Staphylococcus aureus
AYGSCIGWGAFILPGDWIKQSGPI

SEQ ID NO: 1575933 - protein, 22 aa, Staphylococcus aureus
DGNMLKPWFVNSVENPVSKRQF

SEQ ID NO: 1575934 - protein, 20 aa, Staphylococcus aureus
DNHQIIWVILNYEFNEARPT

SEQ ID NO: 1575935 - protein, 33 aa, Staphylococcus aureus
DSGSLSVSTSLRKSESVSESSSLSGSQSMSDSV

SEQ ID NO: 1575936 - protein, 26 aa, Staphylococcus aureus
DVLGFLRLVFIPAMIVFFQDSTIDNL

SEQ ID NO: 1575937 - protein, 19 aa, Staphylococcus aureus
EEIEKRLSQKKAFQIEFGR

SEQ ID NO: 1575938 - protein, 21 aa, Staphylococcus aureus
EIGGGYLIWLWLREGQSSLVG

SEQ ID NO: 1575939 - protein, 20 aa, Staphylococcus aureus
FIALMFDFEKAYWIPLSAHT

SEQ ID NO: 1575940 - protein, 18 aa, Staphylococcus aureus
FSSILVIVSIILYVPLYL

SEQ ID NO: 1575941 - protein, 17 aa, Staphylococcus aureus
FVIRYPKLKNMDNDELS

SEQ ID NO: 1575942 - protein, 19 aa, Staphylococcus aureus
GGISGFLGVLLVAGFSVGG

SEQ ID NO: 1575943 - protein, 18 aa, Staphylococcus aureus
GHVLPLVAKYLINREDEV

SEQ ID NO: 1575944 - protein, 29 aa, Staphylococcus aureus
GVTSTAKVPPIMAGDQVLANGVIDSDGNV

SEQ ID NO: 1575945 - protein, 17 aa, Staphylococcus aureus
HNIDFKTAAIAIILAPE

SEQ ID NO: 1575946 - protein, 17 aa, Staphylococcus aureus
IAIFIALMFDFEKAYWI

SEQ ID NO: 1575947 - protein, 24 aa, Staphylococcus aureus
IDQASWRVPFIIIVGIALVAFVFG

SEQ ID NO: 1575948 - protein, 21 aa, Staphylococcus aureus
ILERRHLKKRITVSSSVDLQF

SEQ ID NO: 1575949 - protein, 19 aa, Staphylococcus aureus
IMNMVPWGGPMARVAAVLK

SEQ ID NO: 1575950 - protein, 28 aa, Staphylococcus aureus
ITGALVGSALGLYFKNKVYQKADDLKVK

SEQ ID NO: 1575951 - protein, 22 aa, Staphylococcus aureus
IVFGLVICGIFVAFPEVRKNIS

SEQ ID NO: 1575952 - protein, 23 aa, Staphylococcus aureus
IYAIRPSLLYVFVALFVSVLIGS

SEQ ID NO: 1575953 - protein, 19 aa, Staphylococcus aureus
IYMSVEFIIGSLFILILSK

SEQ ID NO: 1575954 - protein, 17 aa, Staphylococcus aureus
KDYKLVVEDGKVHADYP

SEQ ID NO: 1575955 - protein, 17 aa, Staphylococcus aureus
KILEYISNYGLFSTILG

SEQ ID NO: 1575956 - protein, 21 aa, Staphylococcus aureus
KLFIKPLWQYHCRFYKVDQLS

SEQ ID NO: 1575957 - protein, 26 aa, Staphylococcus aureus
KLVVSEIFKIIGLLLLLYQNQYLILV

SEQ ID NO: 1575958 - protein, 17 aa, Staphylococcus aureus
KQAGGYAYLALAVLSTL

SEQ ID NO: 1575959 - protein, 19 aa, Staphylococcus aureus
KTVSRKVVVQLTKFEKVLY

SEQ ID NO: 1575960 - protein, 17 aa, Staphylococcus aureus
KVFALYFVSIVTANIIV

SEQ ID NO: 1575961 - protein, 24 aa, Staphylococcus aureus
KVGFPRWASITTIMLALFAIIGLI

SEQ ID NO: 1575962 - protein, 36 aa, Staphylococcus aureus
LFKNMRLSWQITKRNKFRLVIEIVILELIIGAILTL

SEQ ID NO: 1575963 - protein, 17 aa, Staphylococcus aureus
LGLIIGFSLSYIAGITL

SEQ ID NO: 1575964 - protein, 17 aa, Staphylococcus aureus
LIVTFPILRKFKIATPV

SEQ ID NO: 1575965 - protein, 21 aa, Staphylococcus aureus
LNLAAIIIISIVVSGGMFLAM

SEQ ID NO: 1575966 - protein, 19 aa, Staphylococcus aureus
LPDELIEMMDHIIAQLDNS

SEQ ID NO: 1575967 - protein, 19 aa, Staphylococcus aureus
LSAYILWGILPIYWQFVDA

SEQ ID NO: 1575968 - protein, 18 aa, Staphylococcus aureus
LSRRFQKLLLLHTSAQGI

SEQ ID NO: 1575969 - protein, 31 aa, Staphylococcus aureus
NEARIAYEADMRKPLYSKRIYQNLTLDSIVF

SEQ ID NO: 1575970 - protein, 26 aa, Staphylococcus aureus
NNPDGRLALITSYIPFLAPFQLVVRA

SEQ ID NO: 1575971 - protein, 18 aa, Staphylococcus aureus
NNTMPIADIKSTNGDVVA

SEQ ID NO: 1575972 - protein, 21 aa, Staphylococcus aureus
RKYKVLSLINVFRAGSMALLQ

SEQ ID NO: 1575973 - protein, 20 aa, Staphylococcus aureus
RRANGLSGNNIRNGQQIVIP

SEQ ID NO: 1575974 - protein, 20 aa, Staphylococcus aureus
RTRYTFVLAPDELFFTRDGL

SEQ ID NO: 1575975 - protein, 18 aa, Staphylococcus aureus
RVYYDMNKPSGKRINAIQ

SEQ ID NO: 1575976 - protein, 27 aa, Staphylococcus aureus
SIVVSGGMFLAMKWEQIHLKDGLKKVL

SEQ ID NO: 1575977 - protein, 17 aa, Staphylococcus aureus
TSIFGMFAAILFMYYYL

SEQ ID NO: 1575978 - protein, 23 aa, Staphylococcus aureus
VAFPEVRKNISFLIIKTDAMGRG

SEQ ID NO: 1575979 - protein, 17 aa, Staphylococcus aureus
VASFAMRLLLGSTLASI

SEQ ID NO: 1575980 - protein, 18 aa, Staphylococcus aureus
YIPFLAPFQLVVRAQTSG

SEQ ID NO: 1575981 - protein, 29 aa, Staphylococcus aureus
AAIARLITEFILLIWRFVDITKINVKLNI

SEQ ID NO: 1575982 - protein, 20 aa, Staphylococcus aureus
ADESLKDAIKDPALENKEHD

SEQ ID NO: 1575983 - protein, 22 aa, Staphylococcus aureus
AILAAIIWNLATWFYGIPSSSS

SEQ ID NO: 1575984 - protein, 17 aa, Staphylococcus aureus
AKFKTIVSEGSSLQGSQ

SEQ ID NO: 1575985 - protein, 20 aa, Staphylococcus aureus
AKRKSNVTLIDWNKRSQGHS

SEQ ID NO: 1575986 - protein, 23 aa, Staphylococcus aureus
DGNMLKPWFVNSVENPVSKRQFY

SEQ ID NO: 1575987 - protein, 18 aa, Staphylococcus aureus
DGSLPQLIFLIAVPNNSQ

SEQ ID NO: 1575988 - protein, 20 aa, Staphylococcus aureus
DSLMKLNPFWTILLSIVFLH

SEQ ID NO: 1575989 - protein, 18 aa, Staphylococcus aureus
EIEKRLSQKKAFQIEFGR

SEQ ID NO: 1575990 - protein, 19 aa, Staphylococcus aureus
ESNTAIMALFIGLILLVVS

SEQ ID NO: 1575991 - protein, 17 aa, Staphylococcus aureus
FAGSFVYIYFMQGVQGF

SEQ ID NO: 1575992 - protein, 17 aa, Staphylococcus aureus
FFLGCLIYFSQMAYNQL

SEQ ID NO: 1575993 - protein, 19 aa, Staphylococcus aureus
FKELYRFDDEIVLQAQQTI

SEQ ID NO: 1575994 - protein, 17 aa, Staphylococcus aureus
FKFSTFFSGYLIGLIVI

SEQ ID NO: 1575995 - protein, 32 aa, Staphylococcus aureus
FKGIDLTSSRFIKWLNDMNIIPGYYGVNSIDL

SEQ ID NO: 1575996 - protein, 17 aa, Staphylococcus aureus
FSPLSKIAHVNINGNNH

SEQ ID NO: 1575997 - protein, 21 aa, Staphylococcus aureus
FSYHYCVFNFMMGSIVSVIGF

SEQ ID NO: 1575998 - protein, 18 aa, Staphylococcus aureus
GKYQFTGLENGTYKVEFE

SEQ ID NO: 1575999 - protein, 28 aa, Staphylococcus aureus
GLNMTFNYCKKRVWSYDMDRMDQVLTNL

SEQ ID NO: 1576000 - protein, 32 aa, Staphylococcus aureus
GSPFFKPLHMILRLFMLLTLISGFWILIQSFM

SEQ ID NO: 1576001 - protein, 23 aa, Staphylococcus aureus
IAQGHVAWGYAIILIISSYFGAK

SEQ ID NO: 1576002 - protein, 27 aa, Staphylococcus aureus
ICVKVFKLDIKWPFLLSELGIVLLGVQ

SEQ ID NO: 1576003 - protein, 26 aa, Staphylococcus aureus
IENDFPHPFKKLIRWSNGIAAGADIQ

SEQ ID NO: 1576004 - protein, 17 aa, Staphylococcus aureus
IGFKETILAIILLAIFL

SEQ ID NO: 1576005 - protein, 19 aa, Staphylococcus aureus
IGQIPGILALFILTICIIG

SEQ ID NO: 1576006 - protein, 20 aa, Staphylococcus aureus
ITFIGILIFYVRLIKKSSLN

SEQ ID NO: 1576007 - protein, 19 aa, Staphylococcus aureus
IYQNLTLDSIVFRNTLRYT

SEQ ID NO: 1576008 - protein, 21 aa, Staphylococcus aureus
KEQQARITLYLKHNTIEPNTI

SEQ ID NO: 1576009 - protein, 26 aa, Staphylococcus aureus
KIFSQISIFFSRVFSVLFTFLIILVI

SEQ ID NO: 1576010 - protein, 22 aa, Staphylococcus aureus
KRSDYIKSYFAFYLILFGASLM

SEQ ID NO: 1576011 - protein, 23 aa, Staphylococcus aureus
LAIGIAGFYFWNKTTSYITTDNA

SEQ ID NO: 1576012 - protein, 18 aa, Staphylococcus aureus
LALILVSLFIRFSKQKIT

SEQ ID NO: 1576013 - protein, 17 aa, Staphylococcus aureus
LDISWFYAGTEKFKIPS

SEQ ID NO: 1576014 - protein, 18 aa, Staphylococcus aureus
LFSDFKVDFHLNNLIEMN

SEQ ID NO: 1576015 - protein, 21 aa, Staphylococcus aureus
LLGLFFRQKIGAAFRSGLTIG

SEQ ID NO: 1576016 - protein, 19 aa, Staphylococcus aureus
LSVLHGRFVTVKGICMVSL

SEQ ID NO: 1576017 - protein, 28 aa, Staphylococcus aureus
LVVYDIGFQFSFIISFFIMLLFPFLQQL

SEQ ID NO: 1576018 - protein, 19 aa, Staphylococcus aureus
LWMIFGGLIIKKYPIYSFF

SEQ ID NO: 1576019 - protein, 21 aa, Staphylococcus aureus
MAYGVSILGHIDFKNQNNLLI

SEQ ID NO: 1576020 - protein, 23 aa, Staphylococcus aureus
MGSKRPMLLGTFIVIIGIALISL

SEQ ID NO: 1576021 - protein, 17 aa, Staphylococcus aureus
MIVSIYFIKIVTSYFTK

SEQ ID NO: 1576022 - protein, 19 aa, Staphylococcus aureus
NIFGKGIIVPALRGVSGGN

SEQ ID NO: 1576023 - protein, 18 aa, Staphylococcus aureus
NIVDIDFDSVPQIHGQNK

SEQ ID NO: 1576024 - protein, 26 aa, Staphylococcus aureus
NLRYFIRRKFEIVKRSRLNVTTKILF

SEQ ID NO: 1576025 - protein, 17 aa, Staphylococcus aureus
NNLVLGEPILVVGNPLG

SEQ ID NO: 1576026 - protein, 18 aa, Staphylococcus aureus
NSGMLGFFIAHGIYSNQL

SEQ ID NO: 1576027 - protein, 24 aa, Staphylococcus aureus
NTLNTAMGALRTSIQNDNTTKTSQ

SEQ ID NO: 1576028 - protein, 38 aa, Staphylococcus aureus
PHNAQRVTLKYKWKFGEGIKAGDYFDFTLSDNVETHGI

SEQ ID NO: 1576029 - protein, 19 aa, Staphylococcus aureus
QQEVILKGQIDRFNTYNNK

SEQ ID NO: 1576030 - protein, 20 aa, Staphylococcus aureus
QRRALKYKRLVDEEVDIDAT

SEQ ID NO: 1576031 - protein, 20 aa, Staphylococcus aureus
RLSLKNEIYPFFLTNKKNFD

SEQ ID NO: 1576032 - protein, 18 aa, Staphylococcus aureus
RSLIPFGLHHIFYSPFWF

SEQ ID NO: 1576033 - protein, 23 aa, Staphylococcus aureus
RSRRDGFNPMRIILAGAAVSAML

SEQ ID NO: 1576034 - protein, 26 aa, Staphylococcus aureus
SHQLWQIIGFCVAYAIFTIVWGLQFP

SEQ ID NO: 1576035 - protein, 24 aa, Staphylococcus aureus
SKLSIRASTIWGIIYLILIITFSL

SEQ ID NO: 1576036 - protein, 26 aa, Staphylococcus aureus
SNVAGGGAFGAFVTTDSYGVATTYTS

SEQ ID NO: 1576037 - protein, 17 aa, Staphylococcus aureus
TDIDFIIIIGFIITFIG

SEQ ID NO: 1576038 - protein, 17 aa, Staphylococcus aureus
VLSFAWPPIQDGLNSLS

SEQ ID NO: 1576039 - protein, 18 aa, Staphylococcus aureus
YRFFGKQGLIAWVAIGTI

SEQ ID NO: 1576040 - protein, 19 aa, Staphylococcus aureus
YTWDRFKNKWTHFLISIPV

SEQ ID NO: 1576041 - protein, 27 aa, Staphylococcus aureus
YVPYGDDWFAYFMRRLAERPQNLSLAV

SEQ ID NO: 1576042 - protein, 19 aa, Staphylococcus aureus
YYFYASMFIYIVFIPLIPR

SEQ ID NO: 1576043 - protein, 25 aa, Staphylococcus aureus
AISLLITVILGFFIARTITKPITDM

SEQ ID NO: 1576044 - protein, 24 aa, Staphylococcus aureus
ATSYGAGIIHFFGGIHEIYFPYVL

SEQ ID NO: 1576045 - protein, 27 aa, Staphylococcus aureus
AYLIELIRWLFTFGILFQLPILFMGLA

SEQ ID NO: 1576046 - protein, 25 aa, Staphylococcus aureus
CIIEITIFCYFQFSTIYIYYTEGVG

SEQ ID NO: 1576047 - protein, 23 aa, Staphylococcus aureus
DPLIKSVEIHKQLPNTLNVDITE

SEQ ID NO: 1576048 - protein, 32 aa, Staphylococcus aureus
DYMSFRISSAILQFLGAISWFFLSLILSLTQF

SEQ ID NO: 1576049 - protein, 17 aa, Staphylococcus aureus
EIIKIWHGGIAIHGGLI

SEQ ID NO: 1576050 - protein, 23 aa, Staphylococcus aureus
ERQRALSYWSIGSWGGSGICSLF

SEQ ID NO: 1576051 - protein, 25 aa, Staphylococcus aureus
ESYNIPTWLGALIMTLAIYVTLLLD

SEQ ID NO: 1576052 - protein, 18 aa, Staphylococcus aureus
ETSLDFFVIEDFSYSPRL

SEQ ID NO: 1576053 - protein, 17 aa, Staphylococcus aureus
FDLKHKKDALALEKVKN

SEQ ID NO: 1576054 - protein, 18 aa, Staphylococcus aureus
FFLSAVGLHGIWDTSLTI

SEQ ID NO: 1576055 - protein, 17 aa, Staphylococcus aureus
FGSTALWIGAGLMSLAV

SEQ ID NO: 1576056 - protein, 17 aa, Staphylococcus aureus
FIICVILGILGLIISLF

SEQ ID NO: 1576057 - protein, 17 aa, Staphylococcus aureus
FILAVIIIPRFLDLGTF

SEQ ID NO: 1576058 - protein, 20 aa, Staphylococcus aureus
FKAYAIKYLNGFTLRKIIFE

SEQ ID NO: 1576059 - protein, 21 aa, Staphylococcus aureus
FKGGLTKAFFIACGVIVFVYM

SEQ ID NO: 1576060 - protein, 19 aa, Staphylococcus aureus
FKIARKSFFVENGSLVQIA

SEQ ID NO: 1576061 - protein, 23 aa, Staphylococcus aureus
FLEKLRVELLFRGKTEAEVEELL

SEQ ID NO: 1576062 - protein, 23 aa, Staphylococcus aureus
FNLKVFCALIYFSTISYVIQIIF

SEQ ID NO: 1576063 - protein, 23 aa, Staphylococcus aureus
FSPFKRLILYGIILIAMTAFLNL

SEQ ID NO: 1576064 - protein, 19 aa, Staphylococcus aureus
FVLFFLMKYAHVMTPEMTQ

SEQ ID NO: 1576065 - protein, 20 aa, Staphylococcus aureus
GEFFGWVAGWALLAEYFIAV

SEQ ID NO: 1576066 - protein, 19 aa, Staphylococcus aureus
GIASRLWSKVRGIFTNMRD

SEQ ID NO: 1576067 - protein, 28 aa, Staphylococcus aureus
GIHFSETLARLGIVLGVFLTSLQMGLYM

SEQ ID NO: 1576068 - protein, 23 aa, Staphylococcus aureus
GNAPFLMFMPIWIGSIVTSILLF

SEQ ID NO: 1576069 - protein, 18 aa, Staphylococcus aureus
GNKKRSKTLISLVQNVVK

SEQ ID NO: 1576070 - protein, 17 aa, Staphylococcus aureus
GNTRTFTQFTFKKAIIF

SEQ ID NO: 1576071 - protein, 18 aa, Staphylococcus aureus
GRMARLVGMILISIVTFI

SEQ ID NO: 1576072 - protein, 20 aa, Staphylococcus aureus
IALMFPLVIVVSFMTFLLTY

SEQ ID NO: 1576073 - protein, 18 aa, Staphylococcus aureus
IAYVFSGYLYRVALVQSS

SEQ ID NO: 1576074 - protein, 26 aa, Staphylococcus aureus
IETPIRKKGFKAFAFLPKKKSQFART

SEQ ID NO: 1576075 - protein, 22 aa, Staphylococcus aureus
IEVPLSALLIVYFIYYIFEKNI

SEQ ID NO: 1576076 - protein, 19 aa, Staphylococcus aureus
IFYSYERAKGQMNFIKDDY

SEQ ID NO: 1576077 - protein, 23 aa, Staphylococcus aureus
IILLSIWTRSYIIGFLAAIINVF

SEQ ID NO: 1576078 - protein, 18 aa, Staphylococcus aureus
ILAFRIIFSVIFMIFILA

SEQ ID NO: 1576079 - protein, 25 aa, Staphylococcus aureus
ILKNKGRNIFTMIGIIIGISSVITI

SEQ ID NO: 1576080 - protein, 18 aa, Staphylococcus aureus
IRIQPKLIIKLFLTLIII

SEQ ID NO: 1576081 - protein, 19 aa, Staphylococcus aureus
ISSYIAIRLKDQFETISIG

SEQ ID NO: 1576082 - protein, 24 aa, Staphylococcus aureus
IVFGGPRLGTSFISAGDDKFLAIT

SEQ ID NO: 1576083 - protein, 23 aa, Staphylococcus aureus
IWIHLLCTMLKYFNNVKEQLNSP

SEQ ID NO: 1576084 - protein, 20 aa, Staphylococcus aureus
IYFGMGVIFSLAYVWTKRLA

SEQ ID NO: 1576085 - protein, 22 aa, Staphylococcus aureus
KGHIRPTTLIIIGISMQTLFIA

SEQ ID NO: 1576086 - protein, 21 aa, Staphylococcus aureus
KKVPEGLDLIVVILFAPAIAF

SEQ ID NO: 1576087 - protein, 24 aa, Staphylococcus aureus
KSKSKGEIFIYGDIVSDKWFESDV

SEQ ID NO: 1576088 - protein, 20 aa, Staphylococcus aureus
KTNLFAIAALCLVMIICYPI

SEQ ID NO: 1576089 - protein, 20 aa, Staphylococcus aureus
KTPLVFGMTLLIVTVIPFYI

SEQ ID NO: 1576090 - protein, 38 aa, Staphylococcus aureus
KYEGHGNGGDGIGFAFSPGVLGETGLNGAAVGIGGLSN

SEQ ID NO: 1576091 - protein, 25 aa, Staphylococcus aureus
LAELKKLDAGYHFKDINGLTPYRGH

SEQ ID NO: 1576092 - protein, 17 aa, Staphylococcus aureus
LAIVPGICIMFVVLAFN

SEQ ID NO: 1576093 - protein, 24 aa, Staphylococcus aureus
LDSIVFRNTLRYTAIMMIAIFIAL

SEQ ID NO: 1576094 - protein, 24 aa, Staphylococcus aureus
LFFMRLAKIQLWFLIKGLTPIFFF

SEQ ID NO: 1576095 - protein, 27 aa, Staphylococcus aureus
LGFDVSWGEWFLYAAPWSIVMSIALYF

SEQ ID NO: 1576096 - protein, 17 aa, Staphylococcus aureus
LILLTFVTVFSVPFNIN

SEQ ID NO: 1576097 - protein, 24 aa, Staphylococcus aureus
LKNVVNHFIAWMGYTKGTFVKTEK

SEQ ID NO: 1576098 - protein, 18 aa, Staphylococcus aureus
LLFELFRFNISGKNVTAI

SEQ ID NO: 1576099 - protein, 22 aa, Staphylococcus aureus
LNLEVLKFPTFTLTTIINMVVM

SEQ ID NO: 1576100 - protein, 22 aa, Staphylococcus aureus
LNLEVLKFPTFTLTTVINMVVM

SEQ ID NO: 1576101 - protein, 17 aa, Staphylococcus aureus
LRFERKFIVIPYVIYAV

SEQ ID NO: 1576102 - protein, 29 aa, Staphylococcus aureus
LTDVKEVRWLFRIIALIVFAVLMFTIYIS

SEQ ID NO: 1576103 - protein, 18 aa, Staphylococcus aureus
LVIVVSFMTFLLTYITNE

SEQ ID NO: 1576104 - protein, 18 aa, Staphylococcus aureus
MDISLGKVLRVSYIINAL

SEQ ID NO: 1576105 - protein, 24 aa, Staphylococcus aureus
MIVASILLLFSFVVFFFIYGMVSG

SEQ ID NO: 1576106 - protein, 17 aa, Staphylococcus aureus
MKYAHVMTPEMTQALTA

SEQ ID NO: 1576107 - protein, 21 aa, Staphylococcus aureus
MPDKMIKRLNISSGAGSVRIS

SEQ ID NO: 1576108 - protein, 19 aa, Staphylococcus aureus
MRRYRLATLTLYTAGGQAE

SEQ ID NO: 1576109 - protein, 18 aa, Staphylococcus aureus
NAGQSVTYYFTDVKAPTV

SEQ ID NO: 1576110 - protein, 25 aa, Staphylococcus aureus
NFTGLPILLAVGFGVLAGFIISSKI

SEQ ID NO: 1576111 - protein, 26 aa, Staphylococcus aureus
NLYKSNHYYWKFVSILLISILIESIA

SEQ ID NO: 1576112 - protein, 18 aa, Staphylococcus aureus
NQRTELINGIGRFTLTSQ

SEQ ID NO: 1576113 - protein, 17 aa, Staphylococcus aureus
PEEALYRGFAILVGGIL

SEQ ID NO: 1576114 - protein, 25 aa, Staphylococcus aureus
PILVVGNPLGVDFKGTVTEGIISGL

SEQ ID NO: 1576115 - protein, 18 aa, Staphylococcus aureus
PLGKEHWGTYVAQVVIGL

SEQ ID NO: 1576116 - protein, 21 aa, Staphylococcus aureus
PVASLALLIAITLFVRKKSKG

SEQ ID NO: 1576117 - protein, 22 aa, Staphylococcus aureus
PVYRYKHCRYAFEKHHLRVRNG

SEQ ID NO: 1576118 - protein, 23 aa, Staphylococcus aureus
QKGESKWSFKKLFNYGIDGLISF

SEQ ID NO: 1576119 - protein, 21 aa, Staphylococcus aureus
QKHVQWAMLVAAFIVGIALFF

SEQ ID NO: 1576120 - protein, 17 aa, Staphylococcus aureus
QRLLKTLQYPLILVSIF

SEQ ID NO: 1576121 - protein, 18 aa, Staphylococcus aureus
RILYTCFILFIYILGTNI

SEQ ID NO: 1576122 - protein, 23 aa, Staphylococcus aureus
RLLPPNYKYLIPFTALTGAILMI

SEQ ID NO: 1576123 - protein, 24 aa, Staphylococcus aureus
RNTLKGALPVGFLGIGEPLIYGVT

SEQ ID NO: 1576124 - protein, 28 aa, Staphylococcus aureus
RTFTQFTFKKAIIFAALFILIGFYDGFV

SEQ ID NO: 1576125 - protein, 21 aa, Staphylococcus aureus
RVIPSMMIGSGIGGAIALGLG

SEQ ID NO: 1576126 - protein, 24 aa, Staphylococcus aureus
RYEKKNMAGLIFVSWYPTVYWIIN

SEQ ID NO: 1576127 - protein, 18 aa, Staphylococcus aureus
RYMLKSMMAGFLLSIVTV

SEQ ID NO: 1576128 - protein, 22 aa, Staphylococcus aureus
SAKLKLELLPNVQNPVISVTTT

SEQ ID NO: 1576129 - protein, 18 aa, Staphylococcus aureus
SALFLKRRSILSMMKDSI

SEQ ID NO: 1576130 - protein, 27 aa, Staphylococcus aureus
SGNEICQEWLYHLGVPTDKIEDLAKHA

SEQ ID NO: 1576131 - protein, 17 aa, Staphylococcus aureus
SPITFWYGKYIILIPSS

SEQ ID NO: 1576132 - protein, 23 aa, Staphylococcus aureus
SQQLSALSRFDAHYKMYTDTKGR

SEQ ID NO: 1576133 - protein, 18 aa, Staphylococcus aureus
SSLVFKFNLPGTVSEVTH

SEQ ID NO: 1576134 - protein, 25 aa, Staphylococcus aureus
TFIPRYGDKVLDAFDYIPFAYLTDK

SEQ ID NO: 1576135 - protein, 29 aa, Staphylococcus aureus
TKKDIDYVLSPIVNRPSLLDRLNKNGKTT

SEQ ID NO: 1576136 - protein, 25 aa, Staphylococcus aureus
TNYDYTKLVFAKPIYNDPSLVKSDT

SEQ ID NO: 1576137 - protein, 17 aa, Staphylococcus aureus
TRSEAISSISSLTGILL

SEQ ID NO: 1576138 - protein, 20 aa, Staphylococcus aureus
VAIGSIFTGIVWGLLLSGSY

SEQ ID NO: 1576139 - protein, 20 aa, Staphylococcus aureus
VGKVSFRFWPFSEFKYNFNP

SEQ ID NO: 1576140 - protein, 18 aa, Staphylococcus aureus
VGLHGIWDTSLTILGSDT

SEQ ID NO: 1576141 - protein, 24 aa, Staphylococcus aureus
VKGRARTKPWIKWVNTALTLAVIL

SEQ ID NO: 1576142 - protein, 27 aa, Staphylococcus aureus
VKPEEKLYKIGDYVWEDVDKDGVQGTD

SEQ ID NO: 1576143 - protein, 26 aa, Staphylococcus aureus
VRSTMKVVLPKGWTLKNVVNHFIAWM

SEQ ID NO: 1576144 - protein, 18 aa, Staphylococcus aureus
VVEIQLWSGIAIAAPAVT

SEQ ID NO: 1576145 - protein, 27 aa, Staphylococcus aureus
WILLYCFLGNILGGFVLFFLMKYAHVM

SEQ ID NO: 1576146 - protein, 26 aa, Staphylococcus aureus
YDYIPRLFWPIYYFIQAPMQKMMIHG

SEQ ID NO: 1576147 - protein, 24 aa, Staphylococcus aureus
YFLKSRMNWIFWILFLNLLMLGIS

SEQ ID NO: 1576148 - protein, 17 aa, Staphylococcus aureus
YNRFSKGLFEWIGYNTK

SEQ ID NO: 1576149 - protein, 23 aa, Staphylococcus aureus
AGAVAKGDCDFLLNTLKDIVDEN

SEQ ID NO: 1576150 - protein, 30 aa, Staphylococcus aureus
AIYFYPRFKRSMIGISVAMTWVFLNDYIDY

SEQ ID NO: 1576151 - protein, 22 aa, Staphylococcus aureus
AKKEPFFGVAFIIMIFAIGGVP

SEQ ID NO: 1576152 - protein, 22 aa, Staphylococcus aureus
AKLTIIFGFAFIQAGLQLLMFM

SEQ ID NO: 1576153 - protein, 21 aa, Staphylococcus aureus
ALEVVPLCLLIWEAYTHYRLY

SEQ ID NO: 1576154 - protein, 24 aa, Staphylococcus aureus
ALGYFLKRINYIKATDSQVIATLV

SEQ ID NO: 1576155 - protein, 21 aa, Staphylococcus aureus
ANYPGPVSDIARVKKLDNLID

SEQ ID NO: 1576156 - protein, 25 aa, Staphylococcus aureus
ASLFKSEGFSIIGLILDIVILTTLI

SEQ ID NO: 1576157 - protein, 26 aa, Staphylococcus aureus
CSISGTFLFVKIIDFIKVKDVIFVPL

SEQ ID NO: 1576158 - protein, 18 aa, Staphylococcus aureus
CYFWNQLLLLFTIITVVI

SEQ ID NO: 1576159 - protein, 26 aa, Staphylococcus aureus
DAFGRKRIAVSILIIFILASGLSMFV

SEQ ID NO: 1576160 - protein, 22 aa, Staphylococcus aureus
DELEGITFLLACYNESETIEDT

SEQ ID NO: 1576161 - protein, 21 aa, Staphylococcus aureus
DFGGWTAPFGIQFLGDSLSLI

SEQ ID NO: 1576162 - protein, 19 aa, Staphylococcus aureus
DITSFVIPIGYTFNLDGSA

SEQ ID NO: 1576163 - protein, 19 aa, Staphylococcus aureus
DMITPRGVKLFYPLPFNVK

SEQ ID NO: 1576164 - protein, 23 aa, Staphylococcus aureus
DRGCLKSVIMLIVLFFLIIFGIV

SEQ ID NO: 1576165 - protein, 19 aa, Staphylococcus aureus
DYFNDRFENEVKFQEKMKD

SEQ ID NO: 1576166 - protein, 18 aa, Staphylococcus aureus
EHLSQFFFWGAWLSSTDR

SEQ ID NO: 1576167 - protein, 17 aa, Staphylococcus aureus
EIIKISVSLMMALIVVS

SEQ ID NO: 1576168 - protein, 19 aa, Staphylococcus aureus
EIQRLAIARMLLKDTASTW

SEQ ID NO: 1576169 - protein, 30 aa, Staphylococcus aureus
EKSETGELIFKFYRHCFRYNEINLKIQDIF

SEQ ID NO: 1576170 - protein, 26 aa, Staphylococcus aureus
EKVLLMLLLYRFAYYFVPVIIALILS

SEQ ID NO: 1576171 - protein, 18 aa, Staphylococcus aureus
ELYLPAAATFAVAIETFL

SEQ ID NO: 1576172 - protein, 28 aa, Staphylococcus aureus
FDFDHPNRIAIFVALAILGFVGLILGVM

SEQ ID NO: 1576173 - protein, 17 aa, Staphylococcus aureus
FFFWGAWLSSTDRPGKT

SEQ ID NO: 1576174 - protein, 18 aa, Staphylococcus aureus
FFLSAVGLHGIWDTSLTV

SEQ ID NO: 1576175 - protein, 24 aa, Staphylococcus aureus
FFPTGHILLKLVFAVICSISGTFL

SEQ ID NO: 1576176 - protein, 27 aa, Staphylococcus aureus
FGGIHEIYFPYVLMRPLLFIAVILGGM

SEQ ID NO: 1576177 - protein, 18 aa, Staphylococcus aureus
FLGNEIIHTLTVLITTLY

SEQ ID NO: 1576178 - protein, 26 aa, Staphylococcus aureus
FRGMIIRVVFRKHLFIGLVVSSLVFA

SEQ ID NO: 1576179 - protein, 25 aa, Staphylococcus aureus
FVGLILGVMVWLGMKSIPIFFILMF

SEQ ID NO: 1576180 - protein, 25 aa, Staphylococcus aureus
FVVLKSSLFFYYLFTKLSLISVLVL

SEQ ID NO: 1576181 - protein, 22 aa, Staphylococcus aureus
GDFAGYLKFDFRQSNSETVDVT

SEQ ID NO: 1576182 - protein, 33 aa, Staphylococcus aureus
GHFGWEYIELGKFWQILFIVGMVLWVIILCRGF

SEQ ID NO: 1576183 - protein, 25 aa, Staphylococcus aureus
GKLKTRGYIDLSVGASFIPYRGNTS

SEQ ID NO: 1576184 - protein, 19 aa, Staphylococcus aureus
GNIIDIDFDSVPQIHGFNK

SEQ ID NO: 1576185 - protein, 18 aa, Staphylococcus aureus
GPSEVLGGSASEFSPTQL

SEQ ID NO: 1576186 - protein, 22 aa, Staphylococcus aureus
GVNLPLKYPFIAAISTSCVLGA

SEQ ID NO: 1576187 - protein, 26 aa, Staphylococcus aureus
HAPSSFWCYIESITLFIVLPLLVLHF

SEQ ID NO: 1576188 - protein, 17 aa, Staphylococcus aureus
HHFKIARKSFFVENGSL

SEQ ID NO: 1576189 - protein, 17 aa, Staphylococcus aureus
HIAVAISGSIYNEAVIK

SEQ ID NO: 1576190 - protein, 29 aa, Staphylococcus aureus
HVTFADYWRWWIVHLWVEGIFEAFAVVLI

SEQ ID NO: 1576191 - protein, 25 aa, Staphylococcus aureus
IDQTGFKSWMIWAIEPSMLRIGLQG

SEQ ID NO: 1576192 - protein, 24 aa, Staphylococcus aureus
IDYIKRVSKSKIWTSDDNAAYDLT

SEQ ID NO: 1576193 - protein, 19 aa, Staphylococcus aureus
IELSMLFLLNAYIRKNSMN

SEQ ID NO: 1576194 - protein, 17 aa, Staphylococcus aureus
IFWVFSILAVIFLVLFS

SEQ ID NO: 1576195 - protein, 25 aa, Staphylococcus aureus
IGLFVIKGYLYVKHAGFKMTEEQIT

SEQ ID NO: 1576196 - protein, 17 aa, Staphylococcus aureus
IKAQRFSLNYHYPTVAE

SEQ ID NO: 1576197 - protein, 17 aa, Staphylococcus aureus
IKYLNGFTLRKIIFENF

SEQ ID NO: 1576198 - protein, 18 aa, Staphylococcus aureus
ILSLFGITALLLVVALPI

SEQ ID NO: 1576199 - protein, 25 aa, Staphylococcus aureus
INIIMKGRQAGVFMFLTAQRPDADV

SEQ ID NO: 1576200 - protein, 17 aa, Staphylococcus aureus
IQLHPKKAKAMMTKEQA

SEQ ID NO: 1576201 - protein, 22 aa, Staphylococcus aureus
IRYASYEQIEFAVIDEGPGISL

SEQ ID NO: 1576202 - protein, 19 aa, Staphylococcus aureus
ITEEIICRGLIIRILFRNH

SEQ ID NO: 1576203 - protein, 41 aa, Staphylococcus aureus
IVFALLFRFIVRLIPIFYIFRVLSIFIFIMGFKMLGVSIQK

SEQ ID NO: 1576204 - protein, 17 aa, Staphylococcus aureus
IVGVLWNSSKVLSTFLF

SEQ ID NO: 1576205 - protein, 22 aa, Staphylococcus aureus
IVIPENFSKLAMQLDAKTPSKI

SEQ ID NO: 1576206 - protein, 25 aa, Staphylococcus aureus
IYHSFLLKKWYLIIYLLFILAALLI

SEQ ID NO: 1576207 - protein, 18 aa, Staphylococcus aureus
KDNELFAKEFKKVLQNSK

SEQ ID NO: 1576208 - protein, 25 aa, Staphylococcus aureus
KEKQALKDRINQILQQGHNGINNAM

SEQ ID NO: 1576209 - protein, 19 aa, Staphylococcus aureus
KHETEFAGIIFSFTGQSST

SEQ ID NO: 1576210 - protein, 18 aa, Staphylococcus aureus
KKVKGFGSKTFDKLKSYF

SEQ ID NO: 1576211 - protein, 19 aa, Staphylococcus aureus
KNWLSNTWSSIRTNTIGKA

SEQ ID NO: 1576212 - protein, 21 aa, Staphylococcus aureus
KRAALVHVIFNLIGVIIFTIF

SEQ ID NO: 1576213 - protein, 25 aa, Staphylococcus aureus
KSDIAFPYKGTFIFLASTGLWNAIG

SEQ ID NO: 1576214 - protein, 32 aa, Staphylococcus aureus
KYYFQAVLNNASFWKEYKFYNANNQELATTVV

SEQ ID NO: 1576215 - protein, 26 aa, Staphylococcus aureus
LESLPIDFRILMIIGALVSSITAIMP

SEQ ID NO: 1576216 - protein, 26 aa, Staphylococcus aureus
LGNGNIRYTFTNEIEHKVEVTANLEI

SEQ ID NO: 1576217 - protein, 59 aa, Staphylococcus aureus
LILLAFIFSAYRAWQMRHGKIILRKSKLTTFLSWLTLCLCIAIALILYALPYLILGSNN

SEQ ID NO: 1576218 - protein, 17 aa, Staphylococcus aureus
LMIFGILGGHAYGFENY

SEQ ID NO: 1576219 - protein, 18 aa, Staphylococcus aureus
LMVLPLWAQHKVKSNYEK

SEQ ID NO: 1576220 - protein, 22 aa, Staphylococcus aureus
LNGKELLGYARFRHDPEGDFGR

SEQ ID NO: 1576221 - protein, 26 aa, Staphylococcus aureus
LNISSDIFMWFKLVLNDTTEFNNIKQ

SEQ ID NO: 1576222 - protein, 18 aa, Staphylococcus aureus
LNTAMGQLQHGIDDENAT

SEQ ID NO: 1576223 - protein, 17 aa, Staphylococcus aureus
LPVKRSDYIKSYFAFYL

SEQ ID NO: 1576224 - protein, 19 aa, Staphylococcus aureus
MGNPLGLQFANSVTSGIIS

SEQ ID NO: 1576225 - protein, 21 aa, Staphylococcus aureus
MIMIIPTWINLLLKTYAFIGL

SEQ ID NO: 1576226 - protein, 23 aa, Staphylococcus aureus
MPTEVEIAGPIVIENKFIDPKTN

SEQ ID NO: 1576227 - protein, 44 aa, Staphylococcus aureus
MRHGQILLRRSKRIAVLSWLTLCLCIAIALILYALPYLILGSNN

SEQ ID NO: 1576228 - protein, 24 aa, Staphylococcus aureus
MVLWVIILCRGFLPAIRNKVQANH

SEQ ID NO: 1576229 - protein, 18 aa, Staphylococcus aureus
NEWFKAHFSFNDLEVDDA

SEQ ID NO: 1576230 - protein, 31 aa, Staphylococcus aureus
NKFFGIEIQRLFPFNIAKTWHVQLVIFWVAT

SEQ ID NO: 1576231 - protein, 26 aa, Staphylococcus aureus
NKFMQFNCFICLILIIVFYIIGMNIQ

SEQ ID NO: 1576232 - protein, 27 aa, Staphylococcus aureus
NKVVRFILRTVVGYGIFAYGLHYFSNL

SEQ ID NO: 1576233 - protein, 34 aa, Staphylococcus aureus
NMYLKEVKGSLLLELAVVFGISALVTSFLKHKHE

SEQ ID NO: 1576234 - protein, 24 aa, Staphylococcus aureus
NRGCLKSAAMLIVLFLFIIFGIVA

SEQ ID NO: 1576235 - protein, 18 aa, Staphylococcus aureus
NRIVAFIIATTVSSLIFA

SEQ ID NO: 1576236 - protein, 26 aa, Staphylococcus aureus
NYDRAVELYYYIKGGRVDYGAAHAAK

SEQ ID NO: 1576237 - protein, 19 aa, Staphylococcus aureus
QDGFMKGLFGIETTGPMLA

SEQ ID NO: 1576238 - protein, 21 aa, Staphylococcus aureus
QEIFFHNLIYFFSAIFGFLTL

SEQ ID NO: 1576239 - protein, 21 aa, Staphylococcus aureus
QMRRIELCRLLVMKPDLVIFD

SEQ ID NO: 1576240 - protein, 21 aa, Staphylococcus aureus
QRRALKYKRLVDEEVDNEETD

SEQ ID NO: 1576241 - protein, 22 aa, Staphylococcus aureus
QVCNFYPERIILLGHGENSIYL

SEQ ID NO: 1576242 - protein, 18 aa, Staphylococcus aureus
RIVDKEAFTKANADKTNK

SEQ ID NO: 1576243 - protein, 17 aa, Staphylococcus aureus
RKRQRLFGEHDVNHINQ

SEQ ID NO: 1576244 - protein, 19 aa, Staphylococcus aureus
RLVKVLLTILVIVFSILLV

SEQ ID NO: 1576245 - protein, 19 aa, Staphylococcus aureus
RNEMIEFPNGKRVITPNTD

SEQ ID NO: 1576246 - protein, 18 aa, Staphylococcus aureus
RNQLPISYLYEGVGILET

SEQ ID NO: 1576247 - protein, 17 aa, Staphylococcus aureus
RRSSELALYQTLGLSKF

SEQ ID NO: 1576248 - protein, 18 aa, Staphylococcus aureus
SKAFPVILISLLVIRTVM

SEQ ID NO: 1576249 - protein, 24 aa, Staphylococcus aureus
SKITRNQMTFLFAIPITVALIHTL

SEQ ID NO: 1576250 - protein, 18 aa, Staphylococcus aureus
SLNLDKLDKTYVIHYTGE

SEQ ID NO: 1576251 - protein, 23 aa, Staphylococcus aureus
SMIGEWGHILGWIDSHWWLFGHF

SEQ ID NO: 1576252 - protein, 22 aa, Staphylococcus aureus
TGPLVVYWNWAWGITVIVIYGI

SEQ ID NO: 1576253 - protein, 19 aa, Staphylococcus aureus
TPKVEKWIKISCWALNVGL

SEQ ID NO: 1576254 - protein, 19 aa, Staphylococcus aureus
TVTKLVVFILLTFGFYVFF

SEQ ID NO: 1576255 - protein, 31 aa, Staphylococcus aureus
TYLLIGNFLRRSCFVLFSLQIIWFTVELTNQ

SEQ ID NO: 1576256 - protein, 17 aa, Staphylococcus aureus
VALPLFISNILKEGVGV

SEQ ID NO: 1576257 - protein, 18 aa, Staphylococcus aureus
VEIAYSMRNIINHSQAGA

SEQ ID NO: 1576258 - protein, 19 aa, Staphylococcus aureus
VHPMLSLFFFYSAFAVPFT

SEQ ID NO: 1576259 - protein, 22 aa, Staphylococcus aureus
VISGGILMAIVFLFGANSFDPK

SEQ ID NO: 1576260 - protein, 20 aa, Staphylococcus aureus
VKVKKGDFVIVYKLADSDKI

SEQ ID NO: 1576261 - protein, 17 aa, Staphylococcus aureus
VNHKRYSTVASILNQYK

SEQ ID NO: 1576262 - protein, 18 aa, Staphylococcus aureus
VPQHIAHPTWSLLTNVLL

SEQ ID NO: 1576263 - protein, 21 aa, Staphylococcus aureus
VYLFYRIAIIFLKSKKTIHTN

SEQ ID NO: 1576264 - protein, 18 aa, Staphylococcus aureus
YVFWELTSVSSFLLISYW

SEQ ID NO: 1576265 - protein, 19 aa, Staphylococcus aureus
AKNDLKEIPQLVTKKNDVS

SEQ ID NO: 1576266 - protein, 17 aa, Staphylococcus aureus
AKYKWHILISFTLSIVL

SEQ ID NO: 1576267 - protein, 24 aa, Staphylococcus aureus
ANIIVCGYFAFSIFVGIYLSINDR

SEQ ID NO: 1576268 - protein, 22 aa, Staphylococcus aureus
ASLKLFASYAIATYILVMLTSA

SEQ ID NO: 1576269 - protein, 18 aa, Staphylococcus aureus
ATKISILFAVAFFIINYI

SEQ ID NO: 1576270 - protein, 18 aa, Staphylococcus aureus
AVPLGVRGKDDILSLNLH

SEQ ID NO: 1576271 - protein, 17 aa, Staphylococcus aureus
DLFKERISNGVILIVLA

SEQ ID NO: 1576272 - protein, 18 aa, Staphylococcus aureus
DLRVAYEHDITKSKQLTK

SEQ ID NO: 1576273 - protein, 21 aa, Staphylococcus aureus
DLVRTAEGWRIDNLKRFNLKP

SEQ ID NO: 1576274 - protein, 21 aa, Staphylococcus aureus
DRPGKTFSYTNNWPYDVDAGN

SEQ ID NO: 1576275 - protein, 28 aa, Staphylococcus aureus
DVTTGKDIIPPKTYSGNVDQVVTIDNQQ

SEQ ID NO: 1576276 - protein, 33 aa, Staphylococcus aureus
EAVSAVQYMSSWPWHWAKPMKHLMENGSISTYG

SEQ ID NO: 1576277 - protein, 18 aa, Staphylococcus aureus
EPLFGVAFIIMIFAIGGV

SEQ ID NO: 1576278 - protein, 17 aa, Staphylococcus aureus
EQIIFTPQLVFVITDMS

SEQ ID NO: 1576279 - protein, 25 aa, Staphylococcus aureus
ESILICVTSGFIGLILGVVFATIID

SEQ ID NO: 1576280 - protein, 17 aa, Staphylococcus aureus
FDARDSRHLSFIEAPII

SEQ ID NO: 1576281 - protein, 26 aa, Staphylococcus aureus
FIALMLKWWLILAISIIVLIIITVAM

SEQ ID NO: 1576282 - protein, 18 aa, Staphylococcus aureus
FIIIIGFIITFIGILSIF

SEQ ID NO: 1576283 - protein, 21 aa, Staphylococcus aureus
FILAIVVAMCLFKVEKHVSSP

SEQ ID NO: 1576284 - protein, 17 aa, Staphylococcus aureus
FINKIINRHEMSAKDTT

SEQ ID NO: 1576285 - protein, 22 aa, Staphylococcus aureus
FKIYIKNKVRPLAVFKIVETAD

SEQ ID NO: 1576286 - protein, 17 aa, Staphylococcus aureus
FLTACIGGGIGGAVIGG

SEQ ID NO: 1576287 - protein, 19 aa, Staphylococcus aureus
FQLEKLIVWSSCFIGFLGV

SEQ ID NO: 1576288 - protein, 17 aa, Staphylococcus aureus
FTPLLVAAALYFVLTFV

SEQ ID NO: 1576289 - protein, 19 aa, Staphylococcus aureus
FYSIFKSPLTYLAILVVSS

SEQ ID NO: 1576290 - protein, 17 aa, Staphylococcus aureus
GEILGNGNIRYTFTNEI

SEQ ID NO: 1576291 - protein, 17 aa, Staphylococcus aureus
GENVYKIGVTRRLEPMD

SEQ ID NO: 1576292 - protein, 22 aa, Staphylococcus aureus
GGFGDGLVNVFTQLAPLFQWSA

SEQ ID NO: 1576293 - protein, 17 aa, Staphylococcus aureus
GGLFCSLIVPLAMLYFV

SEQ ID NO: 1576294 - protein, 20 aa, Staphylococcus aureus
GKALMLPVAILPAAGLLLAI

SEQ ID NO: 1576295 - protein, 19 aa, Staphylococcus aureus
GKILGVVRYFGGLLKGLIS

SEQ ID NO: 1576296 - protein, 18 aa, Staphylococcus aureus
GKSDSVLEFYTIDGNIKV

SEQ ID NO: 1576297 - protein, 23 aa, Staphylococcus aureus
GSISDVFYTLSWLIISISLILNL

SEQ ID NO: 1576298 - protein, 23 aa, Staphylococcus aureus
HDLWRRIVEVLLLLMALTGNVFT

SEQ ID NO: 1576299 - protein, 31 aa, Staphylococcus aureus
HFIFEVTDLAPLIAAIICILVFKYKKVQLAG

SEQ ID NO: 1576300 - protein, 22 aa, Staphylococcus aureus
HLTDPPVLLAIFGIVITVILYA

SEQ ID NO: 1576301 - protein, 21 aa, Staphylococcus aureus
HTSVLKYYFWITILIIAIIVG

SEQ ID NO: 1576302 - protein, 20 aa, Staphylococcus aureus
IAALLLVSGLFLAFRQRSTN

SEQ ID NO: 1576303 - protein, 18 aa, Staphylococcus aureus
IDHMMIAVGVIKQMNIEV

SEQ ID NO: 1576304 - protein, 24 aa, Staphylococcus aureus
IDQASWRVPFIIIVGIALVAFIFG

SEQ ID NO: 1576305 - protein, 20 aa, Staphylococcus aureus
IKTGRFIATASIAFSILLII

SEQ ID NO: 1576306 - protein, 18 aa, Staphylococcus aureus
IMKKLGLDNGRISKITRN

SEQ ID NO: 1576307 - protein, 29 aa, Staphylococcus aureus
INIIFYGICVLCFLVLPIIFIPNPNHVFI

SEQ ID NO: 1576308 - protein, 20 aa, Staphylococcus aureus
INLPSYLGFFAGKRFVPIMM

SEQ ID NO: 1576309 - protein, 25 aa, Staphylococcus aureus
IRYYLFEKRYHPFIAAIAIGLIALL

SEQ ID NO: 1576310 - protein, 19 aa, Staphylococcus aureus
ISPTLFVLLMYLLSMITAY

SEQ ID NO: 1576311 - protein, 17 aa, Staphylococcus aureus
ITFATALFIFVVITLYR

SEQ ID NO: 1576312 - protein, 23 aa, Staphylococcus aureus
ITMALSIMLRDFQSIIGVKHFIF

SEQ ID NO: 1576313 - protein, 19 aa, Staphylococcus aureus
IVHRDDIITEQDILAHINL

SEQ ID NO: 1576314 - protein, 25 aa, Staphylococcus aureus
IVSFCFIFLLLLFFRYILKRYFNYM

SEQ ID NO: 1576315 - protein, 24 aa, Staphylococcus aureus
IYLKTKRLEVVILIHFINNLSSLL

SEQ ID NO: 1576316 - protein, 20 aa, Staphylococcus aureus
KDSYKVFVQFDERIETDGDD

SEQ ID NO: 1576317 - protein, 19 aa, Staphylococcus aureus
KENLEAMGGGDLVGGILDP

SEQ ID NO: 1576318 - protein, 27 aa, Staphylococcus aureus
KLIVWSSCFIGFLGVIFFYCYLNKKLT

SEQ ID NO: 1576319 - protein, 19 aa, Staphylococcus aureus
KLVFFIFSISFIFVILIPK

SEQ ID NO: 1576320 - protein, 21 aa, Staphylococcus aureus
KNDYRIFSFDARDSRHLSFIE

SEQ ID NO: 1576321 - protein, 25 aa, Staphylococcus aureus
KPSVRTRAVRSLAVAEPVVNAADAK

SEQ ID NO: 1576322 - protein, 17 aa, Staphylococcus aureus
KRKETLPNFFVLLKSIV

SEQ ID NO: 1576323 - protein, 26 aa, Staphylococcus aureus
KRVHLKRWQFISILIGTIIITAVITV

SEQ ID NO: 1576324 - protein, 25 aa, Staphylococcus aureus
KSLGWWDLFFAIPMFLLFAYLPNYN

SEQ ID NO: 1576325 - protein, 20 aa, Staphylococcus aureus
LASLGSLLLFRRKKENKDKK

SEQ ID NO: 1576326 - protein, 20 aa, Staphylococcus aureus
LATKDFIIGIALAIVILIVF

SEQ ID NO: 1576327 - protein, 26 aa, Staphylococcus aureus
LFFRYILKRYFNYMLNYKVWYLTLLA

SEQ ID NO: 1576328 - protein, 19 aa, Staphylococcus aureus
LFLYYLIQNWIVCFITSEL

SEQ ID NO: 1576329 - protein, 20 aa, Staphylococcus aureus
LGGIRLSSVYVISWATLASY

SEQ ID NO: 1576330 - protein, 31 aa, Staphylococcus aureus
LIDYKGGGMANLFKDLVHLVGTITNLDGDEA

SEQ ID NO: 1576331 - protein, 24 aa, Staphylococcus aureus
LKARLKMFHFSKERLLIIRALITW

SEQ ID NO: 1576332 - protein, 25 aa, Staphylococcus aureus
LKARLKMFHFSKERLLIIRALITWF

SEQ ID NO: 1576333 - protein, 23 aa, Staphylococcus aureus
LKKDIKGSYFVKDKNFDVSKFIN

SEQ ID NO: 1576334 - protein, 31 aa, Staphylococcus aureus
LKKQSKLILIFICIFTFLLMVIQSQFLMGQS

SEQ ID NO: 1576335 - protein, 22 aa, Staphylococcus aureus
LLHIRTGLDYGDKRTCQAFATV

SEQ ID NO: 1576336 - protein, 17 aa, Staphylococcus aureus
LNAFKNFLPLIILALIY

SEQ ID NO: 1576337 - protein, 19 aa, Staphylococcus aureus
LNFKQLIGYVFAPIAFLMG

SEQ ID NO: 1576338 - protein, 18 aa, Staphylococcus aureus
LRAQEMNIPISIEIPDEV

SEQ ID NO: 1576339 - protein, 22 aa, Staphylococcus aureus
LSSASVPFEFDVHALIFSENAF

SEQ ID NO: 1576340 - protein, 24 aa, Staphylococcus aureus
LTHPLRGILMLVVLIVFWIVGKKL

SEQ ID NO: 1576341 - protein, 24 aa, Staphylococcus aureus
LTHPLRGILMLVVLVVFWIVGKKL

SEQ ID NO: 1576342 - protein, 17 aa, Staphylococcus aureus
LTKQACDNFVSRYTSEV

SEQ ID NO: 1576343 - protein, 18 aa, Staphylococcus aureus
LTLFSIIAFMLLHSQSFV

SEQ ID NO: 1576344 - protein, 19 aa, Staphylococcus aureus
LVRPIGIYILMMIGMSTVT

SEQ ID NO: 1576345 - protein, 21 aa, Staphylococcus aureus
LVVLGSFIFAAGVNAFIISGN

SEQ ID NO: 1576346 - protein, 28 aa, Staphylococcus aureus
MAKGLKFKIAFNFGLPLVIALSHAYFTS

SEQ ID NO: 1576347 - protein, 17 aa, Staphylococcus aureus
MCFTIFYYLFTGFMSYG

SEQ ID NO: 1576348 - protein, 25 aa, Staphylococcus aureus
MGGQTIRLMEEFLRNGNKEEIAYHK

SEQ ID NO: 1576349 - protein, 23 aa, Staphylococcus aureus
MICASILLLISFVVFFFIYGMVS

SEQ ID NO: 1576350 - protein, 17 aa, Staphylococcus aureus
MIISDIVARIIIKPLEL

SEQ ID NO: 1576351 - protein, 25 aa, Staphylococcus aureus
MKDVELPLALPLILGGIRLSSVYVI

SEQ ID NO: 1576352 - protein, 18 aa, Staphylococcus aureus
MNGKLSVQDNGSYSLNLD

SEQ ID NO: 1576353 - protein, 18 aa, Staphylococcus aureus
MSAILCFEYDFIALSFLF

SEQ ID NO: 1576354 - protein, 18 aa, Staphylococcus aureus
MTDSILIGPGLGVDFKGN

SEQ ID NO: 1576355 - protein, 24 aa, Staphylococcus aureus
NELKLRLLPSFKNMCFTIFYYLFT

SEQ ID NO: 1576356 - protein, 18 aa, Staphylococcus aureus
NGKYRFDNLDSGKYKVIF

SEQ ID NO: 1576357 - protein, 25 aa, Staphylococcus aureus
NNYFGIKDKVDWAGHKIDEGIDAVN

SEQ ID NO: 1576358 - protein, 18 aa, Staphylococcus aureus
PGKKVHLVGHSMGGQTIR

SEQ ID NO: 1576359 - protein, 19 aa, Staphylococcus aureus
PLSSLLIVYFIYYIFEKNI

SEQ ID NO: 1576360 - protein, 19 aa, Staphylococcus aureus
PSLLLAVAIIASFGASIPN

SEQ ID NO: 1576361 - protein, 24 aa, Staphylococcus aureus
QIQSFKMIVVIAFLGAIVVTILVV

SEQ ID NO: 1576362 - protein, 17 aa, Staphylococcus aureus
QLDLVRTAEGWRIDNLK

SEQ ID NO: 1576363 - protein, 27 aa, Staphylococcus aureus
QYLFDNTRAVFGFNFFVDKKQLITSQL

SEQ ID NO: 1576364 - protein, 26 aa, Staphylococcus aureus
RARMFEIMEMYKPYAVYHAAAHKHVP

SEQ ID NO: 1576365 - protein, 17 aa, Staphylococcus aureus
RITKMCIQQSHSLTKTL

SEQ ID NO: 1576366 - protein, 42 aa, Staphylococcus aureus
RTELYGYPERAYKSYYVYGGYRLTWDNGLVLYSNKADGNGKN

SEQ ID NO: 1576367 - protein, 17 aa, Staphylococcus aureus
SAVGLHGIWDTSLTILG

SEQ ID NO: 1576368 - protein, 25 aa, Staphylococcus aureus
SETTRISDALIRMQREHVHMSLIID

SEQ ID NO: 1576369 - protein, 20 aa, Staphylococcus aureus
SFLIAVCCIIYIKQIDETED

SEQ ID NO: 1576370 - protein, 17 aa, Staphylococcus aureus
SFVDVMIIFLREGLEVL

SEQ ID NO: 1576371 - protein, 17 aa, Staphylococcus aureus
SGLLLAGLFIWNIMQWS

SEQ ID NO: 1576372 - protein, 39 aa, Staphylococcus aureus
SILTIVALLSFKLYRFYFYRLFAIVTWVLFIGSLSQYFD

SEQ ID NO: 1576373 - protein, 33 aa, Staphylococcus aureus
SKERLLIIRALITWFYTMLWSIVGVVWIVFSIP

SEQ ID NO: 1576374 - protein, 29 aa, Staphylococcus aureus
SKLKYTAKWFPFGPIFAAILCIVVIIGQD

SEQ ID NO: 1576375 - protein, 24 aa, Staphylococcus aureus
SKVTREGLALGVYIILSGSRSSAI

SEQ ID NO: 1576376 - protein, 33 aa, Staphylococcus aureus
SLAVKEFVKPAGLKRVGIIAALGATVMLGLSTI

SEQ ID NO: 1576377 - protein, 20 aa, Staphylococcus aureus
SSWHFYALFLCFFIISYKLT

SEQ ID NO: 1576378 - protein, 22 aa, Staphylococcus aureus
TFHSYHDLEFLFVTREDEVETL

SEQ ID NO: 1576379 - protein, 39 aa, Staphylococcus aureus
TGDSIKQNGLLGGVMTLLVGLGLMKRKKKKDENDQDDSQ

SEQ ID NO: 1576380 - protein, 26 aa, Staphylococcus aureus
TSRIIGHDAREEWRKNDGVVPVISSL

SEQ ID NO: 1576381 - protein, 20 aa, Staphylococcus aureus
TTLTYIVSLCFLFICIYLNM

SEQ ID NO: 1576382 - protein, 17 aa, Staphylococcus aureus
VALSYALLGGFAALISY

SEQ ID NO: 1576383 - protein, 19 aa, Staphylococcus aureus
VERFFKLVFFIFSISFIFV

SEQ ID NO: 1576384 - protein, 24 aa, Staphylococcus aureus
VFPEQKLPLYIVFTLFVAVAIIMN

SEQ ID NO: 1576385 - protein, 18 aa, Staphylococcus aureus
VGLHGIWDTSLTVLGSDT

SEQ ID NO: 1576386 - protein, 24 aa, Staphylococcus aureus
VGVFKPHAVRDMNGHALPVTKDGN

SEQ ID NO: 1576387 - protein, 17 aa, Staphylococcus aureus
VICCIALVFAAGVASIV

SEQ ID NO: 1576388 - protein, 35 aa, Staphylococcus aureus
VKEGDTFTFKYGQYFRPGSVRLPSQTQNLYNAQGN

SEQ ID NO: 1576389 - protein, 27 aa, Staphylococcus aureus
VLYAVSLFLPLFIIYSMVRPPDKNNRY

SEQ ID NO: 1576390 - protein, 23 aa, Staphylococcus aureus
VMIICYPITLIIVSLLYNIDSSL

SEQ ID NO: 1576391 - protein, 28 aa, Staphylococcus aureus
VQPLNKYPVVFVHGFLGLVGDNAPALYP

SEQ ID NO: 1576392 - protein, 17 aa, Staphylococcus aureus
VRLSRERLILFFIAVML

SEQ ID NO: 1576393 - protein, 26 aa, Staphylococcus aureus
VSHRMPFYFAGALGILAFIMSVVLIH

SEQ ID NO: 1576394 - protein, 26 aa, Staphylococcus aureus
VSIQKLQLLGAMPRHVIEGFPTINWL

SEQ ID NO: 1576395 - protein, 21 aa, Staphylococcus aureus
VSSSMSGSVSKSTSLSDSISN

SEQ ID NO: 1576396 - protein, 24 aa, Staphylococcus aureus
VTFSYKLNEGIAIFIGILPHGILE

SEQ ID NO: 1576397 - protein, 20 aa, Staphylococcus aureus
VTVGNFTSIFGMFAAILFMY

SEQ ID NO: 1576398 - protein, 18 aa, Staphylococcus aureus
VVIIPVLFIMNALFGLTG

SEQ ID NO: 1576399 - protein, 24 aa, Staphylococcus aureus
VVSLCISIPLGIIAAKRFHKLSDK

SEQ ID NO: 1576400 - protein, 27 aa, Staphylococcus aureus
YLYRIFSRAYFYLPFLLIYFLVQGYSI

SEQ ID NO: 1576401 - protein, 24 aa, Staphylococcus aureus
YQMKISFLPALGFNQILLEREGDQ

SEQ ID NO: 1576402 - protein, 24 aa, Staphylococcus aureus
YQMKISFLPALGFNQILLEREKDQ

SEQ ID NO: 1576403 - protein, 19 aa, Staphylococcus aureus
YSKGFAVLYVWLVNLGEAR

SEQ ID NO: 1576404 - protein, 17 aa, Staphylococcus aureus
YWLSALILVVFILATLF

SEQ ID NO: 1576405 - protein, 23 aa, Staphylococcus aureus
AFFKGNAPYIFAHRGGMALRPEQ

SEQ ID NO: 1576406 - protein, 18 aa, Staphylococcus aureus
AGPLFNFILALVLFIGLA

SEQ ID NO: 1576407 - protein, 25 aa, Staphylococcus aureus
AGYGFDVFNYWLGIILMLFVSWFAL

SEQ ID NO: 1576408 - protein, 17 aa, Staphylococcus aureus
AHGGPIVAVLGGIDHIL

SEQ ID NO: 1576409 - protein, 18 aa, Staphylococcus aureus
AIIYCILVKKYAYLAIGQ

SEQ ID NO: 1576410 - protein, 24 aa, Staphylococcus aureus
AILVIKYTLGFGVGLVDYVHIGSQ

SEQ ID NO: 1576411 - protein, 19 aa, Staphylococcus aureus
ARYPGRFNININVEDKYRN

SEQ ID NO: 1576412 - protein, 17 aa, Staphylococcus aureus
AVFETLLLIGVAYFLTA

SEQ ID NO: 1576413 - protein, 17 aa, Staphylococcus aureus
AVFFPIIALLIIYYMIR

SEQ ID NO: 1576414 - protein, 34 aa, Staphylococcus aureus
AVRLFGVTFKELWLPVLTICFILAISKITTYGGL

SEQ ID NO: 1576415 - protein, 17 aa, Staphylococcus aureus
AYVLIRMFKNKPAYEDV

SEQ ID NO: 1576416 - protein, 25 aa, Staphylococcus aureus
CLVAAVIMPRIWPLNKIPDEYAKEV

SEQ ID NO: 1576417 - protein, 17 aa, Staphylococcus aureus
CQLIFRHILIQELSRLI

SEQ ID NO: 1576418 - protein, 18 aa, Staphylococcus aureus
CVNSGFDLDSLFQKSLTY

SEQ ID NO: 1576419 - protein, 32 aa, Staphylococcus aureus
DASGNKTTTTFKYEVTRNSMSDSVSTSGSTQQ

SEQ ID NO: 1576420 - protein, 25 aa, Staphylococcus aureus
DELFKYDIELTYPFDLVEVDSSQIN

SEQ ID NO: 1576421 - protein, 18 aa, Staphylococcus aureus
DFFRGSRITETFGKYQHS

SEQ ID NO: 1576422 - protein, 17 aa, Staphylococcus aureus
DNMFFNYLNAEHPIGLA

SEQ ID NO: 1576423 - protein, 22 aa, Staphylococcus aureus
DPLIKSVEIHKQLPNTLNVDIT

SEQ ID NO: 1576424 - protein, 22 aa, Staphylococcus aureus
DRFGEPELKVGEMYYINNQEYQ

SEQ ID NO: 1576425 - protein, 18 aa, Staphylococcus aureus
DRLKGEFRNVGTVIQAYL

SEQ ID NO: 1576426 - protein, 19 aa, Staphylococcus aureus
EIKYPSAKFNQPEAKDKTE

SEQ ID NO: 1576427 - protein, 20 aa, Staphylococcus aureus
ELKGAKFIILYAYSMLVLLA

SEQ ID NO: 1576428 - protein, 24 aa, Staphylococcus aureus
ELSNFRILKRIGFTHTDMLKGLLL

SEQ ID NO: 1576429 - protein, 22 aa, Staphylococcus aureus
ESPLLEFRVFKYNDFSVAMILI

SEQ ID NO: 1576430 - protein, 17 aa, Staphylococcus aureus
EYLNWRSLFHVVAPIAA

SEQ ID NO: 1576431 - protein, 17 aa, Staphylococcus aureus
FALFLFYKNEFDSENPN

SEQ ID NO: 1576432 - protein, 18 aa, Staphylococcus aureus
FKHPGEWKNQDLGTGAGN

SEQ ID NO: 1576433 - protein, 18 aa, Staphylococcus aureus
FKLGVPMLTIIMLMLSGF

SEQ ID NO: 1576434 - protein, 20 aa, Staphylococcus aureus
FKMVKKFRKGVISVNDVMFS

SEQ ID NO: 1576435 - protein, 19 aa, Staphylococcus aureus
FKNSTYMLKIYIANTPRLS

SEQ ID NO: 1576436 - protein, 19 aa, Staphylococcus aureus
FLILYSIVFMLVICFVVLG

SEQ ID NO: 1576437 - protein, 17 aa, Staphylococcus aureus
FSAFAKTLGYIILSACM

SEQ ID NO: 1576438 - protein, 17 aa, Staphylococcus aureus
FVTVIVYNFCVKRNITI

SEQ ID NO: 1576439 - protein, 18 aa, Staphylococcus aureus
FWSKVALIGIQVWLGFPF

SEQ ID NO: 1576440 - protein, 20 aa, Staphylococcus aureus
GENSITRFIEYTKTNLPIIG

SEQ ID NO: 1576441 - protein, 31 aa, Staphylococcus aureus
GESLDKVKHTPFFLPKRRRKEDEEDVEVTNE

SEQ ID NO: 1576442 - protein, 23 aa, Staphylococcus aureus
GGIGCAVSMLFLSKLIDNRSRNF

SEQ ID NO: 1576443 - protein, 18 aa, Staphylococcus aureus
GIIAFIFLILARKSNAVN

SEQ ID NO: 1576444 - protein, 26 aa, Staphylococcus aureus
GIKEKVPIIFSFRAVFETLLLIGVAY

SEQ ID NO: 1576445 - protein, 17 aa, Staphylococcus aureus
GIVLWNKSIQSFGVSAL

SEQ ID NO: 1576446 - protein, 30 aa, Staphylococcus aureus
GMTEWERGLRMFPKSGLLNFELAIANRSLN

SEQ ID NO: 1576447 - protein, 22 aa, Staphylococcus aureus
GQIITFKAFELIGSSRAMPVTT

SEQ ID NO: 1576448 - protein, 25 aa, Staphylococcus aureus
GRCRNCHKRISLTHFFGETFALIPI

SEQ ID NO: 1576449 - protein, 26 aa, Staphylococcus aureus
GRLAEEKGRVIGMAKLKTIKEQEKPD

SEQ ID NO: 1576450 - protein, 36 aa, Staphylococcus aureus
GSAWWSWVICSGIIGCLYGWIGLKLNLSSGLFSRKS

SEQ ID NO: 1576451 - protein, 19 aa, Staphylococcus aureus
GTAWLMKLLPPVVVGPVIM

SEQ ID NO: 1576452 - protein, 27 aa, Staphylococcus aureus
GVSIQKLQLLGAMPRHVIEGFPTINWL

SEQ ID NO: 1576453 - protein, 23 aa, Staphylococcus aureus
GYENPDLGTFFLMDTTSRIIGHD

SEQ ID NO: 1576454 - protein, 22 aa, Staphylococcus aureus
HGYHAGFLFALLITVISFFCSF

SEQ ID NO: 1576455 - protein, 47 aa, Staphylococcus aureus
HIDPNSKGDLALRSTLYGYNSNIIWRSMSWDNEVAFNNGSGSGDGID

SEQ ID NO: 1576456 - protein, 25 aa, Staphylococcus aureus
HNILFLCPFLPVISFAVIFINSQVG

SEQ ID NO: 1576457 - protein, 24 aa, Staphylococcus aureus
HVAHVLPSYHLRKLGVDIASNHHI

SEQ ID NO: 1576458 - protein, 19 aa, Staphylococcus aureus
IAVLLCLPLHFKVTKIPED

SEQ ID NO: 1576459 - protein, 20 aa, Staphylococcus aureus
IGISACTAGVTGNLGGNSSK

SEQ ID NO: 1576460 - protein, 25 aa, Staphylococcus aureus
IGWYGFNVGSAFTFDQIAMLAFTNT

SEQ ID NO: 1576461 - protein, 23 aa, Staphylococcus aureus
IIFVALEFFYIMYLETIATTSKK

SEQ ID NO: 1576462 - protein, 27 aa, Staphylococcus aureus
IIIAFGIKLPILIACVLILSGLSFGYI

SEQ ID NO: 1576463 - protein, 19 aa, Staphylococcus aureus
IIVFLPLVFVSGSVGEMFR

SEQ ID NO: 1576464 - protein, 19 aa, Staphylococcus aureus
ILINICLAITALSMGIFIS

SEQ ID NO: 1576465 - protein, 24 aa, Staphylococcus aureus
ILNQELREAIKNPAIKDKDHSAPN

SEQ ID NO: 1576466 - protein, 19 aa, Staphylococcus aureus
INNIKRFNQLTGMTEDEIR

SEQ ID NO: 1576467 - protein, 18 aa, Staphylococcus aureus
ISDIVARIIIKPLELPIG

SEQ ID NO: 1576468 - protein, 19 aa, Staphylococcus aureus
ISPHIPLALFMLFQMMFCT

SEQ ID NO: 1576469 - protein, 19 aa, Staphylococcus aureus
IVILIVFALLFRFIVRLIP

SEQ ID NO: 1576470 - protein, 19 aa, Staphylococcus aureus
IWFILLGFMYLRYKRIAAK

SEQ ID NO: 1576471 - protein, 17 aa, Staphylococcus aureus
IYFTGGILGMAFVTSNI

SEQ ID NO: 1576472 - protein, 21 aa, Staphylococcus aureus
IYKLGLKQAKIAAVVQPISGI

SEQ ID NO: 1576473 - protein, 18 aa, Staphylococcus aureus
KCYLLIFLPVAFLCALIE

SEQ ID NO: 1576474 - protein, 21 aa, Staphylococcus aureus
KDIKSSASSAFNWTKDQIGKG

SEQ ID NO: 1576475 - protein, 18 aa, Staphylococcus aureus
KEIIAYSIPFVIVSLNYP

SEQ ID NO: 1576476 - protein, 35 aa, Staphylococcus aureus
KENRLKETIQLYGRDDFIGGIAIEIVSSSLYEQQI

SEQ ID NO: 1576477 - protein, 30 aa, Staphylococcus aureus
KFFSSLFTGNWRGVWDGIVMILKGTVQLIW

SEQ ID NO: 1576478 - protein, 20 aa, Staphylococcus aureus
KFVSEICLIIFLIIYTYQSF

SEQ ID NO: 1576479 - protein, 17 aa, Staphylococcus aureus
KIKREIQELKNLKKDLI

SEQ ID NO: 1576480 - protein, 21 aa, Staphylococcus aureus
KKLVIAICCTTFIGILIFYVR

SEQ ID NO: 1576481 - protein, 17 aa, Staphylococcus aureus
KQFFSTVLIPLSTSMKT

SEQ ID NO: 1576482 - protein, 19 aa, Staphylococcus aureus
KRLIDMMVDQVINDMESFK

SEQ ID NO: 1576483 - protein, 26 aa, Staphylococcus aureus
KRVHLKRWQFISILIGTTLITAVITV

SEQ ID NO: 1576484 - protein, 42 aa, Staphylococcus aureus
KVMTVKYAGQTWTRNISDWIAKSGTTNFSLSMTASTGGATNL

SEQ ID NO: 1576485 - protein, 18 aa, Staphylococcus aureus
KYLDGVKDRMGVTVNGRI

SEQ ID NO: 1576486 - protein, 18 aa, Staphylococcus aureus
LADEIKYPSAKFNQPEAK

SEQ ID NO: 1576487 - protein, 17 aa, Staphylococcus aureus
LAPYKKAKTLERQVYEL

SEQ ID NO: 1576488 - protein, 20 aa, Staphylococcus aureus
LCFLILPILLLTSVSAYAVS

SEQ ID NO: 1576489 - protein, 18 aa, Staphylococcus aureus
LDAVPSLDRMASIFEEGF

SEQ ID NO: 1576490 - protein, 26 aa, Staphylococcus aureus
LENMPDWLGNIGYIFPLRYAGDALTN

SEQ ID NO: 1576491 - protein, 18 aa, Staphylococcus aureus
LETFAIAVVGTFIAAIIC

SEQ ID NO: 1576492 - protein, 17 aa, Staphylococcus aureus
LFKQWLQYILLVTTIVI

SEQ ID NO: 1576493 - protein, 18 aa, Staphylococcus aureus
LFWEILDNYISIVSSVII

SEQ ID NO: 1576494 - protein, 17 aa, Staphylococcus aureus
LGSSVLFSVTFRKYMPL

SEQ ID NO: 1576495 - protein, 17 aa, Staphylococcus aureus
LIFIRQRLTMVILNGVI

SEQ ID NO: 1576496 - protein, 23 aa, Staphylococcus aureus
LIMFSVFFAFVFQEDVMIKSMGM

SEQ ID NO: 1576497 - protein, 26 aa, Staphylococcus aureus
LITSSQRWGLNQGINANGWMRTDLKG

SEQ ID NO: 1576498 - protein, 23 aa, Staphylococcus aureus
LITSVVLFFSFVALKYTHSINIT

SEQ ID NO: 1576499 - protein, 23 aa, Staphylococcus aureus
LLAPKWYIVFVMVALPVLIEFLV

SEQ ID NO: 1576500 - protein, 21 aa, Staphylococcus aureus
LLILICSGLSYSKAELQRIIR

SEQ ID NO: 1576501 - protein, 18 aa, Staphylococcus aureus
LNEKGEVIGTTKTDENGK

SEQ ID NO: 1576502 - protein, 17 aa, Staphylococcus aureus
LNLLPGVIWGIGNLFMF

SEQ ID NO: 1576503 - protein, 23 aa, Staphylococcus aureus
LPALIGWSSMRVFGGSPILGLVL

SEQ ID NO: 1576504 - protein, 19 aa, Staphylococcus aureus
LRYTAIMMIAIFIALMFDF

SEQ ID NO: 1576505 - protein, 17 aa, Staphylococcus aureus
LSAVFLMSSILCFEYDF

SEQ ID NO: 1576506 - protein, 20 aa, Staphylococcus aureus
LSNIRLGFKQEIEARKNGEK

SEQ ID NO: 1576507 - protein, 25 aa, Staphylococcus aureus
LSQQLSALSRFDAHYKMYTDTKGRE

SEQ ID NO: 1576508 - protein, 27 aa, Staphylococcus aureus
LSTSIRRSEIVLGYLIGYGIFAIIQTL

SEQ ID NO: 1576509 - protein, 19 aa, Staphylococcus aureus
LTLFSIIAFMLLHSQSFVV

SEQ ID NO: 1576510 - protein, 27 aa, Staphylococcus aureus
MATTSFILAFPMALIWPTIQTGLNAFS

SEQ ID NO: 1576511 - protein, 19 aa, Staphylococcus aureus
MATVPAMLISSFSAIIVGT

SEQ ID NO: 1576512 - protein, 19 aa, Staphylococcus aureus
MKAANPTAKELAKRKQEAI

SEQ ID NO: 1576513 - protein, 22 aa, Staphylococcus aureus
MLNYAETLYFIFNIAFLLIGGY

SEQ ID NO: 1576514 - protein, 17 aa, Staphylococcus aureus
MMNQIKIDTMLHGYHAG

SEQ ID NO: 1576515 - protein, 21 aa, Staphylococcus aureus
MSVSIAGPIGFVGLIVPHIVK

SEQ ID NO: 1576516 - protein, 19 aa, Staphylococcus aureus
MTFLCGWLAFVGAIVSIYI

SEQ ID NO: 1576517 - protein, 17 aa, Staphylococcus aureus
MVFSKAYVTVLMTIVSL

SEQ ID NO: 1576518 - protein, 25 aa, Staphylococcus aureus
MWTVPCYLCAIIAIIYGFTGIGIKK

SEQ ID NO: 1576519 - protein, 19 aa, Staphylococcus aureus
NFVSRGNISFSPSAIGAGV

SEQ ID NO: 1576520 - protein, 24 aa, Staphylococcus aureus
NFYAGLNLGEWKYFTYLLLGVFLA

SEQ ID NO: 1576521 - protein, 17 aa, Staphylococcus aureus
NKFTHIAYIKPMNGNQS

SEQ ID NO: 1576522 - protein, 24 aa, Staphylococcus aureus
NKYDMLMKAFQIDASVNPGNSGGA

SEQ ID NO: 1576523 - protein, 18 aa, Staphylococcus aureus
NLHSFKVGRGFDKEDNEL

SEQ ID NO: 1576524 - protein, 17 aa, Staphylococcus aureus
NLSSGLFSRKSMIYFNI

SEQ ID NO: 1576525 - protein, 17 aa, Staphylococcus aureus
NQIPIFIVMGLYICMYA

SEQ ID NO: 1576526 - protein, 20 aa, Staphylococcus aureus
NRLLEIVCVNSGFDLDSLFQ

SEQ ID NO: 1576527 - protein, 23 aa, Staphylococcus aureus
NSEFQMIQFIPLVAVPQVFFSGI

SEQ ID NO: 1576528 - protein, 24 aa, Staphylococcus aureus
NTVTGLPSGLTFDSTNNTISGTPT

SEQ ID NO: 1576529 - protein, 19 aa, Staphylococcus aureus
PATGKVVLLPTHRGTVSSG

SEQ ID NO: 1576530 - protein, 41 aa, Staphylococcus aureus
PIIQGWDHVDFIGVDFLDFKRKGAELANFYTGIINDLLRVE

SEQ ID NO: 1576531 - protein, 24 aa, Staphylococcus aureus
PNQMIEYGKSQGRDIHYQEGVPSY

SEQ ID NO: 1576532 - protein, 23 aa, Staphylococcus aureus
PQLLTKINWKVFITPAILTLVLA

SEQ ID NO: 1576533 - protein, 32 aa, Staphylococcus aureus
PQTGELLALVSTPSYDVYPFMYGMSNEEYNKL

SEQ ID NO: 1576534 - protein, 30 aa, Staphylococcus aureus
PTARYTFGYLRFEILVAFLNGLALIVISIW

SEQ ID NO: 1576535 - protein, 20 aa, Staphylococcus aureus
PVAEFNRMITLVFITDLLTA

SEQ ID NO: 1576536 - protein, 28 aa, Staphylococcus aureus
PVLRKFKIATPVFKPLFAWQMSGILLWI

SEQ ID NO: 1576537 - protein, 18 aa, Staphylococcus aureus
PVQRLIKLLGDIFIPILP

SEQ ID NO: 1576538 - protein, 17 aa, Staphylococcus aureus
QAASKFFFLNVLSLLEV

SEQ ID NO: 1576539 - protein, 30 aa, Staphylococcus aureus
QFGTFEYTESAVTQVRYVDVTTGKDIIPPK

SEQ ID NO: 1576540 - protein, 20 aa, Staphylococcus aureus
QHFKTIRFINTVCKSILLVL

SEQ ID NO: 1576541 - protein, 19 aa, Staphylococcus aureus
QKERITIYMKHNVKGYKNI

SEQ ID NO: 1576542 - protein, 30 aa, Staphylococcus aureus
QLAGLKFSISLKVIERLLLALILPLIILII

SEQ ID NO: 1576543 - protein, 28 aa, Staphylococcus aureus
QLEETVAFTKERVEGFLNKSKNEQAALK

SEQ ID NO: 1576544 - protein, 17 aa, Staphylococcus aureus
QSVDAFKNINIPLTLAG

SEQ ID NO: 1576545 - protein, 36 aa, Staphylococcus aureus
QYGQKKSKKGWFWGCGGCLVLFILIIIGISACTAGV

SEQ ID NO: 1576546 - protein, 19 aa, Staphylococcus aureus
RFHDISRTMLFPMIMTVFS

SEQ ID NO: 1576547 - protein, 20 aa, Staphylococcus aureus
RKLRRKRQKRIQYSVITILV

SEQ ID NO: 1576548 - protein, 21 aa, Staphylococcus aureus
RKLTGETIPYVFILIDNFDAV

SEQ ID NO: 1576549 - protein, 18 aa, Staphylococcus aureus
RRNIWISAGIIGIIQYSS

SEQ ID NO: 1576550 - protein, 21 aa, Staphylococcus aureus
RVFPNSKLDIITPVDMSSNAK

SEQ ID NO: 1576551 - protein, 23 aa, Staphylococcus aureus
SETYKFATAFLFLILATAGISQF

SEQ ID NO: 1576552 - protein, 27 aa, Staphylococcus aureus
SGKLKTRGYIDLSVGASFIPYRGNTST

SEQ ID NO: 1576553 - protein, 21 aa, Staphylococcus aureus
SIEECKIVFINNIKRFNQLTG

SEQ ID NO: 1576554 - protein, 25 aa, Staphylococcus aureus
SLSVSTSLRSSESVSESDSLSDSKS

SEQ ID NO: 1576555 - protein, 18 aa, Staphylococcus aureus
SLWYVILINICLAITALS

SEQ ID NO: 1576556 - protein, 25 aa, Staphylococcus aureus
STSDSLRTSTSLSDSVSMSTSGSLS

SEQ ID NO: 1576557 - protein, 23 aa, Staphylococcus aureus
SVSILIGLLFGWIPARAASKKEL

SEQ ID NO: 1576558 - protein, 20 aa, Staphylococcus aureus
SVWLVLLFSAMGLWQVSSAA

SEQ ID NO: 1576559 - protein, 24 aa, Staphylococcus aureus
TAIALFLVVFCWQPIHFYALAIKR

SEQ ID NO: 1576560 - protein, 24 aa, Staphylococcus aureus
TKGQIRPTILIIIGISMQTLFIAL

SEQ ID NO: 1576561 - protein, 17 aa, Staphylococcus aureus
TKYKWHILISFTLSVVL

SEQ ID NO: 1576562 - protein, 20 aa, Staphylococcus aureus
TLFTYASYILITWLVIIFAL

SEQ ID NO: 1576563 - protein, 35 aa, Staphylococcus aureus
TMRILRSAFLSGLMLEFISMLGIGLVALEATLNLV

SEQ ID NO: 1576564 - protein, 31 aa, Staphylococcus aureus
TPYFKPLHMVLRLFMLLTLISGFWILIQSFM

SEQ ID NO: 1576565 - protein, 17 aa, Staphylococcus aureus
VAMCLFKVEKHVSSPFL

SEQ ID NO: 1576566 - protein, 17 aa, Staphylococcus aureus
VAMFIPLFFLYKYHQPM

SEQ ID NO: 1576567 - protein, 19 aa, Staphylococcus aureus
VAQMKEFYVGDYPKHIPMM

SEQ ID NO: 1576568 - protein, 17 aa, Staphylococcus aureus
VCLMGFNLYIPVYLQEQ

SEQ ID NO: 1576569 - protein, 24 aa, Staphylococcus aureus
VDNHVYTDIKWCRMIIRQILSNAL

SEQ ID NO: 1576570 - protein, 18 aa, Staphylococcus aureus
VGLIVVWLIFYREAASQT

SEQ ID NO: 1576571 - protein, 24 aa, Staphylococcus aureus
VGVFKPHAVRDMNGHALPLTKDGN

SEQ ID NO: 1576572 - protein, 18 aa, Staphylococcus aureus
VLFLKRRSSELALYQTLG

SEQ ID NO: 1576573 - protein, 20 aa, Staphylococcus aureus
VPAVCVLIINLFLVFISIAA

SEQ ID NO: 1576574 - protein, 28 aa, Staphylococcus aureus
VPLIVIIVCLLFKMATVPAMVISSFSAI

SEQ ID NO: 1576575 - protein, 24 aa, Staphylococcus aureus
VRIPETLLDIKLEMLDLMHKYQVK

SEQ ID NO: 1576576 - protein, 18 aa, Staphylococcus aureus
VYLRAIICAIIIITHLLT

SEQ ID NO: 1576577 - protein, 19 aa, Staphylococcus aureus
YDQIGLWAPILLLLARVLQ

SEQ ID NO: 1576578 - protein, 26 aa, Staphylococcus aureus
YFGKDRFRLFNGWYYLIKYAMPVVII

SEQ ID NO: 1576579 - protein, 18 aa, Staphylococcus aureus
YKSLKVTRFKKSPMDSYF

SEQ ID NO: 1576580 - protein, 17 aa, Staphylococcus aureus
AAGWFVNIFDWRYLFLV

SEQ ID NO: 1576581 - protein, 17 aa, Staphylococcus aureus
AAYCVAFLIKWIEKKVP

SEQ ID NO: 1576582 - protein, 23 aa, Staphylococcus aureus
ACFNKWQFSIIMLSPLILLSAGL

SEQ ID NO: 1576583 - protein, 17 aa, Staphylococcus aureus
ADKVIKHVDGFKHPGEW

SEQ ID NO: 1576584 - protein, 18 aa, Staphylococcus aureus
AFAGSFVYIYFMQGIQGF

SEQ ID NO: 1576585 - protein, 17 aa, Staphylococcus aureus
AGAMIGIMYVFKFGPSI

SEQ ID NO: 1576586 - protein, 23 aa, Staphylococcus aureus
AGKQEALISFTFKVDEKIKKYPF

SEQ ID NO: 1576587 - protein, 19 aa, Staphylococcus aureus
AIFEILALLIASTFSLGFL

SEQ ID NO: 1576588 - protein, 24 aa, Staphylococcus aureus
AISKVWLYFMYYWIIFGIGCYLGQ

SEQ ID NO: 1576589 - protein, 21 aa, Staphylococcus aureus
AKAFLLRQIEDTFKSKQTEMR

SEQ ID NO: 1576590 - protein, 24 aa, Staphylococcus aureus
ANGAYKYNPYILNQINKLGKDYGE

SEQ ID NO: 1576591 - protein, 23 aa, Staphylococcus aureus
ANGAYKYNPYILNQINQLGKEYG

SEQ ID NO: 1576592 - protein, 22 aa, Staphylococcus aureus
ANMVFDWNLRWYLLGNIPHLPI

SEQ ID NO: 1576593 - protein, 26 aa, Staphylococcus aureus
ASHYNWKIPFYIIAIITFLCLLGIML

SEQ ID NO: 1576594 - protein, 27 aa, Staphylococcus aureus
ASNPVGWAVIGGFVFGSVSTMLVDWAY

SEQ ID NO: 1576595 - protein, 24 aa, Staphylococcus aureus
ATHCVTRLRLVLKDESKVDKEALS

SEQ ID NO: 1576596 - protein, 20 aa, Staphylococcus aureus
ATIMVSWLWFFLLAILGKVL

SEQ ID NO: 1576597 - protein, 20 aa, Staphylococcus aureus
ATKISVIFAVAFFIINYIGM

SEQ ID NO: 1576598 - protein, 25 aa, Staphylococcus aureus
AVVLIMVLIGFIFWRQDDYTSRDFE

SEQ ID NO: 1576599 - protein, 22 aa, Staphylococcus aureus
CYYLYRLIFTYKYDIVSRTQKF

SEQ ID NO: 1576600 - protein, 19 aa, Staphylococcus aureus
DFSVAMILIVLMFMLFIGN

SEQ ID NO: 1576601 - protein, 24 aa, Staphylococcus aureus
DITGMTCAACSSRIEKVLNKMNGV

SEQ ID NO: 1576602 - protein, 28 aa, Staphylococcus aureus
DKNSRYGIAGPMPIVMVSIIKSMMHQKM

SEQ ID NO: 1576603 - protein, 26 aa, Staphylococcus aureus
DNIFTFFYKKVAVLFIECLIYIILGI

SEQ ID NO: 1576604 - protein, 18 aa, Staphylococcus aureus
DRRQMTGIWVGIIIIVIA

SEQ ID NO: 1576605 - protein, 18 aa, Staphylococcus aureus
DSKIVSDCRHLLKHPDNL

SEQ ID NO: 1576606 - protein, 23 aa, Staphylococcus aureus
EAKEVKEVKAPKETKAVKPAAKA

SEQ ID NO: 1576607 - protein, 29 aa, Staphylococcus aureus
EEIVFRGMIIRVIFRKHLFLGLLVSSLVF

SEQ ID NO: 1576608 - protein, 18 aa, Staphylococcus aureus
EEKRKVRRKRQKRIQYSV

SEQ ID NO: 1576609 - protein, 25 aa, Staphylococcus aureus
EHIRYGESILKCSILKSQHINNVAA

SEQ ID NO: 1576610 - protein, 20 aa, Staphylococcus aureus
EIIDDIRLPSFIEEIESICK

SEQ ID NO: 1576611 - protein, 20 aa, Staphylococcus aureus
EKFSELHALYSFDTEIKNLF

SEQ ID NO: 1576612 - protein, 18 aa, Staphylococcus aureus
EKTIPVVYNPGVSNSYTN

SEQ ID NO: 1576613 - protein, 25 aa, Staphylococcus aureus
ELGGMFFLLAFCMIVPWRVAMLYKY

SEQ ID NO: 1576614 - protein, 22 aa, Staphylococcus aureus
ESFIRPNSHFDYEYKLYKDKFE

SEQ ID NO: 1576615 - protein, 19 aa, Staphylococcus aureus
EVNFARFIIIIAGIFGFGM

SEQ ID NO: 1576616 - protein, 20 aa, Staphylococcus aureus
FALFVAFLFSYDRKNIDFKK

SEQ ID NO: 1576617 - protein, 22 aa, Staphylococcus aureus
FCQNIPKKSWFVSATSTTNNKE

SEQ ID NO: 1576618 - protein, 19 aa, Staphylococcus aureus
FDEEIYLINKDFKKEQGNE

SEQ ID NO: 1576619 - protein, 21 aa, Staphylococcus aureus
FEGVFIYPALLALIIAAISYI

SEQ ID NO: 1576620 - protein, 24 aa, Staphylococcus aureus
FGSVSTMLVDWAYQNNKAGIKDKA

SEQ ID NO: 1576621 - protein, 20 aa, Staphylococcus aureus
FIAVLLCLPLHFKVTKIPED

SEQ ID NO: 1576622 - protein, 18 aa, Staphylococcus aureus
FIIGIALAIVILIVFAVL

SEQ ID NO: 1576623 - protein, 26 aa, Staphylococcus aureus
FNHLQNRFEAIVAFLMIALFCKFILY

SEQ ID NO: 1576624 - protein, 18 aa, Staphylococcus aureus
FNLIKAIGVLLLIIGIVI

SEQ ID NO: 1576625 - protein, 23 aa, Staphylococcus aureus
FPEQKLPVYILFTLFVVVAIVSN

SEQ ID NO: 1576626 - protein, 28 aa, Staphylococcus aureus
FSLIASILVLWLYFRKSIPKTFDTENLS

SEQ ID NO: 1576627 - protein, 17 aa, Staphylococcus aureus
FVVAKLFGFVFLASACG

SEQ ID NO: 1576628 - protein, 19 aa, Staphylococcus aureus
FWVIMVIIGFLYVCKLQFY

SEQ ID NO: 1576629 - protein, 18 aa, Staphylococcus aureus
FYNRCQEIILSRLQSDKS

SEQ ID NO: 1576630 - protein, 25 aa, Staphylococcus aureus
GFTLRKIIFENFSKKCTYWVTLIIS

SEQ ID NO: 1576631 - protein, 18 aa, Staphylococcus aureus
GGELKHGTIALIEDGTPV

SEQ ID NO: 1576632 - protein, 26 aa, Staphylococcus aureus
GGKTYFLFYVIRELFRRHSEVRLLDP

SEQ ID NO: 1576633 - protein, 18 aa, Staphylococcus aureus
GGWIGIKGSFGLNQILGV

SEQ ID NO: 1576634 - protein, 21 aa, Staphylococcus aureus
GHSIWIVSLCLFFSGIAGVLG

SEQ ID NO: 1576635 - protein, 18 aa, Staphylococcus aureus
GIAKAGNVFPVLSPILGW

SEQ ID NO: 1576636 - protein, 27 aa, Staphylococcus aureus
GIMYVFKFGPSILFKANYGPFLFEKLM

SEQ ID NO: 1576637 - protein, 18 aa, Staphylococcus aureus
GIVLLRLFKINLLSFKKL

SEQ ID NO: 1576638 - protein, 19 aa, Staphylococcus aureus
GKILGVVRYFGGLLKGLIA

SEQ ID NO: 1576639 - protein, 22 aa, Staphylococcus aureus
GLIDGSFSWMGLLDAVSKGIIS

SEQ ID NO: 1576640 - protein, 17 aa, Staphylococcus aureus
GLWFPINTFPNWLQHVA

SEQ ID NO: 1576641 - protein, 26 aa, Staphylococcus aureus
GNQTIEVGKTMNPVVLTTTDNGTGTV

SEQ ID NO: 1576642 - protein, 23 aa, Staphylococcus aureus
GRILFGFGSLFFGLEFMGDAVKP

SEQ ID NO: 1576643 - protein, 20 aa, Staphylococcus aureus
HEVNFARFIIIIAGIFGFGM

SEQ ID NO: 1576644 - protein, 19 aa, Staphylococcus aureus
HFFGETFALIPIVFIKYDF

SEQ ID NO: 1576645 - protein, 25 aa, Staphylococcus aureus
HKAHGGEISPLFTGGHNNMVASITT

SEQ ID NO: 1576646 - protein, 23 aa, Staphylococcus aureus
HKIPIFAGMAIIFTVYFSNKKSI

SEQ ID NO: 1576647 - protein, 19 aa, Staphylococcus aureus
HKYILIATICLSWISLFSA

SEQ ID NO: 1576648 - protein, 18 aa, Staphylococcus aureus
HLMLSFGMFIVTFIGVVV

SEQ ID NO: 1576649 - protein, 19 aa, Staphylococcus aureus
IALFCKFILYLIIVTFDKI

SEQ ID NO: 1576650 - protein, 25 aa, Staphylococcus aureus
IANDGYRIQPHIGLTIHESTNKDDV

SEQ ID NO: 1576651 - protein, 23 aa, Staphylococcus aureus
IAVLKMLIIFLVINYGTDISYDH

SEQ ID NO: 1576652 - protein, 18 aa, Staphylococcus aureus
ICQLIFRHILIQELSRLI

SEQ ID NO: 1576653 - protein, 31 aa, Staphylococcus aureus
ICRGLIIRILFRNHLFLGFIVSTVFFTLIHE

SEQ ID NO: 1576654 - protein, 17 aa, Staphylococcus aureus
IDIKQRFFGKDSERHEV

SEQ ID NO: 1576655 - protein, 24 aa, Staphylococcus aureus
IFENLPMIFALGVAIGLAGGDGVA

SEQ ID NO: 1576656 - protein, 20 aa, Staphylococcus aureus
IGGIRLSSVYVISWATLASY

SEQ ID NO: 1576657 - protein, 24 aa, Staphylococcus aureus
IGILAILVGFVWFKLYQYTTNPKA

SEQ ID NO: 1576658 - protein, 25 aa, Staphylococcus aureus
IGLFVIKGYLYVKHAGFKMTDEQIT

SEQ ID NO: 1576659 - protein, 18 aa, Staphylococcus aureus
IHYIPGFLGVFIASTGLI

SEQ ID NO: 1576660 - protein, 22 aa, Staphylococcus aureus
IIAIISLCILTYTTMIGSVLAD

SEQ ID NO: 1576661 - protein, 17 aa, Staphylococcus aureus
IIARVGPIKVLRIILII

SEQ ID NO: 1576662 - protein, 22 aa, Staphylococcus aureus
IIFVALEFFYIMYLETIATTSR

SEQ ID NO: 1576663 - protein, 27 aa, Staphylococcus aureus
IIFYGVCVLCILLLPIIFIPNPNHVFI

SEQ ID NO: 1576664 - protein, 18 aa, Staphylococcus aureus
IKESLAVVLDESKRLNRL

SEQ ID NO: 1576665 - protein, 17 aa, Staphylococcus aureus
IKGGRVDYGAAHAAKYG

SEQ ID NO: 1576666 - protein, 19 aa, Staphylococcus aureus
IKVPASILNKSVKGIQLEQ

SEQ ID NO: 1576667 - protein, 25 aa, Staphylococcus aureus
ILFIFRCFVVVLVFVGAVVKTETVW

SEQ ID NO: 1576668 - protein, 23 aa, Staphylococcus aureus
ILFISIFLKFSFNIEFIATIMNI

SEQ ID NO: 1576669 - protein, 17 aa, Staphylococcus aureus
ILGSLLIIISNIPLLLI

SEQ ID NO: 1576670 - protein, 22 aa, Staphylococcus aureus
ILKQFFCFTFSKYLRSHIDDTL

SEQ ID NO: 1576671 - protein, 20 aa, Staphylococcus aureus
ILLGVCGLVAILFNFPKLKK

SEQ ID NO: 1576672 - protein, 23 aa, Staphylococcus aureus
IMLFWIFMSFIFQKLLFPPSKNN

SEQ ID NO: 1576673 - protein, 19 aa, Staphylococcus aureus
IPVLSFFNMLSIFQIYVVA

SEQ ID NO: 1576674 - protein, 17 aa, Staphylococcus aureus
ISDKRSKTRGYAIDMNP

SEQ ID NO: 1576675 - protein, 18 aa, Staphylococcus aureus
ISKLIPVMFIRRWFDMKT

SEQ ID NO: 1576676 - protein, 23 aa, Staphylococcus aureus
ISNGAPCNKILSLIGYSDTIVLQ

SEQ ID NO: 1576677 - protein, 19 aa, Staphylococcus aureus
ISQQIPVIIVFILSIFSVI

SEQ ID NO: 1576678 - protein, 21 aa, Staphylococcus aureus
ITFLCLLGIMLFIPNKSHYSI

SEQ ID NO: 1576679 - protein, 24 aa, Staphylococcus aureus
ITMALSIMLRDFQSVIGVKHFIFE

SEQ ID NO: 1576680 - protein, 18 aa, Staphylococcus aureus
ITQQIPVIIVFILSIFSV

SEQ ID NO: 1576681 - protein, 17 aa, Staphylococcus aureus
ITSFIALHFSWYYLLLV

SEQ ID NO: 1576682 - protein, 23 aa, Staphylococcus aureus
IVSRTQKFICVISATVLSVLSSV

SEQ ID NO: 1576683 - protein, 17 aa, Staphylococcus aureus
IVYFAWIAVMMGFFLVN

SEQ ID NO: 1576684 - protein, 22 aa, Staphylococcus aureus
IWIHLLCTMIKYFNNVKEQLNS

SEQ ID NO: 1576685 - protein, 29 aa, Staphylococcus aureus
IWVFGSLLCLFYMIKAFRQIDVIKSSSLE

SEQ ID NO: 1576686 - protein, 17 aa, Staphylococcus aureus
KDVKGRAAINDDNFTQF

SEQ ID NO: 1576687 - protein, 20 aa, Staphylococcus aureus
KEFWPVYLVVTGIAIVVPCI

SEQ ID NO: 1576688 - protein, 32 aa, Staphylococcus aureus
KERLLIIRALITWFYTMLWSIVGVVWIVFSIP

SEQ ID NO: 1576689 - protein, 29 aa, Staphylococcus aureus
KETLDDTKHLPLLFAKRRRKEDEEDVTVE

SEQ ID NO: 1576690 - protein, 17 aa, Staphylococcus aureus
KGYRIAGNIIIIVYIIS

SEQ ID NO: 1576691 - protein, 18 aa, Staphylococcus aureus
KHIPMMPDKVFMEDIREA

SEQ ID NO: 1576692 - protein, 18 aa, Staphylococcus aureus
KHVDGFKHPGEWKNQDLG

SEQ ID NO: 1576693 - protein, 18 aa, Staphylococcus aureus
KIVVLPIIIYAILFVIIG

SEQ ID NO: 1576694 - protein, 19 aa, Staphylococcus aureus
KLFGGKYMGYLIFVFFIFV

SEQ ID NO: 1576695 - protein, 28 aa, Staphylococcus aureus
KLKFPHMLYIIFGFLLMYGLDYLYDTFA

SEQ ID NO: 1576696 - protein, 22 aa, Staphylococcus aureus
KNSNIKVVIGMLQIDKSQIKQS

SEQ ID NO: 1576697 - protein, 20 aa, Staphylococcus aureus
KPAGLKRVGIIAALGATVML

SEQ ID NO: 1576698 - protein, 23 aa, Staphylococcus aureus
KQNKKWYLPFGYDAQDIDLNNIS

SEQ ID NO: 1576699 - protein, 19 aa, Staphylococcus aureus
KRGDYFDFTLSNNVNTYGV

SEQ ID NO: 1576700 - protein, 22 aa, Staphylococcus aureus
KRVGIIAALGATVMLCLSTIKK

SEQ ID NO: 1576701 - protein, 17 aa, Staphylococcus aureus
KSIIAIISLCILTYTTM

SEQ ID NO: 1576702 - protein, 21 aa, Staphylococcus aureus
KSTFMKSIAINIILASAIQTV

SEQ ID NO: 1576703 - protein, 24 aa, Staphylococcus aureus
KTYVKHFLAFNGFMGVITFVLLIV

SEQ ID NO: 1576704 - protein, 20 aa, Staphylococcus aureus
KVRRKRQKRIQYSVITILVL

SEQ ID NO: 1576705 - protein, 20 aa, Staphylococcus aureus
LAAKEFVKPAGLKRVGIIAA

SEQ ID NO: 1576706 - protein, 27 aa, Staphylococcus aureus
LAPLFQWSADWLDRLGQSFSNWANSAA

SEQ ID NO: 1576707 - protein, 17 aa, Staphylococcus aureus
LAYGIAFNGSVDLQGDK

SEQ ID NO: 1576708 - protein, 30 aa, Staphylococcus aureus
LDNHYALAMYRRTLECYTEPQIDDTNDGIV

SEQ ID NO: 1576709 - protein, 20 aa, Staphylococcus aureus
LEQKEAAIAEVNKLKQQAID

SEQ ID NO: 1576710 - protein, 27 aa, Staphylococcus aureus
LHNAFNVRIGWLILRLLAVVFAWMTFL

SEQ ID NO: 1576711 - protein, 26 aa, Staphylococcus aureus
LIFPYVGLRLRWQWYQSGLKTWQVNL

SEQ ID NO: 1576712 - protein, 17 aa, Staphylococcus aureus
LIIMGLCEGVVPLIAYN

SEQ ID NO: 1576713 - protein, 18 aa, Staphylococcus aureus
LISYLSIPVLSFYNMLSI

SEQ ID NO: 1576714 - protein, 42 aa, Staphylococcus aureus
LIVFAVLFRFIVRLIPIFYIFRVLSIFIFIMGFKMLGVSIQK

SEQ ID NO: 1576715 - protein, 22 aa, Staphylococcus aureus
LLAPKWYITFVMVALPVLIEFL

SEQ ID NO: 1576716 - protein, 17 aa, Staphylococcus aureus
LLFSIPTPVAVILMGIA

SEQ ID NO: 1576717 - protein, 18 aa, Staphylococcus aureus
LLLLCILSYLVTNKKKPF

SEQ ID NO: 1576718 - protein, 39 aa, Staphylococcus aureus
LLNILKKNIKLLLILPAICLVVSTALTFFVMPDKYTAST

SEQ ID NO: 1576719 - protein, 32 aa, Staphylococcus aureus
LLRSDRYLHLTILKRRIIMIGFITLPLYYLLF

SEQ ID NO: 1576720 - protein, 17 aa, Staphylococcus aureus
LNAVLVGAGFVSSLLMI

SEQ ID NO: 1576721 - protein, 17 aa, Staphylococcus aureus
LNVLLPLVFISVLIGIF

SEQ ID NO: 1576722 - protein, 27 aa, Staphylococcus aureus
LPIAISMRITKSFKQLILLSVFLGELS

SEQ ID NO: 1576723 - protein, 19 aa, Staphylococcus aureus
LRIYIVLIIAVIVMMLSLS

SEQ ID NO: 1576724 - protein, 17 aa, Staphylococcus aureus
LRSLKNFINNLDFYLKT

SEQ ID NO: 1576725 - protein, 25 aa, Staphylococcus aureus
LSLLLTFICYLVWTVSYRNRSYNKE

SEQ ID NO: 1576726 - protein, 22 aa, Staphylococcus aureus
LSNINMLLAFVVLLGLFIVGPT

SEQ ID NO: 1576727 - protein, 36 aa, Staphylococcus aureus
LSSILMKNKWPFLIALPFMIGYGIGITIYYQRKVAY

SEQ ID NO: 1576728 - protein, 30 aa, Staphylococcus aureus
LTDVKEVRWLFRLIALIVFAVLMFTIYISY

SEQ ID NO: 1576729 - protein, 23 aa, Staphylococcus aureus
LTGSEMLEAFIIGLLFSTVLIWT

SEQ ID NO: 1576730 - protein, 19 aa, Staphylococcus aureus
LTLTTAFIALFSMLITLLL

SEQ ID NO: 1576731 - protein, 23 aa, Staphylococcus aureus
LVLPRVLKYIGMVNMYYLSSFLF

SEQ ID NO: 1576732 - protein, 18 aa, Staphylococcus aureus
MHIDGDLKGSSVGYKKLE

SEQ ID NO: 1576733 - protein, 29 aa, Staphylococcus aureus
MPNIGAFIAWGFIAAIFIDNGWFPNKDLA

SEQ ID NO: 1576734 - protein, 23 aa, Staphylococcus aureus
MQLPWVSFIVHFSFSIVIAIIYC

SEQ ID NO: 1576735 - protein, 23 aa, Staphylococcus aureus
MRDLEMNTRFFVVTTSYIDKIEQ

SEQ ID NO: 1576736 - protein, 18 aa, Staphylococcus aureus
MRYSLISGILIGFIAPLI

SEQ ID NO: 1576737 - protein, 19 aa, Staphylococcus aureus
MSSILCFEYDFIALSFLFL

SEQ ID NO: 1576738 - protein, 17 aa, Staphylococcus aureus
MSVFFRLAGDLPVFQKS

SEQ ID NO: 1576739 - protein, 18 aa, Staphylococcus aureus
MVCDGYLMRIENLTPSNF

SEQ ID NO: 1576740 - protein, 17 aa, Staphylococcus aureus
MYKLFYNRCQEIILSRL

SEQ ID NO: 1576741 - protein, 17 aa, Staphylococcus aureus
MYSEKIVVLPIIIYAIL

SEQ ID NO: 1576742 - protein, 26 aa, Staphylococcus aureus
NAPRGEFLHMLLGVFLATLVSFVVAA

SEQ ID NO: 1576743 - protein, 32 aa, Staphylococcus aureus
NAREALKRAFLIMCLIGFGVGILANAGNIIRG

SEQ ID NO: 1576744 - protein, 26 aa, Staphylococcus aureus
NCYFVYRVKPTWRKFISFPITQIVNI

SEQ ID NO: 1576745 - protein, 25 aa, Staphylococcus aureus
NDYKKFKVFSLISTLVIVILAIIRF

SEQ ID NO: 1576746 - protein, 24 aa, Staphylococcus aureus
NGKPFKYDHHYNITYKFNGPSDVA

SEQ ID NO: 1576747 - protein, 19 aa, Staphylococcus aureus
NIKERVKYIALYDSMPKPN

SEQ ID NO: 1576748 - protein, 17 aa, Staphylococcus aureus
NILGISIRNTRPSNKQL

SEQ ID NO: 1576749 - protein, 18 aa, Staphylococcus aureus
NKAEELANSIINNINKAT

SEQ ID NO: 1576750 - protein, 29 aa, Staphylococcus aureus
NKFYNKWIACLLVAFPIFTSFTTYCNSHF

SEQ ID NO: 1576751 - protein, 17 aa, Staphylococcus aureus
NKPVVTLMPQFVDYLES

SEQ ID NO: 1576752 - protein, 27 aa, Staphylococcus aureus
NLGLDDIRNTHVWEVDEQPAVNEIFEA

SEQ ID NO: 1576753 - protein, 20 aa, Staphylococcus aureus
NLSLTMIFLILTYFKEVKLY

SEQ ID NO: 1576754 - protein, 25 aa, Staphylococcus aureus
NMEGKEVRFGAGLSALFTVITTAFT

SEQ ID NO: 1576755 - protein, 20 aa, Staphylococcus aureus
NNAQRQLAIQQINNAETLNK

SEQ ID NO: 1576756 - protein, 24 aa, Staphylococcus aureus
NNKAGIKDKADWVGHKLDDGIDVV

SEQ ID NO: 1576757 - protein, 32 aa, Staphylococcus aureus
NNMSFRISSAILQFLGAISWFFLSLILSLTQF

SEQ ID NO: 1576758 - protein, 38 aa, Staphylococcus aureus
NNNYSAILKKFWMMYWPKLVILMGIIILIVILNAIFNN

SEQ ID NO: 1576759 - protein, 17 aa, Staphylococcus aureus
NPNYRKILFEGSEYQQV

SEQ ID NO: 1576760 - protein, 24 aa, Staphylococcus aureus
NSAELKLSLSILPILMIIYGIVAK

SEQ ID NO: 1576761 - protein, 23 aa, Staphylococcus aureus
NSTMWMFIGFMIFGAVSSLISAI

SEQ ID NO: 1576762 - protein, 24 aa, Staphylococcus aureus
NSTYKIYLALMAFDQNLLSLNHTE

SEQ ID NO: 1576763 - protein, 18 aa, Staphylococcus aureus
NTFGMPWTIFLFHPHHDN

SEQ ID NO: 1576764 - protein, 31 aa, Staphylococcus aureus
PFRKEGIKALNWRSSYIPQFIRMVIVVTLLI

SEQ ID NO: 1576765 - protein, 19 aa, Staphylococcus aureus
PIVLVPLIVERKRIKQHPD

SEQ ID NO: 1576766 - protein, 19 aa, Staphylococcus aureus
PLFFLYKYHQPMFGRLSSQ

SEQ ID NO: 1576767 - protein, 23 aa, Staphylococcus aureus
PTLKRMKFGQSIREEGPQSHMKK

SEQ ID NO: 1576768 - protein, 31 aa, Staphylococcus aureus
PVVRCLPLIISCLKLILILLFLLSILLVIYQ

SEQ ID NO: 1576769 - protein, 23 aa, Staphylococcus aureus
QKTFFKFFIGILLLNLVIILFKT

SEQ ID NO: 1576770 - protein, 18 aa, Staphylococcus aureus
QRLVKILLSFVIAVIVVY

SEQ ID NO: 1576771 - protein, 20 aa, Staphylococcus aureus
QSSLFLKRRSILSMMKDSVK

SEQ ID NO: 1576772 - protein, 18 aa, Staphylococcus aureus
QWVLWTILVTSFFSIGTP

SEQ ID NO: 1576773 - protein, 19 aa, Staphylococcus aureus
RAPAQAFVDKFAKYYTPII

SEQ ID NO: 1576774 - protein, 20 aa, Staphylococcus aureus
RISQQIPVIIVFILSIFSVI

SEQ ID NO: 1576775 - protein, 21 aa, Staphylococcus aureus
RLNLPLFVIKGITIIVLTLYA

SEQ ID NO: 1576776 - protein, 27 aa, Staphylococcus aureus
RNKRIVAYIVCSISLLIQAPLLSAHVQ

SEQ ID NO: 1576777 - protein, 21 aa, Staphylococcus aureus
RPYFHMIWHIFIVIASLLHLI

SEQ ID NO: 1576778 - protein, 18 aa, Staphylococcus aureus
RRYNIPSNASTKVELKGM

SEQ ID NO: 1576779 - protein, 22 aa, Staphylococcus aureus
RVAVAITGWIANLFEAHPATAQ

SEQ ID NO: 1576780 - protein, 22 aa, Staphylococcus aureus
RVRKGAFAFVVIRPILFSCWIF

SEQ ID NO: 1576781 - protein, 19 aa, Staphylococcus aureus
SALLKQIKFQYAITKKQLY

SEQ ID NO: 1576782 - protein, 21 aa, Staphylococcus aureus
SDFDGPVGIGHTRWATHGVPN

SEQ ID NO: 1576783 - protein, 18 aa, Staphylococcus aureus
SENMLGRVNSVFKTMVFA

SEQ ID NO: 1576784 - protein, 17 aa, Staphylococcus aureus
SFIALHFSWYYLLLVLV

SEQ ID NO: 1576785 - protein, 20 aa, Staphylococcus aureus
SFVVAALIMKFTKEPKQDLE

SEQ ID NO: 1576786 - protein, 17 aa, Staphylococcus aureus
SGIHFILSMFNKDVSDD

SEQ ID NO: 1576787 - protein, 25 aa, Staphylococcus aureus
SKDKLEYFNPAGLYQTHSFKKLAPF

SEQ ID NO: 1576788 - protein, 19 aa, Staphylococcus aureus
SLTLIFLILTFFKEVKLYR

SEQ ID NO: 1576789 - protein, 23 aa, Staphylococcus aureus
SNIFKNQYWLFGVKKNKRHDINE

SEQ ID NO: 1576790 - protein, 38 aa, Staphylococcus aureus
SRMIIPNLFSLLASLLVLWLYFRKAIPKSFDANHIKKP

SEQ ID NO: 1576791 - protein, 26 aa, Staphylococcus aureus
SSLKWYELMPIISFLLLKGRCRNCHK

SEQ ID NO: 1576792 - protein, 29 aa, Staphylococcus aureus
STNKGMLFGGLFSILGLALLRRNKKNNKA

SEQ ID NO: 1576793 - protein, 18 aa, Staphylococcus aureus
SVAIKLALNYPLIMLFHT

SEQ ID NO: 1576794 - protein, 31 aa, Staphylococcus aureus
SYIAARGAREFKWRLPDKITIRNSAIGGICM

SEQ ID NO: 1576795 - protein, 25 aa, Staphylococcus aureus
TFFHEKGKLIGMLQMFMTKESIADR

SEQ ID NO: 1576796 - protein, 17 aa, Staphylococcus aureus
TGALVGSALGLYFKNKV

SEQ ID NO: 1576797 - protein, 24 aa, Staphylococcus aureus
TISFGEGNLWFGNWEYTFLNHVGF

SEQ ID NO: 1576798 - protein, 19 aa, Staphylococcus aureus
TKSRLRIYIVLIIAVIVMM

SEQ ID NO: 1576799 - protein, 23 aa, Staphylococcus aureus
TLNAVCGIFAFLIWIHLLCTMIK

SEQ ID NO: 1576800 - protein, 26 aa, Staphylococcus aureus
TLSLGMCAYIIRLVRSNLLILLKSNI

SEQ ID NO: 1576801 - protein, 24 aa, Staphylococcus aureus
TMWSEYRGNPILANLGIHGANMEG

SEQ ID NO: 1576802 - protein, 25 aa, Staphylococcus aureus
TQAIFFKKMIYFWLSEGQLILMLLG

SEQ ID NO: 1576803 - protein, 30 aa, Staphylococcus aureus
TQEKRIDLFFKYNLNHYKSLKVTRFKKSPM

SEQ ID NO: 1576804 - protein, 17 aa, Staphylococcus aureus
TTVKLIFPLQNEIVERM

SEQ ID NO: 1576805 - protein, 18 aa, Staphylococcus aureus
VAVIPLLFLVIPKMKISI

SEQ ID NO: 1576806 - protein, 19 aa, Staphylococcus aureus
VAYLCPNCQHIFSPSLWAV

SEQ ID NO: 1576807 - protein, 17 aa, Staphylococcus aureus
VFIFIALMLKWWLILAI

SEQ ID NO: 1576808 - protein, 18 aa, Staphylococcus aureus
VGIPRFVIVTTYQFGQYA

SEQ ID NO: 1576809 - protein, 23 aa, Staphylococcus aureus
VGSALGLYFKNKVYQKADDLKVK

SEQ ID NO: 1576810 - protein, 19 aa, Staphylococcus aureus
VHPMLSLFFFYSAFAIPFT

SEQ ID NO: 1576811 - protein, 22 aa, Staphylococcus aureus
VIIYLFIRRQFNITNVLLNLRV

SEQ ID NO: 1576812 - protein, 20 aa, Staphylococcus aureus
VIPCVAGALFGEYISNPQAL

SEQ ID NO: 1576813 - protein, 17 aa, Staphylococcus aureus
VKGRAAINDDNFTQFQI

SEQ ID NO: 1576814 - protein, 19 aa, Staphylococcus aureus
VKQLKRRYNIPSNASTKVE

SEQ ID NO: 1576815 - protein, 29 aa, Staphylococcus aureus
VLDGLSFLTLYLLDVHLGYTFSGGFIDYV

SEQ ID NO: 1576816 - protein, 24 aa, Staphylococcus aureus
VLRALRLAQKLGLSIDGVGSHTPY

SEQ ID NO: 1576817 - protein, 29 aa, Staphylococcus aureus
VMIKGQGWSNIWFDLLILMIFIIVFIILN

SEQ ID NO: 1576818 - protein, 17 aa, Staphylococcus aureus
VQYRTSFLIYKEETSRI

SEQ ID NO: 1576819 - protein, 18 aa, Staphylococcus aureus
VRNKIKPFKTFDKPKYEK

SEQ ID NO: 1576820 - protein, 25 aa, Staphylococcus aureus
VSFIPGFELSVFSAFAKTLGYIILS

SEQ ID NO: 1576821 - protein, 17 aa, Staphylococcus aureus
VVFFLGDFIFKYTDWGI

SEQ ID NO: 1576822 - protein, 28 aa, Staphylococcus aureus
VYVIFYFIWLRFEWPQYLIYILFVLCTL

SEQ ID NO: 1576823 - protein, 17 aa, Staphylococcus aureus
VYYDMNKPSGKRINAIQ

SEQ ID NO: 1576824 - protein, 21 aa, Staphylococcus aureus
WISLFFPFINWFIPKRYVKIS

SEQ ID NO: 1576825 - protein, 22 aa, Staphylococcus aureus
WIVKFGESIVGLGSFGAFVYGV

SEQ ID NO: 1576826 - protein, 20 aa, Staphylococcus aureus
WLPIEIKLTLTTAFIALFSM

SEQ ID NO: 1576827 - protein, 19 aa, Staphylococcus aureus
WLSEGQLILMLLGDESAYK

SEQ ID NO: 1576828 - protein, 19 aa, Staphylococcus aureus
WRKFISFPITQIVNISLQT

SEQ ID NO: 1576829 - protein, 26 aa, Staphylococcus aureus
YAAWIAKRVGLTWQDLETGIAERLNT

SEQ ID NO: 1576830 - protein, 20 aa, Staphylococcus aureus
YASDEQIEFAVIDEGPGISI

SEQ ID NO: 1576831 - protein, 23 aa, Staphylococcus aureus
YEKKNMAGLIFVSWYPTVYWIIN

SEQ ID NO: 1576832 - protein, 18 aa, Staphylococcus aureus
YFFLCIVRIFMAGIASLI

SEQ ID NO: 1576833 - protein, 29 aa, Staphylococcus aureus
YFVPIVVGIALLIFIVWITLVTPGTFEPA

SEQ ID NO: 1576834 - protein, 23 aa, Staphylococcus aureus
YITNSWLKPLHMTHTSFKQNNNK

SEQ ID NO: 1576835 - protein, 18 aa, Staphylococcus aureus
YMFIEIIGGLLANSLALL

SEQ ID NO: 1576836 - protein, 25 aa, Staphylococcus aureus
YQTPELYFKAWQGFYHEVHNEPERD

SEQ ID NO: 1576837 - protein, 17 aa, Staphylococcus aureus
YRAGEGLIGSWIALVLY

SEQ ID NO: 1576838 - protein, 17 aa, Staphylococcus aureus
YRIAGNIIIIVYIISIM

SEQ ID NO: 1576839 - protein, 22 aa, Staphylococcus aureus
AASGYAVCIAMLRRLTGMTDVI

SEQ ID NO: 1576840 - protein, 24 aa, Staphylococcus aureus
AKKVMRLSAVLFWIPIAFVLLIAF

SEQ ID NO: 1576841 - protein, 23 aa, Staphylococcus aureus
AKNDLKEIPLLVTKKNDVSETVN

SEQ ID NO: 1576842 - protein, 18 aa, Staphylococcus aureus
ALGSSVLFSVTFRKYMPL

SEQ ID NO: 1576843 - protein, 18 aa, Staphylococcus aureus
ASVTLGTLLISGGVTPAA

SEQ ID NO: 1576844 - protein, 20 aa, Staphylococcus aureus
AVIIIPRFLDLGTFDVTIAF

SEQ ID NO: 1576845 - protein, 21 aa, Staphylococcus aureus
AVKEVKAPKEAKEEKPAAKAD

SEQ ID NO: 1576846 - protein, 24 aa, Staphylococcus aureus
AYLFFKSSVSLVFKIIKSFKKGVI

SEQ ID NO: 1576847 - protein, 17 aa, Staphylococcus aureus
CSITLPITGIDDVRLGR

SEQ ID NO: 1576848 - protein, 17 aa, Staphylococcus aureus
CVFWIYCLVVLLVYIGT

SEQ ID NO: 1576849 - protein, 32 aa, Staphylococcus aureus
DDFFNSNFWIYWKTMFAFEPWHSAMEMRRYLM

SEQ ID NO: 1576850 - protein, 17 aa, Staphylococcus aureus
DEVKSYLDLIEYGNEEI

SEQ ID NO: 1576851 - protein, 17 aa, Staphylococcus aureus
DFMRYSLISGILIGFIA

SEQ ID NO: 1576852 - protein, 24 aa, Staphylococcus aureus
DFVGFISAWGYWFSAFLGNVAYAT

SEQ ID NO: 1576853 - protein, 22 aa, Staphylococcus aureus
DGKDIEYDTEFTIDNKVKKGDT

SEQ ID NO: 1576854 - protein, 19 aa, Staphylococcus aureus
DKPNGANISSQIIGVDTAS

SEQ ID NO: 1576855 - protein, 25 aa, Staphylococcus aureus
DNVKKNLVGIAFIFSSVAVLIFELN

SEQ ID NO: 1576856 - protein, 23 aa, Staphylococcus aureus
DSESQSASAFLSESLSESTSEST

SEQ ID NO: 1576857 - protein, 23 aa, Staphylococcus aureus
DSNVFLLNWDIRGLTSYIFSFLI

SEQ ID NO: 1576858 - protein, 19 aa, Staphylococcus aureus
DSRHLSFIEAPIIVNVQAS

SEQ ID NO: 1576859 - protein, 25 aa, Staphylococcus aureus
DYKKFKVFSLISTLIIVILAIIRFV

SEQ ID NO: 1576860 - protein, 24 aa, Staphylococcus aureus
DYKKFKVFSLISTLVIVILAIIRF

SEQ ID NO: 1576861 - protein, 23 aa, Staphylococcus aureus
EDAKNAIKALANAKRDQINSNPD

SEQ ID NO: 1576862 - protein, 17 aa, Staphylococcus aureus
EEKRKLRRKRQKRIQYS

SEQ ID NO: 1576863 - protein, 31 aa, Staphylococcus aureus
EEKSEIGEIIFKFYRHCFRYNEINLKIQDIF

SEQ ID NO: 1576864 - protein, 18 aa, Staphylococcus aureus
EELLEEFEEGLIRRHQAN

SEQ ID NO: 1576865 - protein, 22 aa, Staphylococcus aureus
ESLIGLRFLKEYDVKRGKDKEN

SEQ ID NO: 1576866 - protein, 19 aa, Staphylococcus aureus
ESRKRYSPNSTYKIYLAMF

SEQ ID NO: 1576867 - protein, 24 aa, Staphylococcus aureus
ESVSRLYVFSIFIILLLTLVFANF

SEQ ID NO: 1576868 - protein, 18 aa, Staphylococcus aureus
FAGNPVLHHLGIAGGNME

SEQ ID NO: 1576869 - protein, 17 aa, Staphylococcus aureus
FGYSRYLTYILVLLATG

SEQ ID NO: 1576870 - protein, 26 aa, Staphylococcus aureus
FIGFLVTCLYFEFAGNPVLHHLGIAG

SEQ ID NO: 1576871 - protein, 19 aa, Staphylococcus aureus
FIINHIVKVLFLFHVPKYV

SEQ ID NO: 1576872 - protein, 17 aa, Staphylococcus aureus
FLLYANVLFLKRRSSEL

SEQ ID NO: 1576873 - protein, 23 aa, Staphylococcus aureus
FLTLPIMVIFAIAIVIDSPGNPI

SEQ ID NO: 1576874 - protein, 20 aa, Staphylococcus aureus
FLVYRIYILFIDYKSVNKKL

SEQ ID NO: 1576875 - protein, 19 aa, Staphylococcus aureus
GGLCAGLISAILSKKISTK

SEQ ID NO: 1576876 - protein, 20 aa, Staphylococcus aureus
GGLLSAIGIAGMDRVTQFNI

SEQ ID NO: 1576877 - protein, 26 aa, Staphylococcus aureus
GIAYIACVLIPFNFFFRFNDIKKDNN

SEQ ID NO: 1576878 - protein, 19 aa, Staphylococcus aureus
GLEGAAFAIVGWVGVKLVV

SEQ ID NO: 1576879 - protein, 20 aa, Staphylococcus aureus
GLTLFSIIAFMLLHSQSFVV

SEQ ID NO: 1576880 - protein, 18 aa, Staphylococcus aureus
GMPLSGFHRHFLIPSIIV

SEQ ID NO: 1576881 - protein, 18 aa, Staphylococcus aureus
GNFFKILVTYSISIFLSV

SEQ ID NO: 1576882 - protein, 17 aa, Staphylococcus aureus
GPLVVYWNWTWGITVAI

SEQ ID NO: 1576883 - protein, 41 aa, Staphylococcus aureus
GPVIELGLKTASTWKKFEVYEGDKKLPVELVSYDSDKDYAY

SEQ ID NO: 1576884 - protein, 29 aa, Staphylococcus aureus
GVVGISGLLASFWFFIAKRRRKEDEEEEL

SEQ ID NO: 1576885 - protein, 19 aa, Staphylococcus aureus
HKLPLGLDFEDVELVSLDL

SEQ ID NO: 1576886 - protein, 17 aa, Staphylococcus aureus
HNYQFGGAMIESERLSE

SEQ ID NO: 1576887 - protein, 26 aa, Staphylococcus aureus
IAKALTDWCDLAFVTKLVLGQSEQPR

SEQ ID NO: 1576888 - protein, 17 aa, Staphylococcus aureus
IALLIIYYMIRFKMRAV

SEQ ID NO: 1576889 - protein, 24 aa, Staphylococcus aureus
IDVKGSDVWTAFEHSLGAPTTQKD

SEQ ID NO: 1576890 - protein, 17 aa, Staphylococcus aureus
IEINEKVKAVAPTKKAQ

SEQ ID NO: 1576891 - protein, 18 aa, Staphylococcus aureus
IEYASLIGCIKRSQTLAG

SEQ ID NO: 1576892 - protein, 22 aa, Staphylococcus aureus
IFIDFLNFVALILVYLCTNPNN

SEQ ID NO: 1576893 - protein, 17 aa, Staphylococcus aureus
IFIVMGLYICMYAIFAM

SEQ ID NO: 1576894 - protein, 24 aa, Staphylococcus aureus
IGHICLSLPFALIGLFTSMFFIII

SEQ ID NO: 1576895 - protein, 18 aa, Staphylococcus aureus
IGISWLCWLILCRLILLC

SEQ ID NO: 1576896 - protein, 19 aa, Staphylococcus aureus
IHEEHKLPLGLDFEDVELV

SEQ ID NO: 1576897 - protein, 17 aa, Staphylococcus aureus
IIMWLFFSCSLLKERKP

SEQ ID NO: 1576898 - protein, 21 aa, Staphylococcus aureus
IKFEMIDCGKGIPEEERQLIF

SEQ ID NO: 1576899 - protein, 31 aa, Staphylococcus aureus
IKFFSSLFTGDWRGVWDAIVMILKGVVQLIW

SEQ ID NO: 1576900 - protein, 22 aa, Staphylococcus aureus
ILKQQLPTRIDIERTKINQWVD

SEQ ID NO: 1576901 - protein, 17 aa, Staphylococcus aureus
ILMKNMLVYGLGGMIVP

SEQ ID NO: 1576902 - protein, 19 aa, Staphylococcus aureus
IMFNFWLYVILYWFIPLLT

SEQ ID NO: 1576903 - protein, 24 aa, Staphylococcus aureus
IPFNLLHLLSLKVVSIMIVLVACL

SEQ ID NO: 1576904 - protein, 20 aa, Staphylococcus aureus
IPGSLVFLFGRMLKTKLQIH

SEQ ID NO: 1576905 - protein, 17 aa, Staphylococcus aureus
IPIYITNFFGGAIAGLI

SEQ ID NO: 1576906 - protein, 19 aa, Staphylococcus aureus
IRLTLQFKIILIVILSKIT

SEQ ID NO: 1576907 - protein, 18 aa, Staphylococcus aureus
ISFMPVIVVIVVYTLIYI

SEQ ID NO: 1576908 - protein, 21 aa, Staphylococcus aureus
ISPKFSILFLIIIYLTIGPLF

SEQ ID NO: 1576909 - protein, 17 aa, Staphylococcus aureus
ISSLSRFCLCVMNPIPI

SEQ ID NO: 1576910 - protein, 18 aa, Staphylococcus aureus
ISTLLLIVILVVFSVLLI

SEQ ID NO: 1576911 - protein, 25 aa, Staphylococcus aureus
ITVLLLKRRTPVIAVDAPAQHTQLH

SEQ ID NO: 1576912 - protein, 17 aa, Staphylococcus aureus
IVICILIKQKIYALIVL

SEQ ID NO: 1576913 - protein, 19 aa, Staphylococcus aureus
KARRIKQDGSYEMIDASDL

SEQ ID NO: 1576914 - protein, 22 aa, Staphylococcus aureus
KCADIIRLISYLSIPVLSFYNM

SEQ ID NO: 1576915 - protein, 27 aa, Staphylococcus aureus
KDFLAQWKLYIISAVVLIMVLIGFIFW

SEQ ID NO: 1576916 - protein, 25 aa, Staphylococcus aureus
KDIEEILSHGIDVWTTLNIQHIESL

SEQ ID NO: 1576917 - protein, 25 aa, Staphylococcus aureus
KDNLPRFYLYLTLFMFSMLGIVLAD

SEQ ID NO: 1576918 - protein, 20 aa, Staphylococcus aureus
KENLEAMGGGDLVGGILDPD

SEQ ID NO: 1576919 - protein, 41 aa, Staphylococcus aureus
KEQRRVIPKFKNRRKMIVICFYSLLAILLILLLASFIKATR

SEQ ID NO: 1576920 - protein, 19 aa, Staphylococcus aureus
KFIIIKVILALPMFILLTI

SEQ ID NO: 1576921 - protein, 24 aa, Staphylococcus aureus
KFILPIVVGLLIWALTPFKPDTVD

SEQ ID NO: 1576922 - protein, 17 aa, Staphylococcus aureus
KFLNFNLSIAMLIALAV

SEQ ID NO: 1576923 - protein, 17 aa, Staphylococcus aureus
KKMDIAYDEYFSVLNSK

SEQ ID NO: 1576924 - protein, 19 aa, Staphylococcus aureus
KLEIVPIHYIHSDKPTNTP

SEQ ID NO: 1576925 - protein, 23 aa, Staphylococcus aureus
KLLGGKYMGYLIFVFFIFVFGLL

SEQ ID NO: 1576926 - protein, 22 aa, Staphylococcus aureus
KLLRTTFILLTLVGIGLTVFSF

SEQ ID NO: 1576927 - protein, 30 aa, Staphylococcus aureus
KLYPVYMIKNPIMFVVEVGMLLALGLTIYP

SEQ ID NO: 1576928 - protein, 21 aa, Staphylococcus aureus
KNEPSSFVISPFSAVQKQVKR

SEQ ID NO: 1576929 - protein, 25 aa, Staphylococcus aureus
KSKDFKITLYISLFISLFILYNEFR

SEQ ID NO: 1576930 - protein, 19 aa, Staphylococcus aureus
KSSEKYRDADTNKQQEYDN

SEQ ID NO: 1576931 - protein, 18 aa, Staphylococcus aureus
KSSILCYIQSILTFVFVP

SEQ ID NO: 1576932 - protein, 23 aa, Staphylococcus aureus
KTTRHRIAIIGLLILVYMLTLSI

SEQ ID NO: 1576933 - protein, 18 aa, Staphylococcus aureus
KVLSTFLFILLLYIAYRK

SEQ ID NO: 1576934 - protein, 19 aa, Staphylococcus aureus
KYIKLSIVTINISFLFISI

SEQ ID NO: 1576935 - protein, 25 aa, Staphylococcus aureus
LAGAFEMIGSLLLFTSIFGKLGKKL

SEQ ID NO: 1576936 - protein, 19 aa, Staphylococcus aureus
LDGLSLMFSLIISLIGIAV

SEQ ID NO: 1576937 - protein, 19 aa, Staphylococcus aureus
LEKEIQAIEIIKDKNNENF

SEQ ID NO: 1576938 - protein, 19 aa, Staphylococcus aureus
LFVMYKKRAQIINFVSRGN

SEQ ID NO: 1576939 - protein, 17 aa, Staphylococcus aureus
LIMLFILDWKMTLLTFI

SEQ ID NO: 1576940 - protein, 19 aa, Staphylococcus aureus
LISIKAFPLAIGALYLPII

SEQ ID NO: 1576941 - protein, 22 aa, Staphylococcus aureus
LKKDIKGSYFVKDKNFDVTKFI

SEQ ID NO: 1576942 - protein, 19 aa, Staphylococcus aureus
LKKVKGFGSKTFDKLNSYF

SEQ ID NO: 1576943 - protein, 17 aa, Staphylococcus aureus
LLMTLGVIVMIIILAIA

SEQ ID NO: 1576944 - protein, 22 aa, Staphylococcus aureus
LNFNLSIAMLIALAVCLIPTTI

SEQ ID NO: 1576945 - protein, 38 aa, Staphylococcus aureus
LNKIINLFVCITLLVAIGMGFVSWIKRTKNTAVKVPHR

SEQ ID NO: 1576946 - protein, 25 aa, Staphylococcus aureus
LNLKGKNLYLIDGIKISELEDELVD

SEQ ID NO: 1576947 - protein, 26 aa, Staphylococcus aureus
LNVFVFNYFFTVPRFTLEMYRFEYPI

SEQ ID NO: 1576948 - protein, 21 aa, Staphylococcus aureus
LPLAGSIVGLFLFYLLLQFKI

SEQ ID NO: 1576949 - protein, 17 aa, Staphylococcus aureus
LSMMLIPGSLVFLFGRM

SEQ ID NO: 1576950 - protein, 25 aa, Staphylococcus aureus
LSRFCLCVMNPIPISMNIKIPPPTS

SEQ ID NO: 1576951 - protein, 24 aa, Staphylococcus aureus
LVLHDFKLLPAFIAAYCVAFLIKW

SEQ ID NO: 1576952 - protein, 19 aa, Staphylococcus aureus
LVVYWNWTWGITVAIILGI

SEQ ID NO: 1576953 - protein, 25 aa, Staphylococcus aureus
LYTAGQCTWYAYGMRQKMGKPVSTY

SEQ ID NO: 1576954 - protein, 25 aa, Staphylococcus aureus
MEGKETRFGIGLSALFTTITTAFTT

SEQ ID NO: 1576955 - protein, 24 aa, Staphylococcus aureus
MGLYICMYAIFAMTAYNHSKRTIR

SEQ ID NO: 1576956 - protein, 20 aa, Staphylococcus aureus
MIDASDLKKGHIVRVATGEQ

SEQ ID NO: 1576957 - protein, 20 aa, Staphylococcus aureus
MLFILDWKMTLLTFITIPIF

SEQ ID NO: 1576958 - protein, 18 aa, Staphylococcus aureus
MLFVSWFALFLFYKNEFD

SEQ ID NO: 1576959 - protein, 24 aa, Staphylococcus aureus
MNPVQRFVKMLSDIFVPIIPAIVA

SEQ ID NO: 1576960 - protein, 37 aa, Staphylococcus aureus
MSSILMKNKWPFLIALPFMNCYGIGVTFYYQQKVAYL

SEQ ID NO: 1576961 - protein, 21 aa, Staphylococcus aureus
NDIAKYFAILPAMFMAAMPAM

SEQ ID NO: 1576962 - protein, 17 aa, Staphylococcus aureus
NEFKLKKMDIAYDEYFS

SEQ ID NO: 1576963 - protein, 23 aa, Staphylococcus aureus
NFSEFPALGLVLAMMIGIGVAEK

SEQ ID NO: 1576964 - protein, 18 aa, Staphylococcus aureus
NGKLPHWSNDDPGKGNLY

SEQ ID NO: 1576965 - protein, 17 aa, Staphylococcus aureus
NHSHWITGMSIEGHKER

SEQ ID NO: 1576966 - protein, 31 aa, Staphylococcus aureus
NIASLNSFERQAVKLLGKVKNGVVVDQVDNN

SEQ ID NO: 1576967 - protein, 42 aa, Staphylococcus aureus
NIIKANITFAIGIKIIALLLVIPGWLTLWIAILSDMGATILV

SEQ ID NO: 1576968 - protein, 20 aa, Staphylococcus aureus
NIKTGVLSFIAFVGAIILIA

SEQ ID NO: 1576969 - protein, 18 aa, Staphylococcus aureus
NIKTRVALYLFENNELTN

SEQ ID NO: 1576970 - protein, 22 aa, Staphylococcus aureus
NILKMLALEQMIVFIITGVVGV

SEQ ID NO: 1576971 - protein, 17 aa, Staphylococcus aureus
NKISPKFSILFLIIIYL

SEQ ID NO: 1576972 - protein, 24 aa, Staphylococcus aureus
NKVKKGDTMTINYDKNVIPSDLTD

SEQ ID NO: 1576973 - protein, 25 aa, Staphylococcus aureus
NLKVREIKGLLTAKILRAQEMNIPI

SEQ ID NO: 1576974 - protein, 18 aa, Staphylococcus aureus
NLSSGRFSRKSMIYFNTG

SEQ ID NO: 1576975 - protein, 18 aa, Staphylococcus aureus
NSLIPIITFLGADIVSIL

SEQ ID NO: 1576976 - protein, 17 aa, Staphylococcus aureus
NYAEALSMMLIPGSLVF

SEQ ID NO: 1576977 - protein, 20 aa, Staphylococcus aureus
NYEFNEPRPTIGQSDEDEKS

SEQ ID NO: 1576978 - protein, 27 aa, Staphylococcus aureus
PDIKAQRSLNLWTYVMLIFMTLAAILT

SEQ ID NO: 1576979 - protein, 21 aa, Staphylococcus aureus
PEGRSIVKLAYKQHIDLPQEV

SEQ ID NO: 1576980 - protein, 18 aa, Staphylococcus aureus
PHHFKLEIVPIHYIHSDK

SEQ ID NO: 1576981 - protein, 30 aa, Staphylococcus aureus
PIFAISAWLYPNFILDFIFIIIMLFLVSLT

SEQ ID NO: 1576982 - protein, 18 aa, Staphylococcus aureus
PLFFIYKYHQPMFGRLSS

SEQ ID NO: 1576983 - protein, 17 aa, Staphylococcus aureus
PLNEVHVGDTLIVKPGE

SEQ ID NO: 1576984 - protein, 19 aa, Staphylococcus aureus
PNCQHIFSPSLWAVIKAKH

SEQ ID NO: 1576985 - protein, 17 aa, Staphylococcus aureus
PSGHAMGSTAYFGSSIY

SEQ ID NO: 1576986 - protein, 26 aa, Staphylococcus aureus
QDITRFIVRVLIPFALIISLFLISQG

SEQ ID NO: 1576987 - protein, 21 aa, Staphylococcus aureus
QKEAKFENGVITRKADEKTPN

SEQ ID NO: 1576988 - protein, 26 aa, Staphylococcus aureus
QKEALKAQVTSAGRVSAANGVEHTAT

SEQ ID NO: 1576989 - protein, 36 aa, Staphylococcus aureus
QLIILGFLLHYIFKINDKWLLVLCVFVIIVNASWNT

SEQ ID NO: 1576990 - protein, 26 aa, Staphylococcus aureus
QPAPSKVVLLPAHRGTVSSGREGSDR

SEQ ID NO: 1576991 - protein, 20 aa, Staphylococcus aureus
RASPVMHHVFWISFLAIFIG

SEQ ID NO: 1576992 - protein, 27 aa, Staphylococcus aureus
RFTLEMYRFEYPITFATSIFASIFTSA

SEQ ID NO: 1576993 - protein, 18 aa, Staphylococcus aureus
RHLKRYKDIEEILSHGID

SEQ ID NO: 1576994 - protein, 20 aa, Staphylococcus aureus
RKDMFFDYVSLKRMVIDEIQ

SEQ ID NO: 1576995 - protein, 22 aa, Staphylococcus aureus
RNFDMRPYFIIFDEVTAFTSTL

SEQ ID NO: 1576996 - protein, 20 aa, Staphylococcus aureus
RVFPNSKLDIITPVDMSSNA

SEQ ID NO: 1576997 - protein, 19 aa, Staphylococcus aureus
RVGEKLLQTFGCKKPMLIG

SEQ ID NO: 1576998 - protein, 19 aa, Staphylococcus aureus
RWLNRLIVVVLMFLNGFGI

SEQ ID NO: 1576999 - protein, 21 aa, Staphylococcus aureus
SDSIKTNVAMNWYFIAVSVVV

SEQ ID NO: 1577000 - protein, 20 aa, Staphylococcus aureus
SESSAIILLMFFIGIIVLSI

SEQ ID NO: 1577001 - protein, 18 aa, Staphylococcus aureus
SFDARDSRHLSFIEAPII

SEQ ID NO: 1577002 - protein, 19 aa, Staphylococcus aureus
SIGVAIFIISFSFYLLNQP

SEQ ID NO: 1577003 - protein, 26 aa, Staphylococcus aureus
SKALHWQKWHAMIGIIIAIPVFVLVL

SEQ ID NO: 1577004 - protein, 17 aa, Staphylococcus aureus
SKLILQVLFNLIDNALK

SEQ ID NO: 1577005 - protein, 25 aa, Staphylococcus aureus
SLMPYSIALSIAWTVFVIIWFLLGI

SEQ ID NO: 1577006 - protein, 21 aa, Staphylococcus aureus
SLNLWTYVMLIFMTLAAILMG

SEQ ID NO: 1577007 - protein, 18 aa, Staphylococcus aureus
SNNKLEVGLGRDISGDPI

SEQ ID NO: 1577008 - protein, 35 aa, Staphylococcus aureus
SRLTVEIMKMLVIQTICVLLGIWVYNLDKSESSAI

SEQ ID NO: 1577009 - protein, 26 aa, Staphylococcus aureus
SSMKWDEILTILPWLIGALIATVFIG

SEQ ID NO: 1577010 - protein, 19 aa, Staphylococcus aureus
SSPVMHHVFLISFVAIFVG

SEQ ID NO: 1577011 - protein, 19 aa, Staphylococcus aureus
SVGAFFIKLMQGYIPVESA

SEQ ID NO: 1577012 - protein, 27 aa, Staphylococcus aureus
SYSPVPEDHAYIRFPVSDGTQELKIVS

SEQ ID NO: 1577013 - protein, 26 aa, Staphylococcus aureus
TDLSYLTQMCVITFLMFTSAASGYAV

SEQ ID NO: 1577014 - protein, 26 aa, Staphylococcus aureus
TERLKQSWKSFLIVLAACLILIIASE

SEQ ID NO: 1577015 - protein, 24 aa, Staphylococcus aureus
TLNAICGIFAFLIWIHLLCTMLKY

SEQ ID NO: 1577016 - protein, 22 aa, Staphylococcus aureus
TLNQAMHGLRQSIQDNAATKAN

SEQ ID NO: 1577017 - protein, 18 aa, Staphylococcus aureus
TLTVLKLIIKPLWQYHCR

SEQ ID NO: 1577018 - protein, 27 aa, Staphylococcus aureus
TNLFILTMIICFTITYLVHNDYFVAMT

SEQ ID NO: 1577019 - protein, 18 aa, Staphylococcus aureus
TPAYIYAIPVASLALLIA

SEQ ID NO: 1577020 - protein, 18 aa, Staphylococcus aureus
TTIGGLLSAIGIAGMDRV

SEQ ID NO: 1577021 - protein, 19 aa, Staphylococcus aureus
VASLALLIAITLFVRKKSK

SEQ ID NO: 1577022 - protein, 24 aa, Staphylococcus aureus
VCFLFICVYLNMAIGSSKINFSDI

SEQ ID NO: 1577023 - protein, 19 aa, Staphylococcus aureus
VDISPNMLIQRLKAGKVYK

SEQ ID NO: 1577024 - protein, 17 aa, Staphylococcus aureus
VDPSLGFALGWNYWFNW

SEQ ID NO: 1577025 - protein, 19 aa, Staphylococcus aureus
VEEFFIWTVPCYLCAIIAI

SEQ ID NO: 1577026 - protein, 25 aa, Staphylococcus aureus
VELGSWKAPYSIVFVLDIFSALLII

SEQ ID NO: 1577027 - protein, 24 aa, Staphylococcus aureus
VGTASILVGTTLIFGLGNQEAKAA

SEQ ID NO: 1577028 - protein, 21 aa, Staphylococcus aureus
VKRVKEAGGHIPVDLDALVKG

SEQ ID NO: 1577029 - protein, 23 aa, Staphylococcus aureus
VLQYQIYLGLKFDFYNRQVYLIK

SEQ ID NO: 1577030 - protein, 19 aa, Staphylococcus aureus
VTLAALVPIYGAVRELIPW

SEQ ID NO: 1577031 - protein, 30 aa, Staphylococcus aureus
VTNQVRISFPNANQYKVEFPTDDDQITTPY

SEQ ID NO: 1577032 - protein, 17 aa, Staphylococcus aureus
VTSRFYGHLGLLLLVII

SEQ ID NO: 1577033 - protein, 19 aa, Staphylococcus aureus
VYGPTWLYIISVIVFSLSY

SEQ ID NO: 1577034 - protein, 26 aa, Staphylococcus aureus
WFVNIFDWRYLFLVVLLIGMIDFVFG

SEQ ID NO: 1577035 - protein, 24 aa, Staphylococcus aureus
YEDYRESLSLPDIVANGALPIGLD

SEQ ID NO: 1577036 - protein, 31 aa, Staphylococcus aureus
YFDIGFIEYFSRMIIPNIFSLIASILVLWLY

SEQ ID NO: 1577037 - protein, 17 aa, Staphylococcus aureus
YHNIFALIFDWLVILGS

SEQ ID NO: 1577038 - protein, 21 aa, Staphylococcus aureus
YKKERLETAFSNFFTYENLTE

SEQ ID NO: 1577039 - protein, 26 aa, Staphylococcus aureus
YLLGWKFLKDNMMIFIFGVISIIPMV

SEQ ID NO: 1577040 - protein, 17 aa, Staphylococcus aureus
YMGYLIFVFFIFVFGLL

SEQ ID NO: 1577041 - protein, 29 aa, Staphylococcus aureus
YQNEPLPNRKDFVVSFITGALVGSALGLY

SEQ ID NO: 1577042 - protein, 17 aa, Staphylococcus aureus
YYFCVAMVIVVLLMFFG

SEQ ID NO: 1577043 - protein, 17 aa, Staphylococcus aureus
YYSLYLGVIGAFIGGLT

SEQ ID NO: 1577044 - protein, 18 aa, Staphylococcus aureus
AAAMPFAGSAYSWVNVLF

SEQ ID NO: 1577045 - protein, 20 aa, Staphylococcus aureus
ADIKYALKEAFNESIPHTLE

SEQ ID NO: 1577046 - protein, 22 aa, Staphylococcus aureus
ANEIPKAKIDANKDVDKQVQAL

SEQ ID NO: 1577047 - protein, 24 aa, Staphylococcus aureus
ANEKGIKGVYVILKDSNGKELDRT

SEQ ID NO: 1577048 - protein, 19 aa, Staphylococcus aureus
ASALLPYVMAEVVRKEATL

SEQ ID NO: 1577049 - protein, 22 aa, Staphylococcus aureus
ATPIAGFLVMFGFNHPTTIVIY

SEQ ID NO: 1577050 - protein, 21 aa, Staphylococcus aureus
DADAALTHFIEIWPYVEGQIQ

SEQ ID NO: 1577051 - protein, 18 aa, Staphylococcus aureus
DDAKRLANTLLNSDNTNV

SEQ ID NO: 1577052 - protein, 23 aa, Staphylococcus aureus
DDAKRTAYSQAVNAAATILNKTA

SEQ ID NO: 1577053 - protein, 29 aa, Staphylococcus aureus
DEKVLKDNEHSPLLFAKRRKDKEEDVETT

SEQ ID NO: 1577054 - protein, 17 aa, Staphylococcus aureus
DIDLKKGDIITEIDGKK

SEQ ID NO: 1577055 - protein, 29 aa, Staphylococcus aureus
DNAPALYPNYWGGNKYKVIEELRKQGYNV

SEQ ID NO: 1577056 - protein, 23 aa, Staphylococcus aureus
EAVRKIMFALNRFMGNKYSNIDL

SEQ ID NO: 1577057 - protein, 20 aa, Staphylococcus aureus
EFTDKFRINKGFRLDFWATF

SEQ ID NO: 1577058 - protein, 25 aa, Staphylococcus aureus
EKVLGWLCWVMLLVLTVITMFIALV

SEQ ID NO: 1577059 - protein, 25 aa, Staphylococcus aureus
EVIQWFYKEVDWFEAKLKDDKSNTG

SEQ ID NO: 1577060 - protein, 25 aa, Staphylococcus aureus
FAAYNFLYTFSFSMILGELIRATKG

SEQ ID NO: 1577061 - protein, 18 aa, Staphylococcus aureus
FAILGFVGLILGVMVWLG

SEQ ID NO: 1577062 - protein, 19 aa, Staphylococcus aureus
FAILGFVGLILGVMVWLGM

SEQ ID NO: 1577063 - protein, 17 aa, Staphylococcus aureus
FLISMLYLFVGIDFDIF

SEQ ID NO: 1577064 - protein, 17 aa, Staphylococcus aureus
FNPKLQPGEERVKQEGQ

SEQ ID NO: 1577065 - protein, 25 aa, Staphylococcus aureus
GAGQEVYKIGNYVWEDTNKNGVQEL

SEQ ID NO: 1577066 - protein, 17 aa, Staphylococcus aureus
GHIPGASILIVKNGKVF

SEQ ID NO: 1577067 - protein, 18 aa, Staphylococcus aureus
GIIAFIFVILARKSKAVH

SEQ ID NO: 1577068 - protein, 25 aa, Staphylococcus aureus
GTTWSHLKWAIPLISIALIIILTIS

SEQ ID NO: 1577069 - protein, 19 aa, Staphylococcus aureus
HEVNFARFIIIIAGIFGFG

SEQ ID NO: 1577070 - protein, 19 aa, Staphylococcus aureus
HGISTLRKVPEIKSSTEDK

SEQ ID NO: 1577071 - protein, 17 aa, Staphylococcus aureus
ICTVIWIVLVIILSFKF

SEQ ID NO: 1577072 - protein, 22 aa, Staphylococcus aureus
IDLVSTWLVYFFPFINWFIPKR

SEQ ID NO: 1577073 - protein, 23 aa, Staphylococcus aureus
IDNHQIIWVMLNYEFNEPRPTIG

SEQ ID NO: 1577074 - protein, 35 aa, Staphylococcus aureus
IEDGITLLIVMAVVLVLLVIFGFISADNMAKRQTK

SEQ ID NO: 1577075 - protein, 18 aa, Staphylococcus aureus
IGGIRLSSVYVISWATLA

SEQ ID NO: 1577076 - protein, 22 aa, Staphylococcus aureus
IIFVALEFFYIMYLETIATTSK

SEQ ID NO: 1577077 - protein, 27 aa, Staphylococcus aureus
IILFLMEFARGMYILSYINFLPTVTSI

SEQ ID NO: 1577078 - protein, 18 aa, Staphylococcus aureus
ILFTYKWALGVTAVVDQN

SEQ ID NO: 1577079 - protein, 22 aa, Staphylococcus aureus
IMFAIWQVMQFIWPAVKALIVS

SEQ ID NO: 1577080 - protein, 18 aa, Staphylococcus aureus
IMIFPSFKNLCFVLFSYF

SEQ ID NO: 1577081 - protein, 26 aa, Staphylococcus aureus
INKGFRLDFWATFLIVWFILFLLFWY

SEQ ID NO: 1577082 - protein, 19 aa, Staphylococcus aureus
IQQELIRLTSHPKARAIVT

SEQ ID NO: 1577083 - protein, 17 aa, Staphylococcus aureus
IRLSSVYVISWATLASY

SEQ ID NO: 1577084 - protein, 18 aa, Staphylococcus aureus
ISKYGSFFLKGIKITILI

SEQ ID NO: 1577085 - protein, 30 aa, Staphylococcus aureus
ISTGNMWRYLVAIIACMIWYFNKSHVSIIG

SEQ ID NO: 1577086 - protein, 25 aa, Staphylococcus aureus
ITRMGRLESYFAISTAMFGQPEVYL

SEQ ID NO: 1577087 - protein, 30 aa, Staphylococcus aureus
IVISAILIAIGWRLIWKREIDKHKNVMLAA

SEQ ID NO: 1577088 - protein, 23 aa, Staphylococcus aureus
IVKVVVANIGYEGQYHVRIINQD

SEQ ID NO: 1577089 - protein, 20 aa, Staphylococcus aureus
IWTAIWTFLSTIWNTIITIA

SEQ ID NO: 1577090 - protein, 25 aa, Staphylococcus aureus
KEKQALKDRINQILQQGHNDINNAL

SEQ ID NO: 1577091 - protein, 29 aa, Staphylococcus aureus
KGPSRSKLRTVIICNLAFAICMILGTLTA

SEQ ID NO: 1577092 - protein, 19 aa, Staphylococcus aureus
KMVKKFRKGVISVNDVMFS

SEQ ID NO: 1577093 - protein, 17 aa, Staphylococcus aureus
KNFISYVVIINTKVIHL

SEQ ID NO: 1577094 - protein, 21 aa, Staphylococcus aureus
KRKLRRKRQKRIQYSVITILV

SEQ ID NO: 1577095 - protein, 20 aa, Staphylococcus aureus
KRVGIIAALGATVMLGLSTI

SEQ ID NO: 1577096 - protein, 18 aa, Staphylococcus aureus
KTAAIAIILAPEFYNAIK

SEQ ID NO: 1577097 - protein, 18 aa, Staphylococcus aureus
KVLFLFHVPKYVLGTVSA

SEQ ID NO: 1577098 - protein, 23 aa, Staphylococcus aureus
LAIHLSYYVTFLILWLLIIELLT

SEQ ID NO: 1577099 - protein, 29 aa, Staphylococcus aureus
LDIAQGTSMRTTDKYGYYNYAGYSNFIVT

SEQ ID NO: 1577100 - protein, 18 aa, Staphylococcus aureus
LDSIVFRNTLRYAAIMMI

SEQ ID NO: 1577101 - protein, 17 aa, Staphylococcus aureus
LFIGSFILGYSISSIRI

SEQ ID NO: 1577102 - protein, 17 aa, Staphylococcus aureus
LGDHSWFYLPITYATCY

SEQ ID NO: 1577103 - protein, 18 aa, Staphylococcus aureus
LGLIPIYLGIKVAIYDDC

SEQ ID NO: 1577104 - protein, 18 aa, Staphylococcus aureus
LIIRGIAYLTTRRNLEEL

SEQ ID NO: 1577105 - protein, 18 aa, Staphylococcus aureus
LIYIFFKVIFDKRIKDEE

SEQ ID NO: 1577106 - protein, 17 aa, Staphylococcus aureus
LKLFRITNPIARGLALG

SEQ ID NO: 1577107 - protein, 21 aa, Staphylococcus aureus
LKMDISLGKVLRVSYIINALN

SEQ ID NO: 1577108 - protein, 17 aa, Staphylococcus aureus
LKPDADWIRIASKSLPW

SEQ ID NO: 1577109 - protein, 24 aa, Staphylococcus aureus
LLLAPKWYIAFVMVALPVLIEFLV

SEQ ID NO: 1577110 - protein, 18 aa, Staphylococcus aureus
LLLHLRPLGLKDKSLGEG

SEQ ID NO: 1577111 - protein, 27 aa, Staphylococcus aureus
LNKIINLFVCIALLVAIGMGFVSWIKR

SEQ ID NO: 1577112 - protein, 17 aa, Staphylococcus aureus
LQGYFVFDKGMTKAFYK

SEQ ID NO: 1577113 - protein, 18 aa, Staphylococcus aureus
LSAVFLMSAILCFEYDFI

SEQ ID NO: 1577114 - protein, 18 aa, Staphylococcus aureus
LSIPSFWQGLLFILAFSL

SEQ ID NO: 1577115 - protein, 19 aa, Staphylococcus aureus
LVVLIAWILYYFVDVKLTN

SEQ ID NO: 1577116 - protein, 19 aa, Staphylococcus aureus
LYWMELGQGHLDEAINIAT

SEQ ID NO: 1577117 - protein, 26 aa, Staphylococcus aureus
LYYIVSEFLFLLVIFTFGIAGIIFLM

SEQ ID NO: 1577118 - protein, 18 aa, Staphylococcus aureus
MATVPAMLISSFSAIIVG

SEQ ID NO: 1577119 - protein, 23 aa, Staphylococcus aureus
MFLISIFMLFRLHVDKPTHSEEE

SEQ ID NO: 1577120 - protein, 22 aa, Staphylococcus aureus
MGNISFMPVIIVIIVYTLIYIV

SEQ ID NO: 1577121 - protein, 19 aa, Staphylococcus aureus
MKQAGGYAYLALAVLSTLL

SEQ ID NO: 1577122 - protein, 17 aa, Staphylococcus aureus
MLLIAVTFLISMLYLFV

SEQ ID NO: 1577123 - protein, 19 aa, Staphylococcus aureus
MLLSTSMLILSSSSSLGLA

SEQ ID NO: 1577124 - protein, 21 aa, Staphylococcus aureus
MPMLWANFFWVWGHPEVYIVI

SEQ ID NO: 1577125 - protein, 20 aa, Staphylococcus aureus
NEIRIPRNIAAVIVGIALAV

SEQ ID NO: 1577126 - protein, 18 aa, Staphylococcus aureus
NFDLKKIESRNCIVKGQF

SEQ ID NO: 1577127 - protein, 18 aa, Staphylococcus aureus
NINEIKDKVLSEHNSTVQ

SEQ ID NO: 1577128 - protein, 17 aa, Staphylococcus aureus
NLGDYVWEDTNKDGKQD

SEQ ID NO: 1577129 - protein, 17 aa, Staphylococcus aureus
NRNALFVSGDWKLSQTQ

SEQ ID NO: 1577130 - protein, 23 aa, Staphylococcus aureus
PEHHYQFGGSLIKSKNLSTLLKP

SEQ ID NO: 1577131 - protein, 17 aa, Staphylococcus aureus
PKFGIGKGLFLSLFTSV

SEQ ID NO: 1577132 - protein, 18 aa, Staphylococcus aureus
PKVLKYIGMVNMYYLSSL

SEQ ID NO: 1577133 - protein, 29 aa, Staphylococcus aureus
PLVKAIMWGRMPWDIIFTVGVIILVVIFI

SEQ ID NO: 1577134 - protein, 22 aa, Staphylococcus aureus
QEVLIKDVVMLAARILLESGAE

SEQ ID NO: 1577135 - protein, 20 aa, Staphylococcus aureus
QPTVKVYEYLGKKDELPQSV

SEQ ID NO: 1577136 - protein, 19 aa, Staphylococcus aureus
RDFQSVIGVKHFIFEVTDL

SEQ ID NO: 1577137 - protein, 22 aa, Staphylococcus aureus
RIPLYIGVLLLYYSRFIIMYDN

SEQ ID NO: 1577138 - protein, 18 aa, Staphylococcus aureus
RLIGLIIGFGLCFPYVLL

SEQ ID NO: 1577139 - protein, 17 aa, Staphylococcus aureus
SAVGLHGIWDTSLTVLG

SEQ ID NO: 1577140 - protein, 28 aa, Staphylococcus aureus
SLAVKEFVKPAGLKRVGIIAALGATVML

SEQ ID NO: 1577141 - protein, 23 aa, Staphylococcus aureus
SNTGNRMFKRYAVITTSAKILGR

SEQ ID NO: 1577142 - protein, 23 aa, Staphylococcus aureus
SSFRKISKVIIYFLVFFYILSHH

SEQ ID NO: 1577143 - protein, 18 aa, Staphylococcus aureus
SSHNINAYYALSRSLPLF

SEQ ID NO: 1577144 - protein, 29 aa, Staphylococcus aureus
STNKGMLFGGLFSILGLVLLRRNKKNNKA

SEQ ID NO: 1577145 - protein, 25 aa, Staphylococcus aureus
SVLLFCAGVAFAFYVGFPIIIQFAL

SEQ ID NO: 1577146 - protein, 23 aa, Staphylococcus aureus
SYLHLILPIAMLIALTVCLIPTT

SEQ ID NO: 1577147 - protein, 18 aa, Staphylococcus aureus
TDYIKGIGLAVGTAGSAV

SEQ ID NO: 1577148 - protein, 20 aa, Staphylococcus aureus
TKMNTFFASIVVGLMYSVFS

SEQ ID NO: 1577149 - protein, 20 aa, Staphylococcus aureus
VASLALLIAITLFVRKKSKG

SEQ ID NO: 1577150 - protein, 20 aa, Staphylococcus aureus
VFRNTLRYAAIMMIAIFIAL

SEQ ID NO: 1577151 - protein, 45 aa, Staphylococcus aureus
VKNSERRGMLKGCGGCLISFILLIILLSACSMMFSNNDNSTSNQS

SEQ ID NO: 1577152 - protein, 18 aa, Staphylococcus aureus
VLLPTHRGTVSSGTEGSG

SEQ ID NO: 1577153 - protein, 22 aa, Staphylococcus aureus
VPAEPGKPVPPAKEEPKKPSKP

SEQ ID NO: 1577154 - protein, 21 aa, Staphylococcus aureus
VPPLFFGGSWDTWVYQGLAVL

SEQ ID NO: 1577155 - protein, 21 aa, Staphylococcus aureus
VSKEFDIKYLDGVKDRMGVTV

SEQ ID NO: 1577156 - protein, 19 aa, Staphylococcus aureus
WINEINDKFGFYIILILSL

SEQ ID NO: 1577157 - protein, 17 aa, Staphylococcus aureus
WQMRHGQILLRRSKRIA

SEQ ID NO: 1577158 - protein, 23 aa, Staphylococcus aureus
WQTNFIISIGIAFIAILLLKGTP

SEQ ID NO: 1577159 - protein, 17 aa, Staphylococcus aureus
YCNSSLKWYELMPIISF

SEQ ID NO: 1577160 - protein, 25 aa, Staphylococcus aureus
YDSDKDYAYIRFPVSNGTRDVKIVS

SEQ ID NO: 1577161 - protein, 28 aa, Staphylococcus aureus
YEHGGNIIDIDFDSVPQIHGFNKHNEII

SEQ ID NO: 1577162 - protein, 19 aa, Staphylococcus aureus
YKQAVAKAEALLNKQSGTN

SEQ ID NO: 1577163 - protein, 23 aa, Staphylococcus aureus
YQFSSRLRKFILIILVGAAIATS

SEQ ID NO: 1577164 - protein, 20 aa, Staphylococcus aureus
YRLIQMIVVLFVISTLAFIL

SEQ ID NO: 1577165 - protein, 19 aa, Staphylococcus aureus
YSLNFDKLDKTYVIHYTGD

SEQ ID NO: 1577166 - protein, 25 aa, Staphylococcus aureus
YTFTELMIIISIIYFKNLYIGRLDK

SEQ ID NO: 1577167 - protein, 32 aa, Staphylococcus aureus
AENIIMAFILTRWAWFCRVIRTSVMQYTASDH

SEQ ID NO: 1577168 - protein, 18 aa, Staphylococcus aureus
AKALDQAMQALRNSIQDQ

SEQ ID NO: 1577169 - protein, 26 aa, Staphylococcus aureus
AKELAKRKQEAISRIKDFSNEKINSI

SEQ ID NO: 1577170 - protein, 23 aa, Staphylococcus aureus
ALEGLKPTLIYPLLTVTATGLLM

SEQ ID NO: 1577171 - protein, 20 aa, Staphylococcus aureus
ANEAHKLLALAANDIDNRSK

SEQ ID NO: 1577172 - protein, 19 aa, Staphylococcus aureus
ASPVMHHVFWISFLAIFIG

SEQ ID NO: 1577173 - protein, 17 aa, Staphylococcus aureus
ATIIATIALVFVALALY

SEQ ID NO: 1577174 - protein, 19 aa, Staphylococcus aureus
AVLVGAGFVSSLLMINKNK

SEQ ID NO: 1577175 - protein, 17 aa, Staphylococcus aureus
CILVFKYKKIQLAGLKF

SEQ ID NO: 1577176 - protein, 17 aa, Staphylococcus aureus
DATKATVNFTDADQAKQ

SEQ ID NO: 1577177 - protein, 23 aa, Staphylococcus aureus
DESKRNAYTQAVTAAEGILNKQT

SEQ ID NO: 1577178 - protein, 20 aa, Staphylococcus aureus
DFDGPVGIGHTRWATHGVPN

SEQ ID NO: 1577179 - protein, 18 aa, Staphylococcus aureus
DGELDIAQGTSMRTTDKY

SEQ ID NO: 1577180 - protein, 22 aa, Staphylococcus aureus
DGKKLFFFLWDFVIFVFNVQLR

SEQ ID NO: 1577181 - protein, 17 aa, Staphylococcus aureus
DKDATKATVNFTDADQA

SEQ ID NO: 1577182 - protein, 19 aa, Staphylococcus aureus
DLTAELNLNLFIDPTTVTK

SEQ ID NO: 1577183 - protein, 22 aa, Staphylococcus aureus
DQNTIKQGVNFTDADEAKRNAY

SEQ ID NO: 1577184 - protein, 19 aa, Staphylococcus aureus
EPLFGVAFIIMIFAIGGVP

SEQ ID NO: 1577185 - protein, 22 aa, Staphylococcus aureus
FDGKHYGIDFALPKGTPIKAPT

SEQ ID NO: 1577186 - protein, 24 aa, Staphylococcus aureus
FDKMFPILMGFFVFLFVFLISGIA

SEQ ID NO: 1577187 - protein, 17 aa, Staphylococcus aureus
FETPAGYTPTVKNTTAE

SEQ ID NO: 1577188 - protein, 17 aa, Staphylococcus aureus
FFICYAIASLITRPIAG

SEQ ID NO: 1577189 - protein, 20 aa, Staphylococcus aureus
FFLGDFIFKYTDWGITKATI

SEQ ID NO: 1577190 - protein, 18 aa, Staphylococcus aureus
FGFDEILFFTLYLLLILI

SEQ ID NO: 1577191 - protein, 18 aa, Staphylococcus aureus
FKNAKPQLLITLIYALIA

SEQ ID NO: 1577192 - protein, 18 aa, Staphylococcus aureus
FKNSTYMLKIYMANTPRL

SEQ ID NO: 1577193 - protein, 19 aa, Staphylococcus aureus
FNKEGANQIQVTWGEKGVF

SEQ ID NO: 1577194 - protein, 17 aa, Staphylococcus aureus
FRRARRLKRPIRMRNLV

SEQ ID NO: 1577195 - protein, 18 aa, Staphylococcus aureus
FTVAFVFAYILSFIVPSK

SEQ ID NO: 1577196 - protein, 31 aa, Staphylococcus aureus
FVNPKQRVLGNTWVYIKGYQDKIEESSGKVS

SEQ ID NO: 1577197 - protein, 19 aa, Staphylococcus aureus
GFLLLYPVVAFMIGAIRDR

SEQ ID NO: 1577198 - protein, 18 aa, Staphylococcus aureus
GGELKHGTIALIEEGTPV

SEQ ID NO: 1577199 - protein, 24 aa, Staphylococcus aureus
GINIKWPIIMTGIFSILTIIIIRC

SEQ ID NO: 1577200 - protein, 18 aa, Staphylococcus aureus
GKFSHFAYVKPNNQSLTS

SEQ ID NO: 1577201 - protein, 25 aa, Staphylococcus aureus
GKTYIKHFLLFNGLMGGLSFVLLLI

SEQ ID NO: 1577202 - protein, 19 aa, Staphylococcus aureus
GKYMGYLIFVFFIFVFGLL

SEQ ID NO: 1577203 - protein, 19 aa, Staphylococcus aureus
GNQLVRMSVPKGSAHEKQL

SEQ ID NO: 1577204 - protein, 23 aa, Staphylococcus aureus
GTREVKIVSSIEYGENIHEDYDY

SEQ ID NO: 1577205 - protein, 21 aa, Staphylococcus aureus
GVKDRMGVTVNGRIDTLNKEE

SEQ ID NO: 1577206 - protein, 25 aa, Staphylococcus aureus
GVSTARKVPEIKNGSVVMATGEILG

SEQ ID NO: 1577207 - protein, 24 aa, Staphylococcus aureus
HDRNELQAFFDANYHDYRFIDREN

SEQ ID NO: 1577208 - protein, 31 aa, Staphylococcus aureus
HFIFEVTDLAPLIAAIICILVFKYKKIQLAG

SEQ ID NO: 1577209 - protein, 18 aa, Staphylococcus aureus
HMIPEVIGNLLLSAAIFL

SEQ ID NO: 1577210 - protein, 20 aa, Staphylococcus aureus
IAALLLVSGLFLAFRRRSTN

SEQ ID NO: 1577211 - protein, 21 aa, Staphylococcus aureus
IESICKRDPLAGKTVTGGIIT

SEQ ID NO: 1577212 - protein, 18 aa, Staphylococcus aureus
IFFAGSFALMYAPLLNEA

SEQ ID NO: 1577213 - protein, 21 aa, Staphylococcus aureus
IFLYFKIRLYSVFLVMVTQII

SEQ ID NO: 1577214 - protein, 24 aa, Staphylococcus aureus
IKLVKRKKYLSIIMYLLVLILSLI

SEQ ID NO: 1577215 - protein, 38 aa, Staphylococcus aureus
IKNAIGVVGISGLLASFWFFIAKRRRKEDEEEELEIRD

SEQ ID NO: 1577216 - protein, 18 aa, Staphylococcus aureus
ILMFIVGVWMHKRSNAKR

SEQ ID NO: 1577217 - protein, 18 aa, Staphylococcus aureus
IMFVVEVGMILTLILICF

SEQ ID NO: 1577218 - protein, 18 aa, Staphylococcus aureus
IMFVVEVGMVLTLILICF

SEQ ID NO: 1577219 - protein, 31 aa, Staphylococcus aureus
IQLAGLKFSISLKVIERLLLALILPLIILII

SEQ ID NO: 1577220 - protein, 23 aa, Staphylococcus aureus
ISDMTGKIYLQVKLKGQIDKEQL

SEQ ID NO: 1577221 - protein, 17 aa, Staphylococcus aureus
IVDIDFDSVPQIHGQNN

SEQ ID NO: 1577222 - protein, 26 aa, Staphylococcus aureus
KAGNVFPVLSPILGWIGVFMTGSVVN

SEQ ID NO: 1577223 - protein, 21 aa, Staphylococcus aureus
KAQQLDGAMGQLETSIRDKDT

SEQ ID NO: 1577224 - protein, 23 aa, Staphylococcus aureus
KEKPMANVLVTLTYPDGTTKSVR

SEQ ID NO: 1577225 - protein, 25 aa, Staphylococcus aureus
KEKQALKDRINQILQQGHNDINNAM

SEQ ID NO: 1577226 - protein, 27 aa, Staphylococcus aureus
KIANRPTDGGLSWSDDHKSLIYRYDAT

SEQ ID NO: 1577227 - protein, 19 aa, Staphylococcus aureus
KLLGGKYMGYLIFVFFIFV

SEQ ID NO: 1577228 - protein, 18 aa, Staphylococcus aureus
KNIGKLIVMYTIAYILNI

SEQ ID NO: 1577229 - protein, 22 aa, Staphylococcus aureus
LAFTSLFLVIWFPASPFVIIFS

SEQ ID NO: 1577230 - protein, 20 aa, Staphylococcus aureus
LAIGALYLPIIFKVIKLQLN

SEQ ID NO: 1577231 - protein, 25 aa, Staphylococcus aureus
LANGAYKYNPYILNQINKLGKDYGE

SEQ ID NO: 1577232 - protein, 29 aa, Staphylococcus aureus
LGIHFSETLARLGIVLGAFLTTLQMGLYM

SEQ ID NO: 1577233 - protein, 17 aa, Staphylococcus aureus
LIVSRYLYSVALNVPSK

SEQ ID NO: 1577234 - protein, 24 aa, Staphylococcus aureus
LKIANEYKIPTYVLGVGLGGLILL

SEQ ID NO: 1577235 - protein, 19 aa, Staphylococcus aureus
LKKVKGFGSKTFDKLKSYF

SEQ ID NO: 1577236 - protein, 22 aa, Staphylococcus aureus
LLTVMVIGLIWLIKDKRQSQHS

SEQ ID NO: 1577237 - protein, 17 aa, Staphylococcus aureus
LNQPQRDALRNQINQAQ

SEQ ID NO: 1577238 - protein, 24 aa, Staphylococcus aureus
LNTAMGNLKHALAEKDNTKRSVNY

SEQ ID NO: 1577239 - protein, 20 aa, Staphylococcus aureus
LRYIHDIWGYIAPNTKKEKQ

SEQ ID NO: 1577240 - protein, 21 aa, Staphylococcus aureus
LSHTPWQFKIFVPDSPTAILF

SEQ ID NO: 1577241 - protein, 24 aa, Staphylococcus aureus
LSQQLSALSRFDAHYKMYTDTKGR

SEQ ID NO: 1577242 - protein, 17 aa, Staphylococcus aureus
LVLGLLISSAMVYINPA

SEQ ID NO: 1577243 - protein, 23 aa, Staphylococcus aureus
LVQNVVKYIVWFIVVTTILSKFG

SEQ ID NO: 1577244 - protein, 19 aa, Staphylococcus aureus
LYLPIIFKVIKLQLNLSKG

SEQ ID NO: 1577245 - protein, 21 aa, Staphylococcus aureus
MDDRIPINVWTGDSIARTGKG

SEQ ID NO: 1577246 - protein, 17 aa, Staphylococcus aureus
MKFAHVMTPEMTQALTA

SEQ ID NO: 1577247 - protein, 18 aa, Staphylococcus aureus
MKFAHVMTPEMTQALTAL

SEQ ID NO: 1577248 - protein, 18 aa, Staphylococcus aureus
MTQLKQGIANKAQIKGSE

SEQ ID NO: 1577249 - protein, 20 aa, Staphylococcus aureus
MYRFFGKQGLIAWVAIGTII

SEQ ID NO: 1577250 - protein, 33 aa, Staphylococcus aureus
NAKDLNFRTHLSGYHKYYPYYPYYPYYPVQLTW

SEQ ID NO: 1577251 - protein, 24 aa, Staphylococcus aureus
NDGSGYPVGTYINASSKGAPYNLP

SEQ ID NO: 1577252 - protein, 20 aa, Staphylococcus aureus
NIFTFFYKKVAVLFFECLVF

SEQ ID NO: 1577253 - protein, 17 aa, Staphylococcus aureus
NKPVVTLMPQFVDYLEG

SEQ ID NO: 1577254 - protein, 25 aa, Staphylococcus aureus
NNGIARISAVQIVISDRAKQSSSTG

SEQ ID NO: 1577255 - protein, 22 aa, Staphylococcus aureus
NPAMLPKSIWENFKSQNFENMI

SEQ ID NO: 1577256 - protein, 18 aa, Staphylococcus aureus
NVENMSFAIPVNEVQKIV

SEQ ID NO: 1577257 - protein, 25 aa, Staphylococcus aureus
NVEVPVKVYPVANAKAPSRDVKGQN

SEQ ID NO: 1577258 - protein, 24 aa, Staphylococcus aureus
NVSHELRTPISLLQGYTESIVDGI

SEQ ID NO: 1577259 - protein, 22 aa, Staphylococcus aureus
NYRVLIPFSTVIGAWLLLVADL

SEQ ID NO: 1577260 - protein, 18 aa, Staphylococcus aureus
PFTPLLVAAALYFVLTFV

SEQ ID NO: 1577261 - protein, 18 aa, Staphylococcus aureus
PVEQGKVVTPVIEINEKV

SEQ ID NO: 1577262 - protein, 19 aa, Staphylococcus aureus
QAKDALRQMTHLSDAQKQS

SEQ ID NO: 1577263 - protein, 18 aa, Staphylococcus aureus
QHSAEIFNHTSINPEPSF

SEQ ID NO: 1577264 - protein, 21 aa, Staphylococcus aureus
QIILYCANFVYIIIFSYIITI

SEQ ID NO: 1577265 - protein, 26 aa, Staphylococcus aureus
QLAYKELEQAVALIRTMPQRQQTSRR

SEQ ID NO: 1577266 - protein, 24 aa, Staphylococcus aureus
QNIIEFLALIGMTACFFLLNMSSV

SEQ ID NO: 1577267 - protein, 37 aa, Staphylococcus aureus
QNKYSIRRFTVGTTSVIVGATILFGIGNHQAQASEQS

SEQ ID NO: 1577268 - protein, 18 aa, Staphylococcus aureus
QSQQPKPYFATGANQANT

SEQ ID NO: 1577269 - protein, 17 aa, Staphylococcus aureus
QTLIKYGNIYAQVYSDQ

SEQ ID NO: 1577270 - protein, 20 aa, Staphylococcus aureus
RAHAPNALMMAAVIIAAGMF

SEQ ID NO: 1577271 - protein, 19 aa, Staphylococcus aureus
RGALLKRRVQTRVNSASSL

SEQ ID NO: 1577272 - protein, 18 aa, Staphylococcus aureus
RGPMGDAVIEGYINENKK

SEQ ID NO: 1577273 - protein, 19 aa, Staphylococcus aureus
RIFEVCIVILLLSAAFLIL

SEQ ID NO: 1577274 - protein, 21 aa, Staphylococcus aureus
RKGHIKRLNRGECTTKGGLLY

SEQ ID NO: 1577275 - protein, 25 aa, Staphylococcus aureus
RKLTGETIPHVFILIDNFDAVKDSP

SEQ ID NO: 1577276 - protein, 17 aa, Staphylococcus aureus
SEYWYMMLWHLILMVPA

SEQ ID NO: 1577277 - protein, 17 aa, Staphylococcus aureus
SGKELDWAKASHEKYLK

SEQ ID NO: 1577278 - protein, 29 aa, Staphylococcus aureus
SGNKTTTTFKYEVTRNSMSDSVSTSGSTQ

SEQ ID NO: 1577279 - protein, 21 aa, Staphylococcus aureus
SNARAGIPSRGMFQMIDPSFR

SEQ ID NO: 1577280 - protein, 17 aa, Staphylococcus aureus
SNFLAFMNFGSFVYMYY

SEQ ID NO: 1577281 - protein, 21 aa, Staphylococcus aureus
TFKLGCFLVFGYIFAGSFSIF

SEQ ID NO: 1577282 - protein, 19 aa, Staphylococcus aureus
TFMVTVWNVLKTVASVVWN

SEQ ID NO: 1577283 - protein, 17 aa, Staphylococcus aureus
THRKPGLYKDFDDGHVY

SEQ ID NO: 1577284 - protein, 20 aa, Staphylococcus aureus
TIKNGTAMPTNLAGGSTTTI

SEQ ID NO: 1577285 - protein, 18 aa, Staphylococcus aureus
TLEIGMVCDGYLMRIENL

SEQ ID NO: 1577286 - protein, 30 aa, Staphylococcus aureus
TTEGAVFIKGGDGFDFGHVERFIQNPPHGA

SEQ ID NO: 1577287 - protein, 21 aa, Staphylococcus aureus
TTGIPGFYTYYALSNKNLVYF

SEQ ID NO: 1577288 - protein, 37 aa, Staphylococcus aureus
TYAGQTWTRNISDWIAKSGTTNFSLSMTASTGGATNL

SEQ ID NO: 1577289 - protein, 22 aa, Staphylococcus aureus
VFSMEIKKDLKLLMKKDNYHNI

SEQ ID NO: 1577290 - protein, 29 aa, Staphylococcus aureus
VGMVLTLILICFPDIFGTSYLSRGYLITI

SEQ ID NO: 1577291 - protein, 20 aa, Staphylococcus aureus
VGVFIPFTLAQFGMVIKWIH

SEQ ID NO: 1577292 - protein, 19 aa, Staphylococcus aureus
VIYFNFTWSFYGNLLYLLP

SEQ ID NO: 1577293 - protein, 33 aa, Staphylococcus aureus
VPIAFKIHILLGFTIMACWPFTRLVHVWSVPLT

SEQ ID NO: 1577294 - protein, 27 aa, Staphylococcus aureus
VSEIKPRMKRSADVTAVSEKEVAEEAK

SEQ ID NO: 1577295 - protein, 17 aa, Staphylococcus aureus
VTGIVSIWTWWKNNNFT

SEQ ID NO: 1577296 - protein, 21 aa, Staphylococcus aureus
VTLLDGSKVIVNVPVKVVEKE

SEQ ID NO: 1577297 - protein, 17 aa, Staphylococcus aureus
VTVTGMLTQGSNENGTQ

SEQ ID NO: 1577298 - protein, 25 aa, Staphylococcus aureus
VVQLIWNLIQLWFVGKILGVVRYFG

SEQ ID NO: 1577299 - protein, 19 aa, Staphylococcus aureus
WQMNFIISIVIAFIAILLL

SEQ ID NO: 1577300 - protein, 24 aa, Staphylococcus aureus
YHLGEEGYPEWIIPTDPSRANEAH

SEQ ID NO: 1577301 - protein, 25 aa, Staphylococcus aureus
YLVELIRWLFTFGILFQLPILFIGL

SEQ ID NO: 1577302 - protein, 21 aa, Staphylococcus aureus
YMATEMFGTFKALTMAMTSPF

SEQ ID NO: 1577303 - protein, 32 aa, Staphylococcus aureus
AAVGIGGLSNAFGFKLDTYHNTSKPNAAAKAN

SEQ ID NO: 1577304 - protein, 26 aa, Staphylococcus aureus
AETIPGEGFAGARIIRKEVQKMFLQE

SEQ ID NO: 1577305 - protein, 18 aa, Staphylococcus aureus
AGTFIFGGSVVIWLLSYV

SEQ ID NO: 1577306 - protein, 24 aa, Staphylococcus aureus
AVAMWPGFSRSGSTISTGVLMKLN

SEQ ID NO: 1577307 - protein, 21 aa, Staphylococcus aureus
AVIIIPRFLDLGTFDVTIAFL

SEQ ID NO: 1577308 - protein, 23 aa, Staphylococcus aureus
DKDATRASSAYVNAEPNKKQSYD

SEQ ID NO: 1577309 - protein, 21 aa, Staphylococcus aureus
DSHLEKNCVIIICSVLLLSIL

SEQ ID NO: 1577310 - protein, 30 aa, Staphylococcus aureus
DVDSRKSASILDIFGGCFQGLLPYSPQVIS

SEQ ID NO: 1577311 - protein, 26 aa, Staphylococcus aureus
DVDTGLSIPTIYAFKKSLDALPNKKT

SEQ ID NO: 1577312 - protein, 18 aa, Staphylococcus aureus
EGIEASYVVARREDNLIG

SEQ ID NO: 1577313 - protein, 19 aa, Staphylococcus aureus
ELFHASGIIAAVVAGLVHG

SEQ ID NO: 1577314 - protein, 25 aa, Staphylococcus aureus
ESLDKVKHTPFFLPKRRRKEDEEDV

SEQ ID NO: 1577315 - protein, 28 aa, Staphylococcus aureus
FDNLDSGKYKVIFEKPAGLTQTVTNTTE

SEQ ID NO: 1577316 - protein, 17 aa, Staphylococcus aureus
FDWLVKLTSQFRAWSEQ

SEQ ID NO: 1577317 - protein, 24 aa, Staphylococcus aureus
FHGQRLNDVILTYVASTGKMRAEY

SEQ ID NO: 1577318 - protein, 18 aa, Staphylococcus aureus
FIIGIALAIVILIIFALL

SEQ ID NO: 1577319 - protein, 18 aa, Staphylococcus aureus
FIPLFYIIFGLKTRDESK

SEQ ID NO: 1577320 - protein, 21 aa, Staphylococcus aureus
FKNICLSLFAYILFGGLSTMA

SEQ ID NO: 1577321 - protein, 19 aa, Staphylococcus aureus
FKNKWTHFLISIPVIIGGS

SEQ ID NO: 1577322 - protein, 24 aa, Staphylococcus aureus
FLGNWIGQIGLNWFVLTTYHNAVY

SEQ ID NO: 1577323 - protein, 19 aa, Staphylococcus aureus
FLVGFLIYLFYSPRLKFDV

SEQ ID NO: 1577324 - protein, 23 aa, Staphylococcus aureus
FNSIVYTCVSLLGNPGKAIAIVL

SEQ ID NO: 1577325 - protein, 23 aa, Staphylococcus aureus
FSIFIKDVMAIVVGVLMFIFNVY

SEQ ID NO: 1577326 - protein, 20 aa, Staphylococcus aureus
FSPFCPSLVTFSVPGAKSGL

SEQ ID NO: 1577327 - protein, 35 aa, Staphylococcus aureus
GDNVVLPALTGNLIPNTKSNALIDAKNTDIKVYRV

SEQ ID NO: 1577328 - protein, 20 aa, Staphylococcus aureus
GGLIGGPVVKYLIKRYNLKP

SEQ ID NO: 1577329 - protein, 26 aa, Staphylococcus aureus
GHTFATSLPAKFVVKDVQPAKPTVTE

SEQ ID NO: 1577330 - protein, 17 aa, Staphylococcus aureus
GKNYLNYTISYIIWSIV

SEQ ID NO: 1577331 - protein, 24 aa, Staphylococcus aureus
GLFVIKGYLYVKHAGFKMTEEQIT

SEQ ID NO: 1577332 - protein, 27 aa, Staphylococcus aureus
GLNMTFNYCKKRVWTYDMDRMDQVLTN

SEQ ID NO: 1577333 - protein, 23 aa, Staphylococcus aureus
GLVCLFMMKLVLAITFFAVSLSI

SEQ ID NO: 1577334 - protein, 26 aa, Staphylococcus aureus
GMTKWEIFKKYILGNPVIWILCVSNV

SEQ ID NO: 1577335 - protein, 18 aa, Staphylococcus aureus
GRISIPYFLIGFVIMALV

SEQ ID NO: 1577336 - protein, 30 aa, Staphylococcus aureus
GVTSTAKVPPIMAGDQVLANGVIDSDGNVI

SEQ ID NO: 1577337 - protein, 33 aa, Staphylococcus aureus
HAGQRVVLKYKLKFADGLKRGDYFDFTLSNNVN

SEQ ID NO: 1577338 - protein, 17 aa, Staphylococcus aureus
IARMILKDAPIIVLDEA

SEQ ID NO: 1577339 - protein, 19 aa, Staphylococcus aureus
IDFDSVPQIHGFNKHNEII

SEQ ID NO: 1577340 - protein, 18 aa, Staphylococcus aureus
IFGKGIIVPALRGVSGGN

SEQ ID NO: 1577341 - protein, 24 aa, Staphylococcus aureus
IIVALLILFSFVPIGLWISALAAG

SEQ ID NO: 1577342 - protein, 17 aa, Staphylococcus aureus
IKFKNSFSMYVLLISPL

SEQ ID NO: 1577343 - protein, 25 aa, Staphylococcus aureus
ILCALALICVIVFYFNLNRKLKLKV

SEQ ID NO: 1577344 - protein, 18 aa, Staphylococcus aureus
ILFVCVYILFSRYASITL

SEQ ID NO: 1577345 - protein, 17 aa, Staphylococcus aureus
ILIHYIMLTICILKFTL

SEQ ID NO: 1577346 - protein, 17 aa, Staphylococcus aureus
ILLEIIFYFILLKNYQY

SEQ ID NO: 1577347 - protein, 22 aa, Staphylococcus aureus
ILSFKFLKALLYLKYLKKQSLY

SEQ ID NO: 1577348 - protein, 17 aa, Staphylococcus aureus
ITAFYRFVLVMIGVISS

SEQ ID NO: 1577349 - protein, 21 aa, Staphylococcus aureus
IWIHLLCTMIKYFNNVKEQLN

SEQ ID NO: 1577350 - protein, 26 aa, Staphylococcus aureus
KRVHLKRWQFISILIGTILITAVITV

SEQ ID NO: 1577351 - protein, 22 aa, Staphylococcus aureus
LAELSGYWAYQDLDKRYVIRVN

SEQ ID NO: 1577352 - protein, 20 aa, Staphylococcus aureus
LATKDFIIGIALAIVILIIF

SEQ ID NO: 1577353 - protein, 20 aa, Staphylococcus aureus
LEHLDRIRISFFTYHRSDAD

SEQ ID NO: 1577354 - protein, 17 aa, Staphylococcus aureus
LIAAIALIFIYISLGYI

SEQ ID NO: 1577355 - protein, 18 aa, Staphylococcus aureus
LIPLNFLLTRYFGVFVSI

SEQ ID NO: 1577356 - protein, 20 aa, Staphylococcus aureus
LKKIESRNCIVKGQFKVNEN

SEQ ID NO: 1577357 - protein, 18 aa, Staphylococcus aureus
LLTRFKIIYIAIAGLTLF

SEQ ID NO: 1577358 - protein, 19 aa, Staphylococcus aureus
LNFLLTRYFGVFVSILINL

SEQ ID NO: 1577359 - protein, 22 aa, Staphylococcus aureus
LNQLAPYFKGFDGSFVLYNERE

SEQ ID NO: 1577360 - protein, 26 aa, Staphylococcus aureus
LNYSVWRMVFVILTIFGFVMVIGSLL

SEQ ID NO: 1577361 - protein, 21 aa, Staphylococcus aureus
LPIYLDVFLIFAAVVFILMYF

SEQ ID NO: 1577362 - protein, 23 aa, Staphylococcus aureus
LSMFGTSWSQIWSTITNFVSSIW

SEQ ID NO: 1577363 - protein, 26 aa, Staphylococcus aureus
LVFYHLKLDVEFASILGLTKDKSLIQ

SEQ ID NO: 1577364 - protein, 17 aa, Staphylococcus aureus
NANAYASGWFTNNDEHL

SEQ ID NO: 1577365 - protein, 21 aa, Staphylococcus aureus
NESNSHLTIGYGTANHPFNSS

SEQ ID NO: 1577366 - protein, 19 aa, Staphylococcus aureus
NISFMPVIVVIVVYTLIYI

SEQ ID NO: 1577367 - protein, 27 aa, Staphylococcus aureus
NKILISLCFIGFIGIAAFYIYLNKKLK

SEQ ID NO: 1577368 - protein, 18 aa, Staphylococcus aureus
NNGSYSLNFDKLDKTYVI

SEQ ID NO: 1577369 - protein, 17 aa, Staphylococcus aureus
NNLDLFFNYGKRLANDH

SEQ ID NO: 1577370 - protein, 21 aa, Staphylococcus aureus
PARFNEVYSITAIDKNNKPFI

SEQ ID NO: 1577371 - protein, 27 aa, Staphylococcus aureus
PFTPLIVAAALYFVLTFVLTRIMNMIE

SEQ ID NO: 1577372 - protein, 31 aa, Staphylococcus aureus
PGRFYVITLYRIIKLVIIFLIELIKANFDVL

SEQ ID NO: 1577373 - protein, 17 aa, Staphylococcus aureus
PILFSCWIFILNMILSR

SEQ ID NO: 1577374 - protein, 27 aa, Staphylococcus aureus
PNKVIRFILRTAIGYSIFAYGLHYFSN

SEQ ID NO: 1577375 - protein, 17 aa, Staphylococcus aureus
PVLQLFIYIVGLFFLLY

SEQ ID NO: 1577376 - protein, 41 aa, Staphylococcus aureus
QDAYSQKGAITLGTRIDSNKSFHFSGKVNLGNKYEGNGNGG

SEQ ID NO: 1577377 - protein, 19 aa, Staphylococcus aureus
QHFKTIRFINTVCKSVLLV

SEQ ID NO: 1577378 - protein, 29 aa, Staphylococcus aureus
QKIGAAFRSGLTIGVAFVGIFLVIDLLVK

SEQ ID NO: 1577379 - protein, 18 aa, Staphylococcus aureus
QPNVKIYEYVGVENGLPQ

SEQ ID NO: 1577380 - protein, 26 aa, Staphylococcus aureus
QPPFFFSVLLPIVFISAIIGILQYTK

SEQ ID NO: 1577381 - protein, 19 aa, Staphylococcus aureus
QQERITLYLKHNTIEPNTI

SEQ ID NO: 1577382 - protein, 28 aa, Staphylococcus aureus
QRLNGLRQVVNRTYRIGTTKRVEVSQGN

SEQ ID NO: 1577383 - protein, 17 aa, Staphylococcus aureus
QRTPVYVYKWEDVQIQH

SEQ ID NO: 1577384 - protein, 17 aa, Staphylococcus aureus
QSGNTFMAANFTVTDKV

SEQ ID NO: 1577385 - protein, 18 aa, Staphylococcus aureus
QVYLIKILIHYIMLTICI

SEQ ID NO: 1577386 - protein, 18 aa, Staphylococcus aureus
RNEMIEFPNGKRVITPNT

SEQ ID NO: 1577387 - protein, 20 aa, Staphylococcus aureus
RTALESKPRVTRSTDVAEAK

SEQ ID NO: 1577388 - protein, 20 aa, Staphylococcus aureus
RYEFMPLKYKKRIVMNGEQE

SEQ ID NO: 1577389 - protein, 46 aa, Staphylococcus aureus
SAKNSERRGMLKGCGGCLISFIILIILLSACSMMFSNNDNSTSNQS

SEQ ID NO: 1577390 - protein, 26 aa, Staphylococcus aureus
SGKLKTRGYIDLSVGASFIPYRGNTS

SEQ ID NO: 1577391 - protein, 23 aa, Staphylococcus aureus
SIAKADGLISFLSTKVPILGTVF

SEQ ID NO: 1577392 - protein, 17 aa, Staphylococcus aureus
SKTLISLVQNVVKYIVW

SEQ ID NO: 1577393 - protein, 19 aa, Staphylococcus aureus
SLWVKPKLVNYIIAKEIGE

SEQ ID NO: 1577394 - protein, 24 aa, Staphylococcus aureus
SPVFKAMMHFSLPMMIGTLLSVIY

SEQ ID NO: 1577395 - protein, 22 aa, Staphylococcus aureus
SQSHLDSGFIFFFIVYVLCISY

SEQ ID NO: 1577396 - protein, 18 aa, Staphylococcus aureus
STNGDVVAKATYDILTKT

SEQ ID NO: 1577397 - protein, 22 aa, Staphylococcus aureus
TAIVNHVNFLKRICIPAPVIGG

SEQ ID NO: 1577398 - protein, 21 aa, Staphylococcus aureus
TIGGIILNYSVWRMVFVILTI

SEQ ID NO: 1577399 - protein, 22 aa, Staphylococcus aureus
TLCLACILYLLGTAIVNHVNFL

SEQ ID NO: 1577400 - protein, 24 aa, Staphylococcus aureus
TLNAVCGIFAFLIWIHLLCTMIKY

SEQ ID NO: 1577401 - protein, 34 aa, Staphylococcus aureus
VDPVTNRDYSIFGWNNENVVRYGGGSADGDSAVN

SEQ ID NO: 1577402 - protein, 23 aa, Staphylococcus aureus
VETRRAIYFIPIWFILLGFMYLR

SEQ ID NO: 1577403 - protein, 17 aa, Staphylococcus aureus
VFLIFAAVVFILMYFQE

SEQ ID NO: 1577404 - protein, 19 aa, Staphylococcus aureus
VFNIISIIMVSMLILSLGA

SEQ ID NO: 1577405 - protein, 18 aa, Staphylococcus aureus
VGVFKPHAVRDMNGHALP

SEQ ID NO: 1577406 - protein, 22 aa, Staphylococcus aureus
VIIYLFIRRQFNITNALLNLRV

SEQ ID NO: 1577407 - protein, 23 aa, Staphylococcus aureus
VLICAMFAICWVAYIQWESTIAS

SEQ ID NO: 1577408 - protein, 17 aa, Staphylococcus aureus
VLLLLKYIGFKLFIYEG

SEQ ID NO: 1577409 - protein, 26 aa, Staphylococcus aureus
VNGFFSVGVVIVFSPFCPSLVTFSVP

SEQ ID NO: 1577410 - protein, 17 aa, Staphylococcus aureus
VTLMPQFVDYLEGQLSS

SEQ ID NO: 1577411 - protein, 19 aa, Staphylococcus aureus
VYGWFLASSVAAFFVGVTE

SEQ ID NO: 1577412 - protein, 28 aa, Staphylococcus aureus
YEQGGNIIDIDFDSVPQIHGFNKHNEII

SEQ ID NO: 1577413 - protein, 40 aa, Staphylococcus aureus
YLLELSVPLISLFGVCIITILLLCSSVILLTNHQHREVAK

SEQ ID NO: 1577414 - protein, 23 aa, Staphylococcus aureus
ADVKSKINAASNIAGVNTVKQQG

SEQ ID NO: 1577415 - protein, 22 aa, Staphylococcus aureus
AESPGVPKVYTFIGQGDASYTI

SEQ ID NO: 1577416 - protein, 19 aa, Staphylococcus aureus
AMTGLKRGVANHNQVVQSD

SEQ ID NO: 1577417 - protein, 23 aa, Staphylococcus aureus
AQTLDHAMELLRNSVADNQTTLA

SEQ ID NO: 1577418 - protein, 20 aa, Staphylococcus aureus
ARQGLTLDRQPALTTLHGAS

SEQ ID NO: 1577419 - protein, 23 aa, Staphylococcus aureus
ASAKLKLELLPNVQNPVISVTTS

SEQ ID NO: 1577420 - protein, 25 aa, Staphylococcus aureus
ASLFKSEGFSIIGLILDVVIMGTLI

SEQ ID NO: 1577421 - protein, 28 aa, Staphylococcus aureus
ATYDILTKTYTFVFTDYVNNKENINGQF

SEQ ID NO: 1577422 - protein, 32 aa, Staphylococcus aureus
DDIDPLHMRHFSNNFGNVIKNAIGVVGISGLL

SEQ ID NO: 1577423 - protein, 22 aa, Staphylococcus aureus
DDKIEYIYFYLLQQNQKSNNSD

SEQ ID NO: 1577424 - protein, 22 aa, Staphylococcus aureus
DEAKRNAYTNAVTQAEQILNKA

SEQ ID NO: 1577425 - protein, 20 aa, Staphylococcus aureus
DGTNVQWSHGAGAGANKPLQ

SEQ ID NO: 1577426 - protein, 21 aa, Staphylococcus aureus
DICHTQSKIGRRFKVISFFVR

SEQ ID NO: 1577427 - protein, 24 aa, Staphylococcus aureus
DIKSNFDVSLFYLKVPELKEILRE

SEQ ID NO: 1577428 - protein, 17 aa, Staphylococcus aureus
DQIPSGYTILATGTPDG

SEQ ID NO: 1577429 - protein, 20 aa, Staphylococcus aureus
DSPDTWKNTVGNTHKTAVVT

SEQ ID NO: 1577430 - protein, 23 aa, Staphylococcus aureus
EAKEVKEVKAPKETKEVKPAAKA

SEQ ID NO: 1577431 - protein, 29 aa, Staphylococcus aureus
ENINGQFSLPLFTDRAKAPKSGTYDANIN

SEQ ID NO: 1577432 - protein, 21 aa, Staphylococcus aureus
ESRAAEPRSVSDYQNANSSYY

SEQ ID NO: 1577433 - protein, 30 aa, Staphylococcus aureus
EVGMILTLILICFPDIFGTSYLSRGYLITI

SEQ ID NO: 1577434 - protein, 44 aa, Staphylococcus aureus
EVTDQFKNRIYYEHPNVASIKFGDITKTYVVLVEGHYDNTGKNL

SEQ ID NO: 1577435 - protein, 18 aa, Staphylococcus aureus
FDLKHKKDALALEKAKNK

SEQ ID NO: 1577436 - protein, 18 aa, Staphylococcus aureus
FFILCIVSLVITILTIVF

SEQ ID NO: 1577437 - protein, 23 aa, Staphylococcus aureus
FGVMLRRYSHLFIVKYEYSIVIL

SEQ ID NO: 1577438 - protein, 17 aa, Staphylococcus aureus
FIITLFMSIVFLSISFA

SEQ ID NO: 1577439 - protein, 28 aa, Staphylococcus aureus
FIQNPPHGATVAWHDSPDTWKNTVGNTH

SEQ ID NO: 1577440 - protein, 17 aa, Staphylococcus aureus
FLGNEIIHTLTVLITTL

SEQ ID NO: 1577441 - protein, 23 aa, Staphylococcus aureus
FPEQKLPLYIVFTLFVAVAIVSN

SEQ ID NO: 1577442 - protein, 33 aa, Staphylococcus aureus
FTVTDKVKSGDYFTAKLPDSLTGNGDVDYSNSN

SEQ ID NO: 1577443 - protein, 20 aa, Staphylococcus aureus
FVFACITTLLWLISYSLLLK

SEQ ID NO: 1577444 - protein, 26 aa, Staphylococcus aureus
GIFLLLRFTPLLGLSNMYVYIVTFVG

SEQ ID NO: 1577445 - protein, 19 aa, Staphylococcus aureus
GKLTIYLGYSPGVGKTYEM

SEQ ID NO: 1577446 - protein, 19 aa, Staphylococcus aureus
GLFAALGSLLLFGRRKKQN

SEQ ID NO: 1577447 - protein, 22 aa, Staphylococcus aureus
GQGDASYTISFKTQGPTVNKLY

SEQ ID NO: 1577448 - protein, 25 aa, Staphylococcus aureus
HLFVKRRTREFALFQLIGLTRQNIL

SEQ ID NO: 1577449 - protein, 27 aa, Staphylococcus aureus
IFNQLYVVFKMIFWFNPALYISKTMMD

SEQ ID NO: 1577450 - protein, 23 aa, Staphylococcus aureus
IKKSEQLGGLLLKNNNIANPDKN

SEQ ID NO: 1577451 - protein, 17 aa, Staphylococcus aureus
ILCICIVASVIYLKVKY

SEQ ID NO: 1577452 - protein, 25 aa, Staphylococcus aureus
ILIKSSRLNNILTILSIALAIIHMG

SEQ ID NO: 1577453 - protein, 29 aa, Staphylococcus aureus
INIIFYGVCVLCFLLLPIIFIPNPNHVFI

SEQ ID NO: 1577454 - protein, 22 aa, Staphylococcus aureus
IPIILCVIGFKAEKLIATMVII

SEQ ID NO: 1577455 - protein, 23 aa, Staphylococcus aureus
IQEKRIDLFFKHNLNNYKNMKVT

SEQ ID NO: 1577456 - protein, 17 aa, Staphylococcus aureus
IQLTLSFTMIGLALGQF

SEQ ID NO: 1577457 - protein, 18 aa, Staphylococcus aureus
IRSVAFFLTALPSYWIAS

SEQ ID NO: 1577458 - protein, 21 aa, Staphylococcus aureus
ITFIGILIFYVRLIKKSSLNI

SEQ ID NO: 1577459 - protein, 25 aa, Staphylococcus aureus
ITSYHIFRIFFILFIIAPGINYFLK

SEQ ID NO: 1577460 - protein, 18 aa, Staphylococcus aureus
IVASVIYLKVKYDEKEKQ

SEQ ID NO: 1577461 - protein, 20 aa, Staphylococcus aureus
KASGILYIIGAVISANLLTF

SEQ ID NO: 1577462 - protein, 19 aa, Staphylococcus aureus
KDSKEPLPDTGSEDEANTS

SEQ ID NO: 1577463 - protein, 20 aa, Staphylococcus aureus
KEKYFLLIFMCNAIIGVLQD

SEQ ID NO: 1577464 - protein, 17 aa, Staphylococcus aureus
KELCLSLLPINIIVVFT

SEQ ID NO: 1577465 - protein, 36 aa, Staphylococcus aureus
KFSIRKYTVGTFSTVIATLVFLGFNTSQAHAAETNQ

SEQ ID NO: 1577466 - protein, 19 aa, Staphylococcus aureus
KKAKSIAFRDVKNHFVRNE

SEQ ID NO: 1577467 - protein, 17 aa, Staphylococcus aureus
KLQIMNIFRSYKLVLKD

SEQ ID NO: 1577468 - protein, 28 aa, Staphylococcus aureus
KPFSKQAGHPVFYVYAGNQGNASVNLGG

SEQ ID NO: 1577469 - protein, 53 aa, Staphylococcus aureus
KQTGDGYQWVIKFNKGHAPHQNMIFWFALPADQVPVGRTDFVTVNSDGTNVQW

SEQ ID NO: 1577470 - protein, 17 aa, Staphylococcus aureus
KVKQAFINANRDVITLA

SEQ ID NO: 1577471 - protein, 23 aa, Staphylococcus aureus
LFFLAEIISAFGVGISTVGANWY

SEQ ID NO: 1577472 - protein, 18 aa, Staphylococcus aureus
LGDSSFLFFDSFIPNSRD

SEQ ID NO: 1577473 - protein, 19 aa, Staphylococcus aureus
LGSAHKMAKEVLNIDDKIE

SEQ ID NO: 1577474 - protein, 17 aa, Staphylococcus aureus
LLDGSKVIVNVPVKVVE

SEQ ID NO: 1577475 - protein, 20 aa, Staphylococcus aureus
LLHLLSLKVVSIMIVLVACL

SEQ ID NO: 1577476 - protein, 22 aa, Staphylococcus aureus
LLIFSILMLFGGINEVTQNKLT

SEQ ID NO: 1577477 - protein, 26 aa, Staphylococcus aureus
LLVAIGMGFVSWIKRTKNTAVKVPHR

SEQ ID NO: 1577478 - protein, 26 aa, Staphylococcus aureus
LNIGVLLLSYSRFVIMKVTMNKSSDV

SEQ ID NO: 1577479 - protein, 23 aa, Staphylococcus aureus
LNREIKGKYYIIGEHFNVEELTS

SEQ ID NO: 1577480 - protein, 18 aa, Staphylococcus aureus
LNTARQGLTLDRQPALTT

SEQ ID NO: 1577481 - protein, 38 aa, Staphylococcus aureus
LPDDIPPTINNPVGINAKYYRGDEVNFTMGVSDRHSGI

SEQ ID NO: 1577482 - protein, 17 aa, Staphylococcus aureus
LPSVKGFKRTRVSMFIW

SEQ ID NO: 1577483 - protein, 18 aa, Staphylococcus aureus
LSGHEAKAAEHTNGELNQ

SEQ ID NO: 1577484 - protein, 24 aa, Staphylococcus aureus
LSYETRLTSDWSITFLTILIIITP

SEQ ID NO: 1577485 - protein, 21 aa, Staphylococcus aureus
LTAKVEVTLLDGSKVIVNVPV

SEQ ID NO: 1577486 - protein, 25 aa, Staphylococcus aureus
LTHPLRGILMLVVLVVFWIVGKKLE

SEQ ID NO: 1577487 - protein, 17 aa, Staphylococcus aureus
LYIIVMVVSVFIIGCNK

SEQ ID NO: 1577488 - protein, 24 aa, Staphylococcus aureus
NELKLRLLPSFKNICFTIFYYLFT

SEQ ID NO: 1577489 - protein, 20 aa, Staphylococcus aureus
NFRTQLTGYPENRYKTYYYY

SEQ ID NO: 1577490 - protein, 22 aa, Staphylococcus aureus
NHKEANGWFVGYVETKDNTYYF

SEQ ID NO: 1577491 - protein, 29 aa, Staphylococcus aureus
NKDNTRIGEDITVTAHILIDGETTPITKT

SEQ ID NO: 1577492 - protein, 27 aa, Staphylococcus aureus
NNGTLFGGLFAALGSLLLFGRRKKQNK

SEQ ID NO: 1577493 - protein, 25 aa, Staphylococcus aureus
NNIFGLKDKVDWVGHKIDNSIDVVK

SEQ ID NO: 1577494 - protein, 17 aa, Staphylococcus aureus
NRGLNLGLDDIRNTHVW

SEQ ID NO: 1577495 - protein, 26 aa, Staphylococcus aureus
NTDIKVYRVDNANDLSESYYVNPSDF

SEQ ID NO: 1577496 - protein, 26 aa, Staphylococcus aureus
NYILELHPSFYLSFIALLIINLAVLV

SEQ ID NO: 1577497 - protein, 17 aa, Staphylococcus aureus
PASITAYNNSIRALQSD

SEQ ID NO: 1577498 - protein, 19 aa, Staphylococcus aureus
PAVCVLIINLFLFFISIAA

SEQ ID NO: 1577499 - protein, 17 aa, Staphylococcus aureus
PNALASIFGISYSSTNR

SEQ ID NO: 1577500 - protein, 30 aa, Staphylococcus aureus
PVNISGIPLDPSALVYLVAPTNQTTNGGSE

SEQ ID NO: 1577501 - protein, 23 aa, Staphylococcus aureus
PYNLPTTPWNTLKASDSKEIALM

SEQ ID NO: 1577502 - protein, 24 aa, Staphylococcus aureus
QATTKIWQNGHIDITPNNPSGHLI

SEQ ID NO: 1577503 - protein, 25 aa, Staphylococcus aureus
QITTPYIVVVNGHIDPNSKGDLALR

SEQ ID NO: 1577504 - protein, 17 aa, Staphylococcus aureus
RILTLILSVIQSYFVIH

SEQ ID NO: 1577505 - protein, 20 aa, Staphylococcus aureus
RKLVIAICCITFIGILTFYV

SEQ ID NO: 1577506 - protein, 25 aa, Staphylococcus aureus
RKQALLFEWSRINSMLDTQLYITRL

SEQ ID NO: 1577507 - protein, 18 aa, Staphylococcus aureus
RLNISSGAGSVRISDVDL

SEQ ID NO: 1577508 - protein, 28 aa, Staphylococcus aureus
RTFTQFTFKKAILFAALFILIGFYDGFV

SEQ ID NO: 1577509 - protein, 19 aa, Staphylococcus aureus
RTKIQEIDRVLASHPDVAT

SEQ ID NO: 1577510 - protein, 18 aa, Staphylococcus aureus
SDITFKVSATDNVNNTTN

SEQ ID NO: 1577511 - protein, 18 aa, Staphylococcus aureus
SEDAHPIVLGNTEKVVVV

SEQ ID NO: 1577512 - protein, 17 aa, Staphylococcus aureus
SIYLVAHRPFKFKMVNN

SEQ ID NO: 1577513 - protein, 17 aa, Staphylococcus aureus
SKNGGTWNPNASDGSNQ

SEQ ID NO: 1577514 - protein, 18 aa, Staphylococcus aureus
SLPIFLYAVIKFFFSAKR

SEQ ID NO: 1577515 - protein, 24 aa, Staphylococcus aureus
SSTREIAGVFGIPLHKFGIETANM

SEQ ID NO: 1577516 - protein, 27 aa, Staphylococcus aureus
TAGTMEWAKLGILIALLFFPTGHILLK

SEQ ID NO: 1577517 - protein, 18 aa, Staphylococcus aureus
TDAINIYFVPSDLVNPTI

SEQ ID NO: 1577518 - protein, 17 aa, Staphylococcus aureus
TIEASVAKFKRQIDSAV

SEQ ID NO: 1577519 - protein, 30 aa, Staphylococcus aureus
TRQVFLGKAGFFIMLGMLQALIVSVGDLLI

SEQ ID NO: 1577520 - protein, 25 aa, Staphylococcus aureus
TVLPEIQHNIKFFKNDDTQNIAEKP

SEQ ID NO: 1577521 - protein, 25 aa, Staphylococcus aureus
TVPVKHVIPEIVAHSHYTVQGQDFP

SEQ ID NO: 1577522 - protein, 21 aa, Staphylococcus aureus
TWISLFFPFINWFIPKEYVKI

SEQ ID NO: 1577523 - protein, 18 aa, Staphylococcus aureus
TYSVEFSTPAGYTPTTAN

SEQ ID NO: 1577524 - protein, 18 aa, Staphylococcus aureus
VILIPTFKLGCFLVFGYI

SEQ ID NO: 1577525 - protein, 47 aa, Staphylococcus aureus
VNINKGRLTKSFASNLANMNFLRWVNFPQDYTVTWTNAKIANRPTDG

SEQ ID NO: 1577526 - protein, 26 aa, Staphylococcus aureus
VNPKQRVLGNTWVYIKGYQDKIEESS

SEQ ID NO: 1577527 - protein, 19 aa, Staphylococcus aureus
VPELKEILREYKLKLSGNK

SEQ ID NO: 1577528 - protein, 25 aa, Staphylococcus aureus
VSLVSDLLGIIAMKKLFVNNKASGI

SEQ ID NO: 1577529 - protein, 23 aa, Staphylococcus aureus
VTVKPLRDKYRVGTSSTAANPVR

SEQ ID NO: 1577530 - protein, 20 aa, Staphylococcus aureus
VVFLCILIFFVLLNRKLKLK

SEQ ID NO: 1577531 - protein, 23 aa, Staphylococcus aureus
VYKAQLYLTPYGPKQYVEHLNQN

SEQ ID NO: 1577532 - protein, 19 aa, Staphylococcus aureus
VYLRAIICAIIIITHLLTQ

SEQ ID NO: 1577533 - protein, 19 aa, Staphylococcus aureus
VYLRAIICAIIIVTHLLTQ

SEQ ID NO: 1577534 - protein, 17 aa, Staphylococcus aureus
YEPLAMCWMLVPETLGG

SEQ ID NO: 1577535 - protein, 32 aa, Staphylococcus aureus
YLIPNLPNGDYRVEFSNLPKGYEVTPSKQGNN

SEQ ID NO: 1577536 - protein, 25 aa, Staphylococcus aureus
YPLGKATSHLLGYVGPINSEELKQK

SEQ ID NO: 1577537 - protein, 24 aa, Staphylococcus aureus
YQMKISFLPALGFNQILLEREEDQ

SEQ ID NO: 1577538 - protein, 17 aa, Staphylococcus aureus
AEHSKTINVVRGQNNQW

SEQ ID NO: 1577539 - protein, 39 aa, Staphylococcus aureus
AIRMLFHPFKPYYIFKFRVPFTPGLIPKRREEIATKIGQ

SEQ ID NO: 1577540 - protein, 23 aa, Staphylococcus aureus
ASAKLKLELLPNVQNPVISVTTT

SEQ ID NO: 1577541 - protein, 17 aa, Staphylococcus aureus
ASESKPRVTRSADVAEA

SEQ ID NO: 1577542 - protein, 23 aa, Staphylococcus aureus
DKDATRASSAYVNAEPNKKQAYD

SEQ ID NO: 1577543 - protein, 26 aa, Staphylococcus aureus
DKMSQAWNFIVTKGMQWVSTITSTLI

SEQ ID NO: 1577544 - protein, 18 aa, Staphylococcus aureus
EPETPMPPTPEVPSEPET

SEQ ID NO: 1577545 - protein, 22 aa, Staphylococcus aureus
FKKLDLCILIILLVIIFCFVCE

SEQ ID NO: 1577546 - protein, 23 aa, Staphylococcus aureus
FQLEELIVWSSCFIGFLEIIFFY

SEQ ID NO: 1577547 - protein, 24 aa, Staphylococcus aureus
FSIETCLIWFYSFIIFNNVDLKNL

SEQ ID NO: 1577548 - protein, 24 aa, Staphylococcus aureus
FTLRKIIFENFSKKCTYWVTLIIT

SEQ ID NO: 1577549 - protein, 18 aa, Staphylococcus aureus
FTSIFGMFAAILFMYYYL

SEQ ID NO: 1577550 - protein, 21 aa, Staphylococcus aureus
FYFRFLHVRSFRENKKSGQPA

SEQ ID NO: 1577551 - protein, 17 aa, Staphylococcus aureus
GDRVSFYCYISIMVAYA

SEQ ID NO: 1577552 - protein, 23 aa, Staphylococcus aureus
GIAKADGLISFLSTKVPILGTVF

SEQ ID NO: 1577553 - protein, 24 aa, Staphylococcus aureus
GIYKPKYNLGDYVWEDTNKNGIQD

SEQ ID NO: 1577554 - protein, 20 aa, Staphylococcus aureus
GQIRPTTLIIIGISMQTLFI

SEQ ID NO: 1577555 - protein, 17 aa, Staphylococcus aureus
GVANRLLIPTGLHHALN

SEQ ID NO: 1577556 - protein, 38 aa, Staphylococcus aureus
GVSIQKLQLLGAMPRHVIEGFPTINWLGFYPSYEPLIA

SEQ ID NO: 1577557 - protein, 18 aa, Staphylococcus aureus
IENFKFFGQYADFKDLKN

SEQ ID NO: 1577558 - protein, 17 aa, Staphylococcus aureus
IFGKGIIVLALRAVSGG

SEQ ID NO: 1577559 - protein, 20 aa, Staphylococcus aureus
IFNKKVNGYHVWIKGYNNDI

SEQ ID NO: 1577560 - protein, 22 aa, Staphylococcus aureus
IFVSWYPTVYWIINAAVVLVAF

SEQ ID NO: 1577561 - protein, 19 aa, Staphylococcus aureus
INYHSKFDILSWLQDPFAT

SEQ ID NO: 1577562 - protein, 25 aa, Staphylococcus aureus
ISFAKRVFTALGIGIVFGVLLHLIY

SEQ ID NO: 1577563 - protein, 17 aa, Staphylococcus aureus
ITYVFSGYLYRVALVQS

SEQ ID NO: 1577564 - protein, 28 aa, Staphylococcus aureus
IVSLCFLFICIYLNMAIGSSKINFSDII

SEQ ID NO: 1577565 - protein, 18 aa, Staphylococcus aureus
KADKRELITAKNHLDDPV

SEQ ID NO: 1577566 - protein, 29 aa, Staphylococcus aureus
KGPSRSKLRTVIICNLAFAICMMLGTLTA

SEQ ID NO: 1577567 - protein, 24 aa, Staphylococcus aureus
KNEFGIKDKNDWIGHKLDVGIDAV

SEQ ID NO: 1577568 - protein, 21 aa, Staphylococcus aureus
KNFLPLIILALIYFIHKIIHK

SEQ ID NO: 1577569 - protein, 25 aa, Staphylococcus aureus
KSLGWWDLFFAIPIFLLFAYLPNYN

SEQ ID NO: 1577570 - protein, 26 aa, Staphylococcus aureus
KTDAARAIDALPHLNNAQKADVKSKI

SEQ ID NO: 1577571 - protein, 17 aa, Staphylococcus aureus
KVADDWIENIKLMNDKN

SEQ ID NO: 1577572 - protein, 21 aa, Staphylococcus aureus
KVFVAPTIKFMEWRVAIQTDA

SEQ ID NO: 1577573 - protein, 17 aa, Staphylococcus aureus
LASFAFAILLSIIIDIG

SEQ ID NO: 1577574 - protein, 18 aa, Staphylococcus aureus
LDSIVFRNTLRYTAIMMI

SEQ ID NO: 1577575 - protein, 31 aa, Staphylococcus aureus
LGDKGLVNSGGFKIDTGYIYTSSMDKTEKQA

SEQ ID NO: 1577576 - protein, 25 aa, Staphylococcus aureus
LGIYKPKYNLGDYVWEDTNKNGIQD

SEQ ID NO: 1577577 - protein, 18 aa, Staphylococcus aureus
LGTLTAKTPLVFGMTLLI

SEQ ID NO: 1577578 - protein, 20 aa, Staphylococcus aureus
LGYIFYPFIYIFPIADQALL

SEQ ID NO: 1577579 - protein, 20 aa, Staphylococcus aureus
LIIKPLWQYHCRFYQVDQLS

SEQ ID NO: 1577580 - protein, 17 aa, Staphylococcus aureus
LIPKRREEIATKIGQVI

SEQ ID NO: 1577581 - protein, 22 aa, Staphylococcus aureus
LKKDIKGSYFVKDKNFDVSKFI

SEQ ID NO: 1577582 - protein, 30 aa, Staphylococcus aureus
LKNFCLTLFRYAFFILWTVIFSYALLSMSY

SEQ ID NO: 1577583 - protein, 25 aa, Staphylococcus aureus
LKNKIDFSKDFNFKVRVANNHQSNT

SEQ ID NO: 1577584 - protein, 17 aa, Staphylococcus aureus
LKNSQTLDLPQSSPQTI

SEQ ID NO: 1577585 - protein, 19 aa, Staphylococcus aureus
LLHLLSLKVVSIMIVLVAC

SEQ ID NO: 1577586 - protein, 23 aa, Staphylococcus aureus
LNSSMKYSVNWYYENLNKHLRQD

SEQ ID NO: 1577587 - protein, 23 aa, Staphylococcus aureus
LPLADIDLAWLVPFMLFAIIGFI

SEQ ID NO: 1577588 - protein, 25 aa, Staphylococcus aureus
LQDVWHLKPAMTIAVSHGTFNITNT

SEQ ID NO: 1577589 - protein, 28 aa, Staphylococcus aureus
LTDVKEVRWLFRIIVLIVFAVVMFTIYI

SEQ ID NO: 1577590 - protein, 26 aa, Staphylococcus aureus
LTNRFSSRPVLLWTLLIFIIGNGIIA

SEQ ID NO: 1577591 - protein, 22 aa, Staphylococcus aureus
MPIADIKSTNGDVVAKATYDIL

SEQ ID NO: 1577592 - protein, 19 aa, Staphylococcus aureus
MVLAVTCFIGYNMYLLYNN

SEQ ID NO: 1577593 - protein, 18 aa, Staphylococcus aureus
NAFFSEIIKVMSRFIGNF

SEQ ID NO: 1577594 - protein, 20 aa, Staphylococcus aureus
NFSKKCTYWVTLIISQILLT

SEQ ID NO: 1577595 - protein, 18 aa, Staphylococcus aureus
NICTVIWIVLVIILSFKF

SEQ ID NO: 1577596 - protein, 22 aa, Staphylococcus aureus
NIIDRLFIYFNYHLEYYENMLF

SEQ ID NO: 1577597 - protein, 24 aa, Staphylococcus aureus
NIRDIKMWILGLIGTIFSTIVIAL

SEQ ID NO: 1577598 - protein, 18 aa, Staphylococcus aureus
NIVDIDFDSVPQIQGQNN

SEQ ID NO: 1577599 - protein, 24 aa, Staphylococcus aureus
NMLIQRLKAGKVYKKERLETAFSN

SEQ ID NO: 1577600 - protein, 19 aa, Staphylococcus aureus
NNTFQDFDINYNGDTKVMT

SEQ ID NO: 1577601 - protein, 17 aa, Staphylococcus aureus
NPIPIYITNFFGGAIAG

SEQ ID NO: 1577602 - protein, 22 aa, Staphylococcus aureus
NYVPEKWILGLLGLIPIYLGIK

SEQ ID NO: 1577603 - protein, 17 aa, Staphylococcus aureus
PDELIEMMDHIIAQLDN

SEQ ID NO: 1577604 - protein, 18 aa, Staphylococcus aureus
PILFSCWLFILNMILSRL

SEQ ID NO: 1577605 - protein, 19 aa, Staphylococcus aureus
PLFFIYKYHQPMFGKLSSQ

SEQ ID NO: 1577606 - protein, 17 aa, Staphylococcus aureus
PNSSITITPKAGTGHSV

SEQ ID NO: 1577607 - protein, 18 aa, Staphylococcus aureus
PRAGRALFSDSLATIVGS

SEQ ID NO: 1577608 - protein, 20 aa, Staphylococcus aureus
PVFMSIYWIVGSIYFYFTRE

SEQ ID NO: 1577609 - protein, 18 aa, Staphylococcus aureus
PVKEFLSGSLEAVFWMIN

SEQ ID NO: 1577610 - protein, 19 aa, Staphylococcus aureus
QHFKTIRFINTVCKSILLV

SEQ ID NO: 1577611 - protein, 18 aa, Staphylococcus aureus
RFNQLTGMTEDEIRVLFN

SEQ ID NO: 1577612 - protein, 30 aa, Staphylococcus aureus
RFVVFSDQFERFGSLTFFDAFLVGLVEETG

SEQ ID NO: 1577613 - protein, 22 aa, Staphylococcus aureus
RGCLKSVIMLIVLFFLIIFGIV

SEQ ID NO: 1577614 - protein, 18 aa, Staphylococcus aureus
RNGTHAGGILKMKGVLDN

SEQ ID NO: 1577615 - protein, 23 aa, Staphylococcus aureus
SAAKRVPVTVNVYQFEFPQTTYT

SEQ ID NO: 1577616 - protein, 38 aa, Staphylococcus aureus
SIISAILMKNKWPFLIALPFMIGYGIGVTFYYQQKVAY

SEQ ID NO: 1577617 - protein, 19 aa, Staphylococcus aureus
SKFDILSWLQDPFATPTLG

SEQ ID NO: 1577618 - protein, 24 aa, Staphylococcus aureus
SPPWNNFFKRFSFYAIAIQYFVVQ

SEQ ID NO: 1577619 - protein, 25 aa, Staphylococcus aureus
SRYEKKNMAGLIFVSWYPTVYWIIN

SEQ ID NO: 1577620 - protein, 24 aa, Staphylococcus aureus
SSIIIYLFIRRQFNISNALLNLSV

SEQ ID NO: 1577621 - protein, 28 aa, Staphylococcus aureus
TVNGQENLYRIAIQYYGSGSPENVEKIR

SEQ ID NO: 1577622 - protein, 22 aa, Staphylococcus aureus
VAGGVELMSAVPMGGNEPTNNP

SEQ ID NO: 1577623 - protein, 18 aa, Staphylococcus aureus
VASFAMRLLLGSTLASII

SEQ ID NO: 1577624 - protein, 29 aa, Staphylococcus aureus
VKGDTFKITVPKELNLNGVTSTAKVPPIM

SEQ ID NO: 1577625 - protein, 17 aa, Staphylococcus aureus
VKMKNIASLNSFERQAV

SEQ ID NO: 1577626 - protein, 19 aa, Staphylococcus aureus
VLFFFGESSVKGFATMLLL

SEQ ID NO: 1577627 - protein, 18 aa, Staphylococcus aureus
VMFIRRWFDMKTTIASAF

SEQ ID NO: 1577628 - protein, 18 aa, Staphylococcus aureus
VQNLILYVSWLFMTMLFM

SEQ ID NO: 1577629 - protein, 17 aa, Staphylococcus aureus
VVFFLGDFIFKYTDWSI

SEQ ID NO: 1577630 - protein, 24 aa, Staphylococcus aureus
VVNAKYDVIYNGHTFATSLPAKFV

SEQ ID NO: 1577631 - protein, 18 aa, Staphylococcus aureus
VVPCILTIVMSHFSKQKA

SEQ ID NO: 1577632 - protein, 21 aa, Staphylococcus aureus
WIVGSIYFYFTREIRYSLNKK

SEQ ID NO: 1577633 - protein, 19 aa, Staphylococcus aureus
WLISIVVGFLSWFISAVCI

SEQ ID NO: 1577634 - protein, 22 aa, Staphylococcus aureus
YDFPIDSLFYIVSLNLSLTLIF

SEQ ID NO: 1577635 - protein, 22 aa, Staphylococcus aureus
YDTKIAITHQITWDFVKAPHGL

SEQ ID NO: 1577636 - protein, 24 aa, Staphylococcus aureus
YITNSWLKPLHMTHTSFKQTNNKS

SEQ ID NO: 1577637 - protein, 26 aa, Staphylococcus aureus
YNGYIFKLVVFVSALLTSHGYIEITR

SEQ ID NO: 1577638 - protein, 19 aa, Staphylococcus aureus
YRFFGKQGLIAWVAIGTII

SEQ ID NO: 1577639 - protein, 17 aa, Staphylococcus aureus
YTVEFETPAGYTPTVKN

SEQ ID NO: 1577640 - protein, 20 aa, Staphylococcus aureus
AFYICFGFSALIFPYVGLRL

SEQ ID NO: 1577641 - protein, 22 aa, Staphylococcus aureus
AREVKIVSSIEYGENFHEDYDY

SEQ ID NO: 1577642 - protein, 25 aa, Staphylococcus aureus
ATSKLFDIVIQWGVLALIVIFQPEI

SEQ ID NO: 1577643 - protein, 28 aa, Staphylococcus aureus
ATYDILTKTYTFVFTDYVNDKENINGQF

SEQ ID NO: 1577644 - protein, 34 aa, Staphylococcus aureus
AVFMRPDIGETFSEFRTFLAVLLMLLLFISISLV

SEQ ID NO: 1577645 - protein, 17 aa, Staphylococcus aureus
CRKFKPKNIFRLEASEH

SEQ ID NO: 1577646 - protein, 18 aa, Staphylococcus aureus
CSITLPITGIDDVRLGRV

SEQ ID NO: 1577647 - protein, 33 aa, Staphylococcus aureus
DDKVKSGDYFTIKYSDTVQVYGLNPEDIKNIGD

SEQ ID NO: 1577648 - protein, 26 aa, Staphylococcus aureus
DIKAQRSLNLWTYVMLIFMTLAAILM

SEQ ID NO: 1577649 - protein, 26 aa, Staphylococcus aureus
DVTTGKDIIPPKTYSGNVDQVVTIDN

SEQ ID NO: 1577650 - protein, 37 aa, Staphylococcus aureus
DVYYTKKKAEVELDINTASTWKKFEVYENNQKLPVRL

SEQ ID NO: 1577651 - protein, 24 aa, Staphylococcus aureus
EHIRYGESILKCSILKSQHINNVA

SEQ ID NO: 1577652 - protein, 23 aa, Staphylococcus aureus
EIEQAKAQLAQALQDIKDLVKAK

SEQ ID NO: 1577653 - protein, 21 aa, Staphylococcus aureus
EIIDFNMFINKIINRHEMSTK

SEQ ID NO: 1577654 - protein, 17 aa, Staphylococcus aureus
ELMSVPGVGQAKANAIV

SEQ ID NO: 1577655 - protein, 33 aa, Staphylococcus aureus
EVTGEFKDKISYKYDNVASINFGDINKTYVVLV

SEQ ID NO: 1577656 - protein, 21 aa, Staphylococcus aureus
FFICQILAFLFPKFPHINLLL

SEQ ID NO: 1577657 - protein, 27 aa, Staphylococcus aureus
FIHWIWPDLPIGAAFAIAAILCPTDAV

SEQ ID NO: 1577658 - protein, 17 aa, Staphylococcus aureus
FIIASGFIADTTSLPLI

SEQ ID NO: 1577659 - protein, 21 aa, Staphylococcus aureus
FKMVNNTAKIVWKQFALSVLI

SEQ ID NO: 1577660 - protein, 21 aa, Staphylococcus aureus
FLTLKSLFWVLPWGIMQRIPL

SEQ ID NO: 1577661 - protein, 20 aa, Staphylococcus aureus
FLVHCFLVFIIAYIGDLIIN

SEQ ID NO: 1577662 - protein, 19 aa, Staphylococcus aureus
FNPPASWLNHLLLDGLNNL

SEQ ID NO: 1577663 - protein, 23 aa, Staphylococcus aureus
FNQLYVVFKMIFWFNPALYISKT

SEQ ID NO: 1577664 - protein, 19 aa, Staphylococcus aureus
FSFDARDSRHLSFIEAPII

SEQ ID NO: 1577665 - protein, 21 aa, Staphylococcus aureus
FTWGIPLHEGHLFGIVNKIIN

SEQ ID NO: 1577666 - protein, 30 aa, Staphylococcus aureus
GAHAPSSFWCYVESIILFILLPLVIVNFHI

SEQ ID NO: 1577667 - protein, 17 aa, Staphylococcus aureus
GKLKPIYFTGGILGMAF

SEQ ID NO: 1577668 - protein, 18 aa, Staphylococcus aureus
GLEVPFMIILGVLSSRLH

SEQ ID NO: 1577669 - protein, 25 aa, Staphylococcus aureus
GNQTIEVGKTMNPIVLTTTDNGTGT

SEQ ID NO: 1577670 - protein, 21 aa, Staphylococcus aureus
GPLVVYWNWTWGVTVAIILGI

SEQ ID NO: 1577671 - protein, 19 aa, Staphylococcus aureus
GVVCSTILFTIIVAIYHQP

SEQ ID NO: 1577672 - protein, 23 aa, Staphylococcus aureus
HKSLIYRYDATLGTQITTNDILT

SEQ ID NO: 1577673 - protein, 22 aa, Staphylococcus aureus
ICASILLLISFVVFFFIYGMVS

SEQ ID NO: 1577674 - protein, 17 aa, Staphylococcus aureus
IFINNMLIYGLGGLIVP

SEQ ID NO: 1577675 - protein, 27 aa, Staphylococcus aureus
IIALVKYKGKYLPLLENGKLLKGSNDV

SEQ ID NO: 1577676 - protein, 22 aa, Staphylococcus aureus
IKSPRILDKVSREFDGQYSTAE

SEQ ID NO: 1577677 - protein, 18 aa, Staphylococcus aureus
IMLIILISVAGIYLKVKY

SEQ ID NO: 1577678 - protein, 33 aa, Staphylococcus aureus
INLKGASLFLRLGARIFKTGIAIILAMSIASLL

SEQ ID NO: 1577679 - protein, 19 aa, Staphylococcus aureus
IRSVAFFLTALPSYWIASI

SEQ ID NO: 1577680 - protein, 24 aa, Staphylococcus aureus
ISKVFAHDMPKIMSVDNVTILSSA

SEQ ID NO: 1577681 - protein, 17 aa, Staphylococcus aureus
ISVLFAVAFFIINYIGM

SEQ ID NO: 1577682 - protein, 24 aa, Staphylococcus aureus
IVKVVVANIGYEGQYHVRIVNQDI

SEQ ID NO: 1577683 - protein, 20 aa, Staphylococcus aureus
IVSIWTWWKNNNFTHASKKG

SEQ ID NO: 1577684 - protein, 28 aa, Staphylococcus aureus
IYVPYGDDWFAYFMRRLAERPQNLSLAV

SEQ ID NO: 1577685 - protein, 27 aa, Staphylococcus aureus
KCADIIRFVSYLSIPVLSFFNMLSIFQ

SEQ ID NO: 1577686 - protein, 21 aa, Staphylococcus aureus
KDVDTFVVISHLGIDPSTQET

SEQ ID NO: 1577687 - protein, 21 aa, Staphylococcus aureus
KEIRAKIFILSIAFLVHCFLV

SEQ ID NO: 1577688 - protein, 24 aa, Staphylococcus aureus
KEKQALKDRINQILQQGHNDINNA

SEQ ID NO: 1577689 - protein, 20 aa, Staphylococcus aureus
KFYSLDGINGLSLLDTLSRT

SEQ ID NO: 1577690 - protein, 18 aa, Staphylococcus aureus
KKLVHFISLILISMLTGL

SEQ ID NO: 1577691 - protein, 19 aa, Staphylococcus aureus
KMDISLGKVLRVSYIINAL

SEQ ID NO: 1577692 - protein, 18 aa, Staphylococcus aureus
KNFWPVVGGTILLGATSR

SEQ ID NO: 1577693 - protein, 17 aa, Staphylococcus aureus
KTGLIYFVMADIGGAFV

SEQ ID NO: 1577694 - protein, 24 aa, Staphylococcus aureus
KTRPEGIKGVEFRDPLQSVTAEMM

SEQ ID NO: 1577695 - protein, 17 aa, Staphylococcus aureus
KTYSGNVDQVVTIDNQQ

SEQ ID NO: 1577696 - protein, 25 aa, Staphylococcus aureus
KVNRLGVPLSVFFGGVKMMIPNMVK

SEQ ID NO: 1577697 - protein, 28 aa, Staphylococcus aureus
KYLPLSDIGMGWVVLSLIGFIIGFIIYK

SEQ ID NO: 1577698 - protein, 20 aa, Staphylococcus aureus
LAQGIGRWGNFMNHEAHGGP

SEQ ID NO: 1577699 - protein, 23 aa, Staphylococcus aureus
LDLLIVWYVLYLLITVFKGTKAI

SEQ ID NO: 1577700 - protein, 20 aa, Staphylococcus aureus
LIMGIISLIVLFIFTLFIMA

SEQ ID NO: 1577701 - protein, 18 aa, Staphylococcus aureus
LKAGQNIRVENGETIPAD

SEQ ID NO: 1577702 - protein, 20 aa, Staphylococcus aureus
LKGSEFTFTPEAPKTITELE

SEQ ID NO: 1577703 - protein, 19 aa, Staphylococcus aureus
LKKAYAYIIKANDNFQRQM

SEQ ID NO: 1577704 - protein, 18 aa, Staphylococcus aureus
LLLSSIIIAFGIKLPILI

SEQ ID NO: 1577705 - protein, 24 aa, Staphylococcus aureus
LLTGLKANILFLFIFVLTVFVFNP

SEQ ID NO: 1577706 - protein, 25 aa, Staphylococcus aureus
LLVAIGMGFVSWINRTKNTAVKVPH

SEQ ID NO: 1577707 - protein, 18 aa, Staphylococcus aureus
LNLRVFKNRTFALCTISS

SEQ ID NO: 1577708 - protein, 20 aa, Staphylococcus aureus
LPIGIAYQFSDWFQNQYVSA

SEQ ID NO: 1577709 - protein, 17 aa, Staphylococcus aureus
LRLPRILIALMVGAMLA

SEQ ID NO: 1577710 - protein, 17 aa, Staphylococcus aureus
LSFAFFLDYIMKLYFTM

SEQ ID NO: 1577711 - protein, 20 aa, Staphylococcus aureus
LSNGSAIPDATITWVSGQAP

SEQ ID NO: 1577712 - protein, 23 aa, Staphylococcus aureus
LSSPKSAIISALIFNALIIVALI

SEQ ID NO: 1577713 - protein, 22 aa, Staphylococcus aureus
LTSELKKAGLTSEVEYINRNIL

SEQ ID NO: 1577714 - protein, 18 aa, Staphylococcus aureus
LVFFIFSVSFIFVILIPK

SEQ ID NO: 1577715 - protein, 27 aa, Staphylococcus aureus
LWNKNEGFRNFIINAWNAIKTFMVTVW

SEQ ID NO: 1577716 - protein, 19 aa, Staphylococcus aureus
MIICYPITIIIVSLLYNID

SEQ ID NO: 1577717 - protein, 19 aa, Staphylococcus aureus
MPYGLCFLPFYKQKKKKQT

SEQ ID NO: 1577718 - protein, 26 aa, Staphylococcus aureus
MSCSARLPVYALFVGIFFKENQSLVV

SEQ ID NO: 1577719 - protein, 22 aa, Staphylococcus aureus
NALQLRFILDWNSQATRDHISY

SEQ ID NO: 1577720 - protein, 26 aa, Staphylococcus aureus
NKIINLFVCIALLVAIGMGFVSWINR

SEQ ID NO: 1577721 - protein, 25 aa, Staphylococcus aureus
NQPNNWAWSSLNICINDSKPSNVKV

SEQ ID NO: 1577722 - protein, 23 aa, Staphylococcus aureus
NSIGSAFTETVSHVGNVEDPGYY

SEQ ID NO: 1577723 - protein, 24 aa, Staphylococcus aureus
NVAGGGAFGAFVTTDSYGVATTYT

SEQ ID NO: 1577724 - protein, 22 aa, Staphylococcus aureus
PAADESLKDAIKNPAVENKEHD

SEQ ID NO: 1577725 - protein, 23 aa, Staphylococcus aureus
PAANGAGAFTIDHVVKSNSTHNA

SEQ ID NO: 1577726 - protein, 26 aa, Staphylococcus aureus
PNKVIRFILRTAIGYSVFAYGLHYFS

SEQ ID NO: 1577727 - protein, 18 aa, Staphylococcus aureus
PTHRKPGLYKDFDDGHVY

SEQ ID NO: 1577728 - protein, 25 aa, Staphylococcus aureus
PVRLIKRKKYYAIIVSLTLFIITLI

SEQ ID NO: 1577729 - protein, 32 aa, Staphylococcus aureus
QDRTVPLYAVFELFTLGNLVFFTRCMSQNLNI

SEQ ID NO: 1577730 - protein, 23 aa, Staphylococcus aureus
QELNGDERLRVAKQNANTAIDAL

SEQ ID NO: 1577731 - protein, 26 aa, Staphylococcus aureus
QITTPYIVVVNGHIDPASTGDLALRS

SEQ ID NO: 1577732 - protein, 19 aa, Staphylococcus aureus
QKERITIYMKYNVKGYKNI

SEQ ID NO: 1577733 - protein, 19 aa, Staphylococcus aureus
QPEIRRALEQLGRGSFLKR

SEQ ID NO: 1577734 - protein, 21 aa, Staphylococcus aureus
QSHLDSGFMFFFIVYVLYISY

SEQ ID NO: 1577735 - protein, 30 aa, Staphylococcus aureus
RFDNLDSGKYKVIFEKPAGLTQTGTNTTED

SEQ ID NO: 1577736 - protein, 25 aa, Staphylococcus aureus
RLNNRKAEALQRLDQLTHLNNAQRQ

SEQ ID NO: 1577737 - protein, 23 aa, Staphylococcus aureus
SAMKRNSWLDITLMIIALIGLSI

SEQ ID NO: 1577738 - protein, 26 aa, Staphylococcus aureus
SANAIIQKPIRTVQEVQSALTNVNRV

SEQ ID NO: 1577739 - protein, 17 aa, Staphylococcus aureus
SEGFIRKYASVVNIEPN

SEQ ID NO: 1577740 - protein, 27 aa, Staphylococcus aureus
SEGQKIFNYALAYGIIFLMFFIVLNYA

SEQ ID NO: 1577741 - protein, 26 aa, Staphylococcus aureus
SKPSVRTRAVRSLAVAEPVVNAADAK

SEQ ID NO: 1577742 - protein, 31 aa, Staphylococcus aureus
SKTVLIDYEKYGQFHNLSIKGTIDQIDKTNN

SEQ ID NO: 1577743 - protein, 21 aa, Staphylococcus aureus
SLLTICVIFLVRMLYIKYTQN

SEQ ID NO: 1577744 - protein, 17 aa, Staphylococcus aureus
SMNQAFNSDITFKVSAT

SEQ ID NO: 1577745 - protein, 18 aa, Staphylococcus aureus
SVCLLIFICIWTFILSLL

SEQ ID NO: 1577746 - protein, 27 aa, Staphylococcus aureus
TAVRHIYEISSLIYKVTMKIKIKAMGI

SEQ ID NO: 1577747 - protein, 23 aa, Staphylococcus aureus
TIYDRIEPALKIIVSAFSKVVTW

SEQ ID NO: 1577748 - protein, 17 aa, Staphylococcus aureus
TKISVLFAVAFFIINYI

SEQ ID NO: 1577749 - protein, 31 aa, Staphylococcus aureus
TLDSGFYKTPKYSLGDYVWYDSNKDGKQDST

SEQ ID NO: 1577750 - protein, 18 aa, Staphylococcus aureus
TNGLKKAYAYIIKANDNF

SEQ ID NO: 1577751 - protein, 27 aa, Staphylococcus aureus
TNIKIYRVPEGYTLNKGYDVNTNDLVD

SEQ ID NO: 1577752 - protein, 19 aa, Staphylococcus aureus
TREFLLKKWEVTSSVADGT

SEQ ID NO: 1577753 - protein, 18 aa, Staphylococcus aureus
TTPLVFGMTLLIVTVIPF

SEQ ID NO: 1577754 - protein, 29 aa, Staphylococcus aureus
TVNGQENLYRIAIQYYGSGSPENVEKIRR

SEQ ID NO: 1577755 - protein, 24 aa, Staphylococcus aureus
TWIAKRVGLTWQDLEKGIAERLNT

SEQ ID NO: 1577756 - protein, 18 aa, Staphylococcus aureus
VERFFKLVFFIFSVSFIF

SEQ ID NO: 1577757 - protein, 18 aa, Staphylococcus aureus
VIFLGEWSSMTQIIFGLI

SEQ ID NO: 1577758 - protein, 30 aa, Staphylococcus aureus
VKGDTFKITVPKELNLNGVTSTAKVPPIMA

SEQ ID NO: 1577759 - protein, 21 aa, Staphylococcus aureus
VKVKKGDFVIVYKLADSDKIV

SEQ ID NO: 1577760 - protein, 17 aa, Staphylococcus aureus
VLLNHWNFWILAIGFII

SEQ ID NO: 1577761 - protein, 20 aa, Staphylococcus aureus
VNATELKAGQNIRVENGETI

SEQ ID NO: 1577762 - protein, 17 aa, Staphylococcus aureus
VNHKRYSTVASMLNQYK

SEQ ID NO: 1577763 - protein, 25 aa, Staphylococcus aureus
VQYMAKRRIGALIVFEKETGLQDYI

SEQ ID NO: 1577764 - protein, 18 aa, Staphylococcus aureus
VREVLRPYKVPMLTMPFV

SEQ ID NO: 1577765 - protein, 19 aa, Staphylococcus aureus
WMRTDLKGSEFTFTPEAPK

SEQ ID NO: 1577766 - protein, 19 aa, Staphylococcus aureus
WNWTWGVTVAIILGIGFYA

SEQ ID NO: 1577767 - protein, 17 aa, Staphylococcus aureus
WQGLLFILAFSLKLDIL

SEQ ID NO: 1577768 - protein, 18 aa, Staphylococcus aureus
WQTNFIISIVIAFIAILL

SEQ ID NO: 1577769 - protein, 25 aa, Staphylococcus aureus
WVFGSLLCLFYMIKAFRQIDVIKSS

SEQ ID NO: 1577770 - protein, 18 aa, Staphylococcus aureus
WYFITFGAFVAFGIFLPN

SEQ ID NO: 1577771 - protein, 25 aa, Staphylococcus aureus
YDSDKDYAYIRFPVSNGAREVKIVS

SEQ ID NO: 1577772 - protein, 24 aa, Staphylococcus aureus
YDYYPTMFYKRGKKTFVIHIKKDG

SEQ ID NO: 1577773 - protein, 25 aa, Staphylococcus aureus
YFAIKCLWVKPKVVNYLIAKELGES

SEQ ID NO: 1577774 - protein, 33 aa, Staphylococcus aureus
YIILSACMTFLFVIVGLCIKLANSFIEPDSQNA

SEQ ID NO: 1577775 - protein, 23 aa, Staphylococcus aureus
YITNSWLKPLHMTHTSFKQTNYK

SEQ ID NO: 1577776 - protein, 19 aa, Staphylococcus aureus
YKDIEAIRHSDIFTAVMMI

SEQ ID NO: 1577777 - protein, 19 aa, Staphylococcus aureus
YSKAFAVLYVWLVNLGEAR

SEQ ID NO: 1577778 - protein, 19 aa, Staphylococcus aureus
AKALDQAMQALRNSIQDQQ

SEQ ID NO: 1577779 - protein, 19 aa, Staphylococcus aureus
AKINSFWPVAGSTVLFGVM

SEQ ID NO: 1577780 - protein, 17 aa, Staphylococcus aureus
ALFILKTIDSHGITDQF

SEQ ID NO: 1577781 - protein, 23 aa, Staphylococcus aureus
ANEIPKAKIDANKDVDKQVQALI

SEQ ID NO: 1577782 - protein, 21 aa, Staphylococcus aureus
AQHMNFQFVGTYGPNKDVVGI

SEQ ID NO: 1577783 - protein, 20 aa, Staphylococcus aureus
ARYPGRFNININVEDKYRDV

SEQ ID NO: 1577784 - protein, 18 aa, Staphylococcus aureus
ASSKDVQILKSWYLRGEN

SEQ ID NO: 1577785 - protein, 26 aa, Staphylococcus aureus
AYLIELIRWLFTFGLLFQLPILFMGL

SEQ ID NO: 1577786 - protein, 21 aa, Staphylococcus aureus
CENTYDLAPRGTFDNWFNMYL

SEQ ID NO: 1577787 - protein, 24 aa, Staphylococcus aureus
DKKDVPFSVTIGNQITTTTADITY

SEQ ID NO: 1577788 - protein, 24 aa, Staphylococcus aureus
DKTAYKMEVTLGNDTYSKDVIVDY

SEQ ID NO: 1577789 - protein, 18 aa, Staphylococcus aureus
DLTEEFGIEFDDSEDIDT

SEQ ID NO: 1577790 - protein, 22 aa, Staphylococcus aureus
DPLHMRHFGDRIGNVIKNALGV

SEQ ID NO: 1577791 - protein, 18 aa, Staphylococcus aureus
DRLGQSFSNWANSAAGEN

SEQ ID NO: 1577792 - protein, 19 aa, Staphylococcus aureus
EAGATPATKAFGRQNFEYI

SEQ ID NO: 1577793 - protein, 30 aa, Staphylococcus aureus
ENINGQFSLPLFTDRAKAPKSGTYDANINI

SEQ ID NO: 1577794 - protein, 24 aa, Staphylococcus aureus
ENVTANITMPAYIDPENVTKTGNV

SEQ ID NO: 1577795 - protein, 25 aa, Staphylococcus aureus
ESNSMHPSDSMSMHHTHSTSTSRSS

SEQ ID NO: 1577796 - protein, 27 aa, Staphylococcus aureus
ETNYDYTKLVFAKPIYNDPSLVKSDTN

SEQ ID NO: 1577797 - protein, 23 aa, Staphylococcus aureus
FAYFKPHLLYLLIGTAIIFVICK

SEQ ID NO: 1577798 - protein, 23 aa, Staphylococcus aureus
FCNFFINIGIFISMQFKGGLTKA

SEQ ID NO: 1577799 - protein, 29 aa, Staphylococcus aureus
FDIFIAGILRLFGVIALMLVVISPIYTVA

SEQ ID NO: 1577800 - protein, 28 aa, Staphylococcus aureus
FDNLDSGKYKVIFEKPAGLTQTGTNTTE

SEQ ID NO: 1577801 - protein, 18 aa, Staphylococcus aureus
FFTIYMLLTIEVQNIILF

SEQ ID NO: 1577802 - protein, 17 aa, Staphylococcus aureus
FISNIWNTIWSFLSGIL

SEQ ID NO: 1577803 - protein, 24 aa, Staphylococcus aureus
FKDIFDKRFLIFFLSAVVLHGIWD

SEQ ID NO: 1577804 - protein, 32 aa, Staphylococcus aureus
FKGINLTSSRFIKWLNDMNVIPGYYGVNSIDL

SEQ ID NO: 1577805 - protein, 18 aa, Staphylococcus aureus
FLIVKLKYKTPGREDKQS

SEQ ID NO: 1577806 - protein, 17 aa, Staphylococcus aureus
FMGGGLIGRIIALVSKF

SEQ ID NO: 1577807 - protein, 17 aa, Staphylococcus aureus
FNTIQMISAFSFFIYLF

SEQ ID NO: 1577808 - protein, 21 aa, Staphylococcus aureus
FPYVPDKAIYNAIVKVVVANI

SEQ ID NO: 1577809 - protein, 32 aa, Staphylococcus aureus
FTYLLIGNFLRRSCFVLFSLQIIWFTVELTNQ

SEQ ID NO: 1577810 - protein, 21 aa, Staphylococcus aureus
GDSLIPYALVFIGLIIFISVV

SEQ ID NO: 1577811 - protein, 25 aa, Staphylococcus aureus
GFTLRKIIFENFSKKCTYWVTLIIT

SEQ ID NO: 1577812 - protein, 19 aa, Staphylococcus aureus
GFVAEFSFNYIFLANLIMY

SEQ ID NO: 1577813 - protein, 20 aa, Staphylococcus aureus
GGLIGRIIALVSKFGLLRAG

SEQ ID NO: 1577814 - protein, 47 aa, Staphylococcus aureus
GHIDPASTGDLALRSTFYGYDSNFIWRSMSWDNEVAFNNGSGSGDGI

SEQ ID NO: 1577815 - protein, 18 aa, Staphylococcus aureus
GKASFTMGLFGITEGAIP

SEQ ID NO: 1577816 - protein, 24 aa, Staphylococcus aureus
GTKPKIMAAIVLWLFGSIASILGL

SEQ ID NO: 1577817 - protein, 18 aa, Staphylococcus aureus
GTLFGGLFAALGSLLLFG

SEQ ID NO: 1577818 - protein, 17 aa, Staphylococcus aureus
GTTVFGGLSLALGAALL

SEQ ID NO: 1577819 - protein, 19 aa, Staphylococcus aureus
HILEPKLSITTQIIIVLIL

SEQ ID NO: 1577820 - protein, 17 aa, Staphylococcus aureus
HNYQFGGAMIESEKLSE

SEQ ID NO: 1577821 - protein, 17 aa, Staphylococcus aureus
IAIILVVWTFHFPEEET

SEQ ID NO: 1577822 - protein, 19 aa, Staphylococcus aureus
IALVSKFGLLRAGLTILKG

SEQ ID NO: 1577823 - protein, 17 aa, Staphylococcus aureus
IASNFGWQTNFIISIVI

SEQ ID NO: 1577824 - protein, 18 aa, Staphylococcus aureus
IDHMMIAVGVIKQMNIVV

SEQ ID NO: 1577825 - protein, 23 aa, Staphylococcus aureus
IDSDGNVIYTFTDYVDNKENVTA

SEQ ID NO: 1577826 - protein, 19 aa, Staphylococcus aureus
IEVIWPKTGLIYFGMADIG

SEQ ID NO: 1577827 - protein, 21 aa, Staphylococcus aureus
IEVIWPKTGLIYFVMADIGGA

SEQ ID NO: 1577828 - protein, 24 aa, Staphylococcus aureus
IGIIAILIGFVWFKLYQYTTNPKA

SEQ ID NO: 1577829 - protein, 29 aa, Staphylococcus aureus
IGQRGDEFILYKFGDESMRVYNTEFEMQQ

SEQ ID NO: 1577830 - protein, 40 aa, Staphylococcus aureus
IGVKLKLAKVIIILCVVAFFTFPVIVMFLLAPDSNKDKDD

SEQ ID NO: 1577831 - protein, 22 aa, Staphylococcus aureus
IIIPTMFLYYFYGSRAVLIPTF

SEQ ID NO: 1577832 - protein, 25 aa, Staphylococcus aureus
ILLLQRFTTGFIKSIAILIGLVLGT

SEQ ID NO: 1577833 - protein, 19 aa, Staphylococcus aureus
ILLQICSLYYHGRRFNEVI

SEQ ID NO: 1577834 - protein, 35 aa, Staphylococcus aureus
IMFVVEVGMLLTLILICFPDIFGTSYLSRGYLITI

SEQ ID NO: 1577835 - protein, 17 aa, Staphylococcus aureus
IPKELTEHYLSKGYSRN

SEQ ID NO: 1577836 - protein, 17 aa, Staphylococcus aureus
ISLPAFFIGIILLFIVT

SEQ ID NO: 1577837 - protein, 26 aa, Staphylococcus aureus
ITLVGAFRFLIPIILAVSNFMGGGLI

SEQ ID NO: 1577838 - protein, 45 aa, Staphylococcus aureus
IVILIIFALLFRFIVKLIPIFYIFRVLSIFIFIMGFKMLGVSIQK

SEQ ID NO: 1577839 - protein, 24 aa, Staphylococcus aureus
IVKVVVANIGYEGQYHVRIINQDI

SEQ ID NO: 1577840 - protein, 21 aa, Staphylococcus aureus
IYKVTMKIKIKAMGINVDEID

SEQ ID NO: 1577841 - protein, 17 aa, Staphylococcus aureus
KASFTMGLFGITEGAIP

SEQ ID NO: 1577842 - protein, 18 aa, Staphylococcus aureus
KATLLAVIASLLSFIIVA

SEQ ID NO: 1577843 - protein, 27 aa, Staphylococcus aureus
KDFLTQWKLYILSAVVLIMVLIGFIFW

SEQ ID NO: 1577844 - protein, 24 aa, Staphylococcus aureus
KDVVGISTRLIRVTYDNRQTEDLT

SEQ ID NO: 1577845 - protein, 17 aa, Staphylococcus aureus
KELTEHYLSKGYSRNDR

SEQ ID NO: 1577846 - protein, 25 aa, Staphylococcus aureus
KFGLLRAGLTILKGAFMLLKGPLKI

SEQ ID NO: 1577847 - protein, 20 aa, Staphylococcus aureus
KGELLPIIFFAVFFGLGLAA

SEQ ID NO: 1577848 - protein, 19 aa, Staphylococcus aureus
KILSGFASDSKWKIMLSIL

SEQ ID NO: 1577849 - protein, 18 aa, Staphylococcus aureus
KIVVLPIIIYAIVFVIIG

SEQ ID NO: 1577850 - protein, 22 aa, Staphylococcus aureus
KKKRSLVSMIIQIIVVILTAIA

SEQ ID NO: 1577851 - protein, 25 aa, Staphylococcus aureus
KKQLLLRKIHGYSLFSSNVRYLTIS

SEQ ID NO: 1577852 - protein, 17 aa, Staphylococcus aureus
KLPEKYKAEYKKKLDQT

SEQ ID NO: 1577853 - protein, 23 aa, Staphylococcus aureus
KLVIKRNGNVVTTFTRRNNTSPW

SEQ ID NO: 1577854 - protein, 25 aa, Staphylococcus aureus
KNIRDMKMWILGLIGTIFSTIVIAL

SEQ ID NO: 1577855 - protein, 23 aa, Staphylococcus aureus
KQAIAGLTPDLAPLQTAKTQLQN

SEQ ID NO: 1577856 - protein, 19 aa, Staphylococcus aureus
KSQISRTTFYTHYKTKDDF

SEQ ID NO: 1577857 - protein, 20 aa, Staphylococcus aureus
KTIYYWIRYLNFDIVNREKD

SEQ ID NO: 1577858 - protein, 37 aa, Staphylococcus aureus
KTTGNTEFWATSSDVLKLKANYTIDDSVKEGDTFTFK

SEQ ID NO: 1577859 - protein, 25 aa, Staphylococcus aureus
KVEEIPFKKERKFNPDLAPGTEKVT

SEQ ID NO: 1577860 - protein, 26 aa, Staphylococcus aureus
KWVPRTGSWRAAFKRAGDYAYATGGK

SEQ ID NO: 1577861 - protein, 26 aa, Staphylococcus aureus
KYIDFMFAGVLAFIFLVYRIYILFID

SEQ ID NO: 1577862 - protein, 25 aa, Staphylococcus aureus
LEDLSRASDYFSEAGATPATKAFGR

SEQ ID NO: 1577863 - protein, 20 aa, Staphylococcus aureus
LEFILSVAVYVIFYFIWLRF

SEQ ID NO: 1577864 - protein, 17 aa, Staphylococcus aureus
LFFSIVLYFSFTTLQFT

SEQ ID NO: 1577865 - protein, 23 aa, Staphylococcus aureus
LIIGFKLNKFISLIITSMITALM

SEQ ID NO: 1577866 - protein, 17 aa, Staphylococcus aureus
LITAKNHLDDPVSTEGK

SEQ ID NO: 1577867 - protein, 25 aa, Staphylococcus aureus
LNGTLPRFSIGTMWKDIKSGASSAF

SEQ ID NO: 1577868 - protein, 17 aa, Staphylococcus aureus
LPIFLYAVIKFFFSAKR

SEQ ID NO: 1577869 - protein, 25 aa, Staphylococcus aureus
LPNGGIKAKSSISMNNVTYTTQDEH

SEQ ID NO: 1577870 - protein, 20 aa, Staphylococcus aureus
LSESYYVNPSDFEDVTNQVR

SEQ ID NO: 1577871 - protein, 26 aa, Staphylococcus aureus
LTDVKVTIDSGTTVYPHQAGYVKLNY

SEQ ID NO: 1577872 - protein, 18 aa, Staphylococcus aureus
LTSIGFRLSYTHLLINIA

SEQ ID NO: 1577873 - protein, 24 aa, Staphylococcus aureus
MCPTEIINIVSFFVLLFIVNTIVL

SEQ ID NO: 1577874 - protein, 25 aa, Staphylococcus aureus
MILFSCLTFFFGLDYERFPNYLKIT

SEQ ID NO: 1577875 - protein, 18 aa, Staphylococcus aureus
MKQAGGYAYLALAVLSTL

SEQ ID NO: 1577876 - protein, 23 aa, Staphylococcus aureus
MLNLEVLKFPTFTLTTIINMVVM

SEQ ID NO: 1577877 - protein, 30 aa, Staphylococcus aureus
MTLDSGFYKTPKYNLGNYVWEDTNKDGKQD

SEQ ID NO: 1577878 - protein, 17 aa, Staphylococcus aureus
MYSEKIVVLPIIIYAIV

SEQ ID NO: 1577879 - protein, 17 aa, Staphylococcus aureus
NAGQSVTYYFTDVKAPT

SEQ ID NO: 1577880 - protein, 22 aa, Staphylococcus aureus
NAYKQAVAKAEALLNKQSGTNE

SEQ ID NO: 1577881 - protein, 19 aa, Staphylococcus aureus
NFLPLIILALIYFIHKIIH

SEQ ID NO: 1577882 - protein, 29 aa, Staphylococcus aureus
NGTLPRFHFGTTMWKDIKSSASSAFNWTK

SEQ ID NO: 1577883 - protein, 24 aa, Staphylococcus aureus
NLKVREIKGLITAKILRAQEMNIP

SEQ ID NO: 1577884 - protein, 22 aa, Staphylococcus aureus
NLYNAQGNIIAKGIYDSKTNTT

SEQ ID NO: 1577885 - protein, 18 aa, Staphylococcus aureus
NMNARWIPTVEKIMKDLG

SEQ ID NO: 1577886 - protein, 18 aa, Staphylococcus aureus
NNGIARILAVQIVTSDHS

SEQ ID NO: 1577887 - protein, 27 aa, Staphylococcus aureus
NQLRNIGYFHGFKGYNFFLNKEEELNF

SEQ ID NO: 1577888 - protein, 22 aa, Staphylococcus aureus
NVPEYVKGAFISMEDERFYNHH

SEQ ID NO: 1577889 - protein, 25 aa, Staphylococcus aureus
PATKAFGRQNFEYINGQKPAESPGV

SEQ ID NO: 1577890 - protein, 18 aa, Staphylococcus aureus
PFHEGVDFPFVYQEVRTP

SEQ ID NO: 1577891 - protein, 17 aa, Staphylococcus aureus
PKLSITTQIIIVLILIE

SEQ ID NO: 1577892 - protein, 24 aa, Staphylococcus aureus
PYYPYYPVQLTWNNGVAFYSNNAK

SEQ ID NO: 1577893 - protein, 24 aa, Staphylococcus aureus
QALNEAMKALKESIKDQPQTEASS

SEQ ID NO: 1577894 - protein, 29 aa, Staphylococcus aureus
QAVNPSTPRMRAFSLAAVAADAPAAGTDI

SEQ ID NO: 1577895 - protein, 19 aa, Staphylococcus aureus
QKVIFPFIIASGFIADTTS

SEQ ID NO: 1577896 - protein, 38 aa, Staphylococcus aureus
QSISKKITGYGLKTTAVIGGAFTVNMLHDQQAFAASDA

SEQ ID NO: 1577897 - protein, 17 aa, Staphylococcus aureus
QTEDLTILSKVKPDPPR

SEQ ID NO: 1577898 - protein, 43 aa, Staphylococcus aureus
RNIELVGNLLPGDYFGTIRFGRKEQLFEIRVKPHTPTITTTAE

SEQ ID NO: 1577899 - protein, 19 aa, Staphylococcus aureus
RTLIFPYVPDKAIYNAIVK

SEQ ID NO: 1577900 - protein, 25 aa, Staphylococcus aureus
RYGKTYKGIMPNWEPGKKVHLVGHS

SEQ ID NO: 1577901 - protein, 25 aa, Staphylococcus aureus
SAYEVLSALILGWSLLVSWNQMVAF

SEQ ID NO: 1577902 - protein, 22 aa, Staphylococcus aureus
SDADAALTHFIETWPYVEGQIQ

SEQ ID NO: 1577903 - protein, 22 aa, Staphylococcus aureus
SESQSASAFLSESLSESTSEST

SEQ ID NO: 1577904 - protein, 24 aa, Staphylococcus aureus
SHFSVPKFNDWIFIVFIISVYYIF

SEQ ID NO: 1577905 - protein, 22 aa, Staphylococcus aureus
SIGEVIGGLALIIGFLTPYVNV

SEQ ID NO: 1577906 - protein, 17 aa, Staphylococcus aureus
SKEPLPDTGSEDEANTS

SEQ ID NO: 1577907 - protein, 19 aa, Staphylococcus aureus
SKVMMPLLFVFLIVIVIKS

SEQ ID NO: 1577908 - protein, 21 aa, Staphylococcus aureus
SPFWFIFLFFFYKKYKTNAEK

SEQ ID NO: 1577909 - protein, 22 aa, Staphylococcus aureus
SPYLPFTYAIDSLRETVGGIVP

SEQ ID NO: 1577910 - protein, 20 aa, Staphylococcus aureus
SRYMPLKVIIDYFKLHMEGR

SEQ ID NO: 1577911 - protein, 17 aa, Staphylococcus aureus
STNAQHMNFQFVGTYGP

SEQ ID NO: 1577912 - protein, 20 aa, Staphylococcus aureus
STSMSLSMSQSISGSTSVST

SEQ ID NO: 1577913 - protein, 26 aa, Staphylococcus aureus
SVFSGLVPYWAVFKIILMMINNTYTI

SEQ ID NO: 1577914 - protein, 18 aa, Staphylococcus aureus
SVVPVVFALLNAIKVLTG

SEQ ID NO: 1577915 - protein, 17 aa, Staphylococcus aureus
SWFYLPITYATRYVYMF

SEQ ID NO: 1577916 - protein, 21 aa, Staphylococcus aureus
TALQAAWSFISNIWNTIWSFL

SEQ ID NO: 1577917 - protein, 18 aa, Staphylococcus aureus
TGMMFNALLAIVAFLVIL

SEQ ID NO: 1577918 - protein, 20 aa, Staphylococcus aureus
TNNTYRQTIYVNPSGDNVVL

SEQ ID NO: 1577919 - protein, 44 aa, Staphylococcus aureus
TPITKTATYKVVRTVPKHVFETARGVLYPGVSDMYDAKQYVKPV

SEQ ID NO: 1577920 - protein, 17 aa, Staphylococcus aureus
TQLKQGIADKEQTKADG

SEQ ID NO: 1577921 - protein, 20 aa, Staphylococcus aureus
TRDVKIVSSIEYGENIHEDY

SEQ ID NO: 1577922 - protein, 23 aa, Staphylococcus aureus
TTGADGWGFLFSKGNAEEYLTNG

SEQ ID NO: 1577923 - protein, 26 aa, Staphylococcus aureus
TTTIKPRTLNRMAVNTVAAPQQGTNV

SEQ ID NO: 1577924 - protein, 26 aa, Staphylococcus aureus
TTTIKQRALNRMAVNTVAAPQQGTNV

SEQ ID NO: 1577925 - protein, 17 aa, Staphylococcus aureus
TVSDALPNGGIKAKSSI

SEQ ID NO: 1577926 - protein, 20 aa, Staphylococcus aureus
TYTKETFVTNLTGYKFNPDA

SEQ ID NO: 1577927 - protein, 27 aa, Staphylococcus aureus
VDRFNSVKMGINYSIYMDADTIPVDKK

SEQ ID NO: 1577928 - protein, 23 aa, Staphylococcus aureus
VIGGVCILIGILIASRKATLLAV

SEQ ID NO: 1577929 - protein, 18 aa, Staphylococcus aureus
VILVPTFKDGSFIVFTYL

SEQ ID NO: 1577930 - protein, 20 aa, Staphylococcus aureus
VLGDHSWFYLPITYATRYVY

SEQ ID NO: 1577931 - protein, 17 aa, Staphylococcus aureus
VSQAVNPSTPRMRAFSL

SEQ ID NO: 1577932 - protein, 21 aa, Staphylococcus aureus
VTATGLLMIYAFNPPASWLNH

SEQ ID NO: 1577933 - protein, 17 aa, Staphylococcus aureus
VTIFAILFVVSLVSDLL

SEQ ID NO: 1577934 - protein, 17 aa, Staphylococcus aureus
VTTGKDIIPPKTYSGNV

SEQ ID NO: 1577935 - protein, 24 aa, Staphylococcus aureus
VYKKDRLDVAFSNFFTYAHLSELR

SEQ ID NO: 1577936 - protein, 18 aa, Staphylococcus aureus
WFPVMASAFLIFTIIIMF

SEQ ID NO: 1577937 - protein, 24 aa, Staphylococcus aureus
WFSTFSIICLSIFIITTLIFIIIE

SEQ ID NO: 1577938 - protein, 20 aa, Staphylococcus aureus
WNNENVVRYGGGSADGDSAV

SEQ ID NO: 1577939 - protein, 18 aa, Staphylococcus aureus
YDFWWLFFPVAGFLVWAI

SEQ ID NO: 1577940 - protein, 24 aa, Staphylococcus aureus
YDIPLSKWRRKIGYVMQSNSMMSG

SEQ ID NO: 1577941 - protein, 21 aa, Staphylococcus aureus
YERGKVLSIIMMDRGMIPLGS

SEQ ID NO: 1577942 - protein, 18 aa, Staphylococcus aureus
YGLFSSIMGMGFIAAFLS

SEQ ID NO: 1577943 - protein, 18 aa, Staphylococcus aureus
YHDYRFIDRENADSGTFN

SEQ ID NO: 1577944 - protein, 19 aa, Staphylococcus aureus
YKKVAVLFFECLVFIILSI

SEQ ID NO: 1577945 - protein, 30 aa, Staphylococcus aureus
YKVDNAADLSESYFVNPENFEDVTNSVNIT

SEQ ID NO: 1577946 - protein, 24 aa, Staphylococcus aureus
YPLGKATSHLLGYVGPINSEELKQ

SEQ ID NO: 1577947 - protein, 17 aa, Staphylococcus aureus
YRIFTFDARDSRHLSFI

SEQ ID NO: 1577948 - protein, 26 aa, Staphylococcus aureus
YSAVFDYWWMFGISFLFFALASLLTF

SEQ ID NO: 1577949 - protein, 26 aa, Staphylococcus aureus
YSGLEKILFCIATIMVSWLWFFLLAI

SEQ ID NO: 1577950 - protein, 17 aa, Staphylococcus aureus
YSKDVIVDYGNQKGQQL

SEQ ID NO: 1577951 - protein, 17 aa, Staphylococcus aureus
AAVAADAPAAGTDITNQ

SEQ ID NO: 1577952 - protein, 19 aa, Staphylococcus aureus
AAYYITRSKFQNILLMIMI

SEQ ID NO: 1577953 - protein, 30 aa, Staphylococcus aureus
ADEMFNNKITYNYSSPIAGIDKPNGANISS

SEQ ID NO: 1577954 - protein, 22 aa, Staphylococcus aureus
AGTQLYHIVASNAYHKDTEDFY

SEQ ID NO: 1577955 - protein, 20 aa, Staphylococcus aureus
AHKDGLKKIVLDLRNNPGGL

SEQ ID NO: 1577956 - protein, 19 aa, Staphylococcus aureus
AKNAIKALANAKRDQINSN

SEQ ID NO: 1577957 - protein, 19 aa, Staphylococcus aureus
ALTAKGYNYTSVDSSYAST

SEQ ID NO: 1577958 - protein, 26 aa, Staphylococcus aureus
AMEMRRYLMRFVHHISGLADFSALKF

SEQ ID NO: 1577959 - protein, 21 aa, Staphylococcus aureus
AMKRNSWLDITLMIIALIGLS

SEQ ID NO: 1577960 - protein, 19 aa, Staphylococcus aureus
APDRIRLSLPKGKYRVNLK

SEQ ID NO: 1577961 - protein, 22 aa, Staphylococcus aureus
AVLVVGCPCALVISTPISIVSA

SEQ ID NO: 1577962 - protein, 30 aa, Staphylococcus aureus
CLGIILMLFISWLGLFLFYKNEFDSENPNP

SEQ ID NO: 1577963 - protein, 18 aa, Staphylococcus aureus
CLISLTFLPEIFYVICCI

SEQ ID NO: 1577964 - protein, 17 aa, Staphylococcus aureus
DGLYWRIGACIIGAIFV

SEQ ID NO: 1577965 - protein, 27 aa, Staphylococcus aureus
DKYEDIKARLTLYSYIDKQAVPNETSL

SEQ ID NO: 1577966 - protein, 25 aa, Staphylococcus aureus
DLFILRIVLLSCLFILTISVINLWT

SEQ ID NO: 1577967 - protein, 23 aa, Staphylococcus aureus
DRIKTRPLYLAAMGTFLVGSIVA

SEQ ID NO: 1577968 - protein, 17 aa, Staphylococcus aureus
DVFNYCLGIILMLFISW

SEQ ID NO: 1577969 - protein, 24 aa, Staphylococcus aureus
EDYRESLNLPDIVANGALPIGLDY

SEQ ID NO: 1577970 - protein, 29 aa, Staphylococcus aureus
EEIVFRGMIIRVIFRKHLFLGLIVSSLVF

SEQ ID NO: 1577971 - protein, 22 aa, Staphylococcus aureus
EIANFSGLLGRVLTEMRLVKIS

SEQ ID NO: 1577972 - protein, 25 aa, Staphylococcus aureus
EIFYVICCIIGYLFFGLGLGIYATP

SEQ ID NO: 1577973 - protein, 25 aa, Staphylococcus aureus
EIIDFNMFINKIINRHEMSAKDTTF

SEQ ID NO: 1577974 - protein, 25 aa, Staphylococcus aureus
ENVTANITMPAYIDPENVTKTGNVT

SEQ ID NO: 1577975 - protein, 25 aa, Staphylococcus aureus
EVIQWFYKEVDWFEAKLKDETNNTG

SEQ ID NO: 1577976 - protein, 19 aa, Staphylococcus aureus
FALFVAFLFSFDRKKIDFK

SEQ ID NO: 1577977 - protein, 18 aa, Staphylococcus aureus
FEHIKGKVLGVFNFVRYI

SEQ ID NO: 1577978 - protein, 17 aa, Staphylococcus aureus
FILGYSISSIRIYMNTA

SEQ ID NO: 1577979 - protein, 20 aa, Staphylococcus aureus
FINKNDCRIFSFDARDSRHL

SEQ ID NO: 1577980 - protein, 32 aa, Staphylococcus aureus
FKGIDLTSSRFIKWLNDMNIIPGYYGVNSINL

SEQ ID NO: 1577981 - protein, 19 aa, Staphylococcus aureus
FLFFKLKYYAIVTILVTMI

SEQ ID NO: 1577982 - protein, 17 aa, Staphylococcus aureus
FLLMYGLDYLYDTFAPP

SEQ ID NO: 1577983 - protein, 24 aa, Staphylococcus aureus
FLLYANVVYFRFFSDFLTFSTLNQ

SEQ ID NO: 1577984 - protein, 25 aa, Staphylococcus aureus
FQYKIFPVLMFLVSTGLGIIVITQN

SEQ ID NO: 1577985 - protein, 24 aa, Staphylococcus aureus
FSFMPLKHLWSLAIEEQFYIFFPV

SEQ ID NO: 1577986 - protein, 24 aa, Staphylococcus aureus
FSTAGNLGWSHPMVNITIIAAIVI

SEQ ID NO: 1577987 - protein, 17 aa, Staphylococcus aureus
FTDKDWQITGIPRTLHI

SEQ ID NO: 1577988 - protein, 22 aa, Staphylococcus aureus
FTTKYLKMFAYSILYAASITII

SEQ ID NO: 1577989 - protein, 17 aa, Staphylococcus aureus
FVCRKFKPKNIFRLEAS

SEQ ID NO: 1577990 - protein, 19 aa, Staphylococcus aureus
FVKHYKRTLLLSLILTVLS

SEQ ID NO: 1577991 - protein, 26 aa, Staphylococcus aureus
GAGANKPLQQMWEYGVNDPDRSHDFK

SEQ ID NO: 1577992 - protein, 17 aa, Staphylococcus aureus
GDFIFKYTDWSITKATI

SEQ ID NO: 1577993 - protein, 20 aa, Staphylococcus aureus
GEPFKMFGIPIFIMAIILFT

SEQ ID NO: 1577994 - protein, 17 aa, Staphylococcus aureus
GGGMIIPAIYAMAGAVW

SEQ ID NO: 1577995 - protein, 23 aa, Staphylococcus aureus
GGIPRDFIDYLFIDEAGQAIPQA

SEQ ID NO: 1577996 - protein, 28 aa, Staphylococcus aureus
GIHFSETLARLGIVLGVFLTSLQMGLYI

SEQ ID NO: 1577997 - protein, 17 aa, Staphylococcus aureus
GITAAWANRQQPNNQQA

SEQ ID NO: 1577998 - protein, 17 aa, Staphylococcus aureus
GIVPALLSTIISKRFEH

SEQ ID NO: 1577999 - protein, 21 aa, Staphylococcus aureus
GKDIIPPKTYSGNVDQVVTID

SEQ ID NO: 1578000 - protein, 18 aa, Staphylococcus aureus
GLFPKRFAKENKNGAPVN

SEQ ID NO: 1578001 - protein, 19 aa, Staphylococcus aureus
GNRIVAFIIATTVSSLIFA

SEQ ID NO: 1578002 - protein, 17 aa, Staphylococcus aureus
GNYFLTLLSAFLITIIL

SEQ ID NO: 1578003 - protein, 28 aa, Staphylococcus aureus
GQRGDEFILYKFGDESMRVYNTEFEMQQ

SEQ ID NO: 1578004 - protein, 27 aa, Staphylococcus aureus
GSIEGTKHLPLLFAKRRRKEDEEDAIV

SEQ ID NO: 1578005 - protein, 20 aa, Staphylococcus aureus
GSNLDKAAVENALSQVTNAK

SEQ ID NO: 1578006 - protein, 19 aa, Staphylococcus aureus
GYIKEIKPLSIISVGFLLL

SEQ ID NO: 1578007 - protein, 24 aa, Staphylococcus aureus
HKDTEDFYISLKIVDVKQPEGDQR

SEQ ID NO: 1578008 - protein, 25 aa, Staphylococcus aureus
HNAEAPKVRKARSVDEGSFDITRDS

SEQ ID NO: 1578009 - protein, 19 aa, Staphylococcus aureus
HVWQLFRSSLAYLLPNGQL

SEQ ID NO: 1578010 - protein, 18 aa, Staphylococcus aureus
IARMILKDAPIIVLDEAT

SEQ ID NO: 1578011 - protein, 41 aa, Staphylococcus aureus
IATTFHASMTFGLIFLFSEEIGDLFSIKVIAISTAIVAVGY

SEQ ID NO: 1578012 - protein, 39 aa, Staphylococcus aureus
IAVCGLSLVGIDFLAVMGFASAISVVFAVLSALTLLPAL

SEQ ID NO: 1578013 - protein, 18 aa, Staphylococcus aureus
IFIGLSIFINIIVDALLV

SEQ ID NO: 1578014 - protein, 22 aa, Staphylococcus aureus
IGGVCILIGILIASRKAALLAV

SEQ ID NO: 1578015 - protein, 18 aa, Staphylococcus aureus
IIGIFTLWYYWRKRKHNI

SEQ ID NO: 1578016 - protein, 18 aa, Staphylococcus aureus
ILHFKRSANMIATILYGM

SEQ ID NO: 1578017 - protein, 20 aa, Staphylococcus aureus
IPDATITWVSGQAPNKDNTR

SEQ ID NO: 1578018 - protein, 17 aa, Staphylococcus aureus
ITIVLSIILETLFYYPY

SEQ ID NO: 1578019 - protein, 18 aa, Staphylococcus aureus
IWLIAMAFFISRGFVKTG

SEQ ID NO: 1578020 - protein, 20 aa, Staphylococcus aureus
IWRSIIPPLVIIALTVVIFL

SEQ ID NO: 1578021 - protein, 17 aa, Staphylococcus aureus
IYIKTKRLEVVIFMHFL

SEQ ID NO: 1578022 - protein, 22 aa, Staphylococcus aureus
KEKPMANVLVTLTYPDGTTKSV

SEQ ID NO: 1578023 - protein, 22 aa, Staphylococcus aureus
KGFITVFFPLWLQVHADGPIST

SEQ ID NO: 1578024 - protein, 17 aa, Staphylococcus aureus
KKLDILTLFAYFKPHLL

SEQ ID NO: 1578025 - protein, 22 aa, Staphylococcus aureus
KLKDVTGQFDVIYSNDNKTATV

SEQ ID NO: 1578026 - protein, 20 aa, Staphylococcus aureus
KLKLYADKFIDTYMNISKDS

SEQ ID NO: 1578027 - protein, 19 aa, Staphylococcus aureus
KMRYIPGLDGLRAIAVLGI

SEQ ID NO: 1578028 - protein, 19 aa, Staphylococcus aureus
KNKFTHVAYIKPINGNNSD

SEQ ID NO: 1578029 - protein, 18 aa, Staphylococcus aureus
KNKWTHFLISIPVIIGGS

SEQ ID NO: 1578030 - protein, 25 aa, Staphylococcus aureus
KPAPGKVVLLLAHRGTVSSGTEGSG

SEQ ID NO: 1578031 - protein, 22 aa, Staphylococcus aureus
KQITYTFTDYVDKYEDIKARLT

SEQ ID NO: 1578032 - protein, 30 aa, Staphylococcus aureus
KSYLPQVFKSMMVPLIIIIAMFFIHINTAL

SEQ ID NO: 1578033 - protein, 21 aa, Staphylococcus aureus
KTNNTYRQTIYVNPSGDNVIA

SEQ ID NO: 1578034 - protein, 17 aa, Staphylococcus aureus
KVIVNVPVKVVEKELSV

SEQ ID NO: 1578035 - protein, 30 aa, Staphylococcus aureus
KVKELGVTPIARFVGFKAVGVDPKIMGIGP

SEQ ID NO: 1578036 - protein, 18 aa, Staphylococcus aureus
LAEAKAAARQNLGTLNHI

SEQ ID NO: 1578037 - protein, 21 aa, Staphylococcus aureus
LAQGIGRWGNFMNHEAHGGSV

SEQ ID NO: 1578038 - protein, 23 aa, Staphylococcus aureus
LDGLRAIAVLGIIIYHLNKQWLT

SEQ ID NO: 1578039 - protein, 18 aa, Staphylococcus aureus
LDILTLFAYFKPHLLYLL

SEQ ID NO: 1578040 - protein, 32 aa, Staphylococcus aureus
LFIYLKRYISFVSVNWIHVWQLFRSSLAYLLP

SEQ ID NO: 1578041 - protein, 19 aa, Staphylococcus aureus
LFLCLLVILIATAYISFVT

SEQ ID NO: 1578042 - protein, 20 aa, Staphylococcus aureus
LFLFFFKENEEIIPESSNIL

SEQ ID NO: 1578043 - protein, 17 aa, Staphylococcus aureus
LFLLFFVATYLFIFPPI

SEQ ID NO: 1578044 - protein, 17 aa, Staphylococcus aureus
LGASKLTITFGISKSLM

SEQ ID NO: 1578045 - protein, 26 aa, Staphylococcus aureus
LGLDDIRNTHVWEVDAQPAVNEIFDA

SEQ ID NO: 1578046 - protein, 23 aa, Staphylococcus aureus
LIYFTGWRIIDPIISIVISLIIL

SEQ ID NO: 1578047 - protein, 23 aa, Staphylococcus aureus
LKARLKMFHFSKERLLIIRTLIT

SEQ ID NO: 1578048 - protein, 17 aa, Staphylococcus aureus
LKSQITVDDKVKSGDYF

SEQ ID NO: 1578049 - protein, 21 aa, Staphylococcus aureus
LLASLGSLLLFRRKKENKDKK

SEQ ID NO: 1578050 - protein, 22 aa, Staphylococcus aureus
LLHIRTGLDYGDKRTCQAFASV

SEQ ID NO: 1578051 - protein, 21 aa, Staphylococcus aureus
LLTIFCCLVLNKWFVSAVITF

SEQ ID NO: 1578052 - protein, 22 aa, Staphylococcus aureus
LMEGRTTIVIAHRLSTIKKAGQ

SEQ ID NO: 1578053 - protein, 18 aa, Staphylococcus aureus
LNGAMTALKAAIADKERT

SEQ ID NO: 1578054 - protein, 25 aa, Staphylococcus aureus
LQDLWHLKPAMTIAVSHGIFNITNT

SEQ ID NO: 1578055 - protein, 25 aa, Staphylococcus aureus
LQKNLKILIILPLLFLIISAIVTFF

SEQ ID NO: 1578056 - protein, 34 aa, Staphylococcus aureus
LQMLNVRYSHWLRFVWPVVAFVLIFGGGLLITQV

SEQ ID NO: 1578057 - protein, 23 aa, Staphylococcus aureus
LTAKTPLVFGMTLLIVTVIPFYI

SEQ ID NO: 1578058 - protein, 26 aa, Staphylococcus aureus
LTIIGAILLMFASIYFIKIVTSYFTK

SEQ ID NO: 1578059 - protein, 22 aa, Staphylococcus aureus
LVYSMLAAFLFIDKVFVNIIYF

SEQ ID NO: 1578060 - protein, 25 aa, Staphylococcus aureus
MPIADIKSTNGDVVAKATYDILTKT

SEQ ID NO: 1578061 - protein, 43 aa, Staphylococcus aureus
MRHGQILLRRSKRIAVLSWLSLCICIALALILYALPYLILGSN

SEQ ID NO: 1578062 - protein, 20 aa, Staphylococcus aureus
MVVFSQRQAQTFKIQQQQFV

SEQ ID NO: 1578063 - protein, 19 aa, Staphylococcus aureus
MWEEHPLFTIIGGTCLVAG

SEQ ID NO: 1578064 - protein, 24 aa, Staphylococcus aureus
NALNGDANLQCAKTEATQAIDNLT

SEQ ID NO: 1578065 - protein, 17 aa, Staphylococcus aureus
NDKVHFTNIDIAIDKGH

SEQ ID NO: 1578066 - protein, 17 aa, Staphylococcus aureus
NEIIALVKYKGKYLPLL

SEQ ID NO: 1578067 - protein, 20 aa, Staphylococcus aureus
NFCNEIDAFYQYRTPLERIL

SEQ ID NO: 1578068 - protein, 17 aa, Staphylococcus aureus
NKRVFKGAEYQLSEISS

SEQ ID NO: 1578069 - protein, 20 aa, Staphylococcus aureus
NLDEQVLALITGEIGSMPDL

SEQ ID NO: 1578070 - protein, 17 aa, Staphylococcus aureus
NLLKYGFTLYQSFQFLN

SEQ ID NO: 1578071 - protein, 34 aa, Staphylococcus aureus
NLMIPDLNSDFILFDFTYDLPLSTYLGQVLNMNA

SEQ ID NO: 1578072 - protein, 19 aa, Staphylococcus aureus
NLTGYKFNPDAKNFKIYEV

SEQ ID NO: 1578073 - protein, 29 aa, Staphylococcus aureus
NLYKSNHYYWKFASILLISILIESIALII

SEQ ID NO: 1578074 - protein, 22 aa, Staphylococcus aureus
NMRERALEIGATFHIVSLPDSG

SEQ ID NO: 1578075 - protein, 31 aa, Staphylococcus aureus
NMTLDSGFYKTPKYNLGNYVWEDTNKDGKQD

SEQ ID NO: 1578076 - protein, 19 aa, Staphylococcus aureus
NQTFNYTWFVGGLLGVGYL

SEQ ID NO: 1578077 - protein, 24 aa, Staphylococcus aureus
NQTIEVGKTMNPIVLTTTDNGTGT

SEQ ID NO: 1578078 - protein, 20 aa, Staphylococcus aureus
NTFMAANFTVTDKVKSGDYF

SEQ ID NO: 1578079 - protein, 24 aa, Staphylococcus aureus
NTWWEFIPALILAGSATYLYLKSY

SEQ ID NO: 1578080 - protein, 25 aa, Staphylococcus aureus
NYLNAEHPIGLVLVILTVLVIIGFV

SEQ ID NO: 1578081 - protein, 26 aa, Staphylococcus aureus
PIFQFSVTELIGWIITHIFFMSLMAL

SEQ ID NO: 1578082 - protein, 26 aa, Staphylococcus aureus
PQTGELLALVSTPSYDVYPFMYGMSN

SEQ ID NO: 1578083 - protein, 17 aa, Staphylococcus aureus
QAQTFKIQQQQFVKKPI

SEQ ID NO: 1578084 - protein, 30 aa, Staphylococcus aureus
QEAARTRNPIRLMIGFDYPDGYGNSETLVP

SEQ ID NO: 1578085 - protein, 29 aa, Staphylococcus aureus
QGDTFKITVPKELNLNGVTSTAKVPPIMA

SEQ ID NO: 1578086 - protein, 19 aa, Staphylococcus aureus
QMISAFSFFIYLFITSNHS

SEQ ID NO: 1578087 - protein, 18 aa, Staphylococcus aureus
QMNAGTQLYHIVASNAYH

SEQ ID NO: 1578088 - protein, 20 aa, Staphylococcus aureus
RAALVHVIFNLIGVIIFTIF

SEQ ID NO: 1578089 - protein, 44 aa, Staphylococcus aureus
RDKERKKGGMAKVLLPLIAAVLIIGALAIFGGMALNNHNNGTKE

SEQ ID NO: 1578090 - protein, 17 aa, Staphylococcus aureus
RFISLVLICAMFAICWV

SEQ ID NO: 1578091 - protein, 18 aa, Staphylococcus aureus
RGGIKGAIAGAALNGILI

SEQ ID NO: 1578092 - protein, 17 aa, Staphylococcus aureus
RKIGYVMQSNSMMSGTI

SEQ ID NO: 1578093 - protein, 18 aa, Staphylococcus aureus
RLWDRVRNIFGSMRDGLK

SEQ ID NO: 1578094 - protein, 23 aa, Staphylococcus aureus
RNATELNTAMGQLQHAIADKTNT

SEQ ID NO: 1578095 - protein, 18 aa, Staphylococcus aureus
RSANMIATILYGMSTVVI

SEQ ID NO: 1578096 - protein, 32 aa, Staphylococcus aureus
RSPFFKPLHMILRLFMLLTLISGFWILIQSFM

SEQ ID NO: 1578097 - protein, 21 aa, Staphylococcus aureus
RYGKTYKGIMPNWEPGKKVHL

SEQ ID NO: 1578098 - protein, 17 aa, Staphylococcus aureus
SHANMPLSMILLGVMLN

SEQ ID NO: 1578099 - protein, 36 aa, Staphylococcus aureus
SHDFKIRNRSGQVIYSWPTVHVYSLEDLSRASDYFS

SEQ ID NO: 1578100 - protein, 26 aa, Staphylococcus aureus
SKKLNEAIPLFASVIVVLAFFLLMIV

SEQ ID NO: 1578101 - protein, 21 aa, Staphylococcus aureus
SKVIGIPKWIQFLFIVIVAMV

SEQ ID NO: 1578102 - protein, 25 aa, Staphylococcus aureus
SLFYKRFSKKYNEIMILRVTITGFA

SEQ ID NO: 1578103 - protein, 40 aa, Staphylococcus aureus
SNKQNKYSIRRFTVGTTSVIVGATILFGIGNHQAQASEQS

SEQ ID NO: 1578104 - protein, 17 aa, Staphylococcus aureus
SNPKGEVNHSNKVSKQH

SEQ ID NO: 1578105 - protein, 22 aa, Staphylococcus aureus
SPEHNYQFGGAMIKSEGVDKLL

SEQ ID NO: 1578106 - protein, 23 aa, Staphylococcus aureus
SSFICAVTHNFILFAISRLFQAI

SEQ ID NO: 1578107 - protein, 46 aa, Staphylococcus aureus
SVKNSERRGMLKGCGGCLISFILLIILLSACSMMFSNNDNSTNNQS

SEQ ID NO: 1578108 - protein, 18 aa, Staphylococcus aureus
SYSLYLWHFAVISFVHSY

SEQ ID NO: 1578109 - protein, 21 aa, Staphylococcus aureus
TASGGDGYSMFGGPREEGISL

SEQ ID NO: 1578110 - protein, 20 aa, Staphylococcus aureus
TELRIKRGNQFRVKYDGDND

SEQ ID NO: 1578111 - protein, 18 aa, Staphylococcus aureus
TFTKCIMVLILSFLLAQN

SEQ ID NO: 1578112 - protein, 18 aa, Staphylococcus aureus
TIYIATTFHASMTFGLIF

SEQ ID NO: 1578113 - protein, 23 aa, Staphylococcus aureus
TKDDSYWKDLIVEGKRVTTVSKD

SEQ ID NO: 1578114 - protein, 26 aa, Staphylococcus aureus
TLGARWDYIGIFSFLLVISIVLFLII

SEQ ID NO: 1578115 - protein, 23 aa, Staphylococcus aureus
TLVTIIVFLPLVFVSGSVGEMFR

SEQ ID NO: 1578116 - protein, 17 aa, Staphylococcus aureus
TNSELKNSQTLDLPQSS

SEQ ID NO: 1578117 - protein, 21 aa, Staphylococcus aureus
TPSYDVYPFMYGMSNEEYNKL

SEQ ID NO: 1578118 - protein, 21 aa, Staphylococcus aureus
TRIKSFIPLLVPLFISAFQRA

SEQ ID NO: 1578119 - protein, 19 aa, Staphylococcus aureus
TVWNVLKTVASVVWNAILK

SEQ ID NO: 1578120 - protein, 21 aa, Staphylococcus aureus
VAKAEALISGTPDVVVTPSEI

SEQ ID NO: 1578121 - protein, 17 aa, Staphylococcus aureus
VALKYAHKLNMTESYPI

SEQ ID NO: 1578122 - protein, 18 aa, Staphylococcus aureus
VASNAYHKDTEDFYISLK

SEQ ID NO: 1578123 - protein, 19 aa, Staphylococcus aureus
VAVSLFFDAIMFFYAKLYD

SEQ ID NO: 1578124 - protein, 19 aa, Staphylococcus aureus
VFRNTLRYTAIMMIAIFIA

SEQ ID NO: 1578125 - protein, 37 aa, Staphylococcus aureus
VGIDSGDTVYPHQAGYVKLNYGFSVPNEAVQGDTFKI

SEQ ID NO: 1578126 - protein, 24 aa, Staphylococcus aureus
VIDSDGNVIYTFTDYVNTKDDVKA

SEQ ID NO: 1578127 - protein, 17 aa, Staphylococcus aureus
VLGVFQLGIIGRLIDSF

SEQ ID NO: 1578128 - protein, 17 aa, Staphylococcus aureus
VNIHILWIIALAIGLMY

SEQ ID NO: 1578129 - protein, 20 aa, Staphylococcus aureus
VSSSMSGSVSKSTSLSDSIS

SEQ ID NO: 1578130 - protein, 20 aa, Staphylococcus aureus
VSVILGSLFYKRFSKKYNEI

SEQ ID NO: 1578131 - protein, 19 aa, Staphylococcus aureus
VTKRWGGKTKTHFGLLLTA

SEQ ID NO: 1578132 - protein, 18 aa, Staphylococcus aureus
VTPSEITAALNKVTQAKN

SEQ ID NO: 1578133 - protein, 18 aa, Staphylococcus aureus
VVIALIFFVLFLVALGSK

SEQ ID NO: 1578134 - protein, 20 aa, Staphylococcus aureus
VYLVMGWVGIILLPIIFIRT

SEQ ID NO: 1578135 - protein, 24 aa, Staphylococcus aureus
WGSVEIETMFAIGIIFIILFVIRE

SEQ ID NO: 1578136 - protein, 18 aa, Staphylococcus aureus
WSIMLISFVVFIGFDMIR

SEQ ID NO: 1578137 - protein, 22 aa, Staphylococcus aureus
YDANINIADEMFNNKITYNYSS

SEQ ID NO: 1578138 - protein, 19 aa, Staphylococcus aureus
YFFCGGLSIMFLDVLISLS

SEQ ID NO: 1578139 - protein, 31 aa, Staphylococcus aureus
YKSYLPQVFKSMMVPLIIIIAMFFIHINTAL

SEQ ID NO: 1578140 - protein, 19 aa, Staphylococcus aureus
YLYEHLRSFSSLYDASFGL

SEQ ID NO: 1578141 - protein, 20 aa, Staphylococcus aureus
YWRIGACIIGAIFVISYLFW

SEQ ID NO: 1578142 - protein, 20 aa, Staphylococcus aureus
AGKSMGMTQFQLMKDVELPL

SEQ ID NO: 1578143 - protein, 22 aa, Staphylococcus aureus
AKETAKRALASYSNLNNAQSTA

SEQ ID NO: 1578144 - protein, 17 aa, Staphylococcus aureus
ALEEKGFKVESKEEYSD

SEQ ID NO: 1578145 - protein, 20 aa, Staphylococcus aureus
ALQAAWSFISNIWNTIWSFL

SEQ ID NO: 1578146 - protein, 39 aa, Staphylococcus aureus
ANNLITYTFTDYVDRFNSVQMGINYSIYMDADTIPVSKN

SEQ ID NO: 1578147 - protein, 22 aa, Staphylococcus aureus
ANQPKYRYVLLAIITAGLSDSL

SEQ ID NO: 1578148 - protein, 26 aa, Staphylococcus aureus
AQALNEAMKALKESIKDQPQTEASSK

SEQ ID NO: 1578149 - protein, 28 aa, Staphylococcus aureus
ARIAYEAEMRKPLYSKRIYQNLTLDSIV

SEQ ID NO: 1578150 - protein, 31 aa, Staphylococcus aureus
ASGNKTTTTFKYEVTRNSMSDSVSTSGSTQQ

SEQ ID NO: 1578151 - protein, 28 aa, Staphylococcus aureus
ATDTKLRIFEVNDTSKLSDSYYADPNDS

SEQ ID NO: 1578152 - protein, 24 aa, Staphylococcus aureus
AVSGAIQGVVGWLTELWGKIQSTL

SEQ ID NO: 1578153 - protein, 19 aa, Staphylococcus aureus
CSEHMLGRVNSVFKTMVFA

SEQ ID NO: 1578154 - protein, 21 aa, Staphylococcus aureus
DFSTLLLISGLLFLFFFKENE

SEQ ID NO: 1578155 - protein, 25 aa, Staphylococcus aureus
DILTMLKATTTVPGLRNNITGNEKA

SEQ ID NO: 1578156 - protein, 26 aa, Staphylococcus aureus
DKAKRDAYTNAVSRAETILNKTQGAN

SEQ ID NO: 1578157 - protein, 19 aa, Staphylococcus aureus
DLFILRLVLLSCLFILTIS

SEQ ID NO: 1578158 - protein, 24 aa, Staphylococcus aureus
DLIDYLDCKVLFIGNLDELNKKAD

SEQ ID NO: 1578159 - protein, 19 aa, Staphylococcus aureus
DNHQIIWVILNYEFNEARP

SEQ ID NO: 1578160 - protein, 23 aa, Staphylococcus aureus
DVKGSDVWTAFEHSLGAPTTQKD

SEQ ID NO: 1578161 - protein, 18 aa, Staphylococcus aureus
EALERFSMDRARQSIRSL

SEQ ID NO: 1578162 - protein, 19 aa, Staphylococcus aureus
EALVRRNGQEIIIHVDDIA

SEQ ID NO: 1578163 - protein, 28 aa, Staphylococcus aureus
EAMGYLKRFALYISVMILIFAIAGCGKG

SEQ ID NO: 1578164 - protein, 33 aa, Staphylococcus aureus
EGNGNGGDGIGFAFSPGVLGETGLNGAAVGIGG

SEQ ID NO: 1578165 - protein, 18 aa, Staphylococcus aureus
EICELLFAQIYNNRNITL

SEQ ID NO: 1578166 - protein, 19 aa, Staphylococcus aureus
ELANYVFFDIELKNLLLYG

SEQ ID NO: 1578167 - protein, 23 aa, Staphylococcus aureus
ELNTAMTALKRAIADKADTKASG

SEQ ID NO: 1578168 - protein, 17 aa, Staphylococcus aureus
EQGGNIVDIDFDSVPQI

SEQ ID NO: 1578169 - protein, 18 aa, Staphylococcus aureus
ERLLIIRTLITWFYTMLW

SEQ ID NO: 1578170 - protein, 21 aa, Staphylococcus aureus
ESATESFLKFSHITGSEGVQA

SEQ ID NO: 1578171 - protein, 19 aa, Staphylococcus aureus
ESSVKGFATMLLLGILMIF

SEQ ID NO: 1578172 - protein, 19 aa, Staphylococcus aureus
ESYLSFTVILYIFGFAILI

SEQ ID NO: 1578173 - protein, 19 aa, Staphylococcus aureus
FATSCLVLTLVVVSSLSSS

SEQ ID NO: 1578174 - protein, 32 aa, Staphylococcus aureus
FDSIFKVARLIRLFKLLRCLSILKRYTPTVLN

SEQ ID NO: 1578175 - protein, 25 aa, Staphylococcus aureus
FFDIELKNLLLYGIFDESIFLKNIT

SEQ ID NO: 1578176 - protein, 33 aa, Staphylococcus aureus
FGGLKDGETYTVKFETPAGYLPTKVNGTTDGEK

SEQ ID NO: 1578177 - protein, 19 aa, Staphylococcus aureus
FIDRENADSGTFNYVKGIF

SEQ ID NO: 1578178 - protein, 19 aa, Staphylococcus aureus
FILAIVVAMCLFKVEKHVS

SEQ ID NO: 1578179 - protein, 28 aa, Staphylococcus aureus
FIQNNIWDFIAIIPFDSIFKVARLIRLF

SEQ ID NO: 1578180 - protein, 31 aa, Staphylococcus aureus
FKGINLTSSRFIKWLNYMNVIPGYYGVNSID

SEQ ID NO: 1578181 - protein, 22 aa, Staphylococcus aureus
FMQGEFPVMMFGLPAAALAIYH

SEQ ID NO: 1578182 - protein, 17 aa, Staphylococcus aureus
FPIPFLPPYLTLDFSDV

SEQ ID NO: 1578183 - protein, 17 aa, Staphylococcus aureus
FPNGKRVLTPNTDTTAY

SEQ ID NO: 1578184 - protein, 21 aa, Staphylococcus aureus
FPNPNQYKVEFNTPDDQITTP

SEQ ID NO: 1578185 - protein, 24 aa, Staphylococcus aureus
FQYKIFPVFMFLVSTGLGILVITQ

SEQ ID NO: 1578186 - protein, 19 aa, Staphylococcus aureus
FRITEMNWEGAFKVNERTL

SEQ ID NO: 1578187 - protein, 17 aa, Staphylococcus aureus
FVALDLKSKDRDAIKAM

SEQ ID NO: 1578188 - protein, 23 aa, Staphylococcus aureus
FVICKLIAQLLIRFKTKDLAEMI

SEQ ID NO: 1578189 - protein, 22 aa, Staphylococcus aureus
GESAWGLFSGVFGKSTNINQVL

SEQ ID NO: 1578190 - protein, 19 aa, Staphylococcus aureus
GKILGVVRYFGGLLKGLIT

SEQ ID NO: 1578191 - protein, 20 aa, Staphylococcus aureus
GKKDGQSFVDITTTQVSTAN

SEQ ID NO: 1578192 - protein, 18 aa, Staphylococcus aureus
GLILKPVTDPLMKRVSEK

SEQ ID NO: 1578193 - protein, 17 aa, Staphylococcus aureus
GNTRTFTQFTFKKAILF

SEQ ID NO: 1578194 - protein, 17 aa, Staphylococcus aureus
GNTRTFTQFTFKKAVLF

SEQ ID NO: 1578195 - protein, 17 aa, Staphylococcus aureus
GSFGMLALNVMWLFVYT

SEQ ID NO: 1578196 - protein, 20 aa, Staphylococcus aureus
GSTIAIFLIVFMAFILIITK

SEQ ID NO: 1578197 - protein, 25 aa, Staphylococcus aureus
GTKPKIMAAIVLWLFGSIASILGLC

SEQ ID NO: 1578198 - protein, 18 aa, Staphylococcus aureus
HPLAEAIVNYAKEKQLIL

SEQ ID NO: 1578199 - protein, 19 aa, Staphylococcus aureus
HYSFLRALILGFFIGFIPI

SEQ ID NO: 1578200 - protein, 21 aa, Staphylococcus aureus
IKSPRILDKVSREFDGKYLTA

SEQ ID NO: 1578201 - protein, 23 aa, Staphylococcus aureus
ILFKSALFLKRRSILSMMKDSIK

SEQ ID NO: 1578202 - protein, 18 aa, Staphylococcus aureus
ILLFSIPTPVAVILMGIA

SEQ ID NO: 1578203 - protein, 28 aa, Staphylococcus aureus
INTYLLRQVKSIGMFLMIAALGLYFVAM

SEQ ID NO: 1578204 - protein, 26 aa, Staphylococcus aureus
IRTLITWFYTMLWSIVGVVWIVFSIP

SEQ ID NO: 1578205 - protein, 20 aa, Staphylococcus aureus
ISKWLYRRKGSWVKLLESLL

SEQ ID NO: 1578206 - protein, 23 aa, Staphylococcus aureus
ITFPNPNQYKVEFNTPDDQITTP

SEQ ID NO: 1578207 - protein, 19 aa, Staphylococcus aureus
ITHGSGFSSVVTVSDALPN

SEQ ID NO: 1578208 - protein, 23 aa, Staphylococcus aureus
ITRSKFQNILLMIMIIPTWINLL

SEQ ID NO: 1578209 - protein, 17 aa, Staphylococcus aureus
IVGVVWIVFSIPNIFEL

SEQ ID NO: 1578210 - protein, 17 aa, Staphylococcus aureus
IVVAMCLFKVEKHVSSP

SEQ ID NO: 1578211 - protein, 22 aa, Staphylococcus aureus
IYSLCFYLLFTHKEIYKIFEEN

SEQ ID NO: 1578212 - protein, 20 aa, Staphylococcus aureus
KDAYEFYGKVQSGITTPTQK

SEQ ID NO: 1578213 - protein, 26 aa, Staphylococcus aureus
KDHSFRYAIFKGLGLGGAMTTGFLTI

SEQ ID NO: 1578214 - protein, 19 aa, Staphylococcus aureus
KDLRVAYEHDITKSKQLTK

SEQ ID NO: 1578215 - protein, 20 aa, Staphylococcus aureus
KFNPDAKNFKIYEVTDQNQF

SEQ ID NO: 1578216 - protein, 18 aa, Staphylococcus aureus
KGALRSGVMDMFAALLQI

SEQ ID NO: 1578217 - protein, 26 aa, Staphylococcus aureus
KGQVLDNGRIRYTFTDYIKDKVNVTA

SEQ ID NO: 1578218 - protein, 17 aa, Staphylococcus aureus
KHNGTPAQSEKRLPDTG

SEQ ID NO: 1578219 - protein, 20 aa, Staphylococcus aureus
KKMRYMPGLDGLRAIAVLGI

SEQ ID NO: 1578220 - protein, 19 aa, Staphylococcus aureus
KPGKWSIYFYGIAYAVTSL

SEQ ID NO: 1578221 - protein, 26 aa, Staphylococcus aureus
KTILYFEIITTIAIGLGIIFGNLFKP

SEQ ID NO: 1578222 - protein, 21 aa, Staphylococcus aureus
KWSAVIAWIVIVAAILIPLAT

SEQ ID NO: 1578223 - protein, 19 aa, Staphylococcus aureus
LFISLFILYNEFRSGNLGE

SEQ ID NO: 1578224 - protein, 23 aa, Staphylococcus aureus
LGCTLPAFMLVVSASLNDNSVTA

SEQ ID NO: 1578225 - protein, 17 aa, Staphylococcus aureus
LGLGGAMTTGFLTIFVL

SEQ ID NO: 1578226 - protein, 20 aa, Staphylococcus aureus
LIGFILYLFFGRTVSARKLN

SEQ ID NO: 1578227 - protein, 30 aa, Staphylococcus aureus
LKKQSKLILIFICIFTFFIMIIQSQFLMGQ

SEQ ID NO: 1578228 - protein, 23 aa, Staphylococcus aureus
LKVREIKGLITAKILRAQEMNIP

SEQ ID NO: 1578229 - protein, 17 aa, Staphylococcus aureus
LLLFFKIIGVSLVPSIL

SEQ ID NO: 1578230 - protein, 17 aa, Staphylococcus aureus
LLNFIIVTFLLGIIIIP

SEQ ID NO: 1578231 - protein, 19 aa, Staphylococcus aureus
LNISSLITINWYSNNMFYN

SEQ ID NO: 1578232 - protein, 17 aa, Staphylococcus aureus
LQRRLYIENGRLIADDR

SEQ ID NO: 1578233 - protein, 21 aa, Staphylococcus aureus
LSFKFLKALLYLKYLKKQSLY

SEQ ID NO: 1578234 - protein, 27 aa, Staphylococcus aureus
LSNLAITLFIIVCFNAFIIFSVQGNAR

SEQ ID NO: 1578235 - protein, 19 aa, Staphylococcus aureus
LTGIFPILSLVMGILIALL

SEQ ID NO: 1578236 - protein, 24 aa, Staphylococcus aureus
MELPWVSFIVHFSFSIVIAIIYCI

SEQ ID NO: 1578237 - protein, 20 aa, Staphylococcus aureus
MTQLKQGIANKAQIKGSENY

SEQ ID NO: 1578238 - protein, 19 aa, Staphylococcus aureus
NDYRIFTFDARDSRHLSFI

SEQ ID NO: 1578239 - protein, 17 aa, Staphylococcus aureus
NLSSGRFSRKSMVYFNI

SEQ ID NO: 1578240 - protein, 26 aa, Staphylococcus aureus
NQDGKRPTEIKVELYQDGKATGKTAT

SEQ ID NO: 1578241 - protein, 24 aa, Staphylococcus aureus
NTKTSIALFKYLYKNNELANYVFF

SEQ ID NO: 1578242 - protein, 17 aa, Staphylococcus aureus
NVIAPVLTGNLKPNTDS

SEQ ID NO: 1578243 - protein, 17 aa, Staphylococcus aureus
NVLTKLQSEYNFDKFNF

SEQ ID NO: 1578244 - protein, 29 aa, Staphylococcus aureus
NYLYVIPIGIVWFCLYYIVFRFLITKFNF

SEQ ID NO: 1578245 - protein, 18 aa, Staphylococcus aureus
NYTVEFETPAGYTPTVKN

SEQ ID NO: 1578246 - protein, 17 aa, Staphylococcus aureus
PLVRYIFERIVMAVIVI

SEQ ID NO: 1578247 - protein, 20 aa, Staphylococcus aureus
PSTQETWRGDYLVKQLSQNP

SEQ ID NO: 1578248 - protein, 23 aa, Staphylococcus aureus
PTLKKLKFGQSIREEGPQSHMKK

SEQ ID NO: 1578249 - protein, 24 aa, Staphylococcus aureus
QFKAQLKAANPFAKELENRKKAAI

SEQ ID NO: 1578250 - protein, 30 aa, Staphylococcus aureus
QLRVLKDIYKGKGIEVLNIYGDLKDGTHSD

SEQ ID NO: 1578251 - protein, 19 aa, Staphylococcus aureus
QPLRINLTSNENFTDKDWQ

SEQ ID NO: 1578252 - protein, 18 aa, Staphylococcus aureus
QQEVILKGQIDRFNTYNN

SEQ ID NO: 1578253 - protein, 20 aa, Staphylococcus aureus
QRHLAVWFVTYLVSGVIMNK

SEQ ID NO: 1578254 - protein, 17 aa, Staphylococcus aureus
RAQEMNIPISIEIPDEV

SEQ ID NO: 1578255 - protein, 19 aa, Staphylococcus aureus
RDNHLKLTLLYQDLEIKRI

SEQ ID NO: 1578256 - protein, 17 aa, Staphylococcus aureus
RKYVHTFEVQLDNKILI

SEQ ID NO: 1578257 - protein, 17 aa, Staphylococcus aureus
RLGQSFSNWANSAAGEN

SEQ ID NO: 1578258 - protein, 30 aa, Staphylococcus aureus
RTFTQFTFKKAVLFAALFILIGFYDGFVGG

SEQ ID NO: 1578259 - protein, 27 aa, Staphylococcus aureus
SDNKNGSLAITGRVSMNQAFNSDITFK

SEQ ID NO: 1578260 - protein, 24 aa, Staphylococcus aureus
SDSESKSASAFLSELLSESTSAST

SEQ ID NO: 1578261 - protein, 23 aa, Staphylococcus aureus
SELVPRWYVEYDGEWYVYNDGRL

SEQ ID NO: 1578262 - protein, 18 aa, Staphylococcus aureus
SFTINFLVNFIVYLCMYL

SEQ ID NO: 1578263 - protein, 24 aa, Staphylococcus aureus
SGIVISVICCLLITAILYYTLDGF

SEQ ID NO: 1578264 - protein, 19 aa, Staphylococcus aureus
SHANMPLSMILLGVMLNFT

SEQ ID NO: 1578265 - protein, 24 aa, Staphylococcus aureus
SIPNIFELYNWPTLAIHLSYYVTF

SEQ ID NO: 1578266 - protein, 25 aa, Staphylococcus aureus
SIQPSEFMKIILILALARVVSRHNQ

SEQ ID NO: 1578267 - protein, 17 aa, Staphylococcus aureus
SIYFYFTREIRYSLNKK

SEQ ID NO: 1578268 - protein, 21 aa, Staphylococcus aureus
SPEAMFVLLAGIGLIATVRRR

SEQ ID NO: 1578269 - protein, 24 aa, Staphylococcus aureus
SREKELLKYFPSDYKKPDEKISDT

SEQ ID NO: 1578270 - protein, 23 aa, Staphylococcus aureus
SREKELLKYFPSDYKKPEEKTSD

SEQ ID NO: 1578271 - protein, 30 aa, Staphylococcus aureus
STAPIKLRTFSRLAMSTFASAATTSAVTAN

SEQ ID NO: 1578272 - protein, 29 aa, Staphylococcus aureus
SVGTASILVGTTLIFGLSGHEAKAAEHTN

SEQ ID NO: 1578273 - protein, 19 aa, Staphylococcus aureus
TAVKQDLTEAQALDQLMDA

SEQ ID NO: 1578274 - protein, 35 aa, Staphylococcus aureus
TGIIKLKSFWIRRLKRLLPAVIVLLMVVGTATLLL

SEQ ID NO: 1578275 - protein, 33 aa, Staphylococcus aureus
TGYPENRYKTYYYYNNGYTLTWDNGLVLYSNKA

SEQ ID NO: 1578276 - protein, 18 aa, Staphylococcus aureus
TIVGRVIGFILMISGIGV

SEQ ID NO: 1578277 - protein, 20 aa, Staphylococcus aureus
TKPLRRLRDQATRVSEGDYS

SEQ ID NO: 1578278 - protein, 22 aa, Staphylococcus aureus
TLNMKYYLIRTIPVCIIAILYV

SEQ ID NO: 1578279 - protein, 18 aa, Staphylococcus aureus
TLVFVIGIIMSKSKEVYY

SEQ ID NO: 1578280 - protein, 26 aa, Staphylococcus aureus
TNYDYTKLVFAKPIYNDPSLVKSDTN

SEQ ID NO: 1578281 - protein, 17 aa, Staphylococcus aureus
TQFSRRTFLKMLGIGGA

SEQ ID NO: 1578282 - protein, 31 aa, Staphylococcus aureus
TTVYPHQAGYVKLNYGFSVPNSAVKGDTFKI

SEQ ID NO: 1578283 - protein, 33 aa, Staphylococcus aureus
TVLVDYEKYGKFYNLSIKGTIDQIDKTNNTYRQ

SEQ ID NO: 1578284 - protein, 19 aa, Staphylococcus aureus
VAIGSIFTGIVWGLLLSGS

SEQ ID NO: 1578285 - protein, 21 aa, Staphylococcus aureus
VICKLIAQFLIRFKTKDLAEM

SEQ ID NO: 1578286 - protein, 23 aa, Staphylococcus aureus
VIGAFIGVLVYLWKTNENFRNTI

SEQ ID NO: 1578287 - protein, 17 aa, Staphylococcus aureus
VIVASLLLWGVHFLILK

SEQ ID NO: 1578288 - protein, 19 aa, Staphylococcus aureus
VKGIKRIVLPLIFSSIERI

SEQ ID NO: 1578289 - protein, 36 aa, Staphylococcus aureus
VNKLYYAAGGRALEYNQLFMYSQLYVESTQDHQQRL

SEQ ID NO: 1578290 - protein, 20 aa, Staphylococcus aureus
VPLSSLLIVYFIYYIFEKNI

SEQ ID NO: 1578291 - protein, 17 aa, Staphylococcus aureus
VVPCILTIVMSHFSKQK

SEQ ID NO: 1578292 - protein, 20 aa, Staphylococcus aureus
VYGWFLASSVAAFFVGVTEP

SEQ ID NO: 1578293 - protein, 27 aa, Staphylococcus aureus
VYYHPRYFFVVVGMRVRLKMNAVSLAT

SEQ ID NO: 1578294 - protein, 17 aa, Staphylococcus aureus
WLTELWGKIQSTLQPIM

SEQ ID NO: 1578295 - protein, 20 aa, Staphylococcus aureus
WMILGGLIIKKYPIYSFFEL

SEQ ID NO: 1578296 - protein, 27 aa, Staphylococcus aureus
YAPYGDDWFAYFMRRLAERPQNLSLAA

SEQ ID NO: 1578297 - protein, 34 aa, Staphylococcus aureus
YDYMSFRISSAILQFLGAISWFFLSLILSLTQFT

SEQ ID NO: 1578298 - protein, 24 aa, Staphylococcus aureus
YQARRVCWFGLALVTVIIGIPLYF

SEQ ID NO: 1578299 - protein, 25 aa, Staphylococcus aureus
AATHCVTRLRLVLKDESKVDKDALS

SEQ ID NO: 1578300 - protein, 20 aa, Staphylococcus aureus
AEALNYMALAGWDSKQMMEG

SEQ ID NO: 1578301 - protein, 28 aa, Staphylococcus aureus
AFNGFSFPERRWVYILALSSSALCGLFI

SEQ ID NO: 1578302 - protein, 17 aa, Staphylococcus aureus
AGAMIGIMYVFKIGPSI

SEQ ID NO: 1578303 - protein, 18 aa, Staphylococcus aureus
AIQKLHGFSTTRIIFHNI

SEQ ID NO: 1578304 - protein, 18 aa, Staphylococcus aureus
AKALNRAMDQLSQEITGN

SEQ ID NO: 1578305 - protein, 18 aa, Staphylococcus aureus
AKNDLKEIPQLVTKKNDV

SEQ ID NO: 1578306 - protein, 18 aa, Staphylococcus aureus
ALDQARNGLTVDKAPLEN

SEQ ID NO: 1578307 - protein, 31 aa, Staphylococcus aureus
ALQNICNFIKAIFEFIINFVIKPIMFAIWQV

SEQ ID NO: 1578308 - protein, 24 aa, Staphylococcus aureus
ALVHAHLLPLVSILVDPAKIVFLN

SEQ ID NO: 1578309 - protein, 17 aa, Staphylococcus aureus
AQIYFSVVFVRMISINI

SEQ ID NO: 1578310 - protein, 22 aa, Staphylococcus aureus
ARIAYEADMRKPLYSKRIYQNL

SEQ ID NO: 1578311 - protein, 29 aa, Staphylococcus aureus
ARIAYEAEMRKPLYSKRIYQNLTLDSIVF

SEQ ID NO: 1578312 - protein, 19 aa, Staphylococcus aureus
ARQALTPDKAPLQTAKTQL

SEQ ID NO: 1578313 - protein, 28 aa, Staphylococcus aureus
ATLDFGDINSAYIIKVVSKYTPTSDGEL

SEQ ID NO: 1578314 - protein, 17 aa, Staphylococcus aureus
AVIVGAMLIGYIAIIAL

SEQ ID NO: 1578315 - protein, 19 aa, Staphylococcus aureus
AYLVVPIVGAFLIDLIGVI

SEQ ID NO: 1578316 - protein, 17 aa, Staphylococcus aureus
CILNRIISFLLIVHSTF

SEQ ID NO: 1578317 - protein, 18 aa, Staphylococcus aureus
CLIAAVNFVLARYTTHAI

SEQ ID NO: 1578318 - protein, 19 aa, Staphylococcus aureus
CSEHMLGRVNSVYKTMVFA

SEQ ID NO: 1578319 - protein, 24 aa, Staphylococcus aureus
DESKRNAYTQAVTAAEGILNKQTG

SEQ ID NO: 1578320 - protein, 17 aa, Staphylococcus aureus
DFDSVPHIHGFNKHTEI

SEQ ID NO: 1578321 - protein, 26 aa, Staphylococcus aureus
DKEKQALKDRINQILQQGHNGINNAM

SEQ ID NO: 1578322 - protein, 19 aa, Staphylococcus aureus
DKIEIRYISLYGLQNLYEI

SEQ ID NO: 1578323 - protein, 19 aa, Staphylococcus aureus
DLDHARQALTPDKAPLQTA

SEQ ID NO: 1578324 - protein, 17 aa, Staphylococcus aureus
DNMFFNYLNAEHPIGLV

SEQ ID NO: 1578325 - protein, 33 aa, Staphylococcus aureus
DPATGKDYSIFGWNNENVVRYGGGSADGDSAVN

SEQ ID NO: 1578326 - protein, 23 aa, Staphylococcus aureus
DTVARFGLKLLFGATLVSFISAA

SEQ ID NO: 1578327 - protein, 32 aa, Staphylococcus aureus
EDEANTSLIWGLLASIGSLLLFRRKKENKDKK

SEQ ID NO: 1578328 - protein, 24 aa, Staphylococcus aureus
EIEQAKAQLAQALKEIKDLVKAKE

SEQ ID NO: 1578329 - protein, 23 aa, Staphylococcus aureus
EIYKLGLKQAKIAAVVQPISGIV

SEQ ID NO: 1578330 - protein, 19 aa, Staphylococcus aureus
FAKEIGAQLASFWKENGSE

SEQ ID NO: 1578331 - protein, 19 aa, Staphylococcus aureus
FAPFAFLVGVPWQDAVQAG

SEQ ID NO: 1578332 - protein, 17 aa, Staphylococcus aureus
FDFDMKTLMTVAVIGAA

SEQ ID NO: 1578333 - protein, 17 aa, Staphylococcus aureus
FDFDMKTLMTVAVIGAT

SEQ ID NO: 1578334 - protein, 24 aa, Staphylococcus aureus
FDIELKNLLLYGIFDESIFLKNIT

SEQ ID NO: 1578335 - protein, 23 aa, Staphylococcus aureus
FHASMTFGLIFLFSEEIGDLFSI

SEQ ID NO: 1578336 - protein, 18 aa, Staphylococcus aureus
FIIQKIYGMTAIQFSWMF

SEQ ID NO: 1578337 - protein, 17 aa, Staphylococcus aureus
FLIAPILAVMDFLGPLA

SEQ ID NO: 1578338 - protein, 18 aa, Staphylococcus aureus
FLLMYGLDYLYDTFAPPT

SEQ ID NO: 1578339 - protein, 25 aa, Staphylococcus aureus
FSTAGNLGWSHPMVYITIIAAIVIL

SEQ ID NO: 1578340 - protein, 17 aa, Staphylococcus aureus
FTDVKAPTVTVGNQTIE

SEQ ID NO: 1578341 - protein, 26 aa, Staphylococcus aureus
FYFSYYQAIIIGCYYLYRLIFTYKYD

SEQ ID NO: 1578342 - protein, 26 aa, Staphylococcus aureus
GAISWDFQTLIGFVFAPFAFLVGVPW

SEQ ID NO: 1578343 - protein, 17 aa, Staphylococcus aureus
GITSGRYSYSLTDYTVQ

SEQ ID NO: 1578344 - protein, 18 aa, Staphylococcus aureus
GLGASKLTITFGISKSLM

SEQ ID NO: 1578345 - protein, 24 aa, Staphylococcus aureus
GLGEAFKYVAPVAGALGYTIEDTS

SEQ ID NO: 1578346 - protein, 24 aa, Staphylococcus aureus
GLGGIGISMGMSWAAATDLGRNFS

SEQ ID NO: 1578347 - protein, 20 aa, Staphylococcus aureus
GQIITFKAFELVGSSRAMPV

SEQ ID NO: 1578348 - protein, 17 aa, Staphylococcus aureus
GSPRLFKELNVSDFSLE

SEQ ID NO: 1578349 - protein, 28 aa, Staphylococcus aureus
GTFIAKYKWSAVIAWIVIVAAILIPLAT

SEQ ID NO: 1578350 - protein, 29 aa, Staphylococcus aureus
GVATTRKVPDIKNGSLVMAKGQVLDNGRI

SEQ ID NO: 1578351 - protein, 21 aa, Staphylococcus aureus
IDDPKLAFSIVYTNQPVPPPW

SEQ ID NO: 1578352 - protein, 18 aa, Staphylococcus aureus
IDFDSVPQIHGFNKHNEI

SEQ ID NO: 1578353 - protein, 18 aa, Staphylococcus aureus
IDGEGGYVDGYIETIEET

SEQ ID NO: 1578354 - protein, 21 aa, Staphylococcus aureus
IDKPNGANISSQIIGVDTASG

SEQ ID NO: 1578355 - protein, 23 aa, Staphylococcus aureus
IFCNFFINIGIFISMQFKGGLTK

SEQ ID NO: 1578356 - protein, 20 aa, Staphylococcus aureus
IGISACTAGITGNLGGNSSK

SEQ ID NO: 1578357 - protein, 23 aa, Staphylococcus aureus
IKATFEFIFNFIIKPIMFAIWQV

SEQ ID NO: 1578358 - protein, 21 aa, Staphylococcus aureus
IKVILALPMFILLTFYLQPLV

SEQ ID NO: 1578359 - protein, 17 aa, Staphylococcus aureus
ILLRSPEKFTLAVGLFN

SEQ ID NO: 1578360 - protein, 19 aa, Staphylococcus aureus
ILTAIAGYSMWKQPIFNIV

SEQ ID NO: 1578361 - protein, 20 aa, Staphylococcus aureus
IPLSKWRRKIGYVMQSNSMM

SEQ ID NO: 1578362 - protein, 30 aa, Staphylococcus aureus
IPLTLKGKKGYKFSIFMGTFTKCIMVLILS

SEQ ID NO: 1578363 - protein, 23 aa, Staphylococcus aureus
IPNTFELYNWPTLAIHLSYYVTF

SEQ ID NO: 1578364 - protein, 19 aa, Staphylococcus aureus
IQFKYRTLTFIGMTTNLTI

SEQ ID NO: 1578365 - protein, 19 aa, Staphylococcus aureus
IQSPITFWYGKYIILIPSS

SEQ ID NO: 1578366 - protein, 19 aa, Staphylococcus aureus
IRYISLYGLQNLYEIKSII

SEQ ID NO: 1578367 - protein, 24 aa, Staphylococcus aureus
ISMKNRFLIMATWNIDEPGGVIKL

SEQ ID NO: 1578368 - protein, 22 aa, Staphylococcus aureus
ITIQGKEHFEGYGSVDIQKNPT

SEQ ID NO: 1578369 - protein, 17 aa, Staphylococcus aureus
IVMLLTIAIILGFGALE

SEQ ID NO: 1578370 - protein, 26 aa, Staphylococcus aureus
IVVSGDMFLAMKWEQIHLKDGLKKVL

SEQ ID NO: 1578371 - protein, 21 aa, Staphylococcus aureus
IVYLVMGWVGIILLPIIFIRT

SEQ ID NO: 1578372 - protein, 21 aa, Staphylococcus aureus
KAHKDGLKKIVLDLRNNPGGL

SEQ ID NO: 1578373 - protein, 18 aa, Staphylococcus aureus
KCILNRIISFLLIVHSTF

SEQ ID NO: 1578374 - protein, 37 aa, Staphylococcus aureus
KDADNWTLDSGFYKTPKYSLGDYVWYDSNKDGKQDST

SEQ ID NO: 1578375 - protein, 19 aa, Staphylococcus aureus
KDLRVAYEHDITKSKQLTE

SEQ ID NO: 1578376 - protein, 19 aa, Staphylococcus aureus
KGIMPNWEPGKKVHLVGHS

SEQ ID NO: 1578377 - protein, 20 aa, Staphylococcus aureus
KIIFENFSKKCTYWVTLIIT

SEQ ID NO: 1578378 - protein, 25 aa, Staphylococcus aureus
KIISRILKFPNNREVAMDIVKSNLP

SEQ ID NO: 1578379 - protein, 17 aa, Staphylococcus aureus
KILGVVRYFGGLLKGLI

SEQ ID NO: 1578380 - protein, 17 aa, Staphylococcus aureus
KILKEFDDKIEIRYISL

SEQ ID NO: 1578381 - protein, 24 aa, Staphylococcus aureus
KIPFYKKHSTLLFATLLIAFGYLS

SEQ ID NO: 1578382 - protein, 22 aa, Staphylococcus aureus
KKKRSLVSMIIQIIVFILTAIA

SEQ ID NO: 1578383 - protein, 19 aa, Staphylococcus aureus
KLKLYADKFIDTYMNISKD

SEQ ID NO: 1578384 - protein, 20 aa, Staphylococcus aureus
KNKAEELANSIINNINKATS

SEQ ID NO: 1578385 - protein, 19 aa, Staphylococcus aureus
KPLYSKRIYQNLTLDSIVF

SEQ ID NO: 1578386 - protein, 19 aa, Staphylococcus aureus
KRRYNIPKNASTKVELKGM

SEQ ID NO: 1578387 - protein, 18 aa, Staphylococcus aureus
KSFIPVYFIVAFVMFLLF

SEQ ID NO: 1578388 - protein, 20 aa, Staphylococcus aureus
KSQISRTTFYTHYKTKDDFI

SEQ ID NO: 1578389 - protein, 21 aa, Staphylococcus aureus
KTAYDQAVAAAKAILNKQTGS

SEQ ID NO: 1578390 - protein, 26 aa, Staphylococcus aureus
KVAMNKLKLVGADVWTSIESAFAPVM

SEQ ID NO: 1578391 - protein, 17 aa, Staphylococcus aureus
LANYVFFDIELKNLLLY

SEQ ID NO: 1578392 - protein, 27 aa, Staphylococcus aureus
LDFLMFIRRFIVLLFVFACITTLLWLI

SEQ ID NO: 1578393 - protein, 25 aa, Staphylococcus aureus
LEHTGRYAYVITMLRRNGYHVIMGD

SEQ ID NO: 1578394 - protein, 18 aa, Staphylococcus aureus
LFISLFILYNEFRSGNLG

SEQ ID NO: 1578395 - protein, 23 aa, Staphylococcus aureus
LFKGDSKGAVTLEKIFPPETVAG

SEQ ID NO: 1578396 - protein, 17 aa, Staphylococcus aureus
LIVPYMIFFAFFSIYYF

SEQ ID NO: 1578397 - protein, 22 aa, Staphylococcus aureus
LKEIKDLVKAKENAKQDVDKQV

SEQ ID NO: 1578398 - protein, 17 aa, Staphylococcus aureus
LKEIYSNSVGAQFGQDA

SEQ ID NO: 1578399 - protein, 26 aa, Staphylococcus aureus
LKGIILAIVGACLWGLGGTVSDFLFK

SEQ ID NO: 1578400 - protein, 20 aa, Staphylococcus aureus
LKLFKLGGKVLLLYFMFCAI

SEQ ID NO: 1578401 - protein, 22 aa, Staphylococcus aureus
LLEIIGSMIIVVWGSSIWSQIR

SEQ ID NO: 1578402 - protein, 23 aa, Staphylococcus aureus
LLFIKQITDLFGLDLSTQLNQAS

SEQ ID NO: 1578403 - protein, 18 aa, Staphylococcus aureus
LLYFMFCAIISVIQNIVG

SEQ ID NO: 1578404 - protein, 20 aa, Staphylococcus aureus
LNLAAIIIISIVVSGDMFLA

SEQ ID NO: 1578405 - protein, 21 aa, Staphylococcus aureus
LPALIIGAAPFYARLVEIAFK

SEQ ID NO: 1578406 - protein, 25 aa, Staphylococcus aureus
LPDVVVRWLSFIPITLFTALVIDSI

SEQ ID NO: 1578407 - protein, 19 aa, Staphylococcus aureus
LRGTALQKVPVNISGIPLD

SEQ ID NO: 1578408 - protein, 20 aa, Staphylococcus aureus
LRLLLTLCIMGFLLFGTHIY

SEQ ID NO: 1578409 - protein, 19 aa, Staphylococcus aureus
LSLTMIFLLLTYFKEVKLY

SEQ ID NO: 1578410 - protein, 17 aa, Staphylococcus aureus
LTIKDIIPRLSRAKLYT

SEQ ID NO: 1578411 - protein, 17 aa, Staphylococcus aureus
LTYKYRRFVTPVTIRIK

SEQ ID NO: 1578412 - protein, 17 aa, Staphylococcus aureus
LVFVIGIIMSKSKEVYY

SEQ ID NO: 1578413 - protein, 20 aa, Staphylococcus aureus
MFAIWQVMQFIWPAVKALIV

SEQ ID NO: 1578414 - protein, 19 aa, Staphylococcus aureus
MFINKIINRHEMSAKDTTF

SEQ ID NO: 1578415 - protein, 23 aa, Staphylococcus aureus
MIIFSIKYLKDFSLKNVYPSWTV

SEQ ID NO: 1578416 - protein, 17 aa, Staphylococcus aureus
NAAQRVSGVTDLKNSAT

SEQ ID NO: 1578417 - protein, 17 aa, Staphylococcus aureus
NADQRNGFIQSLKDDPS

SEQ ID NO: 1578418 - protein, 17 aa, Staphylococcus aureus
NDKVHFSNIDIAIDKGH

SEQ ID NO: 1578419 - protein, 17 aa, Staphylococcus aureus
NEMIEFPNGKRVITPNT

SEQ ID NO: 1578420 - protein, 28 aa, Staphylococcus aureus
NGTLPRFHFGTTMWKDIKSSASSAFNWT

SEQ ID NO: 1578421 - protein, 22 aa, Staphylococcus aureus
NKGELLPIIFFAVFFGLGLAAV

SEQ ID NO: 1578422 - protein, 20 aa, Staphylococcus aureus
NNQKLPVRLVSYSPVPEDHA

SEQ ID NO: 1578423 - protein, 19 aa, Staphylococcus aureus
NPSGHLINPTQAMDIAYTE

SEQ ID NO: 1578424 - protein, 40 aa, Staphylococcus aureus
NTITIRPQDYVVFIPPVGKQIRAVVYYNKVVASNMSNAVT

SEQ ID NO: 1578425 - protein, 28 aa, Staphylococcus aureus
NTKDDVKATLTMPAYIDPENVTKTGNVT

SEQ ID NO: 1578426 - protein, 19 aa, Staphylococcus aureus
NVTLATGIGSTTANKTVLV

SEQ ID NO: 1578427 - protein, 24 aa, Staphylococcus aureus
NYIDSDELFALFIDGQWGVGKTYY

SEQ ID NO: 1578428 - protein, 18 aa, Staphylococcus aureus
PGETSATVTKNWDDNNNQ

SEQ ID NO: 1578429 - protein, 38 aa, Staphylococcus aureus
PHEGQRVVLKYKLKFQDGLKTGDYFDFTLSNNVNTHGV

SEQ ID NO: 1578430 - protein, 17 aa, Staphylococcus aureus
PIFAASQGWIWTVTLVG

SEQ ID NO: 1578431 - protein, 21 aa, Staphylococcus aureus
PNTFELYNWPTLAIHLSYYVT

SEQ ID NO: 1578432 - protein, 33 aa, Staphylococcus aureus
QAVNTSAPRMRAFSLAAVAADAPAAGKDITNQL

SEQ ID NO: 1578433 - protein, 26 aa, Staphylococcus aureus
QDRTVPLYAVFELFTLGNLVFFTRCM

SEQ ID NO: 1578434 - protein, 26 aa, Staphylococcus aureus
QITTPYIVVVNGHIDPNSKGDLALRS

SEQ ID NO: 1578435 - protein, 18 aa, Staphylococcus aureus
QPISGIVMLLTIAIILGF

SEQ ID NO: 1578436 - protein, 23 aa, Staphylococcus aureus
QQTCRFIIVGVLANFAMYGMLTA

SEQ ID NO: 1578437 - protein, 21 aa, Staphylococcus aureus
QSHLDSGFIFFFIVYVLCISC

SEQ ID NO: 1578438 - protein, 19 aa, Staphylococcus aureus
RAHAPNALMMAAVIIAAGM

SEQ ID NO: 1578439 - protein, 19 aa, Staphylococcus aureus
RNEMIEFPNGKRVLTPNTD

SEQ ID NO: 1578440 - protein, 23 aa, Staphylococcus aureus
RQAKSDAKANLGTLTHLNNAQKQ

SEQ ID NO: 1578441 - protein, 20 aa, Staphylococcus aureus
RRVVLPAALPGILTGFILSL

SEQ ID NO: 1578442 - protein, 21 aa, Staphylococcus aureus
RVEGFSCANCAGKFEKNVKQL

SEQ ID NO: 1578443 - protein, 18 aa, Staphylococcus aureus
SDRIRLSLPKGKYRVNLK

SEQ ID NO: 1578444 - protein, 18 aa, Staphylococcus aureus
SFVDVMIIFLREGLEVLL

SEQ ID NO: 1578445 - protein, 20 aa, Staphylococcus aureus
SILWLIGGILLIWNKYSKDE

SEQ ID NO: 1578446 - protein, 20 aa, Staphylococcus aureus
SLKGPIKLVTAIFQLLFGKI

SEQ ID NO: 1578447 - protein, 25 aa, Staphylococcus aureus
SLNTAMGNLKHALAEKDNTKRSVNY

SEQ ID NO: 1578448 - protein, 18 aa, Staphylococcus aureus
STTTFTINVVDTTAPTVT

SEQ ID NO: 1578449 - protein, 24 aa, Staphylococcus aureus
TALKAAIADKERTKASGNYVNADQ

SEQ ID NO: 1578450 - protein, 19 aa, Staphylococcus aureus
TAVNHDLTEAQALDQLMDA

SEQ ID NO: 1578451 - protein, 17 aa, Staphylococcus aureus
TCCMILLGVFALFIYIN

SEQ ID NO: 1578452 - protein, 22 aa, Staphylococcus aureus
TKTSIALFKYLYKNNELANYVF

SEQ ID NO: 1578453 - protein, 21 aa, Staphylococcus aureus
TLVGAFRFLIAPILAVMDFLG

SEQ ID NO: 1578454 - protein, 20 aa, Staphylococcus aureus
TMLRDIRVQFFGKLVNVIPN

SEQ ID NO: 1578455 - protein, 23 aa, Staphylococcus aureus
TPFYKKHSTLLFATLLIAFGYLS

SEQ ID NO: 1578456 - protein, 19 aa, Staphylococcus aureus
TRPLYLAAMGTFLVGSIVA

SEQ ID NO: 1578457 - protein, 17 aa, Staphylococcus aureus
TSAQRVANVTSIQQTAN

SEQ ID NO: 1578458 - protein, 22 aa, Staphylococcus aureus
TTGADGWGFLFSKGNAEEYLTN

SEQ ID NO: 1578459 - protein, 17 aa, Staphylococcus aureus
TVFICSLMIGKTPSYLG

SEQ ID NO: 1578460 - protein, 25 aa, Staphylococcus aureus
TVGTASILVGTTLIFGLGNQEAKAA

SEQ ID NO: 1578461 - protein, 26 aa, Staphylococcus aureus
TVGTASILVGTTLIFGLGNQEAKAAE

SEQ ID NO: 1578462 - protein, 32 aa, Staphylococcus aureus
TVLVDYEKYGKFYNLSIKGTIDQIDKTNNTYR

SEQ ID NO: 1578463 - protein, 25 aa, Staphylococcus aureus
VAGVMGILGGVFWALMAPIVAISSV

SEQ ID NO: 1578464 - protein, 29 aa, Staphylococcus aureus
VATLDFGDINSAYIIKVVSKYTPTSDGEL

SEQ ID NO: 1578465 - protein, 21 aa, Staphylococcus aureus
VGKEVKNHFYLLENQINVDEI

SEQ ID NO: 1578466 - protein, 26 aa, Staphylococcus aureus
VGSLIMLFILDWKMTLLTFITIPIFV

SEQ ID NO: 1578467 - protein, 18 aa, Staphylococcus aureus
VGTASILVGTTLIFGLGN

SEQ ID NO: 1578468 - protein, 23 aa, Staphylococcus aureus
VKKYKPGFLYPWEKMIAIEHRHH

SEQ ID NO: 1578469 - protein, 18 aa, Staphylococcus aureus
VLKSMKNFQVVPYLNMNN

SEQ ID NO: 1578470 - protein, 18 aa, Staphylococcus aureus
VTAASYFFICYAIASLIT

SEQ ID NO: 1578471 - protein, 32 aa, Staphylococcus aureus
VVSFCFIFLLLVFFRYILKRYFNYSLNYKVWY

SEQ ID NO: 1578472 - protein, 25 aa, Staphylococcus aureus
VYAIIALCLYNFLSSILWLIGGILL

SEQ ID NO: 1578473 - protein, 17 aa, Staphylococcus aureus
WGTVIVQVLTFIVLLAL

SEQ ID NO: 1578474 - protein, 18 aa, Staphylococcus aureus
YAALFILKTIDSHCITDQ

SEQ ID NO: 1578475 - protein, 24 aa, Staphylococcus aureus
YDSDKDYAYIRFPVSNGTREVKIV

SEQ ID NO: 1578476 - protein, 25 aa, Staphylococcus aureus
YDSDKDYAYIRFPVSNGTREVKIVS

SEQ ID NO: 1578477 - protein, 25 aa, Staphylococcus aureus
YEDYRESLSLPDIVANGALPIGLDY

SEQ ID NO: 1578478 - protein, 24 aa, Staphylococcus aureus
YFLKSRMNWIFWILFLNFLMLGIS

SEQ ID NO: 1578479 - protein, 18 aa, Staphylococcus aureus
YGNIKLGNGSTIIDQNTE

SEQ ID NO: 1578480 - protein, 25 aa, Staphylococcus aureus
YIVRRYGWDGFKRAGDYAYATGGKV

SEQ ID NO: 1578481 - protein, 21 aa, Staphylococcus aureus
YKKKFNNIILFIFFITANMIV

SEQ ID NO: 1578482 - protein, 28 aa, Staphylococcus aureus
YKVDNASDLSESYYVNPDNFEDVTDSVN

SEQ ID NO: 1578483 - protein, 20 aa, Staphylococcus aureus
YLQPLVRYIFERIVMAVIVI

SEQ ID NO: 1578484 - protein, 17 aa, Staphylococcus aureus
YPVRILILSGLMIGALF

SEQ ID NO: 1578485 - protein, 21 aa, Staphylococcus aureus
YRYLTTRVKYILIPYILMGLF

SEQ ID NO: 1578486 - protein, 24 aa, Staphylococcus aureus
YTNVSGSFEQVAFAKRENATTDKT

SEQ ID NO: 1578487 - protein, 27 aa, Staphylococcus aureus
YVPYGDDWFAYFMRRLAERPQNLSLAA

SEQ ID NO: 1578488 - protein, 18 aa, Staphylococcus aureus
YYHFFSIKDPADVYYTKK

SEQ ID NO: 1578489 - protein, 24 aa, Staphylococcus aureus
AEKGVYAHYMLKEIHEQPAVMRRI

SEQ ID NO: 1578490 - protein, 19 aa, Staphylococcus aureus
AEQSKKTAYDQAVAAAKAI

SEQ ID NO: 1578491 - protein, 17 aa, Staphylococcus aureus
AEQVIKLNDAVTAAKKA

SEQ ID NO: 1578492 - protein, 18 aa, Staphylococcus aureus
AIFANFFINISLVIAMQI

SEQ ID NO: 1578493 - protein, 22 aa, Staphylococcus aureus
AKAQQLDGAMGQLETSIRDKDT

SEQ ID NO: 1578494 - protein, 17 aa, Staphylococcus aureus
AKEIGAQLASFWKENGS

SEQ ID NO: 1578495 - protein, 19 aa, Staphylococcus aureus
ALDQARNGLTVDKAPLENA

SEQ ID NO: 1578496 - protein, 25 aa, Staphylococcus aureus
ALVLCNFVSAILWFVSAISILGRKK

SEQ ID NO: 1578497 - protein, 17 aa, Staphylococcus aureus
AMFKKWTVMADRMMDGD

SEQ ID NO: 1578498 - protein, 20 aa, Staphylococcus aureus
AMRYIVGKWVPRTGSWRAAF

SEQ ID NO: 1578499 - protein, 17 aa, Staphylococcus aureus
ANFFINISLVIAMQIDD

SEQ ID NO: 1578500 - protein, 24 aa, Staphylococcus aureus
APKRVNAKIRFAVAQPAAVASNNV

SEQ ID NO: 1578501 - protein, 23 aa, Staphylococcus aureus
AQALNQAMEALRNSIQDQQQTES

SEQ ID NO: 1578502 - protein, 18 aa, Staphylococcus aureus
AQFFYFYIIFKLPKLLKE

SEQ ID NO: 1578503 - protein, 19 aa, Staphylococcus aureus
ARQALTPDKAPLQNAKTQL

SEQ ID NO: 1578504 - protein, 19 aa, Staphylococcus aureus
ASGLFAFLRTKIASLVKLF

SEQ ID NO: 1578505 - protein, 21 aa, Staphylococcus aureus
AVLVVGCPCALVISTPISIVS

SEQ ID NO: 1578506 - protein, 22 aa, Staphylococcus aureus
DAAKRQIEGATHVNEVTQAQNN

SEQ ID NO: 1578507 - protein, 20 aa, Staphylococcus aureus
DADNMTLDSGFYKTPKYSLG

SEQ ID NO: 1578508 - protein, 22 aa, Staphylococcus aureus
DAKAFLLRQIEDTFKSKQTEMR

SEQ ID NO: 1578509 - protein, 26 aa, Staphylococcus aureus
DANEKGIKGVYVILKDSNGKELDRTT

SEQ ID NO: 1578510 - protein, 17 aa, Staphylococcus aureus
DFAVIKAYAKEHPEDDI

SEQ ID NO: 1578511 - protein, 28 aa, Staphylococcus aureus
DISKVVLMILMFIGRVGLISFIIMIAGR

SEQ ID NO: 1578512 - protein, 17 aa, Staphylococcus aureus
DITSLYFLYLLFKLNSN

SEQ ID NO: 1578513 - protein, 19 aa, Staphylococcus aureus
DKHTIPSDITDDFTPVDIT

SEQ ID NO: 1578514 - protein, 19 aa, Staphylococcus aureus
DKKLPIKLVSYDTVKDYAY

SEQ ID NO: 1578515 - protein, 23 aa, Staphylococcus aureus
DKTNNTYRQTIYVNPSGDNVIAP

SEQ ID NO: 1578516 - protein, 17 aa, Staphylococcus aureus
DKVNVTANLEINLFIDP

SEQ ID NO: 1578517 - protein, 19 aa, Staphylococcus aureus
DLDHARQALTPDKAPLQNA

SEQ ID NO: 1578518 - protein, 22 aa, Staphylococcus aureus
DPLHMRHFSNNFGNVIKNAIGV

SEQ ID NO: 1578519 - protein, 23 aa, Staphylococcus aureus
DQNTIKQGVNFTDADEAKRNAYT

SEQ ID NO: 1578520 - protein, 21 aa, Staphylococcus aureus
EANTSLIWGLLASLGSLLLFR

SEQ ID NO: 1578521 - protein, 21 aa, Staphylococcus aureus
ELFTLGNLVFFTRCMSQNLNI

SEQ ID NO: 1578522 - protein, 19 aa, Staphylococcus aureus
EQPDEPGEIEPIPEDSDSD

SEQ ID NO: 1578523 - protein, 22 aa, Staphylococcus aureus
ERQRALSYWSIGSWGGSGICSL

SEQ ID NO: 1578524 - protein, 19 aa, Staphylococcus aureus
ESQNIIIFLTWVIITMFFF

SEQ ID NO: 1578525 - protein, 22 aa, Staphylococcus aureus
EVPAEPGKPVPPAKDEPKKPSK

SEQ ID NO: 1578526 - protein, 18 aa, Staphylococcus aureus
FAIFIFSFELQWFPFQGS

SEQ ID NO: 1578527 - protein, 23 aa, Staphylococcus aureus
FAVSIGLISFIVWMLIQNNVDFA

SEQ ID NO: 1578528 - protein, 20 aa, Staphylococcus aureus
FFICQILAFLFPKFPHINLL

SEQ ID NO: 1578529 - protein, 20 aa, Staphylococcus aureus
FGLNMSSFWLLFSGAITAIP

SEQ ID NO: 1578530 - protein, 18 aa, Staphylococcus aureus
FHNIHIKIIYWLVLTTIF

SEQ ID NO: 1578531 - protein, 18 aa, Staphylococcus aureus
FIAGVFAIFIFSFELQWF

SEQ ID NO: 1578532 - protein, 20 aa, Staphylococcus aureus
FIEMIKPKISLISSGKNNMY

SEQ ID NO: 1578533 - protein, 18 aa, Staphylococcus aureus
FILGYSISSIRIYMNTAI

SEQ ID NO: 1578534 - protein, 23 aa, Staphylococcus aureus
FINPKLGKNIPFMLGLFSGGLIF

SEQ ID NO: 1578535 - protein, 21 aa, Staphylococcus aureus
FIQLWDTIKGVFTFDLGTTYK

SEQ ID NO: 1578536 - protein, 21 aa, Staphylococcus aureus
FIVATFHWTAGFSFSAGLIDY

SEQ ID NO: 1578537 - protein, 22 aa, Staphylococcus aureus
FKGDSKGAVTLEKIFPPETVAG

SEQ ID NO: 1578538 - protein, 23 aa, Staphylococcus aureus
FLGAAGGVEWGTVIVQVLTFIVL

SEQ ID NO: 1578539 - protein, 18 aa, Staphylococcus aureus
FVALDLKSKDRDAIKAMF

SEQ ID NO: 1578540 - protein, 32 aa, Staphylococcus aureus
FVNPKQRVLGNTWVYIKGYQDKIEESSGKVSA

SEQ ID NO: 1578541 - protein, 18 aa, Staphylococcus aureus
FVVILRKYVHTFEVQLDN

SEQ ID NO: 1578542 - protein, 25 aa, Staphylococcus aureus
GDQSSEVYSPISPIKIATQDNSGNA

SEQ ID NO: 1578543 - protein, 20 aa, Staphylococcus aureus
GDVKGVVLISIIVTIILFIK

SEQ ID NO: 1578544 - protein, 18 aa, Staphylococcus aureus
GIEALKMGNSILAAALTM

SEQ ID NO: 1578545 - protein, 17 aa, Staphylococcus aureus
GNIKLGNGSTIIDQNTE

SEQ ID NO: 1578546 - protein, 20 aa, Staphylococcus aureus
GTPMLVQVFIVFFGITAALG

SEQ ID NO: 1578547 - protein, 21 aa, Staphylococcus aureus
GVKDRMGVTVNGRIDTLNKAD

SEQ ID NO: 1578548 - protein, 18 aa, Staphylococcus aureus
HDSLANEKTRVRLYKSGK

SEQ ID NO: 1578549 - protein, 54 aa, Staphylococcus aureus
HDSLANEKTRVRLYKSGKNWVKSGIKEIEMFKIMGLPFISHSLVSQDNQSISKK

SEQ ID NO: 1578550 - protein, 37 aa, Staphylococcus aureus
HEGQRVVLKYKLKFQDGLKTGDYFDFTLSNNVNTHGV

SEQ ID NO: 1578551 - protein, 19 aa, Staphylococcus aureus
HGISTLRKVPEIKNSTEDK

SEQ ID NO: 1578552 - protein, 25 aa, Staphylococcus aureus
HHGNFKSKFFISLIFAIPIIILSPM

SEQ ID NO: 1578553 - protein, 25 aa, Staphylococcus aureus
HMIPEVIGNLLLSAAIFLYIMLIDW

SEQ ID NO: 1578554 - protein, 18 aa, Staphylococcus aureus
HTATELNTAMTALKRAIA

SEQ ID NO: 1578555 - protein, 17 aa, Staphylococcus aureus
IDIKQRFFGKGSERHEV

SEQ ID NO: 1578556 - protein, 24 aa, Staphylococcus aureus
IDQASWRVPFIIIVGIAILAFVFG

SEQ ID NO: 1578557 - protein, 22 aa, Staphylococcus aureus
IDRRKKILSQYRVTSISEYRKL

SEQ ID NO: 1578558 - protein, 27 aa, Staphylococcus aureus
IFIALMLKWWLLLVISIIVLIIITVAM

SEQ ID NO: 1578559 - protein, 22 aa, Staphylococcus aureus
IFLTITTVFAFFLSSRITKPLR

SEQ ID NO: 1578560 - protein, 19 aa, Staphylococcus aureus
IGSAQKFSTGLLLKQLEEE

SEQ ID NO: 1578561 - protein, 19 aa, Staphylococcus aureus
IHIKIIYWLVLTTIFFIAN

SEQ ID NO: 1578562 - protein, 19 aa, Staphylococcus aureus
IILSPMMGVKLPFQISFTG

SEQ ID NO: 1578563 - protein, 19 aa, Staphylococcus aureus
IIVSAFSKVVTWVTKLPTS

SEQ ID NO: 1578564 - protein, 26 aa, Staphylococcus aureus
ILIKSSRLNNILTILSIVLAIIHMGI

SEQ ID NO: 1578565 - protein, 18 aa, Staphylococcus aureus
ILISLGISIVYWIGSVIL

SEQ ID NO: 1578566 - protein, 19 aa, Staphylococcus aureus
ILVGTTLIFGLGNQEAKAA

SEQ ID NO: 1578567 - protein, 26 aa, Staphylococcus aureus
INFGDIDSAYIVKVVSKYTPGAEDDL

SEQ ID NO: 1578568 - protein, 23 aa, Staphylococcus aureus
IPFNLLHLLSLKVVSIMIVLVAC

SEQ ID NO: 1578569 - protein, 19 aa, Staphylococcus aureus
ISLPAFFIGIILLFIVTNL

SEQ ID NO: 1578570 - protein, 19 aa, Staphylococcus aureus
ISPEVFGVWSGTSLHEIAH

SEQ ID NO: 1578571 - protein, 19 aa, Staphylococcus aureus
ISVAYIYSLYAFYMNNFSG

SEQ ID NO: 1578572 - protein, 27 aa, Staphylococcus aureus
ITHSIPFTILWPILITFLIFTFFSGTH

SEQ ID NO: 1578573 - protein, 27 aa, Staphylococcus aureus
IVSLCFLFICIYLNMAIGSSKINFSDI

SEQ ID NO: 1578574 - protein, 20 aa, Staphylococcus aureus
KATFEFIFNFIIKPIMFAIW

SEQ ID NO: 1578575 - protein, 19 aa, Staphylococcus aureus
KDIIPPKTYSGNVDQVVTI

SEQ ID NO: 1578576 - protein, 20 aa, Staphylococcus aureus
KDLTAELSLNLFIDPTTVTK

SEQ ID NO: 1578577 - protein, 25 aa, Staphylococcus aureus
KELAKRKQEAISRIKDFSNEKINSI

SEQ ID NO: 1578578 - protein, 21 aa, Staphylococcus aureus
KEVPNETNLNLTFATADKETS

SEQ ID NO: 1578579 - protein, 27 aa, Staphylococcus aureus
KGQVLDNGRIRYTFTDYIKDKVNVTAN

SEQ ID NO: 1578580 - protein, 18 aa, Staphylococcus aureus
KKDIIGNISLRYYPFSKW

SEQ ID NO: 1578581 - protein, 22 aa, Staphylococcus aureus
KSIHLLFFLPYRKSFKVHKLTK

SEQ ID NO: 1578582 - protein, 29 aa, Staphylococcus aureus
KSTAPKSLNTRMRMAAIQPNSTDSKNVND

SEQ ID NO: 1578583 - protein, 26 aa, Staphylococcus aureus
KTIVPAQDYLSLKSQITVDDKVKSGD

SEQ ID NO: 1578584 - protein, 26 aa, Staphylococcus aureus
KWVPRTGSWRAAFKRAGDYAYASGGK

SEQ ID NO: 1578585 - protein, 24 aa, Staphylococcus aureus
LARLEQGKFAFAFASGIAAISAVL

SEQ ID NO: 1578586 - protein, 24 aa, Staphylococcus aureus
LDGAMQRLESAIANKDQTKASENY

SEQ ID NO: 1578587 - protein, 17 aa, Staphylococcus aureus
LDIKFYSLDGINGLSLL

SEQ ID NO: 1578588 - protein, 17 aa, Staphylococcus aureus
LEVPFMIILGVLSSRLH

SEQ ID NO: 1578589 - protein, 24 aa, Staphylococcus aureus
LFAYFKPHLLYLLIGTAIIFVICK

SEQ ID NO: 1578590 - protein, 19 aa, Staphylococcus aureus
LFVVILRKYVHTFEVQLDN

SEQ ID NO: 1578591 - protein, 18 aa, Staphylococcus aureus
LGKLGRVFLLIPLSIILI

SEQ ID NO: 1578592 - protein, 19 aa, Staphylococcus aureus
LGLMIPLLILISIVVFSLA

SEQ ID NO: 1578593 - protein, 27 aa, Staphylococcus aureus
LGPLAARLVALVTKFGWAKTGTLVLSK

SEQ ID NO: 1578594 - protein, 17 aa, Staphylococcus aureus
LIGTIFSTIVIALLRTI

SEQ ID NO: 1578595 - protein, 17 aa, Staphylococcus aureus
LILLTFVTIFSVPFNIN

SEQ ID NO: 1578596 - protein, 20 aa, Staphylococcus aureus
LIVHRDDIITEQDILAHINL

SEQ ID NO: 1578597 - protein, 19 aa, Staphylococcus aureus
LKANIWFLIIFVLTVLVFN

SEQ ID NO: 1578598 - protein, 22 aa, Staphylococcus aureus
LKGRRAIVAIGCMFMITFVVLF

SEQ ID NO: 1578599 - protein, 23 aa, Staphylococcus aureus
LKIANEYKIPTYVLGVGLGGLIL

SEQ ID NO: 1578600 - protein, 18 aa, Staphylococcus aureus
LKVTSAYEYLEARFGPSI

SEQ ID NO: 1578601 - protein, 17 aa, Staphylococcus aureus
LLSSIIIAFGIKLPILI

SEQ ID NO: 1578602 - protein, 24 aa, Staphylococcus aureus
LNKADGKFSHFAYVKPNNQSLSSV

SEQ ID NO: 1578603 - protein, 25 aa, Staphylococcus aureus
LRTKIASLVKLFPILGVSISSLTLP

SEQ ID NO: 1578604 - protein, 24 aa, Staphylococcus aureus
LSVSTSLRSSESVSESDSLSDSKS

SEQ ID NO: 1578605 - protein, 34 aa, Staphylococcus aureus
LTGYPENRYKTYYYYNNGYTLTWDNGLVLYSNKA

SEQ ID NO: 1578606 - protein, 20 aa, Staphylococcus aureus
LTITTVFAFFLSSRITKPLR

SEQ ID NO: 1578607 - protein, 18 aa, Staphylococcus aureus
LTYKYRRFVTPVTIRIKA

SEQ ID NO: 1578608 - protein, 20 aa, Staphylococcus aureus
LVLTGLPWSGFMGSKIAGMM

SEQ ID NO: 1578609 - protein, 17 aa, Staphylococcus aureus
LYLKSYRNFMVSYFYQL

SEQ ID NO: 1578610 - protein, 17 aa, Staphylococcus aureus
MAIGEVIAERKIRYTFT

SEQ ID NO: 1578611 - protein, 29 aa, Staphylococcus aureus
MKLSKIKIISWIASIYIEILRGTPMLVQV

SEQ ID NO: 1578612 - protein, 25 aa, Staphylococcus aureus
MLLKGPLKIISVIFQLLFGKIGLIR

SEQ ID NO: 1578613 - protein, 30 aa, Staphylococcus aureus
MQNASGLPTDGFTYKWNRDTTGTNDANWAA

SEQ ID NO: 1578614 - protein, 18 aa, Staphylococcus aureus
MRTDLKGSEFTFTPEAPK

SEQ ID NO: 1578615 - protein, 36 aa, Staphylococcus aureus
NAERVTLKYKWKFGEGIKAGDYFDFTLSDNVETHGI

SEQ ID NO: 1578616 - protein, 21 aa, Staphylococcus aureus
NAKRPLVNKSFFQNKRYASFL

SEQ ID NO: 1578617 - protein, 27 aa, Staphylococcus aureus
NANTNAFRPGGVQELNEYQLSQLFTDQ

SEQ ID NO: 1578618 - protein, 18 aa, Staphylococcus aureus
NAQRQLAIQQINNAETLN

SEQ ID NO: 1578619 - protein, 18 aa, Staphylococcus aureus
NFSGNAYLNGLQQQSNYF

SEQ ID NO: 1578620 - protein, 23 aa, Staphylococcus aureus
NNTGIRMFKRYAVITTSAKILGR

SEQ ID NO: 1578621 - protein, 22 aa, Staphylococcus aureus
NPQLKKRITVIDGHSHTVLQNG

SEQ ID NO: 1578622 - protein, 28 aa, Staphylococcus aureus
NQLRNIGYFHGFKGYNFFLNKEEELNFE

SEQ ID NO: 1578623 - protein, 17 aa, Staphylococcus aureus
NRKKAAISKIKDISTDK

SEQ ID NO: 1578624 - protein, 18 aa, Staphylococcus aureus
NTITEAWNGVKTAVSGAI

SEQ ID NO: 1578625 - protein, 17 aa, Staphylococcus aureus
NVNKASGLFAFLRTKIA

SEQ ID NO: 1578626 - protein, 19 aa, Staphylococcus aureus
PEAYRSGIAFSSKRLLKLA

SEQ ID NO: 1578627 - protein, 18 aa, Staphylococcus aureus
PEKLKELVRNDSNTDRST

SEQ ID NO: 1578628 - protein, 29 aa, Staphylococcus aureus
PEQLYKYYYDRGYTLTWDNGLVLYSNKAN

SEQ ID NO: 1578629 - protein, 23 aa, Staphylococcus aureus
PEVPSEPGTPVPPTPEVPAEPGK

SEQ ID NO: 1578630 - protein, 31 aa, Staphylococcus aureus
PHAGQRAVLKYKLKFENGLHQGDYFDFTLSN

SEQ ID NO: 1578631 - protein, 17 aa, Staphylococcus aureus
PKVLKYIGMVNMYYLSS

SEQ ID NO: 1578632 - protein, 18 aa, Staphylococcus aureus
PKVLKYIGMVNMYYLSSF

SEQ ID NO: 1578633 - protein, 18 aa, Staphylococcus aureus
PLAGVFAVGIFTKRTNTF

SEQ ID NO: 1578634 - protein, 28 aa, Staphylococcus aureus
PMMGVKLPFQISFTGSDWIVLILATILF

SEQ ID NO: 1578635 - protein, 20 aa, Staphylococcus aureus
PSGEVIAKGTFDLNTKTITY

SEQ ID NO: 1578636 - protein, 17 aa, Staphylococcus aureus
PTLAKSIIDQATQAVTD

SEQ ID NO: 1578637 - protein, 18 aa, Staphylococcus aureus
PVQLTWNNGVAFYSNNAQ

SEQ ID NO: 1578638 - protein, 17 aa, Staphylococcus aureus
PYFLLGFVMMALFHTYV

SEQ ID NO: 1578639 - protein, 24 aa, Staphylococcus aureus
PYVEGKTLYDAIVKVHVKTIDYDG

SEQ ID NO: 1578640 - protein, 22 aa, Staphylococcus aureus
QAGQGYRGYGAFVKNDSSGNSQ

SEQ ID NO: 1578641 - protein, 27 aa, Staphylococcus aureus
QDYFLQFEWFQPLLISLAALLILIGLI

SEQ ID NO: 1578642 - protein, 17 aa, Staphylococcus aureus
QIAKKLKQAFIDDLAVS

SEQ ID NO: 1578643 - protein, 18 aa, Staphylococcus aureus
QLTHAFKQAKDNLHGDQK

SEQ ID NO: 1578644 - protein, 22 aa, Staphylococcus aureus
QRLHFYAAIFIAPLLITLTISG

SEQ ID NO: 1578645 - protein, 18 aa, Staphylococcus aureus
QSVLKWAENSSVASRFFN

SEQ ID NO: 1578646 - protein, 18 aa, Staphylococcus aureus
RALILGFFIGFIPINIYN

SEQ ID NO: 1578647 - protein, 29 aa, Staphylococcus aureus
RFDNLDSGKYKVIFEKPAGLTQTGTNTTE

SEQ ID NO: 1578648 - protein, 18 aa, Staphylococcus aureus
RKYSVGTASILVGTTLIF

SEQ ID NO: 1578649 - protein, 18 aa, Staphylococcus aureus
RRGSYHMQFYLILLAILY

SEQ ID NO: 1578650 - protein, 22 aa, Staphylococcus aureus
RTAKGYYFVRTFYRKDKLPDRK

SEQ ID NO: 1578651 - protein, 24 aa, Staphylococcus aureus
RVLLPLSCLISILLMTQGVPQTLH

SEQ ID NO: 1578652 - protein, 21 aa, Staphylococcus aureus
SAADYFKLSNGSAIPDATITW

SEQ ID NO: 1578653 - protein, 22 aa, Staphylococcus aureus
SAMRYIVGKWVPRTGSWRAAFK

SEQ ID NO: 1578654 - protein, 31 aa, Staphylococcus aureus
SDELQYRRAMLFLRAMILHKLLLIANNTTIY

SEQ ID NO: 1578655 - protein, 19 aa, Staphylococcus aureus
SDFKLEKTAFDPNQSGNTF

SEQ ID NO: 1578656 - protein, 28 aa, Staphylococcus aureus
SDKMSQAWNFIVTKGMQWVSTITSTLIN

SEQ ID NO: 1578657 - protein, 19 aa, Staphylococcus aureus
SELNTAMSNLQRGINDEAA

SEQ ID NO: 1578658 - protein, 17 aa, Staphylococcus aureus
SGVTDLKNSATSLNNAM

SEQ ID NO: 1578659 - protein, 22 aa, Staphylococcus aureus
SIETCLIWFYTFIIFNNVDLKN

SEQ ID NO: 1578660 - protein, 19 aa, Staphylococcus aureus
SKRLLKLAIILYGLKLNIY

SEQ ID NO: 1578661 - protein, 22 aa, Staphylococcus aureus
SKSGKQLARMSVPKGSAHEKQL

SEQ ID NO: 1578662 - protein, 21 aa, Staphylococcus aureus
SKYSGVFIYKDLKSIEDTNNA

SEQ ID NO: 1578663 - protein, 25 aa, Staphylococcus aureus
SLFTGNWRGVWDGIVMILKGTVQLI

SEQ ID NO: 1578664 - protein, 26 aa, Staphylococcus aureus
SNLALTLFIIVCFNAFIIFSVQGNAR

SEQ ID NO: 1578665 - protein, 18 aa, Staphylococcus aureus
SNLKQGIANKDTVKASEN

SEQ ID NO: 1578666 - protein, 25 aa, Staphylococcus aureus
SNTKLYPGQVWTIADLLQITVSNSS

SEQ ID NO: 1578667 - protein, 25 aa, Staphylococcus aureus
SQSVFKWAQNSGVASRFFNMMNTTG

SEQ ID NO: 1578668 - protein, 19 aa, Staphylococcus aureus
STMASELNTAMSNLQRGIN

SEQ ID NO: 1578669 - protein, 26 aa, Staphylococcus aureus
TAPKRLNTRMRIAAVQPSSTEAKNVN

SEQ ID NO: 1578670 - protein, 20 aa, Staphylococcus aureus
TAVKQDLTEVQALDQLMDAL

SEQ ID NO: 1578671 - protein, 18 aa, Staphylococcus aureus
TCCMILLGVFALFIYINT

SEQ ID NO: 1578672 - protein, 17 aa, Staphylococcus aureus
TGLKANIWFLIIFVLTV

SEQ ID NO: 1578673 - protein, 20 aa, Staphylococcus aureus
TIIFSLKCKIHLFFNSINAI

SEQ ID NO: 1578674 - protein, 22 aa, Staphylococcus aureus
TKIASLVKLFPILGVSISSLTL

SEQ ID NO: 1578675 - protein, 26 aa, Staphylococcus aureus
TLDDTKHLPLLFAKRRRKEDEEDVTV

SEQ ID NO: 1578676 - protein, 35 aa, Staphylococcus aureus
TLQMLNVRYSHWLRFVWPVVAFVLIFGGGLLITQV

SEQ ID NO: 1578677 - protein, 19 aa, Staphylococcus aureus
TLVTIIVFLPLVFVSGSVG

SEQ ID NO: 1578678 - protein, 31 aa, Staphylococcus aureus
TMDFFWELATLILIMLLGHWIEMNAVGNAGN

SEQ ID NO: 1578679 - protein, 21 aa, Staphylococcus aureus
TSPWVKEASADNVTGIVGTNN

SEQ ID NO: 1578680 - protein, 17 aa, Staphylococcus aureus
TSTITIVSTDASGNKTT

SEQ ID NO: 1578681 - protein, 19 aa, Staphylococcus aureus
TTLPSGWTSNLTKSDNKNG

SEQ ID NO: 1578682 - protein, 23 aa, Staphylococcus aureus
VAGGGAFGAFVTTDSYGVATTYT

SEQ ID NO: 1578683 - protein, 18 aa, Staphylococcus aureus
VAGSSVLFGIILRKYGNF

SEQ ID NO: 1578684 - protein, 25 aa, Staphylococcus aureus
VAPKRLNAKMRFAVAQPAAVASNNV

SEQ ID NO: 1578685 - protein, 28 aa, Staphylococcus aureus
VATTRKVPDIKNGSLVMAKGQVLDNGRI

SEQ ID NO: 1578686 - protein, 22 aa, Staphylococcus aureus
VFFISRAYNWYELDAKFVEGIK

SEQ ID NO: 1578687 - protein, 17 aa, Staphylococcus aureus
VGIDYALFILFRYRQVM

SEQ ID NO: 1578688 - protein, 19 aa, Staphylococcus aureus
VKQLKRRYNIPKNASTKVE

SEQ ID NO: 1578689 - protein, 30 aa, Staphylococcus aureus
VKSGDYFTIKYSDTVQVYGLNPEDIKNIGD

SEQ ID NO: 1578690 - protein, 17 aa, Staphylococcus aureus
VLHAWSPFIVLTVIVMI

SEQ ID NO: 1578691 - protein, 22 aa, Staphylococcus aureus
VLRVFLGYVHFFFKTSPKASYN

SEQ ID NO: 1578692 - protein, 23 aa, Staphylococcus aureus
VLTYPEIWEWLLFFEITLATLIV

SEQ ID NO: 1578693 - protein, 22 aa, Staphylococcus aureus
VLVGLILLRLFKINLFSFKKLT

SEQ ID NO: 1578694 - protein, 25 aa, Staphylococcus aureus
VNLDFGDITSAYVVMVNTKFQYTNS

SEQ ID NO: 1578695 - protein, 18 aa, Staphylococcus aureus
VPQIHGFNKHNEIIEEDT

SEQ ID NO: 1578696 - protein, 18 aa, Staphylococcus aureus
VTSAQRVANVTSIQQTAN

SEQ ID NO: 1578697 - protein, 18 aa, Staphylococcus aureus
VYLRAIICAIIIVTHLLT

SEQ ID NO: 1578698 - protein, 22 aa, Staphylococcus aureus
WDIFVSKLFLALTVFAMYMVVI

SEQ ID NO: 1578699 - protein, 17 aa, Staphylococcus aureus
WMLATSFLVHGTLKFVD

SEQ ID NO: 1578700 - protein, 28 aa, Staphylococcus aureus
WRMLTVYFIAGLFGNFVSLSFNTTTISV

SEQ ID NO: 1578701 - protein, 24 aa, Staphylococcus aureus
WYNLGEDGHPEWIIPTDPARKNDA

SEQ ID NO: 1578702 - protein, 20 aa, Staphylococcus aureus
YDKEGYRDGEFEKGDKGMWT

SEQ ID NO: 1578703 - protein, 20 aa, Staphylococcus aureus
YENVNAKLELNSYIDKKEVP

SEQ ID NO: 1578704 - protein, 18 aa, Staphylococcus aureus
YGLFSSIMGIGFIAAFLS

SEQ ID NO: 1578705 - protein, 23 aa, Staphylococcus aureus
YITNSWLKPLHMTHTSFKQTNNK

SEQ ID NO: 1578706 - protein, 22 aa, Staphylococcus aureus
YMPEHPISLILPVLVIGTSIAA

SEQ ID NO: 1578707 - protein, 24 aa, Staphylococcus aureus
YQARRVCWFGSALVTIIIGIPLYF

SEQ ID NO: 1578708 - protein, 20 aa, Staphylococcus aureus
ADKDATKATVNFTDADQAKQ

SEQ ID NO: 1578709 - protein, 24 aa, Staphylococcus aureus
AEALNQAMEALRNSIQDQQQTEAG

SEQ ID NO: 1578710 - protein, 19 aa, Staphylococcus aureus
AFAGSFVYIYFMQGVQRFD

SEQ ID NO: 1578711 - protein, 17 aa, Staphylococcus aureus
AGNGSSASDYFKLSNGS

SEQ ID NO: 1578712 - protein, 18 aa, Staphylococcus aureus
AHINEIFGLYEIIPGFIV

SEQ ID NO: 1578713 - protein, 21 aa, Staphylococcus aureus
AKDLNFRTHLSGYHKNYPYYP

SEQ ID NO: 1578714 - protein, 17 aa, Staphylococcus aureus
ANIYYKSIIKITITVKV

SEQ ID NO: 1578715 - protein, 23 aa, Staphylococcus aureus
AQALNQAMEALRNSIQDQQQTEA

SEQ ID NO: 1578716 - protein, 21 aa, Staphylococcus aureus
ATKSFLVWMLVAAVIGFIFPQ

SEQ ID NO: 1578717 - protein, 22 aa, Staphylococcus aureus
ATLFPIRIVVINSLGFSSNFTM

SEQ ID NO: 1578718 - protein, 33 aa, Staphylococcus aureus
AVFMRPDIGETFSEFRTFLAVLLILLLFISISL

SEQ ID NO: 1578719 - protein, 26 aa, Staphylococcus aureus
CADIIRFVSYLSIPVLSFFNMLSIFQ

SEQ ID NO: 1578720 - protein, 19 aa, Staphylococcus aureus
DEKSFRKYFAKGYSYNSTG

SEQ ID NO: 1578721 - protein, 18 aa, Staphylococcus aureus
DEQKRNAYNQAVSAAETI

SEQ ID NO: 1578722 - protein, 17 aa, Staphylococcus aureus
DGAVNWSCEKPNLLNVA

SEQ ID NO: 1578723 - protein, 21 aa, Staphylococcus aureus
DIQPMPTLLMYGTKDLIVETR

SEQ ID NO: 1578724 - protein, 27 aa, Staphylococcus aureus
DISKVVLMILMFIGRVGLISFIIMIAG

SEQ ID NO: 1578725 - protein, 27 aa, Staphylococcus aureus
DKAKRDAYTNAVSRAETILNKTQGANT

SEQ ID NO: 1578726 - protein, 21 aa, Staphylococcus aureus
DKDLKGAKLKVEAYHPKYPTN

SEQ ID NO: 1578727 - protein, 32 aa, Staphylococcus aureus
DKVKSGDYFTIKYSDTVQVYGLNPEDIKNIGD

SEQ ID NO: 1578728 - protein, 18 aa, Staphylococcus aureus
DLVSTWIAYFLPMINWFI

SEQ ID NO: 1578729 - protein, 17 aa, Staphylococcus aureus
DMNKLRYLYGHTAAYTR

SEQ ID NO: 1578730 - protein, 26 aa, Staphylococcus aureus
DPVTNRDYSIFGWNNENVVRYGGGSA

SEQ ID NO: 1578731 - protein, 46 aa, Staphylococcus aureus
DRDKERKKGGMAKVLLPLIAAVLIIGALAIFGGMALNNHNNGTKEN

SEQ ID NO: 1578732 - protein, 23 aa, Staphylococcus aureus
DSDKDYAYIRFPVSNGAREVKIV

SEQ ID NO: 1578733 - protein, 30 aa, Staphylococcus aureus
DSGSLSVSTSLRKSESVSESSSLSCSQSMS

SEQ ID NO: 1578734 - protein, 25 aa, Staphylococcus aureus
DVTDEFKNKMTYGSNQSVNLDFGDI

SEQ ID NO: 1578735 - protein, 22 aa, Staphylococcus aureus
DYMKHIQNMIGYIPKSDLQVVF

SEQ ID NO: 1578736 - protein, 27 aa, Staphylococcus aureus
DYTLDTDKTKYSWSNSYSNVNGSSTAN

SEQ ID NO: 1578737 - protein, 22 aa, Staphylococcus aureus
EAKESKEPLPDTGSEDEANTSL

SEQ ID NO: 1578738 - protein, 20 aa, Staphylococcus aureus
EAVKILKDIRVDGKTDQQIA

SEQ ID NO: 1578739 - protein, 24 aa, Staphylococcus aureus
EEIEHAKAQLAQALQDIKDLVKAK

SEQ ID NO: 1578740 - protein, 18 aa, Staphylococcus aureus
EELIKKLSIAVDWFSNLS

SEQ ID NO: 1578741 - protein, 19 aa, Staphylococcus aureus
EFQTHLFGYYNYYYTSNLT

SEQ ID NO: 1578742 - protein, 22 aa, Staphylococcus aureus
EIKPRMKRSTDVTAVAEKEVVE

SEQ ID NO: 1578743 - protein, 26 aa, Staphylococcus aureus
EKLNNRKSEALQRLDQLTHLNNAQRQ

SEQ ID NO: 1578744 - protein, 25 aa, Staphylococcus aureus
ENVKKTGNVTLATGIGSTTANKTVL

SEQ ID NO: 1578745 - protein, 20 aa, Staphylococcus aureus
EQQARITLYLKHNTIEPNTI

SEQ ID NO: 1578746 - protein, 19 aa, Staphylococcus aureus
ESRKRYSPDSTYKIYLALF

SEQ ID NO: 1578747 - protein, 22 aa, Staphylococcus aureus
EYLRKFLEGYKYVVENRYNYQF

SEQ ID NO: 1578748 - protein, 19 aa, Staphylococcus aureus
FAGSFSIFSLIALMTIEPQ

SEQ ID NO: 1578749 - protein, 27 aa, Staphylococcus aureus
FDNLDSGKYKVIFEKPTGLTQTGTNTT

SEQ ID NO: 1578750 - protein, 20 aa, Staphylococcus aureus
FDTNGGYSLNFNNLDQSKNY

SEQ ID NO: 1578751 - protein, 17 aa, Staphylococcus aureus
FEESYGFLSEPFVRDKD

SEQ ID NO: 1578752 - protein, 18 aa, Staphylococcus aureus
FFCGGLSIMFLDVLISLS

SEQ ID NO: 1578753 - protein, 18 aa, Staphylococcus aureus
FIDRENADSGTFNYVKGI

SEQ ID NO: 1578754 - protein, 20 aa, Staphylococcus aureus
FIKHYKRTLLLSLILTVLSG

SEQ ID NO: 1578755 - protein, 23 aa, Staphylococcus aureus
FKIATPVFKPLFAWQMSGILLWI

SEQ ID NO: 1578756 - protein, 18 aa, Staphylococcus aureus
FKQGLLIVFAYFFLGSAS

SEQ ID NO: 1578757 - protein, 18 aa, Staphylococcus aureus
FLKGIKITILISLIGVAL

SEQ ID NO: 1578758 - protein, 17 aa, Staphylococcus aureus
FNSSPIGHKKKLDQDDE

SEQ ID NO: 1578759 - protein, 20 aa, Staphylococcus aureus
FRITEMNWEGAFKVNERTLK

SEQ ID NO: 1578760 - protein, 19 aa, Staphylococcus aureus
FSKKCTYWVTLIISQILLT

SEQ ID NO: 1578761 - protein, 29 aa, Staphylococcus aureus
FVNPKQRVLGNTWVYIKGYQDKIEESSGK

SEQ ID NO: 1578762 - protein, 17 aa, Staphylococcus aureus
FYKNPDFKKVNPSKYKY

SEQ ID NO: 1578763 - protein, 17 aa, Staphylococcus aureus
GALPALIIGAAPFYARL

SEQ ID NO: 1578764 - protein, 17 aa, Staphylococcus aureus
GETGLNGAAVGIGGLSN

SEQ ID NO: 1578765 - protein, 31 aa, Staphylococcus aureus
GGLKDGETYTVKFETPAGYLPTKENGTTDGE

SEQ ID NO: 1578766 - protein, 28 aa, Staphylococcus aureus
GIHFSETLARLGIVLGAFLTTLQMGLYM

SEQ ID NO: 1578767 - protein, 19 aa, Staphylococcus aureus
GKDKLKEPIIEHSTPIELE

SEQ ID NO: 1578768 - protein, 22 aa, Staphylococcus aureus
GKNEPSSFVISPFSAVQQQIKR

SEQ ID NO: 1578769 - protein, 27 aa, Staphylococcus aureus
GLNMTFNYCKKRVWSYDMDRMDQVLTN

SEQ ID NO: 1578770 - protein, 24 aa, Staphylococcus aureus
GLSIPEFIIMIALASFFQPSLWNL

SEQ ID NO: 1578771 - protein, 19 aa, Staphylococcus aureus
GRMARLVGMILIAIVTFIY

SEQ ID NO: 1578772 - protein, 18 aa, Staphylococcus aureus
HGISTLRKVPEIKSTDGQ

SEQ ID NO: 1578773 - protein, 17 aa, Staphylococcus aureus
HGTVSIYDALRQSFNIP

SEQ ID NO: 1578774 - protein, 18 aa, Staphylococcus aureus
IADIKSTNGDVVAKATYD

SEQ ID NO: 1578775 - protein, 25 aa, Staphylococcus aureus
IAIGYKFLSKRSMYLTILVTILISI

SEQ ID NO: 1578776 - protein, 22 aa, Staphylococcus aureus
IAIMPSFYLWFFGEEFASTVPL

SEQ ID NO: 1578777 - protein, 19 aa, Staphylococcus aureus
IDFDSVPHIHGFNKHTEII

SEQ ID NO: 1578778 - protein, 18 aa, Staphylococcus aureus
IEINEKVKAVAPTKQKQA

SEQ ID NO: 1578779 - protein, 18 aa, Staphylococcus aureus
IFATIIVGIIKFGIPMLI

SEQ ID NO: 1578780 - protein, 17 aa, Staphylococcus aureus
IFLGEWSSMTQIIFGLI

SEQ ID NO: 1578781 - protein, 19 aa, Staphylococcus aureus
IGIPLYFTLFVPHLSTEIY

SEQ ID NO: 1578782 - protein, 17 aa, Staphylococcus aureus
IIFSYLIGIVSLFTGLI

SEQ ID NO: 1578783 - protein, 24 aa, Staphylococcus aureus
IIGAELDISWFYAGTEKFKIPSLS

SEQ ID NO: 1578784 - protein, 17 aa, Staphylococcus aureus
IILDPILIFGFDLNVVG

SEQ ID NO: 1578785 - protein, 22 aa, Staphylococcus aureus
IKERGELRVGLSADYAPMEFEH

SEQ ID NO: 1578786 - protein, 18 aa, Staphylococcus aureus
ILFVCVYILFSRYANITL

SEQ ID NO: 1578787 - protein, 17 aa, Staphylococcus aureus
ILGLVAWMCGINIMNII

SEQ ID NO: 1578788 - protein, 18 aa, Staphylococcus aureus
ILGLVAWMCGINIMNIIR

SEQ ID NO: 1578789 - protein, 17 aa, Staphylococcus aureus
IPGFIVSVIVTYVVSKL

SEQ ID NO: 1578790 - protein, 17 aa, Staphylococcus aureus
IPSNGVWYDHIGIDKER

SEQ ID NO: 1578791 - protein, 18 aa, Staphylococcus aureus
IRIKFNVIRHTKDLIKHM

SEQ ID NO: 1578792 - protein, 22 aa, Staphylococcus aureus
KANNRFSHVAFIKPNNGKTTSV

SEQ ID NO: 1578793 - protein, 25 aa, Staphylococcus aureus
KAQALDHAMELLRNSVADNQATLAS

SEQ ID NO: 1578794 - protein, 18 aa, Staphylococcus aureus
KDFIANVSHELRTPISLL

SEQ ID NO: 1578795 - protein, 22 aa, Staphylococcus aureus
KDLKLLDYRVQQILEGVLSEST

SEQ ID NO: 1578796 - protein, 20 aa, Staphylococcus aureus
KDLTAELSLNLFIDPTTVTQ

SEQ ID NO: 1578797 - protein, 24 aa, Staphylococcus aureus
KEDAKNAIKALANAKRDQINSNPD

SEQ ID NO: 1578798 - protein, 19 aa, Staphylococcus aureus
KFDRFKFYNSKAHPDLTVK

SEQ ID NO: 1578799 - protein, 20 aa, Staphylococcus aureus
KFNPNAKNFKIYEVTDQNQF

SEQ ID NO: 1578800 - protein, 29 aa, Staphylococcus aureus
KGLFYSVLFWLCILSFFSVLNEMVLNVSL

SEQ ID NO: 1578801 - protein, 29 aa, Staphylococcus aureus
KGSIEGTKHLPLLFAKRRRKEDEEDAIVE

SEQ ID NO: 1578802 - protein, 18 aa, Staphylococcus aureus
KIAIWIGIVAQIYFSVVF

SEQ ID NO: 1578803 - protein, 22 aa, Staphylococcus aureus
KLFIKPLWQYHCRFYKVDQLSV

SEQ ID NO: 1578804 - protein, 19 aa, Staphylococcus aureus
KPHAVRDMNGHALPLTKDG

SEQ ID NO: 1578805 - protein, 17 aa, Staphylococcus aureus
KPNGANISSQIIGVDTA

SEQ ID NO: 1578806 - protein, 19 aa, Staphylococcus aureus
KTAAIAIILAPEFYNAIKD

SEQ ID NO: 1578807 - protein, 20 aa, Staphylococcus aureus
KVDLDGSGFNRGVTGLNRQM

SEQ ID NO: 1578808 - protein, 24 aa, Staphylococcus aureus
KVLLMLLLYRFAYYFVPVIIALIL

SEQ ID NO: 1578809 - protein, 35 aa, Staphylococcus aureus
KYEGHGNGGDGIGFAFSPGVLGETGLNGAAVGIGG

SEQ ID NO: 1578810 - protein, 18 aa, Staphylococcus aureus
KYKRPVIDVIEERIPNTI

SEQ ID NO: 1578811 - protein, 17 aa, Staphylococcus aureus
LDQAMERLINGIQDKDQ

SEQ ID NO: 1578812 - protein, 17 aa, Staphylococcus aureus
LFNYGIDGLISFNSKPL

SEQ ID NO: 1578813 - protein, 18 aa, Staphylococcus aureus
LFTDRAKAPKSGTYDANI

SEQ ID NO: 1578814 - protein, 25 aa, Staphylococcus aureus
LGLDDIRNTHVWEVDEQPAVNEIFE

SEQ ID NO: 1578815 - protein, 29 aa, Staphylococcus aureus
LGLNMTFNYCKKRVWSYDMDRMDQVLTNL

SEQ ID NO: 1578816 - protein, 23 aa, Staphylococcus aureus
LGYTIGYWLARLLKLDRQDQKAV

SEQ ID NO: 1578817 - protein, 23 aa, Staphylococcus aureus
LIAIMPSFYLWFFGEEFASTVPL

SEQ ID NO: 1578818 - protein, 17 aa, Staphylococcus aureus
LIGYVFAPIAFLMGIPW

SEQ ID NO: 1578819 - protein, 20 aa, Staphylococcus aureus
LKDLMLHQSGLYKYKSSKDY

SEQ ID NO: 1578820 - protein, 19 aa, Staphylococcus aureus
LKQNPKLGISNVKFNEEEK

SEQ ID NO: 1578821 - protein, 17 aa, Staphylococcus aureus
LNISSGAGSVRISDVDL

SEQ ID NO: 1578822 - protein, 25 aa, Staphylococcus aureus
LNNGIARILAVQIVTSDHSKPSSNS

SEQ ID NO: 1578823 - protein, 20 aa, Staphylococcus aureus
LPYIPLLVLFAGVANLIPFL

SEQ ID NO: 1578824 - protein, 17 aa, Staphylococcus aureus
LQKLLAPYHKAKTLERQ

SEQ ID NO: 1578825 - protein, 19 aa, Staphylococcus aureus
LRALILGFFIGFIPINIYN

SEQ ID NO: 1578826 - protein, 42 aa, Staphylococcus aureus
LTDVKVTIDSGTTVYPHQAGYVKLNYGFSVPNSAVKGDTFKI

SEQ ID NO: 1578827 - protein, 19 aa, Staphylococcus aureus
LTYKYRRVVTPVTIRIKAP

SEQ ID NO: 1578828 - protein, 23 aa, Staphylococcus aureus
LTYNSLRLFGSFGNLVFGMTVIL

SEQ ID NO: 1578829 - protein, 26 aa, Staphylococcus aureus
LVFYHLKLDVEFASILGLTKDKSLLQ

SEQ ID NO: 1578830 - protein, 21 aa, Staphylococcus aureus
LYNAQGNIIAKGIYDSTTNTT

SEQ ID NO: 1578831 - protein, 30 aa, Staphylococcus aureus
MATGEVLEGGKIRYTFTNDIEDKVDVTAEL

SEQ ID NO: 1578832 - protein, 18 aa, Staphylococcus aureus
MHIDGNLKGSSVGYKKLE

SEQ ID NO: 1578833 - protein, 19 aa, Staphylococcus aureus
MMRIYKDVDTFVVISHLGI

SEQ ID NO: 1578834 - protein, 17 aa, Staphylococcus aureus
MNARWIPTVEKIMKDLG

SEQ ID NO: 1578835 - protein, 18 aa, Staphylococcus aureus
MSNIYTILPWFLITIPII

SEQ ID NO: 1578836 - protein, 19 aa, Staphylococcus aureus
MVQNLWWGAGYNVIAVPLA

SEQ ID NO: 1578837 - protein, 17 aa, Staphylococcus aureus
NEARIAYEADMRKPLYS

SEQ ID NO: 1578838 - protein, 21 aa, Staphylococcus aureus
NEYRIPRTLLGIIIGSSLAIS

SEQ ID NO: 1578839 - protein, 24 aa, Staphylococcus aureus
NFGDINKTYVVLVEGHYDNTGKNL

SEQ ID NO: 1578840 - protein, 22 aa, Staphylococcus aureus
NGDSLIPYALVFIGLIIFISVV

SEQ ID NO: 1578841 - protein, 26 aa, Staphylococcus aureus
NGTLFGGLFAALGSLLLFGRRKKQNK

SEQ ID NO: 1578842 - protein, 27 aa, Staphylococcus aureus
NGWFQGMGWPPSGRVLVHWFSVSERGS

SEQ ID NO: 1578843 - protein, 24 aa, Staphylococcus aureus
NIVGAKWVFFTSFIVLLFPIFFLG

SEQ ID NO: 1578844 - protein, 23 aa, Staphylococcus aureus
NKVDGKFSHFAYMKPNNQSLSSV

SEQ ID NO: 1578845 - protein, 35 aa, Staphylococcus aureus
NKYSIRRFTVGTTSVIVGATILFGIGNHQAQASEQ

SEQ ID NO: 1578846 - protein, 17 aa, Staphylococcus aureus
NMSLDFDTNGGYSLNFN

SEQ ID NO: 1578847 - protein, 27 aa, Staphylococcus aureus
NNGMLFGGLFSILGLALLRRNKKNHKA

SEQ ID NO: 1578848 - protein, 20 aa, Staphylococcus aureus
NNPSGHLINPTQAMDIAYTE

SEQ ID NO: 1578849 - protein, 22 aa, Staphylococcus aureus
NPLIKSVEIHKQLPNTLNVDIT

SEQ ID NO: 1578850 - protein, 21 aa, Staphylococcus aureus
NRLNGGLFGQVFTVYYNDKYV

SEQ ID NO: 1578851 - protein, 23 aa, Staphylococcus aureus
NRVVLIPTFKQGLLIVFAYFFLG

SEQ ID NO: 1578852 - protein, 23 aa, Staphylococcus aureus
NTLNQAMHGLRESIQDNAATKAN

SEQ ID NO: 1578853 - protein, 20 aa, Staphylococcus aureus
NTYTKQTFVTNLTGYKFNPN

SEQ ID NO: 1578854 - protein, 29 aa, Staphylococcus aureus
PAAYYITRSKFQNILLMIMIIPTWINLLL

SEQ ID NO: 1578855 - protein, 32 aa, Staphylococcus aureus
PATGKDYSIFGWNNENVVRYGGGSADGDSAVN

SEQ ID NO: 1578856 - protein, 20 aa, Staphylococcus aureus
PIADIKSTNGDVVAKATYDI

SEQ ID NO: 1578857 - protein, 20 aa, Staphylococcus aureus
PIVLCMACNSLFKIEMRNKS

SEQ ID NO: 1578858 - protein, 21 aa, Staphylococcus aureus
PIVLCMACNSLFKIEMRNKSF

SEQ ID NO: 1578859 - protein, 19 aa, Staphylococcus aureus
PKITNPLLHEFGTKQYPDE

SEQ ID NO: 1578860 - protein, 18 aa, Staphylococcus aureus
PKSQYRRKRREFFHNEDR

SEQ ID NO: 1578861 - protein, 17 aa, Staphylococcus aureus
PTDLGVSEVTRFNVGNE

SEQ ID NO: 1578862 - protein, 19 aa, Staphylococcus aureus
PWGWKEHLPYLLMLTLSLV

SEQ ID NO: 1578863 - protein, 18 aa, Staphylococcus aureus
QIIARVGPIKVLRIILII

SEQ ID NO: 1578864 - protein, 23 aa, Staphylococcus aureus
QIILYCANYMYIVIYAYITKISD

SEQ ID NO: 1578865 - protein, 26 aa, Staphylococcus aureus
QLKNKIDFSKDFNFKVRVANNHQSNT

SEQ ID NO: 1578866 - protein, 24 aa, Staphylococcus aureus
QNGNQPKVRIFEYLGNNEDIAKSV

SEQ ID NO: 1578867 - protein, 21 aa, Staphylococcus aureus
QSHLDSGFIFFFIVYVLCISY

SEQ ID NO: 1578868 - protein, 23 aa, Staphylococcus aureus
QYPDEYRYGFYVKPTLNRLNGGL

SEQ ID NO: 1578869 - protein, 20 aa, Staphylococcus aureus
REVKIVSSIEYGENFHEDYD

SEQ ID NO: 1578870 - protein, 18 aa, Staphylococcus aureus
RIKTRPLYLAAMGTFLVG

SEQ ID NO: 1578871 - protein, 24 aa, Staphylococcus aureus
RKQALLFEWSRINSMLDTQLYITR

SEQ ID NO: 1578872 - protein, 21 aa, Staphylococcus aureus
RKTSEIELKLDARGRLYYFHQ

SEQ ID NO: 1578873 - protein, 25 aa, Staphylococcus aureus
RRKKLKFGLIIGVLTMISYLLFLLS

SEQ ID NO: 1578874 - protein, 18 aa, Staphylococcus aureus
RSTDVTAVAEKEVVEETK

SEQ ID NO: 1578875 - protein, 29 aa, Staphylococcus aureus
RTFTQFTFKKAIIFAALFILIGFYDGFVG

SEQ ID NO: 1578876 - protein, 22 aa, Staphylococcus aureus
RVRKGAFAFVVIRPILFSCWLF

SEQ ID NO: 1578877 - protein, 18 aa, Staphylococcus aureus
RYIKVLILYIFTTLLSSI

SEQ ID NO: 1578878 - protein, 22 aa, Staphylococcus aureus
SIKKYYTIFLFFHINLATIGGI

SEQ ID NO: 1578879 - protein, 23 aa, Staphylococcus aureus
SLNNAMKGLRDSIANETTVKASQ

SEQ ID NO: 1578880 - protein, 18 aa, Staphylococcus aureus
SNPKGEVNHSNKVSKQHK

SEQ ID NO: 1578881 - protein, 21 aa, Staphylococcus aureus
SRRDGFNPMRIILAGAAVSAM

SEQ ID NO: 1578882 - protein, 20 aa, Staphylococcus aureus
SVHPMLSLFFFYSAFAVPFT

SEQ ID NO: 1578883 - protein, 25 aa, Staphylococcus aureus
TDRRGRIRIVNDMALKMLGMAKEDI

SEQ ID NO: 1578884 - protein, 27 aa, Staphylococcus aureus
TFEYTESAVTQVRYVDVTTGKDIIPPK

SEQ ID NO: 1578885 - protein, 26 aa, Staphylococcus aureus
TKDDVKATLTMPAYIDPENVKKTGNV

SEQ ID NO: 1578886 - protein, 24 aa, Staphylococcus aureus
TKTITYKFTDYVDRYENVNAKLEL

SEQ ID NO: 1578887 - protein, 18 aa, Staphylococcus aureus
TLNWFKNTWGYMNLGASV

SEQ ID NO: 1578888 - protein, 22 aa, Staphylococcus aureus
TNAKLKVQAYHSSYPNNIGQIN

SEQ ID NO: 1578889 - protein, 18 aa, Staphylococcus aureus
TTDPAILLPLYILSFSSV

SEQ ID NO: 1578890 - protein, 26 aa, Staphylococcus aureus
TYDILTKTYTFVFTDYVNDKENINGQ

SEQ ID NO: 1578891 - protein, 21 aa, Staphylococcus aureus
VAFYICFGFSALIFPYVGLRL

SEQ ID NO: 1578892 - protein, 19 aa, Staphylococcus aureus
VDDKVKSGDYFTIKYSDTV

SEQ ID NO: 1578893 - protein, 19 aa, Staphylococcus aureus
VDLVSTWIAYFLPMINWFI

SEQ ID NO: 1578894 - protein, 22 aa, Staphylococcus aureus
VEAYHPKYPTNIGQINQNVTNI

SEQ ID NO: 1578895 - protein, 20 aa, Staphylococcus aureus
VELTACWMIFMILSGTYLLI

SEQ ID NO: 1578896 - protein, 21 aa, Staphylococcus aureus
VELTACWMIFMILSGTYLLIK

SEQ ID NO: 1578897 - protein, 22 aa, Staphylococcus aureus
VETRRAIYFIPIWFILLGFMYL

SEQ ID NO: 1578898 - protein, 18 aa, Staphylococcus aureus
VIFLLGLFFRQKIGAAFR

SEQ ID NO: 1578899 - protein, 30 aa, Staphylococcus aureus
VIHACVLLFIIISIGLVFHRLQTKTNSIEP

SEQ ID NO: 1578900 - protein, 23 aa, Staphylococcus aureus
VLIYFTGWRIIDSIISIVISLII

SEQ ID NO: 1578901 - protein, 28 aa, Staphylococcus aureus
VLQDNEHSPVLIAKRLKDKDGNVETTTS

SEQ ID NO: 1578902 - protein, 37 aa, Staphylococcus aureus
VNKIINLFVCIALLVAIGMGFVSWINRTKNTAVKVPH

SEQ ID NO: 1578903 - protein, 18 aa, Staphylococcus aureus
VPHIHGFNKHTEIIEEDT

SEQ ID NO: 1578904 - protein, 21 aa, Staphylococcus aureus
VSESSSLSCSQSMSDSVSTSD

SEQ ID NO: 1578905 - protein, 24 aa, Staphylococcus aureus
VSTARKVPEIKNGSVVMATGEVLE

SEQ ID NO: 1578906 - protein, 24 aa, Staphylococcus aureus
WDSIDNICTVVWIVLVIILSFKFL

SEQ ID NO: 1578907 - protein, 24 aa, Staphylococcus aureus
WFTWGIPLHEGHLFGIVNKIINLF

SEQ ID NO: 1578908 - protein, 18 aa, Staphylococcus aureus
WGNTRTFTQFTFKKAIIF

SEQ ID NO: 1578909 - protein, 17 aa, Staphylococcus aureus
WINLLLKTYAFIGLLSH

SEQ ID NO: 1578910 - protein, 28 aa, Staphylococcus aureus
YDYYPTMFYKRGKKSFVIHIKKDGSRFQ

SEQ ID NO: 1578911 - protein, 23 aa, Staphylococcus aureus
YEHGGNIIDIDFDSVPHIHGFNK

SEQ ID NO: 1578912 - protein, 27 aa, Staphylococcus aureus
YFSARNSWIRWILGTIISISIAIASLV

SEQ ID NO: 1578913 - protein, 19 aa, Staphylococcus aureus
YILLIIWMYLVLRIIKKRS

SEQ ID NO: 1578914 - protein, 17 aa, Staphylococcus aureus
YNFCVKRNITIKMPKEV

SEQ ID NO: 1578915 - protein, 19 aa, Staphylococcus aureus
YNFTIYVPYGDDWFAYFMR

SEQ ID NO: 1578916 - protein, 19 aa, Staphylococcus aureus
YRYKHCRYAFEKHHLRVRN

SEQ ID NO: 1578917 - protein, 18 aa, Staphylococcus aureus
YRYVLPAIITAGLSDSLF

SEQ ID NO: 1578918 - protein, 25 aa, Staphylococcus aureus
YTSNLTWKNGVAFYSNNAQGDGKDK

SEQ ID NO: 1578919 - protein, 19 aa, Staphylococcus aureus
ADESLKDAIKDPALENKEH

SEQ ID NO: 1578920 - protein, 24 aa, Staphylococcus aureus
AGWLGIPVPFKFSGFSFDVTSTLV

SEQ ID NO: 1578921 - protein, 18 aa, Staphylococcus aureus
AKALNRAMDQLSQEITDN

SEQ ID NO: 1578922 - protein, 20 aa, Staphylococcus aureus
ALTAKGYNYTSVDSSYASTY

SEQ ID NO: 1578923 - protein, 19 aa, Staphylococcus aureus
ANLELDFLMFIRRFIVLLF

SEQ ID NO: 1578924 - protein, 26 aa, Staphylococcus aureus
ANMGTYIKYAFFWIWGFAIVMLVIAM

SEQ ID NO: 1578925 - protein, 26 aa, Staphylococcus aureus
ANNLITYTFTDYVDRFNSVKMGINYS

SEQ ID NO: 1578926 - protein, 18 aa, Staphylococcus aureus
AQHSISISLIFAVILFVS

SEQ ID NO: 1578927 - protein, 25 aa, Staphylococcus aureus
ASIAKAGGLISFLSTKVPILGTVFT

SEQ ID NO: 1578928 - protein, 26 aa, Staphylococcus aureus
ATYIGWRSIFVVSILLTLLAMYLIKH

SEQ ID NO: 1578929 - protein, 24 aa, Staphylococcus aureus
AVSGAIQGVVDWLTQLWGKIQSTL

SEQ ID NO: 1578930 - protein, 22 aa, Staphylococcus aureus
CEIGGGYLIWLWLREGQSSLVG

SEQ ID NO: 1578931 - protein, 19 aa, Staphylococcus aureus
DADNMTLDSGFYKTPKYSL

SEQ ID NO: 1578932 - protein, 23 aa, Staphylococcus aureus
DAVKRQIEGATHVNEVTQAQNNA

SEQ ID NO: 1578933 - protein, 20 aa, Staphylococcus aureus
DAVQIVPLIIKYASELKLYG

SEQ ID NO: 1578934 - protein, 18 aa, Staphylococcus aureus
DAYEFYGKVQSGITTPTQ

SEQ ID NO: 1578935 - protein, 39 aa, Staphylococcus aureus
DAYSQKGAITLGTRIDSNKSFHFSGKVNLGNKYEGNGNG

SEQ ID NO: 1578936 - protein, 17 aa, Staphylococcus aureus
DDAKRLANTLLNSDNTN

SEQ ID NO: 1578937 - protein, 18 aa, Staphylococcus aureus
DEQKRNAYNQAISAAETI

SEQ ID NO: 1578938 - protein, 18 aa, Staphylococcus aureus
DEQKRNAYNQAVSNAETI

SEQ ID NO: 1578939 - protein, 18 aa, Staphylococcus aureus
DFIDYLFIDEAGQAIPQA

SEQ ID NO: 1578940 - protein, 19 aa, Staphylococcus aureus
DGAMQRLQSAIANKDQTKA

SEQ ID NO: 1578941 - protein, 26 aa, Staphylococcus aureus
DKEKQALKDRINQILQQGHNDINNAM

SEQ ID NO: 1578942 - protein, 25 aa, Staphylococcus aureus
DKNSRYGIAGPMPIVMVSIIKSMMH

SEQ ID NO: 1578943 - protein, 24 aa, Staphylococcus aureus
DKTAYKMEVTLGNDTYSEEIIVDY

SEQ ID NO: 1578944 - protein, 19 aa, Staphylococcus aureus
DLNQPQRDALRNQINQAQA

SEQ ID NO: 1578945 - protein, 24 aa, Staphylococcus aureus
DLVGWRYTFLFLIIVSIIVGFLMM

SEQ ID NO: 1578946 - protein, 22 aa, Staphylococcus aureus
DPHLGHALAVVANAKINDQEKL

SEQ ID NO: 1578947 - protein, 23 aa, Staphylococcus aureus
DSPTTFIWVCIITLIAHQLEGNI

SEQ ID NO: 1578948 - protein, 24 aa, Staphylococcus aureus
DVTDEFKNKMTYGSNQSVNLDFGD

SEQ ID NO: 1578949 - protein, 25 aa, Staphylococcus aureus
DVTEQFKDKITYGANDSVNVDFGSI

SEQ ID NO: 1578950 - protein, 26 aa, Staphylococcus aureus
EEHPERYYNGRDYRREQILEEENEKS

SEQ ID NO: 1578951 - protein, 17 aa, Staphylococcus aureus
EEIPFKKERKFNPDLAP

SEQ ID NO: 1578952 - protein, 31 aa, Staphylococcus aureus
EEKSETGELIFKFYRHCFRYNEINLKIQDIF

SEQ ID NO: 1578953 - protein, 32 aa, Staphylococcus aureus
EGNGNGGDGIGFAFSPGVLGETGLNGAAVGIG

SEQ ID NO: 1578954 - protein, 19 aa, Staphylococcus aureus
EIEQAKAQLAQALQDIKDL

SEQ ID NO: 1578955 - protein, 25 aa, Staphylococcus aureus
EKAQAEAGGRPNYRTTGYSQSNATT

SEQ ID NO: 1578956 - protein, 21 aa, Staphylococcus aureus
ETNWKYEFKDLPKYDEGKKIE

SEQ ID NO: 1578957 - protein, 18 aa, Staphylococcus aureus
EWLEVSFLSMLWSVVQVV

SEQ ID NO: 1578958 - protein, 17 aa, Staphylococcus aureus
EYNIPVERFFKTLIGQG

SEQ ID NO: 1578959 - protein, 26 aa, Staphylococcus aureus
FDNLDSGKYKVIFEKPTGLTQTGTNT

SEQ ID NO: 1578960 - protein, 23 aa, Staphylococcus aureus
FGDINKTYVVLVEGHYDNTGKNL

SEQ ID NO: 1578961 - protein, 30 aa, Staphylococcus aureus
FGTAGIRGKFGLGEGRLNKFTIEKLALGLA

SEQ ID NO: 1578962 - protein, 17 aa, Staphylococcus aureus
FIGILGLYLILRKRFNS

SEQ ID NO: 1578963 - protein, 17 aa, Staphylococcus aureus
FIKIGLYFQIAYIVLMA

SEQ ID NO: 1578964 - protein, 20 aa, Staphylococcus aureus
FKIAVGVLVTGAFSLVDAVQ

SEQ ID NO: 1578965 - protein, 25 aa, Staphylococcus aureus
FKMVFKAPRAVIIGVCLQFSIMPTL

SEQ ID NO: 1578966 - protein, 21 aa, Staphylococcus aureus
FLEKLRIELLFRGKTEAEVEE

SEQ ID NO: 1578967 - protein, 23 aa, Staphylococcus aureus
FLEKLRVELLFRGKTEEEVEELL

SEQ ID NO: 1578968 - protein, 24 aa, Staphylococcus aureus
FLKHKHEIEFAGILFSFTGQSSTG

SEQ ID NO: 1578969 - protein, 21 aa, Staphylococcus aureus
FNNKITYNYSSPIAGIDKPNG

SEQ ID NO: 1578970 - protein, 19 aa, Staphylococcus aureus
FTLRKIIFENFSKKCTYWV

SEQ ID NO: 1578971 - protein, 17 aa, Staphylococcus aureus
FTPEAPKTITELEKKVE

SEQ ID NO: 1578972 - protein, 25 aa, Staphylococcus aureus
FTSAYNGFSWFAFLLIIQASTIISM

SEQ ID NO: 1578973 - protein, 25 aa, Staphylococcus aureus
GAGQEVYKIGNYVWEDTNKNGVQDL

SEQ ID NO: 1578974 - protein, 19 aa, Staphylococcus aureus
GEVGVKGVTVVAYDNKTNK

SEQ ID NO: 1578975 - protein, 24 aa, Staphylococcus aureus
GFIITVFMSIVFLSISFAKLIFST

SEQ ID NO: 1578976 - protein, 19 aa, Staphylococcus aureus
GFRGGPAYYITKGLNQKWL

SEQ ID NO: 1578977 - protein, 18 aa, Staphylococcus aureus
GQNMTKAQVEAALNQVTT

SEQ ID NO: 1578978 - protein, 17 aa, Staphylococcus aureus
GSFSIFSLIALMTIEPQ

SEQ ID NO: 1578979 - protein, 25 aa, Staphylococcus aureus
GTVQLIWNLIQLWFVGKILGVVRYF

SEQ ID NO: 1578980 - protein, 40 aa, Staphylococcus aureus
GTYDANINIADEMFDNKITYNYSSPIAGIDKPNGANISSQ

SEQ ID NO: 1578981 - protein, 40 aa, Staphylococcus aureus
GTYDANINIADEMFNNKITYNYSSPIAGIDKPNGANISSQ

SEQ ID NO: 1578982 - protein, 32 aa, Staphylococcus aureus
HAGQRVVLKYKLKFADGLKRGDYFDFTLSNNV

SEQ ID NO: 1578983 - protein, 24 aa, Staphylococcus aureus
HDKDGGFRGGPAYYITKGLNQKWL

SEQ ID NO: 1578984 - protein, 19 aa, Staphylococcus aureus
HIYQGEALGIIGEPESSKA

SEQ ID NO: 1578985 - protein, 24 aa, Staphylococcus aureus
HMIIFSIKYLKGFSLENVYPSWTV

SEQ ID NO: 1578986 - protein, 18 aa, Staphylococcus aureus
HRLVKILLSFVITVIVVY

SEQ ID NO: 1578987 - protein, 25 aa, Staphylococcus aureus
IEHPGKLLNYILEAFGIDFNSLTKG

SEQ ID NO: 1578988 - protein, 18 aa, Staphylococcus aureus
IEINEKVKAVAPTKKPQS

SEQ ID NO: 1578989 - protein, 18 aa, Staphylococcus aureus
IEINEKVKAVAPTKQKQS

SEQ ID NO: 1578990 - protein, 19 aa, Staphylococcus aureus
IEINEKVKAVAPTKQKQSK

SEQ ID NO: 1578991 - protein, 22 aa, Staphylococcus aureus
IFIDDYYLIFLLQGIYIIGAEL

SEQ ID NO: 1578992 - protein, 17 aa, Staphylococcus aureus
IFIYGDIVSDKWFESDV

SEQ ID NO: 1578993 - protein, 21 aa, Staphylococcus aureus
IFLFFKLKYYAIVTILVTMII

SEQ ID NO: 1578994 - protein, 18 aa, Staphylococcus aureus
IGTTVFGGLSLALGAALL

SEQ ID NO: 1578995 - protein, 17 aa, Staphylococcus aureus
IGVFKKSLSAIWNATKS

SEQ ID NO: 1578996 - protein, 18 aa, Staphylococcus aureus
IILCCLLTIIVFKRSEKQ

SEQ ID NO: 1578997 - protein, 29 aa, Staphylococcus aureus
IIVALLILFSFVPIGLWISALAAGVHVGI

SEQ ID NO: 1578998 - protein, 17 aa, Staphylococcus aureus
IIVSAFSKVVTWVTKLP

SEQ ID NO: 1578999 - protein, 19 aa, Staphylococcus aureus
IKYLDGVKDRMGVTVNGRI

SEQ ID NO: 1579000 - protein, 19 aa, Staphylococcus aureus
ILGLVAWMCGINIMNIIRI

SEQ ID NO: 1579001 - protein, 23 aa, Staphylococcus aureus
ILNQELREAIKNPAIKDKDHSAP

SEQ ID NO: 1579002 - protein, 21 aa, Staphylococcus aureus
IPFKKERKFNPDLAPGTEKVT

SEQ ID NO: 1579003 - protein, 17 aa, Staphylococcus aureus
IQLIFAFILLKTTMGIK

SEQ ID NO: 1579004 - protein, 17 aa, Staphylococcus aureus
ISFFCSFMLQGKKKEVD

SEQ ID NO: 1579005 - protein, 28 aa, Staphylococcus aureus
IVSLCFLFICIYLNMAIGSSKINFSDIV

SEQ ID NO: 1579006 - protein, 19 aa, Staphylococcus aureus
IVTSTLVFSSMPFQNAHAD

SEQ ID NO: 1579007 - protein, 20 aa, Staphylococcus aureus
IYYKSIIKITITVKVGTNLQ

SEQ ID NO: 1579008 - protein, 18 aa, Staphylococcus aureus
KAKLKEQVQSATTLDGVQ

SEQ ID NO: 1579009 - protein, 17 aa, Staphylococcus aureus
KEFGGIFATFPAVFLVS

SEQ ID NO: 1579010 - protein, 25 aa, Staphylococcus aureus
KFEPRLEQYEVLKADGNYVQAHNHI

SEQ ID NO: 1579011 - protein, 19 aa, Staphylococcus aureus
KGVFDYRRSLLRTDVVLNS

SEQ ID NO: 1579012 - protein, 17 aa, Staphylococcus aureus
KLALFLLIGIMIKITGT

SEQ ID NO: 1579013 - protein, 19 aa, Staphylococcus aureus
KLDIWTLFAYFKPHLLYLL

SEQ ID NO: 1579014 - protein, 21 aa, Staphylococcus aureus
KNIIAVIAIVIIVYIALKYAP

SEQ ID NO: 1579015 - protein, 23 aa, Staphylococcus aureus
KPSGKRINAIQILNKETGKFENI

SEQ ID NO: 1579016 - protein, 24 aa, Staphylococcus aureus
KPSVRTRAVRSLAVAEPVVNAADA

SEQ ID NO: 1579017 - protein, 18 aa, Staphylococcus aureus
KPTDLGVSEVTRFNVGNE

SEQ ID NO: 1579018 - protein, 22 aa, Staphylococcus aureus
KQITYTFTDYVDKYEDIKSRLT

SEQ ID NO: 1579019 - protein, 20 aa, Staphylococcus aureus
KRNAYNQAISAAETILNKQT

SEQ ID NO: 1579020 - protein, 26 aa, Staphylococcus aureus
KSEIIQSYILSLAINFHPHEVAFLLI

SEQ ID NO: 1579021 - protein, 20 aa, Staphylococcus aureus
KTAYDQAVAAAKAILNKQTG

SEQ ID NO: 1579022 - protein, 20 aa, Staphylococcus aureus
KVILALPMFILLTIYLQPLV

SEQ ID NO: 1579023 - protein, 24 aa, Staphylococcus aureus
KVLKDNEHSPLLFAKRRKDKEEDV

SEQ ID NO: 1579024 - protein, 43 aa, Staphylococcus aureus
KVMTVKYAGQTWTRNISDWIAKSGTTNFSLSMTASTGGATNLQ

SEQ ID NO: 1579025 - protein, 18 aa, Staphylococcus aureus
KVTATGDFGGWQGIYAGV

SEQ ID NO: 1579026 - protein, 17 aa, Staphylococcus aureus
KVYKHIGSDELAESVYA

SEQ ID NO: 1579027 - protein, 26 aa, Staphylococcus aureus
KYEDIKSRLTLYSYIDKKTVPNETSL

SEQ ID NO: 1579028 - protein, 26 aa, Staphylococcus aureus
KYIDFMFASVLAFIFLVYRIYILFID

SEQ ID NO: 1579029 - protein, 18 aa, Staphylococcus aureus
LDALPSLDRMASIFEEGF

SEQ ID NO: 1579030 - protein, 17 aa, Staphylococcus aureus
LDLIKSRIDDMNAIDGS

SEQ ID NO: 1579031 - protein, 19 aa, Staphylococcus aureus
LENIKAWFGSFNEKMSERN

SEQ ID NO: 1579032 - protein, 17 aa, Staphylococcus aureus
LEVPFMIILGVLSSRLQ

SEQ ID NO: 1579033 - protein, 17 aa, Staphylococcus aureus
LFILRLVLLSCLFILTI

SEQ ID NO: 1579034 - protein, 25 aa, Staphylococcus aureus
LFILTISVINLWTFLMLLNLNIANM

SEQ ID NO: 1579035 - protein, 17 aa, Staphylococcus aureus
LFLIISAIVTFFVLSPK

SEQ ID NO: 1579036 - protein, 17 aa, Staphylococcus aureus
LFVCVYILFSRYANITL

SEQ ID NO: 1579037 - protein, 19 aa, Staphylococcus aureus
LGITSGRYSYSLTDYTVQI

SEQ ID NO: 1579038 - protein, 17 aa, Staphylococcus aureus
LGKIKSFFSDFLNAGAE

SEQ ID NO: 1579039 - protein, 26 aa, Staphylococcus aureus
LIGGSRLFWRIYRKYLGGKSFNKKPT

SEQ ID NO: 1579040 - protein, 19 aa, Staphylococcus aureus
LIIKPLWQYHCRFYQVDQL

SEQ ID NO: 1579041 - protein, 17 aa, Staphylococcus aureus
LIILLVIIFCFVCEIIK

SEQ ID NO: 1579042 - protein, 17 aa, Staphylococcus aureus
LILGGIFLKMKYDEKKY

SEQ ID NO: 1579043 - protein, 17 aa, Staphylococcus aureus
LIPFIPIKFSFIKFNNV

SEQ ID NO: 1579044 - protein, 20 aa, Staphylococcus aureus
LIVTSTLVFSSMPFQNAHAD

SEQ ID NO: 1579045 - protein, 20 aa, Staphylococcus aureus
LKFSNVGSRIDINISENEDQ

SEQ ID NO: 1579046 - protein, 21 aa, Staphylococcus aureus
LKGSEFTFTPEAPKTITELEK

SEQ ID NO: 1579047 - protein, 17 aa, Staphylococcus aureus
LKSQIKVDDKVKSGDYF

SEQ ID NO: 1579048 - protein, 23 aa, Staphylococcus aureus
LLFIKQVTDLFGLDLSTQLNQAS

SEQ ID NO: 1579049 - protein, 19 aa, Staphylococcus aureus
LPTTLAIIGGIITLLGVSL

SEQ ID NO: 1579050 - protein, 18 aa, Staphylococcus aureus
LQKLLAPYHKAKTLERQV

SEQ ID NO: 1579051 - protein, 19 aa, Staphylococcus aureus
LRAQEMNIPISIEIPDEVS

SEQ ID NO: 1579052 - protein, 19 aa, Staphylococcus aureus
LVFIVELIQGYSFERAVKV

SEQ ID NO: 1579053 - protein, 26 aa, Staphylococcus aureus
LWVHRRCLKPMFTIANQIAYNNKMVL

SEQ ID NO: 1579054 - protein, 28 aa, Staphylococcus aureus
LYIKKPLRRLTWLMAIIIYCGVYTGALV

SEQ ID NO: 1579055 - protein, 17 aa, Staphylococcus aureus
METLKHLVDNEIPNAEQ

SEQ ID NO: 1579056 - protein, 18 aa, Staphylococcus aureus
MHIDGDLKGSSVGYKRLE

SEQ ID NO: 1579057 - protein, 17 aa, Staphylococcus aureus
MHIDGNLKGSSVGDRKL

SEQ ID NO: 1579058 - protein, 20 aa, Staphylococcus aureus
MMRIYKDVDTFVVISHLGID

SEQ ID NO: 1579059 - protein, 19 aa, Staphylococcus aureus
MSRSLKWRAQRRKERQENS

SEQ ID NO: 1579060 - protein, 49 aa, Staphylococcus aureus
NEKTRVRLYKSGKNWVKSGIKEIEMFKIMGLPFISHSLVSQDNQSISKK

SEQ ID NO: 1579061 - protein, 19 aa, Staphylococcus aureus
NEWLEVSFLSMLWSVVQVV

SEQ ID NO: 1579062 - protein, 19 aa, Staphylococcus aureus
NIPVERFFKTLIGQGDAID

SEQ ID NO: 1579063 - protein, 24 aa, Staphylococcus aureus
NIQYLGGVRDNWGVTANGRIDTLN

SEQ ID NO: 1579064 - protein, 20 aa, Staphylococcus aureus
NLTGYKFNPNAKNFKIYEVT

SEQ ID NO: 1579065 - protein, 27 aa, Staphylococcus aureus
NNAFNVRIGWLILRILAVVFAWMTFLR

SEQ ID NO: 1579066 - protein, 25 aa, Staphylococcus aureus
NNLITYTFTDYVDRFNSVKMGINYS

SEQ ID NO: 1579067 - protein, 18 aa, Staphylococcus aureus
NQTFNYTWFVGGLLGVGY

SEQ ID NO: 1579068 - protein, 23 aa, Staphylococcus aureus
NRPYFHMIWHIFIVIASLLHLIA

SEQ ID NO: 1579069 - protein, 22 aa, Staphylococcus aureus
NSIGSAFTETVSHAGNAEDPGY

SEQ ID NO: 1579070 - protein, 25 aa, Staphylococcus aureus
NVAGGGAFGAFVTTDSYGVATTYTS

SEQ ID NO: 1579071 - protein, 23 aa, Staphylococcus aureus
NYVPEKWILGLLGLIPIYLGIKV

SEQ ID NO: 1579072 - protein, 19 aa, Staphylococcus aureus
PFFRLYLITWMMHLILIGG

SEQ ID NO: 1579073 - protein, 20 aa, Staphylococcus aureus
PILRKFKIATPVFKPLFAWQ

SEQ ID NO: 1579074 - protein, 23 aa, Staphylococcus aureus
PKRVNAKMRFAVAQPAAVASNNV

SEQ ID NO: 1579075 - protein, 17 aa, Staphylococcus aureus
PNYVMGMSFITEGAIPF

SEQ ID NO: 1579076 - protein, 23 aa, Staphylococcus aureus
PSVRTRAVRSLAVAEPVVNAADA

SEQ ID NO: 1579077 - protein, 29 aa, Staphylococcus aureus
QAVNTSAPRMRAFSLAAVAADAPAAGTDI

SEQ ID NO: 1579078 - protein, 29 aa, Staphylococcus aureus
QNATGLPTDGFTYKWNRDTTGTNDANWSA

SEQ ID NO: 1579079 - protein, 18 aa, Staphylococcus aureus
QNNLDLFFNYGKRLANDH

SEQ ID NO: 1579080 - protein, 24 aa, Staphylococcus aureus
QNPQLKKRITVIDGHSHTVLQNGQ

SEQ ID NO: 1579081 - protein, 18 aa, Staphylococcus aureus
QPDEPGEIEPIPEDSDSD

SEQ ID NO: 1579082 - protein, 24 aa, Staphylococcus aureus
QPNNWAWSSLNICINDSKPSNVKV

SEQ ID NO: 1579083 - protein, 19 aa, Staphylococcus aureus
QRLQSAIANKDQTKASENY

SEQ ID NO: 1579084 - protein, 42 aa, Staphylococcus aureus
QSGNTFMAANFKVTGQVKSGDYFTAKLPDSVTGNGDVDYSNS

SEQ ID NO: 1579085 - protein, 26 aa, Staphylococcus aureus
QSLNNAMKGLRYSIANETTVKASQNY

SEQ ID NO: 1579086 - protein, 22 aa, Staphylococcus aureus
QTIEVGKTMNPIVLTTTDNGTG

SEQ ID NO: 1579087 - protein, 21 aa, Staphylococcus aureus
RAVLIPTFSSIIFLFFKLKYY

SEQ ID NO: 1579088 - protein, 22 aa, Staphylococcus aureus
RAVLIPTFSSIIFLFFKLKYYA

SEQ ID NO: 1579089 - protein, 19 aa, Staphylococcus aureus
RDNHLKLNLLYQDLEIKRI

SEQ ID NO: 1579090 - protein, 28 aa, Staphylococcus aureus
RDRLPLSELYEGVGILETPFGYLISLDK

SEQ ID NO: 1579091 - protein, 18 aa, Staphylococcus aureus
RFHDISRTMLFPMIMTVF

SEQ ID NO: 1579092 - protein, 17 aa, Staphylococcus aureus
RGKDIWIEFDEQFNQLY

SEQ ID NO: 1579093 - protein, 23 aa, Staphylococcus aureus
RNATELNTAMGQLQHAIADKTTT

SEQ ID NO: 1579094 - protein, 18 aa, Staphylococcus aureus
RTIPVCIIAILYVLLSPT

SEQ ID NO: 1579095 - protein, 18 aa, Staphylococcus aureus
RVEGNFCVIILYCLLPLF

SEQ ID NO: 1579096 - protein, 21 aa, Staphylococcus aureus
RVRKGAFAFVVIRPILFSCWL

SEQ ID NO: 1579097 - protein, 27 aa, Staphylococcus aureus
RVYRDDFRVIFEVQDFGIGIKLEDQQR

SEQ ID NO: 1579098 - protein, 24 aa, Staphylococcus aureus
SDSESKSASAFLSESLSESTSEST

SEQ ID NO: 1579099 - protein, 17 aa, Staphylococcus aureus
SEITAALNKVTQAKNDL

SEQ ID NO: 1579100 - protein, 18 aa, Staphylococcus aureus
SESLSMSGSDSTSVSDST

SEQ ID NO: 1579101 - protein, 28 aa, Staphylococcus aureus
SGNKTTTTFKYEVTRNSMSDSVSTSGST

SEQ ID NO: 1579102 - protein, 24 aa, Staphylococcus aureus
SHSKYSGVFIYKDLKSIEDTNNAI

SEQ ID NO: 1579103 - protein, 36 aa, Staphylococcus aureus
SISKKITGYGLKTTAVIGGAFTVNMLHDQQAFAASD

SEQ ID NO: 1579104 - protein, 17 aa, Staphylococcus aureus
SLAYGGWPLPFHDLVPH

SEQ ID NO: 1579105 - protein, 24 aa, Staphylococcus aureus
SLSPLMWLNFLFIKIGETVGIFNP

SEQ ID NO: 1579106 - protein, 17 aa, Staphylococcus aureus
SNLKQGIANKDTVKASE

SEQ ID NO: 1579107 - protein, 24 aa, Staphylococcus aureus
SNPCFKITDIKAVSKIAEKHELLV

SEQ ID NO: 1579108 - protein, 17 aa, Staphylococcus aureus
SNPKGEVNHSNKASKQH

SEQ ID NO: 1579109 - protein, 23 aa, Staphylococcus aureus
SNSMHPSDSMSMHHTHSTSTSRS

SEQ ID NO: 1579110 - protein, 25 aa, Staphylococcus aureus
SPPWNNFFKRFSFYAIAIQYFVVQF

SEQ ID NO: 1579111 - protein, 25 aa, Staphylococcus aureus
SQSVLKWAQNSGVASRFFNMMNTTG

SEQ ID NO: 1579112 - protein, 24 aa, Staphylococcus aureus
SRITKPLRRLRDQATRVSEGDYSY

SEQ ID NO: 1579113 - protein, 20 aa, Staphylococcus aureus
SRLIPLKITIVLSIILETLF

SEQ ID NO: 1579114 - protein, 17 aa, Staphylococcus aureus
SSMSGSVSKSTSLSDSI

SEQ ID NO: 1579115 - protein, 28 aa, Staphylococcus aureus
STAPIKLRTFSRLAMSTFASAATTSAVT

SEQ ID NO: 1579116 - protein, 27 aa, Staphylococcus aureus
STAPKRLNTRMRMAAVQPSSTDSKNVN

SEQ ID NO: 1579117 - protein, 19 aa, Staphylococcus aureus
SVVPVVFALLNAIKVLTGG

SEQ ID NO: 1579118 - protein, 19 aa, Staphylococcus aureus
TAKVEVTLLDGSKVIVNVP

SEQ ID NO: 1579119 - protein, 19 aa, Staphylococcus aureus
TASESKPRVTRSADVAEAK

SEQ ID NO: 1579120 - protein, 21 aa, Staphylococcus aureus
TIQGKEHFEGYGSVDIQKKPT

SEQ ID NO: 1579121 - protein, 19 aa, Staphylococcus aureus
TLGGLWKQRVRWAQGGHEV

SEQ ID NO: 1579122 - protein, 17 aa, Staphylococcus aureus
TLNSINFTDADQAKKDA

SEQ ID NO: 1579123 - protein, 21 aa, Staphylococcus aureus
TLPYFLAGHHAFTYRNDLLFI

SEQ ID NO: 1579124 - protein, 18 aa, Staphylococcus aureus
TRDVKIVSSIEYGENIHE

SEQ ID NO: 1579125 - protein, 27 aa, Staphylococcus aureus
TSFASKVADGFKRVVSNVGDGMKNALD

SEQ ID NO: 1579126 - protein, 25 aa, Staphylococcus aureus
TSFASKVADGFKRVVSNVGDGMSDA

SEQ ID NO: 1579127 - protein, 21 aa, Staphylococcus aureus
TSPWVKEASAATVAGIAGTNN

SEQ ID NO: 1579128 - protein, 19 aa, Staphylococcus aureus
TTLTYIVSLCFLFICIYLN

SEQ ID NO: 1579129 - protein, 39 aa, Staphylococcus aureus
TVTIRPQDYVVFIPPVGKQIRAVVYYNKVVASNMSNAVT

SEQ ID NO: 1579130 - protein, 17 aa, Staphylococcus aureus
TYSVEFSTPAGYTPTTA

SEQ ID NO: 1579131 - protein, 24 aa, Staphylococcus aureus
VAQAKESAKRALASYSNLNNAQST

SEQ ID NO: 1579132 - protein, 21 aa, Staphylococcus aureus
VEAYHPKYPTNIGQINQNVTN

SEQ ID NO: 1579133 - protein, 37 aa, Staphylococcus aureus
VGIDSGTTVYPHQAGYVKLNYGFSVPNSAVKGDTFKI

SEQ ID NO: 1579134 - protein, 25 aa, Staphylococcus aureus
VIDSDGNVIYTFTDYVDNKENVTAN

SEQ ID NO: 1579135 - protein, 28 aa, Staphylococcus aureus
VKGHLLLELAVIFGISALVTSFLKHKHE

SEQ ID NO: 1579136 - protein, 17 aa, Staphylococcus aureus
VKIVSSIEYGENIHEDY

SEQ ID NO: 1579137 - protein, 22 aa, Staphylococcus aureus
VKVVVANIGYEGQYHVRIINQD

SEQ ID NO: 1579138 - protein, 17 aa, Staphylococcus aureus
VNAAKAILTKASGQNVD

SEQ ID NO: 1579139 - protein, 26 aa, Staphylococcus aureus
VPFVTAWLADIIYRKVFRLYTNDIFK

SEQ ID NO: 1579140 - protein, 17 aa, Staphylococcus aureus
VPQIHGFNKHNEIIEED

SEQ ID NO: 1579141 - protein, 18 aa, Staphylococcus aureus
VQYRTSFLIYKEETSRIE

SEQ ID NO: 1579142 - protein, 17 aa, Staphylococcus aureus
VTIIAMVIVGLVLIFFS

SEQ ID NO: 1579143 - protein, 22 aa, Staphylococcus aureus
VTISILFSYIINRVLKKISTPY

SEQ ID NO: 1579144 - protein, 17 aa, Staphylococcus aureus
VVLHGIWDTSLTVLGSD

SEQ ID NO: 1579145 - protein, 18 aa, Staphylococcus aureus
VVLHGIWDTSLTVLGSDT

SEQ ID NO: 1579146 - protein, 21 aa, Staphylococcus aureus
VYAEKLIQYGNRYRKDYSNVD

SEQ ID NO: 1579147 - protein, 17 aa, Staphylococcus aureus
WHYTFTAAMVYAVSGSI

SEQ ID NO: 1579148 - protein, 23 aa, Staphylococcus aureus
WSAMNKPNVAKVVNAKYDVIYNG

SEQ ID NO: 1579149 - protein, 25 aa, Staphylococcus aureus
WYNLGEDGHPEWVIPTDPARRNDAM

SEQ ID NO: 1579150 - protein, 36 aa, Staphylococcus aureus
YAGQTWTRNISDWIAKSGTTNFSLSMTASTGGATNL

SEQ ID NO: 1579151 - protein, 20 aa, Staphylococcus aureus
YASDEQIEFAVIDEGPGISL

SEQ ID NO: 1579152 - protein, 18 aa, Staphylococcus aureus
YCNSSLKWYELMPIISFL

SEQ ID NO: 1579153 - protein, 21 aa, Staphylococcus aureus
YDFPIDSLFYIVSLNLSLTLI

SEQ ID NO: 1579154 - protein, 18 aa, Staphylococcus aureus
YGGGSADGDSAVNPVDPT

SEQ ID NO: 1579155 - protein, 35 aa, Staphylococcus aureus
YIILSACMTFLFVIVGLCIKLANSFIDPDSQNAYF

SEQ ID NO: 1579156 - protein, 23 aa, Staphylococcus aureus
YLIGKLSVIYGFLATCIVLPIVF

SEQ ID NO: 1579157 - protein, 31 aa, Staphylococcus aureus
YLIPNLPNGDYRVEFSNLPKGYEVTPSKQGN

SEQ ID NO: 1579158 - protein, 26 aa, Staphylococcus aureus
YLVELIRWLFTFGILFQLPILFIGLA

SEQ ID NO: 1579159 - protein, 22 aa, Staphylococcus aureus
YRVQGFTCANCAGKFEKNVKKI

SEQ ID NO: 1579160 - protein, 25 aa, Staphylococcus aureus
YTNVSGSFEQVAFAKRENATTDKTA

SEQ ID NO: 1579161 - protein, 17 aa, Staphylococcus aureus
AEAKAAAKQNLGTLNHI

SEQ ID NO: 1579162 - protein, 20 aa, Staphylococcus aureus
AELFHASGIIAAVVAGLVHG

SEQ ID NO: 1579163 - protein, 26 aa, Staphylococcus aureus
AIIGYLCGNFQFGLLVATGTLAHIYV

SEQ ID NO: 1579164 - protein, 27 aa, Staphylococcus aureus
AKELAKRKQEAISRIKDFSNEKINSIR

SEQ ID NO: 1579165 - protein, 17 aa, Staphylococcus aureus
AKQVIKLNDAVTAAKKA

SEQ ID NO: 1579166 - protein, 18 aa, Staphylococcus aureus
ALGKIKSFFSDFLNAGAE

SEQ ID NO: 1579167 - protein, 21 aa, Staphylococcus aureus
ALHSRCPEAMVIDINDTKMLT

SEQ ID NO: 1579168 - protein, 18 aa, Staphylococcus aureus
AMFFIHFNTALIMLITAP

SEQ ID NO: 1579169 - protein, 17 aa, Staphylococcus aureus
ANTALGHLNNLNNAQRQ

SEQ ID NO: 1579170 - protein, 24 aa, Staphylococcus aureus
AQTLDHAMELLRNSVADNQTTLAS

SEQ ID NO: 1579171 - protein, 24 aa, Staphylococcus aureus
ASIVKAGGLISFLSTKVPILGTVF

SEQ ID NO: 1579172 - protein, 19 aa, Staphylococcus aureus
ATTPLVFGMTLLIVTVIPF

SEQ ID NO: 1579173 - protein, 23 aa, Staphylococcus aureus
AVAKAEALISATPDVVVTPSEIT

SEQ ID NO: 1579174 - protein, 19 aa, Staphylococcus aureus
AVPLGVRGKDDILSLNLHE

SEQ ID NO: 1579175 - protein, 20 aa, Staphylococcus aureus
CAVLLIQLGFEPLKAAMLCL

SEQ ID NO: 1579176 - protein, 30 aa, Staphylococcus aureus
DEQMASFGWRIPFLLGLFLGLFGLYLRRKL

SEQ ID NO: 1579177 - protein, 32 aa, Staphylococcus aureus
DESLDKVKHTPFFLPKRRRKEDEEDVEVTNEN

SEQ ID NO: 1579178 - protein, 27 aa, Staphylococcus aureus
DFYDDLSIKLVRPFGDMLGLHNEFIPS

SEQ ID NO: 1579179 - protein, 20 aa, Staphylococcus aureus
DIKSGASSAFNWTKDKIGKG

SEQ ID NO: 1579180 - protein, 20 aa, Staphylococcus aureus
DIKSGASSAFNWTKDQIGKG

SEQ ID NO: 1579181 - protein, 28 aa, Staphylococcus aureus
DKAKRDAYTNAVSRAEAILNKTQGANTS

SEQ ID NO: 1579182 - protein, 19 aa, Staphylococcus aureus
DKDATKATVNFTDADQAKQ

SEQ ID NO: 1579183 - protein, 34 aa, Staphylococcus aureus
DKGGYLIPNLPNGDYRVEFSNLPQGYEVTPSKQG

SEQ ID NO: 1579184 - protein, 17 aa, Staphylococcus aureus
DKYRLVYQGGITTIKNG

SEQ ID NO: 1579185 - protein, 18 aa, Staphylococcus aureus
DLDLIKSRIDDMNAIDGS

SEQ ID NO: 1579186 - protein, 22 aa, Staphylococcus aureus
DLVEIKKTLEFFGVDKEDENNQ

SEQ ID NO: 1579187 - protein, 26 aa, Staphylococcus aureus
DNLDSGKYKVIFEKPAGLTQTGTNTT

SEQ ID NO: 1579188 - protein, 17 aa, Staphylococcus aureus
DQLKTTWQGIVKENQAS

SEQ ID NO: 1579189 - protein, 24 aa, Staphylococcus aureus
DSEKFPVLRKAIRSVTQSKQRGLL

SEQ ID NO: 1579190 - protein, 17 aa, Staphylococcus aureus
DSFGWKETIPPKKDGDS

SEQ ID NO: 1579191 - protein, 19 aa, Staphylococcus aureus
DTYKGRLSLKNEIYPFFLT

SEQ ID NO: 1579192 - protein, 33 aa, Staphylococcus aureus
DYMSFRISSAILQFLGAISWFFLSLILSLTQFT

SEQ ID NO: 1579193 - protein, 20 aa, Staphylococcus aureus
EIEHAKAQLAQALQDIKDLV

SEQ ID NO: 1579194 - protein, 21 aa, Staphylococcus aureus
EIEQAKAQLGQALQDIKDLVK

SEQ ID NO: 1579195 - protein, 29 aa, Staphylococcus aureus
EKMGYLKRIGMCISLLIVIIFVTSCGGGN

SEQ ID NO: 1579196 - protein, 21 aa, Staphylococcus aureus
EKNKFTHVAYIKPINGNNSDS

SEQ ID NO: 1579197 - protein, 20 aa, Staphylococcus aureus
EKQALKDRINQILQQGHNGI

SEQ ID NO: 1579198 - protein, 19 aa, Staphylococcus aureus
EKYFLLIFMCNAIIGVLQD

SEQ ID NO: 1579199 - protein, 24 aa, Staphylococcus aureus
ELNTAMTALKRAIADKAETKASGN

SEQ ID NO: 1579200 - protein, 22 aa, Staphylococcus aureus
ELSNFRILKRIGFTHTDMLKGL

SEQ ID NO: 1579201 - protein, 20 aa, Staphylococcus aureus
ERTLFKPIVYGFESFLKGST

SEQ ID NO: 1579202 - protein, 22 aa, Staphylococcus aureus
ESLIGLRFLKGYDVRRGKDKEN

SEQ ID NO: 1579203 - protein, 27 aa, Staphylococcus aureus
ETLDDTKHLPLLFAKRRRKEDEEDVTV

SEQ ID NO: 1579204 - protein, 21 aa, Staphylococcus aureus
ETPKVRKARSVDEGSFDITRD

SEQ ID NO: 1579205 - protein, 22 aa, Staphylococcus aureus
EVGKEVKNHFYLLENQINVDEI

SEQ ID NO: 1579206 - protein, 22 aa, Staphylococcus aureus
FAAVLGPLVFMFGLFISVMGNA

SEQ ID NO: 1579207 - protein, 17 aa, Staphylococcus aureus
FFSSWFLTFGYVCVVAL

SEQ ID NO: 1579208 - protein, 17 aa, Staphylococcus aureus
FGALAGVLVFFISRAYN

SEQ ID NO: 1579209 - protein, 23 aa, Staphylococcus aureus
FHGQRLNDVILTYVASTGKMRAE

SEQ ID NO: 1579210 - protein, 17 aa, Staphylococcus aureus
FIIGSLFILILSKLFKH

SEQ ID NO: 1579211 - protein, 17 aa, Staphylococcus aureus
FKIALSRFIHNKIAMLS

SEQ ID NO: 1579212 - protein, 20 aa, Staphylococcus aureus
FKPHAVRDMNGHALPLTKDG

SEQ ID NO: 1579213 - protein, 20 aa, Staphylococcus aureus
FKWYDFVYFIDTLVYLFILI

SEQ ID NO: 1579214 - protein, 19 aa, Staphylococcus aureus
FLKLFRITNPIARGLALGT

SEQ ID NO: 1579215 - protein, 20 aa, Staphylococcus aureus
FNIGDIKQYFTLSNGQAIPN

SEQ ID NO: 1579216 - protein, 19 aa, Staphylococcus aureus
FNPDAKNFKIYEVTDQNQF

SEQ ID NO: 1579217 - protein, 20 aa, Staphylococcus aureus
FPKENWWVFIVLLLLVGNVE

SEQ ID NO: 1579218 - protein, 18 aa, Staphylococcus aureus
FPSGHAMGSTAYFGSGIY

SEQ ID NO: 1579219 - protein, 17 aa, Staphylococcus aureus
FRKYFAKGYSYNSTGLS

SEQ ID NO: 1579220 - protein, 17 aa, Staphylococcus aureus
FSSLVFGAFSSLGVRSC

SEQ ID NO: 1579221 - protein, 21 aa, Staphylococcus aureus
FSVQVKQPWLLLQYGSTDVEA

SEQ ID NO: 1579222 - protein, 25 aa, Staphylococcus aureus
FVPVVMAASVALFFLNLAFAETDRP

SEQ ID NO: 1579223 - protein, 17 aa, Staphylococcus aureus
GALLGGLMYGYSMLLLF

SEQ ID NO: 1579224 - protein, 18 aa, Staphylococcus aureus
GELKNIFVDKVETIELPL

SEQ ID NO: 1579225 - protein, 24 aa, Staphylococcus aureus
GFSSSGFYVGFLLLFILIVGIYVA

SEQ ID NO: 1579226 - protein, 20 aa, Staphylococcus aureus
GGIIGVIFAVWILSIVEKRL

SEQ ID NO: 1579227 - protein, 21 aa, Staphylococcus aureus
GIGCAVSMLFLSKLIDNRSRN

SEQ ID NO: 1579228 - protein, 22 aa, Staphylococcus aureus
GKDYSIFGWNNENVVRYGGGSA

SEQ ID NO: 1579229 - protein, 19 aa, Staphylococcus aureus
GLDGLRAFAVIGIIIYHLN

SEQ ID NO: 1579230 - protein, 17 aa, Staphylococcus aureus
GLKKVLSTYPIKNLETL

SEQ ID NO: 1579231 - protein, 29 aa, Staphylococcus aureus
GNEKSQAEAGGRPNFRTTGYSQSNATTDG

SEQ ID NO: 1579232 - protein, 20 aa, Staphylococcus aureus
GNISFMPVIIVIIVYTLIYI

SEQ ID NO: 1579233 - protein, 21 aa, Staphylococcus aureus
GNTFMAANFTVTDKVKSGDYF

SEQ ID NO: 1579234 - protein, 18 aa, Staphylococcus aureus
GQRLGEKTAHVLDTKNRL

SEQ ID NO: 1579235 - protein, 19 aa, Staphylococcus aureus
GRYKASWITNEMMRVASRE

SEQ ID NO: 1579236 - protein, 36 aa, Staphylococcus aureus
GSAWWSWVICSGIIGCLYGWIGLKLNLSSGRFSRKS

SEQ ID NO: 1579237 - protein, 19 aa, Staphylococcus aureus
GSVKHKWIYVLFTIIDIPI

SEQ ID NO: 1579238 - protein, 25 aa, Staphylococcus aureus
GTEPKIKLYVSLKCPDFDDVAQKIN

SEQ ID NO: 1579239 - protein, 22 aa, Staphylococcus aureus
GTLKITVIATIFAVPVGLGAAI

SEQ ID NO: 1579240 - protein, 17 aa, Staphylococcus aureus
GYRYIAASVSFLEVLVY

SEQ ID NO: 1579241 - protein, 20 aa, Staphylococcus aureus
HAIFEILALLIASTFSLGFL

SEQ ID NO: 1579242 - protein, 23 aa, Staphylococcus aureus
HGALIPEFFPIDTIIELSHRAVS

SEQ ID NO: 1579243 - protein, 19 aa, Staphylococcus aureus
HGKFWNKWFYVRKWKHKIL

SEQ ID NO: 1579244 - protein, 21 aa, Staphylococcus aureus
HKEANGWFVGYVETKDNTYYF

SEQ ID NO: 1579245 - protein, 20 aa, Staphylococcus aureus
HKFIIIKVILALPMFILLTI

SEQ ID NO: 1579246 - protein, 22 aa, Staphylococcus aureus
HMFNCIRTINAIIWIITYPSIY

SEQ ID NO: 1579247 - protein, 17 aa, Staphylococcus aureus
HSGGSKNGGTWNPNASD

SEQ ID NO: 1579248 - protein, 18 aa, Staphylococcus aureus
IALMFDFEKAYWIPLSAH

SEQ ID NO: 1579249 - protein, 20 aa, Staphylococcus aureus
IDKPNGANISSQIIGVDTAS

SEQ ID NO: 1579250 - protein, 25 aa, Staphylococcus aureus
IFNQLYVVFKMIFWFNPALYISKTM

SEQ ID NO: 1579251 - protein, 18 aa, Staphylococcus aureus
IFYTRSQNKFSFVISDLN

SEQ ID NO: 1579252 - protein, 27 aa, Staphylococcus aureus
IGDQSSEVFSPISPIKIATQDNSGNAV

SEQ ID NO: 1579253 - protein, 18 aa, Staphylococcus aureus
IGFTHTDMLKGLLLKITF

SEQ ID NO: 1579254 - protein, 22 aa, Staphylococcus aureus
IGLVSFYAIYIWIEHRTIHQHV

SEQ ID NO: 1579255 - protein, 41 aa, Staphylococcus aureus
IGVKLKLAKVIIILCVVAFFIFPVIIMFLLAPDLNKGKDDA

SEQ ID NO: 1579256 - protein, 18 aa, Staphylococcus aureus
IIGKLLYESLETIDPGPM

SEQ ID NO: 1579257 - protein, 17 aa, Staphylococcus aureus
IIIPEIANDLGLQNSSF

SEQ ID NO: 1579258 - protein, 24 aa, Staphylococcus aureus
IKIHLESFQTFLINKKVNGKEVTP

SEQ ID NO: 1579259 - protein, 38 aa, Staphylococcus aureus
IKNALGVVGISGLLASFWFFIAKRRRKEDEEEELEIRD

SEQ ID NO: 1579260 - protein, 21 aa, Staphylococcus aureus
IKTKRLEVVIFMHFLNNLLAL

SEQ ID NO: 1579261 - protein, 18 aa, Staphylococcus aureus
ILCICIVASVIYLKVKYD

SEQ ID NO: 1579262 - protein, 18 aa, Staphylococcus aureus
ILHFKRSTNMIATILYGM

SEQ ID NO: 1579263 - protein, 23 aa, Staphylococcus aureus
ILIFKTKWLDTKAFSKKFVPVVM

SEQ ID NO: 1579264 - protein, 18 aa, Staphylococcus aureus
ILIILLVIIFCFVCEIIK

SEQ ID NO: 1579265 - protein, 26 aa, Staphylococcus aureus
INGQFSLPLFTDRAKAPKSGTYDANI

SEQ ID NO: 1579266 - protein, 23 aa, Staphylococcus aureus
INNELEDIFAIMLENSYPEHQRD

SEQ ID NO: 1579267 - protein, 17 aa, Staphylococcus aureus
IQMLLGYFLSRFLINTK

SEQ ID NO: 1579268 - protein, 18 aa, Staphylococcus aureus
IQQELIRLTSHPKARAIV

SEQ ID NO: 1579269 - protein, 35 aa, Staphylococcus aureus
ISDSLTAKVEVTLLDGSKVIVNVPVKVVEKELTVV

SEQ ID NO: 1579270 - protein, 17 aa, Staphylococcus aureus
ISIIALIIFGPKKLPQF

SEQ ID NO: 1579271 - protein, 17 aa, Staphylococcus aureus
ITNPIARGLALGTSGHT

SEQ ID NO: 1579272 - protein, 18 aa, Staphylococcus aureus
ITPKGVKLFYPLPFNVKT

SEQ ID NO: 1579273 - protein, 17 aa, Staphylococcus aureus
IVDEAKALNRVMDQLSQ

SEQ ID NO: 1579274 - protein, 18 aa, Staphylococcus aureus
IYFNFTWSFYGNLLYLLP

SEQ ID NO: 1579275 - protein, 18 aa, Staphylococcus aureus
IYQNLTLDSIVFRNTLRY

SEQ ID NO: 1579276 - protein, 19 aa, Staphylococcus aureus
KDLKGAKLKVEAYHPKYPT

SEQ ID NO: 1579277 - protein, 23 aa, Staphylococcus aureus
KESMYKLSYVVRVSAKNLDELKQ

SEQ ID NO: 1579278 - protein, 20 aa, Staphylococcus aureus
KETLPDIAHEINIVNLTSEN

SEQ ID NO: 1579279 - protein, 19 aa, Staphylococcus aureus
KFSNVGSRIDINISENEDQ

SEQ ID NO: 1579280 - protein, 18 aa, Staphylococcus aureus
KFSNYLLNPINDFPELFT

SEQ ID NO: 1579281 - protein, 19 aa, Staphylococcus aureus
KGLGWYDLFFTVPMFLLFV

SEQ ID NO: 1579282 - protein, 19 aa, Staphylococcus aureus
KGTTVRLIFPLQNEIVERM

SEQ ID NO: 1579283 - protein, 26 aa, Staphylococcus aureus
KIKSYFLRWIPSFHILQSGQFIVSSQ

SEQ ID NO: 1579284 - protein, 20 aa, Staphylococcus aureus
KIPGKSGGINNEYAGQVDVM

SEQ ID NO: 1579285 - protein, 21 aa, Staphylococcus aureus
KKKRSLVSMIIQIIVVILTAI

SEQ ID NO: 1579286 - protein, 17 aa, Staphylococcus aureus
KKNLKWLGVVATLMMTF

SEQ ID NO: 1579287 - protein, 23 aa, Staphylococcus aureus
KKTAYDQAVAAAKAILNKQTGSN

SEQ ID NO: 1579288 - protein, 17 aa, Staphylococcus aureus
KPASISLIICLIVLGLL

SEQ ID NO: 1579289 - protein, 17 aa, Staphylococcus aureus
KPIPLKDLMLHQSGLYK

SEQ ID NO: 1579290 - protein, 19 aa, Staphylococcus aureus
KQIVMLGRQAGFFLILACQ

SEQ ID NO: 1579291 - protein, 22 aa, Staphylococcus aureus
KQVYGWFLASSVAAFFVGVTEP

SEQ ID NO: 1579292 - protein, 22 aa, Staphylococcus aureus
KSKSKGEIFIYGDIVSDKWFES

SEQ ID NO: 1579293 - protein, 20 aa, Staphylococcus aureus
KTFMVNVWNVLKAVASVVWN

SEQ ID NO: 1579294 - protein, 26 aa, Staphylococcus aureus
KTISRLGTVFFLFVFNIGISIFVFLL

SEQ ID NO: 1579295 - protein, 25 aa, Staphylococcus aureus
KTIVPAQDYLSLKSQITVDDKVKSG

SEQ ID NO: 1579296 - protein, 25 aa, Staphylococcus aureus
KTNLFSEKILDEFISSNSFPEDEVR

SEQ ID NO: 1579297 - protein, 23 aa, Staphylococcus aureus
KVSSETKYVLGFQPASERTLFKP

SEQ ID NO: 1579298 - protein, 21 aa, Staphylococcus aureus
KVVVANIGYEGQYHVRIVNQD

SEQ ID NO: 1579299 - protein, 19 aa, Staphylococcus aureus
KYIGMPIFLAIMWLIFQTT

SEQ ID NO: 1579300 - protein, 19 aa, Staphylococcus aureus
LASACGAYIATMVPSQILK

SEQ ID NO: 1579301 - protein, 19 aa, Staphylococcus aureus
LAVVGFGLFAAVLGPLVFM

SEQ ID NO: 1579302 - protein, 27 aa, Staphylococcus aureus
LDVDTRLSIPTIYAFKKSLDALPNKKT

SEQ ID NO: 1579303 - protein, 27 aa, Staphylococcus aureus
LEQFKAQLKAANPFAKELENRKKAAIS

SEQ ID NO: 1579304 - protein, 18 aa, Staphylococcus aureus
LFFKFKLLLFEVNQMQYV

SEQ ID NO: 1579305 - protein, 25 aa, Staphylococcus aureus
LFIIFAMFLPISFLLSMLPSFDGMG

SEQ ID NO: 1579306 - protein, 21 aa, Staphylococcus aureus
LGTLFTIILAIAFIINLVLAF

SEQ ID NO: 1579307 - protein, 22 aa, Staphylococcus aureus
LHHIFYSPFWFEFGSYTNHAGE

SEQ ID NO: 1579308 - protein, 28 aa, Staphylococcus aureus
LHYSWITLLCVGVILLLLGTLGNAVQAT

SEQ ID NO: 1579309 - protein, 18 aa, Staphylococcus aureus
LILACQRPDAKYFSDGIR

SEQ ID NO: 1579310 - protein, 18 aa, Staphylococcus aureus
LKGAKFIILYAYSMLVLL

SEQ ID NO: 1579311 - protein, 20 aa, Staphylococcus aureus
LKLDVEFASILGLTKDKSLL

SEQ ID NO: 1579312 - protein, 17 aa, Staphylococcus aureus
LLDELPTTLAIIGGIIT

SEQ ID NO: 1579313 - protein, 18 aa, Staphylococcus aureus
LLFEVVSAFGTVGLSMNL

SEQ ID NO: 1579314 - protein, 19 aa, Staphylococcus aureus
LLFIICVILGILGLIISLF

SEQ ID NO: 1579315 - protein, 17 aa, Staphylococcus aureus
LLIVIIFVTSCGGGNKI

SEQ ID NO: 1579316 - protein, 17 aa, Staphylococcus aureus
LLLAIVVGVCGSLVALA

SEQ ID NO: 1579317 - protein, 25 aa, Staphylococcus aureus
LMIPCKPDHPLVYWATYSNASDLLS

SEQ ID NO: 1579318 - protein, 18 aa, Staphylococcus aureus
LMMLLPFTLLSILIVIFI

SEQ ID NO: 1579319 - protein, 18 aa, Staphylococcus aureus
LNFKQLIGYVFAPIAFLM

SEQ ID NO: 1579320 - protein, 22 aa, Staphylococcus aureus
LNSSMKYSVNWYYENLNKHLRQ

SEQ ID NO: 1579321 - protein, 21 aa, Staphylococcus aureus
LQPLVRYIFERIVMAVIVIIG

SEQ ID NO: 1579322 - protein, 20 aa, Staphylococcus aureus
LRGTALQKVPVNISGIPLDP

SEQ ID NO: 1579323 - protein, 18 aa, Staphylococcus aureus
LRYYPFDFVAMFITLIII

SEQ ID NO: 1579324 - protein, 19 aa, Staphylococcus aureus
LSAVFLMSAILCFEYDFIA

SEQ ID NO: 1579325 - protein, 17 aa, Staphylococcus aureus
LSLFGITALLLVVALPI

SEQ ID NO: 1579326 - protein, 18 aa, Staphylococcus aureus
LSNEGMVLYLDRNTRTAK

SEQ ID NO: 1579327 - protein, 26 aa, Staphylococcus aureus
LTALFVCGLISWLYYHYRIDSIKQLE

SEQ ID NO: 1579328 - protein, 18 aa, Staphylococcus aureus
LTVFICSLMIGKTPSYLG

SEQ ID NO: 1579329 - protein, 21 aa, Staphylococcus aureus
LVELLCAAVLGIIALFFYIFR

SEQ ID NO: 1579330 - protein, 28 aa, Staphylococcus aureus
LVKAIMWGRMPWDIIFTVGVIILVVIFI

SEQ ID NO: 1579331 - protein, 27 aa, Staphylococcus aureus
LWNKNEGFRNFIINAWNAIKTFMVNVW

SEQ ID NO: 1579332 - protein, 17 aa, Staphylococcus aureus
MGFGMMFGSDTQKQFFL

SEQ ID NO: 1579333 - protein, 24 aa, Staphylococcus aureus
MKNNIGLKFAFRSTDLVEIKKTLE

SEQ ID NO: 1579334 - protein, 20 aa, Staphylococcus aureus
MKRATYWLNLLILFTNIFYF

SEQ ID NO: 1579335 - protein, 26 aa, Staphylococcus aureus
MLLKGPLKIISVIFQLLFGKIGLIRN

SEQ ID NO: 1579336 - protein, 18 aa, Staphylococcus aureus
NAIKGNRIVAFIIATTVS

SEQ ID NO: 1579337 - protein, 28 aa, Staphylococcus aureus
NAYKQAVAKAEALISGTPDVVVTPSEIT

SEQ ID NO: 1579338 - protein, 17 aa, Staphylococcus aureus
NCATFPNQMIEYGKSQG

SEQ ID NO: 1579339 - protein, 24 aa, Staphylococcus aureus
NGDLFRFYKNPDFKKVNPSKYKYE

SEQ ID NO: 1579340 - protein, 17 aa, Staphylococcus aureus
NIDFKKTLIMIFIQVLI

SEQ ID NO: 1579341 - protein, 28 aa, Staphylococcus aureus
NINGQFSLPLFTDRAKAPKSGTYDANIN

SEQ ID NO: 1579342 - protein, 19 aa, Staphylococcus aureus
NINIADEMFDNKITYNYSS

SEQ ID NO: 1579343 - protein, 21 aa, Staphylococcus aureus
NKGKEALTIDSSMFKLKSGDK

SEQ ID NO: 1579344 - protein, 26 aa, Staphylococcus aureus
NKIVPAQDYLALKSQIKVDDKVKSGD

SEQ ID NO: 1579345 - protein, 26 aa, Staphylococcus aureus
NKIVPAQDYLSLKSQITVDDKVKSGD

SEQ ID NO: 1579346 - protein, 36 aa, Staphylococcus aureus
NKYSIRRFTVGTTSVIVGATILFGIGNHQAQASEQS

SEQ ID NO: 1579347 - protein, 28 aa, Staphylococcus aureus
NLGLDDIRNTHVWEVDAQPAVNEIFDAT

SEQ ID NO: 1579348 - protein, 17 aa, Staphylococcus aureus
NLSSGRFSRKSMIYFNI

SEQ ID NO: 1579349 - protein, 23 aa, Staphylococcus aureus
NLTLNFMISFLFVISATVIGIFL

SEQ ID NO: 1579350 - protein, 27 aa, Staphylococcus aureus
NNIKMRKMVPWAIVFFILILIIILFFL

SEQ ID NO: 1579351 - protein, 24 aa, Staphylococcus aureus
NQVDYRFFIGFKLYLNEQEVSVKN

SEQ ID NO: 1579352 - protein, 18 aa, Staphylococcus aureus
NTNQLIDVTEQFKDKITY

SEQ ID NO: 1579353 - protein, 24 aa, Staphylococcus aureus
NVIMTRAGITLIITVAFSISTMLY

SEQ ID NO: 1579354 - protein, 19 aa, Staphylococcus aureus
NVWNVLKAVASVVWNAILT

SEQ ID NO: 1579355 - protein, 19 aa, Staphylococcus aureus
NYHDYRFIDRENADSGTFN

SEQ ID NO: 1579356 - protein, 18 aa, Staphylococcus aureus
PDLIRLSKTFLIESRELT

SEQ ID NO: 1579357 - protein, 20 aa, Staphylococcus aureus
PFDYKGMSIFAVMIGSFTLL

SEQ ID NO: 1579358 - protein, 19 aa, Staphylococcus aureus
PFTPLLVAAALYFVLTFVL

SEQ ID NO: 1579359 - protein, 17 aa, Staphylococcus aureus
PGEKIAMDGIIVNGLSA

SEQ ID NO: 1579360 - protein, 17 aa, Staphylococcus aureus
PKAVALKAQQAAIKEEA

SEQ ID NO: 1579361 - protein, 18 aa, Staphylococcus aureus
PLFFIYKYHQPMFGKLSS

SEQ ID NO: 1579362 - protein, 18 aa, Staphylococcus aureus
PLQAIKFQLLVVFIHTTA

SEQ ID NO: 1579363 - protein, 17 aa, Staphylococcus aureus
PLYSKRIYQNLTLDSIV

SEQ ID NO: 1579364 - protein, 28 aa, Staphylococcus aureus
PNKVIRFILRTAIGYSIFAYGLHYFSNL

SEQ ID NO: 1579365 - protein, 25 aa, Staphylococcus aureus
PNMLIQRLKAGKVYKKERLETAFSN

SEQ ID NO: 1579366 - protein, 19 aa, Staphylococcus aureus
PSGKRINAIQILNKETGKF

SEQ ID NO: 1579367 - protein, 20 aa, Staphylococcus aureus
PSLPVKFAIGTFLAGASYIL

SEQ ID NO: 1579368 - protein, 18 aa, Staphylococcus aureus
PVVEFNRSITLVFITDLL

SEQ ID NO: 1579369 - protein, 25 aa, Staphylococcus aureus
QAVAMWPGFSRSGSTISTGVLMKLN

SEQ ID NO: 1579370 - protein, 17 aa, Staphylococcus aureus
QKEAAIAEVNKLKQQAI

SEQ ID NO: 1579371 - protein, 24 aa, Staphylococcus aureus
QKIPLLIKRHVYSINVKAFSLIEM

SEQ ID NO: 1579372 - protein, 23 aa, Staphylococcus aureus
QKTFFKFFIGILLLNLIIILFKT

SEQ ID NO: 1579373 - protein, 21 aa, Staphylococcus aureus
QPTVKVYEYLGKKDELPQSVY

SEQ ID NO: 1579374 - protein, 20 aa, Staphylococcus aureus
QSAFTFKIVIQLGSVFAAAW

SEQ ID NO: 1579375 - protein, 22 aa, Staphylococcus aureus
QSHLDSGFMFFFIVYVLYISYF

SEQ ID NO: 1579376 - protein, 23 aa, Staphylococcus aureus
QSNSHLHVGYGTVNHPFNSSPIG

SEQ ID NO: 1579377 - protein, 20 aa, Staphylococcus aureus
QSSLFLKRRSILSMMKDSIK

SEQ ID NO: 1579378 - protein, 17 aa, Staphylococcus aureus
QTELAYMQNIFSFDERH

SEQ ID NO: 1579379 - protein, 18 aa, Staphylococcus aureus
QTLIKYGNIYAQVYSDQQ

SEQ ID NO: 1579380 - protein, 26 aa, Staphylococcus aureus
QYLFDNTRAVFGFNFFLDKKQLITSQ

SEQ ID NO: 1579381 - protein, 24 aa, Staphylococcus aureus
RAVLNFVVVFILSASFIAYAPDYI

SEQ ID NO: 1579382 - protein, 21 aa, Staphylococcus aureus
RIAYEADMRKPLYSKRIYQNL

SEQ ID NO: 1579383 - protein, 18 aa, Staphylococcus aureus
RIKTRPLYLAAMGTFLLG

SEQ ID NO: 1579384 - protein, 20 aa, Staphylococcus aureus
RKEDMLACINQFYEDMIDRS

SEQ ID NO: 1579385 - protein, 17 aa, Staphylococcus aureus
RKYSVGTASILVGTTLI

SEQ ID NO: 1579386 - protein, 24 aa, Staphylococcus aureus
RLNNRKSEALQRLDQLTHLNNAQR

SEQ ID NO: 1579387 - protein, 17 aa, Staphylococcus aureus
RMSEMGFGMMFGSDTQK

SEQ ID NO: 1579388 - protein, 17 aa, Staphylococcus aureus
RSILAGIMMSFARALGE

SEQ ID NO: 1579389 - protein, 33 aa, Staphylococcus aureus
RTIKEFILGVLFVPALVCFIFFAVFGASAIYLQ

SEQ ID NO: 1579390 - protein, 19 aa, Staphylococcus aureus
RTIPVCIIAILYVLLSPTH

SEQ ID NO: 1579391 - protein, 22 aa, Staphylococcus aureus
SAMKRNSWLDITLMIIALIGLS

SEQ ID NO: 1579392 - protein, 17 aa, Staphylococcus aureus
SDAKANLGTLTHLNNAQ

SEQ ID NO: 1579393 - protein, 24 aa, Staphylococcus aureus
SDQFERFGSLTFFDAFLVGLVEET

SEQ ID NO: 1579394 - protein, 20 aa, Staphylococcus aureus
SEIKPRMKRSADVAEVAEKE

SEQ ID NO: 1579395 - protein, 17 aa, Staphylococcus aureus
SEMGFGMMFGSDTQKQF

SEQ ID NO: 1579396 - protein, 19 aa, Staphylococcus aureus
SFVDYDFAHLLFSDGSVTQ

SEQ ID NO: 1579397 - protein, 21 aa, Staphylococcus aureus
SGSNLDKAAVENALSQVTNAK

SEQ ID NO: 1579398 - protein, 24 aa, Staphylococcus aureus
SIFKIVDLDEAWSFLQVAQGKALS

SEQ ID NO: 1579399 - protein, 22 aa, Staphylococcus aureus
SIGSAFTETVSHVGNKENPGYY

SEQ ID NO: 1579400 - protein, 23 aa, Staphylococcus aureus
SIIIYLFIRRQFNISNALLNLSV

SEQ ID NO: 1579401 - protein, 23 aa, Staphylococcus aureus
SIRYASYEQIEFAVIDEGPGISL

SEQ ID NO: 1579402 - protein, 20 aa, Staphylococcus aureus
SKLSDWASYMHRVTKNHPMF

SEQ ID NO: 1579403 - protein, 18 aa, Staphylococcus aureus
SLIARIASIFSKEPDTFN

SEQ ID NO: 1579404 - protein, 27 aa, Staphylococcus aureus
SNFYFSYYQAIIIGCYYLYRLIFTYKY

SEQ ID NO: 1579405 - protein, 27 aa, Staphylococcus aureus
SRDYPVIQGCVLFIGFFVVIINTIADL

SEQ ID NO: 1579406 - protein, 18 aa, Staphylococcus aureus
SRKRYSPDSTYKIYLAMF

SEQ ID NO: 1579407 - protein, 19 aa, Staphylococcus aureus
SRLIPLKITIVLSIILETL

SEQ ID NO: 1579408 - protein, 19 aa, Staphylococcus aureus
SRNDIFLTSLIKINRLNLD

SEQ ID NO: 1579409 - protein, 26 aa, Staphylococcus aureus
SSEFLYKFELEPAFIKIVSNQRINKL

SEQ ID NO: 1579410 - protein, 23 aa, Staphylococcus aureus
SSLLTICVIFLVRMLYIKYTQNI

SEQ ID NO: 1579411 - protein, 28 aa, Staphylococcus aureus
STAPKSLNTRMRMAAIQPNSTDSKNVND

SEQ ID NO: 1579412 - protein, 26 aa, Staphylococcus aureus
SVAPKRLNAKMRFAVAQPAAVASNNV

SEQ ID NO: 1579413 - protein, 33 aa, Staphylococcus aureus
TATELNGAMTVLKAAIADKERTKASGNYVNADQ

SEQ ID NO: 1579414 - protein, 24 aa, Staphylococcus aureus
TDKVKSGDYFTAKLPDSLTGNGDV

SEQ ID NO: 1579415 - protein, 25 aa, Staphylococcus aureus
TDLNRTGFWIKIPGKSGGINNEYAG

SEQ ID NO: 1579416 - protein, 23 aa, Staphylococcus aureus
TFFIRLTLQFKIILIVILSKITK

SEQ ID NO: 1579417 - protein, 17 aa, Staphylococcus aureus
TILHLAGIDTKNYLMFG

SEQ ID NO: 1579418 - protein, 17 aa, Staphylococcus aureus
TKKRVEIAYSMRNIINH

SEQ ID NO: 1579419 - protein, 17 aa, Staphylococcus aureus
TLEQKAKALKEIDEAEK

SEQ ID NO: 1579420 - protein, 22 aa, Staphylococcus aureus
TMLAGLIPFIPIKFSFIKFNNV

SEQ ID NO: 1579421 - protein, 19 aa, Staphylococcus aureus
TNSELKNSQTLDLPQSSPQ

SEQ ID NO: 1579422 - protein, 23 aa, Staphylococcus aureus
TNVSGSFEQVAFAKRENATTDKT

SEQ ID NO: 1579423 - protein, 22 aa, Staphylococcus aureus
TRSQNKFSFVISDLNFYYENNF

SEQ ID NO: 1579424 - protein, 22 aa, Staphylococcus aureus
TTKHEVEQTIYVNPLKLNAKNT

SEQ ID NO: 1579425 - protein, 37 aa, Staphylococcus aureus
TVNKLYYAAGGRALEYNQLFMYSQLYVESTQDHQQRL

SEQ ID NO: 1579426 - protein, 24 aa, Staphylococcus aureus
TVTGLPSGLSYDSATNSIIGTPTK

SEQ ID NO: 1579427 - protein, 20 aa, Staphylococcus aureus
TVWNVLKTVASVVWNAILKA

SEQ ID NO: 1579428 - protein, 21 aa, Staphylococcus aureus
TWLPIEIKLALITTLIALFST

SEQ ID NO: 1579429 - protein, 20 aa, Staphylococcus aureus
VCNFYPERIILLGHGENSIY

SEQ ID NO: 1579430 - protein, 23 aa, Staphylococcus aureus
VDIFMCGVATFLQANKVTGTGLP

SEQ ID NO: 1579431 - protein, 19 aa, Staphylococcus aureus
VFYHLKLDVEFASILGLTK

SEQ ID NO: 1579432 - protein, 25 aa, Staphylococcus aureus
VGTASILVGTTLIFGIGSQEAKAAE

SEQ ID NO: 1579433 - protein, 25 aa, Staphylococcus aureus
VIDSDGNVIYTFTDYVNTKDDVKAT

SEQ ID NO: 1579434 - protein, 20 aa, Staphylococcus aureus
VIKLWLTIILIVTTVLILLS

SEQ ID NO: 1579435 - protein, 17 aa, Staphylococcus aureus
VLFDEGFIALRPSGTEP

SEQ ID NO: 1579436 - protein, 25 aa, Staphylococcus aureus
VLGYTIGYWLARLLKLDRQDQKAVS

SEQ ID NO: 1579437 - protein, 17 aa, Staphylococcus aureus
VNEIIALYKDNDELYDK

SEQ ID NO: 1579438 - protein, 25 aa, Staphylococcus aureus
VNGKPFKYDHHYNITYKFNGPTDVA

SEQ ID NO: 1579439 - protein, 18 aa, Staphylococcus aureus
VNIHIVWIIALAIGLMYG

SEQ ID NO: 1579440 - protein, 29 aa, Staphylococcus aureus
VNKNRVVLIPTFKQGLLIVFAYFFLGSAS

SEQ ID NO: 1579441 - protein, 24 aa, Staphylococcus aureus
VNLDFGDITSAYVVMVNTKFQYTN

SEQ ID NO: 1579442 - protein, 21 aa, Staphylococcus aureus
VNLGLKDKIFFKDSANYQAKM

SEQ ID NO: 1579443 - protein, 18 aa, Staphylococcus aureus
VPFMLMWMTKSKRNKAIG

SEQ ID NO: 1579444 - protein, 24 aa, Staphylococcus aureus
VQLIWNLIQLWFVGKILGVVRYFG

SEQ ID NO: 1579445 - protein, 25 aa, Staphylococcus aureus
VRMASPIIVNARFSDPITGVEKLII

SEQ ID NO: 1579446 - protein, 18 aa, Staphylococcus aureus
VSSFKLGDSSFLFFDSFI

SEQ ID NO: 1579447 - protein, 24 aa, Staphylococcus aureus
VSTARKVPEIKNGSVVMATGEILG

SEQ ID NO: 1579448 - protein, 17 aa, Staphylococcus aureus
VTDQFDVIYSNDNKTAT

SEQ ID NO: 1579449 - protein, 40 aa, Staphylococcus aureus
VTDQFKNRIYYEHPNVASIKFGDITKTYVVLVEGHYDNTG

SEQ ID NO: 1579450 - protein, 17 aa, Staphylococcus aureus
VTIARMILKDAPIIVLD

SEQ ID NO: 1579451 - protein, 17 aa, Staphylococcus aureus
VVIAVIFGVLLGTIAGY

SEQ ID NO: 1579452 - protein, 33 aa, Staphylococcus aureus
VVSFCFIFLLLVFFKYILKRYFNYSLNYKVWYL

SEQ ID NO: 1579453 - protein, 18 aa, Staphylococcus aureus
WGNTRTFTQFTFKKAILF

SEQ ID NO: 1579454 - protein, 29 aa, Staphylococcus aureus
WKYLILTCLVVLICLYFASRSFKRTLIRP

SEQ ID NO: 1579455 - protein, 30 aa, Staphylococcus aureus
WNTVTSWFSRVAWSVAEKMGQALNFIITKG

SEQ ID NO: 1579456 - protein, 19 aa, Staphylococcus aureus
WQTNFIISIVIAFIAILLL

SEQ ID NO: 1579457 - protein, 18 aa, Staphylococcus aureus
YCTFLVVILLFLWPLLYS

SEQ ID NO: 1579458 - protein, 22 aa, Staphylococcus aureus
YDFPIDSLFYIVSLNLSLTMIF

SEQ ID NO: 1579459 - protein, 34 aa, Staphylococcus aureus
YEGNGNGGDGIGFAFSPGVLGETGLNGAAVGIGG

SEQ ID NO: 1579460 - protein, 17 aa, Staphylococcus aureus
YETIFLLGLILALFTVL

SEQ ID NO: 1579461 - protein, 21 aa, Staphylococcus aureus
YIICVIGELCLSPTGNSAAVK

SEQ ID NO: 1579462 - protein, 17 aa, Staphylococcus aureus
YIKGYQDKIEESSGKVS

SEQ ID NO: 1579463 - protein, 21 aa, Staphylococcus aureus
YKTGENYAYLGLSANFLIFDE

SEQ ID NO: 1579464 - protein, 17 aa, Staphylococcus aureus
YNTYKDLAVYKIKSVKD

SEQ ID NO: 1579465 - protein, 19 aa, Staphylococcus aureus
YQLHTPYFWSSILTALFVC

SEQ ID NO: 1579466 - protein, 25 aa, Staphylococcus aureus
YTNVRGSFEQVAFAKRKNATTDKTA

SEQ ID NO: 1579467 - protein, 22 aa, Staphylococcus aureus
YVKTPSNKVLGFYPTNANTNAF

SEQ ID NO: 1579468 - protein, 24 aa, Staphylococcus aureus
YVTSDFLAGLGFGATQMIGENSGI

SEQ ID NO: 1579469 - protein, 30 aa, Staphylococcus aureus
YYVDNSWGWLPWNWSDGIGQSVMYGLYAIT

SEQ ID NO: 1579470 - protein, 19 aa, Staphylococcus aureus
AALTTLIGMFGQILMGILI

SEQ ID NO: 1579471 - protein, 24 aa, Staphylococcus aureus
ADEAKRNAYTNAVTQAEQILNKAQ

SEQ ID NO: 1579472 - protein, 24 aa, Staphylococcus aureus
ADEAKRNAYTNAVTQAEQILNKVQ

SEQ ID NO: 1579473 - protein, 18 aa, Staphylococcus aureus
AFGSTALWIGAGLMSLAV

SEQ ID NO: 1579474 - protein, 26 aa, Staphylococcus aureus
AFPLLSVAIGSIFTGIVWGLLLSGSY

SEQ ID NO: 1579475 - protein, 21 aa, Staphylococcus aureus
AGQGYRGYGAFVKNDSSGNSQ

SEQ ID NO: 1579476 - protein, 17 aa, Staphylococcus aureus
AHLDFVGLILVATIATT

SEQ ID NO: 1579477 - protein, 44 aa, Staphylococcus aureus
AHMIPEVIGNLLLSAAIFLYIMLIDWRMASALLVTIPISIFAFK

SEQ ID NO: 1579478 - protein, 18 aa, Staphylococcus aureus
AIAVLGIIIYHLNKQWLT

SEQ ID NO: 1579479 - protein, 20 aa, Staphylococcus aureus
AICGIFALFIWVHLLCTILN

SEQ ID NO: 1579480 - protein, 17 aa, Staphylococcus aureus
AIGALYLPVIFKVIKLQ

SEQ ID NO: 1579481 - protein, 23 aa, Staphylococcus aureus
AIGRASVVPTFFGVNEPILFGAP

SEQ ID NO: 1579482 - protein, 29 aa, Staphylococcus aureus
AIKLGERLKHPFILKRIVGQSGMSYGALG

SEQ ID NO: 1579483 - protein, 26 aa, Staphylococcus aureus
AKNDIDKRVQALIDEIDQNPNLTDKE

SEQ ID NO: 1579484 - protein, 17 aa, Staphylococcus aureus
ALGLAIPLVTARSTSIG

SEQ ID NO: 1579485 - protein, 23 aa, Staphylococcus aureus
ALKAAIADKERTKASGNYVNADQ

SEQ ID NO: 1579486 - protein, 22 aa, Staphylococcus aureus
ALPIGIAYQFSDWFQNQYVSAW

SEQ ID NO: 1579487 - protein, 21 aa, Staphylococcus aureus
AMRYIVGKWVPRTGSWRAAFK

SEQ ID NO: 1579488 - protein, 50 aa, Staphylococcus aureus
ANEKTRVRLYKSGKNWVKSGIKEIEMFKIMGLPFISHSLVSQDNQSISKK

SEQ ID NO: 1579489 - protein, 19 aa, Staphylococcus aureus
ANLELDFLMFVRRFIVLLF

SEQ ID NO: 1579490 - protein, 17 aa, Staphylococcus aureus
ANTALGHLNNLNNVQRQ

SEQ ID NO: 1579491 - protein, 17 aa, Staphylococcus aureus
APVGAIISFIGVPYFLY

SEQ ID NO: 1579492 - protein, 24 aa, Staphylococcus aureus
AQAKETAKRALASYSNLNNAQSTA

SEQ ID NO: 1579493 - protein, 30 aa, Staphylococcus aureus
ASGNKTTTTFKYEVTRNSMSDSVSTSGSTQ

SEQ ID NO: 1579494 - protein, 25 aa, Staphylococcus aureus
ASIVKAGGLISFLSTKVPILGTVFT

SEQ ID NO: 1579495 - protein, 17 aa, Staphylococcus aureus
ASLSPRMFAANVPQTTT

SEQ ID NO: 1579496 - protein, 25 aa, Staphylococcus aureus
ASNFKNLVGRVCRFNEIFNNSSGDL

SEQ ID NO: 1579497 - protein, 17 aa, Staphylococcus aureus
ASVIAMSGDTIFMHKNS

SEQ ID NO: 1579498 - protein, 19 aa, Staphylococcus aureus
ATKISVIFAVAFFIINYIG

SEQ ID NO: 1579499 - protein, 21 aa, Staphylococcus aureus
ATRYMPLKVIIDYFKLHMEGR

SEQ ID NO: 1579500 - protein, 19 aa, Staphylococcus aureus
ATSLFILEPRKGRKNLNAS

SEQ ID NO: 1579501 - protein, 27 aa, Staphylococcus aureus
ATTSFILAFPMALIWPTIQSGLNAFST

SEQ ID NO: 1579502 - protein, 28 aa, Staphylococcus aureus
AVLPGVALSFLFGIPMFIGALITGMIAS

SEQ ID NO: 1579503 - protein, 22 aa, Staphylococcus aureus
AVRKIMFALNRFMGNKYSNIDL

SEQ ID NO: 1579504 - protein, 18 aa, Staphylococcus aureus
AVSGMTHLNDAQKQALKG

SEQ ID NO: 1579505 - protein, 25 aa, Staphylococcus aureus
CLALKCKLIIVLGEFEVKYLTGFIL

SEQ ID NO: 1579506 - protein, 18 aa, Staphylococcus aureus
DAGIRSGVFIALATFLRP

SEQ ID NO: 1579507 - protein, 19 aa, Staphylococcus aureus
DAYEFYGKVQSGITTPTQK

SEQ ID NO: 1579508 - protein, 23 aa, Staphylococcus aureus
DDAKRTAYSQAVNAAATILNKTS

SEQ ID NO: 1579509 - protein, 56 aa, Staphylococcus aureus
DDIDPLHMRHFSNNFGNVIKNAIGVVGISGLLASFWFFIAKRRRKEDEEEELEIRD

SEQ ID NO: 1579510 - protein, 17 aa, Staphylococcus aureus
DEIKARTDLTDKEKQEA

SEQ ID NO: 1579511 - protein, 35 aa, Staphylococcus aureus
DFKIRNRSGQVIYDWPTVHIYSLEDLSRASDYFSE

SEQ ID NO: 1579512 - protein, 24 aa, Staphylococcus aureus
DFKRNMRTAQRMAKTDIPDEIKTE

SEQ ID NO: 1579513 - protein, 18 aa, Staphylococcus aureus
DFSNEKINSIRNSEIGTA

SEQ ID NO: 1579514 - protein, 21 aa, Staphylococcus aureus
DFSTLLLISGLLFLFFFKESE

SEQ ID NO: 1579515 - protein, 21 aa, Staphylococcus aureus
DFVSSYIKKGSSFYDDVKKRV

SEQ ID NO: 1579516 - protein, 20 aa, Staphylococcus aureus
DGKHYGIDFALPKGTPIKAP

SEQ ID NO: 1579517 - protein, 30 aa, Staphylococcus aureus
DIDPLHMRHFSNNFGNVIKNAIGVVGISGL

SEQ ID NO: 1579518 - protein, 25 aa, Staphylococcus aureus
DILTMLKATTTVPGLRNNITGNEKS

SEQ ID NO: 1579519 - protein, 18 aa, Staphylococcus aureus
DKDGGFRGGPAYYITKGL

SEQ ID NO: 1579520 - protein, 20 aa, Staphylococcus aureus
DLNQPQRDALRNQINQAQAL

SEQ ID NO: 1579521 - protein, 17 aa, Staphylococcus aureus
DLVKAKEDAKQDVDKQV

SEQ ID NO: 1579522 - protein, 17 aa, Staphylococcus aureus
DMNYSVKISNFIAKDLD

SEQ ID NO: 1579523 - protein, 26 aa, Staphylococcus aureus
DNKYDMLMKAFQIDASVNPGNSGGAV

SEQ ID NO: 1579524 - protein, 32 aa, Staphylococcus aureus
DNMTLDSGFYKTPKYNLGNYVWEDTNKDGKQD

SEQ ID NO: 1579525 - protein, 19 aa, Staphylococcus aureus
DPHRSHDFKIRNRSGQVIY

SEQ ID NO: 1579526 - protein, 26 aa, Staphylococcus aureus
DSFELRLPSIFSALLLGAMYLNRNDF

SEQ ID NO: 1579527 - protein, 17 aa, Staphylococcus aureus
DTFPGINKWLIPIGTSP

SEQ ID NO: 1579528 - protein, 21 aa, Staphylococcus aureus
DTKIAITHQITWDFVKAPHGL

SEQ ID NO: 1579529 - protein, 18 aa, Staphylococcus aureus
DTMTVKYDKHTIPSDITD

SEQ ID NO: 1579530 - protein, 26 aa, Staphylococcus aureus
EAAEKRSNVHLVDWYKASAGHPEYFA

SEQ ID NO: 1579531 - protein, 19 aa, Staphylococcus aureus
EALFLLFFVATYLFIFPPI

SEQ ID NO: 1579532 - protein, 24 aa, Staphylococcus aureus
EDLRLMALCWGMTLLCLTLLMNVN

SEQ ID NO: 1579533 - protein, 23 aa, Staphylococcus aureus
EDTTHVRWFLNINNEKRYVSKDI

SEQ ID NO: 1579534 - protein, 18 aa, Staphylococcus aureus
EFKYSYFDEPVLRDINLD

SEQ ID NO: 1579535 - protein, 24 aa, Staphylococcus aureus
EIIDFNMFINKIINRHEMSTKDTT

SEQ ID NO: 1579536 - protein, 18 aa, Staphylococcus aureus
EINEKVKAVVPTKKAQSK

SEQ ID NO: 1579537 - protein, 20 aa, Staphylococcus aureus
EKQALKDRINQILQQGHNDI

SEQ ID NO: 1579538 - protein, 23 aa, Staphylococcus aureus
ELENRKKAAISKIKDISTDKIDR

SEQ ID NO: 1579539 - protein, 23 aa, Staphylococcus aureus
ELGSWKAPYSIVFVLDIFSALLI

SEQ ID NO: 1579540 - protein, 19 aa, Staphylococcus aureus
ENGKYCFDNLDSGKYKVIF

SEQ ID NO: 1579541 - protein, 23 aa, Staphylococcus aureus
ENPLIKSVEIHKQLPNTLNVDIT

SEQ ID NO: 1579542 - protein, 25 aa, Staphylococcus aureus
ENYKEECLRAIILEFDNKKTIKENI

SEQ ID NO: 1579543 - protein, 27 aa, Staphylococcus aureus
EQQFPPRNAQRRKRRRDLATNHNKQVH

SEQ ID NO: 1579544 - protein, 26 aa, Staphylococcus aureus
ERLNNRKAEALQRLDQLTHLNNAQRQ

SEQ ID NO: 1579545 - protein, 19 aa, Staphylococcus aureus
ESIKYLGTVLLIPGSIALI

SEQ ID NO: 1579546 - protein, 18 aa, Staphylococcus aureus
ESIKYLGTVLLVPGSIAL

SEQ ID NO: 1579547 - protein, 20 aa, Staphylococcus aureus
ESRKRYSPDSTYKIYLALFG

SEQ ID NO: 1579548 - protein, 19 aa, Staphylococcus aureus
ETSLDFFVIEDFSYSPRLV

SEQ ID NO: 1579549 - protein, 23 aa, Staphylococcus aureus
ETVKATELNNAMHSLQNGINDET

SEQ ID NO: 1579550 - protein, 20 aa, Staphylococcus aureus
EVNGTSDIWGKLNNSLKDYG

SEQ ID NO: 1579551 - protein, 28 aa, Staphylococcus aureus
FAISACLYPNFILDFIFIIIMLFLVSLT

SEQ ID NO: 1579552 - protein, 23 aa, Staphylococcus aureus
FDDAKRLANALLNSDNTNVNDIN

SEQ ID NO: 1579553 - protein, 19 aa, Staphylococcus aureus
FDKMFPILMGFFVFLFVFL

SEQ ID NO: 1579554 - protein, 19 aa, Staphylococcus aureus
FDLIILLRKYVKYINFNYN

SEQ ID NO: 1579555 - protein, 27 aa, Staphylococcus aureus
FDNLDSGKYKVIFEKPAGLTQTGTNTT

SEQ ID NO: 1579556 - protein, 27 aa, Staphylococcus aureus
FDNLDSGKYKVIFEKPAGLTQTVTNTT

SEQ ID NO: 1579557 - protein, 17 aa, Staphylococcus aureus
FDYRRSLLRTDVVLNSE

SEQ ID NO: 1579558 - protein, 17 aa, Staphylococcus aureus
FETPAGYTPTVKNTTAD

SEQ ID NO: 1579559 - protein, 33 aa, Staphylococcus aureus
FGGLKDGETYTVKFETPTGYLPTKVNGTTDGEK

SEQ ID NO: 1579560 - protein, 20 aa, Staphylococcus aureus
FGLGLLYTWIPLKADHLGGA

SEQ ID NO: 1579561 - protein, 17 aa, Staphylococcus aureus
FIGKSMFRNNIKSINIL

SEQ ID NO: 1579562 - protein, 18 aa, Staphylococcus aureus
FILSFGWQPLIFNALLYL

SEQ ID NO: 1579563 - protein, 29 aa, Staphylococcus aureus
FITGALVGSALGLYFKNKVYQKADDLKVK

SEQ ID NO: 1579564 - protein, 24 aa, Staphylococcus aureus
FKDIFDKRFLIFFLSAVGLHGIWD

SEQ ID NO: 1579565 - protein, 21 aa, Staphylococcus aureus
FKPHAVRDMNGHALPLTKDGN

SEQ ID NO: 1579566 - protein, 17 aa, Staphylococcus aureus
FLALFLISIIANFWFIQ

SEQ ID NO: 1579567 - protein, 20 aa, Staphylococcus aureus
FLGATFILSFGWQPLIFNAL

SEQ ID NO: 1579568 - protein, 25 aa, Staphylococcus aureus
FLQIFFKLPLIVTAVLSILLGIFAG

SEQ ID NO: 1579569 - protein, 23 aa, Staphylococcus aureus
FLTFPIMFIFAIAIVIDSPGNPI

SEQ ID NO: 1579570 - protein, 22 aa, Staphylococcus aureus
FLTRALKHTRWNAYSFAAINTV

SEQ ID NO: 1579571 - protein, 17 aa, Staphylococcus aureus
FMAANFTVTDKVKSGDY

SEQ ID NO: 1579572 - protein, 19 aa, Staphylococcus aureus
FMIGLTLTFIVALFSFLAA

SEQ ID NO: 1579573 - protein, 17 aa, Staphylococcus aureus
FMLGKYWIQLLIATVII

SEQ ID NO: 1579574 - protein, 17 aa, Staphylococcus aureus
FRLTEQILNRFNIEFTT

SEQ ID NO: 1579575 - protein, 19 aa, Staphylococcus aureus
FTSISWPILAVVAVIGVFI

SEQ ID NO: 1579576 - protein, 23 aa, Staphylococcus aureus
FTTKYLKMFAYSILYAALITIIT

SEQ ID NO: 1579577 - protein, 17 aa, Staphylococcus aureus
FVLDIFSALLIITSIII

SEQ ID NO: 1579578 - protein, 28 aa, Staphylococcus aureus
FVNPKQRVLGNTWVYIKGYQDKIEESSG

SEQ ID NO: 1579579 - protein, 21 aa, Staphylococcus aureus
FYKKVAVLFFECLVFIILSIT

SEQ ID NO: 1579580 - protein, 25 aa, Staphylococcus aureus
GAGANKPLQQMWEYGVNDPHRSHDF

SEQ ID NO: 1579581 - protein, 26 aa, Staphylococcus aureus
GAGQEVYKIGNYVWEDTNKNGVQELG

SEQ ID NO: 1579582 - protein, 25 aa, Staphylococcus aureus
GDQKLARDQLQAVTTVNALPNLNHA

SEQ ID NO: 1579583 - protein, 19 aa, Staphylococcus aureus
GDTMTVKYDKHTIPSDITD

SEQ ID NO: 1579584 - protein, 20 aa, Staphylococcus aureus
GEIQRLAIARMLLKDTASTW

SEQ ID NO: 1579585 - protein, 23 aa, Staphylococcus aureus
GELDFPNSEIFYYQQQQFTFPVD

SEQ ID NO: 1579586 - protein, 17 aa, Staphylococcus aureus
GETSATVTKNWDDNNNQ

SEQ ID NO: 1579587 - protein, 21 aa, Staphylococcus aureus
GHHLKFYAVQKLHGFSTTRII

SEQ ID NO: 1579588 - protein, 19 aa, Staphylococcus aureus
GKYQFTGLENGTYKVEFET

SEQ ID NO: 1579589 - protein, 17 aa, Staphylococcus aureus
GNIIDIDFDSVPHIHGF

SEQ ID NO: 1579590 - protein, 37 aa, Staphylococcus aureus
GNTFMAANFKVTGQVKSGDYFTAKLPDSVTGNGDVDY

SEQ ID NO: 1579591 - protein, 22 aa, Staphylococcus aureus
GRFGDGLINIFTQLMPLFKFVS

SEQ ID NO: 1579592 - protein, 17 aa, Staphylococcus aureus
GRVDYGAAHAAKYGHER

SEQ ID NO: 1579593 - protein, 18 aa, Staphylococcus aureus
GRYKASWITNEMMRVASR

SEQ ID NO: 1579594 - protein, 24 aa, Staphylococcus aureus
GSDIADATITWVSGQAPNKDNTRI

SEQ ID NO: 1579595 - protein, 23 aa, Staphylococcus aureus
GSNQIQVTWCEKGVFDYRRSLLR

SEQ ID NO: 1579596 - protein, 25 aa, Staphylococcus aureus
GTAEERQAAMNRINEIVLETIKDIN

SEQ ID NO: 1579597 - protein, 21 aa, Staphylococcus aureus
GTPAYIYAIPVASLALLIAIT

SEQ ID NO: 1579598 - protein, 24 aa, Staphylococcus aureus
GVFFICSILLFLGFIFNALLKYTN

SEQ ID NO: 1579599 - protein, 26 aa, Staphylococcus aureus
GVIDSDGNVIYTFTDYVNTKDDVKAT

SEQ ID NO: 1579600 - protein, 25 aa, Staphylococcus aureus
GVNLKLRYPFIGAIVGSGIGSAYIA

SEQ ID NO: 1579601 - protein, 24 aa, Staphylococcus aureus
GWLGIPVPFRFSGFSFDVTSTLVF

SEQ ID NO: 1579602 - protein, 21 aa, Staphylococcus aureus
HDMSNIYTILPWFLITIPIII

SEQ ID NO: 1579603 - protein, 19 aa, Staphylococcus aureus
HDSLANEKTRVRLYKSGKN

SEQ ID NO: 1579604 - protein, 18 aa, Staphylococcus aureus
HDVFIIVAIFSLFRIEVD

SEQ ID NO: 1579605 - protein, 19 aa, Staphylococcus aureus
HERVQGISVVKSFAIEDNE

SEQ ID NO: 1579606 - protein, 25 aa, Staphylococcus aureus
HKDSEDFYISLKIIDVKQPEGDQRV

SEQ ID NO: 1579607 - protein, 22 aa, Staphylococcus aureus
HKSLIYRYDATLGTQITTNDIL

SEQ ID NO: 1579608 - protein, 22 aa, Staphylococcus aureus
HLDACITRLRVEVVDKSKVDVA

SEQ ID NO: 1579609 - protein, 17 aa, Staphylococcus aureus
IAFCVGFLMYSIFKVIF

SEQ ID NO: 1579610 - protein, 18 aa, Staphylococcus aureus
IAMFCTQIGYPAQSKAIP

SEQ ID NO: 1579611 - protein, 19 aa, Staphylococcus aureus
IANGIPTPVLTPDTVTQAV

SEQ ID NO: 1579612 - protein, 22 aa, Staphylococcus aureus
IAPPEFAFMIGVSLALVINFKS

SEQ ID NO: 1579613 - protein, 23 aa, Staphylococcus aureus
IAVNILCCLVLLGVFLSALYINS

SEQ ID NO: 1579614 - protein, 24 aa, Staphylococcus aureus
IDFGNADSAYVVMVNTKFQYTNSE

SEQ ID NO: 1579615 - protein, 17 aa, Staphylococcus aureus
IDNASVLDEFYWLNKED

SEQ ID NO: 1579616 - protein, 21 aa, Staphylococcus aureus
IDNHQIIWVMLNYEFNEARPT

SEQ ID NO: 1579617 - protein, 19 aa, Staphylococcus aureus
IDRIRNSTIGTAEERQAAM

SEQ ID NO: 1579618 - protein, 20 aa, Staphylococcus aureus
IDVTDKFKITYSNDNKTATV

SEQ ID NO: 1579619 - protein, 18 aa, Staphylococcus aureus
IEHIKRDIQGSVNAKDFK

SEQ ID NO: 1579620 - protein, 19 aa, Staphylococcus aureus
IEKGETVAFVGMSGGGKST

SEQ ID NO: 1579621 - protein, 18 aa, Staphylococcus aureus
IELPLAHMIPEVIGNLLL

SEQ ID NO: 1579622 - protein, 18 aa, Staphylococcus aureus
IEQAKAQLAQALQDIKDL

SEQ ID NO: 1579623 - protein, 21 aa, Staphylococcus aureus
IFALGISIYTVFYQRKKDNNL

SEQ ID NO: 1579624 - protein, 18 aa, Staphylococcus aureus
IFMYISFFTLPLILIIEL

SEQ ID NO: 1579625 - protein, 24 aa, Staphylococcus aureus
IFNNQIHLIFSIFIFSFIMQIIGL

SEQ ID NO: 1579626 - protein, 17 aa, Staphylococcus aureus
IFSALLIITSIIITAIV

SEQ ID NO: 1579627 - protein, 19 aa, Staphylococcus aureus
IGRYLRYFRNLTRDIQKRP

SEQ ID NO: 1579628 - protein, 21 aa, Staphylococcus aureus
IGSAFTETVSHVGNKENPGYY

SEQ ID NO: 1579629 - protein, 19 aa, Staphylococcus aureus
IIFGGRKGFISYLTLFLNF

SEQ ID NO: 1579630 - protein, 17 aa, Staphylococcus aureus
IILPPLAAMLFIKIGYH

SEQ ID NO: 1579631 - protein, 18 aa, Staphylococcus aureus
IINSLTFTETVPNRSYAR

SEQ ID NO: 1579632 - protein, 17 aa, Staphylococcus aureus
IIPKLSRAKLYTIATSG

SEQ ID NO: 1579633 - protein, 17 aa, Staphylococcus aureus
IISSVIVGLIFIFLIGA

SEQ ID NO: 1579634 - protein, 17 aa, Staphylococcus aureus
IKARTDLTDKEKQEAIA

SEQ ID NO: 1579635 - protein, 27 aa, Staphylococcus aureus
IKCGGAPMKIMYLAEDYFRKHKIRSNA

SEQ ID NO: 1579636 - protein, 17 aa, Staphylococcus aureus
IKDVMAIVVGVLMFIFN

SEQ ID NO: 1579637 - protein, 25 aa, Staphylococcus aureus
IKVQRSLNLWAYVMLIFMTLATILT

SEQ ID NO: 1579638 - protein, 18 aa, Staphylococcus aureus
ILGGVFWALMAPIAAVSS

SEQ ID NO: 1579639 - protein, 17 aa, Staphylococcus aureus
ILIFIYSQFTLKEMKYK

SEQ ID NO: 1579640 - protein, 17 aa, Staphylococcus aureus
IMVSMLFTLLIVPWLSS

SEQ ID NO: 1579641 - protein, 21 aa, Staphylococcus aureus
IMYFVKIKWYSILLIMTSQII

SEQ ID NO: 1579642 - protein, 17 aa, Staphylococcus aureus
INANGWMRTDLKGSEFT

SEQ ID NO: 1579643 - protein, 20 aa, Staphylococcus aureus
INFGFSFDLIILLRKYVKYI

SEQ ID NO: 1579644 - protein, 21 aa, Staphylococcus aureus
INGQFSLPLFTDRAKAPKSGT

SEQ ID NO: 1579645 - protein, 17 aa, Staphylococcus aureus
INPVVGMTIIPCLGAMI

SEQ ID NO: 1579646 - protein, 19 aa, Staphylococcus aureus
INYIGIYKIILIILLTSVL

SEQ ID NO: 1579647 - protein, 29 aa, Staphylococcus aureus
IPLTLKGKKGYKFSIFMGTFTKCTMVLIL

SEQ ID NO: 1579648 - protein, 24 aa, Staphylococcus aureus
IPNTFELYNWPTLAIHLSYYVTFL

SEQ ID NO: 1579649 - protein, 21 aa, Staphylococcus aureus
IPSDITDDFTPVDITDPSGEV

SEQ ID NO: 1579650 - protein, 17 aa, Staphylococcus aureus
IPSMMIGSGIGGAIALG

SEQ ID NO: 1579651 - protein, 19 aa, Staphylococcus aureus
IQDKKSWIAMEDIQKIFLK

SEQ ID NO: 1579652 - protein, 35 aa, Staphylococcus aureus
ISDSLTAKVEVTLLDGSKVIVNVPVKVVEKELSVV

SEQ ID NO: 1579653 - protein, 17 aa, Staphylococcus aureus
ISIKAFPLAIGALYLPV

SEQ ID NO: 1579654 - protein, 23 aa, Staphylococcus aureus
ITEMHWTLWKYLILTCLVVLICL

SEQ ID NO: 1579655 - protein, 28 aa, Staphylococcus aureus
ITHSIPFTILWPILITFLIFTFFSGTNP

SEQ ID NO: 1579656 - protein, 18 aa, Staphylococcus aureus
IVGVLWNSSKVLSTFLFI

SEQ ID NO: 1579657 - protein, 19 aa, Staphylococcus aureus
IVICILIKQKIYAVIVLVI

SEQ ID NO: 1579658 - protein, 45 aa, Staphylococcus aureus
IVILIIFALLFRFIVRLIPIFYIFRVLSIFIFIMGFKMLGVSIQK

SEQ ID NO: 1579659 - protein, 26 aa, Staphylococcus aureus
IVSFCFIFLLLLFFRYILKRYFNYML

SEQ ID NO: 1579660 - protein, 25 aa, Staphylococcus aureus
IVSLNLSLTMIFLLLTYFKEVKLYK

SEQ ID NO: 1579661 - protein, 30 aa, Staphylococcus aureus
IVVLLIKAIITWLLLIPVFNFMTSFVESTN

SEQ ID NO: 1579662 - protein, 39 aa, Staphylococcus aureus
IVYFIVCLLISFLALISMNIRILSGFLFLISAIVTIPLV

SEQ ID NO: 1579663 - protein, 19 aa, Staphylococcus aureus
IWTAIWTFLSTIWNTIITI

SEQ ID NO: 1579664 - protein, 26 aa, Staphylococcus aureus
IYHSFLLKKWYLIIYLLFILAALVIT

SEQ ID NO: 1579665 - protein, 18 aa, Staphylococcus aureus
KAANPTAKELAKRKQEAI

SEQ ID NO: 1579666 - protein, 17 aa, Staphylococcus aureus
KCVNLFYTFVYHSNLLK

SEQ ID NO: 1579667 - protein, 24 aa, Staphylococcus aureus
KDAAKRQIEGATHVSEVTQAQNNA

SEQ ID NO: 1579668 - protein, 22 aa, Staphylococcus aureus
KDGKRAFKPSTIVTKNGIRYGI

SEQ ID NO: 1579669 - protein, 23 aa, Staphylococcus aureus
KDKRLDILSSVLLLISSISLLLY

SEQ ID NO: 1579670 - protein, 24 aa, Staphylococcus aureus
KDNLPRFYLYLTLFMFSMLGIVLA

SEQ ID NO: 1579671 - protein, 20 aa, Staphylococcus aureus
KDSKIVSDCRHLLKHPDNLI

SEQ ID NO: 1579672 - protein, 20 aa, Staphylococcus aureus
KEIQKAFAEFFHGVNHKLMG

SEQ ID NO: 1579673 - protein, 18 aa, Staphylococcus aureus
KELCLSLLPINIIVVFTF

SEQ ID NO: 1579674 - protein, 24 aa, Staphylococcus aureus
KFILPIVVGLLIWALTPIKPEAVD

SEQ ID NO: 1579675 - protein, 24 aa, Staphylococcus aureus
KFWFPELPTWIPGIIAILLLMAAN

SEQ ID NO: 1579676 - protein, 28 aa, Staphylococcus aureus
KGDTFKITVPKELNLNGVTSTAKVPPIM

SEQ ID NO: 1579677 - protein, 24 aa, Staphylococcus aureus
KGQSFSIGDIKQYFTLSNGQPIPS

SEQ ID NO: 1579678 - protein, 25 aa, Staphylococcus aureus
KIDGKGWQKDKSWGGYNVTRYEVVN

SEQ ID NO: 1579679 - protein, 25 aa, Staphylococcus aureus
KKKSTRKIVLLSLIFSLLMIALVSF

SEQ ID NO: 1579680 - protein, 18 aa, Staphylococcus aureus
KKLPIKLVSYDTVKDYAY

SEQ ID NO: 1579681 - protein, 18 aa, Staphylococcus aureus
KKNGKLYVQITVNHSHWI

SEQ ID NO: 1579682 - protein, 31 aa, Staphylococcus aureus
KKQSKLIPIFICIFTFLLIVIQSQFLMGQSI

SEQ ID NO: 1579683 - protein, 20 aa, Staphylococcus aureus
KKRISIFIFICSIPTVYLAW

SEQ ID NO: 1579684 - protein, 23 aa, Staphylococcus aureus
KLGMLLIRWMLATSFLVHGTLKF

SEQ ID NO: 1579685 - protein, 23 aa, Staphylococcus aureus
KLSDVSGFAEFEVQGRNLTQTNT

SEQ ID NO: 1579686 - protein, 20 aa, Staphylococcus aureus
KLTYKYRRVVTPVTIRIKAP

SEQ ID NO: 1579687 - protein, 20 aa, Staphylococcus aureus
KMDISLGKVLRVSYIINALN

SEQ ID NO: 1579688 - protein, 18 aa, Staphylococcus aureus
KNAIKALANAKRDQINSN

SEQ ID NO: 1579689 - protein, 19 aa, Staphylococcus aureus
KNKIGAVLLVGLFGLLFFI

SEQ ID NO: 1579690 - protein, 26 aa, Staphylococcus aureus
KNNGSLSITGRVSMNQAFNSDITFKV

SEQ ID NO: 1579691 - protein, 24 aa, Staphylococcus aureus
KPFDNKRLIDMMVDQVINDMESFK

SEQ ID NO: 1579692 - protein, 20 aa, Staphylococcus aureus
KPSGKRINAIQILNKETDKF

SEQ ID NO: 1579693 - protein, 17 aa, Staphylococcus aureus
KQQDLKGILAFSTVSQL

SEQ ID NO: 1579694 - protein, 20 aa, Staphylococcus aureus
KRFNQLTGMTEDEIRVLFNE

SEQ ID NO: 1579695 - protein, 21 aa, Staphylococcus aureus
KRNAYNQAVSAAETILNKQTG

SEQ ID NO: 1579696 - protein, 20 aa, Staphylococcus aureus
KRPIIKRYVALGGTLLTLVA

SEQ ID NO: 1579697 - protein, 19 aa, Staphylococcus aureus
KRPLVNKSFFQNKRYASFL

SEQ ID NO: 1579698 - protein, 25 aa, Staphylococcus aureus
KRTPKEIVFAWSPFVILTAFVLVWS

SEQ ID NO: 1579699 - protein, 22 aa, Staphylococcus aureus
KTAYDQAVAAAKAILNKQTGSN

SEQ ID NO: 1579700 - protein, 22 aa, Staphylococcus aureus
KTNNTYRQTIYVNPSGDNVIAP

SEQ ID NO: 1579701 - protein, 22 aa, Staphylococcus aureus
KTNNTYRQTIYVNPSGDNVVLP

SEQ ID NO: 1579702 - protein, 25 aa, Staphylococcus aureus
KTRPEGIKGVEFRDPLQSVTAEMMR

SEQ ID NO: 1579703 - protein, 22 aa, Staphylococcus aureus
KTWIGIPLWVHRRCLKPMFTIA

SEQ ID NO: 1579704 - protein, 18 aa, Staphylococcus aureus
KVIVNVPVKVVEKELSVV

SEQ ID NO: 1579705 - protein, 20 aa, Staphylococcus aureus
KVKHMLRQRVIYKNNGHPIG

SEQ ID NO: 1579706 - protein, 17 aa, Staphylococcus aureus
KVQGNAIAKAEAEQLKQ

SEQ ID NO: 1579707 - protein, 17 aa, Staphylococcus aureus
KWTDIFMYISFFTLPLI

SEQ ID NO: 1579708 - protein, 37 aa, Staphylococcus aureus
KYAGQTWTRNISDWIAKSGTTNFSLSMTASTGGATNL

SEQ ID NO: 1579709 - protein, 18 aa, Staphylococcus aureus
KYMGYLIFVFFIFVFGLL

SEQ ID NO: 1579710 - protein, 18 aa, Staphylococcus aureus
LAEAKAAAKQNLGTLNHI

SEQ ID NO: 1579711 - protein, 20 aa, Staphylococcus aureus
LALTIGWIGRYLRYFRNLTR

SEQ ID NO: 1579712 - protein, 17 aa, Staphylococcus aureus
LDIFSALLIITSIIITA

SEQ ID NO: 1579713 - protein, 21 aa, Staphylococcus aureus
LELLFGPLRRLVASFTTLTQS

SEQ ID NO: 1579714 - protein, 19 aa, Staphylococcus aureus
LEQFKAQMKAANPTAKELA

SEQ ID NO: 1579715 - protein, 22 aa, Staphylococcus aureus
LEVLRLPRITLAILAGGALGMS

SEQ ID NO: 1579716 - protein, 23 aa, Staphylococcus aureus
LFFLAEIISAFGVGISTVEANWY

SEQ ID NO: 1579717 - protein, 17 aa, Staphylococcus aureus
LFGWKTNFGEAIFQSIN

SEQ ID NO: 1579718 - protein, 26 aa, Staphylococcus aureus
LFIWFFKLKYSFGHIINSKIFAQEFI

SEQ ID NO: 1579719 - protein, 17 aa, Staphylococcus aureus
LFVCVYILFSRYASITL

SEQ ID NO: 1579720 - protein, 24 aa, Staphylococcus aureus
LGLMPHWNLYFWITLVITFVVTAI

SEQ ID NO: 1579721 - protein, 19 aa, Staphylococcus aureus
LGVGEGFNVIASDALAMLQ

SEQ ID NO: 1579722 - protein, 39 aa, Staphylococcus aureus
LIAMNKFHVLAGYRAKFILMVILTMMVFVLINTYLLRQV

SEQ ID NO: 1579723 - protein, 17 aa, Staphylococcus aureus
LIFGLSGHEAKAAEHTN

SEQ ID NO: 1579724 - protein, 17 aa, Staphylococcus aureus
LISLGISIVYWIGSVIL

SEQ ID NO: 1579725 - protein, 20 aa, Staphylococcus aureus
LKDLGCALSDIDMLLKGEGT

SEQ ID NO: 1579726 - protein, 18 aa, Staphylococcus aureus
LKGETKTKYDAMKKDNVE

SEQ ID NO: 1579727 - protein, 18 aa, Staphylococcus aureus
LKKDLKGVNILNLMSLFI

SEQ ID NO: 1579728 - protein, 19 aa, Staphylococcus aureus
LLASLLVSITLVPALAATL

SEQ ID NO: 1579729 - protein, 18 aa, Staphylococcus aureus
LLSSISHIFLMFFVTAIS

SEQ ID NO: 1579730 - protein, 30 aa, Staphylococcus aureus
LMMSISAFVFFKSGIHFILSMFNKDVSDEM

SEQ ID NO: 1579731 - protein, 17 aa, Staphylococcus aureus
LMPLFKFVSQGLQNMSI

SEQ ID NO: 1579732 - protein, 17 aa, Staphylococcus aureus
LMVLPLWAQHKVKSNYE

SEQ ID NO: 1579733 - protein, 21 aa, Staphylococcus aureus
LNAVLVGAGFVSSLLMINKNK

SEQ ID NO: 1579734 - protein, 17 aa, Staphylococcus aureus
LNDLVGFVGQDNFLLNL

SEQ ID NO: 1579735 - protein, 18 aa, Staphylococcus aureus
LNGDERLREAKQNANTAI

SEQ ID NO: 1579736 - protein, 23 aa, Staphylococcus aureus
LNKPKLVQNFALKLAKNLDDINN

SEQ ID NO: 1579737 - protein, 21 aa, Staphylococcus aureus
LNNAMKGLRDSIANETTVKAS

SEQ ID NO: 1579738 - protein, 21 aa, Staphylococcus aureus
LNNAMKGLRDSIANETTVKTS

SEQ ID NO: 1579739 - protein, 23 aa, Staphylococcus aureus
LNQLAPYFKGFDGSFVLYNEREQ

SEQ ID NO: 1579740 - protein, 32 aa, Staphylococcus aureus
LNRGLNLGLDDIRNTHVWEVDEQPAVNEIFEA

SEQ ID NO: 1579741 - protein, 22 aa, Staphylococcus aureus
LNYLVDLSFNFHDWLLDLFTRI

SEQ ID NO: 1579742 - protein, 23 aa, Staphylococcus aureus
LPIYLDVFLIFAAVVFILMYFQE

SEQ ID NO: 1579743 - protein, 21 aa, Staphylococcus aureus
LPMGSFIGGILIKNLGIDYTL

SEQ ID NO: 1579744 - protein, 18 aa, Staphylococcus aureus
LPNAVFWLKTYPERLKQA

SEQ ID NO: 1579745 - protein, 23 aa, Staphylococcus aureus
LRAQEMNIPISIEIPDEVTRINL

SEQ ID NO: 1579746 - protein, 23 aa, Staphylococcus aureus
LSHLYYKLVNCFVEEVQFDDGVG

SEQ ID NO: 1579747 - protein, 17 aa, Staphylococcus aureus
LSLFLFKMFDSASLIIL

SEQ ID NO: 1579748 - protein, 17 aa, Staphylococcus aureus
LTKGMGIAGDITKAAWS

SEQ ID NO: 1579749 - protein, 17 aa, Staphylococcus aureus
LTLEQKEAAIAEVNKLK

SEQ ID NO: 1579750 - protein, 22 aa, Staphylococcus aureus
LTPEQKEAAIAEVNKLKQQAIE

SEQ ID NO: 1579751 - protein, 17 aa, Staphylococcus aureus
LTRFKIIYIAIAGLTLF

SEQ ID NO: 1579752 - protein, 22 aa, Staphylococcus aureus
LTYNSLRLFGSFGNLVFGMTVI

SEQ ID NO: 1579753 - protein, 17 aa, Staphylococcus aureus
LVTIIVFLPLVFVSGSV

SEQ ID NO: 1579754 - protein, 18 aa, Staphylococcus aureus
LWVKPKLVNYIIAKEIGE

SEQ ID NO: 1579755 - protein, 19 aa, Staphylococcus aureus
MAKTDIPDEIKTEVTANIR

SEQ ID NO: 1579756 - protein, 21 aa, Staphylococcus aureus
MGGLTFLLSIVITSLVAIIFV

SEQ ID NO: 1579757 - protein, 25 aa, Staphylococcus aureus
MMKIFDLPLSFFINRSTGDLIYRSN

SEQ ID NO: 1579758 - protein, 27 aa, Staphylococcus aureus
MMRIYKDVDTFVVISHLGIDPSTQETW

SEQ ID NO: 1579759 - protein, 24 aa, Staphylococcus aureus
NAETPKVRKARSVDEGSFDITRDS

SEQ ID NO: 1579760 - protein, 17 aa, Staphylococcus aureus
NATELNTAMGTLKHAIA

SEQ ID NO: 1579761 - protein, 23 aa, Staphylococcus aureus
NDLSESYYVNPSDFEDVTNQVRI

SEQ ID NO: 1579762 - protein, 23 aa, Staphylococcus aureus
NESNSHLTIGYGTANHPFNSSTI

SEQ ID NO: 1579763 - protein, 23 aa, Staphylococcus aureus
NFDLKKIESRNCIVKGQFKVNEN

SEQ ID NO: 1579764 - protein, 24 aa, Staphylococcus aureus
NFTDKGWQITGIPRTLHIENSTNR

SEQ ID NO: 1579765 - protein, 19 aa, Staphylococcus aureus
NGIARISAVQIVISDRAKQ

SEQ ID NO: 1579766 - protein, 26 aa, Staphylococcus aureus
NGWFSINLFLPFAIAIQYYTIDKLIS

SEQ ID NO: 1579767 - protein, 19 aa, Staphylococcus aureus
NIGDIKQYFTLSNGQAIPN

SEQ ID NO: 1579768 - protein, 20 aa, Staphylococcus aureus
NIKTSVLSFIAFVGAFILIA

SEQ ID NO: 1579769 - protein, 18 aa, Staphylococcus aureus
NIVFKQLFEEVSLYHMLI

SEQ ID NO: 1579770 - protein, 25 aa, Staphylococcus aureus
NIYKKRGKFSLLLLGINNTVIYIMP

SEQ ID NO: 1579771 - protein, 18 aa, Staphylococcus aureus
NKEGSNQIQVTWCEKGVF

SEQ ID NO: 1579772 - protein, 23 aa, Staphylococcus aureus
NKYVEAFKPYLLTLLYLAIFITL

SEQ ID NO: 1579773 - protein, 22 aa, Staphylococcus aureus
NLEGTYRVADRVYTPKRNITLN

SEQ ID NO: 1579774 - protein, 29 aa, Staphylococcus aureus
NLGLDDIRNTHVWEVDAQPAVNEIFDATP

SEQ ID NO: 1579775 - protein, 20 aa, Staphylococcus aureus
NLTSNENFTDKGWQITGIPR

SEQ ID NO: 1579776 - protein, 19 aa, Staphylococcus aureus
NLTSQIERGTTVAGVQGIQ

SEQ ID NO: 1579777 - protein, 22 aa, Staphylococcus aureus
NLYNAQGNIIAKGIYDSTTNTT

SEQ ID NO: 1579778 - protein, 18 aa, Staphylococcus aureus
NNGIARISAVQIVTSDRA

SEQ ID NO: 1579779 - protein, 29 aa, Staphylococcus aureus
NNIKMRKMVPWAIGFFILILIIILFFLLR

SEQ ID NO: 1579780 - protein, 24 aa, Staphylococcus aureus
NQLLEVIDDLFIRYIEENSNYDML

SEQ ID NO: 1579781 - protein, 18 aa, Staphylococcus aureus
NRSYARASANEITSKTVS

SEQ ID NO: 1579782 - protein, 17 aa, Staphylococcus aureus
NSELSIVDSLNFQPAKN

SEQ ID NO: 1579783 - protein, 24 aa, Staphylococcus aureus
NSILLKSILSLGIIYGGTFGIYPK

SEQ ID NO: 1579784 - protein, 25 aa, Staphylococcus aureus
NSKPLRMMIYLGLFIFSISALYIIY

SEQ ID NO: 1579785 - protein, 27 aa, Staphylococcus aureus
NTDIKVYRVDNANDLSESYYVNPSDFE

SEQ ID NO: 1579786 - protein, 22 aa, Staphylococcus aureus
NTGIRMFKRYAVITTSAKILGR

SEQ ID NO: 1579787 - protein, 19 aa, Staphylococcus aureus
NTLNGAMGTLRNSIQDNAA

SEQ ID NO: 1579788 - protein, 19 aa, Staphylococcus aureus
NTLNGAMGTLRNSIQDNTA

SEQ ID NO: 1579789 - protein, 21 aa, Staphylococcus aureus
NTNAFRPGGAQQLNEYQLSQL

SEQ ID NO: 1579790 - protein, 25 aa, Staphylococcus aureus
NVKYKEVLTGFKFIAQEIRQLDDHQ

SEQ ID NO: 1579791 - protein, 17 aa, Staphylococcus aureus
NVLKEIGNWIPIKYVTN

SEQ ID NO: 1579792 - protein, 24 aa, Staphylococcus aureus
NVNKASGLFAFLRTKIASLVKLFP

SEQ ID NO: 1579793 - protein, 21 aa, Staphylococcus aureus
PAADESLKDAIKDPALENKEH

SEQ ID NO: 1579794 - protein, 17 aa, Staphylococcus aureus
PEHNYQFGGAMIESEKL

SEQ ID NO: 1579795 - protein, 17 aa, Staphylococcus aureus
PETPMPPTPEVPSEPET

SEQ ID NO: 1579796 - protein, 18 aa, Staphylococcus aureus
PIELEFKSEPPVEKHELT

SEQ ID NO: 1579797 - protein, 17 aa, Staphylococcus aureus
PIIILSIYFKNYVPTIV

SEQ ID NO: 1579798 - protein, 18 aa, Staphylococcus aureus
PILFSCWIFILNMILSRL

SEQ ID NO: 1579799 - protein, 17 aa, Staphylococcus aureus
PKLGISNVKFNEEEKDT

SEQ ID NO: 1579800 - protein, 18 aa, Staphylococcus aureus
PNALAGIFGISYSSVNRI

SEQ ID NO: 1579801 - protein, 17 aa, Staphylococcus aureus
PQSNRIYDFSQYEDVTS

SEQ ID NO: 1579802 - protein, 20 aa, Staphylococcus aureus
PSDITDDFTPVDITDPSGEV

SEQ ID NO: 1579803 - protein, 22 aa, Staphylococcus aureus
PTNNTFQDFDINYNGDTKVMTV

SEQ ID NO: 1579804 - protein, 25 aa, Staphylococcus aureus
PYYPYYPVQLTWNNGVAFYSNNAKG

SEQ ID NO: 1579805 - protein, 20 aa, Staphylococcus aureus
QALSWVIKNERQAGATTDTF

SEQ ID NO: 1579806 - protein, 24 aa, Staphylococcus aureus
QDGKRPEKVSVNLLANGEKVKTLD

SEQ ID NO: 1579807 - protein, 17 aa, Staphylococcus aureus
QDLKGILAFSTVSQLGM

SEQ ID NO: 1579808 - protein, 30 aa, Staphylococcus aureus
QEAARTRNPIRLMIGFDYPDAYGNSETLVP

SEQ ID NO: 1579809 - protein, 21 aa, Staphylococcus aureus
QGVRECVPTLLGYAGVGISFG

SEQ ID NO: 1579810 - protein, 18 aa, Staphylococcus aureus
QHAVTDLNQLNGLNNPQR

SEQ ID NO: 1579811 - protein, 59 aa, Staphylococcus aureus
QITTPYIVVVNGHIDPASTGDLALRSTFYGYDSNFIWRSMSWDNEVAFNNGSGSGDGID

SEQ ID NO: 1579812 - protein, 27 aa, Staphylococcus aureus
QKEALKAQVTSAGRVSVANGVEHTATE

SEQ ID NO: 1579813 - protein, 23 aa, Staphylococcus aureus
QKIPLLIKRHVYSINVKAFSLIE

SEQ ID NO: 1579814 - protein, 18 aa, Staphylococcus aureus
QMNFIISIVIAFIAILLL

SEQ ID NO: 1579815 - protein, 20 aa, Staphylococcus aureus
QNLHSFKVGRGFDKEDNELR

SEQ ID NO: 1579816 - protein, 18 aa, Staphylococcus aureus
QPLRINLTSNENFTDKGW

SEQ ID NO: 1579817 - protein, 20 aa, Staphylococcus aureus
QQAKDALRQMTHLSDAQKQS

SEQ ID NO: 1579818 - protein, 21 aa, Staphylococcus aureus
QQAKDALRQMTHLSDAQKQSI

SEQ ID NO: 1579819 - protein, 22 aa, Staphylococcus aureus
QRVTIARMILKDAPIIVLDEAT

SEQ ID NO: 1579820 - protein, 22 aa, Staphylococcus aureus
QSNSHLHVGYGTVNHPFNSSPI

SEQ ID NO: 1579821 - protein, 36 aa, Staphylococcus aureus
QYGQKKSKKGWFWGCGGCLVLFILIIIGISACTAGI

SEQ ID NO: 1579822 - protein, 20 aa, Staphylococcus aureus
RCDEVKDFYDDLSIKLVRPF

SEQ ID NO: 1579823 - protein, 17 aa, Staphylococcus aureus
RGLFPWAAVGDISRGTL

SEQ ID NO: 1579824 - protein, 19 aa, Staphylococcus aureus
RISAVQIVISDRAKQSSST

SEQ ID NO: 1579825 - protein, 24 aa, Staphylococcus aureus
RKFQEKWYGIFLEKINIYKKRGKF

SEQ ID NO: 1579826 - protein, 25 aa, Staphylococcus aureus
RKQLLLRKIHGYSLFSSNVRYLTIS

SEQ ID NO: 1579827 - protein, 18 aa, Staphylococcus aureus
RKYILVTVWTIIILTLLI

SEQ ID NO: 1579828 - protein, 33 aa, Staphylococcus aureus
RKYSVGTASILVGTTLIFGLSGHEAKAAEHTNG

SEQ ID NO: 1579829 - protein, 24 aa, Staphylococcus aureus
RLNNRKAEALQRLDQLTHLNNAQR

SEQ ID NO: 1579830 - protein, 29 aa, Staphylococcus aureus
RQVFLGKAGFFIMLGMLQALIVSVGDLLI

SEQ ID NO: 1579831 - protein, 20 aa, Staphylococcus aureus
RSTGDLIYRSNLSTQIQNLL

SEQ ID NO: 1579832 - protein, 20 aa, Staphylococcus aureus
RSYSLYLWHFAVISFVHSYY

SEQ ID NO: 1579833 - protein, 17 aa, Staphylococcus aureus
RVIPSMMIGSGIGGAIA

SEQ ID NO: 1579834 - protein, 24 aa, Staphylococcus aureus
RVPFIVDFLYDFWWLFFPVAVFLV

SEQ ID NO: 1579835 - protein, 19 aa, Staphylococcus aureus
RVYYDMNKPSGKRINAIQI

SEQ ID NO: 1579836 - protein, 19 aa, Staphylococcus aureus
RYEFMPLKYKKRIVMNGEQ

SEQ ID NO: 1579837 - protein, 17 aa, Staphylococcus aureus
RYIKVLILYIFTTLLSS

SEQ ID NO: 1579838 - protein, 18 aa, Staphylococcus aureus
RYYPFDSVAMFITLIIIA

SEQ ID NO: 1579839 - protein, 18 aa, Staphylococcus aureus
SALYIIYLFINIMISGVN

SEQ ID NO: 1579840 - protein, 26 aa, Staphylococcus aureus
SANAIIQKPIRSVQEVQTALTNVNRV

SEQ ID NO: 1579841 - protein, 21 aa, Staphylococcus aureus
SDSIKTNVAMNWYFIAASVVV

SEQ ID NO: 1579842 - protein, 24 aa, Staphylococcus aureus
SEIRKKLAQKLMRLPLGVVESKKI

SEQ ID NO: 1579843 - protein, 18 aa, Staphylococcus aureus
SEITAALNKVTQAKNDLN

SEQ ID NO: 1579844 - protein, 20 aa, Staphylococcus aureus
SFLGGLGIFLYGLKIMGDGL

SEQ ID NO: 1579845 - protein, 17 aa, Staphylococcus aureus
SGHEAKAAEHTNGELNQ

SEQ ID NO: 1579846 - protein, 24 aa, Staphylococcus aureus
SGLEKILFCIATIMVSWLWFFLLA

SEQ ID NO: 1579847 - protein, 25 aa, Staphylococcus aureus
SGLEKILFCIATIMVSWLWFFLLAI

SEQ ID NO: 1579848 - protein, 20 aa, Staphylococcus aureus
SGNQLVRMSVPKGSAHEKQL

SEQ ID NO: 1579849 - protein, 17 aa, Staphylococcus aureus
SHDFKIRNRSGQVIYDW

SEQ ID NO: 1579850 - protein, 19 aa, Staphylococcus aureus
SHGTVSIYDALRQSFNIPA

SEQ ID NO: 1579851 - protein, 19 aa, Staphylococcus aureus
SHTPWQFKIFVPDSPTAIL

SEQ ID NO: 1579852 - protein, 17 aa, Staphylococcus aureus
SIFAFKKVMSGFNETYA

SEQ ID NO: 1579853 - protein, 19 aa, Staphylococcus aureus
SIKLFKADNTPLTITNTTY

SEQ ID NO: 1579854 - protein, 22 aa, Staphylococcus aureus
SIPTVYLAWNLPSIIDMFTKLQ

SEQ ID NO: 1579855 - protein, 24 aa, Staphylococcus aureus
SIRYASYEQIEFAVIDEGPGISLE

SEQ ID NO: 1579856 - protein, 25 aa, Staphylococcus aureus
SKVAYVVEFFEWFNTLETFKNWKKK

SEQ ID NO: 1579857 - protein, 26 aa, Staphylococcus aureus
SLANMKEILNYYGLNSKGFRVDDVDD

SEQ ID NO: 1579858 - protein, 25 aa, Staphylococcus aureus
SLGQLIAFTTILGYFIRPIQVLLNA

SEQ ID NO: 1579859 - protein, 18 aa, Staphylococcus aureus
SLIFLIACLFMLNVNIPN

SEQ ID NO: 1579860 - protein, 18 aa, Staphylococcus aureus
SLLFLGIIILLSILIFIY

SEQ ID NO: 1579861 - protein, 17 aa, Staphylococcus aureus
SLNHIFISPSAKFIKKV

SEQ ID NO: 1579862 - protein, 24 aa, Staphylococcus aureus
SNIISYCFLAIFSVILNIIIGKVF

SEQ ID NO: 1579863 - protein, 18 aa, Staphylococcus aureus
SPAAMFVLVAGIGLIATV

SEQ ID NO: 1579864 - protein, 17 aa, Staphylococcus aureus
SQNIIIFLTWVIITMFF

SEQ ID NO: 1579865 - protein, 18 aa, Staphylococcus aureus
SQQFWDIFVSKLLLSLTV

SEQ ID NO: 1579866 - protein, 18 aa, Staphylococcus aureus
SRKRYSPNSTYKIYLAMF

SEQ ID NO: 1579867 - protein, 17 aa, Staphylococcus aureus
SRMSWNHKHYLFESWNK

SEQ ID NO: 1579868 - protein, 18 aa, Staphylococcus aureus
SRMSWNHKHYLFESWNKE

SEQ ID NO: 1579869 - protein, 24 aa, Staphylococcus aureus
SSFRKISKVIIYFLVFFYILSHHI

SEQ ID NO: 1579870 - protein, 26 aa, Staphylococcus aureus
SSLFTGNWRGVWDGIVMILKGTVQLI

SEQ ID NO: 1579871 - protein, 27 aa, Staphylococcus aureus
SSLFTGNWRGVWDGIVMILKGTVQLIW

SEQ ID NO: 1579872 - protein, 26 aa, Staphylococcus aureus
SSMKWDEILTILPWLIGALIATIFIG

SEQ ID NO: 1579873 - protein, 26 aa, Staphylococcus aureus
SSMKWDEILTILPWLIGALIVTIFIG

SEQ ID NO: 1579874 - protein, 18 aa, Staphylococcus aureus
SSPVMHHVFLISFVAIFV

SEQ ID NO: 1579875 - protein, 20 aa, Staphylococcus aureus
SSVFYYKTGDMLPEDTTHVR

SEQ ID NO: 1579876 - protein, 28 aa, Staphylococcus aureus
STSESNSMHPSDSMSMHHTHSTSTSIST

SEQ ID NO: 1579877 - protein, 18 aa, Staphylococcus aureus
STSQRSSESVSESDSLSD

SEQ ID NO: 1579878 - protein, 24 aa, Staphylococcus aureus
SVGYRAQLTLSIGVGESTENLIDL

SEQ ID NO: 1579879 - protein, 19 aa, Staphylococcus aureus
SWITWVFIGILGLYLILRK

SEQ ID NO: 1579880 - protein, 20 aa, Staphylococcus aureus
TAIVIVIFALFGLMFYLYHL

SEQ ID NO: 1579881 - protein, 34 aa, Staphylococcus aureus
TAVRHIYEISSLIYKVTMKIKIKAMGINVDEIDK

SEQ ID NO: 1579882 - protein, 31 aa, Staphylococcus aureus
TDEKVLKDNEHSPLLFAKRRKDKEEDVETTT

SEQ ID NO: 1579883 - protein, 22 aa, Staphylococcus aureus
TELNTAMGTLKHAIADKTNTLA

SEQ ID NO: 1579884 - protein, 30 aa, Staphylococcus aureus
TEYQDYFLQFEWFQPLLISLAALLILIGLI

SEQ ID NO: 1579885 - protein, 20 aa, Staphylococcus aureus
TFLIAVCCIIYIKQIDETED

SEQ ID NO: 1579886 - protein, 18 aa, Staphylococcus aureus
TFTKCTMVLILSFLLAQN

SEQ ID NO: 1579887 - protein, 27 aa, Staphylococcus aureus
TGALVGSALGLYFKNKVYQKADDLKVK

SEQ ID NO: 1579888 - protein, 21 aa, Staphylococcus aureus
THILFCSKILLLIIVSIAIIQ

SEQ ID NO: 1579889 - protein, 21 aa, Staphylococcus aureus
TIQGKEHFEGYGSVDIQKNPT

SEQ ID NO: 1579890 - protein, 44 aa, Staphylococcus aureus
TIYIATTFHASMTFGLIFLFSEEIGDLFSIKVIAISTAIVAVGY

SEQ ID NO: 1579891 - protein, 18 aa, Staphylococcus aureus
TKAQDLDGAMQRLQSAIA

SEQ ID NO: 1579892 - protein, 19 aa, Staphylococcus aureus
TLLDGSKVIVNVPVKVVEK

SEQ ID NO: 1579893 - protein, 20 aa, Staphylococcus aureus
TLLDGSKVIVNVPVKVVEKE

SEQ ID NO: 1579894 - protein, 22 aa, Staphylococcus aureus
TLNTAMKGLRDSIANEATIKAG

SEQ ID NO: 1579895 - protein, 36 aa, Staphylococcus aureus
TLQMLNMRYSHWFRFVWPVVAFVLIFGGGLLITQVL

SEQ ID NO: 1579896 - protein, 24 aa, Staphylococcus aureus
TLTPEQKEAAIAEVNKLKQQAIEQ

SEQ ID NO: 1579897 - protein, 22 aa, Staphylococcus aureus
TNGLKKAYAYIIKANDNFQRQM

SEQ ID NO: 1579898 - protein, 29 aa, Staphylococcus aureus
TNTLLMIPMCISFLFGPLVDALPLKKTLF

SEQ ID NO: 1579899 - protein, 17 aa, Staphylococcus aureus
TQLMPLFKFVSQGLQNM

SEQ ID NO: 1579900 - protein, 32 aa, Staphylococcus aureus
TSTAPVKLRTFSRLAMSTFASAATTSAVTANT

SEQ ID NO: 1579901 - protein, 31 aa, Staphylococcus aureus
TSTAPVKLRTFSRLAMSTFASAATTTAVTAN

SEQ ID NO: 1579902 - protein, 19 aa, Staphylococcus aureus
TTLPNGWTSNLTKADKNNG

SEQ ID NO: 1579903 - protein, 26 aa, Staphylococcus aureus
TYDILTKTYTFVFTDYVNNKENINGQ

SEQ ID NO: 1579904 - protein, 21 aa, Staphylococcus aureus
TYGDFWGFLSGWAQSFIYFPA

SEQ ID NO: 1579905 - protein, 25 aa, Staphylococcus aureus
VAQAKETAKRALASYSNLNNAQSTA

SEQ ID NO: 1579906 - protein, 25 aa, Staphylococcus aureus
VENNEYRGGPAYYIEYGIGGKFGKI

SEQ ID NO: 1579907 - protein, 19 aa, Staphylococcus aureus
VFLLLFIMKYGFRKIEAIV

SEQ ID NO: 1579908 - protein, 23 aa, Staphylococcus aureus
VGILSLFGIFALLLVITLPIYTV

SEQ ID NO: 1579909 - protein, 22 aa, Staphylococcus aureus
VGLMVPHIARFLIGTDYAKILP

SEQ ID NO: 1579910 - protein, 18 aa, Staphylococcus aureus
VGYKRLEIDFSKEDRDIS

SEQ ID NO: 1579911 - protein, 18 aa, Staphylococcus aureus
VKQSVKFTDADKAKRDAY

SEQ ID NO: 1579912 - protein, 21 aa, Staphylococcus aureus
VKRSFGRIGQIMRKEVNGTSD

SEQ ID NO: 1579913 - protein, 21 aa, Staphylococcus aureus
VLKNTRLFILITIGALIYLVS

SEQ ID NO: 1579914 - protein, 24 aa, Staphylococcus aureus
VLSKDRTTLIVAHRLSTITHADKI

SEQ ID NO: 1579915 - protein, 19 aa, Staphylococcus aureus
VMLAARILLESGAEGTRVE

SEQ ID NO: 1579916 - protein, 25 aa, Staphylococcus aureus
VPIVPELLKSLNFNQFNLVDAQCKP

SEQ ID NO: 1579917 - protein, 17 aa, Staphylococcus aureus
VSDCRHLLKHPDNLIDG

SEQ ID NO: 1579918 - protein, 21 aa, Staphylococcus aureus
VSEIKPRMKRSADVAEVAEKE

SEQ ID NO: 1579919 - protein, 30 aa, Staphylococcus aureus
VSGSVGEMFRPFALAIAFSLLASLLVSITL

SEQ ID NO: 1579920 - protein, 19 aa, Staphylococcus aureus
VSIWTWWKNNNFTHASKKG

SEQ ID NO: 1579921 - protein, 25 aa, Staphylococcus aureus
VTVLLLKRRTPVIAVDAPAQHTQLH

SEQ ID NO: 1579922 - protein, 24 aa, Staphylococcus aureus
VVLLPFHWRALQSVNWQAVQLDTF

SEQ ID NO: 1579923 - protein, 19 aa, Staphylococcus aureus
VVLLPTHRGTVSSGTEGSG

SEQ ID NO: 1579924 - protein, 19 aa, Staphylococcus aureus
VYKRRKMVKEEGLALTSGI

SEQ ID NO: 1579925 - protein, 17 aa, Staphylococcus aureus
WAQLKRNKLAVVGMIGL

SEQ ID NO: 1579926 - protein, 21 aa, Staphylococcus aureus
WIVKFGESIVGLGSFGAFVYG

SEQ ID NO: 1579927 - protein, 18 aa, Staphylococcus aureus
WLLAKRKYILVTVWTIII

SEQ ID NO: 1579928 - protein, 18 aa, Staphylococcus aureus
WTAGFSFSAGLIDYVLSL

SEQ ID NO: 1579929 - protein, 19 aa, Staphylococcus aureus
YAVQKLHGFSTTRIIFHNI

SEQ ID NO: 1579930 - protein, 24 aa, Staphylococcus aureus
YDLINCLKKGIVYHHGSVPENVRK

SEQ ID NO: 1579931 - protein, 37 aa, Staphylococcus aureus
YEGNGNGGDGIGFAFSPGVLGETGLNGAAVGIGGLSN

SEQ ID NO: 1579932 - protein, 18 aa, Staphylococcus aureus
YETIFLLGLILALFTVLP

SEQ ID NO: 1579933 - protein, 18 aa, Staphylococcus aureus
YFLHFCVLLLLKYIGFKL

SEQ ID NO: 1579934 - protein, 17 aa, Staphylococcus aureus
YGGGSADGDSAVNPKDP

SEQ ID NO: 1579935 - protein, 18 aa, Staphylococcus aureus
YIFLTGHHTFYMAAFLAI

SEQ ID NO: 1579936 - protein, 19 aa, Staphylococcus aureus
YKKKDYKYISDYVKNNSQL

SEQ ID NO: 1579937 - protein, 35 aa, Staphylococcus aureus
YKSYLPQVFKSMMVPLIIIIAMFFIHFNTALIMLI

SEQ ID NO: 1579938 - protein, 20 aa, Staphylococcus aureus
YLANISILSILGYVFALIQS

SEQ ID NO: 1579939 - protein, 27 aa, Staphylococcus aureus
YLPLSDIGMGWVVLSLIGFIIGFIIYK

SEQ ID NO: 1579940 - protein, 17 aa, Staphylococcus aureus
YLPVIFKVIKLQLNLSK

SEQ ID NO: 1579941 - protein, 24 aa, Staphylococcus aureus
YPLEKATSHLLGYVGPINSEELKQ

SEQ ID NO: 1579942 - protein, 22 aa, Staphylococcus aureus
YVKTPSNKVLGFYSNNANTNAF

SEQ ID NO: 1579943 - protein, 17 aa, Staphylococcus aureus
YYYYFSVLFMLIGIIGA

SEQ ID NO: 1579944 - protein, 19 aa, Staphylococcus aureus
AAGGSILFGVTFRKYTHLL

SEQ ID NO: 1579945 - protein, 22 aa, Staphylococcus aureus
AAVKQTAKSDIGRLTDLNNAQR

SEQ ID NO: 1579946 - protein, 23 aa, Staphylococcus aureus
AESLSAFRLILATIILLPFVIIK

SEQ ID NO: 1579947 - protein, 19 aa, Staphylococcus aureus
AFAGSFVYIYFMQGVQGFD

SEQ ID NO: 1579948 - protein, 18 aa, Staphylococcus aureus
AFAGSFVYIYFMQGVQRF

SEQ ID NO: 1579949 - protein, 19 aa, Staphylococcus aureus
AGPLFNFILALVLFIGLAY

SEQ ID NO: 1579950 - protein, 28 aa, Staphylococcus aureus
AIARLITEFFLLIWRFIDITKINVKLNI

SEQ ID NO: 1579951 - protein, 17 aa, Staphylococcus aureus
AKAAAKQNLGTLNHITN

SEQ ID NO: 1579952 - protein, 19 aa, Staphylococcus aureus
AKALNRAMDQLSQEITGNE

SEQ ID NO: 1579953 - protein, 26 aa, Staphylococcus aureus
AKELAKRKQEAISRIKDFSNEKMNSI

SEQ ID NO: 1579954 - protein, 21 aa, Staphylococcus aureus
AKESKEPLPDTGSEDEANTSL

SEQ ID NO: 1579955 - protein, 20 aa, Staphylococcus aureus
AKLAQCHEFIKKLPEGYDTN

SEQ ID NO: 1579956 - protein, 18 aa, Staphylococcus aureus
AKLPDSLTGNGDVDYSNS

SEQ ID NO: 1579957 - protein, 20 aa, Staphylococcus aureus
AKNAIKALANAKRDQINSNP

SEQ ID NO: 1579958 - protein, 18 aa, Staphylococcus aureus
ALESQINNAATRGEVAQK

SEQ ID NO: 1579959 - protein, 19 aa, Staphylococcus aureus
ALNGDEKLAAAKQTAKSDI

SEQ ID NO: 1579960 - protein, 27 aa, Staphylococcus aureus
ALPNGVIKARSSITMNNVTYTTQDEHG

SEQ ID NO: 1579961 - protein, 18 aa, Staphylococcus aureus
ANLELDFLMFIRRFIVLL

SEQ ID NO: 1579962 - protein, 24 aa, Staphylococcus aureus
AQALNQAMEALRNSIQDQQQTESG

SEQ ID NO: 1579963 - protein, 19 aa, Staphylococcus aureus
AQQSISISLIFAVILFVSA

SEQ ID NO: 1579964 - protein, 19 aa, Staphylococcus aureus
ASDYFKLSNGSAIPDATIT

SEQ ID NO: 1579965 - protein, 17 aa, Staphylococcus aureus
ASESKPRVTRSADVVEA

SEQ ID NO: 1579966 - protein, 35 aa, Staphylococcus aureus
ASKTVLIDYEKYGQFHNLSIKGTIDQIDKTNNTYR

SEQ ID NO: 1579967 - protein, 19 aa, Staphylococcus aureus
ATIIVGIDIILIVLIIVTL

SEQ ID NO: 1579968 - protein, 18 aa, Staphylococcus aureus
ATLGKWVPYLLGIVMLGM

SEQ ID NO: 1579969 - protein, 17 aa, Staphylococcus aureus
ATPEHNYQFGGAMIESE

SEQ ID NO: 1579970 - protein, 28 aa, Staphylococcus aureus
ATYDILTKTYTFVFTDYVNDKQNINGKF

SEQ ID NO: 1579971 - protein, 23 aa, Staphylococcus aureus
AVAKAEALISGTPDVVVTPSEIT

SEQ ID NO: 1579972 - protein, 24 aa, Staphylococcus aureus
AVFILNFKLIFTLPLTILNRQSLF

SEQ ID NO: 1579973 - protein, 33 aa, Staphylococcus aureus
AVFMRPDIGETFSEFRTFLAVLLMLLLFISISL

SEQ ID NO: 1579974 - protein, 25 aa, Staphylococcus aureus
AVVEFGLFVAVLGPLVFMFGLFISV

SEQ ID NO: 1579975 - protein, 19 aa, Staphylococcus aureus
AVVIALIFFVLFLVTLGSK

SEQ ID NO: 1579976 - protein, 27 aa, Staphylococcus aureus
AYLIELIRWLFTFGILFQLPILFIGLA

SEQ ID NO: 1579977 - protein, 18 aa, Staphylococcus aureus
AYLLKISRSFEVILLEEK

SEQ ID NO: 1579978 - protein, 23 aa, Staphylococcus aureus
CEIGGGYLIWLWLREGQSSLVGL

SEQ ID NO: 1579979 - protein, 18 aa, Staphylococcus aureus
CGLLGGRVSEDINFNEVS

SEQ ID NO: 1579980 - protein, 23 aa, Staphylococcus aureus
CLLTVFLSFNFVNSILFDGSFVF

SEQ ID NO: 1579981 - protein, 17 aa, Staphylococcus aureus
CQNIPQKSWFVSATSTT

SEQ ID NO: 1579982 - protein, 19 aa, Staphylococcus aureus
CRGLIIRILFRNHLFLGFI

SEQ ID NO: 1579983 - protein, 23 aa, Staphylococcus aureus
DAAKRQIEGATHVNEVTQAQNNA

SEQ ID NO: 1579984 - protein, 21 aa, Staphylococcus aureus
DAKNAIKALANAKRDQINSNP

SEQ ID NO: 1579985 - protein, 34 aa, Staphylococcus aureus
DDEIDPLHMRHFGDRIGNVIKNALGVVGISGLLA

SEQ ID NO: 1579986 - protein, 25 aa, Staphylococcus aureus
DDVLKGKAYTSAKQFFSTVLIPLST

SEQ ID NO: 1579987 - protein, 21 aa, Staphylococcus aureus
DEAVKILKDIRVDGKTDQQIA

SEQ ID NO: 1579988 - protein, 24 aa, Staphylococcus aureus
DEQKRNAYNQAISAAETILNKQTG

SEQ ID NO: 1579989 - protein, 24 aa, Staphylococcus aureus
DFIGFSSAWGYWFAAFLGNVAYAT

SEQ ID NO: 1579990 - protein, 19 aa, Staphylococcus aureus
DFIIIIGFIITFIGILSIF

SEQ ID NO: 1579991 - protein, 17 aa, Staphylococcus aureus
DKANAFVNSLNGLNQQQ

SEQ ID NO: 1579992 - protein, 27 aa, Staphylococcus aureus
DKLILLDFRLPRMMITILAGAALSISG

SEQ ID NO: 1579993 - protein, 24 aa, Staphylococcus aureus
DKLVIKRNGNVVTTFTRRNNTSPW

SEQ ID NO: 1579994 - protein, 19 aa, Staphylococcus aureus
DLAIAVVMGAAFNKIISSL

SEQ ID NO: 1579995 - protein, 25 aa, Staphylococcus aureus
DLDGAMQRLESAIANKDQTKASENY

SEQ ID NO: 1579996 - protein, 25 aa, Staphylococcus aureus
DLDGAMQRLQSAIANKDQTKASENY

SEQ ID NO: 1579997 - protein, 48 aa, Staphylococcus aureus
DLLILKAGVESPVLFVLITIFCSIIFNSIVYTCVSLLGNPGKAIAIVL

SEQ ID NO: 1579998 - protein, 24 aa, Staphylococcus aureus
DLRQFGGLIKRYPVLGWSFFIAAL

SEQ ID NO: 1579999 - protein, 21 aa, Staphylococcus aureus
DLSESYYVNPSDFEDVTNQVR

SEQ ID NO: 1580000 - protein, 17 aa, Staphylococcus aureus
DLVKAKEDAKNAIKALA

SEQ ID NO: 1580001 - protein, 17 aa, Staphylococcus aureus
DLVKAKESAKQDIDKQV

SEQ ID NO: 1580002 - protein, 37 aa, Staphylococcus aureus
DMLKRLKYKKARNFYSMLYDWRINKNPLYKGVYSIVS

SEQ ID NO: 1580003 - protein, 20 aa, Staphylococcus aureus
DMSNIYTILPWFLITIPIII

SEQ ID NO: 1580004 - protein, 30 aa, Staphylococcus aureus
DNAPALYPNYWGGNKFKVIEELRKQGYNVH

SEQ ID NO: 1580005 - protein, 29 aa, Staphylococcus aureus
DSGSLSVSTSLRKSESVSESSSLSGSQSM

SEQ ID NO: 1580006 - protein, 18 aa, Staphylococcus aureus
DSKEPLPDTGSEDEANTS

SEQ ID NO: 1580007 - protein, 24 aa, Staphylococcus aureus
DSLMKLNPFWTILLSIVFLHEKVR

SEQ ID NO: 1580008 - protein, 27 aa, Staphylococcus aureus
DTKAPIANVKFKLSKKDGSVVKDNQKE

SEQ ID NO: 1580009 - protein, 20 aa, Staphylococcus aureus
DTKIAITHQITWDFVKAPHG

SEQ ID NO: 1580010 - protein, 18 aa, Staphylococcus aureus
DTKLAWMFMYGVSGLLIP

SEQ ID NO: 1580011 - protein, 21 aa, Staphylococcus aureus
DTPEKAISGGADFIHKHFLSS

SEQ ID NO: 1580012 - protein, 18 aa, Staphylococcus aureus
DVKGVVLISIIVTIILFI

SEQ ID NO: 1580013 - protein, 20 aa, Staphylococcus aureus
DVSAQKVWEGTQKVKPTIYF

SEQ ID NO: 1580014 - protein, 30 aa, Staphylococcus aureus
EAGATAATKAFGRQNFEYINGQKPAESPGV

SEQ ID NO: 1580015 - protein, 20 aa, Staphylococcus aureus
EAKALNRVMDQLSQEITGNE

SEQ ID NO: 1580016 - protein, 20 aa, Staphylococcus aureus
EFVIAIRFLLGIAGALIMPT

SEQ ID NO: 1580017 - protein, 17 aa, Staphylococcus aureus
EGRLHEMHHQIRTSIGV

SEQ ID NO: 1580018 - protein, 24 aa, Staphylococcus aureus
EKTLIEYMDYLSLKDSKRILKSYP

SEQ ID NO: 1580019 - protein, 17 aa, Staphylococcus aureus
ELIKKLSIAVDWFSNLS

SEQ ID NO: 1580020 - protein, 30 aa, Staphylococcus aureus
ELNGAMTALKAAIADKERTKASGNYVNADQ

SEQ ID NO: 1580021 - protein, 24 aa, Staphylococcus aureus
ELNTAMTALKRAIADKADTKASGN

SEQ ID NO: 1580022 - protein, 28 aa, Staphylococcus aureus
EMFDNKITYNYSSPIAGIDKPNGANISS

SEQ ID NO: 1580023 - protein, 21 aa, Staphylococcus aureus
ENATESFLKFSHITGSDGVQA

SEQ ID NO: 1580024 - protein, 17 aa, Staphylococcus aureus
ENFKFFGQYADFKDLKN

SEQ ID NO: 1580025 - protein, 24 aa, Staphylococcus aureus
ENPLIKSVEIHKQLPNTLNVDITE

SEQ ID NO: 1580026 - protein, 19 aa, Staphylococcus aureus
ENVNFIWRLLACYVTSVTV

SEQ ID NO: 1580027 - protein, 26 aa, Staphylococcus aureus
EQFKAQLKAANPFAKELENRKKAAIS

SEQ ID NO: 1580028 - protein, 20 aa, Staphylococcus aureus
EQLTHAFKQAKDNLHGDQKL

SEQ ID NO: 1580029 - protein, 44 aa, Staphylococcus aureus
ERNIELVGNLLPGDYFGTIRFGRKEQLFEIRVKPHTPTITTTAE

SEQ ID NO: 1580030 - protein, 22 aa, Staphylococcus aureus
ESGVEVLIHIGIDTVKLNGEGF

SEQ ID NO: 1580031 - protein, 30 aa, Staphylococcus aureus
ESLDKVKHTPFFLPKRRRKEDEEDVEVTNE

SEQ ID NO: 1580032 - protein, 33 aa, Staphylococcus aureus
ETMGYLKGFALYISILILIVFIAGCGKSDKTKE

SEQ ID NO: 1580033 - protein, 21 aa, Staphylococcus aureus
ETNWKYEFKNLPKYDEGKKIE

SEQ ID NO: 1580034 - protein, 26 aa, Staphylococcus aureus
ETNYDYTKLVFAKPIYNDPSLVKSDT

SEQ ID NO: 1580035 - protein, 20 aa, Staphylococcus aureus
EVHVASEFVYNMPLLSEKPL

SEQ ID NO: 1580036 - protein, 42 aa, Staphylococcus aureus
EVTDQFKNRIYYEHPNVASIKFGDITKTYVVLVEGHYDNTGK

SEQ ID NO: 1580037 - protein, 17 aa, Staphylococcus aureus
FALCNLYYFAAVQNHYD

SEQ ID NO: 1580038 - protein, 21 aa, Staphylococcus aureus
FCLISPVMFYQLWAFVAPGLH

SEQ ID NO: 1580039 - protein, 22 aa, Staphylococcus aureus
FCNFFINIGIFISMQFKGGLTK

SEQ ID NO: 1580040 - protein, 23 aa, Staphylococcus aureus
FCSSCLGCDIFSILEAEVFSSLV

SEQ ID NO: 1580041 - protein, 23 aa, Staphylococcus aureus
FDAFVVRMMLIPALTKLFGKGSW

SEQ ID NO: 1580042 - protein, 21 aa, Staphylococcus aureus
FDLIIGLLLNFQIFLKNKKYD

SEQ ID NO: 1580043 - protein, 21 aa, Staphylococcus aureus
FDLKASGWAYFLYEWAGIPGT

SEQ ID NO: 1580044 - protein, 26 aa, Staphylococcus aureus
FEYQFSSRLRKFILIILVGAAIATSV

SEQ ID NO: 1580045 - protein, 18 aa, Staphylococcus aureus
FFASFAFAILLSITIDIG

SEQ ID NO: 1580046 - protein, 18 aa, Staphylococcus aureus
FFGQYADFKSLKSYNHGD

SEQ ID NO: 1580047 - protein, 24 aa, Staphylococcus aureus
FFIGGVFSLLSTMLLYRFVVFSDQ

SEQ ID NO: 1580048 - protein, 17 aa, Staphylococcus aureus
FFKFKLLLFEVNQMQYV

SEQ ID NO: 1580049 - protein, 22 aa, Staphylococcus aureus
FGDINKTYVVLVEGHYDNTGKN

SEQ ID NO: 1580050 - protein, 17 aa, Staphylococcus aureus
FGDLGVGLMAWLNIIAI

SEQ ID NO: 1580051 - protein, 23 aa, Staphylococcus aureus
FGGLIGGPVVKYLIKRYNLKPQH

SEQ ID NO: 1580052 - protein, 18 aa, Staphylococcus aureus
FGGSVVIWLLSYVGPHGI

SEQ ID NO: 1580053 - protein, 46 aa, Staphylococcus aureus
FHIGFIRYFSRMIIPNLFSLLASIIVLWLYFRKAIPKTFDDNNIKH

SEQ ID NO: 1580054 - protein, 25 aa, Staphylococcus aureus
FIMKYGFRKIEAIVGTFIFTVLFIF

SEQ ID NO: 1580055 - protein, 26 aa, Staphylococcus aureus
FIVGILRLFGVIALMLVVISPIYTVA

SEQ ID NO: 1580056 - protein, 19 aa, Staphylococcus aureus
FKDIAWRDLLIIPIIGVLS

SEQ ID NO: 1580057 - protein, 28 aa, Staphylococcus aureus
FKDKITYKYQNVASINFGDINKTYVVLV

SEQ ID NO: 1580058 - protein, 19 aa, Staphylococcus aureus
FKNICLSLIAYVFFGGFSI

SEQ ID NO: 1580059 - protein, 19 aa, Staphylococcus aureus
FKYDVKKILDDVSFQIPQG

SEQ ID NO: 1580060 - protein, 19 aa, Staphylococcus aureus
FLGDFIFKYTDWGITKATI

SEQ ID NO: 1580061 - protein, 19 aa, Staphylococcus aureus
FLILCEFFYGIPFLGATFI

SEQ ID NO: 1580062 - protein, 19 aa, Staphylococcus aureus
FLLMYGLDYLYDMFAPPTL

SEQ ID NO: 1580063 - protein, 24 aa, Staphylococcus aureus
FLPALIGWSSMRVFGGSPILGLVL

SEQ ID NO: 1580064 - protein, 19 aa, Staphylococcus aureus
FMPIPMPGSVIGLVLLFVL

SEQ ID NO: 1580065 - protein, 20 aa, Staphylococcus aureus
FNIGDIKQYFTLSNGQAIPS

SEQ ID NO: 1580066 - protein, 26 aa, Staphylococcus aureus
FNLYRIEAKLSRKVIYLLSFTLLLVS

SEQ ID NO: 1580067 - protein, 20 aa, Staphylococcus aureus
FPILMGFFVFLFVFLISGIA

SEQ ID NO: 1580068 - protein, 23 aa, Staphylococcus aureus
FPMPVKVIRRFKKNDTPPTMMPA

SEQ ID NO: 1580069 - protein, 20 aa, Staphylococcus aureus
FPNPNQYKVEFNTPDDQITT

SEQ ID NO: 1580070 - protein, 20 aa, Staphylococcus aureus
FRIEVDLTFIAAVLTIVGYS

SEQ ID NO: 1580071 - protein, 18 aa, Staphylococcus aureus
FTDVKAPTVTVGNQTIEV

SEQ ID NO: 1580072 - protein, 25 aa, Staphylococcus aureus
FTIACISVSWLWFFLLAILGEMVGS

SEQ ID NO: 1580073 - protein, 17 aa, Staphylococcus aureus
FTLRKIIFENFSKKCTY

SEQ ID NO: 1580074 - protein, 24 aa, Staphylococcus aureus
FTLRKIIFENFSKKCTYWVTLIIS

SEQ ID NO: 1580075 - protein, 23 aa, Staphylococcus aureus
FTPDTSKLIDVTDKFKITYSNDN

SEQ ID NO: 1580076 - protein, 17 aa, Staphylococcus aureus
FVCRKFKPKNIFRLKES

SEQ ID NO: 1580077 - protein, 24 aa, Staphylococcus aureus
FVGLMVPHIARFLIGTDYAKILPL

SEQ ID NO: 1580078 - protein, 23 aa, Staphylococcus aureus
FVLTNVYYHYNLKASNDAKIMKT

SEQ ID NO: 1580079 - protein, 27 aa, Staphylococcus aureus
FWNKNEGFRNFIINAWNAIKTFMVTVW

SEQ ID NO: 1580080 - protein, 28 aa, Staphylococcus aureus
FYHSNPFKFGASIGRYSGRIDNAKFKLQ

SEQ ID NO: 1580081 - protein, 18 aa, Staphylococcus aureus
GAIAMMILLVFQTKGQIR

SEQ ID NO: 1580082 - protein, 25 aa, Staphylococcus aureus
GAVKTADVAWAFGDLGVGLMAWLNI

SEQ ID NO: 1580083 - protein, 30 aa, Staphylococcus aureus
GDKGLVNSGGFKIDTGYIYTSSMDKTEKQA

SEQ ID NO: 1580084 - protein, 23 aa, Staphylococcus aureus
GDLAYLLPKIHIIKGEYCSSKFN

SEQ ID NO: 1580085 - protein, 36 aa, Staphylococcus aureus
GDNVVLPALTGNLIPNTKSNALIDAKNTDIKVYRVD

SEQ ID NO: 1580086 - protein, 18 aa, Staphylococcus aureus
GEATDECTDIYSIGIVLY

SEQ ID NO: 1580087 - protein, 23 aa, Staphylococcus aureus
GEFEVKYLTGFILILLLEGIFTN

SEQ ID NO: 1580088 - protein, 32 aa, Staphylococcus aureus
GESLDKVKHTPFFLPKRRRKEDEEDVEVTNEN

SEQ ID NO: 1580089 - protein, 20 aa, Staphylococcus aureus
GESSVKGFATMLLLGILMIF

SEQ ID NO: 1580090 - protein, 29 aa, Staphylococcus aureus
GETISVPSLIGMLMLIGIVVTNAIVLIDR

SEQ ID NO: 1580091 - protein, 17 aa, Staphylococcus aureus
GFDEILFFTLYLLLILI

SEQ ID NO: 1580092 - protein, 26 aa, Staphylococcus aureus
GFIYLREEYPQFILYSIVLLLMTFYY

SEQ ID NO: 1580093 - protein, 18 aa, Staphylococcus aureus
GFLLLYPVVAFMIGAIRD

SEQ ID NO: 1580094 - protein, 25 aa, Staphylococcus aureus
GGNIIDIDFDSVPQIHGFNKHNEII

SEQ ID NO: 1580095 - protein, 48 aa, Staphylococcus aureus
GHIDPASTGDLALRSTFYGYDSNFIWRSMSWDNEVAFNNGSGSGDGID

SEQ ID NO: 1580096 - protein, 17 aa, Staphylococcus aureus
GIASLLMSLIMGLLSEK

SEQ ID NO: 1580097 - protein, 20 aa, Staphylococcus aureus
GIERRWLDQIIMFVADMLLA

SEQ ID NO: 1580098 - protein, 17 aa, Staphylococcus aureus
GIIAFIFLMLARKSNAL

SEQ ID NO: 1580099 - protein, 17 aa, Staphylococcus aureus
GISPLRKVPDIKSKDDN

SEQ ID NO: 1580100 - protein, 18 aa, Staphylococcus aureus
GISQAVAMWPGFSRSGST

SEQ ID NO: 1580101 - protein, 20 aa, Staphylococcus aureus
GISVAYIYSLYAFYMNNFSS

SEQ ID NO: 1580102 - protein, 17 aa, Staphylococcus aureus
GKKKIESIMTHFRSNPP

SEQ ID NO: 1580103 - protein, 18 aa, Staphylococcus aureus
GKVADDWIENIKLMNDKN

SEQ ID NO: 1580104 - protein, 24 aa, Staphylococcus aureus
GLSISISWFPAFFVTGFLGGLTTF

SEQ ID NO: 1580105 - protein, 19 aa, Staphylococcus aureus
GNEILELTYQLVILIQLFM

SEQ ID NO: 1580106 - protein, 18 aa, Staphylococcus aureus
GNFLKILVTYSISIFLSV

SEQ ID NO: 1580107 - protein, 22 aa, Staphylococcus aureus
GQAGGLAIIIGWIITAIGMISL

SEQ ID NO: 1580108 - protein, 22 aa, Staphylococcus aureus
GQIITFKAFELVGSSRAMPVTT

SEQ ID NO: 1580109 - protein, 19 aa, Staphylococcus aureus
GQIRPTTLIIIGISMQTLF

SEQ ID NO: 1580110 - protein, 19 aa, Staphylococcus aureus
GQSMAFRQGQLYRDDRPVD

SEQ ID NO: 1580111 - protein, 22 aa, Staphylococcus aureus
GRCRNCRKRISLTHFLGETFAL

SEQ ID NO: 1580112 - protein, 22 aa, Staphylococcus aureus
GRFGDGLVNIFTQLMPLFKFVS

SEQ ID NO: 1580113 - protein, 19 aa, Staphylococcus aureus
GRSIREFISGVLLVPAIVS

SEQ ID NO: 1580114 - protein, 18 aa, Staphylococcus aureus
GSFGVLHYQGFTKIIIVL

SEQ ID NO: 1580115 - protein, 20 aa, Staphylococcus aureus
GSTIALFLIVFMAFILIITK

SEQ ID NO: 1580116 - protein, 24 aa, Staphylococcus aureus
GTAEERQAAMNRINEIVLETIKDI

SEQ ID NO: 1580117 - protein, 17 aa, Staphylococcus aureus
GVSDVYDAKQYVKPVND

SEQ ID NO: 1580118 - protein, 19 aa, Staphylococcus aureus
GVTVNGRITLLDKENSKIH

SEQ ID NO: 1580119 - protein, 18 aa, Staphylococcus aureus
GYLYRVALVQSSRVDLIF

SEQ ID NO: 1580120 - protein, 19 aa, Staphylococcus aureus
HDMLVKLALFLLIGIMIKI

SEQ ID NO: 1580121 - protein, 54 aa, Staphylococcus aureus
HDSLANEKTRVRLYKSGKNWVKSGIKEIEMFKIMGLPFISHSIVSQDNQSISKK

SEQ ID NO: 1580122 - protein, 18 aa, Staphylococcus aureus
HDTIVAGGNYTNASPDKQ

SEQ ID NO: 1580123 - protein, 17 aa, Staphylococcus aureus
HGFNIPLLLTIIIILLG

SEQ ID NO: 1580124 - protein, 25 aa, Staphylococcus aureus
HHGNFKVKFFVSLIFAIPIILLSPL

SEQ ID NO: 1580125 - protein, 47 aa, Staphylococcus aureus
HIDPNSKGDLALRSTLYGYDSRFVWRSMSWDNEVAFNNGSGSGDGID

SEQ ID NO: 1580126 - protein, 24 aa, Staphylococcus aureus
HKAHGGEISPLFTGGHNNMVASIT

SEQ ID NO: 1580127 - protein, 20 aa, Staphylococcus aureus
HKSKDALKYASKDPAVSTTD

SEQ ID NO: 1580128 - protein, 18 aa, Staphylococcus aureus
HLQRRLYIENGRLIADDR

SEQ ID NO: 1580129 - protein, 18 aa, Staphylococcus aureus
HNYQFGGAMIESERLSEL

SEQ ID NO: 1580130 - protein, 25 aa, Staphylococcus aureus
HPANLFFKNIEDIKIGFKGHEYLPK

SEQ ID NO: 1580131 - protein, 19 aa, Staphylococcus aureus
HQTQIIKILAKVKPDPPRI

SEQ ID NO: 1580132 - protein, 22 aa, Staphylococcus aureus
HTSHLKNAILEREMGSTTAIGM

SEQ ID NO: 1580133 - protein, 17 aa, Staphylococcus aureus
HVLPLVAKYLINREDEV

SEQ ID NO: 1580134 - protein, 24 aa, Staphylococcus aureus
IALAFRLNQTVTFWTAGGVSGTTW

SEQ ID NO: 1580135 - protein, 23 aa, Staphylococcus aureus
IAVLKMLVIFLVINYGTDVSYDH

SEQ ID NO: 1580136 - protein, 25 aa, Staphylococcus aureus
IAYIACVLIPFNFFFRFNDIKKDNN

SEQ ID NO: 1580137 - protein, 19 aa, Staphylococcus aureus
ICTHFKTILFNTIQMISAF

SEQ ID NO: 1580138 - protein, 18 aa, Staphylococcus aureus
IDDEGMVLFLNRNIKKAT

SEQ ID NO: 1580139 - protein, 18 aa, Staphylococcus aureus
IDGTEEVPGKPGIKNPET

SEQ ID NO: 1580140 - protein, 25 aa, Staphylococcus aureus
IDKLEFKPKLTSVYVKEFNNTGIYK

SEQ ID NO: 1580141 - protein, 21 aa, Staphylococcus aureus
IDKNRIKCMLVDRPTLLKHTD

SEQ ID NO: 1580142 - protein, 24 aa, Staphylococcus aureus
IDQASWRVPFIIILGIAILAFVFG

SEQ ID NO: 1580143 - protein, 25 aa, Staphylococcus aureus
IDQTGLKSWMIWAIEPSMLRIGLQG

SEQ ID NO: 1580144 - protein, 17 aa, Staphylococcus aureus
IELEFKSEPPVEKHELT

SEQ ID NO: 1580145 - protein, 29 aa, Staphylococcus aureus
IFAISAWLYPNFILDFIFIIIMLFLVSLT

SEQ ID NO: 1580146 - protein, 23 aa, Staphylococcus aureus
IFASILLLFSFVVFFFIYGMVSG

SEQ ID NO: 1580147 - protein, 22 aa, Staphylococcus aureus
IFIDDYYLIFLLQGIYIIGAAL

SEQ ID NO: 1580148 - protein, 17 aa, Staphylococcus aureus
IFIVMGLYICMYAIFAI

SEQ ID NO: 1580149 - protein, 17 aa, Staphylococcus aureus
IFIVQKVIEHFKNESKK

SEQ ID NO: 1580150 - protein, 19 aa, Staphylococcus aureus
IFYALNFISLSLILLAKAK

SEQ ID NO: 1580151 - protein, 22 aa, Staphylococcus aureus
IGLLVWFIAGFQFKGHSNDKQI

SEQ ID NO: 1580152 - protein, 18 aa, Staphylococcus aureus
IGQFSIYFILLIGVLLGT

SEQ ID NO: 1580153 - protein, 17 aa, Staphylococcus aureus
IGVAIGMAKKNDGVVAL

SEQ ID NO: 1580154 - protein, 17 aa, Staphylococcus aureus
IGVIGILGGVFWALMAP

SEQ ID NO: 1580155 - protein, 20 aa, Staphylococcus aureus
IGVPISLCWGSAVNYYQYKI

SEQ ID NO: 1580156 - protein, 25 aa, Staphylococcus aureus
IGWYGFNVGSAFTFDKIAMLAFTNT

SEQ ID NO: 1580157 - protein, 21 aa, Staphylococcus aureus
IHSPITFWYGKYIILIPSLYF

SEQ ID NO: 1580158 - protein, 18 aa, Staphylococcus aureus
IIAAKILIFNPIADNTPK

SEQ ID NO: 1580159 - protein, 24 aa, Staphylococcus aureus
IIARVGPIKVLRIILIINAIALII

SEQ ID NO: 1580160 - protein, 21 aa, Staphylococcus aureus
IIGGLIGWAAGAIMGKDIPGG

SEQ ID NO: 1580161 - protein, 32 aa, Staphylococcus aureus
IILTLFGIGFFVVGLILKPVTDPLMKRVSEKV

SEQ ID NO: 1580162 - protein, 20 aa, Staphylococcus aureus
IIPKCFPLRKTAVLVTGIFE

SEQ ID NO: 1580163 - protein, 26 aa, Staphylococcus aureus
IIRILFRNHLFLGFIVSTVFFTLIHE

SEQ ID NO: 1580164 - protein, 26 aa, Staphylococcus aureus
IISFGIKLPLLIAFVLILAGLSFGYI

SEQ ID NO: 1580165 - protein, 20 aa, Staphylococcus aureus
IIVQIKEIFAPLMTISINSI

SEQ ID NO: 1580166 - protein, 23 aa, Staphylococcus aureus
IKDIPKDATIVWYDFDEPNEQEN

SEQ ID NO: 1580167 - protein, 31 aa, Staphylococcus aureus
IKFFSSLFTGDWRGVWDAIIMILKGVVQLIW

SEQ ID NO: 1580168 - protein, 17 aa, Staphylococcus aureus
IKFPDRIMALITGDVKE

SEQ ID NO: 1580169 - protein, 17 aa, Staphylococcus aureus
IKGKVLGVFNFVRYIGM

SEQ ID NO: 1580170 - protein, 19 aa, Staphylococcus aureus
IKIGFKGHEYLPKPKINNL

SEQ ID NO: 1580171 - protein, 27 aa, Staphylococcus aureus
IKIYQVPKGYTLNKGYDVNTKELTDVT

SEQ ID NO: 1580172 - protein, 22 aa, Staphylococcus aureus
IKKHFDCAMIFISHDLTVINKI

SEQ ID NO: 1580173 - protein, 37 aa, Staphylococcus aureus
IKNAIGVVGISGLLASFWFFIAKRRRKEDEEEELEIR

SEQ ID NO: 1580174 - protein, 22 aa, Staphylococcus aureus
IKPGGSLFYLLALLSFPMPVKV

SEQ ID NO: 1580175 - protein, 22 aa, Staphylococcus aureus
IKQRHLAVWFVIYLVSGVIMNK

SEQ ID NO: 1580176 - protein, 19 aa, Staphylococcus aureus
IKTGVLSFIAFVGAIILIA

SEQ ID NO: 1580177 - protein, 17 aa, Staphylococcus aureus
IKTRVALYLFENNELTN

SEQ ID NO: 1580178 - protein, 19 aa, Staphylococcus aureus
ILAGIPTIVFGFFALTYVT

SEQ ID NO: 1580179 - protein, 17 aa, Staphylococcus aureus
ILFGLALLIKRPSQCLK

SEQ ID NO: 1580180 - protein, 23 aa, Staphylococcus aureus
ILFISIFLKFSFNIEFTSTIMNI

SEQ ID NO: 1580181 - protein, 20 aa, Staphylococcus aureus
ILIFSCLWTAITNKYLPSET

SEQ ID NO: 1580182 - protein, 17 aa, Staphylococcus aureus
ILISGAVFIVFLLLPAR

SEQ ID NO: 1580183 - protein, 20 aa, Staphylococcus aureus
ILLGVCGLIAILFNFPKLKK

SEQ ID NO: 1580184 - protein, 19 aa, Staphylococcus aureus
ILLSVCMGLIFGLIAGIER

SEQ ID NO: 1580185 - protein, 19 aa, Staphylococcus aureus
ILMAIVFLFGVDSFKPKSS

SEQ ID NO: 1580186 - protein, 26 aa, Staphylococcus aureus
ILTCLNLGVAPVFAVIVGLVLHDFKL

SEQ ID NO: 1580187 - protein, 18 aa, Staphylococcus aureus
ILVTYSISIFLSVFLYTL

SEQ ID NO: 1580188 - protein, 23 aa, Staphylococcus aureus
ILYMGSLFYAWMAFRNLWNRPLL

SEQ ID NO: 1580189 - protein, 35 aa, Staphylococcus aureus
IMFLQIVTFAGIYFKLGDLMSLFTLQSNDSQNMGR

SEQ ID NO: 1580190 - protein, 22 aa, Staphylococcus aureus
IMLFWIFMSFIFQKLLFPPSKN

SEQ ID NO: 1580191 - protein, 18 aa, Staphylococcus aureus
IMLIILISVASIYFKMKY

SEQ ID NO: 1580192 - protein, 17 aa, Staphylococcus aureus
IMVSMLFTLLVVPWLSS

SEQ ID NO: 1580193 - protein, 22 aa, Staphylococcus aureus
IMYFVKIKWYSILLIMTSQIIL

SEQ ID NO: 1580194 - protein, 18 aa, Staphylococcus aureus
INANTFLYFLTPIINCPD

SEQ ID NO: 1580195 - protein, 17 aa, Staphylococcus aureus
INEKVKAVVPTKKAQSK

SEQ ID NO: 1580196 - protein, 17 aa, Staphylococcus aureus
INERMWDASFLKLNSLY

SEQ ID NO: 1580197 - protein, 22 aa, Staphylococcus aureus
INGQFSLPLFTDRAKAPKSGTY

SEQ ID NO: 1580198 - protein, 27 aa, Staphylococcus aureus
INGQFSLPLFTDRAKAPKSGTYDANIN

SEQ ID NO: 1580199 - protein, 29 aa, Staphylococcus aureus
INIIFYGICVLCFLLLPIIFIPNPNHVFI

SEQ ID NO: 1580200 - protein, 18 aa, Staphylococcus aureus
INIPLTFAGGQGQSQSQS

SEQ ID NO: 1580201 - protein, 32 aa, Staphylococcus aureus
INLKGASLFLRLGARIFKTGIAIILAMSIASL

SEQ ID NO: 1580202 - protein, 25 aa, Staphylococcus aureus
INNATTCDKVAEIIAQAQALNEAMK

SEQ ID NO: 1580203 - protein, 36 aa, Staphylococcus aureus
INTYLLRQVKSIGMFLMIAALGLYFVAMNNLKAAGQ

SEQ ID NO: 1580204 - protein, 25 aa, Staphylococcus aureus
INVNKAGGIFAFLRTKIASLVKLFP

SEQ ID NO: 1580205 - protein, 24 aa, Staphylococcus aureus
INYHSKFDILSWLQDPFATPTLGK

SEQ ID NO: 1580206 - protein, 29 aa, Staphylococcus aureus
IPIIVVLLLIGGIAWGVYAFFANTPKNTY

SEQ ID NO: 1580207 - protein, 20 aa, Staphylococcus aureus
IPSLEIDNASVLDEFYWLNK

SEQ ID NO: 1580208 - protein, 18 aa, Staphylococcus aureus
IQLFMAFIIGVLAAHQFK

SEQ ID NO: 1580209 - protein, 25 aa, Staphylococcus aureus
IRFYYIDIFVCFVAVVFFNVTNYMV

SEQ ID NO: 1580210 - protein, 17 aa, Staphylococcus aureus
IRTVLILPWAVPSFVTI

SEQ ID NO: 1580211 - protein, 25 aa, Staphylococcus aureus
IRYYLFEKRYHPFIAAIVIGLIALL

SEQ ID NO: 1580212 - protein, 18 aa, Staphylococcus aureus
ISGGADFIHKHFLSSTDQ

SEQ ID NO: 1580213 - protein, 22 aa, Staphylococcus aureus
ISIPSRFILNIVRTIPDLLLAA

SEQ ID NO: 1580214 - protein, 17 aa, Staphylococcus aureus
ISISMFDYHLTFIDLLI

SEQ ID NO: 1580215 - protein, 25 aa, Staphylococcus aureus
ISKEFDIKYLDGVKDNWGVTVNGRI

SEQ ID NO: 1580216 - protein, 24 aa, Staphylococcus aureus
ISLLITVILGFFIARTITKPITDM

SEQ ID NO: 1580217 - protein, 23 aa, Staphylococcus aureus
ISPYLPFTYAIDSLRETVGGIVP

SEQ ID NO: 1580218 - protein, 20 aa, Staphylococcus aureus
ISTDKIDRIRNSTIGTAEER

SEQ ID NO: 1580219 - protein, 24 aa, Staphylococcus aureus
ISTDKIDRIRNSTIGTAEERQAAM

SEQ ID NO: 1580220 - protein, 30 aa, Staphylococcus aureus
ISTGNMWRYLVAIIACMIWYFNKAHVSIIG

SEQ ID NO: 1580221 - protein, 31 aa, Staphylococcus aureus
ISTGNMWRYLVAIIACMIWYFNKSHVSIIGI

SEQ ID NO: 1580222 - protein, 19 aa, Staphylococcus aureus
ITEITLMFYSIISSNYQTV

SEQ ID NO: 1580223 - protein, 22 aa, Staphylococcus aureus
ITKPLRRLRDQATRVSEGDYSY

SEQ ID NO: 1580224 - protein, 24 aa, Staphylococcus aureus
ITTPYIVVVNGHIDPNSKGDLALR

SEQ ID NO: 1580225 - protein, 24 aa, Staphylococcus aureus
IVAVGICAGVWIVLKKLPGIDDPM

SEQ ID NO: 1580226 - protein, 17 aa, Staphylococcus aureus
IVDEAKALNRAMDQLSQ

SEQ ID NO: 1580227 - protein, 17 aa, Staphylococcus aureus
IVDIDFDSVPQIQGQNN

SEQ ID NO: 1580228 - protein, 17 aa, Staphylococcus aureus
IVDKLGGGGMSTVYLAE

SEQ ID NO: 1580229 - protein, 17 aa, Staphylococcus aureus
IVERSRESFNIEHKLRK

SEQ ID NO: 1580230 - protein, 17 aa, Staphylococcus aureus
IVKGLGIPKSVVNASKI

SEQ ID NO: 1580231 - protein, 24 aa, Staphylococcus aureus
IVSSCIMLPFGYIVGYFVGTRPHT

SEQ ID NO: 1580232 - protein, 18 aa, Staphylococcus aureus
IVVTAIHFKIKYDEKEKQ

SEQ ID NO: 1580233 - protein, 17 aa, Staphylococcus aureus
IVYAIVAFCMFNYLSSI

SEQ ID NO: 1580234 - protein, 19 aa, Staphylococcus aureus
KAKLILALNNYMPKIEKAL

SEQ ID NO: 1580235 - protein, 19 aa, Staphylococcus aureus
KALKLSLMDYVLKVDPLKD

SEQ ID NO: 1580236 - protein, 20 aa, Staphylococcus aureus
KAMFKKWTVMADRMMDGDKV

SEQ ID NO: 1580237 - protein, 20 aa, Staphylococcus aureus
KAVILEVIFSMSGIGKLLIN

SEQ ID NO: 1580238 - protein, 17 aa, Staphylococcus aureus
KDDLSSVLHENRANEDV

SEQ ID NO: 1580239 - protein, 21 aa, Staphylococcus aureus
KDGKRAFKPSTIVTKNSIRYG

SEQ ID NO: 1580240 - protein, 20 aa, Staphylococcus aureus
KDLRVAYEHDITKSKQLTKE

SEQ ID NO: 1580241 - protein, 22 aa, Staphylococcus aureus
KEEKYDYTLMEFAQPIYNSADK

SEQ ID NO: 1580242 - protein, 23 aa, Staphylococcus aureus
KEFKTNRINIRRNYDNKPQNLKL

SEQ ID NO: 1580243 - protein, 24 aa, Staphylococcus aureus
KEKQALKDRINQILQQGHNGINNA

SEQ ID NO: 1580244 - protein, 32 aa, Staphylococcus aureus
KERLLIIRVLITWFYTMLWSIVGVVWIVFSIP

SEQ ID NO: 1580245 - protein, 17 aa, Staphylococcus aureus
KETQLMYTATFDVKPHR

SEQ ID NO: 1580246 - protein, 26 aa, Staphylococcus aureus
KGILFGGLFSILGFALLRRNKKNHKA

SEQ ID NO: 1580247 - protein, 27 aa, Staphylococcus aureus
KGKVTRYDLISVLPFGNTIAQIDVKGS

SEQ ID NO: 1580248 - protein, 19 aa, Staphylococcus aureus
KIGLSALGYKVDNETTQFD

SEQ ID NO: 1580249 - protein, 18 aa, Staphylococcus aureus
KIVVLPIIIYAIVFVVIG

SEQ ID NO: 1580250 - protein, 26 aa, Staphylococcus aureus
KIYQVPKGYTLNKGYDVNTKELTDVT

SEQ ID NO: 1580251 - protein, 18 aa, Staphylococcus aureus
KKGKVGVITINKFQNDTS

SEQ ID NO: 1580252 - protein, 30 aa, Staphylococcus aureus
KKQSKLIPIFICIFTFLLMVIQSQFLMGQS

SEQ ID NO: 1580253 - protein, 20 aa, Staphylococcus aureus
KKVPEGLDLIVVILFAPAIA

SEQ ID NO: 1580254 - protein, 24 aa, Staphylococcus aureus
KKYEWPLFVIYSFIFVLLLPNTFY

SEQ ID NO: 1580255 - protein, 28 aa, Staphylococcus aureus
KLKFTHMLYIIFGFLLMYGLDYLYDMFA

SEQ ID NO: 1580256 - protein, 24 aa, Staphylococcus aureus
KLNNRKSEALQRLDQLTHLNNAQR

SEQ ID NO: 1580257 - protein, 24 aa, Staphylococcus aureus
KNAIPHTMMLGAIFVLFSDIVGRV

SEQ ID NO: 1580258 - protein, 20 aa, Staphylococcus aureus
KNGKTFFFIDKLEFKPKLTS

SEQ ID NO: 1580259 - protein, 24 aa, Staphylococcus aureus
KNKGKEALTIDSSMFKLKSGDKTF

SEQ ID NO: 1580260 - protein, 17 aa, Staphylococcus aureus
KNTWGYMNLGASVLPST

SEQ ID NO: 1580261 - protein, 19 aa, Staphylococcus aureus
KPNSAITITPKAGTGHSAS

SEQ ID NO: 1580262 - protein, 19 aa, Staphylococcus aureus
KPRVTRSADVVEAKEASDE

SEQ ID NO: 1580263 - protein, 22 aa, Staphylococcus aureus
KPSGKRINAIQILNKETGKFES

SEQ ID NO: 1580264 - protein, 19 aa, Staphylococcus aureus
KRFNQLTGMTEDEIRVLFN

SEQ ID NO: 1580265 - protein, 35 aa, Staphylococcus aureus
KRILKSYPYMLSGGMLQRLMIALALALKPKLIIAD

SEQ ID NO: 1580266 - protein, 17 aa, Staphylococcus aureus
KRSFSAGTIAAFMTMFA

SEQ ID NO: 1580267 - protein, 17 aa, Staphylococcus aureus
KSIKGKALDEVVKDVRG

SEQ ID NO: 1580268 - protein, 21 aa, Staphylococcus aureus
KSITCKSIIGLNLERLGVTGE

SEQ ID NO: 1580269 - protein, 22 aa, Staphylococcus aureus
KSKEIPFIIIIQFACILINTGL

SEQ ID NO: 1580270 - protein, 23 aa, Staphylococcus aureus
KSKEPIQLLVIMGITVLITLLLW

SEQ ID NO: 1580271 - protein, 21 aa, Staphylococcus aureus
KSKSKGEIFIYGDIVSDKWFE

SEQ ID NO: 1580272 - protein, 19 aa, Staphylococcus aureus
KTITEAWNGIKTAVSGAIQ

SEQ ID NO: 1580273 - protein, 17 aa, Staphylococcus aureus
KTKDVSAQKVWEGTQKV

SEQ ID NO: 1580274 - protein, 21 aa, Staphylococcus aureus
KTNNTYRQTIYVNPSGDNVVL

SEQ ID NO: 1580275 - protein, 24 aa, Staphylococcus aureus
KTYVKHFLAFNGFMGLITFVLLIV

SEQ ID NO: 1580276 - protein, 23 aa, Staphylococcus aureus
KVSLKTSFTFMLIIVLIIWSFIY

SEQ ID NO: 1580277 - protein, 22 aa, Staphylococcus aureus
KYANDFRKLGNYKGDILDAQKK

SEQ ID NO: 1580278 - protein, 17 aa, Staphylococcus aureus
KYHIPRVAIIFNAIISM

SEQ ID NO: 1580279 - protein, 20 aa, Staphylococcus aureus
KYIIFGIVLAITLLIVGIAY

SEQ ID NO: 1580280 - protein, 34 aa, Staphylococcus aureus
KYSIRRFTVGTTSVIVGATILFGIGNHQAQASEQ

SEQ ID NO: 1580281 - protein, 19 aa, Staphylococcus aureus
KYSKLDYFFIIGISTLSLF

SEQ ID NO: 1580282 - protein, 19 aa, Staphylococcus aureus
LAAGILAFIGLILSPAIGA

SEQ ID NO: 1580283 - protein, 24 aa, Staphylococcus aureus
LAITLLIVGIAYYLISLNNAKGQV

SEQ ID NO: 1580284 - protein, 18 aa, Staphylococcus aureus
LAITMIVIFVKRNLSSSD

SEQ ID NO: 1580285 - protein, 18 aa, Staphylococcus aureus
LAPFYKSYLPQVFKSMMV

SEQ ID NO: 1580286 - protein, 17 aa, Staphylococcus aureus
LCNLYYFAAVQNHYDLF

SEQ ID NO: 1580287 - protein, 25 aa, Staphylococcus aureus
LCNMLSYGIGENVNFIWRLLACYVT

SEQ ID NO: 1580288 - protein, 22 aa, Staphylococcus aureus
LDGAMQRLESAIANKDQTKASE

SEQ ID NO: 1580289 - protein, 24 aa, Staphylococcus aureus
LDGAMQRLQSAIANKDQTKASENY

SEQ ID NO: 1580290 - protein, 18 aa, Staphylococcus aureus
LDQYVNYFMFFNVIATLL

SEQ ID NO: 1580291 - protein, 25 aa, Staphylococcus aureus
LEDLSRASDYFSEAGATAATKAFGR

SEQ ID NO: 1580292 - protein, 22 aa, Staphylococcus aureus
LEQYKLLIMSTLSQYTFDKYYR

SEQ ID NO: 1580293 - protein, 17 aa, Staphylococcus aureus
LESAIANKDQTKASENY

SEQ ID NO: 1580294 - protein, 27 aa, Staphylococcus aureus
LFFRYILKRYFNYMLNYKVWYLTLLAG

SEQ ID NO: 1580295 - protein, 18 aa, Staphylococcus aureus
LFGGKYMGYLIFVFFIFV

SEQ ID NO: 1580296 - protein, 25 aa, Staphylococcus aureus
LFIMRLAKIQLWFLIKGLTPIFFFL

SEQ ID NO: 1580297 - protein, 20 aa, Staphylococcus aureus
LFLFFFKESEEIIPESSNIL

SEQ ID NO: 1580298 - protein, 22 aa, Staphylococcus aureus
LFLIFHLIRLATKIEDQFNKIF

SEQ ID NO: 1580299 - protein, 18 aa, Staphylococcus aureus
LFTLFPLIIPSFFAVFDI

SEQ ID NO: 1580300 - protein, 25 aa, Staphylococcus aureus
LGGGILEFATWHWLFYINIPIAIIA

SEQ ID NO: 1580301 - protein, 26 aa, Staphylococcus aureus
LGGIHEIYFPYVLMRPLLFIAVILGG

SEQ ID NO: 1580302 - protein, 23 aa, Staphylococcus aureus
LHGYHAGFLFALLITVISFFCSF

SEQ ID NO: 1580303 - protein, 17 aa, Staphylococcus aureus
LICATSILVTLLLLVMQ

SEQ ID NO: 1580304 - protein, 19 aa, Staphylococcus aureus
LICQLIFRHILIQELSRLI

SEQ ID NO: 1580305 - protein, 17 aa, Staphylococcus aureus
LIIASAYATWIAKRVGL

SEQ ID NO: 1580306 - protein, 35 aa, Staphylococcus aureus
LIILGFLLHYIFKINDKWLLILCVLVIIINASWNT

SEQ ID NO: 1580307 - protein, 18 aa, Staphylococcus aureus
LIPFIPIKFSFFKFNNLN

SEQ ID NO: 1580308 - protein, 17 aa, Staphylococcus aureus
LITAKNHLDDPVSTDGK

SEQ ID NO: 1580309 - protein, 24 aa, Staphylococcus aureus
LITLCLTLAFPAYLLKISRSFEVI

SEQ ID NO: 1580310 - protein, 17 aa, Staphylococcus aureus
LIVISMLLLLFWSTEKV

SEQ ID NO: 1580311 - protein, 17 aa, Staphylococcus aureus
LKADGAVEYGVKNSKFL

SEQ ID NO: 1580312 - protein, 44 aa, Staphylococcus aureus
LKARLKMFHFSKERLLIIRALITWFYTMLWSIVGVVWIVFSIPN

SEQ ID NO: 1580313 - protein, 23 aa, Staphylococcus aureus
LKARLKMFHFSKERLLIIRVLIT

SEQ ID NO: 1580314 - protein, 22 aa, Staphylococcus aureus
LKLFIKPLWQYHCRFYQIDQLS

SEQ ID NO: 1580315 - protein, 24 aa, Staphylococcus aureus
LKLFKLGGKLLLLYFMFCAIISVI

SEQ ID NO: 1580316 - protein, 19 aa, Staphylococcus aureus
LLAIPSFIIALVILSLVSN

SEQ ID NO: 1580317 - protein, 23 aa, Staphylococcus aureus
LLFIFGVAFAFYVGFPMIIQFAL

SEQ ID NO: 1580318 - protein, 24 aa, Staphylococcus aureus
LLFIKQITDLFGFDLSTQLNQASA

SEQ ID NO: 1580319 - protein, 25 aa, Staphylococcus aureus
LLFIKQITDLFGFDLSTQLNQASAI

SEQ ID NO: 1580320 - protein, 20 aa, Staphylococcus aureus
LLLLYFMFCAIISVIQNIVG

SEQ ID NO: 1580321 - protein, 26 aa, Staphylococcus aureus
LLVAIGMGFVSWIKRTKNTAIKVPHR

SEQ ID NO: 1580322 - protein, 30 aa, Staphylococcus aureus
LMAITLCGFVICYGLIFGLFYLLSGSTADY

SEQ ID NO: 1580323 - protein, 18 aa, Staphylococcus aureus
LMIFGILGGHAYGFENYT

SEQ ID NO: 1580324 - protein, 22 aa, Staphylococcus aureus
LNAVLVGAGFVSSLLMINKNKV

SEQ ID NO: 1580325 - protein, 23 aa, Staphylococcus aureus
LNEELREAIKNPAIKDKDHSAPN

SEQ ID NO: 1580326 - protein, 19 aa, Staphylococcus aureus
LNEKGEVIGTTKTDENGKY

SEQ ID NO: 1580327 - protein, 18 aa, Staphylococcus aureus
LNGDEKLAAAKQTAKSDI

SEQ ID NO: 1580328 - protein, 21 aa, Staphylococcus aureus
LNGFGIYIGRFLRLHSVYFFN

SEQ ID NO: 1580329 - protein, 17 aa, Staphylococcus aureus
LNHKWIVIILSTLILVT

SEQ ID NO: 1580330 - protein, 17 aa, Staphylococcus aureus
LNKSRIRIEKELKNNIT

SEQ ID NO: 1580331 - protein, 17 aa, Staphylococcus aureus
LNLNLFIDPTTVTKQGK

SEQ ID NO: 1580332 - protein, 17 aa, Staphylococcus aureus
LNLRVFKNRTFALCTIS

SEQ ID NO: 1580333 - protein, 17 aa, Staphylococcus aureus
LNRGECTTKGGLLYIDM

SEQ ID NO: 1580334 - protein, 22 aa, Staphylococcus aureus
LPFVGSDSWQHFVLPIFTIVVI

SEQ ID NO: 1580335 - protein, 19 aa, Staphylococcus aureus
LPKVLKYIGMVNMYYLSSL

SEQ ID NO: 1580336 - protein, 31 aa, Staphylococcus aureus
LQNICNFIKVIFEFILNFVIKPIMFAIWQVM

SEQ ID NO: 1580337 - protein, 17 aa, Staphylococcus aureus
LRKIIFENFSKKCTYWV

SEQ ID NO: 1580338 - protein, 28 aa, Staphylococcus aureus
LRRANDWFKKYGVWAVFICRFIPVLRVL

SEQ ID NO: 1580339 - protein, 17 aa, Staphylococcus aureus
LSAYSIFYTRSQNKFSF

SEQ ID NO: 1580340 - protein, 17 aa, Staphylococcus aureus
LSFKFLKSLLYLKYLKK

SEQ ID NO: 1580341 - protein, 23 aa, Staphylococcus aureus
LSGGISYYAATVVHKFNKRYKRK

SEQ ID NO: 1580342 - protein, 24 aa, Staphylococcus aureus
LSISISWFPAFFVTGFLGGLTTFS

SEQ ID NO: 1580343 - protein, 18 aa, Staphylococcus aureus
LSIYFKNYVPTIVLTIII

SEQ ID NO: 1580344 - protein, 19 aa, Staphylococcus aureus
LSLTMIFLILTYFKEVKLY

SEQ ID NO: 1580345 - protein, 17 aa, Staphylococcus aureus
LSNEGMVLYLDRNTRTA

SEQ ID NO: 1580346 - protein, 19 aa, Staphylococcus aureus
LSSMLYRVFLDISSFSSKG

SEQ ID NO: 1580347 - protein, 22 aa, Staphylococcus aureus
LTAKTPLVFGMTLLIVTVIPFY

SEQ ID NO: 1580348 - protein, 27 aa, Staphylococcus aureus
LTAKVEVTLLDGSKVIVNVPVKVVEKE

SEQ ID NO: 1580349 - protein, 17 aa, Staphylococcus aureus
LTEQIERGTTVAGVQGI

SEQ ID NO: 1580350 - protein, 25 aa, Staphylococcus aureus
LTIYDRIEPALKIIVSAFSKVVTWV

SEQ ID NO: 1580351 - protein, 17 aa, Staphylococcus aureus
LTSVIGIVGRYMSRQRL

SEQ ID NO: 1580352 - protein, 18 aa, Staphylococcus aureus
LVGFLIYLFYSPRLKFDV

SEQ ID NO: 1580353 - protein, 18 aa, Staphylococcus aureus
LVHAHLLPVVSILVEPAK

SEQ ID NO: 1580354 - protein, 23 aa, Staphylococcus aureus
LVLPRVLKYIGMVNMYYLSSLLF

SEQ ID NO: 1580355 - protein, 17 aa, Staphylococcus aureus
LWDRVRNIFGSMRDGLK

SEQ ID NO: 1580356 - protein, 18 aa, Staphylococcus aureus
LYAGMVFFNLDAVSWLHV

SEQ ID NO: 1580357 - protein, 17 aa, Staphylococcus aureus
LYISIMVLSIFIIGCGK

SEQ ID NO: 1580358 - protein, 19 aa, Staphylococcus aureus
MAIVSMLLIGMAISNVSKG

SEQ ID NO: 1580359 - protein, 17 aa, Staphylococcus aureus
MALPMIWYVASALWFFP

SEQ ID NO: 1580360 - protein, 23 aa, Staphylococcus aureus
MAQVKSTMLVTVWVFTGIEGAVV

SEQ ID NO: 1580361 - protein, 18 aa, Staphylococcus aureus
MEVIFTRILRIIMGVLLL

SEQ ID NO: 1580362 - protein, 27 aa, Staphylococcus aureus
MFDNKITYNYSSPIAGIDKPNGANISS

SEQ ID NO: 1580363 - protein, 18 aa, Staphylococcus aureus
MFNPSFIVRSFHVITTAG

SEQ ID NO: 1580364 - protein, 22 aa, Staphylococcus aureus
MGGLTFLLSIVITSLVVIIFVD

SEQ ID NO: 1580365 - protein, 28 aa, Staphylococcus aureus
MGVNLPFQFTFPGSEWVVLILSTILFFY

SEQ ID NO: 1580366 - protein, 17 aa, Staphylococcus aureus
MIFPTKHAIGLVSDSGL

SEQ ID NO: 1580367 - protein, 19 aa, Staphylococcus aureus
MIVSIYFIKIVTSYFTKKL

SEQ ID NO: 1580368 - protein, 18 aa, Staphylococcus aureus
MLDIKFYSLDGINGLSLL

SEQ ID NO: 1580369 - protein, 17 aa, Staphylococcus aureus
MLIPALTKLFGKGSWYL

SEQ ID NO: 1580370 - protein, 17 aa, Staphylococcus aureus
MNLPGISLLPETERFYP

SEQ ID NO: 1580371 - protein, 22 aa, Staphylococcus aureus
MPDKMIKRLNLSSGAGSVRISD

SEQ ID NO: 1580372 - protein, 25 aa, Staphylococcus aureus
MPRHVIEGFPTINWLGFYPTYEPLI

SEQ ID NO: 1580373 - protein, 17 aa, Staphylococcus aureus
MRALLIFYMYFAVTDNG

SEQ ID NO: 1580374 - protein, 25 aa, Staphylococcus aureus
MTALKAAIADKERTKASGNYVNADQ

SEQ ID NO: 1580375 - protein, 17 aa, Staphylococcus aureus
MTLVALGISVAYIYSLY

SEQ ID NO: 1580376 - protein, 33 aa, Staphylococcus aureus
MTSMPEYWLAILFIYYLGVRWQLLPFVGSDSWQ

SEQ ID NO: 1580377 - protein, 18 aa, Staphylococcus aureus
MTYQSAKIFIVQKVIEHF

SEQ ID NO: 1580378 - protein, 21 aa, Staphylococcus aureus
MVLAVTCFIGYNMYLLYNNTI

SEQ ID NO: 1580379 - protein, 23 aa, Staphylococcus aureus
MVLMYRFFGKQGLIAWVAIGTII

SEQ ID NO: 1580380 - protein, 21 aa, Staphylococcus aureus
MVQNLWWGAGYNIVAVPLAAG

SEQ ID NO: 1580381 - protein, 17 aa, Staphylococcus aureus
MWAEHPLFTIIGGACLV

SEQ ID NO: 1580382 - protein, 36 aa, Staphylococcus aureus
NAERVTLKYKWKFEDGIKPGDYFDFTLSNNVETHGI

SEQ ID NO: 1580383 - protein, 17 aa, Staphylococcus aureus
NAIKALANAKRDQINSN

SEQ ID NO: 1580384 - protein, 17 aa, Staphylococcus aureus
NAKRPLVNKSFFQNKRY

SEQ ID NO: 1580385 - protein, 17 aa, Staphylococcus aureus
NDSLLVQWWHWMNHLLH

SEQ ID NO: 1580386 - protein, 17 aa, Staphylococcus aureus
NDYRIFTFDARDSRHLS

SEQ ID NO: 1580387 - protein, 22 aa, Staphylococcus aureus
NEEILPDTKYPIAVTDWNKKYS

SEQ ID NO: 1580388 - protein, 19 aa, Staphylococcus aureus
NEIPKAKIDANKDVDKQVQ

SEQ ID NO: 1580389 - protein, 24 aa, Staphylococcus aureus
NEIYKLGLKQAKIAAVVQPISGIV

SEQ ID NO: 1580390 - protein, 17 aa, Staphylococcus aureus
NEKGEVIGTTKTDENGK

SEQ ID NO: 1580391 - protein, 26 aa, Staphylococcus aureus
NENDKELLFRTNLHGYHANYGYYYYY

SEQ ID NO: 1580392 - protein, 26 aa, Staphylococcus aureus
NEPLPNRKDFVVSFITGALVGSALGL

SEQ ID NO: 1580393 - protein, 17 aa, Staphylococcus aureus
NEVHVGDTLIVKPGEKI

SEQ ID NO: 1580394 - protein, 22 aa, Staphylococcus aureus
NFIIPFVLVFVIDGMKGIKEIL

SEQ ID NO: 1580395 - protein, 19 aa, Staphylococcus aureus
NFRTQLTGYPENRYKTYYY

SEQ ID NO: 1580396 - protein, 24 aa, Staphylococcus aureus
NFYAGLNLFEWKYFTYLLLGVFLA

SEQ ID NO: 1580397 - protein, 20 aa, Staphylococcus aureus
NGFFSVGVVIVFSPFCPSLV

SEQ ID NO: 1580398 - protein, 18 aa, Staphylococcus aureus
NGILFFLIPFFASGIFNT

SEQ ID NO: 1580399 - protein, 17 aa, Staphylococcus aureus
NGILLFLIPFFASAIFN

SEQ ID NO: 1580400 - protein, 19 aa, Staphylococcus aureus
NIFGKGIIVPALRAVSGGN

SEQ ID NO: 1580401 - protein, 18 aa, Staphylococcus aureus
NIIDIDFDSVPQIHGFNK

SEQ ID NO: 1580402 - protein, 17 aa, Staphylococcus aureus
NINEIKDKVLSEHNSTV

SEQ ID NO: 1580403 - protein, 26 aa, Staphylococcus aureus
NKFSEIELPLALSFFSGKRLVPIMTA

SEQ ID NO: 1580404 - protein, 19 aa, Staphylococcus aureus
NKNPLYKGVYSIVSYWEKN

SEQ ID NO: 1580405 - protein, 28 aa, Staphylococcus aureus
NKNRVVLIPTFKQGLLIVFAYFFLGSAS

SEQ ID NO: 1580406 - protein, 19 aa, Staphylococcus aureus
NLVIAICCMIFLAVFTLFL

SEQ ID NO: 1580407 - protein, 18 aa, Staphylococcus aureus
NNENVVRYGGGSADGDSA

SEQ ID NO: 1580408 - protein, 26 aa, Staphylococcus aureus
NNKWVWAIAFANIFVYFVRYGVLDWA

SEQ ID NO: 1580409 - protein, 38 aa, Staphylococcus aureus
NNLITYTFTDYVDRFNSVQMGINYSIYMDADTIPVSKN

SEQ ID NO: 1580410 - protein, 20 aa, Staphylococcus aureus
NPEKLKELVRNDSNTDHSTK

SEQ ID NO: 1580411 - protein, 17 aa, Staphylococcus aureus
NRSYARASANEITSKTV

SEQ ID NO: 1580412 - protein, 21 aa, Staphylococcus aureus
NRYKRAIEIAEQVLESVEPGV

SEQ ID NO: 1580413 - protein, 25 aa, Staphylococcus aureus
NSIVLKSILSLGIIYGGTFGIYPKA

SEQ ID NO: 1580414 - protein, 21 aa, Staphylococcus aureus
NSNIKVVIGMLQIDKSQIKQS

SEQ ID NO: 1580415 - protein, 37 aa, Staphylococcus aureus
NSTTGKTEFWATSSDVLKLKANYTIDDSVKEGDTFTF

SEQ ID NO: 1580416 - protein, 39 aa, Staphylococcus aureus
NTINKRINFIFGVIVFIFAVLVLRLGYLQIAQGSHYKQI

SEQ ID NO: 1580417 - protein, 23 aa, Staphylococcus aureus
NVIVCGYFAFSIFVGIYLSINDR

SEQ ID NO: 1580418 - protein, 18 aa, Staphylococcus aureus
NVPTVKVYEYLRSDELPE

SEQ ID NO: 1580419 - protein, 36 aa, Staphylococcus aureus
NYSDILKKFWMMYWPKLVILMGIIILIVILNAIFNN

SEQ ID NO: 1580420 - protein, 28 aa, Staphylococcus aureus
PAAYYITRSKFQNILLMIMIIPTWINLL

SEQ ID NO: 1580421 - protein, 24 aa, Staphylococcus aureus
PATGKVVLLPAHRGTVSSGTEGSD

SEQ ID NO: 1580422 - protein, 17 aa, Staphylococcus aureus
PEHPMKLVLPIITLVGG

SEQ ID NO: 1580423 - protein, 19 aa, Staphylococcus aureus
PIADIKSTNGDVVAKATYD

SEQ ID NO: 1580424 - protein, 21 aa, Staphylococcus aureus
PIADIKSTNGDVVAKATYDIL

SEQ ID NO: 1580425 - protein, 21 aa, Staphylococcus aureus
PKSKRKSRFFIISMVLAVTCF

SEQ ID NO: 1580426 - protein, 17 aa, Staphylococcus aureus
PMKLVLPIITLVGGTVG

SEQ ID NO: 1580427 - protein, 18 aa, Staphylococcus aureus
PSGKELDWAKASHEKYLK

SEQ ID NO: 1580428 - protein, 18 aa, Staphylococcus aureus
PTDLGVSEVTRFNVGNES

SEQ ID NO: 1580429 - protein, 29 aa, Staphylococcus aureus
PTNATTNAFRPGGVQELNEYQLSQLFTDQ

SEQ ID NO: 1580430 - protein, 24 aa, Staphylococcus aureus
PVVKRPSAKLVLAIVVIFIVVCSI

SEQ ID NO: 1580431 - protein, 18 aa, Staphylococcus aureus
PYLKCGYIIPLQFGHFKE

SEQ ID NO: 1580432 - protein, 17 aa, Staphylococcus aureus
QAIADAENVLKQNANKQ

SEQ ID NO: 1580433 - protein, 22 aa, Staphylococcus aureus
QAIAGLTPDLAPLQTAKTQLQN

SEQ ID NO: 1580434 - protein, 18 aa, Staphylococcus aureus
QAYDEKVTAAEHIVSGTP

SEQ ID NO: 1580435 - protein, 24 aa, Staphylococcus aureus
QDGKRPEKVSVNLLANGEKVKAVD

SEQ ID NO: 1580436 - protein, 17 aa, Staphylococcus aureus
QDLPNCATFPNQMIEYG

SEQ ID NO: 1580437 - protein, 24 aa, Staphylococcus aureus
QELNGDERLRVAKQNANTAIDALT

SEQ ID NO: 1580438 - protein, 25 aa, Staphylococcus aureus
QELNGDERLRVAKQNANTAIDALTQ

SEQ ID NO: 1580439 - protein, 23 aa, Staphylococcus aureus
QFKGDHLRRAISYLMISTVGGIG

SEQ ID NO: 1580440 - protein, 26 aa, Staphylococcus aureus
QFYLYYIVSALLFWLVILTFGIAGII

SEQ ID NO: 1580441 - protein, 26 aa, Staphylococcus aureus
QGHKDEFDPNLPIDGTEEVPGKPGIK

SEQ ID NO: 1580442 - protein, 17 aa, Staphylococcus aureus
QGIANKAQIKGSENYHD

SEQ ID NO: 1580443 - protein, 18 aa, Staphylococcus aureus
QHFKTIRFINTVCKSVLL

SEQ ID NO: 1580444 - protein, 21 aa, Staphylococcus aureus
QKEAKFENGVITRKADEKTTN

SEQ ID NO: 1580445 - protein, 22 aa, Staphylococcus aureus
QKGRTFLWFMHLSEQLRRTGEQ

SEQ ID NO: 1580446 - protein, 17 aa, Staphylococcus aureus
QKHSKLKFDHLIIDEAH

SEQ ID NO: 1580447 - protein, 29 aa, Staphylococcus aureus
QLAGLKFSISLKVIERILLALILPLIILI

SEQ ID NO: 1580448 - protein, 18 aa, Staphylococcus aureus
QLINLAIVRLKEEYDFID

SEQ ID NO: 1580449 - protein, 27 aa, Staphylococcus aureus
QLNYAEFFICIVLSLGVVAPIKNFTNY

SEQ ID NO: 1580450 - protein, 18 aa, Staphylococcus aureus
QPLRINLTSNENFTDKDW

SEQ ID NO: 1580451 - protein, 19 aa, Staphylococcus aureus
QRVTIARMILKDAPIIVLD

SEQ ID NO: 1580452 - protein, 38 aa, Staphylococcus aureus
QSISKKMTGYGLKTTAVIGGAFTVNMLHDQQAFAASDA

SEQ ID NO: 1580453 - protein, 18 aa, Staphylococcus aureus
QSPITFWYGKYIILIPSS

SEQ ID NO: 1580454 - protein, 17 aa, Staphylococcus aureus
RDNVMVVWLDFKKGDSY

SEQ ID NO: 1580455 - protein, 17 aa, Staphylococcus aureus
REAETEITAAQRVIDNG

SEQ ID NO: 1580456 - protein, 25 aa, Staphylococcus aureus
REFISGVLLVPAIVSFVWFSVFGVL

SEQ ID NO: 1580457 - protein, 17 aa, Staphylococcus aureus
RFEREVHNSSQLSHQNI

SEQ ID NO: 1580458 - protein, 18 aa, Staphylococcus aureus
RGAVFPGVSDVYDAKQYV

SEQ ID NO: 1580459 - protein, 19 aa, Staphylococcus aureus
RILAVVFAWMTFLRIGSKV

SEQ ID NO: 1580460 - protein, 18 aa, Staphylococcus aureus
RKIGYVMQSNSMMSGTIR

SEQ ID NO: 1580461 - protein, 20 aa, Staphylococcus aureus
RKTITEAWNGIKTAVSGAIQ

SEQ ID NO: 1580462 - protein, 25 aa, Staphylococcus aureus
RNATELNTAMGTLKHAIADKTNTLA

SEQ ID NO: 1580463 - protein, 20 aa, Staphylococcus aureus
RNAYNQAVSAAETILNKQTG

SEQ ID NO: 1580464 - protein, 18 aa, Staphylococcus aureus
RNKTLIVIAHRLSTIQHA

SEQ ID NO: 1580465 - protein, 19 aa, Staphylococcus aureus
RSFYSIRKSILGVASVIVS

SEQ ID NO: 1580466 - protein, 18 aa, Staphylococcus aureus
RSILAGIMMSFARALGEF

SEQ ID NO: 1580467 - protein, 47 aa, Staphylococcus aureus
RSVKNSERRGMLKGCGGCLISFILLIILLSACSMMFSNNDNSTSNQS

SEQ ID NO: 1580468 - protein, 21 aa, Staphylococcus aureus
RTAVKQDLTEVQALDQLMDAL

SEQ ID NO: 1580469 - protein, 21 aa, Staphylococcus aureus
RVQGFTCANCAGKFEKNVKKI

SEQ ID NO: 1580470 - protein, 18 aa, Staphylococcus aureus
RWQLLPFVGSDSWQHFVL

SEQ ID NO: 1580471 - protein, 19 aa, Staphylococcus aureus
RYLTTRVKYILIPYILMGL

SEQ ID NO: 1580472 - protein, 18 aa, Staphylococcus aureus
RYTAIMMIAIFIALMFDF

SEQ ID NO: 1580473 - protein, 22 aa, Staphylococcus aureus
SAGSIGWLILEYIFKKTTSLLG

SEQ ID NO: 1580474 - protein, 22 aa, Staphylococcus aureus
SAKLKLELLPNVQNPVISVTTS

SEQ ID NO: 1580475 - protein, 46 aa, Staphylococcus aureus
SAKNSERRGMLKGCGGCLISFILLIILLSACSMMFSNKDNSTSNQS

SEQ ID NO: 1580476 - protein, 21 aa, Staphylococcus aureus
SALTAKGYNYTSVDSSYASTY

SEQ ID NO: 1580477 - protein, 20 aa, Staphylococcus aureus
SAVGLHGIWDTSLTVLGSDT

SEQ ID NO: 1580478 - protein, 20 aa, Staphylococcus aureus
SDFKLEKTAFDPNQSGNTFM

SEQ ID NO: 1580479 - protein, 20 aa, Staphylococcus aureus
SDIRWADKIAKLMDKSYKQF

SEQ ID NO: 1580480 - protein, 25 aa, Staphylococcus aureus
SDLLNRFGSILIVGWAMLISGVAMN

SEQ ID NO: 1580481 - protein, 18 aa, Staphylococcus aureus
SEYWYMMLWHLILMVPAV

SEQ ID NO: 1580482 - protein, 22 aa, Staphylococcus aureus
SGQFFWPAILAFVLTGIGLPLL

SEQ ID NO: 1580483 - protein, 21 aa, Staphylococcus aureus
SHIRKKLARKLMHLPLGVVES

SEQ ID NO: 1580484 - protein, 19 aa, Staphylococcus aureus
SHSWDIPSTILSIAGMIGL

SEQ ID NO: 1580485 - protein, 20 aa, Staphylococcus aureus
SHTPWQFKIFVPDSPTAILF

SEQ ID NO: 1580486 - protein, 23 aa, Staphylococcus aureus
SIFIAVPLWGMMKKRQLKKSPKH

SEQ ID NO: 1580487 - protein, 17 aa, Staphylococcus aureus
SILFCRLYFHAHYFSDV

SEQ ID NO: 1580488 - protein, 18 aa, Staphylococcus aureus
SILFCRLYFHAHYFSDVI

SEQ ID NO: 1580489 - protein, 39 aa, Staphylococcus aureus
SILTIVALLSFKLYRFYFYRLFAIVTWLLFIGSLSQYFD

SEQ ID NO: 1580490 - protein, 33 aa, Staphylococcus aureus
SIRRFTVGTTSVIVGATILFGIGNHQAQASEQS

SEQ ID NO: 1580491 - protein, 18 aa, Staphylococcus aureus
SKDDLKINSEEVRNVEEK

SEQ ID NO: 1580492 - protein, 19 aa, Staphylococcus aureus
SKVIVNVPVKVVEKELTVV

SEQ ID NO: 1580493 - protein, 25 aa, Staphylococcus aureus
SLIKEPKLLIIIPILIVAFIVSKLI

SEQ ID NO: 1580494 - protein, 18 aa, Staphylococcus aureus
SMVQAGNPIAYAYNLDDL

SEQ ID NO: 1580495 - protein, 19 aa, Staphylococcus aureus
SNHPLAISIVDFAKSKNVS

SEQ ID NO: 1580496 - protein, 26 aa, Staphylococcus aureus
SNLAITLFIIVCFNAFIIFSVQGNAR

SEQ ID NO: 1580497 - protein, 18 aa, Staphylococcus aureus
SPAAMFVLVTGIGLIATV

SEQ ID NO: 1580498 - protein, 17 aa, Staphylococcus aureus
SQNIIIFLTWVIISMFF

SEQ ID NO: 1580499 - protein, 20 aa, Staphylococcus aureus
SQYPEIFFIIVALFLMLFNY

SEQ ID NO: 1580500 - protein, 21 aa, Staphylococcus aureus
SRFYGHLGLLLLVIIACMFTG

SEQ ID NO: 1580501 - protein, 17 aa, Staphylococcus aureus
SRMSWNHNHYPFDSWNK

SEQ ID NO: 1580502 - protein, 17 aa, Staphylococcus aureus
SSLPWLLMFFLILSAGA

SEQ ID NO: 1580503 - protein, 25 aa, Staphylococcus aureus
SSNAKLPVIFWMHGGGYIAGDKQYK

SEQ ID NO: 1580504 - protein, 25 aa, Staphylococcus aureus
SSVAGGGAFGAFVTTDSTGVATTYT

SEQ ID NO: 1580505 - protein, 29 aa, Staphylococcus aureus
STAPVKLRTFSRLAMSTFASAATTTAVTA

SEQ ID NO: 1580506 - protein, 19 aa, Staphylococcus aureus
STFMKSIAINIILASAIQT

SEQ ID NO: 1580507 - protein, 20 aa, Staphylococcus aureus
STILTLLLVTGWHMRTLITV

SEQ ID NO: 1580508 - protein, 23 aa, Staphylococcus aureus
STLRANYRYLLINNIVVVFIGIL

SEQ ID NO: 1580509 - protein, 36 aa, Staphylococcus aureus
STMLLYRFVVFSDQFERFGSLTFFDAFLVGLVEETG

SEQ ID NO: 1580510 - protein, 17 aa, Staphylococcus aureus
SVIGLVLLFVLLCTGAV

SEQ ID NO: 1580511 - protein, 19 aa, Staphylococcus aureus
SVYYIFWLLAKRKYILVTV

SEQ ID NO: 1580512 - protein, 23 aa, Staphylococcus aureus
SYVKTPSNKVLGFYPTNANTNAF

SEQ ID NO: 1580513 - protein, 25 aa, Staphylococcus aureus
TATYKVVSTVPKHVFETNRGAVFPG

SEQ ID NO: 1580514 - protein, 17 aa, Staphylococcus aureus
TCALFYFILFMYNVPMQ

SEQ ID NO: 1580515 - protein, 17 aa, Staphylococcus aureus
TDYVKGIGLAVGTAGSA

SEQ ID NO: 1580516 - protein, 18 aa, Staphylococcus aureus
TEEQRNGFIQSLKDDPSV

SEQ ID NO: 1580517 - protein, 19 aa, Staphylococcus aureus
TEKTIPVVYNPGVSNSYTN

SEQ ID NO: 1580518 - protein, 19 aa, Staphylococcus aureus
TELGKFFIGKYSIKTDKTI

SEQ ID NO: 1580519 - protein, 25 aa, Staphylococcus aureus
TFFNEKGKLFGMLQMFMTKESIADR

SEQ ID NO: 1580520 - protein, 18 aa, Staphylococcus aureus
TFMAANFTVTDKVKSGDY

SEQ ID NO: 1580521 - protein, 17 aa, Staphylococcus aureus
TGETKFIDWGVFLVLGI

SEQ ID NO: 1580522 - protein, 21 aa, Staphylococcus aureus
TGIEGAVVFSGRAKSKKDVGT

SEQ ID NO: 1580523 - protein, 17 aa, Staphylococcus aureus
TIVFGFFALTYVTPVLR

SEQ ID NO: 1580524 - protein, 18 aa, Staphylococcus aureus
TKAQDLDGAMQRLESAIA

SEQ ID NO: 1580525 - protein, 17 aa, Staphylococcus aureus
TKLKWKSAGALLVEAIK

SEQ ID NO: 1580526 - protein, 25 aa, Staphylococcus aureus
TKLRIFEVNDTSKLSDSYYADPNDS

SEQ ID NO: 1580527 - protein, 17 aa, Staphylococcus aureus
TKRIISFLLILSAITVL

SEQ ID NO: 1580528 - protein, 18 aa, Staphylococcus aureus
TKYPIAVTDWNKKYSKNE

SEQ ID NO: 1580529 - protein, 17 aa, Staphylococcus aureus
TLFGGLFAALGSLLLFG

SEQ ID NO: 1580530 - protein, 24 aa, Staphylococcus aureus
TLNAVCGIFAFLIWIHLLCTMLKY

SEQ ID NO: 1580531 - protein, 17 aa, Staphylococcus aureus
TLNSINFTDADQAKKDD

SEQ ID NO: 1580532 - protein, 18 aa, Staphylococcus aureus
TLSLFLFKMFDSASLIIL

SEQ ID NO: 1580533 - protein, 19 aa, Staphylococcus aureus
TLTGYKFNPDAKNFKIYEV

SEQ ID NO: 1580534 - protein, 31 aa, Staphylococcus aureus
TMDFFWELATLILIMLLGHWIEMNAVGNAGD

SEQ ID NO: 1580535 - protein, 24 aa, Staphylococcus aureus
TMWSEYRGNPILANLGIHGPNMEG

SEQ ID NO: 1580536 - protein, 18 aa, Staphylococcus aureus
TNATQAIDVLTSLNDPQK

SEQ ID NO: 1580537 - protein, 23 aa, Staphylococcus aureus
TNGLKKAYAYIIKVNDNFQRQMG

SEQ ID NO: 1580538 - protein, 27 aa, Staphylococcus aureus
TNKGMLFGGLFSILGLALLRRNKKNHK

SEQ ID NO: 1580539 - protein, 29 aa, Staphylococcus aureus
TRVLKIFLLCFAGNILGAAILFSFMRFSN

SEQ ID NO: 1580540 - protein, 19 aa, Staphylococcus aureus
TRYTFVLAPDELFFTRDGL

SEQ ID NO: 1580541 - protein, 27 aa, Staphylococcus aureus
TSFASKVADGFKRVVSNVGDGMSDALG

SEQ ID NO: 1580542 - protein, 30 aa, Staphylococcus aureus
TVDVFPVKDYGSGMTPFYTALSVWVGALLM

SEQ ID NO: 1580543 - protein, 28 aa, Staphylococcus aureus
TVGGIVPEILITKLIILTLFGIGFFVVG

SEQ ID NO: 1580544 - protein, 25 aa, Staphylococcus aureus
TVILFSALISFVLTNVYYHYNLKAS

SEQ ID NO: 1580545 - protein, 31 aa, Staphylococcus aureus
TVIVLLGITWLYLRYVAFRHDLKYLPGGQTL

SEQ ID NO: 1580546 - protein, 24 aa, Staphylococcus aureus
TVQLIWNLIQLWFVGKILGVVRYF

SEQ ID NO: 1580547 - protein, 23 aa, Staphylococcus aureus
TWLTAEEALSFGLIDEVLGANEI

SEQ ID NO: 1580548 - protein, 38 aa, Staphylococcus aureus
TYAGQTWTRNISDWIAKSGTTNFSLSMTASTGGATNLQ

SEQ ID NO: 1580549 - protein, 19 aa, Staphylococcus aureus
TYKQTVFVNPKQRVLGNTW

SEQ ID NO: 1580550 - protein, 29 aa, Staphylococcus aureus
VAGFGFDVFNYWLGIVMMLFISWLGLFLF

SEQ ID NO: 1580551 - protein, 19 aa, Staphylococcus aureus
VAGYLFYFAVSVGVISFIV

SEQ ID NO: 1580552 - protein, 20 aa, Staphylococcus aureus
VATLGKWVPYLLGIVMLGMG

SEQ ID NO: 1580553 - protein, 17 aa, Staphylococcus aureus
VCHPLLFMFFTKIFIQS

SEQ ID NO: 1580554 - protein, 17 aa, Staphylococcus aureus
VCMGLIFGLIAGIERRW

SEQ ID NO: 1580555 - protein, 24 aa, Staphylococcus aureus
VDSSRWKLGNKFTKEFNEVEGAVK

SEQ ID NO: 1580556 - protein, 23 aa, Staphylococcus aureus
VEDSRNGIVLKLLSVVFTVVMGV

SEQ ID NO: 1580557 - protein, 24 aa, Staphylococcus aureus
VEYKEVLTGFKFIAQEIRQLDDHQ

SEQ ID NO: 1580558 - protein, 18 aa, Staphylococcus aureus
VFRNTLRYTAIMMIAIFI

SEQ ID NO: 1580559 - protein, 37 aa, Staphylococcus aureus
VGIDSGDTVYPHQAGYVKLNYGFSVPNSAVKGDTFKI

SEQ ID NO: 1580560 - protein, 17 aa, Staphylococcus aureus
VHRDDIITEQDILAHIN

SEQ ID NO: 1580561 - protein, 25 aa, Staphylococcus aureus
VIDFGNADSAYVVMVNTKFQYTNSE

SEQ ID NO: 1580562 - protein, 21 aa, Staphylococcus aureus
VIKLWLTIILIVTTVLILLSI

SEQ ID NO: 1580563 - protein, 24 aa, Staphylococcus aureus
VIYFYLGMIIFKLGNSKKVIVTSY

SEQ ID NO: 1580564 - protein, 19 aa, Staphylococcus aureus
VKDNWGVTVNGRITLLDKE

SEQ ID NO: 1580565 - protein, 18 aa, Staphylococcus aureus
VKETLPAILVVSITYTFT

SEQ ID NO: 1580566 - protein, 22 aa, Staphylococcus aureus
VKLKSILVAILFTSLVLTAGTV

SEQ ID NO: 1580567 - protein, 18 aa, Staphylococcus aureus
VKPTIYFKLYKQDDNQNT

SEQ ID NO: 1580568 - protein, 26 aa, Staphylococcus aureus
VKWSTAQRMIITWVITLLISALLAGL

SEQ ID NO: 1580569 - protein, 22 aa, Staphylococcus aureus
VLGDHSWFYLPITYATRYVYMF

SEQ ID NO: 1580570 - protein, 17 aa, Staphylococcus aureus
VLGPLVFMFGLFISVMG

SEQ ID NO: 1580571 - protein, 22 aa, Staphylococcus aureus
VLMAIALGYTFKTAINPYISTF

SEQ ID NO: 1580572 - protein, 24 aa, Staphylococcus aureus
VLNMNAKVPNHFNFNRLVIDYDAD

SEQ ID NO: 1580573 - protein, 23 aa, Staphylococcus aureus
VLTDVRWTSLLIEQLINNALKYA

SEQ ID NO: 1580574 - protein, 18 aa, Staphylococcus aureus
VLVGAGFVSSLLMINKNK

SEQ ID NO: 1580575 - protein, 25 aa, Staphylococcus aureus
VMGLYICMYAIFAITAYNHSKRTIR

SEQ ID NO: 1580576 - protein, 27 aa, Staphylococcus aureus
VPIAFKIHILLGFTIMACWPFTRLVHV

SEQ ID NO: 1580577 - protein, 33 aa, Staphylococcus aureus
VQFNFVKEDGMWKLDWDHSVIIPGMQKDQSIHI

SEQ ID NO: 1580578 - protein, 22 aa, Staphylococcus aureus
VQNVVKYIVWFIVVTTILSKFG

SEQ ID NO: 1580579 - protein, 24 aa, Staphylococcus aureus
VQPISGIVMLLTIAIILGFGALEI

SEQ ID NO: 1580580 - protein, 17 aa, Staphylococcus aureus
VRLFKKRSFSAGTIAAF

SEQ ID NO: 1580581 - protein, 18 aa, Staphylococcus aureus
VRPIGIYILMMIGMSSVT

SEQ ID NO: 1580582 - protein, 31 aa, Staphylococcus aureus
VSQAVNPSTPRMRAFSLAAVAADAPAAGTDI

SEQ ID NO: 1580583 - protein, 24 aa, Staphylococcus aureus
VSTMASELNTAMSNLQRGINDEAA

SEQ ID NO: 1580584 - protein, 24 aa, Staphylococcus aureus
VSVSILIGLLFGWIPARAASKKEL

SEQ ID NO: 1580585 - protein, 19 aa, Staphylococcus aureus
VTNEFKDKITYKYQNVASI

SEQ ID NO: 1580586 - protein, 25 aa, Staphylococcus aureus
VTTGKDIIPPKTYSGNVDQVVTIDN

SEQ ID NO: 1580587 - protein, 20 aa, Staphylococcus aureus
VVIYFNFTWSFYGSLLYLLP

SEQ ID NO: 1580588 - protein, 31 aa, Staphylococcus aureus
VVRCLPLIISCLKLILILLFYFQYFWSYIKL

SEQ ID NO: 1580589 - protein, 24 aa, Staphylococcus aureus
VVSLCISIPLGIIAAKRFHKWTDK

SEQ ID NO: 1580590 - protein, 33 aa, Staphylococcus aureus
VVSQAVNPSTPRMRAFSLAAVAADAPAAGTDIT

SEQ ID NO: 1580591 - protein, 17 aa, Staphylococcus aureus
VWVGALLMVSLLTVDNK

SEQ ID NO: 1580592 - protein, 28 aa, Staphylococcus aureus
VYVIFYFIWLRFEWPHYLLYILLVLGAL

SEQ ID NO: 1580593 - protein, 17 aa, Staphylococcus aureus
WEQFQAFQNQQNQQNQQ

SEQ ID NO: 1580594 - protein, 18 aa, Staphylococcus aureus
WIGVTIIFGAFALFWFVG

SEQ ID NO: 1580595 - protein, 18 aa, Staphylococcus aureus
WIVYCMLFTLVLKFTGLS

SEQ ID NO: 1580596 - protein, 29 aa, Staphylococcus aureus
WNTVTSWFSRVAWSVAEKMGQALNFIITK

SEQ ID NO: 1580597 - protein, 17 aa, Staphylococcus aureus
WQHFVLPIFTIVVIEGC

SEQ ID NO: 1580598 - protein, 24 aa, Staphylococcus aureus
WQTNFIISIGIAFIAILLLKGTPE

SEQ ID NO: 1580599 - protein, 19 aa, Staphylococcus aureus
WRELLAISIQLPLQVFTFF

SEQ ID NO: 1580600 - protein, 20 aa, Staphylococcus aureus
WRLLACYVTSVTVIIVALII

SEQ ID NO: 1580601 - protein, 20 aa, Staphylococcus aureus
WSIVGVVWIVFSIPNTFELY

SEQ ID NO: 1580602 - protein, 19 aa, Staphylococcus aureus
WTALAVVYPLVTAYVLTFI

SEQ ID NO: 1580603 - protein, 25 aa, Staphylococcus aureus
WTQNAQRMNFQFTNSYGPSKDVVGI

SEQ ID NO: 1580604 - protein, 19 aa, Staphylococcus aureus
WVVLILSTILFFYGGKPFL

SEQ ID NO: 1580605 - protein, 24 aa, Staphylococcus aureus
YDILTKTYTFVFTDYVNNKENING

SEQ ID NO: 1580606 - protein, 22 aa, Staphylococcus aureus
YDSRSILLAALIVLSKEINANT

SEQ ID NO: 1580607 - protein, 23 aa, Staphylococcus aureus
YDVKSHGTVSIYDALRQSFNIPA

SEQ ID NO: 1580608 - protein, 33 aa, Staphylococcus aureus
YDYMSFRISSAILQFLGAISWFFLSLILSLTQF

SEQ ID NO: 1580609 - protein, 17 aa, Staphylococcus aureus
YDYTLMVFAQPITNNPD

SEQ ID NO: 1580610 - protein, 18 aa, Staphylococcus aureus
YEQGGNIIDIDFDSVPQI

SEQ ID NO: 1580611 - protein, 19 aa, Staphylococcus aureus
YFFIIGISTLSLFLFKMFD

SEQ ID NO: 1580612 - protein, 17 aa, Staphylococcus aureus
YFNDRFENEVKFQEKMK

SEQ ID NO: 1580613 - protein, 24 aa, Staphylococcus aureus
YFVMVGFRRGFWLSMIHLSATIVS

SEQ ID NO: 1580614 - protein, 33 aa, Staphylococcus aureus
YHANYGYYYYYPVSLTWDNGVAFYSNNAQGDGK

SEQ ID NO: 1580615 - protein, 19 aa, Staphylococcus aureus
YIKVLPFIIKYVGITINKI

SEQ ID NO: 1580616 - protein, 18 aa, Staphylococcus aureus
YIPSKFTHEITGTLRKQP

SEQ ID NO: 1580617 - protein, 18 aa, Staphylococcus aureus
YITDHWLKPLQMKHTTFK

SEQ ID NO: 1580618 - protein, 20 aa, Staphylococcus aureus
YIVILTCALFYFILFMYNVP

SEQ ID NO: 1580619 - protein, 23 aa, Staphylococcus aureus
YKKDRLDVAFSNFFTYAHLSELR

SEQ ID NO: 1580620 - protein, 18 aa, Staphylococcus aureus
YLCYIPLFFLFIALYPFL

SEQ ID NO: 1580621 - protein, 21 aa, Staphylococcus aureus
YLFYSPRLKFDVLENPNKGNK

SEQ ID NO: 1580622 - protein, 18 aa, Staphylococcus aureus
YLYLKSYRNFMVSYFYQL

SEQ ID NO: 1580623 - protein, 19 aa, Staphylococcus aureus
YMFYKRKVLTDNFLDKYMQ

SEQ ID NO: 1580624 - protein, 23 aa, Staphylococcus aureus
YNKRPIKGTIFFIFFISFISVFY

SEQ ID NO: 1580625 - protein, 31 aa, Staphylococcus aureus
YNTCEKYCLGAVFFYFWGVFLYNSLHKCKGF

SEQ ID NO: 1580626 - protein, 22 aa, Staphylococcus aureus
YPARFNEVYSITAIDKNNKPFI

SEQ ID NO: 1580627 - protein, 18 aa, Staphylococcus aureus
YRAGEGLIGSWIALVLYA

SEQ ID NO: 1580628 - protein, 19 aa, Staphylococcus aureus
YSLTSRIFYALNFISLSLI

SEQ ID NO: 1580629 - protein, 17 aa, Staphylococcus aureus
YSSPIAGIDKPNGANIS

SEQ ID NO: 1580630 - protein, 20 aa, Staphylococcus aureus
YTALSVWVGALLMVSLLTVD

SEQ ID NO: 1580631 - protein, 26 aa, Staphylococcus aureus
YTLDTDKTKYSWSNSYSSVNGSSTAN

SEQ ID NO: 1580632 - protein, 23 aa, Staphylococcus aureus
YVGFPMIIQFALKLSLTLNISPV

SEQ ID NO: 1580633 - protein, 17 aa, Staphylococcus aureus
AAAKQNLGTLNHITNAQ

SEQ ID NO: 1580634 - protein, 23 aa, Staphylococcus aureus
AANGASAFTIDHVVKSNSTHNAS

SEQ ID NO: 1580635 - protein, 33 aa, Staphylococcus aureus
AAVGIGGLSNAFGFKLDTYHNTSKPNAAAKANA

SEQ ID NO: 1580636 - protein, 33 aa, Staphylococcus aureus
AAVGIGGLSNAFGFKLDTYHNTSKPNSAAKANA

SEQ ID NO: 1580637 - protein, 23 aa, Staphylococcus aureus
ACFNKWQFSIIMLSPLILISTGL

SEQ ID NO: 1580638 - protein, 21 aa, Staphylococcus aureus
ACVLIPLNFYFRLNNTKNHNE

SEQ ID NO: 1580639 - protein, 24 aa, Staphylococcus aureus
ADDAKRTAYSQAVNAAATILNKTS

SEQ ID NO: 1580640 - protein, 19 aa, Staphylococcus aureus
ADEVIKKAYVVSGDLDEQN

SEQ ID NO: 1580641 - protein, 20 aa, Staphylococcus aureus
ADIKYALKEAFNEAIPHTLE

SEQ ID NO: 1580642 - protein, 23 aa, Staphylococcus aureus
AELIHWISILPVIIFIKGSRLVK

SEQ ID NO: 1580643 - protein, 23 aa, Staphylococcus aureus
AELIHWISILPVIIFNKGPRLVK

SEQ ID NO: 1580644 - protein, 23 aa, Staphylococcus aureus
AELIHWISILPVIIFNKGSRLVK

SEQ ID NO: 1580645 - protein, 18 aa, Staphylococcus aureus
AFAGSFVYIYFMQGVQGF

SEQ ID NO: 1580646 - protein, 18 aa, Staphylococcus aureus
AFIKRLANEKNYKFETVT

SEQ ID NO: 1580647 - protein, 26 aa, Staphylococcus aureus
AFINANRDAISFAEGDISVTNTPNGS

SEQ ID NO: 1580648 - protein, 18 aa, Staphylococcus aureus
AFWPAAGGSILFGVTFRK

SEQ ID NO: 1580649 - protein, 34 aa, Staphylococcus aureus
AGANKPLPEMWPYGVNDSRSWDYKIRNRSGQVIY

SEQ ID NO: 1580650 - protein, 17 aa, Staphylococcus aureus
AGGILKMKGVLDNKKAR

SEQ ID NO: 1580651 - protein, 17 aa, Staphylococcus aureus
AGGSVLFGVTFRKYTQF

SEQ ID NO: 1580652 - protein, 24 aa, Staphylococcus aureus
AGILRLFGVIALMLVVISPIYTVA

SEQ ID NO: 1580653 - protein, 24 aa, Staphylococcus aureus
AGRFGDGLVNIFTQLMPLFKFVSQ

SEQ ID NO: 1580654 - protein, 18 aa, Staphylococcus aureus
AGSFSIFSLIALMTIEPQ

SEQ ID NO: 1580655 - protein, 18 aa, Staphylococcus aureus
AGTGFAFASLTNTKMMDM

SEQ ID NO: 1580656 - protein, 21 aa, Staphylococcus aureus
AGTQLYHIVATNAYHKDTEDF

SEQ ID NO: 1580657 - protein, 18 aa, Staphylococcus aureus
AGWMGIKGSFGLNQILGV

SEQ ID NO: 1580658 - protein, 17 aa, Staphylococcus aureus
AHGGPIVAVLGGIDHVL

SEQ ID NO: 1580659 - protein, 17 aa, Staphylococcus aureus
AHKKVYREFVSKQNKDK

SEQ ID NO: 1580660 - protein, 19 aa, Staphylococcus aureus
AICGIFALFIWVHLLCTIL

SEQ ID NO: 1580661 - protein, 20 aa, Staphylococcus aureus
AIFLGILMFFIWPSIQAGIY

SEQ ID NO: 1580662 - protein, 30 aa, Staphylococcus aureus
AIKLGEHLKHPFILKRIVGQSGMSYGALGK

SEQ ID NO: 1580663 - protein, 20 aa, Staphylococcus aureus
AIQGVIDWLSELWDKIQTTI

SEQ ID NO: 1580664 - protein, 20 aa, Staphylococcus aureus
AIVILIVFALLFRFIVRLIP

SEQ ID NO: 1580665 - protein, 29 aa, Staphylococcus aureus
AIYFYPRFKRSMIGIIVAMTWVFLNDYID

SEQ ID NO: 1580666 - protein, 18 aa, Staphylococcus aureus
AKALNRAMDQLSEEITGN

SEQ ID NO: 1580667 - protein, 18 aa, Staphylococcus aureus
AKALNRVMDQLSQEITGN

SEQ ID NO: 1580668 - protein, 18 aa, Staphylococcus aureus
AKALNRVMDQLSQGITGN

SEQ ID NO: 1580669 - protein, 17 aa, Staphylococcus aureus
AKERLAQALQDIKDLVK

SEQ ID NO: 1580670 - protein, 20 aa, Staphylococcus aureus
AKIDAEFMRGRVLKYKPNLE

SEQ ID NO: 1580671 - protein, 17 aa, Staphylococcus aureus
AKNAIKALTNAKRDQIN

SEQ ID NO: 1580672 - protein, 21 aa, Staphylococcus aureus
AKSSILCYIQSILIFVFVPYF

SEQ ID NO: 1580673 - protein, 17 aa, Staphylococcus aureus
AKVEVTLLDGSKVIVNV

SEQ ID NO: 1580674 - protein, 18 aa, Staphylococcus aureus
ALFLLFFVATYLFIFPPI

SEQ ID NO: 1580675 - protein, 20 aa, Staphylococcus aureus
ALLEQFSWHSAFLINVPFAI

SEQ ID NO: 1580676 - protein, 21 aa, Staphylococcus aureus
ALQNIYLRVYYPPVVIGLTAL

SEQ ID NO: 1580677 - protein, 20 aa, Staphylococcus aureus
AMETLKHLVDNEIPNAEQTV

SEQ ID NO: 1580678 - protein, 18 aa, Staphylococcus aureus
AMFKKWTVMADRMMDGDT

SEQ ID NO: 1580679 - protein, 26 aa, Staphylococcus aureus
AMGFEMQESIALFSQWEKSGVNTEIA

SEQ ID NO: 1580680 - protein, 20 aa, Staphylococcus aureus
AMTGLKRGVANHNQVVQSDN

SEQ ID NO: 1580681 - protein, 21 aa, Staphylococcus aureus
AMTQLKQGIANKAQIKGSENY

SEQ ID NO: 1580682 - protein, 20 aa, Staphylococcus aureus
ANEIPKAKIDANKDVDKQVQ

SEQ ID NO: 1580683 - protein, 17 aa, Staphylococcus aureus
ANGALPIGLDYEGVTLQ

SEQ ID NO: 1580684 - protein, 17 aa, Staphylococcus aureus
ANISFIVTIILLIITAI

SEQ ID NO: 1580685 - protein, 23 aa, Staphylococcus aureus
ANKPVVTLMPQFVDYLEGQLSSK

SEQ ID NO: 1580686 - protein, 18 aa, Staphylococcus aureus
ANPIPIYITNFFGGAIAG

SEQ ID NO: 1580687 - protein, 20 aa, Staphylococcus aureus
ANYKRHGMKLMILGNDEPYN

SEQ ID NO: 1580688 - protein, 22 aa, Staphylococcus aureus
ANYPGPVSDIARVKKLDNLIDG

SEQ ID NO: 1580689 - protein, 17 aa, Staphylococcus aureus
APFYKSYLPQVFKSMMV

SEQ ID NO: 1580690 - protein, 21 aa, Staphylococcus aureus
APKFGCVNGCMLFILYYRVNR

SEQ ID NO: 1580691 - protein, 24 aa, Staphylococcus aureus
AQALNQAMEALRNSIQDQQQTEAG

SEQ ID NO: 1580692 - protein, 25 aa, Staphylococcus aureus
AQDYLELKSQIKVDDKVKSGDYFTI

SEQ ID NO: 1580693 - protein, 19 aa, Staphylococcus aureus
AQHSISISLIFAVILFVSA

SEQ ID NO: 1580694 - protein, 20 aa, Staphylococcus aureus
ASALLPYVMAEVVRKEATLF

SEQ ID NO: 1580695 - protein, 19 aa, Staphylococcus aureus
ASDEIVKGLGIPKSVVNAS

SEQ ID NO: 1580696 - protein, 26 aa, Staphylococcus aureus
ASKQAGHPVFYVYAGNQGNASVNLGG

SEQ ID NO: 1580697 - protein, 20 aa, Staphylococcus aureus
ASPLQIIRYFLIPEALGSLV

SEQ ID NO: 1580698 - protein, 17 aa, Staphylococcus aureus
ASVLPSTFLGILPVGMY

SEQ ID NO: 1580699 - protein, 29 aa, Staphylococcus aureus
ATDTKLRIFEVNDISKLSDSYYADPNDSN

SEQ ID NO: 1580700 - protein, 25 aa, Staphylococcus aureus
ATGKDYSIFGWNNENVVRYGGGSAD

SEQ ID NO: 1580701 - protein, 17 aa, Staphylococcus aureus
ATIKAGQNYADASPNNR

SEQ ID NO: 1580702 - protein, 20 aa, Staphylococcus aureus
ATKSFLVWMLVAAVIGFIFP

SEQ ID NO: 1580703 - protein, 17 aa, Staphylococcus aureus
ATLGKWVPYLLGIVMLG

SEQ ID NO: 1580704 - protein, 31 aa, Staphylococcus aureus
ATSEATKHNGTRAQSEERLPDTGDSIKQNGL

SEQ ID NO: 1580705 - protein, 19 aa, Staphylococcus aureus
ATTTVPGLRNNIAGNEKAQ

SEQ ID NO: 1580706 - protein, 19 aa, Staphylococcus aureus
ATWLEPFGGIKGRKETNFP

SEQ ID NO: 1580707 - protein, 20 aa, Staphylococcus aureus
AVGVLFYLRSNKRQIIEKAI

SEQ ID NO: 1580708 - protein, 19 aa, Staphylococcus aureus
AVPVKFDVLTLLVFAIVLM

SEQ ID NO: 1580709 - protein, 24 aa, Staphylococcus aureus
AVYKAQLYLSPYGPKQYVEHLNQN

SEQ ID NO: 1580710 - protein, 17 aa, Staphylococcus aureus
AWANWVSLVTIIPIEAV

SEQ ID NO: 1580711 - protein, 18 aa, Staphylococcus aureus
AYGHGVSGVNMGAKTGTG

SEQ ID NO: 1580712 - protein, 24 aa, Staphylococcus aureus
AYLFFKSSVSLVFKIIKRFKKGVI

SEQ ID NO: 1580713 - protein, 32 aa, Staphylococcus aureus
AYNEKSGIMRAEYAGKIWEANISDLGLDKSEA

SEQ ID NO: 1580714 - protein, 21 aa, Staphylococcus aureus
AYPLVIAYVLTFIFYQVGHLF

SEQ ID NO: 1580715 - protein, 22 aa, Staphylococcus aureus
AYVKPLNQFKLGTVTVSGTVTQ

SEQ ID NO: 1580716 - protein, 18 aa, Staphylococcus aureus
CNDCCRCDLSRRCNDDRV

SEQ ID NO: 1580717 - protein, 17 aa, Staphylococcus aureus
CPTEIINTVSFFVLLFI

SEQ ID NO: 1580718 - protein, 25 aa, Staphylococcus aureus
CVKVFKLDIKWPFLLSELGIVLLGV

SEQ ID NO: 1580719 - protein, 21 aa, Staphylococcus aureus
CYYLYRLIFTYKYDIVSKTQK

SEQ ID NO: 1580720 - protein, 22 aa, Staphylococcus aureus
DAAKRQIEGATHVSEVTQAQNN

SEQ ID NO: 1580721 - protein, 39 aa, Staphylococcus aureus
DAYSQKGAITLGTRIDSNKSFHFSGKVNLGNKYEGHGNG

SEQ ID NO: 1580722 - protein, 17 aa, Staphylococcus aureus
DAYTNAVAHAEGILSKA

SEQ ID NO: 1580723 - protein, 58 aa, Staphylococcus aureus
DDEIDPLHMRHFGDRIGNVIKNALGVVGISGLLASFWFFIAKRRRKEDEEEELEIRDN

SEQ ID NO: 1580724 - protein, 34 aa, Staphylococcus aureus
DDEIDPLHMRHFGVRIGNVIKNALGVVGISGLLA

SEQ ID NO: 1580725 - protein, 17 aa, Staphylococcus aureus
DDLFIEGITAYDNERHH

SEQ ID NO: 1580726 - protein, 18 aa, Staphylococcus aureus
DDMFISRKALTPVFSSVL

SEQ ID NO: 1580727 - protein, 22 aa, Staphylococcus aureus
DEAKRNAYTNAVTQAEQILNKV

SEQ ID NO: 1580728 - protein, 17 aa, Staphylococcus aureus
DEEIYLINKDFKKEQSN

SEQ ID NO: 1580729 - protein, 33 aa, Staphylococcus aureus
DEIDPLHMRHFGDRIGNVIKNALGVVGISGLLA

SEQ ID NO: 1580730 - protein, 17 aa, Staphylococcus aureus
DELPTTLAIIGGIITLL

SEQ ID NO: 1580731 - protein, 23 aa, Staphylococcus aureus
DEQKRNAYNQAISAAETILNKQT

SEQ ID NO: 1580732 - protein, 26 aa, Staphylococcus aureus
DFSDRVTLKVAFILPIILISLSIRAC

SEQ ID NO: 1580733 - protein, 18 aa, Staphylococcus aureus
DFSNEKMNSIRNSEIGTA

SEQ ID NO: 1580734 - protein, 20 aa, Staphylococcus aureus
DFSTLLLISGLLFLFFFKEN

SEQ ID NO: 1580735 - protein, 24 aa, Staphylococcus aureus
DFYISIKSPRKFKKAVAVVTLITN

SEQ ID NO: 1580736 - protein, 17 aa, Staphylococcus aureus
DGERVAVNIIGYKTGGL

SEQ ID NO: 1580737 - protein, 20 aa, Staphylococcus aureus
DGFKHPGEWKNQDLGTGAGN

SEQ ID NO: 1580738 - protein, 20 aa, Staphylococcus aureus
DGKRAFKPSTIVTKNGIRYG

SEQ ID NO: 1580739 - protein, 19 aa, Staphylococcus aureus
DGSLPQLIFLIAVPNNSQD

SEQ ID NO: 1580740 - protein, 19 aa, Staphylococcus aureus
DGTNVQWSNGAGAGANKPL

SEQ ID NO: 1580741 - protein, 20 aa, Staphylococcus aureus
DIDFDSVPQIHGFNKHNEII

SEQ ID NO: 1580742 - protein, 25 aa, Staphylococcus aureus
DIDSSRWKLGNKFTKEFNEVEGAVK

SEQ ID NO: 1580743 - protein, 17 aa, Staphylococcus aureus
DIELQFLIESILICVTS

SEQ ID NO: 1580744 - protein, 25 aa, Staphylococcus aureus
DIKAQRSLNLWTYVMLIFMTLAAIL

SEQ ID NO: 1580745 - protein, 19 aa, Staphylococcus aureus
DILLIVSIFINLVYSLISY

SEQ ID NO: 1580746 - protein, 23 aa, Staphylococcus aureus
DILTKTYTFVFTDYVNNKENING

SEQ ID NO: 1580747 - protein, 18 aa, Staphylococcus aureus
DKEGYRDGEFEKGDKGTW

SEQ ID NO: 1580748 - protein, 23 aa, Staphylococcus aureus
DKLVIKRNGNVVTTFTRHNNTSP

SEQ ID NO: 1580749 - protein, 26 aa, Staphylococcus aureus
DKNSRYGIAGPMPIVMVSIIKSMMHQ

SEQ ID NO: 1580750 - protein, 25 aa, Staphylococcus aureus
DKTAYKMEVSLGNDTYSEEIIVDYG

SEQ ID NO: 1580751 - protein, 22 aa, Staphylococcus aureus
DKTAYKMEVTLGNDAYSEEIIV

SEQ ID NO: 1580752 - protein, 24 aa, Staphylococcus aureus
DKTAYKMEVTLGNDAYSEEIIVDY

SEQ ID NO: 1580753 - protein, 17 aa, Staphylococcus aureus
DKTETLNSINFTDADQA

SEQ ID NO: 1580754 - protein, 22 aa, Staphylococcus aureus
DKVKSGDYFTAKLPDSLTGNGD

SEQ ID NO: 1580755 - protein, 17 aa, Staphylococcus aureus
DLIKVKRVLFPMQELID

SEQ ID NO: 1580756 - protein, 20 aa, Staphylococcus aureus
DLNQPQRDALRNHINQAQAL

SEQ ID NO: 1580757 - protein, 20 aa, Staphylococcus aureus
DLVDCIGCGVFVDGGVVTLV

SEQ ID NO: 1580758 - protein, 17 aa, Staphylococcus aureus
DLVKAKEDAKNAIKALT

SEQ ID NO: 1580759 - protein, 27 aa, Staphylococcus aureus
DNIFTFFYKKVAVLFFECLVFIILSIT

SEQ ID NO: 1580760 - protein, 27 aa, Staphylococcus aureus
DNLDSGKYKVIFEKPAGLTQTGTNTTE

SEQ ID NO: 1580761 - protein, 19 aa, Staphylococcus aureus
DNNSIKSGQNYTDATTANK

SEQ ID NO: 1580762 - protein, 18 aa, Staphylococcus aureus
DPEYIFYAYKRFNFELKD

SEQ ID NO: 1580763 - protein, 25 aa, Staphylococcus aureus
DPVTNRDYSIFGWNNENVVRYGGGS

SEQ ID NO: 1580764 - protein, 26 aa, Staphylococcus aureus
DQIWSNSKFKLALKVQDRQDSNEILK

SEQ ID NO: 1580765 - protein, 19 aa, Staphylococcus aureus
DRIKTRPLYLAAMGTFLVG

SEQ ID NO: 1580766 - protein, 17 aa, Staphylococcus aureus
DRINQILQQGHNDINNA

SEQ ID NO: 1580767 - protein, 21 aa, Staphylococcus aureus
DSHLEKNCVIVICSVLLLNIL

SEQ ID NO: 1580768 - protein, 26 aa, Staphylococcus aureus
DSIVTSILLFFAFRTSNNIVVQHRII

SEQ ID NO: 1580769 - protein, 23 aa, Staphylococcus aureus
DSKEYKELIILMTKVKISKIVAK

SEQ ID NO: 1580770 - protein, 22 aa, Staphylococcus aureus
DSNVFLLNWDIRGLTSYIFSFL

SEQ ID NO: 1580771 - protein, 23 aa, Staphylococcus aureus
DSNVFLLTWDIRGLTSYIFSFLI

SEQ ID NO: 1580772 - protein, 25 aa, Staphylococcus aureus
DSSVISRWLRYVLIVIGSAALYLGY

SEQ ID NO: 1580773 - protein, 40 aa, Staphylococcus aureus
DTGDSIKQNGLLGGVMTLLVGLGLMKRKKKKDENEQDDSQ

SEQ ID NO: 1580774 - protein, 36 aa, Staphylococcus aureus
DTGKTEFWATSSDVLKLKANYTIDDSVKEGDTFTFK

SEQ ID NO: 1580775 - protein, 18 aa, Staphylococcus aureus
DVMFSSSIMYRIKKNAFS

SEQ ID NO: 1580776 - protein, 33 aa, Staphylococcus aureus
DVVSQAVNPSAPRMRAFSLAAVAADAPAAGTDI

SEQ ID NO: 1580777 - protein, 27 aa, Staphylococcus aureus
DYALFILFRYRQVMKTETDYIKGIGLA

SEQ ID NO: 1580778 - protein, 34 aa, Staphylococcus aureus
DYKIRNRSGQVIYDWPTVHINSLKDLARASDYFS

SEQ ID NO: 1580779 - protein, 20 aa, Staphylococcus aureus
DYNLIKVVPYILVLVLALLG

SEQ ID NO: 1580780 - protein, 25 aa, Staphylococcus aureus
EAAEKRSNVHLVDWYKASEGHPEYF

SEQ ID NO: 1580781 - protein, 22 aa, Staphylococcus aureus
EAAKRQIEGATHVNEVTQAQNN

SEQ ID NO: 1580782 - protein, 22 aa, Staphylococcus aureus
EAFIRPNSHFDYEYKLYKDKFE

SEQ ID NO: 1580783 - protein, 31 aa, Staphylococcus aureus
EAGATPATKAFGRQTFEYINGERPTESPGVP

SEQ ID NO: 1580784 - protein, 22 aa, Staphylococcus aureus
EALNQAMEALRNSIQDQQQTEA

SEQ ID NO: 1580785 - protein, 29 aa, Staphylococcus aureus
EAMGYLKRLSWYISILILIVVIAGCGKGN

SEQ ID NO: 1580786 - protein, 17 aa, Staphylococcus aureus
EAMKSYVSEQIKNRQEQ

SEQ ID NO: 1580787 - protein, 22 aa, Staphylococcus aureus
EDAKNAIKALANAKRDQINSNP

SEQ ID NO: 1580788 - protein, 18 aa, Staphylococcus aureus
EDQDFIFDRFYRVDKSRS

SEQ ID NO: 1580789 - protein, 24 aa, Staphylococcus aureus
EEEYYHKNAFAMDKSHPEPIEDND

SEQ ID NO: 1580790 - protein, 21 aa, Staphylococcus aureus
EEILPDTKYPIAVTDWNKKYS

SEQ ID NO: 1580791 - protein, 30 aa, Staphylococcus aureus
EEIVFRGMIIRVIFRKHLFLGLIVSSLVFA

SEQ ID NO: 1580792 - protein, 21 aa, Staphylococcus aureus
EEKYDYTLMEFAQPIYNSADK

SEQ ID NO: 1580793 - protein, 23 aa, Staphylococcus aureus
EEMNRIIKLVEELLELTKGDVND

SEQ ID NO: 1580794 - protein, 19 aa, Staphylococcus aureus
EFILSVSVYVIFYFIWLRF

SEQ ID NO: 1580795 - protein, 18 aa, Staphylococcus aureus
EFILSVVVYVIFYFIWLR

SEQ ID NO: 1580796 - protein, 23 aa, Staphylococcus aureus
EIANFSGLLGRVLTEMRLVKISN

SEQ ID NO: 1580797 - protein, 23 aa, Staphylococcus aureus
EIENFKFFVQYGDFKDINDYKDG

SEQ ID NO: 1580798 - protein, 21 aa, Staphylococcus aureus
EIEQAKAQLAQALKEIKDLVK

SEQ ID NO: 1580799 - protein, 20 aa, Staphylococcus aureus
EIEQAKAQLAQALQEIKDLV

SEQ ID NO: 1580800 - protein, 19 aa, Staphylococcus aureus
EIEQAKAQLGQALQDIKDL

SEQ ID NO: 1580801 - protein, 22 aa, Staphylococcus aureus
EIKPRMKRSTDVTAVTEKEVVE

SEQ ID NO: 1580802 - protein, 17 aa, Staphylococcus aureus
EILPDTKYPIAVTDWNK

SEQ ID NO: 1580803 - protein, 19 aa, Staphylococcus aureus
EIMERYKPYAVYHAAAHKH

SEQ ID NO: 1580804 - protein, 19 aa, Staphylococcus aureus
EIQPIAALLDKMKIKYRQQ

SEQ ID NO: 1580805 - protein, 20 aa, Staphylococcus aureus
EIVKSPRILDEVSKDLNDKY

SEQ ID NO: 1580806 - protein, 25 aa, Staphylococcus aureus
EKIIKLYFRIIIAYLKDDDGIIDSK

SEQ ID NO: 1580807 - protein, 17 aa, Staphylococcus aureus
EKKDLTAELSLNLFIDP

SEQ ID NO: 1580808 - protein, 20 aa, Staphylococcus aureus
EKNKFTHVAYIKPINGNNSD

SEQ ID NO: 1580809 - protein, 25 aa, Staphylococcus aureus
EKQAGQGFKGYGTFVKTGADGTTAK

SEQ ID NO: 1580810 - protein, 19 aa, Staphylococcus aureus
EKQRITTAFMNKNQNIRGY

SEQ ID NO: 1580811 - protein, 48 aa, Staphylococcus aureus
EKTRVRLYKSGKNWVKSGIKEIEMFKIMGLPFISHSLVSQDNQSISKK

SEQ ID NO: 1580812 - protein, 28 aa, Staphylococcus aureus
EKVLKDNEHSPLLFAKRRKDKEEDVETT

SEQ ID NO: 1580813 - protein, 21 aa, Staphylococcus aureus
EKVVFDYRRSLLRTDVVLNSE

SEQ ID NO: 1580814 - protein, 19 aa, Staphylococcus aureus
ELETVKAILEEIGYFDTKA

SEQ ID NO: 1580815 - protein, 17 aa, Staphylococcus aureus
ELIKKLSIAVDWFSSLS

SEQ ID NO: 1580816 - protein, 22 aa, Staphylococcus aureus
EMKEALIEAGGTRIRPILMTAI

SEQ ID NO: 1580817 - protein, 25 aa, Staphylococcus aureus
ENSAGFKIDTGYNFKDPMDKEEKQA

SEQ ID NO: 1580818 - protein, 22 aa, Staphylococcus aureus
EPVDEITQFGGEEVPQGHKDEF

SEQ ID NO: 1580819 - protein, 17 aa, Staphylococcus aureus
EQGGNIIDIDFDSVPQI

SEQ ID NO: 1580820 - protein, 20 aa, Staphylococcus aureus
EQQARITLYLKHNTKEPNTI

SEQ ID NO: 1580821 - protein, 27 aa, Staphylococcus aureus
EQQFPPRNAQRRKRRRDLATNHNKQHH

SEQ ID NO: 1580822 - protein, 23 aa, Staphylococcus aureus
EQSKRLALASAKEGYVESAKDIN

SEQ ID NO: 1580823 - protein, 17 aa, Staphylococcus aureus
ERLFKNNRYKRAIEIAE

SEQ ID NO: 1580824 - protein, 45 aa, Staphylococcus aureus
ERNIELVGNLLPGDYFGTIRFGRKEQLFEIRVKPHTPRITTTAEE

SEQ ID NO: 1580825 - protein, 29 aa, Staphylococcus aureus
ERQHLRPKISATFLAWLLIFLMFALPIGI

SEQ ID NO: 1580826 - protein, 24 aa, Staphylococcus aureus
ESLDKVKHTPFFLPKRRRKEDEED

SEQ ID NO: 1580827 - protein, 17 aa, Staphylococcus aureus
ESPLFKGKYSVNNSDLL

SEQ ID NO: 1580828 - protein, 19 aa, Staphylococcus aureus
ESRKRYSPDSTYKIYLAMF

SEQ ID NO: 1580829 - protein, 20 aa, Staphylococcus aureus
ETIELPLAHMIPEVVGNLLL

SEQ ID NO: 1580830 - protein, 18 aa, Staphylococcus aureus
EVIWPKTGLVYFGMADIG

SEQ ID NO: 1580831 - protein, 23 aa, Staphylococcus aureus
EVNKLKQQAIEQINNAADVHTVE

SEQ ID NO: 1580832 - protein, 18 aa, Staphylococcus aureus
EVQPIAALLDKMKIKYRQ

SEQ ID NO: 1580833 - protein, 25 aa, Staphylococcus aureus
EVRQERGITFGLFRLSVGLEDPDEL

SEQ ID NO: 1580834 - protein, 27 aa, Staphylococcus aureus
EVSHRMPFYFAGALGILAFIMSIVLIH

SEQ ID NO: 1580835 - protein, 26 aa, Staphylococcus aureus
FAKELKNRKKAAISKIKDISTDKIDR

SEQ ID NO: 1580836 - protein, 26 aa, Staphylococcus aureus
FDAFVVRMMLIPALTKLFGKGSWYLP

SEQ ID NO: 1580837 - protein, 19 aa, Staphylococcus aureus
FDDAKRLANTLLNSDNTNV

SEQ ID NO: 1580838 - protein, 19 aa, Staphylococcus aureus
FDEEIYLINKDFKKEESKD

SEQ ID NO: 1580839 - protein, 29 aa, Staphylococcus aureus
FDIFIAGILRLFGVIALMLVVVSPIYAVA

SEQ ID NO: 1580840 - protein, 21 aa, Staphylococcus aureus
FDNKITYNYSSPIAGIDKPNG

SEQ ID NO: 1580841 - protein, 17 aa, Staphylococcus aureus
FDRFKFYNSKAHPDLTV

SEQ ID NO: 1580842 - protein, 18 aa, Staphylococcus aureus
FFGQYADFKSLKSYNNGD

SEQ ID NO: 1580843 - protein, 21 aa, Staphylococcus aureus
FFSNQTFNYTWFVGGLLGVGY

SEQ ID NO: 1580844 - protein, 24 aa, Staphylococcus aureus
FGGLIGGPVVKYLIKRYNLKPQHS

SEQ ID NO: 1580845 - protein, 18 aa, Staphylococcus aureus
FGTSLLRIIKKMLDLTGI

SEQ ID NO: 1580846 - protein, 29 aa, Staphylococcus aureus
FGYDQLKKLEGMLDFPMLSTNVYKDGKRA

SEQ ID NO: 1580847 - protein, 18 aa, Staphylococcus aureus
FHNIHIKIIYWLVLTAIF

SEQ ID NO: 1580848 - protein, 24 aa, Staphylococcus aureus
FHNIHLKIIYWLILTSIFFIANIL

SEQ ID NO: 1580849 - protein, 19 aa, Staphylococcus aureus
FHNVCKNVQIAFQIVIAIV

SEQ ID NO: 1580850 - protein, 18 aa, Staphylococcus aureus
FHTHLLYNTCEKYCLGAV

SEQ ID NO: 1580851 - protein, 37 aa, Staphylococcus aureus
FHTHLLYNTCEKYCLGAVFFYFWGVFLYNSLHKCKGF

SEQ ID NO: 1580852 - protein, 47 aa, Staphylococcus aureus
FHVGFVRYFSRMIIPNLFSLLASIIVLWLYFRKAIPKSFDANHIKKP

SEQ ID NO: 1580853 - protein, 18 aa, Staphylococcus aureus
FIAQRPIFQFSVAELIGW

SEQ ID NO: 1580854 - protein, 22 aa, Staphylococcus aureus
FIFNKKVNGYHVWIKGYNNDIT

SEQ ID NO: 1580855 - protein, 23 aa, Staphylococcus aureus
FIGGPGAVFWMWITAFLGASSAF

SEQ ID NO: 1580856 - protein, 19 aa, Staphylococcus aureus
FIIGIALAIVILIVFAVLF

SEQ ID NO: 1580857 - protein, 27 aa, Staphylococcus aureus
FIIPFLLIFIIDGFRGVKETLPAILVV

SEQ ID NO: 1580858 - protein, 26 aa, Staphylococcus aureus
FILATLFLKFDRLIAVLGGVTPFLIA

SEQ ID NO: 1580859 - protein, 25 aa, Staphylococcus aureus
FILPWKVCLYIGIALGIIVTIFLLV

SEQ ID NO: 1580860 - protein, 17 aa, Staphylococcus aureus
FIMRRTAVEILFATIGL

SEQ ID NO: 1580861 - protein, 26 aa, Staphylococcus aureus
FIQNPPHGATVAWHDNPDTWKNTVGN

SEQ ID NO: 1580862 - protein, 22 aa, Staphylococcus aureus
FITIDFGSFFLMGIILILISSI

SEQ ID NO: 1580863 - protein, 26 aa, Staphylococcus aureus
FIVAKDGLFPKWFAKENKNKAPVNAL

SEQ ID NO: 1580864 - protein, 27 aa, Staphylococcus aureus
FKDKISYKYDNVASINFGDINKTYVVL

SEQ ID NO: 1580865 - protein, 19 aa, Staphylococcus aureus
FKFLKALLYLKYLKKQSLY

SEQ ID NO: 1580866 - protein, 22 aa, Staphylococcus aureus
FKGDHLRRAISYLMISTVGGIG

SEQ ID NO: 1580867 - protein, 23 aa, Staphylococcus aureus
FKIYIKNKVRPLALFKIVETADG

SEQ ID NO: 1580868 - protein, 21 aa, Staphylococcus aureus
FKKYGVWAVFICRFIPVLRVL

SEQ ID NO: 1580869 - protein, 23 aa, Staphylococcus aureus
FKRNMRTAQRMAKTDIPDEIKTE

SEQ ID NO: 1580870 - protein, 17 aa, Staphylococcus aureus
FKYVLNNKWVWAIAFAN

SEQ ID NO: 1580871 - protein, 25 aa, Staphylococcus aureus
FLFKKLTWPVGLIVAAITISSLGSL

SEQ ID NO: 1580872 - protein, 20 aa, Staphylococcus aureus
FLGATFILSFGWQPLLFNAL

SEQ ID NO: 1580873 - protein, 17 aa, Staphylococcus aureus
FLSAVGLHGIWDTSLTV

SEQ ID NO: 1580874 - protein, 21 aa, Staphylococcus aureus
FLTLKSLFWVLPWAIMQRIPL

SEQ ID NO: 1580875 - protein, 20 aa, Staphylococcus aureus
FLVHCFLVYIIAYIGELIIN

SEQ ID NO: 1580876 - protein, 18 aa, Staphylococcus aureus
FMMLPLADIDLAWLVPFI

SEQ ID NO: 1580877 - protein, 19 aa, Staphylococcus aureus
FMMLPLADIDLAWLVPFML

SEQ ID NO: 1580878 - protein, 19 aa, Staphylococcus aureus
FNAVKVLKIDFVVMIIGAI

SEQ ID NO: 1580879 - protein, 18 aa, Staphylococcus aureus
FNEIILLMYLISIICYFY

SEQ ID NO: 1580880 - protein, 26 aa, Staphylococcus aureus
FNILPKIIGGIGWLLAKVTRQPKLES

SEQ ID NO: 1580881 - protein, 19 aa, Staphylococcus aureus
FNKEGANQIQVTWGENVVF

SEQ ID NO: 1580882 - protein, 17 aa, Staphylococcus aureus
FNLLHLLSLKVTSILIV

SEQ ID NO: 1580883 - protein, 18 aa, Staphylococcus aureus
FNNAHLWDDSAVDAIDTI

SEQ ID NO: 1580884 - protein, 17 aa, Staphylococcus aureus
FNTIQMISAFSFFIYLL

SEQ ID NO: 1580885 - protein, 18 aa, Staphylococcus aureus
FPEFQRLTVKKLEFKYSY

SEQ ID NO: 1580886 - protein, 23 aa, Staphylococcus aureus
FPEQKLPIYILFTLFVVVAIVSN

SEQ ID NO: 1580887 - protein, 18 aa, Staphylococcus aureus
FPIDSLFYIVSLNLSLTL

SEQ ID NO: 1580888 - protein, 19 aa, Staphylococcus aureus
FPIDSLFYIVSLNLSLTMI

SEQ ID NO: 1580889 - protein, 17 aa, Staphylococcus aureus
FPLLSVAIGSIFTGIVW

SEQ ID NO: 1580890 - protein, 31 aa, Staphylococcus aureus
FQLEELIVWSSCFIGFLGIIFFYCHLNKKLT

SEQ ID NO: 1580891 - protein, 20 aa, Staphylococcus aureus
FRITEMNWEAAFKVNERTLK

SEQ ID NO: 1580892 - protein, 17 aa, Staphylococcus aureus
FSFLFVAPLLYGIHVLL

SEQ ID NO: 1580893 - protein, 20 aa, Staphylococcus aureus
FSIMSLCMLITLDSQNIIVF

SEQ ID NO: 1580894 - protein, 18 aa, Staphylococcus aureus
FSKKCTYWVTLIISQILL

SEQ ID NO: 1580895 - protein, 17 aa, Staphylococcus aureus
FSKKCTYWVTLIITQIL

SEQ ID NO: 1580896 - protein, 17 aa, Staphylococcus aureus
FSLKCKIHLFFNSINAI

SEQ ID NO: 1580897 - protein, 17 aa, Staphylococcus aureus
FSTLAGYTPTTVNAGTD

SEQ ID NO: 1580898 - protein, 24 aa, Staphylococcus aureus
FTFFLNVLLPLVFISVLIGIFNYI

SEQ ID NO: 1580899 - protein, 17 aa, Staphylococcus aureus
FTIYMLLTIEVQNIILF

SEQ ID NO: 1580900 - protein, 28 aa, Staphylococcus aureus
FTPDTSKLIDVTDKFKITYSNDNKTATV

SEQ ID NO: 1580901 - protein, 23 aa, Staphylococcus aureus
FVKLKSILVAILFTSLVLTAGTV

SEQ ID NO: 1580902 - protein, 21 aa, Staphylococcus aureus
FVSWYPTVYWIINAAVVLVAF

SEQ ID NO: 1580903 - protein, 17 aa, Staphylococcus aureus
FVVIIRKYVHTFEVQLD

SEQ ID NO: 1580904 - protein, 17 aa, Staphylococcus aureus
FYAYKRFNFELKDPNFT

SEQ ID NO: 1580905 - protein, 33 aa, Staphylococcus aureus
FYYWCGVALMLFISWLGLFLFYKNEFDSENPNP

SEQ ID NO: 1580906 - protein, 19 aa, Staphylococcus aureus
GATVHEFNLIKAIGVLLLI

SEQ ID NO: 1580907 - protein, 28 aa, Staphylococcus aureus
GAVFIVFLLLPARWFTGLVTEKTVDDNR

SEQ ID NO: 1580908 - protein, 27 aa, Staphylococcus aureus
GAYLFFKSSVSLVFKMVKKFRKGVISV

SEQ ID NO: 1580909 - protein, 21 aa, Staphylococcus aureus
GDEYLKVIAVLLIAAIISLFV

SEQ ID NO: 1580910 - protein, 23 aa, Staphylococcus aureus
GEGYRPHFKINYGEKIEETIKNM

SEQ ID NO: 1580911 - protein, 17 aa, Staphylococcus aureus
GELDIAQGTSMRTTDKY

SEQ ID NO: 1580912 - protein, 21 aa, Staphylococcus aureus
GESFISNPLLVYMEPYASSTA

SEQ ID NO: 1580913 - protein, 23 aa, Staphylococcus aureus
GFDVFNYWLGIILMLFVSWFALF

SEQ ID NO: 1580914 - protein, 21 aa, Staphylococcus aureus
GFGVYKGVKYFSGTGELEKYG

SEQ ID NO: 1580915 - protein, 17 aa, Staphylococcus aureus
GGICCYIVINYIKVKLK

SEQ ID NO: 1580916 - protein, 24 aa, Staphylococcus aureus
GGLCTIIGGLITVWCRNFIENKRK

SEQ ID NO: 1580917 - protein, 32 aa, Staphylococcus aureus
GGLKDGETYTVKFETPAGYLPTKVNGTTDGEK

SEQ ID NO: 1580918 - protein, 25 aa, Staphylococcus aureus
GGNIIDIDFDSVPQIHGFNKHTEII

SEQ ID NO: 1580919 - protein, 17 aa, Staphylococcus aureus
GGSKNGGTWNPNASDGS

SEQ ID NO: 1580920 - protein, 31 aa, Staphylococcus aureus
GIKEKVPIIFSFRAVFETLLLIGVAYFLTAA

SEQ ID NO: 1580921 - protein, 23 aa, Staphylococcus aureus
GIKYETMNFLSLPPKDIFLASVL

SEQ ID NO: 1580922 - protein, 19 aa, Staphylococcus aureus
GILGGVFWALMAPIAAVSS

SEQ ID NO: 1580923 - protein, 18 aa, Staphylococcus aureus
GIPAFLMSILMGFTGLVL

SEQ ID NO: 1580924 - protein, 19 aa, Staphylococcus aureus
GIPAWAWSALFLVIIFSLN

SEQ ID NO: 1580925 - protein, 24 aa, Staphylococcus aureus
GIVAACVTFLFGSLRVNSIGVNAV

SEQ ID NO: 1580926 - protein, 25 aa, Staphylococcus aureus
GKDIPYKLLANFLNEFDKNVDKISS

SEQ ID NO: 1580927 - protein, 23 aa, Staphylococcus aureus
GKKVELGQAFIKRLANEKNYKFE

SEQ ID NO: 1580928 - protein, 20 aa, Staphylococcus aureus
GKLSVIYGFLATCIVLPIVF

SEQ ID NO: 1580929 - protein, 25 aa, Staphylococcus aureus
GKTYIKQFLLFNGLMGGLSFVLLLI

SEQ ID NO: 1580930 - protein, 22 aa, Staphylococcus aureus
GLVELLCAAVLGIIALFFYIFR

SEQ ID NO: 1580931 - protein, 18 aa, Staphylococcus aureus
GMMTGLIIGGVPPLQAIK

SEQ ID NO: 1580932 - protein, 20 aa, Staphylococcus aureus
GNGFKKLLLINFQMLAPENK

SEQ ID NO: 1580933 - protein, 25 aa, Staphylococcus aureus
GNQTIEVGKTMNLIVLTTTDNGTGT

SEQ ID NO: 1580934 - protein, 26 aa, Staphylococcus aureus
GNQTIEVGKTMNPIVLTTTDNGTGTV

SEQ ID NO: 1580935 - protein, 25 aa, Staphylococcus aureus
GNQTIEVGKTMNPVVLTTTDNGTGT

SEQ ID NO: 1580936 - protein, 36 aa, Staphylococcus aureus
GNTFMAANFKVAGKVKSGDYFTAKLPDSVTGNGDVD

SEQ ID NO: 1580937 - protein, 18 aa, Staphylococcus aureus
GPFPISWTPFGELFSGVF

SEQ ID NO: 1580938 - protein, 17 aa, Staphylococcus aureus
GPMGDAVIEGYINENKK

SEQ ID NO: 1580939 - protein, 18 aa, Staphylococcus aureus
GPQIRRLPVSKMNQDLLA

SEQ ID NO: 1580940 - protein, 23 aa, Staphylococcus aureus
GQDINVTAHILIDGETTPITKTA

SEQ ID NO: 1580941 - protein, 19 aa, Staphylococcus aureus
GQRQFTLNGQVIQIMDIIN

SEQ ID NO: 1580942 - protein, 22 aa, Staphylococcus aureus
GQTPVGRTEFVTVNADGTNVQW

SEQ ID NO: 1580943 - protein, 23 aa, Staphylococcus aureus
GQVKSGDYFTAKLPDSVTGNGDV

SEQ ID NO: 1580944 - protein, 19 aa, Staphylococcus aureus
GRKTLPILLGKNASLTFMA

SEQ ID NO: 1580945 - protein, 17 aa, Staphylococcus aureus
GRLTKSFTSNLNNMNFL

SEQ ID NO: 1580946 - protein, 27 aa, Staphylococcus aureus
GSIEGTKHLPLLFAKRRRKEDEEDVIF

SEQ ID NO: 1580947 - protein, 18 aa, Staphylococcus aureus
GSLEAVFWMINKILKLAP

SEQ ID NO: 1580948 - protein, 20 aa, Staphylococcus aureus
GSNKIAFTIACISVSWLWFF

SEQ ID NO: 1580949 - protein, 21 aa, Staphylococcus aureus
GSNKIAFTIACISVSWLWFFL

SEQ ID NO: 1580950 - protein, 17 aa, Staphylococcus aureus
GTASILIGSLMYLGTQQ

SEQ ID NO: 1580951 - protein, 28 aa, Staphylococcus aureus
GTFIAKHKWSALIAWVIIVAAIFIPIAT

SEQ ID NO: 1580952 - protein, 18 aa, Staphylococcus aureus
GTFKPYGSAYGHGVSGVN

SEQ ID NO: 1580953 - protein, 21 aa, Staphylococcus aureus
GTGLEFKSMISLLIIIITIIL

SEQ ID NO: 1580954 - protein, 17 aa, Staphylococcus aureus
GTSQGVYANGWMRTDLN

SEQ ID NO: 1580955 - protein, 24 aa, Staphylococcus aureus
GTTWSHLKWAIPLISIALIIILTI

SEQ ID NO: 1580956 - protein, 18 aa, Staphylococcus aureus
GVASDCWIAVIAGGSAFL

SEQ ID NO: 1580957 - protein, 18 aa, Staphylococcus aureus
GVGLFIHWIWPDLPIGAA

SEQ ID NO: 1580958 - protein, 22 aa, Staphylococcus aureus
GVGSYFIAFALFFFAFTTILSY

SEQ ID NO: 1580959 - protein, 18 aa, Staphylococcus aureus
GVMLRRYSHLFIVKYEYS

SEQ ID NO: 1580960 - protein, 26 aa, Staphylococcus aureus
GVSIQKLQLLGAMPRHVIEGFPTINW

SEQ ID NO: 1580961 - protein, 24 aa, Staphylococcus aureus
GVVFFLGDFIFKFTDWGITKATIV

SEQ ID NO: 1580962 - protein, 24 aa, Staphylococcus aureus
GVVMKYAYNWAFFNPIRKIYYNIT

SEQ ID NO: 1580963 - protein, 18 aa, Staphylococcus aureus
GVWWRELLAISIQLPLQV

SEQ ID NO: 1580964 - protein, 25 aa, Staphylococcus aureus
GWFSAFSFICLSIFIITTLIFIIIE

SEQ ID NO: 1580965 - protein, 17 aa, Staphylococcus aureus
GYASTLFSNAMVIGQLG

SEQ ID NO: 1580966 - protein, 22 aa, Staphylococcus aureus
GYENPDLGTFFLMDTTSRIIGH

SEQ ID NO: 1580967 - protein, 23 aa, Staphylococcus aureus
GYLVEYFNWRSLFHVVASIAAVT

SEQ ID NO: 1580968 - protein, 28 aa, Staphylococcus aureus
HAIFDVVPRIAFGSIVAYIIGQHIDVFI

SEQ ID NO: 1580969 - protein, 33 aa, Staphylococcus aureus
HAIRKKSIGVASVLVGTLIGFGLLSSKEADASE

SEQ ID NO: 1580970 - protein, 18 aa, Staphylococcus aureus
HEDYDYTLMVFAQPITNN

SEQ ID NO: 1580971 - protein, 21 aa, Staphylococcus aureus
HEFNLIKAIGVLLLIVGIITM

SEQ ID NO: 1580972 - protein, 19 aa, Staphylococcus aureus
HEVEQTIYVNPLKLNAKNT

SEQ ID NO: 1580973 - protein, 34 aa, Staphylococcus aureus
HFIFEVTDFAPLIAAIICIVIFKYKKVQLAGLKF

SEQ ID NO: 1580974 - protein, 24 aa, Staphylococcus aureus
HFVVFRLLPTLIMNFVLLIMLYPS

SEQ ID NO: 1580975 - protein, 20 aa, Staphylococcus aureus
HGITKIIIIFVMLCGKVGLL

SEQ ID NO: 1580976 - protein, 18 aa, Staphylococcus aureus
HGKFWNKWFYVRKWKHKI

SEQ ID NO: 1580977 - protein, 18 aa, Staphylococcus aureus
HIKIIYWLVLTAIFFIAN

SEQ ID NO: 1580978 - protein, 20 aa, Staphylococcus aureus
HIKWDKIFYGDDWVNNVVET

SEQ ID NO: 1580979 - protein, 24 aa, Staphylococcus aureus
HKDTEDFYITLKIIDVKQPEGDQR

SEQ ID NO: 1580980 - protein, 19 aa, Staphylococcus aureus
HKEKVMLLPTFNHFCFVLF

SEQ ID NO: 1580981 - protein, 17 aa, Staphylococcus aureus
HKLPLGLDFEDVELVSL

SEQ ID NO: 1580982 - protein, 18 aa, Staphylococcus aureus
HLIFWLLLGFTFGFFPPI

SEQ ID NO: 1580983 - protein, 34 aa, Staphylococcus aureus
HLLYNTCEKYCLGAVFFYFWGVFLYNSLHKCKGF

SEQ ID NO: 1580984 - protein, 17 aa, Staphylococcus aureus
HMIPEVVGNLLLSAAIF

SEQ ID NO: 1580985 - protein, 24 aa, Staphylococcus aureus
HNAEAPKVRKARSVDEGSFDITRD

SEQ ID NO: 1580986 - protein, 25 aa, Staphylococcus aureus
HNIIIELILSFGLLGVFIIMICILL

SEQ ID NO: 1580987 - protein, 20 aa, Staphylococcus aureus
HPFDYKGMSIFAVMIGSFTL

SEQ ID NO: 1580988 - protein, 18 aa, Staphylococcus aureus
HPPMIVHYFFDLMVTMGI

SEQ ID NO: 1580989 - protein, 19 aa, Staphylococcus aureus
HQTQIIKILSKVKPDPPRI

SEQ ID NO: 1580990 - protein, 22 aa, Staphylococcus aureus
HRWLNRLIVVILMFLNGFGIYI

SEQ ID NO: 1580991 - protein, 19 aa, Staphylococcus aureus
HSFGYEPQEGPGLLFKVLP

SEQ ID NO: 1580992 - protein, 24 aa, Staphylococcus aureus
HSHFPNFGGGVLGFYLLELSVPLI

SEQ ID NO: 1580993 - protein, 19 aa, Staphylococcus aureus
HVQWAMLVAAFIVGIALFF

SEQ ID NO: 1580994 - protein, 22 aa, Staphylococcus aureus
IAAFIGVVVYLWKTNETFRKNM

SEQ ID NO: 1580995 - protein, 21 aa, Staphylococcus aureus
IACYFRFIHVRSFRENKKSGQ

SEQ ID NO: 1580996 - protein, 17 aa, Staphylococcus aureus
IAGCGKGNKVKEDSKET

SEQ ID NO: 1580997 - protein, 20 aa, Staphylococcus aureus
IAIRLKDQFETISIGTYDIT

SEQ ID NO: 1580998 - protein, 17 aa, Staphylococcus aureus
IALVIFAIIGKFIVTPY

SEQ ID NO: 1580999 - protein, 20 aa, Staphylococcus aureus
IANGIPTPVLTPDTVTQAVT

SEQ ID NO: 1581000 - protein, 26 aa, Staphylococcus aureus
IARHKTSEELVRWQTYMETLSENLYK

SEQ ID NO: 1581001 - protein, 21 aa, Staphylococcus aureus
IASVVPVVFALLNAIKVLTGG

SEQ ID NO: 1581002 - protein, 20 aa, Staphylococcus aureus
IATIICIYILIKQLFESKDG

SEQ ID NO: 1581003 - protein, 17 aa, Staphylococcus aureus
IAVGVLVTGAFSLVDAV

SEQ ID NO: 1581004 - protein, 21 aa, Staphylococcus aureus
IAVLMDRIMESFGLSGKSFIP

SEQ ID NO: 1581005 - protein, 24 aa, Staphylococcus aureus
IDFGNADSAYVVMVNTKFQYTTSE

SEQ ID NO: 1581006 - protein, 17 aa, Staphylococcus aureus
IDHMMIAVGVIKQMNIE

SEQ ID NO: 1581007 - protein, 17 aa, Staphylococcus aureus
IDLILSIVLLFLTLPIM

SEQ ID NO: 1581008 - protein, 22 aa, Staphylococcus aureus
IDNHQIIWVMLNYEFNEPRPTI

SEQ ID NO: 1581009 - protein, 19 aa, Staphylococcus aureus
IDNMFFNYLNAEHPIGLAL

SEQ ID NO: 1581010 - protein, 18 aa, Staphylococcus aureus
IDNMFFNYLNAEHPIGLV

SEQ ID NO: 1581011 - protein, 24 aa, Staphylococcus aureus
IDPLHMRHFSNNFGNVIKNAIGVV

SEQ ID NO: 1581012 - protein, 43 aa, Staphylococcus aureus
IDPNSKGDLALRSTLYGYNSNIIWRSMSWDNEVAFNNGSGSGD

SEQ ID NO: 1581013 - protein, 26 aa, Staphylococcus aureus
IDSQLLKGHVYNGISGGQFKDSPPME

SEQ ID NO: 1581014 - protein, 18 aa, Staphylococcus aureus
IEHAKAQLAQALQDIKDL

SEQ ID NO: 1581015 - protein, 17 aa, Staphylococcus aureus
IEINEKVKAVAPTKQKQ

SEQ ID NO: 1581016 - protein, 18 aa, Staphylococcus aureus
IEIWPYVEGQIQTKDGAL

SEQ ID NO: 1581017 - protein, 26 aa, Staphylococcus aureus
IESILICVTSGFIGLILGVVFATIID

SEQ ID NO: 1581018 - protein, 22 aa, Staphylococcus aureus
IESRAAEPRSVSDYQNANSSYY

SEQ ID NO: 1581019 - protein, 23 aa, Staphylococcus aureus
IFDVVPRIALGSIVAYIIGQHID

SEQ ID NO: 1581020 - protein, 18 aa, Staphylococcus aureus
IFEYKVSKNMGFEVYYLA

SEQ ID NO: 1581021 - protein, 18 aa, Staphylococcus aureus
IFFAILTITGFREVIINA

SEQ ID NO: 1581022 - protein, 17 aa, Staphylococcus aureus
IFFIIVALFLMLFNYYT

SEQ ID NO: 1581023 - protein, 25 aa, Staphylococcus aureus
IFHNIHLKIIYWLILTSIFFIANIL

SEQ ID NO: 1581024 - protein, 20 aa, Staphylococcus aureus
IGARLFYSIVSFIVNLFRAI

SEQ ID NO: 1581025 - protein, 19 aa, Staphylococcus aureus
IGELKNIFVDKVETIELPL

SEQ ID NO: 1581026 - protein, 21 aa, Staphylococcus aureus
IGKNELTGALQLKNKVSFKND

SEQ ID NO: 1581027 - protein, 19 aa, Staphylococcus aureus
IGLMIPLLILISIVVFSLA

SEQ ID NO: 1581028 - protein, 26 aa, Staphylococcus aureus
IGMFCLCLTFIPKFGIGKGLFLSLFT

SEQ ID NO: 1581029 - protein, 40 aa, Staphylococcus aureus
IGVKLKLAKVIIILCVVAFFTFPVIVMFLLAPDLNKGKDD

SEQ ID NO: 1581030 - protein, 23 aa, Staphylococcus aureus
IGWSEWKVVTVFWAVGLISGLIG

SEQ ID NO: 1581031 - protein, 23 aa, Staphylococcus aureus
IGWSEWKVVTVFWAVGLNSGLIG

SEQ ID NO: 1581032 - protein, 25 aa, Staphylococcus aureus
IGWYGFNVGSAFTFDNIAMLAFANT

SEQ ID NO: 1581033 - protein, 18 aa, Staphylococcus aureus
IHEEHKLPLGLDFEDVEL

SEQ ID NO: 1581034 - protein, 18 aa, Staphylococcus aureus
IIGVIGILGGVFWALMAP

SEQ ID NO: 1581035 - protein, 17 aa, Staphylococcus aureus
IIIGCYYLYRLIFTYKY

SEQ ID NO: 1581036 - protein, 28 aa, Staphylococcus aureus
IIISFGIKLPVLIAFVLILAGLSFGYIY

SEQ ID NO: 1581037 - protein, 26 aa, Staphylococcus aureus
IIIVLLLIGGIAWGVYAFFANTPKNT

SEQ ID NO: 1581038 - protein, 19 aa, Staphylococcus aureus
IIPAIIVVMVIDFGKIILY

SEQ ID NO: 1581039 - protein, 18 aa, Staphylococcus aureus
IISIAIALVIFAIIGKFI

SEQ ID NO: 1581040 - protein, 18 aa, Staphylococcus aureus
IIVSAFSKVVTWVTKLPT

SEQ ID NO: 1581041 - protein, 21 aa, Staphylococcus aureus
IIVVMVIDFGKIILYISSLSF

SEQ ID NO: 1581042 - protein, 22 aa, Staphylococcus aureus
IKAMFKKWTLMADRMMDGDTVG

SEQ ID NO: 1581043 - protein, 19 aa, Staphylococcus aureus
IKDLVKAKENAKQDVDKQV

SEQ ID NO: 1581044 - protein, 19 aa, Staphylococcus aureus
IKFNKRVAYFLGVLSGVFY

SEQ ID NO: 1581045 - protein, 19 aa, Staphylococcus aureus
IKHADGFKHPGEWKNQDLG

SEQ ID NO: 1581046 - protein, 21 aa, Staphylococcus aureus
IKIKNAVKMASEFARNNPFKK

SEQ ID NO: 1581047 - protein, 17 aa, Staphylococcus aureus
IKKAYVVSGDLDEQNDL

SEQ ID NO: 1581048 - protein, 17 aa, Staphylococcus aureus
IKLANSFIDPDSQNAYF

SEQ ID NO: 1581049 - protein, 17 aa, Staphylococcus aureus
IKNPYLSTSTHRIKEEN

SEQ ID NO: 1581050 - protein, 22 aa, Staphylococcus aureus
IKSLWMKPKLVNYIIAKEIGES

SEQ ID NO: 1581051 - protein, 27 aa, Staphylococcus aureus
IKTALKRLPWLIILTFLGMVTATILGR

SEQ ID NO: 1581052 - protein, 19 aa, Staphylococcus aureus
IKYLSLTQRKLFLFTKSTY

SEQ ID NO: 1581053 - protein, 17 aa, Staphylococcus aureus
ILAVVAVIGVFIGILVY

SEQ ID NO: 1581054 - protein, 32 aa, Staphylococcus aureus
ILGDKGLVNSGGFKIDTGYIYTSSMDKTEKQA

SEQ ID NO: 1581055 - protein, 25 aa, Staphylococcus aureus
ILGLIKFFSSLFVGDWRGVWDGIVM

SEQ ID NO: 1581056 - protein, 18 aa, Staphylococcus aureus
ILGPGIGGFMAEVSHRMP

SEQ ID NO: 1581057 - protein, 17 aa, Staphylococcus aureus
ILIPTFKLGCFLVFGYI

SEQ ID NO: 1581058 - protein, 43 aa, Staphylococcus aureus
ILIVFAVLFRFIVRLIPIFYIFRVLSIFIFIMGFKMLGVSIQK

SEQ ID NO: 1581059 - protein, 17 aa, Staphylococcus aureus
ILLSVFLIFNFVNSILF

SEQ ID NO: 1581060 - protein, 23 aa, Staphylococcus aureus
ILRAQEMNFPISIEIPDEVSSIN

SEQ ID NO: 1581061 - protein, 19 aa, Staphylococcus aureus
ILSLFGITALLLVVALPIY

SEQ ID NO: 1581062 - protein, 19 aa, Staphylococcus aureus
ILTIVEWVILVKIFNRKIP

SEQ ID NO: 1581063 - protein, 24 aa, Staphylococcus aureus
ILYMGSLFYAWMAFRNLWNRPLLL

SEQ ID NO: 1581064 - protein, 17 aa, Staphylococcus aureus
IMAMLIYLLSLFTSIIG

SEQ ID NO: 1581065 - protein, 35 aa, Staphylococcus aureus
IMFLQIVTFAGIYFKLGDLMSLFSLQSNDSQNMGR

SEQ ID NO: 1581066 - protein, 19 aa, Staphylococcus aureus
IMLIILISVAGIHFKMKYD

SEQ ID NO: 1581067 - protein, 18 aa, Staphylococcus aureus
IMLIILISVAGIYFKMKY

SEQ ID NO: 1581068 - protein, 18 aa, Staphylococcus aureus
IMVSMLFTLLIVPWLSSK

SEQ ID NO: 1581069 - protein, 17 aa, Staphylococcus aureus
INAASNIAGVNTVKQQG

SEQ ID NO: 1581070 - protein, 23 aa, Staphylococcus aureus
INGQFSLPLFTDRAKAPKSGTYD

SEQ ID NO: 1581071 - protein, 17 aa, Staphylococcus aureus
INIDINFTYLLALSIIG

SEQ ID NO: 1581072 - protein, 17 aa, Staphylococcus aureus
INKTYVVLVEGHYDNTG

SEQ ID NO: 1581073 - protein, 18 aa, Staphylococcus aureus
INKTYVVLVEGHYDNTGK

SEQ ID NO: 1581074 - protein, 19 aa, Staphylococcus aureus
INMKTRIAMFLYDKSEVSN

SEQ ID NO: 1581075 - protein, 20 aa, Staphylococcus aureus
IPDATITWVSGQAPNKNNTT

SEQ ID NO: 1581076 - protein, 21 aa, Staphylococcus aureus
IPEASRLVLQAGALAEGGEVF

SEQ ID NO: 1581077 - protein, 40 aa, Staphylococcus aureus
IPEVVGNLLLSAAIFLYIMLIDWRMACALLVTIPIALFAF

SEQ ID NO: 1581078 - protein, 24 aa, Staphylococcus aureus
IPFLLIFIVDGFRGVKETLPAILV

SEQ ID NO: 1581079 - protein, 17 aa, Staphylococcus aureus
IPIIIVLLLIGGIAWGV

SEQ ID NO: 1581080 - protein, 18 aa, Staphylococcus aureus
IPMLNWGVPKKFAKISQS

SEQ ID NO: 1581081 - protein, 22 aa, Staphylococcus aureus
IPQGYGSYNSFSINYKTKITNE

SEQ ID NO: 1581082 - protein, 19 aa, Staphylococcus aureus
IPSRFILNIVRTIPDLLLA

SEQ ID NO: 1581083 - protein, 23 aa, Staphylococcus aureus
IPTFARKRLFGHQSMVWATAGIA

SEQ ID NO: 1581084 - protein, 18 aa, Staphylococcus aureus
IQLTLSFTMIGLALGQFI

SEQ ID NO: 1581085 - protein, 28 aa, Staphylococcus aureus
IQNATGLPTDGFTYKWNNAATGTNDANW

SEQ ID NO: 1581086 - protein, 17 aa, Staphylococcus aureus
IQPRTPQGFEMLFNNFS

SEQ ID NO: 1581087 - protein, 19 aa, Staphylococcus aureus
IQQELIRLTSHPKARTIVT

SEQ ID NO: 1581088 - protein, 17 aa, Staphylococcus aureus
IRKDGMLLFNLHQGALL

SEQ ID NO: 1581089 - protein, 17 aa, Staphylococcus aureus
ISAFIFNMYHRAWEYAS

SEQ ID NO: 1581090 - protein, 17 aa, Staphylococcus aureus
ISDSLTAKVEVTLLDGS

SEQ ID NO: 1581091 - protein, 25 aa, Staphylococcus aureus
ISFAKRVFTALGIGIVFGVLLHLAY

SEQ ID NO: 1581092 - protein, 21 aa, Staphylococcus aureus
ISLFFPFINWFIPKRYVKISR

SEQ ID NO: 1581093 - protein, 24 aa, Staphylococcus aureus
ISTSESLSMSGSTHNSTSVSDSDS

SEQ ID NO: 1581094 - protein, 17 aa, Staphylococcus aureus
ISTWISLFFPFINWFIP

SEQ ID NO: 1581095 - protein, 18 aa, Staphylococcus aureus
ITAWITAFLIKRPSRQRK

SEQ ID NO: 1581096 - protein, 17 aa, Staphylococcus aureus
ITEGIKDDGVIQAHDGE

SEQ ID NO: 1581097 - protein, 22 aa, Staphylococcus aureus
ITIQGKEHFEGYGSVDIQKKPT

SEQ ID NO: 1581098 - protein, 22 aa, Staphylococcus aureus
ITIQGKEHFEGYGSVDIQSNPE

SEQ ID NO: 1581099 - protein, 25 aa, Staphylococcus aureus
ITTPYIVVVNGHIDPASTGDLALRS

SEQ ID NO: 1581100 - protein, 25 aa, Staphylococcus aureus
IVIFIACAYVIYRRIEEVSEEVDEL

SEQ ID NO: 1581101 - protein, 22 aa, Staphylococcus aureus
IVISVICCLLITGILYYTLDGF

SEQ ID NO: 1581102 - protein, 19 aa, Staphylococcus aureus
IVLCMACNSLFKIEMRNKS

SEQ ID NO: 1581103 - protein, 20 aa, Staphylococcus aureus
IVLIVWNFSTGLTFTLDHWL

SEQ ID NO: 1581104 - protein, 17 aa, Staphylococcus aureus
IVLLRLFKINLLSFKKL

SEQ ID NO: 1581105 - protein, 19 aa, Staphylococcus aureus
IVQLIKFILGKFISSLGNS

SEQ ID NO: 1581106 - protein, 17 aa, Staphylococcus aureus
IVSQFGFDLKHKKDALA

SEQ ID NO: 1581107 - protein, 23 aa, Staphylococcus aureus
IVTKEAFPLLSVAIGSIITGIVW

SEQ ID NO: 1581108 - protein, 39 aa, Staphylococcus aureus
IVYLIVCLLISFLALISMNIRILSGFLFLISAIVTIPLV

SEQ ID NO: 1581109 - protein, 19 aa, Staphylococcus aureus
IWFILLGFMYLRYKRIAAN

SEQ ID NO: 1581110 - protein, 17 aa, Staphylococcus aureus
IYFSVVFVRMISINIAG

SEQ ID NO: 1581111 - protein, 29 aa, Staphylococcus aureus
IYGAVRELIPWSKLNQEISQWVQIVSISV

SEQ ID NO: 1581112 - protein, 17 aa, Staphylococcus aureus
IYGRRVAKRAVWLGFSS

SEQ ID NO: 1581113 - protein, 22 aa, Staphylococcus aureus
IYGRRVAKRAVWLGFSSTLIMI

SEQ ID NO: 1581114 - protein, 22 aa, Staphylococcus aureus
IYKLGLKQAKIAAVVQPISGIV

SEQ ID NO: 1581115 - protein, 19 aa, Staphylococcus aureus
IYQNLTLDSIVFRNTLRYA

SEQ ID NO: 1581116 - protein, 25 aa, Staphylococcus aureus
IYQVPKGYTLNKGYDVNTKELTDVT

SEQ ID NO: 1581117 - protein, 17 aa, Staphylococcus aureus
KAALLAVIASLLSFIIV

SEQ ID NO: 1581118 - protein, 18 aa, Staphylococcus aureus
KAALLSVIASLLSFIIVA

SEQ ID NO: 1581119 - protein, 19 aa, Staphylococcus aureus
KAAVTEFKNTFVPQNIRET

SEQ ID NO: 1581120 - protein, 25 aa, Staphylococcus aureus
KADVKSKINAASNIAGVNTVKQQGT

SEQ ID NO: 1581121 - protein, 25 aa, Staphylococcus aureus
KAGNVFPILSPILGWIGVFMTGSVV

SEQ ID NO: 1581122 - protein, 25 aa, Staphylococcus aureus
KAGNVFPVLSPILGWIGVFMTGSVV

SEQ ID NO: 1581123 - protein, 20 aa, Staphylococcus aureus
KAHKDGLKKIVLDLRNNPGG

SEQ ID NO: 1581124 - protein, 17 aa, Staphylococcus aureus
KALNRAMNQLSQEITGN

SEQ ID NO: 1581125 - protein, 24 aa, Staphylococcus aureus
KAQALDHAMELLRNSVADNQATLA

SEQ ID NO: 1581126 - protein, 24 aa, Staphylococcus aureus
KASEGHPEYFAYDGIHLEYAGSKA

SEQ ID NO: 1581127 - protein, 20 aa, Staphylococcus aureus
KATELNNAMHSLQNGINDET

SEQ ID NO: 1581128 - protein, 37 aa, Staphylococcus aureus
KDADNMTLDRGFYKTPKYSLGDYVWYDSNKDGKQDST

SEQ ID NO: 1581129 - protein, 20 aa, Staphylococcus aureus
KDLRAAYEHDITKSKQLTEE

SEQ ID NO: 1581130 - protein, 19 aa, Staphylococcus aureus
KDSKEPLPDTGSEGEANMS

SEQ ID NO: 1581131 - protein, 20 aa, Staphylococcus aureus
KDYSIFGWNNENVVRYGGGS

SEQ ID NO: 1581132 - protein, 34 aa, Staphylococcus aureus
KEGDTFTFKYGQYFRPGSVRLPSQTQNLYNAQGN

SEQ ID NO: 1581133 - protein, 26 aa, Staphylococcus aureus
KEKQALKYRINQILQQGHNDINNALT

SEQ ID NO: 1581134 - protein, 24 aa, Staphylococcus aureus
KELAKRKQEAISRIKDFSNEKINS

SEQ ID NO: 1581135 - protein, 22 aa, Staphylococcus aureus
KELKGAKFIILYAYSMLVLLAL

SEQ ID NO: 1581136 - protein, 19 aa, Staphylococcus aureus
KELWIKRANDSLVKHFYEQ

SEQ ID NO: 1581137 - protein, 21 aa, Staphylococcus aureus
KEQRFLTIYDFILNIIAMLSI

SEQ ID NO: 1581138 - protein, 20 aa, Staphylococcus aureus
KESYLSFTIILYIFGFAILI

SEQ ID NO: 1581139 - protein, 19 aa, Staphylococcus aureus
KETFVSTLTGYKFNPDAKN

SEQ ID NO: 1581140 - protein, 29 aa, Staphylococcus aureus
KFQWLQNWTIFYWAWWISWAPFVGIFIAR

SEQ ID NO: 1581141 - protein, 33 aa, Staphylococcus aureus
KFSIRKYTVGTFSTVIATLVFLGLNTSQAQAAE

SEQ ID NO: 1581142 - protein, 19 aa, Staphylococcus aureus
KFTHVAYVKPLNQFKLGTV

SEQ ID NO: 1581143 - protein, 22 aa, Staphylococcus aureus
KGESKWSFKKLFNYGIDGLISF

SEQ ID NO: 1581144 - protein, 20 aa, Staphylococcus aureus
KGFDFKGEFPKPDKSKYNGQ

SEQ ID NO: 1581145 - protein, 24 aa, Staphylococcus aureus
KGGIKEFKLDFANKNIIGKLGKLL

SEQ ID NO: 1581146 - protein, 18 aa, Staphylococcus aureus
KGIMPNWEPGKKVHLVGH

SEQ ID NO: 1581147 - protein, 19 aa, Staphylococcus aureus
KGRMARLVGMILISIVTFI

SEQ ID NO: 1581148 - protein, 29 aa, Staphylococcus aureus
KGSIEGTKHLPLLFAKRRRKEDEEDVEVT

SEQ ID NO: 1581149 - protein, 23 aa, Staphylococcus aureus
KIENFKFLGQYADFKDLKNYKNG

SEQ ID NO: 1581150 - protein, 19 aa, Staphylococcus aureus
KIIKRFKKGVISVNDVMFS

SEQ ID NO: 1581151 - protein, 26 aa, Staphylococcus aureus
KILIVLCFIGFIGIAAFYIYLNKKLK

SEQ ID NO: 1581152 - protein, 23 aa, Staphylococcus aureus
KILKQFFCFTFSKYLYRHIYDTL

SEQ ID NO: 1581153 - protein, 23 aa, Staphylococcus aureus
KKAFINHIMTWVSFFIGRLAFIF

SEQ ID NO: 1581154 - protein, 19 aa, Staphylococcus aureus
KKIIVCSQIGQSIFMFILL

SEQ ID NO: 1581155 - protein, 18 aa, Staphylococcus aureus
KKILKYVCFSGFIAAILL

SEQ ID NO: 1581156 - protein, 22 aa, Staphylococcus aureus
KKIPEYILSFIYALMYWATIPF

SEQ ID NO: 1581157 - protein, 17 aa, Staphylococcus aureus
KKIYARFLVVINVLTTI

SEQ ID NO: 1581158 - protein, 18 aa, Staphylococcus aureus
KKLHAILLEGTRGKEKNP

SEQ ID NO: 1581159 - protein, 20 aa, Staphylococcus aureus
KKNHPIQCHDCCRCDLSRRC

SEQ ID NO: 1581160 - protein, 23 aa, Staphylococcus aureus
KKVMRLSAVLFWIPIALVLLIAF

SEQ ID NO: 1581161 - protein, 17 aa, Staphylococcus aureus
KLFKLSWIVLAVLLVGY

SEQ ID NO: 1581162 - protein, 18 aa, Staphylococcus aureus
KLHFCVEKINQLTDLNSA

SEQ ID NO: 1581163 - protein, 24 aa, Staphylococcus aureus
KLIFLACTLFGLVVLIALLTQTLI

SEQ ID NO: 1581164 - protein, 23 aa, Staphylococcus aureus
KLKCFKPQLIKFVLQGEKRGKLE

SEQ ID NO: 1581165 - protein, 20 aa, Staphylococcus aureus
KLKLELLPNVQNPVISVTTS

SEQ ID NO: 1581166 - protein, 19 aa, Staphylococcus aureus
KLNGMYCISIFVLTRLLSL

SEQ ID NO: 1581167 - protein, 35 aa, Staphylococcus aureus
KLQQAARTGSPIRLMIGFDYPDAFGNGETLVPVNL

SEQ ID NO: 1581168 - protein, 18 aa, Staphylococcus aureus
KMASEFARNNPFKKGNLV

SEQ ID NO: 1581169 - protein, 24 aa, Staphylococcus aureus
KMKPHQFEQLFLIFIDNAIKYDVK

SEQ ID NO: 1581170 - protein, 36 aa, Staphylococcus aureus
KNAIGVVGISGLLASFWFFIAKRRRKEDEEEELEIR

SEQ ID NO: 1581171 - protein, 37 aa, Staphylococcus aureus
KNALGVVGISGLLASFWFFIAKRRRKEDEEEELEIRD

SEQ ID NO: 1581172 - protein, 19 aa, Staphylococcus aureus
KNHPIQCNDCCRCDLSRRC

SEQ ID NO: 1581173 - protein, 26 aa, Staphylococcus aureus
KNIRDIKMWILGLIGTIFSTIVIALL

SEQ ID NO: 1581174 - protein, 23 aa, Staphylococcus aureus
KNKFTAQCKLAYSFIATIATIFA

SEQ ID NO: 1581175 - protein, 19 aa, Staphylococcus aureus
KNKGFKIGDTLTLSQSDEK

SEQ ID NO: 1581176 - protein, 22 aa, Staphylococcus aureus
KNKVSFKNDFEFNIRVANNHQS

SEQ ID NO: 1581177 - protein, 17 aa, Staphylococcus aureus
KNSRMSWNHNHYPFDSW

SEQ ID NO: 1581178 - protein, 17 aa, Staphylococcus aureus
KNSTYMLKIYMANTPRL

SEQ ID NO: 1581179 - protein, 21 aa, Staphylococcus aureus
KNVQIAFQIVIAIVIIVVNTV

SEQ ID NO: 1581180 - protein, 26 aa, Staphylococcus aureus
KPDEKLYKIGDYVWEDVDKDGVQGTD

SEQ ID NO: 1581181 - protein, 18 aa, Staphylococcus aureus
KPNTAQVINAKYDVIYNG

SEQ ID NO: 1581182 - protein, 19 aa, Staphylococcus aureus
KPPKRSLYALIMTLCGVHG

SEQ ID NO: 1581183 - protein, 19 aa, Staphylococcus aureus
KPTDLGVSEVTRFNVGNES

SEQ ID NO: 1581184 - protein, 24 aa, Staphylococcus aureus
KQAIAGLTPDLAPLQAAKTQLQND

SEQ ID NO: 1581185 - protein, 21 aa, Staphylococcus aureus
KQHAVTDLNQLNGLNNPQRQA

SEQ ID NO: 1581186 - protein, 27 aa, Staphylococcus aureus
KQIKDKRLPQVINEAVEILKHLTDGRY

SEQ ID NO: 1581187 - protein, 21 aa, Staphylococcus aureus
KQITYTFTDYVDKYEDIKARL

SEQ ID NO: 1581188 - protein, 22 aa, Staphylococcus aureus
KQKEAKFENGVITRKADEKTTD

SEQ ID NO: 1581189 - protein, 31 aa, Staphylococcus aureus
KQNINGKFSLPLFTDRAKAPKSGTYDANINI

SEQ ID NO: 1581190 - protein, 25 aa, Staphylococcus aureus
KQSRIELFTTDGLQVIGNISTISKK

SEQ ID NO: 1581191 - protein, 42 aa, Staphylococcus aureus
KQTGDGYQWVIKFNKGHAPHENMIYWFALPAGQTPVGRTEFV

SEQ ID NO: 1581192 - protein, 24 aa, Staphylococcus aureus
KQVFWRILLFYILAIFVIGMLIPY

SEQ ID NO: 1581193 - protein, 26 aa, Staphylococcus aureus
KRAGFHELFFDLIFVYAIQKIAHVIL

SEQ ID NO: 1581194 - protein, 19 aa, Staphylococcus aureus
KRFEREVHNSSQLSHQNIV

SEQ ID NO: 1581195 - protein, 18 aa, Staphylococcus aureus
KRKKSAISKIKDISTDEI

SEQ ID NO: 1581196 - protein, 24 aa, Staphylococcus aureus
KRLVPIMTAFYCTFLVVILLFLWP

SEQ ID NO: 1581197 - protein, 22 aa, Staphylococcus aureus
KRPEKVSINLLANGEKVKTLDV

SEQ ID NO: 1581198 - protein, 21 aa, Staphylococcus aureus
KRSDYIKSYFAFYLILFGASL

SEQ ID NO: 1581199 - protein, 19 aa, Staphylococcus aureus
KRVAYFLGVLSGVFYIGIV

SEQ ID NO: 1581200 - protein, 19 aa, Staphylococcus aureus
KRYFNYMLNYKVWYLTLLA

SEQ ID NO: 1581201 - protein, 21 aa, Staphylococcus aureus
KSASMGNALGFTNNQSGGAGQ

SEQ ID NO: 1581202 - protein, 21 aa, Staphylococcus aureus
KSGKQLARMSVPKGSAHEKQL

SEQ ID NO: 1581203 - protein, 27 aa, Staphylococcus aureus
KSKALRWQKWHAMIGIIIAIPVFVLVL

SEQ ID NO: 1581204 - protein, 17 aa, Staphylococcus aureus
KSLSSSQSMSGSESTST

SEQ ID NO: 1581205 - protein, 18 aa, Staphylococcus aureus
KTGIAIILAMYIASLLPD

SEQ ID NO: 1581206 - protein, 19 aa, Staphylococcus aureus
KTKAQDLDGAMQRLQSAIA

SEQ ID NO: 1581207 - protein, 22 aa, Staphylococcus aureus
KTKRFPLYILMFEQIISILWVY

SEQ ID NO: 1581208 - protein, 21 aa, Staphylococcus aureus
KTWIGIPLWVHRRCLKPMFTI

SEQ ID NO: 1581209 - protein, 18 aa, Staphylococcus aureus
KVAIKAIFIPPREKEETL

SEQ ID NO: 1581210 - protein, 19 aa, Staphylococcus aureus
KVDLDGSGFNRGVTGLNRQ

SEQ ID NO: 1581211 - protein, 17 aa, Staphylococcus aureus
KVGPRLGANKVVAGNTI

SEQ ID NO: 1581212 - protein, 18 aa, Staphylococcus aureus
KVIFDKRIKDEEDVEKEL

SEQ ID NO: 1581213 - protein, 19 aa, Staphylococcus aureus
KVMTVKYAGQTWTRNISDW

SEQ ID NO: 1581214 - protein, 18 aa, Staphylococcus aureus
KVQGNAIAKAEAEQLKQN

SEQ ID NO: 1581215 - protein, 31 aa, Staphylococcus aureus
KVTILLFISLIVAVAFFFGLKTYQGHKNIQL

SEQ ID NO: 1581216 - protein, 21 aa, Staphylococcus aureus
KVVVANIGYEGQYHVRIINQD

SEQ ID NO: 1581217 - protein, 17 aa, Staphylococcus aureus
KWTALAVAYPLVTAYVL

SEQ ID NO: 1581218 - protein, 26 aa, Staphylococcus aureus
KYEDIKARLTLYSYIDKQAVPNETSL

SEQ ID NO: 1581219 - protein, 17 aa, Staphylococcus aureus
KYKRPVIDVIEERIPNT

SEQ ID NO: 1581220 - protein, 25 aa, Staphylococcus aureus
KYSIRRFTVGTTSVIVGATILFGIG

SEQ ID NO: 1581221 - protein, 26 aa, Staphylococcus aureus
KYSIRRFTVGTTSVIVGATILFGIGN

SEQ ID NO: 1581222 - protein, 20 aa, Staphylococcus aureus
LAAIIWNLATWFYGIPSSSS

SEQ ID NO: 1581223 - protein, 24 aa, Staphylococcus aureus
LADKAIEVITQFVAQNRGKFSDDT

SEQ ID NO: 1581224 - protein, 22 aa, Staphylococcus aureus
LAEAKAAAKQNLGTLNHITNAQ

SEQ ID NO: 1581225 - protein, 26 aa, Staphylococcus aureus
LAGAFEMIGSLLLFTSIFGKLGKKLV

SEQ ID NO: 1581226 - protein, 24 aa, Staphylococcus aureus
LAIGALYLPIIFKVIKLQLNLSKG

SEQ ID NO: 1581227 - protein, 20 aa, Staphylococcus aureus
LAPLFQWSADWLDRLGQSFS

SEQ ID NO: 1581228 - protein, 20 aa, Staphylococcus aureus
LASIGSLLLFRRKKENKDKK

SEQ ID NO: 1581229 - protein, 23 aa, Staphylococcus aureus
LAVIPVIVCLIIFKDNAAKIEQL

SEQ ID NO: 1581230 - protein, 21 aa, Staphylococcus aureus
LCPNCQYIFSPSLWAVIKAKH

SEQ ID NO: 1581231 - protein, 25 aa, Staphylococcus aureus
LDINTASTWKKFEVYENNQKLPVRL

SEQ ID NO: 1581232 - protein, 18 aa, Staphylococcus aureus
LDIWTLFAYFKPHLLYLL

SEQ ID NO: 1581233 - protein, 18 aa, Staphylococcus aureus
LDNAMGAVQQYIDEQHLG

SEQ ID NO: 1581234 - protein, 27 aa, Staphylococcus aureus
LEAATHCVTRLRLVLKDESKVDKDALS

SEQ ID NO: 1581235 - protein, 22 aa, Staphylococcus aureus
LEELEKMLIQLSIFHSYHDLEF

SEQ ID NO: 1581236 - protein, 22 aa, Staphylococcus aureus
LENRKKAAISKIKDISTDKIDR

SEQ ID NO: 1581237 - protein, 27 aa, Staphylococcus aureus
LEQFKAQLKAANPFAKELKNRKKAAIS

SEQ ID NO: 1581238 - protein, 25 aa, Staphylococcus aureus
LFFMRLAKIQLWFLIKGLTPIFFFL

SEQ ID NO: 1581239 - protein, 17 aa, Staphylococcus aureus
LFFTVPMFLLFVYLPNY

SEQ ID NO: 1581240 - protein, 17 aa, Staphylococcus aureus
LFGIIFAVLTLVFVIGI

SEQ ID NO: 1581241 - protein, 17 aa, Staphylococcus aureus
LFHASGIIAAVVAGLVH

SEQ ID NO: 1581242 - protein, 23 aa, Staphylococcus aureus
LFLICSFGVLIGLYQYRHAKTVD

SEQ ID NO: 1581243 - protein, 17 aa, Staphylococcus aureus
LFTYKWALGVTAVVDQN

SEQ ID NO: 1581244 - protein, 20 aa, Staphylococcus aureus
LFVMYKKRAQIINFVSRGNI

SEQ ID NO: 1581245 - protein, 18 aa, Staphylococcus aureus
LFWEILDNYISIVGSVII

SEQ ID NO: 1581246 - protein, 17 aa, Staphylococcus aureus
LGDHSWFYLPITYATRY

SEQ ID NO: 1581247 - protein, 32 aa, Staphylococcus aureus
LGDKGLVNSGGFKIDTGYIYTSSMDKTEKQAG

SEQ ID NO: 1581248 - protein, 18 aa, Staphylococcus aureus
LGETGLNGAAVGIGGLSN

SEQ ID NO: 1581249 - protein, 25 aa, Staphylococcus aureus
LGIGGAVYGIGSFLYYRKIKFYMFI

SEQ ID NO: 1581250 - protein, 19 aa, Staphylococcus aureus
LGIVFAMLITITFAFVFNT

SEQ ID NO: 1581251 - protein, 25 aa, Staphylococcus aureus
LGLDDIRNTHVWEVDAQPAVNEIFD

SEQ ID NO: 1581252 - protein, 18 aa, Staphylococcus aureus
LGLIPIYLGIKVTIYDDC

SEQ ID NO: 1581253 - protein, 28 aa, Staphylococcus aureus
LGLNMTFNYCKKRVWTYDMDRMDQVLTN

SEQ ID NO: 1581254 - protein, 20 aa, Staphylococcus aureus
LGPKGMENSAGFKIDTGYNF

SEQ ID NO: 1581255 - protein, 18 aa, Staphylococcus aureus
LGVPEGIANFAATFGLSI

SEQ ID NO: 1581256 - protein, 17 aa, Staphylococcus aureus
LIAFLAFLYFSVMKHNE

SEQ ID NO: 1581257 - protein, 18 aa, Staphylococcus aureus
LIAFLAFLYFSVMKHNER

SEQ ID NO: 1581258 - protein, 26 aa, Staphylococcus aureus
LIAIGYKFLSKRSMYLTIPVTILISI

SEQ ID NO: 1581259 - protein, 23 aa, Staphylococcus aureus
LIFLACTLLGLVVLIALLTQTLI

SEQ ID NO: 1581260 - protein, 18 aa, Staphylococcus aureus
LIFSLLCAQRILLSEKII

SEQ ID NO: 1581261 - protein, 22 aa, Staphylococcus aureus
LIIGFGLCFPYVLLPYGFGQIF

SEQ ID NO: 1581262 - protein, 19 aa, Staphylococcus aureus
LILVVTIVFGGPRLGTSFI

SEQ ID NO: 1581263 - protein, 20 aa, Staphylococcus aureus
LILVVTIVFGGPRLGTSFIS

SEQ ID NO: 1581264 - protein, 17 aa, Staphylococcus aureus
LIPFIPIKFSFIKLNNV

SEQ ID NO: 1581265 - protein, 19 aa, Staphylococcus aureus
LIPLYAVGVFIPFTLAQFG

SEQ ID NO: 1581266 - protein, 23 aa, Staphylococcus aureus
LISVFKLGVPMLTIIMLMLSGFD

SEQ ID NO: 1581267 - protein, 18 aa, Staphylococcus aureus
LIVSRYLYSVALNVPSKI

SEQ ID NO: 1581268 - protein, 25 aa, Staphylococcus aureus
LKDLARASDYFSEAGATPATKAFGR

SEQ ID NO: 1581269 - protein, 20 aa, Staphylococcus aureus
LKFSIQRQHYVLKRMLIEDQ

SEQ ID NO: 1581270 - protein, 22 aa, Staphylococcus aureus
LKGSEFTFTPEAPKTITELEKK

SEQ ID NO: 1581271 - protein, 17 aa, Staphylococcus aureus
LKITIVLSVILETLYYY

SEQ ID NO: 1581272 - protein, 29 aa, Staphylococcus aureus
LKKQSKLILIFICIFTFFIMIIQSQFLMG

SEQ ID NO: 1581273 - protein, 25 aa, Staphylococcus aureus
LKLCIKPLWQYHCRFYKVDQLSVQY

SEQ ID NO: 1581274 - protein, 24 aa, Staphylococcus aureus
LKLGGKALKPLGFITAITDNIGKK

SEQ ID NO: 1581275 - protein, 18 aa, Staphylococcus aureus
LKLYPTKNLEDFYDKEGF

SEQ ID NO: 1581276 - protein, 18 aa, Staphylococcus aureus
LKNSQTLDLPQSSPQTIS

SEQ ID NO: 1581277 - protein, 19 aa, Staphylococcus aureus
LKPIKGDNIFVWQGDITTL

SEQ ID NO: 1581278 - protein, 17 aa, Staphylococcus aureus
LKQELKNTVTPTKVEEN

SEQ ID NO: 1581279 - protein, 19 aa, Staphylococcus aureus
LKQQAIEQINNAADVHTVE

SEQ ID NO: 1581280 - protein, 20 aa, Staphylococcus aureus
LKYVCFSGFIAAILLGMIYF

SEQ ID NO: 1581281 - protein, 21 aa, Staphylococcus aureus
LLASIGSLLLFRRKKENKDKK

SEQ ID NO: 1581282 - protein, 18 aa, Staphylococcus aureus
LLDWLKIANEYKIPTYVL

SEQ ID NO: 1581283 - protein, 19 aa, Staphylococcus aureus
LLFLIISAIVTFFVLSPKY

SEQ ID NO: 1581284 - protein, 19 aa, Staphylococcus aureus
LLFSVMGLWHVSNAAEQHT

SEQ ID NO: 1581285 - protein, 17 aa, Staphylococcus aureus
LLFWLLLGFIFGFFPPI

SEQ ID NO: 1581286 - protein, 23 aa, Staphylococcus aureus
LLIGMALVRFRLTLMRRGYENIN

SEQ ID NO: 1581287 - protein, 19 aa, Staphylococcus aureus
LLNLRVFKNRTFALCTISS

SEQ ID NO: 1581288 - protein, 21 aa, Staphylococcus aureus
LLPGSLLGSFISRYLTFESFN

SEQ ID NO: 1581289 - protein, 18 aa, Staphylococcus aureus
LLPLLKLVLVVVFAMLFF

SEQ ID NO: 1581290 - protein, 26 aa, Staphylococcus aureus
LLVAIGMGFVSWIKRTKNTAVKVTHR

SEQ ID NO: 1581291 - protein, 30 aa, Staphylococcus aureus
LMAITLCGFVICYGLIFGLFYLLSGSKVDY

SEQ ID NO: 1581292 - protein, 21 aa, Staphylococcus aureus
LMLDAGDAFQGLPLSNQSKGE

SEQ ID NO: 1581293 - protein, 20 aa, Staphylococcus aureus
LMPYGLCFLPFYKQKKKKQT

SEQ ID NO: 1581294 - protein, 20 aa, Staphylococcus aureus
LMYTCAYVLIRMFKNKPAYE

SEQ ID NO: 1581295 - protein, 19 aa, Staphylococcus aureus
LNFDFMRYSLISGILIGFI

SEQ ID NO: 1581296 - protein, 17 aa, Staphylococcus aureus
LNGVLIFKIELLIYYYV

SEQ ID NO: 1581297 - protein, 43 aa, Staphylococcus aureus
LNIIKANITFAIGIKIIALLLVIPGWLTLWIAILSDMGATILV

SEQ ID NO: 1581298 - protein, 17 aa, Staphylococcus aureus
LNKADFAVIKAYAKEHP

SEQ ID NO: 1581299 - protein, 24 aa, Staphylococcus aureus
LNNGIARILAVQIVTSDHSKPSSN

SEQ ID NO: 1581300 - protein, 20 aa, Staphylococcus aureus
LNSAMGNLRQAVADKEQVKR

SEQ ID NO: 1581301 - protein, 21 aa, Staphylococcus aureus
LNTAMKGLRDSIANEATIKAE

SEQ ID NO: 1581302 - protein, 22 aa, Staphylococcus aureus
LNTAMKGLRDSIANEATIKAGQ

SEQ ID NO: 1581303 - protein, 25 aa, Staphylococcus aureus
LNTARQGLTLDRQPAFTTLHGASNL

SEQ ID NO: 1581304 - protein, 18 aa, Staphylococcus aureus
LNYWSIKLLTSFTSLISV

SEQ ID NO: 1581305 - protein, 17 aa, Staphylococcus aureus
LPAILVVSITYTFTQGL

SEQ ID NO: 1581306 - protein, 25 aa, Staphylococcus aureus
LPDDIPPTINNPVGLNAKYYRGDEV

SEQ ID NO: 1581307 - protein, 25 aa, Staphylococcus aureus
LPIYLDVFLIFGVVISILMYIQEKS

SEQ ID NO: 1581308 - protein, 17 aa, Staphylococcus aureus
LPLGLDFEDVELVSLDL

SEQ ID NO: 1581309 - protein, 19 aa, Staphylococcus aureus
LPLILKFILNLALIGIVII

SEQ ID NO: 1581310 - protein, 18 aa, Staphylococcus aureus
LPMLIQLPIIMGLYFVLK

SEQ ID NO: 1581311 - protein, 17 aa, Staphylococcus aureus
LPNTYPFLLSLIIIIVT

SEQ ID NO: 1581312 - protein, 17 aa, Staphylococcus aureus
LPQSVYLDASDKNKYKD

SEQ ID NO: 1581313 - protein, 20 aa, Staphylococcus aureus
LPTNILMWFVSLVVFIIGFI

SEQ ID NO: 1581314 - protein, 19 aa, Staphylococcus aureus
LPYFLAGHHAFTYRNDLLF

SEQ ID NO: 1581315 - protein, 17 aa, Staphylococcus aureus
LQALIVSVGDLLILKAG

SEQ ID NO: 1581316 - protein, 27 aa, Staphylococcus aureus
LQDNEHSPVLIAKRLKDKDGNVETTTS

SEQ ID NO: 1581317 - protein, 17 aa, Staphylococcus aureus
LQMKKMMSFYGLTKNLG

SEQ ID NO: 1581318 - protein, 20 aa, Staphylococcus aureus
LQNIYLRVYYPPVVIGLTAL

SEQ ID NO: 1581319 - protein, 19 aa, Staphylococcus aureus
LQNIYLRVYYPPVVIGLTV

SEQ ID NO: 1581320 - protein, 19 aa, Staphylococcus aureus
LRGLWKQRVRWAQGGHEVL

SEQ ID NO: 1581321 - protein, 23 aa, Staphylococcus aureus
LRSYKELFLKATILNTTHLFRSG

SEQ ID NO: 1581322 - protein, 23 aa, Staphylococcus aureus
LRSYKELFLKATILNTTHLYRSG

SEQ ID NO: 1581323 - protein, 23 aa, Staphylococcus aureus
LRVAVAITGWIANLFEAHPATAQ

SEQ ID NO: 1581324 - protein, 21 aa, Staphylococcus aureus
LRYIHDIWGYIAPNTKKEKQP

SEQ ID NO: 1581325 - protein, 17 aa, Staphylococcus aureus
LSALFLYTFEYFIQLNK

SEQ ID NO: 1581326 - protein, 19 aa, Staphylococcus aureus
LSAYILWGILPIYWQFVDE

SEQ ID NO: 1581327 - protein, 17 aa, Staphylococcus aureus
LSFKFLKALLYLKYLKK

SEQ ID NO: 1581328 - protein, 19 aa, Staphylococcus aureus
LSGSISLSGSTSLSTSDSL

SEQ ID NO: 1581329 - protein, 32 aa, Staphylococcus aureus
LSIPLILKGKKGYKFSIFMGTFTKCIMVLILS

SEQ ID NO: 1581330 - protein, 23 aa, Staphylococcus aureus
LSNINMLLAFVVLIGLFIVGPTL

SEQ ID NO: 1581331 - protein, 25 aa, Staphylococcus aureus
LSSSALCGLFIQHLSTFNMKYYLIR

SEQ ID NO: 1581332 - protein, 24 aa, Staphylococcus aureus
LSTFKPGELDSVILNISMLLFLFI

SEQ ID NO: 1581333 - protein, 18 aa, Staphylococcus aureus
LSTGTLFVGLAAITSAGF

SEQ ID NO: 1581334 - protein, 23 aa, Staphylococcus aureus
LSTSISTSMSMSASKSTSQSTSV

SEQ ID NO: 1581335 - protein, 23 aa, Staphylococcus aureus
LSTSISTSMSMSASTSTSQSTSV

SEQ ID NO: 1581336 - protein, 22 aa, Staphylococcus aureus
LSVFLIFNFVNSILFDNPFDFL

SEQ ID NO: 1581337 - protein, 17 aa, Staphylococcus aureus
LSYSISMSDSTSTSDSD

SEQ ID NO: 1581338 - protein, 18 aa, Staphylococcus aureus
LTGLKLILLALFIMSIYL

SEQ ID NO: 1581339 - protein, 17 aa, Staphylococcus aureus
LTGYKFNPDAKNFKIYE

SEQ ID NO: 1581340 - protein, 24 aa, Staphylococcus aureus
LTHPLRGIIMLVVLIVFWIVGKKL

SEQ ID NO: 1581341 - protein, 18 aa, Staphylococcus aureus
LTLIFLILTFFKEVKLYR

SEQ ID NO: 1581342 - protein, 20 aa, Staphylococcus aureus
LTLLKATTTVPGLRNNIAGN

SEQ ID NO: 1581343 - protein, 19 aa, Staphylococcus aureus
LTLTTTFIALFSMLITILL

SEQ ID NO: 1581344 - protein, 17 aa, Staphylococcus aureus
LTSHRWLNRLIVVILMF

SEQ ID NO: 1581345 - protein, 17 aa, Staphylococcus aureus
LVFTVVFIFQFVSRIAD

SEQ ID NO: 1581346 - protein, 17 aa, Staphylococcus aureus
LVFVIGIIMSKSKEVDY

SEQ ID NO: 1581347 - protein, 25 aa, Staphylococcus aureus
LVILTVLVIIGFVLNMFVKHFKKER

SEQ ID NO: 1581348 - protein, 29 aa, Staphylococcus aureus
LVVMILCALAFICVIVFYFNLNRKLKLKV

SEQ ID NO: 1581349 - protein, 18 aa, Staphylococcus aureus
LYESNKYYPIYGSSELGK

SEQ ID NO: 1581350 - protein, 17 aa, Staphylococcus aureus
LYISIMVLSIFIIGCNS

SEQ ID NO: 1581351 - protein, 19 aa, Staphylococcus aureus
MAIMIPLALMFGKLADKIG

SEQ ID NO: 1581352 - protein, 29 aa, Staphylococcus aureus
MAITLCGFVICYGVIFGLFYLLSGSTADY

SEQ ID NO: 1581353 - protein, 18 aa, Staphylococcus aureus
MAKTDIPDEIKTEVTANI

SEQ ID NO: 1581354 - protein, 27 aa, Staphylococcus aureus
MATYIGWRSIFVVSILLTLLAMYLIKY

SEQ ID NO: 1581355 - protein, 29 aa, Staphylococcus aureus
MEGFLRLHIPNWLRRLITRSLAVIPVIVC

SEQ ID NO: 1581356 - protein, 25 aa, Staphylococcus aureus
MEGKEVRFGAGLSALFTVITTAFTT

SEQ ID NO: 1581357 - protein, 23 aa, Staphylococcus aureus
MFNNKITYNYSSPIAGIDKPNGA

SEQ ID NO: 1581358 - protein, 20 aa, Staphylococcus aureus
MFYKFRYILITLIILLLSIM

SEQ ID NO: 1581359 - protein, 17 aa, Staphylococcus aureus
MGIKGSFGLNQILGVFM

SEQ ID NO: 1581360 - protein, 24 aa, Staphylococcus aureus
MGMALAFGVLFDAFVVRMMLIPAL

SEQ ID NO: 1581361 - protein, 19 aa, Staphylococcus aureus
MIEYASLIGCIKRSQTLAG

SEQ ID NO: 1581362 - protein, 20 aa, Staphylococcus aureus
MIISDIVARIIIKPLELPIG

SEQ ID NO: 1581363 - protein, 17 aa, Staphylococcus aureus
MIITLCLLFFDDLIFIT

SEQ ID NO: 1581364 - protein, 17 aa, Staphylococcus aureus
MILKGTVQLIWNLIQLW

SEQ ID NO: 1581365 - protein, 17 aa, Staphylococcus aureus
MKFAHVMTPEMTQALIA

SEQ ID NO: 1581366 - protein, 17 aa, Staphylococcus aureus
MKQELRKSLTVAGLVLM

SEQ ID NO: 1581367 - protein, 19 aa, Staphylococcus aureus
MLFVSWFALFLFYKNEFDS

SEQ ID NO: 1581368 - protein, 20 aa, Staphylococcus aureus
MLFVSWFALFLFYKNEFDSE

SEQ ID NO: 1581369 - protein, 18 aa, Staphylococcus aureus
MLLSTSILILSSSSLGLA

SEQ ID NO: 1581370 - protein, 19 aa, Staphylococcus aureus
MLLSTSMLILSSSSSSLGL

SEQ ID NO: 1581371 - protein, 18 aa, Staphylococcus aureus
MMFISMMVLLVFALILLM

SEQ ID NO: 1581372 - protein, 25 aa, Staphylococcus aureus
MMLFISWLGLFLFYKNEFDSENPNK

SEQ ID NO: 1581373 - protein, 25 aa, Staphylococcus aureus
MMLFISWLGLFLFYKNKFDSENPNK

SEQ ID NO: 1581374 - protein, 18 aa, Staphylococcus aureus
MNWEAAFKVNERTLKMTD

SEQ ID NO: 1581375 - protein, 28 aa, Staphylococcus aureus
MPYLRLLFTIIFSLKCKIHLFFNSINAI

SEQ ID NO: 1581376 - protein, 17 aa, Staphylococcus aureus
MSNSMSLSTSESLSASM

SEQ ID NO: 1581377 - protein, 23 aa, Staphylococcus aureus
MTSKKRWTALVVLAVSLFVVTMD

SEQ ID NO: 1581378 - protein, 19 aa, Staphylococcus aureus
MVNNNAKIVWKQFALSVLI

SEQ ID NO: 1581379 - protein, 17 aa, Staphylococcus aureus
MYLTIPVTILISIFLSL

SEQ ID NO: 1581380 - protein, 18 aa, Staphylococcus aureus
NAFFSEIIKVMSRFIGDF

SEQ ID NO: 1581381 - protein, 21 aa, Staphylococcus aureus
NAICGIFALFIWVHLLCTILN

SEQ ID NO: 1581382 - protein, 18 aa, Staphylococcus aureus
NAYNQAVSNAETILNKQT

SEQ ID NO: 1581383 - protein, 27 aa, Staphylococcus aureus
NDFKMVFKAPRAVIVGVCLQFSIMPTL

SEQ ID NO: 1581384 - protein, 25 aa, Staphylococcus aureus
NDMKIAYAILRDRLNLSIKNNWVDE

SEQ ID NO: 1581385 - protein, 18 aa, Staphylococcus aureus
NEAMKMLHYAAAEVRGRK

SEQ ID NO: 1581386 - protein, 19 aa, Staphylococcus aureus
NEGMPFSGFHRHFLMPSII

SEQ ID NO: 1581387 - protein, 17 aa, Staphylococcus aureus
NEIPKAKIDANKDVDKQ

SEQ ID NO: 1581388 - protein, 28 aa, Staphylococcus aureus
NEKAQAEAGGRPNFRTTGYSQSNATTDG

SEQ ID NO: 1581389 - protein, 23 aa, Staphylococcus aureus
NEKAQAEAGGRPNYKTTGYSQSN

SEQ ID NO: 1581390 - protein, 27 aa, Staphylococcus aureus
NEKAQAEAGGRPNYRTTGYSQSNATTD

SEQ ID NO: 1581391 - protein, 23 aa, Staphylococcus aureus
NFDLKKIESRNCIVKGQFKVNDN

SEQ ID NO: 1581392 - protein, 18 aa, Staphylococcus aureus
NFGNVIKNAIGVVGISGL

SEQ ID NO: 1581393 - protein, 19 aa, Staphylococcus aureus
NFSEFPALGLVLAVMIGIG

SEQ ID NO: 1581394 - protein, 25 aa, Staphylococcus aureus
NGDTIKVAWPTSGTVKIEGYSKTVS

SEQ ID NO: 1581395 - protein, 23 aa, Staphylococcus aureus
NGIARISAVQIVISDRAKQSSST

SEQ ID NO: 1581396 - protein, 17 aa, Staphylococcus aureus
NGITAVWANRQQPNNQQ

SEQ ID NO: 1581397 - protein, 24 aa, Staphylococcus aureus
NGKKSLLKRRLINIKEANLKKQSK

SEQ ID NO: 1581398 - protein, 24 aa, Staphylococcus aureus
NGKKSLLKRRLINIKEGNLKKQSK

SEQ ID NO: 1581399 - protein, 28 aa, Staphylococcus aureus
NGKKVELGQAFIKRLANEKNYKFETVTR

SEQ ID NO: 1581400 - protein, 18 aa, Staphylococcus aureus
NGKYCFDNLDSGKYKVIF

SEQ ID NO: 1581401 - protein, 25 aa, Staphylococcus aureus
NHLLKANHFLQFFIILYTHRMIITL

SEQ ID NO: 1581402 - protein, 22 aa, Staphylococcus aureus
NHSGGSKNGGTWNPNASDGSNQ

SEQ ID NO: 1581403 - protein, 26 aa, Staphylococcus aureus
NIRDIKMWILGLIGTILSTFVIALLK

SEQ ID NO: 1581404 - protein, 21 aa, Staphylococcus aureus
NIRDIKMWILGLVGTIFSTIV

SEQ ID NO: 1581405 - protein, 20 aa, Staphylococcus aureus
NITHGSGFSSVVTVSDALPN

SEQ ID NO: 1581406 - protein, 18 aa, Staphylococcus aureus
NKDYLLYWMELGQVHLDE

SEQ ID NO: 1581407 - protein, 26 aa, Staphylococcus aureus
NKIINLFVCIALLVAIGMGFVSWIKR

SEQ ID NO: 1581408 - protein, 25 aa, Staphylococcus aureus
NKIVPAQDYLSLKSQITVDDKVKSG

SEQ ID NO: 1581409 - protein, 24 aa, Staphylococcus aureus
NLKVREIKGLITAKILRAQEMNFP

SEQ ID NO: 1581410 - protein, 19 aa, Staphylococcus aureus
NMYVAFSVYGMMVTYGFNL

SEQ ID NO: 1581411 - protein, 19 aa, Staphylococcus aureus
NNAQRQLAIQQINNAETLN

SEQ ID NO: 1581412 - protein, 17 aa, Staphylococcus aureus
NNGSYSLNFDKLDKTYV

SEQ ID NO: 1581413 - protein, 18 aa, Staphylococcus aureus
NNKITYNYSSPIAGIDKP

SEQ ID NO: 1581414 - protein, 25 aa, Staphylococcus aureus
NNLITYTFTDYVDRFNSVQMGINYS

SEQ ID NO: 1581415 - protein, 20 aa, Staphylococcus aureus
NNQITYNYSSPIAGIDKPNG

SEQ ID NO: 1581416 - protein, 21 aa, Staphylococcus aureus
NNTFQNFDITYNGDTKVMTVT

SEQ ID NO: 1581417 - protein, 17 aa, Staphylococcus aureus
NPDTWKNTVGNTHKTAV

SEQ ID NO: 1581418 - protein, 19 aa, Staphylococcus aureus
NPYLSTSTHRIKEENIKNM

SEQ ID NO: 1581419 - protein, 26 aa, Staphylococcus aureus
NQDGKRPTEIKVELYQDGKATGKTAK

SEQ ID NO: 1581420 - protein, 21 aa, Staphylococcus aureus
NQDLLAKCYLSCLKLADQYSL

SEQ ID NO: 1581421 - protein, 17 aa, Staphylococcus aureus
NQQSALTAKGYNYTSVD

SEQ ID NO: 1581422 - protein, 23 aa, Staphylococcus aureus
NQTIEVGKTMNPIVLTTTDNGTG

SEQ ID NO: 1581423 - protein, 25 aa, Staphylococcus aureus
NRILKGKIAKTFIGKSMFRNNIKSI

SEQ ID NO: 1581424 - protein, 18 aa, Staphylococcus aureus
NRKKAAISKIKDISTDKI

SEQ ID NO: 1581425 - protein, 22 aa, Staphylococcus aureus
NSGSNLDKAAVENALSQVTNAK

SEQ ID NO: 1581426 - protein, 24 aa, Staphylococcus aureus
NSIVLKSILSLGIIHGGTFGIYPK

SEQ ID NO: 1581427 - protein, 23 aa, Staphylococcus aureus
NTARQGLTLDRQPAFTTLHGASN

SEQ ID NO: 1581428 - protein, 21 aa, Staphylococcus aureus
NTFMAANFKVTGQVKSGDYFT

SEQ ID NO: 1581429 - protein, 38 aa, Staphylococcus aureus
NTINKRINFIFGVIIFIFAVLVLRLGYLQIAQGSHYKQ

SEQ ID NO: 1581430 - protein, 32 aa, Staphylococcus aureus
NTKDDVKATLTVPAYIDPEYVTHTGNVTLATG

SEQ ID NO: 1581431 - protein, 19 aa, Staphylococcus aureus
NTLEIGMVCDGYLMRIENL

SEQ ID NO: 1581432 - protein, 17 aa, Staphylococcus aureus
NVESALQNVQRAKNDLN

SEQ ID NO: 1581433 - protein, 20 aa, Staphylococcus aureus
NVVFDYRRSLLRTDVVLNSE

SEQ ID NO: 1581434 - protein, 22 aa, Staphylococcus aureus
NYRCISESNITLKNIKEILKKE

SEQ ID NO: 1581435 - protein, 25 aa, Staphylococcus aureus
PAFFKGNAPYIFAHRGGMVLRPEQT

SEQ ID NO: 1581436 - protein, 18 aa, Staphylococcus aureus
PDLIRLSKTFLIESRDLT

SEQ ID NO: 1581437 - protein, 23 aa, Staphylococcus aureus
PDVVVRWLSFIPITLFTALVIDS

SEQ ID NO: 1581438 - protein, 18 aa, Staphylococcus aureus
PEKLKELVRNDSNTDHST

SEQ ID NO: 1581439 - protein, 18 aa, Staphylococcus aureus
PFDLRVLMDAVYELNDHQ

SEQ ID NO: 1581440 - protein, 17 aa, Staphylococcus aureus
PHIHGFNKHTEIIEEDT

SEQ ID NO: 1581441 - protein, 19 aa, Staphylococcus aureus
PILAVVAVIGVFIGILVYL

SEQ ID NO: 1581442 - protein, 19 aa, Staphylococcus aureus
PIMISGILFFKTNLDKTYI

SEQ ID NO: 1581443 - protein, 20 aa, Staphylococcus aureus
PIVLVPLIVERKRIKQHPDV

SEQ ID NO: 1581444 - protein, 22 aa, Staphylococcus aureus
PKPKRKSRFFIISMVLAVTCFI

SEQ ID NO: 1581445 - protein, 23 aa, Staphylococcus aureus
PLADIDLAWLVPFILLAIIGFII

SEQ ID NO: 1581446 - protein, 22 aa, Staphylococcus aureus
PLADIDLAWLVPFMLFAIIGFI

SEQ ID NO: 1581447 - protein, 17 aa, Staphylococcus aureus
PLAGVFTSISWPVLLVI

SEQ ID NO: 1581448 - protein, 17 aa, Staphylococcus aureus
PLGFLLGRNRWLYNAIE

SEQ ID NO: 1581449 - protein, 22 aa, Staphylococcus aureus
PLSDRHFLIFLLLVFMTYPLHK

SEQ ID NO: 1581450 - protein, 18 aa, Staphylococcus aureus
PLSFAYVIFIVFLQVGFS

SEQ ID NO: 1581451 - protein, 18 aa, Staphylococcus aureus
PLSLLMALIALKLSDVSL

SEQ ID NO: 1581452 - protein, 30 aa, Staphylococcus aureus
PMVVYAVSAGYKWFFAYPDEHIETVNTLTI

SEQ ID NO: 1581453 - protein, 24 aa, Staphylococcus aureus
PNKEVIKLSVSIGVGYLTDNDPKS

SEQ ID NO: 1581454 - protein, 22 aa, Staphylococcus aureus
PQGYGSLNSFSINYKTKITNEQ

SEQ ID NO: 1581455 - protein, 23 aa, Staphylococcus aureus
PQLLTKINWKVFITPVILTLVLS

SEQ ID NO: 1581456 - protein, 24 aa, Staphylococcus aureus
PQNIIGFLALFGMIAAFFIANRSS

SEQ ID NO: 1581457 - protein, 20 aa, Staphylococcus aureus
PQSLDMFLNIILKESNRIES

SEQ ID NO: 1581458 - protein, 17 aa, Staphylococcus aureus
PSGKRINAIQILNKETG

SEQ ID NO: 1581459 - protein, 20 aa, Staphylococcus aureus
PSGKRINAIQILNKETGKFE

SEQ ID NO: 1581460 - protein, 21 aa, Staphylococcus aureus
PSLILMVLVPLIFFVPNIFGK

SEQ ID NO: 1581461 - protein, 20 aa, Staphylococcus aureus
PSNNKLEVGLGRDISGDPIT

SEQ ID NO: 1581462 - protein, 19 aa, Staphylococcus aureus
PTGNGASASDYFKLSNGSA

SEQ ID NO: 1581463 - protein, 38 aa, Staphylococcus aureus
PTIDKLYYAAGGRALEYNQLFMYSQLYVESTQDYQQRL

SEQ ID NO: 1581464 - protein, 18 aa, Staphylococcus aureus
PTLAKSIIDQATQAVTDA

SEQ ID NO: 1581465 - protein, 23 aa, Staphylococcus aureus
PTNNTFQNFDITYNGDTKVMTVT

SEQ ID NO: 1581466 - protein, 28 aa, Staphylococcus aureus
PVGLNAKYYRGDEVSFTMGVSDRHSGLK

SEQ ID NO: 1581467 - protein, 25 aa, Staphylococcus aureus
PVGNQIRALIFYNNVVASNMSNAVT

SEQ ID NO: 1581468 - protein, 17 aa, Staphylococcus aureus
PVGWVILAGLAMSTVFA

SEQ ID NO: 1581469 - protein, 20 aa, Staphylococcus aureus
PVKEFLGGSLEAVFWMINKI

SEQ ID NO: 1581470 - protein, 19 aa, Staphylococcus aureus
PVPYAMHVALLCIKYLSLT

SEQ ID NO: 1581471 - protein, 19 aa, Staphylococcus aureus
PYLTPMVIFSIIFTLFFSS

SEQ ID NO: 1581472 - protein, 23 aa, Staphylococcus aureus
PYNLPTTPWNTLKASDAKEIALI

SEQ ID NO: 1581473 - protein, 20 aa, Staphylococcus aureus
PYRGHAHTAILTFDELLKQY

SEQ ID NO: 1581474 - protein, 24 aa, Staphylococcus aureus
QATTKIWQNGHVDITPNNPSGHLI

SEQ ID NO: 1581475 - protein, 29 aa, Staphylococcus aureus
QAVNTSAPRMRAFSLSAVAADAPAAGKDI

SEQ ID NO: 1581476 - protein, 17 aa, Staphylococcus aureus
QDAIANLDTLRDLNQPQ

SEQ ID NO: 1581477 - protein, 42 aa, Staphylococcus aureus
QDAYSQKGAITLGTRIDSNKSFHFSGKVNLGNKYEGNGNGGD

SEQ ID NO: 1581478 - protein, 24 aa, Staphylococcus aureus
QDGKKLFFFLWDFVIFVFNVQLRK

SEQ ID NO: 1581479 - protein, 26 aa, Staphylococcus aureus
QKEALKAQVTSAGRVSVANGVEHTAT

SEQ ID NO: 1581480 - protein, 24 aa, Staphylococcus aureus
QKYPNPFLNPALIASLGIIFVLLI

SEQ ID NO: 1581481 - protein, 18 aa, Staphylococcus aureus
QLDQAMERLINGIQDKDQ

SEQ ID NO: 1581482 - protein, 37 aa, Staphylococcus aureus
QLIILGFLLHYIFKINDKWLLVLCVFVIIVNASWNTI

SEQ ID NO: 1581483 - protein, 21 aa, Staphylococcus aureus
QLLGASLWGVFALGNWPGIGH

SEQ ID NO: 1581484 - protein, 17 aa, Staphylococcus aureus
QMNAGTQLYHIVATNAY

SEQ ID NO: 1581485 - protein, 26 aa, Staphylococcus aureus
QNGDTIKVAWPTSGTVKIEGYSKTVP

SEQ ID NO: 1581486 - protein, 17 aa, Staphylococcus aureus
QPDEPGEIEPIPEDSDS

SEQ ID NO: 1581487 - protein, 23 aa, Staphylococcus aureus
QPELPYIVVIVDELADLMMVAGK

SEQ ID NO: 1581488 - protein, 18 aa, Staphylococcus aureus
QQERITLYLKHNTIEPNT

SEQ ID NO: 1581489 - protein, 21 aa, Staphylococcus aureus
QRALSYWSIGSWGGSGICTLF

SEQ ID NO: 1581490 - protein, 18 aa, Staphylococcus aureus
QRLLKTLQYPLILVSIFI

SEQ ID NO: 1581491 - protein, 18 aa, Staphylococcus aureus
QRLVKILLSFVVAVIVVY

SEQ ID NO: 1581492 - protein, 28 aa, Staphylococcus aureus
QRPIFQFSVAELIGWIITHIFFMSLMAL

SEQ ID NO: 1581493 - protein, 42 aa, Staphylococcus aureus
QSGNTFMAANFTVTGQVKSGDYFTAKLPDSVTGNGDVDYSNS

SEQ ID NO: 1581494 - protein, 39 aa, Staphylococcus aureus
QSISKKMTGYGLKTTAVIGGAFTINMLHDQQAFAASDAP

SEQ ID NO: 1581495 - protein, 17 aa, Staphylococcus aureus
QTFNYTWFVGGLLGVGY

SEQ ID NO: 1581496 - protein, 25 aa, Staphylococcus aureus
QVINAKYDVIYNGHTFATSLPAKFV

SEQ ID NO: 1581497 - protein, 39 aa, Staphylococcus aureus
QWILNFKRSIAIIYRTELLPSLYLYLYLKNNNDFKSPQY

SEQ ID NO: 1581498 - protein, 22 aa, Staphylococcus aureus
QWSADWLDRLGQSFSNWANSAA

SEQ ID NO: 1581499 - protein, 17 aa, Staphylococcus aureus
QWVIWTILVTSFFSIGT

SEQ ID NO: 1581500 - protein, 18 aa, Staphylococcus aureus
QWVIWTILVTSFFSIGTP

SEQ ID NO: 1581501 - protein, 17 aa, Staphylococcus aureus
RAIDLILSIVLLFLTLP

SEQ ID NO: 1581502 - protein, 20 aa, Staphylococcus aureus
RANDWFKKYGVWAVFICRFI

SEQ ID NO: 1581503 - protein, 19 aa, Staphylococcus aureus
RATNPLIDFKLFKSKAYTG

SEQ ID NO: 1581504 - protein, 19 aa, Staphylococcus aureus
RCRNCRKRISLTHFLGETF

SEQ ID NO: 1581505 - protein, 19 aa, Staphylococcus aureus
RDFQSVIGVKHFIFEVTDF

SEQ ID NO: 1581506 - protein, 17 aa, Staphylococcus aureus
RDVKIVSSIEYGENIHE

SEQ ID NO: 1581507 - protein, 17 aa, Staphylococcus aureus
REAESEITAAQRVIDNG

SEQ ID NO: 1581508 - protein, 24 aa, Staphylococcus aureus
RESRCINMLFVILVLYIIGIAFIL

SEQ ID NO: 1581509 - protein, 24 aa, Staphylococcus aureus
RFIGDFPIVSAIVIIIFGILVMLI

SEQ ID NO: 1581510 - protein, 19 aa, Staphylococcus aureus
RFTGIMYILAYLAGFITFW

SEQ ID NO: 1581511 - protein, 19 aa, Staphylococcus aureus
RFVPIVTAFAAIFLGILMF

SEQ ID NO: 1581512 - protein, 17 aa, Staphylococcus aureus
RGLANVRPALPVSDEYL

SEQ ID NO: 1581513 - protein, 23 aa, Staphylococcus aureus
RHHFKIARKSFFVENGSLVQIAP

SEQ ID NO: 1581514 - protein, 29 aa, Staphylococcus aureus
RHSGLKSTTITTLPSGWTSNLTKSDKKNG

SEQ ID NO: 1581515 - protein, 24 aa, Staphylococcus aureus
RILKGKIAKTFIGKSMFRNNIKSI

SEQ ID NO: 1581516 - protein, 25 aa, Staphylococcus aureus
RKDCRQMTGIWAGIIIIVIAAIILG

SEQ ID NO: 1581517 - protein, 19 aa, Staphylococcus aureus
RKDMFFDYVSLKRMVIDEI

SEQ ID NO: 1581518 - protein, 25 aa, Staphylococcus aureus
RKYLKLGETFFLYLTWYSIGRFFIE

SEQ ID NO: 1581519 - protein, 19 aa, Staphylococcus aureus
RLEFSGIGLLFCQKTVDAM

SEQ ID NO: 1581520 - protein, 20 aa, Staphylococcus aureus
RLNLPLFVIKGITIIVLALF

SEQ ID NO: 1581521 - protein, 17 aa, Staphylococcus aureus
RLVKYINVFYAMIANVP

SEQ ID NO: 1581522 - protein, 19 aa, Staphylococcus aureus
RNAYNQAVSNAETILNKQT

SEQ ID NO: 1581523 - protein, 20 aa, Staphylococcus aureus
RNAYNQAVSNAETILNKQTG

SEQ ID NO: 1581524 - protein, 22 aa, Staphylococcus aureus
RNEVKEVLNYLDALNYGYDQIK

SEQ ID NO: 1581525 - protein, 24 aa, Staphylococcus aureus
RNLKEKRFDQKYFRIGSVATLESI

SEQ ID NO: 1581526 - protein, 17 aa, Staphylococcus aureus
RQRKRSKATHFSNQNKD

SEQ ID NO: 1581527 - protein, 21 aa, Staphylococcus aureus
RSILIPLKAVLGFVLSLMATL

SEQ ID NO: 1581528 - protein, 22 aa, Staphylococcus aureus
RTFTQFTFKKALLFAALFILIG

SEQ ID NO: 1581529 - protein, 45 aa, Staphylococcus aureus
RTIYIATTFHASMTFGLIFLFSEEIGDLFSIKVIAISTAIVAVGY

SEQ ID NO: 1581530 - protein, 20 aa, Staphylococcus aureus
RTKIQEIDRVLASHPDVATI

SEQ ID NO: 1581531 - protein, 26 aa, Staphylococcus aureus
RTKLLEYRKPILLMSMALVFATVVGV

SEQ ID NO: 1581532 - protein, 23 aa, Staphylococcus aureus
RTLNYKLLFSFMIATIGTIIMFS

SEQ ID NO: 1581533 - protein, 32 aa, Staphylococcus aureus
RTVPKQVFETARGVLYPGVSDMYDAKQYVKPV

SEQ ID NO: 1581534 - protein, 20 aa, Staphylococcus aureus
RVARSYGAIVVDVVDDADGK

SEQ ID NO: 1581535 - protein, 23 aa, Staphylococcus aureus
RVTNAIKGLEHFIMRRTAVEILF

SEQ ID NO: 1581536 - protein, 18 aa, Staphylococcus aureus
RYDWCYLLYIARHVSKTC

SEQ ID NO: 1581537 - protein, 24 aa, Staphylococcus aureus
RYYLFEKRYHPFIAAIAIGLIALL

SEQ ID NO: 1581538 - protein, 23 aa, Staphylococcus aureus
SAAKRVPVTVNVYQFEFPQTSYT

SEQ ID NO: 1581539 - protein, 23 aa, Staphylococcus aureus
SAANGAGAFTIDHVVKNNSTHNA

SEQ ID NO: 1581540 - protein, 17 aa, Staphylococcus aureus
SAISSQIDRAGHVSEVT

SEQ ID NO: 1581541 - protein, 25 aa, Staphylococcus aureus
SAITFVDIWHFFSLVNRYENEDKYD

SEQ ID NO: 1581542 - protein, 18 aa, Staphylococcus aureus
SAIVTFFVLSPKYQANTQ

SEQ ID NO: 1581543 - protein, 45 aa, Staphylococcus aureus
SAKNSERRGMLKGCGGCLISFIILIILLSACSMMFSNNDNSTSNQ

SEQ ID NO: 1581544 - protein, 22 aa, Staphylococcus aureus
SAKYKWHIIISFTLSIVLFLLL

SEQ ID NO: 1581545 - protein, 29 aa, Staphylococcus aureus
SARTWLNKRFGELEIYIGLDAAVALGHPA

SEQ ID NO: 1581546 - protein, 20 aa, Staphylococcus aureus
SASDYFKLSNGSAIPDATIT

SEQ ID NO: 1581547 - protein, 25 aa, Staphylococcus aureus
SAYEVLSALILAWSLLVSWNQMVAF

SEQ ID NO: 1581548 - protein, 19 aa, Staphylococcus aureus
SDAKEIALITAKQTGDGYQ

SEQ ID NO: 1581549 - protein, 23 aa, Staphylococcus aureus
SDDSKRSIVIFGGIAAAIGPVVF

SEQ ID NO: 1581550 - protein, 17 aa, Staphylococcus aureus
SDGQRQFTLNGQVIQIM

SEQ ID NO: 1581551 - protein, 27 aa, Staphylococcus aureus
SDKKNGSLAISGRVSMNQAYNSDITFK

SEQ ID NO: 1581552 - protein, 17 aa, Staphylococcus aureus
SDSIMILSINPKTKKTE

SEQ ID NO: 1581553 - protein, 26 aa, Staphylococcus aureus
SEPSVRTRAVRSLAVAEPVVNAADAK

SEQ ID NO: 1581554 - protein, 20 aa, Staphylococcus aureus
SESQSASAFLSESLSESTSE

SEQ ID NO: 1581555 - protein, 19 aa, Staphylococcus aureus
SEYWYMMLWHLILMVPAVC

SEQ ID NO: 1581556 - protein, 19 aa, Staphylococcus aureus
SFFTIYMLLTIEVQNIILF

SEQ ID NO: 1581557 - protein, 36 aa, Staphylococcus aureus
SFIGVELIYLFMLGFYRLPGLVAIIALTTYIYLTLV

SEQ ID NO: 1581558 - protein, 18 aa, Staphylococcus aureus
SFLIGSTYIFSAVVGMLA

SEQ ID NO: 1581559 - protein, 17 aa, Staphylococcus aureus
SGFFSIMSLCMLITLDS

SEQ ID NO: 1581560 - protein, 18 aa, Staphylococcus aureus
SGSMSVSISLSDSSNISG

SEQ ID NO: 1581561 - protein, 18 aa, Staphylococcus aureus
SGYAHIQNATGLPTDGFT

SEQ ID NO: 1581562 - protein, 21 aa, Staphylococcus aureus
SHKATFTMLRDIRVQFFGKLV

SEQ ID NO: 1581563 - protein, 25 aa, Staphylococcus aureus
SHSKYSGVFIYKDLKSIEDTNNAIT

SEQ ID NO: 1581564 - protein, 24 aa, Staphylococcus aureus
SIAICVFAFKMVQVMKQNAEGNAE

SEQ ID NO: 1581565 - protein, 22 aa, Staphylococcus aureus
SIIIYLFIRRQFNISNALLNLR

SEQ ID NO: 1581566 - protein, 22 aa, Staphylococcus aureus
SIIIYLFIRRQFNISNALLNLS

SEQ ID NO: 1581567 - protein, 17 aa, Staphylococcus aureus
SIIKIFFATMQTLIYLC

SEQ ID NO: 1581568 - protein, 19 aa, Staphylococcus aureus
SILLTLLAMYLIKYAPETK

SEQ ID NO: 1581569 - protein, 23 aa, Staphylococcus aureus
SITINGFFAKGGLYTGNVPTVKV

SEQ ID NO: 1581570 - protein, 25 aa, Staphylococcus aureus
SITKEIRAKIAILSLAFLVHCFLVY

SEQ ID NO: 1581571 - protein, 18 aa, Staphylococcus aureus
SIVIAFIAIFLLKGTPEK

SEQ ID NO: 1581572 - protein, 34 aa, Staphylococcus aureus
SKERLLIIRALITWFYTMLWSIVGVVWIMFSIPN

SEQ ID NO: 1581573 - protein, 20 aa, Staphylococcus aureus
SKFVSSFSIYGGIALGLIVI

SEQ ID NO: 1581574 - protein, 26 aa, Staphylococcus aureus
SKKLNEAIPLFATVIVVLAFFLLMIV

SEQ ID NO: 1581575 - protein, 18 aa, Staphylococcus aureus
SKLIPVMFIRRWFDMKTT

SEQ ID NO: 1581576 - protein, 22 aa, Staphylococcus aureus
SKNQLKRMSLVLNTDRGNIKIK

SEQ ID NO: 1581577 - protein, 18 aa, Staphylococcus aureus
SKSLPWIILIVILVHIFS

SEQ ID NO: 1581578 - protein, 21 aa, Staphylococcus aureus
SKTQKLICVISATVLSVLSSV

SEQ ID NO: 1581579 - protein, 33 aa, Staphylococcus aureus
SKTVLIDYEKYGQFHNLSIKGTIDQIDKTNNTY

SEQ ID NO: 1581580 - protein, 19 aa, Staphylococcus aureus
SLIGCIKRSQTLAGAVNTI

SEQ ID NO: 1581581 - protein, 18 aa, Staphylococcus aureus
SLISIMLYFILKDENIVE

SEQ ID NO: 1581582 - protein, 23 aa, Staphylococcus aureus
SLKKGQDGFKEMLGSMGTMAGSQ

SEQ ID NO: 1581583 - protein, 22 aa, Staphylococcus aureus
SLKTELSFVEPLISRLELEEAN

SEQ ID NO: 1581584 - protein, 28 aa, Staphylococcus aureus
SNFYFSYYQAIIIGCYYLYRLIFTYKYD

SEQ ID NO: 1581585 - protein, 22 aa, Staphylococcus aureus
SNGAPCNQILSLIGYSDTIVMQ

SEQ ID NO: 1581586 - protein, 21 aa, Staphylococcus aureus
SNSHLRVGYGTVNHPYNSTTI

SEQ ID NO: 1581587 - protein, 18 aa, Staphylococcus aureus
SNSHLTIGYGTANHPFNS

SEQ ID NO: 1581588 - protein, 23 aa, Staphylococcus aureus
SNSMHPSDSMSMHHTHSTSTSRL

SEQ ID NO: 1581589 - protein, 23 aa, Staphylococcus aureus
SPWVKEASAANVAGIAGTNNGIT

SEQ ID NO: 1581590 - protein, 20 aa, Staphylococcus aureus
SRFVPIVTAFAAIFLGVLMF

SEQ ID NO: 1581591 - protein, 20 aa, Staphylococcus aureus
SRIMPLKITIVLSIILETLF

SEQ ID NO: 1581592 - protein, 17 aa, Staphylococcus aureus
SRITKPLRRLRDQATRV

SEQ ID NO: 1581593 - protein, 20 aa, Staphylococcus aureus
SRLVKYINIFYAMIANVPII

SEQ ID NO: 1581594 - protein, 18 aa, Staphylococcus aureus
SSATGHTMDFFWELATLI

SEQ ID NO: 1581595 - protein, 19 aa, Staphylococcus aureus
SSCSYQIGATLSIFSVAGK

SEQ ID NO: 1581596 - protein, 39 aa, Staphylococcus aureus
SSIMSAILMKNKWPFLIALPFMIGYGIGVTFYYQQKVAY

SEQ ID NO: 1581597 - protein, 23 aa, Staphylococcus aureus
SSITAIIPMFFGKPFLSQYETTW

SEQ ID NO: 1581598 - protein, 18 aa, Staphylococcus aureus
SSSLSYSISMSDSTSTSD

SEQ ID NO: 1581599 - protein, 19 aa, Staphylococcus aureus
SSSMSGSVSKSTSLSDSIS

SEQ ID NO: 1581600 - protein, 31 aa, Staphylococcus aureus
STAPIKLRTFSRLAMSTFASAATTSAVTANT

SEQ ID NO: 1581601 - protein, 19 aa, Staphylococcus aureus
STFNMKYYLIRTIPVSIIA

SEQ ID NO: 1581602 - protein, 20 aa, Staphylococcus aureus
STILTLLLVTGWHMRTLITI

SEQ ID NO: 1581603 - protein, 27 aa, Staphylococcus aureus
STITIRPEDYVVFIPPVGNQIRALIFY

SEQ ID NO: 1581604 - protein, 24 aa, Staphylococcus aureus
STMLAAMCGFLFLASDPAKDGGFL

SEQ ID NO: 1581605 - protein, 19 aa, Staphylococcus aureus
STQETWRGDYLVKQLSQNP

SEQ ID NO: 1581606 - protein, 26 aa, Staphylococcus aureus
SVGTASILVGTTLIFGLSGHEAKAAE

SEQ ID NO: 1581607 - protein, 27 aa, Staphylococcus aureus
SVGTASILVGTTLIFGLSGHEAKAAEH

SEQ ID NO: 1581608 - protein, 24 aa, Staphylococcus aureus
SVIDKRLKYIILHEYAHAKNRDTL

SEQ ID NO: 1581609 - protein, 25 aa, Staphylococcus aureus
SVLLFCAGIAFAFYVGFPIIIQFAL

SEQ ID NO: 1581610 - protein, 18 aa, Staphylococcus aureus
SVSESSSLSGSQSMSDSV

SEQ ID NO: 1581611 - protein, 20 aa, Staphylococcus aureus
SVTKFNDWIFIIFIISVYYI

SEQ ID NO: 1581612 - protein, 20 aa, Staphylococcus aureus
SVWLVLLFSVMGLWHVSNAA

SEQ ID NO: 1581613 - protein, 30 aa, Staphylococcus aureus
SVYVIFYFIWLRFEWPHYLLYILLVLGALS

SEQ ID NO: 1581614 - protein, 19 aa, Staphylococcus aureus
SYNHTWNILGYVLNGFVFS

SEQ ID NO: 1581615 - protein, 23 aa, Staphylococcus aureus
SYVKTPSNKVLGFYPTSANTNAF

SEQ ID NO: 1581616 - protein, 24 aa, Staphylococcus aureus
SYYLNCYFVYKVKPTWRKFISFPI

SEQ ID NO: 1581617 - protein, 23 aa, Staphylococcus aureus
TAEERQAAMNRINEIVLETIKDI

SEQ ID NO: 1581618 - protein, 21 aa, Staphylococcus aureus
TAMTGLKRGVANHNQVVQSDN

SEQ ID NO: 1581619 - protein, 25 aa, Staphylococcus aureus
TAVIGGAFTINMLHDQQAFAASDAP

SEQ ID NO: 1581620 - protein, 33 aa, Staphylococcus aureus
TAVRHIYEISSLIYKVTMKIKIKAMGINVDEID

SEQ ID NO: 1581621 - protein, 18 aa, Staphylococcus aureus
TAVSIAIKHIQDSVPNVT

SEQ ID NO: 1581622 - protein, 20 aa, Staphylococcus aureus
TDAASAIDALPHLNNAQKAD

SEQ ID NO: 1581623 - protein, 19 aa, Staphylococcus aureus
TDYIKGIGLAVGTAGSAVI

SEQ ID NO: 1581624 - protein, 21 aa, Staphylococcus aureus
TEEIKFPKGLSFLRESTISIS

SEQ ID NO: 1581625 - protein, 25 aa, Staphylococcus aureus
TELNTAMTALKRAIADKADTKASGN

SEQ ID NO: 1581626 - protein, 26 aa, Staphylococcus aureus
TELNTAMTALKRAIADKADTKASGNY

SEQ ID NO: 1581627 - protein, 35 aa, Staphylococcus aureus
TESPGVPKVYTFIGKGDASYTISFKTQGPTIDKLY

SEQ ID NO: 1581628 - protein, 19 aa, Staphylococcus aureus
TFMAANFKVTGQVKSGDYF

SEQ ID NO: 1581629 - protein, 19 aa, Staphylococcus aureus
TFPEFQRLTVKKLEFKYSY

SEQ ID NO: 1581630 - protein, 39 aa, Staphylococcus aureus
TGDSIKQNGLLGGVMTLLVGLGLMKRKKKKDENEQDDSQ

SEQ ID NO: 1581631 - protein, 34 aa, Staphylococcus aureus
TGKTEFWATSSDVLKLKANYTIDDSVKEGDIFTF

SEQ ID NO: 1581632 - protein, 35 aa, Staphylococcus aureus
TGKTEFWATSSDVLKLKANYTIDDSVKEGDTFTFK

SEQ ID NO: 1581633 - protein, 24 aa, Staphylococcus aureus
TGNRPFFRLYLITWMMHLILIGGS

SEQ ID NO: 1581634 - protein, 18 aa, Staphylococcus aureus
TGPLIVYWNWAWGITVIV

SEQ ID NO: 1581635 - protein, 25 aa, Staphylococcus aureus
TGQVKSGDYFTAKLPDSVTGNGDVD

SEQ ID NO: 1581636 - protein, 20 aa, Staphylococcus aureus
THRLKFKNSTYMLKIYMANT

SEQ ID NO: 1581637 - protein, 28 aa, Staphylococcus aureus
TIITMVLCGFLFPLAITLIGQLFFYQQA

SEQ ID NO: 1581638 - protein, 18 aa, Staphylococcus aureus
TILSTSILILSSSSLGLA

SEQ ID NO: 1581639 - protein, 17 aa, Staphylococcus aureus
TITEAWNGVKTAVSGAI

SEQ ID NO: 1581640 - protein, 21 aa, Staphylococcus aureus
TKIYITHQILWDFVKAPHALI

SEQ ID NO: 1581641 - protein, 33 aa, Staphylococcus aureus
TKLFGKGSWYLPAWLNRIIPRVDIEGHALEKYK

SEQ ID NO: 1581642 - protein, 22 aa, Staphylococcus aureus
TKLRIFEVNDTSKLSDSYYADP

SEQ ID NO: 1581643 - protein, 18 aa, Staphylococcus aureus
TKNLEDFYDKEGFRDQEF

SEQ ID NO: 1581644 - protein, 24 aa, Staphylococcus aureus
TKVDKRELITAKNHLDDPVSTEGK

SEQ ID NO: 1581645 - protein, 25 aa, Staphylococcus aureus
TLAIHLSYYVTFLILWLLIIELLTT

SEQ ID NO: 1581646 - protein, 18 aa, Staphylococcus aureus
TLEQKAKALKEIDEAEKR

SEQ ID NO: 1581647 - protein, 21 aa, Staphylococcus aureus
TLFTYASYILITWLAIIFALL

SEQ ID NO: 1581648 - protein, 23 aa, Staphylococcus aureus
TLIGGIFVWIGWYGFNVGSAFTF

SEQ ID NO: 1581649 - protein, 22 aa, Staphylococcus aureus
TLNMKYYLIRTIPVCIIALLYV

SEQ ID NO: 1581650 - protein, 22 aa, Staphylococcus aureus
TLNQAMHGLRESIQDNAATKAN

SEQ ID NO: 1581651 - protein, 22 aa, Staphylococcus aureus
TLNTAMKGLRDSIANEATIKAE

SEQ ID NO: 1581652 - protein, 23 aa, Staphylococcus aureus
TLNTAMKGLRDSIANEATIKAEQ

SEQ ID NO: 1581653 - protein, 20 aa, Staphylococcus aureus
TLQIIFPYSLSMAIVGLVES

SEQ ID NO: 1581654 - protein, 25 aa, Staphylococcus aureus
TLSLGMCAYIIRLVRSNLLTLLQSN

SEQ ID NO: 1581655 - protein, 26 aa, Staphylococcus aureus
TLTIPKDRPVVFKLQAMDTMTSFWIP

SEQ ID NO: 1581656 - protein, 21 aa, Staphylococcus aureus
TNAKLKVQAYHSSYPNNIGQI

SEQ ID NO: 1581657 - protein, 21 aa, Staphylococcus aureus
TNEAINIYFVPSDLVNPTISV

SEQ ID NO: 1581658 - protein, 17 aa, Staphylococcus aureus
TNETFRKNMTKAWEDIK

SEQ ID NO: 1581659 - protein, 18 aa, Staphylococcus aureus
TNFVCKWTNPIINLQRPS

SEQ ID NO: 1581660 - protein, 18 aa, Staphylococcus aureus
TNQIPIFIVMGLYICMYA

SEQ ID NO: 1581661 - protein, 26 aa, Staphylococcus aureus
TNVNRVNDRLTLAINQLVPLADNSAL

SEQ ID NO: 1581662 - protein, 26 aa, Staphylococcus aureus
TPITKTATYKVVRTVPKQVFETARGV

SEQ ID NO: 1581663 - protein, 29 aa, Staphylococcus aureus
TQLEETVAFTKERVEGFLNKSKNEQATLK

SEQ ID NO: 1581664 - protein, 20 aa, Staphylococcus aureus
TQLMPLFKFMSQGLQNMSID

SEQ ID NO: 1581665 - protein, 17 aa, Staphylococcus aureus
TRIAMFLYDKSEVSNVV

SEQ ID NO: 1581666 - protein, 23 aa, Staphylococcus aureus
TRKKYIRNLILGFVGIAIVISLI

SEQ ID NO: 1581667 - protein, 24 aa, Staphylococcus aureus
TRQPKLESFFGIEMMFLGNTEALA

SEQ ID NO: 1581668 - protein, 27 aa, Staphylococcus aureus
TSANTNAFRPGGVNPLNEYQLSQLFTD

SEQ ID NO: 1581669 - protein, 30 aa, Staphylococcus aureus
TSEATKHNGTRAQSEERLPDTGDSIKQNGL

SEQ ID NO: 1581670 - protein, 21 aa, Staphylococcus aureus
TSESLSMSGSDSTSVSDSTSM

SEQ ID NO: 1581671 - protein, 21 aa, Staphylococcus aureus
TSMSISDSMSVSVSLSDSTST

SEQ ID NO: 1581672 - protein, 17 aa, Staphylococcus aureus
TSMSLSMSQSTSGSTSV

SEQ ID NO: 1581673 - protein, 31 aa, Staphylococcus aureus
TSNKFDMLLCLPIHKCVNLFYTFVYHSNLLK

SEQ ID NO: 1581674 - protein, 35 aa, Staphylococcus aureus
TSNLNNMNFLRWVNFPQDYTVTWTNAKIANRPTDG

SEQ ID NO: 1581675 - protein, 17 aa, Staphylococcus aureus
TSQLRHRLMIQSIVSSE

SEQ ID NO: 1581676 - protein, 27 aa, Staphylococcus aureus
TSTSDSLRTSTSLSDSVSMSTSGSLSK

SEQ ID NO: 1581677 - protein, 22 aa, Staphylococcus aureus
TSVIVGATILFGIGNHQAQASE

SEQ ID NO: 1581678 - protein, 23 aa, Staphylococcus aureus
TSVIVGATILFGIGNHQAQASEQ

SEQ ID NO: 1581679 - protein, 23 aa, Staphylococcus aureus
TTGADGWGFLFSKGDGNEYLQKG

SEQ ID NO: 1581680 - protein, 18 aa, Staphylococcus aureus
TTKHEVEQTIYVNPLKLN

SEQ ID NO: 1581681 - protein, 18 aa, Staphylococcus aureus
TTLPNGWTSNLTKSDNKN

SEQ ID NO: 1581682 - protein, 32 aa, Staphylococcus aureus
TTLTYLVSLCFLFICVYLNMAIGSSKINFSDI

SEQ ID NO: 1581683 - protein, 23 aa, Staphylococcus aureus
TTPFLLVAVFCFARSSDRFYNWL

SEQ ID NO: 1581684 - protein, 25 aa, Staphylococcus aureus
TTTIKPRTLNRMAVNTVAAPQQGTN

SEQ ID NO: 1581685 - protein, 31 aa, Staphylococcus aureus
TTVYPHQAGYVKLNYGFSVPNSPVKGDTFKI

SEQ ID NO: 1581686 - protein, 23 aa, Staphylococcus aureus
TTYKKVLHWSLNHKWIVIILSTL

SEQ ID NO: 1581687 - protein, 20 aa, Staphylococcus aureus
TVKNKVFKLIFLACTLFGLV

SEQ ID NO: 1581688 - protein, 25 aa, Staphylococcus aureus
TVLPEIQHNIKFFKNDDGQNIADKP

SEQ ID NO: 1581689 - protein, 31 aa, Staphylococcus aureus
TVLVDYEKYGKFYNLSIKGTIDQVDKTNNTY

SEQ ID NO: 1581690 - protein, 19 aa, Staphylococcus aureus
TVPENHFTAIIGESGSGKS

SEQ ID NO: 1581691 - protein, 17 aa, Staphylococcus aureus
TVTIVFHNVCKNVQIAF

SEQ ID NO: 1581692 - protein, 23 aa, Staphylococcus aureus
TWLTLFLPMMNWLIPKKYVKINK

SEQ ID NO: 1581693 - protein, 18 aa, Staphylococcus aureus
TWNILGYVLNGFVFSILG

SEQ ID NO: 1581694 - protein, 25 aa, Staphylococcus aureus
TYDILTKTYTFVFTDYVNNKENING

SEQ ID NO: 1581695 - protein, 22 aa, Staphylococcus aureus
TYLQIFAEWGILFGALFIIFML

SEQ ID NO: 1581696 - protein, 31 aa, Staphylococcus aureus
TYQNEPLPNRKDFVVSFITGALVGSALGLYF

SEQ ID NO: 1581697 - protein, 18 aa, Staphylococcus aureus
TYSVEFSTLAGYTPTTVN

SEQ ID NO: 1581698 - protein, 17 aa, Staphylococcus aureus
VAESGLKNGGYQVMIVI

SEQ ID NO: 1581699 - protein, 20 aa, Staphylococcus aureus
VAILPAAGILLAFGNAMHNE

SEQ ID NO: 1581700 - protein, 17 aa, Staphylococcus aureus
VAIRLFKVEKHVSSPFL

SEQ ID NO: 1581701 - protein, 17 aa, Staphylococcus aureus
VALDGDENLVAAKQQAN

SEQ ID NO: 1581702 - protein, 19 aa, Staphylococcus aureus
VATLGKWVPYLLGIVMLGM

SEQ ID NO: 1581703 - protein, 18 aa, Staphylococcus aureus
VATNAYHKDTEDFYITLK

SEQ ID NO: 1581704 - protein, 21 aa, Staphylococcus aureus
VDAYLKVIAVLLIAAVVSLFV

SEQ ID NO: 1581705 - protein, 37 aa, Staphylococcus aureus
VDGLFKYPHFLWFDLGRPDIWITIIAGVLYFIQAYVS

SEQ ID NO: 1581706 - protein, 26 aa, Staphylococcus aureus
VDRFNSVQMGINYSIYMDADTIPVSK

SEQ ID NO: 1581707 - protein, 30 aa, Staphylococcus aureus
VEEIVFRGMIIRVIFRKHLFLGLIVSSLVF

SEQ ID NO: 1581708 - protein, 25 aa, Staphylococcus aureus
VEEQLRFLIPKLHFCVEKINQLTDL

SEQ ID NO: 1581709 - protein, 24 aa, Staphylococcus aureus
VFCSSCLGCDIFSILEAEVFSSLV

SEQ ID NO: 1581710 - protein, 19 aa, Staphylococcus aureus
VFDWNLRWYLLENIPHLPI

SEQ ID NO: 1581711 - protein, 18 aa, Staphylococcus aureus
VFETNRGAVFPGVSDVYD

SEQ ID NO: 1581712 - protein, 19 aa, Staphylococcus aureus
VFKQWLQYILLVTTIVIAL

SEQ ID NO: 1581713 - protein, 26 aa, Staphylococcus aureus
VFTSISWPVLLVIAIIAAFIGVVVYL

SEQ ID NO: 1581714 - protein, 23 aa, Staphylococcus aureus
VGDWRGVWDGIVMILKGTVQLIW

SEQ ID NO: 1581715 - protein, 19 aa, Staphylococcus aureus
VGHSYSFVDVMIIFLREGL

SEQ ID NO: 1581716 - protein, 37 aa, Staphylococcus aureus
VGIESGDTVYPHQAGYVKLNYGFSVPNSAVKGDTFKI

SEQ ID NO: 1581717 - protein, 25 aa, Staphylococcus aureus
VGSLIMLFILDWKMTLLTFITIPIF

SEQ ID NO: 1581718 - protein, 18 aa, Staphylococcus aureus
VGTASILIGSLMYLGTQQ

SEQ ID NO: 1581719 - protein, 20 aa, Staphylococcus aureus
VGTASILVGTTLIFGLSGHE

SEQ ID NO: 1581720 - protein, 25 aa, Staphylococcus aureus
VGTASILVGTTLIFGLSGHEAKAAE

SEQ ID NO: 1581721 - protein, 21 aa, Staphylococcus aureus
VGVCGSLVALAMFFLSGYMVT

SEQ ID NO: 1581722 - protein, 25 aa, Staphylococcus aureus
VGVLSLFGIFALLLVVTFPIYTVAS

SEQ ID NO: 1581723 - protein, 24 aa, Staphylococcus aureus
VGVLSLFGIFALLLVVTLPIYTVA

SEQ ID NO: 1581724 - protein, 25 aa, Staphylococcus aureus
VIDSDGNVIYTFTDYVDTKENVTAN

SEQ ID NO: 1581725 - protein, 17 aa, Staphylococcus aureus
VIFIFQFAYSKLFNTIA

SEQ ID NO: 1581726 - protein, 22 aa, Staphylococcus aureus
VIGAFIGILVYLWKTNENFRKT

SEQ ID NO: 1581727 - protein, 23 aa, Staphylococcus aureus
VIGGVCILIGILIASRKAALLSV

SEQ ID NO: 1581728 - protein, 21 aa, Staphylococcus aureus
VIGVFIGILVYLWKTNENFRK

SEQ ID NO: 1581729 - protein, 22 aa, Staphylococcus aureus
VIGVFIGILVYLWKTNENFRKT

SEQ ID NO: 1581730 - protein, 19 aa, Staphylococcus aureus
VIIEILVGIVLSAIITAIA

SEQ ID NO: 1581731 - protein, 23 aa, Staphylococcus aureus
VIIICFITFLSILIFFMKLNQKL

SEQ ID NO: 1581732 - protein, 18 aa, Staphylococcus aureus
VISGGILMAIVFLFGVDS

SEQ ID NO: 1581733 - protein, 19 aa, Staphylococcus aureus
VKCYLLIFLPVAFLCALIE

SEQ ID NO: 1581734 - protein, 35 aa, Staphylococcus aureus
VKEGDIFTFKYGQYFRPGSVRLPSQTQNLYNAQGN

SEQ ID NO: 1581735 - protein, 20 aa, Staphylococcus aureus
VKFTDLFIAFKKGIYLKSVL

SEQ ID NO: 1581736 - protein, 17 aa, Staphylococcus aureus
VKLFKADNTPLNVTNIT

SEQ ID NO: 1581737 - protein, 39 aa, Staphylococcus aureus
VKNNLRYGIRKHKLGAASVFLGTMIVVGMGQDKEAAASE

SEQ ID NO: 1581738 - protein, 17 aa, Staphylococcus aureus
VKSPRILDEVSKDLNDR

SEQ ID NO: 1581739 - protein, 20 aa, Staphylococcus aureus
VKSSEKYRDADTNKQQEYDN

SEQ ID NO: 1581740 - protein, 25 aa, Staphylococcus aureus
VLIYFTGWRIIDPIISIVISLIILR

SEQ ID NO: 1581741 - protein, 18 aa, Staphylococcus aureus
VLLYLCYLFITANFLDYT

SEQ ID NO: 1581742 - protein, 26 aa, Staphylococcus aureus
VLQKNLKILIILPLLFLIISAIVTFF

SEQ ID NO: 1581743 - protein, 31 aa, Staphylococcus aureus
VLVDYEKYGKFYNLSIKGTIDQIDKTNNTYR

SEQ ID NO: 1581744 - protein, 18 aa, Staphylococcus aureus
VMTVKYAGQTWTRNISDW

SEQ ID NO: 1581745 - protein, 18 aa, Staphylococcus aureus
VNAAKAILTKASGQNVDK

SEQ ID NO: 1581746 - protein, 18 aa, Staphylococcus aureus
VNAFNWQAVFYIFGAVGI

SEQ ID NO: 1581747 - protein, 28 aa, Staphylococcus aureus
VNGQENLYRIAIQYYGSGSPENVEKIRR

SEQ ID NO: 1581748 - protein, 18 aa, Staphylococcus aureus
VNHSHWITGMSIEGHKER

SEQ ID NO: 1581749 - protein, 20 aa, Staphylococcus aureus
VNINKGRLTKSFTSNLNNMN

SEQ ID NO: 1581750 - protein, 24 aa, Staphylococcus aureus
VNIPDKKLQIVFHILEIKLHAACN

SEQ ID NO: 1581751 - protein, 22 aa, Staphylococcus aureus
VNKLKQQAIEQINNAADVHTVE

SEQ ID NO: 1581752 - protein, 25 aa, Staphylococcus aureus
VPIVPELLKSLNFNQFNLVEAQCKP

SEQ ID NO: 1581753 - protein, 20 aa, Staphylococcus aureus
VPNEKISLVSLKEVLDEKFP

SEQ ID NO: 1581754 - protein, 19 aa, Staphylococcus aureus
VRKGAFTFVVIRPTLFSCW

SEQ ID NO: 1581755 - protein, 43 aa, Staphylococcus aureus
VRTDAKGHYEFGGLKDGETYTVKFETPTGYLPTKVNGTTDGEK

SEQ ID NO: 1581756 - protein, 17 aa, Staphylococcus aureus
VSEVTRFNVGNESNGLI

SEQ ID NO: 1581757 - protein, 19 aa, Staphylococcus aureus
VSIPGMMTGLIIGGVPPLQ

SEQ ID NO: 1581758 - protein, 18 aa, Staphylococcus aureus
VSMNQAFNSDITFKVSAT

SEQ ID NO: 1581759 - protein, 18 aa, Staphylococcus aureus
VSSFKLQIIFVILKMSET

SEQ ID NO: 1581760 - protein, 21 aa, Staphylococcus aureus
VSTSQRSSESVSESDSLSDSK

SEQ ID NO: 1581761 - protein, 28 aa, Staphylococcus aureus
VTDIPLDPSALVYLVIPTSQTRDGGSEA

SEQ ID NO: 1581762 - protein, 25 aa, Staphylococcus aureus
VTDKVKSGDYFTAKLPDSLTGNGDV

SEQ ID NO: 1581763 - protein, 19 aa, Staphylococcus aureus
VTDQFKDKITYKYQNVASI

SEQ ID NO: 1581764 - protein, 33 aa, Staphylococcus aureus
VTDQFKNRIYYEHPNVASIKFGDITKTYVVLVE

SEQ ID NO: 1581765 - protein, 19 aa, Staphylococcus aureus
VTGEFKDKISYKYDNVASI

SEQ ID NO: 1581766 - protein, 31 aa, Staphylococcus aureus
VTGEFKDKISYKYDNVASINFGDINKTYVVL

SEQ ID NO: 1581767 - protein, 27 aa, Staphylococcus aureus
VTGQVKSGDYFTAKLPDSVTGNGDVDY

SEQ ID NO: 1581768 - protein, 23 aa, Staphylococcus aureus
VTIKPLRDKYRVGTSSTAANPVR

SEQ ID NO: 1581769 - protein, 32 aa, Staphylococcus aureus
VTKEEIPFEKKREFNPDLKPGEEKVTQEGQTG

SEQ ID NO: 1581770 - protein, 24 aa, Staphylococcus aureus
VTLFHCIILILAFLYEFTANRTLN

SEQ ID NO: 1581771 - protein, 32 aa, Staphylococcus aureus
VTNEFKDKITYKYQNVASINFGDINKTYVVLV

SEQ ID NO: 1581772 - protein, 23 aa, Staphylococcus aureus
VTNKFQIVVAIVIIVFQIVLKNV

SEQ ID NO: 1581773 - protein, 28 aa, Staphylococcus aureus
VTSFASKVADGFKRVVSNVGDGMSDALG

SEQ ID NO: 1581774 - protein, 26 aa, Staphylococcus aureus
VTSTAKVPPIMAGDQVLANGVIDSDG

SEQ ID NO: 1581775 - protein, 18 aa, Staphylococcus aureus
VTVNADGTNVQWSNGAGA

SEQ ID NO: 1581776 - protein, 26 aa, Staphylococcus aureus
VTVPVKRVIPEIVAHSHYTVQGQDFP

SEQ ID NO: 1581777 - protein, 17 aa, Staphylococcus aureus
VVAHFFLGATAAAFGNA

SEQ ID NO: 1581778 - protein, 28 aa, Staphylococcus aureus
VVALAVYLFRFVWVYVLYPYFYLAISPF

SEQ ID NO: 1581779 - protein, 18 aa, Staphylococcus aureus
VVFIFQFVSRIADLVIMK

SEQ ID NO: 1581780 - protein, 17 aa, Staphylococcus aureus
VVPCILTIVMSNFSKQK

SEQ ID NO: 1581781 - protein, 22 aa, Staphylococcus aureus
VVPPLFFGGSWDTWVYQGLAVL

SEQ ID NO: 1581782 - protein, 20 aa, Staphylococcus aureus
VVVANIGYEGQYHVRIVNQD

SEQ ID NO: 1581783 - protein, 29 aa, Staphylococcus aureus
VVYVIFYFIWLRFEWPQYLIYILLVLGAL

SEQ ID NO: 1581784 - protein, 19 aa, Staphylococcus aureus
VYIALKYAPFLKEQDWNPV

SEQ ID NO: 1581785 - protein, 24 aa, Staphylococcus aureus
VYKKDRLDVAFSNFFTYSHLSELR

SEQ ID NO: 1581786 - protein, 26 aa, Staphylococcus aureus
VYRDDFRVIFEVQDFGIGIKLEDQQR

SEQ ID NO: 1581787 - protein, 26 aa, Staphylococcus aureus
VYYTKKKAEVELDINTASTWKKFEVY

SEQ ID NO: 1581788 - protein, 17 aa, Staphylococcus aureus
WAVYGIVALVFAYFSFH

SEQ ID NO: 1581789 - protein, 18 aa, Staphylococcus aureus
WFALFLFYKNEFDSENPN

SEQ ID NO: 1581790 - protein, 17 aa, Staphylococcus aureus
WFGEQRTPVYVYKWEDV

SEQ ID NO: 1581791 - protein, 18 aa, Staphylococcus aureus
WFVIPIIIVAALAIPTVK

SEQ ID NO: 1581792 - protein, 26 aa, Staphylococcus aureus
WFVNIFDWRYLFLVVLLIGMVDFVFG

SEQ ID NO: 1581793 - protein, 18 aa, Staphylococcus aureus
WGNTRTFTQFTFKKALLF

SEQ ID NO: 1581794 - protein, 25 aa, Staphylococcus aureus
WGPEIGRIYILPALIGSIILIAIVT

SEQ ID NO: 1581795 - protein, 25 aa, Staphylococcus aureus
WGPEIGRIYILPALIGSIILIALVT

SEQ ID NO: 1581796 - protein, 18 aa, Staphylococcus aureus
WHGFNIPLLLTIIIIILG

SEQ ID NO: 1581797 - protein, 22 aa, Staphylococcus aureus
WISLFFPFINWFITKRYVKISR

SEQ ID NO: 1581798 - protein, 17 aa, Staphylococcus aureus
WLKPLNMTHTSFKQTNN

SEQ ID NO: 1581799 - protein, 20 aa, Staphylococcus aureus
WLPIEIKLTLTTTFIALFSM

SEQ ID NO: 1581800 - protein, 20 aa, Staphylococcus aureus
WLPIEIKLTLTTTFIALFST

SEQ ID NO: 1581801 - protein, 17 aa, Staphylococcus aureus
WLSELWDKIQTTIEPIK

SEQ ID NO: 1581802 - protein, 19 aa, Staphylococcus aureus
WNATKSIFGFLFNSVKSIF

SEQ ID NO: 1581803 - protein, 21 aa, Staphylococcus aureus
WNNENVVRYGGGSADGDSAVN

SEQ ID NO: 1581804 - protein, 20 aa, Staphylococcus aureus
WQEKLVGMGVDLSAIGASAA

SEQ ID NO: 1581805 - protein, 29 aa, Staphylococcus aureus
WSTVTSWFSRVAWSVAEKMGQALNFIITK

SEQ ID NO: 1581806 - protein, 26 aa, Staphylococcus aureus
WVSPYKTRMILGFTMSFLNAIFIALP

SEQ ID NO: 1581807 - protein, 26 aa, Staphylococcus aureus
YALFILFRYRQVMKTETDYVKGIGLA

SEQ ID NO: 1581808 - protein, 27 aa, Staphylococcus aureus
YALFILFRYRQVMKTETDYVKGIGLAV

SEQ ID NO: 1581809 - protein, 18 aa, Staphylococcus aureus
YAMARKGISMEINAISTL

SEQ ID NO: 1581810 - protein, 24 aa, Staphylococcus aureus
YDILTKTYTFVFTDYVNDKENING

SEQ ID NO: 1581811 - protein, 18 aa, Staphylococcus aureus
YDKEGFRDQEFEKGDKGN

SEQ ID NO: 1581812 - protein, 24 aa, Staphylococcus aureus
YDSDKDYAYIRFPVSNGTRDVKIV

SEQ ID NO: 1581813 - protein, 20 aa, Staphylococcus aureus
YDSGIKFPDRIMALITGDVK

SEQ ID NO: 1581814 - protein, 17 aa, Staphylococcus aureus
YDWCYLLYIARHVSKTC

SEQ ID NO: 1581815 - protein, 33 aa, Staphylococcus aureus
YEGHGNGGDGIGFAFSPGVLGETGLNGAAVGIG

SEQ ID NO: 1581816 - protein, 22 aa, Staphylococcus aureus
YEKKNMAGLIFVSWYPTVYWII

SEQ ID NO: 1581817 - protein, 17 aa, Staphylococcus aureus
YFIIVGIIIPTMFLYYF

SEQ ID NO: 1581818 - protein, 17 aa, Staphylococcus aureus
YFIMSADVLEVVDISPE

SEQ ID NO: 1581819 - protein, 24 aa, Staphylococcus aureus
YFLKSRKNWIFWILFLNILMLGIS

SEQ ID NO: 1581820 - protein, 20 aa, Staphylococcus aureus
YGNRHCKNIRDVSRQINRII

SEQ ID NO: 1581821 - protein, 19 aa, Staphylococcus aureus
YGWFLASSVAAFFVGVTEP

SEQ ID NO: 1581822 - protein, 17 aa, Staphylococcus aureus
YHCRFYKVDQLSVQYRT

SEQ ID NO: 1581823 - protein, 24 aa, Staphylococcus aureus
YHLGEEGYPEWVIPTDPARKNEAM

SEQ ID NO: 1581824 - protein, 18 aa, Staphylococcus aureus
YIFFIVSLFLFIIFVWYF

SEQ ID NO: 1581825 - protein, 33 aa, Staphylococcus aureus
YIILSACMTFLFVIVGLCIKLANSFIDPDSQNA

SEQ ID NO: 1581826 - protein, 26 aa, Staphylococcus aureus
YILELHPSFYPSFIALLIINLAVLVW

SEQ ID NO: 1581827 - protein, 19 aa, Staphylococcus aureus
YITNSWLKPLNMTHTSFKQ

SEQ ID NO: 1581828 - protein, 24 aa, Staphylococcus aureus
YKKFKVFSLISTLIIVILAIIRFV

SEQ ID NO: 1581829 - protein, 20 aa, Staphylococcus aureus
YKKVAVLFFECLVFIILSIT

SEQ ID NO: 1581830 - protein, 25 aa, Staphylococcus aureus
YKQAVAKAEALISGTPDVVVTPSEI

SEQ ID NO: 1581831 - protein, 21 aa, Staphylococcus aureus
YKVKPTWRKFISFPITQIVNV

SEQ ID NO: 1581832 - protein, 18 aa, Staphylococcus aureus
YLIGKLSVIYGFLATCIV

SEQ ID NO: 1581833 - protein, 39 aa, Staphylococcus aureus
YLLELSVPLISLFGVCIITILLLCSSVILLTNHQHRDVA

SEQ ID NO: 1581834 - protein, 18 aa, Staphylococcus aureus
YLSCLKLADQYSLNHVAF

SEQ ID NO: 1581835 - protein, 17 aa, Staphylococcus aureus
YLTIYVLVALMYWVVCF

SEQ ID NO: 1581836 - protein, 19 aa, Staphylococcus aureus
YNAQGNIIAKGIYDSTTNT

SEQ ID NO: 1581837 - protein, 18 aa, Staphylococcus aureus
YNFTIYVPYGDYWFAYFM

SEQ ID NO: 1581838 - protein, 20 aa, Staphylococcus aureus
YNGYIFKLVVFASALLTSHG

SEQ ID NO: 1581839 - protein, 18 aa, Staphylococcus aureus
YNLGDYVWEDTNKDGKQD

SEQ ID NO: 1581840 - protein, 23 aa, Staphylococcus aureus
YPIDLLFIICVILGILGLIISLF

SEQ ID NO: 1581841 - protein, 19 aa, Staphylococcus aureus
YPWGQCTWYVHQRRKEIGK

SEQ ID NO: 1581842 - protein, 24 aa, Staphylococcus aureus
YQARRVCWFGSALVTVIIGISLYF

SEQ ID NO: 1581843 - protein, 24 aa, Staphylococcus aureus
YQFSSRLRKFILIILVGAAIATSV

SEQ ID NO: 1581844 - protein, 26 aa, Staphylococcus aureus
YRKIKFYMFISKIFKFNKTTEITLNY

SEQ ID NO: 1581845 - protein, 20 aa, Staphylococcus aureus
YRLIQMIVVLFVISTLTFIL

SEQ ID NO: 1581846 - protein, 35 aa, Staphylococcus aureus
YRQKKSKKGWFWGCGGCLVLFILIIIGISACTAGI

SEQ ID NO: 1581847 - protein, 19 aa, Staphylococcus aureus
YSFVDVMIIFLREGLEVLL

SEQ ID NO: 1581848 - protein, 18 aa, Staphylococcus aureus
YSSPIAGIDKPNGANISS

SEQ ID NO: 1581849 - protein, 17 aa, Staphylococcus aureus
YTEKSTHSYKQRIKELD

SEQ ID NO: 1581850 - protein, 17 aa, Staphylococcus aureus
YTLNIPYIIALIPTVIL

SEQ ID NO: 1581851 - protein, 24 aa, Staphylococcus aureus
YVEDSRNGIVLKLLSVVFTVVMGV

SEQ ID NO: 1581852 - protein, 22 aa, Staphylococcus aureus
YVKTPSNKVLGFYPTNATTNAF

SEQ ID NO: 1581853 - protein, 27 aa, Staphylococcus aureus
YVPYGDYWFAYFMRRLAERPQNLSLAV

SEQ ID NO: 1581854 - protein, 18 aa, Staphylococcus aureus
YVVTFFFCIIIGACNLFV

SEQ ID NO: 1581855 - protein, 18 aa, Staphylococcus aureus
YYFVFHIIIYQLELILNK

SEQ ID NO: 1581856 - protein, 23 aa, Staphylococcus aureus
AADLSESYFVNPENFEDVTNSVN

SEQ ID NO: 1581857 - protein, 17 aa, Staphylococcus aureus
AAFPSLYGHKVLIACLL

SEQ ID NO: 1581858 - protein, 18 aa, Staphylococcus aureus
AAGGSVLFGVTFRKYTQF

SEQ ID NO: 1581859 - protein, 19 aa, Staphylococcus aureus
AALAGMVVLSCINPVAGAV

SEQ ID NO: 1581860 - protein, 20 aa, Staphylococcus aureus
AANFANYFSILKFFKITIPF

SEQ ID NO: 1581861 - protein, 25 aa, Staphylococcus aureus
AATHCVTRLRLVLKDESKVDKGALS

SEQ ID NO: 1581862 - protein, 31 aa, Staphylococcus aureus
AAVGIGGLSNAFGFKLDTYHNTSTPNASAKA

SEQ ID NO: 1581863 - protein, 32 aa, Staphylococcus aureus
AAVGIGGLSNAFGFKLDTYHNTSTPNASAKAK

SEQ ID NO: 1581864 - protein, 21 aa, Staphylococcus aureus
AAVKSKINAASNIAGVNTVKQ

SEQ ID NO: 1581865 - protein, 17 aa, Staphylococcus aureus
ACGALIFNRRHQLKAKT

SEQ ID NO: 1581866 - protein, 20 aa, Staphylococcus aureus
ACNAVDIVVVIAFQTLVATV

SEQ ID NO: 1581867 - protein, 17 aa, Staphylococcus aureus
ACSSSIHFINWIFLLGG

SEQ ID NO: 1581868 - protein, 20 aa, Staphylococcus aureus
ADAALTHFIEIWPYVEGQIQ

SEQ ID NO: 1581869 - protein, 27 aa, Staphylococcus aureus
ADAALTHVIEIWPYVEGQIQTKDGALY

SEQ ID NO: 1581870 - protein, 24 aa, Staphylococcus aureus
ADDAKRTAYSQAVNAAATILNKTA

SEQ ID NO: 1581871 - protein, 17 aa, Staphylococcus aureus
ADEMFNNKITYNYSSPI

SEQ ID NO: 1581872 - protein, 22 aa, Staphylococcus aureus
ADIGCAFVMFGITYFVGSYFSE

SEQ ID NO: 1581873 - protein, 17 aa, Staphylococcus aureus
ADKRELITAKNHLDDPV

SEQ ID NO: 1581874 - protein, 20 aa, Staphylococcus aureus
ADMYKWGAIIILAITLGFAD

SEQ ID NO: 1581875 - protein, 21 aa, Staphylococcus aureus
ADVKSKINAASNIAGVNTVKQ

SEQ ID NO: 1581876 - protein, 17 aa, Staphylococcus aureus
ADVLMKLSRSFNYEIYH

SEQ ID NO: 1581877 - protein, 17 aa, Staphylococcus aureus
AEEVIKLNDAVTAAKQA

SEQ ID NO: 1581878 - protein, 22 aa, Staphylococcus aureus
AEFRKNVTYHLALIGKTVYPTF

SEQ ID NO: 1581879 - protein, 17 aa, Staphylococcus aureus
AEHSKTLNVVRGQNNQW

SEQ ID NO: 1581880 - protein, 23 aa, Staphylococcus aureus
AELIHWISILPVIIFNKGPRVVK

SEQ ID NO: 1581881 - protein, 22 aa, Staphylococcus aureus
AETPKVRKARSVDEGSFDITRD

SEQ ID NO: 1581882 - protein, 26 aa, Staphylococcus aureus
AFAMGVPLGHIFTHRFGFKRNYLFFV

SEQ ID NO: 1581883 - protein, 18 aa, Staphylococcus aureus
AFLLYANVLFLKRRSSEL

SEQ ID NO: 1581884 - protein, 20 aa, Staphylococcus aureus
AFVPSVVGLICASYVVNDVL

SEQ ID NO: 1581885 - protein, 17 aa, Staphylococcus aureus
AGACLGLGYGNLSSSMQ

SEQ ID NO: 1581886 - protein, 19 aa, Staphylococcus aureus
AGAFSIAGAGAVAFGVMAI

SEQ ID NO: 1581887 - protein, 22 aa, Staphylococcus aureus
AGIERKWLDQIIMFIADMLLAI

SEQ ID NO: 1581888 - protein, 17 aa, Staphylococcus aureus
AGIGCYFWNQLLLLFTI

SEQ ID NO: 1581889 - protein, 20 aa, Staphylococcus aureus
AGKHTPVKPMSATKDHHNKA

SEQ ID NO: 1581890 - protein, 23 aa, Staphylococcus aureus
AGKQEALISFTFKVDEKIKKYPL

SEQ ID NO: 1581891 - protein, 18 aa, Staphylococcus aureus
AGLLSSAIFALAHFLNIT

SEQ ID NO: 1581892 - protein, 23 aa, Staphylococcus aureus
AGRFGDGLVNVFTQLAPLFLWVA

SEQ ID NO: 1581893 - protein, 17 aa, Staphylococcus aureus
AGTFIFGGSVVIWLLSY

SEQ ID NO: 1581894 - protein, 20 aa, Staphylococcus aureus
AGTLAYIYAIPVASLALLIA

SEQ ID NO: 1581895 - protein, 30 aa, Staphylococcus aureus
AGVKGALIGSLWLMLSIIPLLIILGIGTAI

SEQ ID NO: 1581896 - protein, 28 aa, Staphylococcus aureus
AGVKGALIGSLWLMLSIIPLSIILGIGK

SEQ ID NO: 1581897 - protein, 24 aa, Staphylococcus aureus
AGYKKGWIERIILRIVDIGLSIPE

SEQ ID NO: 1581898 - protein, 22 aa, Staphylococcus aureus
AGYSMWKPPIFNIVFTKESVDF

SEQ ID NO: 1581899 - protein, 26 aa, Staphylococcus aureus
AHMIPEVIGNLLLSAAIFLYIMLIDW

SEQ ID NO: 1581900 - protein, 43 aa, Staphylococcus aureus
AHMIPEVIGNLLLSAAIFLYIMLIDWRMACALLVTIPIALFAF

SEQ ID NO: 1581901 - protein, 17 aa, Staphylococcus aureus
AIAVLGIIIYHLNKQWL

SEQ ID NO: 1581902 - protein, 23 aa, Staphylococcus aureus
AIFSCLPSGVLPNYINKLLNKSE

SEQ ID NO: 1581903 - protein, 20 aa, Staphylococcus aureus
AIGGVPPFSGFRESTYFPRC

SEQ ID NO: 1581904 - protein, 18 aa, Staphylococcus aureus
AIIGEWAEASIVVILFAI

SEQ ID NO: 1581905 - protein, 17 aa, Staphylococcus aureus
AIITFIVTFYLFKILHF

SEQ ID NO: 1581906 - protein, 26 aa, Staphylococcus aureus
AIKKGWPSMMYRIWKNPEKYKSYFIG

SEQ ID NO: 1581907 - protein, 29 aa, Staphylococcus aureus
AIKLGEHLKHPFILKRIAGQSGMSYGALG

SEQ ID NO: 1581908 - protein, 20 aa, Staphylococcus aureus
AILEQFSWHSAFLINVPFAI

SEQ ID NO: 1581909 - protein, 20 aa, Staphylococcus aureus
AILGIGGAVAAVLFTRKDSR

SEQ ID NO: 1581910 - protein, 17 aa, Staphylococcus aureus
AILMSLSTIIVAINAFT

SEQ ID NO: 1581911 - protein, 23 aa, Staphylococcus aureus
AILSIGGAVAAVLVTRKDSRDKL

SEQ ID NO: 1581912 - protein, 19 aa, Staphylococcus aureus
AIQKLHGFSTTRIIFHNIH

SEQ ID NO: 1581913 - protein, 22 aa, Staphylococcus aureus
AISCVFWIYCLVVLLVYIGTIF

SEQ ID NO: 1581914 - protein, 19 aa, Staphylococcus aureus
AISLWRFVAGFIVALVVAI

SEQ ID NO: 1581915 - protein, 24 aa, Staphylococcus aureus
AISLWRFVGGFVVALLVAIPLGFL

SEQ ID NO: 1581916 - protein, 27 aa, Staphylococcus aureus
AIYACRFVWVYFWYKDFYFPKNIQSYL

SEQ ID NO: 1581917 - protein, 21 aa, Staphylococcus aureus
AIYAMAGAVWPNGGRQTFNAI

SEQ ID NO: 1581918 - protein, 23 aa, Staphylococcus aureus
AIYFYPRFKRSMIGIIVAMTCVF

SEQ ID NO: 1581919 - protein, 31 aa, Staphylococcus aureus
AIYFYPRFKRSMIGISVAMTWIFLNDYIDYF

SEQ ID NO: 1581920 - protein, 19 aa, Staphylococcus aureus
AKAAAKQNLGTLNHITNAQ

SEQ ID NO: 1581921 - protein, 27 aa, Staphylococcus aureus
AKANHSIEFNMIWKAMLIPSMGYIVGL

SEQ ID NO: 1581922 - protein, 28 aa, Staphylococcus aureus
AKDKKLEVISSLFSVKKITFDLSDAKKT

SEQ ID NO: 1581923 - protein, 18 aa, Staphylococcus aureus
AKDRLAQALQDIKDLVKA

SEQ ID NO: 1581924 - protein, 18 aa, Staphylococcus aureus
AKERLAQALQDIKDLVKA

SEQ ID NO: 1581925 - protein, 19 aa, Staphylococcus aureus
AKGFVRKAGTFIFGGSVVI

SEQ ID NO: 1581926 - protein, 20 aa, Staphylococcus aureus
AKIFIVQKVIQHFKNESKKD

SEQ ID NO: 1581927 - protein, 18 aa, Staphylococcus aureus
AKINSFWPVAGSTVLFGV

SEQ ID NO: 1581928 - protein, 24 aa, Staphylococcus aureus
AKITRNQMTFLFAIPMTVALIHTL

SEQ ID NO: 1581929 - protein, 17 aa, Staphylococcus aureus
AKKNVFWPVAGISALFA

SEQ ID NO: 1581930 - protein, 27 aa, Staphylococcus aureus
AKPEEKLYKIGDYVWEDVDKDGVQGTD

SEQ ID NO: 1581931 - protein, 19 aa, Staphylococcus aureus
AKSPKFLVRFWTLASGTIL

SEQ ID NO: 1581932 - protein, 25 aa, Staphylococcus aureus
AKTKLRLYMREIPKSSIKPEHFHLM

SEQ ID NO: 1581933 - protein, 18 aa, Staphylococcus aureus
AKVEVTLLDGSKVIVNVP

SEQ ID NO: 1581934 - protein, 17 aa, Staphylococcus aureus
ALEEISFMLNRAMANED

SEQ ID NO: 1581935 - protein, 24 aa, Staphylococcus aureus
ALFEEVVCRGIIFNEFLKNNTPLK

SEQ ID NO: 1581936 - protein, 18 aa, Staphylococcus aureus
ALFSDSLATIVGSIFGTT

SEQ ID NO: 1581937 - protein, 18 aa, Staphylococcus aureus
ALFSDSLATIVGSVFGTT

SEQ ID NO: 1581938 - protein, 27 aa, Staphylococcus aureus
ALIFPYVGLRLRWQWYQSGLKSWQVNL

SEQ ID NO: 1581939 - protein, 17 aa, Staphylococcus aureus
ALIGALIAMKFDLSPLA

SEQ ID NO: 1581940 - protein, 25 aa, Staphylococcus aureus
ALIMFSVFFAFVFQEDVMIKSMGMA

SEQ ID NO: 1581941 - protein, 19 aa, Staphylococcus aureus
ALKIKGMVLYMNRNTKTTK

SEQ ID NO: 1581942 - protein, 19 aa, Staphylococcus aureus
ALKSACRVNNIPIITSHAL

SEQ ID NO: 1581943 - protein, 18 aa, Staphylococcus aureus
ALLDIKLEMLDLMNKYQI

SEQ ID NO: 1581944 - protein, 17 aa, Staphylococcus aureus
ALLFALSSGRTFIGQTT

SEQ ID NO: 1581945 - protein, 19 aa, Staphylococcus aureus
ALLLHLRPLGLKDKSLGEG

SEQ ID NO: 1581946 - protein, 23 aa, Staphylococcus aureus
ALLYNFVSAILWFIVAISLFIRK

SEQ ID NO: 1581947 - protein, 23 aa, Staphylococcus aureus
ALNNAMKGLRDSIANETTVKTSQ

SEQ ID NO: 1581948 - protein, 20 aa, Staphylococcus aureus
ALNQAMEALRNSIQDQQQTE

SEQ ID NO: 1581949 - protein, 24 aa, Staphylococcus aureus
ALPEGKMALRHGFDTATEVGIKAP

SEQ ID NO: 1581950 - protein, 26 aa, Staphylococcus aureus
ALPNGEIKARSSISMNNVTYTTQDEH

SEQ ID NO: 1581951 - protein, 27 aa, Staphylococcus aureus
ALPNGEIKARSSISMNNVTYTTQDEHG

SEQ ID NO: 1581952 - protein, 20 aa, Staphylococcus aureus
ALSDRFGRRPVLLASLLGAT

SEQ ID NO: 1581953 - protein, 24 aa, Staphylococcus aureus
ALSMFGTSWSQIWSTITNFVSNIW

SEQ ID NO: 1581954 - protein, 19 aa, Staphylococcus aureus
ALSSGRTFIGQTTFHPEKL

SEQ ID NO: 1581955 - protein, 18 aa, Staphylococcus aureus
ALTAKGYNYTSVDSSYAS

SEQ ID NO: 1581956 - protein, 19 aa, Staphylococcus aureus
ALVIGAAPFYARLVEIAFK

SEQ ID NO: 1581957 - protein, 17 aa, Staphylococcus aureus
ALVRRNGQEIMIHVDDI

SEQ ID NO: 1581958 - protein, 19 aa, Staphylococcus aureus
ALVSMPLLSIIGLDFNSSI

SEQ ID NO: 1581959 - protein, 17 aa, Staphylococcus aureus
AMEALRNSIQDQQQTEA

SEQ ID NO: 1581960 - protein, 20 aa, Staphylococcus aureus
AMFNPSFIVRSFHVITTAGM

SEQ ID NO: 1581961 - protein, 27 aa, Staphylococcus aureus
AMGYIKRIGLYISIFILIVMVAGCGKD

SEQ ID NO: 1581962 - protein, 18 aa, Staphylococcus aureus
AMIFPIINVWLISQWGWR

SEQ ID NO: 1581963 - protein, 24 aa, Staphylococcus aureus
AMKQSRVFAQLGIAMFTLIITISV

SEQ ID NO: 1581964 - protein, 19 aa, Staphylococcus aureus
AMTALKRAIADKADTKTSG

SEQ ID NO: 1581965 - protein, 18 aa, Staphylococcus aureus
ANEIPKAKIDANKDADKQ

SEQ ID NO: 1581966 - protein, 25 aa, Staphylococcus aureus
ANEKGIKGVYVILKDSNGKELDRTT

SEQ ID NO: 1581967 - protein, 17 aa, Staphylococcus aureus
ANEKNYKFETVTRNVAE

SEQ ID NO: 1581968 - protein, 22 aa, Staphylococcus aureus
ANGAYKYNPYILNQINQLGKEY

SEQ ID NO: 1581969 - protein, 20 aa, Staphylococcus aureus
ANIFIYKGKTVVKLEKGKDT

SEQ ID NO: 1581970 - protein, 24 aa, Staphylococcus aureus
ANIIVCGYFAFSIFVGIYLSINNR

SEQ ID NO: 1581971 - protein, 22 aa, Staphylococcus aureus
ANIYYKSIIKITITVKVGTNLQ

SEQ ID NO: 1581972 - protein, 25 aa, Staphylococcus aureus
ANLELDFLMFIRKFIVLLFVFACIT

SEQ ID NO: 1581973 - protein, 20 aa, Staphylococcus aureus
ANLTSQIERGTTVAGVQGIQ

SEQ ID NO: 1581974 - protein, 27 aa, Staphylococcus aureus
ANMFSTFRFSWAYRLATIITLIISILQ

SEQ ID NO: 1581975 - protein, 17 aa, Staphylococcus aureus
ANMPLSMILLGVMLNFT

SEQ ID NO: 1581976 - protein, 19 aa, Staphylococcus aureus
ANMTNHWGMEKKVITSNKK

SEQ ID NO: 1581977 - protein, 22 aa, Staphylococcus aureus
ANMVFDWKLRWYLLENIPHLPI

SEQ ID NO: 1581978 - protein, 40 aa, Staphylococcus aureus
ANNLITYTFTDYVDRFNSVKMGINYSIYMDADTIPVDKKD

SEQ ID NO: 1581979 - protein, 17 aa, Staphylococcus aureus
ANNRFTHVAFIKPNNGK

SEQ ID NO: 1581980 - protein, 17 aa, Staphylococcus aureus
ANRSLWIKFKEGISQLL

SEQ ID NO: 1581981 - protein, 20 aa, Staphylococcus aureus
ANVKGLGVISSREFSKAETQ

SEQ ID NO: 1581982 - protein, 22 aa, Staphylococcus aureus
APIPGRSAVGIEVPNEKISLVS

SEQ ID NO: 1581983 - protein, 17 aa, Staphylococcus aureus
APKTVIGNMSFKVARIY

SEQ ID NO: 1581984 - protein, 18 aa, Staphylococcus aureus
APSQAFVDKFAKYYTPII

SEQ ID NO: 1581985 - protein, 27 aa, Staphylococcus aureus
APSSFWCYVESIILFILLPLVIVNFHI

SEQ ID NO: 1581986 - protein, 18 aa, Staphylococcus aureus
APVGAIISFIGVPCFLYL

SEQ ID NO: 1581987 - protein, 18 aa, Staphylococcus aureus
APVGAIISFIGVPYFLYL

SEQ ID NO: 1581988 - protein, 23 aa, Staphylococcus aureus
AQAKESAKRALASYSNLNNAQST

SEQ ID NO: 1581989 - protein, 20 aa, Staphylococcus aureus
AQALNQAMEALRNSIQDQQQ

SEQ ID NO: 1581990 - protein, 17 aa, Staphylococcus aureus
AQSEERLPDTGDSIKQN

SEQ ID NO: 1581991 - protein, 17 aa, Staphylococcus aureus
AQSFGMKILAFDPYLTD

SEQ ID NO: 1581992 - protein, 19 aa, Staphylococcus aureus
ARFISLVLICAMFAICWVA

SEQ ID NO: 1581993 - protein, 29 aa, Staphylococcus aureus
ARFISLVLICAMFAICWVVYIQWESTIAS

SEQ ID NO: 1581994 - protein, 18 aa, Staphylococcus aureus
ARILERVIATPIDLDAVR

SEQ ID NO: 1581995 - protein, 25 aa, Staphylococcus aureus
ARMFEIMEMYKPYAVYHAAAHKHVP

SEQ ID NO: 1581996 - protein, 24 aa, Staphylococcus aureus
ASDLKYSTEITLNFDSEDIEDYVE

SEQ ID NO: 1581997 - protein, 24 aa, Staphylococcus aureus
ASDRIRLSLPKGKYRVNLKGIYGE

SEQ ID NO: 1581998 - protein, 21 aa, Staphylococcus aureus
ASEHPMKLVLPIITLVGGTVG

SEQ ID NO: 1581999 - protein, 18 aa, Staphylococcus aureus
ASESKPRVTRSADVAEAK

SEQ ID NO: 1582000 - protein, 19 aa, Staphylococcus aureus
ASFLPLVMLGLHHIFTPIH

SEQ ID NO: 1582001 - protein, 19 aa, Staphylococcus aureus
ASGILYIIGAVISANLLTF

SEQ ID NO: 1582002 - protein, 21 aa, Staphylococcus aureus
ASILVGTTLIFGLGNQEAKAA

SEQ ID NO: 1582003 - protein, 22 aa, Staphylococcus aureus
ASKPVVTLMPQFVDYLEGQLSS

SEQ ID NO: 1582004 - protein, 34 aa, Staphylococcus aureus
ASKTVLIDYEKYGQFHNLSIKGTIDQIDKTNNTY

SEQ ID NO: 1582005 - protein, 21 aa, Staphylococcus aureus
ASNLRLIFKHILPNTLGAIIV

SEQ ID NO: 1582006 - protein, 24 aa, Staphylococcus aureus
ASNPVGWAVLGGFAVATGITIAAD

SEQ ID NO: 1582007 - protein, 24 aa, Staphylococcus aureus
ASSEFFIYMFAFWFIFSSIAGLFT

SEQ ID NO: 1582008 - protein, 24 aa, Staphylococcus aureus
ASSEFQMIQFIPLVIVPQVLFAGI

SEQ ID NO: 1582009 - protein, 29 aa, Staphylococcus aureus
ASSVGVSGNAIWDFLLKFINNEPINTPFY

SEQ ID NO: 1582010 - protein, 21 aa, Staphylococcus aureus
ASVIVSTLFLITSQHQAHAAE

SEQ ID NO: 1582011 - protein, 20 aa, Staphylococcus aureus
ASVVPVVFALLNAIKVLTGG

SEQ ID NO: 1582012 - protein, 17 aa, Staphylococcus aureus
ATAKLNAKTYLNTLTSI

SEQ ID NO: 1582013 - protein, 28 aa, Staphylococcus aureus
ATDEVMISPSFIKQKWFGEQRTPVYVYK

SEQ ID NO: 1582014 - protein, 18 aa, Staphylococcus aureus
ATDIDFIIIIGFIITFIG

SEQ ID NO: 1582015 - protein, 25 aa, Staphylococcus aureus
ATDTCIICISGFLFFTYLYLNSHDF

SEQ ID NO: 1582016 - protein, 28 aa, Staphylococcus aureus
ATDTKLRIFEVNDISKLSDSYYADPNDS

SEQ ID NO: 1582017 - protein, 22 aa, Staphylococcus aureus
ATELNGAMTVLKAAIADKERTK

SEQ ID NO: 1582018 - protein, 32 aa, Staphylococcus aureus
ATELNGAMTVLKAAIADKERTKASGNYVNADQ

SEQ ID NO: 1582019 - protein, 22 aa, Staphylococcus aureus
ATEPMPHLFIISDEFAELKSEQ

SEQ ID NO: 1582020 - protein, 18 aa, Staphylococcus aureus
ATFQELQDGIGLPLFTAL

SEQ ID NO: 1582021 - protein, 31 aa, Staphylococcus aureus
ATGKDYSIFGWNNENVVRYGGGSADGDSAVN

SEQ ID NO: 1582022 - protein, 18 aa, Staphylococcus aureus
ATGKVVLLPTHRGTVSSG

SEQ ID NO: 1582023 - protein, 25 aa, Staphylococcus aureus
ATGLPTDGFTYKWNNAATGTNDANW

SEQ ID NO: 1582024 - protein, 18 aa, Staphylococcus aureus
ATIHDFNLIKAIGVLLLI

SEQ ID NO: 1582025 - protein, 25 aa, Staphylococcus aureus
ATIPIIASLFIPFGASIGLDTMALI

SEQ ID NO: 1582026 - protein, 19 aa, Staphylococcus aureus
ATIPSFIGLLILYYICRLI

SEQ ID NO: 1582027 - protein, 22 aa, Staphylococcus aureus
ATITLLCTFLIVTLTMTLTTYR

SEQ ID NO: 1582028 - protein, 25 aa, Staphylococcus aureus
ATKVGEVWAMLCISLLLVAYLMLKR

SEQ ID NO: 1582029 - protein, 26 aa, Staphylococcus aureus
ATWIAKRVGLTWQDLEKGIAERLNTA

SEQ ID NO: 1582030 - protein, 20 aa, Staphylococcus aureus
ATYLYLKLYRNFMVSYFYQL

SEQ ID NO: 1582031 - protein, 25 aa, Staphylococcus aureus
AVATGITIAADWAYENNMWGLKDKT

SEQ ID NO: 1582032 - protein, 18 aa, Staphylococcus aureus
AVCVLIINLFLFFISIAA

SEQ ID NO: 1582033 - protein, 25 aa, Staphylococcus aureus
AVGSGLAFAADWAYQTNKLGLKDKT

SEQ ID NO: 1582034 - protein, 19 aa, Staphylococcus aureus
AVIFYKRLEFSGIGLLFCQ

SEQ ID NO: 1582035 - protein, 19 aa, Staphylococcus aureus
AVIKPESQQAYFLNVIFLM

SEQ ID NO: 1582036 - protein, 24 aa, Staphylococcus aureus
AVITCVFVPIIFKKLFPVPDEFNR

SEQ ID NO: 1582037 - protein, 24 aa, Staphylococcus aureus
AVKTADVAWAFGDLGVGLMAWLNI

SEQ ID NO: 1582038 - protein, 33 aa, Staphylococcus aureus
AVLDGLSFLTLYLLDVHLGYTFSGGFIDYVLLG

SEQ ID NO: 1582039 - protein, 19 aa, Staphylococcus aureus
AVLIPTFSSIIFLFFKLKY

SEQ ID NO: 1582040 - protein, 22 aa, Staphylococcus aureus
AVLTLVFVIGIIMSKSKEVYYS

SEQ ID NO: 1582041 - protein, 22 aa, Staphylococcus aureus
AVLVVGCPCALVITTPISIVSA

SEQ ID NO: 1582042 - protein, 27 aa, Staphylococcus aureus
AVNTSAPRMRAFSLAAVAADAPAAGKD

SEQ ID NO: 1582043 - protein, 28 aa, Staphylococcus aureus
AVNTSAPRMRAFSLAAVAADAPAAGKDI

SEQ ID NO: 1582044 - protein, 27 aa, Staphylococcus aureus
AVNTSAPRMRAFSLAAVAADAPAAGTD

SEQ ID NO: 1582045 - protein, 28 aa, Staphylococcus aureus
AVNTSAPRMRAFSLAAVAADAPAAGTDI

SEQ ID NO: 1582046 - protein, 28 aa, Staphylococcus aureus
AVNTSAPRMRAFSLSAVAADAPAAGKDI

SEQ ID NO: 1582047 - protein, 18 aa, Staphylococcus aureus
AVQIVPLIIKYASEFKII

SEQ ID NO: 1582048 - protein, 24 aa, Staphylococcus aureus
AVRDDAWLQKKLNYISKKTYQGIF

SEQ ID NO: 1582049 - protein, 18 aa, Staphylococcus aureus
AVTISIVITMVFVTIVTG

SEQ ID NO: 1582050 - protein, 26 aa, Staphylococcus aureus
AVVLIMVLIGFIFWRQDDYTSRDFEN

SEQ ID NO: 1582051 - protein, 30 aa, Staphylococcus aureus
AVYVIFYFIWIRFEWPHYLLYILLVLGALS

SEQ ID NO: 1582052 - protein, 29 aa, Staphylococcus aureus
AVYVIFYFIWLRFEWPQYLIYILLVLGAL

SEQ ID NO: 1582053 - protein, 27 aa, Staphylococcus aureus
AYKQAVAKAEALISGTPDVVVTPSEIT

SEQ ID NO: 1582054 - protein, 20 aa, Staphylococcus aureus
CGSSWPLCHGALIPEFFPID

SEQ ID NO: 1582055 - protein, 25 aa, Staphylococcus aureus
CIIEITIFCYFQFSTIYIYNTEGVR

SEQ ID NO: 1582056 - protein, 18 aa, Staphylococcus aureus
CILNRIISFLLIVHSTFL

SEQ ID NO: 1582057 - protein, 23 aa, Staphylococcus aureus
CLIDSFFNYLFGYSRYLTYILVL

SEQ ID NO: 1582058 - protein, 26 aa, Staphylococcus aureus
CLLYLSILLCVFKIIIPSRIGEILGW

SEQ ID NO: 1582059 - protein, 17 aa, Staphylococcus aureus
CLMLGDKPLLFLAPISY

SEQ ID NO: 1582060 - protein, 20 aa, Staphylococcus aureus
CLTFLGFVYQLYSKKSMQLV

SEQ ID NO: 1582061 - protein, 17 aa, Staphylococcus aureus
CLTVFKMKGIYAALTTL

SEQ ID NO: 1582062 - protein, 19 aa, Staphylococcus aureus
CLVLLIILIVGYVIMTKTN

SEQ ID NO: 1582063 - protein, 20 aa, Staphylococcus aureus
CMLFIPQLYFYLPLLSFIGG

SEQ ID NO: 1582064 - protein, 19 aa, Staphylococcus aureus
CNAVDIAVVIAFQTLVATV

SEQ ID NO: 1582065 - protein, 20 aa, Staphylococcus aureus
CQFGRQGVKLLFKRPKSNMF

SEQ ID NO: 1582066 - protein, 17 aa, Staphylococcus aureus
CRFNEIFNNSSGDLAYL

SEQ ID NO: 1582067 - protein, 24 aa, Staphylococcus aureus
CRQVCNFYPERIILLGHGENSIYL

SEQ ID NO: 1582068 - protein, 25 aa, Staphylococcus aureus
CRQVCNFYPERIILLGHGENSIYLI

SEQ ID NO: 1582069 - protein, 17 aa, Staphylococcus aureus
CSCIFSFLYQFISIEET

SEQ ID NO: 1582070 - protein, 17 aa, Staphylococcus aureus
CVEWLAAAVVLYFCGVI

SEQ ID NO: 1582071 - protein, 26 aa, Staphylococcus aureus
CVKVFKLDIKWPFLLSELGIVLLGVQ

SEQ ID NO: 1582072 - protein, 20 aa, Staphylococcus aureus
CVLIPLNFFFRFNDIKKDNN

SEQ ID NO: 1582073 - protein, 20 aa, Staphylococcus aureus
CVLLFIIISIALIFHRLQTK

SEQ ID NO: 1582074 - protein, 19 aa, Staphylococcus aureus
CVLLLLKYIGFKLFIYLFM

SEQ ID NO: 1582075 - protein, 19 aa, Staphylococcus aureus
CWIMMTMLFFLLNMAAIGN

SEQ ID NO: 1582076 - protein, 19 aa, Staphylococcus aureus
CWIMMTMLFFLLNMASIGN

SEQ ID NO: 1582077 - protein, 17 aa, Staphylococcus aureus
CYFWNQLLLLFTIITIV

SEQ ID NO: 1582078 - protein, 34 aa, Staphylococcus aureus
DADNMTLDSGFYKTPKYNLGNYVWEDTNKDGKQD

SEQ ID NO: 1582079 - protein, 36 aa, Staphylococcus aureus
DADNMTLDSGFYKTSKYSLGDYVWYDSNKDGKQDST

SEQ ID NO: 1582080 - protein, 20 aa, Staphylococcus aureus
DAEQSKKTAYDQAVAAAKAI

SEQ ID NO: 1582081 - protein, 21 aa, Staphylococcus aureus
DAGKHTLVKPMSTTKDHHNKA

SEQ ID NO: 1582082 - protein, 17 aa, Staphylococcus aureus
DAINPKEPVNVSKEELK

SEQ ID NO: 1582083 - protein, 23 aa, Staphylococcus aureus
DALKGKAYTSAKQFFSTVLIPLS

SEQ ID NO: 1582084 - protein, 23 aa, Staphylococcus aureus
DASDEIVKGLGIPKSVVNASKIK

SEQ ID NO: 1582085 - protein, 40 aa, Staphylococcus aureus
DAYSQKGAITLGTRIDSNKSFHFSGKVNLGNKYEGNGNGG

SEQ ID NO: 1582086 - protein, 17 aa, Staphylococcus aureus
DDAKRLANTLINSDHTN

SEQ ID NO: 1582087 - protein, 24 aa, Staphylococcus aureus
DDALKGKVYTSAKQFFSTVLIPLS

SEQ ID NO: 1582088 - protein, 32 aa, Staphylococcus aureus
DDFFNSNFWIYWKMMFAFEPWHSAMEMRRYLM

SEQ ID NO: 1582089 - protein, 21 aa, Staphylococcus aureus
DDGGHLIARMFGGSKDIDNLV

SEQ ID NO: 1582090 - protein, 33 aa, Staphylococcus aureus
DDIDPLHMRHFSNNFGNVIKNAIGVVGISGLLA

SEQ ID NO: 1582091 - protein, 21 aa, Staphylococcus aureus
DDYWKDFMVEGQRVRTISKDA

SEQ ID NO: 1582092 - protein, 21 aa, Staphylococcus aureus
DEAKALNRVMDQLSQGITGNE

SEQ ID NO: 1582093 - protein, 23 aa, Staphylococcus aureus
DEEGDKFLVLSILFVVLKSSLFF

SEQ ID NO: 1582094 - protein, 18 aa, Staphylococcus aureus
DEEIYLINKDFKKEQSND

SEQ ID NO: 1582095 - protein, 32 aa, Staphylococcus aureus
DEIDPLHMRHFGDRIGNVIKNALGVVGISGLL

SEQ ID NO: 1582096 - protein, 20 aa, Staphylococcus aureus
DEIEVIKAQLVILDENYDLD

SEQ ID NO: 1582097 - protein, 30 aa, Staphylococcus aureus
DEKVLKDNEHSPLLFAKRRKDKEEDVETTT

SEQ ID NO: 1582098 - protein, 26 aa, Staphylococcus aureus
DEKVLKDNEHSPLLIAKRRKDKEEDV

SEQ ID NO: 1582099 - protein, 22 aa, Staphylococcus aureus
DELEGITFLLACYNESDTIEDT

SEQ ID NO: 1582100 - protein, 18 aa, Staphylococcus aureus
DELFALFIDGQWGVGKTY

SEQ ID NO: 1582101 - protein, 27 aa, Staphylococcus aureus
DELILLDFRLPRMMITILAGVTLSISG

SEQ ID NO: 1582102 - protein, 37 aa, Staphylococcus aureus
DENGKYRFDNLDSGKYKVIFEKPAGLTQTGTNTTEDD

SEQ ID NO: 1582103 - protein, 24 aa, Staphylococcus aureus
DEQKRNAYNQAVSAAETILNKQTG

SEQ ID NO: 1582104 - protein, 28 aa, Staphylococcus aureus
DEVETLKWARWLPHMTLRDQNIRGFVYN

SEQ ID NO: 1582105 - protein, 30 aa, Staphylococcus aureus
DEVETLKWARWLPHMTLRSQNIRGFVYNQR

SEQ ID NO: 1582106 - protein, 28 aa, Staphylococcus aureus
DEVKGNLLLELAVIFGVSSLVTAFLKTK

SEQ ID NO: 1582107 - protein, 19 aa, Staphylococcus aureus
DFAKEWSFWGIKYGLFIQS

SEQ ID NO: 1582108 - protein, 18 aa, Staphylococcus aureus
DFAVIKAYAKEHPEDDIP

SEQ ID NO: 1582109 - protein, 17 aa, Staphylococcus aureus
DFIDYLFIDEAGQAIPQ

SEQ ID NO: 1582110 - protein, 31 aa, Staphylococcus aureus
DFKRNMRTAQRMAKTYIPDEIKTEVTANIRD

SEQ ID NO: 1582111 - protein, 24 aa, Staphylococcus aureus
DFVGFISAWGYWFSAFLGNVAYVT

SEQ ID NO: 1582112 - protein, 20 aa, Staphylococcus aureus
DFVTRGNLSLSPQKLGADVM

SEQ ID NO: 1582113 - protein, 19 aa, Staphylococcus aureus
DFVTRGNLSLSPQTIGEET

SEQ ID NO: 1582114 - protein, 24 aa, Staphylococcus aureus
DGAKFCPECGYKIANLNNVSNIRD

SEQ ID NO: 1582115 - protein, 28 aa, Staphylococcus aureus
DGETYTVKFETPAGYLPTKVNGTTDGEK

SEQ ID NO: 1582116 - protein, 17 aa, Staphylococcus aureus
DGGYSLDFSDLDNSKDY

SEQ ID NO: 1582117 - protein, 19 aa, Staphylococcus aureus
DGIKALLDHEQFNVDIQTG

SEQ ID NO: 1582118 - protein, 22 aa, Staphylococcus aureus
DGKHYGIDFALPIGTPIKAPTN

SEQ ID NO: 1582119 - protein, 21 aa, Staphylococcus aureus
DGKKLFFFLWDFVIFVFNVQL

SEQ ID NO: 1582120 - protein, 23 aa, Staphylococcus aureus
DGKKLIFFLWDFMMYVFNIQMRN

SEQ ID NO: 1582121 - protein, 19 aa, Staphylococcus aureus
DGNVIYTFTDYVDNKNDVK

SEQ ID NO: 1582122 - protein, 19 aa, Staphylococcus aureus
DGNVIYTFTDYVNTKDDVK

SEQ ID NO: 1582123 - protein, 38 aa, Staphylococcus aureus
DGSIAVFMRPDIGETFSEFRTFLAVLLMLLLFISISLV

SEQ ID NO: 1582124 - protein, 44 aa, Staphylococcus aureus
DGSKKKMSTTVKVVSIATVLLLLGGLVFAIFAYVDHSNKAKERM

SEQ ID NO: 1582125 - protein, 25 aa, Staphylococcus aureus
DGVVMKYAYNWAFFNPIRKIYYNIT

SEQ ID NO: 1582126 - protein, 19 aa, Staphylococcus aureus
DGWFKDEIIPIQVNSVEYT

SEQ ID NO: 1582127 - protein, 28 aa, Staphylococcus aureus
DIAQGTSMRTTDKYGYYNYAGYSNFIVT

SEQ ID NO: 1582128 - protein, 20 aa, Staphylococcus aureus
DICHTQSKIGRRFKLISFFV

SEQ ID NO: 1582129 - protein, 27 aa, Staphylococcus aureus
DIDPLHMRHFSNNFGNVIKNAIGVVGI

SEQ ID NO: 1582130 - protein, 26 aa, Staphylococcus aureus
DILTMLKATTTVPGLRNNITGNEKSQ

SEQ ID NO: 1582131 - protein, 22 aa, Staphylococcus aureus
DIPLSKWRRKIGYVMQSNSMMS

SEQ ID NO: 1582132 - protein, 26 aa, Staphylococcus aureus
DIPTPRPEKTLTLGKGNGLLSGLLNA

SEQ ID NO: 1582133 - protein, 19 aa, Staphylococcus aureus
DIRILSEMRQLFPKMNLVM

SEQ ID NO: 1582134 - protein, 23 aa, Staphylococcus aureus
DIYARRVAKRAVWLGFSSTLIMI

SEQ ID NO: 1582135 - protein, 29 aa, Staphylococcus aureus
DKAKRDAYTNAVSRAEAILNKTQGANTSK

SEQ ID NO: 1582136 - protein, 18 aa, Staphylococcus aureus
DKANAFVNSLNGLNQQQQ

SEQ ID NO: 1582137 - protein, 18 aa, Staphylococcus aureus
DKDKSIVVDGQYQSVDAF

SEQ ID NO: 1582138 - protein, 20 aa, Staphylococcus aureus
DKDLKGAKLKVEAYHPKYPT

SEQ ID NO: 1582139 - protein, 26 aa, Staphylococcus aureus
DKEKQALKDRINQILQQGHNDINNAL

SEQ ID NO: 1582140 - protein, 17 aa, Staphylococcus aureus
DKGKWTIYTDFAKSNKP

SEQ ID NO: 1582141 - protein, 25 aa, Staphylococcus aureus
DKIVKSSVCLLSYVTLIRRVDMPTT

SEQ ID NO: 1582142 - protein, 25 aa, Staphylococcus aureus
DKKDVPFSVTIGNQITTTTADITYP

SEQ ID NO: 1582143 - protein, 25 aa, Staphylococcus aureus
DKLNELRSGFNIDNYITLEEYFENW

SEQ ID NO: 1582144 - protein, 23 aa, Staphylococcus aureus
DKMKSWYERFGFGKSTKGMFDGE

SEQ ID NO: 1582145 - protein, 21 aa, Staphylococcus aureus
DKTAYKMEVTLGNDAYSEEII

SEQ ID NO: 1582146 - protein, 23 aa, Staphylococcus aureus
DKTAYKMEVTLGNDTYSEEVIVD

SEQ ID NO: 1582147 - protein, 20 aa, Staphylococcus aureus
DKVAGYLFYFAVSIGLISFI

SEQ ID NO: 1582148 - protein, 17 aa, Staphylococcus aureus
DKVKSGDYFTIKYSDTV

SEQ ID NO: 1582149 - protein, 18 aa, Staphylococcus aureus
DLAIAVVMGAAFNKIITS

SEQ ID NO: 1582150 - protein, 19 aa, Staphylococcus aureus
DLARMPIRLISNGQIDYGN

SEQ ID NO: 1582151 - protein, 22 aa, Staphylococcus aureus
DLARMPIRLTVNGQIDYSDRVI

SEQ ID NO: 1582152 - protein, 24 aa, Staphylococcus aureus
DLDDLCWLLPGIIICGVILIVSFT

SEQ ID NO: 1582153 - protein, 20 aa, Staphylococcus aureus
DLFVVAKLFGFVFLASACGA

SEQ ID NO: 1582154 - protein, 25 aa, Staphylococcus aureus
DLIIKFPLVLLILEFELNFESKIKW

SEQ ID NO: 1582155 - protein, 17 aa, Staphylococcus aureus
DLMLHQSGLYKYKSSKD

SEQ ID NO: 1582156 - protein, 19 aa, Staphylococcus aureus
DLMMLLPFTLLSILIVIFI

SEQ ID NO: 1582157 - protein, 20 aa, Staphylococcus aureus
DLMMLLPFTLLSILIVIFIF

SEQ ID NO: 1582158 - protein, 24 aa, Staphylococcus aureus
DLPTFIMISIFSFVIFDSVENINS

SEQ ID NO: 1582159 - protein, 19 aa, Staphylococcus aureus
DLSESYYVNPDNFEDVTDS

SEQ ID NO: 1582160 - protein, 19 aa, Staphylococcus aureus
DLVSIWLVYFLPFINWFIP

SEQ ID NO: 1582161 - protein, 19 aa, Staphylococcus aureus
DLYFEMDLELLSPDKAHDV

SEQ ID NO: 1582162 - protein, 17 aa, Staphylococcus aureus
DMFISRKALTPVFSSVL

SEQ ID NO: 1582163 - protein, 42 aa, Staphylococcus aureus
DMLKRLKYKKARNFYSMLYDWRINKNPLYKGVYSIVSYWEKN

SEQ ID NO: 1582164 - protein, 21 aa, Staphylococcus aureus
DMSGWTKEDVIAFENLTNIKI

SEQ ID NO: 1582165 - protein, 30 aa, Staphylococcus aureus
DNAPALYPNYWGGSKFKVIEELRKQGYNVH

SEQ ID NO: 1582166 - protein, 24 aa, Staphylococcus aureus
DNEHSPVLIAKRLKDKDGNVETTT

SEQ ID NO: 1582167 - protein, 32 aa, Staphylococcus aureus
DNFKTLFTIGVWRKTFFSVITWTLVWTLVATT

SEQ ID NO: 1582168 - protein, 21 aa, Staphylococcus aureus
DNIFTFFYKKVAVLFFECLVF

SEQ ID NO: 1582169 - protein, 17 aa, Staphylococcus aureus
DNKDIRTFLNFSSIYRW

SEQ ID NO: 1582170 - protein, 18 aa, Staphylococcus aureus
DNKITYNYSSPIAGIDKP

SEQ ID NO: 1582171 - protein, 26 aa, Staphylococcus aureus
DNLDSGKYKVIFEKPAGLTQTVTNTT

SEQ ID NO: 1582172 - protein, 17 aa, Staphylococcus aureus
DNPKLAFSIVYTNQPVP

SEQ ID NO: 1582173 - protein, 18 aa, Staphylococcus aureus
DNPYDLTPKGTFDNWFNM

SEQ ID NO: 1582174 - protein, 19 aa, Staphylococcus aureus
DNVIAPVLTGNLKPNTDSN

SEQ ID NO: 1582175 - protein, 17 aa, Staphylococcus aureus
DPETLFILMSQVLFHPL

SEQ ID NO: 1582176 - protein, 21 aa, Staphylococcus aureus
DPLIKSVEIHKQLPNTLNVDI

SEQ ID NO: 1582177 - protein, 18 aa, Staphylococcus aureus
DQEMPGFGMSLLTATLPV

SEQ ID NO: 1582178 - protein, 24 aa, Staphylococcus aureus
DRIKTRPLYLAAMGTFLVGSIVAA

SEQ ID NO: 1582179 - protein, 45 aa, Staphylococcus aureus
DRNKERKKGGMAKVLLPLIAAVLIIGALAIFGGMALNNHNNGTKE

SEQ ID NO: 1582180 - protein, 17 aa, Staphylococcus aureus
DRVIKKRYKGIEYLIIK

SEQ ID NO: 1582181 - protein, 20 aa, Staphylococcus aureus
DRYADKHIDDNYGLERISKT

SEQ ID NO: 1582182 - protein, 23 aa, Staphylococcus aureus
DSESQSASAFLSESLSVSTSEST

SEQ ID NO: 1582183 - protein, 17 aa, Staphylococcus aureus
DSKIVSDCRHLLKHPDN

SEQ ID NO: 1582184 - protein, 22 aa, Staphylococcus aureus
DSNAFLLNWDIRGLTSYIFSFL

SEQ ID NO: 1582185 - protein, 24 aa, Staphylococcus aureus
DSQLLKGHIYNGISGGQFKDLPPM

SEQ ID NO: 1582186 - protein, 22 aa, Staphylococcus aureus
DSSVISRWLRYVLIVIGSAALY

SEQ ID NO: 1582187 - protein, 17 aa, Staphylococcus aureus
DSYIYGFKENQLIKIEA

SEQ ID NO: 1582188 - protein, 26 aa, Staphylococcus aureus
DTKAPIANVKFKLSKKDGSVVKDNQK

SEQ ID NO: 1582189 - protein, 17 aa, Staphylococcus aureus
DTKEYTTEINLIELVDE

SEQ ID NO: 1582190 - protein, 26 aa, Staphylococcus aureus
DTKLRIFEVNDTSKLSDSYYADPNDS

SEQ ID NO: 1582191 - protein, 20 aa, Staphylococcus aureus
DTNGDGWANVDFNTSSLPQS

SEQ ID NO: 1582192 - protein, 32 aa, Staphylococcus aureus
DTNIFPYTGVVAFKSATGFVVGKNTILTNKHV

SEQ ID NO: 1582193 - protein, 23 aa, Staphylococcus aureus
DTQVKRVYDEAVDKAKEALNKAT

SEQ ID NO: 1582194 - protein, 26 aa, Staphylococcus aureus
DTTFKGMTYQSAKIFIVQKVIQHFKN

SEQ ID NO: 1582195 - protein, 23 aa, Staphylococcus aureus
DTTKHEVEQTIYVNPLKLNAKNT

SEQ ID NO: 1582196 - protein, 31 aa, Staphylococcus aureus
DTVKRLNEIVICISFLFLTIFIGGCGTGKEA

SEQ ID NO: 1582197 - protein, 30 aa, Staphylococcus aureus
DTVYPHQAGYVKLNYGFSVPNEAVQGDTFK

SEQ ID NO: 1582198 - protein, 21 aa, Staphylococcus aureus
DVDKRVQALIDEIDRNPNLTD

SEQ ID NO: 1582199 - protein, 21 aa, Staphylococcus aureus
DVESYFLTWVHQMKTPITAAQ

SEQ ID NO: 1582200 - protein, 21 aa, Staphylococcus aureus
DVFLLLFIMKYGFRKIEAIVG

SEQ ID NO: 1582201 - protein, 24 aa, Staphylococcus aureus
DVGWPATSSIAWASSIAAFIIPLG

SEQ ID NO: 1582202 - protein, 19 aa, Staphylococcus aureus
DVTDQFDVIYSNDNKTATV

SEQ ID NO: 1582203 - protein, 23 aa, Staphylococcus aureus
DVVVRWLSFIPITLFTALVIDSI

SEQ ID NO: 1582204 - protein, 18 aa, Staphylococcus aureus
DVYWCTADPGWVTGTSYG

SEQ ID NO: 1582205 - protein, 24 aa, Staphylococcus aureus
DWLGIPVPFRFSGFSFDVTSTLVF

SEQ ID NO: 1582206 - protein, 30 aa, Staphylococcus aureus
DYCNSLLKWYELMPIISFLLLKGRCRNCRK

SEQ ID NO: 1582207 - protein, 24 aa, Staphylococcus aureus
DYILDILNILGFVFVYSAITLAIL

SEQ ID NO: 1582208 - protein, 21 aa, Staphylococcus aureus
DYNLIKVVPYILVLVLALLGV

SEQ ID NO: 1582209 - protein, 27 aa, Staphylococcus aureus
DYTLDTDKTKYSWSNSYSSVNGSSTAN

SEQ ID NO: 1582210 - protein, 25 aa, Staphylococcus aureus
DYTLYELYNLMLLKEEKLFYKCVNN

SEQ ID NO: 1582211 - protein, 20 aa, Staphylococcus aureus
EADKIFLLPFEKHMSQFMRH

SEQ ID NO: 1582212 - protein, 25 aa, Staphylococcus aureus
EAEFLTRYKALVICAFNEKQSFDAL

SEQ ID NO: 1582213 - protein, 19 aa, Staphylococcus aureus
EAIEIAALAGMVVLSCINP

SEQ ID NO: 1582214 - protein, 20 aa, Staphylococcus aureus
EAKALNRVMDQLSQGITGNE

SEQ ID NO: 1582215 - protein, 20 aa, Staphylococcus aureus
EAKEGMGVSEVKGTDVTSKV

SEQ ID NO: 1582216 - protein, 20 aa, Staphylococcus aureus
EAKTALQIDEIIKRANELDS

SEQ ID NO: 1582217 - protein, 20 aa, Staphylococcus aureus
EALKIKGMVLYMNRNTKTTK

SEQ ID NO: 1582218 - protein, 19 aa, Staphylococcus aureus
EALQKLKSLGLKDVTIEKV

SEQ ID NO: 1582219 - protein, 28 aa, Staphylococcus aureus
EAMGYLKRFSLYISVMILIFAIAGCGKG

SEQ ID NO: 1582220 - protein, 17 aa, Staphylococcus aureus
EAMKSYVSEQIKNKQEQ

SEQ ID NO: 1582221 - protein, 24 aa, Staphylococcus aureus
EATMPGSLPTMFYSHIRYRTLSVT

SEQ ID NO: 1582222 - protein, 19 aa, Staphylococcus aureus
EAVQKLKSLGLKDVTIEKV

SEQ ID NO: 1582223 - protein, 24 aa, Staphylococcus aureus
EAVRKIMFALNRFMGNKYSNIDLG

SEQ ID NO: 1582224 - protein, 20 aa, Staphylococcus aureus
EAVSAVQYMSSWPWHWAEPM

SEQ ID NO: 1582225 - protein, 34 aa, Staphylococcus aureus
EAVSAVQYMSSWPWHWAKPMKHLMENGSISTYGL

SEQ ID NO: 1582226 - protein, 32 aa, Staphylococcus aureus
EAVSAVQYMSSWPWHWAKPMKYLMENGSISTY

SEQ ID NO: 1582227 - protein, 32 aa, Staphylococcus aureus
EDEANTSLIWGFLASLGSLLLFRRKKENKDKN

SEQ ID NO: 1582228 - protein, 21 aa, Staphylococcus aureus
EDGYFWFQGRVDDVIMTAGER

SEQ ID NO: 1582229 - protein, 18 aa, Staphylococcus aureus
EDWKTLIPYFSIGIVTVF

SEQ ID NO: 1582230 - protein, 17 aa, Staphylococcus aureus
EEFFIWTVPCYLCAIIA

SEQ ID NO: 1582231 - protein, 19 aa, Staphylococcus aureus
EEIAIRRAFGVKSRDIELL

SEQ ID NO: 1582232 - protein, 25 aa, Staphylococcus aureus
EEIKDPKARMVAIWDKTFPYLLISP

SEQ ID NO: 1582233 - protein, 30 aa, Staphylococcus aureus
EEIVFRGMIIRVIFRKKLFLGLIVSSLVFA

SEQ ID NO: 1582234 - protein, 28 aa, Staphylococcus aureus
EELIFRGFLLRVFFRKHLFIGTLVSSFL

SEQ ID NO: 1582235 - protein, 25 aa, Staphylococcus aureus
EEQSKRLALASAEEGYVESAEDINK

SEQ ID NO: 1582236 - protein, 17 aa, Staphylococcus aureus
EERARLKEIELTEKEME

SEQ ID NO: 1582237 - protein, 18 aa, Staphylococcus aureus
EERRQWEQFQAFQNQQNQ

SEQ ID NO: 1582238 - protein, 17 aa, Staphylococcus aureus
EETKKALDEQVKSAITE

SEQ ID NO: 1582239 - protein, 19 aa, Staphylococcus aureus
EETVAFTKERVEGFLNKSK

SEQ ID NO: 1582240 - protein, 20 aa, Staphylococcus aureus
EEYVFRKVIFGELFNAIKAN

SEQ ID NO: 1582241 - protein, 22 aa, Staphylococcus aureus
EFIEMIKPKISLISSGKNNMYH

SEQ ID NO: 1582242 - protein, 19 aa, Staphylococcus aureus
EFQTHLFGYYNYYYYNTSN

SEQ ID NO: 1582243 - protein, 23 aa, Staphylococcus aureus
EGKEVRFGAGLSALFTVITTAFT

SEQ ID NO: 1582244 - protein, 18 aa, Staphylococcus aureus
EGLHIIKDLIVATVRAVV

SEQ ID NO: 1582245 - protein, 24 aa, Staphylococcus aureus
EIDPLHMRHFGDRIGNVIKNALGV

SEQ ID NO: 1582246 - protein, 23 aa, Staphylococcus aureus
EIEEFKFFVQYGNFKELENYKDG

SEQ ID NO: 1582247 - protein, 22 aa, Staphylococcus aureus
EIEHAKAQLAQALQDIKDLVKA

SEQ ID NO: 1582248 - protein, 23 aa, Staphylococcus aureus
EIENFKFFVQYGNFKDINDYKNG

SEQ ID NO: 1582249 - protein, 23 aa, Staphylococcus aureus
EIENLKFFVQYGNFKDINDYKDG

SEQ ID NO: 1582250 - protein, 20 aa, Staphylococcus aureus
EIEQAKAQLAQALQDIKDLV

SEQ ID NO: 1582251 - protein, 19 aa, Staphylococcus aureus
EIEQAKAQLAQALQEIKDL

SEQ ID NO: 1582252 - protein, 20 aa, Staphylococcus aureus
EIEQAKAQLGQALQDIKDLV

SEQ ID NO: 1582253 - protein, 23 aa, Staphylococcus aureus
EIEQAKAQLGQALQDIKDLVKAK

SEQ ID NO: 1582254 - protein, 18 aa, Staphylococcus aureus
EIEVIKAQLAILDENYDL

SEQ ID NO: 1582255 - protein, 22 aa, Staphylococcus aureus
EIEVIKAQLAILGENYDLDFDL

SEQ ID NO: 1582256 - protein, 20 aa, Staphylococcus aureus
EIFFHNLIYFFSAIFGFLTL

SEQ ID NO: 1582257 - protein, 20 aa, Staphylococcus aureus
EIFQHLAISLWRFVAGFIVA

SEQ ID NO: 1582258 - protein, 20 aa, Staphylococcus aureus
EIFQHLAISLWRFVGGFVVA

SEQ ID NO: 1582259 - protein, 17 aa, Staphylococcus aureus
EIFSVIKIIYLISVSYL

SEQ ID NO: 1582260 - protein, 17 aa, Staphylococcus aureus
EIIAYSIPFVIVSLNYP

SEQ ID NO: 1582261 - protein, 23 aa, Staphylococcus aureus
EIIPHGTREEIDPNLPEGETKVI

SEQ ID NO: 1582262 - protein, 22 aa, Staphylococcus aureus
EIKDPKARMVATWDKTFPYLLI

SEQ ID NO: 1582263 - protein, 21 aa, Staphylococcus aureus
EIKNFKFFVQYGNFKDLKNYK

SEQ ID NO: 1582264 - protein, 21 aa, Staphylococcus aureus
EIKPRMKRSTDVTAVTEKEVV

SEQ ID NO: 1582265 - protein, 23 aa, Staphylococcus aureus
EIKVWKLIQFISFFPTISSGPID

SEQ ID NO: 1582266 - protein, 18 aa, Staphylococcus aureus
EINEKVKAVVPTKQKQSK

SEQ ID NO: 1582267 - protein, 19 aa, Staphylococcus aureus
EIYPFFLTNKMNFDLKKIE

SEQ ID NO: 1582268 - protein, 23 aa, Staphylococcus aureus
EKAKGFVRKAGIFIFGGSVVIWL

SEQ ID NO: 1582269 - protein, 25 aa, Staphylococcus aureus
EKATLRFGGKLMLIIGPLFPVIGIT

SEQ ID NO: 1582270 - protein, 25 aa, Staphylococcus aureus
EKDRMEFQMLYGFRSELAEEIANED

SEQ ID NO: 1582271 - protein, 29 aa, Staphylococcus aureus
EKFANFFKMLWLRLKAMKHYKSLNKESKK

SEQ ID NO: 1582272 - protein, 29 aa, Staphylococcus aureus
EKFANFFQMLWLKLKAMKHYKALNKESKK

SEQ ID NO: 1582273 - protein, 18 aa, Staphylococcus aureus
EKFGPRKLALVGMAIVVI

SEQ ID NO: 1582274 - protein, 19 aa, Staphylococcus aureus
EKFHIPRVAIIFNAIISMI

SEQ ID NO: 1582275 - protein, 23 aa, Staphylococcus aureus
EKIKENKALDLLIFNQENKNVTE

SEQ ID NO: 1582276 - protein, 20 aa, Staphylococcus aureus
EKISKFKGLAILSSDALSSV

SEQ ID NO: 1582277 - protein, 29 aa, Staphylococcus aureus
EKKIFPYILMSVGAFLTLGFVIFSIHKGR

SEQ ID NO: 1582278 - protein, 29 aa, Staphylococcus aureus
EKKIFPYILMSVGALLTLGFVIFSIHKGR

SEQ ID NO: 1582279 - protein, 24 aa, Staphylococcus aureus
EKPPKRSLYALIMTLCGVHGTISL

SEQ ID NO: 1582280 - protein, 18 aa, Staphylococcus aureus
EKTKDVSAQKVWEGTQKV

SEQ ID NO: 1582281 - protein, 22 aa, Staphylococcus aureus
EKVAHAYAYGGPNMAVKSLEKL

SEQ ID NO: 1582282 - protein, 25 aa, Staphylococcus aureus
EKVLKDNEHSPLLFAKRRKDKEEDV

SEQ ID NO: 1582283 - protein, 20 aa, Staphylococcus aureus
ELESYFLMWVHQIKTPITAS

SEQ ID NO: 1582284 - protein, 28 aa, Staphylococcus aureus
ELHAIFDVVPRIALGSIVAYIIGQHIDV

SEQ ID NO: 1582285 - protein, 21 aa, Staphylococcus aureus
ELIIRFIFVCIFFNNFIMLIE

SEQ ID NO: 1582286 - protein, 22 aa, Staphylococcus aureus
ELKEEIRLFVKEGLSAHVAPRE

SEQ ID NO: 1582287 - protein, 19 aa, Staphylococcus aureus
ELLQSLNFNQFNLVEAQCK

SEQ ID NO: 1582288 - protein, 18 aa, Staphylococcus aureus
ELMSVPGVGQAKANAIVE

SEQ ID NO: 1582289 - protein, 19 aa, Staphylococcus aureus
ELSVILGLVLAFYMDISPG

SEQ ID NO: 1582290 - protein, 17 aa, Staphylococcus aureus
ELTELCDSFQIHYDIND

SEQ ID NO: 1582291 - protein, 17 aa, Staphylococcus aureus
ELYQDGKATVKTATLNE

SEQ ID NO: 1582292 - protein, 26 aa, Staphylococcus aureus
EMETSFPRCQISYFTFGISQYYTTNF

SEQ ID NO: 1582293 - protein, 28 aa, Staphylococcus aureus
EMFNNKITYNYSSPIAGIDKPNGANISS

SEQ ID NO: 1582294 - protein, 25 aa, Staphylococcus aureus
EMLMVWDRLTGGLIFVGGVVSIVIV

SEQ ID NO: 1582295 - protein, 27 aa, Staphylococcus aureus
EMMRIYKGVDTFVVISHLGIDPSTQET

SEQ ID NO: 1582296 - protein, 20 aa, Staphylococcus aureus
ENDHCLYFFDITEQVQTNGL

SEQ ID NO: 1582297 - protein, 22 aa, Staphylococcus aureus
ENDKRMDAGFVIFYMSVNMGAL

SEQ ID NO: 1582298 - protein, 35 aa, Staphylococcus aureus
ENGKYRFDNLDSGKYKVIFEKPAGLTQTGTNTTED

SEQ ID NO: 1582299 - protein, 25 aa, Staphylococcus aureus
ENIPLKGYVVRGGREMENHFECLWD

SEQ ID NO: 1582300 - protein, 19 aa, Staphylococcus aureus
ENQLVRMSVPKGSAHEKQL

SEQ ID NO: 1582301 - protein, 30 aa, Staphylococcus aureus
ENTNATLFGAMMALLGSLLLFRKRKQDHKE

SEQ ID NO: 1582302 - protein, 31 aa, Staphylococcus aureus
ENTNATLFGAMMALLGSLLLFRKRKQDHKEK

SEQ ID NO: 1582303 - protein, 19 aa, Staphylococcus aureus
EPGKKVHLVGHSMGGQTIR

SEQ ID NO: 1582304 - protein, 19 aa, Staphylococcus aureus
EPKGTFKDWLNMYINEVKG

SEQ ID NO: 1582305 - protein, 24 aa, Staphylococcus aureus
EPLPNRKDFVVSFITGALVGSALG

SEQ ID NO: 1582306 - protein, 19 aa, Staphylococcus aureus
EPQDEVIIHGAKDDSDADS

SEQ ID NO: 1582307 - protein, 20 aa, Staphylococcus aureus
EQAMCKGLFLTILKMLIHIL

SEQ ID NO: 1582308 - protein, 26 aa, Staphylococcus aureus
EQFKAQMKAANPLAKELAKRKQEAIS

SEQ ID NO: 1582309 - protein, 17 aa, Staphylococcus aureus
EQFKAQMKAANPTAKEL

SEQ ID NO: 1582310 - protein, 27 aa, Staphylococcus aureus
EQGGNIIDIDFDSVPQIHGFNKHTEII

SEQ ID NO: 1582311 - protein, 33 aa, Staphylococcus aureus
EQLIKRLKAGKVYKRDRLDVAFNNFFTYAHLSE

SEQ ID NO: 1582312 - protein, 19 aa, Staphylococcus aureus
EQLINLAIVRLKEEYDFID

SEQ ID NO: 1582313 - protein, 20 aa, Staphylococcus aureus
EQQARITLYLKHNTKEPNTM

SEQ ID NO: 1582314 - protein, 22 aa, Staphylococcus aureus
EREHRRKGSIFMDFRNELKNLN

SEQ ID NO: 1582315 - protein, 22 aa, Staphylococcus aureus
ERKYKVLSLINVFRAGSMALLQ

SEQ ID NO: 1582316 - protein, 19 aa, Staphylococcus aureus
ERLLIIRTLITWFYTMLWS

SEQ ID NO: 1582317 - protein, 30 aa, Staphylococcus aureus
ESCKVMKCLSKWAFYISFLILVISITAGCG

SEQ ID NO: 1582318 - protein, 25 aa, Staphylococcus aureus
ESEVIKWFHREHDWFKTQLNNETNN

SEQ ID NO: 1582319 - protein, 18 aa, Staphylococcus aureus
ESKEPLPDTGSEDEANTS

SEQ ID NO: 1582320 - protein, 19 aa, Staphylococcus aureus
ESLAFLIFVRLINGIATAV

SEQ ID NO: 1582321 - protein, 24 aa, Staphylococcus aureus
ESLDKVKHTPFFLPKRHKEDEEDV

SEQ ID NO: 1582322 - protein, 20 aa, Staphylococcus aureus
ESNSHLTIGYGTANHPFNSS

SEQ ID NO: 1582323 - protein, 25 aa, Staphylococcus aureus
ESNSMHPSDSMSMHHTHSTSTSIST

SEQ ID NO: 1582324 - protein, 22 aa, Staphylococcus aureus
ESPEIKKMFSIMFSLVNIGIFL

SEQ ID NO: 1582325 - protein, 20 aa, Staphylococcus aureus
ESQQAYFLNVIFLMIILFVL

SEQ ID NO: 1582326 - protein, 19 aa, Staphylococcus aureus
ESVSESSSLSGSQSMSDSV

SEQ ID NO: 1582327 - protein, 19 aa, Staphylococcus aureus
ESYILPVIVITIAYAAIYF

SEQ ID NO: 1582328 - protein, 19 aa, Staphylococcus aureus
ESYLSFTVIHYIFGFAILI

SEQ ID NO: 1582329 - protein, 25 aa, Staphylococcus aureus
ETDKSGNIFYTWDKVFGMPETTNVQ

SEQ ID NO: 1582330 - protein, 21 aa, Staphylococcus aureus
ETEFPRIQLFMKSYTGEEDWE

SEQ ID NO: 1582331 - protein, 20 aa, Staphylococcus aureus
ETIELPLAHMIPEVIGNLLL

SEQ ID NO: 1582332 - protein, 21 aa, Staphylococcus aureus
ETISVPSLIGMLMLIGIVVTN

SEQ ID NO: 1582333 - protein, 19 aa, Staphylococcus aureus
ETKFIDWGVFLVLGIFIGS

SEQ ID NO: 1582334 - protein, 18 aa, Staphylococcus aureus
ETKREFNPKLQPGEERVK

SEQ ID NO: 1582335 - protein, 28 aa, Staphylococcus aureus
ETKVFPMWLRWSLFIILVGVDTYIAITC

SEQ ID NO: 1582336 - protein, 30 aa, Staphylococcus aureus
ETLDDTKHLPLLFAKRHRKEEEEDVTVEEK

SEQ ID NO: 1582337 - protein, 28 aa, Staphylococcus aureus
ETLDDTKHLPLLFAKRRRKEDEEDVTVE

SEQ ID NO: 1582338 - protein, 21 aa, Staphylococcus aureus
ETLQIIFPYSLSMAIVGLVES

SEQ ID NO: 1582339 - protein, 20 aa, Staphylococcus aureus
ETMGIFAIIIFVFFTISILI

SEQ ID NO: 1582340 - protein, 18 aa, Staphylococcus aureus
ETNWKYKFKDLPKYDEGK

SEQ ID NO: 1582341 - protein, 24 aa, Staphylococcus aureus
ETVKATELNTAMSNLQNGINDEAA

SEQ ID NO: 1582342 - protein, 20 aa, Staphylococcus aureus
ETVKTFLARHDFSKKTVSAI

SEQ ID NO: 1582343 - protein, 30 aa, Staphylococcus aureus
EVGMILTLILICFPDIFGTNYLSRGYLITI

SEQ ID NO: 1582344 - protein, 30 aa, Staphylococcus aureus
EVGMILTLILICFPDIFGTSYLSRSYLITI

SEQ ID NO: 1582345 - protein, 19 aa, Staphylococcus aureus
EVHFVFDLSLMEIRTIYRM

SEQ ID NO: 1582346 - protein, 25 aa, Staphylococcus aureus
EVIQWFKDEHHWFKAKLKSEANNTG

SEQ ID NO: 1582347 - protein, 24 aa, Staphylococcus aureus
EVIQWFYKEVDWFEAKLNSETNNT

SEQ ID NO: 1582348 - protein, 17 aa, Staphylococcus aureus
EVIWPKTGLIYFGMADI

SEQ ID NO: 1582349 - protein, 19 aa, Staphylococcus aureus
EVIWPKTGLIYFVMADIGG

SEQ ID NO: 1582350 - protein, 30 aa, Staphylococcus aureus
EVKGHLLLELAVVFGISALVTSFLKYKREI

SEQ ID NO: 1582351 - protein, 28 aa, Staphylococcus aureus
EVKGNLLLELAVVFGISSLVTAFLKTKH

SEQ ID NO: 1582352 - protein, 18 aa, Staphylococcus aureus
EVNFARFIIIIAGIFCFG

SEQ ID NO: 1582353 - protein, 18 aa, Staphylococcus aureus
EVPILIHFLNNFLALFYV

SEQ ID NO: 1582354 - protein, 43 aa, Staphylococcus aureus
EVTDQFKNRIYYEHPNVASIKFGDITKTYVVLVEGHYDNTGKN

SEQ ID NO: 1582355 - protein, 19 aa, Staphylococcus aureus
EVTDQNQFVDSFTLDTSKL

SEQ ID NO: 1582356 - protein, 18 aa, Staphylococcus aureus
EVVGGLALIIGFLTPYVN

SEQ ID NO: 1582357 - protein, 18 aa, Staphylococcus aureus
EVVKRLQGIRSRIYNSQQ

SEQ ID NO: 1582358 - protein, 25 aa, Staphylococcus aureus
EVVVLEHLIQWFLVYFAIYQAVNEK

SEQ ID NO: 1582359 - protein, 20 aa, Staphylococcus aureus
EVYQYFKPHFLYLAIGTLVI

SEQ ID NO: 1582360 - protein, 20 aa, Staphylococcus aureus
EVYQYFKPHFLYLVIGTAIV

SEQ ID NO: 1582361 - protein, 22 aa, Staphylococcus aureus
EYASLIGCIKRSHTLAGAVNTI

SEQ ID NO: 1582362 - protein, 20 aa, Staphylococcus aureus
EYDYYPTLFYKRKRKSFMIH

SEQ ID NO: 1582363 - protein, 24 aa, Staphylococcus aureus
EYDYYPTLFYKRRRKTFVIHVKKD

SEQ ID NO: 1582364 - protein, 17 aa, Staphylococcus aureus
FAGSFVYIYFMQGVQRF

SEQ ID NO: 1582365 - protein, 19 aa, Staphylococcus aureus
FAIKCLRVKPKVVNYLIAK

SEQ ID NO: 1582366 - protein, 19 aa, Staphylococcus aureus
FAILGFVGLILGFMVWLGM

SEQ ID NO: 1582367 - protein, 25 aa, Staphylococcus aureus
FAKELEKRKKVAISKIKDISTDKID

SEQ ID NO: 1582368 - protein, 17 aa, Staphylococcus aureus
FALCTISSMIIMMSMGG

SEQ ID NO: 1582369 - protein, 19 aa, Staphylococcus aureus
FALFVAFLFSFDRKNIDFK

SEQ ID NO: 1582370 - protein, 24 aa, Staphylococcus aureus
FALGWNYWFNWVVTVAADITIAAQ

SEQ ID NO: 1582371 - protein, 24 aa, Staphylococcus aureus
FAPIAFLMGIPWSEAVPAGSLMAT

SEQ ID NO: 1582372 - protein, 18 aa, Staphylococcus aureus
FAVASLLSVPLLVSLASG

SEQ ID NO: 1582373 - protein, 19 aa, Staphylococcus aureus
FAVFIGFDMIRPAITNYFS

SEQ ID NO: 1582374 - protein, 19 aa, Staphylococcus aureus
FCGYAFAGIVEKAGCLEVL

SEQ ID NO: 1582375 - protein, 17 aa, Staphylococcus aureus
FCIYFVVSYIKGVIMMV

SEQ ID NO: 1582376 - protein, 21 aa, Staphylococcus aureus
FCLISPVMFYQLWAFIAPGLH

SEQ ID NO: 1582377 - protein, 22 aa, Staphylococcus aureus
FCQNIPKKSWFVSATSTTNNKD

SEQ ID NO: 1582378 - protein, 23 aa, Staphylococcus aureus
FDDAKRLANALINSDNTNVNDIN

SEQ ID NO: 1582379 - protein, 19 aa, Staphylococcus aureus
FDEEIYLINKDFKKEQSNE

SEQ ID NO: 1582380 - protein, 29 aa, Staphylococcus aureus
FDFDHPNRIAIFVAFAILGFVGLILGFMV

SEQ ID NO: 1582381 - protein, 18 aa, Staphylococcus aureus
FDHAHLWDDSAVNAIDTI

SEQ ID NO: 1582382 - protein, 25 aa, Staphylococcus aureus
FDHPNRVAIFVALAILGFVGLILGV

SEQ ID NO: 1582383 - protein, 29 aa, Staphylococcus aureus
FDIFIAGILRLFGVIALMLVVALPIYTVA

SEQ ID NO: 1582384 - protein, 30 aa, Staphylococcus aureus
FDIGFIEYFSRMIIPNIFSLIASILVLWLY

SEQ ID NO: 1582385 - protein, 19 aa, Staphylococcus aureus
FDNKMFKLKFDSDLIAQFV

SEQ ID NO: 1582386 - protein, 27 aa, Staphylococcus aureus
FDNLDSGKYKVIFEKPAGLKQTGTNTT

SEQ ID NO: 1582387 - protein, 28 aa, Staphylococcus aureus
FDNLDSGKYKVIFEKPAGLKQTGTNTTE

SEQ ID NO: 1582388 - protein, 17 aa, Staphylococcus aureus
FDVSKFINFLKEYGVTA

SEQ ID NO: 1582389 - protein, 17 aa, Staphylococcus aureus
FEGIPHFLNITSHRNNG

SEQ ID NO: 1582390 - protein, 25 aa, Staphylococcus aureus
FEHNHAFKGLNWHQSLFYSLFQSAT

SEQ ID NO: 1582391 - protein, 28 aa, Staphylococcus aureus
FEIELPGIFSALLLGAMYSYRMDFKKTN

SEQ ID NO: 1582392 - protein, 17 aa, Staphylococcus aureus
FELNFESKIKWGCEMMI

SEQ ID NO: 1582393 - protein, 19 aa, Staphylococcus aureus
FETSFKYGNVIKEYHDKLA

SEQ ID NO: 1582394 - protein, 17 aa, Staphylococcus aureus
FFCSFMLQGKKKEVDSR

SEQ ID NO: 1582395 - protein, 32 aa, Staphylococcus aureus
FFGGAVATLLGWRWIFIISIVISLIALFLIKG

SEQ ID NO: 1582396 - protein, 19 aa, Staphylococcus aureus
FFGQYADFKSLKSYNHGDV

SEQ ID NO: 1582397 - protein, 17 aa, Staphylococcus aureus
FFINISLVIAMQIDDVL

SEQ ID NO: 1582398 - protein, 25 aa, Staphylococcus aureus
FFLDVKLTLAALFIFPFYILTVYVF

SEQ ID NO: 1582399 - protein, 26 aa, Staphylococcus aureus
FFLTCFPGILLICIRKVPYFKYLTEF

SEQ ID NO: 1582400 - protein, 25 aa, Staphylococcus aureus
FFLTCFPGILLICIRKVPYFKYPTE

SEQ ID NO: 1582401 - protein, 19 aa, Staphylococcus aureus
FFRYILKRYFNYMLNYKVW

SEQ ID NO: 1582402 - protein, 18 aa, Staphylococcus aureus
FFSFINWFIPKRCVKISR

SEQ ID NO: 1582403 - protein, 19 aa, Staphylococcus aureus
FGAFALFWFVGIHGPSIVE

SEQ ID NO: 1582404 - protein, 18 aa, Staphylococcus aureus
FGCKRTKVGNDFSSVKYI

SEQ ID NO: 1582405 - protein, 18 aa, Staphylococcus aureus
FGDINKTYVVLVEGHYDN

SEQ ID NO: 1582406 - protein, 20 aa, Staphylococcus aureus
FGDITKTYVVLVEGHYDNTG

SEQ ID NO: 1582407 - protein, 20 aa, Staphylococcus aureus
FGFDEILFFTLYLLLILIVL

SEQ ID NO: 1582408 - protein, 31 aa, Staphylococcus aureus
FGGAVATTMGWRWIFIFSIIVAVLSMLLIKG

SEQ ID NO: 1582409 - protein, 26 aa, Staphylococcus aureus
FGGIHEIYFPYVLMRPLLFIAVILGG

SEQ ID NO: 1582410 - protein, 32 aa, Staphylococcus aureus
FGGLKDGETYTVKFETPAGYLPTKENGTTDGE

SEQ ID NO: 1582411 - protein, 23 aa, Staphylococcus aureus
FGHALRNALIPVITIIVPMLASI

SEQ ID NO: 1582412 - protein, 18 aa, Staphylococcus aureus
FGILVILAIIAVVYVAAK

SEQ ID NO: 1582413 - protein, 17 aa, Staphylococcus aureus
FGKEAAMIAGYQYSTEF

SEQ ID NO: 1582414 - protein, 24 aa, Staphylococcus aureus
FGLLRAGLTILKGAFMLLKGPLKI

SEQ ID NO: 1582415 - protein, 20 aa, Staphylococcus aureus
FGLVICGIFVAFPEVRKNIS

SEQ ID NO: 1582416 - protein, 18 aa, Staphylococcus aureus
FGRRPVLLASLLGATIDY

SEQ ID NO: 1582417 - protein, 17 aa, Staphylococcus aureus
FGSLTFFDAFLVGLVEE

SEQ ID NO: 1582418 - protein, 29 aa, Staphylococcus aureus
FGTAGIRGKFGLGEGRLNKFTIEKLALGL

SEQ ID NO: 1582419 - protein, 30 aa, Staphylococcus aureus
FGYDQLKKLEGMLDFPMLSTNVYKDGKCAF

SEQ ID NO: 1582420 - protein, 27 aa, Staphylococcus aureus
FGYLKGFEGVFIYPALLALIIAAISYV

SEQ ID NO: 1582421 - protein, 25 aa, Staphylococcus aureus
FIAESYRAAILYQNWFFITHWKLSL

SEQ ID NO: 1582422 - protein, 18 aa, Staphylococcus aureus
FIATASIVFSILLIIHYF

SEQ ID NO: 1582423 - protein, 17 aa, Staphylococcus aureus
FICSLMVGKTPEYLNMP

SEQ ID NO: 1582424 - protein, 19 aa, Staphylococcus aureus
FIEMIKSKISLISSGKNNM

SEQ ID NO: 1582425 - protein, 23 aa, Staphylococcus aureus
FIFIDFLNFVALILVYLCTNPNN

SEQ ID NO: 1582426 - protein, 24 aa, Staphylococcus aureus
FIFWLIVGISMWFFVNQGILNGTK

SEQ ID NO: 1582427 - protein, 23 aa, Staphylococcus aureus
FIGEALFLLFFVATYLYIFSPIF

SEQ ID NO: 1582428 - protein, 23 aa, Staphylococcus aureus
FIGGVFSLLSTMVLYRFVVFSDQ

SEQ ID NO: 1582429 - protein, 21 aa, Staphylococcus aureus
FIGLLILYYICRLISEERLYR

SEQ ID NO: 1582430 - protein, 18 aa, Staphylococcus aureus
FIIASGYIGVWLYHFLER

SEQ ID NO: 1582431 - protein, 18 aa, Staphylococcus aureus
FIIGIALAIMILIIFALL

SEQ ID NO: 1582432 - protein, 17 aa, Staphylococcus aureus
FIIPFVLVFIVDGMKGI

SEQ ID NO: 1582433 - protein, 17 aa, Staphylococcus aureus
FIIVILFVMYKKRAQII

SEQ ID NO: 1582434 - protein, 20 aa, Staphylococcus aureus
FIKFPIPFLPPYLTLDFSDV

SEQ ID NO: 1582435 - protein, 19 aa, Staphylococcus aureus
FILAILVAIRLFKVEKHVS

SEQ ID NO: 1582436 - protein, 23 aa, Staphylococcus aureus
FILAIVVAMCLFKVEKHVSSPFL

SEQ ID NO: 1582437 - protein, 17 aa, Staphylococcus aureus
FILAIVVTMCLFKVEKH

SEQ ID NO: 1582438 - protein, 25 aa, Staphylococcus aureus
FILGLCIGVGMILREFYIFRFIIGK

SEQ ID NO: 1582439 - protein, 17 aa, Staphylococcus aureus
FILITIGALIYLVSMIF

SEQ ID NO: 1582440 - protein, 25 aa, Staphylococcus aureus
FILPWKVCLYIGIALGIVVTIFLLV

SEQ ID NO: 1582441 - protein, 17 aa, Staphylococcus aureus
FINKIINRHEMSAKDIT

SEQ ID NO: 1582442 - protein, 21 aa, Staphylococcus aureus
FINKNDCRIFSFDARDSRHLS

SEQ ID NO: 1582443 - protein, 20 aa, Staphylococcus aureus
FISKYGSFFLKGIKITILIS

SEQ ID NO: 1582444 - protein, 17 aa, Staphylococcus aureus
FISLFILYNEFRSGNLG

SEQ ID NO: 1582445 - protein, 25 aa, Staphylococcus aureus
FISLSLLCLCLFFSKLLKFNFFNLK

SEQ ID NO: 1582446 - protein, 17 aa, Staphylococcus aureus
FITEGIQNIILFITWIM

SEQ ID NO: 1582447 - protein, 18 aa, Staphylococcus aureus
FITEGIQNIILFITWIML

SEQ ID NO: 1582448 - protein, 18 aa, Staphylococcus aureus
FITQCISMFKLIDNMYNY

SEQ ID NO: 1582449 - protein, 19 aa, Staphylococcus aureus
FITQCISMFKLIDNMYNYD

SEQ ID NO: 1582450 - protein, 24 aa, Staphylococcus aureus
FITVISVLLAFHLKQHYDQTTNEN

SEQ ID NO: 1582451 - protein, 18 aa, Staphylococcus aureus
FIVDIILIFTVLKIIMYI

SEQ ID NO: 1582452 - protein, 22 aa, Staphylococcus aureus
FIVICLNAFIVFSVKGNMHEAL

SEQ ID NO: 1582453 - protein, 25 aa, Staphylococcus aureus
FIVLKSSLFFYYLFTKLSLISVLVL

SEQ ID NO: 1582454 - protein, 26 aa, Staphylococcus aureus
FIVLKSSLFFYYLFTKLSLISVLVLH

SEQ ID NO: 1582455 - protein, 37 aa, Staphylococcus aureus
FIVYAIIALCLYNFLSSILWLIGGILLIWNKYSKDES

SEQ ID NO: 1582456 - protein, 18 aa, Staphylococcus aureus
FKDDAFGNVSINLDSTEL

SEQ ID NO: 1582457 - protein, 18 aa, Staphylococcus aureus
FKDIAWRDLLIIPIIGVI

SEQ ID NO: 1582458 - protein, 19 aa, Staphylococcus aureus
FKDIAWRDLLIIPIIGVLI

SEQ ID NO: 1582459 - protein, 27 aa, Staphylococcus aureus
FKDKITYKYQNVASINFGDINKTYVVL

SEQ ID NO: 1582460 - protein, 28 aa, Staphylococcus aureus
FKDKITYKYQNVASINFGDITKTYVVLV

SEQ ID NO: 1582461 - protein, 19 aa, Staphylococcus aureus
FKGDSLLIHSLENYDNIVK

SEQ ID NO: 1582462 - protein, 26 aa, Staphylococcus aureus
FKGIDLTSSRFIKWLNDMNIVPGYYG

SEQ ID NO: 1582463 - protein, 32 aa, Staphylococcus aureus
FKGIDLTSSRFIKWLNDMNVIPGYYGVNSIDL

SEQ ID NO: 1582464 - protein, 32 aa, Staphylococcus aureus
FKGINLTSSRFIKWLNDMNIIPGYYGVNSIDL

SEQ ID NO: 1582465 - protein, 24 aa, Staphylococcus aureus
FKGVRIQPYFKHIDFIFAGVFAFI

SEQ ID NO: 1582466 - protein, 45 aa, Staphylococcus aureus
FKGVRIQPYFKYIDFIFAGVFAFIFLAYRILMLWQGYISQQKALN

SEQ ID NO: 1582467 - protein, 20 aa, Staphylococcus aureus
FKIDHMMIAVGVIKQMNIVV

SEQ ID NO: 1582468 - protein, 20 aa, Staphylococcus aureus
FKIIKRFKKGVISVNDVMFS

SEQ ID NO: 1582469 - protein, 21 aa, Staphylococcus aureus
FKITVPKELNLNGVTSTAKVP

SEQ ID NO: 1582470 - protein, 23 aa, Staphylococcus aureus
FKKLSWPVGPIVAAITISSLGSL

SEQ ID NO: 1582471 - protein, 21 aa, Staphylococcus aureus
FKLQAMDTMTSFWIPQLGGQK

SEQ ID NO: 1582472 - protein, 22 aa, Staphylococcus aureus
FKLQAMDTMTSFWIPQLGGQKY

SEQ ID NO: 1582473 - protein, 20 aa, Staphylococcus aureus
FKLRRYTLIIYFLLLTLYPF

SEQ ID NO: 1582474 - protein, 20 aa, Staphylococcus aureus
FKLSSLPASLPIDLVALSNK

SEQ ID NO: 1582475 - protein, 25 aa, Staphylococcus aureus
FKMVFKTPRAVIIGVCLQFSIMPTL

SEQ ID NO: 1582476 - protein, 20 aa, Staphylococcus aureus
FKNICLSLFAYILFGGLSTM

SEQ ID NO: 1582477 - protein, 17 aa, Staphylococcus aureus
FKREFSKLIGFLIIALI

SEQ ID NO: 1582478 - protein, 17 aa, Staphylococcus aureus
FKRVVSNVGDGMKNALD

SEQ ID NO: 1582479 - protein, 17 aa, Staphylococcus aureus
FKRVVSNVGDGMSDALG

SEQ ID NO: 1582480 - protein, 26 aa, Staphylococcus aureus
FKSVIDKRLKYIILHEYAHAKNRDTL

SEQ ID NO: 1582481 - protein, 17 aa, Staphylococcus aureus
FKVGRGFDKEDNELRKK

SEQ ID NO: 1582482 - protein, 20 aa, Staphylococcus aureus
FKVLAPVMKFIMYILSVAVE

SEQ ID NO: 1582483 - protein, 20 aa, Staphylococcus aureus
FKVTIWYTAPTALRMLMSAG

SEQ ID NO: 1582484 - protein, 21 aa, Staphylococcus aureus
FKYLKWLAISKKFSYKMFLVF

SEQ ID NO: 1582485 - protein, 20 aa, Staphylococcus aureus
FLAIIPFLGILIHWILFFLM

SEQ ID NO: 1582486 - protein, 17 aa, Staphylococcus aureus
FLDELPTTLAIIGGIIT

SEQ ID NO: 1582487 - protein, 26 aa, Staphylococcus aureus
FLDGNGRLGRILIILMLVNAGVIDKP

SEQ ID NO: 1582488 - protein, 24 aa, Staphylococcus aureus
FLDPKSGVEKLVISNGQNIERIET

SEQ ID NO: 1582489 - protein, 24 aa, Staphylococcus aureus
FLGDEIQNALPLIKFENYLSFILF

SEQ ID NO: 1582490 - protein, 24 aa, Staphylococcus aureus
FLGGFILAIAMERWNLHTRVALTI

SEQ ID NO: 1582491 - protein, 23 aa, Staphylococcus aureus
FLIAKLFSQFVLRFREKDLAEMI

SEQ ID NO: 1582492 - protein, 19 aa, Staphylococcus aureus
FLIAVCCIIYIKQINETED

SEQ ID NO: 1582493 - protein, 26 aa, Staphylococcus aureus
FLILPLCLVMGATAYAVANPVGQPTN

SEQ ID NO: 1582494 - protein, 17 aa, Staphylococcus aureus
FLIYMLKDHEKFIPAVA

SEQ ID NO: 1582495 - protein, 21 aa, Staphylococcus aureus
FLIYRIYILFIDYKSVNKKLD

SEQ ID NO: 1582496 - protein, 25 aa, Staphylococcus aureus
FLKEHFSKWNWLSSLVAFIGIFIIS

SEQ ID NO: 1582497 - protein, 20 aa, Staphylococcus aureus
FLKRRFPNNNVPVNFNLDTE

SEQ ID NO: 1582498 - protein, 21 aa, Staphylococcus aureus
FLLHYIFKINDKWLLVLCVFV

SEQ ID NO: 1582499 - protein, 24 aa, Staphylococcus aureus
FLMFIRRFIVLLFVFACITTLLWL

SEQ ID NO: 1582500 - protein, 17 aa, Staphylococcus aureus
FLNFVALILVYLCTNPN

SEQ ID NO: 1582501 - protein, 18 aa, Staphylococcus aureus
FLNQGGILRDKGMANASG

SEQ ID NO: 1582502 - protein, 17 aa, Staphylococcus aureus
FLPKRHKEDEEDVKVTN

SEQ ID NO: 1582503 - protein, 29 aa, Staphylococcus aureus
FLQPILFLYFRFIYCRNLFSNYVTNVSND

SEQ ID NO: 1582504 - protein, 20 aa, Staphylococcus aureus
FLRLYILTLMFFSVNAILNV

SEQ ID NO: 1582505 - protein, 17 aa, Staphylococcus aureus
FLSESLSVSTSESTSES

SEQ ID NO: 1582506 - protein, 22 aa, Staphylococcus aureus
FLTAWVADIVYRKVFRLYTNDI

SEQ ID NO: 1582507 - protein, 21 aa, Staphylococcus aureus
FLTLKSLFWVLPWAIMQRILL

SEQ ID NO: 1582508 - protein, 20 aa, Staphylococcus aureus
FLVHCFLVYIIAYIGDLIIN

SEQ ID NO: 1582509 - protein, 18 aa, Staphylococcus aureus
FLYFKIRLYSVFLVMVTQ

SEQ ID NO: 1582510 - protein, 27 aa, Staphylococcus aureus
FMLNAPFVYSFWWFKHTCFLYVYHRRY

SEQ ID NO: 1582511 - protein, 27 aa, Staphylococcus aureus
FMMLPLADIDLAWLVPFILLAIIGFII

SEQ ID NO: 1582512 - protein, 19 aa, Staphylococcus aureus
FMVLISLILAQIVLPLITP

SEQ ID NO: 1582513 - protein, 36 aa, Staphylococcus aureus
FMVSLPIIIILLIWLSWRFYKYSKFVKMMNNLNKFG

SEQ ID NO: 1582514 - protein, 19 aa, Staphylococcus aureus
FMWFKSRSILGGAIPHIVL

SEQ ID NO: 1582515 - protein, 24 aa, Staphylococcus aureus
FNAIKANRIVAFIIATTVSSLIFA

SEQ ID NO: 1582516 - protein, 30 aa, Staphylococcus aureus
FNAPKCLLVACGFVGAIAWTIYQLTVDLEF

SEQ ID NO: 1582517 - protein, 17 aa, Staphylococcus aureus
FNGAPWLFFFPGVLLGG

SEQ ID NO: 1582518 - protein, 17 aa, Staphylococcus aureus
FNGETAVSIAIKHIQDS

SEQ ID NO: 1582519 - protein, 17 aa, Staphylococcus aureus
FNGLYRFQGLRRYKSKY

SEQ ID NO: 1582520 - protein, 18 aa, Staphylococcus aureus
FNIPLSFISEHQHPILRD

SEQ ID NO: 1582521 - protein, 24 aa, Staphylococcus aureus
FNKYSYRKLFLVALVLFTIGSLIC

SEQ ID NO: 1582522 - protein, 18 aa, Staphylococcus aureus
FNNFRIHKAFEHKHQPEI

SEQ ID NO: 1582523 - protein, 27 aa, Staphylococcus aureus
FNNQITYNYSSPIAGIDKPNGANISSQ

SEQ ID NO: 1582524 - protein, 19 aa, Staphylococcus aureus
FNPNAKNFKIYEVTDQNQF

SEQ ID NO: 1582525 - protein, 17 aa, Staphylococcus aureus
FNPYKVLSVSIIISIGA

SEQ ID NO: 1582526 - protein, 20 aa, Staphylococcus aureus
FNTISAIRWRRRNYNYRKQI

SEQ ID NO: 1582527 - protein, 19 aa, Staphylococcus aureus
FPILMGFFVFLFVFLISGI

SEQ ID NO: 1582528 - protein, 21 aa, Staphylococcus aureus
FPILRKFKIATPVFKPLFAWQ

SEQ ID NO: 1582529 - protein, 19 aa, Staphylococcus aureus
FPKENWWVFIVLLLLVGNV

SEQ ID NO: 1582530 - protein, 21 aa, Staphylococcus aureus
FPQGKRGGALGIIAGSIGVGT

SEQ ID NO: 1582531 - protein, 19 aa, Staphylococcus aureus
FPSGHAMGSTAYFGSGIYL

SEQ ID NO: 1582532 - protein, 17 aa, Staphylococcus aureus
FPVMASVFLIFTIIIMF

SEQ ID NO: 1582533 - protein, 18 aa, Staphylococcus aureus
FQCLLYTQQTCRFIIVGV

SEQ ID NO: 1582534 - protein, 26 aa, Staphylococcus aureus
FQIVPRWFWFYIVLVSIVFPFEIGKE

SEQ ID NO: 1582535 - protein, 24 aa, Staphylococcus aureus
FQLEELIVWSSCFIGFLEIIIFLL

SEQ ID NO: 1582536 - protein, 25 aa, Staphylococcus aureus
FQYKIFPVLMFLVSTGLGILVIAQN

SEQ ID NO: 1582537 - protein, 23 aa, Staphylococcus aureus
FRNFDMRPYFIIFDEVTAFTSTL

SEQ ID NO: 1582538 - protein, 20 aa, Staphylococcus aureus
FRVLGRPAGFLVTFLDIFKG

SEQ ID NO: 1582539 - protein, 24 aa, Staphylococcus aureus
FRVLGRPAGFLVTFLDIFKGFITA

SEQ ID NO: 1582540 - protein, 22 aa, Staphylococcus aureus
FRVVLIPVFILFALVDFGFGNV

SEQ ID NO: 1582541 - protein, 18 aa, Staphylococcus aureus
FRYILKRYFNYMLNYKVW

SEQ ID NO: 1582542 - protein, 25 aa, Staphylococcus aureus
FSAFSLDIPRGIYVSSYTNLKQDVT

SEQ ID NO: 1582543 - protein, 25 aa, Staphylococcus aureus
FSDETRTAIYISPFWFIFLFFFYKK

SEQ ID NO: 1582544 - protein, 20 aa, Staphylococcus aureus
FSFDARDSRHLSFIEAPIIV

SEQ ID NO: 1582545 - protein, 25 aa, Staphylococcus aureus
FSFDARDSRHLSFIEAPIIVNVQAS

SEQ ID NO: 1582546 - protein, 20 aa, Staphylococcus aureus
FSIDIANAFVKPESQQAYFL

SEQ ID NO: 1582547 - protein, 20 aa, Staphylococcus aureus
FSIIMWLFFSCSLLKERKPV

SEQ ID NO: 1582548 - protein, 17 aa, Staphylococcus aureus
FSIITALEYRSQHPLAS

SEQ ID NO: 1582549 - protein, 26 aa, Staphylococcus aureus
FSIPNIFELYNWPTLAIHLSYYVTFL

SEQ ID NO: 1582550 - protein, 18 aa, Staphylococcus aureus
FSLFTLYVNHIFIAGTLY

SEQ ID NO: 1582551 - protein, 25 aa, Staphylococcus aureus
FSLTVKETFLTWSLLETIISVSGII

SEQ ID NO: 1582552 - protein, 21 aa, Staphylococcus aureus
FSMEIKKDLKLLMKKDNYHNI

SEQ ID NO: 1582553 - protein, 17 aa, Staphylococcus aureus
FSNEKINSIRNSEIGTA

SEQ ID NO: 1582554 - protein, 17 aa, Staphylococcus aureus
FSNEKMNSIRNSEIGSA

SEQ ID NO: 1582555 - protein, 17 aa, Staphylococcus aureus
FSNEKMNSIRNSEIGTA

SEQ ID NO: 1582556 - protein, 24 aa, Staphylococcus aureus
FSPFKRLILYGIILIAMTAFLNLM

SEQ ID NO: 1582557 - protein, 23 aa, Staphylococcus aureus
FSPFKRLILYGIILIAMTVFLNL

SEQ ID NO: 1582558 - protein, 30 aa, Staphylococcus aureus
FSQVWPILIFLPFVVIFFLKINKHYRDIAE

SEQ ID NO: 1582559 - protein, 19 aa, Staphylococcus aureus
FSSATGHTMDFFWELATLI

SEQ ID NO: 1582560 - protein, 17 aa, Staphylococcus aureus
FSSIIFLFFKLKYYAIV

SEQ ID NO: 1582561 - protein, 17 aa, Staphylococcus aureus
FSTPAGYTPTTANSGTD

SEQ ID NO: 1582562 - protein, 18 aa, Staphylococcus aureus
FSVAMILIVLMFMLFIGN

SEQ ID NO: 1582563 - protein, 29 aa, Staphylococcus aureus
FSVISKLGWLKIIFIESLPLRAYSLEWFP

SEQ ID NO: 1582564 - protein, 17 aa, Staphylococcus aureus
FSVIVLIPFTAYTYEPM

SEQ ID NO: 1582565 - protein, 21 aa, Staphylococcus aureus
FSVTKFNDWIFIIFIISVYYI

SEQ ID NO: 1582566 - protein, 25 aa, Staphylococcus aureus
FSYETRAAIYISPFWFIFLFFFYKK

SEQ ID NO: 1582567 - protein, 19 aa, Staphylococcus aureus
FSYHQAIIIGCYYLYRLIF

SEQ ID NO: 1582568 - protein, 22 aa, Staphylococcus aureus
FTASGGDGYSMFGSPREEGISL

SEQ ID NO: 1582569 - protein, 17 aa, Staphylococcus aureus
FTCANCAGKFEKNVKKI

SEQ ID NO: 1582570 - protein, 18 aa, Staphylococcus aureus
FTDLFIAFKKGIYLKSVL

SEQ ID NO: 1582571 - protein, 26 aa, Staphylococcus aureus
FTHRFGFKRNYLFFVFLFLLGSIMGL

SEQ ID NO: 1582572 - protein, 25 aa, Staphylococcus aureus
FTIACISVSWLWFFLLAILGKMVGS

SEQ ID NO: 1582573 - protein, 17 aa, Staphylococcus aureus
FTINFFVNFIVYLCMYL

SEQ ID NO: 1582574 - protein, 19 aa, Staphylococcus aureus
FTKERVEGFLNKSKNEQAA

SEQ ID NO: 1582575 - protein, 23 aa, Staphylococcus aureus
FTKKNIHEPWLFSLPSLILMVLV

SEQ ID NO: 1582576 - protein, 24 aa, Staphylococcus aureus
FTKKNIHEPWLFSLPSLLLMGLIP

SEQ ID NO: 1582577 - protein, 18 aa, Staphylococcus aureus
FTLFDFTYDLPLSTYLGQ

SEQ ID NO: 1582578 - protein, 29 aa, Staphylococcus aureus
FTLRKIIFENFSKKCTYWVTLIITQILLT

SEQ ID NO: 1582579 - protein, 19 aa, Staphylococcus aureus
FTQFTFKKALLFAALFILI

SEQ ID NO: 1582580 - protein, 18 aa, Staphylococcus aureus
FTRDGLPIAKTRGLQNVV

SEQ ID NO: 1582581 - protein, 19 aa, Staphylococcus aureus
FTSISWPILAVVAVIGAFI

SEQ ID NO: 1582582 - protein, 23 aa, Staphylococcus aureus
FTWGIPLHEGHLFGILNKIINLF

SEQ ID NO: 1582583 - protein, 19 aa, Staphylococcus aureus
FTWGIPLHEGHLFGIVNKI

SEQ ID NO: 1582584 - protein, 23 aa, Staphylococcus aureus
FTWGIPLHEGHLFGIVNKIINLF

SEQ ID NO: 1582585 - protein, 24 aa, Staphylococcus aureus
FVAFPEVRKNISFLIIKTDAMGRG

SEQ ID NO: 1582586 - protein, 20 aa, Staphylococcus aureus
FVDSFTLDTSKLKDVTNQFN

SEQ ID NO: 1582587 - protein, 21 aa, Staphylococcus aureus
FVEICHFKEQINFKLGNIKWF

SEQ ID NO: 1582588 - protein, 23 aa, Staphylococcus aureus
FVGLILGVMVWLGMKSIPIFFIL

SEQ ID NO: 1582589 - protein, 24 aa, Staphylococcus aureus
FVGLMVPHIVRFLIGTDYAKILPL

SEQ ID NO: 1582590 - protein, 22 aa, Staphylococcus aureus
FVICKLIAQLLIRFKTKDLAEM

SEQ ID NO: 1582591 - protein, 23 aa, Staphylococcus aureus
FVKLKSILLAILFTSLALTAGTV

SEQ ID NO: 1582592 - protein, 17 aa, Staphylococcus aureus
FVKPESQQAYFLNVIFL

SEQ ID NO: 1582593 - protein, 23 aa, Staphylococcus aureus
FVLASLAIYWAMWPTTAEVILII

SEQ ID NO: 1582594 - protein, 17 aa, Staphylococcus aureus
FVLAVLLQYVFAVKLRW

SEQ ID NO: 1582595 - protein, 24 aa, Staphylococcus aureus
FVLFFLMKFAHVMTPEMTQALTAL

SEQ ID NO: 1582596 - protein, 18 aa, Staphylococcus aureus
FVLFWKNYVNFTGRSRRS

SEQ ID NO: 1582597 - protein, 17 aa, Staphylococcus aureus
FVLIIPILYRFFKRIHL

SEQ ID NO: 1582598 - protein, 26 aa, Staphylococcus aureus
FVLSPIVNVWIFKLFVEVLGMNSFSV

SEQ ID NO: 1582599 - protein, 31 aa, Staphylococcus aureus
FVNMPVLHLHYGYYICLAVMFVIAVVLIIFF

SEQ ID NO: 1582600 - protein, 19 aa, Staphylococcus aureus
FVNNRASGILYIIGAVISA

SEQ ID NO: 1582601 - protein, 18 aa, Staphylococcus aureus
FVTTDSYGVASTYTSSSA

SEQ ID NO: 1582602 - protein, 18 aa, Staphylococcus aureus
FVTVKGICMVSLMLVILH

SEQ ID NO: 1582603 - protein, 29 aa, Staphylococcus aureus
FVVLLIKAIITWLLVIPIFNFMTSFVEST

SEQ ID NO: 1582604 - protein, 19 aa, Staphylococcus aureus
FVWAIAYGSCIGWGAFIIP

SEQ ID NO: 1582605 - protein, 17 aa, Staphylococcus aureus
FVYSLVGILCFCIPFTI

SEQ ID NO: 1582606 - protein, 18 aa, Staphylococcus aureus
FWFRCRRRFLRMIWWSNK

SEQ ID NO: 1582607 - protein, 21 aa, Staphylococcus aureus
FWFSELPTWIPGVIAILLLMA

SEQ ID NO: 1582608 - protein, 19 aa, Staphylococcus aureus
FWQGILFILAFSLKLDILP

SEQ ID NO: 1582609 - protein, 20 aa, Staphylococcus aureus
FWVIMVIIGFLYVCKLQFYP

SEQ ID NO: 1582610 - protein, 18 aa, Staphylococcus aureus
FYAGKNMQGFLHLIFFWT

SEQ ID NO: 1582611 - protein, 21 aa, Staphylococcus aureus
FYCLVIFPMTIVVYLRVSQKN

SEQ ID NO: 1582612 - protein, 17 aa, Staphylococcus aureus
FYGIPFLGATFILSFGW

SEQ ID NO: 1582613 - protein, 21 aa, Staphylococcus aureus
FYSIFKSLLTYLAILIVSSLI

SEQ ID NO: 1582614 - protein, 18 aa, Staphylococcus aureus
FYSLDGINGLSLLDTLSR

SEQ ID NO: 1582615 - protein, 21 aa, Staphylococcus aureus
GAAKVGYGTFVKNGADGVTNQ

SEQ ID NO: 1582616 - protein, 23 aa, Staphylococcus aureus
GAAQFKNGAWVIAGIGDLINTMI

SEQ ID NO: 1582617 - protein, 19 aa, Staphylococcus aureus
GAFDYRRSLLRTDVVLNSE

SEQ ID NO: 1582618 - protein, 20 aa, Staphylococcus aureus
GAFFKIWIVIGLVIIGTYAF

SEQ ID NO: 1582619 - protein, 24 aa, Staphylococcus aureus
GAFLKIWIVIGLVIIGTYAFFVGI

SEQ ID NO: 1582620 - protein, 25 aa, Staphylococcus aureus
GAGKQEALISFTFKVDEKIKKYPFN

SEQ ID NO: 1582621 - protein, 18 aa, Staphylococcus aureus
GAISIVIADLIGRTLFLP

SEQ ID NO: 1582622 - protein, 22 aa, Staphylococcus aureus
GALAGYLGSIVFKKYPIVTKQD

SEQ ID NO: 1582623 - protein, 21 aa, Staphylococcus aureus
GALIPEFFPIDTIIELSHRAV

SEQ ID NO: 1582624 - protein, 21 aa, Staphylococcus aureus
GALKSRAMVLYINRNTRTAKG

SEQ ID NO: 1582625 - protein, 19 aa, Staphylococcus aureus
GALLLYLPFTGKKQISFLD

SEQ ID NO: 1582626 - protein, 17 aa, Staphylococcus aureus
GAMIMGPLVGWLMKKTD

SEQ ID NO: 1582627 - protein, 17 aa, Staphylococcus aureus
GAMKVLLQFVNKLATVE

SEQ ID NO: 1582628 - protein, 21 aa, Staphylococcus aureus
GARLFYSIVSFIVNLFRAIPF

SEQ ID NO: 1582629 - protein, 17 aa, Staphylococcus aureus
GASGVGSVWSFKSMFNT

SEQ ID NO: 1582630 - protein, 22 aa, Staphylococcus aureus
GASPEIAVLIALVIILILTLPP

SEQ ID NO: 1582631 - protein, 19 aa, Staphylococcus aureus
GASPLQIIRYFLIPEALGS

SEQ ID NO: 1582632 - protein, 28 aa, Staphylococcus aureus
GAVFIVFLLLPARWFTGLVTEKTVEDNR

SEQ ID NO: 1582633 - protein, 25 aa, Staphylococcus aureus
GAYLFFKSSVSLVFKIIKRFKKGVI

SEQ ID NO: 1582634 - protein, 25 aa, Staphylococcus aureus
GAYLFFKSSVSLVFKIIKSFKKGVI

SEQ ID NO: 1582635 - protein, 25 aa, Staphylococcus aureus
GAYLFFRSSVLLIFKTLKKSKNGRV

SEQ ID NO: 1582636 - protein, 22 aa, Staphylococcus aureus
GDEYLKVIAVLLIAAIVSLFVL

SEQ ID NO: 1582637 - protein, 17 aa, Staphylococcus aureus
GDFIFKYTDWGITKATI

SEQ ID NO: 1582638 - protein, 25 aa, Staphylococcus aureus
GDFVGFISAWGYWFSAFLGNVAYAT

SEQ ID NO: 1582639 - protein, 18 aa, Staphylococcus aureus
GDHSPREMGFNLFINLLN

SEQ ID NO: 1582640 - protein, 17 aa, Staphylococcus aureus
GDINKTYVVLVEGHYDN

SEQ ID NO: 1582641 - protein, 18 aa, Staphylococcus aureus
GDKGCGNGPNGFRNEMIE

SEQ ID NO: 1582642 - protein, 22 aa, Staphylococcus aureus
GDLAYLLPKIHIIKGEYCSSKF

SEQ ID NO: 1582643 - protein, 25 aa, Staphylococcus aureus
GDLVGWRYTFLFLIIVSIIVGFLMV

SEQ ID NO: 1582644 - protein, 25 aa, Staphylococcus aureus
GDLVGWRYTFLFLIIVSVIVGFLMM

SEQ ID NO: 1582645 - protein, 30 aa, Staphylococcus aureus
GDNAPALYPNYWGGNKYKVIEELRKQGYNV

SEQ ID NO: 1582646 - protein, 21 aa, Staphylococcus aureus
GDNRLLLGIVLGVITFWLFAQ

SEQ ID NO: 1582647 - protein, 18 aa, Staphylococcus aureus
GDQALKFIRSRKEEGDGG

SEQ ID NO: 1582648 - protein, 24 aa, Staphylococcus aureus
GDQKKYNLGDYVWEDTNKDGKQDA

SEQ ID NO: 1582649 - protein, 19 aa, Staphylococcus aureus
GDSTIWLIGILVVFTAISY

SEQ ID NO: 1582650 - protein, 17 aa, Staphylococcus aureus
GDTFKITVPKELNLNGV

SEQ ID NO: 1582651 - protein, 25 aa, Staphylococcus aureus
GDTIFKPKNSFLMIHNSWVMTVGNA

SEQ ID NO: 1582652 - protein, 21 aa, Staphylococcus aureus
GEIQRLAIARMLLKDTASTWI

SEQ ID NO: 1582653 - protein, 21 aa, Staphylococcus aureus
GEIQRLAITRMLLKDTASTWI

SEQ ID NO: 1582654 - protein, 24 aa, Staphylococcus aureus
GEKFAKIGSLIFVFLIGTVTIAAI

SEQ ID NO: 1582655 - protein, 23 aa, Staphylococcus aureus
GELDFPNSEIFYYQQQQFTFLVD

SEQ ID NO: 1582656 - protein, 17 aa, Staphylococcus aureus
GEMFVWPAVPTIANQLA

SEQ ID NO: 1582657 - protein, 21 aa, Staphylococcus aureus
GENSITRFIEYTKTNLPIIGN

SEQ ID NO: 1582658 - protein, 20 aa, Staphylococcus aureus
GEPFKMFGIPIFILAIILFT

SEQ ID NO: 1582659 - protein, 32 aa, Staphylococcus aureus
GESLDKVKHTPFFLPKRRRKEDEEDVEVKNEN

SEQ ID NO: 1582660 - protein, 29 aa, Staphylococcus aureus
GESLDKVKHTPFFLPKRRRKEDEEDVEVT

SEQ ID NO: 1582661 - protein, 30 aa, Staphylococcus aureus
GESLDKVKHTPFFLPKRRRKEDEEDVEVTN

SEQ ID NO: 1582662 - protein, 31 aa, Staphylococcus aureus
GESLDKVKHTPFFLPKRRRKEEEEDVEVTNE

SEQ ID NO: 1582663 - protein, 17 aa, Staphylococcus aureus
GFFSVGVVIVFSPFCPS

SEQ ID NO: 1582664 - protein, 18 aa, Staphylococcus aureus
GFSRSGSTISTGVLMKLN

SEQ ID NO: 1582665 - protein, 26 aa, Staphylococcus aureus
GFSTAGNLGWSHPMVYITIIAAIVIL

SEQ ID NO: 1582666 - protein, 30 aa, Staphylococcus aureus
GFTLRKIIFENFSKKCTYWVTLIISQILLT

SEQ ID NO: 1582667 - protein, 24 aa, Staphylococcus aureus
GFVGTCGWMVYTLFFNGFNVHTIY

SEQ ID NO: 1582668 - protein, 25 aa, Staphylococcus aureus
GFVIGWTYWLCWIVSSMSDLTAMEQ

SEQ ID NO: 1582669 - protein, 22 aa, Staphylococcus aureus
GFWMFKEYFSLTVKETFLTWSL

SEQ ID NO: 1582670 - protein, 19 aa, Staphylococcus aureus
GGALKRFSIFAMGIVPYIT

SEQ ID NO: 1582671 - protein, 19 aa, Staphylococcus aureus
GGFTLKGLVPVVANNTDSP

SEQ ID NO: 1582672 - protein, 20 aa, Staphylococcus aureus
GGFVAEFSFNYIFLANLIMY

SEQ ID NO: 1582673 - protein, 17 aa, Staphylococcus aureus
GGGMIIPAIYAMAGSVW

SEQ ID NO: 1582674 - protein, 17 aa, Staphylococcus aureus
GGGSADGDSAVNPVDPT

SEQ ID NO: 1582675 - protein, 18 aa, Staphylococcus aureus
GGILKMKGVLENKTARNR

SEQ ID NO: 1582676 - protein, 25 aa, Staphylococcus aureus
GGKTYFLFYVIRELFRRHSEVRLLD

SEQ ID NO: 1582677 - protein, 19 aa, Staphylococcus aureus
GGLKDGETYTVKFETPAGY

SEQ ID NO: 1582678 - protein, 21 aa, Staphylococcus aureus
GGLLKKPAFIIPMLLQGLTYV

SEQ ID NO: 1582679 - protein, 18 aa, Staphylococcus aureus
GGLWFPINTFPNWLQHVA

SEQ ID NO: 1582680 - protein, 19 aa, Staphylococcus aureus
GGNIIDIDFDSVPHIHGFN

SEQ ID NO: 1582681 - protein, 19 aa, Staphylococcus aureus
GGNVLVEWHGITIETNGIL

SEQ ID NO: 1582682 - protein, 19 aa, Staphylococcus aureus
GGPFPISWTPFGELFSGVF

SEQ ID NO: 1582683 - protein, 18 aa, Staphylococcus aureus
GGRVDYGAAHAAKYGHER

SEQ ID NO: 1582684 - protein, 19 aa, Staphylococcus aureus
GGSTIWLIGILVVFTAISY

SEQ ID NO: 1582685 - protein, 18 aa, Staphylococcus aureus
GGSVVIWLLSYVGPHGIN

SEQ ID NO: 1582686 - protein, 24 aa, Staphylococcus aureus
GGTRIRPILMTAIATIGALVPLLF

SEQ ID NO: 1582687 - protein, 24 aa, Staphylococcus aureus
GGVMTLLVGLGLMKRKKKKDENDQ

SEQ ID NO: 1582688 - protein, 17 aa, Staphylococcus aureus
GHALRNALIPIITIIVP

SEQ ID NO: 1582689 - protein, 26 aa, Staphylococcus aureus
GHTFASSLPAKFVVKDVQPAKPTVTE

SEQ ID NO: 1582690 - protein, 18 aa, Staphylococcus aureus
GHVLPLVAQYLINREEEV

SEQ ID NO: 1582691 - protein, 28 aa, Staphylococcus aureus
GIASVTLCTLLISGGVTPAANAAQHDEA

SEQ ID NO: 1582692 - protein, 21 aa, Staphylococcus aureus
GIATIICIYILIKQLFESKDG

SEQ ID NO: 1582693 - protein, 26 aa, Staphylococcus aureus
GIDKSQKYNFLITSSHMQNRYSNGIM

SEQ ID NO: 1582694 - protein, 36 aa, Staphylococcus aureus
GIDSGDTVYPHQAGYVKLNYGFSVPNEAVQGDTFKI

SEQ ID NO: 1582695 - protein, 36 aa, Staphylococcus aureus
GIDSGTTVYPHQAGYVKLNYGFSVPNSAVKGDTFKI

SEQ ID NO: 1582696 - protein, 17 aa, Staphylococcus aureus
GIGGKFGKIYGIIFAIV

SEQ ID NO: 1582697 - protein, 29 aa, Staphylococcus aureus
GIHFSETLARLGIVLGVFLMSLQMGLYIF

SEQ ID NO: 1582698 - protein, 29 aa, Staphylococcus aureus
GIHFSETLARLGIVLGVFLTSLQMGLYMF

SEQ ID NO: 1582699 - protein, 18 aa, Staphylococcus aureus
GIIGVIFAVWILSIVEKR

SEQ ID NO: 1582700 - protein, 17 aa, Staphylococcus aureus
GIILAIVGACLWGLGGT

SEQ ID NO: 1582701 - protein, 29 aa, Staphylococcus aureus
GIKDFKVTLLNEKGEVIGTTKTDENGKYR

SEQ ID NO: 1582702 - protein, 25 aa, Staphylococcus aureus
GIMYVFKFGPSILFMNCTQSSRQLN

SEQ ID NO: 1582703 - protein, 18 aa, Staphylococcus aureus
GINLKKKNIYSIRKLGVG

SEQ ID NO: 1582704 - protein, 17 aa, Staphylococcus aureus
GIPLYFTLFVPHLSIEI

SEQ ID NO: 1582705 - protein, 24 aa, Staphylococcus aureus
GIPNKRFGQIGVLLYFGDVTLTHK

SEQ ID NO: 1582706 - protein, 18 aa, Staphylococcus aureus
GIQNIILFITWIMLVIMF

SEQ ID NO: 1582707 - protein, 19 aa, Staphylococcus aureus
GIQNIILFITWIMLVIMFL

SEQ ID NO: 1582708 - protein, 23 aa, Staphylococcus aureus
GISNIIISFIFYKSKFKRLLIGT

SEQ ID NO: 1582709 - protein, 18 aa, Staphylococcus aureus
GISTLRKVPDIKSTDGQV

SEQ ID NO: 1582710 - protein, 21 aa, Staphylococcus aureus
GIVAKMIAVWFFRKYDNHMRG

SEQ ID NO: 1582711 - protein, 22 aa, Staphylococcus aureus
GIVAKMIAVWFFRKYDNHMRGS

SEQ ID NO: 1582712 - protein, 23 aa, Staphylococcus aureus
GIVISVICCLLITGILYYTLDGF

SEQ ID NO: 1582713 - protein, 18 aa, Staphylococcus aureus
GIVRGFEWYPFDNPISLM

SEQ ID NO: 1582714 - protein, 19 aa, Staphylococcus aureus
GIVRGFEWYPFDNPISLMT

SEQ ID NO: 1582715 - protein, 17 aa, Staphylococcus aureus
GIVWCLLLSGSYALIRF

SEQ ID NO: 1582716 - protein, 34 aa, Staphylococcus aureus
GKDDMSLDTGFYKEPKYNLGDYVWEDTNKDGIQD

SEQ ID NO: 1582717 - protein, 20 aa, Staphylococcus aureus
GKFRINQVIMGAGDYKNLGG

SEQ ID NO: 1582718 - protein, 18 aa, Staphylococcus aureus
GKGTERYLNYQARRVCWF

SEQ ID NO: 1582719 - protein, 23 aa, Staphylococcus aureus
GKKKRSLVSMIIQIIVFILTAIA

SEQ ID NO: 1582720 - protein, 23 aa, Staphylococcus aureus
GKKLVFFLWDFITYVFNIQMRNV

SEQ ID NO: 1582721 - protein, 18 aa, Staphylococcus aureus
GKKNLKWLGVVATLMMTF

SEQ ID NO: 1582722 - protein, 17 aa, Staphylococcus aureus
GKKSFVIHIKKDGSRFQ

SEQ ID NO: 1582723 - protein, 25 aa, Staphylococcus aureus
GKKSYYNFFGIGAFDSSAVRSGKSY

SEQ ID NO: 1582724 - protein, 22 aa, Staphylococcus aureus
GKPKTIVFYHLKLDKSYAPIFG

SEQ ID NO: 1582725 - protein, 17 aa, Staphylococcus aureus
GKPVPPAKEEPKKPSKP

SEQ ID NO: 1582726 - protein, 21 aa, Staphylococcus aureus
GKTYFLFYMIRELFKRDAEVR

SEQ ID NO: 1582727 - protein, 21 aa, Staphylococcus aureus
GKTYFLFYMIRELFKRNAEVR

SEQ ID NO: 1582728 - protein, 17 aa, Staphylococcus aureus
GKYRFDNLDSGKYKVIF

SEQ ID NO: 1582729 - protein, 18 aa, Staphylococcus aureus
GLAAMLGSIIAYAFARYI

SEQ ID NO: 1582730 - protein, 19 aa, Staphylococcus aureus
GLAIMTWVISLFKVSVKHP

SEQ ID NO: 1582731 - protein, 23 aa, Staphylococcus aureus
GLAMDYEVFLMSRIHEEYSKTGD

SEQ ID NO: 1582732 - protein, 24 aa, Staphylococcus aureus
GLAMDYEVFLMSRIHEEYSKTGDN

SEQ ID NO: 1582733 - protein, 18 aa, Staphylococcus aureus
GLCVAIFYTISGFKNIKL

SEQ ID NO: 1582734 - protein, 25 aa, Staphylococcus aureus
GLDVKWGATITAIFAILIFVSKSGQ

SEQ ID NO: 1582735 - protein, 24 aa, Staphylococcus aureus
GLFPLSTFQFLFIFKKTSLNMFEV

SEQ ID NO: 1582736 - protein, 39 aa, Staphylococcus aureus
GLIAMKKFHVLAGYRAKFILMVILTMMVFVLINTYLLRQ

SEQ ID NO: 1582737 - protein, 18 aa, Staphylococcus aureus
GLIPFIPIKFSFIKFNNV

SEQ ID NO: 1582738 - protein, 20 aa, Staphylococcus aureus
GLIYGHSMLILFLVAACIFL

SEQ ID NO: 1582739 - protein, 22 aa, Staphylococcus aureus
GLLTAYAGGFVCTYLFGTTKAM

SEQ ID NO: 1582740 - protein, 27 aa, Staphylococcus aureus
GLNMTFNYCKKRVWRYDMDRMDQVLTN

SEQ ID NO: 1582741 - protein, 25 aa, Staphylococcus aureus
GLSIPEFIIVIALASFFQPSLWNLV

SEQ ID NO: 1582742 - protein, 18 aa, Staphylococcus aureus
GLSLFIAATFHWTAGFSF

SEQ ID NO: 1582743 - protein, 18 aa, Staphylococcus aureus
GLSLILVFIIELILYIKD

SEQ ID NO: 1582744 - protein, 23 aa, Staphylococcus aureus
GLVAWMCVINIMNIIRILKSELL

SEQ ID NO: 1582745 - protein, 17 aa, Staphylococcus aureus
GLVNIFTQLMPLFKFMS

SEQ ID NO: 1582746 - protein, 17 aa, Staphylococcus aureus
GLVPGMIGGAIADDGSF

SEQ ID NO: 1582747 - protein, 18 aa, Staphylococcus aureus
GMIGGAIADDGSFYGSDA

SEQ ID NO: 1582748 - protein, 17 aa, Staphylococcus aureus
GMMNFIFQFLYTLFYEP

SEQ ID NO: 1582749 - protein, 21 aa, Staphylococcus aureus
GMPTAKLGYLADITVGDVRTS

SEQ ID NO: 1582750 - protein, 24 aa, Staphylococcus aureus
GMSPELVLRLAIAFYIVAAILGLF

SEQ ID NO: 1582751 - protein, 21 aa, Staphylococcus aureus
GMVVLSCINPVAGAVAIGAYS

SEQ ID NO: 1582752 - protein, 18 aa, Staphylococcus aureus
GNGQDFLNQGGILRDKGM

SEQ ID NO: 1582753 - protein, 18 aa, Staphylococcus aureus
GNIIDIDFDSVPHIHGFN

SEQ ID NO: 1582754 - protein, 21 aa, Staphylococcus aureus
GNISFMPVIIVIIVYTLIYIV

SEQ ID NO: 1582755 - protein, 20 aa, Staphylococcus aureus
GNISFMPVIIVIVVYTLIYI

SEQ ID NO: 1582756 - protein, 18 aa, Staphylococcus aureus
GNKEEIAYHKAHGGEISP

SEQ ID NO: 1582757 - protein, 20 aa, Staphylococcus aureus
GNMLKPWFVNSVENPVSKRQ

SEQ ID NO: 1582758 - protein, 37 aa, Staphylococcus aureus
GNTFMAANFKVAGKVKSGDYFTAKLPDSVTGNGDVDY

SEQ ID NO: 1582759 - protein, 23 aa, Staphylococcus aureus
GNTFMAANFKVTGQVKSGDYFTA

SEQ ID NO: 1582760 - protein, 25 aa, Staphylococcus aureus
GNTFMAANFKVTGQVKSGDYFTAKL

SEQ ID NO: 1582761 - protein, 23 aa, Staphylococcus aureus
GNTTGADGWGFMFTQGNGQDFLN

SEQ ID NO: 1582762 - protein, 18 aa, Staphylococcus aureus
GNVIKEYHDKLAFLKTVE

SEQ ID NO: 1582763 - protein, 20 aa, Staphylococcus aureus
GNVTLATGIGSTTANKTVLV

SEQ ID NO: 1582764 - protein, 17 aa, Staphylococcus aureus
GNYFLTLMAAFFITIIL

SEQ ID NO: 1582765 - protein, 17 aa, Staphylococcus aureus
GNYLKSVLIGLVSIAMI

SEQ ID NO: 1582766 - protein, 41 aa, Staphylococcus aureus
GPIIELGLKTALTWKKLEVYEGDKKLPVELVSYDSDKDYAY

SEQ ID NO: 1582767 - protein, 42 aa, Staphylococcus aureus
GPIIELGLKTASTWKKFEVYEGDKKLPVELVSYDSDKDYAYI

SEQ ID NO: 1582768 - protein, 29 aa, Staphylococcus aureus
GPLIGGGILEFATWHWLFYINIPIAIIAI

SEQ ID NO: 1582769 - protein, 21 aa, Staphylococcus aureus
GPLVVYWNWAWGITVIVIYGI

SEQ ID NO: 1582770 - protein, 17 aa, Staphylococcus aureus
GPNGFRNEMIEFPNGKR

SEQ ID NO: 1582771 - protein, 21 aa, Staphylococcus aureus
GPRVVKYINIFYAMIANVPII

SEQ ID NO: 1582772 - protein, 21 aa, Staphylococcus aureus
GQFFWPAILAFVLTGIGLLLL

SEQ ID NO: 1582773 - protein, 20 aa, Staphylococcus aureus
GQFFWPAILAFVLTGIGLPL

SEQ ID NO: 1582774 - protein, 26 aa, Staphylococcus aureus
GQFHGQRLNDVVLNYDAATSTITATY

SEQ ID NO: 1582775 - protein, 22 aa, Staphylococcus aureus
GQHFLLRYIDWVGHALTGNLGY

SEQ ID NO: 1582776 - protein, 20 aa, Staphylococcus aureus
GQILLYIGIIFTILSGIEYF

SEQ ID NO: 1582777 - protein, 17 aa, Staphylococcus aureus
GQIPGILALFILTICII

SEQ ID NO: 1582778 - protein, 17 aa, Staphylococcus aureus
GQIRPTTLIIIGISMQM

SEQ ID NO: 1582779 - protein, 20 aa, Staphylococcus aureus
GQPELRRNSMDAFAVLAYSF

SEQ ID NO: 1582780 - protein, 26 aa, Staphylococcus aureus
GQPELRRNSMDAFPILAYSFSNKEND

SEQ ID NO: 1582781 - protein, 17 aa, Staphylococcus aureus
GQYAKRFFFFATSCLVL

SEQ ID NO: 1582782 - protein, 27 aa, Staphylococcus aureus
GQYLGWNALFWFTFLLAIMIVIGAYYA

SEQ ID NO: 1582783 - protein, 17 aa, Staphylococcus aureus
GRALFSDSLATIVGSIF

SEQ ID NO: 1582784 - protein, 22 aa, Staphylococcus aureus
GRFGDGLINIFTQLMPLFKFAS

SEQ ID NO: 1582785 - protein, 20 aa, Staphylococcus aureus
GRFGDGLVNIFTQLMPLFKF

SEQ ID NO: 1582786 - protein, 22 aa, Staphylococcus aureus
GRFGDGLVNIFTQLMPLFKFMS

SEQ ID NO: 1582787 - protein, 31 aa, Staphylococcus aureus
GRFYVITLYRIIKLIIIFLIELIKANFDVLK

SEQ ID NO: 1582788 - protein, 33 aa, Staphylococcus aureus
GRLFGVTFKELWLPVLTICFILAISKITTYSGL

SEQ ID NO: 1582789 - protein, 20 aa, Staphylococcus aureus
GRLMKFIPHSVMIGFVNALG

SEQ ID NO: 1582790 - protein, 30 aa, Staphylococcus aureus
GRPQYHPRMLLSIILCAYIQGVYSGRQIQN

SEQ ID NO: 1582791 - protein, 23 aa, Staphylococcus aureus
GRRYKGKWIHDQMMRVAKRESNY

SEQ ID NO: 1582792 - protein, 19 aa, Staphylococcus aureus
GRTFLWFMHLSEQLRRTGE

SEQ ID NO: 1582793 - protein, 47 aa, Staphylococcus aureus
GRTIYIATTFHASMTFGLIFLFSEEIGDLFSIKVIAISTAIVAVGYI

SEQ ID NO: 1582794 - protein, 26 aa, Staphylococcus aureus
GSAGAARLLLFFGLLDAGSAIATSSG

SEQ ID NO: 1582795 - protein, 17 aa, Staphylococcus aureus
GSAIALNLLCNIPLIVG

SEQ ID NO: 1582796 - protein, 24 aa, Staphylococcus aureus
GSASAKWGILGPIFVPMLILIGFH

SEQ ID NO: 1582797 - protein, 25 aa, Staphylococcus aureus
GSDTLKIFILIVVVWILVFILMGAG

SEQ ID NO: 1582798 - protein, 34 aa, Staphylococcus aureus
GSEDEANTSLIWGLLASIGSLLLFRRKKENKDKK

SEQ ID NO: 1582799 - protein, 23 aa, Staphylococcus aureus
GSGKSVCINGIITSILLNAKPHE

SEQ ID NO: 1582800 - protein, 24 aa, Staphylococcus aureus
GSGKSVCINGIITSILLNAKPHEV

SEQ ID NO: 1582801 - protein, 27 aa, Staphylococcus aureus
GSIEGTKHLPLLFAKRRRKEDEENVEV

SEQ ID NO: 1582802 - protein, 21 aa, Staphylococcus aureus
GSLRLPPTIAVLMSIGEVVGG

SEQ ID NO: 1582803 - protein, 31 aa, Staphylococcus aureus
GSNKIAFTIACISVSWLWFFLLAILGKMIGS

SEQ ID NO: 1582804 - protein, 26 aa, Staphylococcus aureus
GSNNNVVPPNSPKNGTNASNKNEAKD

SEQ ID NO: 1582805 - protein, 20 aa, Staphylococcus aureus
GSPAERAGIRPKDLITKVNG

SEQ ID NO: 1582806 - protein, 18 aa, Staphylococcus aureus
GSTFKSYGLAAAIQEGAF

SEQ ID NO: 1582807 - protein, 22 aa, Staphylococcus aureus
GSVDFAQEWSFWGIKYGLFIQS

SEQ ID NO: 1582808 - protein, 21 aa, Staphylococcus aureus
GSVFLPFLISGFLFYICLPFR

SEQ ID NO: 1582809 - protein, 25 aa, Staphylococcus aureus
GSVSLRNIWDITWIIPLVLILILIA

SEQ ID NO: 1582810 - protein, 18 aa, Staphylococcus aureus
GSVYGTGLSAMWITIGLT

SEQ ID NO: 1582811 - protein, 17 aa, Staphylococcus aureus
GSVYSTGLSAMWITIGL

SEQ ID NO: 1582812 - protein, 17 aa, Staphylococcus aureus
GSWRMLTVYFIAGLFGN

SEQ ID NO: 1582813 - protein, 25 aa, Staphylococcus aureus
GTEPKIKLYVSLKCPNFDDVAQKIN

SEQ ID NO: 1582814 - protein, 28 aa, Staphylococcus aureus
GTFEYTESAVTQVRYVDVTTGKDIIPPK

SEQ ID NO: 1582815 - protein, 24 aa, Staphylococcus aureus
GTKPKIMAAIVLWLFGSIASIVGL

SEQ ID NO: 1582816 - protein, 17 aa, Staphylococcus aureus
GTNIVWANYFGRKHVGS

SEQ ID NO: 1582817 - protein, 23 aa, Staphylococcus aureus
GTREVKIVSSIEYGENFHEDYDY

SEQ ID NO: 1582818 - protein, 36 aa, Staphylococcus aureus
GTSYHAGLVGKEFLEKWAGVPTEVHVASEFVYNMPL

SEQ ID NO: 1582819 - protein, 43 aa, Staphylococcus aureus
GTSYHAGLVGKEFLEKWAGVPTEVYVASEFVYNMPLLSEKPLF

SEQ ID NO: 1582820 - protein, 26 aa, Staphylococcus aureus
GTTWSHLKWAIPLIGIVLFIILTISK

SEQ ID NO: 1582821 - protein, 17 aa, Staphylococcus aureus
GTVGSLIVLRGLSLMGD

SEQ ID NO: 1582822 - protein, 26 aa, Staphylococcus aureus
GTVQLIWNLIQLWFIGKILGVVRYFG

SEQ ID NO: 1582823 - protein, 19 aa, Staphylococcus aureus
GTVTEGIISGLNRNVLIDF

SEQ ID NO: 1582824 - protein, 26 aa, Staphylococcus aureus
GTYDANINIADEMFNNQITYNYSSPI

SEQ ID NO: 1582825 - protein, 17 aa, Staphylococcus aureus
GVETALENVQRAKNELN

SEQ ID NO: 1582826 - protein, 18 aa, Staphylococcus aureus
GVGFIPEKGEIIAPFDGT

SEQ ID NO: 1582827 - protein, 17 aa, Staphylococcus aureus
GVISFIVWMLIQNDVDF

SEQ ID NO: 1582828 - protein, 23 aa, Staphylococcus aureus
GVISSSLVNFVFLPPKFETKIYY

SEQ ID NO: 1582829 - protein, 22 aa, Staphylococcus aureus
GVKDRMGVTVNGRIDTLNKADG

SEQ ID NO: 1582830 - protein, 21 aa, Staphylococcus aureus
GVKDRMGVTVNGRIDTLNKEG

SEQ ID NO: 1582831 - protein, 22 aa, Staphylococcus aureus
GVKSRDIELLFLIESILICVTS

SEQ ID NO: 1582832 - protein, 34 aa, Staphylococcus aureus
GVSIQKLQLLGAMPRHVIEGFPTVNWLGFYPSYE

SEQ ID NO: 1582833 - protein, 24 aa, Staphylococcus aureus
GVSTARKVPDIKNGSVVMATGKIL

SEQ ID NO: 1582834 - protein, 19 aa, Staphylococcus aureus
GVSVKFYRRSEFIIEVFQN

SEQ ID NO: 1582835 - protein, 24 aa, Staphylococcus aureus
GVTFSYKFNEGIAIFIGILPHGIL

SEQ ID NO: 1582836 - protein, 28 aa, Staphylococcus aureus
GVTSTAKVPPIMAGDQVLANGVIDSDGN

SEQ ID NO: 1582837 - protein, 45 aa, Staphylococcus aureus
GVTSTAKVPPIMAGDQVLANGVIDSFGNVIYTFTDYVNTKENVTA

SEQ ID NO: 1582838 - protein, 30 aa, Staphylococcus aureus
GVVGISGLLASFWFFIAKRRRKEDEEEELE

SEQ ID NO: 1582839 - protein, 18 aa, Staphylococcus aureus
GVVSMLAATMFVVSSHEA

SEQ ID NO: 1582840 - protein, 18 aa, Staphylococcus aureus
GVVSVLAATMFVVTSHEA

SEQ ID NO: 1582841 - protein, 21 aa, Staphylococcus aureus
GVYLFCRIGIIFLKSKKTIHT

SEQ ID NO: 1582842 - protein, 25 aa, Staphylococcus aureus
GWIISIPGLIVWQAFSIFVGTIQAY

SEQ ID NO: 1582843 - protein, 22 aa, Staphylococcus aureus
GWLGIPVPFKISGFSFDVTSTL

SEQ ID NO: 1582844 - protein, 17 aa, Staphylococcus aureus
GWMGIKGSFGLNQILGV

SEQ ID NO: 1582845 - protein, 26 aa, Staphylococcus aureus
GWSQLRKNKLAVIGMIGLIMIILFAL

SEQ ID NO: 1582846 - protein, 17 aa, Staphylococcus aureus
GYEISFAKWMIVGIPTV

SEQ ID NO: 1582847 - protein, 37 aa, Staphylococcus aureus
GYIILSACMTFLFVIVGLCIKLANSFIEPDSQNAYFL

SEQ ID NO: 1582848 - protein, 17 aa, Staphylococcus aureus
GYIIPLQFGHFKETSLD

SEQ ID NO: 1582849 - protein, 17 aa, Staphylococcus aureus
GYIKEIKPLSIISVGFL

SEQ ID NO: 1582850 - protein, 26 aa, Staphylococcus aureus
GYLKGFEGVFIYPALLALIIAAISYV

SEQ ID NO: 1582851 - protein, 18 aa, Staphylococcus aureus
GYTLNIPYIIALIPTVIL

SEQ ID NO: 1582852 - protein, 18 aa, Staphylococcus aureus
GYVQPFWPLVIINVFEEF

SEQ ID NO: 1582853 - protein, 37 aa, Staphylococcus aureus
HAGQRVVLKYKLKFADGLKRGDYFDFTLSNNVNTYGV

SEQ ID NO: 1582854 - protein, 26 aa, Staphylococcus aureus
HAGWLGVPVPFRFSGFSFDVTSTLVF

SEQ ID NO: 1582855 - protein, 27 aa, Staphylococcus aureus
HAIFDVVPRIALGSIVAYIIGQHIDVF

SEQ ID NO: 1582856 - protein, 17 aa, Staphylococcus aureus
HDGSRLLFYYAPVAILI

SEQ ID NO: 1582857 - protein, 17 aa, Staphylococcus aureus
HDISRTMVLPIIMCAFS

SEQ ID NO: 1582858 - protein, 17 aa, Staphylococcus aureus
HDISRTMVLPIIMCAYS

SEQ ID NO: 1582859 - protein, 22 aa, Staphylococcus aureus
HDMSNIYTILPWFLITIPIIIL

SEQ ID NO: 1582860 - protein, 55 aa, Staphylococcus aureus
HDSLANEKTRVRLYKSGKNWVKSGIKEIEMFKIMGLPFISHSLVSQDNQSISKKI

SEQ ID NO: 1582861 - protein, 32 aa, Staphylococcus aureus
HEGQRVVLKYKLKFQDGLKTGDYFDFTLSNNV

SEQ ID NO: 1582862 - protein, 17 aa, Staphylococcus aureus
HEIKESYDILIKQAHRL

SEQ ID NO: 1582863 - protein, 17 aa, Staphylococcus aureus
HENKKTLTIEMPDKMIK

SEQ ID NO: 1582864 - protein, 17 aa, Staphylococcus aureus
HEVEQTIYVSPLKLNAK

SEQ ID NO: 1582865 - protein, 18 aa, Staphylococcus aureus
HFFGETFALIPIVFIMYD

SEQ ID NO: 1582866 - protein, 34 aa, Staphylococcus aureus
HFIFEVTDLAPLIAAIICIVIFKYKKVQLAGLKF

SEQ ID NO: 1582867 - protein, 18 aa, Staphylococcus aureus
HFNNLYLMKRLAQFEMKI

SEQ ID NO: 1582868 - protein, 24 aa, Staphylococcus aureus
HGALIPEFFPIDTIIELSHRAVSA

SEQ ID NO: 1582869 - protein, 25 aa, Staphylococcus aureus
HGALIPEFFPIDTIIELSHRAVSAF

SEQ ID NO: 1582870 - protein, 19 aa, Staphylococcus aureus
HGHVLPLVAQYLINREDEV

SEQ ID NO: 1582871 - protein, 21 aa, Staphylococcus aureus
HGLFMPMIFMFLLGAFTKSAQ

SEQ ID NO: 1582872 - protein, 24 aa, Staphylococcus aureus
HIAQGHVAWGYAIILIISSYVGAK

SEQ ID NO: 1582873 - protein, 18 aa, Staphylococcus aureus
HIKIIYWLVLTTIFFIAN

SEQ ID NO: 1582874 - protein, 17 aa, Staphylococcus aureus
HILEPKLSITTQIIIVL

SEQ ID NO: 1582875 - protein, 19 aa, Staphylococcus aureus
HILEPKLSITTQIITVLIL

SEQ ID NO: 1582876 - protein, 23 aa, Staphylococcus aureus
HILLEHKEQLILIAETLLTEETL

SEQ ID NO: 1582877 - protein, 18 aa, Staphylococcus aureus
HIPTFFKYPIVSRLSVLE

SEQ ID NO: 1582878 - protein, 19 aa, Staphylococcus aureus
HKATFTMLRDIRVQFFGKL

SEQ ID NO: 1582879 - protein, 20 aa, Staphylococcus aureus
HKEKIMLLPTFKHFCFVLFS

SEQ ID NO: 1582880 - protein, 24 aa, Staphylococcus aureus
HKGYRKGAIFTVVCWFVISLAIFS

SEQ ID NO: 1582881 - protein, 20 aa, Staphylococcus aureus
HKHEVEFAGIIFSFTGQSST

SEQ ID NO: 1582882 - protein, 25 aa, Staphylococcus aureus
HKHLKLGETFFLYLTWYSIGRFFIE

SEQ ID NO: 1582883 - protein, 19 aa, Staphylococcus aureus
HKKVVGGLMLSAALTSFLT

SEQ ID NO: 1582884 - protein, 18 aa, Staphylococcus aureus
HKLIKLIISTVLSLPLLM

SEQ ID NO: 1582885 - protein, 24 aa, Staphylococcus aureus
HKSIHLLFFLPYRKSFKVHKLTKR

SEQ ID NO: 1582886 - protein, 19 aa, Staphylococcus aureus
HKYILIATICLSWISLFSV

SEQ ID NO: 1582887 - protein, 17 aa, Staphylococcus aureus
HLEGTYTVAGRVYTPKR

SEQ ID NO: 1582888 - protein, 23 aa, Staphylococcus aureus
HLGEEGYPEWVIPTDPARKNEAM

SEQ ID NO: 1582889 - protein, 22 aa, Staphylococcus aureus
HLILEEFEKMLIQLSTFHSYHD

SEQ ID NO: 1582890 - protein, 24 aa, Staphylococcus aureus
HLLKANHFLQFFIILYTYRMIITL

SEQ ID NO: 1582891 - protein, 26 aa, Staphylococcus aureus
HLMIPCEPDHPLVYWATFSNASDLLS

SEQ ID NO: 1582892 - protein, 22 aa, Staphylococcus aureus
HLQHRFEAIVAFLMITLFCKFI

SEQ ID NO: 1582893 - protein, 17 aa, Staphylococcus aureus
HLSRLKLYSTYVLTHST

SEQ ID NO: 1582894 - protein, 21 aa, Staphylococcus aureus
HMIIFSIKYLKDFSLANVYPS

SEQ ID NO: 1582895 - protein, 21 aa, Staphylococcus aureus
HMIIFSIKYLKDFSLENVYPS

SEQ ID NO: 1582896 - protein, 26 aa, Staphylococcus aureus
HNATELNTAMGTLKHAIADKTNTLAS

SEQ ID NO: 1582897 - protein, 17 aa, Staphylococcus aureus
HNQPVWDLIKPRLLPSF

SEQ ID NO: 1582898 - protein, 25 aa, Staphylococcus aureus
HNVRMPRMLAGLFIGGALAVSGLLM

SEQ ID NO: 1582899 - protein, 24 aa, Staphylococcus aureus
HPFDYKGMSIFAVMIGSFTLLLTQ

SEQ ID NO: 1582900 - protein, 23 aa, Staphylococcus aureus
HRDLWRRIVEVLLLLMTLTGNVF

SEQ ID NO: 1582901 - protein, 17 aa, Staphylococcus aureus
HRLVKILLSFVITVIVV

SEQ ID NO: 1582902 - protein, 19 aa, Staphylococcus aureus
HRPYGGVVPQGMTQAPYTE

SEQ ID NO: 1582903 - protein, 22 aa, Staphylococcus aureus
HSGGSKNGGTWNPNASDGSNQG

SEQ ID NO: 1582904 - protein, 19 aa, Staphylococcus aureus
HSMLILFLVAACIFLIVLV

SEQ ID NO: 1582905 - protein, 23 aa, Staphylococcus aureus
HTLNWFKNTWVYMNLGASVLPST

SEQ ID NO: 1582906 - protein, 22 aa, Staphylococcus aureus
HTSVLKYYFWITILIIAIIVGA

SEQ ID NO: 1582907 - protein, 18 aa, Staphylococcus aureus
HVALLCIKYLSLTQRKLF

SEQ ID NO: 1582908 - protein, 25 aa, Staphylococcus aureus
HVFLLTWDIRGLKSYIFSFLIVVAL

SEQ ID NO: 1582909 - protein, 18 aa, Staphylococcus aureus
HVLLPFMFGPIIASIICV

SEQ ID NO: 1582910 - protein, 40 aa, Staphylococcus aureus
HVNSTTGKTEFWATSSDVLKLKANYTIDDSVKEGDTFTFK

SEQ ID NO: 1582911 - protein, 18 aa, Staphylococcus aureus
HVVLGITISDSWRNIFVL

SEQ ID NO: 1582912 - protein, 17 aa, Staphylococcus aureus
HYIMMIFAAYTIMADVL

SEQ ID NO: 1582913 - protein, 23 aa, Staphylococcus aureus
HYLSRPIAIIFWIIAELAIIATD

SEQ ID NO: 1582914 - protein, 22 aa, Staphylococcus aureus
IAALLLVSGLFLAFRRRSTNKK

SEQ ID NO: 1582915 - protein, 25 aa, Staphylococcus aureus
IAESLCALAAMLIVYLLRDRLTVDT

SEQ ID NO: 1582916 - protein, 25 aa, Staphylococcus aureus
IAESYRAAILYHEWYFMDHLKLMLY

SEQ ID NO: 1582917 - protein, 17 aa, Staphylococcus aureus
IAFPKANAFIVIILLLL

SEQ ID NO: 1582918 - protein, 18 aa, Staphylococcus aureus
IAGAGAVAFGVMAISAIK

SEQ ID NO: 1582919 - protein, 19 aa, Staphylococcus aureus
IAGFASIVTFMFYKEYFYE

SEQ ID NO: 1582920 - protein, 24 aa, Staphylococcus aureus
IAGKDYHILFGMGILAYTLGLRHA

SEQ ID NO: 1582921 - protein, 17 aa, Staphylococcus aureus
IAGNIIIIVYIISIMSI

SEQ ID NO: 1582922 - protein, 19 aa, Staphylococcus aureus
IAHVLPSYHLRKLGLDIVS

SEQ ID NO: 1582923 - protein, 21 aa, Staphylococcus aureus
IAIAFILSFFFMKDVIPNRKL

SEQ ID NO: 1582924 - protein, 23 aa, Staphylococcus aureus
IAIILVIWTFHFPKEETVAKSKF

SEQ ID NO: 1582925 - protein, 26 aa, Staphylococcus aureus
IAIPTRIATQTQIAIPTRIAIQNQIV

SEQ ID NO: 1582926 - protein, 33 aa, Staphylococcus aureus
IAIPTRIATQTQIAIPTRIAIQNQIVTQIQIAI

SEQ ID NO: 1582927 - protein, 20 aa, Staphylococcus aureus
IAIRLKDQFETISIGPYDIT

SEQ ID NO: 1582928 - protein, 22 aa, Staphylococcus aureus
IAKRVGLTWQDLEKGIAERLNT

SEQ ID NO: 1582929 - protein, 20 aa, Staphylococcus aureus
IALFYVCFYKITKYPINVCD

SEQ ID NO: 1582930 - protein, 24 aa, Staphylococcus aureus
IALMLKWWLLLVISIIVLIIITVA

SEQ ID NO: 1582931 - protein, 18 aa, Staphylococcus aureus
IALWPGFSRSGSTISTGS

SEQ ID NO: 1582932 - protein, 18 aa, Staphylococcus aureus
IANLNSFERQAVKLPGKV

SEQ ID NO: 1582933 - protein, 25 aa, Staphylococcus aureus
IANNGYRIQPHIGLTIHESTNKDEV

SEQ ID NO: 1582934 - protein, 25 aa, Staphylococcus aureus
IANTILRWLSIFVIPLFGIIISKLV

SEQ ID NO: 1582935 - protein, 18 aa, Staphylococcus aureus
IAPPEFAFMIGVSLALVI

SEQ ID NO: 1582936 - protein, 27 aa, Staphylococcus aureus
IAQIDVKGSDVWTAFEHSLGAPTIQKD

SEQ ID NO: 1582937 - protein, 17 aa, Staphylococcus aureus
IAVGIVFYFTSSILAVI

SEQ ID NO: 1582938 - protein, 24 aa, Staphylococcus aureus
IAVISVLLAFHLKQHYDQITNEKH

SEQ ID NO: 1582939 - protein, 20 aa, Staphylococcus aureus
IAVVCLMIFSSQKTTYFGYM

SEQ ID NO: 1582940 - protein, 26 aa, Staphylococcus aureus
IAYGSCIGWGAFIIPGDWIKQSGPIA

SEQ ID NO: 1582941 - protein, 17 aa, Staphylococcus aureus
ICALNGYYPTIYTLQLL

SEQ ID NO: 1582942 - protein, 28 aa, Staphylococcus aureus
ICVKVFKLDIKWPFLLSELGIVLLGVQI

SEQ ID NO: 1582943 - protein, 27 aa, Staphylococcus aureus
ICVKVLKLDIKWPFLLSELGIVLLGVQ

SEQ ID NO: 1582944 - protein, 17 aa, Staphylococcus aureus
IDALPHLNNAQKADVKS

SEQ ID NO: 1582945 - protein, 18 aa, Staphylococcus aureus
IDDEGMVLFLNRNTKKAT

SEQ ID NO: 1582946 - protein, 18 aa, Staphylococcus aureus
IDFDSVPHIHGFNKHTEI

SEQ ID NO: 1582947 - protein, 23 aa, Staphylococcus aureus
IDFGSDLYSTFSYVKDTIYPLIN

SEQ ID NO: 1582948 - protein, 20 aa, Staphylococcus aureus
IDFIIIIGFIITFIGILSIF

SEQ ID NO: 1582949 - protein, 17 aa, Staphylococcus aureus
IDFWVIMVIIGFLYVCK

SEQ ID NO: 1582950 - protein, 17 aa, Staphylococcus aureus
IDGEGGYADGYIETIEE

SEQ ID NO: 1582951 - protein, 17 aa, Staphylococcus aureus
IDHMMIAVGVIKQMNIV

SEQ ID NO: 1582952 - protein, 25 aa, Staphylococcus aureus
IDKLEFKPKLTSVYVKEFNNTGFYK

SEQ ID NO: 1582953 - protein, 19 aa, Staphylococcus aureus
IDKVIEFFIILIAANFANY

SEQ ID NO: 1582954 - protein, 17 aa, Staphylococcus aureus
IDMSIGIVGFLMTYLPI

SEQ ID NO: 1582955 - protein, 26 aa, Staphylococcus aureus
IDPLHMRHFSNNFGNVIKNAIGVVGI

SEQ ID NO: 1582956 - protein, 45 aa, Staphylococcus aureus
IDPNSKGDLALRSTLYGYNSNIIWRSMSWDNEVAFNNGSGSGDGI

SEQ ID NO: 1582957 - protein, 23 aa, Staphylococcus aureus
IDQASWRVAFIIIVGIALVAFIF

SEQ ID NO: 1582958 - protein, 17 aa, Staphylococcus aureus
IDSGDTVYPHQAGYVKL

SEQ ID NO: 1582959 - protein, 24 aa, Staphylococcus aureus
IDSPTTFIWVCIITLIAHQLEGNI

SEQ ID NO: 1582960 - protein, 30 aa, Staphylococcus aureus
IDYKGGGMANLFKDLVHLVGTITNLDGDEG

SEQ ID NO: 1582961 - protein, 23 aa, Staphylococcus aureus
IEAIIGLRFLKEYDVKRDKDKEN

SEQ ID NO: 1582962 - protein, 17 aa, Staphylococcus aureus
IEFICQYLAQWTSNKIL

SEQ ID NO: 1582963 - protein, 17 aa, Staphylococcus aureus
IEGCHILLMTAHLITQT

SEQ ID NO: 1582964 - protein, 18 aa, Staphylococcus aureus
IEGVQNYITRFVIGALSI

SEQ ID NO: 1582965 - protein, 17 aa, Staphylococcus aureus
IEIKSSDSSSVNVAPKT

SEQ ID NO: 1582966 - protein, 17 aa, Staphylococcus aureus
IEINEKVKAVAPTKKPQ

SEQ ID NO: 1582967 - protein, 18 aa, Staphylococcus aureus
IELTKAVIYIQLVLFLIA

SEQ ID NO: 1582968 - protein, 20 aa, Staphylococcus aureus
IENFKFFVQYGDFKDINDYK

SEQ ID NO: 1582969 - protein, 20 aa, Staphylococcus aureus
IENFKFFVQYGNFKDFKDYK

SEQ ID NO: 1582970 - protein, 18 aa, Staphylococcus aureus
IENFKFFVQYGNFKDLSK

SEQ ID NO: 1582971 - protein, 20 aa, Staphylococcus aureus
IENFKFFVQYGNFKNFEKYN

SEQ ID NO: 1582972 - protein, 25 aa, Staphylococcus aureus
IENITCLLLVPTIIWLTNRFVFPNL

SEQ ID NO: 1582973 - protein, 24 aa, Staphylococcus aureus
IENYYCLVIYDWRVIESETIMSNF

SEQ ID NO: 1582974 - protein, 18 aa, Staphylococcus aureus
IEQAKAQLAQALKEIKDL

SEQ ID NO: 1582975 - protein, 18 aa, Staphylococcus aureus
IEQAKAQLAQALQEIKDI

SEQ ID NO: 1582976 - protein, 18 aa, Staphylococcus aureus
IERICKRDPLAGKTVTGG

SEQ ID NO: 1582977 - protein, 20 aa, Staphylococcus aureus
IEVIWPKTGLIYFVMADIGG

SEQ ID NO: 1582978 - protein, 23 aa, Staphylococcus aureus
IEYASLIGCIKRSQTLAGAVNTI

SEQ ID NO: 1582979 - protein, 27 aa, Staphylococcus aureus
IFDLILRFMAKLSYKKLLITLGVIVMI

SEQ ID NO: 1582980 - protein, 23 aa, Staphylococcus aureus
IFGEDRFRWSATMIGLSLAVFGI

SEQ ID NO: 1582981 - protein, 18 aa, Staphylococcus aureus
IFGKGIIVPALRAVSAGN

SEQ ID NO: 1582982 - protein, 18 aa, Staphylococcus aureus
IFGKGIIVPALRAVSGGN

SEQ ID NO: 1582983 - protein, 21 aa, Staphylococcus aureus
IFIALMFDFEKAYWIPLSAHT

SEQ ID NO: 1582984 - protein, 23 aa, Staphylococcus aureus
IFIDDYYLIFLLQGIYIIGAELD

SEQ ID NO: 1582985 - protein, 25 aa, Staphylococcus aureus
IFIGGPGAVFWMWITAFLGASSAFI

SEQ ID NO: 1582986 - protein, 18 aa, Staphylococcus aureus
IFIVMGLYICMYAIFAMT

SEQ ID NO: 1582987 - protein, 22 aa, Staphylococcus aureus
IFLAIMWLIFQTTFTWIGTPLS

SEQ ID NO: 1582988 - protein, 19 aa, Staphylococcus aureus
IFLTKGGNVLVEWHGITIE

SEQ ID NO: 1582989 - protein, 19 aa, Staphylococcus aureus
IFNIISIIMVSMLILSLGA

SEQ ID NO: 1582990 - protein, 21 aa, Staphylococcus aureus
IFNKKVNGYHVWIKGYNYDIT

SEQ ID NO: 1582991 - protein, 18 aa, Staphylococcus aureus
IFPYILMSVGAFLTLGFV

SEQ ID NO: 1582992 - protein, 22 aa, Staphylococcus aureus
IFRSIFFLKKYIDMIISTIKQK

SEQ ID NO: 1582993 - protein, 25 aa, Staphylococcus aureus
IFSPFKRLILYGIILIAMTAFLNLM

SEQ ID NO: 1582994 - protein, 24 aa, Staphylococcus aureus
IGAGRIGLGVAKRAQSFGMKILAF

SEQ ID NO: 1582995 - protein, 27 aa, Staphylococcus aureus
IGDQSSEVFSPISPIKIATQDNSGNVV

SEQ ID NO: 1582996 - protein, 25 aa, Staphylococcus aureus
IGEKFAKIGGLIFIFLIGTVTIAAI

SEQ ID NO: 1582997 - protein, 17 aa, Staphylococcus aureus
IGFFVFFFTFLISGIGL

SEQ ID NO: 1582998 - protein, 27 aa, Staphylococcus aureus
IGFNKRAIFPFIIASGFIADTTSLPLI

SEQ ID NO: 1582999 - protein, 24 aa, Staphylococcus aureus
IGFSEEFFFRKYIIEHILTKYKSK

SEQ ID NO: 1583000 - protein, 18 aa, Staphylococcus aureus
IGFSFLWIAGKDHHILFG

SEQ ID NO: 1583001 - protein, 17 aa, Staphylococcus aureus
IGFSIDIANAFVKPESQ

SEQ ID NO: 1583002 - protein, 18 aa, Staphylococcus aureus
IGGITNVIAIRMLFHPFK

SEQ ID NO: 1583003 - protein, 24 aa, Staphylococcus aureus
IGGLLSGIVKLGWEVMFPPRTPER

SEQ ID NO: 1583004 - protein, 24 aa, Staphylococcus aureus
IGIIAILVGFIWFKLYQYTTNPKA

SEQ ID NO: 1583005 - protein, 17 aa, Staphylococcus aureus
IGILKAIGIKTRHLLSA

SEQ ID NO: 1583006 - protein, 17 aa, Staphylococcus aureus
IGISWLCWLILCRLILL

SEQ ID NO: 1583007 - protein, 17 aa, Staphylococcus aureus
IGLIIIVIFDFIGPVIN

SEQ ID NO: 1583008 - protein, 17 aa, Staphylococcus aureus
IGLLVWFIAGFQFKGHS

SEQ ID NO: 1583009 - protein, 20 aa, Staphylococcus aureus
IGLLVWFIAGFQFKGHSNDK

SEQ ID NO: 1583010 - protein, 25 aa, Staphylococcus aureus
IGLSIPEFIIMIALASFFQPSIWNL

SEQ ID NO: 1583011 - protein, 19 aa, Staphylococcus aureus
IGMLILYYICRLISEERLY

SEQ ID NO: 1583012 - protein, 25 aa, Staphylococcus aureus
IGNMSFKVARIYILEQVIDYLNQKS

SEQ ID NO: 1583013 - protein, 17 aa, Staphylococcus aureus
IGNVIKNALGVVGISGL

SEQ ID NO: 1583014 - protein, 30 aa, Staphylococcus aureus
IGQRGDEFILYKFGDESMRVYNTEFEMQQD

SEQ ID NO: 1583015 - protein, 18 aa, Staphylococcus aureus
IGRFLRYEFMPLKYKKRI

SEQ ID NO: 1583016 - protein, 19 aa, Staphylococcus aureus
IGSAALYLGYFIALQQDTT

SEQ ID NO: 1583017 - protein, 25 aa, Staphylococcus aureus
IGSDILYWGVIEWAFYYQVPPNGAK

SEQ ID NO: 1583018 - protein, 17 aa, Staphylococcus aureus
IGSLSFIVLILLFFIIN

SEQ ID NO: 1583019 - protein, 20 aa, Staphylococcus aureus
IGSPRLFKELNVSDFSLEFE

SEQ ID NO: 1583020 - protein, 26 aa, Staphylococcus aureus
IGTICIKSNMMFSGYVSEQCINNDEW

SEQ ID NO: 1583021 - protein, 19 aa, Staphylococcus aureus
IGVLLSFLAIQLLENKSKK

SEQ ID NO: 1583022 - protein, 33 aa, Staphylococcus aureus
IGVVGISGLLASFWFFIAKRRRKEDEEEELEIR

SEQ ID NO: 1583023 - protein, 17 aa, Staphylococcus aureus
IHKLILSRFSKKGKQFD

SEQ ID NO: 1583024 - protein, 27 aa, Staphylococcus aureus
IHMSETLARLGIVLGVFLTSLQMGLCM

SEQ ID NO: 1583025 - protein, 26 aa, Staphylococcus aureus
IHSRKLRIWLYLVLLAVFIGACGMKK

SEQ ID NO: 1583026 - protein, 22 aa, Staphylococcus aureus
IIAFFSMFAYFAVLVFVPLLVV

SEQ ID NO: 1583027 - protein, 25 aa, Staphylococcus aureus
IIAGIFCFGMSLYLIASNSNDLWDL

SEQ ID NO: 1583028 - protein, 24 aa, Staphylococcus aureus
IIARVGPIKVLRFILIINAIALII

SEQ ID NO: 1583029 - protein, 17 aa, Staphylococcus aureus
IIASLFIPFGASIGLNT

SEQ ID NO: 1583030 - protein, 18 aa, Staphylococcus aureus
IICLSIFSITTLIFIIIE

SEQ ID NO: 1583031 - protein, 17 aa, Staphylococcus aureus
IIDIDFDSVPQIHGFNK

SEQ ID NO: 1583032 - protein, 21 aa, Staphylococcus aureus
IIFGAFALFWFVGIHGPSIVE

SEQ ID NO: 1583033 - protein, 22 aa, Staphylococcus aureus
IIFLREGLEVLLIVMTLTTMTR

SEQ ID NO: 1583034 - protein, 23 aa, Staphylococcus aureus
IIFLREGLEVLLIVMTLTTMTRK

SEQ ID NO: 1583035 - protein, 22 aa, Staphylococcus aureus
IIFVALEFFYIMYLETFATTSR

SEQ ID NO: 1583036 - protein, 17 aa, Staphylococcus aureus
IIFVMLCGKVGLLTLLR

SEQ ID NO: 1583037 - protein, 26 aa, Staphylococcus aureus
IIGAYSIIFPLIFKFGAENSNVIMIC

SEQ ID NO: 1583038 - protein, 30 aa, Staphylococcus aureus
IIGGACLVAGLALIVHMIINRLFRKRKIKH

SEQ ID NO: 1583039 - protein, 18 aa, Staphylococcus aureus
IIGGVPPLQAIKFQLLVV

SEQ ID NO: 1583040 - protein, 17 aa, Staphylococcus aureus
IIGKLLYESLEAIDPGP

SEQ ID NO: 1583041 - protein, 26 aa, Staphylococcus aureus
IIGLFVIKGYLYVKHAGFKMTEEQIT

SEQ ID NO: 1583042 - protein, 18 aa, Staphylococcus aureus
IIGVFKKSLSAIWNATKS

SEQ ID NO: 1583043 - protein, 19 aa, Staphylococcus aureus
IIGVFKKSLSAIWNATKSI

SEQ ID NO: 1583044 - protein, 19 aa, Staphylococcus aureus
IIIFICWIMMTMLFFLLNM

SEQ ID NO: 1583045 - protein, 20 aa, Staphylococcus aureus
IIIFICWIMMTMLFFLLNMA

SEQ ID NO: 1583046 - protein, 25 aa, Staphylococcus aureus
IIIPSRIGEILGWLISLLTQQFNIF

SEQ ID NO: 1583047 - protein, 29 aa, Staphylococcus aureus
IIKAALKRLPWLIILTFLGMITATILGRF

SEQ ID NO: 1583048 - protein, 33 aa, Staphylococcus aureus
IIKLKRFWIRRLKRLLPAVIVLLMIVGTATLLL

SEQ ID NO: 1583049 - protein, 19 aa, Staphylococcus aureus
IILCCLLTIIVFKRSEKQF

SEQ ID NO: 1583050 - protein, 18 aa, Staphylococcus aureus
IILCCLLTIIVFKRSKKQ

SEQ ID NO: 1583051 - protein, 19 aa, Staphylococcus aureus
IILCCLLTIIVFKRSKKQF

SEQ ID NO: 1583052 - protein, 20 aa, Staphylococcus aureus
IILFLLCLTVFKMKGIYAAL

SEQ ID NO: 1583053 - protein, 22 aa, Staphylococcus aureus
IILFPLSILFFITSHFIVGLTP

SEQ ID NO: 1583054 - protein, 19 aa, Staphylococcus aureus
IILGFLLHYIFKINDKWLL

SEQ ID NO: 1583055 - protein, 21 aa, Staphylococcus aureus
IILLSIWTRSFIIGFLAAIIN

SEQ ID NO: 1583056 - protein, 22 aa, Staphylococcus aureus
IILPPLAAMLFIKIGYHPIAGL

SEQ ID NO: 1583057 - protein, 23 aa, Staphylococcus aureus
IILSTCVSFLFVVIGLSIDIADA

SEQ ID NO: 1583058 - protein, 20 aa, Staphylococcus aureus
IIMSGLIGAILLTFGDGLTR

SEQ ID NO: 1583059 - protein, 17 aa, Staphylococcus aureus
IINEWYFFVITTILMIY

SEQ ID NO: 1583060 - protein, 23 aa, Staphylococcus aureus
IIPTCINLLLKTYAFIGLLSHDG

SEQ ID NO: 1583061 - protein, 27 aa, Staphylococcus aureus
IIPVWKLIIIWFLRVALSLLITIPVAL

SEQ ID NO: 1583062 - protein, 26 aa, Staphylococcus aureus
IIQLPLIKLFLCKKRLPSKEISVLEH

SEQ ID NO: 1583063 - protein, 17 aa, Staphylococcus aureus
IIRFAHISYGLYMGEHL

SEQ ID NO: 1583064 - protein, 25 aa, Staphylococcus aureus
IIRILKSELLLAFSTSNSEAVLPVM

SEQ ID NO: 1583065 - protein, 28 aa, Staphylococcus aureus
IIRTLITWFYTMLWSIVGVVWIVFSIPN

SEQ ID NO: 1583066 - protein, 37 aa, Staphylococcus aureus
IISAILMKNKWPFLIALPFMIGYGIGVTFYYQQKVAY

SEQ ID NO: 1583067 - protein, 27 aa, Staphylococcus aureus
IITMVLCGFLFPLAITLIGQIFFYQQA

SEQ ID NO: 1583068 - protein, 19 aa, Staphylococcus aureus
IITSHALRHTHCSYLLAKG

SEQ ID NO: 1583069 - protein, 19 aa, Staphylococcus aureus
IIVQIKEIFAPLMTISINS

SEQ ID NO: 1583070 - protein, 41 aa, Staphylococcus aureus
IIVYFIVCLLISFLALISMNIRILSGFLFLISAFVTIPLVL

SEQ ID NO: 1583071 - protein, 21 aa, Staphylococcus aureus
IKAKSFVIFMIIIAASMIGLS

SEQ ID NO: 1583072 - protein, 17 aa, Staphylococcus aureus
IKAQLVILDENYDLDFD

SEQ ID NO: 1583073 - protein, 18 aa, Staphylococcus aureus
IKDFRHINDIYQISRSIY

SEQ ID NO: 1583074 - protein, 18 aa, Staphylococcus aureus
IKDLVKAKENAKQDVDKQ

SEQ ID NO: 1583075 - protein, 27 aa, Staphylococcus aureus
IKERGELRVGLSAGYAPMEFEHTVNGK

SEQ ID NO: 1583076 - protein, 21 aa, Staphylococcus aureus
IKESYDILIKQAHRLSTLFDD

SEQ ID NO: 1583077 - protein, 20 aa, Staphylococcus aureus
IKFAIVQSYPVLKFLLFFIP

SEQ ID NO: 1583078 - protein, 22 aa, Staphylococcus aureus
IKFENYLSFILFDVDKDVFDAP

SEQ ID NO: 1583079 - protein, 18 aa, Staphylococcus aureus
IKFFSEFVAAAVVISIAA

SEQ ID NO: 1583080 - protein, 31 aa, Staphylococcus aureus
IKFFSSLFTGNWRGVWDGIVMILKGTVQLIW

SEQ ID NO: 1583081 - protein, 22 aa, Staphylococcus aureus
IKFGDITKTYVVLVEGHYDNTG

SEQ ID NO: 1583082 - protein, 24 aa, Staphylococcus aureus
IKHADGFKHPGEWKNQDLGTGTGN

SEQ ID NO: 1583083 - protein, 24 aa, Staphylococcus aureus
IKKAGETMATWLAIIFIVAALILG

SEQ ID NO: 1583084 - protein, 19 aa, Staphylococcus aureus
IKKNGKLYVQITVNHSHWI

SEQ ID NO: 1583085 - protein, 19 aa, Staphylococcus aureus
IKKNIKTLFLVKVFHAVKY

SEQ ID NO: 1583086 - protein, 24 aa, Staphylococcus aureus
IKLVKRKKYVSIIMYLLVMILSLI

SEQ ID NO: 1583087 - protein, 25 aa, Staphylococcus aureus
IKQILRLLFLLAMYELGKYVTEQVY

SEQ ID NO: 1583088 - protein, 22 aa, Staphylococcus aureus
IKQMPNIFLARLISEDNDKKTY

SEQ ID NO: 1583089 - protein, 32 aa, Staphylococcus aureus
IKQNGLLGGVMTLLVGLGLMKRKKKKDENDQD

SEQ ID NO: 1583090 - protein, 26 aa, Staphylococcus aureus
IKQVFWRILLFYALSIAVIGAIIPYT

SEQ ID NO: 1583091 - protein, 21 aa, Staphylococcus aureus
IKSPRILDKVSREFDGQYLTA

SEQ ID NO: 1583092 - protein, 20 aa, Staphylococcus aureus
IKSPRILDKVSREFDGQYST

SEQ ID NO: 1583093 - protein, 17 aa, Staphylococcus aureus
IKVPIDFISVIFSVLGF

SEQ ID NO: 1583094 - protein, 25 aa, Staphylococcus aureus
IKVQRSLNLWAYVMLIFMTLAAILT

SEQ ID NO: 1583095 - protein, 23 aa, Staphylococcus aureus
IKWLHERPKNWLSKLSVNLLGGI

SEQ ID NO: 1583096 - protein, 19 aa, Staphylococcus aureus
ILAGIVLSAIITAIAISTG

SEQ ID NO: 1583097 - protein, 17 aa, Staphylococcus aureus
ILATEIIIPVWKLIIIW

SEQ ID NO: 1583098 - protein, 33 aa, Staphylococcus aureus
ILATIDFLGVFGIRLFALVSKFGLLRAGLTILK

SEQ ID NO: 1583099 - protein, 17 aa, Staphylococcus aureus
ILAVQIVTSDHSKPSSN

SEQ ID NO: 1583100 - protein, 20 aa, Staphylococcus aureus
ILCMLLILTMRVESLTVSVI

SEQ ID NO: 1583101 - protein, 23 aa, Staphylococcus aureus
ILEELEKMLIQLSIFHSYHDLEF

SEQ ID NO: 1583102 - protein, 25 aa, Staphylococcus aureus
ILEGGKIRYTFTNDIEDKVDVTAEL

SEQ ID NO: 1583103 - protein, 21 aa, Staphylococcus aureus
ILERRHLKKRITISSSVDLQF

SEQ ID NO: 1583104 - protein, 20 aa, Staphylococcus aureus
ILFFIIAMMMFIRKDKVELV

SEQ ID NO: 1583105 - protein, 18 aa, Staphylococcus aureus
ILFGSKILLFIIMSIAII

SEQ ID NO: 1583106 - protein, 19 aa, Staphylococcus aureus
ILFGSKILLFIIMSIAIIQ

SEQ ID NO: 1583107 - protein, 25 aa, Staphylococcus aureus
ILFVFRCLVVVLVFVGAVVKTETVW

SEQ ID NO: 1583108 - protein, 20 aa, Staphylococcus aureus
ILFVLYKKRSEIIDFVTRGN

SEQ ID NO: 1583109 - protein, 21 aa, Staphylococcus aureus
ILFVMYKKRAQIINFVSRGNI

SEQ ID NO: 1583110 - protein, 24 aa, Staphylococcus aureus
ILGEFFKYFMDYHPIFKTLLGVVV

SEQ ID NO: 1583111 - protein, 19 aa, Staphylococcus aureus
ILGGAFWALMAPVVAISSV

SEQ ID NO: 1583112 - protein, 20 aa, Staphylococcus aureus
ILHMMARKYISFAKRVFTAL

SEQ ID NO: 1583113 - protein, 19 aa, Staphylococcus aureus
ILIAIAIYVCRFVWVYFWY

SEQ ID NO: 1583114 - protein, 22 aa, Staphylococcus aureus
ILICVTSGFIGLILGVVFATII

SEQ ID NO: 1583115 - protein, 17 aa, Staphylococcus aureus
ILIISFVTLGIIIHASI

SEQ ID NO: 1583116 - protein, 18 aa, Staphylococcus aureus
ILKACYELPSTDLLDFMS

SEQ ID NO: 1583117 - protein, 26 aa, Staphylococcus aureus
ILKNKGRNIFTMIGIIIGISSVITIM

SEQ ID NO: 1583118 - protein, 23 aa, Staphylococcus aureus
ILLCAGKLLGIVGVILGIPGYAI

SEQ ID NO: 1583119 - protein, 17 aa, Staphylococcus aureus
ILLCILSLIVTNKKEPF

SEQ ID NO: 1583120 - protein, 20 aa, Staphylococcus aureus
ILLFSIPTPVAVILMGIAAL

SEQ ID NO: 1583121 - protein, 17 aa, Staphylococcus aureus
ILLIASFIRASKANNES

SEQ ID NO: 1583122 - protein, 19 aa, Staphylococcus aureus
ILLICYKITVKICRYFSKE

SEQ ID NO: 1583123 - protein, 18 aa, Staphylococcus aureus
ILLIFRSIFFLKKYIDMI

SEQ ID NO: 1583124 - protein, 21 aa, Staphylococcus aureus
ILLILICSGLSYSKTELQRII

SEQ ID NO: 1583125 - protein, 17 aa, Staphylococcus aureus
ILLPLYILSFSSVSLLA

SEQ ID NO: 1583126 - protein, 17 aa, Staphylococcus aureus
ILLRLFKINLFSFKKLT

SEQ ID NO: 1583127 - protein, 19 aa, Staphylococcus aureus
ILLSVCIGLVFGLIAGIER

SEQ ID NO: 1583128 - protein, 17 aa, Staphylococcus aureus
ILPDTKYPIAVTDWNKK

SEQ ID NO: 1583129 - protein, 26 aa, Staphylococcus aureus
ILRDKGMANASGFKIDTAYNNVNGKV

SEQ ID NO: 1583130 - protein, 22 aa, Staphylococcus aureus
ILSVAFLIYVEFSLLVYMIYAG

SEQ ID NO: 1583131 - protein, 18 aa, Staphylococcus aureus
ILTCLTFLGFVYQLYSKK

SEQ ID NO: 1583132 - protein, 18 aa, Staphylococcus aureus
ILTICIIGKLLYESLEAI

SEQ ID NO: 1583133 - protein, 20 aa, Staphylococcus aureus
ILTLGALTVAIGRVIDDSIV

SEQ ID NO: 1583134 - protein, 18 aa, Staphylococcus aureus
ILVATIVFGGPRLGTSFI

SEQ ID NO: 1583135 - protein, 24 aa, Staphylococcus aureus
ILVFTVIFIFQFVSRIADLVIMKV

SEQ ID NO: 1583136 - protein, 19 aa, Staphylococcus aureus
ILVGIVLSAIITAIAISTG

SEQ ID NO: 1583137 - protein, 19 aa, Staphylococcus aureus
ILVGTTLIFGLSGHEAKAA

SEQ ID NO: 1583138 - protein, 20 aa, Staphylococcus aureus
ILVGTTLIFGLSGHEAKAAE

SEQ ID NO: 1583139 - protein, 21 aa, Staphylococcus aureus
ILVLLTILLIASFIRASKANN

SEQ ID NO: 1583140 - protein, 17 aa, Staphylococcus aureus
ILYCANFVYIIIFSYII

SEQ ID NO: 1583141 - protein, 17 aa, Staphylococcus aureus
ILYIPFLISKKMPRVLS

SEQ ID NO: 1583142 - protein, 18 aa, Staphylococcus aureus
IMETYKPYAVYHAAAHKH

SEQ ID NO: 1583143 - protein, 17 aa, Staphylococcus aureus
IMGLFGFTLLIPVLYKG

SEQ ID NO: 1583144 - protein, 17 aa, Staphylococcus aureus
IMGMGFIAAFLSSIMNN

SEQ ID NO: 1583145 - protein, 22 aa, Staphylococcus aureus
IMICTGCRVSGARNIKIEHINQ

SEQ ID NO: 1583146 - protein, 20 aa, Staphylococcus aureus
IMIIPTWINLLLKTYAFIGL

SEQ ID NO: 1583147 - protein, 23 aa, Staphylococcus aureus
IMIKVILALPMFILLTIYLQPLV

SEQ ID NO: 1583148 - protein, 18 aa, Staphylococcus aureus
IMISGILFFKTNIDKTYI

SEQ ID NO: 1583149 - protein, 17 aa, Staphylococcus aureus
IMKKLGLDNGRISKITR

SEQ ID NO: 1583150 - protein, 19 aa, Staphylococcus aureus
IMKLPDGYKTVLHEKGNNL

SEQ ID NO: 1583151 - protein, 19 aa, Staphylococcus aureus
IMNICRYTLILGFILMSLP

SEQ ID NO: 1583152 - protein, 38 aa, Staphylococcus aureus
IMSSILMKNKWPFLIALPFMNCYGIGVTFYYQQKVAYL

SEQ ID NO: 1583153 - protein, 17 aa, Staphylococcus aureus
IMVPFFLIYMLKDHEKF

SEQ ID NO: 1583154 - protein, 28 aa, Staphylococcus aureus
INFLKVFKWRIVGFLAFLLIAILFLTLG

SEQ ID NO: 1583155 - protein, 17 aa, Staphylococcus aureus
INFPMLLVGRSIQALGA

SEQ ID NO: 1583156 - protein, 21 aa, Staphylococcus aureus
INFVSRGNISFSPSAIGAGVM

SEQ ID NO: 1583157 - protein, 26 aa, Staphylococcus aureus
INHKGYRKGAIFTVVCWFVISLAIFS

SEQ ID NO: 1583158 - protein, 18 aa, Staphylococcus aureus
INIADEMFNNKITYNYSS

SEQ ID NO: 1583159 - protein, 19 aa, Staphylococcus aureus
INKTYVVLVEGHYDNTGKN

SEQ ID NO: 1583160 - protein, 31 aa, Staphylococcus aureus
INLKGASLFLRLGARIFKTGIAIILAMSIAS

SEQ ID NO: 1583161 - protein, 25 aa, Staphylococcus aureus
INLYFKYNLNHYKSLKVTRFKKSPM

SEQ ID NO: 1583162 - protein, 20 aa, Staphylococcus aureus
INPEPSFKFDGKKYEFELSD

SEQ ID NO: 1583163 - protein, 35 aa, Staphylococcus aureus
INTYLLRQVKSIGMFLMIAAVGLYFVAMNNLKAAG

SEQ ID NO: 1583164 - protein, 25 aa, Staphylococcus aureus
INVNKAGGLFAFLRTKIASLVKLFP

SEQ ID NO: 1583165 - protein, 25 aa, Staphylococcus aureus
INVNKAGSIFAFLRTKIASLVKLFP

SEQ ID NO: 1583166 - protein, 17 aa, Staphylococcus aureus
IPFNLLHLLSLKVTSIL

SEQ ID NO: 1583167 - protein, 19 aa, Staphylococcus aureus
IPFVSAFIVHELCKKFIPI

SEQ ID NO: 1583168 - protein, 17 aa, Staphylococcus aureus
IPFWGLVVILTIITIFL

SEQ ID NO: 1583169 - protein, 20 aa, Staphylococcus aureus
IPFYKKHSTLLFATLLIAFG

SEQ ID NO: 1583170 - protein, 17 aa, Staphylococcus aureus
IPGILALFILTICIIGK

SEQ ID NO: 1583171 - protein, 26 aa, Staphylococcus aureus
IPHKITRYILGTLFTLALTLTIIGIT

SEQ ID NO: 1583172 - protein, 23 aa, Staphylococcus aureus
IPIIASVVPVVFALLNAIKVLTG

SEQ ID NO: 1583173 - protein, 29 aa, Staphylococcus aureus
IPIIIVLLLIGGIAWGVYAFFANTLKNTY

SEQ ID NO: 1583174 - protein, 18 aa, Staphylococcus aureus
IPILSGFIARSIADKPGF

SEQ ID NO: 1583175 - protein, 25 aa, Staphylococcus aureus
IPKTRRTAGSIVLQIALLFVSQLAF

SEQ ID NO: 1583176 - protein, 20 aa, Staphylococcus aureus
IPLFFLYKYHQPMFGRLSSQ

SEQ ID NO: 1583177 - protein, 18 aa, Staphylococcus aureus
IPLGFLLGRNRWLYNAIE

SEQ ID NO: 1583178 - protein, 17 aa, Staphylococcus aureus
IPLHEGHLFGIVNKIIN

SEQ ID NO: 1583179 - protein, 20 aa, Staphylococcus aureus
IPLSLLMALIALKLSDVSLN

SEQ ID NO: 1583180 - protein, 17 aa, Staphylococcus aureus
IPLYAVGVFIPFTLAQF

SEQ ID NO: 1583181 - protein, 18 aa, Staphylococcus aureus
IPLYAVGVFIPFTLSQFG

SEQ ID NO: 1583182 - protein, 17 aa, Staphylococcus aureus
IPNMVKYPILMLPILTT

SEQ ID NO: 1583183 - protein, 19 aa, Staphylococcus aureus
IPQHIKIRLKYIYIITFLE

SEQ ID NO: 1583184 - protein, 19 aa, Staphylococcus aureus
IPSEPGKPVPPAKEEPKKP

SEQ ID NO: 1583185 - protein, 23 aa, Staphylococcus aureus
IPSGALGLMGIVGYVSYYSIWSK

SEQ ID NO: 1583186 - protein, 22 aa, Staphylococcus aureus
IPSLEIDNASVLDEFYWLNKED

SEQ ID NO: 1583187 - protein, 18 aa, Staphylococcus aureus
IPTWKSFIFTSFAFVFIG

SEQ ID NO: 1583188 - protein, 25 aa, Staphylococcus aureus
IPVYLGMPMGIVFEVEGKTIYHTGD

SEQ ID NO: 1583189 - protein, 17 aa, Staphylococcus aureus
IQAFIHSILFGFPTKKS

SEQ ID NO: 1583190 - protein, 23 aa, Staphylococcus aureus
IQEKRIDLYFTHNLNNYKNMKVT

SEQ ID NO: 1583191 - protein, 24 aa, Staphylococcus aureus
IQIFMYWFIFGLGFRNNRTVENIP

SEQ ID NO: 1583192 - protein, 17 aa, Staphylococcus aureus
IQKLHGFSTTRIIFHNI

SEQ ID NO: 1583193 - protein, 24 aa, Staphylococcus aureus
IQLLIYVPFCFFLTASVTLLTSTL

SEQ ID NO: 1583194 - protein, 17 aa, Staphylococcus aureus
IQNIILFITWIMLVIMF

SEQ ID NO: 1583195 - protein, 18 aa, Staphylococcus aureus
IQSWRQTHCYGVVEWKGR

SEQ ID NO: 1583196 - protein, 23 aa, Staphylococcus aureus
IQYLGGVRDNWRVTANGRIDTLN

SEQ ID NO: 1583197 - protein, 18 aa, Staphylococcus aureus
IRAQEMNIPISIEIPDEV

SEQ ID NO: 1583198 - protein, 17 aa, Staphylococcus aureus
IRDMKMWVLGLVGTIFG

SEQ ID NO: 1583199 - protein, 17 aa, Staphylococcus aureus
IRESIRLAIVPTIDSVK

SEQ ID NO: 1583200 - protein, 43 aa, Staphylococcus aureus
IRHGQILLRRSKRIAVLSWLSLCICIALALILYALPYLILGSN

SEQ ID NO: 1583201 - protein, 21 aa, Staphylococcus aureus
IRIELLISGFIFILASLSDFV

SEQ ID NO: 1583202 - protein, 30 aa, Staphylococcus aureus
IRKHKLGAASVFLGTMIVVGMGQDKEAAAS

SEQ ID NO: 1583203 - protein, 26 aa, Staphylococcus aureus
IRKHLKLGETFFLYLTWYSFGRFFIE

SEQ ID NO: 1583204 - protein, 35 aa, Staphylococcus aureus
IRKYSVGTASILVGTTLIFGLSGHEAKAAEHTNGE

SEQ ID NO: 1583205 - protein, 20 aa, Staphylococcus aureus
IRLTLQFKIILIVILSKITK

SEQ ID NO: 1583206 - protein, 19 aa, Staphylococcus aureus
IRNKIKPFKIFDKPKYEKT

SEQ ID NO: 1583207 - protein, 25 aa, Staphylococcus aureus
IRPLIKRYAIQFIHHQTKLHYEKSE

SEQ ID NO: 1583208 - protein, 19 aa, Staphylococcus aureus
IRPTTLIIIGISMQMLFIA

SEQ ID NO: 1583209 - protein, 25 aa, Staphylococcus aureus
ISAAKRVPVTLNVYQFEFPQTIYTT

SEQ ID NO: 1583210 - protein, 17 aa, Staphylococcus aureus
ISALFSKKLETVIYKQL

SEQ ID NO: 1583211 - protein, 17 aa, Staphylococcus aureus
ISALVTSFLKYKREIEF

SEQ ID NO: 1583212 - protein, 17 aa, Staphylococcus aureus
ISATVLSVLSSVFGLFT

SEQ ID NO: 1583213 - protein, 26 aa, Staphylococcus aureus
ISDSTGRRKLLIIAMIIFTLASLGIV

SEQ ID NO: 1583214 - protein, 25 aa, Staphylococcus aureus
ISFAKRVFTALGIGIIFGVLLHLIY

SEQ ID NO: 1583215 - protein, 22 aa, Staphylococcus aureus
ISFFLFPVILLFVFSPEKEEEQ

SEQ ID NO: 1583216 - protein, 24 aa, Staphylococcus aureus
ISFIPGFEISVFKALARTLGYIIL

SEQ ID NO: 1583217 - protein, 23 aa, Staphylococcus aureus
ISGFLFYICLPFQNSLEKVGFPR

SEQ ID NO: 1583218 - protein, 25 aa, Staphylococcus aureus
ISGFLFYICLPFRNLLEKVGFPRWA

SEQ ID NO: 1583219 - protein, 18 aa, Staphylococcus aureus
ISGGSGFIGGIIAGFLAG

SEQ ID NO: 1583220 - protein, 23 aa, Staphylococcus aureus
ISGLKIIYFTALPYYMTKYLVKL

SEQ ID NO: 1583221 - protein, 27 aa, Staphylococcus aureus
ISHLVLTRTGLYIIDSQLLKGHIYNGI

SEQ ID NO: 1583222 - protein, 18 aa, Staphylococcus aureus
ISIALIFHRLQTKTHSIE

SEQ ID NO: 1583223 - protein, 20 aa, Staphylococcus aureus
ISIFMLFRLHVDKPTHSEEE

SEQ ID NO: 1583224 - protein, 19 aa, Staphylococcus aureus
ISIHIYRVILNFKLDSRKM

SEQ ID NO: 1583225 - protein, 17 aa, Staphylococcus aureus
ISILFAVAFFIINYIGM

SEQ ID NO: 1583226 - protein, 24 aa, Staphylococcus aureus
ISKELRDKYEWNPSLLSKIDNYLK

SEQ ID NO: 1583227 - protein, 26 aa, Staphylococcus aureus
ISKITRNQMTFLFAIPITVALIHTLI

SEQ ID NO: 1583228 - protein, 23 aa, Staphylococcus aureus
ISKKFSYKIFLVFIAIIFFAFPF

SEQ ID NO: 1583229 - protein, 26 aa, Staphylococcus aureus
ISKKFSYKMFLVFIAIIFFAFPFVLL

SEQ ID NO: 1583230 - protein, 23 aa, Staphylococcus aureus
ISKKTYQGIFSFDVLGLQDIHRN

SEQ ID NO: 1583231 - protein, 19 aa, Staphylococcus aureus
ISKQFDIKYLDGVKDRMGV

SEQ ID NO: 1583232 - protein, 34 aa, Staphylococcus aureus
ISKSNSGSMSNSIRHFTSLSTSGLMSLSDSNSMS

SEQ ID NO: 1583233 - protein, 22 aa, Staphylococcus aureus
ISLCIVCVFVLNYFYKNDYIEY

SEQ ID NO: 1583234 - protein, 21 aa, Staphylococcus aureus
ISLIFIRQRLTMVILNGVIGF

SEQ ID NO: 1583235 - protein, 17 aa, Staphylococcus aureus
ISLISFMIINGKQQELD

SEQ ID NO: 1583236 - protein, 17 aa, Staphylococcus aureus
ISLPAFFIGIILLFIFT

SEQ ID NO: 1583237 - protein, 17 aa, Staphylococcus aureus
ISLSMALTLPFIITKGQ

SEQ ID NO: 1583238 - protein, 29 aa, Staphylococcus aureus
ISNIFSRRFWPSFTFLIPIIIGMLLAMGS

SEQ ID NO: 1583239 - protein, 24 aa, Staphylococcus aureus
ISPLDFKILIGIGLVFCIATPIAS

SEQ ID NO: 1583240 - protein, 28 aa, Staphylococcus aureus
ISQFYLYYIVSAFLFWLVIFTFGIAGII

SEQ ID NO: 1583241 - protein, 23 aa, Staphylococcus aureus
ISRILKFPNNREVAMDIVKSNLP

SEQ ID NO: 1583242 - protein, 23 aa, Staphylococcus aureus
ISSDIFMWFKLVLNDTTEFNNIK

SEQ ID NO: 1583243 - protein, 24 aa, Staphylococcus aureus
ISSLIQLRKSLKMRYQMIDAANYR

SEQ ID NO: 1583244 - protein, 24 aa, Staphylococcus aureus
ISSMLCLLLGYFLLTKEEYLRKTE

SEQ ID NO: 1583245 - protein, 20 aa, Staphylococcus aureus
ISVSVIFLAISFAKVIFSAF

SEQ ID NO: 1583246 - protein, 21 aa, Staphylococcus aureus
ISVYYIFWLLAKRKYILVTFW

SEQ ID NO: 1583247 - protein, 25 aa, Staphylococcus aureus
ITFIVCIFGALKLIETTHMPKSQIP

SEQ ID NO: 1583248 - protein, 17 aa, Staphylococcus aureus
ITGSIVFNLCKNGETLL

SEQ ID NO: 1583249 - protein, 19 aa, Staphylococcus aureus
ITIAADWAYENNMWGLKDK

SEQ ID NO: 1583250 - protein, 21 aa, Staphylococcus aureus
ITIRLKLARQNLHVLVCDNGI

SEQ ID NO: 1583251 - protein, 19 aa, Staphylococcus aureus
ITKLKWKSAGALLVEAIKE

SEQ ID NO: 1583252 - protein, 19 aa, Staphylococcus aureus
ITLGIIIHASITYVLSEKH

SEQ ID NO: 1583253 - protein, 21 aa, Staphylococcus aureus
ITLLIIGIAYYLISLNNAKGQ

SEQ ID NO: 1583254 - protein, 27 aa, Staphylococcus aureus
ITLLIVYIIPRFFKAIPAPLIAIIVLT

SEQ ID NO: 1583255 - protein, 25 aa, Staphylococcus aureus
ITLLIVYVIPRFYKAIPAPLIAIIV

SEQ ID NO: 1583256 - protein, 18 aa, Staphylococcus aureus
ITLNYILFFAVIIIGTCI

SEQ ID NO: 1583257 - protein, 17 aa, Staphylococcus aureus
ITLSPKLAQTVVQQLSQ

SEQ ID NO: 1583258 - protein, 17 aa, Staphylococcus aureus
ITMIRFYGFSVMLENEQ

SEQ ID NO: 1583259 - protein, 17 aa, Staphylococcus aureus
ITNPLLHEFGTKQYPDE

SEQ ID NO: 1583260 - protein, 17 aa, Staphylococcus aureus
ITPNNPSGHLINPTQAM

SEQ ID NO: 1583261 - protein, 22 aa, Staphylococcus aureus
ITRSKFQNILLMIMIIPTCINL

SEQ ID NO: 1583262 - protein, 20 aa, Staphylococcus aureus
ITSFIALHFSWYYLLLVLVI

SEQ ID NO: 1583263 - protein, 24 aa, Staphylococcus aureus
ITSYHIFRIFFILFIIAPGINYFL

SEQ ID NO: 1583264 - protein, 24 aa, Staphylococcus aureus
ITTKKAAILKLHIDGDIKGSSVGY

SEQ ID NO: 1583265 - protein, 34 aa, Staphylococcus aureus
IVALLSFKLYRFYFYRLFAIITWILFIGSLSQYF

SEQ ID NO: 1583266 - protein, 19 aa, Staphylococcus aureus
IVALMAGIGFIARRASHKA

SEQ ID NO: 1583267 - protein, 19 aa, Staphylococcus aureus
IVATVICLKVKYDEKEKQK

SEQ ID NO: 1583268 - protein, 17 aa, Staphylococcus aureus
IVATVIYLKVKYDEKEK

SEQ ID NO: 1583269 - protein, 23 aa, Staphylococcus aureus
IVDEAKALNRAMDQLSQEITDNE

SEQ ID NO: 1583270 - protein, 19 aa, Staphylococcus aureus
IVEEIVFRGMIIRVVLLQS

SEQ ID NO: 1583271 - protein, 19 aa, Staphylococcus aureus
IVFCISMVILGIYVEITKD

SEQ ID NO: 1583272 - protein, 17 aa, Staphylococcus aureus
IVFFPIFYLGYISPKNI

SEQ ID NO: 1583273 - protein, 23 aa, Staphylococcus aureus
IVFGGPRLGTSFISAGDDKFLAI

SEQ ID NO: 1583274 - protein, 17 aa, Staphylococcus aureus
IVFGLVICGIFVAFPEV

SEQ ID NO: 1583275 - protein, 30 aa, Staphylococcus aureus
IVFIFIALMLKWWLLLVISIIVLIIITVAM

SEQ ID NO: 1583276 - protein, 18 aa, Staphylococcus aureus
IVFKRLKAFPLQMSIKPN

SEQ ID NO: 1583277 - protein, 22 aa, Staphylococcus aureus
IVFKRLKAFPLQMSIKPNTSTI

SEQ ID NO: 1583278 - protein, 18 aa, Staphylococcus aureus
IVGACLWGLGGTVSDFLF

SEQ ID NO: 1583279 - protein, 18 aa, Staphylococcus aureus
IVIAGYFAAGIFKKKKVV

SEQ ID NO: 1583280 - protein, 18 aa, Staphylococcus aureus
IVICILIKQKIYALIVLV

SEQ ID NO: 1583281 - protein, 25 aa, Staphylococcus aureus
IVIGYKFLSKRSMYLTILVTILISI

SEQ ID NO: 1583282 - protein, 28 aa, Staphylococcus aureus
IVISAILIAIGWRLIWKREINKHKNVML

SEQ ID NO: 1583283 - protein, 21 aa, Staphylococcus aureus
IVISLIALFLIKGTPETKAKD

SEQ ID NO: 1583284 - protein, 22 aa, Staphylococcus aureus
IVISVICCLLITAILYYTLDGF

SEQ ID NO: 1583285 - protein, 18 aa, Staphylococcus aureus
IVKSPRILDEVSKDLNNK

SEQ ID NO: 1583286 - protein, 17 aa, Staphylococcus aureus
IVLGEPILVVGNPLGVD

SEQ ID NO: 1583287 - protein, 25 aa, Staphylococcus aureus
IVLGGPGAVFWMWIIAFIGAASAFI

SEQ ID NO: 1583288 - protein, 19 aa, Staphylococcus aureus
IVLIPTFKQGCLIVFVYLF

SEQ ID NO: 1583289 - protein, 18 aa, Staphylococcus aureus
IVLKIFKYVSLASIVAAI

SEQ ID NO: 1583290 - protein, 23 aa, Staphylococcus aureus
IVLVGLILLRLFKINLFSFKKLT

SEQ ID NO: 1583291 - protein, 20 aa, Staphylococcus aureus
IVQLPGFIIIITFLIVLINL

SEQ ID NO: 1583292 - protein, 19 aa, Staphylococcus aureus
IVQVLTFIVLLALLEKFAW

SEQ ID NO: 1583293 - protein, 31 aa, Staphylococcus aureus
IVQVLTFIVLLALLKKFAWGPLKDIMDKRER

SEQ ID NO: 1583294 - protein, 24 aa, Staphylococcus aureus
IVSFCFIFLLLLFFRYILKRYFNY

SEQ ID NO: 1583295 - protein, 25 aa, Staphylococcus aureus
IVSLNLSLTMIFLILTYFKEVKLYK

SEQ ID NO: 1583296 - protein, 23 aa, Staphylococcus aureus
IVTIGVFVDRGWTIYEAGTIAIL

SEQ ID NO: 1583297 - protein, 19 aa, Staphylococcus aureus
IVVDGQYQSVDAFKNINIP

SEQ ID NO: 1583298 - protein, 30 aa, Staphylococcus aureus
IVVLLIKAIITWLLLIPVFNIMTSFVESTN

SEQ ID NO: 1583299 - protein, 18 aa, Staphylococcus aureus
IVVQSCLESNWSNLIEKH

SEQ ID NO: 1583300 - protein, 24 aa, Staphylococcus aureus
IVVSEVHLLYSMLIVLVGLILLRL

SEQ ID NO: 1583301 - protein, 21 aa, Staphylococcus aureus
IVVVVGFGIYFYASKDKEINN

SEQ ID NO: 1583302 - protein, 17 aa, Staphylococcus aureus
IVYFAWIAVIMGFFLVN

SEQ ID NO: 1583303 - protein, 18 aa, Staphylococcus aureus
IVYFAWIAVIMGFFLVNI

SEQ ID NO: 1583304 - protein, 20 aa, Staphylococcus aureus
IVYLCMYLLFVVIAGYSKQA

SEQ ID NO: 1583305 - protein, 19 aa, Staphylococcus aureus
IWFMLLAFMYLRYKRIAAK

SEQ ID NO: 1583306 - protein, 18 aa, Staphylococcus aureus
IWIVIGLVIIGTYAFFVG

SEQ ID NO: 1583307 - protein, 20 aa, Staphylococcus aureus
IWLVYFLPCINWFIPKKYAI

SEQ ID NO: 1583308 - protein, 22 aa, Staphylococcus aureus
IYDSGIKFPDRIMALITGDVKE

SEQ ID NO: 1583309 - protein, 19 aa, Staphylococcus aureus
IYFFYEYRMNWRNTKKQIG

SEQ ID NO: 1583310 - protein, 32 aa, Staphylococcus aureus
IYGAVRELIPWSKLNHEISQWVQIVSVSVLII

SEQ ID NO: 1583311 - protein, 32 aa, Staphylococcus aureus
IYIIRILKLPFLISLRFYVFFFVGVLITGVVK

SEQ ID NO: 1583312 - protein, 25 aa, Staphylococcus aureus
IYIVILTCALFYFILFMYNVPMQAY

SEQ ID NO: 1583313 - protein, 22 aa, Staphylococcus aureus
IYKVTMKIKIKAMGINVDEIDK

SEQ ID NO: 1583314 - protein, 17 aa, Staphylococcus aureus
IYLCVFVIIITPVIIYI

SEQ ID NO: 1583315 - protein, 18 aa, Staphylococcus aureus
IYLQNLRGFSALDSGLLL

SEQ ID NO: 1583316 - protein, 26 aa, Staphylococcus aureus
IYVCRFVWVYFWYKDFYFPKNIQSYL

SEQ ID NO: 1583317 - protein, 18 aa, Staphylococcus aureus
IYVGSLFVAVIVRNISES

SEQ ID NO: 1583318 - protein, 20 aa, Staphylococcus aureus
IYYKSIIKITITVKVGTNVQ

SEQ ID NO: 1583319 - protein, 26 aa, Staphylococcus aureus
KAAEDRKNTVLYLMHYHKRITDKQWQ

SEQ ID NO: 1583320 - protein, 21 aa, Staphylococcus aureus
KAAKLAQCHEFIKKLPEGYDT

SEQ ID NO: 1583321 - protein, 19 aa, Staphylococcus aureus
KAEALQHKLIKLIISTVLS

SEQ ID NO: 1583322 - protein, 27 aa, Staphylococcus aureus
KAGNVFPVLSPILGWIGVLFMTGSVVN

SEQ ID NO: 1583323 - protein, 20 aa, Staphylococcus aureus
KAHAPRIVTPMIITNLENKE

SEQ ID NO: 1583324 - protein, 25 aa, Staphylococcus aureus
KAKKSGIVSDCRHLLKHPDNLMDGT

SEQ ID NO: 1583325 - protein, 33 aa, Staphylococcus aureus
KAKLFPLDYTHIFPGECIWFDVLKRGNPSIEKM

SEQ ID NO: 1583326 - protein, 18 aa, Staphylococcus aureus
KALARTLGYIILSACMTF

SEQ ID NO: 1583327 - protein, 20 aa, Staphylococcus aureus
KALARTLGYIILSTCVSFLF

SEQ ID NO: 1583328 - protein, 17 aa, Staphylococcus aureus
KALDQAMQALRNSIQDQ

SEQ ID NO: 1583329 - protein, 25 aa, Staphylococcus aureus
KALHLQKWHAMIGIIIAIPVFVLVL

SEQ ID NO: 1583330 - protein, 18 aa, Staphylococcus aureus
KALLFAALFILIGFYDGF

SEQ ID NO: 1583331 - protein, 17 aa, Staphylococcus aureus
KALNRAMDQLSQEITGN

SEQ ID NO: 1583332 - protein, 24 aa, Staphylococcus aureus
KARTRKMGGTGLGLAISKEIMEAH

SEQ ID NO: 1583333 - protein, 19 aa, Staphylococcus aureus
KASPEFISSTSFSQTLINF

SEQ ID NO: 1583334 - protein, 28 aa, Staphylococcus aureus
KAVEAGKAIPYWDVFGLHINQVGYQGQA

SEQ ID NO: 1583335 - protein, 21 aa, Staphylococcus aureus
KAYAVDLISLIALPMIIVNSV

SEQ ID NO: 1583336 - protein, 18 aa, Staphylococcus aureus
KCILNRIMSFLVIVHSTF

SEQ ID NO: 1583337 - protein, 37 aa, Staphylococcus aureus
KDADNMTLDSGFYKTPKYSLGDYVWYDSNKDGKQDST

SEQ ID NO: 1583338 - protein, 21 aa, Staphylococcus aureus
KDATRASSAYVNAKPNKKQAY

SEQ ID NO: 1583339 - protein, 17 aa, Staphylococcus aureus
KDELYKKSGKNPIINQQ

SEQ ID NO: 1583340 - protein, 19 aa, Staphylococcus aureus
KDFIFRVLSGVAIGIVAGL

SEQ ID NO: 1583341 - protein, 26 aa, Staphylococcus aureus
KDFLAQWKLYTISAVVLIMVLIGFIF

SEQ ID NO: 1583342 - protein, 26 aa, Staphylococcus aureus
KDFLTQWKLYIISTVVLIMVLIGFIF

SEQ ID NO: 1583343 - protein, 21 aa, Staphylococcus aureus
KDGKRAFKPSTIVTKNGICYG

SEQ ID NO: 1583344 - protein, 18 aa, Staphylococcus aureus
KDHHSGKKGAAIGAGTAG

SEQ ID NO: 1583345 - protein, 23 aa, Staphylococcus aureus
KDIFDKRFLIFFLSAVGLHGIWD

SEQ ID NO: 1583346 - protein, 24 aa, Staphylococcus aureus
KDILDKRFLIFFLSAVGLHGIWDT

SEQ ID NO: 1583347 - protein, 21 aa, Staphylococcus aureus
KDIRTFLNFSSIYRWQTTTLA

SEQ ID NO: 1583348 - protein, 17 aa, Staphylococcus aureus
KDITNWFQTYNKSLLSA

SEQ ID NO: 1583349 - protein, 26 aa, Staphylococcus aureus
KDKISYKYDNVASINFGDINKTYVVL

SEQ ID NO: 1583350 - protein, 18 aa, Staphylococcus aureus
KDLGCALSDIDMLLKGEG

SEQ ID NO: 1583351 - protein, 25 aa, Staphylococcus aureus
KDLIKHMPNIFLARLISENNDKKTY

SEQ ID NO: 1583352 - protein, 19 aa, Staphylococcus aureus
KDLRAAYEHDITKSKQLTE

SEQ ID NO: 1583353 - protein, 19 aa, Staphylococcus aureus
KDLRAAYEHDITKSKQLTV

SEQ ID NO: 1583354 - protein, 20 aa, Staphylococcus aureus
KDLTAELTLNLFIDPTTVTK

SEQ ID NO: 1583355 - protein, 24 aa, Staphylococcus aureus
KDRQRALSYWSIGSWGGSGVCSFF

SEQ ID NO: 1583356 - protein, 20 aa, Staphylococcus aureus
KDSKEPLPDTGSEDEANTSL

SEQ ID NO: 1583357 - protein, 19 aa, Staphylococcus aureus
KDSKEPLPDTGSEGEANTS

SEQ ID NO: 1583358 - protein, 18 aa, Staphylococcus aureus
KDSRQFALIVDRYDNILY

SEQ ID NO: 1583359 - protein, 21 aa, Staphylococcus aureus
KDVFDAPKFLVIVDNYQNPEE

SEQ ID NO: 1583360 - protein, 21 aa, Staphylococcus aureus
KDVSAQKVWEGTQKVKPTIYF

SEQ ID NO: 1583361 - protein, 25 aa, Staphylococcus aureus
KEAKRYKNEYNLKKPLAEHINLTDY

SEQ ID NO: 1583362 - protein, 21 aa, Staphylococcus aureus
KEALYFRQWILNFKRSIAIIY

SEQ ID NO: 1583363 - protein, 18 aa, Staphylococcus aureus
KEDVIAFENLTNIKINLK

SEQ ID NO: 1583364 - protein, 26 aa, Staphylococcus aureus
KEEIEHAKAQLAQALQDIKDLVKAKE

SEQ ID NO: 1583365 - protein, 24 aa, Staphylococcus aureus
KEEKYDYTLMEFAQPIYNSADKFK

SEQ ID NO: 1583366 - protein, 21 aa, Staphylococcus aureus
KEELFKYTVIVVSTVIFFLVF

SEQ ID NO: 1583367 - protein, 23 aa, Staphylococcus aureus
KEFKTNRINIRRNYDNTPQNLKL

SEQ ID NO: 1583368 - protein, 20 aa, Staphylococcus aureus
KEGVGTWVGKDIKVLTSKFG

SEQ ID NO: 1583369 - protein, 17 aa, Staphylococcus aureus
KEHFNNLYLMKRLAQFE

SEQ ID NO: 1583370 - protein, 21 aa, Staphylococcus aureus
KEIFKSPRILDEVSKDLDDKY

SEQ ID NO: 1583371 - protein, 20 aa, Staphylococcus aureus
KEIQKAFAEFFHGVNHKLRG

SEQ ID NO: 1583372 - protein, 21 aa, Staphylococcus aureus
KEIRAKIFILSLAFLVHCFLV

SEQ ID NO: 1583373 - protein, 25 aa, Staphylococcus aureus
KELAKRKQEAISRIKDFSNEKMNSI

SEQ ID NO: 1583374 - protein, 24 aa, Staphylococcus aureus
KELENRKKAAISKIKDISTDKIDR

SEQ ID NO: 1583375 - protein, 22 aa, Staphylococcus aureus
KELKGSKFIILYAYSMLVLLAL

SEQ ID NO: 1583376 - protein, 25 aa, Staphylococcus aureus
KENAQPRATFRSVSSNARTTNVNYS

SEQ ID NO: 1583377 - protein, 20 aa, Staphylococcus aureus
KEPIDEIVNYAPEIIPHGTR

SEQ ID NO: 1583378 - protein, 18 aa, Staphylococcus aureus
KEQRRVIPKYKNRRKMIV

SEQ ID NO: 1583379 - protein, 25 aa, Staphylococcus aureus
KEVRNKIFFTLAMLVIFKIGTYIPA

SEQ ID NO: 1583380 - protein, 28 aa, Staphylococcus aureus
KFDSNIFCCKSCILASNLAFTFLLLKAS

SEQ ID NO: 1583381 - protein, 21 aa, Staphylococcus aureus
KFDVADLIVLVVMLLSLNVVI

SEQ ID NO: 1583382 - protein, 21 aa, Staphylococcus aureus
KFGDITKTYVVLVEGHYDNTG

SEQ ID NO: 1583383 - protein, 24 aa, Staphylococcus aureus
KFILPIVVGLLIWALTPFKPYAVD

SEQ ID NO: 1583384 - protein, 21 aa, Staphylococcus aureus
KFNPDAKNFKIYEVTDQNQFV

SEQ ID NO: 1583385 - protein, 19 aa, Staphylococcus aureus
KFQQIEAIEVKKCDFKDDL

SEQ ID NO: 1583386 - protein, 20 aa, Staphylococcus aureus
KFQQIEVIEVKKCDFKDDLF

SEQ ID NO: 1583387 - protein, 19 aa, Staphylococcus aureus
KFRINQVIMGAGDYKNLGG

SEQ ID NO: 1583388 - protein, 17 aa, Staphylococcus aureus
KFSELQALYSFDTEIKS

SEQ ID NO: 1583389 - protein, 19 aa, Staphylococcus aureus
KFSNYLLNPINDFPELFTD

SEQ ID NO: 1583390 - protein, 22 aa, Staphylococcus aureus
KFSTHKWMLYGILLTGPASMLA

SEQ ID NO: 1583391 - protein, 19 aa, Staphylococcus aureus
KFTDLFIAFKKGNYLKSVL

SEQ ID NO: 1583392 - protein, 25 aa, Staphylococcus aureus
KGAIELPGLLSFLADNSFKTKVQGL

SEQ ID NO: 1583393 - protein, 24 aa, Staphylococcus aureus
KGDTFKITVPKELNLNGVTSTAKV

SEQ ID NO: 1583394 - protein, 21 aa, Staphylococcus aureus
KGFITVFFPLWLPVHADGPIT

SEQ ID NO: 1583395 - protein, 33 aa, Staphylococcus aureus
KGGYLIPNLPNGDYRVEFSNLPQGYEVTPSKQG

SEQ ID NO: 1583396 - protein, 17 aa, Staphylococcus aureus
KGHIPGASILIVKNGKV

SEQ ID NO: 1583397 - protein, 22 aa, Staphylococcus aureus
KGIRIDWVATFVVLELILAILY

SEQ ID NO: 1583398 - protein, 17 aa, Staphylococcus aureus
KGKVFCTEDLFYGYIED

SEQ ID NO: 1583399 - protein, 27 aa, Staphylococcus aureus
KGKVTRYDLISVLPFGNTVAQIDVKGS

SEQ ID NO: 1583400 - protein, 29 aa, Staphylococcus aureus
KGLFFSVLFWLCILSFFSVLNEMVLNVSL

SEQ ID NO: 1583401 - protein, 19 aa, Staphylococcus aureus
KGLSWYDLFFTVPMFLLFV

SEQ ID NO: 1583402 - protein, 23 aa, Staphylococcus aureus
KGPRLVKYINIFYAMIANVPIII

SEQ ID NO: 1583403 - protein, 20 aa, Staphylococcus aureus
KGTFKPYGSAYGHGVSGVNM

SEQ ID NO: 1583404 - protein, 22 aa, Staphylococcus aureus
KGVKDVKGRVAINDDNFTQFQI

SEQ ID NO: 1583405 - protein, 27 aa, Staphylococcus aureus
KHIDFIFAGVFAFIFLAYRILTLWQDY

SEQ ID NO: 1583406 - protein, 19 aa, Staphylococcus aureus
KHIGFFSAFAIVMGTVIGS

SEQ ID NO: 1583407 - protein, 17 aa, Staphylococcus aureus
KHIPMMPDKVLMDDIQE

SEQ ID NO: 1583408 - protein, 22 aa, Staphylococcus aureus
KHKRRINIIIIFVGIFVLALMT

SEQ ID NO: 1583409 - protein, 19 aa, Staphylococcus aureus
KHLDACITRLRVEVNDKSK

SEQ ID NO: 1583410 - protein, 25 aa, Staphylococcus aureus
KHSRIELFTTDGLQVIGDISTISKK

SEQ ID NO: 1583411 - protein, 17 aa, Staphylococcus aureus
KHTLPSDLTDDFSPVDI

SEQ ID NO: 1583412 - protein, 20 aa, Staphylococcus aureus
KIAIWIGIVVQICYNVVIVS

SEQ ID NO: 1583413 - protein, 18 aa, Staphylococcus aureus
KIARKSFFVENGSLVQIA

SEQ ID NO: 1583414 - protein, 19 aa, Staphylococcus aureus
KIAVGVLVTGAFSLVDAVQ

SEQ ID NO: 1583415 - protein, 19 aa, Staphylococcus aureus
KIDHMMIAVGVIKQMNIVV

SEQ ID NO: 1583416 - protein, 17 aa, Staphylococcus aureus
KIESRNCIVKGQFKVND

SEQ ID NO: 1583417 - protein, 21 aa, Staphylococcus aureus
KIFLWVFGILVILAIIAVVYV

SEQ ID NO: 1583418 - protein, 20 aa, Staphylococcus aureus
KIHLESFQTFLINKKVSGKE

SEQ ID NO: 1583419 - protein, 17 aa, Staphylococcus aureus
KIKREIQELKNLKNDLI

SEQ ID NO: 1583420 - protein, 23 aa, Staphylococcus aureus
KIKSYFLRWIPSFHILQSGLFIV

SEQ ID NO: 1583421 - protein, 26 aa, Staphylococcus aureus
KIKSYFLRWIPSFHILQSGLFIVSSQ

SEQ ID NO: 1583422 - protein, 18 aa, Staphylococcus aureus
KILGVVRYFGGLLKGLIS

SEQ ID NO: 1583423 - protein, 19 aa, Staphylococcus aureus
KILIIACLMTWFYSDFYLM

SEQ ID NO: 1583424 - protein, 19 aa, Staphylococcus aureus
KILKPVIAIVIGFFLLIFI

SEQ ID NO: 1583425 - protein, 31 aa, Staphylococcus aureus
KILSGFASDSKWKIMLSILLSIISVFSGLVP

SEQ ID NO: 1583426 - protein, 20 aa, Staphylococcus aureus
KINDKWLLVLCVFVIIVNAS

SEQ ID NO: 1583427 - protein, 22 aa, Staphylococcus aureus
KINLKGSGFVSHQSISKGQKLT

SEQ ID NO: 1583428 - protein, 24 aa, Staphylococcus aureus
KINRLSFKGQIFFVSIDSMMDQIN

SEQ ID NO: 1583429 - protein, 24 aa, Staphylococcus aureus
KINRLSFKGQIFFVSIDSMMEQIN

SEQ ID NO: 1583430 - protein, 17 aa, Staphylococcus aureus
KINSFWPVAGSTVLFGV

SEQ ID NO: 1583431 - protein, 22 aa, Staphylococcus aureus
KIQEILAIFLILYGFLKLIKNM

SEQ ID NO: 1583432 - protein, 22 aa, Staphylococcus aureus
KIRRANGLSGNNIRNGQQIVIP

SEQ ID NO: 1583433 - protein, 19 aa, Staphylococcus aureus
KISWIVLVILLFGYLISEF

SEQ ID NO: 1583434 - protein, 18 aa, Staphylococcus aureus
KITIPFDQYFSVDLAINI

SEQ ID NO: 1583435 - protein, 19 aa, Staphylococcus aureus
KITVPKELNLNGVTSTAKV

SEQ ID NO: 1583436 - protein, 17 aa, Staphylococcus aureus
KIVSFLIKQGEISEVYY

SEQ ID NO: 1583437 - protein, 21 aa, Staphylococcus aureus
KKAFINHIMTWVSLFIGRLAF

SEQ ID NO: 1583438 - protein, 20 aa, Staphylococcus aureus
KKALLFAALFILIGFYDGFV

SEQ ID NO: 1583439 - protein, 18 aa, Staphylococcus aureus
KKDYKLVVEDGKVHADYP

SEQ ID NO: 1583440 - protein, 22 aa, Staphylococcus aureus
KKEALYFRQWILNFKRSIAIIY

SEQ ID NO: 1583441 - protein, 47 aa, Staphylococcus aureus
KKEALYFRQWILNFKRSIAIIYRTELLPSLYLYLYLKNNNDFKSPQY

SEQ ID NO: 1583442 - protein, 26 aa, Staphylococcus aureus
KKFLFHIVYICFFYFMDSYFLIFSII

SEQ ID NO: 1583443 - protein, 23 aa, Staphylococcus aureus
KKGTGNFTAHGDIIHKTYKEEFP

SEQ ID NO: 1583444 - protein, 17 aa, Staphylococcus aureus
KKHNFYYILSIHVLNNL

SEQ ID NO: 1583445 - protein, 21 aa, Staphylococcus aureus
KKIFPYILMSVGAFLTLGFVI

SEQ ID NO: 1583446 - protein, 22 aa, Staphylococcus aureus
KKKIRKLPIILLIVVILLIALI

SEQ ID NO: 1583447 - protein, 23 aa, Staphylococcus aureus
KKKKIRKLPIILLIVVILLIALI

SEQ ID NO: 1583448 - protein, 23 aa, Staphylococcus aureus
KKKKIRKLPIILLIVVILLIALV

SEQ ID NO: 1583449 - protein, 18 aa, Staphylococcus aureus
KKKMDILNIHTAKSSEVN

SEQ ID NO: 1583450 - protein, 19 aa, Staphylococcus aureus
KKKNIYSIRKLGVGIASVT

SEQ ID NO: 1583451 - protein, 21 aa, Staphylococcus aureus
KKLDFLSSVLLLISSISLLLY

SEQ ID NO: 1583452 - protein, 18 aa, Staphylococcus aureus
KKRITISSSVDLQFIHID

SEQ ID NO: 1583453 - protein, 20 aa, Staphylococcus aureus
KKRWLIPLLILYILIVLKFT

SEQ ID NO: 1583454 - protein, 19 aa, Staphylococcus aureus
KKRYKGIEYLIIKEPITTQ

SEQ ID NO: 1583455 - protein, 23 aa, Staphylococcus aureus
KKVMRLSAVLFWIPIAFVLLIAF

SEQ ID NO: 1583456 - protein, 17 aa, Staphylococcus aureus
KKVVGGLMLSAALTSFL

SEQ ID NO: 1583457 - protein, 17 aa, Staphylococcus aureus
KKYDFQAFIGLGDDDKN

SEQ ID NO: 1583458 - protein, 20 aa, Staphylococcus aureus
KKYILALYMVKPIHLVLLKL

SEQ ID NO: 1583459 - protein, 19 aa, Staphylococcus aureus
KLFKLGGKVLLLYFMFCTI

SEQ ID NO: 1583460 - protein, 20 aa, Staphylococcus aureus
KLKLELLPNVQNPVISVTTT

SEQ ID NO: 1583461 - protein, 20 aa, Staphylococcus aureus
KLLFEVVSAFGTVGLSMNLT

SEQ ID NO: 1583462 - protein, 23 aa, Staphylococcus aureus
KLLRTTFILLTLVGIGLTVFSFI

SEQ ID NO: 1583463 - protein, 19 aa, Staphylococcus aureus
KLNKLLLIISLLSIFQVVE

SEQ ID NO: 1583464 - protein, 17 aa, Staphylococcus aureus
KLNRADHRLIIYKDIHE

SEQ ID NO: 1583465 - protein, 18 aa, Staphylococcus aureus
KLPEKYKAEYKKKLDQTR

SEQ ID NO: 1583466 - protein, 24 aa, Staphylococcus aureus
KLPGVNTAMDWDRKYPYGDTLRGI

SEQ ID NO: 1583467 - protein, 19 aa, Staphylococcus aureus
KLPNAVFWLKAYPERLKQA

SEQ ID NO: 1583468 - protein, 17 aa, Staphylococcus aureus
KLRLDMREIPKSSIKPE

SEQ ID NO: 1583469 - protein, 19 aa, Staphylococcus aureus
KLRRKRQKRIQYSVITILV

SEQ ID NO: 1583470 - protein, 20 aa, Staphylococcus aureus
KLSCSTMMASSIILTNILPY

SEQ ID NO: 1583471 - protein, 17 aa, Staphylococcus aureus
KLSIQFINKNDCRIFSF

SEQ ID NO: 1583472 - protein, 28 aa, Staphylococcus aureus
KLTNRFSSRPVLLWTLLIFIIGNGIIAV

SEQ ID NO: 1583473 - protein, 20 aa, Staphylococcus aureus
KLTSNRFWIGIAAPTVVSII

SEQ ID NO: 1583474 - protein, 23 aa, Staphylococcus aureus
KLTYKYRRFVTPVTIRIKASDRI

SEQ ID NO: 1583475 - protein, 19 aa, Staphylococcus aureus
KLVIAICCITFIGILTFYV

SEQ ID NO: 1583476 - protein, 21 aa, Staphylococcus aureus
KLYESNKYFPIYGSSELGKDD

SEQ ID NO: 1583477 - protein, 25 aa, Staphylococcus aureus
KMSIPLIAVIFSWWLATKTANEKFE

SEQ ID NO: 1583478 - protein, 21 aa, Staphylococcus aureus
KMVNNTPKIVWKQFALSVLIF

SEQ ID NO: 1583479 - protein, 21 aa, Staphylococcus aureus
KMVQNLWWGAGYNVIAVPLAA

SEQ ID NO: 1583480 - protein, 36 aa, Staphylococcus aureus
KNALGVVGISGLLASFWFFIAKRRRKEDEEEELEIR

SEQ ID NO: 1583481 - protein, 18 aa, Staphylococcus aureus
KNDILKMSYALRNLNVDV

SEQ ID NO: 1583482 - protein, 24 aa, Staphylococcus aureus
KNDVKATLTMPAYIDPENVTKTGN

SEQ ID NO: 1583483 - protein, 30 aa, Staphylococcus aureus
KNDYRIFSFDARDSRHFSFIEAPIIVNVQA

SEQ ID NO: 1583484 - protein, 17 aa, Staphylococcus aureus
KNENICILTPTKSLLSQ

SEQ ID NO: 1583485 - protein, 21 aa, Staphylococcus aureus
KNEPSSFVISPFSAVHQQIKR

SEQ ID NO: 1583486 - protein, 22 aa, Staphylococcus aureus
KNFDFIGGLFLGLTVGLLLFGI

SEQ ID NO: 1583487 - protein, 21 aa, Staphylococcus aureus
KNFDVSKFINFLKEYGVTAES

SEQ ID NO: 1583488 - protein, 23 aa, Staphylococcus aureus
KNFLPLIILVLIYFIHKIIHKTK

SEQ ID NO: 1583489 - protein, 20 aa, Staphylococcus aureus
KNFSEFPALGLVLAVMIGIG

SEQ ID NO: 1583490 - protein, 19 aa, Staphylococcus aureus
KNFWPVVGGTILLGATSRK

SEQ ID NO: 1583491 - protein, 24 aa, Staphylococcus aureus
KNGFKTTLGLILEKFIEYVSKPKY

SEQ ID NO: 1583492 - protein, 18 aa, Staphylococcus aureus
KNGICYGIIGVTTPETKT

SEQ ID NO: 1583493 - protein, 18 aa, Staphylococcus aureus
KNHHSGKKGAVIGAGTAG

SEQ ID NO: 1583494 - protein, 20 aa, Staphylococcus aureus
KNIASLNSFERQAVKLPGKV

SEQ ID NO: 1583495 - protein, 22 aa, Staphylococcus aureus
KNIKDLKTWVMGLIGTILGSLI

SEQ ID NO: 1583496 - protein, 17 aa, Staphylococcus aureus
KNINIPLTFAGGQGQSQ

SEQ ID NO: 1583497 - protein, 26 aa, Staphylococcus aureus
KNIRDIKMWILGLIGTIFSTIVIAIL

SEQ ID NO: 1583498 - protein, 28 aa, Staphylococcus aureus
KNIRDIKMWILGLIGTILSTFVIAILKT

SEQ ID NO: 1583499 - protein, 29 aa, Staphylococcus aureus
KNIRDIKMWILGLIGTILSTFVIAILKTI

SEQ ID NO: 1583500 - protein, 30 aa, Staphylococcus aureus
KNKNALLYLLFCWTGIPGVIGMVEGVLTLM

SEQ ID NO: 1583501 - protein, 17 aa, Staphylococcus aureus
KNLDDFYDKEGFRDQEF

SEQ ID NO: 1583502 - protein, 17 aa, Staphylococcus aureus
KNLEDFYDKEGFRDQEF

SEQ ID NO: 1583503 - protein, 24 aa, Staphylococcus aureus
KNLKIEYKNGVGTYYANVNGSIET

SEQ ID NO: 1583504 - protein, 21 aa, Staphylococcus aureus
KNLLTAILLHFILDLTSGFYE

SEQ ID NO: 1583505 - protein, 20 aa, Staphylococcus aureus
KNMFENYGLIALKDNHIEVK

SEQ ID NO: 1583506 - protein, 22 aa, Staphylococcus aureus
KNNIPSRIAFAVSSQTDSRTII

SEQ ID NO: 1583507 - protein, 24 aa, Staphylococcus aureus
KNNSRTLIFPYIPDKAVYNAIVKV

SEQ ID NO: 1583508 - protein, 21 aa, Staphylococcus aureus
KNPEKLKELVRNDSNTDHSTK

SEQ ID NO: 1583509 - protein, 17 aa, Staphylococcus aureus
KNSRMSWNHKHYLFESW

SEQ ID NO: 1583510 - protein, 17 aa, Staphylococcus aureus
KNTWGYMNLGASVRPST

SEQ ID NO: 1583511 - protein, 22 aa, Staphylococcus aureus
KNTYTKQTFVTNLTGYKFNPNA

SEQ ID NO: 1583512 - protein, 20 aa, Staphylococcus aureus
KPFDNKRLIDMMVDQVINNM

SEQ ID NO: 1583513 - protein, 20 aa, Staphylococcus aureus
KPFTGLAILKLAQEGRLNLN

SEQ ID NO: 1583514 - protein, 21 aa, Staphylococcus aureus
KPGQSMAFCQGQLYRDDRPVD

SEQ ID NO: 1583515 - protein, 18 aa, Staphylococcus aureus
KPIPLKDLMLHQSGLYKY

SEQ ID NO: 1583516 - protein, 22 aa, Staphylococcus aureus
KPKEGVGTWVGKDIKVLTSKFA

SEQ ID NO: 1583517 - protein, 19 aa, Staphylococcus aureus
KPRVTRSADVVEASDVSEV

SEQ ID NO: 1583518 - protein, 20 aa, Staphylococcus aureus
KPSGKRINAIQILNKETAKF

SEQ ID NO: 1583519 - protein, 24 aa, Staphylococcus aureus
KPSVRTRAVRSLAVTEPVVNAADA

SEQ ID NO: 1583520 - protein, 19 aa, Staphylococcus aureus
KPTLLPIIPLLGISLGSLI

SEQ ID NO: 1583521 - protein, 26 aa, Staphylococcus aureus
KQELNGDERLRVAKQNANTAIDALTQ

SEQ ID NO: 1583522 - protein, 17 aa, Staphylococcus aureus
KQGDLLINFDLDYIRKH

SEQ ID NO: 1583523 - protein, 18 aa, Staphylococcus aureus
KQGDLLINFDLDYIRNHA

SEQ ID NO: 1583524 - protein, 23 aa, Staphylococcus aureus
KQHFKTIRFINTVCKSILLVLIA

SEQ ID NO: 1583525 - protein, 23 aa, Staphylococcus aureus
KQHRFSFKGQIFFVSIDSMMEKI

SEQ ID NO: 1583526 - protein, 24 aa, Staphylococcus aureus
KQKEAKFENGVIIRKADEKTTNNT

SEQ ID NO: 1583527 - protein, 21 aa, Staphylococcus aureus
KQKIRYKLVYKSVSTKHSDDS

SEQ ID NO: 1583528 - protein, 18 aa, Staphylococcus aureus
KQLDAHALNLMMIQDSMV

SEQ ID NO: 1583529 - protein, 18 aa, Staphylococcus aureus
KQLKRRYNIPKNASTKVE

SEQ ID NO: 1583530 - protein, 23 aa, Staphylococcus aureus
KQLYRTDLLFQFNDSIKQTYAVE

SEQ ID NO: 1583531 - protein, 20 aa, Staphylococcus aureus
KQNGLLGGVMTLLVGLGLMK

SEQ ID NO: 1583532 - protein, 20 aa, Staphylococcus aureus
KQNPKLGISNVKFKEEEKDT

SEQ ID NO: 1583533 - protein, 18 aa, Staphylococcus aureus
KQNPKLGISNVKFNGEEK

SEQ ID NO: 1583534 - protein, 22 aa, Staphylococcus aureus
KQQAKDALRQMTHLSDAQKQSI

SEQ ID NO: 1583535 - protein, 17 aa, Staphylococcus aureus
KQRGVDLFLNRLIIILS

SEQ ID NO: 1583536 - protein, 24 aa, Staphylococcus aureus
KQVFKIEPIRLIYSGSNLTIEGQY

SEQ ID NO: 1583537 - protein, 23 aa, Staphylococcus aureus
KRDKGTWIINSGMNIQLKGGALK

SEQ ID NO: 1583538 - protein, 20 aa, Staphylococcus aureus
KREIIKISVSLLMALIVVSL

SEQ ID NO: 1583539 - protein, 19 aa, Staphylococcus aureus
KRFHTVVAIAIIPFHNPCK

SEQ ID NO: 1583540 - protein, 19 aa, Staphylococcus aureus
KRFHTVVAIAIIPFHSPCK

SEQ ID NO: 1583541 - protein, 17 aa, Staphylococcus aureus
KRGKFRINQVIMGAGDY

SEQ ID NO: 1583542 - protein, 22 aa, Staphylococcus aureus
KRIDLYFKYNLKNYHSMKVTSF

SEQ ID NO: 1583543 - protein, 21 aa, Staphylococcus aureus
KRIDLYFKYNLNHYSSMKVTS

SEQ ID NO: 1583544 - protein, 22 aa, Staphylococcus aureus
KRIQYSVITILVLLIGVILIYM

SEQ ID NO: 1583545 - protein, 21 aa, Staphylococcus aureus
KRISKDIWAVFKLLYQNKGRF

SEQ ID NO: 1583546 - protein, 20 aa, Staphylococcus aureus
KRKYILVTFWTIIILTLLIT

SEQ ID NO: 1583547 - protein, 19 aa, Staphylococcus aureus
KRLAVPIIIHMLQNGFVVI

SEQ ID NO: 1583548 - protein, 19 aa, Staphylococcus aureus
KRLIDMMVDQVINNMESFK

SEQ ID NO: 1583549 - protein, 19 aa, Staphylococcus aureus
KRLKAFPLQMSIKPNTSTI

SEQ ID NO: 1583550 - protein, 20 aa, Staphylococcus aureus
KRLNTLMFYILLIIHYFIIC

SEQ ID NO: 1583551 - protein, 24 aa, Staphylococcus aureus
KRQLYRTDLLFQFNDSIKQTYTVE

SEQ ID NO: 1583552 - protein, 19 aa, Staphylococcus aureus
KRREIIDFVTRGNLSLSPQ

SEQ ID NO: 1583553 - protein, 21 aa, Staphylococcus aureus
KRSYSLYLWHFAVISFVHSYY

SEQ ID NO: 1583554 - protein, 21 aa, Staphylococcus aureus
KRTPKEIVFAWSPFVILTAFV

SEQ ID NO: 1583555 - protein, 26 aa, Staphylococcus aureus
KRVHLKRWHFISILIGTILITAVITV

SEQ ID NO: 1583556 - protein, 22 aa, Staphylococcus aureus
KRVNAKMRFAVAQPAAVASNNV

SEQ ID NO: 1583557 - protein, 17 aa, Staphylococcus aureus
KRYKGIDYLIIKEPITT

SEQ ID NO: 1583558 - protein, 17 aa, Staphylococcus aureus
KRYPVKMVDNKVIPTKE

SEQ ID NO: 1583559 - protein, 19 aa, Staphylococcus aureus
KSAGALLVEAIKELWLPIL

SEQ ID NO: 1583560 - protein, 19 aa, Staphylococcus aureus
KSDEMKLEPVLAVDDDEHK

SEQ ID NO: 1583561 - protein, 23 aa, Staphylococcus aureus
KSDEMKLEPVLAVDDDEHKRNIT

SEQ ID NO: 1583562 - protein, 18 aa, Staphylococcus aureus
KSFIKIGLYFQIAYIVLM

SEQ ID NO: 1583563 - protein, 21 aa, Staphylococcus aureus
KSFMLPIAILPAAGLLLGIGG

SEQ ID NO: 1583564 - protein, 20 aa, Staphylococcus aureus
KSGVGGTGITRLYKDGTVKH

SEQ ID NO: 1583565 - protein, 26 aa, Staphylococcus aureus
KSGYSYCFHCNWFINDCRNHGWSCCR

SEQ ID NO: 1583566 - protein, 24 aa, Staphylococcus aureus
KSIIAIISLCILTYTTMIGSVLAD

SEQ ID NO: 1583567 - protein, 22 aa, Staphylococcus aureus
KSIRLSSPILIKNKFLDPKSGV

SEQ ID NO: 1583568 - protein, 24 aa, Staphylococcus aureus
KSKDFKITLYISLFISLFISLFIL

SEQ ID NO: 1583569 - protein, 18 aa, Staphylococcus aureus
KSLGLKDVKIEKVYNNQA

SEQ ID NO: 1583570 - protein, 17 aa, Staphylococcus aureus
KSLLDIFSDPVVKTDYT

SEQ ID NO: 1583571 - protein, 23 aa, Staphylococcus aureus
KSLQLPLILKFILNLALIGIVII

SEQ ID NO: 1583572 - protein, 25 aa, Staphylococcus aureus
KSNLFSEKILDEFISSNSFPENEVR

SEQ ID NO: 1583573 - protein, 25 aa, Staphylococcus aureus
KSPVFKAMMHFSLPMMIGTLLSVIY

SEQ ID NO: 1583574 - protein, 26 aa, Staphylococcus aureus
KSPVQSIICYLALHRLHKVPMMMEGK

SEQ ID NO: 1583575 - protein, 26 aa, Staphylococcus aureus
KSSIKPEHFHLMYLLEQHSPYFIDAE

SEQ ID NO: 1583576 - protein, 27 aa, Staphylococcus aureus
KSSIKSEHFHLMYLLEQHSPYFIDAEL

SEQ ID NO: 1583577 - protein, 19 aa, Staphylococcus aureus
KSSILCYIQSILIFVFVPY

SEQ ID NO: 1583578 - protein, 20 aa, Staphylococcus aureus
KSTLCHLLLRFYDVNDGFIR

SEQ ID NO: 1583579 - protein, 33 aa, Staphylococcus aureus
KSYLPQVFKSMMVPLIIMIAMFFIHFNTTLIML

SEQ ID NO: 1583580 - protein, 26 aa, Staphylococcus aureus
KTDAARAIDALPHLNNAQKAAVKSKI

SEQ ID NO: 1583581 - protein, 21 aa, Staphylococcus aureus
KTDANGIANIKALPSGDYILK

SEQ ID NO: 1583582 - protein, 35 aa, Staphylococcus aureus
KTGETTSSQSWWGLYALLGMLALFIPKFRKESKYL

SEQ ID NO: 1583583 - protein, 25 aa, Staphylococcus aureus
KTKDDSYWKDLIVEGKRVTTVSKDP

SEQ ID NO: 1583584 - protein, 20 aa, Staphylococcus aureus
KTKHEVEFAGTIFSFTGNSS

SEQ ID NO: 1583585 - protein, 21 aa, Staphylococcus aureus
KTKLRLDMREIPKSSIKSEHF

SEQ ID NO: 1583586 - protein, 34 aa, Staphylococcus aureus
KTVGRYGWKTFLYFEIITTIAIGLGIIFGNLFKP

SEQ ID NO: 1583587 - protein, 34 aa, Staphylococcus aureus
KTVLVDYEKYGKFYNLSIKGTIDQIDKTNNTYRQ

SEQ ID NO: 1583588 - protein, 24 aa, Staphylococcus aureus
KTYVKHFLAFNGFIGVITFVLLIV

SEQ ID NO: 1583589 - protein, 25 aa, Staphylococcus aureus
KTYVKHFLAFNGFMGFITFVLLIVQ

SEQ ID NO: 1583590 - protein, 26 aa, Staphylococcus aureus
KVAMNKLKLVGADVWSSIESAFAPVM

SEQ ID NO: 1583591 - protein, 19 aa, Staphylococcus aureus
KVASFAMRLLLGSTLASII

SEQ ID NO: 1583592 - protein, 22 aa, Staphylococcus aureus
KVFPIMGLFGFILLIPILYKGL

SEQ ID NO: 1583593 - protein, 17 aa, Staphylococcus aureus
KVGRLMKFIPHSVMIGF

SEQ ID NO: 1583594 - protein, 19 aa, Staphylococcus aureus
KVIFGELFNAIKANRIVAF

SEQ ID NO: 1583595 - protein, 25 aa, Staphylococcus aureus
KVINAKYDVIYNGHTFASSLPAKFV

SEQ ID NO: 1583596 - protein, 18 aa, Staphylococcus aureus
KVIVNVPVKVVEKELTVV

SEQ ID NO: 1583597 - protein, 19 aa, Staphylococcus aureus
KVKKGDFVIVYKLADSDKI

SEQ ID NO: 1583598 - protein, 23 aa, Staphylococcus aureus
KVLGWLCWVMLLVLTVITMFIAL

SEQ ID NO: 1583599 - protein, 23 aa, Staphylococcus aureus
KVLKDNEHSPLLFAKRRKDKEED

SEQ ID NO: 1583600 - protein, 17 aa, Staphylococcus aureus
KVLSTFFFILLLYITYR

SEQ ID NO: 1583601 - protein, 17 aa, Staphylococcus aureus
KVLSTFLFILLLYIAYR

SEQ ID NO: 1583602 - protein, 24 aa, Staphylococcus aureus
KVLYRLTFVGSIFLAVISILPIFA

SEQ ID NO: 1583603 - protein, 37 aa, Staphylococcus aureus
KVMPSRLRAGFAYIKKYWLRLSITYIITLILIYTYEY

SEQ ID NO: 1583604 - protein, 43 aa, Staphylococcus aureus
KVMTVKYAGQTWTRNISDWIAKSGTANFSLSMTASTGGATNLQ

SEQ ID NO: 1583605 - protein, 21 aa, Staphylococcus aureus
KVPILYAMHVAPLCIKYLSLT

SEQ ID NO: 1583606 - protein, 17 aa, Staphylococcus aureus
KVPLAFIQIFLGMLLFI

SEQ ID NO: 1583607 - protein, 24 aa, Staphylococcus aureus
KVTLLNEKGEVIGTTKTDENGKYR

SEQ ID NO: 1583608 - protein, 17 aa, Staphylococcus aureus
KVVDILFIFGLLGGAAT

SEQ ID NO: 1583609 - protein, 19 aa, Staphylococcus aureus
KWLNDMNIVPGYYGVNSID

SEQ ID NO: 1583610 - protein, 20 aa, Staphylococcus aureus
KYFDISCVPILTRSQKSLQG

SEQ ID NO: 1583611 - protein, 18 aa, Staphylococcus aureus
KYFMDYHPIFKTLLGVVV

SEQ ID NO: 1583612 - protein, 21 aa, Staphylococcus aureus
KYGKFLFKTIVPLVVTTWIII

SEQ ID NO: 1583613 - protein, 27 aa, Staphylococcus aureus
KYIDFMFAGALAFIFLIYRIYILFIDY

SEQ ID NO: 1583614 - protein, 26 aa, Staphylococcus aureus
KYIDFMFAGVLAFIFLIYRIYSLFSG

SEQ ID NO: 1583615 - protein, 19 aa, Staphylococcus aureus
KYIIFGVILVITLLIIGIA

SEQ ID NO: 1583616 - protein, 17 aa, Staphylococcus aureus
KYIIPWALLGFALVMVY

SEQ ID NO: 1583617 - protein, 20 aa, Staphylococcus aureus
KYIKLSIVTINISFLFISII

SEQ ID NO: 1583618 - protein, 18 aa, Staphylococcus aureus
KYILKRYFNYSLNYKVWY

SEQ ID NO: 1583619 - protein, 22 aa, Staphylococcus aureus
KYKKKFNNIILFIFFITANMIV

SEQ ID NO: 1583620 - protein, 51 aa, Staphylococcus aureus
KYKRQRPHPFLGRQVLTWGYFLCSFICSVYLFLCKLCIIYVIVLINRRIDM

SEQ ID NO: 1583621 - protein, 18 aa, Staphylococcus aureus
KYLSLTQRKLFLFTKSTY

SEQ ID NO: 1583622 - protein, 19 aa, Staphylococcus aureus
KYVCFSGFIAAILLGMIYF

SEQ ID NO: 1583623 - protein, 21 aa, Staphylococcus aureus
KYVDNLWFFLIFLLFFGLFLF

SEQ ID NO: 1583624 - protein, 32 aa, Staphylococcus aureus
KYYFQAVLNNASFWKEYKFYNVNNQELATTVV

SEQ ID NO: 1583625 - protein, 23 aa, Staphylococcus aureus
LADKAIEVIVQFVAQNRGKFSDD

SEQ ID NO: 1583626 - protein, 22 aa, Staphylococcus aureus
LAFTSLFLVIWFPASPFIIIFS

SEQ ID NO: 1583627 - protein, 24 aa, Staphylococcus aureus
LAIHLSYYVTFLILWLLIIELLTT

SEQ ID NO: 1583628 - protein, 19 aa, Staphylococcus aureus
LAIIPFSGILIHWILFFLM

SEQ ID NO: 1583629 - protein, 17 aa, Staphylococcus aureus
LAIMTWVISLFNVSVKH

SEQ ID NO: 1583630 - protein, 17 aa, Staphylococcus aureus
LAIPSFIIALVILSLVS

SEQ ID NO: 1583631 - protein, 20 aa, Staphylococcus aureus
LAKNDLKEIPQLVTKMNDVS

SEQ ID NO: 1583632 - protein, 17 aa, Staphylococcus aureus
LALITSYVPFLAPFQLV

SEQ ID NO: 1583633 - protein, 21 aa, Staphylococcus aureus
LALSAYILWGILPIYWQFVDA

SEQ ID NO: 1583634 - protein, 19 aa, Staphylococcus aureus
LANEKNYKFETVTRNVAES

SEQ ID NO: 1583635 - protein, 24 aa, Staphylococcus aureus
LANGAYKYNPYILNQINQLGKEFG

SEQ ID NO: 1583636 - protein, 18 aa, Staphylococcus aureus
LAPLIVLIVWNFSTGLTF

SEQ ID NO: 1583637 - protein, 21 aa, Staphylococcus aureus
LARQNLHVLVCDNGIGMSSSR

SEQ ID NO: 1583638 - protein, 27 aa, Staphylococcus aureus
LASPIKRSEIIFGYVFGYGSFSVIQTI

SEQ ID NO: 1583639 - protein, 17 aa, Staphylococcus aureus
LATIIIFLSLLFMIIYI

SEQ ID NO: 1583640 - protein, 17 aa, Staphylococcus aureus
LATIIIFLSLLFTFIYI

SEQ ID NO: 1583641 - protein, 23 aa, Staphylococcus aureus
LATIPFVVAFIVGAARGNIIYSV

SEQ ID NO: 1583642 - protein, 20 aa, Staphylococcus aureus
LATKDFIIGIALAIMILIIF

SEQ ID NO: 1583643 - protein, 31 aa, Staphylococcus aureus
LATKRLNKCMPMKYRKLKLMQIKMLISKFKH

SEQ ID NO: 1583644 - protein, 17 aa, Staphylococcus aureus
LAVILKFSLWRYKKLTV

SEQ ID NO: 1583645 - protein, 24 aa, Staphylococcus aureus
LAVIPVIVCLSIFKGNAAKIEQLL

SEQ ID NO: 1583646 - protein, 24 aa, Staphylococcus aureus
LAVLVVGCPCALVISTPISIVSAI

SEQ ID NO: 1583647 - protein, 17 aa, Staphylococcus aureus
LAVTCFLGYNMYLLYNN

SEQ ID NO: 1583648 - protein, 17 aa, Staphylococcus aureus
LCFLILPLCLVMGATAY

SEQ ID NO: 1583649 - protein, 17 aa, Staphylococcus aureus
LCIGITLIVVSLILNHE

SEQ ID NO: 1583650 - protein, 20 aa, Staphylococcus aureus
LCLCRLNVVISLFISALVGG

SEQ ID NO: 1583651 - protein, 22 aa, Staphylococcus aureus
LCTFVSWLLIPHKITRYILGTL

SEQ ID NO: 1583652 - protein, 26 aa, Staphylococcus aureus
LCTQHTCRFIIVGVLANFAMYGMLTA

SEQ ID NO: 1583653 - protein, 18 aa, Staphylococcus aureus
LCYVSYRLASFDFISETI

SEQ ID NO: 1583654 - protein, 19 aa, Staphylococcus aureus
LDALAKLSGILMDENVREK

SEQ ID NO: 1583655 - protein, 19 aa, Staphylococcus aureus
LDGLRAIAVLGIIIYHLNK

SEQ ID NO: 1583656 - protein, 25 aa, Staphylococcus aureus
LDGNGRLGRILIILMLVNAGVIDKP

SEQ ID NO: 1583657 - protein, 17 aa, Staphylococcus aureus
LDILTLFAYFKPHLLYL

SEQ ID NO: 1583658 - protein, 18 aa, Staphylococcus aureus
LDISWFYAGTEKFKIPSL

SEQ ID NO: 1583659 - protein, 27 aa, Staphylococcus aureus
LDQFKAQLKVANPFAKELEKRKKVAIS

SEQ ID NO: 1583660 - protein, 24 aa, Staphylococcus aureus
LDSIVFRNTLRYAAIMMIAIFIAL

SEQ ID NO: 1583661 - protein, 17 aa, Staphylococcus aureus
LEAATHCVTRLRLVLKD

SEQ ID NO: 1583662 - protein, 20 aa, Staphylococcus aureus
LEAFNRSKAKAIIDVDNGVA

SEQ ID NO: 1583663 - protein, 21 aa, Staphylococcus aureus
LEDGKIRYTFTNDVEHKVEVT

SEQ ID NO: 1583664 - protein, 22 aa, Staphylococcus aureus
LEDGKIRYTFTNDVEHKVEVTA

SEQ ID NO: 1583665 - protein, 18 aa, Staphylococcus aureus
LEDTKKALDEQVKSAITE

SEQ ID NO: 1583666 - protein, 20 aa, Staphylococcus aureus
LEELEKMLIQLSTYHSYHDL

SEQ ID NO: 1583667 - protein, 27 aa, Staphylococcus aureus
LEETVAFTKERVEGFLNKSKNEQAALK

SEQ ID NO: 1583668 - protein, 20 aa, Staphylococcus aureus
LEFILSVAVYVIFYFIWIRF

SEQ ID NO: 1583669 - protein, 21 aa, Staphylococcus aureus
LEGTYRVADRVYTPKRNITLN

SEQ ID NO: 1583670 - protein, 17 aa, Staphylococcus aureus
LEIFKGDQIALVGPSGA

SEQ ID NO: 1583671 - protein, 22 aa, Staphylococcus aureus
LEKIDWLKWNAINMMNIMLQTV

SEQ ID NO: 1583672 - protein, 24 aa, Staphylococcus aureus
LEKINKDIVGWIKLSGTSLNYPVL

SEQ ID NO: 1583673 - protein, 18 aa, Staphylococcus aureus
LEMLDLMNKYQIKIEDEK

SEQ ID NO: 1583674 - protein, 20 aa, Staphylococcus aureus
LENILGISIRNTRPSNKQLK

SEQ ID NO: 1583675 - protein, 21 aa, Staphylococcus aureus
LENRKKAAISKIKDISTDKID

SEQ ID NO: 1583676 - protein, 17 aa, Staphylococcus aureus
LEPKLSITTQIIIVLIL

SEQ ID NO: 1583677 - protein, 19 aa, Staphylococcus aureus
LEQHSPYFIDAELTELRDS

SEQ ID NO: 1583678 - protein, 26 aa, Staphylococcus aureus
LESLPIDFRILMIIGALVSSITAIIP

SEQ ID NO: 1583679 - protein, 17 aa, Staphylococcus aureus
LESQINNAATRGEVAQK

SEQ ID NO: 1583680 - protein, 27 aa, Staphylococcus aureus
LEVDTGLSIPTIYAFKKSLDALPNKKT

SEQ ID NO: 1583681 - protein, 19 aa, Staphylococcus aureus
LFGISAWGANKYKNSDKQI

SEQ ID NO: 1583682 - protein, 24 aa, Staphylococcus aureus
LFIFRCLVVVLVFMGAVAKTETVW

SEQ ID NO: 1583683 - protein, 18 aa, Staphylococcus aureus
LFIGRLAFIFSKEVFDKP

SEQ ID NO: 1583684 - protein, 19 aa, Staphylococcus aureus
LFIKPLWQYHCRYYQVDQL

SEQ ID NO: 1583685 - protein, 25 aa, Staphylococcus aureus
LFILTISVINLWTFLILLNLNIANM

SEQ ID NO: 1583686 - protein, 26 aa, Staphylococcus aureus
LFILTMIICLTITYLVHNDYFVAMTI

SEQ ID NO: 1583687 - protein, 24 aa, Staphylococcus aureus
LFITRLAKIQLWFLIKGLTPIFFF

SEQ ID NO: 1583688 - protein, 17 aa, Staphylococcus aureus
LFIVRLLFRKKNVDLTE

SEQ ID NO: 1583689 - protein, 32 aa, Staphylococcus aureus
LFIYLKRYITFVSVNWRQVWYIFHSSLAYLLP

SEQ ID NO: 1583690 - protein, 17 aa, Staphylococcus aureus
LFKELNVSDFSLEFENK

SEQ ID NO: 1583691 - protein, 25 aa, Staphylococcus aureus
LFKGRRGPAGFFFMLGVTAFVLIYW

SEQ ID NO: 1583692 - protein, 17 aa, Staphylococcus aureus
LFKPIVYGFESFLKGST

SEQ ID NO: 1583693 - protein, 17 aa, Staphylococcus aureus
LFLALTVFAMYMVAITI

SEQ ID NO: 1583694 - protein, 19 aa, Staphylococcus aureus
LFLFFFKENEEIIPESSNI

SEQ ID NO: 1583695 - protein, 19 aa, Staphylococcus aureus
LFLFFFKESEEIIPKSSNI

SEQ ID NO: 1583696 - protein, 18 aa, Staphylococcus aureus
LFLGIMVFLAGCDYSKPE

SEQ ID NO: 1583697 - protein, 19 aa, Staphylococcus aureus
LFLTFLIGFSEEFFFRKYI

SEQ ID NO: 1583698 - protein, 18 aa, Staphylococcus aureus
LFLVLLILNSQFIKNQNN

SEQ ID NO: 1583699 - protein, 19 aa, Staphylococcus aureus
LFMYYCLLYKSPEYNQHKR

SEQ ID NO: 1583700 - protein, 18 aa, Staphylococcus aureus
LFNLGGGAAKKIAIEVLL

SEQ ID NO: 1583701 - protein, 18 aa, Staphylococcus aureus
LFPILGMSISSLTLPITL

SEQ ID NO: 1583702 - protein, 22 aa, Staphylococcus aureus
LFRKRKIKHTKNGQVAHYKAAK

SEQ ID NO: 1583703 - protein, 24 aa, Staphylococcus aureus
LFTAADGWIGFTIIFGAFALFWFV

SEQ ID NO: 1583704 - protein, 17 aa, Staphylococcus aureus
LFTDRAKAPKSGTYDAN

SEQ ID NO: 1583705 - protein, 24 aa, Staphylococcus aureus
LFTGNWRGVWDGIVMILKGTVQLI

SEQ ID NO: 1583706 - protein, 18 aa, Staphylococcus aureus
LFTLFPLIIPSFFVVFDI

SEQ ID NO: 1583707 - protein, 20 aa, Staphylococcus aureus
LFTLGNLVFFTRCMSQNLNI

SEQ ID NO: 1583708 - protein, 20 aa, Staphylococcus aureus
LFTLVLQVFFYKDLNIKQPI

SEQ ID NO: 1583709 - protein, 18 aa, Staphylococcus aureus
LFTSLRSKYYLFVSDPVM

SEQ ID NO: 1583710 - protein, 21 aa, Staphylococcus aureus
LFVAVLGPLVFMFGLFISVMG

SEQ ID NO: 1583711 - protein, 18 aa, Staphylococcus aureus
LFVKEGLSAHVAPREIEF

SEQ ID NO: 1583712 - protein, 19 aa, Staphylococcus aureus
LFYSPRLKFDVLENPNKGN

SEQ ID NO: 1583713 - protein, 17 aa, Staphylococcus aureus
LGALLRYLISFLNTDGG

SEQ ID NO: 1583714 - protein, 18 aa, Staphylococcus aureus
LGAMYSYRMDFKKTNSVI

SEQ ID NO: 1583715 - protein, 18 aa, Staphylococcus aureus
LGASLSFIKLFKVDPIEA

SEQ ID NO: 1583716 - protein, 24 aa, Staphylococcus aureus
LGASVRPSTFLGILPVGMYLISIN

SEQ ID NO: 1583717 - protein, 24 aa, Staphylococcus aureus
LGEFEVKYLTGFILILLLEGIFTN

SEQ ID NO: 1583718 - protein, 26 aa, Staphylococcus aureus
LGFALGWNYWFNWVVTVAADITIAAQ

SEQ ID NO: 1583719 - protein, 37 aa, Staphylococcus aureus
LGGTGFVGMELFRLLQNHPFFRVTFISSESMSGKSII

SEQ ID NO: 1583720 - protein, 20 aa, Staphylococcus aureus
LGIIGCLIDSFFNYLFGYSR

SEQ ID NO: 1583721 - protein, 18 aa, Staphylococcus aureus
LGILIHWILFFLMILFVL

SEQ ID NO: 1583722 - protein, 19 aa, Staphylococcus aureus
LGINFPMLLLVRSIQALGA

SEQ ID NO: 1583723 - protein, 17 aa, Staphylococcus aureus
LGITCISGMLGVTEPAM

SEQ ID NO: 1583724 - protein, 22 aa, Staphylococcus aureus
LGITISDSWRNIFVLPIIIIAI

SEQ ID NO: 1583725 - protein, 20 aa, Staphylococcus aureus
LGKMNEKFHIPRVAIIFNAI

SEQ ID NO: 1583726 - protein, 22 aa, Staphylococcus aureus
LGLIGGFLLARKYMMDYLKKNP

SEQ ID NO: 1583727 - protein, 23 aa, Staphylococcus aureus
LGLIGGFLLARKYMMDYLKKNPP

SEQ ID NO: 1583728 - protein, 17 aa, Staphylococcus aureus
LGLYFKNKVYQKADDLK

SEQ ID NO: 1583729 - protein, 17 aa, Staphylococcus aureus
LGLYHLDTMGWHKTIPP

SEQ ID NO: 1583730 - protein, 19 aa, Staphylococcus aureus
LGNGFKKTAADQFSDAGAG

SEQ ID NO: 1583731 - protein, 17 aa, Staphylococcus aureus
LGPIIGGLLYTYMGYSI

SEQ ID NO: 1583732 - protein, 27 aa, Staphylococcus aureus
LGPLAARLVALVTRFGWAKTGTLVLSK

SEQ ID NO: 1583733 - protein, 18 aa, Staphylococcus aureus
LGPLIGWGFFPTVASKFG

SEQ ID NO: 1583734 - protein, 26 aa, Staphylococcus aureus
LGRLFKNILRFIGLVILLDILMFLSI

SEQ ID NO: 1583735 - protein, 20 aa, Staphylococcus aureus
LGSLVYRLLLSIILNLPVWV

SEQ ID NO: 1583736 - protein, 23 aa, Staphylococcus aureus
LGVASVIVSTVFLITSQHQAQAA

SEQ ID NO: 1583737 - protein, 17 aa, Staphylococcus aureus
LGVFQLGIIGCLIDSFF

SEQ ID NO: 1583738 - protein, 33 aa, Staphylococcus aureus
LGVVGISGLLASFWFFIAKRRRKEDEEEELEIR

SEQ ID NO: 1583739 - protein, 17 aa, Staphylococcus aureus
LHIDLVGSIWFVLLTAI

SEQ ID NO: 1583740 - protein, 18 aa, Staphylococcus aureus
LHLLSLKVTSILIVLVAC

SEQ ID NO: 1583741 - protein, 23 aa, Staphylococcus aureus
LHMANTFGGLTIENAASQSMSAT

SEQ ID NO: 1583742 - protein, 27 aa, Staphylococcus aureus
LHNAFNVRIGWLILRLLAVIFAWMTFL

SEQ ID NO: 1583743 - protein, 19 aa, Staphylococcus aureus
LHPPMIVHYFFDLMVMMGI

SEQ ID NO: 1583744 - protein, 17 aa, Staphylococcus aureus
LHVGYGTVNHPFNSSPI

SEQ ID NO: 1583745 - protein, 24 aa, Staphylococcus aureus
LIAIMPSFYLWFFGEEFASTVPLM

SEQ ID NO: 1583746 - protein, 37 aa, Staphylococcus aureus
LIAMNKFHVLAGYRAKFILMVILTMMVFVLINTYLLR

SEQ ID NO: 1583747 - protein, 17 aa, Staphylococcus aureus
LIDGLKASPEFISSTSF

SEQ ID NO: 1583748 - protein, 19 aa, Staphylococcus aureus
LIDMSIGIVGFLMTYLPIQ

SEQ ID NO: 1583749 - protein, 21 aa, Staphylococcus aureus
LIDSFFNYLFGYSRYLTYILV

SEQ ID NO: 1583750 - protein, 17 aa, Staphylococcus aureus
LIFFVFVAFIFVVIVLQ

SEQ ID NO: 1583751 - protein, 19 aa, Staphylococcus aureus
LIFSLLCAQRILLSEKIIA

SEQ ID NO: 1583752 - protein, 23 aa, Staphylococcus aureus
LIFVSWYPTVYWIINATVVLVAF

SEQ ID NO: 1583753 - protein, 18 aa, Staphylococcus aureus
LIGAIIGFVVVRIRIDLS

SEQ ID NO: 1583754 - protein, 19 aa, Staphylococcus aureus
LIGGFLLARKYMMDYLKKN

SEQ ID NO: 1583755 - protein, 21 aa, Staphylococcus aureus
LIGGICCYIVINYIKVKLKYH

SEQ ID NO: 1583756 - protein, 22 aa, Staphylococcus aureus
LIGMALVRFRLTLMRRGYENIN

SEQ ID NO: 1583757 - protein, 20 aa, Staphylococcus aureus
LIGVCACLLYLSILLCVFKI

SEQ ID NO: 1583758 - protein, 26 aa, Staphylococcus aureus
LIHLTFVPLLFLSRFTNMVYTLSATV

SEQ ID NO: 1583759 - protein, 23 aa, Staphylococcus aureus
LIIDMCLFLSYTNIYLCVFVIII

SEQ ID NO: 1583760 - protein, 25 aa, Staphylococcus aureus
LIIFAERYLPFFTIGMGWIVPAIIG

SEQ ID NO: 1583761 - protein, 17 aa, Staphylococcus aureus
LIIILSILFFVLMICIS

SEQ ID NO: 1583762 - protein, 20 aa, Staphylococcus aureus
LIIIVIFDFIGPVINKHDYA

SEQ ID NO: 1583763 - protein, 35 aa, Staphylococcus aureus
LIILGFLLHYIFKINDKWLLVLCVFVIIVNASWNT

SEQ ID NO: 1583764 - protein, 35 aa, Staphylococcus aureus
LIILGFLLHYIFKISDKWLLVLCVFVIIVNASWNT

SEQ ID NO: 1583765 - protein, 28 aa, Staphylococcus aureus
LIILTLFGMGFFVVGLILKPVTDPLMKR

SEQ ID NO: 1583766 - protein, 18 aa, Staphylococcus aureus
LIIPSFFVVFDIFLTFMP

SEQ ID NO: 1583767 - protein, 21 aa, Staphylococcus aureus
LIIVGVINLFLIRSRKKGKRQ

SEQ ID NO: 1583768 - protein, 21 aa, Staphylococcus aureus
LIKIIPSYHALIVRSQTTVTE

SEQ ID NO: 1583769 - protein, 24 aa, Staphylococcus aureus
LIKSSRLNNILTILSIALAVIHMG

SEQ ID NO: 1583770 - protein, 17 aa, Staphylococcus aureus
LILGLIGGFLLARKYMM

SEQ ID NO: 1583771 - protein, 28 aa, Staphylococcus aureus
LILLAFIFSAYRAWQIRHGQILLRRSKR

SEQ ID NO: 1583772 - protein, 23 aa, Staphylococcus aureus
LILLCGIITLLIRIIPFIMISKV

SEQ ID NO: 1583773 - protein, 17 aa, Staphylococcus aureus
LILLVVSLVTRFIKSNS

SEQ ID NO: 1583774 - protein, 23 aa, Staphylococcus aureus
LILSCIGFGLFLWGFSNVASEGW

SEQ ID NO: 1583775 - protein, 25 aa, Staphylococcus aureus
LILTIPMVFGLIAIMPSFYLWFFGE

SEQ ID NO: 1583776 - protein, 23 aa, Staphylococcus aureus
LILTVPMVFGLIAIMPSFYLWFF

SEQ ID NO: 1583777 - protein, 30 aa, Staphylococcus aureus
LIPNLPNGDYRVEFSNLPKGYEVTPSKQGN

SEQ ID NO: 1583778 - protein, 33 aa, Staphylococcus aureus
LIPTFKLGCFLVFWIYFCWKFFDIYTNCPYDNR

SEQ ID NO: 1583779 - protein, 17 aa, Staphylococcus aureus
LIPYFSIGIVTVFIYLK

SEQ ID NO: 1583780 - protein, 17 aa, Staphylococcus aureus
LIQELSRLIPLNITIVL

SEQ ID NO: 1583781 - protein, 28 aa, Staphylococcus aureus
LIQIFYKFLSSLLHRTHIKVNFYKNESS

SEQ ID NO: 1583782 - protein, 23 aa, Staphylococcus aureus
LISDMTGKIYLQVKLKGKIDKEQ

SEQ ID NO: 1583783 - protein, 23 aa, Staphylococcus aureus
LISDMTGKIYLQVKLQGQIDKEQ

SEQ ID NO: 1583784 - protein, 19 aa, Staphylococcus aureus
LISILTFIITCFSIIQVLD

SEQ ID NO: 1583785 - protein, 17 aa, Staphylococcus aureus
LISLTFLPEIVYVICCI

SEQ ID NO: 1583786 - protein, 19 aa, Staphylococcus aureus
LIVLHGRFVTVKGICMVSL

SEQ ID NO: 1583787 - protein, 17 aa, Staphylococcus aureus
LIVYWNWAWGITVIVIY

SEQ ID NO: 1583788 - protein, 17 aa, Staphylococcus aureus
LIWFYTFIIFNNVDLKN

SEQ ID NO: 1583789 - protein, 25 aa, Staphylococcus aureus
LIYMIRIGVQIAHLLSDLKGRLATA

SEQ ID NO: 1583790 - protein, 33 aa, Staphylococcus aureus
LKALYDLWRWDFGKLLIPFRIFLSTFPVVLVLE

SEQ ID NO: 1583791 - protein, 50 aa, Staphylococcus aureus
LKARLKMFHFSKERLLIIRALITWFYTMLWSIVGVVWIMFSIPNTFELYN

SEQ ID NO: 1583792 - protein, 18 aa, Staphylococcus aureus
LKDKFNINNNIWITKVGN

SEQ ID NO: 1583793 - protein, 25 aa, Staphylococcus aureus
LKEHFSKWNWLSSLVAFIGISIISI

SEQ ID NO: 1583794 - protein, 17 aa, Staphylococcus aureus
LKEISYIQAEGFAGGEL

SEQ ID NO: 1583795 - protein, 21 aa, Staphylococcus aureus
LKEQFPYGFMLQGNGKVFGCL

SEQ ID NO: 1583796 - protein, 17 aa, Staphylococcus aureus
LKFSLWRYKKLTVAILV

SEQ ID NO: 1583797 - protein, 32 aa, Staphylococcus aureus
LKGAGKSLMKLGFKGGEKFAVKTGLQKTMQQA

SEQ ID NO: 1583798 - protein, 21 aa, Staphylococcus aureus
LKIANEYKIPTYVLGAGLGGL

SEQ ID NO: 1583799 - protein, 26 aa, Staphylococcus aureus
LKIFLLCFAGNILGAAILFSFMRFSN

SEQ ID NO: 1583800 - protein, 17 aa, Staphylococcus aureus
LKITIVLSIILETLFYY

SEQ ID NO: 1583801 - protein, 23 aa, Staphylococcus aureus
LKKDIKGSYFVKDKNFDVSKVIN

SEQ ID NO: 1583802 - protein, 23 aa, Staphylococcus aureus
LKKDIKGSYFVKDKNFDVTKFIN

SEQ ID NO: 1583803 - protein, 31 aa, Staphylococcus aureus
LKKQSKLILIFICIFTFFLMVIQSQFLMGQS

SEQ ID NO: 1583804 - protein, 18 aa, Staphylococcus aureus
LKKVKGFGSKTFDKLNSY

SEQ ID NO: 1583805 - protein, 27 aa, Staphylococcus aureus
LKLCIKPLWQYHCRFYKVDQLSVQYRT

SEQ ID NO: 1583806 - protein, 22 aa, Staphylococcus aureus
LKLDKDLAPIFGLSSNTETFTP

SEQ ID NO: 1583807 - protein, 20 aa, Staphylococcus aureus
LKLDLYSLILSCIGFGLFLW

SEQ ID NO: 1583808 - protein, 21 aa, Staphylococcus aureus
LKLRLLPSFKNICFTIFYYLF

SEQ ID NO: 1583809 - protein, 17 aa, Staphylococcus aureus
LKLSIPLILKGKKGYKF

SEQ ID NO: 1583810 - protein, 20 aa, Staphylococcus aureus
LKLSSLMSQISAVFQKVYLF

SEQ ID NO: 1583811 - protein, 19 aa, Staphylococcus aureus
LKLTRWKNDGLAGFTAGSI

SEQ ID NO: 1583812 - protein, 21 aa, Staphylococcus aureus
LKLYADKYIDAYMTIPKDGKA

SEQ ID NO: 1583813 - protein, 23 aa, Staphylococcus aureus
LKLYPTKNLDGFYDKEGFRDQEF

SEQ ID NO: 1583814 - protein, 17 aa, Staphylococcus aureus
LKLYSTYVLTHSTLLLV

SEQ ID NO: 1583815 - protein, 17 aa, Staphylococcus aureus
LKMFAYIILLGAIVAAF

SEQ ID NO: 1583816 - protein, 18 aa, Staphylococcus aureus
LKQAPRIADACHVSTSRV

SEQ ID NO: 1583817 - protein, 21 aa, Staphylococcus aureus
LKQDIYGIVWIFMLFLSLAMM

SEQ ID NO: 1583818 - protein, 21 aa, Staphylococcus aureus
LKQNPKLGISNVKFNEEEKDT

SEQ ID NO: 1583819 - protein, 23 aa, Staphylococcus aureus
LKQWDLKGILAYSTISQLGMIMV

SEQ ID NO: 1583820 - protein, 22 aa, Staphylococcus aureus
LKSERSFSIFLSISLVLIITGS

SEQ ID NO: 1583821 - protein, 20 aa, Staphylococcus aureus
LKTGDYFDFTLSNNVNTHGV

SEQ ID NO: 1583822 - protein, 24 aa, Staphylococcus aureus
LKVGRLMKFIPRPVMIGFVNALGI

SEQ ID NO: 1583823 - protein, 24 aa, Staphylococcus aureus
LKVGRLMKFIPRSVMIGFVNALGI

SEQ ID NO: 1583824 - protein, 22 aa, Staphylococcus aureus
LKVREIKGLITTKILRAQEMNI

SEQ ID NO: 1583825 - protein, 24 aa, Staphylococcus aureus
LKVREIKGLLTAKILRAQEMNIPI

SEQ ID NO: 1583826 - protein, 26 aa, Staphylococcus aureus
LKYTEMKWLTPDGHYIHGKGIKPDVP

SEQ ID NO: 1583827 - protein, 19 aa, Staphylococcus aureus
LLAPKWYIALVMVALPVLI

SEQ ID NO: 1583828 - protein, 21 aa, Staphylococcus aureus
LLEQHSPYFIDAELTELCDSF

SEQ ID NO: 1583829 - protein, 21 aa, Staphylococcus aureus
LLEVLKSDYILLARAKGVPNK

SEQ ID NO: 1583830 - protein, 24 aa, Staphylococcus aureus
LLFFILVLRISYIMITGHSNGQDL

SEQ ID NO: 1583831 - protein, 19 aa, Staphylococcus aureus
LLFLCLLVILIATAYISFV

SEQ ID NO: 1583832 - protein, 18 aa, Staphylococcus aureus
LLGASLWGVFALGNWLGI

SEQ ID NO: 1583833 - protein, 19 aa, Staphylococcus aureus
LLHLLSLKVTSILIVLVAC

SEQ ID NO: 1583834 - protein, 19 aa, Staphylococcus aureus
LLHMIKLLLHLIWVLQQSK

SEQ ID NO: 1583835 - protein, 18 aa, Staphylococcus aureus
LLHRSALDSGLTLLPGAI

SEQ ID NO: 1583836 - protein, 21 aa, Staphylococcus aureus
LLHVFTMIVAIVFGLVLNINR

SEQ ID NO: 1583837 - protein, 28 aa, Staphylococcus aureus
LLIICGCIPKLGALANIIPLPVLGGAMI

SEQ ID NO: 1583838 - protein, 25 aa, Staphylococcus aureus
LLILKAGVESPVLFVLITIFCSIIF

SEQ ID NO: 1583839 - protein, 19 aa, Staphylococcus aureus
LLINFDLDYIRNHAKSDIT

SEQ ID NO: 1583840 - protein, 17 aa, Staphylococcus aureus
LLIQLGFEPLKAAMLCL

SEQ ID NO: 1583841 - protein, 23 aa, Staphylococcus aureus
LLKGRRAIVAIGCMFMITFVVLF

SEQ ID NO: 1583842 - protein, 24 aa, Staphylococcus aureus
LLKTPRFVLPMLIQGMTFVLLFTY

SEQ ID NO: 1583843 - protein, 20 aa, Staphylococcus aureus
LLKYILEAFGIDFNSLTKGM

SEQ ID NO: 1583844 - protein, 17 aa, Staphylococcus aureus
LLLAVLFIINFILFNAR

SEQ ID NO: 1583845 - protein, 17 aa, Staphylococcus aureus
LLLKLSIPLILKGKKGY

SEQ ID NO: 1583846 - protein, 19 aa, Staphylococcus aureus
LLLKLSIPLILKGKKGYKF

SEQ ID NO: 1583847 - protein, 20 aa, Staphylococcus aureus
LLLRATVQFLNQWLGDTLAF

SEQ ID NO: 1583848 - protein, 17 aa, Staphylococcus aureus
LLPKLFITFPRRYRNVF

SEQ ID NO: 1583849 - protein, 18 aa, Staphylococcus aureus
LLQRQFRIGYNRASRLMD

SEQ ID NO: 1583850 - protein, 29 aa, Staphylococcus aureus
LLSAAIFLYIMLIDWRMACALLVTIPIAL

SEQ ID NO: 1583851 - protein, 23 aa, Staphylococcus aureus
LLSDLKGRLAIAITIQNIMLIIG

SEQ ID NO: 1583852 - protein, 25 aa, Staphylococcus aureus
LLTGLKANILFLFIFVLTVFVFNPL

SEQ ID NO: 1583853 - protein, 20 aa, Staphylococcus aureus
LLTSLLYKLFSPVSEMIMNS

SEQ ID NO: 1583854 - protein, 18 aa, Staphylococcus aureus
LMALPRFNSYIKAEMMEL

SEQ ID NO: 1583855 - protein, 18 aa, Staphylococcus aureus
LMCVGLAIMTWVISLFNV

SEQ ID NO: 1583856 - protein, 21 aa, Staphylococcus aureus
LMEGRTTIVIAHRLSTIKKAG

SEQ ID NO: 1583857 - protein, 18 aa, Staphylococcus aureus
LMHYHKRITDKQWQDAKK

SEQ ID NO: 1583858 - protein, 25 aa, Staphylococcus aureus
LMPLFGLSLILVFIIELILYVKDRR

SEQ ID NO: 1583859 - protein, 17 aa, Staphylococcus aureus
LMPLFKFASQGLQNMSI

SEQ ID NO: 1583860 - protein, 17 aa, Staphylococcus aureus
LMPLFKFVSQGLQNLSI

SEQ ID NO: 1583861 - protein, 23 aa, Staphylococcus aureus
LMPMTLLGMIAFYIAIFTINNPD

SEQ ID NO: 1583862 - protein, 18 aa, Staphylococcus aureus
LMPYSIALSIAWTVFVII

SEQ ID NO: 1583863 - protein, 20 aa, Staphylococcus aureus
LMSAIICFEYDFIALAFLFF

SEQ ID NO: 1583864 - protein, 18 aa, Staphylococcus aureus
LMSVGAFLTLGFVIFSIH

SEQ ID NO: 1583865 - protein, 20 aa, Staphylococcus aureus
LMVWDCLTGGLIFVGGVVSI

SEQ ID NO: 1583866 - protein, 21 aa, Staphylococcus aureus
LMYWVVCFIISIIQGIYESYI

SEQ ID NO: 1583867 - protein, 17 aa, Staphylococcus aureus
LNAFKNFLPLIILVLIY

SEQ ID NO: 1583868 - protein, 23 aa, Staphylococcus aureus
LNAICGIFAFLIWIHLLCTMLKY

SEQ ID NO: 1583869 - protein, 25 aa, Staphylococcus aureus
LNEKEAFRMISLLKNEFRGVRNKTP

SEQ ID NO: 1583870 - protein, 21 aa, Staphylococcus aureus
LNEVQRNGFIQSLKDDPSQST

SEQ ID NO: 1583871 - protein, 20 aa, Staphylococcus aureus
LNFDFMRYSLISGILIGFIA

SEQ ID NO: 1583872 - protein, 25 aa, Staphylococcus aureus
LNFESKIKWGCEMMIHSRKLRIWLY

SEQ ID NO: 1583873 - protein, 22 aa, Staphylococcus aureus
LNFLERYLVIMIVLAVATYFVF

SEQ ID NO: 1583874 - protein, 19 aa, Staphylococcus aureus
LNGDERLREAKQNANTAID

SEQ ID NO: 1583875 - protein, 17 aa, Staphylococcus aureus
LNHKWIVIILSTLILVA

SEQ ID NO: 1583876 - protein, 18 aa, Staphylococcus aureus
LNIFKPVRNNAFWPVTGA

SEQ ID NO: 1583877 - protein, 38 aa, Staphylococcus aureus
LNILKKNIKLLLILPAICLVVSAALTFFVMPDKYTAST

SEQ ID NO: 1583878 - protein, 22 aa, Staphylococcus aureus
LNKASRAINRAVQLDDAMGAVQ

SEQ ID NO: 1583879 - protein, 17 aa, Staphylococcus aureus
LNKLLLIISLLSIFQVV

SEQ ID NO: 1583880 - protein, 25 aa, Staphylococcus aureus
LNKNLCLSVSMLDNLVKGAAGQAIQ

SEQ ID NO: 1583881 - protein, 17 aa, Staphylococcus aureus
LNLAAIIIISIVVSGDM

SEQ ID NO: 1583882 - protein, 28 aa, Staphylococcus aureus
LNLGLDDIRNTHVWEVDEQPAVNEIFEA

SEQ ID NO: 1583883 - protein, 20 aa, Staphylococcus aureus
LNLLCNIPLIVGALITVLDV

SEQ ID NO: 1583884 - protein, 21 aa, Staphylococcus aureus
LNLSLTMIFLILTYFKEVKLY

SEQ ID NO: 1583885 - protein, 17 aa, Staphylococcus aureus
LNLWTYVMLIFITLAAI

SEQ ID NO: 1583886 - protein, 22 aa, Staphylococcus aureus
LNNAMKGLRDSIANETTVKASQ

SEQ ID NO: 1583887 - protein, 22 aa, Staphylococcus aureus
LNNGIARILAVQIVTSDHSKPS

SEQ ID NO: 1583888 - protein, 26 aa, Staphylococcus aureus
LNNLMSRVKLNQFQRIQILTQVQIVV

SEQ ID NO: 1583889 - protein, 23 aa, Staphylococcus aureus
LNNRKSEALQRLDQLTHLNNAQR

SEQ ID NO: 1583890 - protein, 17 aa, Staphylococcus aureus
LNQAMEALRNSIQDQQQ

SEQ ID NO: 1583891 - protein, 21 aa, Staphylococcus aureus
LNQAMHGLRQSIQDNAATKAN

SEQ ID NO: 1583892 - protein, 17 aa, Staphylococcus aureus
LNQYIIMTLGIFMIIIG

SEQ ID NO: 1583893 - protein, 29 aa, Staphylococcus aureus
LNSFERQAVKLPGKVKNGVVVDQVDNNGL

SEQ ID NO: 1583894 - protein, 18 aa, Staphylococcus aureus
LNSPLFVIKGITIIVLAL

SEQ ID NO: 1583895 - protein, 23 aa, Staphylococcus aureus
LNSSMKYSVNWYYENLNKHLRQY

SEQ ID NO: 1583896 - protein, 21 aa, Staphylococcus aureus
LNWYIGFSVLLTVIFRKYISL

SEQ ID NO: 1583897 - protein, 17 aa, Staphylococcus aureus
LPAFFIGIILLFIVTID

SEQ ID NO: 1583898 - protein, 18 aa, Staphylococcus aureus
LPAILVVSITYTFTQGLL

SEQ ID NO: 1583899 - protein, 21 aa, Staphylococcus aureus
LPALIGWSSMRVFGGSPILGI

SEQ ID NO: 1583900 - protein, 18 aa, Staphylococcus aureus
LPDELIEMMDHIITQRDD

SEQ ID NO: 1583901 - protein, 23 aa, Staphylococcus aureus
LPEGETKVIPGKDGLKDPETGEI

SEQ ID NO: 1583902 - protein, 18 aa, Staphylococcus aureus
LPEQWYSMIEDFKVTIWY

SEQ ID NO: 1583903 - protein, 19 aa, Staphylococcus aureus
LPGILTGFILSLSRALGET

SEQ ID NO: 1583904 - protein, 21 aa, Staphylococcus aureus
LPIAISMRITKSFKQLISLSV

SEQ ID NO: 1583905 - protein, 20 aa, Staphylococcus aureus
LPIVLVPLIVERKRIKQHPD

SEQ ID NO: 1583906 - protein, 24 aa, Staphylococcus aureus
LPIYLDVFLIFAAVVFILMYFQEK

SEQ ID NO: 1583907 - protein, 33 aa, Staphylococcus aureus
LPKTGMKIITSWITWVFIGILGLYLILRKRFNS

SEQ ID NO: 1583908 - protein, 19 aa, Staphylococcus aureus
LPLLFAVGTALGLAGGDGV

SEQ ID NO: 1583909 - protein, 17 aa, Staphylococcus aureus
LPMNMVVTNSIVIAFIS

SEQ ID NO: 1583910 - protein, 27 aa, Staphylococcus aureus
LPQVFKSMMVPLIIIIAMFFIHFNTAL

SEQ ID NO: 1583911 - protein, 21 aa, Staphylococcus aureus
LPSDLTDDFSPVDITDPSGEV

SEQ ID NO: 1583912 - protein, 21 aa, Staphylococcus aureus
LPTFIMISIFSFVIFDSVENI

SEQ ID NO: 1583913 - protein, 18 aa, Staphylococcus aureus
LPTHFKGINLTSSRFIKW

SEQ ID NO: 1583914 - protein, 28 aa, Staphylococcus aureus
LPTPELRDIPVIFILGFCGFVIYHAALN

SEQ ID NO: 1583915 - protein, 27 aa, Staphylococcus aureus
LPVTVYEGFPFVAFCMYQEGFQSLQEG

SEQ ID NO: 1583916 - protein, 26 aa, Staphylococcus aureus
LPVTVYEGFPFVAFRMYQEGFQSLQE

SEQ ID NO: 1583917 - protein, 17 aa, Staphylococcus aureus
LPYAVLEAMGGKANIKH

SEQ ID NO: 1583918 - protein, 19 aa, Staphylococcus aureus
LQDGIGLPLFTALPIVSGM

SEQ ID NO: 1583919 - protein, 23 aa, Staphylococcus aureus
LQHKRYSNVFALGDASNVPTSKT

SEQ ID NO: 1583920 - protein, 19 aa, Staphylococcus aureus
LQNNLDLFFNYGKRLANDH

SEQ ID NO: 1583921 - protein, 26 aa, Staphylococcus aureus
LQSVYLKRYLLRAMMAGFIIRIITVF

SEQ ID NO: 1583922 - protein, 24 aa, Staphylococcus aureus
LRAQEMSIPISIEIPDEVTHINLN

SEQ ID NO: 1583923 - protein, 20 aa, Staphylococcus aureus
LRGALLKRRVQTRVNSASSL

SEQ ID NO: 1583924 - protein, 19 aa, Staphylococcus aureus
LRIILQIVIVVIWLSILVS

SEQ ID NO: 1583925 - protein, 17 aa, Staphylococcus aureus
LRIIPANIIGAMIASVI

SEQ ID NO: 1583926 - protein, 19 aa, Staphylococcus aureus
LRLLLTLCIMGFLLFGTHI

SEQ ID NO: 1583927 - protein, 17 aa, Staphylococcus aureus
LRMTYMGLIISMFASLL

SEQ ID NO: 1583928 - protein, 21 aa, Staphylococcus aureus
LRSPEKFTLAVGLFNFINDKY

SEQ ID NO: 1583929 - protein, 19 aa, Staphylococcus aureus
LRVKPKVVNYLIAKELGES

SEQ ID NO: 1583930 - protein, 29 aa, Staphylococcus aureus
LRVLKDIYKGKGIEVLNIYGDLKDGTHSD

SEQ ID NO: 1583931 - protein, 17 aa, Staphylococcus aureus
LRVPFKDLLSAKHSIDT

SEQ ID NO: 1583932 - protein, 19 aa, Staphylococcus aureus
LRYAAIMMIAIFIALMFDF

SEQ ID NO: 1583933 - protein, 20 aa, Staphylococcus aureus
LRYEFMPLKYKKRIVMEGTE

SEQ ID NO: 1583934 - protein, 20 aa, Staphylococcus aureus
LRYTAIMMIAIFIALMFDFE

SEQ ID NO: 1583935 - protein, 19 aa, Staphylococcus aureus
LSAVFLMSAIICFEYDFIA

SEQ ID NO: 1583936 - protein, 20 aa, Staphylococcus aureus
LSAYILWGILPIYWQFVDEI

SEQ ID NO: 1583937 - protein, 23 aa, Staphylococcus aureus
LSDKAIELIVQFVAQYRNKFSDD

SEQ ID NO: 1583938 - protein, 18 aa, Staphylococcus aureus
LSEIFKIGIPAFLMSILM

SEQ ID NO: 1583939 - protein, 18 aa, Staphylococcus aureus
LSESYYVNPDNFEDVTDS

SEQ ID NO: 1583940 - protein, 23 aa, Staphylococcus aureus
LSEYKEVVPMLALLKSLERRCLM

SEQ ID NO: 1583941 - protein, 23 aa, Staphylococcus aureus
LSEYKEVVPMLALLKSLERRRLM

SEQ ID NO: 1583942 - protein, 21 aa, Staphylococcus aureus
LSFILAIVVAIRLFKVEKHVS

SEQ ID NO: 1583943 - protein, 18 aa, Staphylococcus aureus
LSFLRPNILDQYYGAGNL

SEQ ID NO: 1583944 - protein, 17 aa, Staphylococcus aureus
LSIKGTIDQIDKTNNTY

SEQ ID NO: 1583945 - protein, 17 aa, Staphylococcus aureus
LSIYFKNYVPTIVLTII

SEQ ID NO: 1583946 - protein, 25 aa, Staphylococcus aureus
LSKIKIISWIPSIYIEILRGTPMLV

SEQ ID NO: 1583947 - protein, 19 aa, Staphylococcus aureus
LSLFLTLRFIQGLTGGGVI

SEQ ID NO: 1583948 - protein, 22 aa, Staphylococcus aureus
LSLIIRGIAYLTTRRNLEELEP

SEQ ID NO: 1583949 - protein, 25 aa, Staphylococcus aureus
LSLNAVCGIFAFLIWIHLLCTMLKY

SEQ ID NO: 1583950 - protein, 18 aa, Staphylococcus aureus
LSLYPTKNLEGFYDKEGF

SEQ ID NO: 1583951 - protein, 22 aa, Staphylococcus aureus
LSMALTLPFIITKGQAFEYRND

SEQ ID NO: 1583952 - protein, 23 aa, Staphylococcus aureus
LSMFGTSWSQIWSTTTNFVSSIW

SEQ ID NO: 1583953 - protein, 21 aa, Staphylococcus aureus
LSMITAYIFYSYERAKGQMNF

SEQ ID NO: 1583954 - protein, 17 aa, Staphylococcus aureus
LSMSQSISGSTSTSTST

SEQ ID NO: 1583955 - protein, 20 aa, Staphylococcus aureus
LSNMLEGFGLIELKDDHIQV

SEQ ID NO: 1583956 - protein, 27 aa, Staphylococcus aureus
LSSMKWDEILTILPWLIGALIATVFIG

SEQ ID NO: 1583957 - protein, 24 aa, Staphylococcus aureus
LSSSALCGLFIQHLSTLNMKYYLI

SEQ ID NO: 1583958 - protein, 17 aa, Staphylococcus aureus
LSSSQSMSGSESTSTSV

SEQ ID NO: 1583959 - protein, 24 aa, Staphylococcus aureus
LSSYWFAELGFTFFNYHYTAKLIK

SEQ ID NO: 1583960 - protein, 17 aa, Staphylococcus aureus
LSTLMSQISAVFQKVYL

SEQ ID NO: 1583961 - protein, 22 aa, Staphylococcus aureus
LSVAIGSIFTGIVWGLLLSGSY

SEQ ID NO: 1583962 - protein, 17 aa, Staphylococcus aureus
LSVLHGRFDTVKGICMV

SEQ ID NO: 1583963 - protein, 28 aa, Staphylococcus aureus
LSYSTIMSCISFLYTLDFITKSLTKNNE

SEQ ID NO: 1583964 - protein, 17 aa, Staphylococcus aureus
LTAFGLKAKDSGHFADV

SEQ ID NO: 1583965 - protein, 23 aa, Staphylococcus aureus
LTAGTAFLIWLGDQITQFGVGNG

SEQ ID NO: 1583966 - protein, 18 aa, Staphylococcus aureus
LTAIAGYSMWKPPIFNIV

SEQ ID NO: 1583967 - protein, 18 aa, Staphylococcus aureus
LTAIAGYSMWKQPIFNIV

SEQ ID NO: 1583968 - protein, 26 aa, Staphylococcus aureus
LTAKVEVTLLDGSKEIVNVPVKVVEK

SEQ ID NO: 1583969 - protein, 22 aa, Staphylococcus aureus
LTDAKWASIMIEQILNNALKYA

SEQ ID NO: 1583970 - protein, 28 aa, Staphylococcus aureus
LTDVKEVRWLFRIIALIVFAVVMFTIYI

SEQ ID NO: 1583971 - protein, 30 aa, Staphylococcus aureus
LTDVKEVRWLFRLIALIVFAVLMFTIYNSY

SEQ ID NO: 1583972 - protein, 21 aa, Staphylococcus aureus
LTEEIKFPKGLSFLRESTISI

SEQ ID NO: 1583973 - protein, 24 aa, Staphylococcus aureus
LTFFKKKHCLAFVFVILQMMFAFF

SEQ ID NO: 1583974 - protein, 29 aa, Staphylococcus aureus
LTFIVLLALLEKFAWGPLKDVMDKRERDI

SEQ ID NO: 1583975 - protein, 22 aa, Staphylococcus aureus
LTGLKANIWFLIIFVLTVLVFN

SEQ ID NO: 1583976 - protein, 22 aa, Staphylococcus aureus
LTGPLIVYWNWAWGITVMVIYG

SEQ ID NO: 1583977 - protein, 22 aa, Staphylococcus aureus
LTGSEMLEAFIIGLLFSTVLIL

SEQ ID NO: 1583978 - protein, 18 aa, Staphylococcus aureus
LTGSEMLEAFIVGLLFST

SEQ ID NO: 1583979 - protein, 18 aa, Staphylococcus aureus
LTGYKFNPNAKNFKIYEV

SEQ ID NO: 1583980 - protein, 17 aa, Staphylococcus aureus
LTHAFKQAKDNLHGDQK

SEQ ID NO: 1583981 - protein, 18 aa, Staphylococcus aureus
LTHEGWESVLVWAPLLLA

SEQ ID NO: 1583982 - protein, 25 aa, Staphylococcus aureus
LTIKKRYKIGFIFWGVSIISLGLIM

SEQ ID NO: 1583983 - protein, 24 aa, Staphylococcus aureus
LTIKKRYKIGFIFWGVSIISLGLM

SEQ ID NO: 1583984 - protein, 19 aa, Staphylococcus aureus
LTIRLFLKLINRIKLIPFA

SEQ ID NO: 1583985 - protein, 18 aa, Staphylococcus aureus
LTISILLSIMLAYTTHIL

SEQ ID NO: 1583986 - protein, 17 aa, Staphylococcus aureus
LTIVALLSFKLYRFYFY

SEQ ID NO: 1583987 - protein, 24 aa, Staphylococcus aureus
LTIYDRIEPALKIIVSAFNKVVTW

SEQ ID NO: 1583988 - protein, 24 aa, Staphylococcus aureus
LTLFTYKAPNGMRAMGALANAAIA

SEQ ID NO: 1583989 - protein, 26 aa, Staphylococcus aureus
LTLPYFLAGHHAFTYRNDLLFIASGM

SEQ ID NO: 1583990 - protein, 17 aa, Staphylococcus aureus
LTMPFVIVTWFTILLSG

SEQ ID NO: 1583991 - protein, 23 aa, Staphylococcus aureus
LTPEQKEAAIAEVNKLKQQAIEQ

SEQ ID NO: 1583992 - protein, 20 aa, Staphylococcus aureus
LTQYVLRIILQIVIVVIWLS

SEQ ID NO: 1583993 - protein, 17 aa, Staphylococcus aureus
LTSNENFTDKDWQITGI

SEQ ID NO: 1583994 - protein, 17 aa, Staphylococcus aureus
LTTLIGMFGQILMGILI

SEQ ID NO: 1583995 - protein, 18 aa, Staphylococcus aureus
LTVAIGRVIDDSIVVVEN

SEQ ID NO: 1583996 - protein, 17 aa, Staphylococcus aureus
LTVLKLIIKPLWQYHCR

SEQ ID NO: 1583997 - protein, 17 aa, Staphylococcus aureus
LTVPLSGLFFFYESNAF

SEQ ID NO: 1583998 - protein, 18 aa, Staphylococcus aureus
LTYKYRRFVTPVTILIKV

SEQ ID NO: 1583999 - protein, 18 aa, Staphylococcus aureus
LVAIRLFKVEKHVSSPFL

SEQ ID NO: 1584000 - protein, 17 aa, Staphylococcus aureus
LVDCIGCGVFVDGGVVT

SEQ ID NO: 1584001 - protein, 21 aa, Staphylococcus aureus
LVDYEKYGKFYNLSIKGTIDQ

SEQ ID NO: 1584002 - protein, 22 aa, Staphylococcus aureus
LVDYEKYGKFYNLSIKGTIDQI

SEQ ID NO: 1584003 - protein, 18 aa, Staphylococcus aureus
LVFSWIVSFIPGFELSVF

SEQ ID NO: 1584004 - protein, 19 aa, Staphylococcus aureus
LVGFIWRIVTAENPFVPPV

SEQ ID NO: 1584005 - protein, 23 aa, Staphylococcus aureus
LVGILCFFIPFKINGNNTIFVDH

SEQ ID NO: 1584006 - protein, 18 aa, Staphylococcus aureus
LVGIVLSAIITAIAISTG

SEQ ID NO: 1584007 - protein, 17 aa, Staphylococcus aureus
LVGMVFMNLLIKVHPTR

SEQ ID NO: 1584008 - protein, 24 aa, Staphylococcus aureus
LVGSALGLYFKNKVYQKADDLKVK

SEQ ID NO: 1584009 - protein, 18 aa, Staphylococcus aureus
LVIFKLPMNMVVTNSIVI

SEQ ID NO: 1584010 - protein, 17 aa, Staphylococcus aureus
LVIIPFILAVSVLFMIE

SEQ ID NO: 1584011 - protein, 17 aa, Staphylococcus aureus
LVILPTLIISWVTIFNY

SEQ ID NO: 1584012 - protein, 24 aa, Staphylococcus aureus
LVISGGILMAIVFLFGANSFNPKS

SEQ ID NO: 1584013 - protein, 18 aa, Staphylococcus aureus
LVITFLLHRFRPRNIIQT

SEQ ID NO: 1584014 - protein, 24 aa, Staphylococcus aureus
LVITICFITFLSILIFFMKLNQKL

SEQ ID NO: 1584015 - protein, 17 aa, Staphylococcus aureus
LVIVRRFNPYKVLSVSI

SEQ ID NO: 1584016 - protein, 25 aa, Staphylococcus aureus
LVLHDFKLLPAFIAAYCVAFLIKWI

SEQ ID NO: 1584017 - protein, 17 aa, Staphylococcus aureus
LVLLIILIVGYVIMTKI

SEQ ID NO: 1584018 - protein, 19 aa, Staphylococcus aureus
LVNFCFCSLTSGLASLELS

SEQ ID NO: 1584019 - protein, 24 aa, Staphylococcus aureus
LVPALAATLFKKGVKRRNKQHQEG

SEQ ID NO: 1584020 - protein, 25 aa, Staphylococcus aureus
LVSGITWRILAPIFITGIIGAMTVI

SEQ ID NO: 1584021 - protein, 26 aa, Staphylococcus aureus
LVTIMALRWGISVGIASAVLTVVIIL

SEQ ID NO: 1584022 - protein, 17 aa, Staphylococcus aureus
LVTMITVLILKRRTPVI

SEQ ID NO: 1584023 - protein, 19 aa, Staphylococcus aureus
LVVPFMFMWMTKSKRNKAI

SEQ ID NO: 1584024 - protein, 24 aa, Staphylococcus aureus
LVVYDIGFQFSFIYFIFYYVTFSF

SEQ ID NO: 1584025 - protein, 22 aa, Staphylococcus aureus
LVYPIINICVIVFRPITLLLNK

SEQ ID NO: 1584026 - protein, 25 aa, Staphylococcus aureus
LWNKNEGFRNFIINVWNAIKTFMVT

SEQ ID NO: 1584027 - protein, 27 aa, Staphylococcus aureus
LWQIICFCIAYAIFTIVWGLQFPVMDT

SEQ ID NO: 1584028 - protein, 28 aa, Staphylococcus aureus
LWSRTWEGARISLFIGVVAAILDIFIGV

SEQ ID NO: 1584029 - protein, 31 aa, Staphylococcus aureus
LYGIFATICIKGRRKLSIILFVIAKIVSLMA

SEQ ID NO: 1584030 - protein, 28 aa, Staphylococcus aureus
LYGIFATICIKGRRKLSVILFVITIIVS

SEQ ID NO: 1584031 - protein, 17 aa, Staphylococcus aureus
LYISIIVLSIFIIGCGK

SEQ ID NO: 1584032 - protein, 18 aa, Staphylococcus aureus
LYLCCCFILLKGFTIYVI

SEQ ID NO: 1584033 - protein, 22 aa, Staphylococcus aureus
LYLNIATLILFIINLTRKNYSF

SEQ ID NO: 1584034 - protein, 17 aa, Staphylococcus aureus
LYLSQPLSLIFYLKSLL

SEQ ID NO: 1584035 - protein, 20 aa, Staphylococcus aureus
LYNAQGNIIAKGIYDSTTNT

SEQ ID NO: 1584036 - protein, 28 aa, Staphylococcus aureus
LYQLEIILRWVLMMQVMLLMNLLNQKFL

SEQ ID NO: 1584037 - protein, 22 aa, Staphylococcus aureus
LYRIVMVLSVFIIGCDKSSDTS

SEQ ID NO: 1584038 - protein, 19 aa, Staphylococcus aureus
LYSKLKERFEIEQQEKQKR

SEQ ID NO: 1584039 - protein, 26 aa, Staphylococcus aureus
LYTAGQCTWYAYGIRQKMGKPISTYW

SEQ ID NO: 1584040 - protein, 26 aa, Staphylococcus aureus
LYTQQTCRFIIVGVLANFAMYGMLTA

SEQ ID NO: 1584041 - protein, 18 aa, Staphylococcus aureus
LYVNHIFIAGTLYALDIY

SEQ ID NO: 1584042 - protein, 25 aa, Staphylococcus aureus
LYYIVSEFLFFLVIFTFGIAGIIFL

SEQ ID NO: 1584043 - protein, 17 aa, Staphylococcus aureus
MAIMIPLALMFGKLADK

SEQ ID NO: 1584044 - protein, 20 aa, Staphylococcus aureus
MALLALSSIIAFVLPRKRKN

SEQ ID NO: 1584045 - protein, 20 aa, Staphylococcus aureus
MALLALSSIVAFVLPRKRKN

SEQ ID NO: 1584046 - protein, 36 aa, Staphylococcus aureus
MAPSEAIHFCFTYRHALRLVSPDTLFAQFTTELIQL

SEQ ID NO: 1584047 - protein, 30 aa, Staphylococcus aureus
MARGLKFKIMFNFGLPLVIVLSHAYFTSLA

SEQ ID NO: 1584048 - protein, 19 aa, Staphylococcus aureus
MARYWWIIFPIGGFLSWLI

SEQ ID NO: 1584049 - protein, 28 aa, Staphylococcus aureus
MATTSFILAFPMALIWPTIQSELNAFST

SEQ ID NO: 1584050 - protein, 24 aa, Staphylococcus aureus
MDNHVYTDIKWCRMIIRQILSNAL

SEQ ID NO: 1584051 - protein, 26 aa, Staphylococcus aureus
MEIRTIYRMILKLHNIMLNVKLGLNI

SEQ ID NO: 1584052 - protein, 26 aa, Staphylococcus aureus
MESEKRKRFDIFLKYYYENLTSKQVF

SEQ ID NO: 1584053 - protein, 18 aa, Staphylococcus aureus
METRGMVLYINRNTRTTK

SEQ ID NO: 1584054 - protein, 24 aa, Staphylococcus aureus
MFDNKITYNYSSPIAGIDKPNGAN

SEQ ID NO: 1584055 - protein, 21 aa, Staphylococcus aureus
MFIIELIKGIILGIVEGLTEF

SEQ ID NO: 1584056 - protein, 18 aa, Staphylococcus aureus
MFLISIFMLFRLHVDKPT

SEQ ID NO: 1584057 - protein, 22 aa, Staphylococcus aureus
MFNNKITYNYSSPIAGIDKPNG

SEQ ID NO: 1584058 - protein, 27 aa, Staphylococcus aureus
MFNNKITYNYSSPIAGIDKPNGANISS

SEQ ID NO: 1584059 - protein, 17 aa, Staphylococcus aureus
MFNPSFIVRSFHVITTA

SEQ ID NO: 1584060 - protein, 18 aa, Staphylococcus aureus
MFYKRKVLTDNFLDKYMQ

SEQ ID NO: 1584061 - protein, 22 aa, Staphylococcus aureus
MGGLTFLLSIVITSLVAIIFVE

SEQ ID NO: 1584062 - protein, 26 aa, Staphylococcus aureus
MGGQTIRLMEEFLRNGNKEEIAYHKA

SEQ ID NO: 1584063 - protein, 19 aa, Staphylococcus aureus
MGILSFIIIMFLVPKQNVS

SEQ ID NO: 1584064 - protein, 19 aa, Staphylococcus aureus
MGIYVLRSFGMAFIMMPMV

SEQ ID NO: 1584065 - protein, 17 aa, Staphylococcus aureus
MGPKIFSFRKNETLYTI

SEQ ID NO: 1584066 - protein, 17 aa, Staphylococcus aureus
MGPLVGWLMKKTDQLIQ

SEQ ID NO: 1584067 - protein, 22 aa, Staphylococcus aureus
MGSTIAIFLIVFMAFILIITKS

SEQ ID NO: 1584068 - protein, 31 aa, Staphylococcus aureus
MHEALKRVFLIFCLIGFGVGVLANASFVIKG

SEQ ID NO: 1584069 - protein, 17 aa, Staphylococcus aureus
MHLILIGGSRLFWRIYR

SEQ ID NO: 1584070 - protein, 18 aa, Staphylococcus aureus
MHLILIGGSRLFWRIYRK

SEQ ID NO: 1584071 - protein, 23 aa, Staphylococcus aureus
MHLVELFSLLTIIIFGEVLVGLA

SEQ ID NO: 1584072 - protein, 18 aa, Staphylococcus aureus
MIAIFIALMFDFEKAYWI

SEQ ID NO: 1584073 - protein, 27 aa, Staphylococcus aureus
MICLCLSFIPKFGIGKGLFLSLFTSVS

SEQ ID NO: 1584074 - protein, 20 aa, Staphylococcus aureus
MIIFSIKYLKDFPLENVYPS

SEQ ID NO: 1584075 - protein, 20 aa, Staphylococcus aureus
MIIFSIKYLKDFSLENFYPS

SEQ ID NO: 1584076 - protein, 20 aa, Staphylococcus aureus
MIIFSIKYLKDFSLENIYPS

SEQ ID NO: 1584077 - protein, 25 aa, Staphylococcus aureus
MIITAIVLMGVWFIFNSLIALIVSI

SEQ ID NO: 1584078 - protein, 17 aa, Staphylococcus aureus
MIITMLMGGFFGLLNET

SEQ ID NO: 1584079 - protein, 44 aa, Staphylococcus aureus
MILIIFALLFRFIVRLIPIFYIFRVLSIFIFIMGFKMLGVSIQK

SEQ ID NO: 1584080 - protein, 32 aa, Staphylococcus aureus
MIMIIPTWINLLLKTCAFIGLLSHDGVINQFF

SEQ ID NO: 1584081 - protein, 18 aa, Staphylococcus aureus
MISAFSFFIYLFIYLLHP

SEQ ID NO: 1584082 - protein, 18 aa, Staphylococcus aureus
MISAFSFFIYLFIYYIQS

SEQ ID NO: 1584083 - protein, 18 aa, Staphylococcus aureus
MITEGIKDDGVIQAHDGE

SEQ ID NO: 1584084 - protein, 26 aa, Staphylococcus aureus
MITVLILKRRTPVIAVDAPAQHTQLH

SEQ ID NO: 1584085 - protein, 18 aa, Staphylococcus aureus
MKLEPVLAVDDDEHKRNI

SEQ ID NO: 1584086 - protein, 17 aa, Staphylococcus aureus
MKLNPFWTILLSIVFLH

SEQ ID NO: 1584087 - protein, 18 aa, Staphylococcus aureus
MKLPDGYKTVLHEKGNNL

SEQ ID NO: 1584088 - protein, 30 aa, Staphylococcus aureus
MKLSKIKIISWIASIYIEILRGTPMLVQVF

SEQ ID NO: 1584089 - protein, 17 aa, Staphylococcus aureus
MLEAFIVGLLFSTDLIW

SEQ ID NO: 1584090 - protein, 17 aa, Staphylococcus aureus
MLFWIFMTFILQKILFP

SEQ ID NO: 1584091 - protein, 24 aa, Staphylococcus aureus
MLHGYHAGFLFALLITVVSFFCSF

SEQ ID NO: 1584092 - protein, 18 aa, Staphylococcus aureus
MLLSTSMLILSSSSIGLA

SEQ ID NO: 1584093 - protein, 24 aa, Staphylococcus aureus
MLMVWDRLTGGLIFVGGVVSIVLV

SEQ ID NO: 1584094 - protein, 23 aa, Staphylococcus aureus
MLNLEVLKFPTFTLTTVINMVVM

SEQ ID NO: 1584095 - protein, 18 aa, Staphylococcus aureus
MLQALIVSVGDLLILKAG

SEQ ID NO: 1584096 - protein, 19 aa, Staphylococcus aureus
MLQNLWWGAGYNVIAVPLA

SEQ ID NO: 1584097 - protein, 29 aa, Staphylococcus aureus
MLSTNVYKDGKCAFKPSTIVTKNGIRYGI

SEQ ID NO: 1584098 - protein, 17 aa, Staphylococcus aureus
MMIVSLFAITAIVLSAF

SEQ ID NO: 1584099 - protein, 18 aa, Staphylococcus aureus
MMMFIRKDKVELVGPQYY

SEQ ID NO: 1584100 - protein, 17 aa, Staphylococcus aureus
MMTLQIHTGGINLKKKN

SEQ ID NO: 1584101 - protein, 18 aa, Staphylococcus aureus
MMTLQIHTGGINLKKKNI

SEQ ID NO: 1584102 - protein, 17 aa, Staphylococcus aureus
MNMLSLFIFGKIVEAII

SEQ ID NO: 1584103 - protein, 24 aa, Staphylococcus aureus
MNPVQRFVKMLSDIFVPIITAIVA

SEQ ID NO: 1584104 - protein, 21 aa, Staphylococcus aureus
MPIFQCITCVFVGNSVGIVGI

SEQ ID NO: 1584105 - protein, 20 aa, Staphylococcus aureus
MPLLSEKPLFVYISQSGETA

SEQ ID NO: 1584106 - protein, 17 aa, Staphylococcus aureus
MPMLKFDSPVGISVYLV

SEQ ID NO: 1584107 - protein, 26 aa, Staphylococcus aureus
MPRHVIEGFPTINWLGFYPSYEPLIV

SEQ ID NO: 1584108 - protein, 20 aa, Staphylococcus aureus
MPYGLCFLPLYTQKKKKQTF

SEQ ID NO: 1584109 - protein, 20 aa, Staphylococcus aureus
MQLPWVSFIVHFSFSIVIAI

SEQ ID NO: 1584110 - protein, 24 aa, Staphylococcus aureus
MQLPWVSFIVHFSFSIVIAIIYCI

SEQ ID NO: 1584111 - protein, 18 aa, Staphylococcus aureus
MQPAHLFFMIAAPEGGAQ

SEQ ID NO: 1584112 - protein, 44 aa, Staphylococcus aureus
MRHGQILLRRSKRIAVLSWLSLCICIALALALYALPYLILGSNN

SEQ ID NO: 1584113 - protein, 19 aa, Staphylococcus aureus
MRYIVGKWVPRTGSWRAAF

SEQ ID NO: 1584114 - protein, 18 aa, Staphylococcus aureus
MSAILCFEYDFIALAFLF

SEQ ID NO: 1584115 - protein, 17 aa, Staphylococcus aureus
MSIALRFIPTLMDELDK

SEQ ID NO: 1584116 - protein, 17 aa, Staphylococcus aureus
MSICADVFGIVRTFSIM

SEQ ID NO: 1584117 - protein, 28 aa, Staphylococcus aureus
MSKGLKFKIAFNFGLPLVIALSHAYFTS

SEQ ID NO: 1584118 - protein, 21 aa, Staphylococcus aureus
MSLAPNFKRYGFWNRVGLGSL

SEQ ID NO: 1584119 - protein, 20 aa, Staphylococcus aureus
MSLLALSSIIAFVLPRKRKN

SEQ ID NO: 1584120 - protein, 25 aa, Staphylococcus aureus
MSNELYEEIKILLSQNQLLASAGTL

SEQ ID NO: 1584121 - protein, 19 aa, Staphylococcus aureus
MSNLKQGIANKDTVKASEN

SEQ ID NO: 1584122 - protein, 18 aa, Staphylococcus aureus
MSSILCFEYDFIALAFLF

SEQ ID NO: 1584123 - protein, 36 aa, Staphylococcus aureus
MSSILMKNKWPFLIALPFMIGYGIGVTFYYQQKVAY

SEQ ID NO: 1584124 - protein, 18 aa, Staphylococcus aureus
MTAFLLVLVYRTYKVTKE

SEQ ID NO: 1584125 - protein, 18 aa, Staphylococcus aureus
MTGWTKEDVIAFENLTNI

SEQ ID NO: 1584126 - protein, 17 aa, Staphylococcus aureus
MTKEEIEHAKAQLAQAL

SEQ ID NO: 1584127 - protein, 18 aa, Staphylococcus aureus
MTKLSYAATRSFLDVGQK

SEQ ID NO: 1584128 - protein, 19 aa, Staphylococcus aureus
MTQGWWFPVMASVFLIFTI

SEQ ID NO: 1584129 - protein, 23 aa, Staphylococcus aureus
MTSKKRWTALVVLAISLFVVTMD

SEQ ID NO: 1584130 - protein, 32 aa, Staphylococcus aureus
MTSMPEYWLAILFIYYLGVRWQLLPFVGSDSW

SEQ ID NO: 1584131 - protein, 25 aa, Staphylococcus aureus
MTVLKAAIADKERTKASGNYVNADQ

SEQ ID NO: 1584132 - protein, 17 aa, Staphylococcus aureus
MTYQSAKIFIVQKVIQQ

SEQ ID NO: 1584133 - protein, 18 aa, Staphylococcus aureus
MVCDGYLIRIENLTPSNF

SEQ ID NO: 1584134 - protein, 17 aa, Staphylococcus aureus
MVLYRFVVFSDQFERFG

SEQ ID NO: 1584135 - protein, 18 aa, Staphylococcus aureus
MWILGLIGTILSTFVIAL

SEQ ID NO: 1584136 - protein, 26 aa, Staphylococcus aureus
MYFVIKCLWVKPKVVNYLIAKELGES

SEQ ID NO: 1584137 - protein, 19 aa, Staphylococcus aureus
MYFVKIKWYSILLIMTSQI

SEQ ID NO: 1584138 - protein, 21 aa, Staphylococcus aureus
MYWVVCFIMSIIQGIYESYIE

SEQ ID NO: 1584139 - protein, 23 aa, Staphylococcus aureus
NACPEFFAKTSFAQALIIFAERY

SEQ ID NO: 1584140 - protein, 18 aa, Staphylococcus aureus
NADQRNGFIQSLKDDPSQ

SEQ ID NO: 1584141 - protein, 31 aa, Staphylococcus aureus
NAERVTLKYKWKFGEDVKPGDYFDFTLSNNV

SEQ ID NO: 1584142 - protein, 17 aa, Staphylococcus aureus
NAFNWQAVFYIFGAVGI

SEQ ID NO: 1584143 - protein, 17 aa, Staphylococcus aureus
NAFWPAAGGSVLFGVTF

SEQ ID NO: 1584144 - protein, 23 aa, Staphylococcus aureus
NAFYEILHLPNLNEEQRNGFIQS

SEQ ID NO: 1584145 - protein, 23 aa, Staphylococcus aureus
NAIPHTMMLGAIFVLFSDIVGRI

SEQ ID NO: 1584146 - protein, 25 aa, Staphylococcus aureus
NAISVIKYTLGFGVGLVDYIHIGSQ

SEQ ID NO: 1584147 - protein, 17 aa, Staphylococcus aureus
NAKDAVNAMTHLNDAQK

SEQ ID NO: 1584148 - protein, 22 aa, Staphylococcus aureus
NAKDLNFRTHLSGYHKNYPYYP

SEQ ID NO: 1584149 - protein, 23 aa, Staphylococcus aureus
NAKDLNFRTHLSGYHKNYPYYPN

SEQ ID NO: 1584150 - protein, 26 aa, Staphylococcus aureus
NAPRGEFLHMLLGVFLSALVSFVVAA

SEQ ID NO: 1584151 - protein, 31 aa, Staphylococcus aureus
NAREALKRAFLIMCLIGFGVGILANAGNIIR

SEQ ID NO: 1584152 - protein, 17 aa, Staphylococcus aureus
NATELKAGQNIRIENGE

SEQ ID NO: 1584153 - protein, 40 aa, Staphylococcus aureus
NAYSQKGAITLGTRIDSNKSFHFSGKVNLGNKYEGHGNGG

SEQ ID NO: 1584154 - protein, 22 aa, Staphylococcus aureus
NCISYLLPMINWFIPKKGVKLS

SEQ ID NO: 1584155 - protein, 26 aa, Staphylococcus aureus
NDELFKYDIELIYPFDLVEVDSSQIN

SEQ ID NO: 1584156 - protein, 17 aa, Staphylococcus aureus
NDFEFNIRVANNHQSVT

SEQ ID NO: 1584157 - protein, 18 aa, Staphylococcus aureus
NDFEFNIRVANNHQSVTT

SEQ ID NO: 1584158 - protein, 32 aa, Staphylococcus aureus
NDFKMVFKAPRAVIIGVCLQFSIIPTLAFIIA

SEQ ID NO: 1584159 - protein, 21 aa, Staphylococcus aureus
NDIDKRVQALIDEIDQNPNLT

SEQ ID NO: 1584160 - protein, 21 aa, Staphylococcus aureus
NDNPIRYVIAILVVVLMVLGV

SEQ ID NO: 1584161 - protein, 17 aa, Staphylococcus aureus
NEAMKMLHYAAAEVRGR

SEQ ID NO: 1584162 - protein, 25 aa, Staphylococcus aureus
NEEIKKIALSEVLKETANKENAQPR

SEQ ID NO: 1584163 - protein, 20 aa, Staphylococcus aureus
NEGMPFSGFHRHFLIPSIIV

SEQ ID NO: 1584164 - protein, 28 aa, Staphylococcus aureus
NEIIALVKYKGKYLPLLENGKLLKDSND

SEQ ID NO: 1584165 - protein, 22 aa, Staphylococcus aureus
NEKWRINAENTKLVTNELNHLN

SEQ ID NO: 1584166 - protein, 17 aa, Staphylococcus aureus
NELKLRLLPSFKNICFT

SEQ ID NO: 1584167 - protein, 18 aa, Staphylococcus aureus
NEMIEFPNGKRVLTPNTD

SEQ ID NO: 1584168 - protein, 19 aa, Staphylococcus aureus
NERSDLIVIVFIVISTMIF

SEQ ID NO: 1584169 - protein, 20 aa, Staphylococcus aureus
NESNSHLTIGYGTANHPFNS

SEQ ID NO: 1584170 - protein, 21 aa, Staphylococcus aureus
NEYRIPRTLLGIIIGSSLGIS

SEQ ID NO: 1584171 - protein, 23 aa, Staphylococcus aureus
NEYRTLMLIPTWKSFIFTSFAFV

SEQ ID NO: 1584172 - protein, 18 aa, Staphylococcus aureus
NFDLKKIESHNCIVKGQF

SEQ ID NO: 1584173 - protein, 22 aa, Staphylococcus aureus
NFDLKKIESHNCIVKGQFKVND

SEQ ID NO: 1584174 - protein, 24 aa, Staphylococcus aureus
NFGDINKTYVVLVEGHYDKTGKNL

SEQ ID NO: 1584175 - protein, 25 aa, Staphylococcus aureus
NFGDINKTYVVLVEGHYDKTGKNLK

SEQ ID NO: 1584176 - protein, 18 aa, Staphylococcus aureus
NFIIPFVLVFIVDDMKGI

SEQ ID NO: 1584177 - protein, 27 aa, Staphylococcus aureus
NFILELHPSFYLSFIALLIINLAVLVW

SEQ ID NO: 1584178 - protein, 17 aa, Staphylococcus aureus
NFKIYEVTDQNQFVDSF

SEQ ID NO: 1584179 - protein, 20 aa, Staphylococcus aureus
NFRTINRFRVHPIMNDILDH

SEQ ID NO: 1584180 - protein, 24 aa, Staphylococcus aureus
NFSEFPALGLVLAMMIGIGVAEKT

SEQ ID NO: 1584181 - protein, 20 aa, Staphylococcus aureus
NFSKKCTYWVTLIITQILLT

SEQ ID NO: 1584182 - protein, 24 aa, Staphylococcus aureus
NFTGLPILLAVGFGALAGFIISSK

SEQ ID NO: 1584183 - protein, 17 aa, Staphylococcus aureus
NGDAKLIAAQNAAKQHL

SEQ ID NO: 1584184 - protein, 24 aa, Staphylococcus aureus
NGDFAGHLKFNFRQSNSETVDVTE

SEQ ID NO: 1584185 - protein, 23 aa, Staphylococcus aureus
NGDFAGYLKFDFRQSNSETVDVT

SEQ ID NO: 1584186 - protein, 17 aa, Staphylococcus aureus
NGILFFLIPFFASGIFN

SEQ ID NO: 1584187 - protein, 18 aa, Staphylococcus aureus
NGILFFLIPFFVSAIFNT

SEQ ID NO: 1584188 - protein, 18 aa, Staphylococcus aureus
NGITAAWANRQQPNNQQA

SEQ ID NO: 1584189 - protein, 23 aa, Staphylococcus aureus
NGKKSLLKRRLINIKEANLKKQS

SEQ ID NO: 1584190 - protein, 25 aa, Staphylococcus aureus
NGKKSLLKRRLMNIKDANLKKQSKL

SEQ ID NO: 1584191 - protein, 19 aa, Staphylococcus aureus
NGKNFFFIDKLEFKPKLTS

SEQ ID NO: 1584192 - protein, 19 aa, Staphylococcus aureus
NGTLFGGLFAALGSLLLFG

SEQ ID NO: 1584193 - protein, 25 aa, Staphylococcus aureus
NGTLFGGLFAALGSLLLFGRRKKQN

SEQ ID NO: 1584194 - protein, 19 aa, Staphylococcus aureus
NGWEFMARYWWIIFPIGGF

SEQ ID NO: 1584195 - protein, 24 aa, Staphylococcus aureus
NHLQNRFGAIVAFLMITLFCKFIL

SEQ ID NO: 1584196 - protein, 27 aa, Staphylococcus aureus
NHVIDYLTPLFMERAIELTNDYIENNL

SEQ ID NO: 1584197 - protein, 17 aa, Staphylococcus aureus
NIARVIILFATFYGAVK

SEQ ID NO: 1584198 - protein, 31 aa, Staphylococcus aureus
NIASLNSFERQAVKLLGKVKNGVVVDQVNNN

SEQ ID NO: 1584199 - protein, 28 aa, Staphylococcus aureus
NIDEIDFWLRFGFKLKRYTGLSKEGIKL

SEQ ID NO: 1584200 - protein, 17 aa, Staphylococcus aureus
NIDLGLTQWGFKQLPNE

SEQ ID NO: 1584201 - protein, 19 aa, Staphylococcus aureus
NIGDIKQYFTLSNGQAIPS

SEQ ID NO: 1584202 - protein, 22 aa, Staphylococcus aureus
NIIDRLFIYFNYYLEYYENMLF

SEQ ID NO: 1584203 - protein, 21 aa, Staphylococcus aureus
NIKKAVALNHGHVLPLVAQYL

SEQ ID NO: 1584204 - protein, 20 aa, Staphylococcus aureus
NIKQAFPHFLIPNVPFNLET

SEQ ID NO: 1584205 - protein, 23 aa, Staphylococcus aureus
NILFLCPFLPVISFVVIFINSQV

SEQ ID NO: 1584206 - protein, 18 aa, Staphylococcus aureus
NILGKGIIVPALRAVSGG

SEQ ID NO: 1584207 - protein, 27 aa, Staphylococcus aureus
NINFGDIDSAYIVKVVSKYTPGAEDDL

SEQ ID NO: 1584208 - protein, 21 aa, Staphylococcus aureus
NIRDIKMWILGLIGTILSTFV

SEQ ID NO: 1584209 - protein, 19 aa, Staphylococcus aureus
NIRIQPKLIIKLFLTLIII

SEQ ID NO: 1584210 - protein, 25 aa, Staphylococcus aureus
NISNALLNFRVFKNRTFALCTISSM

SEQ ID NO: 1584211 - protein, 24 aa, Staphylococcus aureus
NITFPNPNQYKVEFNTPDDQITTP

SEQ ID NO: 1584212 - protein, 18 aa, Staphylococcus aureus
NIVDIDFDSVPQIHGQNN

SEQ ID NO: 1584213 - protein, 18 aa, Staphylococcus aureus
NIVDIDFDSVPQIQGQNI

SEQ ID NO: 1584214 - protein, 18 aa, Staphylococcus aureus
NIVDIDFDSVPQIQGQNK

SEQ ID NO: 1584215 - protein, 24 aa, Staphylococcus aureus
NIYYFKAHHIIGFDTWQHTLLKRN

SEQ ID NO: 1584216 - protein, 21 aa, Staphylococcus aureus
NKASRAINRAVQLDDAMGAVQ

SEQ ID NO: 1584217 - protein, 18 aa, Staphylococcus aureus
NKFTHIAYIKPMNGNQSN

SEQ ID NO: 1584218 - protein, 27 aa, Staphylococcus aureus
NKGKALRWQKWHAMIGVIIAIPVFVLV

SEQ ID NO: 1584219 - protein, 22 aa, Staphylococcus aureus
NKGKEALTIDSSMFKLKSSDKT

SEQ ID NO: 1584220 - protein, 22 aa, Staphylococcus aureus
NKGKEGLTIDSSMFKLKSGDKT

SEQ ID NO: 1584221 - protein, 24 aa, Staphylococcus aureus
NKGPRLVKYINIFYAMIANVPIII

SEQ ID NO: 1584222 - protein, 21 aa, Staphylococcus aureus
NKIFFTLAMLVIFKIGTYIPA

SEQ ID NO: 1584223 - protein, 18 aa, Staphylococcus aureus
NKIGAVLLVGLFGLLFFI

SEQ ID NO: 1584224 - protein, 37 aa, Staphylococcus aureus
NKIINLFVCITLLVAIGMGFVSWIKRTKNTAVKVPHR

SEQ ID NO: 1584225 - protein, 17 aa, Staphylococcus aureus
NKIKALANAKRDQINSN

SEQ ID NO: 1584226 - protein, 17 aa, Staphylococcus aureus
NKITYNYSSPIAGIDKP

SEQ ID NO: 1584227 - protein, 25 aa, Staphylococcus aureus
NKIVPAQDYLALKSQIKVDDKVKSG

SEQ ID NO: 1584228 - protein, 19 aa, Staphylococcus aureus
NKKVNGYHVWIKGYNNDIT

SEQ ID NO: 1584229 - protein, 28 aa, Staphylococcus aureus
NKKYKRRNKWFGFIIIILVILLVALGVK

SEQ ID NO: 1584230 - protein, 17 aa, Staphylococcus aureus
NKLKQQAIEQINNAADV

SEQ ID NO: 1584231 - protein, 21 aa, Staphylococcus aureus
NKLKQQAIEQINNAADVHTVE

SEQ ID NO: 1584232 - protein, 24 aa, Staphylococcus aureus
NKQNKKWYLSFGYDAEDIDLNNIS

SEQ ID NO: 1584233 - protein, 26 aa, Staphylococcus aureus
NKQSRIELFTTDGLQVIGDISTISKK

SEQ ID NO: 1584234 - protein, 18 aa, Staphylococcus aureus
NKRPIKGTIFFIFFISFI

SEQ ID NO: 1584235 - protein, 27 aa, Staphylococcus aureus
NKSKALRWQKWHAMIGVIIAIPVFVLV

SEQ ID NO: 1584236 - protein, 21 aa, Staphylococcus aureus
NKSKTRVASYIQTRSGQNILR

SEQ ID NO: 1584237 - protein, 19 aa, Staphylococcus aureus
NKSQKWYLIIILNTINIIQ

SEQ ID NO: 1584238 - protein, 24 aa, Staphylococcus aureus
NKVVRFILRTVVGYSVFAYGLHYF

SEQ ID NO: 1584239 - protein, 18 aa, Staphylococcus aureus
NLAIGVVVGVVFSAIFFA

SEQ ID NO: 1584240 - protein, 18 aa, Staphylococcus aureus
NLAIVPGICIMFVVLAFN

SEQ ID NO: 1584241 - protein, 19 aa, Staphylococcus aureus
NLDEQVLALITGEIGSMPD

SEQ ID NO: 1584242 - protein, 30 aa, Staphylococcus aureus
NLFSLLASIIVLWLYFRKAIPKTFDDNNIK

SEQ ID NO: 1584243 - protein, 27 aa, Staphylococcus aureus
NLGLDDIRNTHVWEVDAQPAVNEIFDA

SEQ ID NO: 1584244 - protein, 27 aa, Staphylococcus aureus
NLGLDDIRNTHVWEVDDQPAVNEISEA

SEQ ID NO: 1584245 - protein, 20 aa, Staphylococcus aureus
NLIITFPILRKFKIATPVFK

SEQ ID NO: 1584246 - protein, 25 aa, Staphylococcus aureus
NLISRLSAMLLQSMTVRLGIATGMD

SEQ ID NO: 1584247 - protein, 19 aa, Staphylococcus aureus
NLKGETKTKYDAMKKDNVE

SEQ ID NO: 1584248 - protein, 24 aa, Staphylococcus aureus
NLKNIHIGFIIGIYILLMAVLNLL

SEQ ID NO: 1584249 - protein, 24 aa, Staphylococcus aureus
NLKVREIKGLITAKILRAQEMSIP

SEQ ID NO: 1584250 - protein, 25 aa, Staphylococcus aureus
NLKVREIKGLLTAKIIRAQEMNIPI

SEQ ID NO: 1584251 - protein, 31 aa, Staphylococcus aureus
NLLGARLFGELEFWFSIIKVVTIIAMVIVGL

SEQ ID NO: 1584252 - protein, 18 aa, Staphylococcus aureus
NLLKYGFTLYQSFQFLNL

SEQ ID NO: 1584253 - protein, 20 aa, Staphylococcus aureus
NLTGYKFNPDAKNFKIYEVT

SEQ ID NO: 1584254 - protein, 19 aa, Staphylococcus aureus
NLTGYKFNPNAKNFKIYEV

SEQ ID NO: 1584255 - protein, 26 aa, Staphylococcus aureus
NLTGYKFNPNAKNFKIYEVTDQNQFV

SEQ ID NO: 1584256 - protein, 22 aa, Staphylococcus aureus
NLTLNFMISFLFVISATVIGIF

SEQ ID NO: 1584257 - protein, 19 aa, Staphylococcus aureus
NLTNIKINLKGSGFVSHQS

SEQ ID NO: 1584258 - protein, 32 aa, Staphylococcus aureus
NMAEALKRGFLIFCLIGFGVGVLANASFIIKG

SEQ ID NO: 1584259 - protein, 17 aa, Staphylococcus aureus
NMIENYGLIALKDDYIE

SEQ ID NO: 1584260 - protein, 17 aa, Staphylococcus aureus
NMLPLVISGGILMAIVF

SEQ ID NO: 1584261 - protein, 17 aa, Staphylococcus aureus
NMRMMFIGMMLLLVFAL

SEQ ID NO: 1584262 - protein, 25 aa, Staphylococcus aureus
NMTIPRIVAILGIISAMLTFKDKQI

SEQ ID NO: 1584263 - protein, 22 aa, Staphylococcus aureus
NMWGLKDKTDWVGHKIDDGIDV

SEQ ID NO: 1584264 - protein, 23 aa, Staphylococcus aureus
NMWGLKDKTDWVGHKIDDGIDVV

SEQ ID NO: 1584265 - protein, 27 aa, Staphylococcus aureus
NNATLFGGLFAALGSLLLFGRRKKQNK

SEQ ID NO: 1584266 - protein, 19 aa, Staphylococcus aureus
NNGIARILAVQIVTSDHSK

SEQ ID NO: 1584267 - protein, 20 aa, Staphylococcus aureus
NNGIARISAVQIVTSDRAKQ

SEQ ID NO: 1584268 - protein, 24 aa, Staphylococcus aureus
NNGIARISAVQIVTSDRAKQSSST

SEQ ID NO: 1584269 - protein, 24 aa, Staphylococcus aureus
NNIFGLKDKVDWVGHKIDNSIDVV

SEQ ID NO: 1584270 - protein, 26 aa, Staphylococcus aureus
NNIRFLKLKVGKIINVAKVDIIAFDK

SEQ ID NO: 1584271 - protein, 19 aa, Staphylococcus aureus
NNLNNFSFIVAKGVTNESI

SEQ ID NO: 1584272 - protein, 19 aa, Staphylococcus aureus
NNQITYNYSSPIAGIDKPN

SEQ ID NO: 1584273 - protein, 23 aa, Staphylococcus aureus
NNTGIRMFKRYAVITTSAQILGR

SEQ ID NO: 1584274 - protein, 17 aa, Staphylococcus aureus
NNTMPIADIKSTNGDVV

SEQ ID NO: 1584275 - protein, 17 aa, Staphylococcus aureus
NNYEVHFVFDLSLMEIR

SEQ ID NO: 1584276 - protein, 17 aa, Staphylococcus aureus
NPDAKNFKIYEVTDQNQ

SEQ ID NO: 1584277 - protein, 19 aa, Staphylococcus aureus
NPEKLKELVRNDSNTDRST

SEQ ID NO: 1584278 - protein, 22 aa, Staphylococcus aureus
NPKADIPGIIFSTIGFGALLYG

SEQ ID NO: 1584279 - protein, 17 aa, Staphylococcus aureus
NPKLKAFVEDFFNKYTK

SEQ ID NO: 1584280 - protein, 23 aa, Staphylococcus aureus
NPQLKKRITVIDGHSHTVLQNGR

SEQ ID NO: 1584281 - protein, 18 aa, Staphylococcus aureus
NPSGHLINPTQVMDIAYT

SEQ ID NO: 1584282 - protein, 26 aa, Staphylococcus aureus
NQDGKRPTEIKVELYQDGKATVKTAT

SEQ ID NO: 1584283 - protein, 19 aa, Staphylococcus aureus
NQKIYCFIDEIFKGTNTTE

SEQ ID NO: 1584284 - protein, 23 aa, Staphylococcus aureus
NRFSESFDLYTLILSIYLHLIIV

SEQ ID NO: 1584285 - protein, 19 aa, Staphylococcus aureus
NRFTHVAFIKPNNGKTTSV

SEQ ID NO: 1584286 - protein, 23 aa, Staphylococcus aureus
NRFVFPNLIELFRKSMNNARKSK

SEQ ID NO: 1584287 - protein, 31 aa, Staphylococcus aureus
NRGLNLGLDDIRNTHVWEVDEQPAVNEIFEA

SEQ ID NO: 1584288 - protein, 20 aa, Staphylococcus aureus
NRLNGGFFGQVFTVYYNDKY

SEQ ID NO: 1584289 - protein, 28 aa, Staphylococcus aureus
NSFERQAVKLPGKVKNGVVVDQVDNNGL

SEQ ID NO: 1584290 - protein, 25 aa, Staphylococcus aureus
NSILLKSILSLGIIYGGTFGIYPKA

SEQ ID NO: 1584291 - protein, 17 aa, Staphylococcus aureus
NSLLRIPYENGFFNMLY

SEQ ID NO: 1584292 - protein, 17 aa, Staphylococcus aureus
NSMHPSDSMSMHHTHST

SEQ ID NO: 1584293 - protein, 21 aa, Staphylococcus aureus
NSRTLIFPYIPDKAVYNAIVK

SEQ ID NO: 1584294 - protein, 21 aa, Staphylococcus aureus
NTAIMTLFIGLILLVVSLVTR

SEQ ID NO: 1584295 - protein, 32 aa, Staphylococcus aureus
NTDEKVLKDNEHSPLLFAKRRKDKEEDVETTT

SEQ ID NO: 1584296 - protein, 29 aa, Staphylococcus aureus
NTEQQFPPRNAQRRKRRRDLATNHNKQHH

SEQ ID NO: 1584297 - protein, 25 aa, Staphylococcus aureus
NTFDWKDVEQAFSWSETGKMNMAYE

SEQ ID NO: 1584298 - protein, 18 aa, Staphylococcus aureus
NTIISWTIGIIGLGFTIA

SEQ ID NO: 1584299 - protein, 39 aa, Staphylococcus aureus
NTINKRINFIFGVIIFIFAVLVLRLGYLQIAQGSHYKQI

SEQ ID NO: 1584300 - protein, 23 aa, Staphylococcus aureus
NTITYKFTDYVDRYENVNAKLEL

SEQ ID NO: 1584301 - protein, 33 aa, Staphylococcus aureus
NTKDDVKATLTVPAYIDPEYVTHTGNVTLATGI

SEQ ID NO: 1584302 - protein, 20 aa, Staphylococcus aureus
NTKRIISFLLILSAITVLIM

SEQ ID NO: 1584303 - protein, 23 aa, Staphylococcus aureus
NTLKGALPVGFLGIGEPLIYGVT

SEQ ID NO: 1584304 - protein, 23 aa, Staphylococcus aureus
NTLNQAMHGLRQSIQDNAATKAN

SEQ ID NO: 1584305 - protein, 21 aa, Staphylococcus aureus
NTNATLFDAMVALLGSLLLFR

SEQ ID NO: 1584306 - protein, 20 aa, Staphylococcus aureus
NTNATLFGAMMALLGSLLLF

SEQ ID NO: 1584307 - protein, 27 aa, Staphylococcus aureus
NTNATLFGAMMALLGSLLLFRKRKQDH

SEQ ID NO: 1584308 - protein, 28 aa, Staphylococcus aureus
NTNATLFGAMMALLGSLLLFRKRKQDHK

SEQ ID NO: 1584309 - protein, 19 aa, Staphylococcus aureus
NTNQLIDVTEQFKDKITYG

SEQ ID NO: 1584310 - protein, 36 aa, Staphylococcus aureus
NTSIKVYKVDNVADLSESYFVNPENFEDVTNSVNIT

SEQ ID NO: 1584311 - protein, 20 aa, Staphylococcus aureus
NTVKQSVKFTDADKAKRDAY

SEQ ID NO: 1584312 - protein, 24 aa, Staphylococcus aureus
NTWWEFIPALILAGSATYLYLKLY

SEQ ID NO: 1584313 - protein, 40 aa, Staphylococcus aureus
NTYTKETFVSTLTGYKFNPDAKNFKIYEVTDQNQFVDSFT

SEQ ID NO: 1584314 - protein, 24 aa, Staphylococcus aureus
NVASEGWGNINYVILPIFLSIFIL

SEQ ID NO: 1584315 - protein, 20 aa, Staphylococcus aureus
NVFLLTWDIRGLTSYIFSFL

SEQ ID NO: 1584316 - protein, 17 aa, Staphylococcus aureus
NVIAPVLTGNLKPNTES

SEQ ID NO: 1584317 - protein, 19 aa, Staphylococcus aureus
NVILYSRYIMMIFATILVV

SEQ ID NO: 1584318 - protein, 17 aa, Staphylococcus aureus
NVIRHTKDLIKHMPNIF

SEQ ID NO: 1584319 - protein, 25 aa, Staphylococcus aureus
NVKLGLNITCLFEKPSVFKSLVSQI

SEQ ID NO: 1584320 - protein, 19 aa, Staphylococcus aureus
NVQNLILYISWIFMTMLFM

SEQ ID NO: 1584321 - protein, 18 aa, Staphylococcus aureus
NVSRKVVVQLTKFEKVLY

SEQ ID NO: 1584322 - protein, 25 aa, Staphylococcus aureus
NVYMFKTALKLAGDPYYSGMALLSD

SEQ ID NO: 1584323 - protein, 18 aa, Staphylococcus aureus
NWLSNTWSSIRTNTIGKA

SEQ ID NO: 1584324 - protein, 28 aa, Staphylococcus aureus
NWVSPYKTRMILGFIMSFLNAIFIALPI

SEQ ID NO: 1584325 - protein, 28 aa, Staphylococcus aureus
NWVSPYKTRMILGFTMSFLNAIFIALPI

SEQ ID NO: 1584326 - protein, 26 aa, Staphylococcus aureus
NYAKSWLKHLLSYIIGTGILHLIVYL

SEQ ID NO: 1584327 - protein, 26 aa, Staphylococcus aureus
NYDITEMHWTLWKYLILTCLVVLICL

SEQ ID NO: 1584328 - protein, 19 aa, Staphylococcus aureus
NYGLKYIKGKIVVFRLIIL

SEQ ID NO: 1584329 - protein, 19 aa, Staphylococcus aureus
NYLKSVLIGLVSVAMIIVL

SEQ ID NO: 1584330 - protein, 20 aa, Staphylococcus aureus
NYLVDLSFNFHDWLLDLFTR

SEQ ID NO: 1584331 - protein, 20 aa, Staphylococcus aureus
NYPGPVSDIARVKKLDNLID

SEQ ID NO: 1584332 - protein, 25 aa, Staphylococcus aureus
NYTCNLDLFILRLVLLSCLFILTIS

SEQ ID NO: 1584333 - protein, 22 aa, Staphylococcus aureus
PAEPGKPLPPAKEEPKKPSKPV

SEQ ID NO: 1584334 - protein, 19 aa, Staphylococcus aureus
PAGILGLLFDDFIEEHLFS

SEQ ID NO: 1584335 - protein, 18 aa, Staphylococcus aureus
PAGLLGGAYYLKRREEKG

SEQ ID NO: 1584336 - protein, 19 aa, Staphylococcus aureus
PAPSKVVLLPTHRGTVSSG

SEQ ID NO: 1584337 - protein, 19 aa, Staphylococcus aureus
PAPSKVVLLSTHRGTVSSG

SEQ ID NO: 1584338 - protein, 17 aa, Staphylococcus aureus
PASMLAIEFGWFLTEMG

SEQ ID NO: 1584339 - protein, 19 aa, Staphylococcus aureus
PDEITRALTQVTDAKNGLN

SEQ ID NO: 1584340 - protein, 19 aa, Staphylococcus aureus
PDLIRYGQPKDHGDYYEVT

SEQ ID NO: 1584341 - protein, 18 aa, Staphylococcus aureus
PDNFSFLIAITILIAIAI

SEQ ID NO: 1584342 - protein, 17 aa, Staphylococcus aureus
PDTGDVVERGEPTTEVT

SEQ ID NO: 1584343 - protein, 23 aa, Staphylococcus aureus
PDTGELKGALGVEKIFDSYLSGS

SEQ ID NO: 1584344 - protein, 20 aa, Staphylococcus aureus
PDTSKLIDVTDKFKITYSND

SEQ ID NO: 1584345 - protein, 17 aa, Staphylococcus aureus
PEEALYRGFAILVGGVL

SEQ ID NO: 1584346 - protein, 22 aa, Staphylococcus aureus
PEHHYQFGGSLIKSKNLSTLLK

SEQ ID NO: 1584347 - protein, 17 aa, Staphylococcus aureus
PEHNYQFGGAMIESERL

SEQ ID NO: 1584348 - protein, 20 aa, Staphylococcus aureus
PEKYKSYFIGDWYVSGDSAY

SEQ ID NO: 1584349 - protein, 20 aa, Staphylococcus aureus
PEQKEAAIAEVNKLKQQAIE

SEQ ID NO: 1584350 - protein, 21 aa, Staphylococcus aureus
PESQQAYFLNVIFLMIVLFVL

SEQ ID NO: 1584351 - protein, 22 aa, Staphylococcus aureus
PEVPSEPGTPVPPTPEVPAEPG

SEQ ID NO: 1584352 - protein, 24 aa, Staphylococcus aureus
PFADLAILLGINWLAILLYIEAFV

SEQ ID NO: 1584353 - protein, 20 aa, Staphylococcus aureus
PFEKYSLYIINDFKTFIDCT

SEQ ID NO: 1584354 - protein, 19 aa, Staphylococcus aureus
PFFEYARSFDFIIVSDIGL

SEQ ID NO: 1584355 - protein, 17 aa, Staphylococcus aureus
PFGELFSGVFMGMFIIV

SEQ ID NO: 1584356 - protein, 17 aa, Staphylococcus aureus
PFHENKKTLTIEMPDKM

SEQ ID NO: 1584357 - protein, 24 aa, Staphylococcus aureus
PFINPKLGKNIPFMLGLFSGGLIF

SEQ ID NO: 1584358 - protein, 22 aa, Staphylococcus aureus
PFISYGGSALWSMMTGIGIVLS

SEQ ID NO: 1584359 - protein, 27 aa, Staphylococcus aureus
PFIVAKDGLFPKWFAKENKNKAPVNAL

SEQ ID NO: 1584360 - protein, 18 aa, Staphylococcus aureus
PFLTACIGGGIGGAVTGG

SEQ ID NO: 1584361 - protein, 21 aa, Staphylococcus aureus
PFSGILIHWILFFLMILFVLV

SEQ ID NO: 1584362 - protein, 17 aa, Staphylococcus aureus
PFVGRLSDRFGDKRLII

SEQ ID NO: 1584363 - protein, 21 aa, Staphylococcus aureus
PFVGSDSWQHFVLPIFTIVVI

SEQ ID NO: 1584364 - protein, 27 aa, Staphylococcus aureus
PFVLAPIVNVWIFKLFVEVLGMNSFSV

SEQ ID NO: 1584365 - protein, 18 aa, Staphylococcus aureus
PFVSYARLSGNSTFKTTV

SEQ ID NO: 1584366 - protein, 35 aa, Staphylococcus aureus
PFWAKVALIGIQVWLGFPFVFALFTGVLQSISSDW

SEQ ID NO: 1584367 - protein, 22 aa, Staphylococcus aureus
PFYKKHSTLLFATLLIAFGYLS

SEQ ID NO: 1584368 - protein, 17 aa, Staphylococcus aureus
PGEKIAMDGIIINGVSA

SEQ ID NO: 1584369 - protein, 21 aa, Staphylococcus aureus
PGICLVLLIILIGGYVIMTKT

SEQ ID NO: 1584370 - protein, 17 aa, Staphylococcus aureus
PGIGHKIIGFTALIVIL

SEQ ID NO: 1584371 - protein, 18 aa, Staphylococcus aureus
PGPGLGILLAYMIFGKGT

SEQ ID NO: 1584372 - protein, 31 aa, Staphylococcus aureus
PHAGQRAVLKYKLKFEDGLHQGDYFDFTLSN

SEQ ID NO: 1584373 - protein, 17 aa, Staphylococcus aureus
PHALKAFPSAINQDNYP

SEQ ID NO: 1584374 - protein, 32 aa, Staphylococcus aureus
PHEGQRAILKYKLKFENGLHQGDFFDFTLSKN

SEQ ID NO: 1584375 - protein, 22 aa, Staphylococcus aureus
PIGGVLFIIGWIMLIIATFKFA

SEQ ID NO: 1584376 - protein, 38 aa, Staphylococcus aureus
PIGIKFRLLKIGLILFCVLFFLFPVILMFVFSPEEDKQ

SEQ ID NO: 1584377 - protein, 30 aa, Staphylococcus aureus
PIGVKLRLLKWIFIVLCISFFLFPVILLFV

SEQ ID NO: 1584378 - protein, 32 aa, Staphylococcus aureus
PIINVWLISQWGWRFAWQFWGILILLLFIPIV

SEQ ID NO: 1584379 - protein, 25 aa, Staphylococcus aureus
PIKLVKRKKYLSIIMYLLVLILSLI

SEQ ID NO: 1584380 - protein, 30 aa, Staphylococcus aureus
PILAISAWLYPNFILDFIFIIIMLFLVSLT

SEQ ID NO: 1584381 - protein, 23 aa, Staphylococcus aureus
PILEELLFRVYILEVLKNKIKLL

SEQ ID NO: 1584382 - protein, 27 aa, Staphylococcus aureus
PILYRFFKRIHLGWFVLPIPIVIFIYM

SEQ ID NO: 1584383 - protein, 18 aa, Staphylococcus aureus
PISTYWFHAQFWNDRAKD

SEQ ID NO: 1584384 - protein, 21 aa, Staphylococcus aureus
PIVFCAWPYYNVHMTCPTTSP

SEQ ID NO: 1584385 - protein, 18 aa, Staphylococcus aureus
PKIIMSIILLATFSGALM

SEQ ID NO: 1584386 - protein, 22 aa, Staphylococcus aureus
PKKDYQVFFLSRLNKPAKYKKD

SEQ ID NO: 1584387 - protein, 23 aa, Staphylococcus aureus
PKLAFEIPLRYKIMGIVGSVWGI

SEQ ID NO: 1584388 - protein, 17 aa, Staphylococcus aureus
PKLAFSIVYTNQPVPPP

SEQ ID NO: 1584389 - protein, 25 aa, Staphylococcus aureus
PKLFITFPRRYRNVFLMMVVVGLFG

SEQ ID NO: 1584390 - protein, 22 aa, Staphylococcus aureus
PKSKRKSRFFIISMVLAVTCFI

SEQ ID NO: 1584391 - protein, 18 aa, Staphylococcus aureus
PKYKLSVDEIIKKEHLDK

SEQ ID NO: 1584392 - protein, 19 aa, Staphylococcus aureus
PLFFIYKYHQPMFGRLSSQ

SEQ ID NO: 1584393 - protein, 26 aa, Staphylococcus aureus
PLILIVVVVGFGIYFYASKDKEINNT

SEQ ID NO: 1584394 - protein, 17 aa, Staphylococcus aureus
PLILKIILNLALIGIVI

SEQ ID NO: 1584395 - protein, 18 aa, Staphylococcus aureus
PLLIAKRRKDKEVDVETT

SEQ ID NO: 1584396 - protein, 17 aa, Staphylococcus aureus
PLMKLNLAYLKAHAPSI

SEQ ID NO: 1584397 - protein, 22 aa, Staphylococcus aureus
PLNEMPHLLVAGSTGSGKSVCI

SEQ ID NO: 1584398 - protein, 28 aa, Staphylococcus aureus
PLNPEVIKWAKKVYGLTVLDTWWMTETG

SEQ ID NO: 1584399 - protein, 23 aa, Staphylococcus aureus
PLNYLVDLSFNFHDWLLDLFTRI

SEQ ID NO: 1584400 - protein, 17 aa, Staphylococcus aureus
PLVGWLMKKTDQLIQPR

SEQ ID NO: 1584401 - protein, 25 aa, Staphylococcus aureus
PMIIICLFVFLSLRIQNSEHFYSAV

SEQ ID NO: 1584402 - protein, 18 aa, Staphylococcus aureus
PMMSEFFDLPGVSIATGS

SEQ ID NO: 1584403 - protein, 19 aa, Staphylococcus aureus
PMTMFRQRFQGLRKDQPVY

SEQ ID NO: 1584404 - protein, 17 aa, Staphylococcus aureus
PNALAGIFGISYSSVNR

SEQ ID NO: 1584405 - protein, 28 aa, Staphylococcus aureus
PNDFKMAFKAPRAVIIGVCLQFSIMPTL

SEQ ID NO: 1584406 - protein, 25 aa, Staphylococcus aureus
PNKTQWWLVIPVGLVYAVIYYFVFR

SEQ ID NO: 1584407 - protein, 27 aa, Staphylococcus aureus
PNKVIRFILRTAIGYSVFAYGLHFFSN

SEQ ID NO: 1584408 - protein, 27 aa, Staphylococcus aureus
PNKVIRFILRTAIGYSVFAYGLHYFSN

SEQ ID NO: 1584409 - protein, 18 aa, Staphylococcus aureus
PNRMGNLAIKKGWPSMMY

SEQ ID NO: 1584410 - protein, 17 aa, Staphylococcus aureus
PNVKIYEYVGVENGLPQ

SEQ ID NO: 1584411 - protein, 23 aa, Staphylococcus aureus
PPGDAYLKVIAVLLIAAVVSLFV

SEQ ID NO: 1584412 - protein, 20 aa, Staphylococcus aureus
PPLFFGGSWDTWVYQGLAVL

SEQ ID NO: 1584413 - protein, 24 aa, Staphylococcus aureus
PPLQAIKFQLLVVFIHTTATIMSA

SEQ ID NO: 1584414 - protein, 18 aa, Staphylococcus aureus
PRFSIHQFIAKEAIPVAV

SEQ ID NO: 1584415 - protein, 21 aa, Staphylococcus aureus
PRTALESKPRVTRSTDVAEAK

SEQ ID NO: 1584416 - protein, 18 aa, Staphylococcus aureus
PRVTRSADVVEAKEGMGV

SEQ ID NO: 1584417 - protein, 22 aa, Staphylococcus aureus
PRYFFVVVGMRVRLKMNAVSLA

SEQ ID NO: 1584418 - protein, 18 aa, Staphylococcus aureus
PSGHALSSTMVIMILLFL

SEQ ID NO: 1584419 - protein, 18 aa, Staphylococcus aureus
PSGKRINAIQILNKETGK

SEQ ID NO: 1584420 - protein, 21 aa, Staphylococcus aureus
PSGKRINAIQILNKETGKFEN

SEQ ID NO: 1584421 - protein, 21 aa, Staphylococcus aureus
PSKPVERGKVVTPVIEINEKV

SEQ ID NO: 1584422 - protein, 29 aa, Staphylococcus aureus
PSLGFALGWNYWFNWVVTVAADIMIAAQV

SEQ ID NO: 1584423 - protein, 19 aa, Staphylococcus aureus
PSLIARIASIFSKEPDTFN

SEQ ID NO: 1584424 - protein, 19 aa, Staphylococcus aureus
PSLLLMGLIPIIFFVPNIL

SEQ ID NO: 1584425 - protein, 17 aa, Staphylococcus aureus
PSLYGHKVLIACLLVLF

SEQ ID NO: 1584426 - protein, 22 aa, Staphylococcus aureus
PSNPKGEVNHSNKVSKQHKTDA

SEQ ID NO: 1584427 - protein, 23 aa, Staphylococcus aureus
PSNPKGEVNHSNKVSKQHKTDAL

SEQ ID NO: 1584428 - protein, 27 aa, Staphylococcus aureus
PSSVAGGGAFGAFVTTDSYGVASTYTS

SEQ ID NO: 1584429 - protein, 33 aa, Staphylococcus aureus
PTIGGIILNYSVWRMVFVILTIFGFVMVIGSLL

SEQ ID NO: 1584430 - protein, 24 aa, Staphylococcus aureus
PTLKRMKFGQSIREEGPQNHMKKT

SEQ ID NO: 1584431 - protein, 17 aa, Staphylococcus aureus
PTLLRLIDITGFSFPSG

SEQ ID NO: 1584432 - protein, 23 aa, Staphylococcus aureus
PVAHWVWGGSWINKLGVLDFAGG

SEQ ID NO: 1584433 - protein, 26 aa, Staphylococcus aureus
PVFNEKMKSLAFIGVAFQINLTVQYL

SEQ ID NO: 1584434 - protein, 27 aa, Staphylococcus aureus
PVKGRARTNPWIKWMNIVLTLAVILAM

SEQ ID NO: 1584435 - protein, 18 aa, Staphylococcus aureus
PVLATWRGIFQGYKSMGP

SEQ ID NO: 1584436 - protein, 25 aa, Staphylococcus aureus
PVRLIKRKKYYAIIVSLIFFIITLI

SEQ ID NO: 1584437 - protein, 31 aa, Staphylococcus aureus
PVVRCLPLIISCLKLILILLFLLSIILVIYQ

SEQ ID NO: 1584438 - protein, 22 aa, Staphylococcus aureus
PWKGVYVLAITLWIATWWITEA

SEQ ID NO: 1584439 - protein, 17 aa, Staphylococcus aureus
PYLKCGYIIPLQFGHFK

SEQ ID NO: 1584440 - protein, 24 aa, Staphylococcus aureus
PYLRLLFTIIFSLKCKIHLFFNSI

SEQ ID NO: 1584441 - protein, 27 aa, Staphylococcus aureus
PYYPNYYYPVQLTWNNGVAFYSNSAQG

SEQ ID NO: 1584442 - protein, 24 aa, Staphylococcus aureus
QAEECYKRKLFLPAAATLSVALET

SEQ ID NO: 1584443 - protein, 17 aa, Staphylococcus aureus
QAGFFLILACQRPDAKY

SEQ ID NO: 1584444 - protein, 34 aa, Staphylococcus aureus
QAIYFYPRFKRSMIGISVAMIWVFLNDYIDYFHL

SEQ ID NO: 1584445 - protein, 19 aa, Staphylococcus aureus
QAKERLAQALQDIKDLVKA

SEQ ID NO: 1584446 - protein, 21 aa, Staphylococcus aureus
QAKGAVIALGIIVLYVFLGLA

SEQ ID NO: 1584447 - protein, 17 aa, Staphylococcus aureus
QALESQINNAATRDEVA

SEQ ID NO: 1584448 - protein, 19 aa, Staphylococcus aureus
QALESQINNAATRGEVAQK

SEQ ID NO: 1584449 - protein, 23 aa, Staphylococcus aureus
QALLYEWSRINSMLDTQLYITRL

SEQ ID NO: 1584450 - protein, 17 aa, Staphylococcus aureus
QALNQAMEALRNSIQDQ

SEQ ID NO: 1584451 - protein, 18 aa, Staphylococcus aureus
QAMEALRNSIQDQQQTEA

SEQ ID NO: 1584452 - protein, 21 aa, Staphylococcus aureus
QARYPGRFNININVEDKYRDV

SEQ ID NO: 1584453 - protein, 25 aa, Staphylococcus aureus
QAVAKAEALISATPDVVVTPSEITA

SEQ ID NO: 1584454 - protein, 29 aa, Staphylococcus aureus
QAVNTSAPRMRAFSLAAVAADAPAAGKDI

SEQ ID NO: 1584455 - protein, 32 aa, Staphylococcus aureus
QAVNTSAPRMRAFSLAAVAADAPAAGKDITNQ

SEQ ID NO: 1584456 - protein, 33 aa, Staphylococcus aureus
QAVNTSAPRMRAFSLAAVAADAPAAGTDITNQL

SEQ ID NO: 1584457 - protein, 23 aa, Staphylococcus aureus
QAVSRISPKMGMMKNSVLNQSRN

SEQ ID NO: 1584458 - protein, 17 aa, Staphylococcus aureus
QAVYKKIHSTVVDNGGK

SEQ ID NO: 1584459 - protein, 41 aa, Staphylococcus aureus
QDAYSQKGAITLGTRIDSNKSFHFSGKVNLGNKYEGHGNGG

SEQ ID NO: 1584460 - protein, 24 aa, Staphylococcus aureus
QDGKRPEKVSVNLLANGEKVETVD

SEQ ID NO: 1584461 - protein, 17 aa, Staphylococcus aureus
QDIIKIIAKEASMDKKI

SEQ ID NO: 1584462 - protein, 22 aa, Staphylococcus aureus
QDVDKRVQALIDEIDQNPNLTD

SEQ ID NO: 1584463 - protein, 17 aa, Staphylococcus aureus
QEALANLDTLRDLNQPQ

SEQ ID NO: 1584464 - protein, 18 aa, Staphylococcus aureus
QEALANLDTLRDLNQPQR

SEQ ID NO: 1584465 - protein, 17 aa, Staphylococcus aureus
QEKRIDLYFKYNLKNYH

SEQ ID NO: 1584466 - protein, 17 aa, Staphylococcus aureus
QEKRIDLYFKYNLNHYS

SEQ ID NO: 1584467 - protein, 24 aa, Staphylococcus aureus
QFITIDFGSFFLMGIILILISSIF

SEQ ID NO: 1584468 - protein, 24 aa, Staphylococcus aureus
QFKAQLKAANPFAKELEKRKKSAI

SEQ ID NO: 1584469 - protein, 25 aa, Staphylococcus aureus
QFKAQLKAANPFAKELEKRKKSAIS

SEQ ID NO: 1584470 - protein, 20 aa, Staphylococcus aureus
QFYLLFPLVITFLLHRFRPR

SEQ ID NO: 1584471 - protein, 18 aa, Staphylococcus aureus
QGDFFDFTLSKNVNTHGV

SEQ ID NO: 1584472 - protein, 26 aa, Staphylococcus aureus
QGIAKAGAIFPLFSPVLGWIGVFMTG

SEQ ID NO: 1584473 - protein, 26 aa, Staphylococcus aureus
QGIAKAGAVFPLFSPVLGWIGVFMTG

SEQ ID NO: 1584474 - protein, 27 aa, Staphylococcus aureus
QGKKDLKAELDLNLFIDPTTVTKRGNQ

SEQ ID NO: 1584475 - protein, 18 aa, Staphylococcus aureus
QGLILLFILLCFPFTPNT

SEQ ID NO: 1584476 - protein, 27 aa, Staphylococcus aureus
QGSAAFGAWFVYKRQRRRLGITCISGM

SEQ ID NO: 1584477 - protein, 20 aa, Staphylococcus aureus
QGVTCNGLADPALIGLNSGA

SEQ ID NO: 1584478 - protein, 31 aa, Staphylococcus aureus
QHERRHLRPKISVTFLAWLLIFLMFALPIGI

SEQ ID NO: 1584479 - protein, 17 aa, Staphylococcus aureus
QHSISISLIFAVILCVS

SEQ ID NO: 1584480 - protein, 22 aa, Staphylococcus aureus
QIAIPTRIAIQNQIVTQIQIAI

SEQ ID NO: 1584481 - protein, 18 aa, Staphylococcus aureus
QIEFGRKGTNLTYQDKLK

SEQ ID NO: 1584482 - protein, 17 aa, Staphylococcus aureus
QIILYCANYMYIVIYAY

SEQ ID NO: 1584483 - protein, 19 aa, Staphylococcus aureus
QIITFKAFELVGSSRAMPV

SEQ ID NO: 1584484 - protein, 21 aa, Staphylococcus aureus
QILLQICSLYYHGRRFNEVIK

SEQ ID NO: 1584485 - protein, 19 aa, Staphylococcus aureus
QIQEGFKMAFNEKDGTGYV

SEQ ID NO: 1584486 - protein, 25 aa, Staphylococcus aureus
QIQSFKMIVVIAFWGAIVVTVLVVA

SEQ ID NO: 1584487 - protein, 26 aa, Staphylococcus aureus
QIVVQILAAILIQIAVQIRVVILHQI

SEQ ID NO: 1584488 - protein, 27 aa, Staphylococcus aureus
QIVVQILAAILIQIAVQIRVVILHQIV

SEQ ID NO: 1584489 - protein, 19 aa, Staphylococcus aureus
QIVYCRKAKALVVGNQNWI

SEQ ID NO: 1584490 - protein, 24 aa, Staphylococcus aureus
QKAALKIAEFYSEYLHSSKKNIYH

SEQ ID NO: 1584491 - protein, 23 aa, Staphylococcus aureus
QKECWPVYLIVTAIAIVVPCILT

SEQ ID NO: 1584492 - protein, 19 aa, Staphylococcus aureus
QKERIIIYMKYNVKGFKEI

SEQ ID NO: 1584493 - protein, 19 aa, Staphylococcus aureus
QKLPSLIMYGFSINEKYIK

SEQ ID NO: 1584494 - protein, 23 aa, Staphylococcus aureus
QKRIQYSVITILVLLIAVILIYM

SEQ ID NO: 1584495 - protein, 18 aa, Staphylococcus aureus
QKVIFPFIIASGFIADTT

SEQ ID NO: 1584496 - protein, 30 aa, Staphylococcus aureus
QLAGLKFSISLKVIERLLLALILPLVILII

SEQ ID NO: 1584497 - protein, 24 aa, Staphylococcus aureus
QLDAKAWRKTFPPKKDGDKEKVVP

SEQ ID NO: 1584498 - protein, 17 aa, Staphylococcus aureus
QLFKRRYNRFYGNDVGE

SEQ ID NO: 1584499 - protein, 19 aa, Staphylococcus aureus
QLIIGHIWHDIGLSYLRSI

SEQ ID NO: 1584500 - protein, 23 aa, Staphylococcus aureus
QLIQPRTSQGFEMLFNNFSAGIL

SEQ ID NO: 1584501 - protein, 18 aa, Staphylococcus aureus
QLLPIIGIPLPFISYGGS

SEQ ID NO: 1584502 - protein, 27 aa, Staphylococcus aureus
QLRNIGYFHGFKGYNFFLNKEEELNFE

SEQ ID NO: 1584503 - protein, 26 aa, Staphylococcus aureus
QLSMCLNMNLQLIRLLLHMIKLLLHL

SEQ ID NO: 1584504 - protein, 26 aa, Staphylococcus aureus
QMFGYPEQRYGYYYNSYQLTWDNGLV

SEQ ID NO: 1584505 - protein, 23 aa, Staphylococcus aureus
QMIFPTKHAIGLVSDSGLELLIH

SEQ ID NO: 1584506 - protein, 28 aa, Staphylococcus aureus
QNEPLPNRKDFVVSFITGALVGSALGLY

SEQ ID NO: 1584507 - protein, 24 aa, Staphylococcus aureus
QNGNQPKVRVFEYLGNNEDIAKSV

SEQ ID NO: 1584508 - protein, 23 aa, Staphylococcus aureus
QNIIGFLALFGMIAAFFIANRSS

SEQ ID NO: 1584509 - protein, 34 aa, Staphylococcus aureus
QNINGKFSLPLFTDRAKAPKSGIYDANINIADEM

SEQ ID NO: 1584510 - protein, 17 aa, Staphylococcus aureus
QNIYPAHVERLLTQSSS

SEQ ID NO: 1584511 - protein, 19 aa, Staphylococcus aureus
QPLVRYIFERIVMAVIVII

SEQ ID NO: 1584512 - protein, 24 aa, Staphylococcus aureus
QPTNNAFQDFDINYNGDTKVMTVT

SEQ ID NO: 1584513 - protein, 26 aa, Staphylococcus aureus
QQFPPRNAQRRKRRRDLATNHNKQVH

SEQ ID NO: 1584514 - protein, 20 aa, Staphylococcus aureus
QQRIEINVVPVLNTKMLTTK

SEQ ID NO: 1584515 - protein, 20 aa, Staphylococcus aureus
QRKDMFCDYVSLKRMVIDEI

SEQ ID NO: 1584516 - protein, 34 aa, Staphylococcus aureus
QRLNGLRQVVNRTYRIGTTKRVEVRQGNVQTKKV

SEQ ID NO: 1584517 - protein, 22 aa, Staphylococcus aureus
QRLVIIPFILAVSVLFMIEYTL

SEQ ID NO: 1584518 - protein, 18 aa, Staphylococcus aureus
QRNIKFSDMLDVKFYSLD

SEQ ID NO: 1584519 - protein, 20 aa, Staphylococcus aureus
QRRALKYKRLVDEEVDNEET

SEQ ID NO: 1584520 - protein, 21 aa, Staphylococcus aureus
QRRKEIGKPVPLTWGNGGDWG

SEQ ID NO: 1584521 - protein, 17 aa, Staphylococcus aureus
QSFIIGITFLILVIGTC

SEQ ID NO: 1584522 - protein, 17 aa, Staphylococcus aureus
QSGGSKNGGTWNPNASD

SEQ ID NO: 1584523 - protein, 37 aa, Staphylococcus aureus
QSGNTFMAAKFTVTGQVKAGDYFTAKLPDSVNGNGDV

SEQ ID NO: 1584524 - protein, 42 aa, Staphylococcus aureus
QSGNTFMAANFKVAGKVKSGDYFTAKLPDSVTGNGDVDYSNS

SEQ ID NO: 1584525 - protein, 25 aa, Staphylococcus aureus
QSHFSVPKFNDWIFIIFIISVYYIF

SEQ ID NO: 1584526 - protein, 21 aa, Staphylococcus aureus
QSHLDSGFMFFFIVYVLCISY

SEQ ID NO: 1584527 - protein, 18 aa, Staphylococcus aureus
QSMTVRLGIATGMDLAQM

SEQ ID NO: 1584528 - protein, 20 aa, Staphylococcus aureus
QSNSTGIGLFIVKQISNHTN

SEQ ID NO: 1584529 - protein, 19 aa, Staphylococcus aureus
QSPITFWYGKYIILIPSSY

SEQ ID NO: 1584530 - protein, 25 aa, Staphylococcus aureus
QSVYLKRYLLRAMMAGFIIGIITVF

SEQ ID NO: 1584531 - protein, 24 aa, Staphylococcus aureus
QSYIRRLFGYTAIHFIITSDFENK

SEQ ID NO: 1584532 - protein, 22 aa, Staphylococcus aureus
QTCRFIIVGVLANFAMYGMLTA

SEQ ID NO: 1584533 - protein, 17 aa, Staphylococcus aureus
QTHCYGVVEWKGRQYSI

SEQ ID NO: 1584534 - protein, 22 aa, Staphylococcus aureus
QTPFYQQFHILKVLPSYKSVLK

SEQ ID NO: 1584535 - protein, 21 aa, Staphylococcus aureus
QTTELGKFFIGKYSIKTDKTI

SEQ ID NO: 1584536 - protein, 21 aa, Staphylococcus aureus
QVCNFYPERIILLGHGENSIY

SEQ ID NO: 1584537 - protein, 29 aa, Staphylococcus aureus
QVQPLNKYPVVFVHGFLGLVGDNAPALYP

SEQ ID NO: 1584538 - protein, 18 aa, Staphylococcus aureus
QYLYLTGRQHDMLIIGGQ

SEQ ID NO: 1584539 - protein, 19 aa, Staphylococcus aureus
QYVIEWVTLLILLVIIIAY

SEQ ID NO: 1584540 - protein, 22 aa, Staphylococcus aureus
RANRNFRFFQIFTAALQSFSHG

SEQ ID NO: 1584541 - protein, 24 aa, Staphylococcus aureus
RARHFGLMSACFGVGMVAGPVAGG

SEQ ID NO: 1584542 - protein, 19 aa, Staphylococcus aureus
RAYSLEWFPVAIIATILGY

SEQ ID NO: 1584543 - protein, 21 aa, Staphylococcus aureus
RCDEVKDFYDDLSIKLVRPFG

SEQ ID NO: 1584544 - protein, 18 aa, Staphylococcus aureus
RCQDGIVLFWPIDGEIEL

SEQ ID NO: 1584545 - protein, 19 aa, Staphylococcus aureus
RDEDSWLASFEVNEMLMLK

SEQ ID NO: 1584546 - protein, 27 aa, Staphylococcus aureus
RDELSYHKKIECDWKLLNQLTKRAYTN

SEQ ID NO: 1584547 - protein, 22 aa, Staphylococcus aureus
RDGKTAMLIAVNYSLTGIITVA

SEQ ID NO: 1584548 - protein, 21 aa, Staphylococcus aureus
RDIRILSGMRHLFPKMNLVMT

SEQ ID NO: 1584549 - protein, 22 aa, Staphylococcus aureus
RDLEINARFFVVTTSYIDKIEQ

SEQ ID NO: 1584550 - protein, 17 aa, Staphylococcus aureus
RDNHLKLNLLYQDLEIK

SEQ ID NO: 1584551 - protein, 23 aa, Staphylococcus aureus
RDSKRVVLYISIMVLSIFIIGCG

SEQ ID NO: 1584552 - protein, 26 aa, Staphylococcus aureus
RDYPIIQGCVLFIGFFVVLINSIADL

SEQ ID NO: 1584553 - protein, 17 aa, Staphylococcus aureus
REFSKLIGFLIIALIAV

SEQ ID NO: 1584554 - protein, 17 aa, Staphylococcus aureus
REIDALKLFSKNHSEYV

SEQ ID NO: 1584555 - protein, 18 aa, Staphylococcus aureus
RERLILFFIAVMLSSAAV

SEQ ID NO: 1584556 - protein, 23 aa, Staphylococcus aureus
RESKNFWQDAWAQLKRNKLAVVG

SEQ ID NO: 1584557 - protein, 24 aa, Staphylococcus aureus
RESRCINMLFVILVLYVTGIAFIL

SEQ ID NO: 1584558 - protein, 28 aa, Staphylococcus aureus
RFCYITLPLPLFFTIKWVILNNGYLRII

SEQ ID NO: 1584559 - protein, 29 aa, Staphylococcus aureus
RFDNLDSGKYKVIFEKPAGLKQTGTNTTE

SEQ ID NO: 1584560 - protein, 30 aa, Staphylococcus aureus
RFDNLDSGKYKVIFEKPAGLKQTGTNTTED

SEQ ID NO: 1584561 - protein, 19 aa, Staphylococcus aureus
RFFGKQGFNCMGCNWHNHC

SEQ ID NO: 1584562 - protein, 17 aa, Staphylococcus aureus
RFHDISRTMLFPMIMTA

SEQ ID NO: 1584563 - protein, 26 aa, Staphylococcus aureus
RFHDISRTMLFPTIMTVFSIIFYIVL

SEQ ID NO: 1584564 - protein, 27 aa, Staphylococcus aureus
RFIETPIRRKGFKAFAFLPKKKGQFAR

SEQ ID NO: 1584565 - protein, 19 aa, Staphylococcus aureus
RFIIIIAGIFCFGMSLYLI

SEQ ID NO: 1584566 - protein, 20 aa, Staphylococcus aureus
RFLIVKLKYKTPGREDKQSQ

SEQ ID NO: 1584567 - protein, 17 aa, Staphylococcus aureus
RFLNHFYDYKAGMDELR

SEQ ID NO: 1584568 - protein, 19 aa, Staphylococcus aureus
RFVDPSLGFALGWNYWFNW

SEQ ID NO: 1584569 - protein, 17 aa, Staphylococcus aureus
RGDYFDFTLSNNVNTYG

SEQ ID NO: 1584570 - protein, 18 aa, Staphylococcus aureus
RGDYFDFTLSNNVNTYGV

SEQ ID NO: 1584571 - protein, 19 aa, Staphylococcus aureus
RGSIIPNYVMGMSFITEGA

SEQ ID NO: 1584572 - protein, 18 aa, Staphylococcus aureus
RGTALQKVPVNISGIPLD

SEQ ID NO: 1584573 - protein, 20 aa, Staphylococcus aureus
RHLLLFPGILLQGAAIAALV

SEQ ID NO: 1584574 - protein, 17 aa, Staphylococcus aureus
RHTHCSYLLAKGVSIHY

SEQ ID NO: 1584575 - protein, 22 aa, Staphylococcus aureus
RIEAKLSRKVIYLLSFTLLLVS

SEQ ID NO: 1584576 - protein, 17 aa, Staphylococcus aureus
RIILPPLILSISNEIKY

SEQ ID NO: 1584577 - protein, 19 aa, Staphylococcus aureus
RILYTCFILFIYILGSNIS

SEQ ID NO: 1584578 - protein, 18 aa, Staphylococcus aureus
RISAVQIVTSDRAKQSSS

SEQ ID NO: 1584579 - protein, 19 aa, Staphylococcus aureus
RITKSFKQLISLSVFLGEL

SEQ ID NO: 1584580 - protein, 18 aa, Staphylococcus aureus
RIVDKEAFTKANADKSNK

SEQ ID NO: 1584581 - protein, 20 aa, Staphylococcus aureus
RIVGPRHQLFLPIAILVGAC

SEQ ID NO: 1584582 - protein, 20 aa, Staphylococcus aureus
RKEFSIFMTLGMTKKSMRLI

SEQ ID NO: 1584583 - protein, 21 aa, Staphylococcus aureus
RKEFSIFMTLGMTKKSMRLIV

SEQ ID NO: 1584584 - protein, 24 aa, Staphylococcus aureus
RKKTEFSPQLVIYMGGGMIIGSML

SEQ ID NO: 1584585 - protein, 19 aa, Staphylococcus aureus
RKLVIAICCITFIGILTFY

SEQ ID NO: 1584586 - protein, 21 aa, Staphylococcus aureus
RKMPLFMTIIFTVYFSNKKST

SEQ ID NO: 1584587 - protein, 20 aa, Staphylococcus aureus
RKNYSFILTKIMNQFKEIYN

SEQ ID NO: 1584588 - protein, 20 aa, Staphylococcus aureus
RKRKETLPKFFVLLKSIVKC

SEQ ID NO: 1584589 - protein, 18 aa, Staphylococcus aureus
RKSPAQIILMIQRNLFAL

SEQ ID NO: 1584590 - protein, 24 aa, Staphylococcus aureus
RKTTRHRIAIIGLLILVFMLTLSI

SEQ ID NO: 1584591 - protein, 24 aa, Staphylococcus aureus
RKTTRHRIAIIGLLILVYILTLSI

SEQ ID NO: 1584592 - protein, 32 aa, Staphylococcus aureus
RKYSVGTASILVGTTLIFGLSGHEAKAAEHTN

SEQ ID NO: 1584593 - protein, 34 aa, Staphylococcus aureus
RKYSVGTASILVGTTLIFGLSGHEAKAAEHTNGE

SEQ ID NO: 1584594 - protein, 18 aa, Staphylococcus aureus
RLANTLINSDHTNVNDIN

SEQ ID NO: 1584595 - protein, 17 aa, Staphylococcus aureus
RLHKVPMMMEGKWQSTI

SEQ ID NO: 1584596 - protein, 27 aa, Staphylococcus aureus
RLKGIILAIVSACLWGLGGTVSDFLFK

SEQ ID NO: 1584597 - protein, 19 aa, Staphylococcus aureus
RLLHVYSYGALLFGLILTA

SEQ ID NO: 1584598 - protein, 27 aa, Staphylococcus aureus
RLLLTLCIMGFLLFRTHIYIVYKTLEH

SEQ ID NO: 1584599 - protein, 18 aa, Staphylococcus aureus
RLNISSGAGSVRISDADL

SEQ ID NO: 1584600 - protein, 19 aa, Staphylococcus aureus
RLNISSGAGSVRISDVDLE

SEQ ID NO: 1584601 - protein, 24 aa, Staphylococcus aureus
RLNNRKSEALQRLNQLTHLNNAQR

SEQ ID NO: 1584602 - protein, 24 aa, Staphylococcus aureus
RLQTFKVIFALVITLCFIVGTYWV

SEQ ID NO: 1584603 - protein, 23 aa, Staphylococcus aureus
RLSEKSSGIGLYIVSTISKRLGH

SEQ ID NO: 1584604 - protein, 21 aa, Staphylococcus aureus
RLSLKNEIYPFFLTNKMNFDL

SEQ ID NO: 1584605 - protein, 25 aa, Staphylococcus aureus
RLSLKNEIYPFFLTNKMNFDLKKIE

SEQ ID NO: 1584606 - protein, 20 aa, Staphylococcus aureus
RLSQKKAFQIEFGRKGTNLT

SEQ ID NO: 1584607 - protein, 26 aa, Staphylococcus aureus
RLTLMRRGYENINMFTIIQLVTPFVT

SEQ ID NO: 1584608 - protein, 31 aa, Staphylococcus aureus
RLVIIPFILAVSVLCMIEYTLVSIGLNSYIK

SEQ ID NO: 1584609 - protein, 20 aa, Staphylococcus aureus
RMFIPNLFSLLASIIVLWLY

SEQ ID NO: 1584610 - protein, 18 aa, Staphylococcus aureus
RNEMIEFPNGKRVITPST

SEQ ID NO: 1584611 - protein, 20 aa, Staphylococcus aureus
RNFDMLPYFIIFDEVTAFTS

SEQ ID NO: 1584612 - protein, 19 aa, Staphylococcus aureus
RNGTHAGGILKMKGVLDNK

SEQ ID NO: 1584613 - protein, 19 aa, Staphylococcus aureus
RNGTHAGGILKMKGVLENK

SEQ ID NO: 1584614 - protein, 22 aa, Staphylococcus aureus
RNKIFFTLAMLVIFKIGTYIPA

SEQ ID NO: 1584615 - protein, 20 aa, Staphylococcus aureus
RNLGTLICYKIPLSRGNVDV

SEQ ID NO: 1584616 - protein, 18 aa, Staphylococcus aureus
RNTTLRNTLKGALPVGFL

SEQ ID NO: 1584617 - protein, 19 aa, Staphylococcus aureus
RPAGFLVTFLDIFKGFITV

SEQ ID NO: 1584618 - protein, 17 aa, Staphylococcus aureus
RPASFYKVEGFFYSHID

SEQ ID NO: 1584619 - protein, 20 aa, Staphylococcus aureus
RPGKTFSYTNNWPYDVDAGN

SEQ ID NO: 1584620 - protein, 20 aa, Staphylococcus aureus
RPILVAQLFLTFLIGFSEEF

SEQ ID NO: 1584621 - protein, 18 aa, Staphylococcus aureus
RQAAMNRINEIVLETIKD

SEQ ID NO: 1584622 - protein, 18 aa, Staphylococcus aureus
RQASLIRRMIVLLRGALL

SEQ ID NO: 1584623 - protein, 26 aa, Staphylococcus aureus
RQKLKKLGIRKGIPVVFSDESPIVIR

SEQ ID NO: 1584624 - protein, 19 aa, Staphylococcus aureus
RQRLTMVILNGVIGFVVTL

SEQ ID NO: 1584625 - protein, 19 aa, Staphylococcus aureus
RQSLPISTLYTGVGVLSTD

SEQ ID NO: 1584626 - protein, 25 aa, Staphylococcus aureus
RQSLPLSSLYTGVGVLNTDKGVVIS

SEQ ID NO: 1584627 - protein, 20 aa, Staphylococcus aureus
RQTMKSVIMPQAIKNILPSL

SEQ ID NO: 1584628 - protein, 30 aa, Staphylococcus aureus
RQVFLGKAGFFIMLGMLQALIVSVGDLLIL

SEQ ID NO: 1584629 - protein, 20 aa, Staphylococcus aureus
RQVFLVGISIFFLGTLLGGL

SEQ ID NO: 1584630 - protein, 19 aa, Staphylococcus aureus
RRKEIGKPVPLTWGNGGDW

SEQ ID NO: 1584631 - protein, 25 aa, Staphylococcus aureus
RRNKLKFGLIIGVLAMISYLLFLLS

SEQ ID NO: 1584632 - protein, 20 aa, Staphylococcus aureus
RRPMPLRAFNPVSSFRWARG

SEQ ID NO: 1584633 - protein, 28 aa, Staphylococcus aureus
RRQLRPKISATFLAWLLIFLMFALPIGI

SEQ ID NO: 1584634 - protein, 21 aa, Staphylococcus aureus
RSEYWYMMLWHLIFILPAFFV

SEQ ID NO: 1584635 - protein, 19 aa, Staphylococcus aureus
RSIVIFGGIAAAIGPVVFG

SEQ ID NO: 1584636 - protein, 17 aa, Staphylococcus aureus
RSKYYLFVSDPVMIGID

SEQ ID NO: 1584637 - protein, 22 aa, Staphylococcus aureus
RSRRDGFNPMRIILAGAAVSAM

SEQ ID NO: 1584638 - protein, 21 aa, Staphylococcus aureus
RTAKGYYFVRTFYRKDKLPDR

SEQ ID NO: 1584639 - protein, 28 aa, Staphylococcus aureus
RTFTQFTFKKSIIFAALFILIGFYDGFV

SEQ ID NO: 1584640 - protein, 29 aa, Staphylococcus aureus
RTIKEFILGVLFVPALVCFIFFAIFGASA

SEQ ID NO: 1584641 - protein, 22 aa, Staphylococcus aureus
RTIKEFILGVLFVPAVVCIIFF

SEQ ID NO: 1584642 - protein, 44 aa, Staphylococcus aureus
RTIYIATTFHASMTFGLIFLFSEEIGDLFSIKVITISTAIVAVG

SEQ ID NO: 1584643 - protein, 24 aa, Staphylococcus aureus
RTKIASLVKLFPILGMSISSLTLP

SEQ ID NO: 1584644 - protein, 25 aa, Staphylococcus aureus
RTLIFPYVPDKAIYNAIVKVVVANI

SEQ ID NO: 1584645 - protein, 18 aa, Staphylococcus aureus
RTLIFPYVPDKAVYNAIV

SEQ ID NO: 1584646 - protein, 17 aa, Staphylococcus aureus
RTNFVVVRFGNVLGSRG

SEQ ID NO: 1584647 - protein, 19 aa, Staphylococcus aureus
RTRYTFVLAPDELFFTRDG

SEQ ID NO: 1584648 - protein, 28 aa, Staphylococcus aureus
RTSRLCNRFNYGYKYDCWVIYWGSFCYQ

SEQ ID NO: 1584649 - protein, 28 aa, Staphylococcus aureus
RTWKARCQLCIIFSLFALMSNLTGIVID

SEQ ID NO: 1584650 - protein, 21 aa, Staphylococcus aureus
RVEGFSCANCAGKFEKNVKEL

SEQ ID NO: 1584651 - protein, 17 aa, Staphylococcus aureus
RVKKPASISLIICLIIL

SEQ ID NO: 1584652 - protein, 18 aa, Staphylococcus aureus
RVKKPASISLIICLIVLG

SEQ ID NO: 1584653 - protein, 23 aa, Staphylococcus aureus
RVLLPLSCLISILLMTQGVPQTL

SEQ ID NO: 1584654 - protein, 20 aa, Staphylococcus aureus
RVVLIPVFILFALVDFGFGN

SEQ ID NO: 1584655 - protein, 19 aa, Staphylococcus aureus
RYIHDIWGYIAPNTKKEKQ

SEQ ID NO: 1584656 - protein, 18 aa, Staphylococcus aureus
RYLNYQARRVCWFGSALV

SEQ ID NO: 1584657 - protein, 17 aa, Staphylococcus aureus
RYRIWFQKDEDWNPFGK

SEQ ID NO: 1584658 - protein, 28 aa, Staphylococcus aureus
SAAYFYSIYEMIRWLNGSTTQPHLYFET

SEQ ID NO: 1584659 - protein, 23 aa, Staphylococcus aureus
SADEKQAAMNRINEIVLETIRDI

SEQ ID NO: 1584660 - protein, 18 aa, Staphylococcus aureus
SAFTFKIVIQLGSVFAAA

SEQ ID NO: 1584661 - protein, 20 aa, Staphylococcus aureus
SAFVTIPLVLLIVTLIIPIL

SEQ ID NO: 1584662 - protein, 23 aa, Staphylococcus aureus
SAGAIGWLILEYIFKKTTSLLGL

SEQ ID NO: 1584663 - protein, 22 aa, Staphylococcus aureus
SAGAIGWLILEYILKKTTSLLG

SEQ ID NO: 1584664 - protein, 23 aa, Staphylococcus aureus
SAIRLPFTFMWFKSRSILGGAIP

SEQ ID NO: 1584665 - protein, 24 aa, Staphylococcus aureus
SALELLLACGLSFASSVADVTVVS

SEQ ID NO: 1584666 - protein, 19 aa, Staphylococcus aureus
SALFLKRRSILSMMKDSIK

SEQ ID NO: 1584667 - protein, 20 aa, Staphylococcus aureus
SALLKQIKFQYAITKRQLYR

SEQ ID NO: 1584668 - protein, 26 aa, Staphylococcus aureus
SALTAKGYNYTSVDISYASTYNDTNK

SEQ ID NO: 1584669 - protein, 25 aa, Staphylococcus aureus
SANDGLRARCIEISDVFTTSADNAD

SEQ ID NO: 1584670 - protein, 23 aa, Staphylococcus aureus
SASAKWGILAPIFVPMLIIVGFH

SEQ ID NO: 1584671 - protein, 20 aa, Staphylococcus aureus
SATESFLKFSHITGSDGVQA

SEQ ID NO: 1584672 - protein, 22 aa, Staphylococcus aureus
SDADTALTHFIEIWPYVEGQIQ

SEQ ID NO: 1584673 - protein, 17 aa, Staphylococcus aureus
SDEQIEFAVTDEGPGIS

SEQ ID NO: 1584674 - protein, 24 aa, Staphylococcus aureus
SDFFELRKLYIFAIMILASGSLLC

SEQ ID NO: 1584675 - protein, 21 aa, Staphylococcus aureus
SDGNVIYTFTDYVNTKDDVKA

SEQ ID NO: 1584676 - protein, 17 aa, Staphylococcus aureus
SDIVARIIIKPLELPVG

SEQ ID NO: 1584677 - protein, 18 aa, Staphylococcus aureus
SDLKGRLATAITIQNIML

SEQ ID NO: 1584678 - protein, 29 aa, Staphylococcus aureus
SDLLNRFGSILIVRWAMLISGVAMNLRHP

SEQ ID NO: 1584679 - protein, 28 aa, Staphylococcus aureus
SDNKNGSLAITGRVSMNQAFNSDITFKV

SEQ ID NO: 1584680 - protein, 26 aa, Staphylococcus aureus
SDSRVISRWLRYVLIVIGSAALYLGY

SEQ ID NO: 1584681 - protein, 23 aa, Staphylococcus aureus
SDTLKIFILIVIVWILVFILMGA

SEQ ID NO: 1584682 - protein, 18 aa, Staphylococcus aureus
SDVKLRFYKEYMYSMTVY

SEQ ID NO: 1584683 - protein, 18 aa, Staphylococcus aureus
SDVSLNILTLGALTVAIG

SEQ ID NO: 1584684 - protein, 29 aa, Staphylococcus aureus
SDWNRVGWGEIPMSLGFTYSSNTLMMHLQ

SEQ ID NO: 1584685 - protein, 21 aa, Staphylococcus aureus
SDYETIFLLGLILALFTVLPT

SEQ ID NO: 1584686 - protein, 18 aa, Staphylococcus aureus
SEAMKSYVSEQIKNKQEQ

SEQ ID NO: 1584687 - protein, 17 aa, Staphylococcus aureus
SEHMLGRVNSVYKTMVF

SEQ ID NO: 1584688 - protein, 19 aa, Staphylococcus aureus
SEIKPRMKRSTDVAEVAEK

SEQ ID NO: 1584689 - protein, 21 aa, Staphylococcus aureus
SEIRKKLARKLMHLPLGVVES

SEQ ID NO: 1584690 - protein, 21 aa, Staphylococcus aureus
SEKLNKLLLIISLLSIFQVVE

SEQ ID NO: 1584691 - protein, 20 aa, Staphylococcus aureus
SELKKAGLTSEVEYINRNIL

SEQ ID NO: 1584692 - protein, 21 aa, Staphylococcus aureus
SELLKIAIILYIPFLISKKMP

SEQ ID NO: 1584693 - protein, 21 aa, Staphylococcus aureus
SELNGDEKLAAAKQTAKSDIG

SEQ ID NO: 1584694 - protein, 17 aa, Staphylococcus aureus
SEMLEAFIVGLLFSTDL

SEQ ID NO: 1584695 - protein, 27 aa, Staphylococcus aureus
SEMLMVWDRLTGGLIFVGGVVSIVLVI

SEQ ID NO: 1584696 - protein, 32 aa, Staphylococcus aureus
SENTNATLFGAMMALLGSLLLFRKRKQDHKEK

SEQ ID NO: 1584697 - protein, 25 aa, Staphylococcus aureus
SEPSVRTRAVRSLAVAEPVVNAADA

SEQ ID NO: 1584698 - protein, 20 aa, Staphylococcus aureus
SESFPRIFRITSRDTNLIKI

SEQ ID NO: 1584699 - protein, 21 aa, Staphylococcus aureus
SESQSASAFLSESLSESTSES

SEQ ID NO: 1584700 - protein, 17 aa, Staphylococcus aureus
SEYFHRIVPKVSYKAFV

SEQ ID NO: 1584701 - protein, 19 aa, Staphylococcus aureus
SEYWYMMLWHLIFILPAFF

SEQ ID NO: 1584702 - protein, 21 aa, Staphylococcus aureus
SEYYLNSILKKRENGSELNEI

SEQ ID NO: 1584703 - protein, 20 aa, Staphylococcus aureus
SFILAIVVAIRLFKVEKHVS

SEQ ID NO: 1584704 - protein, 18 aa, Staphylococcus aureus
SFILAVIIIPRFLDLGTF

SEQ ID NO: 1584705 - protein, 18 aa, Staphylococcus aureus
SFISRYLTFESFNLYFGI

SEQ ID NO: 1584706 - protein, 21 aa, Staphylococcus aureus
SFLIAVCCIIYIKQIDETEDE

SEQ ID NO: 1584707 - protein, 25 aa, Staphylococcus aureus
SFLKYKREIEFAGIIFSFTGQSSTG

SEQ ID NO: 1584708 - protein, 22 aa, Staphylococcus aureus
SFMMTVTMPFYLTTQNILLMVG

SEQ ID NO: 1584709 - protein, 18 aa, Staphylococcus aureus
SFQCLLCTQHTCRFIIVG

SEQ ID NO: 1584710 - protein, 18 aa, Staphylococcus aureus
SFQTFLINKKVSGKEVTP

SEQ ID NO: 1584711 - protein, 22 aa, Staphylococcus aureus
SFRKISKVIIYFLVFFYILSHH

SEQ ID NO: 1584712 - protein, 28 aa, Staphylococcus aureus
SFSTYLVCNFCFIIWLLYTNTLLKECKT

SEQ ID NO: 1584713 - protein, 20 aa, Staphylococcus aureus
SFVQFRELLVQSGLISGSAL

SEQ ID NO: 1584714 - protein, 19 aa, Staphylococcus aureus
SFVVAALIMKFTKEPKQDL

SEQ ID NO: 1584715 - protein, 17 aa, Staphylococcus aureus
SGDTVYPHQAGYVKLNY

SEQ ID NO: 1584716 - protein, 20 aa, Staphylococcus aureus
SGFICLFLVLLILNSQFIKN

SEQ ID NO: 1584717 - protein, 22 aa, Staphylococcus aureus
SGGISYYAATVVHKFNKRYKRK

SEQ ID NO: 1584718 - protein, 20 aa, Staphylococcus aureus
SGHAEAFFPSKLPLINLRMN

SEQ ID NO: 1584719 - protein, 18 aa, Staphylococcus aureus
SGLAKWLGEQLKSLNGVS

SEQ ID NO: 1584720 - protein, 20 aa, Staphylococcus aureus
SGLASLATACFLIRDGQMEG

SEQ ID NO: 1584721 - protein, 21 aa, Staphylococcus aureus
SGLMKPNISNIVGRLYPENDR

SEQ ID NO: 1584722 - protein, 38 aa, Staphylococcus aureus
SGNTFMAANFKVAGKVKSGDYFTAKLPDSVTGNGDVDY

SEQ ID NO: 1584723 - protein, 38 aa, Staphylococcus aureus
SGNTFMAANFKVTGQVKSGDYFTAKLPDSVTGNGDVDY

SEQ ID NO: 1584724 - protein, 26 aa, Staphylococcus aureus
SGNTFMAANFTVTGQVKSGDYFTAKL

SEQ ID NO: 1584725 - protein, 22 aa, Staphylococcus aureus
SGQFFWPAILAFVLTGIDLPLL

SEQ ID NO: 1584726 - protein, 18 aa, Staphylococcus aureus
SGSISLSGSTSLSTSDSL

SEQ ID NO: 1584727 - protein, 26 aa, Staphylococcus aureus
SGSVGEMFRPFALAIAFSLLASLLVS

SEQ ID NO: 1584728 - protein, 22 aa, Staphylococcus aureus
SGVVCATILFTIIVAIYHQPLL

SEQ ID NO: 1584729 - protein, 21 aa, Staphylococcus aureus
SGVVCSTILFTIIVAIYHQPL

SEQ ID NO: 1584730 - protein, 17 aa, Staphylococcus aureus
SHARLHIFSKRNLGTLI

SEQ ID NO: 1584731 - protein, 24 aa, Staphylococcus aureus
SHFSVPKFNDWIFIISVYYIFWLL

SEQ ID NO: 1584732 - protein, 20 aa, Staphylococcus aureus
SHGPLSIDTAINFTNQILDG

SEQ ID NO: 1584733 - protein, 19 aa, Staphylococcus aureus
SHIAFCIPTVVIIVLPQLY

SEQ ID NO: 1584734 - protein, 17 aa, Staphylococcus aureus
SHIKFNRVLLITIGGII

SEQ ID NO: 1584735 - protein, 31 aa, Staphylococcus aureus
SHMQNRYSNGIMRTNLEGVTITTPQADLIDD

SEQ ID NO: 1584736 - protein, 25 aa, Staphylococcus aureus
SHPWLNRIIVLILMFLNGFGIYIGR

SEQ ID NO: 1584737 - protein, 20 aa, Staphylococcus aureus
SHRLFMIFIYALAMGIVYLT

SEQ ID NO: 1584738 - protein, 19 aa, Staphylococcus aureus
SIFVVSILLTLLAMYLIKH

SEQ ID NO: 1584739 - protein, 19 aa, Staphylococcus aureus
SIIFVAFICVWTFILTLIF

SEQ ID NO: 1584740 - protein, 22 aa, Staphylococcus aureus
SIIIYLFIRRQFNISNALLNFR

SEQ ID NO: 1584741 - protein, 25 aa, Staphylococcus aureus
SIIRPVKKLKLATERLIDGDFKTPI

SEQ ID NO: 1584742 - protein, 39 aa, Staphylococcus aureus
SIISAILMKNKWPFLIALPFMICYGIGVTFYYQQKVAYL

SEQ ID NO: 1584743 - protein, 17 aa, Staphylococcus aureus
SIISQWWQWMQQLLQLN

SEQ ID NO: 1584744 - protein, 25 aa, Staphylococcus aureus
SIIWLAGSFGFGWYISIFGNYSKTY

SEQ ID NO: 1584745 - protein, 20 aa, Staphylococcus aureus
SIKLFKADNTPLTITNTTYG

SEQ ID NO: 1584746 - protein, 25 aa, Staphylococcus aureus
SIKSDLWSAFYIFTAFNVVYAIFLF

SEQ ID NO: 1584747 - protein, 39 aa, Staphylococcus aureus
SILTIVALLSFKLYRFYFYRLFAIVTWILFIGSLSQYFD

SEQ ID NO: 1584748 - protein, 20 aa, Staphylococcus aureus
SILWVVWGIFLIWTKYSKDG

SEQ ID NO: 1584749 - protein, 18 aa, Staphylococcus aureus
SIMSLCMLITLDSQNIIV

SEQ ID NO: 1584750 - protein, 17 aa, Staphylococcus aureus
SIPSFWQGILFILAFSL

SEQ ID NO: 1584751 - protein, 29 aa, Staphylococcus aureus
SISGIFSRRFWPSFTFLIPIIIGVLLAMG

SEQ ID NO: 1584752 - protein, 25 aa, Staphylococcus aureus
SISTSESLSMSGLTHNSTSVSDSDS

SEQ ID NO: 1584753 - protein, 23 aa, Staphylococcus aureus
SIVKAGGLISFLSTKVPILGTVF

SEQ ID NO: 1584754 - protein, 17 aa, Staphylococcus aureus
SKDDLKINSEEVRNVEE

SEQ ID NO: 1584755 - protein, 28 aa, Staphylococcus aureus
SKDPFLDLRVFKSKGFMIATIGLIVVTM

SEQ ID NO: 1584756 - protein, 32 aa, Staphylococcus aureus
SKEERIMEGLSLIPLPGMGFLKGAGKSLMKLG

SEQ ID NO: 1584757 - protein, 25 aa, Staphylococcus aureus
SKEPRLEPRLGNQYGGKLVLILDDG

SEQ ID NO: 1584758 - protein, 17 aa, Staphylococcus aureus
SKFQNILLMIMIIPTWI

SEQ ID NO: 1584759 - protein, 23 aa, Staphylococcus aureus
SKGKITYLKGEAMQYDLSTTGGN

SEQ ID NO: 1584760 - protein, 26 aa, Staphylococcus aureus
SKILKPVIVIVIGFFLLIFIMVAYLV

SEQ ID NO: 1584761 - protein, 19 aa, Staphylococcus aureus
SKILLFIIMSIAIIQHLLQ

SEQ ID NO: 1584762 - protein, 43 aa, Staphylococcus aureus
SKKKMSTTAKVVSIATVLLLLGGLVFAIFAYVDHSNKAKERML

SEQ ID NO: 1584763 - protein, 23 aa, Staphylococcus aureus
SKLKDVTGQFDVIYSNDNKTATV

SEQ ID NO: 1584764 - protein, 19 aa, Staphylococcus aureus
SKLSNWASYMHQVTKNHPM

SEQ ID NO: 1584765 - protein, 19 aa, Staphylococcus aureus
SKPIPLKDLMLHQSGLYKY

SEQ ID NO: 1584766 - protein, 20 aa, Staphylococcus aureus
SKPRVTRSADVVEAKEASDA

SEQ ID NO: 1584767 - protein, 19 aa, Staphylococcus aureus
SKRRILKGIILVVYAIIAA

SEQ ID NO: 1584768 - protein, 23 aa, Staphylococcus aureus
SKSKVKFKGVKINSVKRDKNKVY

SEQ ID NO: 1584769 - protein, 21 aa, Staphylococcus aureus
SKSTLLCFLTSAVLGVMVNFA

SEQ ID NO: 1584770 - protein, 17 aa, Staphylococcus aureus
SKVFAHDMSKIMSVDNV

SEQ ID NO: 1584771 - protein, 26 aa, Staphylococcus aureus
SKVIGIPRWIQFLFIVIVAMVISASM

SEQ ID NO: 1584772 - protein, 19 aa, Staphylococcus aureus
SKVIVNVPVKVVEKELSVV

SEQ ID NO: 1584773 - protein, 19 aa, Staphylococcus aureus
SKVLSTFLFILLLYITYRK

SEQ ID NO: 1584774 - protein, 19 aa, Staphylococcus aureus
SKWLYRRKGSWVKVLESLL

SEQ ID NO: 1584775 - protein, 23 aa, Staphylococcus aureus
SKYLTKYSICMVNFVNNVKAINL

SEQ ID NO: 1584776 - protein, 24 aa, Staphylococcus aureus
SLCVGSVMIPLTFIIGADLLLLSD

SEQ ID NO: 1584777 - protein, 24 aa, Staphylococcus aureus
SLDKVKHTPFFLPKRHKEDVKVTN

SEQ ID NO: 1584778 - protein, 24 aa, Staphylococcus aureus
SLFAALGGLFLVGRRRKNKNNEEK

SEQ ID NO: 1584779 - protein, 19 aa, Staphylococcus aureus
SLFFPFINWFIPKRYIKIS

SEQ ID NO: 1584780 - protein, 17 aa, Staphylococcus aureus
SLFYCLVIFPMTIVVYL

SEQ ID NO: 1584781 - protein, 17 aa, Staphylococcus aureus
SLIGLMFFLTCFPGILL

SEQ ID NO: 1584782 - protein, 18 aa, Staphylococcus aureus
SLIGLMFFLTCFPGILLI

SEQ ID NO: 1584783 - protein, 20 aa, Staphylococcus aureus
SLIGMLMLIGIVVTNAIVLI

SEQ ID NO: 1584784 - protein, 18 aa, Staphylococcus aureus
SLILMVLVPVIFFVPNIF

SEQ ID NO: 1584785 - protein, 24 aa, Staphylococcus aureus
SLITSVVLYFSFVALKYAHKLNMT

SEQ ID NO: 1584786 - protein, 21 aa, Staphylococcus aureus
SLKRGAMGDAVIKGYINENKK

SEQ ID NO: 1584787 - protein, 25 aa, Staphylococcus aureus
SLKWYELMPIISFLLLKGRCRNCRK

SEQ ID NO: 1584788 - protein, 31 aa, Staphylococcus aureus
SLLRKIKQKNWQSASLITLIKQLVIRMYLKF

SEQ ID NO: 1584789 - protein, 26 aa, Staphylococcus aureus
SLMPYSIALSIVWTVFVIIWFLLGIP

SEQ ID NO: 1584790 - protein, 18 aa, Staphylococcus aureus
SLNLENLDKTYVVHYDGE

SEQ ID NO: 1584791 - protein, 21 aa, Staphylococcus aureus
SLRYIHDIWGYIAPNTKKEKQ

SEQ ID NO: 1584792 - protein, 22 aa, Staphylococcus aureus
SLRYIHDIWGYIAPNTKKEKQP

SEQ ID NO: 1584793 - protein, 30 aa, Staphylococcus aureus
SLSPLMWLNFLFIKIVETVGIFNPTTIHFW

SEQ ID NO: 1584794 - protein, 26 aa, Staphylococcus aureus
SLSVSMSLRSSESVSESDSLSDSKST

SEQ ID NO: 1584795 - protein, 20 aa, Staphylococcus aureus
SLVLIITGSIVFNLCKNGET

SEQ ID NO: 1584796 - protein, 24 aa, Staphylococcus aureus
SLVSIGTAIGLIFTQIGFPIVDII

SEQ ID NO: 1584797 - protein, 26 aa, Staphylococcus aureus
SLVVLYHFCLPFLIVLMHKYLSSNCR

SEQ ID NO: 1584798 - protein, 19 aa, Staphylococcus aureus
SLWVKPKLVNYIIAKEIGG

SEQ ID NO: 1584799 - protein, 20 aa, Staphylococcus aureus
SMIEDFKVTIWYTAPTALRM

SEQ ID NO: 1584800 - protein, 21 aa, Staphylococcus aureus
SMMLDMYIIYKTVKNIITSEG

SEQ ID NO: 1584801 - protein, 26 aa, Staphylococcus aureus
SMMVVFSIMLFLFVKRNKKKNKNESQ

SEQ ID NO: 1584802 - protein, 24 aa, Staphylococcus aureus
SNELYEEIKILLSQNQLLASAGTL

SEQ ID NO: 1584803 - protein, 17 aa, Staphylococcus aureus
SNLFSNEVLNSFIKSTS

SEQ ID NO: 1584804 - protein, 20 aa, Staphylococcus aureus
SNMYVAFSVYGMMVTYGFNL

SEQ ID NO: 1584805 - protein, 28 aa, Staphylococcus aureus
SNNATLFGGLFAALGSLLLFGRRKKQNK

SEQ ID NO: 1584806 - protein, 17 aa, Staphylococcus aureus
SNNKLEVGLGRDISGDP

SEQ ID NO: 1584807 - protein, 21 aa, Staphylococcus aureus
SNQTFNYTWFVGGLLGVGYLT

SEQ ID NO: 1584808 - protein, 17 aa, Staphylococcus aureus
SNSHLTIGYGTANHPFN

SEQ ID NO: 1584809 - protein, 26 aa, Staphylococcus aureus
SPFIFKLKVFCALIHFSTISYVIQII

SEQ ID NO: 1584810 - protein, 21 aa, Staphylococcus aureus
SPIIVNARFSDPVTGVEKLII

SEQ ID NO: 1584811 - protein, 17 aa, Staphylococcus aureus
SPLESGLILLPGGLIMG

SEQ ID NO: 1584812 - protein, 19 aa, Staphylococcus aureus
SPLIWLNFLFIKIGETVGI

SEQ ID NO: 1584813 - protein, 25 aa, Staphylococcus aureus
SPVPEDHAYIRFPVSDGTQELKIVS

SEQ ID NO: 1584814 - protein, 19 aa, Staphylococcus aureus
SPWVKEASAANVTGIVGTN

SEQ ID NO: 1584815 - protein, 20 aa, Staphylococcus aureus
SQFLPLLIVKKLPFVQYSGI

SEQ ID NO: 1584816 - protein, 18 aa, Staphylococcus aureus
SQVKGIGFDVDFKVDDYV

SEQ ID NO: 1584817 - protein, 27 aa, Staphylococcus aureus
SRKANELRLAIRLEHLLSKDEIIYTYI

SEQ ID NO: 1584818 - protein, 18 aa, Staphylococcus aureus
SRKRYSPDSTYKIYLALF

SEQ ID NO: 1584819 - protein, 17 aa, Staphylococcus aureus
SRLEVDTGLSIPTIYAF

SEQ ID NO: 1584820 - protein, 37 aa, Staphylococcus aureus
SRMIIPNLFSLLASLLVLWLYFRKAIPKTFEDNKIKR

SEQ ID NO: 1584821 - protein, 19 aa, Staphylococcus aureus
SRMSWNHKHYLFESWNKEQ

SEQ ID NO: 1584822 - protein, 18 aa, Staphylococcus aureus
SRTMLFPMIMTAFSIIFY

SEQ ID NO: 1584823 - protein, 20 aa, Staphylococcus aureus
SRTQKLICVISATVLSVLSS

SEQ ID NO: 1584824 - protein, 17 aa, Staphylococcus aureus
SSDSSSVNVAPKTDNTN

SEQ ID NO: 1584825 - protein, 20 aa, Staphylococcus aureus
SSIGAFIIKLLQGYIPINSA

SEQ ID NO: 1584826 - protein, 40 aa, Staphylococcus aureus
SSIISAILMKNKWPFLIALPFMICYGIGVTFYYQQKVAYL

SEQ ID NO: 1584827 - protein, 24 aa, Staphylococcus aureus
SSKSGKQLARMSVPKGSAHEKQLP

SEQ ID NO: 1584828 - protein, 17 aa, Staphylococcus aureus
SSLFVATLTTATLVSSP

SEQ ID NO: 1584829 - protein, 27 aa, Staphylococcus aureus
SSLKWYELMPIISFLLLKGRCRNCHKR

SEQ ID NO: 1584830 - protein, 19 aa, Staphylococcus aureus
SSLLGLFQFILGGAVAPLV

SEQ ID NO: 1584831 - protein, 18 aa, Staphylococcus aureus
SSLLNVAGFIVDDYNGYK

SEQ ID NO: 1584832 - protein, 17 aa, Staphylococcus aureus
SSLTIGVILIIIALLKD

SEQ ID NO: 1584833 - protein, 23 aa, Staphylococcus aureus
SSPEAMFVLLAGIGLIATVRRRK

SEQ ID NO: 1584834 - protein, 26 aa, Staphylococcus aureus
SSPPWNDFFKRFSFYAIAIQHFVVQF

SEQ ID NO: 1584835 - protein, 24 aa, Staphylococcus aureus
SSQFHLLMGMGFKKYIDTLKIGKS

SEQ ID NO: 1584836 - protein, 23 aa, Staphylococcus aureus
SSSIKDIFYDGSFKREDDSVETL

SEQ ID NO: 1584837 - protein, 23 aa, Staphylococcus aureus
SSSIKDIFYDGSFKREDNSVETL

SEQ ID NO: 1584838 - protein, 24 aa, Staphylococcus aureus
SSTREIAGVFGIPLHKFGIETSNM

SEQ ID NO: 1584839 - protein, 24 aa, Staphylococcus aureus
SSVAGGGAFGAFVTTDSTGVASTY

SEQ ID NO: 1584840 - protein, 24 aa, Staphylococcus aureus
SSVAGGGAFGAFVTTDSTGVATTY

SEQ ID NO: 1584841 - protein, 25 aa, Staphylococcus aureus
SSYNLKCLLLKLTYRYLDNQPLNDA

SEQ ID NO: 1584842 - protein, 27 aa, Staphylococcus aureus
STAPKRLNTRMRIAAVQPSSTEAKNVN

SEQ ID NO: 1584843 - protein, 40 aa, Staphylococcus aureus
STAYSKSWLAIVCSMMVIFSIMLFLFVKRNKKKNKNESQR

SEQ ID NO: 1584844 - protein, 40 aa, Staphylococcus aureus
STAYSKSWLAIVCSMMVVFSIMLFLFVKRNKKKIKTNHSD

SEQ ID NO: 1584845 - protein, 39 aa, Staphylococcus aureus
STAYSKSWLAIVCSMMVVFSIMLFLFVKRNKKKNKNESQ

SEQ ID NO: 1584846 - protein, 40 aa, Staphylococcus aureus
STAYSKSWLAIVCSMMVVFSIMLFLFVKRNKKKNKNESQQ

SEQ ID NO: 1584847 - protein, 19 aa, Staphylococcus aureus
STDKIDRIRNSTIGTAEER

SEQ ID NO: 1584848 - protein, 17 aa, Staphylococcus aureus
STILSIAGMIGLVWSIK

SEQ ID NO: 1584849 - protein, 32 aa, Staphylococcus aureus
STITATYAGKTWKATTDDLGIDKSQKYNFLIT

SEQ ID NO: 1584850 - protein, 19 aa, Staphylococcus aureus
STLCHLLLRFYDVNDGFIR

SEQ ID NO: 1584851 - protein, 19 aa, Staphylococcus aureus
STLFITILTLIAIVIIGVT

SEQ ID NO: 1584852 - protein, 22 aa, Staphylococcus aureus
STMWMFIGFMVFGAVSSLVSAI

SEQ ID NO: 1584853 - protein, 29 aa, Staphylococcus aureus
STNKGMLFGGLFSILGLALLRRNKKNHKV

SEQ ID NO: 1584854 - protein, 26 aa, Staphylococcus aureus
STSDSLRTSTSLSDSLSMSTSGSLSK

SEQ ID NO: 1584855 - protein, 23 aa, Staphylococcus aureus
STSDSLRTSTSLSGSLSMSTSGS

SEQ ID NO: 1584856 - protein, 21 aa, Staphylococcus aureus
STSESLSMSGSTHNSTSVSDS

SEQ ID NO: 1584857 - protein, 23 aa, Staphylococcus aureus
STSESLSMSGSTHNSTSVSDSDS

SEQ ID NO: 1584858 - protein, 20 aa, Staphylococcus aureus
STSISTSMSMSASTSSSQST

SEQ ID NO: 1584859 - protein, 20 aa, Staphylococcus aureus
STSMSLSMSQSISGSTSTST

SEQ ID NO: 1584860 - protein, 25 aa, Staphylococcus aureus
STSTSIRMSTIASESVSESTSESGS

SEQ ID NO: 1584861 - protein, 26 aa, Staphylococcus aureus
STSTSIRMSTIVSESVSESTSESGST

SEQ ID NO: 1584862 - protein, 24 aa, Staphylococcus aureus
STYFDMINPILIGFFVFFFTFLIS

SEQ ID NO: 1584863 - protein, 21 aa, Staphylococcus aureus
STYKIYLALFGLDRHIISDKN

SEQ ID NO: 1584864 - protein, 25 aa, Staphylococcus aureus
SVCFLFICVYLNMAIGSSKINFSDI

SEQ ID NO: 1584865 - protein, 25 aa, Staphylococcus aureus
SVESLRINIEIAKYKGIISLIVAIV

SEQ ID NO: 1584866 - protein, 18 aa, Staphylococcus aureus
SVGAFFIKLMQGYIPVES

SEQ ID NO: 1584867 - protein, 19 aa, Staphylococcus aureus
SVGYKRLEIDFSKEDRDIS

SEQ ID NO: 1584868 - protein, 24 aa, Staphylococcus aureus
SVGYRAQLTLSIGVGEGTENLIDS

SEQ ID NO: 1584869 - protein, 23 aa, Staphylococcus aureus
SVIDKRLKYIILHEYAHAKNRDT

SEQ ID NO: 1584870 - protein, 24 aa, Staphylococcus aureus
SVIVGAMGVLMVWLSRRNKLKNKA

SEQ ID NO: 1584871 - protein, 46 aa, Staphylococcus aureus
SVKNSERRGMLKGCGGCLISFILLIILLSACSMMFSNNDNSTINQS

SEQ ID NO: 1584872 - protein, 46 aa, Staphylococcus aureus
SVKNSERRGMLKGCGGCLISFILLIILLSACSMMFSNNDNSTSNQS

SEQ ID NO: 1584873 - protein, 22 aa, Staphylococcus aureus
SVLEHYVQWAVIYFAIYQAFVE

SEQ ID NO: 1584874 - protein, 25 aa, Staphylococcus aureus
SVLLFCAGVAFAFYVSFPMIIQFAL

SEQ ID NO: 1584875 - protein, 25 aa, Staphylococcus aureus
SVLLFCAGVAFTFYVGFPIIIQFAL

SEQ ID NO: 1584876 - protein, 20 aa, Staphylococcus aureus
SVSIAGPIGFVGLIVPHIVK

SEQ ID NO: 1584877 - protein, 25 aa, Staphylococcus aureus
SVSNCLRKKYNLVRIQSCINIESFM

SEQ ID NO: 1584878 - protein, 19 aa, Staphylococcus aureus
SVVALVGFIWRIVTAENPF

SEQ ID NO: 1584879 - protein, 20 aa, Staphylococcus aureus
SVWLVLLFSAMGLWHVSNAA

SEQ ID NO: 1584880 - protein, 20 aa, Staphylococcus aureus
SVYYIFWLLAKRKYILVTFW

SEQ ID NO: 1584881 - protein, 20 aa, Staphylococcus aureus
SVYYIFWLLAKRKYILVTVW

SEQ ID NO: 1584882 - protein, 21 aa, Staphylococcus aureus
SWLAIVCSMMVVFSIMLFLFV

SEQ ID NO: 1584883 - protein, 19 aa, Staphylococcus aureus
SYIALLGWLIIGLIFFVIR

SEQ ID NO: 1584884 - protein, 18 aa, Staphylococcus aureus
SYILITWLVIIFALLIVA

SEQ ID NO: 1584885 - protein, 17 aa, Staphylococcus aureus
SYQLTWDNGLVLYSNKA

SEQ ID NO: 1584886 - protein, 23 aa, Staphylococcus aureus
SYVKTPSNKVLGFYPTNATTNAF

SEQ ID NO: 1584887 - protein, 18 aa, Staphylococcus aureus
TAAIFTVLFLFLFIFGII

SEQ ID NO: 1584888 - protein, 17 aa, Staphylococcus aureus
TAEERQAAMNRINEIVL

SEQ ID NO: 1584889 - protein, 22 aa, Staphylococcus aureus
TAETRISGIITNEISVFKGAPN

SEQ ID NO: 1584890 - protein, 26 aa, Staphylococcus aureus
TAGTMEWAKLGILIALLFFPTSHILL

SEQ ID NO: 1584891 - protein, 19 aa, Staphylococcus aureus
TAKQVIKLNDAVTAAKKAL

SEQ ID NO: 1584892 - protein, 20 aa, Staphylococcus aureus
TAKVEVTLLDGSKVIVNVPV

SEQ ID NO: 1584893 - protein, 18 aa, Staphylococcus aureus
TALESKPRVTRSTDVAEA

SEQ ID NO: 1584894 - protein, 20 aa, Staphylococcus aureus
TAMTALKRAIADKADTKTSG

SEQ ID NO: 1584895 - protein, 20 aa, Staphylococcus aureus
TAPMMSEFFDLPGVSIATGS

SEQ ID NO: 1584896 - protein, 17 aa, Staphylococcus aureus
TAPSYIALLGWLIIGLI

SEQ ID NO: 1584897 - protein, 19 aa, Staphylococcus aureus
TASESKPRVTRSADVVEAK

SEQ ID NO: 1584898 - protein, 24 aa, Staphylococcus aureus
TASGKVVLLPAHRGTVSSGTEGSD

SEQ ID NO: 1584899 - protein, 38 aa, Staphylococcus aureus
TAYSKSWLAIVCSMMVVFSIMLFLFVKRNKKKNKNESQ

SEQ ID NO: 1584900 - protein, 17 aa, Staphylococcus aureus
TCIEYIELVYILFMHSI

SEQ ID NO: 1584901 - protein, 19 aa, Staphylococcus aureus
TDANGIANIKALPSGDYIL

SEQ ID NO: 1584902 - protein, 40 aa, Staphylococcus aureus
TDDKGHYEFGGLKDGETYTVKFETPAGYLPTKENGTTDGE

SEQ ID NO: 1584903 - protein, 25 aa, Staphylococcus aureus
TDEIEEIKAQLAILDENYDLDFDLN

SEQ ID NO: 1584904 - protein, 31 aa, Staphylococcus aureus
TDEQMASFGWRIPFLLGLFLGLFGLYLRRKL

SEQ ID NO: 1584905 - protein, 28 aa, Staphylococcus aureus
TDMLKGLLLKITFNFGLPLLVAILHAVF

SEQ ID NO: 1584906 - protein, 29 aa, Staphylococcus aureus
TDMLKGLLLKITFNFGLPLLVAILHAVFA

SEQ ID NO: 1584907 - protein, 18 aa, Staphylococcus aureus
TDQFKDKISYKYDNVASI

SEQ ID NO: 1584908 - protein, 27 aa, Staphylococcus aureus
TDRRGRIRIVNDMALKMFGMAKEDIIG

SEQ ID NO: 1584909 - protein, 27 aa, Staphylococcus aureus
TDTKLRIFEVNDTSKLSDSYYADPNDS

SEQ ID NO: 1584910 - protein, 17 aa, Staphylococcus aureus
TDYVKGIGLAVGTAGST

SEQ ID NO: 1584911 - protein, 20 aa, Staphylococcus aureus
TEEQRNGFIQSLKDDPSVSK

SEQ ID NO: 1584912 - protein, 19 aa, Staphylococcus aureus
TEHSLAMLLSMARNIPQAH

SEQ ID NO: 1584913 - protein, 26 aa, Staphylococcus aureus
TELNTAMTALKRAIADKAETKASGNY

SEQ ID NO: 1584914 - protein, 41 aa, Staphylococcus aureus
TELYGYPERAYKSYYVYGGYRLTWDNGLVLYSNKADGNGKN

SEQ ID NO: 1584915 - protein, 18 aa, Staphylococcus aureus
TELYHKTLGVIGAGRIGL

SEQ ID NO: 1584916 - protein, 24 aa, Staphylococcus aureus
TEMKLVFLEGIFKTLLNKNSQVVF

SEQ ID NO: 1584917 - protein, 30 aa, Staphylococcus aureus
TERLKQSWKSFLIVLAVCLILIIASETLFS

SEQ ID NO: 1584918 - protein, 18 aa, Staphylococcus aureus
TFALCTISSMIIMISMVG

SEQ ID NO: 1584919 - protein, 19 aa, Staphylococcus aureus
TFALIPIVFIKYDFTYVNA

SEQ ID NO: 1584920 - protein, 19 aa, Staphylococcus aureus
TFALIPIVFIMYDFTYVNA

SEQ ID NO: 1584921 - protein, 19 aa, Staphylococcus aureus
TFCILDFIACSVLSADATS

SEQ ID NO: 1584922 - protein, 18 aa, Staphylococcus aureus
TFFIRLTLQFKIILIVIL

SEQ ID NO: 1584923 - protein, 18 aa, Staphylococcus aureus
TFIAGIYGMNFVNMPALH

SEQ ID NO: 1584924 - protein, 18 aa, Staphylococcus aureus
TFIAGIYGMNFVNMPVLH

SEQ ID NO: 1584925 - protein, 27 aa, Staphylococcus aureus
TFIAKHKWSTLIAWVIIVAAIFIPIAT

SEQ ID NO: 1584926 - protein, 19 aa, Staphylococcus aureus
TFIITCFSIIQVLDIFNIN

SEQ ID NO: 1584927 - protein, 19 aa, Staphylococcus aureus
TFIKFPIPFLPPYLTLDFS

SEQ ID NO: 1584928 - protein, 26 aa, Staphylococcus aureus
TFLLYANVVYFRFFSDFLTFSTLNQV

SEQ ID NO: 1584929 - protein, 19 aa, Staphylococcus aureus
TFMAANFTVTDKVKSGDYF

SEQ ID NO: 1584930 - protein, 18 aa, Staphylococcus aureus
TFNEIYFLNEFIEVQLMK

SEQ ID NO: 1584931 - protein, 26 aa, Staphylococcus aureus
TFRFIAFGVIFVFLGLFGIFVGGLNG

SEQ ID NO: 1584932 - protein, 18 aa, Staphylococcus aureus
TFVIYIITLFFTKYTNRK

SEQ ID NO: 1584933 - protein, 21 aa, Staphylococcus aureus
TGANQKWLMSHNMNAMKDNTN

SEQ ID NO: 1584934 - protein, 32 aa, Staphylococcus aureus
TGEFNNRIFYEHPNVASINFGDINKTYVVLVE

SEQ ID NO: 1584935 - protein, 21 aa, Staphylococcus aureus
TGETKFIDWGVFLVLGIFIGS

SEQ ID NO: 1584936 - protein, 20 aa, Staphylococcus aureus
TGIRMFKRYATITTSARILE

SEQ ID NO: 1584937 - protein, 22 aa, Staphylococcus aureus
TGKDIIPPKTYSGNVDQVVTID

SEQ ID NO: 1584938 - protein, 34 aa, Staphylococcus aureus
TGKTEFWATSSDVLKLKANYTIDDSVKEGDTFTF

SEQ ID NO: 1584939 - protein, 23 aa, Staphylococcus aureus
TGLIELLCATVLGIIALFFYIFR

SEQ ID NO: 1584940 - protein, 19 aa, Staphylococcus aureus
TGMMFNALLAIFAFLVILL

SEQ ID NO: 1584941 - protein, 19 aa, Staphylococcus aureus
TGMMFNALLAIVAFLVILL

SEQ ID NO: 1584942 - protein, 25 aa, Staphylococcus aureus
TGNRPFFRLYLITWMMHLILIGGSR

SEQ ID NO: 1584943 - protein, 26 aa, Staphylococcus aureus
TGQVKSGDYFTAKLPDSVTGNGDVDY

SEQ ID NO: 1584944 - protein, 20 aa, Staphylococcus aureus
TGTEYFKWYFPEYPDKIKTL

SEQ ID NO: 1584945 - protein, 18 aa, Staphylococcus aureus
TIAIFLIVFMAFILIITK

SEQ ID NO: 1584946 - protein, 18 aa, Staphylococcus aureus
TICLSWISLFSVQWVVEN

SEQ ID NO: 1584947 - protein, 24 aa, Staphylococcus aureus
TIEALEYMNAYLFKQLVKNNGVEG

SEQ ID NO: 1584948 - protein, 21 aa, Staphylococcus aureus
TIEALEYMNSYLFKQLVKNNG

SEQ ID NO: 1584949 - protein, 22 aa, Staphylococcus aureus
TIIFSLKCKIHLFFNSINAILY

SEQ ID NO: 1584950 - protein, 32 aa, Staphylococcus aureus
TIITMVLCGFLFPLAITLIGQIFFCQQANGSL

SEQ ID NO: 1584951 - protein, 26 aa, Staphylococcus aureus
TIRNIRQNLFWAFGYNIAGIPIAALG

SEQ ID NO: 1584952 - protein, 25 aa, Staphylococcus aureus
TISFGEGSLWFGNWEYTFLNHVGFA

SEQ ID NO: 1584953 - protein, 18 aa, Staphylococcus aureus
TISSMIIMISMVGPALLI

SEQ ID NO: 1584954 - protein, 18 aa, Staphylococcus aureus
TITEGIKDDGVIQAHDGE

SEQ ID NO: 1584955 - protein, 18 aa, Staphylococcus aureus
TIVFFPIFYLGYIFTKKH

SEQ ID NO: 1584956 - protein, 19 aa, Staphylococcus aureus
TKAKHIVSQFGFDLKHKKD

SEQ ID NO: 1584957 - protein, 24 aa, Staphylococcus aureus
TKDDSYWKDLIVEGKRVTTVSKDT

SEQ ID NO: 1584958 - protein, 25 aa, Staphylococcus aureus
TKDDVKATLTMPAYIDPENVTKTGN

SEQ ID NO: 1584959 - protein, 26 aa, Staphylococcus aureus
TKDDVKATLTMPAYIDPENVTKTGNV

SEQ ID NO: 1584960 - protein, 27 aa, Staphylococcus aureus
TKDDVKATLTMPAYIDPENVTKTGNVT

SEQ ID NO: 1584961 - protein, 21 aa, Staphylococcus aureus
TKESAGFGFIGMVGPINAFKF

SEQ ID NO: 1584962 - protein, 21 aa, Staphylococcus aureus
TKETFVSTLTGYKFNPDAKNF

SEQ ID NO: 1584963 - protein, 20 aa, Staphylococcus aureus
TKEVCNKIFFTLAMLVIFKI

SEQ ID NO: 1584964 - protein, 31 aa, Staphylococcus aureus
TKGALEYNDKIDFNKDFTITVPVANNNQGNT

SEQ ID NO: 1584965 - protein, 24 aa, Staphylococcus aureus
TKLRIFEVNDTSKLSDSYYADPND

SEQ ID NO: 1584966 - protein, 20 aa, Staphylococcus aureus
TKLRLDMREIPKSSIKPEHF

SEQ ID NO: 1584967 - protein, 17 aa, Staphylococcus aureus
TKNLEGFYDKEGFRDEE

SEQ ID NO: 1584968 - protein, 18 aa, Staphylococcus aureus
TKPDASWDEMKQKTVEIG

SEQ ID NO: 1584969 - protein, 18 aa, Staphylococcus aureus
TKRGKFRINQVIMGAGDY

SEQ ID NO: 1584970 - protein, 23 aa, Staphylococcus aureus
TKRGKFRINQVIMGAGDYKNLDG

SEQ ID NO: 1584971 - protein, 19 aa, Staphylococcus aureus
TKRLEVVIFMHFLNNLLAL

SEQ ID NO: 1584972 - protein, 25 aa, Staphylococcus aureus
TKTITYKFTDYVDRYENVNAKLELN

SEQ ID NO: 1584973 - protein, 18 aa, Staphylococcus aureus
TKTKMIITIVTIIINVFI

SEQ ID NO: 1584974 - protein, 19 aa, Staphylococcus aureus
TKTSIALFKYLYKNNELAN

SEQ ID NO: 1584975 - protein, 19 aa, Staphylococcus aureus
TKYLKMFAYSILYAALITI

SEQ ID NO: 1584976 - protein, 22 aa, Staphylococcus aureus
TLAGYLGSIVFKKYPIVTKQDM

SEQ ID NO: 1584977 - protein, 25 aa, Staphylococcus aureus
TLDDTKHLPLLFAKRRRKEDEEDVT

SEQ ID NO: 1584978 - protein, 27 aa, Staphylococcus aureus
TLDFGDINSAYIIKVVSKYTPTSDGEL

SEQ ID NO: 1584979 - protein, 29 aa, Staphylococcus aureus
TLDSGFYKTPKYNLGNYVWEDTNKDGKQD

SEQ ID NO: 1584980 - protein, 30 aa, Staphylococcus aureus
TLDSGFYKTPKYSLGDYVWYDSNKDGKQDS

SEQ ID NO: 1584981 - protein, 30 aa, Staphylococcus aureus
TLDSIVFRNTLRYAAIMMIAIFIALMFDFE

SEQ ID NO: 1584982 - protein, 25 aa, Staphylococcus aureus
TLDSIVFRNTLRYTAIMMIAIFIAL

SEQ ID NO: 1584983 - protein, 17 aa, Staphylococcus aureus
TLEVGMVCDGYLMRIEN

SEQ ID NO: 1584984 - protein, 25 aa, Staphylococcus aureus
TLFEYFKPHLLYLLIGTAIIFVICK

SEQ ID NO: 1584985 - protein, 24 aa, Staphylococcus aureus
TLFIIICLNAFIIYSVKGNMAEAL

SEQ ID NO: 1584986 - protein, 17 aa, Staphylococcus aureus
TLGCPVFSGVALAFEFA

SEQ ID NO: 1584987 - protein, 27 aa, Staphylococcus aureus
TLIKQLVIRMYLKFKQLATKRLNKCMP

SEQ ID NO: 1584988 - protein, 60 aa, Staphylococcus aureus
TLILLSFIFSAYRAWQMRHGKIILRKSKLTTFLSWLTLCLCIAIALILYALPYLILGSNN

SEQ ID NO: 1584989 - protein, 19 aa, Staphylococcus aureus
TLISIMLYFILKDENIVEI

SEQ ID NO: 1584990 - protein, 20 aa, Staphylococcus aureus
TLLLASSLTFTGFSATANAE

SEQ ID NO: 1584991 - protein, 19 aa, Staphylococcus aureus
TLMLFIGFFLIRLFGQGSM

SEQ ID NO: 1584992 - protein, 25 aa, Staphylococcus aureus
TLNKADGKFSHFAYVKPNNQSLSSV

SEQ ID NO: 1584993 - protein, 24 aa, Staphylococcus aureus
TLNKEGGKFSHFAYVKPNNQSLTS

SEQ ID NO: 1584994 - protein, 23 aa, Staphylococcus aureus
TLNMKYYLIRTIPVCIIAILYVL

SEQ ID NO: 1584995 - protein, 18 aa, Staphylococcus aureus
TLNMKYYLIRTIPVIIIA

SEQ ID NO: 1584996 - protein, 18 aa, Staphylococcus aureus
TLNTSMGALRTSIQNDNT

SEQ ID NO: 1584997 - protein, 35 aa, Staphylococcus aureus
TLQMLNMRYSHWFRFVWPVVAFVLIFGGGVLITQV

SEQ ID NO: 1584998 - protein, 26 aa, Staphylococcus aureus
TLSLGMCAYIIRLIRSNLLSLYQSNI

SEQ ID NO: 1584999 - protein, 18 aa, Staphylococcus aureus
TLTYMLSVCFLFICVYLN

SEQ ID NO: 1585000 - protein, 24 aa, Staphylococcus aureus
TLVGAFRFLIAPILATIDFLGVFG

SEQ ID NO: 1585001 - protein, 27 aa, Staphylococcus aureus
TLVPALAATLFKKGVKRRNKQHQEGLG

SEQ ID NO: 1585002 - protein, 34 aa, Staphylococcus aureus
TMRILRSAFLSGLMLEFISMLGIGLVALEATLSL

SEQ ID NO: 1585003 - protein, 35 aa, Staphylococcus aureus
TMRILRSAFLSGLMLEFISMLGIGLVALEVTLSLV

SEQ ID NO: 1585004 - protein, 24 aa, Staphylococcus aureus
TMWSEYRGNPILANLGIYGANMEG

SEQ ID NO: 1585005 - protein, 26 aa, Staphylococcus aureus
TNDMKIAYAILRDRLNLSIKNNWVDE

SEQ ID NO: 1585006 - protein, 17 aa, Staphylococcus aureus
TNFVCKWTNPIINLQRS

SEQ ID NO: 1585007 - protein, 28 aa, Staphylococcus aureus
TNKGMLFGGLFSILGLALLRRNKKNHKA

SEQ ID NO: 1585008 - protein, 28 aa, Staphylococcus aureus
TNKGMLFGGLFSILGLALLRRNKKNHKV

SEQ ID NO: 1585009 - protein, 27 aa, Staphylococcus aureus
TNKGMLFGGLFSILGLALLRRNKKNNK

SEQ ID NO: 1585010 - protein, 28 aa, Staphylococcus aureus
TNKGMLFGGLFSILGLALLRRNKKNNKA

SEQ ID NO: 1585011 - protein, 24 aa, Staphylococcus aureus
TNKLGLKDKTDWVGHKIDESIEVV

SEQ ID NO: 1585012 - protein, 17 aa, Staphylococcus aureus
TNLKFGYLDSPIVMLLT

SEQ ID NO: 1585013 - protein, 23 aa, Staphylococcus aureus
TNLNLFKGLSFIGIISLFLWGLG

SEQ ID NO: 1585014 - protein, 23 aa, Staphylococcus aureus
TNLNLFKGLSFIGTISLFSWGLG

SEQ ID NO: 1585015 - protein, 28 aa, Staphylococcus aureus
TNNGMLFGGLFSILGLALLRRNKKNHKA

SEQ ID NO: 1585016 - protein, 23 aa, Staphylococcus aureus
TNNLLREAMKFDQSFKPSQIKGA

SEQ ID NO: 1585017 - protein, 23 aa, Staphylococcus aureus
TNNQLREAMKFDQSFKPSQIKGA

SEQ ID NO: 1585018 - protein, 20 aa, Staphylococcus aureus
TNNTYRQTIYVNPSGDNVIA

SEQ ID NO: 1585019 - protein, 19 aa, Staphylococcus aureus
TPELSAKVPKEYDTSQPFT

SEQ ID NO: 1585020 - protein, 23 aa, Staphylococcus aureus
TPEVRRYIAEVTYAPSKNKHSRI

SEQ ID NO: 1585021 - protein, 22 aa, Staphylococcus aureus
TPEVRRYIAEVTYAPSKNKQSR

SEQ ID NO: 1585022 - protein, 21 aa, Staphylococcus aureus
TPEVRRYIAEVTYASSKNKQS

SEQ ID NO: 1585023 - protein, 32 aa, Staphylococcus aureus
TPFRKEGIKALNWRPSYIPQFIRMAIVVTLLI

SEQ ID NO: 1585024 - protein, 21 aa, Staphylococcus aureus
TPIAGFLVMFGFNHPMTIVIY

SEQ ID NO: 1585025 - protein, 17 aa, Staphylococcus aureus
TPITIQGKEHFEGYGSV

SEQ ID NO: 1585026 - protein, 24 aa, Staphylococcus aureus
TPLSDRHFLIFLLLVFMTYPLHKS

SEQ ID NO: 1585027 - protein, 17 aa, Staphylococcus aureus
TPWHFKIFVPDSSTAIL

SEQ ID NO: 1585028 - protein, 29 aa, Staphylococcus aureus
TPYFKPLHMVLRLFMLLMLISGFWILIQS

SEQ ID NO: 1585029 - protein, 33 aa, Staphylococcus aureus
TQAIFLKKMIYFWLSEGQLILMLLGDESAYKLH

SEQ ID NO: 1585030 - protein, 24 aa, Staphylococcus aureus
TQEKRIDLFFKYNLNHYHSMKVTS

SEQ ID NO: 1585031 - protein, 24 aa, Staphylococcus aureus
TQEKRIDLYFKYNLNNYHGLKITK

SEQ ID NO: 1585032 - protein, 18 aa, Staphylococcus aureus
TQFSRRTFLKMLGIGGAS

SEQ ID NO: 1585033 - protein, 26 aa, Staphylococcus aureus
TQKEVWVWKSDLYKSLLSFDESENEL

SEQ ID NO: 1585034 - protein, 22 aa, Staphylococcus aureus
TQKLPRLVMFSFSINETYIKSL

SEQ ID NO: 1585035 - protein, 29 aa, Staphylococcus aureus
TQLEETVAFTKERVEGFLNKSKNEQAALK

SEQ ID NO: 1585036 - protein, 28 aa, Staphylococcus aureus
TQMFGYPEQRYGYYYNSYQLTWDNGLVL

SEQ ID NO: 1585037 - protein, 27 aa, Staphylococcus aureus
TQQGKRPFGGVIPNCMTQEEYQELESH

SEQ ID NO: 1585038 - protein, 21 aa, Staphylococcus aureus
TQVKRVYDEAVDKAKEALNKA

SEQ ID NO: 1585039 - protein, 22 aa, Staphylococcus aureus
TREVSKISDLRIYPKGDDYVVK

SEQ ID NO: 1585040 - protein, 22 aa, Staphylococcus aureus
TREVSKISDLRIYPKKNDYVIK

SEQ ID NO: 1585041 - protein, 24 aa, Staphylococcus aureus
TRKKYIRNLILGFVGIAIVISLIS

SEQ ID NO: 1585042 - protein, 18 aa, Staphylococcus aureus
TRSGKIMRRVLKAWELNL

SEQ ID NO: 1585043 - protein, 17 aa, Staphylococcus aureus
TRSRLEVDTGLSIPTIY

SEQ ID NO: 1585044 - protein, 20 aa, Staphylococcus aureus
TRTTPLGLFQFGDKDKSIVV

SEQ ID NO: 1585045 - protein, 30 aa, Staphylococcus aureus
TSEATKHNGTRAQSEERLPDTGESIKQNGL

SEQ ID NO: 1585046 - protein, 21 aa, Staphylococcus aureus
TSELKKAGLTSEVEYINRNIL

SEQ ID NO: 1585047 - protein, 27 aa, Staphylococcus aureus
TSEPSVRTRAVRSLAVAEPVVNAADAK

SEQ ID NO: 1585048 - protein, 17 aa, Staphylococcus aureus
TSESLSDLISTSDSDSK

SEQ ID NO: 1585049 - protein, 25 aa, Staphylococcus aureus
TSFASKVADGFKRVVSNVGDGMKNA

SEQ ID NO: 1585050 - protein, 20 aa, Staphylococcus aureus
TSHILLKLVFAVICSICGTF

SEQ ID NO: 1585051 - protein, 25 aa, Staphylococcus aureus
TSIAICVFAFKMVQVMKQNAEGNAE

SEQ ID NO: 1585052 - protein, 24 aa, Staphylococcus aureus
TSITINGFFAKGGLYTGNVPTVKV

SEQ ID NO: 1585053 - protein, 21 aa, Staphylococcus aureus
TSKILLGFMVATGFLSMFVSN

SEQ ID NO: 1585054 - protein, 20 aa, Staphylococcus aureus
TSLISLIAFMLLQTFGRIPP

SEQ ID NO: 1585055 - protein, 20 aa, Staphylococcus aureus
TSMGALRTSIQNDNTTKTSQ

SEQ ID NO: 1585056 - protein, 30 aa, Staphylococcus aureus
TSNKFDMMLCLPIHKCINLFYTFVYHSNLL

SEQ ID NO: 1585057 - protein, 32 aa, Staphylococcus aureus
TSTAPVKIRTFSRLAMSTFASAATTSAVTANT

SEQ ID NO: 1585058 - protein, 18 aa, Staphylococcus aureus
TSTITIVSTDASGNKTTT

SEQ ID NO: 1585059 - protein, 18 aa, Staphylococcus aureus
TSTLLLIVILVVFAVLLI

SEQ ID NO: 1585060 - protein, 26 aa, Staphylococcus aureus
TSTSDSLRTSTSLSDSLSMSTSGSLS

SEQ ID NO: 1585061 - protein, 24 aa, Staphylococcus aureus
TSTSIRMSTIASESVSESTSESGS

SEQ ID NO: 1585062 - protein, 17 aa, Staphylococcus aureus
TSTSRLSSEATTSTSES

SEQ ID NO: 1585063 - protein, 23 aa, Staphylococcus aureus
TTFFKVVDEIVGFAKEIGAQLAS

SEQ ID NO: 1585064 - protein, 36 aa, Staphylococcus aureus
TTGKTEFWATSSDVLKLKANYTIDDSVKEGDTFTFK

SEQ ID NO: 1585065 - protein, 31 aa, Staphylococcus aureus
TTGSWKSEIIQSYILSLAINFHPHEVAFLLI

SEQ ID NO: 1585066 - protein, 17 aa, Staphylococcus aureus
TTKEKYFLLIFMSNAII

SEQ ID NO: 1585067 - protein, 18 aa, Staphylococcus aureus
TTKHEVEQTIYVSPLKLN

SEQ ID NO: 1585068 - protein, 24 aa, Staphylococcus aureus
TTLLEPFGLPALTLPFIIVTWILL

SEQ ID NO: 1585069 - protein, 18 aa, Staphylococcus aureus
TTLPNGWISNLTKSDNKN

SEQ ID NO: 1585070 - protein, 33 aa, Staphylococcus aureus
TTLTYIVSLCFLFICIYLNMAIGSSKINFSDII

SEQ ID NO: 1585071 - protein, 20 aa, Staphylococcus aureus
TTNLKFGYLDSPIVMLLTLD

SEQ ID NO: 1585072 - protein, 19 aa, Staphylococcus aureus
TTPLVFGMTLLIVTVIPFY

SEQ ID NO: 1585073 - protein, 26 aa, Staphylococcus aureus
TTRKVPDIKNGSLVMAKGQVLDNGRI

SEQ ID NO: 1585074 - protein, 22 aa, Staphylococcus aureus
TTSESPTLVQMVTLSSDNSKSA

SEQ ID NO: 1585075 - protein, 23 aa, Staphylococcus aureus
TTSESPTLVQMVTLSSNNSKSAS

SEQ ID NO: 1585076 - protein, 27 aa, Staphylococcus aureus
TTSRIIGHDAREEWRKNDGVVPVISSL

SEQ ID NO: 1585077 - protein, 36 aa, Staphylococcus aureus
TTTGKTEFWATSSDVLKLKANYTIDDSVKEGDTFTF

SEQ ID NO: 1585078 - protein, 18 aa, Staphylococcus aureus
TVAFTKERVEGFLNKSKN

SEQ ID NO: 1585079 - protein, 29 aa, Staphylococcus aureus
TVDGQENLYRIAIQYYGSGSPENVEKIRR

SEQ ID NO: 1585080 - protein, 28 aa, Staphylococcus aureus
TVGGIVPEILITKLIILTLFGMGFFVVG

SEQ ID NO: 1585081 - protein, 24 aa, Staphylococcus aureus
TVQHGICSMQHFIIASGYIGVWLY

SEQ ID NO: 1585082 - protein, 17 aa, Staphylococcus aureus
TVSESKPRVTRSADVAE

SEQ ID NO: 1585083 - protein, 18 aa, Staphylococcus aureus
TVSESKPRVTRSADVVEA

SEQ ID NO: 1585084 - protein, 27 aa, Staphylococcus aureus
TVTDKVKSGDYFTAKLPDSLTGNGDVD

SEQ ID NO: 1585085 - protein, 32 aa, Staphylococcus aureus
TVTDKVKSGDYFTAKLPDSLTGNGDVDYSNSN

SEQ ID NO: 1585086 - protein, 23 aa, Staphylococcus aureus
TVTGLPSGLSYDSATNSIIGTPT

SEQ ID NO: 1585087 - protein, 30 aa, Staphylococcus aureus
TVVGVGYFIHWIWPALPMPAAFAIAAILCP

SEQ ID NO: 1585088 - protein, 31 aa, Staphylococcus aureus
TVVGVGYFIHWIWPALPMPAAFAIAAILCPT

SEQ ID NO: 1585089 - protein, 25 aa, Staphylococcus aureus
TVVLIMVLIGFIFWRQDDYTSRNFE

SEQ ID NO: 1585090 - protein, 20 aa, Staphylococcus aureus
TVWNVLKTVASVVWNAISKA

SEQ ID NO: 1585091 - protein, 30 aa, Staphylococcus aureus
TVYPHQAGYVKLNYGFSVPNSAVKGDTFKI

SEQ ID NO: 1585092 - protein, 17 aa, Staphylococcus aureus
TWIAKRVGLTWQDLEKG

SEQ ID NO: 1585093 - protein, 23 aa, Staphylococcus aureus
TWISLFFPFINWFIPKRYVKISR

SEQ ID NO: 1585094 - protein, 23 aa, Staphylococcus aureus
TWLTLFLPMMNWLIPKKYVKISK

SEQ ID NO: 1585095 - protein, 39 aa, Staphylococcus aureus
TYDANINIADEMFNNKITYNYSSPIAGIDKPNGANISSQ

SEQ ID NO: 1585096 - protein, 27 aa, Staphylococcus aureus
TYDILTKTYTFVFTDYVNNKENINGQF

SEQ ID NO: 1585097 - protein, 22 aa, Staphylococcus aureus
TYHSYHDLEFLFVTREDEVETL

SEQ ID NO: 1585098 - protein, 25 aa, Staphylococcus aureus
TYKEEFPNEGTLTAFNTNFNPNTGT

SEQ ID NO: 1585099 - protein, 17 aa, Staphylococcus aureus
TYKGRLSLKNEIYPFFL

SEQ ID NO: 1585100 - protein, 25 aa, Staphylococcus aureus
TYKRLRFQVFLGIFIGYAGYYLLRK

SEQ ID NO: 1585101 - protein, 22 aa, Staphylococcus aureus
TYLQIFVEWGILFGALFIIFML

SEQ ID NO: 1585102 - protein, 25 aa, Staphylococcus aureus
TYLVCNFCFIIWLLYTNTLLKECKI

SEQ ID NO: 1585103 - protein, 20 aa, Staphylococcus aureus
TYSVEFSTLAGYTPTTVNAG

SEQ ID NO: 1585104 - protein, 22 aa, Staphylococcus aureus
TYSVEFSTLAGYTPTTVNAGTD

SEQ ID NO: 1585105 - protein, 18 aa, Staphylococcus aureus
VAESGLKNGGYQVMIVIP

SEQ ID NO: 1585106 - protein, 17 aa, Staphylococcus aureus
VAFGFDCGASILVEGGV

SEQ ID NO: 1585107 - protein, 17 aa, Staphylococcus aureus
VAFRRARRLKRPIRMRN

SEQ ID NO: 1585108 - protein, 19 aa, Staphylococcus aureus
VAFRRARRLKRPIRMRNLV

SEQ ID NO: 1585109 - protein, 19 aa, Staphylococcus aureus
VAGAMIGIMYVFKFGPSIL

SEQ ID NO: 1585110 - protein, 28 aa, Staphylococcus aureus
VAGFGFDVFNYWLGIVMMLFISWLGLFL

SEQ ID NO: 1585111 - protein, 23 aa, Staphylococcus aureus
VAGLVGGHFVGLFVGVISGVFRV

SEQ ID NO: 1585112 - protein, 17 aa, Staphylococcus aureus
VAGPIGFVGLIVPHIVK

SEQ ID NO: 1585113 - protein, 21 aa, Staphylococcus aureus
VAIAVGIVFYFASSILAVIQT

SEQ ID NO: 1585114 - protein, 19 aa, Staphylococcus aureus
VAIGSIFTGIVWCLLLSGS

SEQ ID NO: 1585115 - protein, 27 aa, Staphylococcus aureus
VAIIVILLFLRNIRTTAISIISIPLSL

SEQ ID NO: 1585116 - protein, 18 aa, Staphylococcus aureus
VALACLTTACGLIGAVSE

SEQ ID NO: 1585117 - protein, 21 aa, Staphylococcus aureus
VALAFEFAVASLLSVPLLVSL

SEQ ID NO: 1585118 - protein, 18 aa, Staphylococcus aureus
VALDGDENLVAAKQQANN

SEQ ID NO: 1585119 - protein, 17 aa, Staphylococcus aureus
VALLCIKYLSLTQRKLF

SEQ ID NO: 1585120 - protein, 17 aa, Staphylococcus aureus
VALLGSLLLFRKRKQDH

SEQ ID NO: 1585121 - protein, 26 aa, Staphylococcus aureus
VALVQSSRVDLIFTRFENMYFKIIGT

SEQ ID NO: 1585122 - protein, 18 aa, Staphylococcus aureus
VAMFIPLFFIYKYHQPMF

SEQ ID NO: 1585123 - protein, 25 aa, Staphylococcus aureus
VAQAKESAKRALASYSNLNNAQSTA

SEQ ID NO: 1585124 - protein, 18 aa, Staphylococcus aureus
VAQIDVKGSDVWTAFEHS

SEQ ID NO: 1585125 - protein, 18 aa, Staphylococcus aureus
VASSIAEKMGQALNFIIT

SEQ ID NO: 1585126 - protein, 18 aa, Staphylococcus aureus
VAVSEYFHRIVPKVSYKA

SEQ ID NO: 1585127 - protein, 20 aa, Staphylococcus aureus
VCIGLVFGLIAGIERKWLDQ

SEQ ID NO: 1585128 - protein, 21 aa, Staphylococcus aureus
VDAYLKVIAVLLIAALVSLFV

SEQ ID NO: 1585129 - protein, 17 aa, Staphylococcus aureus
VDDKVKSGDYFTIKYSD

SEQ ID NO: 1585130 - protein, 22 aa, Staphylococcus aureus
VDLFLNRLIIILSILFFVLMIC

SEQ ID NO: 1585131 - protein, 19 aa, Staphylococcus aureus
VDLVSTWIAYFLPMINWNS

SEQ ID NO: 1585132 - protein, 28 aa, Staphylococcus aureus
VDPVTNRDYSIFGWNNENVVRYGGGSAD

SEQ ID NO: 1585133 - protein, 22 aa, Staphylococcus aureus
VDQELFTGLTYCFASYISETPG

SEQ ID NO: 1585134 - protein, 23 aa, Staphylococcus aureus
VDTRRAIYFIPIWFMLLAFMYLR

SEQ ID NO: 1585135 - protein, 18 aa, Staphylococcus aureus
VDVFPVKDYGSGMTPFYT

SEQ ID NO: 1585136 - protein, 20 aa, Staphylococcus aureus
VEAIKELWLPILTISAILAI

SEQ ID NO: 1585137 - protein, 23 aa, Staphylococcus aureus
VEAIKELWLPILTISAILAIAKV

SEQ ID NO: 1585138 - protein, 21 aa, Staphylococcus aureus
VEFSLLVYMVYAGFDRQIITF

SEQ ID NO: 1585139 - protein, 17 aa, Staphylococcus aureus
VEIQLLVTMSYQYILGI

SEQ ID NO: 1585140 - protein, 17 aa, Staphylococcus aureus
VEIQLLVTMSYQYILSV

SEQ ID NO: 1585141 - protein, 31 aa, Staphylococcus aureus
VEKFANFFKMLWLRLKAMKHYKALNKESKKQ

SEQ ID NO: 1585142 - protein, 24 aa, Staphylococcus aureus
VESYRAAILYHEWYFMDHWKLMLY

SEQ ID NO: 1585143 - protein, 20 aa, Staphylococcus aureus
VFAVILKFSLWRYKKLTVAI

SEQ ID NO: 1585144 - protein, 26 aa, Staphylococcus aureus
VFAVKLRWFPVAGWEGISTVILPSFA

SEQ ID NO: 1585145 - protein, 17 aa, Staphylococcus aureus
VFAWSPFVILTAFVLVW

SEQ ID NO: 1585146 - protein, 26 aa, Staphylococcus aureus
VFDFIRRTSCCIICIPVLIHTIPIVF

SEQ ID NO: 1585147 - protein, 19 aa, Staphylococcus aureus
VFDNLPLLFAVGTALGLAG

SEQ ID NO: 1585148 - protein, 19 aa, Staphylococcus aureus
VFETNRGAVFPGVSDVYDA

SEQ ID NO: 1585149 - protein, 17 aa, Staphylococcus aureus
VFFIPFVLAPIVNVWIF

SEQ ID NO: 1585150 - protein, 25 aa, Staphylococcus aureus
VFIAFTVTFIGLWVMAAFFNNTNAI

SEQ ID NO: 1585151 - protein, 23 aa, Staphylococcus aureus
VFILNFKLIFTLPLTILNRQSLF

SEQ ID NO: 1585152 - protein, 19 aa, Staphylococcus aureus
VFNIISTIMVSMLILSLGA

SEQ ID NO: 1585153 - protein, 25 aa, Staphylococcus aureus
VFPEQKLPLYIVFTLFVAVAIIMNV

SEQ ID NO: 1585154 - protein, 24 aa, Staphylococcus aureus
VFPEQKLPLYIVFTLFVVVAIVSN

SEQ ID NO: 1585155 - protein, 18 aa, Staphylococcus aureus
VGAARGNIIYSVIVGTIM

SEQ ID NO: 1585156 - protein, 17 aa, Staphylococcus aureus
VGAFSFVAVVVLLLFVV

SEQ ID NO: 1585157 - protein, 17 aa, Staphylococcus aureus
VGARSTLFITILTLIAI

SEQ ID NO: 1585158 - protein, 18 aa, Staphylococcus aureus
VGEKLLQSLGCKKPMLIG

SEQ ID NO: 1585159 - protein, 17 aa, Staphylococcus aureus
VGEMLLQTFGCKKPMLI

SEQ ID NO: 1585160 - protein, 18 aa, Staphylococcus aureus
VGHSYSFVDVMIIFLREG

SEQ ID NO: 1585161 - protein, 37 aa, Staphylococcus aureus
VGIDSGDTVYPHQAGYVKLNYGFSVPNSAVQGDTFKI

SEQ ID NO: 1585162 - protein, 30 aa, Staphylococcus aureus
VGIIKFGIPMLIPLLIKYAIDGVINNHELT

SEQ ID NO: 1585163 - protein, 17 aa, Staphylococcus aureus
VGIPTVIVLLGITWLYL

SEQ ID NO: 1585164 - protein, 27 aa, Staphylococcus aureus
VGIRMFKRYATIMVSARILERVIATPI

SEQ ID NO: 1585165 - protein, 20 aa, Staphylococcus aureus
VGKEVKNHFYLLENQINVDE

SEQ ID NO: 1585166 - protein, 21 aa, Staphylococcus aureus
VGLILGFMVWLGMKSVPIFFI

SEQ ID NO: 1585167 - protein, 19 aa, Staphylococcus aureus
VGLILLRLFKINLFSFKKL

SEQ ID NO: 1585168 - protein, 17 aa, Staphylococcus aureus
VGNGSALRGYKEYLKTR

SEQ ID NO: 1585169 - protein, 18 aa, Staphylococcus aureus
VGSYFIAFALFFFAFTTI

SEQ ID NO: 1585170 - protein, 21 aa, Staphylococcus aureus
VGSYFIAFALFFFAFTTILSY

SEQ ID NO: 1585171 - protein, 19 aa, Staphylococcus aureus
VGVFIPFTLAQFGMVIKWI

SEQ ID NO: 1585172 - protein, 19 aa, Staphylococcus aureus
VGVFIPFTLSQFGMVIKWL

SEQ ID NO: 1585173 - protein, 31 aa, Staphylococcus aureus
VGVFKPHAVRDMNGHALPLTKDGNFYQTNVD

SEQ ID NO: 1585174 - protein, 17 aa, Staphylococcus aureus
VGVLFLVGFLIYLFYSP

SEQ ID NO: 1585175 - protein, 18 aa, Staphylococcus aureus
VGVLFLVGFLIYLFYSPR

SEQ ID NO: 1585176 - protein, 19 aa, Staphylococcus aureus
VGVWWRELLAISIQLPLQV

SEQ ID NO: 1585177 - protein, 18 aa, Staphylococcus aureus
VGYKRLEIDFSKEGRDIS

SEQ ID NO: 1585178 - protein, 25 aa, Staphylococcus aureus
VHHLDPRAKLMFVFLFIILIFVCHS

SEQ ID NO: 1585179 - protein, 18 aa, Staphylococcus aureus
VHKLTKRKWLIFYNTYVN

SEQ ID NO: 1585180 - protein, 26 aa, Staphylococcus aureus
VHYLDPRAKLMFVFLFIILIFFCHSP

SEQ ID NO: 1585181 - protein, 23 aa, Staphylococcus aureus
VIAIVIGFFLLIFIMIAYLVGSF

SEQ ID NO: 1585182 - protein, 17 aa, Staphylococcus aureus
VICCAIFLGVLILFLFL

SEQ ID NO: 1585183 - protein, 21 aa, Staphylococcus aureus
VICYGLIFGLFYLLSGSTADY

SEQ ID NO: 1585184 - protein, 24 aa, Staphylococcus aureus
VIDSDGNVIYTFTDYVDNKENVTA

SEQ ID NO: 1585185 - protein, 24 aa, Staphylococcus aureus
VIDSDGNVIYTFTDYVDTKENVTA

SEQ ID NO: 1585186 - protein, 17 aa, Staphylococcus aureus
VIEDTGLMQSIDSPMFI

SEQ ID NO: 1585187 - protein, 23 aa, Staphylococcus aureus
VIGGVCILIGILIASRQAALLAV

SEQ ID NO: 1585188 - protein, 18 aa, Staphylococcus aureus
VIGIAVVCLMIFSSQKTT

SEQ ID NO: 1585189 - protein, 18 aa, Staphylococcus aureus
VIHVCVLLFIIISIALIF

SEQ ID NO: 1585190 - protein, 19 aa, Staphylococcus aureus
VIIEILAGIVLSAIITAIA

SEQ ID NO: 1585191 - protein, 23 aa, Staphylococcus aureus
VILHYHYIMMIFATIIVVQILLQ

SEQ ID NO: 1585192 - protein, 21 aa, Staphylococcus aureus
VILLFSIPTPVAVILMGIAAL

SEQ ID NO: 1585193 - protein, 17 aa, Staphylococcus aureus
VILLFVFSPEKEEEQTD

SEQ ID NO: 1585194 - protein, 17 aa, Staphylococcus aureus
VILMFVFSPEEDKQTDG

SEQ ID NO: 1585195 - protein, 24 aa, Staphylococcus aureus
VILYMGSLFYAWMAIRNLWNRPLL

SEQ ID NO: 1585196 - protein, 17 aa, Staphylococcus aureus
VIMATTILFSSFFIVSI

SEQ ID NO: 1585197 - protein, 23 aa, Staphylococcus aureus
VINLVCLIIVYFNTYKMSKCIDN

SEQ ID NO: 1585198 - protein, 25 aa, Staphylococcus aureus
VIPALICLFGIFGTMIYRSFQIDNG

SEQ ID NO: 1585199 - protein, 36 aa, Staphylococcus aureus
VIPKYKNRRKMIVICFYSLLAILLILLLASFIKATR

SEQ ID NO: 1585200 - protein, 19 aa, Staphylococcus aureus
VISGGILMAIVFLFGVDSF

SEQ ID NO: 1585201 - protein, 31 aa, Staphylococcus aureus
VITFKGGLAPFTILFSIPFTVIGVIIALLIT

SEQ ID NO: 1585202 - protein, 24 aa, Staphylococcus aureus
VIYFYLGTIIFKLGNSKKVIVTSY

SEQ ID NO: 1585203 - protein, 20 aa, Staphylococcus aureus
VKEKRIRPEDMHIMANIFLP

SEQ ID NO: 1585204 - protein, 20 aa, Staphylococcus aureus
VKEVKAPKEAKEEKPAAKAD

SEQ ID NO: 1585205 - protein, 28 aa, Staphylococcus aureus
VKGHLLLELAVIFGISALVTAFLKHKHE

SEQ ID NO: 1585206 - protein, 21 aa, Staphylococcus aureus
VKHPIKTGMLNGKKYMVMETT

SEQ ID NO: 1585207 - protein, 21 aa, Staphylococcus aureus
VKIKICKQISATFILSIVINL

SEQ ID NO: 1585208 - protein, 20 aa, Staphylococcus aureus
VKLKSILVAILFTSLALTAG

SEQ ID NO: 1585209 - protein, 17 aa, Staphylococcus aureus
VKMANIFIYKGKTVVKL

SEQ ID NO: 1585210 - protein, 18 aa, Staphylococcus aureus
VKNKNFWQDGWSQLRKNK

SEQ ID NO: 1585211 - protein, 38 aa, Staphylococcus aureus
VKNNLRYGIRKHKLGAASVFLGTMIVVGMGQDKEAAAS

SEQ ID NO: 1585212 - protein, 27 aa, Staphylococcus aureus
VKPDEKLYKIGDYVWEDVDKDGVQGTD

SEQ ID NO: 1585213 - protein, 21 aa, Staphylococcus aureus
VKPGDYFDFTLSNNVETHGIS

SEQ ID NO: 1585214 - protein, 19 aa, Staphylococcus aureus
VKPTIYFKLYKQDDNQNTT

SEQ ID NO: 1585215 - protein, 22 aa, Staphylococcus aureus
VKQFLNKKVKRYEIPSMIHHVE

SEQ ID NO: 1585216 - protein, 17 aa, Staphylococcus aureus
VKQGVNFTDADKAKRDA

SEQ ID NO: 1585217 - protein, 21 aa, Staphylococcus aureus
VKRSFGRIGQIMRKEVNGTSS

SEQ ID NO: 1585218 - protein, 18 aa, Staphylococcus aureus
VKSISFTRFYWGLVKHED

SEQ ID NO: 1585219 - protein, 38 aa, Staphylococcus aureus
VKSNLRYGIRKHKLGAASVFLGTMIVVGMGQEKEAAAS

SEQ ID NO: 1585220 - protein, 23 aa, Staphylococcus aureus
VKVFVAPTIKFMEWRVAIQTDAH

SEQ ID NO: 1585221 - protein, 19 aa, Staphylococcus aureus
VKVLFLFHVPKYVLGTVSA

SEQ ID NO: 1585222 - protein, 21 aa, Staphylococcus aureus
VKVTIDSGTTVYPHQAGYVKL

SEQ ID NO: 1585223 - protein, 22 aa, Staphylococcus aureus
VKVVVANIGYEGQYHVRIVNQD

SEQ ID NO: 1585224 - protein, 26 aa, Staphylococcus aureus
VKWSTAQRMIITWVITLPISAFLAAF

SEQ ID NO: 1585225 - protein, 20 aa, Staphylococcus aureus
VLAAAWVFRERYFDMLYLKK

SEQ ID NO: 1585226 - protein, 24 aa, Staphylococcus aureus
VLADEIKYPLAKFNQPEAKDKTEL

SEQ ID NO: 1585227 - protein, 24 aa, Staphylococcus aureus
VLELILAILYFKLGFHYIVSVISG

SEQ ID NO: 1585228 - protein, 18 aa, Staphylococcus aureus
VLFDEGFIALRPSGTEPK

SEQ ID NO: 1585229 - protein, 21 aa, Staphylococcus aureus
VLFVLYKKRREIIDFVTRGNL

SEQ ID NO: 1585230 - protein, 23 aa, Staphylococcus aureus
VLGDHSWFYLPITYATRYVYMFL

SEQ ID NO: 1585231 - protein, 25 aa, Staphylococcus aureus
VLGFLRLVFIPSMIVFFQDSTIDNL

SEQ ID NO: 1585232 - protein, 24 aa, Staphylococcus aureus
VLIIDMCLFLSYINIYLCVFVIII

SEQ ID NO: 1585233 - protein, 19 aa, Staphylococcus aureus
VLIVWNFSTGLTFTLDHWL

SEQ ID NO: 1585234 - protein, 22 aa, Staphylococcus aureus
VLKDNEHSPLLFAKRRKDKEED

SEQ ID NO: 1585235 - protein, 24 aa, Staphylococcus aureus
VLKKDIKGSYFVKDKNFDVSKFIN

SEQ ID NO: 1585236 - protein, 23 aa, Staphylococcus aureus
VLKNKIKLLPAILISISSFTVIH

SEQ ID NO: 1585237 - protein, 17 aa, Staphylococcus aureus
VLLIQLGFEPLKAAMLC

SEQ ID NO: 1585238 - protein, 23 aa, Staphylococcus aureus
VLLPLSCLISILLMTQGVPQTLH

SEQ ID NO: 1585239 - protein, 17 aa, Staphylococcus aureus
VLLSFLAIQLLENKSKK

SEQ ID NO: 1585240 - protein, 18 aa, Staphylococcus aureus
VLLSTHRGTVSSGREGSG

SEQ ID NO: 1585241 - protein, 23 aa, Staphylococcus aureus
VLMAFICVFAFDLKDLLQGFNVE

SEQ ID NO: 1585242 - protein, 20 aa, Staphylococcus aureus
VLMFFIWPSIQAGIYHVGGF

SEQ ID NO: 1585243 - protein, 20 aa, Staphylococcus aureus
VLPKVLKYIGMVNMYYLSSL

SEQ ID NO: 1585244 - protein, 25 aa, Staphylococcus aureus
VLRQYRLSTPLLNFAVFKNKQFTVG

SEQ ID NO: 1585245 - protein, 24 aa, Staphylococcus aureus
VLSLCISIPLGIIAAKRFHKLSDK

SEQ ID NO: 1585246 - protein, 24 aa, Staphylococcus aureus
VLSRFLNYYSHLIIIKSLEESEKL

SEQ ID NO: 1585247 - protein, 25 aa, Staphylococcus aureus
VLVDYEKYGKFYNLSIKGTIDQIDK

SEQ ID NO: 1585248 - protein, 23 aa, Staphylococcus aureus
VLYRLTFVGSIFLAVISILPILA

SEQ ID NO: 1585249 - protein, 25 aa, Staphylococcus aureus
VMGLYICMYAIFAMTAYNHSKRTIR

SEQ ID NO: 1585250 - protein, 29 aa, Staphylococcus aureus
VMIKGQGWSNIWFDLLILMIFIMVFIILN

SEQ ID NO: 1585251 - protein, 20 aa, Staphylococcus aureus
VMIVFLCFDSKPANKYGESP

SEQ ID NO: 1585252 - protein, 18 aa, Staphylococcus aureus
VMKQTPIGIKFRLLKIGL

SEQ ID NO: 1585253 - protein, 24 aa, Staphylococcus aureus
VMYSEKIVVLPIIIYAILFVIIGI

SEQ ID NO: 1585254 - protein, 24 aa, Staphylococcus aureus
VMYSEKIVVLPIIIYAIVFVVIGI

SEQ ID NO: 1585255 - protein, 24 aa, Staphylococcus aureus
VNATELKAGQTIRVENGETIPADG

SEQ ID NO: 1585256 - protein, 19 aa, Staphylococcus aureus
VNDKVHFSNIDIAIDKGHV

SEQ ID NO: 1585257 - protein, 18 aa, Staphylococcus aureus
VNDKVHFTNIDIAIDKGH

SEQ ID NO: 1585258 - protein, 20 aa, Staphylococcus aureus
VNHSHWITGMSIEGHKENII

SEQ ID NO: 1585259 - protein, 19 aa, Staphylococcus aureus
VNINEIKDKVLSEHNSTVQ

SEQ ID NO: 1585260 - protein, 17 aa, Staphylococcus aureus
VNKRLNTLMFYILLIIH

SEQ ID NO: 1585261 - protein, 17 aa, Staphylococcus aureus
VNLFRYVIQEGGISFST

SEQ ID NO: 1585262 - protein, 20 aa, Staphylococcus aureus
VNLPLKYPFIAAISTSCVLG

SEQ ID NO: 1585263 - protein, 18 aa, Staphylococcus aureus
VNNIPIITSHALRHTHCS

SEQ ID NO: 1585264 - protein, 29 aa, Staphylococcus aureus
VNPKQRVLGNTWLYIKGYQDKIEESSGKV

SEQ ID NO: 1585265 - protein, 22 aa, Staphylococcus aureus
VNREGKLIGVVVAKISMPNVEN

SEQ ID NO: 1585266 - protein, 26 aa, Staphylococcus aureus
VNSAGVIPVIFAMAFFLLPRTLTLFY

SEQ ID NO: 1585267 - protein, 39 aa, Staphylococcus aureus
VNSTTGKTEFWATSSDVLKLKANYTIDDSVKEGDTFTFK

SEQ ID NO: 1585268 - protein, 21 aa, Staphylococcus aureus
VPAEPGKPVPPAEEEPKKPSK

SEQ ID NO: 1585269 - protein, 20 aa, Staphylococcus aureus
VPAEPGKPVPPAKDEPKKPS

SEQ ID NO: 1585270 - protein, 20 aa, Staphylococcus aureus
VPAEPGKPVPPAKEEPKKPS

SEQ ID NO: 1585271 - protein, 19 aa, Staphylococcus aureus
VPDLIRLSKTFLIESRELT

SEQ ID NO: 1585272 - protein, 19 aa, Staphylococcus aureus
VPIVPELLQSLNFNQFNLV

SEQ ID NO: 1585273 - protein, 27 aa, Staphylococcus aureus
VPLIVIIVCLLFKMATVPAMVISSFSA

SEQ ID NO: 1585274 - protein, 20 aa, Staphylococcus aureus
VPLSALLIVYFIYYIFEKNI

SEQ ID NO: 1585275 - protein, 26 aa, Staphylococcus aureus
VPNIFGFKWDKGMEAILMKPYNYTME

SEQ ID NO: 1585276 - protein, 20 aa, Staphylococcus aureus
VPSEPGKPVPPAKEEPKKPS

SEQ ID NO: 1585277 - protein, 19 aa, Staphylococcus aureus
VPSEPGTPVPPTPEVPAEP

SEQ ID NO: 1585278 - protein, 18 aa, Staphylococcus aureus
VPTEPGKPVPPAKEEPKK

SEQ ID NO: 1585279 - protein, 24 aa, Staphylococcus aureus
VPTNWKFICCAFVDQELFTGLTYC

SEQ ID NO: 1585280 - protein, 17 aa, Staphylococcus aureus
VPVKFDVLTLLVFAVVL

SEQ ID NO: 1585281 - protein, 22 aa, Staphylococcus aureus
VPYGDDWLAYFMRRLAERPQNL

SEQ ID NO: 1585282 - protein, 32 aa, Staphylococcus aureus
VQFGTFEYTESAVTQVRYVDVTTGKDIIPPKT

SEQ ID NO: 1585283 - protein, 30 aa, Staphylococcus aureus
VQGDTFKITVPKELNLNGVTSTAKVPPIMA

SEQ ID NO: 1585284 - protein, 18 aa, Staphylococcus aureus
VQNLILYISWIFMTMLFM

SEQ ID NO: 1585285 - protein, 22 aa, Staphylococcus aureus
VQNVVKYIVWFIVITTILSKFG

SEQ ID NO: 1585286 - protein, 28 aa, Staphylococcus aureus
VQYMSSWPWHWAEPMKHLMENGSISTYG

SEQ ID NO: 1585287 - protein, 19 aa, Staphylococcus aureus
VQYRTSFLIYKEETIRIER

SEQ ID NO: 1585288 - protein, 22 aa, Staphylococcus aureus
VRDDAWLQKKLNYISKKTYQGI

SEQ ID NO: 1585289 - protein, 19 aa, Staphylococcus aureus
VREVLRPYKVPMLTMPFVI

SEQ ID NO: 1585290 - protein, 20 aa, Staphylococcus aureus
VRIVDKEAFTKANTDKSNKK

SEQ ID NO: 1585291 - protein, 26 aa, Staphylococcus aureus
VRKKRTRSLLALFIMICTGCRVSGAR

SEQ ID NO: 1585292 - protein, 19 aa, Staphylococcus aureus
VRLSRERLILFFIAVMLSS

SEQ ID NO: 1585293 - protein, 23 aa, Staphylococcus aureus
VRQERGITFGLFRLSVGLEDPDE

SEQ ID NO: 1585294 - protein, 23 aa, Staphylococcus aureus
VSDSIKTNVAMNWYFIAVSVVVL

SEQ ID NO: 1585295 - protein, 22 aa, Staphylococcus aureus
VSESIKTNVAMNWYFIAASVVV

SEQ ID NO: 1585296 - protein, 21 aa, Staphylococcus aureus
VSFCIGILLFIGYSVIGLKYS

SEQ ID NO: 1585297 - protein, 26 aa, Staphylococcus aureus
VSFIPGFELSVFSAFAKTLGYIILSA

SEQ ID NO: 1585298 - protein, 18 aa, Staphylococcus aureus
VSFIVHFSFSIVIAIIYC

SEQ ID NO: 1585299 - protein, 17 aa, Staphylococcus aureus
VSFIVHLSFSIVIAIIY

SEQ ID NO: 1585300 - protein, 23 aa, Staphylococcus aureus
VSGDMFLAMKWEQIHLKDGLKKV

SEQ ID NO: 1585301 - protein, 17 aa, Staphylococcus aureus
VSGMTHLNDAQKQALKG

SEQ ID NO: 1585302 - protein, 18 aa, Staphylococcus aureus
VSGVTDLKNSATSLNNAM

SEQ ID NO: 1585303 - protein, 18 aa, Staphylococcus aureus
VSHIKGWLTIIIGALVLG

SEQ ID NO: 1585304 - protein, 20 aa, Staphylococcus aureus
VSILLTLLAMYLIKHAPETK

SEQ ID NO: 1585305 - protein, 19 aa, Staphylococcus aureus
VSKGSLMMISSPRIIDAEK

SEQ ID NO: 1585306 - protein, 19 aa, Staphylococcus aureus
VSKLIPVMFIRRWFDMKTT

SEQ ID NO: 1585307 - protein, 25 aa, Staphylococcus aureus
VSLASDLLGIIAMKKLFVNNRASGI

SEQ ID NO: 1585308 - protein, 22 aa, Staphylococcus aureus
VSLCIVCVFVLNYFYKNDYIEY

SEQ ID NO: 1585309 - protein, 23 aa, Staphylococcus aureus
VSQIKRLKFDSLIIDNANLSSPY

SEQ ID NO: 1585310 - protein, 23 aa, Staphylococcus aureus
VSSFKLGDSSFLFFDSFIPNSRD

SEQ ID NO: 1585311 - protein, 23 aa, Staphylococcus aureus
VSTARKVPEIKNGSVVMATGEIL

SEQ ID NO: 1585312 - protein, 23 aa, Staphylococcus aureus
VSTARKVPEIKNGSVVMATGKIL

SEQ ID NO: 1585313 - protein, 24 aa, Staphylococcus aureus
VSTARKVPEIKNGSVVMATGKILE

SEQ ID NO: 1585314 - protein, 17 aa, Staphylococcus aureus
VSVLFIFFKAPDLALTQ

SEQ ID NO: 1585315 - protein, 18 aa, Staphylococcus aureus
VSVLGSLFSILTIRKIDP

SEQ ID NO: 1585316 - protein, 25 aa, Staphylococcus aureus
VTAIVCGRPAMISGATGAVALLVTP

SEQ ID NO: 1585317 - protein, 22 aa, Staphylococcus aureus
VTATGLLMIYAFNPPASWLNHL

SEQ ID NO: 1585318 - protein, 18 aa, Staphylococcus aureus
VTCFLGYNMYLLYNNTIN

SEQ ID NO: 1585319 - protein, 28 aa, Staphylococcus aureus
VTFIAKHKWSAVIAWIVIVAAILIPLAT

SEQ ID NO: 1585320 - protein, 19 aa, Staphylococcus aureus
VTFIPHVVALFSINKDALK

SEQ ID NO: 1585321 - protein, 19 aa, Staphylococcus aureus
VTGNSFLFVVILRKYVHTF

SEQ ID NO: 1585322 - protein, 17 aa, Staphylococcus aureus
VTIAFLLYIASIVILGV

SEQ ID NO: 1585323 - protein, 25 aa, Staphylococcus aureus
VTIMALRWGISVGIASAVLTVVIIL

SEQ ID NO: 1585324 - protein, 26 aa, Staphylococcus aureus
VTKEEIPYETKRVLDPTMEPGSPDKV

SEQ ID NO: 1585325 - protein, 23 aa, Staphylococcus aureus
VTKNPVDEIVHFAPEEVPQGHKD

SEQ ID NO: 1585326 - protein, 27 aa, Staphylococcus aureus
VTKQPIPHKTIREFDPTLEPGSPDVIV

SEQ ID NO: 1585327 - protein, 19 aa, Staphylococcus aureus
VTKRWAGKTKTHFGLLLTA

SEQ ID NO: 1585328 - protein, 18 aa, Staphylococcus aureus
VTLATGIGSTTANKTVLV

SEQ ID NO: 1585329 - protein, 27 aa, Staphylococcus aureus
VTLLIVYIIPRFFKAIPAPLIAIIVLT

SEQ ID NO: 1585330 - protein, 17 aa, Staphylococcus aureus
VTNQFNITYSNDNKTAT

SEQ ID NO: 1585331 - protein, 27 aa, Staphylococcus aureus
VTNTVTRLPSGLTFDSTNNTISGTPTN

SEQ ID NO: 1585332 - protein, 17 aa, Staphylococcus aureus
VTPSEITAALNKVTQAK

SEQ ID NO: 1585333 - protein, 27 aa, Staphylococcus aureus
VVALAVYLFRFVWVYVLYPYFYLAISP

SEQ ID NO: 1585334 - protein, 17 aa, Staphylococcus aureus
VVALFSINKDALKETKV

SEQ ID NO: 1585335 - protein, 22 aa, Staphylococcus aureus
VVFFLGDFIFKYTDWGITKATI

SEQ ID NO: 1585336 - protein, 24 aa, Staphylococcus aureus
VVFGGPRLGTSFISAGDDKFLAIT

SEQ ID NO: 1585337 - protein, 19 aa, Staphylococcus aureus
VVFPLIFMFGVAFTNYNLY

SEQ ID NO: 1585338 - protein, 19 aa, Staphylococcus aureus
VVFSQRQAQTFKIQQQQFV

SEQ ID NO: 1585339 - protein, 27 aa, Staphylococcus aureus
VVGISGLLASFWFFIAKRRRKEDEEEE

SEQ ID NO: 1585340 - protein, 17 aa, Staphylococcus aureus
VVIAVIFGVLLGTIGGY

SEQ ID NO: 1585341 - protein, 19 aa, Staphylococcus aureus
VVISIIALIIFGPKKLPQF

SEQ ID NO: 1585342 - protein, 17 aa, Staphylococcus aureus
VVLFFSFVALKYTHSIN

SEQ ID NO: 1585343 - protein, 18 aa, Staphylococcus aureus
VVLFFSFVALKYTHSINI

SEQ ID NO: 1585344 - protein, 26 aa, Staphylococcus aureus
VVLKIDFKIALVFGLLFYIVGYSGIT

SEQ ID NO: 1585345 - protein, 24 aa, Staphylococcus aureus
VVLLPFHWRTLQSVNWQAVQLDTF

SEQ ID NO: 1585346 - protein, 20 aa, Staphylococcus aureus
VVLLPTHRGTVSSGREGSDR

SEQ ID NO: 1585347 - protein, 18 aa, Staphylococcus aureus
VVMPFLIVAIITLSGIIT

SEQ ID NO: 1585348 - protein, 25 aa, Staphylococcus aureus
VVRFILRTVVGYGIFAYGLHYFSNL

SEQ ID NO: 1585349 - protein, 24 aa, Staphylococcus aureus
VVSFCFIFLLLVFFKYILKRYFNY

SEQ ID NO: 1585350 - protein, 31 aa, Staphylococcus aureus
VVSFCFIFLLLVFFRYILKRYFNYSLNYKVW

SEQ ID NO: 1585351 - protein, 19 aa, Staphylococcus aureus
VVSNIFKYRQRIIDKANSN

SEQ ID NO: 1585352 - protein, 32 aa, Staphylococcus aureus
VVSQAVNPSTPRMRAFSLAAVAADAPAAGTDI

SEQ ID NO: 1585353 - protein, 23 aa, Staphylococcus aureus
VVSSCIMLPLGYMVGYFIGTRPH

SEQ ID NO: 1585354 - protein, 17 aa, Staphylococcus aureus
VVTPVIEINEKVKAVAP

SEQ ID NO: 1585355 - protein, 24 aa, Staphylococcus aureus
VVVAEILMGIVIGNSFLNIVERDS

SEQ ID NO: 1585356 - protein, 18 aa, Staphylococcus aureus
VVVGVVFSAIFFATKISK

SEQ ID NO: 1585357 - protein, 20 aa, Staphylococcus aureus
VWDIIKPRLIPSLEMGITAM

SEQ ID NO: 1585358 - protein, 27 aa, Staphylococcus aureus
VYAIIALCLYNFFSSILWLIGGILLIW

SEQ ID NO: 1585359 - protein, 18 aa, Staphylococcus aureus
VYKRRKMVKEEGLALTSC

SEQ ID NO: 1585360 - protein, 31 aa, Staphylococcus aureus
VYKVDNAADLSESYFVNPENFEDVTNSVNIT

SEQ ID NO: 1585361 - protein, 29 aa, Staphylococcus aureus
VYKVDNASDLSESYYVNPDNFEDVTDSVN

SEQ ID NO: 1585362 - protein, 19 aa, Staphylococcus aureus
VYLRAIICAIIIIAHLLTQ

SEQ ID NO: 1585363 - protein, 23 aa, Staphylococcus aureus
VYNRCLFMGGLIYQVDTLHFIPA

SEQ ID NO: 1585364 - protein, 24 aa, Staphylococcus aureus
VYNSCLFMGGLIYQFDTLHFIPAI

SEQ ID NO: 1585365 - protein, 20 aa, Staphylococcus aureus
VYPFRDGYKNYVFKDKNSYY

SEQ ID NO: 1585366 - protein, 23 aa, Staphylococcus aureus
VYQFEFPQTIYTTTVGGTLASGT

SEQ ID NO: 1585367 - protein, 23 aa, Staphylococcus aureus
VYVICCIIGYLFFGLGLGIYATP

SEQ ID NO: 1585368 - protein, 18 aa, Staphylococcus aureus
VYYIFWLLAKRKYILVTF

SEQ ID NO: 1585369 - protein, 23 aa, Staphylococcus aureus
WAAMNKPNAAKVINAKYDVIYNG

SEQ ID NO: 1585370 - protein, 18 aa, Staphylococcus aureus
WAEASIVVILFAISEALE

SEQ ID NO: 1585371 - protein, 17 aa, Staphylococcus aureus
WAENSSVASRFFNMMNT

SEQ ID NO: 1585372 - protein, 20 aa, Staphylococcus aureus
WALQSIRLDQFFKKGYATQL

SEQ ID NO: 1585373 - protein, 22 aa, Staphylococcus aureus
WDIFVSKLFLALTVFAMYMVAI

SEQ ID NO: 1585374 - protein, 18 aa, Staphylococcus aureus
WEEHPLFTIIGGACLVAG

SEQ ID NO: 1585375 - protein, 18 aa, Staphylococcus aureus
WEEHPLLTIIGGTCLVAG

SEQ ID NO: 1585376 - protein, 17 aa, Staphylococcus aureus
WFSRVASSIAEKMGQAL

SEQ ID NO: 1585377 - protein, 21 aa, Staphylococcus aureus
WFSTFSIICLSIFSITTLIFI

SEQ ID NO: 1585378 - protein, 18 aa, Staphylococcus aureus
WGNTRTFTQFTFKKSIIF

SEQ ID NO: 1585379 - protein, 17 aa, Staphylococcus aureus
WHFKSIRDVNLFSQFLN

SEQ ID NO: 1585380 - protein, 21 aa, Staphylococcus aureus
WHVLPLGFLFGLGFDTASEIA

SEQ ID NO: 1585381 - protein, 22 aa, Staphylococcus aureus
WHVLPLGFLFGLGFDTASEIAL

SEQ ID NO: 1585382 - protein, 17 aa, Staphylococcus aureus
WINEINDKFGFYIILIL

SEQ ID NO: 1585383 - protein, 18 aa, Staphylococcus aureus
WIQLHPKKAQAMMTKEQA

SEQ ID NO: 1585384 - protein, 27 aa, Staphylococcus aureus
WIRPYKVRMILGFSMSFLNAIFIALPI

SEQ ID NO: 1585385 - protein, 22 aa, Staphylococcus aureus
WISLFFPFINWFIPKRYVKISK

SEQ ID NO: 1585386 - protein, 32 aa, Staphylococcus aureus
WIVSFIPGFELSVFSAFAKTLGYIILSACMTF

SEQ ID NO: 1585387 - protein, 17 aa, Staphylococcus aureus
WKCREIGIEAVRNKGYA

SEQ ID NO: 1585388 - protein, 17 aa, Staphylococcus aureus
WKDFMVEGERVRTISKD

SEQ ID NO: 1585389 - protein, 21 aa, Staphylococcus aureus
WKGAIFTVVCWFVISLAIFSI

SEQ ID NO: 1585390 - protein, 17 aa, Staphylococcus aureus
WLFMPYLILVLLGGILH

SEQ ID NO: 1585391 - protein, 19 aa, Staphylococcus aureus
WLLAKRKYILVTFWTIIIL

SEQ ID NO: 1585392 - protein, 20 aa, Staphylococcus aureus
WLTTIFMLGINFPMLLVGRS

SEQ ID NO: 1585393 - protein, 19 aa, Staphylococcus aureus
WMAQLRDGVPFTAGAFTTG

SEQ ID NO: 1585394 - protein, 19 aa, Staphylococcus aureus
WMILGGLIIKKYPIYSFFE

SEQ ID NO: 1585395 - protein, 17 aa, Staphylococcus aureus
WMMHLILIGGSRLFWRI

SEQ ID NO: 1585396 - protein, 18 aa, Staphylococcus aureus
WMTFLRIGSKVIYSDETG

SEQ ID NO: 1585397 - protein, 22 aa, Staphylococcus aureus
WNIGSKSAFALIIPILSGFIAR

SEQ ID NO: 1585398 - protein, 17 aa, Staphylococcus aureus
WPEVWTAIVETLYMTVV

SEQ ID NO: 1585399 - protein, 18 aa, Staphylococcus aureus
WRMACALLVTIPIALFAF

SEQ ID NO: 1585400 - protein, 18 aa, Staphylococcus aureus
WRSIIPPLVMIALTVVIF

SEQ ID NO: 1585401 - protein, 20 aa, Staphylococcus aureus
WSIVGVVWIMFSIPNTFELY

SEQ ID NO: 1585402 - protein, 21 aa, Staphylococcus aureus
WSIVGVVWIMFSIPNTFELYN

SEQ ID NO: 1585403 - protein, 20 aa, Staphylococcus aureus
WSIVGVVWIVFSIPNIFELY

SEQ ID NO: 1585404 - protein, 23 aa, Staphylococcus aureus
WTVPCYLCAIIAIIYGFTGIGIK

SEQ ID NO: 1585405 - protein, 25 aa, Staphylococcus aureus
WVPRTGSWRAAFKRAGDYAYATGGK

SEQ ID NO: 1585406 - protein, 18 aa, Staphylococcus aureus
WYISILILIVVIAGCGKG

SEQ ID NO: 1585407 - protein, 19 aa, Staphylococcus aureus
YAAIYFRNVRRSMVEQLNE

SEQ ID NO: 1585408 - protein, 19 aa, Staphylococcus aureus
YAGIYFRNVRRSMVEQLNE

SEQ ID NO: 1585409 - protein, 17 aa, Staphylococcus aureus
YAIDSLRETVGGIVPEI

SEQ ID NO: 1585410 - protein, 29 aa, Staphylococcus aureus
YAIRSVLWEHIIQLKMPFFDKNESGQLMS

SEQ ID NO: 1585411 - protein, 25 aa, Staphylococcus aureus
YAIVAFCMFNYLSSILWVVCGIFLI

SEQ ID NO: 1585412 - protein, 26 aa, Staphylococcus aureus
YAIVAFCMFNYLSSILWVVCGIFLIW

SEQ ID NO: 1585413 - protein, 27 aa, Staphylococcus aureus
YAIVAFCMFNYLSSILWVVWGIFLIWT

SEQ ID NO: 1585414 - protein, 17 aa, Staphylococcus aureus
YASDEQIEFAVTDEGPG

SEQ ID NO: 1585415 - protein, 19 aa, Staphylococcus aureus
YCANYMYIVIYAYITKISD

SEQ ID NO: 1585416 - protein, 17 aa, Staphylococcus aureus
YDADPLIRTAITHAQFE

SEQ ID NO: 1585417 - protein, 21 aa, Staphylococcus aureus
YDFPIDSLFYIVSLNLSLTMI

SEQ ID NO: 1585418 - protein, 17 aa, Staphylococcus aureus
YDFQAFIGLGDDDKNQF

SEQ ID NO: 1585419 - protein, 17 aa, Staphylococcus aureus
YDIINEWYFFVITTILM

SEQ ID NO: 1585420 - protein, 21 aa, Staphylococcus aureus
YDIMKKLGLDNGRISKITRNQ

SEQ ID NO: 1585421 - protein, 19 aa, Staphylococcus aureus
YDKEGYRDGEFEKGDKGMW

SEQ ID NO: 1585422 - protein, 20 aa, Staphylococcus aureus
YDSGIKFPDRIMALITGGVK

SEQ ID NO: 1585423 - protein, 23 aa, Staphylococcus aureus
YDSGIRFPDRIMALITGDVKEIN

SEQ ID NO: 1585424 - protein, 25 aa, Staphylococcus aureus
YDYYPTMFYKRGKKSFVIHIKKDGS

SEQ ID NO: 1585425 - protein, 18 aa, Staphylococcus aureus
YEFMPLKYKKRIVMEGTE

SEQ ID NO: 1585426 - protein, 18 aa, Staphylococcus aureus
YEFMPLKYKKRIVMNGEQ

SEQ ID NO: 1585427 - protein, 19 aa, Staphylococcus aureus
YEFNEPRPTIGQSDEDEKS

SEQ ID NO: 1585428 - protein, 21 aa, Staphylococcus aureus
YEFTGSYRWSKGIRLDWVGTL

SEQ ID NO: 1585429 - protein, 20 aa, Staphylococcus aureus
YENVNAKLELNSYIDKKTVP

SEQ ID NO: 1585430 - protein, 21 aa, Staphylococcus aureus
YEPQEGPGLLFKVLPMVFSQM

SEQ ID NO: 1585431 - protein, 17 aa, Staphylococcus aureus
YESNKYYPIYGSSELGK

SEQ ID NO: 1585432 - protein, 21 aa, Staphylococcus aureus
YETTNFLSLPPKDIFLASVLI

SEQ ID NO: 1585433 - protein, 24 aa, Staphylococcus aureus
YFAVSIGLISFIVWMLIQNNVDFA

SEQ ID NO: 1585434 - protein, 25 aa, Staphylococcus aureus
YFHVGFVRYFSRMFIPNLFSLLASI

SEQ ID NO: 1585435 - protein, 19 aa, Staphylococcus aureus
YFIACLFAGVSYVHESISN

SEQ ID NO: 1585436 - protein, 18 aa, Staphylococcus aureus
YFIAFALFFFAFTAILSY

SEQ ID NO: 1585437 - protein, 18 aa, Staphylococcus aureus
YFIAFALFFFAFTTILSY

SEQ ID NO: 1585438 - protein, 22 aa, Staphylococcus aureus
YFSYYQAIIIGCYYLYRLIFTY

SEQ ID NO: 1585439 - protein, 24 aa, Staphylococcus aureus
YFVIVGFRRGFWLSMIHLSATIVS

SEQ ID NO: 1585440 - protein, 24 aa, Staphylococcus aureus
YFVRRYGWGGFKRAGDYAYATGGK

SEQ ID NO: 1585441 - protein, 20 aa, Staphylococcus aureus
YFWKCIFFKINTVVSTELII

SEQ ID NO: 1585442 - protein, 20 aa, Staphylococcus aureus
YGHYFMFLLALNFGISITDL

SEQ ID NO: 1585443 - protein, 28 aa, Staphylococcus aureus
YGIFATICIKGRRKLSIILFVIAIIVSL

SEQ ID NO: 1585444 - protein, 18 aa, Staphylococcus aureus
YGLKYIKGKIVVFRLIIL

SEQ ID NO: 1585445 - protein, 26 aa, Staphylococcus aureus
YGLVSIPGMMTGLIIGGVPPLQAIKF

SEQ ID NO: 1585446 - protein, 36 aa, Staphylococcus aureus
YGQKKSKKGWFWGCGGCLLLFILIIIGISACTAGIT

SEQ ID NO: 1585447 - protein, 17 aa, Staphylococcus aureus
YGVEYLLAATILMGLIQ

SEQ ID NO: 1585448 - protein, 18 aa, Staphylococcus aureus
YHDKLAFLKTVEKDDENS

SEQ ID NO: 1585449 - protein, 17 aa, Staphylococcus aureus
YHLIFALIFLAIISVVS

SEQ ID NO: 1585450 - protein, 17 aa, Staphylococcus aureus
YHPIFKTLLGVVVAIQF

SEQ ID NO: 1585451 - protein, 26 aa, Staphylococcus aureus
YIAWFSHGQLRMEGSLKKVIPSFKEH

SEQ ID NO: 1585452 - protein, 18 aa, Staphylococcus aureus
YIEYKRKSPAQIILMIQR

SEQ ID NO: 1585453 - protein, 25 aa, Staphylococcus aureus
YIILSACMTFLFVVIGFSIDIANAF

SEQ ID NO: 1585454 - protein, 27 aa, Staphylococcus aureus
YIKKPLRRLTWLMAIIIYCGVYTGALV

SEQ ID NO: 1585455 - protein, 18 aa, Staphylococcus aureus
YIPCVSTVVAIRKETYSW

SEQ ID NO: 1585456 - protein, 17 aa, Staphylococcus aureus
YIYLTLVAFNFISGILT

SEQ ID NO: 1585457 - protein, 18 aa, Staphylococcus aureus
YKDIEAIRHSDIFTAVMM

SEQ ID NO: 1585458 - protein, 20 aa, Staphylococcus aureus
YKEIIAYSIPFVIVSLNYPL

SEQ ID NO: 1585459 - protein, 19 aa, Staphylococcus aureus
YKIFPVLMFLVSTGLGILV

SEQ ID NO: 1585460 - protein, 17 aa, Staphylococcus aureus
YKIPTYVLGAGLGGLIL

SEQ ID NO: 1585461 - protein, 18 aa, Staphylococcus aureus
YKIYLALFGLDRHIISDK

SEQ ID NO: 1585462 - protein, 17 aa, Staphylococcus aureus
YKKAVGASSRIYEIMQE

SEQ ID NO: 1585463 - protein, 21 aa, Staphylococcus aureus
YKKVLHWSLNHKWIVIILSTL

SEQ ID NO: 1585464 - protein, 20 aa, Staphylococcus aureus
YKMLFSFLSSIPLVMFSILY

SEQ ID NO: 1585465 - protein, 26 aa, Staphylococcus aureus
YKQAVAKAEALISGTPDVVVTPSEIT

SEQ ID NO: 1585466 - protein, 42 aa, Staphylococcus aureus
YKQEWCIVLSLLFLFPLGLFLMWKFSKWPSLVRTIITVVIVV

SEQ ID NO: 1585467 - protein, 20 aa, Staphylococcus aureus
YKRKRKSFMIHVKKDGSRFQ

SEQ ID NO: 1585468 - protein, 25 aa, Staphylococcus aureus
YKSKFKRLLIGTILLFTNIIIWSNA

SEQ ID NO: 1585469 - protein, 22 aa, Staphylococcus aureus
YLFYSPRLKFDVLENPNKSNKV

SEQ ID NO: 1585470 - protein, 24 aa, Staphylococcus aureus
YLGVLCLGMYLLSFWMINALLRIS

SEQ ID NO: 1585471 - protein, 23 aa, Staphylococcus aureus
YLKTKRLEVVILIHFINNLSSLL

SEQ ID NO: 1585472 - protein, 21 aa, Staphylococcus aureus
YLQIFAEWGILFGALFIIFMI

SEQ ID NO: 1585473 - protein, 22 aa, Staphylococcus aureus
YLRLLFTIIFSLKCKIHLFFNS

SEQ ID NO: 1585474 - protein, 18 aa, Staphylococcus aureus
YLTIKDIIPRLSRAKLYT

SEQ ID NO: 1585475 - protein, 17 aa, Staphylococcus aureus
YLTLVAFNFISGVLTLP

SEQ ID NO: 1585476 - protein, 18 aa, Staphylococcus aureus
YLTTRVKYILIPYILMGL

SEQ ID NO: 1585477 - protein, 24 aa, Staphylococcus aureus
YLVCNFCIIMWLLFSCSLLKERKP

SEQ ID NO: 1585478 - protein, 20 aa, Staphylococcus aureus
YLVDLSFNFHDWLLDLFTRI

SEQ ID NO: 1585479 - protein, 19 aa, Staphylococcus aureus
YMPEHPISLILPVLVIGTS

SEQ ID NO: 1585480 - protein, 18 aa, Staphylococcus aureus
YNFTIYVPYGDDWLAYFM

SEQ ID NO: 1585481 - protein, 17 aa, Staphylococcus aureus
YNHTWNILGYVLNGFVF

SEQ ID NO: 1585482 - protein, 26 aa, Staphylococcus aureus
YNTSNLTWKNGVAFYSNNAQGDGKDK

SEQ ID NO: 1585483 - protein, 17 aa, Staphylococcus aureus
YNYTSVDSSYASTYNDT

SEQ ID NO: 1585484 - protein, 22 aa, Staphylococcus aureus
YPDEYRYGFYVKPTLNRLNGGF

SEQ ID NO: 1585485 - protein, 22 aa, Staphylococcus aureus
YPIDLLFIICVILGILGLIISL

SEQ ID NO: 1585486 - protein, 18 aa, Staphylococcus aureus
YPKWDIPQHIKIRLKYIY

SEQ ID NO: 1585487 - protein, 25 aa, Staphylococcus aureus
YPLEKATSHLLGYVGPINSEELKQK

SEQ ID NO: 1585488 - protein, 17 aa, Staphylococcus aureus
YPYWLTEDSWYEVIPPK

SEQ ID NO: 1585489 - protein, 24 aa, Staphylococcus aureus
YQMKISFLPALGFNQILLEREGEQ

SEQ ID NO: 1585490 - protein, 19 aa, Staphylococcus aureus
YQSVDAFKNINIPLTLAGG

SEQ ID NO: 1585491 - protein, 24 aa, Staphylococcus aureus
YQVPKGYTLNKGYDVNTKELTDVT

SEQ ID NO: 1585492 - protein, 21 aa, Staphylococcus aureus
YRGLQRFKHLIIPLLSQNIRK

SEQ ID NO: 1585493 - protein, 26 aa, Staphylococcus aureus
YRKLSGETIPHVFILIDNFDAVKDSP

SEQ ID NO: 1585494 - protein, 19 aa, Staphylococcus aureus
YRLIQMVVVLFVISTLTFI

SEQ ID NO: 1585495 - protein, 24 aa, Staphylococcus aureus
YRMHKRIDITYSLRNSVSHSNPGE

SEQ ID NO: 1585496 - protein, 24 aa, Staphylococcus aureus
YRNDLLFIASFMVLISLILAQIVL

SEQ ID NO: 1585497 - protein, 21 aa, Staphylococcus aureus
YRNLSKYNKCLMLKPEPLVGK

SEQ ID NO: 1585498 - protein, 34 aa, Staphylococcus aureus
YRPKGKRFAIDMFKMILIQIICVMMGLWIYQLDK

SEQ ID NO: 1585499 - protein, 22 aa, Staphylococcus aureus
YRVEGFSCANCAGKFEKNVKQL

SEQ ID NO: 1585500 - protein, 25 aa, Staphylococcus aureus
YRYSFPLELNFWFGLLYLSILASFL

SEQ ID NO: 1585501 - protein, 26 aa, Staphylococcus aureus
YSAVFDYWWMFAISFLFFALASLLTL

SEQ ID NO: 1585502 - protein, 22 aa, Staphylococcus aureus
YSKAFEVLYVWLVNLGEARSKA

SEQ ID NO: 1585503 - protein, 18 aa, Staphylococcus aureus
YSKGFAVLYVWLVNLGEA

SEQ ID NO: 1585504 - protein, 25 aa, Staphylococcus aureus
YSLVGILCFCIPFTINGNNTIFVDH

SEQ ID NO: 1585505 - protein, 21 aa, Staphylococcus aureus
YSMLVLLALVVSNIFIHILEP

SEQ ID NO: 1585506 - protein, 17 aa, Staphylococcus aureus
YSVEFSTLAGYTPTTVN

SEQ ID NO: 1585507 - protein, 17 aa, Staphylococcus aureus
YSVKISNFIAKDLDQIK

SEQ ID NO: 1585508 - protein, 25 aa, Staphylococcus aureus
YTAGQCTWYAYGIRQKMGKPISTYW

SEQ ID NO: 1585509 - protein, 25 aa, Staphylococcus aureus
YTAKLFPFGPIFAAILCIVVIIGQD

SEQ ID NO: 1585510 - protein, 25 aa, Staphylococcus aureus
YTDFMFASVLAFIFLVYRIYILFID

SEQ ID NO: 1585511 - protein, 23 aa, Staphylococcus aureus
YTKETFVSTLTGYKFNPDAKNFK

SEQ ID NO: 1585512 - protein, 26 aa, Staphylococcus aureus
YTLDTDKTKYSWSNSYSNVNGSSTAN

SEQ ID NO: 1585513 - protein, 25 aa, Staphylococcus aureus
YTLDTDKTKYSWSNSYSSVNGSSTA

SEQ ID NO: 1585514 - protein, 26 aa, Staphylococcus aureus
YTNVRGSFEQVAFAKRKNATTDKTAY

SEQ ID NO: 1585515 - protein, 31 aa, Staphylococcus aureus
YTSDFKIDNSVKMGDTMTVKYDKHTLPSDLT

SEQ ID NO: 1585516 - protein, 18 aa, Staphylococcus aureus
YTTEINLIELVDELPEEH

SEQ ID NO: 1585517 - protein, 19 aa, Staphylococcus aureus
YTYLNIVPFGKDYNGANIS

SEQ ID NO: 1585518 - protein, 25 aa, Staphylococcus aureus
YVFKVLACGILLWSLTTTGSKTAFI

SEQ ID NO: 1585519 - protein, 17 aa, Staphylococcus aureus
YVLIWIIQFFKNKNYVN

SEQ ID NO: 1585520 - protein, 25 aa, Staphylococcus aureus
YVRKVGHTVFKWVAIGMTTLSVLLI

SEQ ID NO: 1585521 - protein, 23 aa, Staphylococcus aureus
YVSFPMIIQFALKLSLTLNISPV

SEQ ID NO: 1585522 - protein, 18 aa, Staphylococcus aureus
YVVPLVILCDILIILELL

SEQ ID NO: 1585523 - protein, 19 aa, Staphylococcus aureus
YVWTKRLAVPIIIHMLQNG

SEQ ID NO: 1585524 - protein, 24 aa, Staphylococcus aureus
YVYCTISFIYRCHSKLSSTSMGGI

SEQ ID NO: 1585525 - protein, 17 aa, Staphylococcus aureus
YYAIKAVGNGSALRGYK

SEQ ID NO: 1585526 - protein, 17 aa, Staphylococcus aureus
YYENMLFIDNVSRRLFK

SEQ ID NO: 1585527 - protein, 17 aa, Staphylococcus aureus
YYFKAQHIIGFDTWQHT

SEQ ID NO: 1585528 - protein, 17 aa, Staphylococcus aureus
YYLEYYENMLFIDNVSR

SEQ ID NO: 1585529 - protein, 20 aa, Staphylococcus aureus
YYLYRLIFTYKYDIVSRTQK

SEQ ID NO: 1585530 - protein, 17 aa, Staphylococcus aureus
YYPFDSVAMFITLIIIA

SEQ ID NO: 1585531 - protein, 23 aa, Staphylococcus aureus
YYPYYPVQLTWNNGVAFYSNNAK

SEQ ID NO: 1585532 - protein, 17 aa, Staphylococcus aureus
YYSHLKGYYGLDHITKG

SEQ ID NO: 1585533 - protein, 18 aa, Staphylococcus aureus
YYSLYLGVIGAFIGGLTV

SEQ ID NO: 1585534 - protein, 17 aa, Staphylococcus aureus
YYTIFLFFHINLATIGG

SEQ ID NO: 1585535 - protein, 17 aa, Staphylococcus aureus
YYYSLRIVHYYDAFGVL

SEQ ID NO: 1585536 - protein, 17 aa, Staphylococcus aureus
YYYSLRIVHYYDAIGVL

SEQ ID NO: 1585537 - protein, 18 aa, Staphylococcus aureus
TFIVCIFGALKLIETTHM

SEQ ID NO: 1585538 - protein, 17 aa, Staphylococcus aureus
VPAGVFIAAFGAPFFIY

SEQ ID NO: 1585539 - protein, 20 aa, Staphylococcus aureus
ERARRFGLIISHIYAVVIGL

SEQ ID NO: 1585540 - protein, 18 aa, Staphylococcus aureus
IATPVFKPLFAWQMSGIL

SEQ ID NO: 1585541 - protein, 17 aa, Staphylococcus aureus
IFGALKLIETTHMPKSQ

SEQ ID NO: 1585542 - protein, 20 aa, Staphylococcus aureus
IWFFKLKYSFGHIINSKIFA

SEQ ID NO: 1585543 - protein, 17 aa, Staphylococcus aureus
LKTAIGLITAFSETFEH

SEQ ID NO: 1585544 - protein, 21 aa, Staphylococcus aureus
LNLFLAWFFIYFDWGQKAVRG

SEQ ID NO: 1585545 - protein, 21 aa, Staphylococcus aureus
LPLSWRQPLSFGLLIIILATL

SEQ ID NO: 1585546 - protein, 17 aa, Staphylococcus aureus
MVACLKTAIGLITAFSE

SEQ ID NO: 1585547 - protein, 20 aa, Staphylococcus aureus
PFVAGLAWIVTKLVPGKDIA

SEQ ID NO: 1585548 - protein, 23 aa, Staphylococcus aureus
QRKLWLRNFMQAFFVVFFVYMAM

SEQ ID NO: 1585549 - protein, 21 aa, Staphylococcus aureus
RISSAILQFLGAISWFFLSLI

SEQ ID NO: 1585550 - protein, 23 aa, Staphylococcus aureus
SHPNCPLRAAIVIPLEMHGSIVG

SEQ ID NO: 1585551 - protein, 22 aa, Staphylococcus aureus
SVGNRIHPWFGFIFAVVIYMSI

SEQ ID NO: 1585552 - protein, 20 aa, Staphylococcus aureus
TKLYPGQVWTIADLLQITVS

SEQ ID NO: 1585553 - protein, 18 aa, Staphylococcus aureus
TNTFGVICGLILGIIFAY

SEQ ID NO: 1585554 - protein, 22 aa, Staphylococcus aureus
VFPEIVMALIFIKAVGPGSFSG

SEQ ID NO: 1585555 - protein, 22 aa, Staphylococcus aureus
AGKAIPYWDVFGLHINQVGYQG

SEQ ID NO: 1585556 - protein, 19 aa, Staphylococcus aureus
ALICLFGIFGTMIYRSFQI

SEQ ID NO: 1585557 - protein, 17 aa, Staphylococcus aureus
APFFKNLFLPNGALSSL

SEQ ID NO: 1585558 - protein, 22 aa, Staphylococcus aureus
DSPEWYKWFFANIVAHTTSLFD

SEQ ID NO: 1585559 - protein, 22 aa, Staphylococcus aureus
FASTIFPVFLVIIIGLVSFYAI

SEQ ID NO: 1585560 - protein, 21 aa, Staphylococcus aureus
FKVLACGILLWSLTTTGSKTA

SEQ ID NO: 1585561 - protein, 17 aa, Staphylococcus aureus
FRLVIEIVILELIIGAI

SEQ ID NO: 1585562 - protein, 19 aa, Staphylococcus aureus
GAFVFRFLALFLISIIANF

SEQ ID NO: 1585563 - protein, 23 aa, Staphylococcus aureus
GFNIDRYRWLTGLLAVFLASATV

SEQ ID NO: 1585564 - protein, 20 aa, Staphylococcus aureus
GGMANLFKDLVHLVGTITNL

SEQ ID NO: 1585565 - protein, 18 aa, Staphylococcus aureus
GVWLYHFLERVLIPTGLH

SEQ ID NO: 1585566 - protein, 18 aa, Staphylococcus aureus
IAGMCASSAMLLPGISGS

SEQ ID NO: 1585567 - protein, 18 aa, Staphylococcus aureus
IAIGLGLIFGVFAYAASF

SEQ ID NO: 1585568 - protein, 19 aa, Staphylococcus aureus
IIQSYILSLAINFHPHEVA

SEQ ID NO: 1585569 - protein, 21 aa, Staphylococcus aureus
IQEVPALFALIFKSAFGLQSA

SEQ ID NO: 1585570 - protein, 22 aa, Staphylococcus aureus
IQNIRFDDMIKLHIESSEEARH

SEQ ID NO: 1585571 - protein, 20 aa, Staphylococcus aureus
ITMICCVLLGSLIGFLFYNF

SEQ ID NO: 1585572 - protein, 18 aa, Staphylococcus aureus
IVIPVVFCSLALSISNVG

SEQ ID NO: 1585573 - protein, 17 aa, Staphylococcus aureus
IVLGCTFTAVAPMILIG

SEQ ID NO: 1585574 - protein, 18 aa, Staphylococcus aureus
KVELPIAMPVIMAGVRTA

SEQ ID NO: 1585575 - protein, 25 aa, Staphylococcus aureus
LFGFIKRLLIPFGLHHIFHAPFWFE

SEQ ID NO: 1585576 - protein, 18 aa, Staphylococcus aureus
LFVFLSLRIQNSEHFYSA

SEQ ID NO: 1585577 - protein, 18 aa, Staphylococcus aureus
LFVICMFVSISMGTSVGT

SEQ ID NO: 1585578 - protein, 25 aa, Staphylococcus aureus
LKNKLIEFFAGYSLANNAAFNQSDF

SEQ ID NO: 1585579 - protein, 23 aa, Staphylococcus aureus
LNKWCFWFFMIGFNVCFLPQFIL

SEQ ID NO: 1585580 - protein, 17 aa, Staphylococcus aureus
LRALRLAQKLGLSIDGV

SEQ ID NO: 1585581 - protein, 21 aa, Staphylococcus aureus
LRFGIPAVLGFLVVFVIALMA

SEQ ID NO: 1585582 - protein, 19 aa, Staphylococcus aureus
LVGAMLLAFYFYRDNPDLK

SEQ ID NO: 1585583 - protein, 18 aa, Staphylococcus aureus
MIIICLFVFLSLRIQNSE

SEQ ID NO: 1585584 - protein, 24 aa, Staphylococcus aureus
NTYLLRQVKSIGMFLMIAALGLYF

SEQ ID NO: 1585585 - protein, 17 aa, Staphylococcus aureus
PVWKLIIIWFLRVALSL

SEQ ID NO: 1585586 - protein, 19 aa, Staphylococcus aureus
RIKSFKKYKDYVAKSASQQ

SEQ ID NO: 1585587 - protein, 19 aa, Staphylococcus aureus
RLHIPNWLRRLITRSLAVI

SEQ ID NO: 1585588 - protein, 18 aa, Staphylococcus aureus
RVLIPFSTVIGAWLLLVA

SEQ ID NO: 1585589 - protein, 19 aa, Staphylococcus aureus
RVNFKIVLPGAILTIIILY

SEQ ID NO: 1585590 - protein, 17 aa, Staphylococcus aureus
SDYIKSYFAFYLILFGA

SEQ ID NO: 1585591 - protein, 24 aa, Staphylococcus aureus
SVKAFGEFEFWFALIKVVTIILMI

SEQ ID NO: 1585592 - protein, 18 aa, Staphylococcus aureus
SYISWIIVVGISLILVVI

SEQ ID NO: 1585593 - protein, 19 aa, Staphylococcus aureus
SYRAAILYHEWYFMDHWKL

SEQ ID NO: 1585594 - protein, 17 aa, Staphylococcus aureus
TRISVLIGVIFLTIVTI

SEQ ID NO: 1585595 - protein, 17 aa, Staphylococcus aureus
VGAKWVFFTSFIVLLFP

SEQ ID NO: 1585596 - protein, 23 aa, Staphylococcus aureus
VSLRNIWDIPWIIPLVLILILIA

SEQ ID NO: 1585597 - protein, 18 aa, Staphylococcus aureus
VYLFRFVWVYVLYPYFYL

SEQ ID NO: 1585598 - protein, 18 aa, Staphylococcus aureus
WDLIKPRLLPSFEMGLTA

SEQ ID NO: 1585599 - protein, 25 aa, Staphylococcus aureus
WKARWQLCIIFSLFALMSNLTGIVI

SEQ ID NO: 1585600 - protein, 18 aa, Staphylococcus aureus
ADNIRVGDRLHFKNNSTS

SEQ ID NO: 1585601 - protein, 24 aa, Staphylococcus aureus
AFASRFSVPFSRRYFIIIITMAVI

SEQ ID NO: 1585602 - protein, 24 aa, Staphylococcus aureus
AIGIFCIIMLFALLGFLPYNINPA

SEQ ID NO: 1585603 - protein, 21 aa, Staphylococcus aureus
ARLFGELEFWFSIIKIATIIG

SEQ ID NO: 1585604 - protein, 19 aa, Staphylococcus aureus
ATLFLKFDRLIAVLGGVTP

SEQ ID NO: 1585605 - protein, 23 aa, Staphylococcus aureus
AVKLRWFPVAGWEGFSTAVLPSL

SEQ ID NO: 1585606 - protein, 19 aa, Staphylococcus aureus
DLVGFKWMYLICGMLVIVI

SEQ ID NO: 1585607 - protein, 23 aa, Staphylococcus aureus
DSTGRRKPLIIAMIIFTLASLGI

SEQ ID NO: 1585608 - protein, 19 aa, Staphylococcus aureus
FDLILRFMAKLSYKKLLMT

SEQ ID NO: 1585609 - protein, 17 aa, Staphylococcus aureus
FESFFGIEMMFLGNTEA

SEQ ID NO: 1585610 - protein, 18 aa, Staphylococcus aureus
FFNKFVFHGRIQYNVEDL

SEQ ID NO: 1585611 - protein, 17 aa, Staphylococcus aureus
FLSKRSMYLTILVTILI

SEQ ID NO: 1585612 - protein, 25 aa, Staphylococcus aureus
FVNMPALHLHYGYYICLAVMFVIAV

SEQ ID NO: 1585613 - protein, 18 aa, Staphylococcus aureus
GILLARYTKLSGFVITIA

SEQ ID NO: 1585614 - protein, 18 aa, Staphylococcus aureus
GLGRRIALHFVKLFGKKT

SEQ ID NO: 1585615 - protein, 19 aa, Staphylococcus aureus
GLLAPWVAGAAMALSSVSV

SEQ ID NO: 1585616 - protein, 20 aa, Staphylococcus aureus
GSVGEMFRPFALAIAFSLLA

SEQ ID NO: 1585617 - protein, 17 aa, Staphylococcus aureus
HPTRFAFMMSLVVLIAW

SEQ ID NO: 1585618 - protein, 20 aa, Staphylococcus aureus
IGKLFFKKDIRQFGSGNTGA

SEQ ID NO: 1585619 - protein, 18 aa, Staphylococcus aureus
IIFIRTSWIFILFIFLGG

SEQ ID NO: 1585620 - protein, 18 aa, Staphylococcus aureus
IKEPKLLIIIPILIVAFI

SEQ ID NO: 1585621 - protein, 22 aa, Staphylococcus aureus
IKKYWLRLSITYIIALILIYTY

SEQ ID NO: 1585622 - protein, 18 aa, Staphylococcus aureus
IKLKSFWIRRLKRLLPAV

SEQ ID NO: 1585623 - protein, 17 aa, Staphylococcus aureus
IKPEHFHLMYLLEQHSP

SEQ ID NO: 1585624 - protein, 17 aa, Staphylococcus aureus
ISLWRFVAGFVVALLVA

SEQ ID NO: 1585625 - protein, 23 aa, Staphylococcus aureus
IYVSLRFEWRMGLSSVLALLHDV

SEQ ID NO: 1585626 - protein, 18 aa, Staphylococcus aureus
KRSGFFYNTFVDPMKNVL

SEQ ID NO: 1585627 - protein, 18 aa, Staphylococcus aureus
KYGPRPLIYTGFTILTIT

SEQ ID NO: 1585628 - protein, 19 aa, Staphylococcus aureus
LDFRLPRMMITILAGAALS

SEQ ID NO: 1585629 - protein, 18 aa, Staphylococcus aureus
LGETFFLYLTWYSIGRFF

SEQ ID NO: 1585630 - protein, 17 aa, Staphylococcus aureus
LIIVGLFVICMFVSISM

SEQ ID NO: 1585631 - protein, 22 aa, Staphylococcus aureus
LMPLTLLGMIAFYIAIFTINNP

SEQ ID NO: 1585632 - protein, 24 aa, Staphylococcus aureus
LNNASFWKEYKFYNANNQELATTV

SEQ ID NO: 1585633 - protein, 25 aa, Staphylococcus aureus
LQMLNMRYSHWFRFVWPVVAFVLIF

SEQ ID NO: 1585634 - protein, 17 aa, Staphylococcus aureus
LRDSFQIHYDINDNHTP

SEQ ID NO: 1585635 - protein, 19 aa, Staphylococcus aureus
LYRFFKRIHLGWFVLPVPI

SEQ ID NO: 1585636 - protein, 18 aa, Staphylococcus aureus
LYSFGRDGLLPSWLSHLN

SEQ ID NO: 1585637 - protein, 22 aa, Staphylococcus aureus
MASFGWRIPFLLGLFLGLFGLY

SEQ ID NO: 1585638 - protein, 17 aa, Staphylococcus aureus
MILRSAILLTITVIFAI

SEQ ID NO: 1585639 - protein, 23 aa, Staphylococcus aureus
MLGFYRLPGLVAIIALTTYIYLT

SEQ ID NO: 1585640 - protein, 17 aa, Staphylococcus aureus
MPSRLRAGFAYIKKYWL

SEQ ID NO: 1585641 - protein, 18 aa, Staphylococcus aureus
NTIIFGWIFYFFLGAYMG

SEQ ID NO: 1585642 - protein, 20 aa, Staphylococcus aureus
PKIIGGIGWLLAKVTRQPKF

SEQ ID NO: 1585643 - protein, 17 aa, Staphylococcus aureus
PLFYFGNIMKPLIWLMN

SEQ ID NO: 1585644 - protein, 20 aa, Staphylococcus aureus
QRLHFYAAIFIAPLLITLTI

SEQ ID NO: 1585645 - protein, 17 aa, Staphylococcus aureus
RILKSELLLAFSTSSSE

SEQ ID NO: 1585646 - protein, 25 aa, Staphylococcus aureus
RKANELRLAIRLEHLLSKDEIIYTY

SEQ ID NO: 1585647 - protein, 17 aa, Staphylococcus aureus
RRLKRLIPAVLFLICVV

SEQ ID NO: 1585648 - protein, 19 aa, Staphylococcus aureus
RSAFLSGLMLEFISMLGIG

SEQ ID NO: 1585649 - protein, 27 aa, Staphylococcus aureus
RYTFEVYRFDYPITFIVSILTSILTSA

SEQ ID NO: 1585650 - protein, 21 aa, Staphylococcus aureus
SILLAYVFKWLGLVDDVLLMV

SEQ ID NO: 1585651 - protein, 17 aa, Staphylococcus aureus
SLIKGYRRLPATVIGAG

SEQ ID NO: 1585652 - protein, 22 aa, Staphylococcus aureus
TFGYKRFEVLAALFNGVTLFVI

SEQ ID NO: 1585653 - protein, 25 aa, Staphylococcus aureus
TIRNIRQNLFWAFGYNIAGIPIAAL

SEQ ID NO: 1585654 - protein, 22 aa, Staphylococcus aureus
TPVQFIIGWQFYVGAYKNLRNG

SEQ ID NO: 1585655 - protein, 19 aa, Staphylococcus aureus
TSFEKWNFVKLAKPLIGVS

SEQ ID NO: 1585656 - protein, 18 aa, Staphylococcus aureus
VTGWTYWFCWIITGMAEV

SEQ ID NO: 1585657 - protein, 24 aa, Staphylococcus aureus
WKSIENIGSLAFKFMVPILAGYIA

SEQ ID NO: 1585658 - protein, 18 aa, Staphylococcus aureus
YIRRLFGYTAIHFIITSD

SEQ ID NO: 1585659 - protein, 23 aa, Staphylococcus aureus
YTEMKWLTPDGHYIHGKGIKPDV

SEQ ID NO: 1585660 - protein, 25 aa, Staphylococcus aureus
ATLLGWRWIFILSIIISLIALFLIK

SEQ ID NO: 1585661 - protein, 24 aa, Staphylococcus aureus
AYFYSIYEMVRWLNGSTTQPHLYF

SEQ ID NO: 1585662 - protein, 17 aa, Staphylococcus aureus
DGFKIAVVVAVMLLAFI

SEQ ID NO: 1585663 - protein, 19 aa, Staphylococcus aureus
ERFNKFEWLAILFAFIGVL

SEQ ID NO: 1585664 - protein, 22 aa, Staphylococcus aureus
FEPRLEQYEVLKADGNYVQAHN

SEQ ID NO: 1585665 - protein, 23 aa, Staphylococcus aureus
FWFPEIPNWISALFCVLLLMSFN

SEQ ID NO: 1585666 - protein, 21 aa, Staphylococcus aureus
GLAIFCFVMYIAFGKYGNVTL

SEQ ID NO: 1585667 - protein, 18 aa, Staphylococcus aureus
HTAYCFIDILLVALTISS

SEQ ID NO: 1585668 - protein, 18 aa, Staphylococcus aureus
IFKKYILGNPVIWILCVS

SEQ ID NO: 1585669 - protein, 23 aa, Staphylococcus aureus
ILTCLVVLICLYFASRSFKRTLI

SEQ ID NO: 1585670 - protein, 17 aa, Staphylococcus aureus
ITYLIPLLIAFSGGRLI

SEQ ID NO: 1585671 - protein, 21 aa, Staphylococcus aureus
KQVFWRILLFYVLSIAVIGAI

SEQ ID NO: 1585672 - protein, 17 aa, Staphylococcus aureus
LFLRNIRTTAISIISIP

SEQ ID NO: 1585673 - protein, 18 aa, Staphylococcus aureus
LIVAVAFFFGLKTYQGHK

SEQ ID NO: 1585674 - protein, 18 aa, Staphylococcus aureus
LIVDDAFVHFDKKRTEKM

SEQ ID NO: 1585675 - protein, 17 aa, Staphylococcus aureus
LKMPGAFMILFILTVVA

SEQ ID NO: 1585676 - protein, 18 aa, Staphylococcus aureus
LKTYRMVFNTISVEKMNA

SEQ ID NO: 1585677 - protein, 18 aa, Staphylococcus aureus
LQLLGAMPRHVIEGFPTI

SEQ ID NO: 1585678 - protein, 21 aa, Staphylococcus aureus
LSFMMPVTMPFYLTTQNILLM

SEQ ID NO: 1585679 - protein, 18 aa, Staphylococcus aureus
LVGWRYTFLFLIIVSIIV

SEQ ID NO: 1585680 - protein, 22 aa, Staphylococcus aureus
MLLPMSMLFLFGRMLSRHGKRV

SEQ ID NO: 1585681 - protein, 18 aa, Staphylococcus aureus
MTKWEIFKKYILGNPVIW

SEQ ID NO: 1585682 - protein, 18 aa, Staphylococcus aureus
NRNFRFFQIFTAALQSFS

SEQ ID NO: 1585683 - protein, 25 aa, Staphylococcus aureus
PKGKRFAIDMLKMILIQIICVMMGL

SEQ ID NO: 1585684 - protein, 21 aa, Staphylococcus aureus
PQVFKSMMVPLIIIIAMFFIH

SEQ ID NO: 1585685 - protein, 18 aa, Staphylococcus aureus
REMKCIVLVFLIHPILIL

SEQ ID NO: 1585686 - protein, 25 aa, Staphylococcus aureus
SGIFSRRFWPSFTFLIPIIIGMLLA

SEQ ID NO: 1585687 - protein, 21 aa, Staphylococcus aureus
SGLMLEFISMLGIGLVALEAT

SEQ ID NO: 1585688 - protein, 19 aa, Staphylococcus aureus
SGLTIGVAFVGIFLVIDLL

SEQ ID NO: 1585689 - protein, 17 aa, Staphylococcus aureus
SNFRILKRIGFTHTDML

SEQ ID NO: 1585690 - protein, 20 aa, Staphylococcus aureus
SPWMLLKLAVVWTLVQFVEG

SEQ ID NO: 1585691 - protein, 21 aa, Staphylococcus aureus
SRRSKKWLYIIIAILLIIVAI

SEQ ID NO: 1585692 - protein, 17 aa, Staphylococcus aureus
TELRDSFQIHYDINDNH

SEQ ID NO: 1585693 - protein, 19 aa, Staphylococcus aureus
TVYEGFPFVAFRMYQEGFQ

SEQ ID NO: 1585694 - protein, 26 aa, Staphylococcus aureus
VATTMGWRWIFIFSIIVAVLSMLLIK

SEQ ID NO: 1585695 - protein, 18 aa, Staphylococcus aureus
WGILSGKMTFFFIITIII

SEQ ID NO: 1585696 - protein, 17 aa, Staphylococcus aureus
WPPSGRVLVHWFSVSER

SEQ ID NO: 1585697 - protein, 19 aa, Staphylococcus aureus
WSTAQRMIITWVITLPISA

SEQ ID NO: 1585698 - protein, 33 aa, Staphylococcus aureus
YVALRISLIKVLRPYYPFPLIVDDAFVHFDKKR

SEQ ID NO: 1585699 - protein, 20 aa, Staphylococcus aureus
ACRFVWVYFWYKDFYFPKNI

SEQ ID NO: 1585700 - protein, 18 aa, Staphylococcus aureus
ADVAWAFGDLGVGLMAWL

SEQ ID NO: 1585701 - protein, 22 aa, Staphylococcus aureus
AEKRSNVHLVDWYKASAGHPEY

SEQ ID NO: 1585702 - protein, 18 aa, Staphylococcus aureus
AIGYKFLSKRSMYLTILV

SEQ ID NO: 1585703 - protein, 19 aa, Staphylococcus aureus
ANSIWAWLLVLVFLPLFGF

SEQ ID NO: 1585704 - protein, 17 aa, Staphylococcus aureus
ERGELRVGLSADYAPME

SEQ ID NO: 1585705 - protein, 23 aa, Staphylococcus aureus
GIHEIYFPYVLMRPLLFIAVILG

SEQ ID NO: 1585706 - protein, 17 aa, Staphylococcus aureus
GIILAIVGACLWGLGGT

SEQ ID NO: 1585707 - protein, 17 aa, Staphylococcus aureus
KLLEYRKPILLMSMALV

SEQ ID NO: 1585708 - protein, 19 aa, Staphylococcus aureus
KSTRKIVLLSLIFSLLMIA

SEQ ID NO: 1585709 - protein, 18 aa, Staphylococcus aureus
KYEWPLFIIYSFIFVLLL

SEQ ID NO: 1585710 - protein, 17 aa, Staphylococcus aureus
LDCPIVFPYAQNAVLIG

SEQ ID NO: 1585711 - protein, 17 aa, Staphylococcus aureus
LFIIYSFIFVLLLPNTF

SEQ ID NO: 1585712 - protein, 17 aa, Staphylococcus aureus
LIVWNFSTGLTFTLDHW

SEQ ID NO: 1585713 - protein, 22 aa, Staphylococcus aureus
LKVFKWRIVGFLAFLLIAILFL

SEQ ID NO: 1585714 - protein, 17 aa, Staphylococcus aureus
LLFAFTIIFMERRSANS

SEQ ID NO: 1585715 - protein, 17 aa, Staphylococcus aureus
LLKKFAWGPLKDVMDKR

SEQ ID NO: 1585716 - protein, 18 aa, Staphylococcus aureus
LMVWDRLTGGLIFVGGVV

SEQ ID NO: 1585717 - protein, 22 aa, Staphylococcus aureus
LSIPEFIIMIALASFFQPSLWN

SEQ ID NO: 1585718 - protein, 23 aa, Staphylococcus aureus
LVVSEIFKIIGLLLLLYQNQYLI

SEQ ID NO: 1585719 - protein, 17 aa, Staphylococcus aureus
LYACLRGMLSITNKSLL

SEQ ID NO: 1585720 - protein, 18 aa, Staphylococcus aureus
MNRIIKLVEELLELTKGD

SEQ ID NO: 1585721 - protein, 20 aa, Staphylococcus aureus
NSKPALDCPIVFPYAQNAVL

SEQ ID NO: 1585722 - protein, 19 aa, Staphylococcus aureus
QRMIITWVITLPISALLAG

SEQ ID NO: 1585723 - protein, 18 aa, Staphylococcus aureus
RAAIYISPFWFIFLFFFY

SEQ ID NO: 1585724 - protein, 25 aa, Staphylococcus aureus
TALKRLPWLIILTFLGMITATILGR

SEQ ID NO: 1585725 - protein, 23 aa, Staphylococcus aureus
VTIFLFCLIIIFFLKDTLHNSEL

SEQ ID NO: 1585726 - protein, 24 aa, Staphylococcus aureus
WFDLGRPDIWITIIAGVLYFIQAY

SEQ ID NO: 1585727 - protein, 17 aa, Staphylococcus aureus
WPLFIIYSFIFVLLLPN

SEQ ID NO: 1585728 - protein, 23 aa, Staphylococcus aureus
WTVPCYLCAIIAIIYGFTGIGIK

SEQ ID NO: 1585729 - protein, 21 aa, Staphylococcus aureus
YFLQFEWFQPLLISLAALLIL

SEQ ID NO: 1585730 - protein, 23 aa, Staphylococcus aureus
YKRLRLQVFLGIFIGYAGYYLLR

SEQ ID NO: 1585731 - protein, 19 aa, Staphylococcus aureus
ALVQSSRVDLIFTRFENMC

SEQ ID NO: 1585732 - protein, 24 aa, Staphylococcus aureus
AQFIPEFIGSLVIGIIAVIGHTLI

SEQ ID NO: 1585733 - protein, 23 aa, Staphylococcus aureus
DGKKRYYNFFGIGAFDSSAVRSG

SEQ ID NO: 1585734 - protein, 18 aa, Staphylococcus aureus
DHEIKMGKYFAGIYIPSK

SEQ ID NO: 1585735 - protein, 24 aa, Staphylococcus aureus
EVETLKWARWLPHMTLRGQNIRGF

SEQ ID NO: 1585736 - protein, 17 aa, Staphylococcus aureus
GSWKAPYSIVFVLDIFS

SEQ ID NO: 1585737 - protein, 17 aa, Staphylococcus aureus
IALHFVKLFGKKTLGLA

SEQ ID NO: 1585738 - protein, 18 aa, Staphylococcus aureus
ILLFFAFRTSNNIVVQHR

SEQ ID NO: 1585739 - protein, 20 aa, Staphylococcus aureus
IYHSFLLKKWYLIIYLLFIL

SEQ ID NO: 1585740 - protein, 20 aa, Staphylococcus aureus
KAGVESPVLFVLITIFCSII

SEQ ID NO: 1585741 - protein, 24 aa, Staphylococcus aureus
LFVLITIFCSIIFNSIVYTCVSLL

SEQ ID NO: 1585742 - protein, 18 aa, Staphylococcus aureus
LGWLCWVMLLVLTVITMF

SEQ ID NO: 1585743 - protein, 19 aa, Staphylococcus aureus
LIFHLIRLAAKIEDQFNKI

SEQ ID NO: 1585744 - protein, 17 aa, Staphylococcus aureus
LIGVLLLTHATYTTILL

SEQ ID NO: 1585745 - protein, 17 aa, Staphylococcus aureus
LLPVGGYVRMAGDGLEE

SEQ ID NO: 1585746 - protein, 24 aa, Staphylococcus aureus
MDLKKVAKTPAVWIILAGLAILPS

SEQ ID NO: 1585747 - protein, 24 aa, Staphylococcus aureus
MLKGLLLKITFNFGLPLLIAILHA

SEQ ID NO: 1585748 - protein, 19 aa, Staphylococcus aureus
QYFSSRIDKILTHKYIGMP

SEQ ID NO: 1585749 - protein, 19 aa, Staphylococcus aureus
SFPERRWVYILALSSSALC

SEQ ID NO: 1585750 - protein, 23 aa, Staphylococcus aureus
SKPLRMMIYLGLFIFSISVLYII

SEQ ID NO: 1585751 - protein, 23 aa, Staphylococcus aureus
SKRILLKILLTILIIIALFIGIM

SEQ ID NO: 1585752 - protein, 24 aa, Staphylococcus aureus
SNFWIYWKTMFAFEPWHSAMEMRR

SEQ ID NO: 1585753 - protein, 24 aa, Staphylococcus aureus
TINKRINFIFGVIVFIFAVLVLRL

SEQ ID NO: 1585754 - protein, 17 aa, Staphylococcus aureus
VGILCFFIPFTINGNNT

SEQ ID NO: 1585755 - protein, 18 aa, Staphylococcus aureus
VKDYGSGMTPFYTALSVW

SEQ ID NO: 1585756 - protein, 17 aa, Staphylococcus aureus
WKAPYSIVFVLDIFSAL

SEQ ID NO: 1585757 - protein, 26 aa, Staphylococcus aureus
AGETIKEHWLPISVIVGAMGVLMIWL

SEQ ID NO: 1585758 - protein, 29 aa, Staphylococcus aureus
AGLAILPSFYAWFNLWAMWDPYGNTGHIK

SEQ ID NO: 1585759 - protein, 19 aa, Staphylococcus aureus
AYNGFSWFAFLLIIQASTI

SEQ ID NO: 1585760 - protein, 20 aa, Staphylococcus aureus
EFAIGMGPKIFSFRKNETLY

SEQ ID NO: 1585761 - protein, 25 aa, Staphylococcus aureus
FANFFKMLWLRLKAMKHYKALNKES

SEQ ID NO: 1585762 - protein, 25 aa, Staphylococcus aureus
GGLAPFTILFSLPFTVIGVIIALLI

SEQ ID NO: 1585763 - protein, 19 aa, Staphylococcus aureus
GNVFPVLSPILGWIGVFMT

SEQ ID NO: 1585764 - protein, 22 aa, Staphylococcus aureus
HPRGLGVLFFVEFWERFSYYGM

SEQ ID NO: 1585765 - protein, 24 aa, Staphylococcus aureus
IKMRKMVPWAIGFFILILIIILFF

SEQ ID NO: 1585766 - protein, 21 aa, Staphylococcus aureus
ILELHPSFYLSFIALLIINLA

SEQ ID NO: 1585767 - protein, 17 aa, Staphylococcus aureus
KDIFVCFVAVVFFNVTN

SEQ ID NO: 1585768 - protein, 31 aa, Staphylococcus aureus
KKSKKGWFWGCGGCLVLFILIIIGISACTAG

SEQ ID NO: 1585769 - protein, 17 aa, Staphylococcus aureus
LDPALLRPGRFDRQIQV

SEQ ID NO: 1585770 - protein, 17 aa, Staphylococcus aureus
LGVPLSVFFGGVKMMIP

SEQ ID NO: 1585771 - protein, 18 aa, Staphylococcus aureus
LKAGKVYKKDRLDVAFSN

SEQ ID NO: 1585772 - protein, 18 aa, Staphylococcus aureus
LTVKETFLTWSLLETIIS

SEQ ID NO: 1585773 - protein, 24 aa, Staphylococcus aureus
NGQENLYRIAIQYYGSGSPENVEK

SEQ ID NO: 1585774 - protein, 21 aa, Staphylococcus aureus
NYAEFFLCIVLSLGVVAPIKN

SEQ ID NO: 1585775 - protein, 19 aa, Staphylococcus aureus
PVIFAIGVAIGLSRSDKGT

SEQ ID NO: 1585776 - protein, 18 aa, Staphylococcus aureus
VLVIIGFVLNMFIKHFKK

SEQ ID NO: 1585777 - protein, 17 aa, Staphylococcus aureus
IFITMICCVLLGSLIGF

SEQ ID NO: 1585778 - protein, 26 aa, Staphylococcus aureus
IITMVLCGFLFPLAITLIGQIFFYQQ

SEQ ID NO: 1585779 - protein, 17 aa, Staphylococcus aureus
IKKRYKIGFIFWGVSII

SEQ ID NO: 1585780 - protein, 18 aa, Staphylococcus aureus
IMLIDWRMASALLVTIPI

SEQ ID NO: 1585781 - protein, 25 aa, Staphylococcus aureus
IRPYKARMILGFSMSFLNAIFIALP

SEQ ID NO: 1585782 - protein, 18 aa, Staphylococcus aureus
KAGGLAIIIGWIITAIGM

SEQ ID NO: 1585783 - protein, 21 aa, Staphylococcus aureus
KRAIFPFIIASGFIADTTSLP

SEQ ID NO: 1585784 - protein, 20 aa, Staphylococcus aureus
LDCITIIIALSIMFFLDVKL

SEQ ID NO: 1585785 - protein, 23 aa, Staphylococcus aureus
LGLKTASTWKKFEVYEGDKKLPV

SEQ ID NO: 1585786 - protein, 23 aa, Staphylococcus aureus
LTSQELFYLFNLILKYISTVPLA

SEQ ID NO: 1585787 - protein, 26 aa, Staphylococcus aureus
NEPLPNRKDFVVSFITGALVGSALGL

SEQ ID NO: 1585788 - protein, 19 aa, Staphylococcus aureus
PVVFCSLALSISNVGESKT

SEQ ID NO: 1585789 - protein, 18 aa, Staphylococcus aureus
RMVFVILTIFGFVMVIGS

SEQ ID NO: 1585790 - protein, 22 aa, Staphylococcus aureus
RYRIPRVAGISIIYLAVVGVIT

SEQ ID NO: 1585791 - protein, 19 aa, Staphylococcus aureus
VFLFFKGKKAFWFMFIGGF

SEQ ID NO: 1585792 - protein, 18 aa, Staphylococcus aureus
VRFVVKFILFFTILNIIA

SEQ ID NO: 1585793 - protein, 19 aa, Staphylococcus aureus
VSASFKWYDFVYFIDTLVY

SEQ ID NO: 1585794 - protein, 17 aa, Staphylococcus aureus
WRYTFLFLIIVSIIVGF

SEQ ID NO: 1585795 - protein, 27 aa, Staphylococcus aureus
ANKELKLIMSLGFILGGIIGFFQGLVA

SEQ ID NO: 1585796 - protein, 18 aa, Staphylococcus aureus
CKQLRQVYPNGVTADHPA

SEQ ID NO: 1585797 - protein, 23 aa, Staphylococcus aureus
DNSWCAGFSMAALLNATKNTDTY

SEQ ID NO: 1585798 - protein, 19 aa, Staphylococcus aureus
LRLLGPLGLHHIFYLPFWQ

SEQ ID NO: 1585799 - protein, 23 aa, Staphylococcus aureus
NVRMPRMIAGLFIGGALAVSGLL

SEQ ID NO: 1585800 - protein, 19 aa, Staphylococcus aureus
PIFRPVMRPLFTLPGRSTV

SEQ ID NO: 1585801 - protein, 24 aa, Staphylococcus aureus
QFSKEEFKTMLAIAGHEGALNEIE

SEQ ID NO: 1585802 - protein, 24 aa, Staphylococcus aureus
RVISRWATEYNIFFKRYSSDQFVA

SEQ ID NO: 1585803 - protein, 35 aa, Staphylococcus aureus
STTAKVVSIATVLLLLGGLVFAIFAYVDHSNKAKE

SEQ ID NO: 1585804 - protein, 19 aa, Staphylococcus aureus
TIMALRWGISVGIASAVLT

SEQ ID NO: 1585805 - protein, 19 aa, Staphylococcus aureus
WVHRRCLKPMFTIANQIAY

SEQ ID NO: 1585806 - protein, 19 aa, Staphylococcus aureus
FHVLAGYRAKFILMVILTM

SEQ ID NO: 1585807 - protein, 17 aa, Staphylococcus aureus
ISWDFQTLIGFVFAPFA

SEQ ID NO: 1585808 - protein, 17 aa, Staphylococcus aureus
MPLKGYVVRGGREMENH

SEQ ID NO: 1585809 - protein, 23 aa, Staphylococcus aureus
NIIWRYILPNAIAPMIVRFSLNI

SEQ ID NO: 1585810 - protein, 24 aa, Staphylococcus aureus
RRNKLKFGLIIGVLTMISYLLFLL

SEQ ID NO: 1585811 - protein, 17 aa, Staphylococcus aureus
TYIGWRSIFVVSILLTL

SEQ ID NO: 1585812 - protein, 18 aa, Staphylococcus aureus
FFLCVAIMYLSIGLQYLL

SEQ ID NO: 1585813 - protein, 24 aa, Staphylococcus aureus
GVTFKELWLPVLTICFILAISKIT

SEQ ID NO: 1585814 - protein, 17 aa, Staphylococcus aureus
IVLMGVWFIFNSLIALI

SEQ ID NO: 1585815 - protein, 17 aa, Staphylococcus aureus
IVTSMFLHFSFEHILMN

SEQ ID NO: 1585816 - protein, 19 aa, Staphylococcus aureus
LSSYYLFNWFFYVYNIGVI

SEQ ID NO: 1585817 - protein, 27 aa, Staphylococcus aureus
MLFHPFKPYYIFKFRVPFTPGLIPKRR

SEQ ID NO: 1585818 - protein, 22 aa, Staphylococcus aureus
TLMRRGYENINMFTIIQLLTPF

SEQ ID NO: 1585819 - protein, 24 aa, Staphylococcus aureus
YFIVCLLISFLALISMNIRILSGF

SEQ ID NO: 1585820 - protein, 17 aa, Staphylococcus aureus
AATFHWTAGFSFSAGLI

SEQ ID NO: 1585821 - protein, 19 aa, Staphylococcus aureus
AYLSYRLEQEYSKDDIFQV

SEQ ID NO: 1585822 - protein, 19 aa, Staphylococcus aureus
FIYLKRYISFVSVNWIHVW

SEQ ID NO: 1585823 - protein, 20 aa, Staphylococcus aureus
IIGALAIFGGMALNNHNNGT

SEQ ID NO: 1585824 - protein, 17 aa, Staphylococcus aureus
IPMLIPLLIKYAIDGVI

SEQ ID NO: 1585825 - protein, 21 aa, Staphylococcus aureus
KRYISFVSVNWIHVWQLFRSS

SEQ ID NO: 1585826 - protein, 24 aa, Staphylococcus aureus
RFYEHGALDYKRLFGAIGKNLTGG

SEQ ID NO: 1585827 - protein, 18 aa, Staphylococcus aureus
RISDALIRMQREHVHMSL

SEQ ID NO: 1585828 - protein, 19 aa, Staphylococcus aureus
RKNTVLYLMHYHKRITDKQ

SEQ ID NO: 1585829 - protein, 25 aa, Staphylococcus aureus
RVGWGEIPMSLGFTYSSNTLMMHLQ

SEQ ID NO: 1585830 - protein, 17 aa, Staphylococcus aureus
VELGQAFIKRLANEKNY

SEQ ID NO: 1585831 - protein, 19 aa, Staphylococcus aureus
YPLMMALTLFFSFLGLLGN

SEQ ID NO: 1585832 - protein, 17 aa, Staphylococcus aureus
GAIGWLILEYIFKKTTS

SEQ ID NO: 1585833 - protein, 17 aa, Staphylococcus aureus
NRAPRFLILPTIILIGI

SEQ ID NO: 1585834 - protein, 19 aa, Staphylococcus aureus
PIFYIFRVLSIFIFIMGFK

SEQ ID NO: 1585835 - protein, 21 aa, Staphylococcus aureus
TSVRIQNRWVVFILFLICSFG

SEQ ID NO: 1585836 - protein, 20 aa, Staphylococcus aureus
WSNSKFKLALKVQDRQDSNE

SEQ ID NO: 1585837 - protein, 21 aa, Staphylococcus aureus
AKDGLFPKWFAKENKNGAPVN

SEQ ID NO: 1585838 - protein, 19 aa, Staphylococcus aureus
ALFLLCFYHLPNLNRYNEK

SEQ ID NO: 1585839 - protein, 17 aa, Staphylococcus aureus
ASAKWGILGPIFVPMLI

SEQ ID NO: 1585840 - protein, 18 aa, Staphylococcus aureus
DGEDFKRPSSVSGSIPSI

SEQ ID NO: 1585841 - protein, 23 aa, Staphylococcus aureus
FASDSKWKIMLSILLSIISVFSG

SEQ ID NO: 1585842 - protein, 18 aa, Staphylococcus aureus
IFGFKWDKGMEAILMKPY

SEQ ID NO: 1585843 - protein, 17 aa, Staphylococcus aureus
ILMGIVIGNSFLNIVER

SEQ ID NO: 1585844 - protein, 17 aa, Staphylococcus aureus
IRILSGFLFLISAIVTI

SEQ ID NO: 1585845 - protein, 21 aa, Staphylococcus aureus
PVPEDHAYIRFPVSDGTQELK

SEQ ID NO: 1585846 - protein, 17 aa, Staphylococcus aureus
QIFFKLPLIVTAVLSIL

SEQ ID NO: 1585847 - protein, 27 aa, Staphylococcus aureus
TSSQSWWGLYALLGMLALFIPKFRKES

SEQ ID NO: 1585848 - protein, 19 aa, Staphylococcus aureus
ASSTWAWLFVLFVLPLIGF

SEQ ID NO: 1585849 - protein, 19 aa, Staphylococcus aureus
FVGTCGWMVYTLFFNGFNV

SEQ ID NO: 1585850 - protein, 23 aa, Staphylococcus aureus
FWNRWHMTLSFWFRDCIYMRSLF

SEQ ID NO: 1585851 - protein, 18 aa, Staphylococcus aureus
GAIFPLFSPVLGWIGVFM

SEQ ID NO: 1585852 - protein, 23 aa, Staphylococcus aureus
GGACLVAGLALIVHMIINRLFRK

SEQ ID NO: 1585853 - protein, 20 aa, Staphylococcus aureus
MLGFLYKYIVAYFINTYAIM

SEQ ID NO: 1585854 - protein, 18 aa, Staphylococcus aureus
NDGYRIQPHIGLTIHEST

SEQ ID NO: 1585855 - protein, 18 aa, Staphylococcus aureus
PLFTGRIVDKFSVSHINW

SEQ ID NO: 1585856 - protein, 17 aa, Staphylococcus aureus
SALILAWSLLVSWNQMV

SEQ ID NO: 1585857 - protein, 18 aa, Staphylococcus aureus
FSTFSFICLSIFIITTLI

SEQ ID NO: 1585858 - protein, 18 aa, Staphylococcus aureus
FTPLLGLSNMYIYIVTFV

SEQ ID NO: 1585859 - protein, 17 aa, Staphylococcus aureus
IAVVVAVMLLAFISLME

SEQ ID NO: 1585860 - protein, 21 aa, Staphylococcus aureus
IFHAPFWFEFGSWKNAAGEII

SEQ ID NO: 1585861 - protein, 19 aa, Staphylococcus aureus
KKKAEVELDINTASTWKKF

SEQ ID NO: 1585862 - protein, 20 aa, Staphylococcus aureus
KLGEHLKHPFILKRIVGQSG

SEQ ID NO: 1585863 - protein, 17 aa, Staphylococcus aureus
KRLPQVINEAVEILKHL

SEQ ID NO: 1585864 - protein, 21 aa, Staphylococcus aureus
MRRYLMRFVHHIGGLADFSAL

SEQ ID NO: 1585865 - protein, 17 aa, Staphylococcus aureus
SAGYKWFFAYPDEHIET

SEQ ID NO: 1585866 - protein, 18 aa, Staphylococcus aureus
AVMGFASAISVIFAVFSA

SEQ ID NO: 1585867 - protein, 18 aa, Staphylococcus aureus
DGSFDWSLVPGYIVAQML

SEQ ID NO: 1585868 - protein, 19 aa, Staphylococcus aureus
EIPKDATIVWYDFDEPNEQ

SEQ ID NO: 1585869 - protein, 18 aa, Staphylococcus aureus
IGVGMILREFYIFRFIIG

SEQ ID NO: 1585870 - protein, 18 aa, Staphylococcus aureus
ILGLCIGVGMILREFYIF

SEQ ID NO: 1585871 - protein, 20 aa, Staphylococcus aureus
KVFGCLGIALAMYATTPKEN

SEQ ID NO: 1585872 - protein, 17 aa, Staphylococcus aureus
LPIAMPVIMAGVRTAMV

SEQ ID NO: 1585873 - protein, 17 aa, Staphylococcus aureus
MSSWTLYYWGWWLSWSP

SEQ ID NO: 1585874 - protein, 19 aa, Staphylococcus aureus
VNLKLRYPFIGAIVGSGIG

SEQ ID NO: 1585875 - protein, 18 aa, Staphylococcus aureus
YRIQPHIGLTIHESTNKD

SEQ ID NO: 1585876 - protein, 36 aa, Staphylococcus aureus
YSKSWLAIVCSMMVVFSIMLFLFVKRNKKKNKNESQ

SEQ ID NO: 1585877 - protein, 18 aa, Staphylococcus aureus
GSDVWTAFEHSLGAPTTQ

SEQ ID NO: 1585878 - protein, 20 aa, Staphylococcus aureus
GTRIRPILMTAIATIGALVP

SEQ ID NO: 1585879 - protein, 19 aa, Staphylococcus aureus
QSWKSFLIVLAACLILIIA

SEQ ID NO: 1585880 - protein, 18 aa, Staphylococcus aureus
RSFYSIRKSTLGVASVIV

SEQ ID NO: 1585881 - protein, 19 aa, Staphylococcus aureus
WFKFWSVIESGGWVIFTHM

SEQ ID NO: 1585882 - protein, 20 aa, Staphylococcus aureus
DEWPFVIAFLPWVLIIIPYL

SEQ ID NO: 1585883 - protein, 19 aa, Staphylococcus aureus
EAFLKYHLLGGRYYQPLAQ

SEQ ID NO: 1585884 - protein, 19 aa, Staphylococcus aureus
EMHWTLWKYLILTCLVVLI

SEQ ID NO: 1585885 - protein, 17 aa, Staphylococcus aureus
FPFFLCVAIMYLSIGLQ

SEQ ID NO: 1585886 - protein, 18 aa, Staphylococcus aureus
KLFRLPAIKRFEEDEELL

SEQ ID NO: 1585887 - protein, 17 aa, Staphylococcus aureus
LAAMCGFLFLASDPAKD

SEQ ID NO: 1585888 - protein, 21 aa, Staphylococcus aureus
LKMTLKYSVCLLIFICIWTFI

SEQ ID NO: 1585889 - protein, 18 aa, Staphylococcus aureus
PFGLPALTLPFIIVTWIL

SEQ ID NO: 1585890 - protein, 17 aa, Staphylococcus aureus
RLLIIRALITWFYTMLW

SEQ ID NO: 1585891 - protein, 19 aa, Staphylococcus aureus
AFFISRGFVKTGLGRRIAL

SEQ ID NO: 1585892 - protein, 23 aa, Staphylococcus aureus
GFEMKESIALFSQWEKSGVNTEI

SEQ ID NO: 1585893 - protein, 24 aa, Staphylococcus aureus
GSILGSMLLRFGRFESSIAKGLTY

SEQ ID NO: 1585894 - protein, 18 aa, Staphylococcus aureus
ILTVCLIGLLILATNEDA

SEQ ID NO: 1585895 - protein, 18 aa, Staphylococcus aureus
INTASTWKKFEVYENNQK

SEQ ID NO: 1585896 - protein, 20 aa, Staphylococcus aureus
LCGFVICYGLIFGLFYLLSG

SEQ ID NO: 1585897 - protein, 18 aa, Staphylococcus aureus
LGLMIPLLILISIVVFSL

SEQ ID NO: 1585898 - protein, 20 aa, Staphylococcus aureus
LGWNYWFNWVVTVAADITIA

SEQ ID NO: 1585899 - protein, 17 aa, Staphylococcus aureus
MCASSAMLLPGISGSFM

SEQ ID NO: 1585900 - protein, 23 aa, Staphylococcus aureus
RQSFNIPALKAWQSVKQNAGNDA

SEQ ID NO: 1585901 - protein, 26 aa, Staphylococcus aureus
SGFYKTPKYSLGDYVWYDSNKDGKQD

SEQ ID NO: 1585902 - protein, 22 aa, Staphylococcus aureus
ARLFGELEFWFSIIKVVTIIAM

SEQ ID NO: 1585903 - protein, 18 aa, Staphylococcus aureus
DIFMWFKLVLNDTTEFNN

SEQ ID NO: 1585904 - protein, 20 aa, Staphylococcus aureus
FAVLVLRLGYLQIAQGSHYK

SEQ ID NO: 1585905 - protein, 17 aa, Staphylococcus aureus
IYLGLKFDFYNRQVYLI

SEQ ID NO: 1585906 - protein, 18 aa, Staphylococcus aureus
RWMFALAFFFIGVIAYMD

SEQ ID NO: 1585907 - protein, 17 aa, Staphylococcus aureus
YCFLGNILGGFVLFFLM

SEQ ID NO: 1585908 - protein, 18 aa, Staphylococcus aureus
ARRVCWFGSALVTVIIGI

SEQ ID NO: 1585909 - protein, 32 aa, Staphylococcus aureus
DILKKFWMMYWPKLVILMGIIILIVILNAIFN

SEQ ID NO: 1585910 - protein, 18 aa, Staphylococcus aureus
GFILRLLGPLGLHHIFYL

SEQ ID NO: 1585911 - protein, 18 aa, Staphylococcus aureus
LTLYLLDLHLGYTFSGGF

SEQ ID NO: 1585912 - protein, 21 aa, Staphylococcus aureus
RAGIMCPEFAIGMGPKIFSFR

SEQ ID NO: 1585913 - protein, 17 aa, Staphylococcus aureus
RRTREFALFQLIGLTRQ

SEQ ID NO: 1585914 - protein, 23 aa, Staphylococcus aureus
SFAKRVFTALGIGIVFGVLLHLV

SEQ ID NO: 1585915 - protein, 20 aa, Staphylococcus aureus
SGLVPYWAVFKIILMMINNA

SEQ ID NO: 1585916 - protein, 19 aa, Staphylococcus aureus
TFGYLRFEILAAFLNGLAL

SEQ ID NO: 1585917 - protein, 18 aa, Staphylococcus aureus
AVKLPGKVKNGVVVDQVD

SEQ ID NO: 1585918 - protein, 17 aa, Staphylococcus aureus
DNIKKVLLFLSRNTSSS

SEQ ID NO: 1585919 - protein, 17 aa, Staphylococcus aureus
GMLDFPMLSTNVYKDGK

SEQ ID NO: 1585920 - protein, 19 aa, Staphylococcus aureus
GVFSLLSTMVLYRFVVFSD

SEQ ID NO: 1585921 - protein, 17 aa, Staphylococcus aureus
IGPSILFKANYGPFLFE

SEQ ID NO: 1585922 - protein, 17 aa, Staphylococcus aureus
IKAQLAILDENYDLDFD

SEQ ID NO: 1585923 - protein, 17 aa, Staphylococcus aureus
IPFLLGLFLGLFGLYLR

SEQ ID NO: 1585924 - protein, 23 aa, Staphylococcus aureus
KDRMEFQMLYGFRSELAEEIANE

SEQ ID NO: 1585925 - protein, 24 aa, Staphylococcus aureus
KEGIKALNWRPSYIPQFIRMAIVV

SEQ ID NO: 1585926 - protein, 17 aa, Staphylococcus aureus
KFSYSWIHFAKIFLYSF

SEQ ID NO: 1585927 - protein, 21 aa, Staphylococcus aureus
MGTASIILGSLVYIGADSQQV

SEQ ID NO: 1585928 - protein, 18 aa, Staphylococcus aureus
QLIKRLKAGKVYKKDRLD

SEQ ID NO: 1585929 - protein, 20 aa, Staphylococcus aureus
RGSREFKWRLPDKITIRNSA

SEQ ID NO: 1585930 - protein, 19 aa, Staphylococcus aureus
YDYTKLVFAKPIYNDPSLV

SEQ ID NO: 1585931 - protein, 20 aa, Staphylococcus aureus
AKELPWGVLILFGGGLALAK

SEQ ID NO: 1585932 - protein, 19 aa, Staphylococcus aureus
DIGFQFSFIISFFIMLLFP

SEQ ID NO: 1585933 - protein, 20 aa, Staphylococcus aureus
ELSVPLISLFGVCIITILLL

SEQ ID NO: 1585934 - protein, 22 aa, Staphylococcus aureus
EVINARLGYYSVVNETNVQLLQ

SEQ ID NO: 1585935 - protein, 17 aa, Staphylococcus aureus
FNPAGLYQTHSFKKLAP

SEQ ID NO: 1585936 - protein, 18 aa, Staphylococcus aureus
FWPVYLIVTAIAIVVPCI

SEQ ID NO: 1585937 - protein, 22 aa, Staphylococcus aureus
KKLEVISSLFSVKKITFDLSDA

SEQ ID NO: 1585938 - protein, 24 aa, Staphylococcus aureus
KPSQIKGAILFGGFYNMQTVRETE

SEQ ID NO: 1585939 - protein, 23 aa, Staphylococcus aureus
LAEEKGRVIGMAKLKTVKEQEKP

SEQ ID NO: 1585940 - protein, 20 aa, Staphylococcus aureus
LQNRFEAIVAFLMITLFCKF

SEQ ID NO: 1585941 - protein, 21 aa, Staphylococcus aureus
PHLKEWERLSGIPIEEQTYER

SEQ ID NO: 1585942 - protein, 18 aa, Staphylococcus aureus
PMIVRFSLNIGVVVLTTS

SEQ ID NO: 1585943 - protein, 20 aa, Staphylococcus aureus
RYTTHLEFEKAIPTLADAAK

SEQ ID NO: 1585944 - protein, 20 aa, Staphylococcus aureus
SFILAFPMALIWPTIQSGLN

SEQ ID NO: 1585945 - protein, 17 aa, Staphylococcus aureus
SSAMLLPGISGSFMLLV

SEQ ID NO: 1585946 - protein, 19 aa, Staphylococcus aureus
SYHIFRIFFILFIIAPGIN

SEQ ID NO: 1585947 - protein, 22 aa, Staphylococcus aureus
TTWSHLKWAIPLIGIALFIILT

SEQ ID NO: 1585948 - protein, 19 aa, Staphylococcus aureus
VGHTVFKWVAIGMTTLSVL

SEQ ID NO: 1585949 - protein, 18 aa, Staphylococcus aureus
ALMLKWWLLLVISIIVLI

SEQ ID NO: 1585950 - protein, 19 aa, Staphylococcus aureus
ANHPIEFNMIWKAMLIPSM

SEQ ID NO: 1585951 - protein, 24 aa, Staphylococcus aureus
ARGLKFKIMFNFGLPLVIALSHAY

SEQ ID NO: 1585952 - protein, 18 aa, Staphylococcus aureus
DLPWKGVYVLAITLWIAT

SEQ ID NO: 1585953 - protein, 20 aa, Staphylococcus aureus
DRLREAMKFDQSFKPSQIKG

SEQ ID NO: 1585954 - protein, 18 aa, Staphylococcus aureus
FVALEFFYIMYLETIATT

SEQ ID NO: 1585955 - protein, 17 aa, Staphylococcus aureus
FYFYLTLFMFSMIGIVL

SEQ ID NO: 1585956 - protein, 18 aa, Staphylococcus aureus
GYFLKRINFIKATDSQVI

SEQ ID NO: 1585957 - protein, 18 aa, Staphylococcus aureus
IKESLAIVLDESKRLNRL

SEQ ID NO: 1585958 - protein, 17 aa, Staphylococcus aureus
KDKTMHLQLLFGQANRQ

SEQ ID NO: 1585959 - protein, 17 aa, Staphylococcus aureus
KEFWPVYLIVTAIAIVV

SEQ ID NO: 1585960 - protein, 18 aa, Staphylococcus aureus
MALLALSSIVAFVLPRKR

SEQ ID NO: 1585961 - protein, 18 aa, Staphylococcus aureus
RRTLECYTEPQIDDSNDG

SEQ ID NO: 1585962 - protein, 20 aa, Staphylococcus aureus
VELPLALPLIIGGIRLSSVY

SEQ ID NO: 1585963 - protein, 18 aa, Staphylococcus aureus
VIDKRLKYIILHEYAHAK

SEQ ID NO: 1585964 - protein, 18 aa, Staphylococcus aureus
WIRRLKRLLPAVIVLLMV

SEQ ID NO: 1585965 - protein, 19 aa, Staphylococcus aureus
YGDDWFAYFMRRLAERPQN

SEQ ID NO: 1585966 - protein, 17 aa, Staphylococcus aureus
YGISLIFVEDVIESLPE

SEQ ID NO: 1585967 - protein, 20 aa, Staphylococcus aureus
YVICCIIGYLFFGLGLGIYA

SEQ ID NO: 1585968 - protein, 17 aa, Staphylococcus aureus
EVIKLSVSIGVGYLTDD

SEQ ID NO: 1585969 - protein, 23 aa, Staphylococcus aureus
FGKDRFRLFSGWYYLIKYAMPVV

SEQ ID NO: 1585970 - protein, 17 aa, Staphylococcus aureus
IDLTSSRFIKWLNDMNI

SEQ ID NO: 1585971 - protein, 22 aa, Staphylococcus aureus
ILFSCLTFFFGLDYERFPNYLK

SEQ ID NO: 1585972 - protein, 18 aa, Staphylococcus aureus
KLDAAYHFKDINGLTPYR

SEQ ID NO: 1585973 - protein, 24 aa, Staphylococcus aureus
LLFLWPLLYSWIVKFGESIVGLGS

SEQ ID NO: 1585974 - protein, 19 aa, Staphylococcus aureus
VSWGEWFLYAAPWSIVMSV

SEQ ID NO: 1585975 - protein, 17 aa, Staphylococcus aureus
WDFQTLIGFVFAPFAFL

SEQ ID NO: 1585976 - protein, 18 aa, Staphylococcus aureus
AYFYLPFLLIYFLIQGYS

SEQ ID NO: 1585977 - protein, 18 aa, Staphylococcus aureus
DKMIKRLNLSSGAGSVRI

SEQ ID NO: 1585978 - protein, 18 aa, Staphylococcus aureus
EHFSKWNWLSSLVAFIGI

SEQ ID NO: 1585979 - protein, 19 aa, Staphylococcus aureus
EYTESAVTQVRYVDVTTGK

SEQ ID NO: 1585980 - protein, 25 aa, Staphylococcus aureus
FDHPNRIAIFVAFAILGFVGLILGV

SEQ ID NO: 1585981 - protein, 23 aa, Staphylococcus aureus
FGRKRIAVSILIIFILVSGLSMF

SEQ ID NO: 1585982 - protein, 17 aa, Staphylococcus aureus
GKILAALLFGMFIAILN

SEQ ID NO: 1585983 - protein, 17 aa, Staphylococcus aureus
GPIKVLRIILIINAIAL

SEQ ID NO: 1585984 - protein, 19 aa, Staphylococcus aureus
IALMFPLMIVVSFMTFLLT

SEQ ID NO: 1585985 - protein, 17 aa, Staphylococcus aureus
INDKWLLILCVLVIIIN

SEQ ID NO: 1585986 - protein, 17 aa, Staphylococcus aureus
IPGLIVWQAFSIFVGTI

SEQ ID NO: 1585987 - protein, 27 aa, Staphylococcus aureus
ISLFGVCIITILLLCSSVILLTNHQHR

SEQ ID NO: 1585988 - protein, 18 aa, Staphylococcus aureus
KEFLEKWAGVPTEVHVAS

SEQ ID NO: 1585989 - protein, 18 aa, Staphylococcus aureus
LHMILRLFMLLTLISGFW

SEQ ID NO: 1585990 - protein, 19 aa, Staphylococcus aureus
LLHYIFKINDKWLLILCVL

SEQ ID NO: 1585991 - protein, 18 aa, Staphylococcus aureus
LNKVCHVHGIKALNVNDL

SEQ ID NO: 1585992 - protein, 19 aa, Staphylococcus aureus
LPSGLSYDSATNSIIGTPT

SEQ ID NO: 1585993 - protein, 22 aa, Staphylococcus aureus
PRGEFLHMLLGVFLAALVSFVV

SEQ ID NO: 1585994 - protein, 20 aa, Staphylococcus aureus
QSRIELFTTDGLQVIGDIST

SEQ ID NO: 1585995 - protein, 22 aa, Staphylococcus aureus
SETLARLGIVLGVFLTSLQMGL

SEQ ID NO: 1585996 - protein, 19 aa, Staphylococcus aureus
SVSTSLRKSESVSESSSLS

SEQ ID NO: 1585997 - protein, 17 aa, Staphylococcus aureus
WGDEWPFVIAFLPWVLI

SEQ ID NO: 1585998 - protein, 20 aa, Staphylococcus aureus
AWLNRIIPRVDIEGHALEKY

SEQ ID NO: 1585999 - protein, 17 aa, Staphylococcus aureus
FEILAAFLNGLALIVIS

SEQ ID NO: 1586000 - protein, 18 aa, Staphylococcus aureus
FVRYFSRMIIPNLFSLLA

SEQ ID NO: 1586001 - protein, 19 aa, Staphylococcus aureus
GIACGFIFYPITMLISKKH

SEQ ID NO: 1586002 - protein, 23 aa, Staphylococcus aureus
GKGSWYLPAWLNRIIPRVDIEGH

SEQ ID NO: 1586003 - protein, 17 aa, Staphylococcus aureus
HFLAFNGFMGFITFVLL

SEQ ID NO: 1586004 - protein, 20 aa, Staphylococcus aureus
IFLLLRFTPLLGLSNMYIYI

SEQ ID NO: 1586005 - protein, 18 aa, Staphylococcus aureus
IFQFSVTELIGWIITHIF

SEQ ID NO: 1586006 - protein, 21 aa, Staphylococcus aureus
IKQNGLLGGVMTLLVGLGLMK

SEQ ID NO: 1586007 - protein, 20 aa, Staphylococcus aureus
ILIAIGWRLIWKREINKHKN

SEQ ID NO: 1586008 - protein, 22 aa, Staphylococcus aureus
IRFLKLKVGKIINVAKVDIIAF

SEQ ID NO: 1586009 - protein, 25 aa, Staphylococcus aureus
KTGKYELGEAFKIYKFNGEEDNSYY

SEQ ID NO: 1586010 - protein, 17 aa, Staphylococcus aureus
LIGGIAWGVYAFFANTP

SEQ ID NO: 1586011 - protein, 19 aa, Staphylococcus aureus
LLVACGFVGAIAWTIYQLT

SEQ ID NO: 1586012 - protein, 26 aa, Staphylococcus aureus
NILMCLRIYLNVFFRMTLKYNQILYI

SEQ ID NO: 1586013 - protein, 24 aa, Staphylococcus aureus
SKALRWQKWHAMIGVIIAIPVFVL

SEQ ID NO: 1586014 - protein, 20 aa, Staphylococcus aureus
TGLPSGLTFDSTNNTISGTP

SEQ ID NO: 1586015 - protein, 17 aa, Staphylococcus aureus
VGKEFLEKWAGVPTEVH

SEQ ID NO: 1586016 - protein, 18 aa, Staphylococcus aureus
VIQGCVLFIGFFVVIINT

SEQ ID NO: 1586017 - protein, 17 aa, Staphylococcus aureus
VNHVNFLKRICIPAPVI

SEQ ID NO: 1586018 - protein, 18 aa, Staphylococcus aureus
VTDLAPLIAAIICILVFK

SEQ ID NO: 1586019 - protein, 21 aa, Staphylococcus aureus
YMSSWPWHWAKPMRYLMENGS

SEQ ID NO: 1586020 - protein, 20 aa, Staphylococcus aureus
DRYGRTLAYVWISKDRMYNK

SEQ ID NO: 1586021 - protein, 20 aa, Staphylococcus aureus
KRLIFKFSIGVLVWGIGLSI

SEQ ID NO: 1586022 - protein, 21 aa, Staphylococcus aureus
NEICQEWLYHLGVSTDKIEDL

SEQ ID NO: 1586023 - protein, 17 aa, Staphylococcus aureus
PKTGLTSVDNFISTVAF

SEQ ID NO: 1586024 - protein, 21 aa, Staphylococcus aureus
SGIIGCLYGWIGLKLNLSSGR

SEQ ID NO: 1586025 - protein, 17 aa, Staphylococcus aureus
VLIMVLIGFIFWRQDDY

SEQ ID NO: 1586026 - protein, 17 aa, Staphylococcus aureus
WLYHLGVSTDKIEDLAK

SEQ ID NO: 1586027 - protein, 17 aa, Staphylococcus aureus
YGEKVLDAFDYIPFAYL

SEQ ID NO: 1586028 - protein, 20 aa, Staphylococcus aureus
AYSQKGAITLGTRIDSNKSF

SEQ ID NO: 1586029 - protein, 17 aa, Staphylococcus aureus
DYKGGGMANLFKDLVHL

SEQ ID NO: 1586030 - protein, 17 aa, Staphylococcus aureus
ELTACWTIFMILSGTYL

SEQ ID NO: 1586031 - protein, 17 aa, Staphylococcus aureus
FIKPLWQYHCRFYKVDQ

SEQ ID NO: 1586032 - protein, 17 aa, Staphylococcus aureus
FRVPFTPGLIPKRREEI

SEQ ID NO: 1586033 - protein, 22 aa, Staphylococcus aureus
IAKHKWSAVIAWIVIVAAILIP

SEQ ID NO: 1586034 - protein, 24 aa, Staphylococcus aureus
IGNFLRRSCFVLFSLQIIWFTVEL

SEQ ID NO: 1586035 - protein, 18 aa, Staphylococcus aureus
LVLRLAIAFYILAAILGL

SEQ ID NO: 1586036 - protein, 25 aa, Staphylococcus aureus
SFWFRDCIYMRSLFYMSRKKLLKSQ

SEQ ID NO: 1586037 - protein, 20 aa, Staphylococcus aureus
SNYFRFQYFNPLKSERYYRN

SEQ ID NO: 1586038 - protein, 17 aa, Staphylococcus aureus
TIFRLMLPFSTYIFILI

SEQ ID NO: 1586039 - protein, 22 aa, Staphylococcus aureus
TRIDSNKSFHFSGKVNLGNKYE

SEQ ID NO: 1586040 - protein, 19 aa, Staphylococcus aureus
TTAVIGGAFTVNMLHDQQA

SEQ ID NO: 1586041 - protein, 17 aa, Staphylococcus aureus
YAYNWAFFNPIRKIYYN

SEQ ID NO: 1586042 - protein, 17 aa, Staphylococcus aureus
ALCGLFIQHLSTLNMKY

SEQ ID NO: 1586043 - protein, 17 aa, Staphylococcus aureus
FVGFLGISYVTFKSVQL

SEQ ID NO: 1586044 - protein, 19 aa, Staphylococcus aureus
GGPGAVFWMWVIAFIGAAS

SEQ ID NO: 1586045 - protein, 18 aa, Staphylococcus aureus
GKMTFFFIITIIILIALV

SEQ ID NO: 1586046 - protein, 17 aa, Staphylococcus aureus
GVLLSFFAIQLLERKSR

SEQ ID NO: 1586047 - protein, 17 aa, Staphylococcus aureus
IIIWFLRVALSLLITIP

SEQ ID NO: 1586048 - protein, 19 aa, Staphylococcus aureus
KMRVVRRRITVFAGVLLAI

SEQ ID NO: 1586049 - protein, 17 aa, Staphylococcus aureus
KQALKDRINQILQQGHN

SEQ ID NO: 1586050 - protein, 23 aa, Staphylococcus aureus
LTLILICFPDIFGTSYLSRGYLI

SEQ ID NO: 1586051 - protein, 17 aa, Staphylococcus aureus
LVKYKGKYLPLLENGKL

SEQ ID NO: 1586052 - protein, 23 aa, Staphylococcus aureus
MFSTFRFSWAYRLATVITLIISI

SEQ ID NO: 1586053 - protein, 17 aa, Staphylococcus aureus
MRLAKIQLWFLIKGLTP

SEQ ID NO: 1586054 - protein, 18 aa, Staphylococcus aureus
MVTMCIGVGMGAAAIFEY

SEQ ID NO: 1586055 - protein, 21 aa, Staphylococcus aureus
NFFHGWPWYAVWLVMLGFGGG

SEQ ID NO: 1586056 - protein, 20 aa, Staphylococcus aureus
RDDFRVIFEVQDFGIGIKLE

SEQ ID NO: 1586057 - protein, 18 aa, Staphylococcus aureus
RIVLPIIIIFIIFIVLYS

SEQ ID NO: 1586058 - protein, 17 aa, Staphylococcus aureus
RRIIMIGFITLPLYYLL

SEQ ID NO: 1586059 - protein, 25 aa, Staphylococcus aureus
SISKKMTGYGLKTTAVIGGAFTVNM

SEQ ID NO: 1586060 - protein, 45 aa, Staphylococcus aureus
TRVRLYKSGKNWVKSGIKEIEMFKIMGLPFISHSLVSQDNQSISK

SEQ ID NO: 1586061 - protein, 17 aa, Staphylococcus aureus
YCKKRVWSYDMDRMDQV

SEQ ID NO: 1586062 - protein, 17 aa, Staphylococcus aureus
AALALWVRCKRNTTLRN

SEQ ID NO: 1586063 - protein, 35 aa, Staphylococcus aureus
DKERKKGGMAKVLLPLIAAVLIIGALAIFGGMALN

SEQ ID NO: 1586064 - protein, 19 aa, Staphylococcus aureus
FKGNAPYIFAHRGGMALRP

SEQ ID NO: 1586065 - protein, 17 aa, Staphylococcus aureus
HPFILKRIVGQSGMSYG

SEQ ID NO: 1586066 - protein, 24 aa, Staphylococcus aureus
KTTTTFKYEVTRNSMSDSVSTSGS

SEQ ID NO: 1586067 - protein, 20 aa, Staphylococcus aureus
LLFCAGVAFAFYVGFPMIIQ

SEQ ID NO: 1586068 - protein, 18 aa, Staphylococcus aureus
LPMIFALGVAIGLAGGDG

SEQ ID NO: 1586069 - protein, 19 aa, Staphylococcus aureus
QLKKRITVIDGHSHTVLQN

SEQ ID NO: 1586070 - protein, 22 aa, Staphylococcus aureus
QSSEVYSPISPIKIATQDNSGN

SEQ ID NO: 1586071 - protein, 20 aa, Staphylococcus aureus
SRLEGVINFENLKVKDVDTT

SEQ ID NO: 1586072 - protein, 19 aa, Staphylococcus aureus
SRLNNILTILSIVLVIIHM

SEQ ID NO: 1586073 - protein, 25 aa, Staphylococcus aureus
SWLTLCLCIAIALILYALPYLILGS

SEQ ID NO: 1586074 - protein, 26 aa, Staphylococcus aureus
TAPVKLRTFSRLAMSTFASAATTTAV

SEQ ID NO: 1586075 - protein, 19 aa, Staphylococcus aureus
TKRNKFRLVIEIVILELII

SEQ ID NO: 1586076 - protein, 19 aa, Staphylococcus aureus
TSDSLRTSTSLSDSLSMST

SEQ ID NO: 1586077 - protein, 19 aa, Staphylococcus aureus
VALSFLFGIPMFVGALITG

SEQ ID NO: 1586078 - protein, 18 aa, Staphylococcus aureus
VVLIPVFILFALVDFGFG

SEQ ID NO: 1586079 - protein, 19 aa, Staphylococcus aureus
ALAATLFKKGVKRRNKQHQ

SEQ ID NO: 1586080 - protein, 17 aa, Staphylococcus aureus
FKLDTYHNTSKPNSAAK

SEQ ID NO: 1586081 - protein, 17 aa, Staphylococcus aureus
IIIPRFLDLGTFDVTIA

SEQ ID NO: 1586082 - protein, 20 aa, Staphylococcus aureus
IKIISWIASIYIEILRGTPM

SEQ ID NO: 1586083 - protein, 17 aa, Staphylococcus aureus
KIDRPSIGIGLINLKDI

SEQ ID NO: 1586084 - protein, 20 aa, Staphylococcus aureus
KQGTGLGLFICKMIIEEHGG

SEQ ID NO: 1586085 - protein, 18 aa, Staphylococcus aureus
LAATLFKKGVKRRNKQHQ

SEQ ID NO: 1586086 - protein, 20 aa, Staphylococcus aureus
LEYIYRLILKYLLWYIKTVK

SEQ ID NO: 1586087 - protein, 18 aa, Staphylococcus aureus
LIIIWFLRVALSLLITIP

SEQ ID NO: 1586088 - protein, 18 aa, Staphylococcus aureus
MRVVRRRITVFAGVLLAI

SEQ ID NO: 1586089 - protein, 17 aa, Staphylococcus aureus
VTMCIGVGMGAAAIFEY

SEQ ID NO: 1586090 - protein, 24 aa, Staphylococcus aureus
YTNPESYLWIGIVFVFFLISYISQ

SEQ ID NO: 1586091 - protein, 19 aa, Staphylococcus aureus
CFLFICIYLNMAIGSSKIN

SEQ ID NO: 1586092 - protein, 31 aa, Staphylococcus aureus
EGHGNGGDGIGFAFSPGVLGETGLNGAAVGI

SEQ ID NO: 1586093 - protein, 17 aa, Staphylococcus aureus
FHFSGKVNLGNKYEGHG

SEQ ID NO: 1586094 - protein, 19 aa, Staphylococcus aureus
KIISWIASIYIEILRGTPM

SEQ ID NO: 1586095 - protein, 17 aa, Staphylococcus aureus
LRAGFAYIKKYWLRLSI

SEQ ID NO: 1586096 - protein, 19 aa, Staphylococcus aureus
LRRLTWLMAIIIYCGVYTG

SEQ ID NO: 1586097 - protein, 26 aa, Staphylococcus aureus
PRYRRPKFPWFKTVIVALIAGIIGAL

SEQ ID NO: 1586098 - protein, 18 aa, Staphylococcus aureus
QLKKRITVIDGHSHTVLQ

SEQ ID NO: 1586099 - protein, 18 aa, Staphylococcus aureus
RSMIGISVAMIWVFLNDY

SEQ ID NO: 1586100 - protein, 17 aa, Staphylococcus aureus
VDTFVVISHLGIDPSTQ

SEQ ID NO: 1586101 - protein, 17 aa, Staphylococcus aureus
VSTSLRSSESVSESDSL

SEQ ID NO: 1586102 - protein, 18 aa, Staphylococcus aureus
ALVKYKGKYLPLLENGKL

SEQ ID NO: 1586103 - protein, 21 aa, Staphylococcus aureus
DSGKYKVIFEKPAGLTQTGTN

SEQ ID NO: 1586104 - protein, 25 aa, Staphylococcus aureus
DTGFYKEPKYNLGDYVWEDTNKDGI

SEQ ID NO: 1586105 - protein, 25 aa, Staphylococcus aureus
DYTNPESYLWIGIVFVFFLISYISQ

SEQ ID NO: 1586106 - protein, 18 aa, Staphylococcus aureus
EDGHPEWIIPTDPARRND

SEQ ID NO: 1586107 - protein, 26 aa, Staphylococcus aureus
FALLFRFIVRLIPIFYIFRVLSIFIF

SEQ ID NO: 1586108 - protein, 19 aa, Staphylococcus aureus
GIIAILVGFVWFKLYQYTT

SEQ ID NO: 1586109 - protein, 17 aa, Staphylococcus aureus
GKMTFFFIITIIILIAL

SEQ ID NO: 1586110 - protein, 17 aa, Staphylococcus aureus
ILVGFVWFKLYQYTTNP

SEQ ID NO: 1586111 - protein, 18 aa, Staphylococcus aureus
KRRIIMIGFITLPLYYLL

SEQ ID NO: 1586112 - protein, 21 aa, Staphylococcus aureus
LEYIYRLILKYLLWYIKTVKG

SEQ ID NO: 1586113 - protein, 19 aa, Staphylococcus aureus
MFRPFALAIAFSLLASLLV

SEQ ID NO: 1586114 - protein, 21 aa, Staphylococcus aureus
QLKKLEGMLDFPMLSTNVYKD

SEQ ID NO: 1586115 - protein, 18 aa, Staphylococcus aureus
RIVLPIIIIFIVFIVLYS

SEQ ID NO: 1586116 - protein, 24 aa, Staphylococcus aureus
RRHLRPKISATFLAWLLIFLMFAL

SEQ ID NO: 1586117 - protein, 25 aa, Staphylococcus aureus
RRHLRPKISATFLAWLLIFLMFALP

SEQ ID NO: 1586118 - protein, 24 aa, Staphylococcus aureus
SFWFRDCIYMRSLFYMSRKKLLKS

SEQ ID NO: 1586119 - protein, 19 aa, Staphylococcus aureus
AGQEVYKIGNYVWEDTNKN

SEQ ID NO: 1586120 - protein, 17 aa, Staphylococcus aureus
ATSHLLGYVGPINSEEL

SEQ ID NO: 1586121 - protein, 23 aa, Staphylococcus aureus
ETGELIFKFYRHCFRYNEINLKI

SEQ ID NO: 1586122 - protein, 17 aa, Staphylococcus aureus
FKLKMPGAFMILFILTV

SEQ ID NO: 1586123 - protein, 19 aa, Staphylococcus aureus
FLTQWKLYIISAVVLIMVL

SEQ ID NO: 1586124 - protein, 23 aa, Staphylococcus aureus
IIRKSHSLEVIFIGTYIYMRLIT

SEQ ID NO: 1586125 - protein, 18 aa, Staphylococcus aureus
KAIITWLLLIPIFNFMTS

SEQ ID NO: 1586126 - protein, 18 aa, Staphylococcus aureus
KRNKFRLVIEIVILELII

SEQ ID NO: 1586127 - protein, 22 aa, Staphylococcus aureus
LNFFHGWPWYAVWLVMLGFGGG

SEQ ID NO: 1586128 - protein, 21 aa, Staphylococcus aureus
LTDVRWTSLMIEQLINNALKY

SEQ ID NO: 1586129 - protein, 17 aa, Staphylococcus aureus
LVLRLAIAFYILAAILG

SEQ ID NO: 1586130 - protein, 19 aa, Staphylococcus aureus
LYGWIGLKLNLSSGRFSRK

SEQ ID NO: 1586131 - protein, 17 aa, Staphylococcus aureus
PKFNDWIFIIFIISVYY

SEQ ID NO: 1586132 - protein, 21 aa, Staphylococcus aureus
PPWNDFFKRFSFYAIAIQYFV

SEQ ID NO: 1586133 - protein, 27 aa, Staphylococcus aureus
PRYRRPKFPWFKTVIVALIAGIIGALL

SEQ ID NO: 1586134 - protein, 17 aa, Staphylococcus aureus
QFWRKFEVYEGDKKLPI

SEQ ID NO: 1586135 - protein, 19 aa, Staphylococcus aureus
QGTGLGLFICKMIIEEHGG

SEQ ID NO: 1586136 - protein, 19 aa, Staphylococcus aureus
RDDFRVIFEVQDFGIGIKL

SEQ ID NO: 1586137 - protein, 17 aa, Staphylococcus aureus
WKLYIISAVVLIMVLIG

SEQ ID NO: 1586138 - protein, 17 aa, Staphylococcus aureus
EILKFIIVGGINTLNYY

SEQ ID NO: 1586139 - protein, 17 aa, Staphylococcus aureus
FKTLFTIGVWRKTFFSV

SEQ ID NO: 1586140 - protein, 18 aa, Staphylococcus aureus
FMRLAKIQLWFLIKGLTP

SEQ ID NO: 1586141 - protein, 24 aa, Staphylococcus aureus
GKVTRYDLISVLPFGNTIAQIDVK

SEQ ID NO: 1586142 - protein, 18 aa, Staphylococcus aureus
IVIIVCLLFKMATVPAML

SEQ ID NO: 1586143 - protein, 24 aa, Staphylococcus aureus
LGFLRLVFIPAMIVFFQDSTIDNL

SEQ ID NO: 1586144 - protein, 20 aa, Staphylococcus aureus
NGTLPRFSLGTMWKDIKSGA

SEQ ID NO: 1586145 - protein, 23 aa, Staphylococcus aureus
NPDGRLALITSYIPFLAPFQLVV

SEQ ID NO: 1586146 - protein, 18 aa, Staphylococcus aureus
NSMHPSDSMSMHHTHSTS

SEQ ID NO: 1586147 - protein, 17 aa, Staphylococcus aureus
VGIALLTFIVWITLVTP

SEQ ID NO: 1586148 - protein, 18 aa, Staphylococcus aureus
VVLIMVLIGFIFWRQDDY

SEQ ID NO: 1586149 - protein, 17 aa, Staphylococcus aureus
ALSFLFGIPMFVGALIT

SEQ ID NO: 1586150 - protein, 27 aa, Staphylococcus aureus
AVGIGGLSNAFGFKLDTYHNTSKPNSA

SEQ ID NO: 1586151 - protein, 21 aa, Staphylococcus aureus
DRYGRTLAYVWISKDRMYNKE

SEQ ID NO: 1586152 - protein, 17 aa, Staphylococcus aureus
EEIGDLFSIKVIAISTA

SEQ ID NO: 1586153 - protein, 32 aa, Staphylococcus aureus
GMLKGCGGCLISFILLIILLSACSMMFSNNDN

SEQ ID NO: 1586154 - protein, 18 aa, Staphylococcus aureus
IRASTIWGIIYLILIITF

SEQ ID NO: 1586155 - protein, 17 aa, Staphylococcus aureus
LSIRASTIWGIIYLILI

SEQ ID NO: 1586156 - protein, 23 aa, Staphylococcus aureus
MISNRLNKFSIRKYTVGTASILV

SEQ ID NO: 1586157 - protein, 27 aa, Staphylococcus aureus
NRKGMIPNRLNKFSIRKYSVGTASILV

SEQ ID NO: 1586158 - protein, 27 aa, Staphylococcus aureus
QRVTLKYKWKFGEGIKAGDYFDFTLSD

SEQ ID NO: 1586159 - protein, 20 aa, Staphylococcus aureus
RISKVFAHDMPKIMSVDNVT

SEQ ID NO: 1586160 - protein, 18 aa, Staphylococcus aureus
RRKFEIVKRSRLNVTTKI

SEQ ID NO: 1586161 - protein, 17 aa, Staphylococcus aureus
SQISIFFSRVFSVLFTF

SEQ ID NO: 1586162 - protein, 20 aa, Staphylococcus aureus
TGIACGFIFYPITMLISKKH

SEQ ID NO: 1586163 - protein, 17 aa, Staphylococcus aureus
VVLMVLMFIGRVGLISF

SEQ ID NO: 1586164 - protein, 18 aa, Staphylococcus aureus
YLYYIVSAFLFWLVILTF

SEQ ID NO: 1586165 - protein, 17 aa, Staphylococcus aureus
DKMIKRLNISSGAGSVR

SEQ ID NO: 1586166 - protein, 24 aa, Staphylococcus aureus
DVKEVRWLFRIIALIVFAVLMFTI

SEQ ID NO: 1586167 - protein, 18 aa, Staphylococcus aureus
GKILAALLFGMFIAILNQ

SEQ ID NO: 1586168 - protein, 17 aa, Staphylococcus aureus
GVSRGKILAALLFGMFI

SEQ ID NO: 1586169 - protein, 18 aa, Staphylococcus aureus
IALMFPLVIVVSFMTFLL

SEQ ID NO: 1586170 - protein, 18 aa, Staphylococcus aureus
IKTGRFIATASIVFSILL

SEQ ID NO: 1586171 - protein, 17 aa, Staphylococcus aureus
ILLFYVLSIAVIGAIIP

SEQ ID NO: 1586172 - protein, 17 aa, Staphylococcus aureus
ILLLFSFVVFFFIYGMV

SEQ ID NO: 1586173 - protein, 17 aa, Staphylococcus aureus
KGKLIGMLQMFMTKESI

SEQ ID NO: 1586174 - protein, 18 aa, Staphylococcus aureus
KLDAGYHFKDINGLTPYR

SEQ ID NO: 1586175 - protein, 18 aa, Staphylococcus aureus
KNKWPFLIALPFMIGYGI

SEQ ID NO: 1586176 - protein, 23 aa, Staphylococcus aureus
LIELIRWLFTFGILFQLPILFMG

SEQ ID NO: 1586177 - protein, 22 aa, Staphylococcus aureus
LTDVRWTSLMIEQLINNALKYA

SEQ ID NO: 1586178 - protein, 24 aa, Staphylococcus aureus
NEICQEWLYHLGVPTDKIEDLAKH

SEQ ID NO: 1586179 - protein, 18 aa, Staphylococcus aureus
NHYYWKFVSILLISILIE

SEQ ID NO: 1586180 - protein, 19 aa, Staphylococcus aureus
NYFRFQYFNPLKSERYYRN

SEQ ID NO: 1586181 - protein, 20 aa, Staphylococcus aureus
PRLFWPIYYFIQAPMQKMMI

SEQ ID NO: 1586182 - protein, 19 aa, Staphylococcus aureus
PVIQGCVLFIGFFVVIINT

SEQ ID NO: 1586183 - protein, 22 aa, Staphylococcus aureus
RSTMKVVLPKGWTLKNVVNHFI

SEQ ID NO: 1586184 - protein, 23 aa, Staphylococcus aureus
TSTAKVPPIMAGDQVLANGVIDS

SEQ ID NO: 1586185 - protein, 19 aa, Staphylococcus aureus
VSWGEWFLYAAPWSIVMSI

SEQ ID NO: 1586186 - protein, 23 aa, Staphylococcus aureus
YFLKSRMNWIFWILFLNLLMLGI

SEQ ID NO: 1586187 - protein, 18 aa, Staphylococcus aureus
DIAFPYKGTFIFLASTGL

SEQ ID NO: 1586188 - protein, 18 aa, Staphylococcus aureus
DNLPRFYLYLTLFMFSML

SEQ ID NO: 1586189 - protein, 21 aa, Staphylococcus aureus
DVWHLKPAMTIAVSHGIFNIT

SEQ ID NO: 1586190 - protein, 21 aa, Staphylococcus aureus
EEKLYKIGDYVWEDVDKDGVQ

SEQ ID NO: 1586191 - protein, 24 aa, Staphylococcus aureus
ETVAFTKERVEGFLNKSKNEQAAL

SEQ ID NO: 1586192 - protein, 23 aa, Staphylococcus aureus
EVINARLGYYSVVNETNVQLLQP

SEQ ID NO: 1586193 - protein, 18 aa, Staphylococcus aureus
EYGISLIFVEDVIESLPE

SEQ ID NO: 1586194 - protein, 22 aa, Staphylococcus aureus
FADYWRWWIVHLWVEGIFEAFA

SEQ ID NO: 1586195 - protein, 17 aa, Staphylococcus aureus
FGIEIQRLFPFNIAKTW

SEQ ID NO: 1586196 - protein, 23 aa, Staphylococcus aureus
FGRKRIAVSILIIFILASGLSMF

SEQ ID NO: 1586197 - protein, 19 aa, Staphylococcus aureus
FKSEGFSIIGLILDIVILT

SEQ ID NO: 1586198 - protein, 18 aa, Staphylococcus aureus
FRVPFTPGLIPKRREEIA

SEQ ID NO: 1586199 - protein, 20 aa, Staphylococcus aureus
IEIQRLFPFNIAKTWHVQLV

SEQ ID NO: 1586200 - protein, 25 aa, Staphylococcus aureus
ILLFLWPLLYSWIVKFGESIVGLGS

SEQ ID NO: 1586201 - protein, 19 aa, Staphylococcus aureus
IPLYIGVLLLYYSRFIIMH

SEQ ID NO: 1586202 - protein, 19 aa, Staphylococcus aureus
KKLSWPVGLIVAAITISSL

SEQ ID NO: 1586203 - protein, 18 aa, Staphylococcus aureus
NGNIRYTFTNEIEHKVEV

SEQ ID NO: 1586204 - protein, 18 aa, Staphylococcus aureus
NHLFLGFIVSTVFFTLIH

SEQ ID NO: 1586205 - protein, 20 aa, Staphylococcus aureus
PHLKEWERLSGIPIEEQTYE

SEQ ID NO: 1586206 - protein, 17 aa, Staphylococcus aureus
PLIYTGFTILTITTIML

SEQ ID NO: 1586207 - protein, 17 aa, Staphylococcus aureus
PMIVRFSLNIGVVVLTT

SEQ ID NO: 1586208 - protein, 19 aa, Staphylococcus aureus
SRLEGVINFENLKVKDVDT

SEQ ID NO: 1586209 - protein, 20 aa, Staphylococcus aureus
TVLLLKRRTPVIAVDAPAQH

SEQ ID NO: 1586210 - protein, 25 aa, Staphylococcus aureus
VKGSLLLELAVVFGISALVTSFLKH

SEQ ID NO: 1586211 - protein, 18 aa, Staphylococcus aureus
VRIGWLILRILAVVFAWM

SEQ ID NO: 1586212 - protein, 19 aa, Staphylococcus aureus
WVIILCRGFLPAIRNKVQA

SEQ ID NO: 1586213 - protein, 30 aa, Staphylococcus aureus
AGQRVVLKYKLKFADGLKRGDYFDFTLSNN

SEQ ID NO: 1586214 - protein, 18 aa, Staphylococcus aureus
AYFYLPFLLIYFLVQGYS

SEQ ID NO: 1586215 - protein, 25 aa, Staphylococcus aureus
EDEANTSLIWGLLASLGSLLLFRRK

SEQ ID NO: 1586216 - protein, 17 aa, Staphylococcus aureus
ELYYYIKGGRVDYGAAH

SEQ ID NO: 1586217 - protein, 17 aa, Staphylococcus aureus
FDMMLCLPIHKCVNLFY

SEQ ID NO: 1586218 - protein, 17 aa, Staphylococcus aureus
FRPFALAIAFSLLASLL

SEQ ID NO: 1586219 - protein, 18 aa, Staphylococcus aureus
FSAYRAWQMRHGKIILRK

SEQ ID NO: 1586220 - protein, 21 aa, Staphylococcus aureus
FYGICVLCFLVLPIIFIPNPN

SEQ ID NO: 1586221 - protein, 18 aa, Staphylococcus aureus
GPGAVFWMWVIAFIGAAS

SEQ ID NO: 1586222 - protein, 18 aa, Staphylococcus aureus
GYFLKRINYIKATDSQVI

SEQ ID NO: 1586223 - protein, 19 aa, Staphylococcus aureus
KINDKWLLVLCVFVIIVNA

SEQ ID NO: 1586224 - protein, 17 aa, Staphylococcus aureus
KKLSWPVGLIVAAITIS

SEQ ID NO: 1586225 - protein, 17 aa, Staphylococcus aureus
KSLGWWDLFFAIPMFLL

SEQ ID NO: 1586226 - protein, 20 aa, Staphylococcus aureus
KVGHTVFKWVAIGMTTLSVL

SEQ ID NO: 1586227 - protein, 17 aa, Staphylococcus aureus
LCGNFQFGLLVATGTLA

SEQ ID NO: 1586228 - protein, 21 aa, Staphylococcus aureus
LFDNTRAVFGFNFFVDKKQLI

SEQ ID NO: 1586229 - protein, 25 aa, Staphylococcus aureus
LGLDDIRNTHVWEVDEQPAVNEIFE

SEQ ID NO: 1586230 - protein, 18 aa, Staphylococcus aureus
LIGGIAWGVYAFFANTPK

SEQ ID NO: 1586231 - protein, 19 aa, Staphylococcus aureus
LLHYIFKINDKWLLVLCVF

SEQ ID NO: 1586232 - protein, 17 aa, Staphylococcus aureus
LNKVCHVHGIKALNVND

SEQ ID NO: 1586233 - protein, 18 aa, Staphylococcus aureus
LPLALPLILGGIRLSSVY

SEQ ID NO: 1586234 - protein, 17 aa, Staphylococcus aureus
LSWPVGLIVAAITISSL

SEQ ID NO: 1586235 - protein, 23 aa, Staphylococcus aureus
LVELIRWLFTFGILFQLPILFIG

SEQ ID NO: 1586236 - protein, 24 aa, Staphylococcus aureus
MFSTFRFSWAYRLATVITLIISIL

SEQ ID NO: 1586237 - protein, 18 aa, Staphylococcus aureus
MMLCLPIHKCVNLFYTFV

SEQ ID NO: 1586238 - protein, 18 aa, Staphylococcus aureus
MMVPLIIIIAMFFIHINT

SEQ ID NO: 1586239 - protein, 22 aa, Staphylococcus aureus
NYFGIKDKVDWAGHKIDEGIDA

SEQ ID NO: 1586240 - protein, 19 aa, Staphylococcus aureus
RALITWFYTMLWSIVGVVW

SEQ ID NO: 1586241 - protein, 20 aa, Staphylococcus aureus
RALITWFYTMLWSIVGVVWI

SEQ ID NO: 1586242 - protein, 24 aa, Staphylococcus aureus
RVHLKRWQFISILIGTIIITAVIT

SEQ ID NO: 1586243 - protein, 20 aa, Staphylococcus aureus
SETLARLGIVLGAFLTTLQM

SEQ ID NO: 1586244 - protein, 18 aa, Staphylococcus aureus
TKRLEVVILIHFINNLSS

SEQ ID NO: 1586245 - protein, 28 aa, Staphylococcus aureus
VYPHQAGYVKLNYGFSVPNSAVKGDTFK

SEQ ID NO: 1586246 - protein, 17 aa, Staphylococcus aureus
WNFIVTKGMQWVSTITS

SEQ ID NO: 1586247 - protein, 21 aa, Staphylococcus aureus
YMSSWPWHWAKPMKHLMENGS

SEQ ID NO: 1586248 - protein, 20 aa, Staphylococcus aureus
YPVVFVHGFLGLVGDNAPAL

SEQ ID NO: 1586249 - protein, 19 aa, Staphylococcus aureus
DHVDFIGVDFLDFKRKGAE

SEQ ID NO: 1586250 - protein, 20 aa, Staphylococcus aureus
DNLPRFYFYLTLFMFSMIGI

SEQ ID NO: 1586251 - protein, 22 aa, Staphylococcus aureus
DQLKKLEGMLDFPMLSTNVYKD

SEQ ID NO: 1586252 - protein, 22 aa, Staphylococcus aureus
DQTGFKSWMIWAIEPSMLRIGL

SEQ ID NO: 1586253 - protein, 21 aa, Staphylococcus aureus
DSGKYKVIFEKPAGLTQTVTN

SEQ ID NO: 1586254 - protein, 24 aa, Staphylococcus aureus
DVKEVRWLFRLIALIVFAVLMFTI

SEQ ID NO: 1586255 - protein, 17 aa, Staphylococcus aureus
FEILVAFLNGLALIVIS

SEQ ID NO: 1586256 - protein, 23 aa, Staphylococcus aureus
FGKDRFRLFNGWYYLIKYAMPVV

SEQ ID NO: 1586257 - protein, 20 aa, Staphylococcus aureus
FKLDIKWPFLLSELGIVLLG

SEQ ID NO: 1586258 - protein, 23 aa, Staphylococcus aureus
FMQFNCFICLILIIVFYIIGMNI

SEQ ID NO: 1586259 - protein, 20 aa, Staphylococcus aureus
GFDVFNYWLGIILMLFVSWF

SEQ ID NO: 1586260 - protein, 19 aa, Staphylococcus aureus
GRDDFIGGIAIEIVSSSLY

SEQ ID NO: 1586261 - protein, 19 aa, Staphylococcus aureus
IFVALEFFYIMYLETIATT

SEQ ID NO: 1586262 - protein, 17 aa, Staphylococcus aureus
IKVWKLIQFISFFPTIS

SEQ ID NO: 1586263 - protein, 23 aa, Staphylococcus aureus
ILSACMTFLFVIVGLCIKLANSF

SEQ ID NO: 1586264 - protein, 18 aa, Staphylococcus aureus
IVIIVCLLFKMATVPAMV

SEQ ID NO: 1586265 - protein, 22 aa, Staphylococcus aureus
KGLKFKIAFNFGLPLVIALSHA

SEQ ID NO: 1586266 - protein, 17 aa, Staphylococcus aureus
KVFKLDIKWPFLLSELG

SEQ ID NO: 1586267 - protein, 19 aa, Staphylococcus aureus
LHMVLRLFMLLTLISGFWI

SEQ ID NO: 1586268 - protein, 20 aa, Staphylococcus aureus
LICVTSGFIGLILGVVFATI

SEQ ID NO: 1586269 - protein, 17 aa, Staphylococcus aureus
LNMTFNYCKKRVWSYDM

SEQ ID NO: 1586270 - protein, 17 aa, Staphylococcus aureus
MKISFLPALGFNQILLE

SEQ ID NO: 1586271 - protein, 21 aa, Staphylococcus aureus
NRISKVFAHDMPKIMSVDNVT

SEQ ID NO: 1586272 - protein, 19 aa, Staphylococcus aureus
QSRIELFTTDGLQVIGDIS

SEQ ID NO: 1586273 - protein, 24 aa, Staphylococcus aureus
RVHLKRWQFISILIGTTLITAVIT

SEQ ID NO: 1586274 - protein, 20 aa, Staphylococcus aureus
SFILAFPMALIWPTIQTGLN

SEQ ID NO: 1586275 - protein, 24 aa, Staphylococcus aureus
SFKLYRFYFYRLFAIVTWILFIGS

SEQ ID NO: 1586276 - protein, 21 aa, Staphylococcus aureus
SGIIGCLYGWIGLKLNLSSGL

SEQ ID NO: 1586277 - protein, 19 aa, Staphylococcus aureus
TFGYLRFEILVAFLNGLAL

SEQ ID NO: 1586278 - protein, 18 aa, Staphylococcus aureus
TLGTRIDSNKSFHFSGKV

SEQ ID NO: 1586279 - protein, 24 aa, Staphylococcus aureus
TSIRRSEIVLGYLIGYGIFAIIQT

SEQ ID NO: 1586280 - protein, 18 aa, Staphylococcus aureus
VKRPWLPPLPENVYQEDL

SEQ ID NO: 1586281 - protein, 18 aa, Staphylococcus aureus
YDIELTYPFDLVEVDSSQ

SEQ ID NO: 1586282 - protein, 35 aa, Staphylococcus aureus
YPERAYKSYYVYGGYRLTWDNGLVLYSNKADGNGK

SEQ ID NO: 1586283 - protein, 18 aa, Staphylococcus aureus
YTTHLEFEKAIPTLADAA

SEQ ID NO: 1586284 - protein, 18 aa, Staphylococcus aureus
ADIIRFVSYLSIPVLSFF

SEQ ID NO: 1586285 - protein, 32 aa, Staphylococcus aureus
AILKKFWMMYWPKLVILMGIIILIVILNAIFN

SEQ ID NO: 1586286 - protein, 22 aa, Staphylococcus aureus
FGSLLCLFYMIKAFRQIDVIKS

SEQ ID NO: 1586287 - protein, 18 aa, Staphylococcus aureus
FIFRCFVVVLVFVGAVVK

SEQ ID NO: 1586288 - protein, 20 aa, Staphylococcus aureus
FIWLRFEWPQYLIYILFVLC

SEQ ID NO: 1586289 - protein, 18 aa, Staphylococcus aureus
FVSYLSIPVLSFFNMLSI

SEQ ID NO: 1586290 - protein, 23 aa, Staphylococcus aureus
FYGVCVLCILLLPIIFIPNPNHV

SEQ ID NO: 1586291 - protein, 21 aa, Staphylococcus aureus
GILAILVGFVWFKLYQYTTNP

SEQ ID NO: 1586292 - protein, 20 aa, Staphylococcus aureus
HLTILKRRIIMIGFITLPLY

SEQ ID NO: 1586293 - protein, 19 aa, Staphylococcus aureus
IALLIFIVWITLVTPGTFE

SEQ ID NO: 1586294 - protein, 21 aa, Staphylococcus aureus
IALMLKWWLILAISIIVLIII

SEQ ID NO: 1586295 - protein, 17 aa, Staphylococcus aureus
ILTILPWLIGALIATVF

SEQ ID NO: 1586296 - protein, 26 aa, Staphylococcus aureus
ISLFGVCIITILLLCSSVILLTNHQH

SEQ ID NO: 1586297 - protein, 23 aa, Staphylococcus aureus
IVSFCFIFLLLLFFRYILKRYFN

SEQ ID NO: 1586298 - protein, 22 aa, Staphylococcus aureus
KDRMEFQMLYGFRSELAEEIAN

SEQ ID NO: 1586299 - protein, 18 aa, Staphylococcus aureus
KFPHMLYIIFGFLLMYGL

SEQ ID NO: 1586300 - protein, 20 aa, Staphylococcus aureus
KLRIFEVNDTSKLSDSYYAD

SEQ ID NO: 1586301 - protein, 27 aa, Staphylococcus aureus
LGGVMTLLVGLGLMKRKKKKDENDQDD

SEQ ID NO: 1586302 - protein, 20 aa, Staphylococcus aureus
LMALIALSSIVAFVLPRKRK

SEQ ID NO: 1586303 - protein, 20 aa, Staphylococcus aureus
LQNRFEAIVAFLMIALFCKF

SEQ ID NO: 1586304 - protein, 18 aa, Staphylococcus aureus
MIVPWRVAMLYKYKKLKK

SEQ ID NO: 1586305 - protein, 19 aa, Staphylococcus aureus
MKNKWPFLIALPFMNCYGI

SEQ ID NO: 1586306 - protein, 17 aa, Staphylococcus aureus
MYVFKFGPSILFKANYG

SEQ ID NO: 1586307 - protein, 19 aa, Staphylococcus aureus
NGAPCNKILSLIGYSDTIV

SEQ ID NO: 1586308 - protein, 17 aa, Staphylococcus aureus
NSMHPSDSMSMHHTHST

SEQ ID NO: 1586309 - protein, 21 aa, Staphylococcus aureus
PLYRKRILSILVVVVIAIGIA

SEQ ID NO: 1586310 - protein, 21 aa, Staphylococcus aureus
PRGEFLHMLLGVFLATLVSFV

SEQ ID NO: 1586311 - protein, 22 aa, Staphylococcus aureus
QTGLKSWMIWAIEPSMLWIGLQ

SEQ ID NO: 1586312 - protein, 26 aa, Staphylococcus aureus
RKMIVICFYSLLAILLILLLASFIKA

SEQ ID NO: 1586313 - protein, 18 aa, Staphylococcus aureus
RRTLECYTEPQIDDTNDG

SEQ ID NO: 1586314 - protein, 19 aa, Staphylococcus aureus
RVVLIPVFILFALVDFGFG

SEQ ID NO: 1586315 - protein, 19 aa, Staphylococcus aureus
SRLRAGFAYIKKYWLRLSI

SEQ ID NO: 1586316 - protein, 20 aa, Staphylococcus aureus
TSYHIFRIFFILFIIAPGIN

SEQ ID NO: 1586317 - protein, 19 aa, Staphylococcus aureus
VAIGMGFVSWINRTKNTAV

SEQ ID NO: 1586318 - protein, 18 aa, Staphylococcus aureus
VVGIALLIFIVWITLVTP

SEQ ID NO: 1586319 - protein, 21 aa, Staphylococcus aureus
WPFLIALPFMNCYGIGVTFYY

SEQ ID NO: 1586320 - protein, 18 aa, Staphylococcus aureus
WWLILAISIIVLIIITVA

SEQ ID NO: 1586321 - protein, 17 aa, Staphylococcus aureus
YTDIKWCRMIIRQILSN

SEQ ID NO: 1586322 - protein, 17 aa, Staphylococcus aureus
AIACGFFLFMFGGVASD

SEQ ID NO: 1586323 - protein, 18 aa, Staphylococcus aureus
AITRKGMVSNRLNKFSIR

SEQ ID NO: 1586324 - protein, 19 aa, Staphylococcus aureus
AKELPWGVLILFGGGLALA

SEQ ID NO: 1586325 - protein, 42 aa, Staphylococcus aureus
DPNSKGDLALRSTLYGYNSNIIWRSMSWDNEVAFNNGSGSGD

SEQ ID NO: 1586326 - protein, 23 aa, Staphylococcus aureus
EIGEIIFKFYRHCFRYNEINLKI

SEQ ID NO: 1586327 - protein, 20 aa, Staphylococcus aureus
FDMMLCLPIHKCVNLFYTFV

SEQ ID NO: 1586328 - protein, 17 aa, Staphylococcus aureus
FERQAVKLLGKVKNGVV

SEQ ID NO: 1586329 - protein, 22 aa, Staphylococcus aureus
FILTMIICFTITYLVHNDYFVA

SEQ ID NO: 1586330 - protein, 21 aa, Staphylococcus aureus
GKETRFGIGLSALFTTITTAF

SEQ ID NO: 1586331 - protein, 28 aa, Staphylococcus aureus
GKGSWYLPAWLNRIIPRVDIEGHALEKY

SEQ ID NO: 1586332 - protein, 21 aa, Staphylococcus aureus
GQGWSNIWFDLLILMIFIIVF

SEQ ID NO: 1586333 - protein, 17 aa, Staphylococcus aureus
HDSLANEKTRVRLYKSG

SEQ ID NO: 1586334 - protein, 17 aa, Staphylococcus aureus
IPKFKNRRKMIVICFYS

SEQ ID NO: 1586335 - protein, 22 aa, Staphylococcus aureus
IPLYRKRILSILVVVVIAIGIA

SEQ ID NO: 1586336 - protein, 20 aa, Staphylococcus aureus
IVCLLFKMATVPAMLISSFS

SEQ ID NO: 1586337 - protein, 18 aa, Staphylococcus aureus
KFSYSWIHFAKIFLYSFI

SEQ ID NO: 1586338 - protein, 23 aa, Staphylococcus aureus
KVTRYDLISVLPFGNTIAQIDVK

SEQ ID NO: 1586339 - protein, 18 aa, Staphylococcus aureus
LAQWKLYIISAVVLIMVL

SEQ ID NO: 1586340 - protein, 22 aa, Staphylococcus aureus
LDFKRKGAELANFYTGIINDLL

SEQ ID NO: 1586341 - protein, 17 aa, Staphylococcus aureus
LIGLRFLKEYDVKRGKD

SEQ ID NO: 1586342 - protein, 17 aa, Staphylococcus aureus
LPWKGVYVLAITLWIAT

SEQ ID NO: 1586343 - protein, 22 aa, Staphylococcus aureus
LSYLTQMCVITFLMFTSAASGY

SEQ ID NO: 1586344 - protein, 20 aa, Staphylococcus aureus
LTDWCDLAFVTKLVLGQSEQ

SEQ ID NO: 1586345 - protein, 20 aa, Staphylococcus aureus
LVAIGMGFVSWIKRTKNTAV

SEQ ID NO: 1586346 - protein, 19 aa, Staphylococcus aureus
LVIQTICVLLGIWVYNLDK

SEQ ID NO: 1586347 - protein, 19 aa, Staphylococcus aureus
LYPNYWGGNKYKVIEELRK

SEQ ID NO: 1586348 - protein, 23 aa, Staphylococcus aureus
MLNVRYSHWLRFVWPVVAFVLIF

SEQ ID NO: 1586349 - protein, 20 aa, Staphylococcus aureus
PEQKLPVYILFTLFVVVAIV

SEQ ID NO: 1586350 - protein, 19 aa, Staphylococcus aureus
PFMNCYGIGVTFYYQQKVA

SEQ ID NO: 1586351 - protein, 17 aa, Staphylococcus aureus
QLIKRLKAGKVYKKDRL

SEQ ID NO: 1586352 - protein, 18 aa, Staphylococcus aureus
QVFWRILLFYILAIFVIG

SEQ ID NO: 1586353 - protein, 18 aa, Staphylococcus aureus
RFCLCVMNPIPISMNIKI

SEQ ID NO: 1586354 - protein, 17 aa, Staphylococcus aureus
RFNEVYSITAIDKNNKP

SEQ ID NO: 1586355 - protein, 17 aa, Staphylococcus aureus
SLIPYALVFIGLIIFIS

SEQ ID NO: 1586356 - protein, 23 aa, Staphylococcus aureus
TLEMYRFEYPITFATSIFASIFT

SEQ ID NO: 1586357 - protein, 19 aa, Staphylococcus aureus
VCLLFKMATVPAMLISSFS

SEQ ID NO: 1586358 - protein, 19 aa, Staphylococcus aureus
VTCLYFEFAGNPVLHHLGI

SEQ ID NO: 1586359 - protein, 17 aa, Staphylococcus aureus
VWSSCFIGFLGVIFFYC

SEQ ID NO: 1586360 - protein, 17 aa, Staphylococcus aureus
WGGNKYKVIEELRKQGY

SEQ ID NO: 1586361 - protein, 17 aa, Staphylococcus aureus
WIACLLVAFPIFTSFTT

SEQ ID NO: 1586362 - protein, 19 aa, Staphylococcus aureus
WKLYIISAVVLIMVLIGFI

SEQ ID NO: 1586363 - protein, 20 aa, Staphylococcus aureus
YDIGFQFSFIISFFIMLLFP

SEQ ID NO: 1586364 - protein, 20 aa, Staphylococcus aureus
YTAGQCTWYAYGMRQKMGKP

SEQ ID NO: 1586365 - protein, 26 aa, Staphylococcus aureus
AKTGKYELGEAFKIYKFNGEEDNSYY

SEQ ID NO: 1586366 - protein, 18 aa, Staphylococcus aureus
DNLPRFYFYLTLFMFSMI

SEQ ID NO: 1586367 - protein, 17 aa, Staphylococcus aureus
EALKRAFLIMCLIGFGV

SEQ ID NO: 1586368 - protein, 17 aa, Staphylococcus aureus
EKVLDAFDYIPFAYLTD

SEQ ID NO: 1586369 - protein, 19 aa, Staphylococcus aureus
FAVLVLRLGYLQIAQGSHY

SEQ ID NO: 1586370 - protein, 21 aa, Staphylococcus aureus
FLMEFARGMYILSYINFLPTV

SEQ ID NO: 1586371 - protein, 21 aa, Staphylococcus aureus
FTELMIIISIIYFKNLYIGRL

SEQ ID NO: 1586372 - protein, 19 aa, Staphylococcus aureus
GAREFKWRLPDKITIRNSA

SEQ ID NO: 1586373 - protein, 32 aa, Staphylococcus aureus
GMLKGCGGCLISFIILIILLSACSMMFSNNDN

SEQ ID NO: 1586374 - protein, 25 aa, Staphylococcus aureus
GTLPRFHFGTTMWKDIKSSASSAFN

SEQ ID NO: 1586375 - protein, 20 aa, Staphylococcus aureus
HIYEISSLIYKVTMKIKIKA

SEQ ID NO: 1586376 - protein, 20 aa, Staphylococcus aureus
ILIAIGWRLIWKREIDKHKN

SEQ ID NO: 1586377 - protein, 24 aa, Staphylococcus aureus
KELAKRKQEAISRIKDFSNEKINS

SEQ ID NO: 1586378 - protein, 18 aa, Staphylococcus aureus
KFQDGLKTGDYFDFTLSN

SEQ ID NO: 1586379 - protein, 17 aa, Staphylococcus aureus
LDFWATFLIVWFILFLL

SEQ ID NO: 1586380 - protein, 18 aa, Staphylococcus aureus
LNKYPVVFVHGFLGLVGD

SEQ ID NO: 1586381 - protein, 18 aa, Staphylococcus aureus
MITIALVWWSAFTILTGM

SEQ ID NO: 1586382 - protein, 22 aa, Staphylococcus aureus
NMPDWLGNIGYIFPLRYAGDAL

SEQ ID NO: 1586383 - protein, 23 aa, Staphylococcus aureus
NPKQRVLGNTWVYIKGYQDKIEE

SEQ ID NO: 1586384 - protein, 17 aa, Staphylococcus aureus
PKIMAAIVLWLFGSIAS

SEQ ID NO: 1586385 - protein, 17 aa, Staphylococcus aureus
PLYIGVLLLYYSRFIIM

SEQ ID NO: 1586386 - protein, 24 aa, Staphylococcus aureus
RKEGIKALNWRSSYIPQFIRMVIV

SEQ ID NO: 1586387 - protein, 20 aa, Staphylococcus aureus
RKVPDIKNGSLVMAKGQVLD

SEQ ID NO: 1586388 - protein, 21 aa, Staphylococcus aureus
RLFGELEFWFSIIKVVTIIAM

SEQ ID NO: 1586389 - protein, 20 aa, Staphylococcus aureus
SKLRTVIICNLAFAICMILG

SEQ ID NO: 1586390 - protein, 20 aa, Staphylococcus aureus
TTWSHLKWAIPLISIALIII

SEQ ID NO: 1586391 - protein, 19 aa, Staphylococcus aureus
VNIFDWRYLFLVVLLIGMI

SEQ ID NO: 1586392 - protein, 18 aa, Staphylococcus aureus
VRIGWLILRLLAVVFAWM

SEQ ID NO: 1586393 - protein, 27 aa, Staphylococcus aureus
VVGISGLLASFWFFIAKRRRKEDEEEE

SEQ ID NO: 1586394 - protein, 26 aa, Staphylococcus aureus
WPFLIALPFMIGYGIGVTFYYQQKVA

SEQ ID NO: 1586395 - protein, 27 aa, Staphylococcus aureus
YAGQTWTRNISDWIAKSGTTNFSLSMT

SEQ ID NO: 1586396 - protein, 22 aa, Staphylococcus aureus
YIVSEFLFLLVIFTFGIAGIIF

SEQ ID NO: 1586397 - protein, 27 aa, Staphylococcus aureus
DSGFYKTPKYSLGDYVWYDSNKDGKQD

SEQ ID NO: 1586398 - protein, 18 aa, Staphylococcus aureus
EAFLKYHLLGGRYYQPLA

SEQ ID NO: 1586399 - protein, 18 aa, Staphylococcus aureus
EKQALKDRINQILQQGHN

SEQ ID NO: 1586400 - protein, 18 aa, Staphylococcus aureus
FYLYLTLFMFSMLGIVLA

SEQ ID NO: 1586401 - protein, 24 aa, Staphylococcus aureus
GMVSNRLNKFSIRKYTVGTASILV

SEQ ID NO: 1586402 - protein, 25 aa, Staphylococcus aureus
GQRVVLKYKLKFQDGLKTGDYFDFT

SEQ ID NO: 1586403 - protein, 25 aa, Staphylococcus aureus
GSILGSMLLRFGRFESSIAKGLTYG

SEQ ID NO: 1586404 - protein, 17 aa, Staphylococcus aureus
HFLLFNGLMGGLSFVLL

SEQ ID NO: 1586405 - protein, 30 aa, Staphylococcus aureus
IELVGNLLPGDYFGTIRFGRKEQLFEIRVK

SEQ ID NO: 1586406 - protein, 17 aa, Staphylococcus aureus
ILKRRIIMIGFITLPLY

SEQ ID NO: 1586407 - protein, 17 aa, Staphylococcus aureus
IPTWLGALIMTLAIYVT

SEQ ID NO: 1586408 - protein, 19 aa, Staphylococcus aureus
IWLRFEWPHYLLYILLVLG

SEQ ID NO: 1586409 - protein, 21 aa, Staphylococcus aureus
KELEQAVALIRTMPQRQQTSR

SEQ ID NO: 1586410 - protein, 18 aa, Staphylococcus aureus
KGDTMTINYDKNVIPSDL

SEQ ID NO: 1586411 - protein, 19 aa, Staphylococcus aureus
KKLFRLPAIKRFEEDEELL

SEQ ID NO: 1586412 - protein, 24 aa, Staphylococcus aureus
KQSKLILIFICIFTFLLMVIQSQF

SEQ ID NO: 1586413 - protein, 21 aa, Staphylococcus aureus
LELSVPLISLFGVCIITILLL

SEQ ID NO: 1586414 - protein, 18 aa, Staphylococcus aureus
LEYNQLFMYSQLYVESTQ

SEQ ID NO: 1586415 - protein, 20 aa, Staphylococcus aureus
LKMTLKYSVCLLIFICIWTF

SEQ ID NO: 1586416 - protein, 18 aa, Staphylococcus aureus
NIPTWLGALIMTLAIYIT

SEQ ID NO: 1586417 - protein, 21 aa, Staphylococcus aureus
RPTDGGLSWSDDHKSLIYRYD

SEQ ID NO: 1586418 - protein, 17 aa, Staphylococcus aureus
SELLLAFSTSSSEAVLP

SEQ ID NO: 1586419 - protein, 17 aa, Staphylococcus aureus
SSLKPFLAYGPAIENMK

SEQ ID NO: 1586420 - protein, 25 aa, Staphylococcus aureus
TLDDTKHLPLLFAKRRRKEDEEDVT

SEQ ID NO: 1586421 - protein, 19 aa, Staphylococcus aureus
VAIGMGFVSWIKRTKNTAV

SEQ ID NO: 1586422 - protein, 17 aa, Staphylococcus aureus
VRTRAVRSLAVAEPVVN

SEQ ID NO: 1586423 - protein, 22 aa, Staphylococcus aureus
WGDEWPFVIAFLPWVLIIIPYL

SEQ ID NO: 1586424 - protein, 19 aa, Staphylococcus aureus
YGPKWLYIISVIVFSLSYL

SEQ ID NO: 1586425 - protein, 20 aa, Staphylococcus aureus
YNIPTWLGALIMTLAIYITL

SEQ ID NO: 1586426 - protein, 18 aa, Staphylococcus aureus
CIAIALILYALPYLILGS

SEQ ID NO: 1586427 - protein, 19 aa, Staphylococcus aureus
EKQALKDRINQILQQGHNG

SEQ ID NO: 1586428 - protein, 17 aa, Staphylococcus aureus
FGLPALTLPFIIVTWIL

SEQ ID NO: 1586429 - protein, 22 aa, Staphylococcus aureus
FSEEIGDLFSIKVIAISTAIVA

SEQ ID NO: 1586430 - protein, 20 aa, Staphylococcus aureus
GFYKPTYNLGDYVWEDTNKN

SEQ ID NO: 1586431 - protein, 23 aa, Staphylococcus aureus
GTSMRTTDKYGYYNYAGYSNFIV

SEQ ID NO: 1586432 - protein, 21 aa, Staphylococcus aureus
HASMTFGLIFLFSEEIGDLFS

SEQ ID NO: 1586433 - protein, 24 aa, Staphylococcus aureus
HTFATSLPAKFVVKDVQPAKPTVT

SEQ ID NO: 1586434 - protein, 24 aa, Staphylococcus aureus
ILISLCFIGFIGIAAFYIYLNKKL

SEQ ID NO: 1586435 - protein, 17 aa, Staphylococcus aureus
ITEFILLIWRFVDITKI

SEQ ID NO: 1586436 - protein, 21 aa, Staphylococcus aureus
KKLEVISSLFSVKKITFDLSD

SEQ ID NO: 1586437 - protein, 23 aa, Staphylococcus aureus
KQAGHPVFYVYAGNQGNASVNLG

SEQ ID NO: 1586438 - protein, 22 aa, Staphylococcus aureus
LAEEKGRVIGMAKLKTIKEQEK

SEQ ID NO: 1586439 - protein, 19 aa, Staphylococcus aureus
LAELSGYWAYQDLDKRYVI

SEQ ID NO: 1586440 - protein, 19 aa, Staphylococcus aureus
LCLACILYLLGTAIVNHVN

SEQ ID NO: 1586441 - protein, 21 aa, Staphylococcus aureus
LKGASLFLRLGARIFKTGIAI

SEQ ID NO: 1586442 - protein, 18 aa, Staphylococcus aureus
LLVACGFVGAIAWTIYQL

SEQ ID NO: 1586443 - protein, 18 aa, Staphylococcus aureus
LRRLTWLMAIIIYCGVYT

SEQ ID NO: 1586444 - protein, 19 aa, Staphylococcus aureus
NGDYRVEFSNLPKGYEVTP

SEQ ID NO: 1586445 - protein, 17 aa, Staphylococcus aureus
NHPIEFNMIWKAMLIPS

SEQ ID NO: 1586446 - protein, 22 aa, Staphylococcus aureus
NIFGLKDKVDWVGHKIDNSIDV

SEQ ID NO: 1586447 - protein, 19 aa, Staphylococcus aureus
PAICLVVSTALTFFVMPDK

SEQ ID NO: 1586448 - protein, 21 aa, Staphylococcus aureus
PLHMRHFSNNFGNVIKNAIGV

SEQ ID NO: 1586449 - protein, 21 aa, Staphylococcus aureus
PSSFWCYIESITLFIVLPLLV

SEQ ID NO: 1586450 - protein, 24 aa, Staphylococcus aureus
RVHLKRWQFISILIGTILITAVIT

SEQ ID NO: 1586451 - protein, 18 aa, Staphylococcus aureus
SDSLRTSTSLSDSVSMST

SEQ ID NO: 1586452 - protein, 23 aa, Staphylococcus aureus
SLDKVKHTPFFLPKRRRKEDEED

SEQ ID NO: 1586453 - protein, 25 aa, Staphylococcus aureus
SSDVLKLKANYTIDDSVKEGDTFTF

SEQ ID NO: 1586454 - protein, 17 aa, Staphylococcus aureus
VIGWTYWLCWIVSSMSD

SEQ ID NO: 1586455 - protein, 34 aa, Staphylococcus aureus
ASNLANMNFLRWVNFPQDYTVTWTNAKIANRPTD

SEQ ID NO: 1586456 - protein, 18 aa, Staphylococcus aureus
DAARAIDALPHLNNAQKA

SEQ ID NO: 1586457 - protein, 20 aa, Staphylococcus aureus
DHPNRIAIFVALAILGFVGL

SEQ ID NO: 1586458 - protein, 19 aa, Staphylococcus aureus
EKQALKDRINQILQQGHND

SEQ ID NO: 1586459 - protein, 29 aa, Staphylococcus aureus
FNKGHAPHQNMIFWFALPADQVPVGRTDF

SEQ ID NO: 1586460 - protein, 18 aa, Staphylococcus aureus
FTPLLGLSNMYVYIVTFV

SEQ ID NO: 1586461 - protein, 18 aa, Staphylococcus aureus
FTQFTFKKAILFAALFIL

SEQ ID NO: 1586462 - protein, 23 aa, Staphylococcus aureus
FYGVCVLCFLLLPIIFIPNPNHV

SEQ ID NO: 1586463 - protein, 20 aa, Staphylococcus aureus
FYKTPKYNLGNYVWEDTNKD

SEQ ID NO: 1586464 - protein, 18 aa, Staphylococcus aureus
GTRIRPILMTAIATIGAL

SEQ ID NO: 1586465 - protein, 17 aa, Staphylococcus aureus
IAGVFGIPLHKFGIETA

SEQ ID NO: 1586466 - protein, 30 aa, Staphylococcus aureus
IRKKSIGVASVLVGTLIGFGLLSSKEADAS

SEQ ID NO: 1586467 - protein, 17 aa, Staphylococcus aureus
IRPILMTAIATIGALVP

SEQ ID NO: 1586468 - protein, 20 aa, Staphylococcus aureus
KKNLVGIAFIFSSVAVLIFE

SEQ ID NO: 1586469 - protein, 21 aa, Staphylococcus aureus
KVFGCLGIALAMYATTPKENR

SEQ ID NO: 1586470 - protein, 19 aa, Staphylococcus aureus
KVVLMILMFIGRVGLISFI

SEQ ID NO: 1586471 - protein, 17 aa, Staphylococcus aureus
LGTRIDSNKSFHFSGKV

SEQ ID NO: 1586472 - protein, 21 aa, Staphylococcus aureus
LLFCAGVAFAFYVGFPIIIQF

SEQ ID NO: 1586473 - protein, 18 aa, Staphylococcus aureus
LLIFSILMLFGGINEVTQ

SEQ ID NO: 1586474 - protein, 17 aa, Staphylococcus aureus
LNMTFNYCKKRVWTYDM

SEQ ID NO: 1586475 - protein, 18 aa, Staphylococcus aureus
LYVVFKMIFWFNPALYIS

SEQ ID NO: 1586476 - protein, 17 aa, Staphylococcus aureus
MCLIGFGVGILANAGNI

SEQ ID NO: 1586477 - protein, 19 aa, Staphylococcus aureus
MSQAWNFIVTKGMQWVSTI

SEQ ID NO: 1586478 - protein, 40 aa, Staphylococcus aureus
PASTGDLALRSTFYGYDSNFIWRSMSWDNEVAFNNGSGSG

SEQ ID NO: 1586479 - protein, 24 aa, Staphylococcus aureus
PVTNRDYSIFGWNNENVVRYGGGS

SEQ ID NO: 1586480 - protein, 17 aa, Staphylococcus aureus
RRLTWLMAIIIYCGVYT

SEQ ID NO: 1586481 - protein, 23 aa, Staphylococcus aureus
SLVSDLLGIIAMKKLFVNNKASG

SEQ ID NO: 1586482 - protein, 22 aa, Staphylococcus aureus
SWLTLCLCIAIALILYALPYLI

SEQ ID NO: 1586483 - protein, 18 aa, Staphylococcus aureus
TIEVGKTMNPVVLTTTDN

SEQ ID NO: 1586484 - protein, 18 aa, Staphylococcus aureus
TTPYIVVVNGHIDPASTG

SEQ ID NO: 1586485 - protein, 19 aa, Staphylococcus aureus
VCLLFKMATVPAMVISSFS

SEQ ID NO: 1586486 - protein, 19 aa, Staphylococcus aureus
VGKQIRAVVYYNKVVASNM

SEQ ID NO: 1586487 - protein, 20 aa, Staphylococcus aureus
VNLKLRYPFIGAIVGSGIGS

SEQ ID NO: 1586488 - protein, 19 aa, Staphylococcus aureus
VRIGWLILRILAVVFAWMT

SEQ ID NO: 1586489 - protein, 17 aa, Staphylococcus aureus
VVVNGHIDPASTGDLAL

SEQ ID NO: 1586490 - protein, 17 aa, Staphylococcus aureus
WFQPLLISLAALLILIG

SEQ ID NO: 1586491 - protein, 18 aa, Staphylococcus aureus
WMSSWTLYYWGWWLSWSP

SEQ ID NO: 1586492 - protein, 23 aa, Staphylococcus aureus
YFTIKYSDTVQVYGLNPEDIKNI

SEQ ID NO: 1586493 - protein, 17 aa, Staphylococcus aureus
YKIGFIFWGVSIISLGL

SEQ ID NO: 1586494 - protein, 19 aa, Staphylococcus aureus
YSQKGAITLGTRIDSNKSF

SEQ ID NO: 1586495 - protein, 18 aa, Staphylococcus aureus
YYRGDEVNFTMGVSDRHS

SEQ ID NO: 1586496 - protein, 23 aa, Staphylococcus aureus
DVKEVRWLFRIIVLIVFAVVMFT

SEQ ID NO: 1586497 - protein, 19 aa, Staphylococcus aureus
DVWHLKPAMTIAVSHGIFN

SEQ ID NO: 1586498 - protein, 19 aa, Staphylococcus aureus
DYSIFGWNNENVVRYGGGS

SEQ ID NO: 1586499 - protein, 19 aa, Staphylococcus aureus
FGRKEQLFEIRVKPHTPTI

SEQ ID NO: 1586500 - protein, 17 aa, Staphylococcus aureus
FKGNAPYIFAHRGGMAL

SEQ ID NO: 1586501 - protein, 17 aa, Staphylococcus aureus
FLKDNMMIFIFGVISII

SEQ ID NO: 1586502 - protein, 17 aa, Staphylococcus aureus
GSFDWSLVPGYIVAQML

SEQ ID NO: 1586503 - protein, 20 aa, Staphylococcus aureus
IFHAPFWFEFGSWKNAAGEI

SEQ ID NO: 1586504 - protein, 17 aa, Staphylococcus aureus
IFYVISCVVGYLCFGLG

SEQ ID NO: 1586505 - protein, 19 aa, Staphylococcus aureus
IKTGRFIATASIVFSILLI

SEQ ID NO: 1586506 - protein, 22 aa, Staphylococcus aureus
ISGLLASFWFFIAKRRRKEDEE

SEQ ID NO: 1586507 - protein, 20 aa, Staphylococcus aureus
IYKPKYNLGDYVWEDTNKNG

SEQ ID NO: 1586508 - protein, 20 aa, Staphylococcus aureus
KQSWKSFLIVLAACLILIIA

SEQ ID NO: 1586509 - protein, 18 aa, Staphylococcus aureus
KRRTREFALFQLIGLTRQ

SEQ ID NO: 1586510 - protein, 17 aa, Staphylococcus aureus
KSLGWWDLFFAIPIFLL

SEQ ID NO: 1586511 - protein, 19 aa, Staphylococcus aureus
KTYIKHFLLFNGLMGGLSF

SEQ ID NO: 1586512 - protein, 19 aa, Staphylococcus aureus
LGWNYWFNWVVTVAADITI

SEQ ID NO: 1586513 - protein, 17 aa, Staphylococcus aureus
LKPAMTIAVSHGIFNIT

SEQ ID NO: 1586514 - protein, 18 aa, Staphylococcus aureus
LPSGLSYDSATNSIIGTP

SEQ ID NO: 1586515 - protein, 19 aa, Staphylococcus aureus
LTLFRYAFFILWTVIFSYA

SEQ ID NO: 1586516 - protein, 24 aa, Staphylococcus aureus
PSSFWCYVESIILFILLPLVIVNF

SEQ ID NO: 1586517 - protein, 23 aa, Staphylococcus aureus
QTGLKSWMIWAIEPSMLWIGLQG

SEQ ID NO: 1586518 - protein, 20 aa, Staphylococcus aureus
RAGIMCPEFAIGMGPKIFSF

SEQ ID NO: 1586519 - protein, 18 aa, Staphylococcus aureus
SEQLGGLLLKNNNIANPD

SEQ ID NO: 1586520 - protein, 20 aa, Staphylococcus aureus
SKLRTVIICNLAFAICMMLG

SEQ ID NO: 1586521 - protein, 22 aa, Staphylococcus aureus
TGDGYQWVIKFNKGHAPHQNMI

SEQ ID NO: 1586522 - protein, 25 aa, Staphylococcus aureus
VGTFSTVIATLVFLGFNTSQAHAAE

SEQ ID NO: 1586523 - protein, 17 aa, Staphylococcus aureus
VKHVIPEIVAHSHYTVQ

SEQ ID NO: 1586524 - protein, 18 aa, Staphylococcus aureus
YLVAIIACMIWYFNKSHV

SEQ ID NO: 1586525 - protein, 25 aa, Staphylococcus aureus
AGQTWTRNISDWIAKSGTTNFSLSM

SEQ ID NO: 1586526 - protein, 23 aa, Staphylococcus aureus
AIMWGRMPWDIIFTVGVIILVVI

SEQ ID NO: 1586527 - protein, 20 aa, Staphylococcus aureus
DLSESYFVNPENFEDVTNSV

SEQ ID NO: 1586528 - protein, 19 aa, Staphylococcus aureus
EKGKLIGMLQMFMTKESIA

SEQ ID NO: 1586529 - protein, 19 aa, Staphylococcus aureus
FGRQNFEYINGQKPAESPG

SEQ ID NO: 1586530 - protein, 17 aa, Staphylococcus aureus
FICYLVWTVSYRNRSYN

SEQ ID NO: 1586531 - protein, 17 aa, Staphylococcus aureus
FILRLLGPLGLHHIFYL

SEQ ID NO: 1586532 - protein, 17 aa, Staphylococcus aureus
FKIAVVVAVMLLAFISL

SEQ ID NO: 1586533 - protein, 22 aa, Staphylococcus aureus
FTIKYSDTVQVYGLNPEDIKNI

SEQ ID NO: 1586534 - protein, 24 aa, Staphylococcus aureus
FWNRWHMTLSFWFRDCIYMRSLFY

SEQ ID NO: 1586535 - protein, 19 aa, Staphylococcus aureus
GFYKPTYNLGDYVWEDTNK

SEQ ID NO: 1586536 - protein, 25 aa, Staphylococcus aureus
GGVMTLLVGLGLMKRKKKKDENDQD

SEQ ID NO: 1586537 - protein, 19 aa, Staphylococcus aureus
GLDDIRNTHVWEVDAQPAV

SEQ ID NO: 1586538 - protein, 27 aa, Staphylococcus aureus
GNGGDGIGFAFSPGVLGETGLNGAAVG

SEQ ID NO: 1586539 - protein, 18 aa, Staphylococcus aureus
GVFSLLSTMVLYRFVVFS

SEQ ID NO: 1586540 - protein, 17 aa, Staphylococcus aureus
IDALPHLNNAQKADVKS

SEQ ID NO: 1586541 - protein, 18 aa, Staphylococcus aureus
IRAKIFILSIAFLVHCFL

SEQ ID NO: 1586542 - protein, 18 aa, Staphylococcus aureus
IVGLCIKLANSFIEPDSQ

SEQ ID NO: 1586543 - protein, 18 aa, Staphylococcus aureus
IYKPKYNLGDYVWEDTNK

SEQ ID NO: 1586544 - protein, 18 aa, Staphylococcus aureus
LPSGLTFDSTNNTISGTP

SEQ ID NO: 1586545 - protein, 20 aa, Staphylococcus aureus
LTTFLSWLTLCLCIAIALIL

SEQ ID NO: 1586546 - protein, 17 aa, Staphylococcus aureus
LYFKAWQGFYHEVHNEP

SEQ ID NO: 1586547 - protein, 18 aa, Staphylococcus aureus
MCASSAMLLPGISGSFML

SEQ ID NO: 1586548 - protein, 19 aa, Staphylococcus aureus
MLGFLYKYIVAYFINTYAI

SEQ ID NO: 1586549 - protein, 20 aa, Staphylococcus aureus
NRKAEALQRLDQLTHLNNAQ

SEQ ID NO: 1586550 - protein, 21 aa, Staphylococcus aureus
PTDGFTYKWNRDTTGTNDANW

SEQ ID NO: 1586551 - protein, 20 aa, Staphylococcus aureus
SEVYSPISPIKIATQDNSGN

SEQ ID NO: 1586552 - protein, 23 aa, Staphylococcus aureus
SFAKRVFTALGIGIVFGVLLHLI

SEQ ID NO: 1586553 - protein, 17 aa, Staphylococcus aureus
TMFYKRGKKTFVIHIKK

SEQ ID NO: 1586554 - protein, 22 aa, Staphylococcus aureus
TTPYIVVVNGHIDPNSKGDLAL

SEQ ID NO: 1586555 - protein, 17 aa, Staphylococcus aureus
VGYLCFGLGLGIYATPS

SEQ ID NO: 1586556 - protein, 17 aa, Staphylococcus aureus
YGWIGLKLNLSSGLFSR

SEQ ID NO: 1586557 - protein, 21 aa, Staphylococcus aureus
YMAKRRIGALIVFEKETGLQD

SEQ ID NO: 1586558 - protein, 18 aa, Staphylococcus aureus
AFFTFPVIVMFLLAPDSN

SEQ ID NO: 1586559 - protein, 19 aa, Staphylococcus aureus
AGAIFPLFSPVLGWIGVFM

SEQ ID NO: 1586560 - protein, 17 aa, Staphylococcus aureus
EALKAQVTSAGRVSAAN

SEQ ID NO: 1586561 - protein, 20 aa, Staphylococcus aureus
EIPKDATIVWYDFDEPNEQE

SEQ ID NO: 1586562 - protein, 18 aa, Staphylococcus aureus
EMHWTLWKYLILTCLVVL

SEQ ID NO: 1586563 - protein, 19 aa, Staphylococcus aureus
EQKLPLYIVFTLFVAVAII

SEQ ID NO: 1586564 - protein, 21 aa, Staphylococcus aureus
FENLPMIFALGVAIGLAGGDG

SEQ ID NO: 1586565 - protein, 19 aa, Staphylococcus aureus
FKIAVVVAVMLLAFISLME

SEQ ID NO: 1586566 - protein, 18 aa, Staphylococcus aureus
FLTQWKLYILSAVVLIMV

SEQ ID NO: 1586567 - protein, 17 aa, Staphylococcus aureus
FRFLIPIILAVSNFMGG

SEQ ID NO: 1586568 - protein, 18 aa, Staphylococcus aureus
FSTFSIICLSIFIITTLI

SEQ ID NO: 1586569 - protein, 25 aa, Staphylococcus aureus
GAVFIKGGDGFDFGHVERFIQNPPH

SEQ ID NO: 1586570 - protein, 17 aa, Staphylococcus aureus
GFFSVGVVIVFSPFCPS

SEQ ID NO: 1586571 - protein, 21 aa, Staphylococcus aureus
GFYKTPKYNLGNYVWEDTNKD

SEQ ID NO: 1586572 - protein, 26 aa, Staphylococcus aureus
GGVMTLLVGLGLMKRKKKKDENDQDD

SEQ ID NO: 1586573 - protein, 17 aa, Staphylococcus aureus
GQFSLPLFTDRAKAPKS

SEQ ID NO: 1586574 - protein, 18 aa, Staphylococcus aureus
GYFHGFKGYNFFLNKEEE

SEQ ID NO: 1586575 - protein, 17 aa, Staphylococcus aureus
HGGFLNEDFRLFSTNNQ

SEQ ID NO: 1586576 - protein, 25 aa, Staphylococcus aureus
HVFETARGVLYPGVSDMYDAKQYVK

SEQ ID NO: 1586577 - protein, 19 aa, Staphylococcus aureus
IDSNKSFHFSGKVNLGNKY

SEQ ID NO: 1586578 - protein, 17 aa, Staphylococcus aureus
IDTGYIYTSSMDKTEKQ

SEQ ID NO: 1586579 - protein, 18 aa, Staphylococcus aureus
IDYEKYGQFHNLSIKGTI

SEQ ID NO: 1586580 - protein, 21 aa, Staphylococcus aureus
IFLLLRFTPLLGLSNMYIYIV

SEQ ID NO: 1586581 - protein, 18 aa, Staphylococcus aureus
IFYIFRVLSIFIFIMGFK

SEQ ID NO: 1586582 - protein, 24 aa, Staphylococcus aureus
IGGTCLVAGLALIVHMIINRLFRK

SEQ ID NO: 1586583 - protein, 23 aa, Staphylococcus aureus
IKIYRVPEGYTLNKGYDVNTNDL

SEQ ID NO: 1586584 - protein, 21 aa, Staphylococcus aureus
IKQRALNRMAVNTVAAPQQGT

SEQ ID NO: 1586585 - protein, 17 aa, Staphylococcus aureus
INLTSSRFIKWLNDMNV

SEQ ID NO: 1586586 - protein, 18 aa, Staphylococcus aureus
ISFPNANQYKVEFPTDDD

SEQ ID NO: 1586587 - protein, 22 aa, Staphylococcus aureus
KALHWQKWHAMIGIIIAIPVFV

SEQ ID NO: 1586588 - protein, 31 aa, Staphylococcus aureus
KEGDTFTFKYGQYFRPGSVRLPSQTQNLYNA

SEQ ID NO: 1586589 - protein, 34 aa, Staphylococcus aureus
KERKKGGMAKVLLPLIAAVLIIGALAIFGGMALN

SEQ ID NO: 1586590 - protein, 19 aa, Staphylococcus aureus
KQNGLLGGVMTLLVGLGLM

SEQ ID NO: 1586591 - protein, 18 aa, Staphylococcus aureus
KRLPQVINEAVEILKHLT

SEQ ID NO: 1586592 - protein, 21 aa, Staphylococcus aureus
KSLNTRMRMAAIQPNSTDSKN

SEQ ID NO: 1586593 - protein, 18 aa, Staphylococcus aureus
LFLLCFYHLPNLNRYNEK

SEQ ID NO: 1586594 - protein, 21 aa, Staphylococcus aureus
LIELIRWLFTFGLLFQLPILF

SEQ ID NO: 1586595 - protein, 19 aa, Staphylococcus aureus
LIVIIVCLLFKMATVPAML

SEQ ID NO: 1586596 - protein, 18 aa, Staphylococcus aureus
LRIFEVNDTSKLSDSYYA

SEQ ID NO: 1586597 - protein, 25 aa, Staphylococcus aureus
LSFKLYRFYFYRLFAIVTWILFIGS

SEQ ID NO: 1586598 - protein, 30 aa, Staphylococcus aureus
LSFKLYRFYFYRLFAIVTWVLFIGSLSQYF

SEQ ID NO: 1586599 - protein, 19 aa, Staphylococcus aureus
MKNKWPFLIALPFMIGYGI

SEQ ID NO: 1586600 - protein, 22 aa, Staphylococcus aureus
NSVKMGINYSIYMDADTIPVDK

SEQ ID NO: 1586601 - protein, 17 aa, Staphylococcus aureus
PRFYFYLTLFMFSMIGI

SEQ ID NO: 1586602 - protein, 17 aa, Staphylococcus aureus
QSSEVYSPISPIKIATQ

SEQ ID NO: 1586603 - protein, 17 aa, Staphylococcus aureus
RKPILLMSMALVFATVV

SEQ ID NO: 1586604 - protein, 18 aa, Staphylococcus aureus
RLRAGFAYIKKYWLRLSI

SEQ ID NO: 1586605 - protein, 18 aa, Staphylococcus aureus
RNTHVWEVDAQPAVNEIF

SEQ ID NO: 1586606 - protein, 19 aa, Staphylococcus aureus
RPTEIKVELYQDGKATGKT

SEQ ID NO: 1586607 - protein, 43 aa, Staphylococcus aureus
RVRLYKSGKNWVKSGIKEIEMFKIMGLPFISHSLVSQDNQSIS

SEQ ID NO: 1586608 - protein, 20 aa, Staphylococcus aureus
SGLVPYWAVFKIILMMINNT

SEQ ID NO: 1586609 - protein, 18 aa, Staphylococcus aureus
TTAVIGGAFTVNMLHDQQ

SEQ ID NO: 1586610 - protein, 18 aa, Staphylococcus aureus
TVPKHVFETARGVLYPGV

SEQ ID NO: 1586611 - protein, 17 aa, Staphylococcus aureus
VAYIVCSISLLIQAPLL

SEQ ID NO: 1586612 - protein, 27 aa, Staphylococcus aureus
VGMLLTLILICFPDIFGTSYLSRGYLI

SEQ ID NO: 1586613 - protein, 19 aa, Staphylococcus aureus
VIVGATILFGIGNHQAQAS

SEQ ID NO: 1586614 - protein, 25 aa, Staphylococcus aureus
VNPSTPRMRAFSLAAVAADAPAAGT

SEQ ID NO: 1586615 - protein, 17 aa, Staphylococcus aureus
WIRRLKRLLPAVIVLLM

SEQ ID NO: 1586616 - protein, 19 aa, Staphylococcus aureus
YSIRRFTVGTTSVIVGATI

SEQ ID NO: 1586617 - protein, 26 aa, Staphylococcus aureus
AARTRNPIRLMIGFDYPDGYGNSETL

SEQ ID NO: 1586618 - protein, 20 aa, Staphylococcus aureus
AFFISRGFVKTGLGRRIALH

SEQ ID NO: 1586619 - protein, 17 aa, Staphylococcus aureus
AIITWLLLIPIFNFMTS

SEQ ID NO: 1586620 - protein, 32 aa, Staphylococcus aureus
AIRKKSIGVASVLVGTLIGFGLLSSKEADASE

SEQ ID NO: 1586621 - protein, 26 aa, Staphylococcus aureus
AVGIGGLSNAFGFKLDTYHNTSKPNA

SEQ ID NO: 1586622 - protein, 24 aa, Staphylococcus aureus
DFGDINSAYIIKVVSKYTPTSDGE

SEQ ID NO: 1586623 - protein, 19 aa, Staphylococcus aureus
DLWHLKPAMTIAVSHGIFN

SEQ ID NO: 1586624 - protein, 26 aa, Staphylococcus aureus
FAVLFRFIVRLIPIFYIFRVLSIFIF

SEQ ID NO: 1586625 - protein, 18 aa, Staphylococcus aureus
FGDITKTYVVLVEGHYDN

SEQ ID NO: 1586626 - protein, 19 aa, Staphylococcus aureus
FIVRVLIPFALIISLFLIS

SEQ ID NO: 1586627 - protein, 20 aa, Staphylococcus aureus
FIWLRFEWPHYLLYILLVLG

SEQ ID NO: 1586628 - protein, 25 aa, Staphylococcus aureus
FIYLKRYISFVSVNWIHVWQLFRSS

SEQ ID NO: 1586629 - protein, 28 aa, Staphylococcus aureus
FKNRIYYEHPNVASIKFGDITKTYVVLV

SEQ ID NO: 1586630 - protein, 18 aa, Staphylococcus aureus
GFRLDFWATFLIVWFILF

SEQ ID NO: 1586631 - protein, 19 aa, Staphylococcus aureus
GTASIILGSLVYIGADSQQ

SEQ ID NO: 1586632 - protein, 17 aa, Staphylococcus aureus
IEYFSRMIIPNIFSLIA

SEQ ID NO: 1586633 - protein, 19 aa, Staphylococcus aureus
IFQFSVTELIGWIITHIFF

SEQ ID NO: 1586634 - protein, 18 aa, Staphylococcus aureus
IKDKADWVGHKLDDGIDV

SEQ ID NO: 1586635 - protein, 18 aa, Staphylococcus aureus
IPFLLGLFLGLFGLYLRR

SEQ ID NO: 1586636 - protein, 18 aa, Staphylococcus aureus
IPTIYAFKKSLDALPNKK

SEQ ID NO: 1586637 - protein, 21 aa, Staphylococcus aureus
IWSNSKFKLALKVQDRQDSNE

SEQ ID NO: 1586638 - protein, 23 aa, Staphylococcus aureus
KDIYKGKGIEVLNIYGDLKDGTH

SEQ ID NO: 1586639 - protein, 19 aa, Staphylococcus aureus
KDTEDFYISLKIVDVKQPE

SEQ ID NO: 1586640 - protein, 17 aa, Staphylococcus aureus
KGGGMANLFKDLVHLVG

SEQ ID NO: 1586641 - protein, 18 aa, Staphylococcus aureus
KGKLIGMLQMFMTKESIA

SEQ ID NO: 1586642 - protein, 31 aa, Staphylococcus aureus
KIRNRSGQVIYSWPTVHVYSLEDLSRASDYF

SEQ ID NO: 1586643 - protein, 21 aa, Staphylococcus aureus
KLTTFLSWLTLCLCIAIALIL

SEQ ID NO: 1586644 - protein, 22 aa, Staphylococcus aureus
KVTRYDLISVLPFGNTIAQIDV

SEQ ID NO: 1586645 - protein, 20 aa, Staphylococcus aureus
KYSIRRFTVGTTSVIVGATI

SEQ ID NO: 1586646 - protein, 19 aa, Staphylococcus aureus
LAITGRVSMNQAFNSDITF

SEQ ID NO: 1586647 - protein, 19 aa, Staphylococcus aureus
LATLILIMLLGHWIEMNAV

SEQ ID NO: 1586648 - protein, 19 aa, Staphylococcus aureus
LAVMGFASAISVVFAVLSA

SEQ ID NO: 1586649 - protein, 21 aa, Staphylococcus aureus
MRRYLMRFVHHISGLADFSAL

SEQ ID NO: 1586650 - protein, 21 aa, Staphylococcus aureus
NDGYRIQPHIGLTIHESTNKD

SEQ ID NO: 1586651 - protein, 19 aa, Staphylococcus aureus
NGQFSLPLFTDRAKAPKSG

SEQ ID NO: 1586652 - protein, 20 aa, Staphylococcus aureus
NGTLPRFSIGTMWKDIKSGA

SEQ ID NO: 1586653 - protein, 19 aa, Staphylococcus aureus
NHYYWKFASILLISILIES

SEQ ID NO: 1586654 - protein, 19 aa, Staphylococcus aureus
NKAGIKDKADWVGHKLDDG

SEQ ID NO: 1586655 - protein, 19 aa, Staphylococcus aureus
NKNGSLAITGRVSMNQAFN

SEQ ID NO: 1586656 - protein, 27 aa, Staphylococcus aureus
NTNATLFGAMMALLGSLLLFRKRKQDH

SEQ ID NO: 1586657 - protein, 20 aa, Staphylococcus aureus
PEIQHNIKFFKNDDTQNIAE

SEQ ID NO: 1586658 - protein, 20 aa, Staphylococcus aureus
PEQKLPLYIVFTLFVAVAII

SEQ ID NO: 1586659 - protein, 18 aa, Staphylococcus aureus
PFFKPLHMILRLFMLLTL

SEQ ID NO: 1586660 - protein, 22 aa, Staphylococcus aureus
PPWNDFFKRFSFYAIAIQYFVV

SEQ ID NO: 1586661 - protein, 20 aa, Staphylococcus aureus
QLKKLEGMLDFPMLSTNVYK

SEQ ID NO: 1586662 - protein, 17 aa, Staphylococcus aureus
TAGNLGWSHPMVNITII

SEQ ID NO: 1586663 - protein, 22 aa, Staphylococcus aureus
TLCGFVICYGLIFGLFYLLSGS

SEQ ID NO: 1586664 - protein, 20 aa, Staphylococcus aureus
TSWITWVFIGILGLYLILRK

SEQ ID NO: 1586665 - protein, 26 aa, Staphylococcus aureus
VNTSAPRMRAFSLAAVAADAPAAGKD

SEQ ID NO: 1586666 - protein, 17 aa, Staphylococcus aureus
VTPIARFVGFKAVGVDP

SEQ ID NO: 1586667 - protein, 17 aa, Staphylococcus aureus
WEFIPALILAGSATYLY

SEQ ID NO: 1586668 - protein, 26 aa, Staphylococcus aureus
WPFLIALPFMIGYGIGITIYYQRKVA

SEQ ID NO: 1586669 - protein, 29 aa, Staphylococcus aureus
YAGQTWTRNISDWIAKSGTTNFSLSMTAS

SEQ ID NO: 1586670 - protein, 17 aa, Staphylococcus aureus
YWWMFGISFLFFALASL

SEQ ID NO: 1586671 - protein, 22 aa, Staphylococcus aureus
AIMWGRMPWDIIFTVGVIILVV

SEQ ID NO: 1586672 - protein, 17 aa, Staphylococcus aureus
AVAKGDCDFLLNTLKDI

SEQ ID NO: 1586673 - protein, 20 aa, Staphylococcus aureus
DTGLSIPTIYAFKKSLDALP

SEQ ID NO: 1586674 - protein, 17 aa, Staphylococcus aureus
FAGVLAFIFLVYRIYIL

SEQ ID NO: 1586675 - protein, 18 aa, Staphylococcus aureus
FIAIIPFDSIFKVARLIR

SEQ ID NO: 1586676 - protein, 21 aa, Staphylococcus aureus
FKKAVLFAALFILIGFYDGFV

SEQ ID NO: 1586677 - protein, 20 aa, Staphylococcus aureus
FRYAIFKGLGLGGAMTTGFL

SEQ ID NO: 1586678 - protein, 18 aa, Staphylococcus aureus
FTQFTFKKAVLFAALFIL

SEQ ID NO: 1586679 - protein, 17 aa, Staphylococcus aureus
HSFRYAIFKGLGLGGAM

SEQ ID NO: 1586680 - protein, 23 aa, Staphylococcus aureus
IEGTKHLPLLFAKRRRKEDEEDA

SEQ ID NO: 1586681 - protein, 18 aa, Staphylococcus aureus
INLFVCITLLVAIGMGFV

SEQ ID NO: 1586682 - protein, 23 aa, Staphylococcus aureus
INLTSSRFIKWLNYMNVIPGYYG

SEQ ID NO: 1586683 - protein, 25 aa, Staphylococcus aureus
ISGIPLDPSALVYLVAPTNQTTNGG

SEQ ID NO: 1586684 - protein, 23 aa, Staphylococcus aureus
ITTPYIVVVNGHIDPNSKGDLAL

SEQ ID NO: 1586685 - protein, 24 aa, Staphylococcus aureus
KDDVKATLTMPAYIDPENVTKTGN

SEQ ID NO: 1586686 - protein, 21 aa, Staphylococcus aureus
KDFKITLYISLFISLFILYNE

SEQ ID NO: 1586687 - protein, 18 aa, Staphylococcus aureus
KITVPKELNLNGVTSTAK

SEQ ID NO: 1586688 - protein, 21 aa, Staphylococcus aureus
KLRIFEVNDTSKLSDSYYADP

SEQ ID NO: 1586689 - protein, 24 aa, Staphylococcus aureus
KQSKLILIFICIFTFFIMIIQSQF

SEQ ID NO: 1586690 - protein, 19 aa, Staphylococcus aureus
KRDAYTNAVSRAETILNKT

SEQ ID NO: 1586691 - protein, 22 aa, Staphylococcus aureus
KTATYKVVRTVPKHVFETARGV

SEQ ID NO: 1586692 - protein, 20 aa, Staphylococcus aureus
KWSAVIAWIVIVAAILIPLA

SEQ ID NO: 1586693 - protein, 20 aa, Staphylococcus aureus
LIAAVLIIGALAIFGGMALN

SEQ ID NO: 1586694 - protein, 17 aa, Staphylococcus aureus
LKAANPFAKELENRKKA

SEQ ID NO: 1586695 - protein, 22 aa, Staphylococcus aureus
LKRAFLIMCLIGFGVGILANAG

SEQ ID NO: 1586696 - protein, 17 aa, Staphylococcus aureus
LPMIFALGVAIGLAGGD

SEQ ID NO: 1586697 - protein, 17 aa, Staphylococcus aureus
LRKIHGYSLFSSNVRYL

SEQ ID NO: 1586698 - protein, 20 aa, Staphylococcus aureus
LTKTYTFVFTDYVNNKENIN

SEQ ID NO: 1586699 - protein, 18 aa, Staphylococcus aureus
MFRPFALAIAFSLLASLL

SEQ ID NO: 1586700 - protein, 20 aa, Staphylococcus aureus
MGTASIILGSLVYIGADSQQ

SEQ ID NO: 1586701 - protein, 18 aa, Staphylococcus aureus
MMVPLIIIIAMFFIHFNT

SEQ ID NO: 1586702 - protein, 17 aa, Staphylococcus aureus
MVPLIIIIAMFFIHFNT

SEQ ID NO: 1586703 - protein, 24 aa, Staphylococcus aureus
NPKQRVLGNTWVYIKGYQDKIEES

SEQ ID NO: 1586704 - protein, 23 aa, Staphylococcus aureus
QVLDNGRIRYTFTDYIKDKVNVT

SEQ ID NO: 1586705 - protein, 19 aa, Staphylococcus aureus
RWGLNQGINANGWMRTDLK

SEQ ID NO: 1586706 - protein, 29 aa, Staphylococcus aureus
SFKLYRFYFYRLFAIVTWVLFIGSLSQYF

SEQ ID NO: 1586707 - protein, 17 aa, Staphylococcus aureus
SGDYFTAKLPDSLTGNG

SEQ ID NO: 1586708 - protein, 18 aa, Staphylococcus aureus
SKSASAFLSELLSESTSA

SEQ ID NO: 1586709 - protein, 17 aa, Staphylococcus aureus
TAGNLGWSHPMVYITII

SEQ ID NO: 1586710 - protein, 25 aa, Staphylococcus aureus
TAPIKLRTFSRLAMSTFASAATTSA

SEQ ID NO: 1586711 - protein, 18 aa, Staphylococcus aureus
TDQFKNRIYYEHPNVASI

SEQ ID NO: 1586712 - protein, 29 aa, Staphylococcus aureus
TVYPHQAGYVKLNYGFSVPNEAVQGDTFK

SEQ ID NO: 1586713 - protein, 24 aa, Staphylococcus aureus
VTSTAKVPPIMAGDQVLANGVIDS

SEQ ID NO: 1586714 - protein, 20 aa, Staphylococcus aureus
WFKFWSVIESGGWVIFTHME

SEQ ID NO: 1586715 - protein, 19 aa, Staphylococcus aureus
YVICCIIGYLFFGLGLGIY

SEQ ID NO: 1586716 - protein, 21 aa, Staphylococcus aureus
AIKCLWVKPKVVNYLIAKELG

SEQ ID NO: 1586717 - protein, 18 aa, Staphylococcus aureus
DIELKNLLLYGIFDESIF

SEQ ID NO: 1586718 - protein, 18 aa, Staphylococcus aureus
DNEHSPLLFAKRRKDKEE

SEQ ID NO: 1586719 - protein, 18 aa, Staphylococcus aureus
EEGYPEWIIPTDPSRANE

SEQ ID NO: 1586720 - protein, 20 aa, Staphylococcus aureus
FIFLLLVFFRYILKRYFNYS

SEQ ID NO: 1586721 - protein, 17 aa, Staphylococcus aureus
FKITLYISLFISLFILY

SEQ ID NO: 1586722 - protein, 18 aa, Staphylococcus aureus
FKSEGFSIIGLILDVVIM

SEQ ID NO: 1586723 - protein, 17 aa, Staphylococcus aureus
FLALIGMTACFFLLNMS

SEQ ID NO: 1586724 - protein, 17 aa, Staphylococcus aureus
FLILPTIILIGILGSTA

SEQ ID NO: 1586725 - protein, 18 aa, Staphylococcus aureus
FQTLIGFVFAPFAFLVGV

SEQ ID NO: 1586726 - protein, 21 aa, Staphylococcus aureus
FYVICCIIGYLFFGLGLGIYA

SEQ ID NO: 1586727 - protein, 20 aa, Staphylococcus aureus
GMKIITSWITWVFIGILGLY

SEQ ID NO: 1586728 - protein, 17 aa, Staphylococcus aureus
GNVIYTFTDYVNTKDDV

SEQ ID NO: 1586729 - protein, 32 aa, Staphylococcus aureus
HAIRKKSIGVASVLVGTLIGFGLLSSKEADAS

SEQ ID NO: 1586730 - protein, 20 aa, Staphylococcus aureus
HEKGKLIGMLQMFMTKESIA

SEQ ID NO: 1586731 - protein, 17 aa, Staphylococcus aureus
IDFMFAGVLAFIFLVYR

SEQ ID NO: 1586732 - protein, 18 aa, Staphylococcus aureus
IIAILIGFVWFKLYQYTT

SEQ ID NO: 1586733 - protein, 18 aa, Staphylococcus aureus
IIQKPIRTVQEVQSALTN

SEQ ID NO: 1586734 - protein, 18 aa, Staphylococcus aureus
IRPQDYVVFIPPVGKQIR

SEQ ID NO: 1586735 - protein, 19 aa, Staphylococcus aureus
ISWDFQTLIGFVFAPFAFL

SEQ ID NO: 1586736 - protein, 18 aa, Staphylococcus aureus
ITEFILLIWRFVDITKIN

SEQ ID NO: 1586737 - protein, 19 aa, Staphylococcus aureus
ITSSQRWGLNQGINANGWM

SEQ ID NO: 1586738 - protein, 20 aa, Staphylococcus aureus
ITSSQRWGLNQGINANGWMR

SEQ ID NO: 1586739 - protein, 19 aa, Staphylococcus aureus
KQMHRYGVVEWKGRQYSIS

SEQ ID NO: 1586740 - protein, 22 aa, Staphylococcus aureus
LDSGKYKVIFEKPAGLTQTGTN

SEQ ID NO: 1586741 - protein, 18 aa, Staphylococcus aureus
MFLAMKWEQIHLKDGLKK

SEQ ID NO: 1586742 - protein, 22 aa, Staphylococcus aureus
NKAGIKDKADWVGHKLDDGIDV

SEQ ID NO: 1586743 - protein, 20 aa, Staphylococcus aureus
PENRYKTYYYYNNGYTLTWD

SEQ ID NO: 1586744 - protein, 18 aa, Staphylococcus aureus
PFFFSVLLPIVFISAIIG

SEQ ID NO: 1586745 - protein, 33 aa, Staphylococcus aureus
RGMLKGCGGCLISFILLIILLSACSMMFSNNDN

SEQ ID NO: 1586746 - protein, 19 aa, Staphylococcus aureus
RISDALIRMQREHVHMSLI

SEQ ID NO: 1586747 - protein, 18 aa, Staphylococcus aureus
SASAKWGILGPIFVPMLI

SEQ ID NO: 1586748 - protein, 19 aa, Staphylococcus aureus
SDIFMWFKLVLNDTTEFNN

SEQ ID NO: 1586749 - protein, 17 aa, Staphylococcus aureus
SDVWTAFEHSLGAPTTQ

SEQ ID NO: 1586750 - protein, 20 aa, Staphylococcus aureus
SVRTRAVRSLAVAEPVVNAA

SEQ ID NO: 1586751 - protein, 26 aa, Staphylococcus aureus
TFIAKYKWSAVIAWIVIVAAILIPLA

SEQ ID NO: 1586752 - protein, 17 aa, Staphylococcus aureus
TRFIVRVLIPFALIISL

SEQ ID NO: 1586753 - protein, 27 aa, Staphylococcus aureus
VFAVLFRFIVRLIPIFYIFRVLSIFIF

SEQ ID NO: 1586754 - protein, 17 aa, Staphylococcus aureus
VFWRILLFYILAIFVIG

SEQ ID NO: 1586755 - protein, 17 aa, Staphylococcus aureus
VKHTPFFLPKRRRKEDE

SEQ ID NO: 1586756 - protein, 17 aa, Staphylococcus aureus
VKRPWLPPLPENVYQED

SEQ ID NO: 1586757 - protein, 18 aa, Staphylococcus aureus
VPKGYTLNKGYDVNTKEL

SEQ ID NO: 1586758 - protein, 18 aa, Staphylococcus aureus
VSAGYKWFFAYPDEHIET

SEQ ID NO: 1586759 - protein, 25 aa, Staphylococcus aureus
VTSTAKVPPIMAGDQVLANGVIDSD

SEQ ID NO: 1586760 - protein, 19 aa, Staphylococcus aureus
VVSFCFIFLLLVFFRYILK

SEQ ID NO: 1586761 - protein, 17 aa, Staphylococcus aureus
WRMGLSSVLALLHDVFI

SEQ ID NO: 1586762 - protein, 23 aa, Staphylococcus aureus
YFLKSRMNWIFWILFLNFLMLGI

SEQ ID NO: 1586763 - protein, 18 aa, Staphylococcus aureus
YGPKWLYIISVIVFSLSY

SEQ ID NO: 1586764 - protein, 19 aa, Staphylococcus aureus
AGILRLFGVIALMLVVISP

SEQ ID NO: 1586765 - protein, 19 aa, Staphylococcus aureus
AQAEAGGRPNYRTTGYSQS

SEQ ID NO: 1586766 - protein, 26 aa, Staphylococcus aureus
AVGIGGLSNAFGFKLDTYHNTSKPNS

SEQ ID NO: 1586767 - protein, 18 aa, Staphylococcus aureus
DFFWELATLILIMLLGHW

SEQ ID NO: 1586768 - protein, 18 aa, Staphylococcus aureus
DGKFSHFAYVKPNNQSLS

SEQ ID NO: 1586769 - protein, 19 aa, Staphylococcus aureus
DIELKNLLLYGIFDESIFL

SEQ ID NO: 1586770 - protein, 17 aa, Staphylococcus aureus
DIFMWFKLVLNDTTEFN

SEQ ID NO: 1586771 - protein, 21 aa, Staphylococcus aureus
DSGKYKVIFEKPTGLTQTGTN

SEQ ID NO: 1586772 - protein, 18 aa, Staphylococcus aureus
EDGHPEWIIPTDPARKND

SEQ ID NO: 1586773 - protein, 17 aa, Staphylococcus aureus
EGYPEWIIPTDPSRANE

SEQ ID NO: 1586774 - protein, 18 aa, Staphylococcus aureus
EQKLPLYIVFTLFVAVAI

SEQ ID NO: 1586775 - protein, 27 aa, Staphylococcus aureus
ERVTLKYKWKFGEGIKAGDYFDFTLSD

SEQ ID NO: 1586776 - protein, 22 aa, Staphylococcus aureus
FENLPMIFALGVAIGLAGGDGV

SEQ ID NO: 1586777 - protein, 17 aa, Staphylococcus aureus
FFLCVAIMYLSIGLQYL

SEQ ID NO: 1586778 - protein, 21 aa, Staphylococcus aureus
FIWLRFEWPHYLLYILLVLGA

SEQ ID NO: 1586779 - protein, 18 aa, Staphylococcus aureus
FLALIGMTACFFLLNMSS

SEQ ID NO: 1586780 - protein, 18 aa, Staphylococcus aureus
FTVGTTSVIVGATILFGI

SEQ ID NO: 1586781 - protein, 18 aa, Staphylococcus aureus
GAFIGVLVYLWKTNENFR

SEQ ID NO: 1586782 - protein, 21 aa, Staphylococcus aureus
GARWDYIGIFSFLLVISIVLF

SEQ ID NO: 1586783 - protein, 19 aa, Staphylococcus aureus
GLDDIRNTHVWEVDEQPAV

SEQ ID NO: 1586784 - protein, 17 aa, Staphylococcus aureus
GNAPYIFAHRGGMALRP

SEQ ID NO: 1586785 - protein, 24 aa, Staphylococcus aureus
GQVLDNGRIRYTFTDYIKDKVNVT

SEQ ID NO: 1586786 - protein, 23 aa, Staphylococcus aureus
GVMTLLVGLGLMKRKKKKDENDQ

SEQ ID NO: 1586787 - protein, 19 aa, Staphylococcus aureus
GYFHGFKGYNFFLNKEEEL

SEQ ID NO: 1586788 - protein, 19 aa, Staphylococcus aureus
IFLLLRFTPLLGLSNMYVY

SEQ ID NO: 1586789 - protein, 19 aa, Staphylococcus aureus
INLFVCITLLVAIGMGFVS

SEQ ID NO: 1586790 - protein, 19 aa, Staphylococcus aureus
ITGYGLKTTAVIGGAFTVN

SEQ ID NO: 1586791 - protein, 18 aa, Staphylococcus aureus
IVGLCIKLANSFIDPDSQ

SEQ ID NO: 1586792 - protein, 29 aa, Staphylococcus aureus
KERKKGGMAKVLLPLIAAVLIIGALAIFG

SEQ ID NO: 1586793 - protein, 20 aa, Staphylococcus aureus
KFHVLAGYRAKFILMVILTM

SEQ ID NO: 1586794 - protein, 20 aa, Staphylococcus aureus
KITGYGLKTTAVIGGAFTVN

SEQ ID NO: 1586795 - protein, 17 aa, Staphylococcus aureus
KVRKARSVDEGSFDITR

SEQ ID NO: 1586796 - protein, 23 aa, Staphylococcus aureus
LDDTKHLPLLFAKRRRKEDEEDV

SEQ ID NO: 1586797 - protein, 17 aa, Staphylococcus aureus
LFISWLGLFLFYKNEFD

SEQ ID NO: 1586798 - protein, 21 aa, Staphylococcus aureus
LKRAFLIMCLIGFGVGILANA

SEQ ID NO: 1586799 - protein, 18 aa, Staphylococcus aureus
LYGWIGLKLNLSSGLFSR

SEQ ID NO: 1586800 - protein, 24 aa, Staphylococcus aureus
NIIWRYILPNAIAPMIVRFSLNIG

SEQ ID NO: 1586801 - protein, 19 aa, Staphylococcus aureus
NKNEGFRNFIINAWNAIKT

SEQ ID NO: 1586802 - protein, 24 aa, Staphylococcus aureus
NTNAFRPGGVQELNEYQLSQLFTD

SEQ ID NO: 1586803 - protein, 28 aa, Staphylococcus aureus
NTNATLFGAMMALLGSLLLFRKRKQDHK

SEQ ID NO: 1586804 - protein, 21 aa, Staphylococcus aureus
PENRYKTYYYYNNGYTLTWDN

SEQ ID NO: 1586805 - protein, 18 aa, Staphylococcus aureus
QIFFKLPLIVTAVLSILL

SEQ ID NO: 1586806 - protein, 17 aa, Staphylococcus aureus
QNGLLGGVMTLLVGLGL

SEQ ID NO: 1586807 - protein, 24 aa, Staphylococcus aureus
RQSFNIPALKAWQSVKQNAGNDAP

SEQ ID NO: 1586808 - protein, 24 aa, Staphylococcus aureus
SSDVLKLKANYTIDDSVKEGDTFT

SEQ ID NO: 1586809 - protein, 22 aa, Staphylococcus aureus
SWLSLCICIALALILYALPYLI

SEQ ID NO: 1586810 - protein, 18 aa, Staphylococcus aureus
TMFYKRGKKSFVIHIKKD

SEQ ID NO: 1586811 - protein, 19 aa, Staphylococcus aureus
TTTTFKYEVTRNSMSDSVS

SEQ ID NO: 1586812 - protein, 18 aa, Staphylococcus aureus
VAYIVCSISLLIQAPLLS

SEQ ID NO: 1586813 - protein, 24 aa, Staphylococcus aureus
VGIGGLSNAFGFKLDTYHNTSKPN

SEQ ID NO: 1586814 - protein, 18 aa, Staphylococcus aureus
VIKLWLTIILIVTTVLIL

SEQ ID NO: 1586815 - protein, 19 aa, Staphylococcus aureus
VNSGGFKIDTGYIYTSSMD

SEQ ID NO: 1586816 - protein, 26 aa, Staphylococcus aureus
VNTSAPRMRAFSLAAVAADAPAAGTD

SEQ ID NO: 1586817 - protein, 17 aa, Staphylococcus aureus
WEFIPALILASSATYLY

SEQ ID NO: 1586818 - protein, 18 aa, Staphylococcus aureus
WGLNQGINANGWMRTDLK

SEQ ID NO: 1586819 - protein, 18 aa, Staphylococcus aureus
WLRFVWPVVAFVLIFGGG

SEQ ID NO: 1586820 - protein, 23 aa, Staphylococcus aureus
YEDIKARLTLYSYIDKQAVPNET

SEQ ID NO: 1586821 - protein, 21 aa, Staphylococcus aureus
YKYYYDRGYTLTWDNGLVLYS

SEQ ID NO: 1586822 - protein, 19 aa, Staphylococcus aureus
YLYYIVSAFLFWLVILTFG

SEQ ID NO: 1586823 - protein, 25 aa, Staphylococcus aureus
AGQRAVLKYKLKFENGLHQGDYFDF

SEQ ID NO: 1586824 - protein, 17 aa, Staphylococcus aureus
CIALALILYALPYLILG

SEQ ID NO: 1586825 - protein, 23 aa, Staphylococcus aureus
DFGDINSAYIIKVVSKYTPTSDG

SEQ ID NO: 1586826 - protein, 24 aa, Staphylococcus aureus
DKISYKYDNVASINFGDINKTYVV

SEQ ID NO: 1586827 - protein, 21 aa, Staphylococcus aureus
DPLHMRHFGDRIGNVIKNALG

SEQ ID NO: 1586828 - protein, 18 aa, Staphylococcus aureus
DVPFSVTIGNQITTTTAD

SEQ ID NO: 1586829 - protein, 19 aa, Staphylococcus aureus
DVWHLKPAMTIAVSHGTFN

SEQ ID NO: 1586830 - protein, 21 aa, Staphylococcus aureus
DVWHLKPAMTIAVSHGTFNIT

SEQ ID NO: 1586831 - protein, 18 aa, Staphylococcus aureus
DYTKLVFAKPIYNDPSLV

SEQ ID NO: 1586832 - protein, 19 aa, Staphylococcus aureus
EQKLPLYIVFTLFVAVAIV

SEQ ID NO: 1586833 - protein, 18 aa, Staphylococcus aureus
EYTESAVTQVRYVDVTTG

SEQ ID NO: 1586834 - protein, 21 aa, Staphylococcus aureus
FDHPNRIAIFVALAILGFVGL

SEQ ID NO: 1586835 - protein, 18 aa, Staphylococcus aureus
FIVRVLIPFALIISLFLI

SEQ ID NO: 1586836 - protein, 17 aa, Staphylococcus aureus
FTQFTFKKAIIFAALFI

SEQ ID NO: 1586837 - protein, 17 aa, Staphylococcus aureus
GFNVCFLPQFILGLDGM

SEQ ID NO: 1586838 - protein, 21 aa, Staphylococcus aureus
GMVSNRLNKFSIRKYTVGTAS

SEQ ID NO: 1586839 - protein, 20 aa, Staphylococcus aureus
GNFKSKFFISLIFAIPIIIL

SEQ ID NO: 1586840 - protein, 23 aa, Staphylococcus aureus
GYLKRFALYISVMILIFAIAGCG

SEQ ID NO: 1586841 - protein, 17 aa, Staphylococcus aureus
HILLGFTIMACWPFTRL

SEQ ID NO: 1586842 - protein, 18 aa, Staphylococcus aureus
IADIKSTNGDVVAKATYD

SEQ ID NO: 1586843 - protein, 21 aa, Staphylococcus aureus
ILTKTYTFVFTDYVNDKENIN

SEQ ID NO: 1586844 - protein, 20 aa, Staphylococcus aureus
IVCLLFKMATVPAMVISSFS

SEQ ID NO: 1586845 - protein, 23 aa, Staphylococcus aureus
KALHWQKWHAMIGIIIAIPVFVL

SEQ ID NO: 1586846 - protein, 23 aa, Staphylococcus aureus
KDDVKATLTMPAYIDPENVKKTG

SEQ ID NO: 1586847 - protein, 19 aa, Staphylococcus aureus
KGFRLDFWATFLIVWFILF

SEQ ID NO: 1586848 - protein, 19 aa, Staphylococcus aureus
KLAKVIIILCVVAFFTFPV

SEQ ID NO: 1586849 - protein, 20 aa, Staphylococcus aureus
KMSQAWNFIVTKGMQWVSTI

SEQ ID NO: 1586850 - protein, 17 aa, Staphylococcus aureus
KNEGFRNFIINAWNAIK

SEQ ID NO: 1586851 - protein, 22 aa, Staphylococcus aureus
LAARLVALVTKFGWAKTGTLVL

SEQ ID NO: 1586852 - protein, 18 aa, Staphylococcus aureus
LAKVIIILCVVAFFTFPV

SEQ ID NO: 1586853 - protein, 20 aa, Staphylococcus aureus
LCALALICVIVFYFNLNRKL

SEQ ID NO: 1586854 - protein, 22 aa, Staphylococcus aureus
LCALALICVIVFYFNLNRKLKL

SEQ ID NO: 1586855 - protein, 17 aa, Staphylococcus aureus
LKPAMTIAVSHGTFNIT

SEQ ID NO: 1586856 - protein, 18 aa, Staphylococcus aureus
LNKFSIRKYTVGTASILV

SEQ ID NO: 1586857 - protein, 18 aa, Staphylococcus aureus
NEAIPLFASVIVVLAFFL

SEQ ID NO: 1586858 - protein, 25 aa, Staphylococcus aureus
NMFSTFRFSWAYRLATVITLIISIL

SEQ ID NO: 1586859 - protein, 20 aa, Staphylococcus aureus
PSSFWCYIESITLFIVLPLL

SEQ ID NO: 1586860 - protein, 19 aa, Staphylococcus aureus
QTIEVGKTMNPVVLTTTDN

SEQ ID NO: 1586861 - protein, 21 aa, Staphylococcus aureus
RNSWIRWILGTIISISIAIAS

SEQ ID NO: 1586862 - protein, 24 aa, Staphylococcus aureus
RRKKLKFGLIIGVLTMISYLLFLL

SEQ ID NO: 1586863 - protein, 35 aa, Staphylococcus aureus
SKSWLAIVCSMMVVFSIMLFLFVKRNKKKNKNESQ

SEQ ID NO: 1586864 - protein, 21 aa, Staphylococcus aureus
SWFSRVAWSVAEKMGQALNFI

SEQ ID NO: 1586865 - protein, 29 aa, Staphylococcus aureus
TVYPHQAGYVKLNYGFSVPNSAVKGDTFK

SEQ ID NO: 1586866 - protein, 19 aa, Staphylococcus aureus
VELTACWTIFMILSGTYLL

SEQ ID NO: 1586867 - protein, 20 aa, Staphylococcus aureus
VKSGDYFTAKLPDSVTGNGD

SEQ ID NO: 1586868 - protein, 26 aa, Staphylococcus aureus
VNPSTPRMRAFSLAAVAADAPAAGTD

SEQ ID NO: 1586869 - protein, 42 aa, Staphylococcus aureus
VRLYKSGKNWVKSGIKEIEMFKIMGLPFISHSLVSQDNQSIS

SEQ ID NO: 1586870 - protein, 18 aa, Staphylococcus aureus
VVGIALLTFIVWITLVTP

SEQ ID NO: 1586871 - protein, 25 aa, Staphylococcus aureus
WPFLIALPFMIGYGIGITIYYQRKV

SEQ ID NO: 1586872 - protein, 18 aa, Staphylococcus aureus
YGWIGLKLNLSSGRFSRK

SEQ ID NO: 1586873 - protein, 17 aa, Staphylococcus aureus
YLVAIIACMIWYFNKSH

SEQ ID NO: 1586874 - protein, 18 aa, Staphylococcus aureus
AGILRLFGVIALMLVVIS

SEQ ID NO: 1586875 - protein, 24 aa, Staphylococcus aureus
APIKLRTFSRLAMSTFASAATTSA

SEQ ID NO: 1586876 - protein, 17 aa, Staphylococcus aureus
CAVTHNFILFAISRLFQ

SEQ ID NO: 1586877 - protein, 24 aa, Staphylococcus aureus
DEANTSLIWGLLASLGSLLLFRRK

SEQ ID NO: 1586878 - protein, 18 aa, Staphylococcus aureus
EDGHPEWVIPTDPARRND

SEQ ID NO: 1586879 - protein, 17 aa, Staphylococcus aureus
ETAKRALASYSNLNNAQ

SEQ ID NO: 1586880 - protein, 18 aa, Staphylococcus aureus
FALLFRFIVKLIPIFYIF

SEQ ID NO: 1586881 - protein, 19 aa, Staphylococcus aureus
FALLFRFIVKLIPIFYIFR

SEQ ID NO: 1586882 - protein, 18 aa, Staphylococcus aureus
FFISRGFVKTGLGRRIAL

SEQ ID NO: 1586883 - protein, 29 aa, Staphylococcus aureus
FGKGSWYLPAWLNRIIPRVDIEGHALEKY

SEQ ID NO: 1586884 - protein, 17 aa, Staphylococcus aureus
FHFSGKVNLGNKYEGNG

SEQ ID NO: 1586885 - protein, 17 aa, Staphylococcus aureus
FLLIWRFIDITKINVKL

SEQ ID NO: 1586886 - protein, 20 aa, Staphylococcus aureus
FSCLTFFFGLDYERFPNYLK

SEQ ID NO: 1586887 - protein, 17 aa, Staphylococcus aureus
FYKRFSKKYNEIMILRV

SEQ ID NO: 1586888 - protein, 17 aa, Staphylococcus aureus
FYLYLTLFMFSMLGIVL

SEQ ID NO: 1586889 - protein, 18 aa, Staphylococcus aureus
GAIGWLILEYIFKKTTSL

SEQ ID NO: 1586890 - protein, 24 aa, Staphylococcus aureus
GEVLEGGKIRYTFTNDIEDKVDVT

SEQ ID NO: 1586891 - protein, 22 aa, Staphylococcus aureus
GFILRLLGPLGLHHIFYLPFWQ

SEQ ID NO: 1586892 - protein, 28 aa, Staphylococcus aureus
GNGGDGIGFAFSPGVLGETGLNGAAVGI

SEQ ID NO: 1586893 - protein, 20 aa, Staphylococcus aureus
GPIFRPVMRPLFTLPGRSTV

SEQ ID NO: 1586894 - protein, 23 aa, Staphylococcus aureus
GQTWTRNISDWIAKSGTTNFSLS

SEQ ID NO: 1586895 - protein, 29 aa, Staphylococcus aureus
GVVGISGLLASFWFFIAKRRRKEDEEEEL

SEQ ID NO: 1586896 - protein, 17 aa, Staphylococcus aureus
ICMYAIFAMTAYNHSKR

SEQ ID NO: 1586897 - protein, 17 aa, Staphylococcus aureus
IDFMFASVLAFIFLVYR

SEQ ID NO: 1586898 - protein, 20 aa, Staphylococcus aureus
IFLLLRFTPLLGLSNMYVYI

SEQ ID NO: 1586899 - protein, 17 aa, Staphylococcus aureus
IRFGRKEQLFEIRVKPH

SEQ ID NO: 1586900 - protein, 18 aa, Staphylococcus aureus
IVKLIPIFYIFRVLSIFI

SEQ ID NO: 1586901 - protein, 26 aa, Staphylococcus aureus
KDKISYKYDNVASINFGDINKTYVVL

SEQ ID NO: 1586902 - protein, 18 aa, Staphylococcus aureus
KNEGFRNFIINAWNAIKT

SEQ ID NO: 1586903 - protein, 17 aa, Staphylococcus aureus
KQITDLFGFDLSTQLNQ

SEQ ID NO: 1586904 - protein, 20 aa, Staphylococcus aureus
KQRVLGNTWVYIKGYQDKIE

SEQ ID NO: 1586905 - protein, 20 aa, Staphylococcus aureus
KTTTTFKYEVTRNSMSDSVS

SEQ ID NO: 1586906 - protein, 22 aa, Staphylococcus aureus
KVFKLDIKWPFLLSELGIVLLG

SEQ ID NO: 1586907 - protein, 24 aa, Staphylococcus aureus
LDDTKHLPLLFAKRRRKEDEEDVT

SEQ ID NO: 1586908 - protein, 18 aa, Staphylococcus aureus
LDPALLRPGRFDRQIQVG

SEQ ID NO: 1586909 - protein, 23 aa, Staphylococcus aureus
LDSGKYKVIFEKPAGLTQTGTNT

SEQ ID NO: 1586910 - protein, 21 aa, Staphylococcus aureus
LFSCLTFFFGLDYERFPNYLK

SEQ ID NO: 1586911 - protein, 17 aa, Staphylococcus aureus
LGIPVPFKFSGFSFDVT

SEQ ID NO: 1586912 - protein, 17 aa, Staphylococcus aureus
LNEAMKALKESIKDQPQ

SEQ ID NO: 1586913 - protein, 18 aa, Staphylococcus aureus
LPKTGLTSVDNFISTVAF

SEQ ID NO: 1586914 - protein, 20 aa, Staphylococcus aureus
LPVIFAIGVAIGLSRSDKGT

SEQ ID NO: 1586915 - protein, 20 aa, Staphylococcus aureus
LTDVRWTSLMIEQLINNALK

SEQ ID NO: 1586916 - protein, 17 aa, Staphylococcus aureus
MVFVILTIFGFVMVIGS

SEQ ID NO: 1586917 - protein, 20 aa, Staphylococcus aureus
NAMKGLRYSIANETTVKASQ

SEQ ID NO: 1586918 - protein, 18 aa, Staphylococcus aureus
NGDYRVEFSNLPKGYEVT

SEQ ID NO: 1586919 - protein, 24 aa, Staphylococcus aureus
NGGDGIGFAFSPGVLGETGLNGAA

SEQ ID NO: 1586920 - protein, 17 aa, Staphylococcus aureus
PILMTAIATIGALVPLL

SEQ ID NO: 1586921 - protein, 22 aa, Staphylococcus aureus
PKQRVLGNTWVYIKGYQDKIEE

SEQ ID NO: 1586922 - protein, 18 aa, Staphylococcus aureus
PRTLNRMAVNTVAAPQQG

SEQ ID NO: 1586923 - protein, 18 aa, Staphylococcus aureus
RKQEAISRIKDFSNEKIN

SEQ ID NO: 1586924 - protein, 23 aa, Staphylococcus aureus
RLPLSELYEGVGILETPFGYLIS

SEQ ID NO: 1586925 - protein, 18 aa, Staphylococcus aureus
RNTHVWEVDEQPAVNEIF

SEQ ID NO: 1586926 - protein, 23 aa, Staphylococcus aureus
TLMRRGYENINMFTIIQLLTPFV

SEQ ID NO: 1586927 - protein, 18 aa, Staphylococcus aureus
TTTTFKYEVTRNSMSDSV

SEQ ID NO: 1586928 - protein, 18 aa, Staphylococcus aureus
VELGQAFIKRLANEKNYK

SEQ ID NO: 1586929 - protein, 17 aa, Staphylococcus aureus
VFNIISIIMVSMLILSL

SEQ ID NO: 1586930 - protein, 17 aa, Staphylococcus aureus
VKLIPIFYIFRVLSIFI

SEQ ID NO: 1586931 - protein, 18 aa, Staphylococcus aureus
VTDEFKNKMTYGSNQSVN

SEQ ID NO: 1586932 - protein, 17 aa, Staphylococcus aureus
VTEQFKDKITYGANDSV

SEQ ID NO: 1586933 - protein, 18 aa, Staphylococcus aureus
VVFCSLALSISNVGESKT

SEQ ID NO: 1586934 - protein, 26 aa, Staphylococcus aureus
VVGISGLLASFWFFIAKRRRKEDEEE

SEQ ID NO: 1586935 - protein, 28 aa, Staphylococcus aureus
VVGISGLLASFWFFIAKRRRKEDEEEEL

SEQ ID NO: 1586936 - protein, 17 aa, Staphylococcus aureus
VYSPISPIKIATQDNSG

SEQ ID NO: 1586937 - protein, 17 aa, Staphylococcus aureus
WIWPDLPIGAAFAIAAI

SEQ ID NO: 1586938 - protein, 23 aa, Staphylococcus aureus
YEDIKSRLTLYSYIDKKTVPNET

SEQ ID NO: 1586939 - protein, 17 aa, Staphylococcus aureus
AFLLRQIEDTFKSKQTE

SEQ ID NO: 1586940 - protein, 23 aa, Staphylococcus aureus
APKRLNTRMRIAAVQPSSTEAKN

SEQ ID NO: 1586941 - protein, 24 aa, Staphylococcus aureus
AVFIKGGDGFDFGHVERFIQNPPH

SEQ ID NO: 1586942 - protein, 21 aa, Staphylococcus aureus
DLNSDFILFDFTYDLPLSTYL

SEQ ID NO: 1586943 - protein, 22 aa, Staphylococcus aureus
DPLHMRHFSNNFGNVIKNAIGV

SEQ ID NO: 1586944 - protein, 25 aa, Staphylococcus aureus
DPVTNRDYSIFGWNNENVVRYGGGS

SEQ ID NO: 1586945 - protein, 28 aa, Staphylococcus aureus
DSGFYKTPKYSLGDYVWYDSNKDGKQDS

SEQ ID NO: 1586946 - protein, 20 aa, Staphylococcus aureus
DSGKYKVIFEKPTGLTQTGT

SEQ ID NO: 1586947 - protein, 25 aa, Staphylococcus aureus
DVDTRLSIPTIYAFKKSLDALPNKK

SEQ ID NO: 1586948 - protein, 19 aa, Staphylococcus aureus
FGDITKTYVVLVEGHYDNT

SEQ ID NO: 1586949 - protein, 17 aa, Staphylococcus aureus
FILGGIIGFFQGLVAIF

SEQ ID NO: 1586950 - protein, 17 aa, Staphylococcus aureus
FIPALILAGSATYLYLK

SEQ ID NO: 1586951 - protein, 19 aa, Staphylococcus aureus
FKSEGFSIIGLILDVVIMG

SEQ ID NO: 1586952 - protein, 19 aa, Staphylococcus aureus
FKYEVTRNSMSDSVSTSGS

SEQ ID NO: 1586953 - protein, 18 aa, Staphylococcus aureus
FLAGLGFGATQMIGENSG

SEQ ID NO: 1586954 - protein, 17 aa, Staphylococcus aureus
FPFGPIFAAILCIVVII

SEQ ID NO: 1586955 - protein, 18 aa, Staphylococcus aureus
FTQFTFKKAIIFAALFIL

SEQ ID NO: 1586956 - protein, 17 aa, Staphylococcus aureus
GDIDSAYIVKVVSKYTP

SEQ ID NO: 1586957 - protein, 17 aa, Staphylococcus aureus
GFWIKIPGKSGGINNEY

SEQ ID NO: 1586958 - protein, 20 aa, Staphylococcus aureus
GGPGAVFWMWVIAFIGAASA

SEQ ID NO: 1586959 - protein, 18 aa, Staphylococcus aureus
GIPMLIPLLIKYAIDGVI

SEQ ID NO: 1586960 - protein, 23 aa, Staphylococcus aureus
GISGLLASFWFFIAKRRRKEDEE

SEQ ID NO: 1586961 - protein, 23 aa, Staphylococcus aureus
GVTFKELWLPVLTICFILAISKI

SEQ ID NO: 1586962 - protein, 24 aa, Staphylococcus aureus
GYLKRIGMCISLLIVIIFVTSCGG

SEQ ID NO: 1586963 - protein, 18 aa, Staphylococcus aureus
HGGFLNEDFRLFSTNNQS

SEQ ID NO: 1586964 - protein, 24 aa, Staphylococcus aureus
HNVRMPRMIAGLFIGGALAVSGLL

SEQ ID NO: 1586965 - protein, 19 aa, Staphylococcus aureus
IGALAIFGGMALNNHNNGT

SEQ ID NO: 1586966 - protein, 19 aa, Staphylococcus aureus
IKKRYKIGFIFWGVSIISL

SEQ ID NO: 1586967 - protein, 23 aa, Staphylococcus aureus
IKMRKMVPWAIVFFILILIIILF

SEQ ID NO: 1586968 - protein, 17 aa, Staphylococcus aureus
ILTILPWIIGALIVTIF

SEQ ID NO: 1586969 - protein, 21 aa, Staphylococcus aureus
ILTKTYTFVFTDYVNNKENIN

SEQ ID NO: 1586970 - protein, 24 aa, Staphylococcus aureus
ISGIPLDPSALVYLVAPTNQTTNG

SEQ ID NO: 1586971 - protein, 24 aa, Staphylococcus aureus
IVSFCFIFLLLLFFRYILKRYFNY

SEQ ID NO: 1586972 - protein, 19 aa, Staphylococcus aureus
KAGGLAIIIGWIITAIGMI

SEQ ID NO: 1586973 - protein, 19 aa, Staphylococcus aureus
KATSHLLGYVGPINSEELK

SEQ ID NO: 1586974 - protein, 19 aa, Staphylococcus aureus
KDNEHSPLLFAKRRKDKEE

SEQ ID NO: 1586975 - protein, 21 aa, Staphylococcus aureus
KQRVLGNTWVYIKGYQDKIEE

SEQ ID NO: 1586976 - protein, 20 aa, Staphylococcus aureus
KRAIFPFIIASGFIADTTSL

SEQ ID NO: 1586977 - protein, 19 aa, Staphylococcus aureus
KRDAYTNAVSRAEAILNKT

SEQ ID NO: 1586978 - protein, 17 aa, Staphylococcus aureus
KRYKIGFIFWGVSIISL

SEQ ID NO: 1586979 - protein, 21 aa, Staphylococcus aureus
KSQAEAGGRPNFRTTGYSQSN

SEQ ID NO: 1586980 - protein, 17 aa, Staphylococcus aureus
KVREIKGLLTAKILRAQ

SEQ ID NO: 1586981 - protein, 18 aa, Staphylococcus aureus
LAKVIIILCVVAFFIFPV

SEQ ID NO: 1586982 - protein, 21 aa, Staphylococcus aureus
LCGFVICYGLIFGLFYLLSGS

SEQ ID NO: 1586983 - protein, 20 aa, Staphylococcus aureus
LFDNTRAVFGFNFFLDKKQL

SEQ ID NO: 1586984 - protein, 25 aa, Staphylococcus aureus
LGLDDIRNTHVWEVDAQPAVNEIFD

SEQ ID NO: 1586985 - protein, 21 aa, Staphylococcus aureus
LLFCAGVAFAFYVGFPMIIQF

SEQ ID NO: 1586986 - protein, 17 aa, Staphylococcus aureus
LLLRKIHGYSLFSSNVR

SEQ ID NO: 1586987 - protein, 18 aa, Staphylococcus aureus
LSLPFALIGLFTSMFFII

SEQ ID NO: 1586988 - protein, 19 aa, Staphylococcus aureus
LTILKRRIIMIGFITLPLY

SEQ ID NO: 1586989 - protein, 19 aa, Staphylococcus aureus
LTKTYTFVFTDYVNDKENI

SEQ ID NO: 1586990 - protein, 17 aa, Staphylococcus aureus
LYIISAVVLIMVLIGFI

SEQ ID NO: 1586991 - protein, 17 aa, Staphylococcus aureus
LYVVFKMIFWFNPALYI

SEQ ID NO: 1586992 - protein, 20 aa, Staphylococcus aureus
MCASSAMLLPGISGSFMLLV

SEQ ID NO: 1586993 - protein, 20 aa, Staphylococcus aureus
MGVKLPFQISFTGSDWIVLI

SEQ ID NO: 1586994 - protein, 26 aa, Staphylococcus aureus
MLFHPFKPYYIFKFRVPFTPGLIPKR

SEQ ID NO: 1586995 - protein, 17 aa, Staphylococcus aureus
NATLFDAMVALLGSLLL

SEQ ID NO: 1586996 - protein, 18 aa, Staphylococcus aureus
NHPIEFNMIWKAMLIPSM

SEQ ID NO: 1586997 - protein, 20 aa, Staphylococcus aureus
NSWGWLPWNWSDGIGQSVMY

SEQ ID NO: 1586998 - protein, 18 aa, Staphylococcus aureus
PKIMAAIVLWLFGSIASI

SEQ ID NO: 1586999 - protein, 20 aa, Staphylococcus aureus
PLHMRHFSNNFGNVIKNAIG

SEQ ID NO: 1587000 - protein, 20 aa, Staphylococcus aureus
QALDHAMELLRNSVADNQAT

SEQ ID NO: 1587001 - protein, 24 aa, Staphylococcus aureus
QFKAQLKAANPFAKELENRKKAAI

SEQ ID NO: 1587002 - protein, 23 aa, Staphylococcus aureus
QSKLILIFICIFTFLLMVIQSQF

SEQ ID NO: 1587003 - protein, 18 aa, Staphylococcus aureus
RLGTVFFLFVFNIGISIF

SEQ ID NO: 1587004 - protein, 23 aa, Staphylococcus aureus
SEFLYKFELEPAFIKIVSNQRIN

SEQ ID NO: 1587005 - protein, 26 aa, Staphylococcus aureus
SIEGTKHLPLLFAKRRRKEDEEDAIV

SEQ ID NO: 1587006 - protein, 24 aa, Staphylococcus aureus
SLDKVKHTPFFLPKRRRKEDEEDV

SEQ ID NO: 1587007 - protein, 19 aa, Staphylococcus aureus
SRLNNILTILSIVLAIIHM

SEQ ID NO: 1587008 - protein, 22 aa, Staphylococcus aureus
SWWGLYALLGMLALFIPKFRKE

SEQ ID NO: 1587009 - protein, 32 aa, Staphylococcus aureus
TDQFKNRIYYEHPNVASIKFGDITKTYVVLVE

SEQ ID NO: 1587010 - protein, 18 aa, Staphylococcus aureus
TIEVGKTMNPIVLTTTDN

SEQ ID NO: 1587011 - protein, 18 aa, Staphylococcus aureus
TILKRRIIMIGFITLPLY

SEQ ID NO: 1587012 - protein, 24 aa, Staphylococcus aureus
TLKGKKGYKFSIFMGTFTKCIMVL

SEQ ID NO: 1587013 - protein, 19 aa, Staphylococcus aureus
TNATLFDAMVALLGSLLLF

SEQ ID NO: 1587014 - protein, 19 aa, Staphylococcus aureus
TSSQSWWGLYALLGMLALF

SEQ ID NO: 1587015 - protein, 20 aa, Staphylococcus aureus
VCGLISWLYYHYRIDSIKQL

SEQ ID NO: 1587016 - protein, 17 aa, Staphylococcus aureus
VDLDEAWSFLQVAQGKA

SEQ ID NO: 1587017 - protein, 18 aa, Staphylococcus aureus
VDYEKYGKFYNLSIKGTI

SEQ ID NO: 1587018 - protein, 17 aa, Staphylococcus aureus
VICIFAFDLKDLLQGFN

SEQ ID NO: 1587019 - protein, 17 aa, Staphylococcus aureus
VLTGFKFIAQEIRQLDD

SEQ ID NO: 1587020 - protein, 17 aa, Staphylococcus aureus
VPFSVTIGNQITTTTAD

SEQ ID NO: 1587021 - protein, 23 aa, Staphylococcus aureus
VVSFCFIFLLLVFFKYILKRYFN

SEQ ID NO: 1587022 - protein, 20 aa, Staphylococcus aureus
VYGPKWLYIISVIVFSLSYL

SEQ ID NO: 1587023 - protein, 23 aa, Staphylococcus aureus
YDDLSIKLVRPFGDMLGLHNEFI

SEQ ID NO: 1587024 - protein, 24 aa, Staphylococcus aureus
YEDIKARLTLYSYIDKQAVPNETS

SEQ ID NO: 1587025 - protein, 17 aa, Staphylococcus aureus
YSIFGWNNENVVRYGGG

SEQ ID NO: 1587026 - protein, 18 aa, Staphylococcus aureus
YSIRRFTVGTTSVIVGAT

SEQ ID NO: 1587027 - protein, 17 aa, Staphylococcus aureus
YTESAVTQVRYVDVTTG

SEQ ID NO: 1587028 - protein, 26 aa, Staphylococcus aureus
AARTRNPIRLMIGFDYPDAYGNSETL

SEQ ID NO: 1587029 - protein, 26 aa, Staphylococcus aureus
AGQTWTRNISDWIAKSGTTNFSLSMT

SEQ ID NO: 1587030 - protein, 22 aa, Staphylococcus aureus
AKRDAYTNAVSRAETILNKTQG

SEQ ID NO: 1587031 - protein, 20 aa, Staphylococcus aureus
AMTRKGMVSNRLNKFSIRKY

SEQ ID NO: 1587032 - protein, 29 aa, Staphylococcus aureus
ANKELKLIMSLGFILGGIIGFFQGLVAIF

SEQ ID NO: 1587033 - protein, 18 aa, Staphylococcus aureus
ANMKEILNYYGLNSKGFR

SEQ ID NO: 1587034 - protein, 17 aa, Staphylococcus aureus
ARRVCWFGSALVTIIIG

SEQ ID NO: 1587035 - protein, 20 aa, Staphylococcus aureus
CLALKCKLIIVLGEFEVKYL

SEQ ID NO: 1587036 - protein, 17 aa, Staphylococcus aureus
DATITWVSGQAPNKDNT

SEQ ID NO: 1587037 - protein, 42 aa, Staphylococcus aureus
DPASTGDLALRSTFYGYDSNFIWRSMSWDNEVAFNNGSGSGD

SEQ ID NO: 1587038 - protein, 19 aa, Staphylococcus aureus
DSEDFYISLKIIDVKQPEG

SEQ ID NO: 1587039 - protein, 18 aa, Staphylococcus aureus
EEIGDLFSIKVIAISTAI

SEQ ID NO: 1587040 - protein, 29 aa, Staphylococcus aureus
EGDTFTFKYGQYFRPGSVRLPSQTQNLYN

SEQ ID NO: 1587041 - protein, 18 aa, Staphylococcus aureus
ELTACWTIFMILSGTYLL

SEQ ID NO: 1587042 - protein, 19 aa, Staphylococcus aureus
ERLLIIRALITWFYTMLWS

SEQ ID NO: 1587043 - protein, 24 aa, Staphylococcus aureus
ESLDKVKHTPFFLPKRRRKEDEED

SEQ ID NO: 1587044 - protein, 22 aa, Staphylococcus aureus
FAIKCLWVKPKVVNYLIAKELG

SEQ ID NO: 1587045 - protein, 24 aa, Staphylococcus aureus
FASDSKWKIMLSILLSIISVFSGL

SEQ ID NO: 1587046 - protein, 17 aa, Staphylococcus aureus
FDLPLSFFINRSTGDLI

SEQ ID NO: 1587047 - protein, 21 aa, Staphylococcus aureus
FGFDVFNYWLGIVMMLFISWL

SEQ ID NO: 1587048 - protein, 24 aa, Staphylococcus aureus
FGKDRFRLFSGWYYLIKYAMPVVI

SEQ ID NO: 1587049 - protein, 18 aa, Staphylococcus aureus
GDIDSAYIVKVVSKYTPG

SEQ ID NO: 1587050 - protein, 25 aa, Staphylococcus aureus
GDQSSEVFSPISPIKIATQDNSGNA

SEQ ID NO: 1587051 - protein, 19 aa, Staphylococcus aureus
GMLLIRWMLATSFLVHGTL

SEQ ID NO: 1587052 - protein, 17 aa, Staphylococcus aureus
GNVIYTFTDYVDNKENV

SEQ ID NO: 1587053 - protein, 22 aa, Staphylococcus aureus
GVTFKELWLPVLTICFILAISK

SEQ ID NO: 1587054 - protein, 24 aa, Staphylococcus aureus
GWFSINLFLPFAIAIQYYTIDKLI

SEQ ID NO: 1587055 - protein, 33 aa, Staphylococcus aureus; identical to SEQ ID NO: 1580969

SEQ ID NO: 1587056 - protein, 18 aa, Staphylococcus aureus
HLLLELAVIFGISALVTS

SEQ ID NO: 1587057 - protein, 19 aa, Staphylococcus aureus
IAAVLIIGALAIFGGMALN

SEQ ID NO: 1587058 - protein, 17 aa, Staphylococcus aureus
IADIKSTNGDVVAKATY

SEQ ID NO: 1587059 - protein, 18 aa, Staphylococcus aureus
IEHAKAQLAQALQDIKDL

SEQ ID NO: 1587060 - protein, 17 aa, Staphylococcus aureus
IHLESFQTFLINKKVNG

SEQ ID NO: 1587061 - protein, 19 aa, Staphylococcus aureus
IIQKPIRSVQEVQTALTNV

SEQ ID NO: 1587062 - protein, 22 aa, Staphylococcus aureus
ILELHPSFYLSFIALLIINLAV

SEQ ID NO: 1587063 - protein, 20 aa, Staphylococcus aureus
IPNTKSNALIDAKNTDIKVY

SEQ ID NO: 1587064 - protein, 21 aa, Staphylococcus aureus
IRALITWFYTMLWSIVGVVWI

SEQ ID NO: 1587065 - protein, 17 aa, Staphylococcus aureus
ITEFFLLIWRFIDITKI

SEQ ID NO: 1587066 - protein, 19 aa, Staphylococcus aureus
KAIITWLLLIPVFNFMTSF

SEQ ID NO: 1587067 - protein, 20 aa, Staphylococcus aureus
KEALKAQVTSAGRVSAANGV

SEQ ID NO: 1587068 - protein, 32 aa, Staphylococcus aureus
KEGDTFTFKYGQYFRPGSVRLPSQTQNLYNAQ

SEQ ID NO: 1587069 - protein, 20 aa, Staphylococcus aureus
KEILNYYGLNSKGFRVDDVD

SEQ ID NO: 1587070 - protein, 19 aa, Staphylococcus aureus
KGSDVWTAFEHSLGAPTTQ

SEQ ID NO: 1587071 - protein, 20 aa, Staphylococcus aureus
KIKSYFLRWIPSFHILQSGQ

SEQ ID NO: 1587072 - protein, 27 aa, Staphylococcus aureus
KIRNRSGQVIYDWPTVHIYSLEDLSRA

SEQ ID NO: 1587073 - protein, 17 aa, Staphylococcus aureus
LDHAMELLRNSVADNQT

SEQ ID NO: 1587074 - protein, 17 aa, Staphylococcus aureus
LELAVIFGISALVTSFL

SEQ ID NO: 1587075 - protein, 26 aa, Staphylococcus aureus
LGLDDIRNTHVWEVDAQPAVNEIFDA

SEQ ID NO: 1587076 - protein, 24 aa, Staphylococcus aureus
LIDYEKYGQFHNLSIKGTIDQIDK

SEQ ID NO: 1587077 - protein, 17 aa, Staphylococcus aureus
LLFFAFRTSNNIVVQHR

SEQ ID NO: 1587078 - protein, 24 aa, Staphylococcus aureus
LLMIPMCISFLFGPLVDALPLKKT

SEQ ID NO: 1587079 - protein, 21 aa, Staphylococcus aureus
LPEIQHNIKFFKNDDTQNIAE

SEQ ID NO: 1587080 - protein, 19 aa, Staphylococcus aureus
LSITGRVSMNQAFNSDITF

SEQ ID NO: 1587081 - protein, 20 aa, Staphylococcus aureus
LTKTYTFVFTDYVNDKENIN

SEQ ID NO: 1587082 - protein, 19 aa, Staphylococcus aureus
LTKTYTFVFTDYVNNKENI

SEQ ID NO: 1587083 - protein, 19 aa, Staphylococcus aureus
NGFFSVGVVIVFSPFCPSL

SEQ ID NO: 1587084 - protein, 18 aa, Staphylococcus aureus
NGQFSLPLFTDRAKAPKS

SEQ ID NO: 1587085 - protein, 19 aa, Staphylococcus aureus
NIFGFKWDKGMEAILMKPY

SEQ ID NO: 1587086 - protein, 17 aa, Staphylococcus aureus
NINKGRLTKSFASNLAN

SEQ ID NO: 1587087 - protein, 21 aa, Staphylococcus aureus
NNRKAEALQRLDQLTHLNNAQ

SEQ ID NO: 1587088 - protein, 23 aa, Staphylococcus aureus
NQVRISFPNANQYKVEFPTDDDQ

SEQ ID NO: 1587089 - protein, 20 aa, Staphylococcus aureus
NRDYSIFGWNNENVVRYGGG

SEQ ID NO: 1587090 - protein, 18 aa, Staphylococcus aureus
NSGGFKIDTGYIYTSSMD

SEQ ID NO: 1587091 - protein, 17 aa, Staphylococcus aureus
NTASTWKKFEVYENNQK

SEQ ID NO: 1587092 - protein, 20 aa, Staphylococcus aureus
PAICLVVSTALTFFVMPDKY

SEQ ID NO: 1587093 - protein, 18 aa, Staphylococcus aureus
PEIGRIYILPALIGSIIL

SEQ ID NO: 1587094 - protein, 17 aa, Staphylococcus aureus
PEKVSVNLLANGEKVKT

SEQ ID NO: 1587095 - protein, 21 aa, Staphylococcus aureus
PKRLNTRMRIAAVQPSSTEAK

SEQ ID NO: 1587096 - protein, 17 aa, Staphylococcus aureus
PKYNLGDYVWEDTNKNG

SEQ ID NO: 1587097 - protein, 19 aa, Staphylococcus aureus
PRTLNRMAVNTVAAPQQGT

SEQ ID NO: 1587098 - protein, 17 aa, Staphylococcus aureus
QDYVVFIPPVGKQIRAV

SEQ ID NO: 1587099 - protein, 17 aa, Staphylococcus aureus
QGKEHFEGYGSVDIQKN

SEQ ID NO: 1587100 - protein, 20 aa, Staphylococcus aureus
QLLLRKIHGYSLFSSNVRYL

SEQ ID NO: 1587101 - protein, 28 aa, Staphylococcus aureus
QSKLIPIFICIFTFLLIVIQSQFLMGQS

SEQ ID NO: 1587102 - protein, 23 aa, Staphylococcus aureus
RLAEEKGRVIGMAKLKTIKEQEK

SEQ ID NO: 1587103 - protein, 17 aa, Staphylococcus aureus
RVAGISIIYLAVVGVIT

SEQ ID NO: 1587104 - protein, 20 aa, Staphylococcus aureus
RYRIPRVAGISIIYLAVVGV

SEQ ID NO: 1587105 - protein, 24 aa, Staphylococcus aureus
SFAKRVFTALGIGIVFGVLLHLVY

SEQ ID NO: 1587106 - protein, 21 aa, Staphylococcus aureus
SKDRTTLIVAHRLSTITHADK

SEQ ID NO: 1587107 - protein, 17 aa, Staphylococcus aureus
SKPALDCPIVFPYAQNA

SEQ ID NO: 1587108 - protein, 23 aa, Staphylococcus aureus
SKPLRMMIYLGLFIFSISALYII

SEQ ID NO: 1587109 - protein, 17 aa, Staphylococcus aureus
SMIGISVAMIWVFLNDY

SEQ ID NO: 1587110 - protein, 18 aa, Staphylococcus aureus
SNLTWKNGVAFYSNNAQG

SEQ ID NO: 1587111 - protein, 21 aa, Staphylococcus aureus
SWLSLCICIALALILYALPYL

SEQ ID NO: 1587112 - protein, 26 aa, Staphylococcus aureus
TAPVKLRTFSRLAMSTFASAATTSAV

SEQ ID NO: 1587113 - protein, 18 aa, Staphylococcus aureus
TKTYTFVFTDYVNDKENI

SEQ ID NO: 1587114 - protein, 26 aa, Staphylococcus aureus
TLDDTKHLPLLFAKRRRKEDEEDVTV

SEQ ID NO: 1587115 - protein, 29 aa, Staphylococcus aureus
TLDSGFYKTPKYSLGDYVWYDSNKDGKQD

SEQ ID NO: 1587116 - protein, 24 aa, Staphylococcus aureus
TLKGKKGYKFSIFMGTFTKCTMVL

SEQ ID NO: 1587117 - protein, 18 aa, Staphylococcus aureus
TNLFSEKILDEFISSNSF

SEQ ID NO: 1587118 - protein, 19 aa, Staphylococcus aureus
TSDSLRTSTSLSDSVSMST

SEQ ID NO: 1587119 - protein, 24 aa, Staphylococcus aureus
TSMPEYWLAILFIYYLGVRWQLLP

SEQ ID NO: 1587120 - protein, 17 aa, Staphylococcus aureus
TVKETFLTWSLLETIIS

SEQ ID NO: 1587121 - protein, 19 aa, Staphylococcus aureus
VDYEKYGKFYNLSIKGTID

SEQ ID NO: 1587122 - protein, 21 aa, Staphylococcus aureus
VKKNLVGIAFIFSSVAVLIFE

SEQ ID NO: 1587123 - protein, 20 aa, Staphylococcus aureus
VLFWLCILSFFSVLNEMVLN

SEQ ID NO: 1587124 - protein, 21 aa, Staphylococcus aureus
VLFWLCILSFFSVLNEMVLNV

SEQ ID NO: 1587125 - protein, 22 aa, Staphylococcus aureus
VLKDNEHSPLLFAKRRKDKEED

SEQ ID NO: 1587126 - protein, 19 aa, Staphylococcus aureus
VLVIIGFVLNMFIKHFKKE

SEQ ID NO: 1587127 - protein, 25 aa, Staphylococcus aureus
VNPKQRVLGNTWVYIKGYQDKIEES

SEQ ID NO: 1587128 - protein, 19 aa, Staphylococcus aureus
VTANITMPAYIDPENVTKT

SEQ ID NO: 1587129 - protein, 19 aa, Staphylococcus aureus
VTDLAPLIAAIICILVFKY

SEQ ID NO: 1587130 - protein, 17 aa, Staphylococcus aureus
VVLPALTGNLIPNTKSN

SEQ ID NO: 1587131 - protein, 30 aa, Staphylococcus aureus
WTLDSGFYKTPKYSLGDYVWYDSNKDGKQD

SEQ ID NO: 1587132 - protein, 17 aa, Staphylococcus aureus
YGQFHNLSIKGTIDQID

SEQ ID NO: 1587133 - protein, 17 aa, Staphylococcus aureus
YGWDGFKRAGDYAYATG

SEQ ID NO: 1587134 - protein, 19 aa, Staphylococcus aureus
YKEECLRAIILEFDNKKTI

SEQ ID NO: 1587135 - protein, 18 aa, Staphylococcus aureus
YKKRGKFSLLLLGINNTV

SEQ ID NO: 1587136 - protein, 18 aa, Staphylococcus aureus
YNGFSWFAFLLIIQASTI

SEQ ID NO: 1587137 - protein, 19 aa, Staphylococcus aureus
YNIPTWLGALIMTLAIYVT

SEQ ID NO: 1587138 - protein, 17 aa, Staphylococcus aureus
AAIFLYIMLIDWRMASA

SEQ ID NO: 1587139 - protein, 19 aa, Staphylococcus aureus
AIIQKPIRTVQEVQSALTN

SEQ ID NO: 1587140 - protein, 31 aa, Staphylococcus aureus
AIRKKSIGVASVLVGTLIGFGLLSSKEADAS

SEQ ID NO: 1587141 - protein, 21 aa, Staphylococcus aureus
AKDGLFPKWFAKENKNKAPVN

SEQ ID NO: 1587142 - protein, 17 aa, Staphylococcus aureus
AKFILMVILTMMVFVLI

SEQ ID NO: 1587143 - protein, 21 aa, Staphylococcus aureus
AKRDAYTNAVSRAETILNKTQ

SEQ ID NO: 1587144 - protein, 18 aa, Staphylococcus aureus
ALSFLFGIPMFVGALITG

SEQ ID NO: 1587145 - protein, 17 aa, Staphylococcus aureus
ANITMPAYIDPENVTKT

SEQ ID NO: 1587146 - protein, 22 aa, Staphylococcus aureus
APKRLNTRMRMAAVQPSSTDSK

SEQ ID NO: 1587147 - protein, 25 aa, Staphylococcus aureus
ATTMGWRWIFIFSIIVAVLSMLLIK

SEQ ID NO: 1587148 - protein, 25 aa, Staphylococcus aureus
ATTNAFRPGGVQELNEYQLSQLFTD

SEQ ID NO: 1587149 - protein, 17 aa, Staphylococcus aureus
AVKQDLTEVQALDQLMD

SEQ ID NO: 1587150 - protein, 19 aa, Staphylococcus aureus
DIDKRVQALIDEIDQNPNL

SEQ ID NO: 1587151 - protein, 18 aa, Staphylococcus aureus
DIKVYRVDNANDLSESYY

SEQ ID NO: 1587152 - protein, 21 aa, Staphylococcus aureus
DIKVYRVDNANDLSESYYVNP

SEQ ID NO: 1587153 - protein, 30 aa, Staphylococcus aureus
DKERKKGGMAKVLLPLIAAVLIIGALAIFG

SEQ ID NO: 1587154 - protein, 25 aa, Staphylococcus aureus
DKITYKYQNVASINFGDINKTYVVL

SEQ ID NO: 1587155 - protein, 23 aa, Staphylococcus aureus
DKKLEVISSLFSVKKITFDLSDA

SEQ ID NO: 1587156 - protein, 17 aa, Staphylococcus aureus
DLFRFYKNPDFKKVNPS

SEQ ID NO: 1587157 - protein, 19 aa, Staphylococcus aureus
DLNSDFILFDFTYDLPLST

SEQ ID NO: 1587158 - protein, 20 aa, Staphylococcus aureus
DLNSDFILFDFTYDLPLSTY

SEQ ID NO: 1587159 - protein, 22 aa, Staphylococcus aureus
DQTGLKSWMIWAIEPSMLRIGL

SEQ ID NO: 1587160 - protein, 23 aa, Staphylococcus aureus
DTGLSIPTIYAFKKSLDALPNKK

SEQ ID NO: 1587161 - protein, 18 aa, Staphylococcus aureus
DYSIFGWNNENVVRYGGG

SEQ ID NO: 1587162 - protein, 18 aa, Staphylococcus aureus
EAKLSRKVIYLLSFTLLL

SEQ ID NO: 1587163 - protein, 17 aa, Staphylococcus aureus
EERRQWEQFQAFQNQQN

SEQ ID NO: 1587164 - protein, 27 aa, Staphylococcus aureus
EGDTFTFKYGQYFRPGSVRLPSQTQNL

SEQ ID NO: 1587165 - protein, 18 aa, Staphylococcus aureus
EKILDEFISSNSFPEDEV

SEQ ID NO: 1587166 - protein, 18 aa, Staphylococcus aureus
ETMGYLKGFALYISILIL

SEQ ID NO: 1587167 - protein, 25 aa, Staphylococcus aureus
EVETLKWARWLPHMTLRGQNIRGFV

SEQ ID NO: 1587168 - protein, 18 aa, Staphylococcus aureus
FDPNLPIDGTEEVPGKPG

SEQ ID NO: 1587169 - protein, 17 aa, Staphylococcus aureus
FFIFPVIIMFLLAPDLN

SEQ ID NO: 1587170 - protein, 17 aa, Staphylococcus aureus
FIKQITDLFGFDLSTQL

SEQ ID NO: 1587171 - protein, 20 aa, Staphylococcus aureus
FIKVIFEFILNFVIKPIMFA

SEQ ID NO: 1587172 - protein, 19 aa, Staphylococcus aureus
FTVGTTSVIVGATILFGIG

SEQ ID NO: 1587173 - protein, 22 aa, Staphylococcus aureus
FYYIDIFVCFVAVVFFNVTNYM

SEQ ID NO: 1587174 - protein, 20 aa, Staphylococcus aureus
GARWDYIGIFSFLLVISIVL

SEQ ID NO: 1587175 - protein, 20 aa, Staphylococcus aureus
GDTIKVAWPTSGTVKIEGYS

SEQ ID NO: 1587176 - protein, 25 aa, Staphylococcus aureus
GFYKTPKYSLGDYVWYDSNKDGKQD

SEQ ID NO: 1587177 - protein, 17 aa, Staphylococcus aureus
GILRLFGVIALMLVVIS

SEQ ID NO: 1587178 - protein, 23 aa, Staphylococcus aureus
GKVTRYDLISVLPFGNTIAQIDV

SEQ ID NO: 1587179 - protein, 24 aa, Staphylococcus aureus
GLDDIRNTHVWEVDEQPAVNEIFE

SEQ ID NO: 1587180 - protein, 20 aa, Staphylococcus aureus
GLYICMYAIFAITAYNHSKR

SEQ ID NO: 1587181 - protein, 32 aa, Staphylococcus aureus
GMLKGCGGCLISFILLIILLSACSMMFSNKDN

SEQ ID NO: 1587182 - protein, 18 aa, Staphylococcus aureus
GNQPKVRIFEYLGNNEDI

SEQ ID NO: 1587183 - protein, 17 aa, Staphylococcus aureus
GSIGWLILEYIFKKTTS

SEQ ID NO: 1587184 - protein, 24 aa, Staphylococcus aureus
GTLPRFHFGTTMWKDIKSSASSAF

SEQ ID NO: 1587185 - protein, 19 aa, Staphylococcus aureus
GTLPRFSLGTMWKDIKSGA

SEQ ID NO: 1587186 - protein, 19 aa, Staphylococcus aureus
HPNVASIKFGDITKTYVVL

SEQ ID NO: 1587187 - protein, 19 aa, Staphylococcus aureus
ICVFAFKMVQVMKQNAEGN

SEQ ID NO: 1587188 - protein, 17 aa, Staphylococcus aureus
IELPLALSFFSGKRLVP

SEQ ID NO: 1587189 - protein, 24 aa, Staphylococcus aureus
IFYGICVLCFLLLPIIFIPNPNHV

SEQ ID NO: 1587190 - protein, 18 aa, Staphylococcus aureus
IGFFVVGLILKPVTDPLM

SEQ ID NO: 1587191 - protein, 20 aa, Staphylococcus aureus
IGFSSAWGYWFAAFLGNVAY

SEQ ID NO: 1587192 - protein, 17 aa, Staphylococcus aureus
IGISVAMIWVFLNDYID

SEQ ID NO: 1587193 - protein, 17 aa, Staphylococcus aureus
IHLKIIYWLILTSIFFI

SEQ ID NO: 1587194 - protein, 17 aa, Staphylococcus aureus
IKPLWQYHCRFYKVDQL

SEQ ID NO: 1587195 - protein, 18 aa, Staphylococcus aureus
ILFSLPFTVIGVIIALLI

SEQ ID NO: 1587196 - protein, 21 aa, Staphylococcus aureus
ILICVTSGFIGLILGVVFATI

SEQ ID NO: 1587197 - protein, 17 aa, Staphylococcus aureus
IMLPFGYIVGYFVGTRP

SEQ ID NO: 1587198 - protein, 17 aa, Staphylococcus aureus
IPKDATIVWYDFDEPNE

SEQ ID NO: 1587199 - protein, 17 aa, Staphylococcus aureus
ISKLGWLKINFIESLPL

SEQ ID NO: 1587200 - protein, 18 aa, Staphylococcus aureus
ITEFFLLIWRFIDITKIN

SEQ ID NO: 1587201 - protein, 17 aa, Staphylococcus aureus
ITMPAYIDPENVTKTGN

SEQ ID NO: 1587202 - protein, 24 aa, Staphylococcus aureus
ITSSQRWGLNQGINANGWMRTDLK

SEQ ID NO: 1587203 - protein, 24 aa, Staphylococcus aureus
ITTPYIVVVNGHIDPASTGDLALR

SEQ ID NO: 1587204 - protein, 20 aa, Staphylococcus aureus
KEALKAQVTSAGRVSVANGV

SEQ ID NO: 1587205 - protein, 17 aa, Staphylococcus aureus
KERKKGGMAKVLLPLIA

SEQ ID NO: 1587206 - protein, 17 aa, Staphylococcus aureus
KFLTLFAGPLFNFILAL

SEQ ID NO: 1587207 - protein, 21 aa, Staphylococcus aureus
KGMLFGGLFSILGLALLRRNK

SEQ ID NO: 1587208 - protein, 20 aa, Staphylococcus aureus
KKARNFYSMLYDWRINKNPL

SEQ ID NO: 1587209 - protein, 27 aa, Staphylococcus aureus
KNRIYYEHPNVASIKFGDITKTYVVLV

SEQ ID NO: 1587210 - protein, 20 aa, Staphylococcus aureus
KRKQEAISRIKDFSNEKINS

SEQ ID NO: 1587211 - protein, 19 aa, Staphylococcus aureus
KSGDYFTAKLPDSVTGNGD

SEQ ID NO: 1587212 - protein, 17 aa, Staphylococcus aureus
KTGRFIATASIAFSILL

SEQ ID NO: 1587213 - protein, 20 aa, Staphylococcus aureus
KTYIKHFLLFNGLMGGLSFV

SEQ ID NO: 1587214 - protein, 18 aa, Staphylococcus aureus
KYEWPLFVIYSFIFVLLL

SEQ ID NO: 1587215 - protein, 19 aa, Staphylococcus aureus
KYIIFGIVLAITLLIVGIA

SEQ ID NO: 1587216 - protein, 17 aa, Staphylococcus aureus
LDAGDAFQGLPLSNQSK

SEQ ID NO: 1587217 - protein, 21 aa, Staphylococcus aureus
LDKVKHTPFFLPKRRRKEDEE

SEQ ID NO: 1587218 - protein, 22 aa, Staphylococcus aureus
LDKVKHTPFFLPKRRRKEDEED

SEQ ID NO: 1587219 - protein, 18 aa, Staphylococcus aureus
LDTDKTKYSWSNSYSNVN

SEQ ID NO: 1587220 - protein, 17 aa, Staphylococcus aureus
LFAIVTWLLFIGSLSQY

SEQ ID NO: 1587221 - protein, 25 aa, Staphylococcus aureus
LFVLITIFCSIIFNSIVYTCVSLLG

SEQ ID NO: 1587222 - protein, 22 aa, Staphylococcus aureus
LGERLKHPFILKRIVGQSGMSY

SEQ ID NO: 1587223 - protein, 17 aa, Staphylococcus aureus
LGLMIPLLILISIVVFS

SEQ ID NO: 1587224 - protein, 18 aa, Staphylococcus aureus
LHMRHFSNNFGNVIKNAI

SEQ ID NO: 1587225 - protein, 20 aa, Staphylococcus aureus
LIDYEKYGQFHNLSIKGTID

SEQ ID NO: 1587226 - protein, 23 aa, Staphylococcus aureus
LIELIRWLFTFGILFQLPILFIG

SEQ ID NO: 1587227 - protein, 17 aa, Staphylococcus aureus
LIGSLWLMLSIIPLSII

SEQ ID NO: 1587228 - protein, 17 aa, Staphylococcus aureus
LKAGKVYKKDRLDVAFS

SEQ ID NO: 1587229 - protein, 21 aa, Staphylococcus aureus
LKAGVESPVLFVLITIFCSII

SEQ ID NO: 1587230 - protein, 23 aa, Staphylococcus aureus
LKGKKGYKFSIFMGTFTKCIMVL

SEQ ID NO: 1587231 - protein, 17 aa, Staphylococcus aureus
LKLILILLFYFQYFWSY

SEQ ID NO: 1587232 - protein, 22 aa, Staphylococcus aureus
LLFCAGVAFAFYVGFPIIIQFA

SEQ ID NO: 1587233 - protein, 30 aa, Staphylococcus aureus
LPKTGMKIITSWITWVFIGILGLYLILRKR

SEQ ID NO: 1587234 - protein, 31 aa, Staphylococcus aureus
LPKTGMKIITSWITWVFIGILGLYLILRKRF

SEQ ID NO: 1587235 - protein, 17 aa, Staphylococcus aureus
LPLALSFFSGKRLVPIM

SEQ ID NO: 1587236 - protein, 17 aa, Staphylococcus aureus
LPLLIAFVLILAGLSFG

SEQ ID NO: 1587237 - protein, 17 aa, Staphylococcus aureus
LRIGRTIKQAFSKANKS

SEQ ID NO: 1587238 - protein, 25 aa, Staphylococcus aureus
LTLKGKKGYKFSIFMGTFTKCIMVL

SEQ ID NO: 1587239 - protein, 17 aa, Staphylococcus aureus
LYYIVSALLFWLVILTF

SEQ ID NO: 1587240 - protein, 19 aa, Staphylococcus aureus
MDFFWELATLILIMLLGHW

SEQ ID NO: 1587241 - protein, 19 aa, Staphylococcus aureus
MGVKLPFQISFTGSDWIVL

SEQ ID NO: 1587242 - protein, 17 aa, Staphylococcus aureus
MHWTLWKYLILTCLVVL

SEQ ID NO: 1587243 - protein, 17 aa, Staphylococcus aureus
MLFGGLFSILGLALLRR

SEQ ID NO: 1587244 - protein, 32 aa, Staphylococcus aureus
MLFHPFKPYYIFKFRVPFTPGLIPKRREEIAT

SEQ ID NO: 1587245 - protein, 21 aa, Staphylococcus aureus
MPDWLGNIGYIFPLRYAGDAL

SEQ ID NO: 1587246 - protein, 18 aa, Staphylococcus aureus
NATTCDKVAEIIAQAQAL

SEQ ID NO: 1587247 - protein, 19 aa, Staphylococcus aureus
NDKELLFRTNLHGYHANYG

SEQ ID NO: 1587248 - protein, 17 aa, Staphylococcus aureus
NEAIPLFASVIVVLAFF

SEQ ID NO: 1587249 - protein, 26 aa, Staphylococcus aureus
NKGMLFGGLFSILGLALLRRNKKNHK

SEQ ID NO: 1587250 - protein, 17 aa, Staphylococcus aureus
NKGRNIFTMIGIIIGIS

SEQ ID NO: 1587251 - protein, 18 aa, Staphylococcus aureus
NMPLKGYVVRGGREMENH

SEQ ID NO: 1587252 - protein, 21 aa, Staphylococcus aureus
NNRKSEALQRLDQLTHLNNAQ

SEQ ID NO: 1587253 - protein, 17 aa, Staphylococcus aureus
NQPKVRIFEYLGNNEDI

SEQ ID NO: 1587254 - protein, 21 aa, Staphylococcus aureus
NRIYYEHPNVASIKFGDITKT

SEQ ID NO: 1587255 - protein, 17 aa, Staphylococcus aureus
NRNFRFFQIFTAALQSF

SEQ ID NO: 1587256 - protein, 21 aa, Staphylococcus aureus
NYAEFFICIVLSLGVVAPIKN

SEQ ID NO: 1587257 - protein, 17 aa, Staphylococcus aureus
PALDCPIVFPYAQNAVL

SEQ ID NO: 1587258 - protein, 25 aa, Staphylococcus aureus
PALYPNYWGGNKFKVIEELRKQGYN

SEQ ID NO: 1587259 - protein, 17 aa, Staphylococcus aureus
PEKVSVNLLANGEKVKA

SEQ ID NO: 1587260 - protein, 21 aa, Staphylococcus aureus
PKRLNTRMRMAAVQPSSTDSK

SEQ ID NO: 1587261 - protein, 39 aa, Staphylococcus aureus
PNSKGDLALRSTLYGYNSNIIWRSMSWDNEVAFNNGSGS

SEQ ID NO: 1587262 - protein, 18 aa, Staphylococcus aureus
PNTKSNALIDAKNTDIKV

SEQ ID NO: 1587263 - protein, 18 aa, Staphylococcus aureus
PVTNRDYSIFGWNNENVV

SEQ ID NO: 1587264 - protein, 29 aa, Staphylococcus aureus
QIVTFAGIYFKLGDLMSLFTLQSNDSQNM

SEQ ID NO: 1587265 - protein, 24 aa, Staphylococcus aureus
QSKLIPIFICIFTFLLMVIQSQFL

SEQ ID NO: 1587266 - protein, 17 aa, Staphylococcus aureus
RGILMLVVLVVFWIVGK

SEQ ID NO: 1587267 - protein, 27 aa, Staphylococcus aureus
RKKGGMAKVLLPLIAAVLIIGALAIFG

SEQ ID NO: 1587268 - protein, 17 aa, Staphylococcus aureus
RRYGWDGFKRAGDYAYA

SEQ ID NO: 1587269 - protein, 18 aa, Staphylococcus aureus
RSFYSIRKSILGVASVIV

SEQ ID NO: 1587270 - protein, 26 aa, Staphylococcus aureus
RVTLKYKWKFEDGIKPGDYFDFTLSN

SEQ ID NO: 1587271 - protein, 20 aa, Staphylococcus aureus
SFPERRWVYILALSSSALCG

SEQ ID NO: 1587272 - protein, 25 aa, Staphylococcus aureus
SIEGTKHLPLLFAKRRRKEDEEDAI

SEQ ID NO: 1587273 - protein, 19 aa, Staphylococcus aureus
SNLTWKNGVAFYSNNAQGD

SEQ ID NO: 1587274 - protein, 18 aa, Staphylococcus aureus
SRLNNILTILSIVLAIIH

SEQ ID NO: 1587275 - protein, 21 aa, Staphylococcus aureus
SVRTRAVRSLAVAEPVVNAAD

SEQ ID NO: 1587276 - protein, 19 aa, Staphylococcus aureus
TADVAWAFGDLGVGLMAWL

SEQ ID NO: 1587277 - protein, 25 aa, Staphylococcus aureus
TAPVKLRTFSRLAMSTFASAATTTA

SEQ ID NO: 1587278 - protein, 17 aa, Staphylococcus aureus
TIEVGKTMNPIVLTTTD

SEQ ID NO: 1587279 - protein, 24 aa, Staphylococcus aureus
TINKRINFIFGVIIFIFAVLVLRL

SEQ ID NO: 1587280 - protein, 25 aa, Staphylococcus aureus
TKDDVKATLTVPAYIDPEYVTHTGN

SEQ ID NO: 1587281 - protein, 44 aa, Staphylococcus aureus
TRVRLYKSGKNWVKSGIKEIEMFKIMGLPFISHSIVSQDNQSIS

SEQ ID NO: 1587282 - protein, 19 aa, Staphylococcus aureus
VAIGMGFVSWIKRTKNTAI

SEQ ID NO: 1587283 - protein, 24 aa, Staphylococcus aureus
VDTGLSIPTIYAFKKSLDALPNKK

SEQ ID NO: 1587284 - protein, 18 aa, Staphylococcus aureus
VGAFRFLIPIILAVSNFM

SEQ ID NO: 1587285 - protein, 19 aa, Staphylococcus aureus
VKDYGSGMTPFYTALSVWV

SEQ ID NO: 1587286 - protein, 33 aa, Staphylococcus aureus
VKNNLRYGIRKHKLGAASVFLGTMIVVGMGQDK

SEQ ID NO: 1587287 - protein, 19 aa, Staphylococcus aureus
VKSGDYFTAKLPDSLTGNG

SEQ ID NO: 1587288 - protein, 25 aa, Staphylococcus aureus
VNTSAPRMRAFSLSAVAADAPAAGK

SEQ ID NO: 1587289 - protein, 17 aa, Staphylococcus aureus
VTIDSGTTVYPHQAGYV

SEQ ID NO: 1587290 - protein, 17 aa, Staphylococcus aureus
VTNRDYSIFGWNNENVV

SEQ ID NO: 1587291 - protein, 17 aa, Staphylococcus aureus
VVLLLIGGIAWGVYAFF

SEQ ID NO: 1587292 - protein, 18 aa, Staphylococcus aureus
VVSGGMFLAMKWEQIHLK

SEQ ID NO: 1587293 - protein, 25 aa, Staphylococcus aureus
WFDLGRPDIWITIIAGVLYFIQAYV

SEQ ID NO: 1587294 - protein, 19 aa, Staphylococcus aureus
WPTVHIYSLEDLSRASDYF

SEQ ID NO: 1587295 - protein, 23 aa, Staphylococcus aureus
WSTAQRMIITWVITLLISALLAG

SEQ ID NO: 1587296 - protein, 20 aa, Staphylococcus aureus
YCLGAVFFYFWGVFLYNSLH

SEQ ID NO: 1587297 - protein, 23 aa, Staphylococcus aureus
YFIVCLLISFLALISMNIRILSG

SEQ ID NO: 1587298 - protein, 25 aa, Staphylococcus aureus
YGYYYYYPVSLTWDNGVAFYSNNAQ

SEQ ID NO: 1587299 - protein, 19 aa, Staphylococcus aureus
YIMLIDWRMACALLVTIPI

SEQ ID NO: 1587300 - protein, 17 aa, Staphylococcus aureus
YLVAIIACMIWYFNKAH

SEQ ID NO: 1587301 - protein, 23 aa, Staphylococcus aureus
YMLSGGMLQRLMIALALALKPKL

SEQ ID NO: 1587302 - protein, 17 aa, Staphylococcus aureus
YRGGPAYYIEYGIGGKF

SEQ ID NO: 1587303 - protein, 17 aa, Staphylococcus aureus
YRIQPHIGLTIHESTNK

SEQ ID NO: 1587304 - protein, 17 aa, Staphylococcus aureus
YSIRRFTVGTTSVIVGA

SEQ ID NO: 1587305 - protein, 21 aa, Staphylococcus aureus
ACLYPNFILDFIFIIIMLFLV

SEQ ID NO: 1587306 - protein, 22 aa, Staphylococcus aureus
AEKRSNVHLVDWYKASEGHPEY

SEQ ID NO: 1587307 - protein, 18 aa, Staphylococcus aureus
AFFIFPVIIMFLLAPDLN

SEQ ID NO: 1587308 - protein, 18 aa, Staphylococcus aureus
AFFTFPVIVMFLLAPDLN

SEQ ID NO: 1587309 - protein, 17 aa, Staphylococcus aureus
AFIGILVYLWKTNENFR

SEQ ID NO: 1587310 - protein, 19 aa, Staphylococcus aureus
AGILRLFGVIALMLVVVSP

SEQ ID NO: 1587311 - protein, 24 aa, Staphylococcus aureus
AGQTWTRNISDWIAKSGTTNFSLS

SEQ ID NO: 1587312 - protein, 18 aa, Staphylococcus aureus
AIGYKFLSKRSMYLTIPV

SEQ ID NO: 1587313 - protein, 18 aa, Staphylococcus aureus
AKVPPIMAGDQVLANGVI

SEQ ID NO: 1587314 - protein, 19 aa, Staphylococcus aureus
ALCGLFIQHLSTFNMKYYL

SEQ ID NO: 1587315 - protein, 17 aa, Staphylococcus aureus
AMKALKESIKDQPQTEA

SEQ ID NO: 1587316 - protein, 23 aa, Staphylococcus aureus
APRGEFLHMLLGVFLAALVSFVV

SEQ ID NO: 1587317 - protein, 17 aa, Staphylococcus aureus
AQLYLSPYGPKQYVEHL

SEQ ID NO: 1587318 - protein, 18 aa, Staphylococcus aureus
AREFKWRLPDKITIRNSA

SEQ ID NO: 1587319 - protein, 18 aa, Staphylococcus aureus
ARRVCWFGSALVTIIIGI

SEQ ID NO: 1587320 - protein, 27 aa, Staphylococcus aureus
ARTGSPIRLMIGFDYPDAFGNGETLVP

SEQ ID NO: 1587321 - protein, 18 aa, Staphylococcus aureus
ASLGSLLLFRRKKENKDK

SEQ ID NO: 1587322 - protein, 29 aa, Staphylococcus aureus
AVGIGGLSNAFGFKLDTYHNTSKPNSAAK

SEQ ID NO: 1587323 - protein, 21 aa, Staphylococcus aureus
AYSQKGAITLGTRIDSNKSFH

SEQ ID NO: 1587324 - protein, 17 aa, Staphylococcus aureus
CGVALMLFISWLGLFLF

SEQ ID NO: 1587325 - protein, 20 aa, Staphylococcus aureus
CLYPNFILDFIFIIIMLFLV

SEQ ID NO: 1587326 - protein, 27 aa, Staphylococcus aureus
CSMMVVFSIMLFLFVKRNKKKNKNESQ

SEQ ID NO: 1587327 - protein, 21 aa, Staphylococcus aureus
DDVKATLTMPAYIDPENVTKT

SEQ ID NO: 1587328 - protein, 24 aa, Staphylococcus aureus
DEANTSLIWGLLASIGSLLLFRRK

SEQ ID NO: 1587329 - protein, 23 aa, Staphylococcus aureus
DEANTSLIWGLLASLGSLLLFRR

SEQ ID NO: 1587330 - protein, 17 aa, Staphylococcus aureus
DGEDFKRPSSVSGSIPS

SEQ ID NO: 1587331 - protein, 17 aa, Staphylococcus aureus
DHIKISLFIAMLLACLL

SEQ ID NO: 1587332 - protein, 20 aa, Staphylococcus aureus
DIELKNLLLYGIFDESIFLK

SEQ ID NO: 1587333 - protein, 25 aa, Staphylococcus aureus
DIPLDPSALVYLVIPTSQTRDGGSE

SEQ ID NO: 1587334 - protein, 36 aa, Staphylococcus aureus
DKERKKGGMAKVLLPLIAAVLIIGALAIFGGMALNN

SEQ ID NO: 1587335 - protein, 42 aa, Staphylococcus aureus
DPNSKGDLALRSTLYGYDSRFVWRSMSWDNEVAFNNGSGSGD

SEQ ID NO: 1587336 - protein, 17 aa, Staphylococcus aureus
DRVTLKVAFILPIILIS

SEQ ID NO: 1587337 - protein, 21 aa, Staphylococcus aureus
DSGKYKVIFEKPAGLKQTGTN

SEQ ID NO: 1587338 - protein, 17 aa, Staphylococcus aureus
DSIKQNGLLGGVMTLLV

SEQ ID NO: 1587339 - protein, 17 aa, Staphylococcus aureus
DTEDFYITLKIIDVKQP

SEQ ID NO: 1587340 - protein, 17 aa, Staphylococcus aureus
EALKAQVTSAGRVSVAN

SEQ ID NO: 1587341 - protein, 24 aa, Staphylococcus aureus
EALKRAFLIMCLIGFGVGILANAG

SEQ ID NO: 1587342 - protein, 26 aa, Staphylococcus aureus
EDEANTSLIWGLLASIGSLLLFRRKK

SEQ ID NO: 1587343 - protein, 29 aa, Staphylococcus aureus
EGDIFTFKYGQYFRPGSVRLPSQTQNLYN

SEQ ID NO: 1587344 - protein, 17 aa, Staphylococcus aureus
EGYPEWVIPTDPARKNE

SEQ ID NO: 1587345 - protein, 19 aa, Staphylococcus aureus
EIRAKIAILSLAFLVHCFL

SEQ ID NO: 1587346 - protein, 17 aa, Staphylococcus aureus
EKKREFNPDLKPGEEKV

SEQ ID NO: 1587347 - protein, 20 aa, Staphylococcus aureus
EKLYKIGDYVWEDVDKDGVQ

SEQ ID NO: 1587348 - protein, 25 aa, Staphylococcus aureus
EKQALKYRINQILQQGHNDINNALT

SEQ ID NO: 1587349 - protein, 30 aa, Staphylococcus aureus; identical to SEQ ID NO: 1582301

SEQ ID NO: 1587350 - protein, 18 aa, Staphylococcus aureus
ETAKRALASYSNLNNAQS

SEQ ID NO: 1587351 - protein, 24 aa, Staphylococcus aureus
ETGELIFKFYRHCFRYNEINLKIQ

SEQ ID NO: 1587352 - protein, 24 aa, Staphylococcus aureus
ETVAFTKERVEGFLNKSKNEQATL

SEQ ID NO: 1587353 - protein, 17 aa, Staphylococcus aureus
EVIKLSVSIGVGYLTDN

SEQ ID NO: 1587354 - protein, 20 aa, Staphylococcus aureus
FDMLLCLPIHKCVNLFYTFV

SEQ ID NO: 1587355 - protein, 21 aa, Staphylococcus aureus
FEMQESIALFSQWEKSGVNTE

SEQ ID NO: 1587356 - protein, 20 aa, Staphylococcus aureus
FEYTESAVTQVRYVDVTTGK

SEQ ID NO: 1587357 - protein, 19 aa, Staphylococcus aureus
FGRKEQLFEIRVKPHTPRI

SEQ ID NO: 1587358 - protein, 18 aa, Staphylococcus aureus
FGRQTFEYINGERPTESP

SEQ ID NO: 1587359 - protein, 18 aa, Staphylococcus aureus
FHFSGKVNLGNKYEGNGN

SEQ ID NO: 1587360 - protein, 24 aa, Staphylococcus aureus
FIAKHKWSALIAWVIIVAAIFIPI

SEQ ID NO: 1587361 - protein, 17 aa, Staphylococcus aureus
FICLILIIVFYIIGMNI

SEQ ID NO: 1587362 - protein, 18 aa, Staphylococcus aureus
FIFLLLLFFRYILKRYFN

SEQ ID NO: 1587363 - protein, 17 aa, Staphylococcus aureus
FIKPLWQYHCRFYQIDQ

SEQ ID NO: 1587364 - protein, 23 aa, Staphylococcus aureus
FKAQLKAANPFAKELENRKKAAI

SEQ ID NO: 1587365 - protein, 17 aa, Staphylococcus aureus
FKGNAPYIFAHRGGMVL

SEQ ID NO: 1587366 - protein, 20 aa, Staphylococcus aureus
FKIAVVVAVMLLAFISLMEA

SEQ ID NO: 1587367 - protein, 19 aa, Staphylococcus aureus
FKLDIKWPFLLSELGIVLL

SEQ ID NO: 1587368 - protein, 20 aa, Staphylococcus aureus
FKRKGAELANFYTGIINDLL

SEQ ID NO: 1587369 - protein, 17 aa, Staphylococcus aureus
FLIFNFVNSILFDNPFD

SEQ ID NO: 1587370 - protein, 17 aa, Staphylococcus aureus
FLIPIILAVSNFMGGGL

SEQ ID NO: 1587371 - protein, 19 aa, Staphylococcus aureus
FLLLPARWFTGLVTEKTVD

SEQ ID NO: 1587372 - protein, 17 aa, Staphylococcus aureus
FLSKRSMYLTIPVTILI

SEQ ID NO: 1587373 - protein, 21 aa, Staphylococcus aureus
FMQFNCFICLILIIVFYIIGM

SEQ ID NO: 1587374 - protein, 17 aa, Staphylococcus aureus
FRPGSVRLPSQTQNLYN

SEQ ID NO: 1587375 - protein, 18 aa, Staphylococcus aureus
FSAFSFICLSIFIITTLI

SEQ ID NO: 1587376 - protein, 19 aa, Staphylococcus aureus
FSAYRAWQMRHGKIILRKS

SEQ ID NO: 1587377 - protein, 24 aa, Staphylococcus aureus
FYKTPKYSLGDYVWYDSNKDGKQD

SEQ ID NO: 1587378 - protein, 20 aa, Staphylococcus aureus
FYVICCIIGYLFFGLGLGIY

SEQ ID NO: 1587379 - protein, 18 aa, Staphylococcus aureus
GADGWGFLFSKGDGNEYL

SEQ ID NO: 1587380 - protein, 19 aa, Staphylococcus aureus
GAFIGVLVYLWKTNENFRN

SEQ ID NO: 1587381 - protein, 17 aa, Staphylococcus aureus
GASAFTIDHVVKSNSTH

SEQ ID NO: 1587382 - protein, 19 aa, Staphylococcus aureus
GDWRGVWDAIIMILKGVVQ

SEQ ID NO: 1587383 - protein, 17 aa, Staphylococcus aureus
GDYRVEFSNLPQGYEVT

SEQ ID NO: 1587384 - protein, 23 aa, Staphylococcus aureus
GFILRLLGPLGLHHIFYLPFWQT

SEQ ID NO: 1587385 - protein, 17 aa, Staphylococcus aureus
GGIFAFLRTKIASLVKL

SEQ ID NO: 1587386 - protein, 26 aa, Staphylococcus aureus
GGVMTLLVGLGLMKRKKKKDENEQDD

SEQ ID NO: 1587387 - protein, 17 aa, Staphylococcus aureus
GHGNGGDGIGFAFSPGV

SEQ ID NO: 1587388 - protein, 29 aa, Staphylococcus aureus
GHGNGGDGIGFAFSPGVLGETGLNGAAVG

SEQ ID NO: 1587389 - protein, 22 aa, Staphylococcus aureus
GIHEIYFPYVLMRPLLFIAVIL

SEQ ID NO: 1587390 - protein, 18 aa, Staphylococcus aureus
GKKLFFFLWDFVIFVFNV

SEQ ID NO: 1587391 - protein, 21 aa, Staphylococcus aureus
GLAPFTILFSLPFTVIGVIIA

SEQ ID NO: 1587392 - protein, 24 aa, Staphylococcus aureus
GMISNRLNKFSIRKYTVGTASILV

SEQ ID NO: 1587393 - protein, 19 aa, Staphylococcus aureus
GMKIITSWITWVFIGILGL

SEQ ID NO: 1587394 - protein, 23 aa, Staphylococcus aureus
GNFLRRSCFVLFSLQIIWFTVEL

SEQ ID NO: 1587395 - protein, 26 aa, Staphylococcus aureus
GNGGDGIGFAFSPGVLGETGLNGAAV

SEQ ID NO: 1587396 - protein, 27 aa, Staphylococcus aureus
GSEGEANMSLIWGLLASLGSLLLFRRK

SEQ ID NO: 1587397 - protein, 17 aa, Staphylococcus aureus
GTTNFSLSMTASTGGAT

SEQ ID NO: 1587398 - protein, 20 aa, Staphylococcus aureus
HASMTFGLIFLFSEEIGDLF

SEQ ID NO: 1587399 - protein, 20 aa, Staphylococcus aureus
HGNFKVKFFVSLIFAIPIIL

SEQ ID NO: 1587400 - protein, 20 aa, Staphylococcus aureus
HLLLELAVIFGISALVTSFL

SEQ ID NO: 1587401 - protein, 17 aa, Staphylococcus aureus
IAILIGFVWFKLYQYTT

SEQ ID NO: 1587402 - protein, 23 aa, Staphylococcus aureus
IAKHKWSAVIAWIVIVAAILIPL

SEQ ID NO: 1587403 - protein, 20 aa, Staphylococcus aureus
IALMLKWWLILAISIIVLII

SEQ ID NO: 1587404 - protein, 29 aa, Staphylococcus aureus
IDPLHMRHFGVRIGNVIKNALGVVGISGL

SEQ ID NO: 1587405 - protein, 18 aa, Staphylococcus aureus
IDSNKSFHFSGKVNLGNK

SEQ ID NO: 1587406 - protein, 23 aa, Staphylococcus aureus
IEGTKHLPLLFAKRRRKEDEEDV

SEQ ID NO: 1587407 - protein, 17 aa, Staphylococcus aureus
IGALAIFGGMALNNHNN

SEQ ID NO: 1587408 - protein, 17 aa, Staphylococcus aureus
IIFSFRAVFETLLLIGV

SEQ ID NO: 1587409 - protein, 21 aa, Staphylococcus aureus
IIKLYFRIIIAYLKDDDGIID

SEQ ID NO: 1587410 - protein, 25 aa, Staphylococcus aureus
IITMVLCGFLFPLAITLIGQLFFYQ

SEQ ID NO: 1587411 - protein, 24 aa, Staphylococcus aureus
IIYRTELLPSLYLYLYLKNNNDFK

SEQ ID NO: 1587412 - protein, 17 aa, Staphylococcus aureus
IKISLFIAMLLACLLIQ

SEQ ID NO: 1587413 - protein, 20 aa, Staphylococcus aureus
IKQNGLLGGVMTLLVGLGLM

SEQ ID NO: 1587414 - protein, 18 aa, Staphylococcus aureus
IKVWKLIQFISFFPTISS

SEQ ID NO: 1587415 - protein, 17 aa, Staphylococcus aureus
ILTILPWLIGALIATIF

SEQ ID NO: 1587416 - protein, 21 aa, Staphylococcus aureus
ILTKTYTFVFTDYVNDKQNIN

SEQ ID NO: 1587417 - protein, 22 aa, Staphylococcus aureus
INANRDAISFAEGDISVTNTPN

SEQ ID NO: 1587418 - protein, 22 aa, Staphylococcus aureus
INGKFSLPLFTDRAKAPKSGTY

SEQ ID NO: 1587419 - protein, 17 aa, Staphylococcus aureus
INMLFVILVLYIIGIAF

SEQ ID NO: 1587420 - protein, 17 aa, Staphylococcus aureus
IPLFASVIVVLAFFLLM

SEQ ID NO: 1587421 - protein, 17 aa, Staphylococcus aureus
IPTWLGALIMTLAIYIT

SEQ ID NO: 1587422 - protein, 20 aa, Staphylococcus aureus
IPYKLLANFLNEFDKNVDKI

SEQ ID NO: 1587423 - protein, 18 aa, Staphylococcus aureus
IRFLKLKVGKIINVAKVD

SEQ ID NO: 1587424 - protein, 25 aa, Staphylococcus aureus
IRKHKLGAASVFLGTMIVVGMGQDK

SEQ ID NO: 1587425 - protein, 19 aa, Staphylococcus aureus
IRNTHVWEVDEQPAVNEIF

SEQ ID NO: 1587426 - protein, 17 aa, Staphylococcus aureus
ISRLGTVFFLFVFNIGI

SEQ ID NO: 1587427 - protein, 19 aa, Staphylococcus aureus
IVAFCMFNYLSSILWVVCG

SEQ ID NO: 1587428 - protein, 18 aa, Staphylococcus aureus
IVLMGVWFIFNSLIALIA

SEQ ID NO: 1587429 - protein, 20 aa, Staphylococcus aureus
IVSFCFIFLLLLFFRYILKR

SEQ ID NO: 1587430 - protein, 18 aa, Staphylococcus aureus
IVTKRFHTVVAIAIIPFH

SEQ ID NO: 1587431 - protein, 17 aa, Staphylococcus aureus
KDFVVSFITGALVGSAL

SEQ ID NO: 1587432 - protein, 18 aa, Staphylococcus aureus
KDRPVVFKLQAMDTMTSF

SEQ ID NO: 1587433 - protein, 20 aa, Staphylococcus aureus
KEFWPVYLIVTAIAIVVPCI

SEQ ID NO: 1587434 - protein, 23 aa, Staphylococcus aureus
KEGIKALNWRSSYIPQFIRMVIV

SEQ ID NO: 1587435 - protein, 24 aa, Staphylococcus aureus
KELAKRKQEAISRIKDFSNEKMNS

SEQ ID NO: 1587436 - protein, 26 aa, Staphylococcus aureus
KGHAPHENMIYWFALPAGQTPVGRTE

SEQ ID NO: 1587437 - protein, 23 aa, Staphylococcus aureus
KGLKFKIAFNFGLPLVIALSHAY

SEQ ID NO: 1587438 - protein, 17 aa, Staphylococcus aureus
KILDEFISSNSFPEDEV

SEQ ID NO: 1587439 - protein, 18 aa, Staphylococcus aureus
KISYKYDNVASINFGDIN

SEQ ID NO: 1587440 - protein, 21 aa, Staphylococcus aureus
KITGYGLKTTAVIGGAFTVNM

SEQ ID NO: 1587441 - protein, 23 aa, Staphylococcus aureus
KITYKYQNVASINFGDINKTYVV

SEQ ID NO: 1587442 - protein, 19 aa, Staphylococcus aureus
KKGDTMTINYDKNVIPSDL

SEQ ID NO: 1587443 - protein, 18 aa, Staphylococcus aureus
KKLQIVFHILEIKLHAAC

SEQ ID NO: 1587444 - protein, 19 aa, Staphylococcus aureus
KKNGSLAISGRVSMNQAYN

SEQ ID NO: 1587445 - protein, 19 aa, Staphylococcus aureus
KLESFFGIEMMFLGNTEAL

SEQ ID NO: 1587446 - protein, 20 aa, Staphylococcus aureus
KMTGYGLKTTAVIGGAFTVN

SEQ ID NO: 1587447 - protein, 17 aa, Staphylococcus aureus
KNKWPFLIALPFMIGYG

SEQ ID NO: 1587448 - protein, 17 aa, Staphylococcus aureus
KPWPKFLTLFAGPLFNF

SEQ ID NO: 1587449 - protein, 17 aa, Staphylococcus aureus
KRLKAGKVYKKDRLDVA

SEQ ID NO: 1587450 - protein, 17 aa, Staphylococcus aureus
KRNKFRLVIEIVILELI

SEQ ID NO: 1587451 - protein, 17 aa, Staphylococcus aureus
KSLLKRRLINIKEGNLK

SEQ ID NO: 1587452 - protein, 18 aa, Staphylococcus aureus
KTKYSWSNSYSNVNGSST

SEQ ID NO: 1587453 - protein, 19 aa, Staphylococcus aureus
KVTIDSGTTVYPHQAGYVK

SEQ ID NO: 1587454 - protein, 21 aa, Staphylococcus aureus
KVTRYDLISVLPFGNTIAQID

SEQ ID NO: 1587455 - protein, 22 aa, Staphylococcus aureus
LAEEKGRVIGMAKLKTVKEQEK

SEQ ID NO: 1587456 - protein, 17 aa, Staphylococcus aureus
LAFIFSAYRAWQMRHGK

SEQ ID NO: 1587457 - protein, 19 aa, Staphylococcus aureus
LAISGRVSMNQAYNSDITF

SEQ ID NO: 1587458 - protein, 17 aa, Staphylococcus aureus
LAKRKQEAISRIKDFSN

SEQ ID NO: 1587459 - protein, 19 aa, Staphylococcus aureus
LAVMGFASAISVIFAVFSA

SEQ ID NO: 1587460 - protein, 21 aa, Staphylococcus aureus
LCALALICVIVFYFNLNRKLK

SEQ ID NO: 1587461 - protein, 18 aa, Staphylococcus aureus
LCGNFQFGLLVATGTLAH

SEQ ID NO: 1587462 - protein, 34 aa, Staphylococcus aureus
LELSVPLISLFGVCIITILLLCSSVILLTNHQHR

SEQ ID NO: 1587463 - protein, 17 aa, Staphylococcus aureus
LEYIYRLILKYLLWYIK

SEQ ID NO: 1587464 - protein, 17 aa, Staphylococcus aureus
LFISWLGLFLFYKNKFD

SEQ ID NO: 1587465 - protein, 27 aa, Staphylococcus aureus
LGGVMTLLVGLGLMKRKKKKDENEQDD

SEQ ID NO: 1587466 - protein, 24 aa, Staphylococcus aureus
LGLKTASTWKKFEVYEGDKKLPVE

SEQ ID NO: 1587467 - protein, 17 aa, Staphylococcus aureus
LIVAVAFFFGLKTYQGH

SEQ ID NO: 1587468 - protein, 22 aa, Staphylococcus aureus
LIVLCFIGFIGIAAFYIYLNKK

SEQ ID NO: 1587469 - protein, 18 aa, Staphylococcus aureus
LKAANPFAKELEKRKKSA

SEQ ID NO: 1587470 - protein, 20 aa, Staphylococcus aureus
LKDNEHSPLLFAKRRKDKEE

SEQ ID NO: 1587471 - protein, 18 aa, Staphylococcus aureus
LKKLEGMLDFPMLSTNVY

SEQ ID NO: 1587472 - protein, 19 aa, Staphylococcus aureus
LKLKVGKIINVAKVDIIAF

SEQ ID NO: 1587473 - protein, 17 aa, Staphylococcus aureus
LKYSFGHIINSKIFAQE

SEQ ID NO: 1587474 - protein, 17 aa, Staphylococcus aureus
LNAKYYRGDEVSFTMGV

SEQ ID NO: 1587475 - protein, 18 aa, Staphylococcus aureus
LNEAMKALKESIKDQPQT

SEQ ID NO: 1587476 - protein, 19 aa, Staphylococcus aureus
LNMTFNYCKKRVWSYDMDR

SEQ ID NO: 1587477 - protein, 22 aa, Staphylococcus aureus
LNNRKSEALQRLDQLTHLNNAQ

SEQ ID NO: 1587478 - protein, 21 aa, Staphylococcus aureus
LPEIQHNIKFFKNDDGQNIAD

SEQ ID NO: 1587479 - protein, 29 aa, Staphylococcus aureus
LPKAGVTIKEHWLPISVIVGAMGVLMIWL

SEQ ID NO: 1587480 - protein, 17 aa, Staphylococcus aureus
LPSGLTFDSTNNTISGT

SEQ ID NO: 1587481 - protein, 21 aa, Staphylococcus aureus
LPWKVCLYIGIALGIIVTIFL

SEQ ID NO: 1587482 - protein, 18 aa, Staphylococcus aureus
LRFLIPKLHFCVEKINQL

SEQ ID NO: 1587483 - protein, 18 aa, Staphylococcus aureus
LRGILMLVVLVVFWIVGK

SEQ ID NO: 1587484 - protein, 17 aa, Staphylococcus aureus
LRTSTSLSDSVSMSTSG

SEQ ID NO: 1587485 - protein, 17 aa, Staphylococcus aureus
LSIFIFIMGFKMLGVSI

SEQ ID NO: 1587486 - protein, 20 aa, Staphylococcus aureus
MASFGWRIPFLLGLFLGLFG

SEQ ID NO: 1587487 - protein, 18 aa, Staphylococcus aureus
MDGFKIAVVVAVMLLAFI

SEQ ID NO: 1587488 - protein, 24 aa, Staphylococcus aureus
MGYLKRFALYISVMILIFAIAGCG

SEQ ID NO: 1587489 - protein, 25 aa, Staphylococcus aureus
MGYLKRLSWYISILILIVVIAGCGK

SEQ ID NO: 1587490 - protein, 19 aa, Staphylococcus aureus
MKNKWPFLIALPFMICYGI

SEQ ID NO: 1587491 - protein, 24 aa, Staphylococcus aureus
MLKGLLLKITFNFGLPLLVAILHA

SEQ ID NO: 1587492 - protein, 19 aa, Staphylococcus aureus
MNRIIKLVEELLELTKGDV

SEQ ID NO: 1587493 - protein, 19 aa, Staphylococcus aureus
MRTTDKYGYYNYAGYSNFI

SEQ ID NO: 1587494 - protein, 23 aa, Staphylococcus aureus
NGQENLYRIAIQYYGSGSPENVE

SEQ ID NO: 1587495 - protein, 22 aa, Staphylococcus aureus
NGVIKARSSITMNNVTYTTQDE

SEQ ID NO: 1587496 - protein, 19 aa, Staphylococcus aureus
NIPTWLGALIMTLAIYITL

SEQ ID NO: 1587497 - protein, 18 aa, Staphylococcus aureus
NIPTWLGALIMTLAIYVT

SEQ ID NO: 1587498 - protein, 19 aa, Staphylococcus aureus
NLPFQFTFPGSEWVVLILS

SEQ ID NO: 1587499 - protein, 26 aa, Staphylococcus aureus
NNGMLFGGLFSILGLALLRRNKKNHK

SEQ ID NO: 1587500 - protein, 30 aa, Staphylococcus aureus
NNMNFLRWVNFPQDYTVTWTNAKIANRPTD

SEQ ID NO: 1587501 - protein, 19 aa, Staphylococcus aureus
NRIYYEHPNVASIKFGDIT

SEQ ID NO: 1587502 - protein, 26 aa, Staphylococcus aureus
NRIYYEHPNVASIKFGDITKTYVVLV

SEQ ID NO: 1587503 - protein, 17 aa, Staphylococcus aureus
NRLSFKGQIFFVSIDSM

SEQ ID NO: 1587504 - protein, 20 aa, Staphylococcus aureus
NTNAFRPGGVNPLNEYQLSQ

SEQ ID NO: 1587505 - protein, 24 aa, Staphylococcus aureus
NTSAPRMRAFSLAAVAADAPAAGK

SEQ ID NO: 1587506 - protein, 18 aa, Staphylococcus aureus
NVFPVLSPILGWIGVFMT

SEQ ID NO: 1587507 - protein, 24 aa, Staphylococcus aureus
PFLIALPFMIGYGIGITIYYQRKV

SEQ ID NO: 1587508 - protein, 20 aa, Staphylococcus aureus
PIFQFSVAELIGWIITHIFF

SEQ ID NO: 1587509 - protein, 20 aa, Staphylococcus aureus
PKIIGGIGWLLAKVTRQPKL

SEQ ID NO: 1587510 - protein, 18 aa, Staphylococcus aureus
PKVRKARSVDEGSFDITR

SEQ ID NO: 1587511 - protein, 20 aa, Staphylococcus aureus
PLPNRKDFVVSFITGALVGS

SEQ ID NO: 1587512 - protein, 23 aa, Staphylococcus aureus
PNGEIKARSSISMNNVTYTTQDE

SEQ ID NO: 1587513 - protein, 17 aa, Staphylococcus aureus
PSGLSYDSATNSIIGTP

SEQ ID NO: 1587514 - protein, 21 aa, Staphylococcus aureus
PYGDYWFAYFMRRLAERPQNL

SEQ ID NO: 1587515 - protein, 19 aa, Staphylococcus aureus
QALDHAMELLRNSVADNQA

SEQ ID NO: 1587516 - protein, 19 aa, Staphylococcus aureus
QDYLELKSQIKVDDKVKSG

SEQ ID NO: 1587517 - protein, 24 aa, Staphylococcus aureus
QFKAQLKAANPFAKELKNRKKAAI

SEQ ID NO: 1587518 - protein, 17 aa, Staphylococcus aureus
QGKEHFEGYGSVDIQSN

SEQ ID NO: 1587519 - protein, 17 aa, Staphylococcus aureus
QGLTLDRQPAFTTLHGA

SEQ ID NO: 1587520 - protein, 24 aa, Staphylococcus aureus
QHLRPKISATFLAWLLIFLMFALP

SEQ ID NO: 1587521 - protein, 29 aa, Staphylococcus aureus
QIVTFAGIYFKLGDLMSLFSLQSNDSQNM

SEQ ID NO: 1587522 - protein, 17 aa, Staphylococcus aureus
QKLARDQLQAVTTVNAL

SEQ ID NO: 1587523 - protein, 18 aa, Staphylococcus aureus
QKNLKILIILPLLFLIIS

SEQ ID NO: 1587524 - protein, 18 aa, Staphylococcus aureus
QMHRYGVVEWKGRQYSIS

SEQ ID NO: 1587525 - protein, 18 aa, Staphylococcus aureus
QNAQRMNFQFTNSYGPSK

SEQ ID NO: 1587526 - protein, 23 aa, Staphylococcus aureus
QSKLILIFICIFTFFIMIIQSQF

SEQ ID NO: 1587527 - protein, 21 aa, Staphylococcus aureus
QTGFKSWMIWAIEPSMLRIGL

SEQ ID NO: 1587528 - protein, 22 aa, Staphylococcus aureus
QTIEVGKTMNLIVLTTTDNGTG

SEQ ID NO: 1587529 - protein, 19 aa, Staphylococcus aureus
QTIEVGKTMNPIVLTTTDN

SEQ ID NO: 1587530 - protein, 25 aa, Staphylococcus aureus
QVFETARGVLYPGVSDMYDAKQYVK

SEQ ID NO: 1587531 - protein, 17 aa, Staphylococcus aureus
RANGLSGNNIRNGQQIV

SEQ ID NO: 1587532 - protein, 17 aa, Staphylococcus aureus
RCINMLFVILVLYIIGI

SEQ ID NO: 1587533 - protein, 18 aa, Staphylococcus aureus
RDQLQAVTTVNALPNLNH

SEQ ID NO: 1587534 - protein, 19 aa, Staphylococcus aureus
RDYSIFGWNNENVVRYGGG

SEQ ID NO: 1587535 - protein, 26 aa, Staphylococcus aureus
RGFYKTPKYSLGDYVWYDSNKDGKQD

SEQ ID NO: 1587536 - protein, 23 aa, Staphylococcus aureus
RHKTSEELVRWQTYMETLSENLY

SEQ ID NO: 1587537 - protein, 17 aa, Staphylococcus aureus
RIGACIVGAIFVISYLY

SEQ ID NO: 1587538 - protein, 17 aa, Staphylococcus aureus
RQMTGIWAGIIIIVIAA

SEQ ID NO: 1587539 - protein, 17 aa, Staphylococcus aureus
RTLNRMAVNTVAAPQQG

SEQ ID NO: 1587540 - protein, 25 aa, Staphylococcus aureus
RTWLNKRFGELEIYIGLDAAVALGH

SEQ ID NO: 1587541 - protein, 20 aa, Staphylococcus aureus
RVNDRLTLAINQLVPLADNS

SEQ ID NO: 1587542 - protein, 19 aa, Staphylococcus aureus
SAAIFLYIMLIDWRMACAL

SEQ ID NO: 1587543 - protein, 18 aa, Staphylococcus aureus
SAGFKIDTGYNFKDPMDK

SEQ ID NO: 1587544 - protein, 18 aa, Staphylococcus aureus
SALILAWSLLVSWNQMVA

SEQ ID NO: 1587545 - protein, 21 aa, Staphylococcus aureus
SETLARLGIVLGAFLTTLQMG

SEQ ID NO: 1587546 - protein, 17 aa, Staphylococcus aureus
SEYKEVVPMLALLKSLE

SEQ ID NO: 1587547 - protein, 23 aa, Staphylococcus aureus
SFAKRVFTALGIGIVFGVLLHLA

SEQ ID NO: 1587548 - protein, 24 aa, Staphylococcus aureus
SFKLYRFYFYRLFAIVTWLLFIGS

SEQ ID NO: 1587549 - protein, 17 aa, Staphylococcus aureus
SGDYFTAKLPDSVTGNG

SEQ ID NO: 1587550 - protein, 26 aa, Staphylococcus aureus
SIEGTKHLPLLFAKRRRKEDEEDVEV

SEQ ID NO: 1587551 - protein, 24 aa, Staphylococcus aureus
SKALRWQKWHAMIGIIIAIPVFVL

SEQ ID NO: 1587552 - protein, 23 aa, Staphylococcus aureus
SKALRWQKWHAMIGVIIAIPVFV

SEQ ID NO: 1587553 - protein, 17 aa, Staphylococcus aureus
SKDRTTLIVAHRLSTIT

SEQ ID NO: 1587554 - protein, 24 aa, Staphylococcus aureus
SKRILLKILLTILIIIALFIGIMY

SEQ ID NO: 1587555 - protein, 18 aa, Staphylococcus aureus
SNKFDMLLCLPIHKCVNL

SEQ ID NO: 1587556 - protein, 20 aa, Staphylococcus aureus
SNSMHPSDSMSMHHTHSTST

SEQ ID NO: 1587557 - protein, 18 aa, Staphylococcus aureus
SRKNWIFWILFLNILMLG

SEQ ID NO: 1587558 - protein, 24 aa, Staphylococcus aureus
SSDVLKLKANYTIDDSVKEGDIFT

SEQ ID NO: 1587559 - protein, 17 aa, Staphylococcus aureus
STAKVPPIMAGDQVLAN

SEQ ID NO: 1587560 - protein, 21 aa, Staphylococcus aureus
SWLAIVCSMMVVFSIMLFLFV

SEQ ID NO: 1587561 - protein, 25 aa, Staphylococcus aureus
TALKRLPWLIILTFLGMVTATILGR

SEQ ID NO: 1587562 - protein, 26 aa, Staphylococcus aureus
TAPIKLRTFSRLAMSTFASAATTSAV

SEQ ID NO: 1587563 - protein, 18 aa, Staphylococcus aureus
TAVIGGAFTINMLHDQQA

SEQ ID NO: 1587564 - protein, 17 aa, Staphylococcus aureus
TDFAPLIAAIICIVIFK

SEQ ID NO: 1587565 - protein, 26 aa, Staphylococcus aureus
TDTKLRIFEVNDISKLSDSYYADPND

SEQ ID NO: 1587566 - protein, 19 aa, Staphylococcus aureus
TFMAANFTVTGQVKSGDYF

SEQ ID NO: 1587567 - protein, 22 aa, Staphylococcus aureus
TGDGYQWVIKFNKGHAPHENMI

SEQ ID NO: 1587568 - protein, 30 aa, Staphylococcus aureus
TGETTSSLSWWGLYALLGMLALFIPKFRKE

SEQ ID NO: 1587569 - protein, 21 aa, Staphylococcus aureus
TIRPEDYVVFIPPVGNQIRAL

SEQ ID NO: 1587570 - protein, 22 aa, Staphylococcus aureus
TKAFGRQNFEYINGQKPAESPG

SEQ ID NO: 1587571 - protein, 23 aa, Staphylococcus aureus
TKTATYKVVRTVPKHVFETARGV

SEQ ID NO: 1587572 - protein, 21 aa, Staphylococcus aureus
TKTATYKVVRTVPKQVFETAR

SEQ ID NO: 1587573 - protein, 17 aa, Staphylococcus aureus
TLAFPAYLLKISRSFEV

SEQ ID NO: 1587574 - protein, 23 aa, Staphylococcus aureus
TLCGFVICYGVIFGLFYLLSGST

SEQ ID NO: 1587575 - protein, 25 aa, Staphylococcus aureus
TLGTRIDSNKSFHFSGKVNLGNKYE

SEQ ID NO: 1587576 - protein, 27 aa, Staphylococcus aureus
TNKGMLFGGLFSILGLALLRRNKKNHK

SEQ ID NO: 1587577 - protein, 21 aa, Staphylococcus aureus
TRIDSNKSFHFSGKVNLGNKY

SEQ ID NO: 1587578 - protein, 23 aa, Staphylococcus aureus
TSDSLRTSTSLSDSVSMSTSGSL

SEQ ID NO: 1587579 - protein, 17 aa, Staphylococcus aureus
TSMRTTDKYGYYNYAGY

SEQ ID NO: 1587580 - protein, 23 aa, Staphylococcus aureus
TSWFSRVAWSVAEKMGQALNFII

SEQ ID NO: 1587581 - protein, 19 aa, Staphylococcus aureus
TWSHLKWAIPLISIALIII

SEQ ID NO: 1587582 - protein, 21 aa, Staphylococcus aureus
VAKELPWGVLILFGGGLALAK

SEQ ID NO: 1587583 - protein, 22 aa, Staphylococcus aureus
VALMLFISWLGLFLFYKNEFDS

SEQ ID NO: 1587584 - protein, 17 aa, Staphylococcus aureus
VAYVVEFFEWFNTLETF

SEQ ID NO: 1587585 - protein, 28 aa, Staphylococcus aureus
VFAVLFRFIVRLIPIFYIFRVLSIFIFI

SEQ ID NO: 1587586 - protein, 18 aa, Staphylococcus aureus
VGILCFFIPFTINGNNTI

SEQ ID NO: 1587587 - protein, 24 aa, Staphylococcus aureus
VGTFSTVIATLVFLGLNTSQAQAA

SEQ ID NO: 1587588 - protein, 19 aa, Staphylococcus aureus
VKRPWLPPLPENVYQEDLV

SEQ ID NO: 1587589 - protein, 20 aa, Staphylococcus aureus
VKSGDYFTAKLPDSLTGNGD

SEQ ID NO: 1587590 - protein, 19 aa, Staphylococcus aureus
VKSGDYFTAKLPDSVTGNG

SEQ ID NO: 1587591 - protein, 19 aa, Staphylococcus aureus
VNIFDWRYLFLVVLLIGMV

SEQ ID NO: 1587592 - protein, 22 aa, Staphylococcus aureus
VPVKRVIPEIVAHSHYTVQGQD

SEQ ID NO: 1587593 - protein, 17 aa, Staphylococcus aureus
VRIGWLILRLLAVVFAW

SEQ ID NO: 1587594 - protein, 21 aa, Staphylococcus aureus
VRISFPNANQYKVEFPTDDDQ

SEQ ID NO: 1587595 - protein, 19 aa, Staphylococcus aureus
VSAGYKWFFAYPDEHIETV

SEQ ID NO: 1587596 - protein, 17 aa, Staphylococcus aureus
VSGAIQGVVGWLTELWG

SEQ ID NO: 1587597 - protein, 18 aa, Staphylococcus aureus
VTIDSGTTVYPHQAGYVK

SEQ ID NO: 1587598 - protein, 22 aa, Staphylococcus aureus
VVQILAAILIQIAVQIRVVILH

SEQ ID NO: 1587599 - protein, 19 aa, Staphylococcus aureus
VYIIPRFFKAIPAPLIAII

SEQ ID NO: 1587600 - protein, 28 aa, Staphylococcus aureus
VYPHQAGYVKLNYGFSVPNSPVKGDTFK

SEQ ID NO: 1587601 - protein, 20 aa, Staphylococcus aureus
WDEILTILPWIIGALIVTIF

SEQ ID NO: 1587602 - protein, 27 aa, Staphylococcus aureus
WPFLIALPFMICYGIGVTFYYQQKVAY

SEQ ID NO: 1587603 - protein, 17 aa, Staphylococcus aureus
WWLILAISIIVLIIITV

SEQ ID NO: 1587604 - protein, 26 aa, Staphylococcus aureus
YAGQTWTRNISDWIAKSGTTNFSLSM

SEQ ID NO: 1587605 - protein, 17 aa, Staphylococcus aureus
YDNVASINFGDINKTYV

SEQ ID NO: 1587606 - protein, 21 aa, Staphylococcus aureus
YFIWLRFEWPQYLIYILLVLG

SEQ ID NO: 1587607 - protein, 17 aa, Staphylococcus aureus
YFSSRIDKILTHKYIGM

SEQ ID NO: 1587608 - protein, 19 aa, Staphylococcus aureus
YGEKVLDAFDYIPFAYLTD

SEQ ID NO: 1587609 - protein, 18 aa, Staphylococcus aureus
YIYRLILKYLLWYIKTVK

SEQ ID NO: 1587610 - protein, 32 aa, Staphylococcus aureus
YKIRNRSGQVIYDWPTVHINSLKDLARASDYF

SEQ ID NO: 1587611 - protein, 20 aa, Staphylococcus aureus
YKYDNVASINFGDINKTYVV

SEQ ID NO: 1587612 - protein, 17 aa, Staphylococcus aureus
YLFFKSSVSLVFKMVKK

SEQ ID NO: 1587613 - protein, 24 aa, Staphylococcus aureus
YLIVCLLISFLALISMNIRILSGF

SEQ ID NO: 1587614 - protein, 34 aa, Staphylococcus aureus
YPERAYKSYYVYGGYRLTWDNGLVLYSNKADGNG

SEQ ID NO: 1587615 - protein, 23 aa, Staphylococcus aureus
YTNPESYLWIGIVFVFFLISYIS

SEQ ID NO: 1587616 - protein, 18 aa, Staphylococcus aureus
YYHKNAFAMDKSHPEPIE

SEQ ID NO: 1587617 - protein, 18 aa, Staphylococcus aureus
YYRGDEVSFTMGVSDRHS

SEQ ID NO: 1587618 - protein, 18 aa, Staphylococcus aureus
AAIFLYIMLIDWRMACAL

SEQ ID NO: 1587619 - protein, 18 aa, Staphylococcus aureus
AAIFLYIMLIDWRMASAL

SEQ ID NO: 1587620 - protein, 25 aa, Staphylococcus aureus
AALKRLPWLIILTFLGMITATILGR

SEQ ID NO: 1587621 - protein, 18 aa, Staphylococcus aureus
AATFHWTAGFSFSAGLID

SEQ ID NO: 1587622 - protein, 19 aa, Staphylococcus aureus
ADGKFSHFAYVKPNNQSLS

SEQ ID NO: 1587623 - protein, 21 aa, Staphylococcus aureus
ADLSESYFVNPENFEDVTNSV

SEQ ID NO: 1587624 - protein, 19 aa, Staphylococcus aureus
ADNIRVGDRLHFKNNSTSY

SEQ ID NO: 1587625 - protein, 26 aa, Staphylococcus aureus
AGETIKEHWLPISVIVGAMGVLMVWL

SEQ ID NO: 1587626 - protein, 25 aa, Staphylococcus aureus
AGETIKEHWLSISVIVGAMGVLMIW

SEQ ID NO: 1587627 - protein, 20 aa, Staphylococcus aureus
AGIFCFGMSLYLIASNSNDL

SEQ ID NO: 1587628 - protein, 18 aa, Staphylococcus aureus
AGILRLFGVIALMLVVAL

SEQ ID NO: 1587629 - protein, 19 aa, Staphylococcus aureus
AGIMCPEFAIGMGPKIFSF

SEQ ID NO: 1587630 - protein, 21 aa, Staphylococcus aureus
AGLAILPSFYAWFNLWAMWDP

SEQ ID NO: 1587631 - protein, 20 aa, Staphylococcus aureus
AGQEVYKIGNYVWEDTNKNG

SEQ ID NO: 1587632 - protein, 25 aa, Staphylococcus aureus
AGQRAVLKYKLKFEDGLHQGDYFDF

SEQ ID NO: 1587633 - protein, 28 aa, Staphylococcus aureus
AGQTWTRNISDWIAKSGTTNFSLSMTAS

SEQ ID NO: 1587634 - protein, 17 aa, Staphylococcus aureus
AIFEFILNFVIKPIMFA

SEQ ID NO: 1587635 - protein, 19 aa, Staphylococcus aureus
AIFLKKMIYFWLSEGQLIL

SEQ ID NO: 1587636 - protein, 19 aa, Staphylococcus aureus
AIIGLRFLKEYDVKRDKDK

SEQ ID NO: 1587637 - protein, 20 aa, Staphylococcus aureus
AIIQKPIRTVQEVQSALTNV

SEQ ID NO: 1587638 - protein, 17 aa, Staphylococcus aureus
AIPTRIAIQNQIVTQIQ

SEQ ID NO: 1587639 - protein, 17 aa, Staphylococcus aureus
AIVCGRPAMISGATGAV

SEQ ID NO: 1587640 - protein, 18 aa, Staphylococcus aureus
AKAWRKTFPPKKDGDKEK

SEQ ID NO: 1587641 - protein, 17 aa, Staphylococcus aureus
AKFCPECGYKIANLNNV

SEQ ID NO: 1587642 - protein, 19 aa, Staphylococcus aureus
AKHKWSTLIAWVIIVAAIF

SEQ ID NO: 1587643 - protein, 23 aa, Staphylococcus aureus
AKRDAYTNAVSRAEAILNKTQGA

SEQ ID NO: 1587644 - protein, 27 aa, Staphylococcus aureus
AKTGKYELGEAFKIYKFNGEEDNSYYY

SEQ ID NO: 1587645 - protein, 20 aa, Staphylococcus aureus
AKVLLPLIAAVLIIGALAIF

SEQ ID NO: 1587646 - protein, 19 aa, Staphylococcus aureus
ALLKKFAWGPLKDVMDKRE

SEQ ID NO: 1587647 - protein, 19 aa, Staphylococcus aureus
ALVQSSRVDLIFTRFENMY

SEQ ID NO: 1587648 - protein, 19 aa, Staphylococcus aureus
AMMALLGSLLLFRKRKQDH

SEQ ID NO: 1587649 - protein, 19 aa, Staphylococcus aureus
AMTRKGMVSNRLNKFSIRK

SEQ ID NO: 1587650 - protein, 17 aa, Staphylococcus aureus
ANASGFKIDTAYNNVNG

SEQ ID NO: 1587651 - protein, 19 aa, Staphylococcus aureus
ANHSIEFNMIWKAMLIPSM

SEQ ID NO: 1587652 - protein, 30 aa, Staphylococcus aureus
ANKPLPEMWPYGVNDSRSWDYKIRNRSGQV

SEQ ID NO: 1587653 - protein, 19 aa, Staphylococcus aureus
ANNGYRIQPHIGLTIHEST

SEQ ID NO: 1587654 - protein, 17 aa, Staphylococcus aureus
APRAVIIGVCLQFSIMP

SEQ ID NO: 1587655 - protein, 17 aa, Staphylococcus aureus
APSKVVLLPAHRGTVSS

SEQ ID NO: 1587656 - protein, 19 aa, Staphylococcus aureus
AQAEAGGRPNFRTTGYSQS

SEQ ID NO: 1587657 - protein, 20 aa, Staphylococcus aureus
AQAEAGGRPNFRTTGYSQSN

SEQ ID NO: 1587658 - protein, 22 aa, Staphylococcus aureus
AQALDHAMELLRNSVADNQATL

SEQ ID NO: 1587659 - protein, 21 aa, Staphylococcus aureus
AQLKAANPFAKELENRKKAAI

SEQ ID NO: 1587660 - protein, 20 aa, Staphylococcus aureus
AQLKVANPFAKELEKRKKVA

SEQ ID NO: 1587661 - protein, 24 aa, Staphylococcus aureus
ARGLKFKIMFNFGLPLVIVLSHAY

SEQ ID NO: 1587662 - protein, 25 aa, Staphylococcus aureus
ASPIKRSEIIFGYVFGYGSFSVIQT

SEQ ID NO: 1587663 - protein, 25 aa, Staphylococcus aureus
ATLLGWRWIFIISIVISLIALFLIK

SEQ ID NO: 1587664 - protein, 26 aa, Staphylococcus aureus
AVGIGGLSNAFGFKLDTYHNTSTPNA

SEQ ID NO: 1587665 - protein, 18 aa, Staphylococcus aureus
AVKLRWFPVAGWEGISTV

SEQ ID NO: 1587666 - protein, 17 aa, Staphylococcus aureus
AVMGFASAISVIFAVFS

SEQ ID NO: 1587667 - protein, 27 aa, Staphylococcus aureus
AVNPSAPRMRAFSLAAVAADAPAAGTD

SEQ ID NO: 1587668 - protein, 18 aa, Staphylococcus aureus
CFIGFLGIIFFYCHLNKK

SEQ ID NO: 1587669 - protein, 18 aa, Staphylococcus aureus
CLGAVFFYFWGVFLYNSL

SEQ ID NO: 1587670 - protein, 17 aa, Staphylococcus aureus
CQIILSCIKVLIDEHYS

SEQ ID NO: 1587671 - protein, 17 aa, Staphylococcus aureus
CTLLISGGVTPAANAAQ

SEQ ID NO: 1587672 - protein, 24 aa, Staphylococcus aureus
CYQTRCWLCESIFYYYYCDFNFKK

SEQ ID NO: 1587673 - protein, 19 aa, Staphylococcus aureus
DADNWTLDSGFYKTPKYSL

SEQ ID NO: 1587674 - protein, 34 aa, Staphylococcus aureus
DADNWTLDSGFYKTPKYSLGDYVWYDSNKDGKQD

SEQ ID NO: 1587675 - protein, 23 aa, Staphylococcus aureus
DEANSSLIWGLLASLGSLLLFRR

SEQ ID NO: 1587676 - protein, 17 aa, Staphylococcus aureus
DEIKESLAIVLDESKRL

SEQ ID NO: 1587677 - protein, 21 aa, Staphylococcus aureus
DEKLYKIGDYVWEDVDKDGVQ

SEQ ID NO: 1587678 - protein, 23 aa, Staphylococcus aureus
DELFKYDIELIYPFDLVEVDSSQ

SEQ ID NO: 1587679 - protein, 19 aa, Staphylococcus aureus
DFFELRKLYIFAIMILASG

SEQ ID NO: 1587680 - protein, 24 aa, Staphylococcus aureus
DGKKRYYNFFGIGAFDSSAVRSGK

SEQ ID NO: 1587681 - protein, 24 aa, Staphylococcus aureus
DGQENLYRIAIQYYGSGSPENVEK

SEQ ID NO: 1587682 - protein, 19 aa, Staphylococcus aureus
DIKVYRVDNANDLSESYYV

SEQ ID NO: 1587683 - protein, 24 aa, Staphylococcus aureus
DKITYKYQNVASINFGDINKTYVV

SEQ ID NO: 1587684 - protein, 19 aa, Staphylococcus aureus
DKTKYSWSNSYSNVNGSST

SEQ ID NO: 1587685 - protein, 19 aa, Staphylococcus aureus
DKTKYSWSNSYSSVNGSST

SEQ ID NO: 1587686 - protein, 20 aa, Staphylococcus aureus
DKVKHTPFFLPKRRRKEDEE

SEQ ID NO: 1587687 - protein, 21 aa, Staphylococcus aureus
DKVKHTPFFLPKRRRKEDEED

SEQ ID NO: 1587688 - protein, 17 aa, Staphylococcus aureus
DLIRWLPELDLPLMDGL

SEQ ID NO: 1587689 - protein, 17 aa, Staphylococcus aureus
DNWTLDSGFYKTPKYSL

SEQ ID NO: 1587690 - protein, 19 aa, Staphylococcus aureus
DPKARMVAIWDKTFPYLLI

SEQ ID NO: 1587691 - protein, 41 aa, Staphylococcus aureus
DPNSKGDLALRSTLYGYNSNIIWRSMSWDNEVAFNNGSGSG

SEQ ID NO: 1587692 - protein, 17 aa, Staphylococcus aureus
DQFKNRIYYEHPNVASI

SEQ ID NO: 1587693 - protein, 23 aa, Staphylococcus aureus
DQSSEVFSPISPIKIATQDNSGN

SEQ ID NO: 1587694 - protein, 24 aa, Staphylococcus aureus
DQSSEVFSPISPIKIATQDNSGNA

SEQ ID NO: 1587695 - protein, 22 aa, Staphylococcus aureus
DSGKYKVIFEKPAGLKQTGTNT

SEQ ID NO: 1587696 - protein, 24 aa, Staphylococcus aureus
DSTGRRKLLIIAMIIFTLASLGIV

SEQ ID NO: 1587697 - protein, 30 aa, Staphylococcus aureus; identical to SEQ ID NO: 1582197

SEQ ID NO: 1587698 - protein, 24 aa, Staphylococcus aureus
DVKEVRWLFRIIALIVFAVVMFTI

SEQ ID NO: 1587699 - protein, 19 aa, Staphylococcus aureus
DVPFSVTIGNQITTTTADI

SEQ ID NO: 1587700 - protein, 18 aa, Staphylococcus aureus
DYTHIFPGECIWFDVLKR

SEQ ID NO: 1587701 - protein, 17 aa, Staphylococcus aureus
DYTKLVFAKPIYNDPSL

SEQ ID NO: 1587702 - protein, 23 aa, Staphylococcus aureus
EAKDSKEPLPDTGSEDEANTSLI

SEQ ID NO: 1587703 - protein, 26 aa, Staphylococcus aureus
EALKRAFLIMCLIGFGVGILANAGNI

SEQ ID NO: 1587704 - protein, 26 aa, Staphylococcus aureus
EDEANTSLIWGLLASLGSLLLFRRKK

SEQ ID NO: 1587705 - protein, 20 aa, Staphylococcus aureus
EEKLYKIGDYVWEDVDKDGV

SEQ ID NO: 1587706 - protein, 18 aa, Staphylococcus aureus
EFNMIWKAMLIPSMGYIV

SEQ ID NO: 1587707 - protein, 26 aa, Staphylococcus aureus
EGDTFTFKYGQYFRPGSVRLPSQTQN

SEQ ID NO: 1587708 - protein, 25 aa, Staphylococcus aureus
EGEANTSLIWGLLASLGSLLLFRRK

SEQ ID NO: 1587709 - protein, 17 aa, Staphylococcus aureus
EGETKVIPGKDGLKDPE

SEQ ID NO: 1587710 - protein, 18 aa, Staphylococcus aureus
EILTILPWIIGALIVTIF

SEQ ID NO: 1587711 - protein, 18 aa, Staphylococcus aureus
EKILDEFISSNSFPENEV

SEQ ID NO: 1587712 - protein, 19 aa, Staphylococcus aureus
EKLYKIGDYVWEDVDKDGV

SEQ ID NO: 1587713 - protein, 19 aa, Staphylococcus aureus
EKMKSLAFIGVAFQINLTV

SEQ ID NO: 1587714 - protein, 20 aa, Staphylococcus aureus
EKRKRFDIFLKYYYENLTSK

SEQ ID NO: 1587715 - protein, 23 aa, Staphylococcus aureus
ELAKRKQEAISRIKDFSNEKINS

SEQ ID NO: 1587716 - protein, 23 aa, Staphylococcus aureus
ELAKRKQEAISRIKDFSNEKMNS

SEQ ID NO: 1587717 - protein, 19 aa, Staphylococcus aureus
ELVLRLAIAFYIVAAILGL

SEQ ID NO: 1587718 - protein, 18 aa, Staphylococcus aureus
ENRYKTYYYYNNGYTLTW

SEQ ID NO: 1587719 - protein, 24 aa, Staphylococcus aureus
EPLPNRKDFVVSFITGALVGSALG

SEQ ID NO: 1587720 - protein, 18 aa, Staphylococcus aureus
EQKLPIYILFTLFVVVAI

SEQ ID NO: 1587721 - protein, 19 aa, Staphylococcus aureus
EQKLPIYILFTLFVVVAIV

SEQ ID NO: 1587722 - protein, 19 aa, Staphylococcus aureus
EQKLPVYILFTLFVVVAIV

SEQ ID NO: 1587723 - protein, 19 aa, Staphylococcus aureus
ERGELRVGLSAGYAPMEFE

SEQ ID NO: 1587724 - protein, 25 aa, Staphylococcus aureus
ERRHLRPKISVTFLAWLLIFLMFAL

SEQ ID NO: 1587725 - protein, 26 aa, Staphylococcus aureus
ERVTLKYKWKFGEDVKPGDYFDFTLS

SEQ ID NO: 1587726 - protein, 17 aa, Staphylococcus aureus
ESAKRALASYSNLNNAQ

SEQ ID NO: 1587727 - protein, 18 aa, Staphylococcus aureus
ESKIKWGCEMMIHSRKLR

SEQ ID NO: 1587728 - protein, 25 aa, Staphylococcus aureus
ESLDKVKHTPFFLPKRRRKEDEEDV

SEQ ID NO: 1587729 - protein, 18 aa, Staphylococcus aureus
ETSFPRCQISYFTFGISQ

SEQ ID NO: 1587730 - protein, 24 aa, Staphylococcus aureus
EVETLKWARWLPHMTLRDQNIRGF

SEQ ID NO: 1587731 - protein, 24 aa, Staphylococcus aureus
EVETLKWARWLPHMTLRSQNIRGF

SEQ ID NO: 1587732 - protein, 18 aa, Staphylococcus aureus
EVYSPISPIKIATQDNSG

SEQ ID NO: 1587733 - protein, 19 aa, Staphylococcus aureus
EVYSPISPIKIATQDNSGN

SEQ ID NO: 1587734 - protein, 23 aa, Staphylococcus aureus
FAKRVFTALGIGIVFGVLLHLIY

SEQ ID NO: 1587735 - protein, 24 aa, Staphylococcus aureus
FANFFKMLWLRLKAMKHYKSLNKE

SEQ ID NO: 1587736 - protein, 21 aa, Staphylococcus aureus
FASTIFPVFLVIIIGLVSFYA

SEQ ID NO: 1587737 - protein, 24 aa, Staphylococcus aureus
FAVKLRWFPVAGWEGFSTAVLPSL

SEQ ID NO: 1587738 - protein, 25 aa, Staphylococcus aureus
FDHPNRIAIFVAFAILGFVGLILGF

SEQ ID NO: 1587739 - protein, 22 aa, Staphylococcus aureus
FDHPNRIAIFVALAILGFVGLI

SEQ ID NO: 1587740 - protein, 18 aa, Staphylococcus aureus
FDIELKNLLLYGIFDESI

SEQ ID NO: 1587741 - protein, 19 aa, Staphylococcus aureus
FDLILRFMAKLSYKKLLIT

SEQ ID NO: 1587742 - protein, 21 aa, Staphylococcus aureus
FDMMLCLPIHKCINLFYTFVY

SEQ ID NO: 1587743 - protein, 26 aa, Staphylococcus aureus
FDNLDSGKYKVIFEKPAGLTQTGTNT

SEQ ID NO: 1587744 - protein, 27 aa, Staphylococcus aureus
FDNLDSGKYKVIFEKPAGLTQTGTNTT

SEQ ID NO: 1587745 - protein, 21 aa, Staphylococcus aureus
FEPRLEQYEVLKADGNYVQAH

SEQ ID NO: 1587746 - protein, 18 aa, Staphylococcus aureus
FERQAVKLLGKVKNGVVV

SEQ ID NO: 1587747 - protein, 17 aa, Staphylococcus aureus
FFKPLHMILRLFMLLTL

SEQ ID NO: 1587748 - protein, 17 aa, Staphylococcus aureus
FGAMMALLGSLLLFRKR

SEQ ID NO: 1587749 - protein, 22 aa, Staphylococcus aureus
FGDINSAYIIKVVSKYTPTSDG

SEQ ID NO: 1587750 - protein, 18 aa, Staphylococcus aureus
FGRKEQLFEIRVKPHTPT

SEQ ID NO: 1587751 - protein, 17 aa, Staphylococcus aureus
FGSDLYSTFSYVKDTIY

SEQ ID NO: 1587752 - protein, 23 aa, Staphylococcus aureus
FGYPEQRYGYYYNSYQLTWDNGL

SEQ ID NO: 1587753 - protein, 23 aa, Staphylococcus aureus
FHASMTFGLIFLFSEEIGDLFSI

SEQ ID NO: 1587754 - protein, 18 aa, Staphylococcus aureus
FHGQRLNDVVLNYDAATS

SEQ ID NO: 1587755 - protein, 23 aa, Staphylococcus aureus
FIAKHKWSAVIAWIVIVAAILIP

SEQ ID NO: 1587756 - protein, 17 aa, Staphylococcus aureus
FIFLLLVFFKYILKRYF

SEQ ID NO: 1587757 - protein, 17 aa, Staphylococcus aureus
FIGFLGVIFFYCYLNKK

SEQ ID NO: 1587758 - protein, 17 aa, Staphylococcus aureus
FIGSLVIGIIAVIGHTL

SEQ ID NO: 1587759 - protein, 17 aa, Staphylococcus aureus
FIVRVLIPFALIISLFL

SEQ ID NO: 1587760 - protein, 20 aa, Staphylococcus aureus
FIWLRFEWPQYLIYILLVLG

SEQ ID NO: 1587761 - protein, 25 aa, Staphylococcus aureus
FIYLKRYITFVSVNWRQVWYIFHSS

SEQ ID NO: 1587762 - protein, 17 aa, Staphylococcus aureus
FKAQLKVANPFAKELEK

SEQ ID NO: 1587763 - protein, 18 aa, Staphylococcus aureus
FKFWSVIESGGWVIFTHM

SEQ ID NO: 1587764 - protein, 17 aa, Staphylococcus aureus
FKGVRIQPYFKYIDFIF

SEQ ID NO: 1587765 - protein, 17 aa, Staphylococcus aureus
FKLDTYHNTSKPNAAAK

SEQ ID NO: 1587766 - protein, 17 aa, Staphylococcus aureus
FKLYRFYFYRLFAIITW

SEQ ID NO: 1587767 - protein, 21 aa, Staphylococcus aureus
FKMAFKAPRAVIIGVCLQFSI

SEQ ID NO: 1587768 - protein, 17 aa, Staphylococcus aureus
FKSEGFSIIGLILDVVI

SEQ ID NO: 1587769 - protein, 18 aa, Staphylococcus aureus
FKSKFFISLIFAIPIIIL

SEQ ID NO: 1587770 - protein, 17 aa, Staphylococcus aureus
FKYEVTRNSMSDSVSTS

SEQ ID NO: 1587771 - protein, 17 aa, Staphylococcus aureus
FLFFLVIFTFGIAGIIF

SEQ ID NO: 1587772 - protein, 25 aa, Staphylococcus aureus
FLFSEEIGDLFSIKVIAISTAIVAV

SEQ ID NO: 1587773 - protein, 18 aa, Staphylococcus aureus
FLHMLLGVFLAALVSFVV

SEQ ID NO: 1587774 - protein, 27 aa, Staphylococcus aureus
FLLHYIFKISDKWLLVLCVFVIIVNAS

SEQ ID NO: 1587775 - protein, 19 aa, Staphylococcus aureus
FLLLPARWFTGLVTEKTVE

SEQ ID NO: 1587776 - protein, 18 aa, Staphylococcus aureus
FLLLRFTPLLGLSNMYVY

SEQ ID NO: 1587777 - protein, 19 aa, Staphylococcus aureus
FLQFEWFQPLLISLAALLI

SEQ ID NO: 1587778 - protein, 18 aa, Staphylococcus aureus
FMNCYGIGVTFYYQQKVA

SEQ ID NO: 1587779 - protein, 17 aa, Staphylococcus aureus
FNYCKKRVWSYDMDRMD

SEQ ID NO: 1587780 - protein, 19 aa, Staphylococcus aureus
FPGECIWFDVLKRGNPSIE

SEQ ID NO: 1587781 - protein, 17 aa, Staphylococcus aureus
FRLYVKLSCSTMMATSI

SEQ ID NO: 1587782 - protein, 19 aa, Staphylococcus aureus
FRVPFTPGLIPKRREEIAT

SEQ ID NO: 1587783 - protein, 22 aa, Staphylococcus aureus
FSEEIGDLFSIKVITISTAIVA

SEQ ID NO: 1587784 - protein, 22 aa, Staphylococcus aureus
FTGDWRGVWDAIIMILKGVVQL

SEQ ID NO: 1587785 - protein, 18 aa, Staphylococcus aureus
FTQFTFKKALLFAALFIL

SEQ ID NO: 1587786 - protein, 17 aa, Staphylococcus aureus
FTQFTFKKSIIFAALFI

SEQ ID NO: 1587787 - protein, 24 aa, Staphylococcus aureus
FTSISWPVLLVIAIIAAFIGVVVY

SEQ ID NO: 1587788 - protein, 18 aa, Staphylococcus aureus
FVALEFFYIMYLETFATT

SEQ ID NO: 1587789 - protein, 22 aa, Staphylococcus aureus
FVIKCLWVKPKVVNYLIAKELG

SEQ ID NO: 1587790 - protein, 24 aa, Staphylococcus aureus
FWFPEIPNWISALFCVLLLMSFNL

SEQ ID NO: 1587791 - protein, 20 aa, Staphylococcus aureus
FYISVLFIAYFCYLLTSFSN

SEQ ID NO: 1587792 - protein, 24 aa, Staphylococcus aureus
FYKTSKYSLGDYVWYDSNKDGKQD

SEQ ID NO: 1587793 - protein, 31 aa, Staphylococcus aureus
GANKPLPEMWPYGVNDSRSWDYKIRNRSGQV

SEQ ID NO: 1587794 - protein, 23 aa, Staphylococcus aureus
GCFLVFWIYFCWKFFDIYTNCPY

SEQ ID NO: 1587795 - protein, 18 aa, Staphylococcus aureus
GDLFRFYKNPDFKKVNPS

SEQ ID NO: 1587796 - protein, 18 aa, Staphylococcus aureus
GDTIKVAWPTSGTVKIEG

SEQ ID NO: 1587797 - protein, 24 aa, Staphylococcus aureus
GESIKQNGLLGGIMTLLVGLGLMK

SEQ ID NO: 1587798 - protein, 17 aa, Staphylococcus aureus
GEVLEGGKIRYTFTNDI

SEQ ID NO: 1587799 - protein, 19 aa, Staphylococcus aureus
GFVRYFSRMFIPNLFSLLA

SEQ ID NO: 1587800 - protein, 18 aa, Staphylococcus aureus
GGIFVWIGWYGFNVGSAF

SEQ ID NO: 1587801 - protein, 26 aa, Staphylococcus aureus
GGIMTLLVGLGLMKRKKKKDENDQDD

SEQ ID NO: 1587802 - protein, 19 aa, Staphylococcus aureus
GGKIRYTFTNDIEDKVDVT

SEQ ID NO: 1587803 - protein, 20 aa, Staphylococcus aureus
GGLAPFTILFSIPFTVIGVI

SEQ ID NO: 1587804 - protein, 22 aa, Staphylococcus aureus
GGLAPFTILFSLPFTVIGVIIA

SEQ ID NO: 1587805 - protein, 17 aa, Staphylococcus aureus
GGLSWPIVLVILILFYF

SEQ ID NO: 1587806 - protein, 19 aa, Staphylococcus aureus
GGSRLFWRIYRKYLGGKSF

SEQ ID NO: 1587807 - protein, 23 aa, Staphylococcus aureus
GHLLLELAVVFGISALVTSFLKY

SEQ ID NO: 1587808 - protein, 23 aa, Staphylococcus aureus
GIAKAGAIFPLFSPVLGWIGVFM

SEQ ID NO: 1587809 - protein, 18 aa, Staphylococcus aureus
GIFYVISCVVGYLCFGLG

SEQ ID NO: 1587810 - protein, 24 aa, Staphylococcus aureus
GIRMFKRYATIMVSARILERVIAT

SEQ ID NO: 1587811 - protein, 24 aa, Staphylococcus aureus
GKALRWQKWHAMIGVIIAIPVFVL

SEQ ID NO: 1587812 - protein, 17 aa, Staphylococcus aureus
GKVKSGDYFTAKLPDSV

SEQ ID NO: 1587813 - protein, 24 aa, Staphylococcus aureus
GKVTRYDLISVLPFGNTVAQIDVK

SEQ ID NO: 1587814 - protein, 19 aa, Staphylococcus aureus
GLAPFTILFSLPFTVIGVI

SEQ ID NO: 1587815 - protein, 24 aa, Staphylococcus aureus
GLDDIRNTHVWEVDAQPAVNEIFD

SEQ ID NO: 1587816 - protein, 24 aa, Staphylococcus aureus
GLDDIRNTHVWEVDDQPAVNEISE

SEQ ID NO: 1587817 - protein, 19 aa, Staphylococcus aureus
GLMLEFISMLGIGLVALEA

SEQ ID NO: 1587818 - protein, 18 aa, Staphylococcus aureus
GLSWPIVLVILILFYFYS

SEQ ID NO: 1587819 - protein, 19 aa, Staphylococcus aureus
GMLFGGLFSILGLALLRRN

SEQ ID NO: 1587820 - protein, 17 aa, Staphylococcus aureus
GNAPYIFAHRGGMVLRP

SEQ ID NO: 1587821 - protein, 17 aa, Staphylococcus aureus
GNFKSKFFISLIFAIPI

SEQ ID NO: 1587822 - protein, 21 aa, Staphylococcus aureus
GNGRLGRILIILMLVNAGVID

SEQ ID NO: 1587823 - protein, 17 aa, Staphylococcus aureus
GNLLLELAVIFGVSSLV

SEQ ID NO: 1587824 - protein, 19 aa, Staphylococcus aureus
GNVFPVLSPILGWIGVLFM

SEQ ID NO: 1587825 - protein, 18 aa, Staphylococcus aureus
GNVIYTFTDYVNTKDDVK

SEQ ID NO: 1587826 - protein, 18 aa, Staphylococcus aureus
GPGAVFWMWIIAFIGAAS

SEQ ID NO: 1587827 - protein, 17 aa, Staphylococcus aureus
GPIKVLRFILIINAIAL

SEQ ID NO: 1587828 - protein, 24 aa, Staphylococcus aureus
GQRAILKYKLKFENGLHQGDFFDF

SEQ ID NO: 1587829 - protein, 24 aa, Staphylococcus aureus
GQRAVLKYKLKFENGLHQGDYFDF

SEQ ID NO: 1587830 - protein, 29 aa, Staphylococcus aureus
GQRVVLKYKLKFADGLKRGDYFDFTLSNN

SEQ ID NO: 1587831 - protein, 24 aa, Staphylococcus aureus
GQRVVLKYKLKFQDGLKTGDYFDF

SEQ ID NO: 1587832 - protein, 18 aa, Staphylococcus aureus
GSDVWTAFEHSLGAPTIQ

SEQ ID NO: 1587833 - protein, 19 aa, Staphylococcus aureus
GSVGEMFRPFALAIAFSLL

SEQ ID NO: 1587834 - protein, 17 aa, Staphylococcus aureus
GSVMIPLTFIIGADLLL

SEQ ID NO: 1587835 - protein, 17 aa, Staphylococcus aureus
GSWKSEIIQSYILSLAI

SEQ ID NO: 1587836 - protein, 22 aa, Staphylococcus aureus
GTSMRTTDKYGYYNYAGYSNFI

SEQ ID NO: 1587837 - protein, 17 aa, Staphylococcus aureus
GVFSLLSTMVLYRFVVF

SEQ ID NO: 1587838 - protein, 26 aa, Staphylococcus aureus
GVKLRLLKWIFIVLCISFFLFPVILL

SEQ ID NO: 1587839 - protein, 24 aa, Staphylococcus aureus
GVPTEVYVASEFVYNMPLLSEKPL

SEQ ID NO: 1587840 - protein, 22 aa, Staphylococcus aureus
GVSGNAIWDFLLKFINNEPINT

SEQ ID NO: 1587841 - protein, 24 aa, Staphylococcus aureus
GYLKRFSLYISVMILIFAIAGCGK

SEQ ID NO: 1587842 - protein, 18 aa, Staphylococcus aureus
GYSYCFHCNWFINDCRNH

SEQ ID NO: 1587843 - protein, 25 aa, Staphylococcus aureus
HEALKRVFLIFCLIGFGVGVLANAS

SEQ ID NO: 1587844 - protein, 21 aa, Staphylococcus aureus
HGNFKVKFFVSLIFAIPIILL

SEQ ID NO: 1587845 - protein, 18 aa, Staphylococcus aureus
HILLGFTIMACWPFTRLV

SEQ ID NO: 1587846 - protein, 17 aa, Staphylococcus aureus
HIPTFFKYPIVSRLSVL

SEQ ID NO: 1587847 - protein, 19 aa, Staphylococcus aureus
HIYEISSLIYKVTMKIKIK

SEQ ID NO: 1587848 - protein, 20 aa, Staphylococcus aureus
HLLLELAVIFGISALVTAFL

SEQ ID NO: 1587849 - protein, 17 aa, Staphylococcus aureus
HMRHFSNNFGNVIKNAI

SEQ ID NO: 1587850 - protein, 18 aa, Staphylococcus aureus
HPNRVAIFVALAILGFVG

SEQ ID NO: 1587851 - protein, 24 aa, Staphylococcus aureus
HTFASSLPAKFVVKDVQPAKPTVT

SEQ ID NO: 1587852 - protein, 17 aa, Staphylococcus aureus
IAGVFGIPLHKFGIETS

SEQ ID NO: 1587853 - protein, 19 aa, Staphylococcus aureus
IAIGYKFLSKRSMYLTILV

SEQ ID NO: 1587854 - protein, 17 aa, Staphylococcus aureus
IAKAGAVFPLFSPVLGW

SEQ ID NO: 1587855 - protein, 18 aa, Staphylococcus aureus
IDALPHLNNAQKAAVKSK

SEQ ID NO: 1587856 - protein, 18 aa, Staphylococcus aureus
IDALPHLNNAQKADVKSK

SEQ ID NO: 1587857 - protein, 25 aa, Staphylococcus aureus
IDEIDFWLRFGFKLKRYTGLSKEGI

SEQ ID NO: 1587858 - protein, 17 aa, Staphylococcus aureus
IDFIFAGVFAFIFLAYR

SEQ ID NO: 1587859 - protein, 17 aa, Staphylococcus aureus
IDFMFAGVLAFIFLIYR

SEQ ID NO: 1587860 - protein, 17 aa, Staphylococcus aureus
IDKRLKYIILHEYAHAK

SEQ ID NO: 1587861 - protein, 17 aa, Staphylococcus aureus
IDLTSSRFIKWLNDMNV

SEQ ID NO: 1587862 - protein, 24 aa, Staphylococcus aureus
IEGTKHLPLLFAKRRRKEDEENVE

SEQ ID NO: 1587863 - protein, 17 aa, Staphylococcus aureus
IEHAKAQLAQALQDIKD

SEQ ID NO: 1587864 - protein, 24 aa, Staphylococcus aureus
IELGLKTALTWKKLEVYEGDKKLP

SEQ ID NO: 1587865 - protein, 18 aa, Staphylococcus aureus
IFGALKLIETTHMPKSQT

SEQ ID NO: 1587866 - protein, 18 aa, Staphylococcus aureus
IGFQFSFIISFFIMLLFP

SEQ ID NO: 1587867 - protein, 24 aa, Staphylococcus aureus
IGGACLVAGLALIVHMIINRLFRK

SEQ ID NO: 1587868 - protein, 17 aa, Staphylococcus aureus
IGLISFIVWMLIQNNVD

SEQ ID NO: 1587869 - protein, 22 aa, Staphylococcus aureus
IGVASVLVGTLIGFGLLSSKEA

SEQ ID NO: 1587870 - protein, 23 aa, Staphylococcus aureus
IGVASVLVGTLIGFGLLSSKEAD

SEQ ID NO: 1587871 - protein, 20 aa, Staphylococcus aureus
IGYFHGFKGYNFFLNKEEEL

SEQ ID NO: 1587872 - protein, 19 aa, Staphylococcus aureus
IIALCLYNFLSSILWLIGG

SEQ ID NO: 1587873 - protein, 28 aa, Staphylococcus aureus
IIIILLIWLSWRFYKYSKFVKMMNNLNK

SEQ ID NO: 1587874 - protein, 18 aa, Staphylococcus aureus
IIIPRFLDLGTFDVTIAF

SEQ ID NO: 1587875 - protein, 26 aa, Staphylococcus aureus
IITMVLCGFLFPLAITLIGQIFFCQQ

SEQ ID NO: 1587876 - protein, 17 aa, Staphylococcus aureus
IIVNARFSDPVTGVEKL

SEQ ID NO: 1587877 - protein, 22 aa, Staphylococcus aureus
IIWRYILPNAIAPMIVRFSLNI

SEQ ID NO: 1587878 - protein, 24 aa, Staphylococcus aureus
IKIYRVPEGYTLNKGYDVNTNDLV

SEQ ID NO: 1587879 - protein, 24 aa, Staphylococcus aureus
IKKGWPSMMYRIWKNPEKYKSYFI

SEQ ID NO: 1587880 - protein, 22 aa, Staphylococcus aureus
IKKYWLRLSITYIITLILIYTY

SEQ ID NO: 1587881 - protein, 17 aa, Staphylococcus aureus
IKPRTLNRMAVNTVAAP

SEQ ID NO: 1587882 - protein, 22 aa, Staphylococcus aureus
IKSDLWSAFYIFTAFNVVYAIF

SEQ ID NO: 1587883 - protein, 21 aa, Staphylococcus aureus
IKSEHFHLMYLLEQHSPYFID

SEQ ID NO: 1587884 - protein, 17 aa, Staphylococcus aureus
IKTRHLLSALVLQILTL

SEQ ID NO: 1587885 - protein, 17 aa, Staphylococcus aureus
IKVAWPTSGTVKIEGYS

SEQ ID NO: 1587886 - protein, 17 aa, Staphylococcus aureus
ILFSLPFTVIGVIIALL

SEQ ID NO: 1587887 - protein, 17 aa, Staphylococcus aureus
ILGIGGAVAAVLVTRKD

SEQ ID NO: 1587888 - protein, 20 aa, Staphylococcus aureus
ILLAYVFKWLGLVDDVLLMV

SEQ ID NO: 1587889 - protein, 24 aa, Staphylococcus aureus
ILSACMTFLFVIVGLCIKLANSFI

SEQ ID NO: 1587890 - protein, 17 aa, Staphylococcus aureus
ILSIGGAVAAVLVTRKD

SEQ ID NO: 1587891 - protein, 17 aa, Staphylococcus aureus
ILTILPWLIGALIVTIF

SEQ ID NO: 1587892 - protein, 19 aa, Staphylococcus aureus
ILTVCLIGLLILATNEDAL

SEQ ID NO: 1587893 - protein, 17 aa, Staphylococcus aureus
IMLFLFVKRNKKKNKNE

SEQ ID NO: 1587894 - protein, 17 aa, Staphylococcus aureus
IMLIDWRMACALLVTIP

SEQ ID NO: 1587895 - protein, 18 aa, Staphylococcus aureus
IMRLAKIQLWFLIKGLTP

SEQ ID NO: 1587896 - protein, 20 aa, Staphylococcus aureus
INKDIVGWIKLSGTSLNYPV

SEQ ID NO: 1587897 - protein, 17 aa, Staphylococcus aureus
INLFVCITLLVAIGMGF

SEQ ID NO: 1587898 - protein, 17 aa, Staphylococcus aureus
INLTSSRFIKWLNDMNI

SEQ ID NO: 1587899 - protein, 18 aa, Staphylococcus aureus
IPGLIVWQAFSIFVGTIQ

SEQ ID NO: 1587900 - protein, 17 aa, Staphylococcus aureus
IPLKGYVVRGGREMENH

SEQ ID NO: 1587901 - protein, 23 aa, Staphylococcus aureus
IPTPRPEKTLTLGKGNGLLSGLL

SEQ ID NO: 1587902 - protein, 19 aa, Staphylococcus aureus
IPYETKRVLDPTMEPGSPD

SEQ ID NO: 1587903 - protein, 18 aa, Staphylococcus aureus
IQGKEHFEGYGSVDIQKK

SEQ ID NO: 1587904 - protein, 17 aa, Staphylococcus aureus
IRILKLPFLISLRFYVF

SEQ ID NO: 1587905 - protein, 18 aa, Staphylococcus aureus
IRILSGFLFLISAIVTIP

SEQ ID NO: 1587906 - protein, 17 aa, Staphylococcus aureus
IRMSTIVSESVSESTSE

SEQ ID NO: 1587907 - protein, 19 aa, Staphylococcus aureus
IRNTHVWEVDAQPAVNEIF

SEQ ID NO: 1587908 - protein, 17 aa, Staphylococcus aureus
IRPTILIIIGISMQTLF

SEQ ID NO: 1587909 - protein, 24 aa, Staphylococcus aureus
IRPYKVRMILGFSMSFLNAIFIAL

SEQ ID NO: 1587910 - protein, 21 aa, Staphylococcus aureus
ISFGEGSLWFGNWEYTFLNHV

SEQ ID NO: 1587911 - protein, 21 aa, Staphylococcus aureus
ISGLLASFWFFIAKRRRKEDE

SEQ ID NO: 1587912 - protein, 24 aa, Staphylococcus aureus
ISKKMTGYGLKTTAVIGGAFTINM

SEQ ID NO: 1587913 - protein, 17 aa, Staphylococcus aureus
ISLFIGVVAAILDIFIG

SEQ ID NO: 1587914 - protein, 23 aa, Staphylococcus aureus
ISLSLLCLCLFFSKLLKFNFFNL

SEQ ID NO: 1587915 - protein, 17 aa, Staphylococcus aureus
ISLWRFVGGFVVALLVA

SEQ ID NO: 1587916 - protein, 19 aa, Staphylococcus aureus
ISQWGWRFAWQFWGILILL

SEQ ID NO: 1587917 - protein, 24 aa, Staphylococcus aureus
ITMVLCGFLFPLAITLIGQIFFYQ

SEQ ID NO: 1587918 - protein, 18 aa, Staphylococcus aureus
IVAFCMFNYLSSILWVVW

SEQ ID NO: 1587919 - protein, 19 aa, Staphylococcus aureus
IVGLCIKLANSFIEPDSQN

SEQ ID NO: 1587920 - protein, 17 aa, Staphylococcus aureus
IVIIVCLLFKMATVPAM

SEQ ID NO: 1587921 - protein, 22 aa, Staphylococcus aureus
IVKSSVCLLSYVTLIRRVDMPT

SEQ ID NO: 1587922 - protein, 18 aa, Staphylococcus aureus
IVLGCTFTAVAPMILIGQ

SEQ ID NO: 1587923 - protein, 18 aa, Staphylococcus aureus
IVNHVNFLKRICIPAPVI

SEQ ID NO: 1587924 - protein, 18 aa, Staphylococcus aureus
IVWSSCFIGFLGIIFFYC

SEQ ID NO: 1587925 - protein, 18 aa, Staphylococcus aureus
IVWSSCFIGFLGVIFFYC

SEQ ID NO: 1587926 - protein, 19 aa, Staphylococcus aureus
IWIRFEWPHYLLYILLVLG

SEQ ID NO: 1587927 - protein, 21 aa, Staphylococcus aureus
IYKPKYNLGDYVWEDTNKNGI

SEQ ID NO: 1587928 - protein, 22 aa, Staphylococcus aureus
IYRTELLPSLYLYLYLKNNNDF

SEQ ID NO: 1587929 - protein, 20 aa, Staphylococcus aureus
KAGAVFPLFSPVLGWIGVFM

SEQ ID NO: 1587930 - protein, 17 aa, Staphylococcus aureus
KAIEVITQFVAQNRGKF

SEQ ID NO: 1587931 - protein, 18 aa, Staphylococcus aureus
KAIITWLLLIPVFNIMTS

SEQ ID NO: 1587932 - protein, 24 aa, Staphylococcus aureus
KARCQLCIIFSLFALMSNLTGIVI

SEQ ID NO: 1587933 - protein, 19 aa, Staphylococcus aureus
KARNFYSMLYDWRINKNPL

SEQ ID NO: 1587934 - protein, 22 aa, Staphylococcus aureus
KCLLVACGFVGAIAWTIYQLTV

SEQ ID NO: 1587935 - protein, 17 aa, Staphylococcus aureus
KDFKITLYISLFISLFI

SEQ ID NO: 1587936 - protein, 19 aa, Staphylococcus aureus
KDGKCAFKPSTIVTKNGIR

SEQ ID NO: 1587937 - protein, 18 aa, Staphylococcus aureus
KDKLEYFNPAGLYQTHSF

SEQ ID NO: 1587938 - protein, 21 aa, Staphylococcus aureus
KEALKAQVTSAGRVSVANGVE

SEQ ID NO: 1587939 - protein, 19 aa, Staphylococcus aureus
KEFLEKWAGVPTEVYVASE

SEQ ID NO: 1587940 - protein, 25 aa, Staphylococcus aureus
KEGIKALNWRPSYIPQFIRMAIVVT

SEQ ID NO: 1587941 - protein, 17 aa, Staphylococcus aureus
KEKVPIIFSFRAVFETL

SEQ ID NO: 1587942 - protein, 18 aa, Staphylococcus aureus
KEKVPIIFSFRAVFETLL

SEQ ID NO: 1587943 - protein, 18 aa, Staphylococcus aureus
KERGELRVGLSADYAPME

SEQ ID NO: 1587944 - protein, 27 aa, Staphylococcus aureus
KFANFFKMLWLRLKAMKHYKALNKESK

SEQ ID NO: 1587945 - protein, 19 aa, Staphylococcus aureus
KFLSSLLHRTHIKVNFYKN

SEQ ID NO: 1587946 - protein, 18 aa, Staphylococcus aureus
KFSYKMFLVFIAIIFFAF

SEQ ID NO: 1587947 - protein, 19 aa, Staphylococcus aureus
KGASLFLRLGARIFKTGIA

SEQ ID NO: 1587948 - protein, 25 aa, Staphylococcus aureus
KGKRFAIDMFKMILIQIICVMMGLW

SEQ ID NO: 1587949 - protein, 24 aa, Staphylococcus aureus
KGNLLLELAVVFGISSLVTAFLKT

SEQ ID NO: 1587950 - protein, 18 aa, Staphylococcus aureus
KIDFKIALVFGLLFYIVG

SEQ ID NO: 1587951 - protein, 18 aa, Staphylococcus aureus
KIEPIRLIYSGSNLTIEG

SEQ ID NO: 1587952 - protein, 20 aa, Staphylococcus aureus
KIKSYFLRWIPSFHILQSGL

SEQ ID NO: 1587953 - protein, 21 aa, Staphylococcus aureus
KIKSYFLRWIPSFHILQSGQF

SEQ ID NO: 1587954 - protein, 23 aa, Staphylococcus aureus
KISYKYDNVASINFGDINKTYVV

SEQ ID NO: 1587955 - protein, 17 aa, Staphylococcus aureus
KITRYILGTLFTLALTL

SEQ ID NO: 1587956 - protein, 19 aa, Staphylococcus aureus
KITVPKELNLNGVTSTAKV

SEQ ID NO: 1587957 - protein, 23 aa, Staphylococcus aureus
KITYKYQNVASINFGDITKTYVV

SEQ ID NO: 1587958 - protein, 17 aa, Staphylococcus aureus
KIVDLDEAWSFLQVAQG

SEQ ID NO: 1587959 - protein, 18 aa, Staphylococcus aureus
KKAEVELDINTASTWKKF

SEQ ID NO: 1587960 - protein, 19 aa, Staphylococcus aureus
KKGGMAKVLLPLIAAVLII

SEQ ID NO: 1587961 - protein, 31 aa, Staphylococcus aureus
KKSKKGWFWGCGGCLLLFILIIIGISACTAG

SEQ ID NO: 1587962 - protein, 30 aa, Staphylococcus aureus
KKSKKGWFWGCGGCLVLFILIIIGISACTA

SEQ ID NO: 1587963 - protein, 19 aa, Staphylococcus aureus
KKSLLKRRLMNIKDANLKK

SEQ ID NO: 1587964 - protein, 20 aa, Staphylococcus aureus
KLEVISSLFSVKKITFDLSD

SEQ ID NO: 1587965 - protein, 19 aa, Staphylococcus aureus
KLGEHLKHPFILKRIAGQS

SEQ ID NO: 1587966 - protein, 24 aa, Staphylococcus aureus
KLGERLKHPFILKRIVGQSGMSYG

SEQ ID NO: 1587967 - protein, 18 aa, Staphylococcus aureus
KLLEYRKPILLMSMALVF

SEQ ID NO: 1587968 - protein, 22 aa, Staphylococcus aureus
KLNELRSGFNIDNYITLEEYFE

SEQ ID NO: 1587969 - protein, 22 aa, Staphylococcus aureus
KLRIFEVNDISKLSDSYYADPN

SEQ ID NO: 1587970 - protein, 19 aa, Staphylococcus aureus
KLRIFEVNDTSKLSDSYYA

SEQ ID NO: 1587971 - protein, 19 aa, Staphylococcus aureus
KNKGRNIFTMIGIIIGISS

SEQ ID NO: 1587972 - protein, 23 aa, Staphylococcus aureus
KPSQIKGAILFGGFYNMQTVRET

SEQ ID NO: 1587973 - protein, 21 aa, Staphylococcus aureus
KQAGHPVFYVYAGNQGNASVN

SEQ ID NO: 1587974 - protein, 23 aa, Staphylococcus aureus
KQILRLLFLLAMYELGKYVTEQV

SEQ ID NO: 1587975 - protein, 23 aa, Staphylococcus aureus
KQLLLRKIHGYSLFSSNVRYLTI

SEQ ID NO: 1587976 - protein, 21 aa, Staphylococcus aureus
KQSWKSFLIVLAVCLILIIAS

SEQ ID NO: 1587977 - protein, 24 aa, Staphylococcus aureus
KQVFWRILLFYALSIAVIGAIIPY

SEQ ID NO: 1587978 - protein, 22 aa, Staphylococcus aureus
KRFKLKMPGAFMILFILTVVAV

SEQ ID NO: 1587979 - protein, 19 aa, Staphylococcus aureus
KRKQEAISRIKDFSNEKIN

SEQ ID NO: 1587980 - protein, 17 aa, Staphylococcus aureus
KRLEVVILIHFINNLSS

SEQ ID NO: 1587981 - protein, 23 aa, Staphylococcus aureus
KRLKAGKVYKRDRLDVAFNNFFT

SEQ ID NO: 1587982 - protein, 20 aa, Staphylococcus aureus
KRTRSLLALFIMICTGCRVS

SEQ ID NO: 1587983 - protein, 18 aa, Staphylococcus aureus
KSGDYFTAKLPDSLTGNG

SEQ ID NO: 1587984 - protein, 17 aa, Staphylococcus aureus
KSLLKRRLINIKEANLK

SEQ ID NO: 1587985 - protein, 22 aa, Staphylococcus aureus
KSLNTRMRMAAIQPNSTDSKNV

SEQ ID NO: 1587986 - protein, 19 aa, Staphylococcus aureus
KSNSGSMSNSIRHFTSLST

SEQ ID NO: 1587987 - protein, 18 aa, Staphylococcus aureus
KSNVTLIDWYKRSQGHSE

SEQ ID NO: 1587988 - protein, 20 aa, Staphylococcus aureus
KSTRKIVLLSLIFSLLMIAL

SEQ ID NO: 1587989 - protein, 34 aa, Staphylococcus aureus
KSWLAIVCSMMVVFSIMLFLFVKRNKKKNKNESQ

SEQ ID NO: 1587990 - protein, 17 aa, Staphylococcus aureus
KTGRFIATASIVFSILL

SEQ ID NO: 1587991 - protein, 23 aa, Staphylococcus aureus
KTPKYSLGDYVWYDSNKDGKQDS

SEQ ID NO: 1587992 - protein, 20 aa, Staphylococcus aureus
KTTAVIGGAFTINMLHDQQA

SEQ ID NO: 1587993 - protein, 17 aa, Staphylococcus aureus
KVGEVWAMLCISLLLVA

SEQ ID NO: 1587994 - protein, 21 aa, Staphylococcus aureus
KVGHTVFKWVAIGMTTLSVLL

SEQ ID NO: 1587995 - protein, 18 aa, Staphylococcus aureus
KVKHTPFFLPKRRRKEDE

SEQ ID NO: 1587996 - protein, 17 aa, Staphylococcus aureus
KVLKLDIKWPFLLSELG

SEQ ID NO: 1587997 - protein, 19 aa, Staphylococcus aureus
KVREIKGLLTAKIIRAQEM

SEQ ID NO: 1587998 - protein, 18 aa, Staphylococcus aureus
KYIIFGVILVITLLIIGI

SEQ ID NO: 1587999 - protein, 17 aa, Staphylococcus aureus
LAFIFSAYRAWQMRHGQ

SEQ ID NO: 1588000 - protein, 22 aa, Staphylococcus aureus
LAKRKQEAISRIKDFSNEKMNS

SEQ ID NO: 1588001 - protein, 21 aa, Staphylococcus aureus
LALLEKFAWGPLKDVMDKRER

SEQ ID NO: 1588002 - protein, 25 aa, Staphylococcus aureus
LATIDFLGVFGIRLFALVSKFGLLR

SEQ ID NO: 1588003 - protein, 21 aa, Staphylococcus aureus
LAVSVLCMIEYTLVSIGLNSY

SEQ ID NO: 1588004 - protein, 20 aa, Staphylococcus aureus
LCALAFICVIVFYFNLNRKL

SEQ ID NO: 1588005 - protein, 21 aa, Staphylococcus aureus
LCALAFICVIVFYFNLNRKLK

SEQ ID NO: 1588006 - protein, 17 aa, Staphylococcus aureus
LCLACILYLLGKAIVNH

SEQ ID NO: 1588007 - protein, 21 aa, Staphylococcus aureus
LCTFVSWLLIPHKITRYILGT

SEQ ID NO: 1588008 - protein, 21 aa, Staphylococcus aureus
LDCITIIIALSIMFFLDVKLT

SEQ ID NO: 1588009 - protein, 25 aa, Staphylococcus aureus
LDDTKHLPLLFAKRHRKEEEEDVTV

SEQ ID NO: 1588010 - protein, 19 aa, Staphylococcus aureus
LDFRLPRMMITILAGVTLS

SEQ ID NO: 1588011 - protein, 20 aa, Staphylococcus aureus
LDILNILGFVFVYSAITLAI

SEQ ID NO: 1588012 - protein, 22 aa, Staphylococcus aureus
LDKVKHTPFFLPKRRRKEEEED

SEQ ID NO: 1588013 - protein, 18 aa, Staphylococcus aureus
LDLRVFKSKGFMIATIGL

SEQ ID NO: 1588014 - protein, 29 aa, Staphylococcus aureus
LDSGFYKTPKYSLGDYVWYDSNKDGKQDS

SEQ ID NO: 1588015 - protein, 23 aa, Staphylococcus aureus
LDSGKYKVIFEKPAGLKQTGTNT

SEQ ID NO: 1588016 - protein, 18 aa, Staphylococcus aureus
LDTDKTKYSWSNSYSSVN

SEQ ID NO: 1588017 - protein, 21 aa, Staphylococcus aureus
LEGGKIRYTFTNDIEDKVDVT

SEQ ID NO: 1588018 - protein, 22 aa, Staphylococcus aureus
LEIILRWVLMMQVMLLMNLLNQ

SEQ ID NO: 1588019 - protein, 17 aa, Staphylococcus aureus
LELAVIFGVSSLVTAFL

SEQ ID NO: 1588020 - protein, 17 aa, Staphylococcus aureus
LELNFWFGLLYLSILAS

SEQ ID NO: 1588021 - protein, 18 aa, Staphylococcus aureus
LFHIVYICFFYFMDSYFL

SEQ ID NO: 1588022 - protein, 28 aa, Staphylococcus aureus
LFLFPLGLFLMWKFSKWPSLVRTIITVV

SEQ ID NO: 1588023 - protein, 18 aa, Staphylococcus aureus
LFLRNIRTTAISIISIPL

SEQ ID NO: 1588024 - protein, 17 aa, Staphylococcus aureus
LFMGGLIYQFDTLHFIP

SEQ ID NO: 1588025 - protein, 23 aa, Staphylococcus aureus
LFSEEIGDLFSIKVIAISTAIVA

SEQ ID NO: 1588026 - protein, 17 aa, Staphylococcus aureus
LGAVFFYFWGVFLYNSL

SEQ ID NO: 1588027 - protein, 18 aa, Staphylococcus aureus
LGETFFLYLTWYSFGRFF

SEQ ID NO: 1588028 - protein, 23 aa, Staphylococcus aureus
LGFLRLVFIPSMIVFFQDSTIDN

SEQ ID NO: 1588029 - protein, 17 aa, Staphylococcus aureus
LGLKDKTDWVGHKIDES

SEQ ID NO: 1588030 - protein, 20 aa, Staphylococcus aureus
LGVPVPFRFSGFSFDVTSTL

SEQ ID NO: 1588031 - protein, 17 aa, Staphylococcus aureus
LGWNYWFNWVVTVAADI

SEQ ID NO: 1588032 - protein, 20 aa, Staphylococcus aureus
LGWNYWFNWVVTVAADIMIA

SEQ ID NO: 1588033 - protein, 18 aa, Staphylococcus aureus
LHLQKWHAMIGIIIAIPV

SEQ ID NO: 1588034 - protein, 17 aa, Staphylococcus aureus
LHMRHFGDRIGNVIKNA

SEQ ID NO: 1588035 - protein, 19 aa, Staphylococcus aureus
LHMRHFSNNFGNVIKNAIG

SEQ ID NO: 1588036 - protein, 17 aa, Staphylococcus aureus
LIAIGWRLIWKREINKH

SEQ ID NO: 1588037 - protein, 25 aa, Staphylococcus aureus
LIAMKKFHVLAGYRAKFILMVILTM

SEQ ID NO: 1588038 - protein, 17 aa, Staphylococcus aureus
LIGGIAWGVYAFFANTL

SEQ ID NO: 1588039 - protein, 18 aa, Staphylococcus aureus
LIGIQVWLGFPFVFALFT

SEQ ID NO: 1588040 - protein, 17 aa, Staphylococcus aureus
LIGLLILATNEDALAKV

SEQ ID NO: 1588041 - protein, 22 aa, Staphylococcus aureus
LIISCLKLILILLFLLSILLVI

SEQ ID NO: 1588042 - protein, 25 aa, Staphylococcus aureus
LIKQLVIRMYLKFKQLATKRLNKCM

SEQ ID NO: 1588043 - protein, 24 aa, Staphylococcus aureus
LIVIIVCLLFKMATVPAMLISSFS

SEQ ID NO: 1588044 - protein, 18 aa, Staphylococcus aureus
LKDKTDWVGHKIDESIEV

SEQ ID NO: 1588045 - protein, 21 aa, Staphylococcus aureus
LKDNEHSPLLFAKRRKDKEED

SEQ ID NO: 1588046 - protein, 19 aa, Staphylococcus aureus
LKLDIKWPFLLSELGIVLL

SEQ ID NO: 1588047 - protein, 21 aa, Staphylococcus aureus
LKSERSFSIFLSISLVLIITG

SEQ ID NO: 1588048 - protein, 20 aa, Staphylococcus aureus
LKVFKWRIVGFLAFLLIAIL

SEQ ID NO: 1588049 - protein, 21 aa, Staphylococcus aureus
LKVFKWRIVGFLAFLLIAILF

SEQ ID NO: 1588050 - protein, 17 aa, Staphylococcus aureus
LKYSTEITLNFDSEDIE

SEQ ID NO: 1588051 - protein, 19 aa, Staphylococcus aureus
LLFCAGVAFAFYVGFPMII

SEQ ID NO: 1588052 - protein, 20 aa, Staphylococcus aureus
LLFCAGVAFAFYVSFPMIIQ

SEQ ID NO: 1588053 - protein, 19 aa, Staphylococcus aureus
LLFLRNIRTTAISIISIPL

SEQ ID NO: 1588054 - protein, 18 aa, Staphylococcus aureus
LLGIIAMKKLFVNNRASG

SEQ ID NO: 1588055 - protein, 17 aa, Staphylococcus aureus
LLIKAIITWLLLIPVFN

SEQ ID NO: 1588056 - protein, 23 aa, Staphylococcus aureus
LLKIGLILFCVLFFLFPVILMFV

SEQ ID NO: 1588057 - protein, 18 aa, Staphylococcus aureus
LLNFRVFKNRTFALCTIS

SEQ ID NO: 1588058 - protein, 17 aa, Staphylococcus aureus
LLPAVIVLLMIVGTATL

SEQ ID NO: 1588059 - protein, 18 aa, Staphylococcus aureus
LLPFHWRTLQSVNWQAVQ

SEQ ID NO: 1588060 - protein, 22 aa, Staphylococcus aureus
LLYLLFCWTGIPGVIGMVEGVL

SEQ ID NO: 1588061 - protein, 17 aa, Staphylococcus aureus
LMRRGYENINMFTIIQL

SEQ ID NO: 1588062 - protein, 17 aa, Staphylococcus aureus
LNITCLFEKPSVFKSLV

SEQ ID NO: 1588063 - protein, 17 aa, Staphylococcus aureus
LNKYPVVFVHGFLGLVG

SEQ ID NO: 1588064 - protein, 23 aa, Staphylococcus aureus
LNKYPVVFVHGFLGLVGDNAPAL

SEQ ID NO: 1588065 - protein, 19 aa, Staphylococcus aureus
LNMTFNYCKKRVWRYDMDR

SEQ ID NO: 1588066 - protein, 18 aa, Staphylococcus aureus
LNMTFNYCKKRVWSYDMD

SEQ ID NO: 1588067 - protein, 24 aa, Staphylococcus aureus
LNNASFWKEYKFYNVNNQELATTV

SEQ ID NO: 1588068 - protein, 21 aa, Staphylococcus aureus
LNPEVIKWAKKVYGLTVLDTW

SEQ ID NO: 1588069 - protein, 22 aa, Staphylococcus aureus
LNYAEFFLCIVLSLGVVAPIKN

SEQ ID NO: 1588070 - protein, 19 aa, Staphylococcus aureus
LPFLISLRFYVFFFVGVLI

SEQ ID NO: 1588071 - protein, 18 aa, Staphylococcus aureus
LPGLLSFLADNSFKTKVQ

SEQ ID NO: 1588072 - protein, 26 aa, Staphylococcus aureus
LPNKLNKYSIRRFTVGTASILVGATL

SEQ ID NO: 1588073 - protein, 22 aa, Staphylococcus aureus
LPTDGFTYKWNRDTTGTNDANW

SEQ ID NO: 1588074 - protein, 21 aa, Staphylococcus aureus
LPWKVCLYIGIALGIVVTIFL

SEQ ID NO: 1588075 - protein, 18 aa, Staphylococcus aureus
LPYFLAGHHAFTYRNDLL

SEQ ID NO: 1588076 - protein, 18 aa, Staphylococcus aureus
LQLLGAMPRHVIEGFPTV

SEQ ID NO: 1588077 - protein, 25 aa, Staphylococcus aureus
LRKIKQKNWQSASLITLIKQLVIRM

SEQ ID NO: 1588078 - protein, 19 aa, Staphylococcus aureus
LRTSTSLSDSVSMSTSGSL

SEQ ID NO: 1588079 - protein, 19 aa, Staphylococcus aureus
LSACMTFLFVVIGFSIDIA

SEQ ID NO: 1588080 - protein, 17 aa, Staphylococcus aureus
LSFKGQIFFVSIDSMMD

SEQ ID NO: 1588081 - protein, 17 aa, Staphylococcus aureus
LSFKGQIFFVSIDSMME

SEQ ID NO: 1588082 - protein, 27 aa, Staphylococcus aureus
LSFKLYRFYFYRLFAIVTWILFIGSLS

SEQ ID NO: 1588083 - protein, 25 aa, Staphylococcus aureus
LSFKLYRFYFYRLFAIVTWLLFIGS

SEQ ID NO: 1588084 - protein, 23 aa, Staphylococcus aureus
LSFMMPVTMPFYLTTQNILLMVG

SEQ ID NO: 1588085 - protein, 22 aa, Staphylococcus aureus
LSIPEFIIMIALASFFQPSIWN

SEQ ID NO: 1588086 - protein, 19 aa, Staphylococcus aureus
LSVPLISLFGVCIITILLL

SEQ ID NO: 1588087 - protein, 19 aa, Staphylococcus aureus
LTKTYTFVFTDYVNDKQNI

SEQ ID NO: 1588088 - protein, 23 aa, Staphylococcus aureus
LTLILICFPDIFGTNYLSRGYLI

SEQ ID NO: 1588089 - protein, 23 aa, Staphylococcus aureus
LTLILICFPDIFGTSYLSRSYLI

SEQ ID NO: 1588090 - protein, 19 aa, Staphylococcus aureus
LTMIICLTITYLVHNDYFV

SEQ ID NO: 1588091 - protein, 19 aa, Staphylococcus aureus
LVCNFCFIIWLLYTNTLLK

SEQ ID NO: 1588092 - protein, 21 aa, Staphylococcus aureus
LVELIRWLFTFGILFQLPILF

SEQ ID NO: 1588093 - protein, 19 aa, Staphylococcus aureus
LVFLEGIFKTLLNKNSQVV

SEQ ID NO: 1588094 - protein, 19 aa, Staphylococcus aureus
LVGILCFCIPFTINGNNTI

SEQ ID NO: 1588095 - protein, 18 aa, Staphylococcus aureus
LVGKEFLEKWAGVPTEVH

SEQ ID NO: 1588096 - protein, 18 aa, Staphylococcus aureus
LVGWRYTFLFLIIVSVIV

SEQ ID NO: 1588097 - protein, 19 aa, Staphylococcus aureus
LVVGLALIVHMIINRLFRK

SEQ ID NO: 1588098 - protein, 17 aa, Staphylococcus aureus
LYFEIITTIAIGLGIIF

SEQ ID NO: 1588099 - protein, 18 aa, Staphylococcus aureus
LYNLMLLKEEKLFYKCVN

SEQ ID NO: 1588100 - protein, 19 aa, Staphylococcus aureus
LYRFFKRIHLGWFVLPIPI

SEQ ID NO: 1588101 - protein, 17 aa, Staphylococcus aureus
LYRIIKLIIIFLIELIK

SEQ ID NO: 1588102 - protein, 27 aa, Staphylococcus aureus
MAEALKRGFLIFCLIGFGVGVLANASF

SEQ ID NO: 1588103 - protein, 23 aa, Staphylococcus aureus
MDGFKIAVVVAVMLLAFISLMEA

SEQ ID NO: 1588104 - protein, 24 aa, Staphylococcus aureus
MFGYPEQRYGYYYNSYQLTWDNGL

SEQ ID NO: 1588105 - protein, 17 aa, Staphylococcus aureus
MFLAMKWEQIHLKDGLK

SEQ ID NO: 1588106 - protein, 23 aa, Staphylococcus aureus
MFSTFRFSWAYRLATIITLIISI

SEQ ID NO: 1588107 - protein, 25 aa, Staphylococcus aureus
MGYIKRIGLYISIFILIVMVAGCGK

SEQ ID NO: 1588108 - protein, 25 aa, Staphylococcus aureus
MGYLKRFALYISVMILIFAIAGCGK

SEQ ID NO: 1588109 - protein, 17 aa, Staphylococcus aureus
MILIQIICVMMGLWIYQ

SEQ ID NO: 1588110 - protein, 18 aa, Staphylococcus aureus
MINPILIGFFVFFFTFLI

SEQ ID NO: 1588111 - protein, 22 aa, Staphylococcus aureus
MIPCEPDHPLVYWATFSNASDL

SEQ ID NO: 1588112 - protein, 19 aa, Staphylococcus aureus
MISPSFIKQKWFGEQRTPV

SEQ ID NO: 1588113 - protein, 18 aa, Staphylococcus aureus
MIVVIAFWGAIVVTVLVV

SEQ ID NO: 1588114 - protein, 23 aa, Staphylococcus aureus
MKCLSKWAFYISFLILVISITAG

SEQ ID NO: 1588115 - protein, 19 aa, Staphylococcus aureus
MLFGGLFSILGLVLLRRNK

SEQ ID NO: 1588116 - protein, 25 aa, Staphylococcus aureus
MLKGLLLKITFNFGLPLLIAILHAV

SEQ ID NO: 1588117 - protein, 20 aa, Staphylococcus aureus
MLMVWDRLTGGLIFVGGVVS

SEQ ID NO: 1588118 - protein, 18 aa, Staphylococcus aureus
MMVPLIIMIAMFFIHFNT

SEQ ID NO: 1588119 - protein, 18 aa, Staphylococcus aureus
MRTAQRMAKTYIPDEIKT

SEQ ID NO: 1588120 - protein, 18 aa, Staphylococcus aureus
MSIPLIAVIFSWWLATKT

SEQ ID NO: 1588121 - protein, 18 aa, Staphylococcus aureus
MSSWPWHWAEPMKHLMEN

SEQ ID NO: 1588122 - protein, 20 aa, Staphylococcus aureus
MVVFSIMLFLFVKRNKKKNK

SEQ ID NO: 1588123 - protein, 17 aa, Staphylococcus aureus
MYVFKFGPSILFMNCTQ

SEQ ID NO: 1588124 - protein, 18 aa, Staphylococcus aureus
NALFWFTFLLAIMIVIGA

SEQ ID NO: 1588125 - protein, 21 aa, Staphylococcus aureus
NAQPRATFRSVSSNARTTNVN

SEQ ID NO: 1588126 - protein, 17 aa, Staphylococcus aureus
NATLFGAMMALLGSLLL

SEQ ID NO: 1588127 - protein, 21 aa, Staphylococcus aureus
NDIDKRVQALIDEIDQNPNLT

SEQ ID NO: 1588128 - protein, 17 aa, Staphylococcus aureus
NEAIPLFATVIVVLAFF

SEQ ID NO: 1588129 - protein, 22 aa, Staphylococcus aureus
NEKGIKGVYVILKDSNGKELDR

SEQ ID NO: 1588130 - protein, 19 aa, Staphylococcus aureus
NFFQMLWLKLKAMKHYKAL

SEQ ID NO: 1588131 - protein, 27 aa, Staphylococcus aureus
NFKVAGKVKSGDYFTAKLPDSVTGNGD

SEQ ID NO: 1588132 - protein, 18 aa, Staphylococcus aureus
NGDYRVEFSNLPQGYEVT

SEQ ID NO: 1588133 - protein, 17 aa, Staphylococcus aureus
NGIARILAVQIVTSDHS

SEQ ID NO: 1588134 - protein, 21 aa, Staphylococcus aureus
NGKFSLPLFTDRAKAPKSGIY

SEQ ID NO: 1588135 - protein, 24 aa, Staphylococcus aureus
NGMLFGGLFSILGLALLRRNKKNH

SEQ ID NO: 1588136 - protein, 19 aa, Staphylococcus aureus
NGRLGRILIILMLVNAGVI

SEQ ID NO: 1588137 - protein, 21 aa, Staphylococcus aureus
NGTLPRFSIGTMWKDIKSGAS

SEQ ID NO: 1588138 - protein, 24 aa, Staphylococcus aureus
NIFSRRFWPSFTFLIPIIIGMLLA

SEQ ID NO: 1588139 - protein, 17 aa, Staphylococcus aureus
NIIKGIVISIVFILLYR

SEQ ID NO: 1588140 - protein, 19 aa, Staphylococcus aureus
NKNLCLSVSMLDNLVKGAA

SEQ ID NO: 1588141 - protein, 25 aa, Staphylococcus aureus
NKTTTTFKYEVTRNSMSDSVSTSGS

SEQ ID NO: 1588142 - protein, 20 aa, Staphylococcus aureus
NKWIACLLVAFPIFTSFTTY

SEQ ID NO: 1588143 - protein, 24 aa, Staphylococcus aureus
NLDSGKYKVIFEKPAGLTQTGTNT

SEQ ID NO: 1588144 - protein, 17 aa, Staphylococcus aureus
NLFSEKILDEFISSNSF

SEQ ID NO: 1588145 - protein, 21 aa, Staphylococcus aureus
NLMSRVKLNQFQRIQILTQVQ

SEQ ID NO: 1588146 - protein, 17 aa, Staphylococcus aureus
NLVGRVCRFNEIFNNSS

SEQ ID NO: 1588147 - protein, 18 aa, Staphylococcus aureus
NLVGRVCRFNEIFNNSSG

SEQ ID NO: 1588148 - protein, 19 aa, Staphylococcus aureus
NMPLKGYVVRGGREMENHF

SEQ ID NO: 1588149 - protein, 22 aa, Staphylococcus aureus
NMPVLHLHYGYYICLAVMFVIA

SEQ ID NO: 1588150 - protein, 19 aa, Staphylococcus aureus
NQLREAMKFDQSFKPSQIK

SEQ ID NO: 1588151 - protein, 19 aa, Staphylococcus aureus
NRKAEALQRLDQLTHLNNA

SEQ ID NO: 1588152 - protein, 19 aa, Staphylococcus aureus
NRKSEALQRLDQLTHLNNA

SEQ ID NO: 1588153 - protein, 20 aa, Staphylococcus aureus
NRKSEALQRLDQLTHLNNAQ

SEQ ID NO: 1588154 - protein, 17 aa, Staphylococcus aureus
NSGGFKIDTGYIYTSSM

SEQ ID NO: 1588155 - protein, 17 aa, Staphylococcus aureus
NSVQMGINYSIYMDADT

SEQ ID NO: 1588156 - protein, 19 aa, Staphylococcus aureus
NTFMAAKFTVTGQVKAGDY

SEQ ID NO: 1588157 - protein, 18 aa, Staphylococcus aureus
NTILRWLSIFVIPLFGII

SEQ ID NO: 1588158 - protein, 24 aa, Staphylococcus aureus
NTSAPRMRAFSLAAVAADAPAAGT

SEQ ID NO: 1588159 - protein, 24 aa, Staphylococcus aureus
NTYLLRQVKSIGMFLMIAAVGLYF

SEQ ID NO: 1588160 - protein, 23 aa, Staphylococcus aureus
NVRMPRMLAGLFIGGALAVSGLL

SEQ ID NO: 1588161 - protein, 17 aa, Staphylococcus aureus
NVSGSFEQVAFAKRENA

SEQ ID NO: 1588162 - protein, 25 aa, Staphylococcus aureus
PALYPNYWGGSKFKVIEELRKQGYN

SEQ ID NO: 1588163 - protein, 17 aa, Staphylococcus aureus
PEKVSVNLLANGEKVET

SEQ ID NO: 1588164 - protein, 20 aa, Staphylococcus aureus
PEQKLPLYIVFTLFVVVAIV

SEQ ID NO: 1588165 - protein, 18 aa, Staphylococcus aureus
PIIQGCVLFIGFFVVLIN

SEQ ID NO: 1588166 - protein, 17 aa, Staphylococcus aureus
PKFNDWIFIISVYYIFW

SEQ ID NO: 1588167 - protein, 20 aa, Staphylococcus aureus
PKISATFLAWLLIFLMFALP

SEQ ID NO: 1588168 - protein, 23 aa, Staphylococcus aureus
PLAARLVALVTKFGWAKTGTLVL

SEQ ID NO: 1588169 - protein, 24 aa, Staphylococcus aureus
PLAARLVALVTRFGWAKTGTLVLS

SEQ ID NO: 1588170 - protein, 19 aa, Staphylococcus aureus
PLHMRHFGDRIGNVIKNAL

SEQ ID NO: 1588171 - protein, 18 aa, Staphylococcus aureus
PLIKRYAIQFIHHQTKLH

SEQ ID NO: 1588172 - protein, 18 aa, Staphylococcus aureus
PLPNRKDFVVSFITGALV

SEQ ID NO: 1588173 - protein, 17 aa, Staphylococcus aureus
PLVLLILEFELNFESKI

SEQ ID NO: 1588174 - protein, 17 aa, Staphylococcus aureus
PMANVLVTLTYPDGTTK

SEQ ID NO: 1588175 - protein, 23 aa, Staphylococcus aureus
PNGVIKARSSITMNNVTYTTQDE

SEQ ID NO: 1588176 - protein, 41 aa, Staphylococcus aureus
PNSKGDLALRSTLYGYDSRFVWRSMSWDNEVAFNNGSGSGD

SEQ ID NO: 1588177 - protein, 40 aa, Staphylococcus aureus
PNSKGDLALRSTLYGYNSNIIWRSMSWDNEVAFNNGSGSG

SEQ ID NO: 1588178 - protein, 21 aa, Staphylococcus aureus
PQVFKSMMVPLIIMIAMFFIH

SEQ ID NO: 1588179 - protein, 19 aa, Staphylococcus aureus
PRGEFLHMLLGVFLAALVS

SEQ ID NO: 1588180 - protein, 22 aa, Staphylococcus aureus
PRGEFLHMLLGVFLSALVSFVV

SEQ ID NO: 1588181 - protein, 23 aa, Staphylococcus aureus
PSFYAWFNLWAMWDPYGNTGHIK

SEQ ID NO: 1588182 - protein, 19 aa, Staphylococcus aureus
PSFYPSFIALLIINLAVLV

SEQ ID NO: 1588183 - protein, 19 aa, Staphylococcus aureus
PSVRTRAVRSLAVAEPVVN

SEQ ID NO: 1588184 - protein, 21 aa, Staphylococcus aureus
PSVRTRAVRSLAVAEPVVNAA

SEQ ID NO: 1588185 - protein, 22 aa, Staphylococcus aureus
PSVRTRAVRSLAVAEPVVNAAD

SEQ ID NO: 1588186 - protein, 19 aa, Staphylococcus aureus
PVYLGMPMGIVFEVEGKTI

SEQ ID NO: 1588187 - protein, 17 aa, Staphylococcus aureus
PWIVLGMLLVKLKILLA

SEQ ID NO: 1588188 - protein, 19 aa, Staphylococcus aureus
PWLNRIIVLILMFLNGFGI

SEQ ID NO: 1588189 - protein, 20 aa, Staphylococcus aureus
PWNDFFKRFSFYAIAIQHFV

SEQ ID NO: 1588190 - protein, 20 aa, Staphylococcus aureus
PWNDFFKRFSFYAIAIQYFV

SEQ ID NO: 1588191 - protein, 21 aa, Staphylococcus aureus
QALDHAMELLRNSVADNQATL

SEQ ID NO: 1588192 - protein, 22 aa, Staphylococcus aureus
QDRYGRTLAYVWISKDRMYNKE

SEQ ID NO: 1588193 - protein, 20 aa, Staphylococcus aureus
QFIPEFIGSLVIGIIAVIGH

SEQ ID NO: 1588194 - protein, 23 aa, Staphylococcus aureus
QFIPEFIGSLVIGIIAVIGHTLI

SEQ ID NO: 1588195 - protein, 17 aa, Staphylococcus aureus
QGKEHFEGYGSVDIQKK

SEQ ID NO: 1588196 - protein, 20 aa, Staphylococcus aureus
QGWSNIWFDLLILMIFIIVF

SEQ ID NO: 1588197 - protein, 20 aa, Staphylococcus aureus
QGWSNIWFDLLILMIFIMVF

SEQ ID NO: 1588198 - protein, 32 aa, Staphylococcus aureus
QKKSKKGWFWGCGGCLVLFILIIIGISACTAG

SEQ ID NO: 1588199 - protein, 17 aa, Staphylococcus aureus
QLIKRLKAGKVYKRDRL

SEQ ID NO: 1588200 - protein, 21 aa, Staphylococcus aureus
QLLLRKIHGYSLFSSNVRYLT

SEQ ID NO: 1588201 - protein, 20 aa, Staphylococcus aureus
QNAQRMNFQFTNSYGPSKDV

SEQ ID NO: 1588202 - protein, 21 aa, Staphylococcus aureus
QNIRFDDMIKLHIESSEEARH

SEQ ID NO: 1588203 - protein, 19 aa, Staphylococcus aureus
QRMIITWVITLPISAFLAA

SEQ ID NO: 1588204 - protein, 17 aa, Staphylococcus aureus
QRMNFQFTNSYGPSKDV

SEQ ID NO: 1588205 - protein, 18 aa, Staphylococcus aureus
QRVLGNTWVYIKGYQDKI

SEQ ID NO: 1588206 - protein, 23 aa, Staphylococcus aureus
QSKLILIFICIFTFFLMVIQSQF

SEQ ID NO: 1588207 - protein, 19 aa, Staphylococcus aureus
QSKRLALASAEEGYVESAE

SEQ ID NO: 1588208 - protein, 19 aa, Staphylococcus aureus
QSRIELFTTDGLQVIGNIS

SEQ ID NO: 1588209 - protein, 20 aa, Staphylococcus aureus
QSRIELFTTDGLQVIGNIST

SEQ ID NO: 1588210 - protein, 20 aa, Staphylococcus aureus
QVFWRILLFYVLSIAVIGAI

SEQ ID NO: 1588211 - protein, 17 aa, Staphylococcus aureus
QVTSAGRVSVANGVEHT

SEQ ID NO: 1588212 - protein, 19 aa, Staphylococcus aureus
QVWLGFPFVFALFTGVLQS

SEQ ID NO: 1588213 - protein, 18 aa, Staphylococcus aureus
QYFSSRIDKILTHKYIGM

SEQ ID NO: 1588214 - protein, 17 aa, Staphylococcus aureus
RDKGMANASGFKIDTAY

SEQ ID NO: 1588215 - protein, 17 aa, Staphylococcus aureus
REIEFAGIIFSFTGQSS

SEQ ID NO: 1588216 - protein, 20 aa, Staphylococcus aureus
RFGSILIVRWAMLISGVAMN

SEQ ID NO: 1588217 - protein, 24 aa, Staphylococcus aureus
RFNSVKMGINYSIYMDADTIPVDK

SEQ ID NO: 1588218 - protein, 17 aa, Staphylococcus aureus
RGYENINMFTIIQLLTP

SEQ ID NO: 1588219 - protein, 20 aa, Staphylococcus aureus
RIDSNKSFHFSGKVNLGNKY

SEQ ID NO: 1588220 - protein, 17 aa, Staphylococcus aureus
RIFEVNDTSKLSDSYYA

SEQ ID NO: 1588221 - protein, 24 aa, Staphylococcus aureus
RIFYEHPNVASINFGDINKTYVVL

SEQ ID NO: 1588222 - protein, 17 aa, Staphylococcus aureus
RILKSELLLAFSTSNSE

SEQ ID NO: 1588223 - protein, 20 aa, Staphylococcus aureus
RISFPNANQYKVEFPTDDDQ

SEQ ID NO: 1588224 - protein, 29 aa, Staphylococcus aureus
RKKSIGVASVLVGTLIGFGLLSSKEADAS

SEQ ID NO: 1588225 - protein, 17 aa, Staphylococcus aureus
RKLRIWLYLVLLAVFIG

SEQ ID NO: 1588226 - protein, 17 aa, Staphylococcus aureus
RKQEAISRIKDFSNEKI

SEQ ID NO: 1588227 - protein, 24 aa, Staphylococcus aureus
RLAEEKGRVIGMAKLKTIKEQEKP

SEQ ID NO: 1588228 - protein, 22 aa, Staphylococcus aureus
RLFKNILRFIGLVILLDILMFL

SEQ ID NO: 1588229 - protein, 19 aa, Staphylococcus aureus
RMLLSIILCAYIQGVYSGR

SEQ ID NO: 1588230 - protein, 18 aa, Staphylococcus aureus
RPFGGVIPNCMTQEEYQE

SEQ ID NO: 1588231 - protein, 21 aa, Staphylococcus aureus
RPHPFLGRQVLTWGYFLCSFI

SEQ ID NO: 1588232 - protein, 19 aa, Staphylococcus aureus
RPTEIKVELYQDGKATVKT

SEQ ID NO: 1588233 - protein, 18 aa, Staphylococcus aureus
RRANGLSGNNIRNGQQIV

SEQ ID NO: 1588234 - protein, 24 aa, Staphylococcus aureus
RRNKLKFGLIIGVLAMISYLLFLL

SEQ ID NO: 1588235 - protein, 20 aa, Staphylococcus aureus
RRNKWFGFIIIILVILLVAL

SEQ ID NO: 1588236 - protein, 19 aa, Staphylococcus aureus
RRTSCCIICIPVLIHTIPI

SEQ ID NO: 1588237 - protein, 20 aa, Staphylococcus aureus
RSGLTIGVAFVGIFLVIDLL

SEQ ID NO: 1588238 - protein, 17 aa, Staphylococcus aureus
RTLMLIPTWKSFIFTSF

SEQ ID NO: 1588239 - protein, 24 aa, Staphylococcus aureus
RVGWGEIPMSLGFTYSSNTLMMHL

SEQ ID NO: 1588240 - protein, 24 aa, Staphylococcus aureus
RVHLKRWHFISILIGTILITAVIT

SEQ ID NO: 1588241 - protein, 19 aa, Staphylococcus aureus
RVISRWLRYVLIVIGSAAL

SEQ ID NO: 1588242 - protein, 20 aa, Staphylococcus aureus
RVLGNTWLYIKGYQDKIEES

SEQ ID NO: 1588243 - protein, 17 aa, Staphylococcus aureus
RVLGNTWVYIKGYQDKI

SEQ ID NO: 1588244 - protein, 17 aa, Staphylococcus aureus
RWMFALAFFFIGVIAYM

SEQ ID NO: 1588245 - protein, 17 aa, Staphylococcus aureus
RYLLRAMMAGFIIGIIT

SEQ ID NO: 1588246 - protein, 17 aa, Staphylococcus aureus
RYLLRAMMAGFIIRIIT

SEQ ID NO: 1588247 - protein, 20 aa, Staphylococcus aureus
RYSFPLELNFWFGLLYLSIL

SEQ ID NO: 1588248 - protein, 20 aa, Staphylococcus aureus
RYSNGIMRTNLEGVTITTPQ

SEQ ID NO: 1588249 - protein, 19 aa, Staphylococcus aureus
RYTTHLEFEKAIPTLADAA

SEQ ID NO: 1588250 - protein, 17 aa, Staphylococcus aureus
SAFLSGLMLEFISMLGI

SEQ ID NO: 1588251 - protein, 24 aa, Staphylococcus aureus
SAGAARLLLFFGLLDAGSAIATSS

SEQ ID NO: 1588252 - protein, 17 aa, Staphylococcus aureus
SDSLRTSTSLSDSLSMS

SEQ ID NO: 1588253 - protein, 17 aa, Staphylococcus aureus
SDSLRTSTSLSDSVSMS

SEQ ID NO: 1588254 - protein, 24 aa, Staphylococcus aureus
SEAIHFCFTYRHALRLVSPDTLFA

SEQ ID NO: 1588255 - protein, 21 aa, Staphylococcus aureus
SEIIQSYILSLAINFHPHEVA

SEQ ID NO: 1588256 - protein, 21 aa, Staphylococcus aureus
SETLARLGIVLGVFLMSLQMG

SEQ ID NO: 1588257 - protein, 21 aa, Staphylococcus aureus
SETLARLGIVLGVFLTSLQMG

SEQ ID NO: 1588258 - protein, 19 aa, Staphylococcus aureus
SEYGISLIFVEDVIESLPE

SEQ ID NO: 1588259 - protein, 24 aa, Staphylococcus aureus
SFAKRVFTALGIGIIFGVLLHLIY

SEQ ID NO: 1588260 - protein, 20 aa, Staphylococcus aureus
SFILAFPMALIWPTIQSELN

SEQ ID NO: 1588261 - protein, 17 aa, Staphylococcus aureus
SFYPSFIALLIINLAVL

SEQ ID NO: 1588262 - protein, 18 aa, Staphylococcus aureus
SGDYFTAKLPDSVTGNGD

SEQ ID NO: 1588263 - protein, 22 aa, Staphylococcus aureus
SGFYKTPKYNLGNYVWEDTNKD

SEQ ID NO: 1588264 - protein, 23 aa, Staphylococcus aureus
SGFYKTPKYNLGNYVWEDTNKDG

SEQ ID NO: 1588265 - protein, 25 aa, Staphylococcus aureus
SGIFSRRFWPSFTFLIPIIIGVLLA

SEQ ID NO: 1588266 - protein, 20 aa, Staphylococcus aureus
SGLLASFWFFIAKRRRKEDE

SEQ ID NO: 1588267 - protein, 21 aa, Staphylococcus aureus
SGLMLEFISMLGIGLVALEVT

SEQ ID NO: 1588268 - protein, 20 aa, Staphylococcus aureus
SGNIFYTWDKVFGMPETTNV

SEQ ID NO: 1588269 - protein, 19 aa, Staphylococcus aureus
SGTANFSLSMTASTGGATN

SEQ ID NO: 1588270 - protein, 17 aa, Staphylococcus aureus
SIFFLKKYIDMIISTIK

SEQ ID NO: 1588271 - protein, 17 aa, Staphylococcus aureus
SIRRFTVGTTSVIVGAT

SEQ ID NO: 1588272 - protein, 18 aa, Staphylococcus aureus
SIRRFTVGTTSVIVGATI

SEQ ID NO: 1588273 - protein, 25 aa, Staphylococcus aureus
SISKKMTGYGLKTTAVIGGAFTINM

SEQ ID NO: 1588274 - protein, 40 aa, Staphylococcus aureus
SKKKMSTTVKVVSIATVLLLLGGLVFAIFAYVDHSNKAKE

SEQ ID NO: 1588275 - protein, 23 aa, Staphylococcus aureus
SKKMTGYGLKTTAVIGGAFTVNM

SEQ ID NO: 1588276 - protein, 35 aa, Staphylococcus aureus
SKSWLAIVCSMMVVFSIMLFLFVKRNKKKIKTNHS

SEQ ID NO: 1588277 - protein, 20 aa, Staphylococcus aureus
SLASDLLGIIAMKKLFVNNR

SEQ ID NO: 1588278 - protein, 17 aa, Staphylococcus aureus
SLFFYYLFTKLSLISVL

SEQ ID NO: 1588279 - protein, 25 aa, Staphylococcus aureus
SLFGVCIITILLLCSSVILLTNHQH

SEQ ID NO: 1588280 - protein, 20 aa, Staphylococcus aureus
SLGMCAYIIRLIRSNLLSLY

SEQ ID NO: 1588281 - protein, 25 aa, Staphylococcus aureus
SLMKLGFKGGEKFAVKTGLQKTMQQ

SEQ ID NO: 1588282 - protein, 24 aa, Staphylococcus aureus
SNFWIYWKMMFAFEPWHSAMEMRR

SEQ ID NO: 1588283 - protein, 19 aa, Staphylococcus aureus
SNLFSEKILDEFISSNSFP

SEQ ID NO: 1588284 - protein, 21 aa, Staphylococcus aureus
SNYFRFQYFNPLKSERYYRNL

SEQ ID NO: 1588285 - protein, 19 aa, Staphylococcus aureus
SPWMLLKLAVVWTLVQFVE

SEQ ID NO: 1588286 - protein, 17 aa, Staphylococcus aureus
SRIELFTTDGLQVIGDI

SEQ ID NO: 1588287 - protein, 17 aa, Staphylococcus aureus
SRLFWRIYRKYLGGKSF

SEQ ID NO: 1588288 - protein, 18 aa, Staphylococcus aureus
SRLNNILTILSIVLVIIH

SEQ ID NO: 1588289 - protein, 23 aa, Staphylococcus aureus
SRRSKKWLYIIIAILLIIVAIFV

SEQ ID NO: 1588290 - protein, 17 aa, Staphylococcus aureus
SSTGFILASAGSAIGLG

SEQ ID NO: 1588291 - protein, 21 aa, Staphylococcus aureus
STAKVPPIMAGDQVLANGVID

SEQ ID NO: 1588292 - protein, 23 aa, Staphylococcus aureus
STIMSCISFLYTLDFITKSLTKN

SEQ ID NO: 1588293 - protein, 28 aa, Staphylococcus aureus
STNKGMLFGGLFSILGLTLLRRNKKNNK

SEQ ID NO: 1588294 - protein, 17 aa, Staphylococcus aureus
STRKIVLLSLIFSLLMI

SEQ ID NO: 1588295 - protein, 18 aa, Staphylococcus aureus
STSIRMSTIVSESVSEST

SEQ ID NO: 1588296 - protein, 17 aa, Staphylococcus aureus
SVLRYYFWLTILIIAII

SEQ ID NO: 1588297 - protein, 20 aa, Staphylococcus aureus
SVRIQNRWVVFILFLICSFG

SEQ ID NO: 1588298 - protein, 18 aa, Staphylococcus aureus
SVRTRAVRSLAVAEPVVN

SEQ ID NO: 1588299 - protein, 26 aa, Staphylococcus aureus
SWLSLCICIALALALYALPYLILGSN

SEQ ID NO: 1588300 - protein, 21 aa, Staphylococcus aureus
SWLTLCLCIAIALILYALPYL

SEQ ID NO: 1588301 - protein, 18 aa, Staphylococcus aureus
SYHIFRIFFILFIIAPGI

SEQ ID NO: 1588302 - protein, 19 aa, Staphylococcus aureus
SYRAAILYHEWYFMDHLKL

SEQ ID NO: 1588303 - protein, 19 aa, Staphylococcus aureus
SYRAAILYQNWFFITHWKL

SEQ ID NO: 1588304 - protein, 23 aa, Staphylococcus aureus
TAGQCTWYAYGIRQKMGKPISTY

SEQ ID NO: 1588305 - protein, 17 aa, Staphylococcus aureus
TAIYISPFWFIFLFFFY

SEQ ID NO: 1588306 - protein, 25 aa, Staphylococcus aureus
TAPVKIRTFSRLAMSTFASAATTSA

SEQ ID NO: 1588307 - protein, 19 aa, Staphylococcus aureus
TFMAANFKVAGKVKSGDYF

SEQ ID NO: 1588308 - protein, 17 aa, Staphylococcus aureus
TFMAANFTVTGQVKSGD

SEQ ID NO: 1588309 - protein, 18 aa, Staphylococcus aureus
TGADGWGFMFTQGNGQDF

SEQ ID NO: 1588310 - protein, 23 aa, Staphylococcus aureus
TGDGYQWVIKFNKGHAPHQNMIF

SEQ ID NO: 1588311 - protein, 18 aa, Staphylococcus aureus
TGKTEFWATSSDVLKLKA

SEQ ID NO: 1588312 - protein, 29 aa, Staphylococcus aureus
TITATYAGKTWKATTDDLGIDKSQKYNFL

SEQ ID NO: 1588313 - protein, 18 aa, Staphylococcus aureus
TKAFGRQNFEYINGQKPA

SEQ ID NO: 1588314 - protein, 25 aa, Staphylococcus aureus
TKQPIPHKTIREFDPTLEPGSPDVI

SEQ ID NO: 1588315 - protein, 20 aa, Staphylococcus aureus
TKRNKFRLVIEIVILELIIG

SEQ ID NO: 1588316 - protein, 18 aa, Staphylococcus aureus
TKTYTFVFTDYVNNKENI

SEQ ID NO: 1588317 - protein, 24 aa, Staphylococcus aureus
TKVFPMWLRWSLFIILVGVDTYIA

SEQ ID NO: 1588318 - protein, 19 aa, Staphylococcus aureus
TLFGSLFAALGGLFLVGRR

SEQ ID NO: 1588319 - protein, 17 aa, Staphylococcus aureus
TLITWFYTMLWSIVGVV

SEQ ID NO: 1588320 - protein, 18 aa, Staphylococcus aureus
TLLVGLGLMKRKKKKDEN

SEQ ID NO: 1588321 - protein, 19 aa, Staphylococcus aureus
TLMRRGYENINMFTIIQLL

SEQ ID NO: 1588322 - protein, 21 aa, Staphylococcus aureus
TLMRRGYENINMFTIIQLLTP

SEQ ID NO: 1588323 - protein, 22 aa, Staphylococcus aureus
TLMRRGYENINMFTIIQLVTPF

SEQ ID NO: 1588324 - protein, 20 aa, Staphylococcus aureus
TNATLFGAMMALLGSLLLFR

SEQ ID NO: 1588325 - protein, 26 aa, Staphylococcus aureus
TNATLFGAMMALLGSLLLFRKRKQDH

SEQ ID NO: 1588326 - protein, 30 aa, Staphylococcus aureus
TNIFPYTGVVAFKSATGFVVGKNTILTNKH

SEQ ID NO: 1588327 - protein, 25 aa, Staphylococcus aureus
TNTVTRLPSGLTFDSTNNTISGTPT

SEQ ID NO: 1588328 - protein, 19 aa, Staphylococcus aureus
TRMILGFIMSFLNAIFIAL

SEQ ID NO: 1588329 - protein, 20 aa, Staphylococcus aureus
TRNQMTFLFAIPITVALIHT

SEQ ID NO: 1588330 - protein, 44 aa, Staphylococcus aureus
TRVRLYKSGKNWVKSGIKEIEMFKIMGLPFISHSLVSQDNQSIS

SEQ ID NO: 1588331 - protein, 20 aa, Staphylococcus aureus
TSESLSMSGLTHNSTSVSDS

SEQ ID NO: 1588332 - protein, 23 aa, Staphylococcus aureus
TSISWPVLLVIAIIAAFIGVVVY

SEQ ID NO: 1588333 - protein, 20 aa, Staphylococcus aureus
TSNLTWKNGVAFYSNNAQGD

SEQ ID NO: 1588334 - protein, 26 aa, Staphylococcus aureus
TSSQSWWGLYALLGMLALFIPKFRKE

SEQ ID NO: 1588335 - protein, 27 aa, Staphylococcus aureus
TSSQSWWGLYALLGMLALLIPKFRKES

SEQ ID NO: 1588336 - protein, 27 aa, Staphylococcus aureus
TSSQSWWSLYALLGMLALFIPKFRKES

SEQ ID NO: 1588337 - protein, 17 aa, Staphylococcus aureus
TSTSLSDSLSMSTSGSL

SEQ ID NO: 1588338 - protein, 22 aa, Staphylococcus aureus
TSWFSRVAWSVAEKMGQALNFI

SEQ ID NO: 1588339 - protein, 34 aa, Staphylococcus aureus
TTAKVVSIATVLLLLGGLVFAIFAYVDHSNKAKE

SEQ ID NO: 1588340 - protein, 19 aa, Staphylococcus aureus
TTAVIGGAFTINMLHDQQA

SEQ ID NO: 1588341 - protein, 23 aa, Staphylococcus aureus
TTPYIVVVNGHIDPASTGDLALR

SEQ ID NO: 1588342 - protein, 18 aa, Staphylococcus aureus
TTPYIVVVNGHIDPNSKG

SEQ ID NO: 1588343 - protein, 23 aa, Staphylococcus aureus
TTWSHLKWAIPLIGIVLFIILTI

SEQ ID NO: 1588344 - protein, 17 aa, Staphylococcus aureus
TVGTTSVIVGATILFGI

SEQ ID NO: 1588345 - protein, 21 aa, Staphylococcus aureus
TVKATELNTAMSNLQNGINDE

SEQ ID NO: 1588346 - protein, 20 aa, Staphylococcus aureus
TVLILKRRTPVIAVDAPAQH

SEQ ID NO: 1588347 - protein, 22 aa, Staphylococcus aureus
TVPCYLCAIIAIIYGFTGIGIK

SEQ ID NO: 1588348 - protein, 29 aa, Staphylococcus aureus
TVYPHQAGYVKLNYGFSVPNSAVQGDTFK

SEQ ID NO: 1588349 - protein, 21 aa, Staphylococcus aureus
TWEGARISLFIGVVAAILDIF

SEQ ID NO: 1588350 - protein, 19 aa, Staphylococcus aureus
TWSHLKWAIPLIGIALFII

SEQ ID NO: 1588351 - protein, 20 aa, Staphylococcus aureus
TWSHLKWAIPLIGIALFIIL

SEQ ID NO: 1588352 - protein, 18 aa, Staphylococcus aureus
VAIGMGFVSWIKRTKNTA

SEQ ID NO: 1588353 - protein, 17 aa, Staphylococcus aureus
VASEGWGNINYVILPIF

SEQ ID NO: 1588354 - protein, 21 aa, Staphylococcus aureus
VDTGLSIPTIYAFKKSLDALP

SEQ ID NO: 1588355 - protein, 18 aa, Staphylococcus aureus
VELYYYIKGGRVDYGAAH

SEQ ID NO: 1588356 - protein, 17 aa, Staphylococcus aureus
VFFYFWGVFLYNSLHKC

SEQ ID NO: 1588357 - protein, 17 aa, Staphylococcus aureus
VFYVYAGNQGNASVNLG

SEQ ID NO: 1588358 - protein, 25 aa, Staphylococcus aureus
VGIGGLSNAFGFKLDTYHNTSKPNA

SEQ ID NO: 1588359 - protein, 25 aa, Staphylococcus aureus
VGIGGLSNAFGFKLDTYHNTSKPNS

SEQ ID NO: 1588360 - protein, 25 aa, Staphylococcus aureus
VGIGGLSNAFGFKLDTYHNTSTPNA

SEQ ID NO: 1588361 - protein, 17 aa, Staphylococcus aureus
VGILCFFIPFKINGNNT

SEQ ID NO: 1588362 - protein, 24 aa, Staphylococcus aureus
VGISGLLASFWFFIAKRRRKEDEE

SEQ ID NO: 1588363 - protein, 25 aa, Staphylococcus aureus
VGISGLLASFWFFIAKRRRKEDEEE

SEQ ID NO: 1588364 - protein, 17 aa, Staphylococcus aureus
VGKEFLEKWAGVPTEVY

SEQ ID NO: 1588365 - protein, 17 aa, Staphylococcus aureus
VGMPLMFAIAEFLGIRK

SEQ ID NO: 1588366 - protein, 26 aa, Staphylococcus aureus
VGTFSTVIATLVFLGFNTSQAHAAET

SEQ ID NO: 1588367 - protein, 17 aa, Staphylococcus aureus
VICYGLIFGLFYLLSGS

SEQ ID NO: 1588368 - protein, 19 aa, Staphylococcus aureus
VIDKRLKYIILHEYAHAKN

SEQ ID NO: 1588369 - protein, 19 aa, Staphylococcus aureus
VISKLGWLKIIFIESLPLR

SEQ ID NO: 1588370 - protein, 19 aa, Staphylococcus aureus
VKATLTMPAYIDPENVTKT

SEQ ID NO: 1588371 - protein, 17 aa, Staphylococcus aureus
VKDYAYIRFSVSNGTKA

SEQ ID NO: 1588372 - protein, 23 aa, Staphylococcus aureus
VKGRARTNPWIKWMNIVLTLAVI

SEQ ID NO: 1588373 - protein, 18 aa, Staphylococcus aureus
VKHVIPEIVAHSHYTVQG

SEQ ID NO: 1588374 - protein, 17 aa, Staphylococcus aureus
VKLPGKVKNGVVVDQVD

SEQ ID NO: 1588375 - protein, 25 aa, Staphylococcus aureus
VKRLNEIVICISFLFLTIFIGGCGT

SEQ ID NO: 1588376 - protein, 21 aa, Staphylococcus aureus
VKSGDYFTAKLPDSVTGNGDV

SEQ ID NO: 1588377 - protein, 33 aa, Staphylococcus aureus
VKSNLRYGIRKHKLGAASVFLGTMIVVGMGQEK

SEQ ID NO: 1588378 - protein, 23 aa, Staphylococcus aureus
VLANGVIDSFGNVIYTFTDYVNT

SEQ ID NO: 1588379 - protein, 18 aa, Staphylococcus aureus
VLLLKRNTPVIAVDAPAQ

SEQ ID NO: 1588380 - protein, 20 aa, Staphylococcus aureus
VNIFDWRYLFLVVLLIGMID

SEQ ID NO: 1588381 - protein, 20 aa, Staphylococcus aureus
VNLPFQFTFPGSEWVVLILS

SEQ ID NO: 1588382 - protein, 26 aa, Staphylococcus aureus
VNPSAPRMRAFSLAAVAADAPAAGTD

SEQ ID NO: 1588383 - protein, 21 aa, Staphylococcus aureus
VPCYLCAIIAIIYGFTGIGIK

SEQ ID NO: 1588384 - protein, 18 aa, Staphylococcus aureus
VPKFNDWIFIIFIISVYY

SEQ ID NO: 1588385 - protein, 21 aa, Staphylococcus aureus
VQSIICYLALHRLHKVPMMME

SEQ ID NO: 1588386 - protein, 17 aa, Staphylococcus aureus
VRIGWLILRILAVVFAW

SEQ ID NO: 1588387 - protein, 18 aa, Staphylococcus aureus
VRIGWLILRLLAVIFAWM

SEQ ID NO: 1588388 - protein, 20 aa, Staphylococcus aureus
VRIQPYFKYIDFIFAGVFAF

SEQ ID NO: 1588389 - protein, 17 aa, Staphylococcus aureus
VSGGMFLAMKWEQIHLK

SEQ ID NO: 1588390 - protein, 17 aa, Staphylococcus aureus
VSLFLSFLISKYDVKGS

SEQ ID NO: 1588391 - protein, 22 aa, Staphylococcus aureus
VSLRNIWDIPWIIPLVLILILI

SEQ ID NO: 1588392 - protein, 21 aa, Staphylococcus aureus
VSLRNIWDITWIIPLVLILIL

SEQ ID NO: 1588393 - protein, 17 aa, Staphylococcus aureus
VSMSLRSSESVSESDSL

SEQ ID NO: 1588394 - protein, 23 aa, Staphylococcus aureus
VSNCLRKKYNLVRIQSCINIESF

SEQ ID NO: 1588395 - protein, 19 aa, Staphylococcus aureus
VTDLAPLIAAIICIVIFKY

SEQ ID NO: 1588396 - protein, 20 aa, Staphylococcus aureus
VYEGFPFVAFCMYQEGFQSL

SEQ ID NO: 1588397 - protein, 17 aa, Staphylococcus aureus
VYLFRFVWVYVLYPYFY

SEQ ID NO: 1588398 - protein, 25 aa, Staphylococcus aureus
VYPHQAGYVKLNYGFSVPNEAVQGD

SEQ ID NO: 1588399 - protein, 27 aa, Staphylococcus aureus
VYPHQAGYVKLNYGFSVPNEAVQGDTF

SEQ ID NO: 1588400 - protein, 19 aa, Staphylococcus aureus
WEFIPALILAGSATYLYLK

SEQ ID NO: 1588401 - protein, 18 aa, Staphylococcus aureus
WFPVAGWEGISTVILPSF

SEQ ID NO: 1588402 - protein, 18 aa, Staphylococcus aureus
WFWFYIVLVSIVFPFEIG

SEQ ID NO: 1588403 - protein, 23 aa, Staphylococcus aureus
WGDEWPFVIAFLPWVLIIIPYLL

SEQ ID NO: 1588404 - protein, 17 aa, Staphylococcus aureus
WLFTFGILFQLPILFIG

SEQ ID NO: 1588405 - protein, 18 aa, Staphylococcus aureus
WLPELDLPLMDGLYLHML

SEQ ID NO: 1588406 - protein, 17 aa, Staphylococcus aureus
WNYWFNWVVTVAADITI

SEQ ID NO: 1588407 - protein, 20 aa, Staphylococcus aureus
WPTVHIYSLEDLSRASDYFS

SEQ ID NO: 1588408 - protein, 17 aa, Staphylococcus aureus
WSTLIAWVIIVAAIFIP

SEQ ID NO: 1588409 - protein, 18 aa, Staphylococcus aureus
WWLVIPVGLVYAVIYYFV

SEQ ID NO: 1588410 - protein, 17 aa, Staphylococcus aureus
WYISILILIVVIAGCGK

SEQ ID NO: 1588411 - protein, 26 aa, Staphylococcus aureus
YAGQTWTRNISDWIAKSGTANFSLSM

SEQ ID NO: 1588412 - protein, 17 aa, Staphylococcus aureus
YCKKRVWRYDMDRMDQV

SEQ ID NO: 1588413 - protein, 19 aa, Staphylococcus aureus
YCLGAVFFYFWGVFLYNSL

SEQ ID NO: 1588414 - protein, 22 aa, Staphylococcus aureus
YCLGAVFFYFWGVFLYNSLHKC

SEQ ID NO: 1588415 - protein, 24 aa, Staphylococcus aureus
YDLWRWDFGKLLIPFRIFLSTFPV

SEQ ID NO: 1588416 - protein, 20 aa, Staphylococcus aureus
YDYTKLVFAKPIYNDPSLVK

SEQ ID NO: 1588417 - protein, 17 aa, Staphylococcus aureus
YEVTRNSMSDSVSTSGS

SEQ ID NO: 1588418 - protein, 17 aa, Staphylococcus aureus
YFLKRINYIKATDSQVI

SEQ ID NO: 1588419 - protein, 17 aa, Staphylococcus aureus
YFLKSRKNWIFWILFLN

SEQ ID NO: 1588420 - protein, 23 aa, Staphylococcus aureus
YFLQFEWFQPLLISLAALLILIG

SEQ ID NO: 1588421 - protein, 23 aa, Staphylococcus aureus
YFYSIYEMIRWLNGSTTQPHLYF

SEQ ID NO: 1588422 - protein, 19 aa, Staphylococcus aureus
YIDFIFAGVFAFIFLAYRI

SEQ ID NO: 1588423 - protein, 24 aa, Staphylococcus aureus
YIDFMFAGALAFIFLIYRIYILFI

SEQ ID NO: 1588424 - protein, 19 aa, Staphylococcus aureus
YIMLIDWRMASALLVTIPI

SEQ ID NO: 1588425 - protein, 19 aa, Staphylococcus aureus
YITLPLPLFFTIKWVILNN

SEQ ID NO: 1588426 - protein, 20 aa, Staphylococcus aureus
YIVSEFLFFLVIFTFGIAGI

SEQ ID NO: 1588427 - protein, 18 aa, Staphylococcus aureus
YIVSEFLFLLVIFTFGIA

SEQ ID NO: 1588428 - protein, 19 aa, Staphylococcus aureus
YIVVVNGHIDPNSKGDLAL

SEQ ID NO: 1588429 - protein, 18 aa, Staphylococcus aureus
YKDIFVCFVAVVFFNVTN

SEQ ID NO: 1588430 - protein, 18 aa, Staphylococcus aureus
YKIGNYVWEDTNKNGVQE

SEQ ID NO: 1588431 - protein, 24 aa, Staphylococcus aureus
YKQEWCIVLSLLFLFPLGLFLMWK

SEQ ID NO: 1588432 - protein, 22 aa, Staphylococcus aureus
YKRLRFQVFLGIFIGYAGYYLL

SEQ ID NO: 1588433 - protein, 17 aa, Staphylococcus aureus
YLCAIIAIIYGFTGIGI

SEQ ID NO: 1588434 - protein, 19 aa, Staphylococcus aureus
YLFLCKLCIIYVIVLINRR

SEQ ID NO: 1588435 - protein, 18 aa, Staphylococcus aureus
YLYYIVSAFLFWLVIFTF

SEQ ID NO: 1588436 - protein, 18 aa, Staphylococcus aureus
YMGSLFYAWMAIRNLWNR

SEQ ID NO: 1588437 - protein, 22 aa, Staphylococcus aureus
YMSSWPWHWAKPMKHLMENGSI

SEQ ID NO: 1588438 - protein, 21 aa, Staphylococcus aureus
YMSSWPWHWAKPMKYLMENGS

SEQ ID NO: 1588439 - protein, 20 aa, Staphylococcus aureus
YNIPTWLGALIMTLAIYVTL

SEQ ID NO: 1588440 - protein, 26 aa, Staphylococcus aureus
YPHQAGYVKLNYGFSVPNSAVKGDTF

SEQ ID NO: 1588441 - protein, 18 aa, Staphylococcus aureus
YPLMMALTLFFSFLGLLG

SEQ ID NO: 1588442 - protein, 18 aa, Staphylococcus aureus
YPNYYYPVQLTWNNGVAF

SEQ ID NO: 1588443 - protein, 17 aa, Staphylococcus aureus
YPVQLTWNNGVAFYSNS

SEQ ID NO: 1588444 - protein, 24 aa, Staphylococcus aureus
YRFYFYRLFAIITWILFIGSLSQY

SEQ ID NO: 1588445 - protein, 17 aa, Staphylococcus aureus
YRHALRLVSPDTLFAQF

SEQ ID NO: 1588446 - protein, 17 aa, Staphylococcus aureus
YRVDNANDLSESYYVNP

SEQ ID NO: 1588447 - protein, 36 aa, Staphylococcus aureus
YSKSWLAIVCSMMVIFSIMLFLFVKRNKKKNKNESQ

SEQ ID NO: 1588448 - protein, 23 aa, Staphylococcus aureus
YSKSWLAIVCSMMVVFSIMLFLF

SEQ ID NO: 1588449 - protein, 17 aa, Staphylococcus aureus
YSQKGAITLGTRIDSNK

SEQ ID NO: 1588450 - protein, 24 aa, Staphylococcus aureus
YTAGQCTWYAYGIRQKMGKPISTY

SEQ ID NO: 1588451 - protein, 28 aa, Staphylococcus aureus
MSGPLFIIVLLFIFFCLGFIVPSSSGLA

SEQ ID NO: 1588452 - protein, 21 aa, Staphylococcus aureus
FITLLILVYLLFFANHLLKAN

SEQ ID NO: 1588453 - protein, 18 aa, Staphylococcus aureus
FSPILWLPKNHGISGLIH

SEQ ID NO: 1588454 - protein, 26 aa, Staphylococcus aureus
IGSIVLILIIIFYRPLMISTFDPTFS

SEQ ID NO: 1588455 - protein, 19 aa, Staphylococcus aureus
ILVLIIPLNMLISRQYLLI

SEQ ID NO: 1588456 - protein, 22 aa, Staphylococcus aureus
KKAVPILLFLFVFSLVIDNSFK

SEQ ID NO: 1588457 - protein, 25 aa, Staphylococcus aureus
LNTTLLHYFVMLLLSLVTVASIQTV

SEQ ID NO: 1588458 - protein, 28 aa, Staphylococcus aureus
QMLMQAILRILFYFSPILWLPKNHGISG

SEQ ID NO: 1588459 - protein, 25 aa, Staphylococcus aureus
QNIKLIKWMIIMLISMLAGISVAVA

SEQ ID NO: 1588460 - protein, 19 aa, Staphylococcus aureus
VPFVYWLLVGISMWFFINQ

SEQ ID NO: 1588461 - protein, 25 aa, Staphylococcus aureus
YASFLFIVFVMYAIQLGYIFTFPFI

SEQ ID NO: 1588462 - protein, 17 aa, Staphylococcus aureus
AITIFSKLKPQLPTCRV

SEQ ID NO: 1588463 - protein, 30 aa, Staphylococcus aureus
AIVAIIPLLIYFYVPFFKKLKVTSAYEYLE

SEQ ID NO: 1588464 - protein, 19 aa, Staphylococcus aureus
AKDMYVVPPSRLINEIPYA

SEQ ID NO: 1588465 - protein, 21 aa, Staphylococcus aureus
ALISLVFLPGIFYVISCVVGY

SEQ ID NO: 1588466 - protein, 26 aa, Staphylococcus aureus
AMLTARLLNEMGRRPDSRYGMVTMCI

SEQ ID NO: 1588467 - protein, 25 aa, Staphylococcus aureus
CTTPLQFVLVRLLQGLFGGVVDASS

SEQ ID NO: 1588468 - protein, 34 aa, Staphylococcus aureus
DLGEYAMPILALGAFLIFFFKRSKINNIGRILFG

SEQ ID NO: 1588469 - protein, 27 aa, Staphylococcus aureus
DYIKSYFAFYLILFGASLMIGLVVTTI

SEQ ID NO: 1588470 - protein, 26 aa, Staphylococcus aureus
ENTWNIIWRYILPNAIAPMIVRFSLN

SEQ ID NO: 1588471 - protein, 24 aa, Staphylococcus aureus
EQIQSLFYEGKLPEIDYDAAKVVK

SEQ ID NO: 1588472 - protein, 25 aa, Staphylococcus aureus
ERQFQPHFLFNTMQTIQYLITLSPK

SEQ ID NO: 1588473 - protein, 22 aa, Staphylococcus aureus
ETKIFLKLILPLAKRSILAGIM

SEQ ID NO: 1588474 - protein, 32 aa, Staphylococcus aureus
EVLRPYKVPMLTMPFVIVTWFTILLSGQVKFV

SEQ ID NO: 1588475 - protein, 24 aa, Staphylococcus aureus
FGGKLMLIIGPLFPVIGITIISMT

SEQ ID NO: 1588476 - protein, 28 aa, Staphylococcus aureus
FSKVFDYILIFFLFGIAVTMIAGAGATF

SEQ ID NO: 1588477 - protein, 24 aa, Staphylococcus aureus
GIWTLKLFILPNHPIIKSGLYKIT

SEQ ID NO: 1588478 - protein, 22 aa, Staphylococcus aureus
HGNVIGMFIFPSVIALLIGIAT

SEQ ID NO: 1588479 - protein, 20 aa, Staphylococcus aureus
IFAYIMLFMVIKTLGGIWTL

SEQ ID NO: 1588480 - protein, 28 aa, Staphylococcus aureus
ILVVLNLFLAWFFIYFDWGQKAVRGAAN

SEQ ID NO: 1588481 - protein, 25 aa, Staphylococcus aureus
IMYSVPVLMFLYPLAIALIVLTLFS

SEQ ID NO: 1588482 - protein, 19 aa, Staphylococcus aureus
ISIPYFLIGFVIMALVNTY

SEQ ID NO: 1588483 - protein, 26 aa, Staphylococcus aureus
KINNIGRILFGFGSLFFGLEFMGDAV

SEQ ID NO: 1588484 - protein, 27 aa, Staphylococcus aureus
LALIVISIWILYEAIVRIIYPQPIESG

SEQ ID NO: 1588485 - protein, 21 aa, Staphylococcus aureus
LDVVFAIPSLLLAVAIIASFG

SEQ ID NO: 1588486 - protein, 25 aa, Staphylococcus aureus
LFIFVFILVNIVLVSIYVNKVNRSH

SEQ ID NO: 1588487 - protein, 19 aa, Staphylococcus aureus
LFQLIRPISPIAWAPFVVL

SEQ ID NO: 1588488 - protein, 23 aa, Staphylococcus aureus
LIVGFFYVFFIPQSLLAFGPYIQ

SEQ ID NO: 1588489 - protein, 17 aa, Staphylococcus aureus
LLTVLLVGRKVGLQSIL

SEQ ID NO: 1588490 - protein, 36 aa, Staphylococcus aureus
MAVAALFPILLIVPLFDILMYFNILPKIIGGIGWLL

SEQ ID NO: 1588491 - protein, 24 aa, Staphylococcus aureus
MPHWNLYFWITLVITFVVTAITAW

SEQ ID NO: 1588492 - protein, 24 aa, Staphylococcus aureus
NEINFWILFVGILVFGVIALDVIG

SEQ ID NO: 1588493 - protein, 17 aa, Staphylococcus aureus
NIIVLVIFIVILHMMAR

SEQ ID NO: 1588494 - protein, 21 aa, Staphylococcus aureus
NINLFLLMTIAMICSTILTLL

SEQ ID NO: 1588495 - protein, 24 aa, Staphylococcus aureus
NLIYWIFVLYFIPIILCVIGFKAE

SEQ ID NO: 1588496 - protein, 24 aa, Staphylococcus aureus
NSNDLWDLFLFVTGLFGVPLAGVF

SEQ ID NO: 1588497 - protein, 33 aa, Staphylococcus aureus
PKQITLYLFIFSFVFFVIAWFFARKPSRILEYI

SEQ ID NO: 1588498 - protein, 24 aa, Staphylococcus aureus
RANRNFRFFQIFTAALQSFSHGTN

SEQ ID NO: 1588499 - protein, 33 aa, Staphylococcus aureus
RVVRRRITVFAGVLLAIIVVLSILLVVQKHRND

SEQ ID NO: 1588500 - protein, 17 aa, Staphylococcus aureus
SLFVIALIIALISGLLF

SEQ ID NO: 1588501 - protein, 31 aa, Staphylococcus aureus
SSIYGLVVLSPILLITALLIKMESPGPAIFK

SEQ ID NO: 1588502 - protein, 25 aa, Staphylococcus aureus
SSKYLLRFAIILYGLKLNIFDIIGQ

SEQ ID NO: 1588503 - protein, 22 aa, Staphylococcus aureus
SVIGFLQSAFWTASILSAPLWG

SEQ ID NO: 1588504 - protein, 28 aa, Staphylococcus aureus
TIFSKLKPQLPTCRVIFTPHLKEWERLS

SEQ ID NO: 1588505 - protein, 22 aa, Staphylococcus aureus
TIFYFEIGALVASLLWGYVSDL

SEQ ID NO: 1588506 - protein, 23 aa, Staphylococcus aureus
TINNELFNIYKFRSMKIDTPNVA

SEQ ID NO: 1588507 - protein, 35 aa, Staphylococcus aureus
TMTNILLFSYLSGALPMFLIFLKNANTVTYTISMN

SEQ ID NO: 1588508 - protein, 25 aa, Staphylococcus aureus
VLNNKWVWAIAFANIFVYFVRYGVL

SEQ ID NO: 1588509 - protein, 27 aa, Staphylococcus aureus
VSTPYALLFFDMIVVAISLTVIPLDKV

SEQ ID NO: 1588510 - protein, 22 aa, Staphylococcus aureus
VTGFLAFIIIGPVALLIGTGIT

SEQ ID NO: 1588511 - protein, 26 aa, Staphylococcus aureus
AAAIACGFFLFMFGGVASDCWIAVIA

SEQ ID NO: 1588512 - protein, 21 aa, Staphylococcus aureus
AFLTFSFVQRYIQIKFFSEFV

SEQ ID NO: 1588513 - protein, 27 aa, Staphylococcus aureus
AHDYFVQAIVIFLIILGSIGFPVLLEV

SEQ ID NO: 1588514 - protein, 24 aa, Staphylococcus aureus
AIALFLVVFCWQPIHFYALAIKRK

SEQ ID NO: 1588515 - protein, 24 aa, Staphylococcus aureus
AIKELWLPILTISAILAIAKVMTY

SEQ ID NO: 1588516 - protein, 28 aa, Staphylococcus aureus
AKGKVTRYDLISVLPFGNTIAQIDVKGS

SEQ ID NO: 1588517 - protein, 27 aa, Staphylococcus aureus
AKNNTRTIIFPYVEGKTLYDAIVKVHV

SEQ ID NO: 1588518 - protein, 21 aa, Staphylococcus aureus
ALITLFNILIHLGFASATSLS

SEQ ID NO: 1588519 - protein, 23 aa, Staphylococcus aureus
ASKFKLIFKHILPNTLGAIVVTS

SEQ ID NO: 1588520 - protein, 21 aa, Staphylococcus aureus
ATVLLLVFMLVTIRGASVSGS

SEQ ID NO: 1588521 - protein, 24 aa, Staphylococcus aureus
AVDNTFMTPLGQSPLLLGADIVIH

SEQ ID NO: 1588522 - protein, 28 aa, Staphylococcus aureus
AVLGIIALFFYIFRFNVLTYKELTYLPF

SEQ ID NO: 1588523 - protein, 27 aa, Staphylococcus aureus
AWALFPLLLFVALFLGVGIITGDFTSM

SEQ ID NO: 1588524 - protein, 24 aa, Staphylococcus aureus
DFYVRKIWVAIKFLGVYLYQLITS

SEQ ID NO: 1588525 - protein, 24 aa, Staphylococcus aureus
DHSYISWIIVVGISLILVVIVSIF

SEQ ID NO: 1588526 - protein, 18 aa, Staphylococcus aureus
DNLIMRILDVVFAIPSLL

SEQ ID NO: 1588527 - protein, 26 aa, Staphylococcus aureus
DSTQFSRRTFLKMLGIGGAGVAIGAS

SEQ ID NO: 1588528 - protein, 24 aa, Staphylococcus aureus
DTCVPNFLFYNIPLMIFGTIAAMV

SEQ ID NO: 1588529 - protein, 26 aa, Staphylococcus aureus
DYNLIKVVPYILVLVLALLGVNVIIV

SEQ ID NO: 1588530 - protein, 26 aa, Staphylococcus aureus
EKQKLMMFWMIITLLLGLVFVGFEIY

SEQ ID NO: 1588531 - protein, 31 aa, Staphylococcus aureus
ELDGKLLEDDLRFRQIIFSHKDDLKSITAKI

SEQ ID NO: 1588532 - protein, 23 aa, Staphylococcus aureus
ERGITFGLFRLSVGLEDPDELIA

SEQ ID NO: 1588533 - protein, 25 aa, Staphylococcus aureus
ETLNKWCFWFFMIGFNVCFLPQFIL

SEQ ID NO: 1588534 - protein, 18 aa, Staphylococcus aureus
EVEKSLVYFLAALKGNDT

SEQ ID NO: 1588535 - protein, 29 aa, Staphylococcus aureus
FFHPITWSLIFITILLLLNIFSVKSFGET

SEQ ID NO: 1588536 - protein, 20 aa, Staphylococcus aureus
FFIFAMILIMIGAFTKSAQF

SEQ ID NO: 1588537 - protein, 19 aa, Staphylococcus aureus
FFSSWFLTFGYVCVVALNA

SEQ ID NO: 1588538 - protein, 17 aa, Staphylococcus aureus
FIALLIATAIAVPLGIL

SEQ ID NO: 1588539 - protein, 24 aa, Staphylococcus aureus
FIQDFFMLAFFTTIGLGASLKLFK

SEQ ID NO: 1588540 - protein, 33 aa, Staphylococcus aureus
FIVNLFRAIPFIILILLLIPFTSLILGTISGPT

SEQ ID NO: 1588541 - protein, 26 aa, Staphylococcus aureus
FLNPVFLVLLAIILLFAFIHPLGGIS

SEQ ID NO: 1588542 - protein, 21 aa, Staphylococcus aureus
FLSFGRYVSFFSSWFLTFGYV

SEQ ID NO: 1588543 - protein, 19 aa, Staphylococcus aureus
FLVFLLAIICTRNLKKRPT

SEQ ID NO: 1588544 - protein, 27 aa, Staphylococcus aureus
FMINVLPIVLVPLIVERKRIKQHPDVQ

SEQ ID NO: 1588545 - protein, 18 aa, Staphylococcus aureus
FPFYIWLPDAMEAPTPVS

SEQ ID NO: 1588546 - protein, 24 aa, Staphylococcus aureus
FRNKITWLQIISGFFFAFGALTYL

SEQ ID NO: 1588547 - protein, 25 aa, Staphylococcus aureus
FTQIGFPIVDIILATLLGLLIVYTG

SEQ ID NO: 1588548 - protein, 25 aa, Staphylococcus aureus
FVILTAFVLVWSAPFFKKLFQPGGA

SEQ ID NO: 1588549 - protein, 19 aa, Staphylococcus aureus
FWFALIKVVTIILMIIAGF

SEQ ID NO: 1588550 - protein, 25 aa, Staphylococcus aureus
GALMTPLMLIVFRFPPHVAVGTSMM

SEQ ID NO: 1588551 - protein, 24 aa, Staphylococcus aureus
GAMSLLFGTFLYFIATQGFVNMQL

SEQ ID NO: 1588552 - protein, 19 aa, Staphylococcus aureus
GEFEFWFALIKVVTIILMI

SEQ ID NO: 1588553 - protein, 24 aa, Staphylococcus aureus
GESKWSFKKLFNYGIDGLISFNSK

SEQ ID NO: 1588554 - protein, 24 aa, Staphylococcus aureus
GGMPMLWANFFWVWGHPEVYIVIL

SEQ ID NO: 1588555 - protein, 24 aa, Staphylococcus aureus
GLFKYPHFLWFDLGRPDIWITIIA

SEQ ID NO: 1588556 - protein, 18 aa, Staphylococcus aureus
GLGLIFGVFAYAASFFGA

SEQ ID NO: 1588557 - protein, 23 aa, Staphylococcus aureus
GTFLLIFVVVFPLIFMFGVAFTN

SEQ ID NO: 1588558 - protein, 34 aa, Staphylococcus aureus
IAIYSITVILFSALISFVLTNVYYHYNLKASNDA

SEQ ID NO: 1588559 - protein, 26 aa, Staphylococcus aureus
IEEVKRPWLPPLPENVYQEDLVETDF

SEQ ID NO: 1588560 - protein, 23 aa, Staphylococcus aureus
IFIYSTIWIIFNLYAVNILLKYT

SEQ ID NO: 1588561 - protein, 29 aa, Staphylococcus aureus
IFQSINPLFILLLAPIISLLWQKLGTKQP

SEQ ID NO: 1588562 - protein, 29 aa, Staphylococcus aureus
IGALFNSLLYFLILLKPRKLNTIANYLFG

SEQ ID NO: 1588563 - protein, 21 aa, Staphylococcus aureus
IGRVPAIIALVVYALLPILRN

SEQ ID NO: 1588564 - protein, 26 aa, Staphylococcus aureus
IGSFVSFIFLALLLVPGSPAALTAPS

SEQ ID NO: 1588565 - protein, 24 aa, Staphylococcus aureus
IGYIVLMAVWLYKVSIKTGQFSII

SEQ ID NO: 1588566 - protein, 24 aa, Staphylococcus aureus
IHLQHASLQYSFLTNFFAAAIACG

SEQ ID NO: 1588567 - protein, 17 aa, Staphylococcus aureus
IIAFLWVLFQDEDHFKF

SEQ ID NO: 1588568 - protein, 18 aa, Staphylococcus aureus
ILINVRLPRLLEALLTGM

SEQ ID NO: 1588569 - protein, 26 aa, Staphylococcus aureus
IMKTLTLFTVLLTLPTLVFSFFGMNV

SEQ ID NO: 1588570 - protein, 24 aa, Staphylococcus aureus
IMLSALTYWLFAQSFINIGPLVGQ

SEQ ID NO: 1588571 - protein, 17 aa, Staphylococcus aureus
IPSLLLAVAIIASFGAS

SEQ ID NO: 1588572 - protein, 25 aa, Staphylococcus aureus
ISLILAIIIVLFVQTFVIVGHVIPN

SEQ ID NO: 1588573 - protein, 26 aa, Staphylococcus aureus
ITIIALFFPIVILAVPFIDTLFAMIR

SEQ ID NO: 1588574 - protein, 33 aa, Staphylococcus aureus
IVTPTIALLIVGLLTIFIFMPLAGFVSDSLVSV

SEQ ID NO: 1588575 - protein, 21 aa, Staphylococcus aureus
KAALVLFMWLPKAYAVLNTEL

SEQ ID NO: 1588576 - protein, 25 aa, Staphylococcus aureus
KDDKHVFPPYQGAPLFKESFLKKHP

SEQ ID NO: 1588577 - protein, 26 aa, Staphylococcus aureus
KGELLPIIFFAVFFGLGLAAVGKKAE

SEQ ID NO: 1588578 - protein, 23 aa, Staphylococcus aureus
KKLNKLFTSLRSKYYLFVSDPVV

SEQ ID NO: 1588579 - protein, 23 aa, Staphylococcus aureus
KLGRVFLLIPLTIVLILIMRFRS

SEQ ID NO: 1588580 - protein, 17 aa, Staphylococcus aureus
KRDINLKFHSRFALEIL

SEQ ID NO: 1588581 - protein, 17 aa, Staphylococcus aureus
KSLVYFLAALKGNDTII

SEQ ID NO: 1588582 - protein, 19 aa, Staphylococcus aureus
KWVGTILTLILIGASIYKE

SEQ ID NO: 1588583 - protein, 24 aa, Staphylococcus aureus
LEAVFWMINKILKLAPLGVFAFIC

SEQ ID NO: 1588584 - protein, 17 aa, Staphylococcus aureus
LFLISIIANFWFIQAAG

SEQ ID NO: 1588585 - protein, 18 aa, Staphylococcus aureus
LFYNFHPAKIFLGDSGAL

SEQ ID NO: 1588586 - protein, 19 aa, Staphylococcus aureus
LGAAILFSFMRFSNVMTPD

SEQ ID NO: 1588587 - protein, 23 aa, Staphylococcus aureus
LGRPDIWITIIAGVLYFIQAYVS

SEQ ID NO: 1588588 - protein, 19 aa, Staphylococcus aureus
LIGLFTSMFFIIIGSGLMK

SEQ ID NO: 1588589 - protein, 17 aa, Staphylococcus aureus
LIIIAFVISFVALADLF

SEQ ID NO: 1588590 - protein, 26 aa, Staphylococcus aureus
LIISVLGAWLGWTLLAGELPFIVAKD

SEQ ID NO: 1588591 - protein, 24 aa, Staphylococcus aureus
LNHWNFWILAIGFIILIAPVTGVA

SEQ ID NO: 1588592 - protein, 21 aa, Staphylococcus aureus
LPYLWVLVVLVFLEGLLAADN

SEQ ID NO: 1588593 - protein, 18 aa, Staphylococcus aureus
LSAQDSWTLAKHLKTFPI

SEQ ID NO: 1588594 - protein, 18 aa, Staphylococcus aureus
LVLGIALPIIYFTLIIRS

SEQ ID NO: 1588595 - protein, 20 aa, Staphylococcus aureus
LVLVYLLHRVLPGRFYVITL

SEQ ID NO: 1588596 - protein, 19 aa, Staphylococcus aureus
LVMLGLHHIFTPIHIEMIN

SEQ ID NO: 1588597 - protein, 29 aa, Staphylococcus aureus
LWIAPIATMIILVIFSLAFYPAYNPKPKD

SEQ ID NO: 1588598 - protein, 28 aa, Staphylococcus aureus
MHLGTLFYLGFLVLFLFAALTSSISLLE

SEQ ID NO: 1588599 - protein, 25 aa, Staphylococcus aureus
MIISSLIIFGIALIICLFRLIKGPT

SEQ ID NO: 1588600 - protein, 21 aa, Staphylococcus aureus
MIPLLMNKLNIDPAVASGPFI

SEQ ID NO: 1588601 - protein, 19 aa, Staphylococcus aureus
MLDMYIIYKTIKNIVTSEG

SEQ ID NO: 1588602 - protein, 25 aa, Staphylococcus aureus
MQGEFPVMMFGLPAAALAIYHTAKP

SEQ ID NO: 1588603 - protein, 22 aa, Staphylococcus aureus
NAFFIIMWLLGQMAIWNFLFLR

SEQ ID NO: 1588604 - protein, 17 aa, Staphylococcus aureus
NIILIRLSGIIGASIST

SEQ ID NO: 1588605 - protein, 23 aa, Staphylococcus aureus
NKDITKWFQTYNKSLLSANSDTF

SEQ ID NO: 1588606 - protein, 25 aa, Staphylococcus aureus
NNSNWIWIFTYLAIILLIVGFFYVF

SEQ ID NO: 1588607 - protein, 24 aa, Staphylococcus aureus
NVIILYLFWELTSFSSFLLISFWR

SEQ ID NO: 1588608 - protein, 25 aa, Staphylococcus aureus
NVIYGMVVLLLICGCIPKLGALANI

SEQ ID NO: 1588609 - protein, 25 aa, Staphylococcus aureus
NWAGWLIFAGIIFFSGSLYILVLTQ

SEQ ID NO: 1588610 - protein, 23 aa, Staphylococcus aureus
PAHFFHQVIVIALVLFVSKIIES

SEQ ID NO: 1588611 - protein, 22 aa, Staphylococcus aureus
PIAIVFLFLQRYLVSGLTTGAT

SEQ ID NO: 1588612 - protein, 27 aa, Staphylococcus aureus
PLGLHHIFYLPFWQTALGGTLEVKGHL

SEQ ID NO: 1588613 - protein, 25 aa, Staphylococcus aureus
PNLIVVILFVLIFEPSIWTIILAMS

SEQ ID NO: 1588614 - protein, 26 aa, Staphylococcus aureus
PQINYNHRYTTHLEFEKAIPTLADAA

SEQ ID NO: 1588615 - protein, 27 aa, Staphylococcus aureus
PQNLTLNFMISFLFVISATVIGIFLYV

SEQ ID NO: 1588616 - protein, 27 aa, Staphylococcus aureus
PSLALLGLMIPLFGIGRVPAIIALVVY

SEQ ID NO: 1588617 - protein, 29 aa, Staphylococcus aureus
PSYIALLGWLIIGLIFFVIRYPKLKNMDN

SEQ ID NO: 1588618 - protein, 28 aa, Staphylococcus aureus
QDSWTLAKHLKTFPIRFKQSVENAQKIV

SEQ ID NO: 1588619 - protein, 31 aa, Staphylococcus aureus
QIPSFFIFTYLLIFIYFLILTSRKGSPIVVI

SEQ ID NO: 1588620 - protein, 32 aa, Staphylococcus aureus
QLKEQRFLTIYDFILNIIAMLSIFGSLVLGLI

SEQ ID NO: 1588621 - protein, 25 aa, Staphylococcus aureus
QWTLIIFAAIFFAIVYWISLNPSKI

SEQ ID NO: 1588622 - protein, 30 aa, Staphylococcus aureus
REWMSSWTLYYWGWWLSWSPFVGVFIARVS

SEQ ID NO: 1588623 - protein, 25 aa, Staphylococcus aureus
RGAYLSLIVYIILSIVKYVTGFVFN

SEQ ID NO: 1588624 - protein, 20 aa, Staphylococcus aureus
RGQLMGIMFIGVGLVEALPI

SEQ ID NO: 1588625 - protein, 18 aa, Staphylococcus aureus
RIFEVCIVILLLSAAFLI

SEQ ID NO: 1588626 - protein, 25 aa, Staphylococcus aureus
RPIKGTIFFIFFISFISVFYSFLNI

SEQ ID NO: 1588627 - protein, 20 aa, Staphylococcus aureus
RRIQIHIETWDRTALEEQEA

SEQ ID NO: 1588628 - protein, 33 aa, Staphylococcus aureus
RRRTWKARWQLCIIFSLFALMSNLTGIVIDHQH

SEQ ID NO: 1588629 - protein, 17 aa, Staphylococcus aureus
RSDSIMILSINPKTKKT

SEQ ID NO: 1588630 - protein, 28 aa, Staphylococcus aureus
RTRVSMFIWLIILLPVPLLLINLGVVFV

SEQ ID NO: 1588631 - protein, 25 aa, Staphylococcus aureus
RTVTKLVVFILLTFGFYVFFAGHNN

SEQ ID NO: 1588632 - protein, 18 aa, Staphylococcus aureus
RYIQIKFFSEFVAAAVVI

SEQ ID NO: 1588633 - protein, 26 aa, Staphylococcus aureus
SIANIFIPLIPAFIGAGLIGGIAAVL

SEQ ID NO: 1588634 - protein, 31 aa, Staphylococcus aureus
SKNYKLYYLSYWYFITFGAFVAFGIFLPNYL

SEQ ID NO: 1588635 - protein, 18 aa, Staphylococcus aureus
SLIGFLFYNFHPAKIFLG

SEQ ID NO: 1588636 - protein, 24 aa, Staphylococcus aureus
SLYGGMILLPIYLQNLRGFSALDS

SEQ ID NO: 1588637 - protein, 23 aa, Staphylococcus aureus
SNFRILWLSQFIAIAGLTVLVPL

SEQ ID NO: 1588638 - protein, 24 aa, Staphylococcus aureus
SNWVFIIFSFIVMPIGLRIERNIS

SEQ ID NO: 1588639 - protein, 18 aa, Staphylococcus aureus
SQALIAFVLLLAGGGNGA

SEQ ID NO: 1588640 - protein, 24 aa, Staphylococcus aureus
SQAPFLIIGLIIVSTILLLICTGY

SEQ ID NO: 1588641 - protein, 28 aa, Staphylococcus aureus
SRVKAFIPLFILGMVFWAIQEQGSNVLN

SEQ ID NO: 1588642 - protein, 33 aa, Staphylococcus aureus
TGVAVFLFGFIKRLLIPFGLHHIFHAPFWFEFG

SEQ ID NO: 1588643 - protein, 24 aa, Staphylococcus aureus
TGVIGMFILFLFGGVVILPGVVAH

SEQ ID NO: 1588644 - protein, 21 aa, Staphylococcus aureus
TIHFGFLSIPITVIWIVAITN

SEQ ID NO: 1588645 - protein, 28 aa, Staphylococcus aureus
TILFTIIVAIYHQPLLALIVAGSLTCAM

SEQ ID NO: 1588646 - protein, 17 aa, Staphylococcus aureus
TSNYLKVMFLSAPFVIL

SEQ ID NO: 1588647 - protein, 18 aa, Staphylococcus aureus
TVIGAWLLLVADLLGRVI

SEQ ID NO: 1588648 - protein, 19 aa, Staphylococcus aureus
TVLWLFLFCYIIIASIDFG

SEQ ID NO: 1588649 - protein, 24 aa, Staphylococcus aureus
TVRSYLIIIALFALIMFIFGDTQE

SEQ ID NO: 1588650 - protein, 29 aa, Staphylococcus aureus
VFANAPFTLLPILIGFSAAKRFGGNPFLG

SEQ ID NO: 1588651 - protein, 18 aa, Staphylococcus aureus
VIFAVWILSIVEKRLHKI

SEQ ID NO: 1588652 - protein, 17 aa, Staphylococcus aureus
VIPQIMPAFLSLILYRF

SEQ ID NO: 1588653 - protein, 20 aa, Staphylococcus aureus
VTLILYIFIANMLGLPFSIV

SEQ ID NO: 1588654 - protein, 26 aa, Staphylococcus aureus
VVVGFFIVFLFIWFSFKTIQLQCFNN

SEQ ID NO: 1588655 - protein, 18 aa, Staphylococcus aureus
WDTFKFFHPITWSLIFIT

SEQ ID NO: 1588656 - protein, 33 aa, Staphylococcus aureus
WGDEWPFVIAFLPWVLIIIPYLLFKSNTLNIIH

SEQ ID NO: 1588657 - protein, 25 aa, Staphylococcus aureus
YRTSLSIWFRQLFMLKPDASLMSGV

SEQ ID NO: 1588658 - protein, 24 aa, Staphylococcus aureus
AAIINVFVFNYFFTEPRYTFEVYR

SEQ ID NO: 1588659 - protein, 27 aa, Staphylococcus aureus
AGIPIAALGLLAPWVAGAAMALSSVSV

SEQ ID NO: 1588660 - protein, 27 aa, Staphylococcus aureus
AGPMITYLIPLLIAFSGGRLIYDLRGG

SEQ ID NO: 1588661 - protein, 21 aa, Staphylococcus aureus
AIIVAFLFWMSSDRSAYEVLS

SEQ ID NO: 1588662 - protein, 25 aa, Staphylococcus aureus
AIKQVFWRILLFYVLSIAVIGAIIP

SEQ ID NO: 1588663 - protein, 19 aa, Staphylococcus aureus
AIWNFLFLRRALPLTKQEL

SEQ ID NO: 1588664 - protein, 28 aa, Staphylococcus aureus
AIYISPFWFIFLFFFYKKYKTNAEKLAY

SEQ ID NO: 1588665 - protein, 20 aa, Staphylococcus aureus
AKMFVMMFGVTIFAFMGYEH

SEQ ID NO: 1588666 - protein, 47 aa, Staphylococcus aureus
ALLAIIFDLILRFMAKLSYKKLLMTLGVIVMIIILAIAIPMFAQKGD

SEQ ID NO: 1588667 - protein, 20 aa, Staphylococcus aureus
ALLPALFWGSVVLINVFVGG

SEQ ID NO: 1588668 - protein, 20 aa, Staphylococcus aureus
AMLLIYPHELFIPAMILSLL

SEQ ID NO: 1588669 - protein, 23 aa, Staphylococcus aureus
AMMFVIILYPLLWTFGISLNPGT

SEQ ID NO: 1588670 - protein, 32 aa, Staphylococcus aureus
ANFYYIFFEKIGFLLVLLLGCVLVYVGYLYFH

SEQ ID NO: 1588671 - protein, 26 aa, Staphylococcus aureus
ANHFLQFFIILYTYRMIITLCLLFFD

SEQ ID NO: 1588672 - protein, 25 aa, Staphylococcus aureus
AQIFYFYIIIQLPKLLKEPFSPVFS

SEQ ID NO: 1588673 - protein, 25 aa, Staphylococcus aureus
ATGIACGFIFYPITMLISKKHKEVH

SEQ ID NO: 1588674 - protein, 32 aa, Staphylococcus aureus
ATYTIIFVNVLIWLCMILYLNNFSDVKLLDVG

SEQ ID NO: 1588675 - protein, 26 aa, Staphylococcus aureus
AVTKSQFVYFNKLSLFHDVQQWLKSA

SEQ ID NO: 1588676 - protein, 32 aa, Staphylococcus aureus
AWCYNKFYNITLPPFLGFFAGKRFVPIVTSVV

SEQ ID NO: 1588677 - protein, 22 aa, Staphylococcus aureus
DDYWKDFMVEGQRVRTISKDAK

SEQ ID NO: 1588678 - protein, 19 aa, Staphylococcus aureus
DGWFLLNLISTIGALLMAI

SEQ ID NO: 1588679 - protein, 28 aa, Staphylococcus aureus
DILTRLIYAIRPSLLYVFVALFVSVLIG

SEQ ID NO: 1588680 - protein, 26 aa, Staphylococcus aureus
DLHGFVNLWLYMYAYSLYLFFDFAGY

SEQ ID NO: 1588681 - protein, 24 aa, Staphylococcus aureus
DRYGRTLAYVWISKDRMYNKELVE

SEQ ID NO: 1588682 - protein, 26 aa, Staphylococcus aureus
DSFGYGFFIPIFFIMVGVDLNIPSLI

SEQ ID NO: 1588683 - protein, 24 aa, Staphylococcus aureus
DTLGYLFPIIGIVGSVFTFVYSIK

SEQ ID NO: 1588684 - protein, 20 aa, Staphylococcus aureus
DYTLMEFAQPIYNSADKFKT

SEQ ID NO: 1588685 - protein, 27 aa, Staphylococcus aureus
EDEVETLKWARWLPHMTLRGQNIRGFV

SEQ ID NO: 1588686 - protein, 27 aa, Staphylococcus aureus
EKFAKIGSLIFIFLIGTVTIAAIVGVV

SEQ ID NO: 1588687 - protein, 22 aa, Staphylococcus aureus
ELKPYILIVTIVAILATFLVQT

SEQ ID NO: 1588688 - protein, 40 aa, Staphylococcus aureus
ENEKSRRSKKWLYIIIAILLIIVAIFVTRALLNNDSDKVS

SEQ ID NO: 1588689 - protein, 19 aa, Staphylococcus aureus
FALIIPILSGFIARSIADK

SEQ ID NO: 1588690 - protein, 26 aa, Staphylococcus aureus
FATMLLLGILMIFVTAVFLSRFLLSL

SEQ ID NO: 1588691 - protein, 24 aa, Staphylococcus aureus
FFSVRLLLSLVFINLTSPVGMHLV

SEQ ID NO: 1588692 - protein, 25 aa, Staphylococcus aureus
FGIAIWVLFHLIIMPIMHTVPAVWD

SEQ ID NO: 1588693 - protein, 30 aa, Staphylococcus aureus
FIPAMILSLLILFFYLFSDGLRDAFDPKMR

SEQ ID NO: 1588694 - protein, 25 aa, Staphylococcus aureus
FLFLVLVIFTLFTYKAPNGMRAMGA

SEQ ID NO: 1588695 - protein, 27 aa, Staphylococcus aureus
FPQDWTIFYWSWWLVYAPFIGLFIARI

SEQ ID NO: 1588696 - protein, 23 aa, Staphylococcus aureus
FQSDLLLFFKIIGVSLVPSILIL

SEQ ID NO: 1588697 - protein, 23 aa, Staphylococcus aureus
FWLFFAGMILFNLSFIIGGSPAA

SEQ ID NO: 1588698 - protein, 20 aa, Staphylococcus aureus
FWTVLISHIAFCIPIVVIIV

SEQ ID NO: 1588699 - protein, 20 aa, Staphylococcus aureus
GFHELFFDLIFVYAIQKIAH

SEQ ID NO: 1588700 - protein, 25 aa, Staphylococcus aureus
GFIDYILYGLLNWDRSHALLVIPVG

SEQ ID NO: 1588701 - protein, 25 aa, Staphylococcus aureus
GFSSTLIMIIVMQLSLHFIPAPEDM

SEQ ID NO: 1588702 - protein, 25 aa, Staphylococcus aureus
GGLIPFLIIILLHSKFRFNAVSMIL

SEQ ID NO: 1588703 - protein, 25 aa, Staphylococcus aureus
GIIKLKSFWIRRLKRLLPAVIVLLM

SEQ ID NO: 1588704 - protein, 33 aa, Staphylococcus aureus
GIILLPIIFIRTSWIFILFIFLGGVSYTIGAWF

SEQ ID NO: 1588705 - protein, 22 aa, Staphylococcus aureus
GKSFMLPIAILPAAGLLLGIGG

SEQ ID NO: 1588706 - protein, 19 aa, Staphylococcus aureus
GLTTLWIPVFSITFSLITL

SEQ ID NO: 1588707 - protein, 23 aa, Staphylococcus aureus
GLVVIEYIFAWPGLGQLSLKAIL

SEQ ID NO: 1588708 - protein, 20 aa, Staphylococcus aureus
GNPLGVDFKGTVTEGIISGL

SEQ ID NO: 1588709 - protein, 18 aa, Staphylococcus aureus
GSGLLLAGLFIWNIMQWS

SEQ ID NO: 1588710 - protein, 24 aa, Staphylococcus aureus
GVGLIILVVFLVPGLVYGILSKEI

SEQ ID NO: 1588711 - protein, 30 aa, Staphylococcus aureus
GVGSYFIAFALFFFAFTTILSYYYITETNV

SEQ ID NO: 1588712 - protein, 24 aa, Staphylococcus aureus
GWIGWTVFILLWGTTLWGILYKSI

SEQ ID NO: 1588713 - protein, 21 aa, Staphylococcus aureus
GYAAIFILILLENVLPIVPSE

SEQ ID NO: 1588714 - protein, 19 aa, Staphylococcus aureus
HGEWYRIVTSMFLHFSFEH

SEQ ID NO: 1588715 - protein, 22 aa, Staphylococcus aureus
HSSNVYMFKTALKLAGDPYYSG

SEQ ID NO: 1588716 - protein, 18 aa, Staphylococcus aureus
HVAWGYAIILIISSYFGA

SEQ ID NO: 1588717 - protein, 20 aa, Staphylococcus aureus
IAFIPIVIPPLLSLFNDLKI

SEQ ID NO: 1588718 - protein, 24 aa, Staphylococcus aureus
IALNLLFNIPLIVGALITVLDVFL

SEQ ID NO: 1588719 - protein, 18 aa, Staphylococcus aureus
IFFLVIGIMYFIITLILM

SEQ ID NO: 1588720 - protein, 27 aa, Staphylococcus aureus
IFIVMMLLMNLILPGSGLLLAGLFIWN

SEQ ID NO: 1588721 - protein, 28 aa, Staphylococcus aureus
IGDSNNLVLGEPILVVGNPLGVDFKGTV

SEQ ID NO: 1588722 - protein, 31 aa, Staphylococcus aureus
IGILLAILYIPIFFLMFYSFNSAGNMIHFEH

SEQ ID NO: 1588723 - protein, 24 aa, Staphylococcus aureus
IGKALMLPVAILPAAGILLAFGNA

SEQ ID NO: 1588724 - protein, 19 aa, Staphylococcus aureus
IIFGLIAMILLVTGVALTS

SEQ ID NO: 1588725 - protein, 23 aa, Staphylococcus aureus
IIGSWRMLTVYFIAGLFGNFVSL

SEQ ID NO: 1588726 - protein, 19 aa, Staphylococcus aureus
IILVIAIIAYMIVQQILNK

SEQ ID NO: 1588727 - protein, 30 aa, Staphylococcus aureus
IIRHQFQGLWIVLFILLGVLLLRATVQFLN

SEQ ID NO: 1588728 - protein, 28 aa, Staphylococcus aureus
IIVIILIAVGVLFYLRSNKRQIIEKAIE

SEQ ID NO: 1588729 - protein, 25 aa, Staphylococcus aureus
IKAKSFVIFMIIIAALMIGLSNIDK

SEQ ID NO: 1588730 - protein, 17 aa, Staphylococcus aureus
IMAFILTRWAWFCRVIR

SEQ ID NO: 1588731 - protein, 29 aa, Staphylococcus aureus
IMSSTLVTIIVFLPLVFVSGSVGEMFRPF

SEQ ID NO: 1588732 - protein, 29 aa, Staphylococcus aureus
IPIGIVWFCLYYIVFRFLITKFNFKTPGR

SEQ ID NO: 1588733 - protein, 18 aa, Staphylococcus aureus
IPVMFIRRWFDMKTTIAS

SEQ ID NO: 1588734 - protein, 25 aa, Staphylococcus aureus
ITAAILIWAFGWTIADPIASILVSV

SEQ ID NO: 1588735 - protein, 21 aa, Staphylococcus aureus
ITLLIVMAVVLVLLVIFGFIS

SEQ ID NO: 1588736 - protein, 19 aa, Staphylococcus aureus
IYVVWQVLLIMFYYHSKPK

SEQ ID NO: 1588737 - protein, 21 aa, Staphylococcus aureus
KFYFCINLILPLIILSAMFVY

SEQ ID NO: 1588738 - protein, 26 aa, Staphylococcus aureus
KILEYIYRLILKYLLWYIKTVKGSVR

SEQ ID NO: 1588739 - protein, 31 aa, Staphylococcus aureus
KKIKHYTYLLYFLICLLLIGLLVIPESPITP

SEQ ID NO: 1588740 - protein, 27 aa, Staphylococcus aureus
KKPLRRLTWLMAIIIYCGVYTGALVRH

SEQ ID NO: 1588741 - protein, 24 aa, Staphylococcus aureus
KLKTRGYIDLSVGASFIPYRGNTS

SEQ ID NO: 1588742 - protein, 33 aa, Staphylococcus aureus
KQYKPFWIVMSFIILIVVLLLPAPSSLPIMAKA

SEQ ID NO: 1588743 - protein, 21 aa, Staphylococcus aureus
KSFYSIRKSSLGVASVAISTL

SEQ ID NO: 1588744 - protein, 23 aa, Staphylococcus aureus
KTELSFVEPLISRLELEEANDKL

SEQ ID NO: 1588745 - protein, 24 aa, Staphylococcus aureus
KTLEHFYISIVALLLAIIVAVPIG

SEQ ID NO: 1588746 - protein, 24 aa, Staphylococcus aureus
KYGVWAVFICRFIPVLRVLITIPA

SEQ ID NO: 1588747 - protein, 23 aa, Staphylococcus aureus
KYQARFIAIQFLLNNMQIANELN

SEQ ID NO: 1588748 - protein, 24 aa, Staphylococcus aureus
KYQTPELYFKAWQGFYHEVHNEPE

SEQ ID NO: 1588749 - protein, 32 aa, Staphylococcus aureus
KYVDNLWFFLIFLLFFGLFLFLITLASQKTAM

SEQ ID NO: 1588750 - protein, 19 aa, Staphylococcus aureus
LDGSLPQLIFLIAVPNNSQ

SEQ ID NO: 1588751 - protein, 30 aa, Staphylococcus aureus
LERVGLIIILAYVLMNIPYFKNLMNRRRTW

SEQ ID NO: 1588752 - protein, 22 aa, Staphylococcus aureus
LGQLLIALVILVGVSLFMSNIN

SEQ ID NO: 1588753 - protein, 17 aa, Staphylococcus aureus
LIISIVILIVNYFKQLN

SEQ ID NO: 1588754 - protein, 25 aa, Staphylococcus aureus
LIPFGLHHIFYSPFWFEFGSYTNHA

SEQ ID NO: 1588755 - protein, 17 aa, Staphylococcus aureus
LIPIIIGMLLAMGSLSN

SEQ ID NO: 1588756 - protein, 25 aa, Staphylococcus aureus
LKIHPLTIIFILLCAGKLLGIVGVI

SEQ ID NO: 1588757 - protein, 27 aa, Staphylococcus aureus
LLTVIITILITKLKWKSAGALLVEAIK

SEQ ID NO: 1588758 - protein, 29 aa, Staphylococcus aureus
LNAFKNFLPLIILALIYFIHKIIHKTKFV

SEQ ID NO: 1588759 - protein, 25 aa, Staphylococcus aureus
LNMNKYLLILLLALSAAIMNMVPWG

SEQ ID NO: 1588760 - protein, 23 aa, Staphylococcus aureus
LNNISLHIYQGEALGIIGEPESS

SEQ ID NO: 1588761 - protein, 20 aa, Staphylococcus aureus
LPFLIIVEFLFIYIPLLYHG

SEQ ID NO: 1588762 - protein, 26 aa, Staphylococcus aureus
LPFPSLMIVLFLVSAFLFLATTFDSG

SEQ ID NO: 1588763 - protein, 17 aa, Staphylococcus aureus
LQLFMGSILFFKLLTEF

SEQ ID NO: 1588764 - protein, 25 aa, Staphylococcus aureus
LQTLLLGCILAFIWPPFALKKDISK

SEQ ID NO: 1588765 - protein, 20 aa, Staphylococcus aureus
LSFVLLAFIFIIGPTVFIME

SEQ ID NO: 1588766 - protein, 18 aa, Staphylococcus aureus
LSLALMSIQLIEIYKLAI

SEQ ID NO: 1588767 - protein, 25 aa, Staphylococcus aureus
LSLIPENLIIVGLFVICMFVSISMG

SEQ ID NO: 1588768 - protein, 19 aa, Staphylococcus aureus
LTLIGVLIYFIVNTGFFSV

SEQ ID NO: 1588769 - protein, 22 aa, Staphylococcus aureus
LVGLLCILYTFLGGFEGVVWSD

SEQ ID NO: 1588770 - protein, 28 aa, Staphylococcus aureus
LVGSIFLFIIIVIFLMYANHLFVKRRTR

SEQ ID NO: 1588771 - protein, 19 aa, Staphylococcus aureus
LVPGILITNAIRDLLAGEL

SEQ ID NO: 1588772 - protein, 35 aa, Staphylococcus aureus
LYLSQPLSLIFYLKSLLLILIYEIGIVFILFHIQT

SEQ ID NO: 1588773 - protein, 19 aa, Staphylococcus aureus
LYVFVALFVSVLIGSILGF

SEQ ID NO: 1588774 - protein, 24 aa, Staphylococcus aureus
MAITLLFSTLFIVSIFIVDILYGV

SEQ ID NO: 1588775 - protein, 25 aa, Staphylococcus aureus
MEIADKWQNRHYRRGSANYKANNVA

SEQ ID NO: 1588776 - protein, 35 aa, Staphylococcus aureus
MFYKFRYILITLIILLLSIMVLFISGLAQGLGREN

SEQ ID NO: 1588777 - protein, 27 aa, Staphylococcus aureus
MGTYIKYAFFWIWGFAIVMLVIAMLMG

SEQ ID NO: 1588778 - protein, 18 aa, Staphylococcus aureus
MLSLFIFGKIVEAIIGSW

SEQ ID NO: 1588779 - protein, 17 aa, Staphylococcus aureus
MNIQLILTIPMVFGLIA

SEQ ID NO: 1588780 - protein, 25 aa, Staphylococcus aureus
MRKIFPLDFKILIGIGLVFCIATPI

SEQ ID NO: 1588781 - protein, 33 aa, Staphylococcus aureus
MSLPKKIFLWVFGILVILAIVAVVYVAAKIFIT

SEQ ID NO: 1588782 - protein, 21 aa, Staphylococcus aureus
NFVNMPALHLHYGYYICLAVM

SEQ ID NO: 1588783 - protein, 26 aa, Staphylococcus aureus
NIADKYNVIITTNVGVFKPHAVRDMN

SEQ ID NO: 1588784 - protein, 24 aa, Staphylococcus aureus
NIERISHLVLTRTGLYIIDSQLLK

SEQ ID NO: 1588785 - protein, 25 aa, Staphylococcus aureus
NLTLTTFIFGIIERSLIPFGLHHIF

SEQ ID NO: 1588786 - protein, 23 aa, Staphylococcus aureus
NVVIMFIFAIIFFGIMNDSGLFK

SEQ ID NO: 1588787 - protein, 24 aa, Staphylococcus aureus
PEGLDLIVVILFAPAIAFGLASII

SEQ ID NO: 1588788 - protein, 18 aa, Staphylococcus aureus
PFTYALSATFTILFCTKL

SEQ ID NO: 1588789 - protein, 24 aa, Staphylococcus aureus
PIAWAPFVVLWFGIGSLPAIAIIF

SEQ ID NO: 1588790 - protein, 20 aa, Staphylococcus aureus
PIHVKQLKDKVSKIVIQMNT

SEQ ID NO: 1588791 - protein, 34 aa, Staphylococcus aureus
PIQTTPQFFQNISPYLPFTYAIDSLRETVGGIVP

SEQ ID NO: 1588792 - protein, 19 aa, Staphylococcus aureus
PLMDGLYLHMLLWSKEQGY

SEQ ID NO: 1588793 - protein, 25 aa, Staphylococcus aureus
PNWITVLFIVLILISFNLLGARLFG

SEQ ID NO: 1588794 - protein, 25 aa, Staphylococcus aureus
PTLVFSFFGMNVPLPIDDHSYISWI

SEQ ID NO: 1588795 - protein, 18 aa, Staphylococcus aureus
QNPLYNRMTIRIKDNGIG

SEQ ID NO: 1588796 - protein, 24 aa, Staphylococcus aureus
QSKKEEVYRRLLASNLTSVPERFI

SEQ ID NO: 1588797 - protein, 28 aa, Staphylococcus aureus
QSPIVLGIIVLLFIPLTVVLKVQEGVIT

SEQ ID NO: 1588798 - protein, 33 aa, Staphylococcus aureus
RALCMLFIPQLYFYLPLLSFIGGLIPFLIIILL

SEQ ID NO: 1588799 - protein, 19 aa, Staphylococcus aureus
RPFRDIVKVRWAQSGFISA

SEQ ID NO: 1588800 - protein, 22 aa, Staphylococcus aureus
RSYSLYLWHYPIIVFVNSYYVQ

SEQ ID NO: 1588801 - protein, 17 aa, Staphylococcus aureus
RVGIILIGLVLMVAIVD

SEQ ID NO: 1588802 - protein, 22 aa, Staphylococcus aureus
RVLKIFLLCFAGNILGAAILFS

SEQ ID NO: 1588803 - protein, 24 aa, Staphylococcus aureus
RVSPRKVIAPLIKAHKAGLALTTN

SEQ ID NO: 1588804 - protein, 17 aa, Staphylococcus aureus
SELLKIAIILYIPFMIS

SEQ ID NO: 1588805 - protein, 20 aa, Staphylococcus aureus
SGFFFAFGALTYLISAQPNM

SEQ ID NO: 1588806 - protein, 26 aa, Staphylococcus aureus
SIALFIFTIIYFIVVLYICLNPSKLI

SEQ ID NO: 1588807 - protein, 27 aa, Staphylococcus aureus
SIMQVLTLVSVIFSPLTFIAGIYGMNF

SEQ ID NO: 1588808 - protein, 27 aa, Staphylococcus aureus
SISSLPWLLMFFLILSAGAISDRVLGL

SEQ ID NO: 1588809 - protein, 17 aa, Staphylococcus aureus
SNAMYLFLFIRSFIRGR

SEQ ID NO: 1588810 - protein, 21 aa, Staphylococcus aureus
SNFMYFTVGLYYKVIKPTRVL

SEQ ID NO: 1588811 - protein, 30 aa, Staphylococcus aureus
SNKYTIIILFVFLLLLIVRYLIHKFKPKKV

SEQ ID NO: 1588812 - protein, 31 aa, Staphylococcus aureus
SQLLTIQFLIVILTFLFIDFFDTAGTLVAVA

SEQ ID NO: 1588813 - protein, 18 aa, Staphylococcus aureus
SQVSNYIAWFSHGQLRME

SEQ ID NO: 1588814 - protein, 31 aa, Staphylococcus aureus
SSLLPTLVAVFLFAALFLPLLMEYGLLEMLG

SEQ ID NO: 1588815 - protein, 24 aa, Staphylococcus aureus
STQFRTLTMRILRSAFLSGLMLEF

SEQ ID NO: 1588816 - protein, 33 aa, Staphylococcus aureus
SVDDITWIIRIISMVVIFIPVLATWRGIFQGYK

SEQ ID NO: 1588817 - protein, 31 aa, Staphylococcus aureus
TAIGIFCIIMLFALLGFLPYNINPAKVFMGD

SEQ ID NO: 1588818 - protein, 21 aa, Staphylococcus aureus
TFVYGFILRLLGPLGLHHIFY

SEQ ID NO: 1588819 - protein, 17 aa, Staphylococcus aureus
TLTYIKKIKAKSFVIFM

SEQ ID NO: 1588820 - protein, 21 aa, Staphylococcus aureus
TLVGMRLRRVSPRKVIAPLIK

SEQ ID NO: 1588821 - protein, 26 aa, Staphylococcus aureus
TLVIVFILGLLLLLPSLILLLRLFVF

SEQ ID NO: 1588822 - protein, 26 aa, Staphylococcus aureus
TLVLVLVIMTLFLKYAPYGKQGLQAL

SEQ ID NO: 1588823 - protein, 29 aa, Staphylococcus aureus
TMEWAKLGILIALLFFPTGHILLKLVFAV

SEQ ID NO: 1588824 - protein, 20 aa, Staphylococcus aureus
TMISLIFLVAFSAKAALVLF

SEQ ID NO: 1588825 - protein, 23 aa, Staphylococcus aureus
TPMIVQLFIIFYGIPELGRLLTN

SEQ ID NO: 1588826 - protein, 21 aa, Staphylococcus aureus
TPMLLGAMIMGPLVGWLMKKT

SEQ ID NO: 1588827 - protein, 23 aa, Staphylococcus aureus
TSFEKWNFVKLAKPLIGVSILIV

SEQ ID NO: 1588828 - protein, 27 aa, Staphylococcus aureus
TWVNIISWTLIIILSILNVYLIVQTFQ

SEQ ID NO: 1588829 - protein, 21 aa, Staphylococcus aureus
TYVWWFMFAVYVSNSLFTLIN

SEQ ID NO: 1588830 - protein, 20 aa, Staphylococcus aureus
VDIWNFWHYTFTAAMVYAVS

SEQ ID NO: 1588831 - protein, 30 aa, Staphylococcus aureus
VGIVYAIVYYFLFDFAIRKFKLKTPGREDE

SEQ ID NO: 1588832 - protein, 20 aa, Staphylococcus aureus
VIKPTRVLKIFLLCFAGNIL

SEQ ID NO: 1588833 - protein, 28 aa, Staphylococcus aureus
VIMIIFMAMPFIFGLWNIVVPLQIGARD

SEQ ID NO: 1588834 - protein, 27 aa, Staphylococcus aureus
VIMSFIIVFFIAFLMNVKLLSNIKVQK

SEQ ID NO: 1588835 - protein, 23 aa, Staphylococcus aureus
VITCVFVPIIFKKLFPVPDEFNR

SEQ ID NO: 1588836 - protein, 18 aa, Staphylococcus aureus
VLVPFLTGLPISAALLAS

SEQ ID NO: 1588837 - protein, 30 aa, Staphylococcus aureus
VSILIVVVGLVILYIFKLNLGIDFSSGTRV

SEQ ID NO: 1588838 - protein, 32 aa, Staphylococcus aureus
VSLRNIWDIPWIIPLVLILILIAFSMAAHINI

SEQ ID NO: 1588839 - protein, 18 aa, Staphylococcus aureus
VVLSLYVLGIIMAFLVST

SEQ ID NO: 1588840 - protein, 25 aa, Staphylococcus aureus
VVSTVIFFLVFFYALDLGITALKNL

SEQ ID NO: 1588841 - protein, 18 aa, Staphylococcus aureus
VYVGYLYFHKIRGLLAFW

SEQ ID NO: 1588842 - protein, 17 aa, Staphylococcus aureus
WVISLGSIVIFFILNIL

SEQ ID NO: 1588843 - protein, 32 aa, Staphylococcus aureus
YHFVLAMFPMLLFLLTLLPFFNIKQSQITNML

SEQ ID NO: 1588844 - protein, 24 aa, Staphylococcus aureus
YISVLIFYIGLWLITPYFHNELTN

SEQ ID NO: 1588845 - protein, 32 aa, Staphylococcus aureus
YKVNRNIFWILLIGMLVIFIALQIRIFTIKED

SEQ ID NO: 1588846 - protein, 23 aa, Staphylococcus aureus
YPNPFLNPALIASLGIIFVLLIF

SEQ ID NO: 1588847 - protein, 26 aa, Staphylococcus aureus
YVTNFGYLWDLFFKHLLMSVYGVLFA

SEQ ID NO: 1588848 - protein, 23 aa, Staphylococcus aureus
AAILFMYYYLLYKSPEYNQRKRF

SEQ ID NO: 1588849 - protein, 18 aa, Staphylococcus aureus
AFEIPLRYKIMGIVGSVW

SEQ ID NO: 1588850 - protein, 26 aa, Staphylococcus aureus
AFTLIEMLLVLLIISLLLILIIPNIA

SEQ ID NO: 1588851 - protein, 24 aa, Staphylococcus aureus
AFVGIFLVIDLLVKNLGPAAQAMV

SEQ ID NO: 1588852 - protein, 23 aa, Staphylococcus aureus
AITSPWMLLKLAVVWTLVQFVEG

SEQ ID NO: 1588853 - protein, 28 aa, Staphylococcus aureus
APFLMFMPIWIGSIVTSILLFFAFRTSN

SEQ ID NO: 1588854 - protein, 24 aa, Staphylococcus aureus
AVAFYPILVPIFIALGYDSIVSVG

SEQ ID NO: 1588855 - protein, 28 aa, Staphylococcus aureus
AVATLLGWRWIFILSIIISLIALFLIKG

SEQ ID NO: 1588856 - protein, 18 aa, Staphylococcus aureus
AVLFILLIQHRVGSMALI

SEQ ID NO: 1588857 - protein, 19 aa, Staphylococcus aureus
CLPMLIQLPIIMGLYFVLK

SEQ ID NO: 1588858 - protein, 22 aa, Staphylococcus aureus
DLLSNLCNLLKYGFTLYQSFQF

SEQ ID NO: 1588859 - protein, 41 aa, Staphylococcus aureus
EEKQSVFVSILSTLIPVVVIALLFIFFLSQAQGGGSGGRMM

SEQ ID NO: 1588860 - protein, 29 aa, Staphylococcus aureus
EEQFYLLFPLVITFLLHRFKPRNIIQTLF

SEQ ID NO: 1588861 - protein, 18 aa, Staphylococcus aureus
EMGSRIPKGVLLVGPPGT

SEQ ID NO: 1588862 - protein, 24 aa, Staphylococcus aureus
EQYQGPMVLQLKKAGHIALIGSPG

SEQ ID NO: 1588863 - protein, 24 aa, Staphylococcus aureus
ETKFIDWGVFLVLGIFIGSYIAAR

SEQ ID NO: 1588864 - protein, 28 aa, Staphylococcus aureus
FIYMLISLFIIITITFFLMKLMPGSPFN

SEQ ID NO: 1588865 - protein, 18 aa, Staphylococcus aureus
FKFVFSLVAITTLVAGVG

SEQ ID NO: 1588866 - protein, 24 aa, Staphylococcus aureus
FLRLYILTLMFFSANAILNVFIPL

SEQ ID NO: 1588867 - protein, 25 aa, Staphylococcus aureus
FNIPLLLTIIIILLGSVLAIKVDWK

SEQ ID NO: 1588868 - protein, 25 aa, Staphylococcus aureus
FNLYFGIFLIFVAILLMVRNKIKPF

SEQ ID NO: 1588869 - protein, 29 aa, Staphylococcus aureus
FQWLQNWTIFYWAWWISWAPFVGIFIARV

SEQ ID NO: 1588870 - protein, 21 aa, Staphylococcus aureus
FTLEVLRLPRITLAILAGAAL

SEQ ID NO: 1588871 - protein, 24 aa, Staphylococcus aureus
GAVTFLLSIPALLPLYKALNMNKY

SEQ ID NO: 1588872 - protein, 23 aa, Staphylococcus aureus
GFAVLFTYLFGDQSPFTYALSAT

SEQ ID NO: 1588873 - protein, 24 aa, Staphylococcus aureus
GGYLLGAIFFLFIQKIMGSEVATL

SEQ ID NO: 1588874 - protein, 26 aa, Staphylococcus aureus
GIFSRRFWPSFTFLIPIIIGMLLAMG

SEQ ID NO: 1588875 - protein, 27 aa, Staphylococcus aureus
GIIAAIAFLILCIGIVAVLNSVKKNLD

SEQ ID NO: 1588876 - protein, 18 aa, Staphylococcus aureus
GIILIMILILLLSLKRQP

SEQ ID NO: 1588877 - protein, 25 aa, Staphylococcus aureus
GILIHWILFFLMILFVLVVLSAPTY

SEQ ID NO: 1588878 - protein, 26 aa, Staphylococcus aureus
GKMTFFFIITIIILIALVYFFIKDAQ

SEQ ID NO: 1588879 - protein, 25 aa, Staphylococcus aureus
GTSAAYFYSIYEMVRWLNGSTTQPH

SEQ ID NO: 1588880 - protein, 29 aa, Staphylococcus aureus
GVPEEKVLLMLLLYRFAYYFVPVIIALIL

SEQ ID NO: 1588881 - protein, 28 aa, Staphylococcus aureus
HFSYIYIFQFMILISLFGVYWIITENYI

SEQ ID NO: 1588882 - protein, 23 aa, Staphylococcus aureus
HKKIGIMYLICAVLMFVRGGIDA

SEQ ID NO: 1588883 - protein, 21 aa, Staphylococcus aureus
HPPMIVHYFFDLMVTMGILCF

SEQ ID NO: 1588884 - protein, 43 aa, Staphylococcus aureus
HQLRRSLFASTIFPVFLVIIIGLVSFYAIYIWIEHRTIHQHVD

SEQ ID NO: 1588885 - protein, 30 aa, Staphylococcus aureus
IAEKMKFIPYLLFVVIWTALVYSPVAHWVW

SEQ ID NO: 1588886 - protein, 24 aa, Staphylococcus aureus
IAIIVVLFITLFYKELFILSFDEE

SEQ ID NO: 1588887 - protein, 21 aa, Staphylococcus aureus
IAVITYFKLWKYLYKEWFTSV

SEQ ID NO: 1588888 - protein, 27 aa, Staphylococcus aureus
IGVLTMISYLLFLLSGLANGLINMNKE

SEQ ID NO: 1588889 - protein, 26 aa, Staphylococcus aureus
IGVTIIFGAFALFWFVGIHGPSIVEP

SEQ ID NO: 1588890 - protein, 30 aa, Staphylococcus aureus
IISIAVAFVILFIVGKFIVTPYTIKGESMD

SEQ ID NO: 1588891 - protein, 20 aa, Staphylococcus aureus
IIVLLVILILMNGVAIILRN

SEQ ID NO: 1588892 - protein, 49 aa, Staphylococcus aureus
ILPLIFALIIPILYRFFKRIHLGWFVLPVPIVIFIYMLTLIKTTMSGNT

SEQ ID NO: 1588893 - protein, 23 aa, Staphylococcus aureus
ILPPLAAMLFIKIGYHPIAGLTM

SEQ ID NO: 1588894 - protein, 18 aa, Staphylococcus aureus
ILVTILISIFLSLTESWQ

SEQ ID NO: 1588895 - protein, 22 aa, Staphylococcus aureus
IRTTTFAILILFLINFSNNADK

SEQ ID NO: 1588896 - protein, 21 aa, Staphylococcus aureus
ISRWLRYVLIVIGSAALYLGY

SEQ ID NO: 1588897 - protein, 17 aa, Staphylococcus aureus
ISVIVAGIYLFHRLQYS

SEQ ID NO: 1588898 - protein, 34 aa, Staphylococcus aureus
ITENEIIALVKYKGKYLPLLENGKLLKGSNDVKI

SEQ ID NO: 1588899 - protein, 25 aa, Staphylococcus aureus
ITLIGGIFVWIGWYGFNVGSAFTFD

SEQ ID NO: 1588900 - protein, 26 aa, Staphylococcus aureus
ITTSTYLFLFIVGVLAILLFEHNHAF

SEQ ID NO: 1588901 - protein, 21 aa, Staphylococcus aureus
IVTTPFVLFFMLKDGHHFKEF

SEQ ID NO: 1588902 - protein, 44 aa, Staphylococcus aureus
KERKKGGMAKVLLPLIAAVLIIGALAIFGGMALNNHNNGTKENK

SEQ ID NO: 1588903 - protein, 24 aa, Staphylococcus aureus
KIITLFIISLIYFVITIIASIVIG

SEQ ID NO: 1588904 - protein, 18 aa, Staphylococcus aureus
KRFKHLIIPLLSQNIRKA

SEQ ID NO: 1588905 - protein, 25 aa, Staphylococcus aureus
KSTIQAFIHSILFGFPTKKSKEPRL

SEQ ID NO: 1588906 - protein, 29 aa, Staphylococcus aureus
KVIIILFISLIVAVAFFFGLKTYQGHKNI

SEQ ID NO: 1588907 - protein, 23 aa, Staphylococcus aureus
LAGDPYYSGMALPSDISSPAQKL

SEQ ID NO: 1588908 - protein, 17 aa, Staphylococcus aureus
LASLLWITREFLLKKWE

SEQ ID NO: 1588909 - protein, 17 aa, Staphylococcus aureus
LCLTVFKMKGIYAALTT

SEQ ID NO: 1588910 - protein, 20 aa, Staphylococcus aureus
LLLTLYPFYIMLDSTKFFYL

SEQ ID NO: 1588911 - protein, 17 aa, Staphylococcus aureus
LPLVLIMTFALLFSSYT

SEQ ID NO: 1588912 - protein, 27 aa, Staphylococcus aureus
LRANRLFWAFALCLLPFSLMLVGGERA

SEQ ID NO: 1588913 - protein, 22 aa, Staphylococcus aureus
LSLIALLLIASFFITSADSATF

SEQ ID NO: 1588914 - protein, 19 aa, Staphylococcus aureus
LTMTLLILPIIIVSSQEAI

SEQ ID NO: 1588915 - protein, 26 aa, Staphylococcus aureus
LVIVIIGVIIFGLFSYLNGNGNMPKQ

SEQ ID NO: 1588916 - protein, 32 aa, Staphylococcus aureus
MIAATNRPDILDPALLRPGRFDRQIQVGRPDV

SEQ ID NO: 1588917 - protein, 22 aa, Staphylococcus aureus
MPLTLLGMIAFYIAIFTINNPD

SEQ ID NO: 1588918 - protein, 25 aa, Staphylococcus aureus
MTHTILLLLVLLAVSLYLSQPLSLI

SEQ ID NO: 1588919 - protein, 19 aa, Staphylococcus aureus
NDNNQLYGFVYPIVDKKEL

SEQ ID NO: 1588920 - protein, 36 aa, Staphylococcus aureus
NKQEKKIFPYILMSVGAFLTLGFVIFSIHKGRRTKN

SEQ ID NO: 1588921 - protein, 23 aa, Staphylococcus aureus
NMNVWILLGVTLILSLFGQLGDL

SEQ ID NO: 1588922 - protein, 22 aa, Staphylococcus aureus
NTSMDWDRKYPYGDTLRGIFGD

SEQ ID NO: 1588923 - protein, 22 aa, Staphylococcus aureus
NVFTLLMFVSIRRYQRTSQIHS

SEQ ID NO: 1588924 - protein, 21 aa, Staphylococcus aureus
PDELFFTRDGLPIAKTRGLQN

SEQ ID NO: 1588925 - protein, 24 aa, Staphylococcus aureus
PGLGILLAYMIFGKGTAKATSYGA

SEQ ID NO: 1588926 - protein, 24 aa, Staphylococcus aureus
PIIVSLILFYLFNPIVNMMERYRI

SEQ ID NO: 1588927 - protein, 27 aa, Staphylococcus aureus
PKFSILFLIIIYLTIGPLFAIPRTAST

SEQ ID NO: 1588928 - protein, 18 aa, Staphylococcus aureus
PLFAFITTFLIGILTGLF

SEQ ID NO: 1588929 - protein, 26 aa, Staphylococcus aureus
PLVLNPVFFIPFVLAPIVNVWIFKLF

SEQ ID NO: 1588930 - protein, 25 aa, Staphylococcus aureus
PQIMPAFLSLILYRFELNLRSASIL

SEQ ID NO: 1588931 - protein, 25 aa, Staphylococcus aureus
QGFFKGFLSLIPVLVGIIVGYVVAI

SEQ ID NO: 1588932 - protein, 68 aa, Staphylococcus aureus
QHKLIKLIISAVLSLPLLMLMFVHLFNMHIPALFTNPWFQFILATPVQFIIGWQFYVGAYKNLRNGGA

SEQ ID NO: 1588933 - protein, 40 aa, Staphylococcus aureus
QKNDFLVPFIIIANFFMALLTFIFIFYANHFMMSQRRKEF

SEQ ID NO: 1588934 - protein, 25 aa, Staphylococcus aureus
QSIMSYLLIALVLTAGTAFLIWLGD

SEQ ID NO: 1588935 - protein, 21 aa, Staphylococcus aureus
RDDAWLQKKLNYISKKTYQGI

SEQ ID NO: 1588936 - protein, 22 aa, Staphylococcus aureus
RDKKDFWIQLHPKKAKAMMTKE

SEQ ID NO: 1588937 - protein, 21 aa, Staphylococcus aureus
RIMYVVIIIAVIYFAIRYIGK

SEQ ID NO: 1588938 - protein, 26 aa, Staphylococcus aureus
RKKIILTLFVLPFPIMVWGVMTQGWW

SEQ ID NO: 1588939 - protein, 24 aa, Staphylococcus aureus
RLIVISMLLLLFWSTEKVLHPIDS

SEQ ID NO: 1588940 - protein, 24 aa, Staphylococcus aureus
RPDTTMEALAKLRTVFKADGTVTA

SEQ ID NO: 1588941 - protein, 24 aa, Staphylococcus aureus
RRKPLIIAMIIFTLASLGIVFVHN

SEQ ID NO: 1588942 - protein, 30 aa, Staphylococcus aureus
SATFLAWLLIFLMFALPIGIAYQFSDWFQN

SEQ ID NO: 1588943 - protein, 26 aa, Staphylococcus aureus
SLGFTMGWLYWALWSLVTSVDVIVAS

SEQ ID NO: 1588944 - protein, 24 aa, Staphylococcus aureus
SLIGMLMLIGIVVTNAIVLIDRVI

SEQ ID NO: 1588945 - protein, 22 aa, Staphylococcus aureus
SLILLGAIPAALLAIIFDLILR

SEQ ID NO: 1588946 - protein, 23 aa, Staphylococcus aureus
SLISIVMVAVLIWIAIKTYKDSV

SEQ ID NO: 1588947 - protein, 41 aa, Staphylococcus aureus
SQSTKELLYVALRISLIKVLRPYYPFPLIVDDAFVHFDKKR

SEQ ID NO: 1588948 - protein, 26 aa, Staphylococcus aureus
SRPVLLWTLLIFIIGNGIIAVAPNFS

SEQ ID NO: 1588949 - protein, 23 aa, Staphylococcus aureus
STLGFIFLMFLSGLEIDFKAFKK

SEQ ID NO: 1588950 - protein, 20 aa, Staphylococcus aureus
SVLIGIFNYIKVLPFIIKYV

SEQ ID NO: 1588951 - protein, 26 aa, Staphylococcus aureus
SVVNRAPRFLILPTIILIGILGSTAG

SEQ ID NO: 1588952 - protein, 18 aa, Staphylococcus aureus
TGWTYWFCWIITGMAEVT

SEQ ID NO: 1588953 - protein, 26 aa, Staphylococcus aureus
TLVVTLLIAIPFFKLPVGIASGAVVE

SEQ ID NO: 1588954 - protein, 30 aa, Staphylococcus aureus
TSGIGIMFVLLFLNGWFQGMGWPPSGRVLV

SEQ ID NO: 1588955 - protein, 19 aa, Staphylococcus aureus
TSKRWLMISVSIFIVMMLL

SEQ ID NO: 1588956 - protein, 25 aa, Staphylococcus aureus
TTGKYPFMMFGLPAAAFAIYKNARP

SEQ ID NO: 1588957 - protein, 24 aa, Staphylococcus aureus
TYHESLLDWLKIANEYKIPTYVLG

SEQ ID NO: 1588958 - protein, 23 aa, Staphylococcus aureus
VFDPFIIVFKTIAAPIIVSLILF

SEQ ID NO: 1588959 - protein, 26 aa, Staphylococcus aureus
VGATIVWLMYLPHWKATEEAGAKLGV

SEQ ID NO: 1588960 - protein, 31 aa, Staphylococcus aureus
VGLFVLALFLISLLLLFCPIILLASAISRGI

SEQ ID NO: 1588961 - protein, 17 aa, Staphylococcus aureus
VIFIFMMISFLIILGRD

SEQ ID NO: 1588962 - protein, 17 aa, Staphylococcus aureus
VLFFMLKDGHHFKEFST

SEQ ID NO: 1588963 - protein, 34 aa, Staphylococcus aureus
VLQKNLKILIILPLLFLIISAIVTFFVLSPKYQA

SEQ ID NO: 1588964 - protein, 30 aa, Staphylococcus aureus
VLVFVPQIVVLFFFISLLEDSGYMARIAVL

SEQ ID NO: 1588965 - protein, 23 aa, Staphylococcus aureus
VMILFAVLILFRGLGKDYDAAVM

SEQ ID NO: 1588966 - protein, 33 aa, Staphylococcus aureus
VPKAIKQVFWRILLFYILAIFVIGMLIPYDSSA

SEQ ID NO: 1588967 - protein, 30 aa, Staphylococcus aureus
VTAFAAIFLGVLMFFIWPSIQAGIYHVGGF

SEQ ID NO: 1588968 - protein, 26 aa, Staphylococcus aureus
VTEAFLKYHLLGGRYYQPLAQTFQMP

SEQ ID NO: 1588969 - protein, 25 aa, Staphylococcus aureus
WGPIAWAIYVLPALPIGYLVFVKKQ

SEQ ID NO: 1588970 - protein, 23 aa, Staphylococcus aureus
WISALFCVLLLMSFNLLSARLFG

SEQ ID NO: 1588971 - protein, 18 aa, Staphylococcus aureus
WNIVLFSIGMYIVVFGLR

SEQ ID NO: 1588972 - protein, 19 aa, Staphylococcus aureus
WVILVKIFNRKIPFLDKVI

SEQ ID NO: 1588973 - protein, 21 aa, Staphylococcus aureus
YFNIFLIFLGIGLVIPVLPVY

SEQ ID NO: 1588974 - protein, 23 aa, Staphylococcus aureus
YNKNEILSFYLNNIYFGDNQYTL

SEQ ID NO: 1588975 - protein, 31 aa, Staphylococcus aureus
ADLAILLGINWLAILLYIEAFVSPFGTGVSF

SEQ ID NO: 1588976 - protein, 24 aa, Staphylococcus aureus
AEDTILNIKVAIKAIFIPPREKEE

SEQ ID NO: 1588977 - protein, 23 aa, Staphylococcus aureus
AFCVGFLMYSIFKVIFKNANLTR

SEQ ID NO: 1588978 - protein, 30 aa, Staphylococcus aureus
AGVIPVIFAMAFFLLPRTLTLFYPDKEWAQ

SEQ ID NO: 1588979 - protein, 19 aa, Staphylococcus aureus
AIDELILLDFRLPRMMITI

SEQ ID NO: 1588980 - protein, 17 aa, Staphylococcus aureus
AILGIGGAVAAVLVTRK

SEQ ID NO: 1588981 - protein, 24 aa, Staphylococcus aureus
ALAAVLLGLIILVAAAIPVSHMRL

SEQ ID NO: 1588982 - protein, 37 aa, Staphylococcus aureus
ALLPLLKLVLVVVFAMVFFVFAILGLVAWMCGINIMN

SEQ ID NO: 1588983 - protein, 25 aa, Staphylococcus aureus
ASFSPLVLFALYWKGLTRAGAVSGM

SEQ ID NO: 1588984 - protein, 17 aa, Staphylococcus aureus
ASGTILGLALMMLLIFN

SEQ ID NO: 1588985 - protein, 24 aa, Staphylococcus aureus
ASLGIIFVLLIFGISYNGYMKGGS

SEQ ID NO: 1588986 - protein, 17 aa, Staphylococcus aureus
ATSLLPIVLLPLGHILT

SEQ ID NO: 1588987 - protein, 27 aa, Staphylococcus aureus
AVLLQYVFAVKLRWFPVAGWEGFSTAV

SEQ ID NO: 1588988 - protein, 29 aa, Staphylococcus aureus
AYTSAKQFFSTVLIPLSTSMKTLSDLTKQ

SEQ ID NO: 1588989 - protein, 29 aa, Staphylococcus aureus
CTDIYSIGIVLYEMLVGEPPFNGETAVSI

SEQ ID NO: 1588990 - protein, 22 aa, Staphylococcus aureus
DDCYYLVMEYIEGPTLSEYIES

SEQ ID NO: 1588991 - protein, 18 aa, Staphylococcus aureus
DFMLYITILMLVFLLMFN

SEQ ID NO: 1588992 - protein, 28 aa, Staphylococcus aureus
DNGSIENSFFLQRINPDSTAQGKIVFDV

SEQ ID NO: 1588993 - protein, 25 aa, Staphylococcus aureus
DQANPIILLLFVTIGFGLIGFIDDY

SEQ ID NO: 1588994 - protein, 24 aa, Staphylococcus aureus
EDDKLKLDYALDFDQDKYTYAEAK

SEQ ID NO: 1588995 - protein, 21 aa, Staphylococcus aureus
EKYEVNVIYLVSHALVETGNG

SEQ ID NO: 1588996 - protein, 23 aa, Staphylococcus aureus
EVNFARFIIIIAGIFGFGMSLYL

SEQ ID NO: 1588997 - protein, 36 aa, Staphylococcus aureus
FAIDMLKMILIQIICVMMGLWIYQLDKHESSTIILM

SEQ ID NO: 1588998 - protein, 32 aa, Staphylococcus aureus
FASFIGVALIYLFMLGFYRLPGLVAIIALTTY

SEQ ID NO: 1588999 - protein, 27 aa, Staphylococcus aureus
FIATFVLMVLMYRFFGKQGLIAWVAIG

SEQ ID NO: 1589000 - protein, 26 aa, Staphylococcus aureus
FIGGPGAVFWMWITAFLGASSAFIES

SEQ ID NO: 1589001 - protein, 18 aa, Staphylococcus aureus
FIVIVFFAAQLLAYLKWS

SEQ ID NO: 1589002 - protein, 17 aa, Staphylococcus aureus
FKKALITGLLIYIVGYS

SEQ ID NO: 1589003 - protein, 26 aa, Staphylococcus aureus
FMLGVTVFVLIYWLNPPGNAWLDNVS

SEQ ID NO: 1589004 - protein, 20 aa, Staphylococcus aureus
FYMAAFLAIILTVSHIKGWL

SEQ ID NO: 1589005 - protein, 18 aa, Staphylococcus aureus
FYVALFLGMILLGIVAFY

SEQ ID NO: 1589006 - protein, 25 aa, Staphylococcus aureus
GFITLPLYYLLFYNQFLLNKNTDIG

SEQ ID NO: 1589007 - protein, 22 aa, Staphylococcus aureus
GGSLFYLLALLSFPMPVKVIRR

SEQ ID NO: 1589008 - protein, 26 aa, Staphylococcus aureus
GHKVLIACLLVLFILILNLRGLTESA

SEQ ID NO: 1589009 - protein, 26 aa, Staphylococcus aureus
GILITFLPLLFLPFLGELGGAATTFS

SEQ ID NO: 1589010 - protein, 21 aa, Staphylococcus aureus
GITWLYLRYVAFRHDLKYLPG

SEQ ID NO: 1589011 - protein, 25 aa, Staphylococcus aureus
GIVITVILYAIKLPGSIFIGMIITA

SEQ ID NO: 1589012 - protein, 21 aa, Staphylococcus aureus
GTALAFYFFIDSLQYISAKET

SEQ ID NO: 1589013 - protein, 17 aa, Staphylococcus aureus
GVLILFGGGLALAKGIS

SEQ ID NO: 1589014 - protein, 19 aa, Staphylococcus aureus
GVMLNFMLVFLTLKAFGYS

SEQ ID NO: 1589015 - protein, 20 aa, Staphylococcus aureus
GVWFMAAIVCYLIIPKPGIA

SEQ ID NO: 1589016 - protein, 18 aa, Staphylococcus aureus
HGLIYLVRFLFGVGEAPM

SEQ ID NO: 1589017 - protein, 19 aa, Staphylococcus aureus
HLYILVMPVLFAVIGFFGI

SEQ ID NO: 1589018 - protein, 29 aa, Staphylococcus aureus
IAIYACRFVWVYFWYKDFYFPKNIQSYLD

SEQ ID NO: 1589019 - protein, 28 aa, Staphylococcus aureus
IALFFEVGLVLLIPLVFTVAKRANVSVL

SEQ ID NO: 1589020 - protein, 17 aa, Staphylococcus aureus
IASLFIPFGASIGLDTM

SEQ ID NO: 1589021 - protein, 29 aa, Staphylococcus aureus
IAVIAIVIIVYIALKYAPFLKEQDWNPVN

SEQ ID NO: 1589022 - protein, 43 aa, Staphylococcus aureus
IIFMERRSANSIWAWLLVLVFLPLFGFILYLLLGRQIQRDQIF

SEQ ID NO: 1589023 - protein, 26 aa, Staphylococcus aureus
IIIAIILIIIILFDVKYYFEQHRKLL

SEQ ID NO: 1589024 - protein, 17 aa, Staphylococcus aureus
IIIILFGFIAAFIDSVV

SEQ ID NO: 1589025 - protein, 31 aa, Staphylococcus aureus
IILNSIFIGAFILNLLFAFTIIFMERRSANS

SEQ ID NO: 1589026 - protein, 23 aa, Staphylococcus aureus
ILLLLLILLTIISLFIGVSELSI

SEQ ID NO: 1589027 - protein, 24 aa, Staphylococcus aureus
ILTLTFHLPLWVLLIAFFLNVCPV

SEQ ID NO: 1589028 - protein, 31 aa, Staphylococcus aureus
IPYREDYLIHLTFVPLLFLGRFTNMVYTLSA

SEQ ID NO: 1589029 - protein, 25 aa, Staphylococcus aureus
ISGKPWIWMPPAIMITLTILSINFV

SEQ ID NO: 1589030 - protein, 19 aa, Staphylococcus aureus
ITFSFALVLILFTNSELLT

SEQ ID NO: 1589031 - protein, 25 aa, Staphylococcus aureus
ITILGGDLMLIPKAIYASKATIRNI

SEQ ID NO: 1589032 - protein, 28 aa, Staphylococcus aureus
ITNMLIFVIWLFYCMSFVAVIILRKREP

SEQ ID NO: 1589033 - protein, 17 aa, Staphylococcus aureus
IYILMAVIIICINIQEV

SEQ ID NO: 1589034 - protein, 17 aa, Staphylococcus aureus
IYPIGMMLLIIGGGGTF

SEQ ID NO: 1589035 - protein, 29 aa, Staphylococcus aureus
KFSQVWPILIFLPFVVIFFLKINKHYRDI

SEQ ID NO: 1589036 - protein, 37 aa, Staphylococcus aureus
KKKSKRILLKILLTILIIIALFIGIMYFLSTRDNVDE

SEQ ID NO: 1589037 - protein, 42 aa, Staphylococcus aureus
KKPWPKFLTLFAGPLFNFILALVLFIGLAYYQGTPTSTVEQV

SEQ ID NO: 1589038 - protein, 22 aa, Staphylococcus aureus
KLFSIIMMYVIGLIVTLGIGSS

SEQ ID NO: 1589039 - protein, 23 aa, Staphylococcus aureus
KLWLRNFMQAFFVVFFVYMAMYL

SEQ ID NO: 1589040 - protein, 22 aa, Staphylococcus aureus
KYSYRKLFLVALVLFTIGSLIC

SEQ ID NO: 1589041 - protein, 28 aa, Staphylococcus aureus
LATIIIFLSLLFTIIYIDDIQKWFNQYT

SEQ ID NO: 1589042 - protein, 25 aa, Staphylococcus aureus
LFGFILLIPVLYKGLIKRITGKSHI

SEQ ID NO: 1589043 - protein, 19 aa, Staphylococcus aureus
LGHIALIFGLGAILGKLLA

SEQ ID NO: 1589044 - protein, 26 aa, Staphylococcus aureus
LIAIKTFLHLINKIKLIPFAIYRIVL

SEQ ID NO: 1589045 - protein, 24 aa, Staphylococcus aureus
LITMVLFALILFQGIFKIGHFSIY

SEQ ID NO: 1589046 - protein, 20 aa, Staphylococcus aureus
LLIIITPLPAFLIIGRIIQG

SEQ ID NO: 1589047 - protein, 31 aa, Staphylococcus aureus
LLTSTILAIAYILMWFNGHMTLTLTLTTIIT

SEQ ID NO: 1589048 - protein, 27 aa, Staphylococcus aureus
LNEVAGWNLTLFIVFRLISGAVVAGVL

SEQ ID NO: 1589049 - protein, 22 aa, Staphylococcus aureus
LPIFVQNLLHRSALDSGLTLLP

SEQ ID NO: 1589050 - protein, 22 aa, Staphylococcus aureus
LSFAYVIFIVFWQVGFSNAVNL

SEQ ID NO: 1589051 - protein, 21 aa, Staphylococcus aureus
LSILNYFVLLPLYGMIFNLAD

SEQ ID NO: 1589052 - protein, 25 aa, Staphylococcus aureus
LSYLRSILLMMLPFGLGVFIQQVSY

SEQ ID NO: 1589053 - protein, 29 aa, Staphylococcus aureus
LSYYYSLSPLMWLNFLFIKIGETVGIFNP

SEQ ID NO: 1589054 - protein, 18 aa, Staphylococcus aureus
LTATLPVILMLVSTITQL

SEQ ID NO: 1589055 - protein, 18 aa, Staphylococcus aureus
LTVFLYALLPIIKNTYTG

SEQ ID NO: 1589056 - protein, 26 aa, Staphylococcus aureus
LVGWRYTFLFLIIVSIIVGFLMMIYL

SEQ ID NO: 1589057 - protein, 19 aa, Staphylococcus aureus
LVNFVFLPPKFETKIYYNS

SEQ ID NO: 1589058 - protein, 25 aa, Staphylococcus aureus
MFLCTLLVWLMTPGLSLFYGGLVQS

SEQ ID NO: 1589059 - protein, 27 aa, Staphylococcus aureus
MPTLVFINPMWFGILFAIVGALLIEKL

SEQ ID NO: 1589060 - protein, 24 aa, Staphylococcus aureus
MVVYIVLIILFTYFYAFVQVNPEK

SEQ ID NO: 1589061 - protein, 24 aa, Staphylococcus aureus
NNTLTFIQLLTPFVVYFLAEEVHA

SEQ ID NO: 1589062 - protein, 23 aa, Staphylococcus aureus
NPILLLILAIIFFIVLKIFKYVS

SEQ ID NO: 1589063 - protein, 22 aa, Staphylococcus aureus
NTKLYPGQVWTIADLLQITVSN

SEQ ID NO: 1589064 - protein, 23 aa, Staphylococcus aureus
NVTLFHCIILILAFLYEFTANRT

SEQ ID NO: 1589065 - protein, 38 aa, Staphylococcus aureus
NWIIVTTMITFVTIFLFCLIIIFFLKDTLHNSELDDAE

SEQ ID NO: 1589066 - protein, 26 aa, Staphylococcus aureus
NYDNIVKSLYIIALAFGVIATIITAT

SEQ ID NO: 1589067 - protein, 18 aa, Staphylococcus aureus
PGYFSTIAAILLLGGIQL

SEQ ID NO: 1589068 - protein, 31 aa, Staphylococcus aureus
PLMLLVQGVVFFILYYVIFRVVIQVFNLNTI

SEQ ID NO: 1589069 - protein, 19 aa, Staphylococcus aureus
PLPAFLIIGRIIQGLSAAC

SEQ ID NO: 1589070 - protein, 26 aa, Staphylococcus aureus
PLSAYAFMIFILLYIPCVSTVAAIRK

SEQ ID NO: 1589071 - protein, 24 aa, Staphylococcus aureus
PNKPDHPFVFWATLKNAASLLDAG

SEQ ID NO: 1589072 - protein, 28 aa, Staphylococcus aureus
PVSIGKLFMIFLIRTIITLPIISLMAHL

SEQ ID NO: 1589073 - protein, 26 aa, Staphylococcus aureus
QNILIDSNKTLKIFDFGIAKALSETS

SEQ ID NO: 1589074 - protein, 33 aa, Staphylococcus aureus
QRHTVNGQENLYRIAIQYYGSGSPENVEKIRRA

SEQ ID NO: 1589075 - protein, 23 aa, Staphylococcus aureus
SFVNLILFRKLNIGGPSKAFAVC

SEQ ID NO: 1589076 - protein, 20 aa, Staphylococcus aureus
SLFIAMLLACLLIQAATNMF

SEQ ID NO: 1589077 - protein, 21 aa, Staphylococcus aureus
STYIGYAPIDDPKLAFSIVYT

SEQ ID NO: 1589078 - protein, 19 aa, Staphylococcus aureus
SVITFWLFAQSLVNVVPIL

SEQ ID NO: 1589079 - protein, 24 aa, Staphylococcus aureus
SVVFAVIYNLWWFVYNGVQATGLH

SEQ ID NO: 1589080 - protein, 30 aa, Staphylococcus aureus
TALIMLITAPFIPLFYIIFGLKTRDESKDQ

SEQ ID NO: 1589081 - protein, 21 aa, Staphylococcus aureus
TALMLMLLMFIGGAPLSAAGG

SEQ ID NO: 1589082 - protein, 18 aa, Staphylococcus aureus
TDARSYIYLVQDNEIDKV

SEQ ID NO: 1589083 - protein, 26 aa, Staphylococcus aureus
TEMSPILLAWIVAAVLRIALGSATVA

SEQ ID NO: 1589084 - protein, 22 aa, Staphylococcus aureus
TILKRRIIMIGFITLPLYYLLF

SEQ ID NO: 1589085 - protein, 22 aa, Staphylococcus aureus
TINVAVEPGYKSLTTKVHIVVP

SEQ ID NO: 1589086 - protein, 19 aa, Staphylococcus aureus
TNRFSSRPVLLWTLLIFII

SEQ ID NO: 1589087 - protein, 34 aa, Staphylococcus aureus
TTIITSCLTLLICSIFINPLIQKIKQFNIKTKQF

SEQ ID NO: 1589088 - protein, 26 aa, Staphylococcus aureus
TVLDVFLLLFIMKYGFRKIEAIVGTL

SEQ ID NO: 1589089 - protein, 18 aa, Staphylococcus aureus
VASISVLVIACPCALGLA

SEQ ID NO: 1589090 - protein, 24 aa, Staphylococcus aureus
VDQLPLFLTLRFIQGLTGGGVIVI

SEQ ID NO: 1589091 - protein, 17 aa, Staphylococcus aureus
VFIVFYVALFLGMILLG

SEQ ID NO: 1589092 - protein, 30 aa, Staphylococcus aureus
VGVLFLVGFLIYLFYSPRLKFDVLENPNKG

SEQ ID NO: 1589093 - protein, 26 aa, Staphylococcus aureus
VIALGIIVLYVFLGLAAPLVTFYDPN

SEQ ID NO: 1589094 - protein, 19 aa, Staphylococcus aureus
VLFVPALVCFIFFAVFGAS

SEQ ID NO: 1589095 - protein, 17 aa, Staphylococcus aureus
VLVTRKDSRDKLKAEYN

SEQ ID NO: 1589096 - protein, 38 aa, Staphylococcus aureus
VQLTKFEKVLYITLITVIAMLSIYMLSLKMDAYDTRGK

SEQ ID NO: 1589097 - protein, 31 aa, Staphylococcus aureus
VVGVGYFIHWIWPALPMPAAFAIAAILCPTD

SEQ ID NO: 1589098 - protein, 19 aa, Staphylococcus aureus
YFQIAYIVLMAITLCGFVI

SEQ ID NO: 1589099 - protein, 22 aa, Staphylococcus aureus
YFYLMLFFSTTIIGALLLYLPF

SEQ ID NO: 1589100 - protein, 24 aa, Staphylococcus aureus
AGFKILAPLMKFIMHILSVAVEAL

SEQ ID NO: 1589101 - protein, 32 aa, Staphylococcus aureus
ATVLSYPVYLFIIGLVILIFIGTFRVATGDIQ

SEQ ID NO: 1589102 - protein, 18 aa, Staphylococcus aureus
AVIAVIMWFYVKPDQPLI

SEQ ID NO: 1589103 - protein, 26 aa, Staphylococcus aureus
CISVSWLWFFLLAILGKMVGSIDKTG

SEQ ID NO: 1589104 - protein, 25 aa, Staphylococcus aureus
DIAWRDLLIIPIIGVIFYALTIAAY

SEQ ID NO: 1589105 - protein, 18 aa, Staphylococcus aureus
FGGSVVIWLLSYVGPHGI

SEQ ID NO: 1589106 - protein, 19 aa, Staphylococcus aureus
FLALISMNIRILSGFLFLI

SEQ ID NO: 1589107 - protein, 20 aa, Staphylococcus aureus
FSHYVILFLALLTIIFGCVG

SEQ ID NO: 1589108 - protein, 23 aa, Staphylococcus aureus
FSLLLIIAIFIYNAFSYLLKRRR

SEQ ID NO: 1589109 - protein, 20 aa, Staphylococcus aureus
FYTLSWLIISISLILNLIKV

SEQ ID NO: 1589110 - protein, 35 aa, Staphylococcus aureus
GAPLYALMILVVTVKLFGFLRAITRYVERLISHKA

SEQ ID NO: 1589111 - protein, 19 aa, Staphylococcus aureus
GIIVAFVVLLITFGSVIAA

SEQ ID NO: 1589112 - protein, 25 aa, Staphylococcus aureus
HDGSRLLFYYAPVAILISLLSVTAS

SEQ ID NO: 1589113 - protein, 18 aa, Staphylococcus aureus
IDIPLRIEKGKTASYIVK

SEQ ID NO: 1589114 - protein, 24 aa, Staphylococcus aureus
IGHICLSLPFALIGLFTSMFFIII

SEQ ID NO: 1589115 - protein, 32 aa, Staphylococcus aureus
IGLIIAVVIALIFFVLFLVALGSKKKVKRQTE

SEQ ID NO: 1589116 - protein, 29 aa, Staphylococcus aureus
IGSVILILIFLFLIFHLIRLAAKIEDQFN

SEQ ID NO: 1589117 - protein, 19 aa, Staphylococcus aureus
IIIYLIIGSALGIIIIPEI

SEQ ID NO: 1589118 - protein, 25 aa, Staphylococcus aureus
IKRYPVLGWSFFIAALSLAGIPPLS

SEQ ID NO: 1589119 - protein, 27 aa, Staphylococcus aureus
INALLLQLIMIFISSTYLILLFNMMLK

SEQ ID NO: 1589120 - protein, 18 aa, Staphylococcus aureus
IPLLLIIGRLIQGLSAAC

SEQ ID NO: 1589121 - protein, 26 aa, Staphylococcus aureus
IPVWKLIIIWFLRVALSLLITIPVAL

SEQ ID NO: 1589122 - protein, 17 aa, Staphylococcus aureus
ITKVLYRLTFVGSIFLA

SEQ ID NO: 1589123 - protein, 25 aa, Staphylococcus aureus
ITLIVVDIIIYYPFLKVYDSEILDE

SEQ ID NO: 1589124 - protein, 30 aa, Staphylococcus aureus
KCIVLVFLIHPILILVFSALAFMIPGASES

SEQ ID NO: 1589125 - protein, 37 aa, Staphylococcus aureus
KKKKIRKLPIILLIVVILLIALVVYIVHSYNSGVEYA

SEQ ID NO: 1589126 - protein, 44 aa, Staphylococcus aureus
KKVAKTPAVWIILAGLAILPSFYAWFNLWAMWDPYGNTGHIKVA

SEQ ID NO: 1589127 - protein, 26 aa, Staphylococcus aureus
KLGGKVLLLYFMFCAIISVIQNIVGV

SEQ ID NO: 1589128 - protein, 29 aa, Staphylococcus aureus
KLIKRWLIAIVVLAIIIWAFAGVPSLELK

SEQ ID NO: 1589129 - protein, 22 aa, Staphylococcus aureus
KLRLDMREIPKSSIKPEHFHLM

SEQ ID NO: 1589130 - protein, 18 aa, Staphylococcus aureus
KMDLKKVAKTPAVWIILA

SEQ ID NO: 1589131 - protein, 23 aa, Staphylococcus aureus
LAPIVNVWIFKLFVEVLGMNSFS

SEQ ID NO: 1589132 - protein, 21 aa, Staphylococcus aureus
LFIIYSFIFVLLLPNTFYMVT

SEQ ID NO: 1589133 - protein, 31 aa, Staphylococcus aureus
LIGLILGPLLFLLTLLFFHPQDLPWKGVYVL

SEQ ID NO: 1589134 - protein, 25 aa, Staphylococcus aureus
LIGSLWLMLSIIPLSIILGIGTAIY

SEQ ID NO: 1589135 - protein, 17 aa, Staphylococcus aureus
LILLCGIVTLLIRIIPF

SEQ ID NO: 1589136 - protein, 18 aa, Staphylococcus aureus
LINFMVFPPKYYGQVEEK

SEQ ID NO: 1589137 - protein, 37 aa, Staphylococcus aureus
LLILKAGVESPVLFVLITIFCSIIFNSIVYTCVSLLG

SEQ ID NO: 1589138 - protein, 21 aa, Staphylococcus aureus
LLLLFLMIIFGGKKGFISYLT

SEQ ID NO: 1589139 - protein, 33 aa, Staphylococcus aureus
LTHKYIGMPIFLAIMWLIFQTTFTWIGTPLSDQ

SEQ ID NO: 1589140 - protein, 24 aa, Staphylococcus aureus
LTIYVLVALMYWVVCFIISIIQGI

SEQ ID NO: 1589141 - protein, 20 aa, Staphylococcus aureus
NGHFMVFLLILLGAFIFGYG

SEQ ID NO: 1589142 - protein, 24 aa, Staphylococcus aureus
NIIQTLFIVSLISLGLMIVIHFIT

SEQ ID NO: 1589143 - protein, 21 aa, Staphylococcus aureus
NIVFILFIFVFATKAGVFPMF

SEQ ID NO: 1589144 - protein, 39 aa, Staphylococcus aureus; identical to SEQ ID NO: 1580416

SEQ ID NO: 1589145 - protein, 24 aa, Staphylococcus aureus
PHQFEQLFLIFIDNAIKYDVKNKK

SEQ ID NO: 1589146 - protein, 23 aa, Staphylococcus aureus
RERYYYYFSVLFMLIGIIGAFTT

SEQ ID NO: 1589147 - protein, 28 aa, Staphylococcus aureus
RHALILFVAMFFIFIAILTLTMWSEYRG

SEQ ID NO: 1589148 - protein, 31 aa, Staphylococcus aureus
RYNHAKPPKFLVRFWTLASGTILGLALMMLL

SEQ ID NO: 1589149 - protein, 20 aa, Staphylococcus aureus
RYYNFFGIGAFDSSAVRSGK

SEQ ID NO: 1589150 - protein, 29 aa, Staphylococcus aureus
SAIAFVLTFIKFPIPFLPPYLTLDFSDVP

SEQ ID NO: 1589151 - protein, 44 aa, Staphylococcus aureus
SFNSKPLRMMIYLGLFIFSISVLYIIYLFINIMISGVNIPGYFS

SEQ ID NO: 1589152 - protein, 27 aa, Staphylococcus aureus
SIAGIIILLLWLYITSFIIIVGAEINA

SEQ ID NO: 1589153 - protein, 20 aa, Staphylococcus aureus
TFIAPIVFILLMVAQGYIAT

SEQ ID NO: 1589154 - protein, 25 aa, Staphylococcus aureus
TIENTEQQFPPRNAQRRKRRRDLAT

SEQ ID NO: 1589155 - protein, 19 aa, Staphylococcus aureus
TQDFKGYSLLIHSLENYDN

SEQ ID NO: 1589156 - protein, 22 aa, Staphylococcus aureus
TSYYLLAFSLMLILPSAIYADT

SEQ ID NO: 1589157 - protein, 27 aa, Staphylococcus aureus
TVKNKVFKLIFLACTLLGLVVLIALLT

SEQ ID NO: 1589158 - protein, 17 aa, Staphylococcus aureus
VIWLLSYVGPHGINVNI

SEQ ID NO: 1589159 - protein, 24 aa, Staphylococcus aureus
VRNKIFFTLAMLVIFKIGTYIPAP

SEQ ID NO: 1589160 - protein, 26 aa, Staphylococcus aureus
VVWSKPLVYGLLITGVLFTLRMRFFQ

SEQ ID NO: 1589161 - protein, 24 aa, Staphylococcus aureus
VYTIHVIILIILLKEFRKYKSINV

SEQ ID NO: 1589162 - protein, 18 aa, Staphylococcus aureus
YIAIVILLHVIGFSFLWI

SEQ ID NO: 1589163 - protein, 22 aa, Staphylococcus aureus
YTLIIYVLLLTLYPFYIMLDST

SEQ ID NO: 1589164 - protein, 26 aa, Staphylococcus aureus
YVLAITLWIATWWITEAIPIAATSLL

SEQ ID NO: 1589165 - protein, 27 aa, Staphylococcus aureus
AAFVGYLELLFGPLRRLVASFTTLTQS

SEQ ID NO: 1589166 - protein, 18 aa, Staphylococcus aureus
ACIGVLLSFFAIQLLERK

SEQ ID NO: 1589167 - protein, 23 aa, Staphylococcus aureus
ADPEYIFYAYKRFNFELKDPNFT

SEQ ID NO: 1589168 - protein, 17 aa, Staphylococcus aureus
AFLLIIQASTIISMEFH

SEQ ID NO: 1589169 - protein, 26 aa, Staphylococcus aureus
AGPSSTFFIVTFSLPINLPIAPEEAL

SEQ ID NO: 1589170 - protein, 20 aa, Staphylococcus aureus
DFMRYSLISGILIGFIAPLI

SEQ ID NO: 1589171 - protein, 32 aa, Staphylococcus aureus
DLIWSQYLIGLLLTAGFFFTISSKFVQLRMLP

SEQ ID NO: 1589172 - protein, 25 aa, Staphylococcus aureus
DNFSFLIVITILIAIAIYACRFVWV

SEQ ID NO: 1589173 - protein, 23 aa, Staphylococcus aureus
EKFWILHYSFLRALILGFFIGFI

SEQ ID NO: 1589174 - protein, 23 aa, Staphylococcus aureus
ELKLIMSLGFILGGIIGFFQGLV

SEQ ID NO: 1589175 - protein, 25 aa, Staphylococcus aureus
ERPYKVPLYPIIPLIAILAGSFVLI

SEQ ID NO: 1589176 - protein, 25 aa, Staphylococcus aureus
FAAAMIAMSFLYLQGGRLIDVLTAI

SEQ ID NO: 1589177 - protein, 17 aa, Staphylococcus aureus
FAILIISIVLIIFGVPI

SEQ ID NO: 1589178 - protein, 31 aa, Staphylococcus aureus
FGMTLLIVTVIPFYIFTALKIAGPSSTFFIV

SEQ ID NO: 1589179 - protein, 23 aa, Staphylococcus aureus
FLAMFLIFTIFVGLPLLIMEFTV

SEQ ID NO: 1589180 - protein, 24 aa, Staphylococcus aureus
FVVLGMFAIFIYKYSYNKNAESGK

SEQ ID NO: 1589181 - protein, 23 aa, Staphylococcus aureus
GEVWAMLCISLLLVAYLMLKRHK

SEQ ID NO: 1589182 - protein, 29 aa, Staphylococcus aureus
GFEAKLYTLIWFIVGIILYLSYGLRHSKK

SEQ ID NO: 1589183 - protein, 41 aa, Staphylococcus aureus
GGIVPEILITKLIILTLFGIGFFVVGLILKPVTDPLMKRVS

SEQ ID NO: 1589184 - protein, 23 aa, Staphylococcus aureus
GGTRIRPILMTAIATIGALVPLL

SEQ ID NO: 1589185 - protein, 33 aa, Staphylococcus aureus
HALLIMVSMLFTLLIVPWLSSKKARTLKKHAAN

SEQ ID NO: 1589186 - protein, 23 aa, Staphylococcus aureus
HMRIFLQIMLPLAKPILAVVALF

SEQ ID NO: 1589187 - protein, 20 aa, Staphylococcus aureus
HYFESPLFKGKYSVNNSDLL

SEQ ID NO: 1589188 - protein, 24 aa, Staphylococcus aureus
IADIPFYILGFLAAFTVGLIAIKT

SEQ ID NO: 1589189 - protein, 24 aa, Staphylococcus aureus
IFFVYFVIVGFRRGFWLSMIHLSA

SEQ ID NO: 1589190 - protein, 26 aa, Staphylococcus aureus
IFIDDYYLIFLLQGIYIIGAALDISW

SEQ ID NO: 1589191 - protein, 21 aa, Staphylococcus aureus
IGAIFMVVIMILVTWNDIRRY

SEQ ID NO: 1589192 - protein, 21 aa, Staphylococcus aureus
IIGALLVLGIGKVLNSTILNK

SEQ ID NO: 1589193 - protein, 25 aa, Staphylococcus aureus
IIYIGMVLVILLFNLDQIVPMIGTI

SEQ ID NO: 1589194 - protein, 26 aa, Staphylococcus aureus
ILGLALMMLLIFNNIGIISITDFTNR

SEQ ID NO: 1589195 - protein, 17 aa, Staphylococcus aureus
IMSLLISFLLWYFTRNW

SEQ ID NO: 1589196 - protein, 17 aa, Staphylococcus aureus
IRWMLATSFLVHGTLKF

SEQ ID NO: 1589197 - protein, 18 aa, Staphylococcus aureus
ISIFFLGTLLGGLSPHFA

SEQ ID NO: 1589198 - protein, 22 aa, Staphylococcus aureus
IVPVLMFAFFGIVLGFATLFKN

SEQ ID NO: 1589199 - protein, 19 aa, Staphylococcus aureus
KDRMEFQMLYGFRSELAEE

SEQ ID NO: 1589200 - protein, 17 aa, Staphylococcus aureus
LDMQPAHLFFMIAAPEG

SEQ ID NO: 1589201 - protein, 28 aa, Staphylococcus aureus
LGTIVAIIVILLFLRNIRTTAISIISIP

SEQ ID NO: 1589202 - protein, 20 aa, Staphylococcus aureus
LGVITFWLFAQSLVNLVVPL

SEQ ID NO: 1589203 - protein, 26 aa, Staphylococcus aureus
LKGKKLTFIISPQWFTNHGLTNQNFD

SEQ ID NO: 1589204 - protein, 28 aa, Staphylococcus aureus
LLHRVLPGRFYVITLYRIIKLVIIFLIE

SEQ ID NO: 1589205 - protein, 17 aa, Staphylococcus aureus
LLTLLYLAIFITLYLIY

SEQ ID NO: 1589206 - protein, 21 aa, Staphylococcus aureus
LMILLTVVLYYFAKRLQQKYP

SEQ ID NO: 1589207 - protein, 18 aa, Staphylococcus aureus
MQGANIIILAMIIGAMIA

SEQ ID NO: 1589208 - protein, 27 aa, Staphylococcus aureus
MTPFYTALSVWVGALLMVSLLTVDNKH

SEQ ID NO: 1589209 - protein, 19 aa, Staphylococcus aureus
NETLYTIRLLPVGGYVRMA

SEQ ID NO: 1589210 - protein, 23 aa, Staphylococcus aureus
NGGYQVMIVIPENFSKLAMQLDA

SEQ ID NO: 1589211 - protein, 36 aa, Staphylococcus aureus
NHSQTPRYRRPKFPWFKTVIVALIAGIIGALLVLGI

SEQ ID NO: 1589212 - protein, 25 aa, Staphylococcus aureus
NMVKYPILMLPILTTAIVSGLVSAL

SEQ ID NO: 1589213 - protein, 44 aa, Staphylococcus aureus
NNIKMRKMVPWAIGFFILILIIILFFLLRNFNSPEAQTKILVNA

SEQ ID NO: 1589214 - protein, 19 aa, Staphylococcus aureus
PFSAVIIILYALDLVIRNS

SEQ ID NO: 1589215 - protein, 19 aa, Staphylococcus aureus
PVAHWVWGGGWINKLGVLD

SEQ ID NO: 1589216 - protein, 39 aa, Staphylococcus aureus
QEIAIVIVIFALFGLMFYLYHLPLEAYLLALGVILLLLL

SEQ ID NO: 1589217 - protein, 18 aa, Staphylococcus aureus
RFSYYGMRALLIFYMYFA

SEQ ID NO: 1589218 - protein, 32 aa, Staphylococcus aureus
SLGGLSWPIVLVILILFYFYSHYLFASSTAHI

SEQ ID NO: 1589219 - protein, 44 aa, Staphylococcus aureus
TIIIALSIMFFLDVKLTLAALFIFPFYILTVYVFFGRLRKLTRE

SEQ ID NO: 1589220 - protein, 24 aa, Staphylococcus aureus
TMIFKPIKLLPLVPFIFISFFINS

SEQ ID NO: 1589221 - protein, 26 aa, Staphylococcus aureus
TTMGWRWIFIFSIIVAVLSMLLIKGT

SEQ ID NO: 1589222 - protein, 25 aa, Staphylococcus aureus
TYIGWRSIFVVSILLTLLAMYLIKH

SEQ ID NO: 1589223 - protein, 34 aa, Staphylococcus aureus
VASSQKFLILYSIVFMLVICFVVLGMFAIFIYKY

SEQ ID NO: 1589224 - protein, 33 aa, Staphylococcus aureus
VFSDDFFNSNFWIYWKTMFAFEPWHSAMEMRRY

SEQ ID NO: 1589225 - protein, 26 aa, Staphylococcus aureus
VGIDYALFILFRYRQVMKTETDYIKG

SEQ ID NO: 1589226 - protein, 29 aa, Staphylococcus aureus
VVNGYILITVLILSLLVVSWQVSLLACIG

SEQ ID NO: 1589227 - protein, 27 aa, Staphylococcus aureus
WGVMTQGWWFPVMASAFLIFTIIIMFI

SEQ ID NO: 1589228 - protein, 18 aa, Staphylococcus aureus
WVGFLSNLIFVPYYSIIL

SEQ ID NO: 1589229 - protein, 29 aa, Staphylococcus aureus
YMKFWFPELPTWIPGVIAILLLMAANLFS

SEQ ID NO: 1589230 - protein, 17 aa, Staphylococcus aureus
YVFTIIILVPFLFSIAI

SEQ ID NO: 1589231 - protein, 23 aa, Staphylococcus aureus
AIGWLILEYIFKKTTSLLGLLLG

SEQ ID NO: 1589232 - protein, 37 aa, Staphylococcus aureus
AIVTIPLVLLIVTLIIPILFFIIAMMLFIRKDKVEMV

SEQ ID NO: 1589233 - protein, 30 aa, Staphylococcus aureus
ANWQTYIMIAVYFLILIVIGFYGYKQATGN

SEQ ID NO: 1589234 - protein, 26 aa, Staphylococcus aureus
ASFGWRIPFLLGLFLGLFGLYLRRKL

SEQ ID NO: 1589235 - protein, 30 aa, Staphylococcus aureus
DYLGYILVALFLITWLISSLIWKFGRIEHK

SEQ ID NO: 1589236 - protein, 24 aa, Staphylococcus aureus
FGQGLFHLLFFWTGIPTIISIIHA

SEQ ID NO: 1589237 - protein, 17 aa, Staphylococcus aureus
FGYILFLALIDRFFKIF

SEQ ID NO: 1589238 - protein, 20 aa, Staphylococcus aureus
GFSWFAFLLIIQASTIISME

SEQ ID NO: 1589239 - protein, 25 aa, Staphylococcus aureus
GLVQNLILLMNPYSLVALVLSVFLF

SEQ ID NO: 1589240 - protein, 20 aa, Staphylococcus aureus
HIPTMFFFGGLIIGIVPYLL

SEQ ID NO: 1589241 - protein, 19 aa, Staphylococcus aureus
HRHFLIPSIIVIAMAGIGC

SEQ ID NO: 1589242 - protein, 20 aa, Staphylococcus aureus
IFFIINFILISYLYDKQYVQ

SEQ ID NO: 1589243 - protein, 34 aa, Staphylococcus aureus
IFGIIGLVVIFAVVSFLFFSMISDQIFFKHVKSD

SEQ ID NO: 1589244 - protein, 27 aa, Staphylococcus aureus
IIKFGIPMLIPLLIKYAIDGVINNHAL

SEQ ID NO: 1589245 - protein, 29 aa, Staphylococcus aureus
ILISGAVFIVFLLLPASWFTGLVNEKTVE

SEQ ID NO: 1589246 - protein, 32 aa, Staphylococcus aureus
IPIIIVLLLIGGIAWGVYAFFANTPKNTYLKS

SEQ ID NO: 1589247 - protein, 18 aa, Staphylococcus aureus
IVPYMIFFAFFSIYYFLT

SEQ ID NO: 1589248 - protein, 24 aa, Staphylococcus aureus
IVVKTLLFFIIGSLVYITGYRQYQ

SEQ ID NO: 1589249 - protein, 41 aa, Staphylococcus aureus
KMSTTAKVVSIATVLLLLGGLVFAIFAYVDHSNKAKERMLN

SEQ ID NO: 1589250 - protein, 28 aa, Staphylococcus aureus
LGGPGAVFWMWVIAFIGAASAFIEATLA

SEQ ID NO: 1589251 - protein, 43 aa, Staphylococcus aureus
LGIIGRLIDSFFNYLFGYSRYLTYILVLLATGFITYSKRIPKT

SEQ ID NO: 1589252 - protein, 73 aa, Staphylococcus aureus
LIVGLIAMNKFHVLAGYRAKFILMVILTMMVFVLINTYLLRQVKSIGMFLMIAALGLYFVAMNNLKAAGQGVT

SEQ ID NO: 1589253 - protein, 19 aa, Staphylococcus aureus
LNWIRPYKARMILGFSMSF

SEQ ID NO: 1589254 - protein, 19 aa, Staphylococcus aureus
LSGFLFLISAIVTIPLVLL

SEQ ID NO: 1589255 - protein, 21 aa, Staphylococcus aureus
LSISIIILVAISIAIYITLNS

SEQ ID NO: 1589256 - protein, 18 aa, Staphylococcus aureus
LVEGLIVGLIAMNKFHVL

SEQ ID NO: 1589257 - protein, 31 aa, Staphylococcus aureus
MHHNAIIETIWFVIPIIIVAALAIPTVKTLY

SEQ ID NO: 1589258 - protein, 23 aa, Staphylococcus aureus
NTSPYMIIIFITAILLVSLQIIY

SEQ ID NO: 1589259 - protein, 20 aa, Staphylococcus aureus
NVVYFRFFSDFLTFSTLNQV

SEQ ID NO: 1589260 - protein, 26 aa, Staphylococcus aureus
PTTAEVILIIILGLPIYFFYEYRMNW

SEQ ID NO: 1589261 - protein, 24 aa, Staphylococcus aureus
QIIANIICWALIAPTLDILIYNEP

SEQ ID NO: 1589262 - protein, 22 aa, Staphylococcus aureus
QNQYQYVPPQQQAPTKQRPAKE

SEQ ID NO: 1589263 - protein, 19 aa, Staphylococcus aureus
QRLIKLLGDIFIPILPAIV

SEQ ID NO: 1589264 - protein, 23 aa, Staphylococcus aureus
QVQWLTTAFLLTNGIVIPLSALV

SEQ ID NO: 1589265 - protein, 42 aa, Staphylococcus aureus
RRKRQKRIQYSVITILVLLIAVILIYMFSPLSKIAHVNINGN

SEQ ID NO: 1589266 - protein, 24 aa, Staphylococcus aureus
SLFAFFLLTVITITLKTYFSYYVD

SEQ ID NO: 1589267 - protein, 18 aa, Staphylococcus aureus
SVSFLEVLVYIVGLGLVM

SEQ ID NO: 1589268 - protein, 24 aa, Staphylococcus aureus
SYVVPPLTLLNQPAKQKATSKAEV

SEQ ID NO: 1589269 - protein, 28 aa, Staphylococcus aureus
TEKVLGWLCWVMLLVLTVITMFIALVSF

SEQ ID NO: 1589270 - protein, 28 aa, Staphylococcus aureus
TGSFYITAFYRFVLVMIGVISSSLVNFV

SEQ ID NO: 1589271 - protein, 18 aa, Staphylococcus aureus
TIGYWLARLLKLDRQDQK

SEQ ID NO: 1589272 - protein, 31 aa, Staphylococcus aureus
TKLFLGIILFFFIIFVHNFDFMLYITILMLV

SEQ ID NO: 1589273 - protein, 33 aa, Staphylococcus aureus
TLQMLNMRYSHWFRFVWPVVAFVLIFGGGVLIT

SEQ ID NO: 1589274 - protein, 23 aa, Staphylococcus aureus
TLVVPFMFMWMTKSKRNKAIGRA

SEQ ID NO: 1589275 - protein, 25 aa, Staphylococcus aureus
VCTATAIMILLYSGLKFGDNAPQGV

SEQ ID NO: 1589276 - protein, 23 aa, Staphylococcus aureus
VIIISFLYMAMYKITSYIYAKVI

SEQ ID NO: 1589277 - protein, 22 aa, Staphylococcus aureus
VNEVYLISHALLETGAVKSELA

SEQ ID NO: 1589278 - protein, 25 aa, Staphylococcus aureus
VPYFILTEMPPFVAGLLIAAIFAAA

SEQ ID NO: 1589279 - protein, 18 aa, Staphylococcus aureus
VVIFSIVMTFIIAKVIKL

SEQ ID NO: 1589280 - protein, 20 aa, Staphylococcus aureus
VVTIIILFGVALVSPIYTLS

SEQ ID NO: 1589281 - protein, 20 aa, Staphylococcus aureus
YFGVSLIVFIVLLSGLTFIP

SEQ ID NO: 1589282 - protein, 17 aa, Staphylococcus aureus
YSHLITLTNHYPFTLDE

SEQ ID NO: 1589283 - protein, 50 aa, Staphylococcus aureus
YSLVALVLSVFLFFKGKKAFWFMFIGGFLLTFLLYANVVYFRFFSDFLTF

SEQ ID NO: 1589284 - protein, 25 aa, Staphylococcus aureus
YYGMRALLIFYMYFAVTDNGLGIDK

SEQ ID NO: 1589285 - protein, 41 aa, Staphylococcus aureus
ASTAYSKSWLAIVCSMMVVFSIMLFLFVKRNKKKNKNESQR

SEQ ID NO: 1589286 - protein, 24 aa, Staphylococcus aureus
DYKAEKLLAPYKKAKTLERQVYEL

SEQ ID NO: 1589287 - protein, 32 aa, Staphylococcus aureus
EMFRPFALAIAFSLLASLLVSITLVPALAATL

SEQ ID NO: 1589288 - protein, 23 aa, Staphylococcus aureus
ENSKPIIATLFLDNYDEITQNMN

SEQ ID NO: 1589289 - protein, 27 aa, Staphylococcus aureus
FEKTNRFFLFAPLFVSMVFGVAFLYLT

SEQ ID NO: 1589290 - protein, 27 aa, Staphylococcus aureus
FLTALPSYWIASILIIYVSVKLNILPT

SEQ ID NO: 1589291 - protein, 17 aa, Staphylococcus aureus
GSMLILVYSMLAAFLFI

SEQ ID NO: 1589292 - protein, 25 aa, Staphylococcus aureus
ICYGLIFGLFYLLSGSRADYLIVTI

SEQ ID NO: 1589293 - protein, 21 aa, Staphylococcus aureus
IDLPYIPLLVLFAGVANLIPF

SEQ ID NO: 1589294 - protein, 19 aa, Staphylococcus aureus
IFISFFFSGSETALTAANK

SEQ ID NO: 1589295 - protein, 26 aa, Staphylococcus aureus
IIVGIVLAILIIFLKELLDKRIKTEE

SEQ ID NO: 1589296 - protein, 17 aa, Staphylococcus aureus
IIVGLISGALWAFGQAN

SEQ ID NO: 1589297 - protein, 17 aa, Staphylococcus aureus
ILSLAINFHPHEVAFLL

SEQ ID NO: 1589298 - protein, 20 aa, Staphylococcus aureus
ISTYLHWTNMFLIALIVVFT

SEQ ID NO: 1589299 - protein, 20 aa, Staphylococcus aureus
ITPMMPYLPLLLTYAQKYDK

SEQ ID NO: 1589300 - protein, 24 aa, Staphylococcus aureus
KETYSWKWTALAVAYPLVTAYVLT

SEQ ID NO: 1589301 - protein, 40 aa, Staphylococcus aureus
KPKKKSTRKIVLLSLIFSLLMIALVSFVAMAMFGNKYEET

SEQ ID NO: 1589302 - protein, 28 aa, Staphylococcus aureus
KVHNAWNVMHLIFPVVSTTFASFKSMYG

SEQ ID NO: 1589303 - protein, 26 aa, Staphylococcus aureus
LALLHDVFIIVAIFSLFRIEVDLTFI

SEQ ID NO: 1589304 - protein, 19 aa, Staphylococcus aureus
LEMRALLLHLRPLGLKDKS

SEQ ID NO: 1589305 - protein, 18 aa, Staphylococcus aureus
LFGMTTYFIMLMLRSVRS

SEQ ID NO: 1589306 - protein, 51 aa, Staphylococcus aureus
LFIDKVFVNIIYFQGMFYTQIFGIPVFLFLNLIIILLCIIVGSVLAYKINQ

SEQ ID NO: 1589307 - protein, 21 aa, Staphylococcus aureus
MLILVYSMLAAFLFIDKVFVN

SEQ ID NO: 1589308 - protein, 23 aa, Staphylococcus aureus
MTGKIYLQVKLKGQIDKEQLVFQ

SEQ ID NO: 1589309 - protein, 39 aa, Staphylococcus aureus
MWITEKLGWYYLILTTIIVFFCIFLIFSPIGKLKLGKPN

SEQ ID NO: 1589310 - protein, 26 aa, Staphylococcus aureus
NDQEKLIYWNPWDTELSIQDADSSLL

SEQ ID NO: 1589311 - protein, 21 aa, Staphylococcus aureus
PLSVRWYGIIIAVGILLGYFV

SEQ ID NO: 1589312 - protein, 25 aa, Staphylococcus aureus
QELFYLFNLILKYISTVPLALIFLF

SEQ ID NO: 1589313 - protein, 26 aa, Staphylococcus aureus
SAYILWGILPIYWQFVDAIGAFEILA

SEQ ID NO: 1589314 - protein, 18 aa, Staphylococcus aureus
SENDHCLYFFDITEQVQT

SEQ ID NO: 1589315 - protein, 20 aa, Staphylococcus aureus
SFSVNLPWTTPGPLGIIMGT

SEQ ID NO: 1589316 - protein, 28 aa, Staphylococcus aureus
SLGNKFAIFLMVVLVVLGGVYASAKLKL

SEQ ID NO: 1589317 - protein, 31 aa, Staphylococcus aureus
SLKTSFTFMLIIVLIIWSFIYTGFNFGDLMI

SEQ ID NO: 1589318 - protein, 26 aa, Staphylococcus aureus
SNQKTWIGIPLWVHRRCLKPMFTIAN

SEQ ID NO: 1589319 - protein, 34 aa, Staphylococcus aureus
TEPLEFSFLFVAPLLFFIHAVLDGLSFLTLYLLD

SEQ ID NO: 1589320 - protein, 24 aa, Staphylococcus aureus
TKKQTIPAFFKGNAPYIFAHRGGM

SEQ ID NO: 1589321 - protein, 21 aa, Staphylococcus aureus
TQFIYLHRRVGQFSNLLMVCH

SEQ ID NO: 1589322 - protein, 21 aa, Staphylococcus aureus
VFLVLIVPFIKPFITFIPRYG

SEQ ID NO: 1589323 - protein, 17 aa, Staphylococcus aureus
VIGPFFALPRLATTSFE

SEQ ID NO: 1589324 - protein, 28 aa, Staphylococcus aureus
WVFFTSFIVLLFPIFFLSQAQTPGMLMA

SEQ ID NO: 1589325 - protein, 18 aa, Staphylococcus aureus
YVVMILYTGWLSTSHQSL

SEQ ID NO: 1589326 - protein, 23 aa, Staphylococcus aureus
AFIQIFLGMLLFITPIPVQFNFD

SEQ ID NO: 1589327 - protein, 26 aa, Staphylococcus aureus
ALTLPILNFIIPFVLVFIVDGMKGIK

SEQ ID NO: 1589328 - protein, 22 aa, Staphylococcus aureus
APIAFLMGIPWSEAVPAGSLMA

SEQ ID NO: 1589329 - protein, 19 aa, Staphylococcus aureus
ATITLLCTFLIVTLTMTLT

SEQ ID NO: 1589330 - protein, 27 aa, Staphylococcus aureus
DPKQPPFFFSVLLPIVFISAIIGILQY

SEQ ID NO: 1589331 - protein, 24 aa, Staphylococcus aureus
EDNSYYYPVIKDGKIVYTLTLSPK

SEQ ID NO: 1589332 - protein, 17 aa, Staphylococcus aureus
ELPWGVLILFGGGLALA

SEQ ID NO: 1589333 - protein, 26 aa, Staphylococcus aureus
FDFGYDQLKKLEGMLDFPMLSTNVYK

SEQ ID NO: 1589334 - protein, 26 aa, Staphylococcus aureus
FGGQLALFIWFFKLKYSFGHIINSKI

SEQ ID NO: 1589335 - protein, 18 aa, Staphylococcus aureus
FGQYAMLFLAPTGLVMAT

SEQ ID NO: 1589336 - protein, 25 aa, Staphylococcus aureus
FKYIVMSLFLWLMWSHQTFFTNRFG

SEQ ID NO: 1589337 - protein, 20 aa, Staphylococcus aureus
GIIFFLALAFLFSSDRKNIR

SEQ ID NO: 1589338 - protein, 24 aa, Staphylococcus aureus
GLSFIGIISLFSWGLGYFGQPHII

SEQ ID NO: 1589339 - protein, 22 aa, Staphylococcus aureus
HKDTLVDIIFYSALFGFIAARI

SEQ ID NO: 1589340 - protein, 30 aa, Staphylococcus aureus
HLTIAIGIALFIFVIVRPPIEFIRQYLAQW

SEQ ID NO: 1589341 - protein, 26 aa, Staphylococcus aureus
IALTTYIYLTLVAFNFISGVLTLPGL

SEQ ID NO: 1589342 - protein, 25 aa, Staphylococcus aureus
IGTTVFGGLSLALGAALLAGRRREL

SEQ ID NO: 1589343 - protein, 21 aa, Staphylococcus aureus
IIGSWLFLLGIGLLYKTVGTL

SEQ ID NO: 1589344 - protein, 27 aa, Staphylococcus aureus
IKEPKLLIIIPILIVAFIISKLIPVMF

SEQ ID NO: 1589345 - protein, 18 aa, Staphylococcus aureus
INFILKSSTKLKADIDFD

SEQ ID NO: 1589346 - protein, 24 aa, Staphylococcus aureus
IQLDQLLVSILQPYEQRIKHENRT

SEQ ID NO: 1589347 - protein, 18 aa, Staphylococcus aureus
ISIKKQLPYIPKQRLYTL

SEQ ID NO: 1589348 - protein, 38 aa, Staphylococcus aureus
ITNVIAIRMLFHPFKPYYIFKFRVPFTPGLIPKRREEI

SEQ ID NO: 1589349 - protein, 23 aa, Staphylococcus aureus
IVILAPLARLIAVLLTPVVNSTL

SEQ ID NO: 1589350 - protein, 17 aa, Staphylococcus aureus
IYGVTLPLGRPFLTACI

SEQ ID NO: 1589351 - protein, 18 aa, Staphylococcus aureus
IYLRAIRDGFISAMPVIL

SEQ ID NO: 1589352 - protein, 18 aa, Staphylococcus aureus
KWISIPSRFILNIVRTIP

SEQ ID NO: 1589353 - protein, 25 aa, Staphylococcus aureus
LLAIQLIFAFILLKTTMGIKVIGGI

SEQ ID NO: 1589354 - protein, 19 aa, Staphylococcus aureus
LPVITIGILFGLAMDYEVF

SEQ ID NO: 1589355 - protein, 31 aa, Staphylococcus aureus
LQNGIWAIIVYFIVCLLISFLALISMNIRIL

SEQ ID NO: 1589356 - protein, 18 aa, Staphylococcus aureus
MFICITLIGLFSQWARTT

SEQ ID NO: 1589357 - protein, 34 aa, Staphylococcus aureus
NAGTPAYIYAIPVASLALLIAITLFVRKKSKGNV

SEQ ID NO: 1589358 - protein, 24 aa, Staphylococcus aureus
NILLPTLVTIMALRWGISVGIASA

SEQ ID NO: 1589359 - protein, 18 aa, Staphylococcus aureus
NIRWKYVGILLAIQLIFA

SEQ ID NO: 1589360 - protein, 42 aa, Staphylococcus aureus
NNDITEMHWTLWKYLILTCLVVLICLYFASRSFKRTLIRPIQ

SEQ ID NO: 1589361 - protein, 23 aa, Staphylococcus aureus
NTTQFVIWLQNGIWAIIVYFIVC

SEQ ID NO: 1589362 - protein, 26 aa, Staphylococcus aureus
PVILFSSIFLLIAYVPNIFGFKWDKG

SEQ ID NO: 1589363 - protein, 22 aa, Staphylococcus aureus
QAIIIIVVTILFIASAWSGLSK

SEQ ID NO: 1589364 - protein, 23 aa, Staphylococcus aureus
QKWLGIVFAILITITFAFVFNTV

SEQ ID NO: 1589365 - protein, 26 aa, Staphylococcus aureus
QLSYTPPYYYLLITITIFGIICSIIF

SEQ ID NO: 1589366 - protein, 22 aa, Staphylococcus aureus
RHLLLFPGILLQGAAIAALVPI

SEQ ID NO: 1589367 - protein, 33 aa, Staphylococcus aureus
RLVYPIINICVIVFRPITLLLNKLTDSINRSLS

SEQ ID NO: 1589368 - protein, 19 aa, Staphylococcus aureus
SLIVLFIFTLFIMAQYAKH

SEQ ID NO: 1589369 - protein, 25 aa, Staphylococcus aureus
SLKNKLIEFFAGYSLANNAAFNQSD

SEQ ID NO: 1589370 - protein, 22 aa, Staphylococcus aureus
SSRLFIKKLLSFSYKFVLYTSA

SEQ ID NO: 1589371 - protein, 22 aa, Staphylococcus aureus
STFLGILPVGMYLISINQLNYA

SEQ ID NO: 1589372 - protein, 24 aa, Staphylococcus aureus
STIFLLIMVPFFLIYMLKDHEKFI

SEQ ID NO: 1589373 - protein, 20 aa, Staphylococcus aureus
TIGFGLMLYAFSSAGDLGFT

SEQ ID NO: 1589374 - protein, 28 aa, Staphylococcus aureus
TTLLNFFHGWPWYAVWLVMLGFGGGMII

SEQ ID NO: 1589375 - protein, 17 aa, Staphylococcus aureus
TVLVPLLPIYMASLQNL

SEQ ID NO: 1589376 - protein, 28 aa, Staphylococcus aureus
VIGVGLFIHWIWPDLPIGAAFAIAAILC

SEQ ID NO: 1589377 - protein, 17 aa, Staphylococcus aureus
VMAPLSFVLASLAIYWA

SEQ ID NO: 1589378 - protein, 30 aa, Staphylococcus aureus
ALIVTLIIIIAIVSMIFFVQTKYGDQSEKG

SEQ ID NO: 1589379 - protein, 23 aa, Staphylococcus aureus
ASIYAIWLIYAAGINYLLLTMLL

SEQ ID NO: 1589380 - protein, 21 aa, Staphylococcus aureus
FISNPLLIYMEPYASSTAELV

SEQ ID NO: 1589381 - protein, 28 aa, Staphylococcus aureus
GIIGSIFMFLIFGVFIRRVTNAIKGLEH

SEQ ID NO: 1589382 - protein, 36 aa, Staphylococcus aureus
GITHSIPFTILWPILITFLIFTFFSGTNPFHVWMWA

SEQ ID NO: 1589383 - protein, 24 aa, Staphylococcus aureus
GQKYVVMKTKDDSYWKDLIVEGKR

SEQ ID NO: 1589384 - protein, 23 aa, Staphylococcus aureus
GVIWRILIFYLGAIFVIVSVYPW

SEQ ID NO: 1589385 - protein, 22 aa, Staphylococcus aureus
HRKLLVIKKLYGYSTLRANYQY

SEQ ID NO: 1589386 - protein, 19 aa, Staphylococcus aureus
IFFNIIFIDFYYYIYNVHL

SEQ ID NO: 1589387 - protein, 24 aa, Staphylococcus aureus
IPASIIGLLVWFIAGFQFKGHSND

SEQ ID NO: 1589388 - protein, 26 aa, Staphylococcus aureus
IVTFIVFMILLITKFSQVWPILIFLP

SEQ ID NO: 1589389 - protein, 21 aa, Staphylococcus aureus
KFILPIVVGLLIWALTPFKPD

SEQ ID NO: 1589390 - protein, 24 aa, Staphylococcus aureus
KGSLRYIHDIWGYIAPNTKKEKQP

SEQ ID NO: 1589391 - protein, 25 aa, Staphylococcus aureus
KKYYTIFLFFHINLATIGGILGLVQ

SEQ ID NO: 1589392 - protein, 19 aa, Staphylococcus aureus
KVLRIIIIVMLVSVVLALL

SEQ ID NO: 1589393 - protein, 18 aa, Staphylococcus aureus
LDITLLQNIFTLMSAAGS

SEQ ID NO: 1589394 - protein, 19 aa, Staphylococcus aureus
LIITQLLYFIDGSLAFLIF

SEQ ID NO: 1589395 - protein, 23 aa, Staphylococcus aureus
LLAFAFIIMFILNPLVVYDIGFQ

SEQ ID NO: 1589396 - protein, 17 aa, Staphylococcus aureus
LNFSVFFLNLIGLTLLG

SEQ ID NO: 1589397 - protein, 24 aa, Staphylococcus aureus
LSIALVVIGIAVVCLMIFSSQKTT

SEQ ID NO: 1589398 - protein, 32 aa, Staphylococcus aureus
NLLLSAAIFLYIMLIDWRMASALLVTIPISIF

SEQ ID NO: 1589399 - protein, 21 aa, Staphylococcus aureus
NPFHVWMWAQLAVFLHVFVDI

SEQ ID NO: 1589400 - protein, 24 aa, Staphylococcus aureus
NQLNYAEFFLCIVLSLGVVAPIKN

SEQ ID NO: 1589401 - protein, 17 aa, Staphylococcus aureus
NRKIIIILALLMGALGF

SEQ ID NO: 1589402 - protein, 26 aa, Staphylococcus aureus
SQHSVLRNYPLLARIRYISEKMGPEL

SEQ ID NO: 1589403 - protein, 27 aa, Staphylococcus aureus
SYDQIGLWAPILLLLARVLQGFSTGGE

SEQ ID NO: 1589404 - protein, 24 aa, Staphylococcus aureus
TIQLLPITGIPLPFISYGGSALWS

SEQ ID NO: 1589405 - protein, 17 aa, Staphylococcus aureus
VAQVLLPLLTKPAPKTV

SEQ ID NO: 1589406 - protein, 25 aa, Staphylococcus aureus
YKGQPMTFRLLLVDTPETKHPKKGV

SEQ ID NO: 1589407 - protein, 23 aa, Staphylococcus aureus
AQQNAFYQVLNMPNLNADQRNGF

SEQ ID NO: 1589408 - protein, 17 aa, Staphylococcus aureus
CLVLIYFYGIYGAAIAR

SEQ ID NO: 1589409 - protein, 23 aa, Staphylococcus aureus
EMTRYFMTIPEASRLVLQAGALA

SEQ ID NO: 1589410 - protein, 18 aa, Staphylococcus aureus
FFNDGNMLKPWFVNSVEN

SEQ ID NO: 1589411 - protein, 30 aa, Staphylococcus aureus
FNLIGVIIFTIFLPVVIHLISLLQDVWHLK

SEQ ID NO: 1589412 - protein, 30 aa, Staphylococcus aureus
FNPVFALWFLITLFFFHVILVIVRRFNPYK

SEQ ID NO: 1589413 - protein, 17 aa, Staphylococcus aureus
FTIACISVSWLWFFLLA

SEQ ID NO: 1589414 - protein, 22 aa, Staphylococcus aureus
GSVFLPFLISGFLFYICLPFQN

SEQ ID NO: 1589415 - protein, 28 aa, Staphylococcus aureus
HPTGSSLKPFLAYGPAIENMKWATNHAI

SEQ ID NO: 1589416 - protein, 26 aa, Staphylococcus aureus
IAYIILAFFFFVFILLFFSDETRAAI

SEQ ID NO: 1589417 - protein, 24 aa, Staphylococcus aureus
IDKNRIKRMLVDRPTLLKHTDDFL

SEQ ID NO: 1589418 - protein, 26 aa, Staphylococcus aureus
IDRLILVFNGFFILCIVSLVITILTI

SEQ ID NO: 1589419 - protein, 25 aa, Staphylococcus aureus
IFNMYHRAWEYASVSELILIVKAVT

SEQ ID NO: 1589420 - protein, 20 aa, Staphylococcus aureus
IIVYPAFIMLFLSFVCLISS

SEQ ID NO: 1589421 - protein, 17 aa, Staphylococcus aureus
IPTIIAVAIVIISTISI

SEQ ID NO: 1589422 - protein, 45 aa, Staphylococcus aureus
IVTGNRPFFRLYLITWMMHLILIGGSRLFWRIYRKYLGGKSFNKK

SEQ ID NO: 1589423 - protein, 41 aa, Staphylococcus aureus
KAMAPIMPIIIIPIISSVVVGLIFIFLIGAPISNIFEALTT

SEQ ID NO: 1589424 - protein, 17 aa, Staphylococcus aureus
KAPAFTEAKLQDPIPAK

SEQ ID NO: 1589425 - protein, 18 aa, Staphylococcus aureus
KELWLPVLTICFILAISK

SEQ ID NO: 1589426 - protein, 39 aa, Staphylococcus aureus
KKNKIGAVLLVGLFGLLFFILVLRISYIMITGHSNGQDL

SEQ ID NO: 1589427 - protein, 24 aa, Staphylococcus aureus
KLGETFFLYLTWYSIGRFFIEGLR

SEQ ID NO: 1589428 - protein, 19 aa, Staphylococcus aureus
LFFGAPTIFNFTLALFIGL

SEQ ID NO: 1589429 - protein, 21 aa, Staphylococcus aureus
LGVTPIARFVGYKAVGVDPKI

SEQ ID NO: 1589430 - protein, 19 aa, Staphylococcus aureus
LKDKTMHLQLLFGQANRQD

SEQ ID NO: 1589431 - protein, 22 aa, Staphylococcus aureus
LKDYVFIDDGWAKHGTYCVVRR

SEQ ID NO: 1589432 - protein, 28 aa, Staphylococcus aureus
LKIEKMNLPGISLLPETERFYPNGNFAS

SEQ ID NO: 1589433 - protein, 18 aa, Staphylococcus aureus
LLASMFYIYRKHIFMAAV

SEQ ID NO: 1589434 - protein, 20 aa, Staphylococcus aureus
LLIYVPFCFFLTASVTLLTS

SEQ ID NO: 1589435 - protein, 18 aa, Staphylococcus aureus
LVQLFLISMLFTQSAYQF

SEQ ID NO: 1589436 - protein, 24 aa, Staphylococcus aureus
LYQRSWLMMLLICNILGMIYGYIW

SEQ ID NO: 1589437 - protein, 21 aa, Staphylococcus aureus
MGKYFAGIYIPSKFTHEITGT

SEQ ID NO: 1589438 - protein, 25 aa, Staphylococcus aureus
MLFITNFNWLYMIGALIAIIVFALY

SEQ ID NO: 1589439 - protein, 19 aa, Staphylococcus aureus
NLVEIYLTSIIDNLHNAQK

SEQ ID NO: 1589440 - protein, 47 aa, Staphylococcus aureus
NVKRTIIKIIGFMIIAFFVVLLLGILLFAYYAWKAPAFTEAKLQDPI

SEQ ID NO: 1589441 - protein, 17 aa, Staphylococcus aureus
PLALSFFSGKRLVPIMT

SEQ ID NO: 1589442 - protein, 23 aa, Staphylococcus aureus
QDKSLLISQILQTKLGKAEADKL

SEQ ID NO: 1589443 - protein, 28 aa, Staphylococcus aureus
QNILLMVGIFILVAILGASLSFIKLFKV

SEQ ID NO: 1589444 - protein, 21 aa, Staphylococcus aureus
RLLILALIDSLIVTFSVFVSY

SEQ ID NO: 1589445 - protein, 27 aa, Staphylococcus aureus
SNRLNKFSIRKYTVGTASILVGTTLIF

SEQ ID NO: 1589446 - protein, 22 aa, Staphylococcus aureus
SYTYLIVVYAIRMFSVSLLMMP

SEQ ID NO: 1589447 - protein, 33 aa, Staphylococcus aureus
TLLEPFGLPALTLPFIIVTWILLFAGIKHDKVD

SEQ ID NO: 1589448 - protein, 26 aa, Staphylococcus aureus
TPMLVQVFIVFFGITAALGLDISALV

SEQ ID NO: 1589449 - protein, 37 aa, Staphylococcus aureus
VEWGTVIVQVLTFIVLLALLKKFAWGPLKDVMDKRER

SEQ ID NO: 1589450 - protein, 26 aa, Staphylococcus aureus
VFRVVLIPVFILFALVDFGFGNVSFL

SEQ ID NO: 1589451 - protein, 33 aa, Staphylococcus aureus
VRIQNRWVVFILFLICSFGVLIGLYQYRHTKTV

SEQ ID NO: 1589452 - protein, 20 aa, Staphylococcus aureus
WLMVLTIFIINVCYVTFLTM

SEQ ID NO: 1589453 - protein, 19 aa, Staphylococcus aureus
YQDKLKIEKMNLPGISLLP

SEQ ID NO: 1589454 - protein, 20 aa, Staphylococcus aureus
AFLLLVVLLFAGMAATYKSV

SEQ ID NO: 1589455 - protein, 27 aa, Staphylococcus aureus
ASYAALITMYIIHLIILSLLGISPIRY

SEQ ID NO: 1589456 - protein, 25 aa, Staphylococcus aureus
AVIIFFMVMVFGFSLFLAGHYTPGG

SEQ ID NO: 1589457 - protein, 30 aa, Staphylococcus aureus
AWLSVLLIVVAFFVVPFVTAWLADIIYRKV

SEQ ID NO: 1589458 - protein, 22 aa, Staphylococcus aureus
DDQIWSNSKFKLALKVQDRQDS

SEQ ID NO: 1589459 - protein, 17 aa, Staphylococcus aureus
EAWLWVLVLVAFSIVVI

SEQ ID NO: 1589460 - protein, 26 aa, Staphylococcus aureus
EEQFYIFFPVILVTLLLTIKKRYKIG

SEQ ID NO: 1589461 - protein, 25 aa, Staphylococcus aureus
GIASVTLGTLLISGGVTPAANAAQH

SEQ ID NO: 1589462 - protein, 26 aa, Staphylococcus aureus
GINYLLLTMLLYIPALLVYSIVQKNN

SEQ ID NO: 1589463 - protein, 21 aa, Staphylococcus aureus
GRSLMLPVAILPAAAIIAGIG

SEQ ID NO: 1589464 - protein, 24 aa, Staphylococcus aureus
HSNIILMMLIFILAGAFSNTAEKM

SEQ ID NO: 1589465 - protein, 21 aa, Staphylococcus aureus
IALIMLFILIKLFMEVHEVFT

SEQ ID NO: 1589466 - protein, 21 aa, Staphylococcus aureus
IVVIFAVMYFLMIRPQQKRAK

SEQ ID NO: 1589467 - protein, 25 aa, Staphylococcus aureus
KVMMPLLFVFLIIIVIKSLTLDGAL

SEQ ID NO: 1589468 - protein, 30 aa, Staphylococcus aureus
LAIINFIIPFLLIFIIDGFRGVKETLPAIL

SEQ ID NO: 1589469 - protein, 23 aa, Staphylococcus aureus
LHAMRRFFINVVLGMVFMSIVVQ

SEQ ID NO: 1589470 - protein, 29 aa, Staphylococcus aureus
LIGVPVIFFVIYLMLMIPIANLGLSSVLT

SEQ ID NO: 1589471 - protein, 21 aa, Staphylococcus aureus
LLFLCLLVILIATAYISFVTG

SEQ ID NO: 1589472 - protein, 18 aa, Staphylococcus aureus
MIPPLAIATAMLIFRRKF

SEQ ID NO: 1589473 - protein, 28 aa, Staphylococcus aureus
NILLGLMTLIIILVLQRFTTGFIKSIAI

SEQ ID NO: 1589474 - protein, 21 aa, Staphylococcus aureus
NRIEWIFILIAIALVLTVEAL

SEQ ID NO: 1589475 - protein, 21 aa, Staphylococcus aureus
NSAFIVIWLIFFIAGRYYERF

SEQ ID NO: 1589476 - protein, 21 aa, Staphylococcus aureus
RYSLITILLIVSIFISLCVGS

SEQ ID NO: 1589477 - protein, 24 aa, Staphylococcus aureus
SFIVLILLFFIINDETNWIYDGGF

SEQ ID NO: 1589478 - protein, 20 aa, Staphylococcus aureus
SFLLFLGNWIGQIGLNWFVL

SEQ ID NO: 1589479 - protein, 35 aa, Staphylococcus aureus
SNLIFVPYYSIILFPLSILFFITSHFIVGLTPLNY

SEQ ID NO: 1589480 - protein, 39 aa, Staphylococcus aureus
TEKLALVYARPLFYFGNIMKPLIWLMNGSARVIIRMFGV

SEQ ID NO: 1589481 - protein, 17 aa, Staphylococcus aureus
TILTLKGYRYIAASVSF

SEQ ID NO: 1589482 - protein, 25 aa, Staphylococcus aureus
TWGEKGVFDYRRSLLRTDVVLNSED

SEQ ID NO: 1589483 - protein, 28 aa, Staphylococcus aureus
VFNIISIIMVSMLILSLGAFANNNKAKA

SEQ ID NO: 1589484 - protein, 22 aa, Staphylococcus aureus
VTMVAITWLLLGDPLATLIGLS

SEQ ID NO: 1589485 - protein, 17 aa, Staphylococcus aureus
WAVFKLLYQNKGRFSIN

SEQ ID NO: 1589486 - protein, 23 aa, Staphylococcus aureus
WIDFPHIYLPFKDYVPSFHLGLV

SEQ ID NO: 1589487 - protein, 18 aa, Staphylococcus aureus
YLIKYAMPVVIILVFIVQ

SEQ ID NO: 1589488 - protein, 25 aa, Staphylococcus aureus
APTIFNFTLALFIGLISGVFSSIFI

SEQ ID NO: 1589489 - protein, 26 aa, Staphylococcus aureus
APYTIVFYFSLFSVIVLIPFTAYTYE

SEQ ID NO: 1589490 - protein, 22 aa, Staphylococcus aureus
DGLTWLYEFGGAIGGLIFGLLY

SEQ ID NO: 1589491 - protein, 18 aa, Staphylococcus aureus
DKMKSWYERFGFGKSTKG

SEQ ID NO: 1589492 - protein, 25 aa, Staphylococcus aureus
ETYNLQKLLAPYHKAKTLERQVYEL

SEQ ID NO: 1589493 - protein, 26 aa, Staphylococcus aureus
EYSKDDIFQVYLNKIYYSDGVTGIKA

SEQ ID NO: 1589494 - protein, 19 aa, Staphylococcus aureus
FEALTTWLKSMQGANIIIL

SEQ ID NO: 1589495 - protein, 17 aa, Staphylococcus aureus
FHQLQWVGFLSNLIFVP

SEQ ID NO: 1589496 - protein, 18 aa, Staphylococcus aureus
IALATFLRPIGGILGDKF

SEQ ID NO: 1589497 - protein, 24 aa, Staphylococcus aureus
IAVLMGMLLIFNLFSINFQRPITY

SEQ ID NO: 1589498 - protein, 24 aa, Staphylococcus aureus
IFDKRFLIFFLSAVGLHGIWDTSL

SEQ ID NO: 1589499 - protein, 22 aa, Staphylococcus aureus
IVNFCRLVPILLLSVWAGAIAD

SEQ ID NO: 1589500 - protein, 21 aa, Staphylococcus aureus
KYMGLFGAILFIIIVGATAIL

SEQ ID NO: 1589501 - protein, 35 aa, Staphylococcus aureus
NRLNTLMFYILLIIHYFIICYFVFSVHPMLSLFFF

SEQ ID NO: 1589502 - protein, 19 aa, Staphylococcus aureus
NSHVDIKSELGYEGGQNSG

SEQ ID NO: 1589503 - protein, 27 aa, Staphylococcus aureus
QTLLLGVILAFLWPPFKLKNDPPKVVK

SEQ ID NO: 1589504 - protein, 26 aa, Staphylococcus aureus
SESVMDGFVEHPFYTATLNGQKYVVM

SEQ ID NO: 1589505 - protein, 24 aa, Staphylococcus aureus
SFIIFHLILFIMWGEHQEYWYLYT

SEQ ID NO: 1589506 - protein, 18 aa, Staphylococcus aureus
SPFYSHLITLTNHYPFTL

SEQ ID NO: 1589507 - protein, 25 aa, Staphylococcus aureus
VDEPLHFQGGLTKRSYFNKNGHVSI

SEQ ID NO: 1589508 - protein, 18 aa, Staphylococcus aureus
YGGKLVLILDDGLEIEVE

SEQ ID NO: 1589509 - protein, 33 aa, Staphylococcus aureus
AFVALMKLSKIKIISWIASIYIEILRGTPMLVQ

SEQ ID NO: 1589510 - protein, 36 aa, Staphylococcus aureus
DELQYRRAMLFLRAMILHKLLLIANNTTIYYAINDF

SEQ ID NO: 1589511 - protein, 25 aa, Staphylococcus aureus
ETDDKYVYLLKESIAKYKMVVASSN

SEQ ID NO: 1589512 - protein, 27 aa, Staphylococcus aureus
FNITNTLIQLPFVAGLAWIVTKLVPGK

SEQ ID NO: 1589513 - protein, 17 aa, Staphylococcus aureus
FWDIFVSKLFLALTVFA

SEQ ID NO: 1589514 - protein, 26 aa, Staphylococcus aureus
GTLIAMIFYVIQLSMPLINLSTLVTD

SEQ ID NO: 1589515 - protein, 18 aa, Staphylococcus aureus
HFLIFLLLVFMTYPLHKS

SEQ ID NO: 1589516 - protein, 22 aa, Staphylococcus aureus
HITWMNWFLAALVPGLVSLIVV

SEQ ID NO: 1589517 - protein, 17 aa, Staphylococcus aureus
IIANFWFIQAAGAVYLI

SEQ ID NO: 1589518 - protein, 19 aa, Staphylococcus aureus
IVMLLTIAIILGFGALEIA

SEQ ID NO: 1589519 - protein, 26 aa, Staphylococcus aureus
IYASIGIIIYVSLRFEWRMGLSSVLA

SEQ ID NO: 1589520 - protein, 26 aa, Staphylococcus aureus
KNNETQYYHFFSIKDPADVYYTKKKA

SEQ ID NO: 1589521 - protein, 19 aa, Staphylococcus aureus
KTIYYWIRYLNFDIVSREK

SEQ ID NO: 1589522 - protein, 19 aa, Staphylococcus aureus
KTYRMVFNTISVEKMNAIL

SEQ ID NO: 1589523 - protein, 26 aa, Staphylococcus aureus
LFGKGSWYLPAWLNRIIPRVDIEGHA

SEQ ID NO: 1589524 - protein, 17 aa, Staphylococcus aureus
LGWLGEPTFEKLLHPIF

SEQ ID NO: 1589525 - protein, 54 aa, Staphylococcus aureus
LPQALEGLKPTLIYPLLTVTATGLLMIYVFNPPASWLNHLLLDGLNNLSGSNIV

SEQ ID NO: 1589526 - protein, 19 aa, Staphylococcus aureus
PALTKLFGKGSWYLPAWLN

SEQ ID NO: 1589527 - protein, 17 aa, Staphylococcus aureus
PVAILPAAAIIAGIGNT

SEQ ID NO: 1589528 - protein, 17 aa, Staphylococcus aureus
RMNSIMQVLTLVSVIFS

SEQ ID NO: 1589529 - protein, 20 aa, Staphylococcus aureus
RQFYHYASTVEPATVIFTKT

SEQ ID NO: 1589530 - protein, 26 aa, Staphylococcus aureus
SAVFDYWWMFAISFLFFALASLLTFF

SEQ ID NO: 1589531 - protein, 28 aa, Staphylococcus aureus
SVILALLVLMSVVLTYMVWNFSPDIANV

SEQ ID NO: 1589532 - protein, 30 aa, Staphylococcus aureus
TEDNRFYEHGALDYKRLFGAIGKNLTGGFG

SEQ ID NO: 1589533 - protein, 21 aa, Staphylococcus aureus
VIGIFLYVMTLQKTSLFGILK

SEQ ID NO: 1589534 - protein, 24 aa, Staphylococcus aureus
VLTLLVFAIVLMIVSVLGSLFSIL

SEQ ID NO: 1589535 - protein, 46 aa, Staphylococcus aureus
VTLVGSLIMLFILDWKMTLLTFITIPIFVLIMIPLGRIMQKISTST

SEQ ID NO: 1589536 - protein, 24 aa, Staphylococcus aureus
WVHRRCLKPMFTIANQIAYNNKMV

SEQ ID NO: 1589537 - protein, 18 aa, Staphylococcus aureus
YMKDILNVVIIMVLLVIG

SEQ ID NO: 1589538 - protein, 22 aa, Staphylococcus aureus
AAIVFLIYQPLKRLNLPLFVIK

SEQ ID NO: 1589539 - protein, 19 aa, Staphylococcus aureus
AFFASKLPLLNFRMNNRNH

SEQ ID NO: 1589540 - protein, 23 aa, Staphylococcus aureus
AISIYLALIFITFTSYLVIILYT

SEQ ID NO: 1589541 - protein, 18 aa, Staphylococcus aureus
DALQLRFILDWNSQAHRP

SEQ ID NO: 1589542 - protein, 26 aa, Staphylococcus aureus
EMRRYLMRFVHHIGGLADFSALKFTK

SEQ ID NO: 1589543 - protein, 32 aa, Staphylococcus aureus
EYQDYFLQFEWFQPLLISLAALLILIGLILVF

SEQ ID NO: 1589544 - protein, 24 aa, Staphylococcus aureus
GATVILPVVIFLLGLFFRQKIGAA

SEQ ID NO: 1589545 - protein, 32 aa, Staphylococcus aureus
GFQFSFIISFFIMLLFPFLQQLSKLQSLFIIT

SEQ ID NO: 1589546 - protein, 31 aa, Staphylococcus aureus
GFSIYFFVDTIWLFILLYAIFQGLFAPAMPQ

SEQ ID NO: 1589547 - protein, 19 aa, Staphylococcus aureus
IFAVFSALTLLPALISIFH

SEQ ID NO: 1589548 - protein, 27 aa, Staphylococcus aureus
KEQQNAFYEILHLPNLTEEQRNGFIQS

SEQ ID NO: 1589549 - protein, 30 aa, Staphylococcus aureus
KMTNAGQSVTYYFTDVKAPTVTVGNQTIEV

SEQ ID NO: 1589550 - protein, 20 aa, Staphylococcus aureus
KVRRDYEFNVNSPEFQDLEL

SEQ ID NO: 1589551 - protein, 23 aa, Staphylococcus aureus
LFDAFVVRMMLIPALTKLFGKGS

SEQ ID NO: 1589552 - protein, 17 aa, Staphylococcus aureus
LHPIFEAINLPTALTTT

SEQ ID NO: 1589553 - protein, 20 aa, Staphylococcus aureus
LLIVVIVGFLLFMYIQDGRI

SEQ ID NO: 1589554 - protein, 17 aa, Staphylococcus aureus
LRIILIINAIALIIYGF

SEQ ID NO: 1589555 - protein, 19 aa, Staphylococcus aureus
LSAWLLIESLSPGEVNFTA

SEQ ID NO: 1589556 - protein, 26 aa, Staphylococcus aureus
LSRSLPLFLLAIFSLVIHSAIFLITI

SEQ ID NO: 1589557 - protein, 28 aa, Staphylococcus aureus
LYPIASYLHLILPIAMLIALTVCLIPTT

SEQ ID NO: 1589558 - protein, 25 aa, Staphylococcus aureus
MVKAGIFLLLRFTPLLGLSNMYIYI

SEQ ID NO: 1589559 - protein, 26 aa, Staphylococcus aureus
NFSILEIILLCLVIYAGAAQFIMCAL

SEQ ID NO: 1589560 - protein, 32 aa, Staphylococcus aureus
NKEMFDKFLHPSRLPDGRWPSQTEFRLSLMQQ

SEQ ID NO: 1589561 - protein, 53 aa, Staphylococcus aureus
QKNNTVIWRSIIPPLVMIALTVVIFLVRPIGIYILMMIGMSTVTIVFGITTYF

SEQ ID NO: 1589562 - protein, 27 aa, Staphylococcus aureus
RKYILVTFWTIIILTLLITFPTNSHHK

SEQ ID NO: 1589563 - protein, 39 aa, Staphylococcus aureus
RTASSTWAWLFVLFVLPLIGFILYLFFGRTVSARKLNKN

SEQ ID NO: 1589564 - protein, 18 aa, Staphylococcus aureus
RYEILYLSIPLLALTYLF

SEQ ID NO: 1589565 - protein, 40 aa, Staphylococcus aureus
SISLIICLIVLGLLMPLFGLSLILVFIIELILYIKDRRAK

SEQ ID NO: 1589566 - protein, 19 aa, Staphylococcus aureus
YAEEPINFILKSSTKLKAD

SEQ ID NO: 1589567 - protein, 18 aa, Staphylococcus aureus
YVISDAVHIGWKGWVYMD

SEQ ID NO: 1589568 - protein, 21 aa, Staphylococcus aureus
AISAIILNFFFNGIKYKQTEE

SEQ ID NO: 1589569 - protein, 20 aa, Staphylococcus aureus
EEHPLFTIIGGACLVAGLAL

SEQ ID NO: 1589570 - protein, 19 aa, Staphylococcus aureus
FSLIIWILLVVLVIYFTIR

SEQ ID NO: 1589571 - protein, 20 aa, Staphylococcus aureus
GIGGAVAAVLVTRKDSRDKL

SEQ ID NO: 1589572 - protein, 21 aa, Staphylococcus aureus
LSYIDNMFFNYLNAEHPIGLA

SEQ ID NO: 1589573 - protein, 18 aa, Staphylococcus aureus
LYGSLFLSGILVIIIAPF

SEQ ID NO: 1589574 - protein, 24 aa, Staphylococcus aureus
MILREFYIFRFIIGKQPYKLNINA

SEQ ID NO: 1589575 - protein, 28 aa, Staphylococcus aureus
MISAFSFFIYLLHPIILDSLFAYTNIFE

SEQ ID NO: 1589576 - protein, 24 aa, Staphylococcus aureus
MLKGLLLKITFNFGLPLLIAILHA

SEQ ID NO: 1589577 - protein, 37 aa, Staphylococcus aureus
NKTPNEIALFTLLTTLTIIFLVVIVTLYPIASYLHLI

SEQ ID NO: 1589578 - protein, 19 aa, Staphylococcus aureus
NVLSHKPIYMKDILNVVII

SEQ ID NO: 1589579 - protein, 24 aa, Staphylococcus aureus
SIDLPTLIMISIFSFVIFDSVENI

SEQ ID NO: 1589580 - protein, 23 aa, Staphylococcus aureus
TIIGALLLYLPFTGKKPISFLDA

SEQ ID NO: 1589581 - protein, 19 aa, Staphylococcus aureus
TTTISFAVSFIIVTYLHVV

SEQ ID NO: 1589582 - protein, 31 aa, Staphylococcus aureus
TVFAFIMIISILLAYVFKWLGLVDDVLLMVI

SEQ ID NO: 1589583 - protein, 19 aa, Staphylococcus aureus
VIVWIAWIKPLAHINEIFG

SEQ ID NO: 1589584 - protein, 20 aa, Staphylococcus aureus
YLDNWWIVTFIFVAQVILSL

SEQ ID NO: 1589585 - protein, 27 aa, Staphylococcus aureus
DYPLMMALTLFFSFLGLLGNLISDITY

SEQ ID NO: 1589586 - protein, 19 aa, Staphylococcus aureus
EVALLQLRIAIHKSPLDTA

SEQ ID NO: 1589587 - protein, 20 aa, Staphylococcus aureus
FLFKKLSWPVGLIVAAITIS

SEQ ID NO: 1589588 - protein, 32 aa, Staphylococcus aureus
FSNLLMVCHPLLFMFFTKIFIQSWKQTHRYGV

SEQ ID NO: 1589589 - protein, 17 aa, Staphylococcus aureus
GFLMTYLPIQKLTSRKY

SEQ ID NO: 1589590 - protein, 24 aa, Staphylococcus aureus
HEDYDYTLMVFAQPITNNPDDYVD

SEQ ID NO: 1589591 - protein, 21 aa, Staphylococcus aureus
HILRNSLIPIITFLGADIVSI

SEQ ID NO: 1589592 - protein, 24 aa, Staphylococcus aureus
IIGVILCICIVASVIYLKVKYDEK

SEQ ID NO: 1589593 - protein, 24 aa, Staphylococcus aureus
IKKRYKIGFIFWGVSIISLGLMMF

SEQ ID NO: 1589594 - protein, 17 aa, Staphylococcus aureus
ISDWNRVGWGEIPMSLG

SEQ ID NO: 1589595 - protein, 26 aa, Staphylococcus aureus
KFANFFKMLWLRLKAMKHYKALNKES

SEQ ID NO: 1589596 - protein, 25 aa, Staphylococcus aureus
LFAYPLIEVIWPKTGLIYFGMADIG

SEQ ID NO: 1589597 - protein, 22 aa, Staphylococcus aureus
LILIGLILVFSIFKPTHRKPGL

SEQ ID NO: 1589598 - protein, 28 aa, Staphylococcus aureus
LPEILYVICCIIGYLFFGLGLGIYATPS

SEQ ID NO: 1589599 - protein, 18 aa, Staphylococcus aureus
PIILFLLCLTVFKMKGIY

SEQ ID NO: 1589600 - protein, 17 aa, Staphylococcus aureus
RDVLANRHQFGEAASLL

SEQ ID NO: 1589601 - protein, 18 aa, Staphylococcus aureus
SAWGLFSGVFGKSTNINQ

SEQ ID NO: 1589602 - protein, 25 aa, Staphylococcus aureus
TDLNPLLMSILISVAFSLLMVTPIS

SEQ ID NO: 1589603 - protein, 20 aa, Staphylococcus aureus
TKLGYLIIIILGVTVGILIY

SEQ ID NO: 1589604 - protein, 20 aa, Staphylococcus aureus
TPIGNFIPGTYRIPAMKSTE

SEQ ID NO: 1589605 - protein, 19 aa, Staphylococcus aureus
VSMLVIMLILLCFTFYNIN

SEQ ID NO: 1589606 - protein, 19 aa, Staphylococcus aureus
YIGDHIYVEGIWLEVQADG

SEQ ID NO: 1589607 - protein, 18 aa, Staphylococcus aureus
AMCWMLVPETLGGLWKQR

SEQ ID NO: 1589608 - protein, 34 aa, Staphylococcus aureus
DADNMTLDSGFYKTPKYSLGDYVWYDSNKDGKQD

SEQ ID NO: 1589609 - protein, 32 aa, Staphylococcus aureus
DSIIKTALKRLPWLIILTFLGMITATILGRFE

SEQ ID NO: 1589610 - protein, 32 aa, Staphylococcus aureus
EHPIGLALVILTVLVIIGFVLNMFIKHFKKER

SEQ ID NO: 1589611 - protein, 33 aa, Staphylococcus aureus
FGTSYLSRGYLITIFIILLITILFANFSEAFAE

SEQ ID NO: 1589612 - protein, 24 aa, Staphylococcus aureus
FHKIRGLLAFWIGALLIAFTLLSN

SEQ ID NO: 1589613 - protein, 19 aa, Staphylococcus aureus
FVALALYLVPGLGLIFALF

SEQ ID NO: 1589614 - protein, 17 aa, Staphylococcus aureus
GMIIAIPVTLIAGPIFN

SEQ ID NO: 1589615 - protein, 22 aa, Staphylococcus aureus
GVSFMVPFIVVGGLLIAIALTL

SEQ ID NO: 1589616 - protein, 19 aa, Staphylococcus aureus
GVVAAKISMPNVENMSFAI

SEQ ID NO: 1589617 - protein, 21 aa, Staphylococcus aureus
GWKTILYFEIITTIAIGLGII

SEQ ID NO: 1589618 - protein, 18 aa, Staphylococcus aureus
IIIWFVIRGVAKLTLFDV

SEQ ID NO: 1589619 - protein, 30 aa, Staphylococcus aureus
IKVILALPMFILLTIYLQPLVRYIFERIVM

SEQ ID NO: 1589620 - protein, 36 aa, Staphylococcus aureus
KNDNPIRYVIAILVVVLMVLGVFQLGIIGRLIDSFF

SEQ ID NO: 1589621 - protein, 17 aa, Staphylococcus aureus
MGTFIVIVFFAAQLLAY

SEQ ID NO: 1589622 - protein, 23 aa, Staphylococcus aureus
STNQFNIPSGKELDWAKASHEKY

SEQ ID NO: 1589623 - protein, 19 aa, Staphylococcus aureus
VLCNFVSAILWFVSAISIL

SEQ ID NO: 1589624 - protein, 20 aa, Staphylococcus aureus
VTLLILLFIIIAYIATTLTF

SEQ ID NO: 1589625 - protein, 24 aa, Staphylococcus aureus
VVFTLPFLFKLLPKENNTNKAHLD

SEQ ID NO: 1589626 - protein, 18 aa, Staphylococcus aureus
WLFSRVFIAFTVTFIGLW

SEQ ID NO: 1589627 - protein, 17 aa, Staphylococcus aureus
ALLILIGLILVFSIFKP

SEQ ID NO: 1589628 - protein, 23 aa, Staphylococcus aureus
DMHIMANIFLPKDGFNNIERISH

SEQ ID NO: 1589629 - protein, 28 aa, Staphylococcus aureus
FIINLVLAFIIIFLERNRRTASSTWAWL

SEQ ID NO: 1589630 - protein, 18 aa, Staphylococcus aureus
FLTMRTILTLKGYRYIAA

SEQ ID NO: 1589631 - protein, 17 aa, Staphylococcus aureus
FTIALYLVIGPFFALPR

SEQ ID NO: 1589632 - protein, 17 aa, Staphylococcus aureus
FYIMLDSTKFFYLLQSF

SEQ ID NO: 1589633 - protein, 28 aa, Staphylococcus aureus
GFVAVILTVCLIGLLILATNEDALAKVH

SEQ ID NO: 1589634 - protein, 23 aa, Staphylococcus aureus
GNDFVSQRFLALANGAYKYNPYI

SEQ ID NO: 1589635 - protein, 33 aa, Staphylococcus aureus
IFNHFIPVIITILLCYFGFQFGLKKRDEMLMFL

SEQ ID NO: 1589636 - protein, 20 aa, Staphylococcus aureus
ILGVLVLSVILLFSIPTPVA

SEQ ID NO: 1589637 - protein, 23 aa, Staphylococcus aureus
ISIFEVIIMFFIGGVFSLLSTMV

SEQ ID NO: 1589638 - protein, 18 aa, Staphylococcus aureus
IVIFGGIAAAIGPVVFGL

SEQ ID NO: 1589639 - protein, 18 aa, Staphylococcus aureus
IVILAFPPLTVALALMTT

SEQ ID NO: 1589640 - protein, 28 aa, Staphylococcus aureus
LGISLIAIMLIVCIVLVIMMMTGGKKDT

SEQ ID NO: 1589641 - protein, 20 aa, Staphylococcus aureus
LQFGLFLIALIGLVIKLIEL

SEQ ID NO: 1589642 - protein, 22 aa, Staphylococcus aureus
LSIALPFCLIPLQLATSNKDLM

SEQ ID NO: 1589643 - protein, 17 aa, Staphylococcus aureus
MLISIILWLLIGVVFFL

SEQ ID NO: 1589644 - protein, 18 aa, Staphylococcus aureus
NLFVFFEVFLMSSYFLLV

SEQ ID NO: 1589645 - protein, 18 aa, Staphylococcus aureus
RVGWGEIPMSLGFTYSSN

SEQ ID NO: 1589646 - protein, 26 aa, Staphylococcus aureus
SHPASVILLIIFILSVAFLIYVEFSL

SEQ ID NO: 1589647 - protein, 18 aa, Staphylococcus aureus
SVPIRILIFYVGALAVIM

SEQ ID NO: 1589648 - protein, 38 aa, Staphylococcus aureus
TYKQTVFVNPKQRVLGNTWVYIKGYQDKIEESSGKVSA

SEQ ID NO: 1589649 - protein, 17 aa, Staphylococcus aureus
VKHDIIAAIFYVSNWWY

SEQ ID NO: 1589650 - protein, 29 aa, Staphylococcus aureus
YGTFMIAVFILNFKLIFTLPLTILNRQSL

SEQ ID NO: 1589651 - protein, 17 aa, Staphylococcus aureus
YLKRYLLRAMMAGFIIG

SEQ ID NO: 1589652 - protein, 19 aa, Staphylococcus aureus
AIAFLLRPIGGVVFGIIGD

SEQ ID NO: 1589653 - protein, 25 aa, Staphylococcus aureus
ASPLQIIRYFLIPEALGSLVLAITT

SEQ ID NO: 1589654 - protein, 26 aa, Staphylococcus aureus
DFIALSFLFLTIALLLIALFYVCFYK

SEQ ID NO: 1589655 - protein, 30 aa, Staphylococcus aureus
DNLLTPLLSIFITAFLTFSFVGPITRQLGY

SEQ ID NO: 1589656 - protein, 19 aa, Staphylococcus aureus
EKGSSQTYILLGYPTKAQK

SEQ ID NO: 1589657 - protein, 45 aa, Staphylococcus aureus
FGGGVLGFYLLELSVPLISLFGVCIITILLLCSSVILLTNHQHRD

SEQ ID NO: 1589658 - protein, 23 aa, Staphylococcus aureus
FQWAMTIFVFFVITMALSIMLRD

SEQ ID NO: 1589659 - protein, 19 aa, Staphylococcus aureus
GFLLLYPVVAFMIGAIRDR

SEQ ID NO: 1589660 - protein, 25 aa, Staphylococcus aureus
GLGGLILLNLLEKVELPIEGMMLIS

SEQ ID NO: 1589661 - protein, 22 aa, Staphylococcus aureus
GQDNFLLNLTFKENIKLGNPEA

SEQ ID NO: 1589662 - protein, 24 aa, Staphylococcus aureus
IAGVFAIFIFSFELQWFPFQGSVD

SEQ ID NO: 1589663 - protein, 20 aa, Staphylococcus aureus
IGIFTLWYYWRKRKHNIDRM

SEQ ID NO: 1589664 - protein, 19 aa, Staphylococcus aureus
IISFVTLGIIIHASITYVL

SEQ ID NO: 1589665 - protein, 19 aa, Staphylococcus aureus
KGAPWNIVLFSIGMYIVVF

SEQ ID NO: 1589666 - protein, 20 aa, Staphylococcus aureus
KISMPNVENMSFAIPVNEVQ

SEQ ID NO: 1589667 - protein, 21 aa, Staphylococcus aureus
KTTLLVTWMFPVGVAIISYGI

SEQ ID NO: 1589668 - protein, 24 aa, Staphylococcus aureus
LGVASVIVSTLFLITSQHQAQAAE

SEQ ID NO: 1589669 - protein, 25 aa, Staphylococcus aureus
LGYTSLWFFGLIAIVIVAFFIFLNV

SEQ ID NO: 1589670 - protein, 20 aa, Staphylococcus aureus
LIPLFILLCFPFTPNTLINF

SEQ ID NO: 1589671 - protein, 28 aa, Staphylococcus aureus
MVILAVVPLLFLVIPKMKISILDDPVAI

SEQ ID NO: 1589672 - protein, 17 aa, Staphylococcus aureus
NAVFWLKTYPERLKQAR

SEQ ID NO: 1589673 - protein, 21 aa, Staphylococcus aureus
NYLTILFLILVLVGMVFNVET

SEQ ID NO: 1589674 - protein, 28 aa, Staphylococcus aureus
QNVVKYIVWFIVITTILSKFGISVEGVI

SEQ ID NO: 1589675 - protein, 18 aa, Staphylococcus aureus
RFYYKDIFVCFVAVVFFN

SEQ ID NO: 1589676 - protein, 18 aa, Staphylococcus aureus
RWMFALAFFFIGVIAYMD

SEQ ID NO: 1589677 - protein, 27 aa, Staphylococcus aureus
SALVMGILWLSILFCRLYFHAHYFSDV

SEQ ID NO: 1589678 - protein, 21 aa, Staphylococcus aureus
SIALITFMQYYFTQETENAIR

SEQ ID NO: 1589679 - protein, 25 aa, Staphylococcus aureus
SISKVWLYFMYYWIIFGIGCYLGQF

SEQ ID NO: 1589680 - protein, 19 aa, Staphylococcus aureus
TFMTYSFSIFLLSSFTMTF

SEQ ID NO: 1589681 - protein, 44 aa, Staphylococcus aureus
TKRFPLYILMFEQIISILWVYIVLLYLGYLFITANFLDYTFMTY

SEQ ID NO: 1589682 - protein, 28 aa, Staphylococcus aureus
VEALQNIYLRVYYPPVVIGLTALVTVIV

SEQ ID NO: 1589683 - protein, 17 aa, Staphylococcus aureus
VIFSIVMMLFVNKLLHG

SEQ ID NO: 1589684 - protein, 27 aa, Staphylococcus aureus
WKRRLKRLIPAVLFLICVVLTFTLIFK

SEQ ID NO: 1589685 - protein, 29 aa, Staphylococcus aureus
AIISALIFNALIIVALIPIAMKGVKVKGY

SEQ ID NO: 1589686 - protein, 25 aa, Staphylococcus aureus
AKYFDISCVPILTRSQKSLQGILVV

SEQ ID NO: 1589687 - protein, 47 aa, Staphylococcus aureus
ATNNNYSDILKKFWMMYWPKLVILMGIIILIVILNAIFNNVNKNDRM

SEQ ID NO: 1589688 - protein, 23 aa, Staphylococcus aureus
DLYLLNNNFLLQIKLDLDSLTAF

SEQ ID NO: 1589689 - protein, 31 aa, Staphylococcus aureus
EKKNMAGLIFVSWYPTVYWIINAAVVLVAFP

SEQ ID NO: 1589690 - protein, 26 aa, Staphylococcus aureus
ESYLWIGIVFVFFLISYISQIVGIMN

SEQ ID NO: 1589691 - protein, 19 aa, Staphylococcus aureus
FSGWYYLIKYAMPVVIILV

SEQ ID NO: 1589692 - protein, 24 aa, Staphylococcus aureus
GALFIIFMLYLLFELFRFNISGKN

SEQ ID NO: 1589693 - protein, 18 aa, Staphylococcus aureus
GGRLTRMPFMSGGYGNYV

SEQ ID NO: 1589694 - protein, 18 aa, Staphylococcus aureus
GIDFLAVMGFASAISVIF

SEQ ID NO: 1589695 - protein, 31 aa, Staphylococcus aureus
HLSYYVTFLILWLLLIELLTTGLLNSISKVI

SEQ ID NO: 1589696 - protein, 25 aa, Staphylococcus aureus
IGKALMLPVAILPAAGLLLAIGTAM

SEQ ID NO: 1589697 - protein, 28 aa, Staphylococcus aureus
IIMGVTVIVLIAILFKFNLAHVATLASV

SEQ ID NO: 1589698 - protein, 17 aa, Staphylococcus aureus
ILSLLGISPIRYVKKTL

SEQ ID NO: 1589699 - protein, 31 aa, Staphylococcus aureus
KATIRNIRQNLFWAFGYNIAGIPIAALGLLA

SEQ ID NO: 1589700 - protein, 26 aa, Staphylococcus aureus
KITSGVIDMLFAHLKNFSKSPPSGTM

SEQ ID NO: 1589701 - protein, 18 aa, Staphylococcus aureus
LIGFIIGFIIYKIKHRKI

SEQ ID NO: 1589702 - protein, 17 aa, Staphylococcus aureus
LISIIVTIILFIKQRHL

SEQ ID NO: 1589703 - protein, 24 aa, Staphylococcus aureus
LMGINNLLTMKGLFGPKALIEMYP

SEQ ID NO: 1589704 - protein, 19 aa, Staphylococcus aureus
LQQYFGKDRFRLFSGWYYL

SEQ ID NO: 1589705 - protein, 19 aa, Staphylococcus aureus
LTLFLNFAILIISIVLIIF

SEQ ID NO: 1589706 - protein, 17 aa, Staphylococcus aureus
MIFAIGGVPPFSGFPGK

SEQ ID NO: 1589707 - protein, 19 aa, Staphylococcus aureus
NKFEWLAILFAFIGVLYMT

SEQ ID NO: 1589708 - protein, 26 aa, Staphylococcus aureus
NQILGVFMYPFALLLGLPYDEAWLVA

SEQ ID NO: 1589709 - protein, 44 aa, Staphylococcus aureus
PLFATVIVVLAFFLLMIVFRSILIPLKAVLGFVLSLMATLGFTT

SEQ ID NO: 1589710 - protein, 24 aa, Staphylococcus aureus
QKEFWPVYLIVTAIAIVVPCILTI

SEQ ID NO: 1589711 - protein, 38 aa, Staphylococcus aureus
SASFKWYDFVYFIDTLVYLFILIFKTKWLDTKAFSKKF

SEQ ID NO: 1589712 - protein, 17 aa, Staphylococcus aureus
SDIFMWFKLVLNDTTEF

SEQ ID NO: 1589713 - protein, 21 aa, Staphylococcus aureus
STYMLKIYMANTPRLSEIKKD

SEQ ID NO: 1589714 - protein, 18 aa, Staphylococcus aureus
TFLPQAFLSYAIGGVFDI

SEQ ID NO: 1589715 - protein, 17 aa, Staphylococcus aureus
TGLGLFICKMIIEEHGG

SEQ ID NO: 1589716 - protein, 23 aa, Staphylococcus aureus
TRTLLIYGAIFGGLFYFSIGVFK

SEQ ID NO: 1589717 - protein, 26 aa, Staphylococcus aureus
VAGISPLMLFPYSIYPILLGVCGLIA

SEQ ID NO: 1589718 - protein, 26 aa, Staphylococcus aureus
VFSGLVPYWAVFKIILMMINNAYTIN

SEQ ID NO: 1589719 - protein, 22 aa, Staphylococcus aureus
VHQHLMLAKSLGAKVKVVYSQT

SEQ ID NO: 1589720 - protein, 18 aa, Staphylococcus aureus
VPIAFKMHILLGFTIMAC

SEQ ID NO: 1589721 - protein, 22 aa, Staphylococcus aureus
VTPFLIVLVVLIAGVYLFKGHV

SEQ ID NO: 1589722 - protein, 17 aa, Staphylococcus aureus
YEPFLQPFRKVIPPIGI

SEQ ID NO: 1589723 - protein, 36 aa, Staphylococcus aureus
AFLTSIFGMIALDVSFLIDMSIGIVGFLMTYLPIQK

SEQ ID NO: 1589724 - protein, 21 aa, Staphylococcus aureus
ASTAFIFLPALIGWSSMRVFG

SEQ ID NO: 1589725 - protein, 17 aa, Staphylococcus aureus
DIIFQIGPGLFGVRDKE

SEQ ID NO: 1589726 - protein, 23 aa, Staphylococcus aureus
DIISGYFVPIVVGIALLTFIVWI

SEQ ID NO: 1589727 - protein, 24 aa, Staphylococcus aureus
EFVKPAGLKRVGIIAALGATVMLG

SEQ ID NO: 1589728 - protein, 18 aa, Staphylococcus aureus
FGVLVGIPVAFLTSIFGM

SEQ ID NO: 1589729 - protein, 19 aa, Staphylococcus aureus
FIGLLILYYICRLISEERL

SEQ ID NO: 1589730 - protein, 18 aa, Staphylococcus aureus
FVILFISIFLKFSFNIEF

SEQ ID NO: 1589731 - protein, 17 aa, Staphylococcus aureus
FYIYRKHIFMAAVGEVL

SEQ ID NO: 1589732 - protein, 37 aa, Staphylococcus aureus
GFIDYFLLGILPNKTQWWLVIPVGLVYAVIYYFVFRF

SEQ ID NO: 1589733 - protein, 21 aa, Staphylococcus aureus
GVTLFLLLKAFSSGASSLTGV

SEQ ID NO: 1589734 - protein, 20 aa, Staphylococcus aureus
IAAYGVAFLIKWIEKKVPEG

SEQ ID NO: 1589735 - protein, 25 aa, Staphylococcus aureus
IANYTPFFVILGKPFVPFLELMQIP

SEQ ID NO: 1589736 - protein, 18 aa, Staphylococcus aureus
ICFPDIFGTSYLSRGYLI

SEQ ID NO: 1589737 - protein, 22 aa, Staphylococcus aureus
IDRPSIGIGLINLKDIPEEERE

SEQ ID NO: 1589738 - protein, 18 aa, Staphylococcus aureus
IGIVLWVIGLHPFAVFFP

SEQ ID NO: 1589739 - protein, 24 aa, Staphylococcus aureus
ISGYLIEIFPKKLLVLIYQATMVI

SEQ ID NO: 1589740 - protein, 33 aa, Staphylococcus aureus
IVVGIALLTFIVWITLVTPGTFEPALVASISVL

SEQ ID NO: 1589741 - protein, 36 aa, Staphylococcus aureus
KLLNILKKNIKLLLILPAICLVVSAALTFFVMPDKY

SEQ ID NO: 1589742 - protein, 17 aa, Staphylococcus aureus
KLVLILDDGLEIEVERI

SEQ ID NO: 1589743 - protein, 19 aa, Staphylococcus aureus
KVFALYFVSIVTANIIVKN

SEQ ID NO: 1589744 - protein, 27 aa, Staphylococcus aureus
LDGLSFLTLYLLDLHLGYTFSGGFIDY

SEQ ID NO: 1589745 - protein, 17 aa, Staphylococcus aureus
LGMIYFALAYVGASTAP

SEQ ID NO: 1589746 - protein, 24 aa, Staphylococcus aureus
LILGMFMFLILLPLEKLFKLSSYY

SEQ ID NO: 1589747 - protein, 19 aa, Staphylococcus aureus
LLILAFFGIKKYFLGGLLS

SEQ ID NO: 1589748 - protein, 18 aa, Staphylococcus aureus
LLPLLTKPAPKTVIGNMS

SEQ ID NO: 1589749 - protein, 17 aa, Staphylococcus aureus
LNYPLIMLFHTPGAILS

SEQ ID NO: 1589750 - protein, 18 aa, Staphylococcus aureus
LTLMFKKLRKFSTHKWML

SEQ ID NO: 1589751 - protein, 22 aa, Staphylococcus aureus
LTVIVVVVAILFFGAPTIFNFT

SEQ ID NO: 1589752 - protein, 17 aa, Staphylococcus aureus
LVYLLFFANHLLKANHF

SEQ ID NO: 1589753 - protein, 20 aa, Staphylococcus aureus
LYVSIFWLSLGLGGIGISMG

SEQ ID NO: 1589754 - protein, 21 aa, Staphylococcus aureus
MIVVAIIIVGVLAFQFMNHTG

SEQ ID NO: 1589755 - protein, 21 aa, Staphylococcus aureus
MTVPLFLIALIVFIGMFYSVV

SEQ ID NO: 1589756 - protein, 18 aa, Staphylococcus aureus
MWMFIGFMIFGAVSSLVS

SEQ ID NO: 1589757 - protein, 27 aa, Staphylococcus aureus
NFHPHEVAFLLIDYKGGGMANLFKDLV

SEQ ID NO: 1589758 - protein, 39 aa, Staphylococcus aureus
PKFNDWIFIIFIISVYYIFWLLAKRKYILVTFWTIIILT

SEQ ID NO: 1589759 - protein, 22 aa, Staphylococcus aureus
QSQQPKPYFATGANQANTSKDK

SEQ ID NO: 1589760 - protein, 25 aa, Staphylococcus aureus
QSSSPAAMFVLVAGIGLIATVRRRK

SEQ ID NO: 1589761 - protein, 19 aa, Staphylococcus aureus
SFLLKLFNFGKLIVIILFL

SEQ ID NO: 1589762 - protein, 34 aa, Staphylococcus aureus
SNIYTILPWFLITIPIIILLSYQLDVLNLGDAVA

SEQ ID NO: 1589763 - protein, 25 aa, Staphylococcus aureus
SSNAKLPVIFWMHGGGYIAGDKQYK

SEQ ID NO: 1589764 - protein, 17 aa, Staphylococcus aureus
TFILFFIIYVIHPINAD

SEQ ID NO: 1589765 - protein, 21 aa, Staphylococcus aureus
TIVFGFFALTFVTPVLRSFIP

SEQ ID NO: 1589766 - protein, 17 aa, Staphylococcus aureus
VAFLIKWIEKKVPEGLD

SEQ ID NO: 1589767 - protein, 32 aa, Staphylococcus aureus
VGLVYAVIYYFVFRFLIVKLKYKTPGREDKQS

SEQ ID NO: 1589768 - protein, 19 aa, Staphylococcus aureus
WRRIVEVLLLLMTLTGNVF

SEQ ID NO: 1589769 - protein, 19 aa, Staphylococcus aureus
WWHWMNHLLHFNLGKSFES

SEQ ID NO: 1589770 - protein, 19 aa, Staphylococcus aureus
YRDVLVPPFLIQILVENAI

SEQ ID NO: 1589771 - protein, 26 aa, Staphylococcus aureus
ANAMKTPMYINMKTRIAMFLYDKSEV

SEQ ID NO: 1589772 - protein, 22 aa, Staphylococcus aureus
AVFLSRFLLSLLVSSNIFKNQF

SEQ ID NO: 1589773 - protein, 25 aa, Staphylococcus aureus
DFKKTLIMIFIQVLIVLFMMNTTIG

SEQ ID NO: 1589774 - protein, 24 aa, Staphylococcus aureus
ELVFFLANLFLEPTKLGYLIIIIL

SEQ ID NO: 1589775 - protein, 18 aa, Staphylococcus aureus
FILIVICPLIFNYTLTLN

SEQ ID NO: 1589776 - protein, 33 aa, Staphylococcus aureus
FISNNMLFGIIFAVLTLVFVIGIIMSKSKEVDY

SEQ ID NO: 1589777 - protein, 26 aa, Staphylococcus aureus
FNVRIGWLILRILAVVFAWMTFLRIG

SEQ ID NO: 1589778 - protein, 25 aa, Staphylococcus aureus
IGIPKWIQFLFIVIVAMVISASMRV

SEQ ID NO: 1589779 - protein, 20 aa, Staphylococcus aureus
IIFTVLCIGIVLWVIGLHPF

SEQ ID NO: 1589780 - protein, 19 aa, Staphylococcus aureus
IIGLFVIKGYLYVKHAGFK

SEQ ID NO: 1589781 - protein, 18 aa, Staphylococcus aureus
IKTRPLYLAAMGTFLLGS

SEQ ID NO: 1589782 - protein, 26 aa, Staphylococcus aureus
ILIFFTFILSIFFILIKSSRLNNILT

SEQ ID NO: 1589783 - protein, 30 aa, Staphylococcus aureus
INDLKLFKISWIVLVILLFGYLISEFTKIP

SEQ ID NO: 1589784 - protein, 25 aa, Staphylococcus aureus
ISTLLLIVILVVFAVLLIVNETKLF

SEQ ID NO: 1589785 - protein, 19 aa, Staphylococcus aureus
KIKKIIIAIPTIGQERLKE

SEQ ID NO: 1589786 - protein, 20 aa, Staphylococcus aureus
LGLVWYVLFNRKNLGSVGMK

SEQ ID NO: 1589787 - protein, 19 aa, Staphylococcus aureus
LITLLLETITFFTRIPITE

SEQ ID NO: 1589788 - protein, 17 aa, Staphylococcus aureus
LPVYLKDLGLTGSDLGL

SEQ ID NO: 1589789 - protein, 26 aa, Staphylococcus aureus
MMFAYVALLGLFLFGLITSLSGVQFF

SEQ ID NO: 1589790 - protein, 17 aa, Staphylococcus aureus
MTFLCGWLAFVGAIVTI

SEQ ID NO: 1589791 - protein, 20 aa, Staphylococcus aureus
MYLFSTHQLKFKNSTYMLKI

SEQ ID NO: 1589792 - protein, 30 aa, Staphylococcus aureus
PLINILRSLPFIILLIAIVPFTKLVVGTSI

SEQ ID NO: 1589793 - protein, 26 aa, Staphylococcus aureus
QGAIIIPVLFIMNALFGLTGVIWSLL

SEQ ID NO: 1589794 - protein, 31 aa, Staphylococcus aureus
QKRQKLLRTTFILLTLVGIGLTAFSFISNNM

SEQ ID NO: 1589795 - protein, 18 aa, Staphylococcus aureus
QNKKWYLPFGYDAEDIDL

SEQ ID NO: 1589796 - protein, 23 aa, Staphylococcus aureus
QRQTLELILLLKDLGCALSDIDM

SEQ ID NO: 1589797 - protein, 24 aa, Staphylococcus aureus
SDQQFFKFRFIQREPVIKENEAYM

SEQ ID NO: 1589798 - protein, 23 aa, Staphylococcus aureus
SFILAFPMALIWPTIQSGLNAFS

SEQ ID NO: 1589799 - protein, 24 aa, Staphylococcus aureus
SLILMVLVPVIFFVPNIFGKGIIV

SEQ ID NO: 1589800 - protein, 17 aa, Staphylococcus aureus
SMLFLFGRMLSRHGKRV

SEQ ID NO: 1589801 - protein, 17 aa, Staphylococcus aureus
TILILVTGTMLLVWLAD

SEQ ID NO: 1589802 - protein, 29 aa, Staphylococcus aureus
TTSSQSWWGLYALLGMLALFIPKFRKESK

SEQ ID NO: 1589803 - protein, 26 aa, Staphylococcus aureus
VAGKSWLFMPYLILVLLGGILHNRIW

SEQ ID NO: 1589804 - protein, 22 aa, Staphylococcus aureus
VGAMLLAFYFYRDNPDLKYAIM

SEQ ID NO: 1589805 - protein, 33 aa, Staphylococcus aureus
VNLIGAFFLGLVVALIYIFFKVIFDKRIKDEED

SEQ ID NO: 1589806 - protein, 27 aa, Staphylococcus aureus
VTILFGILYIILMYTCAYVLIRMFKNK

SEQ ID NO: 1589807 - protein, 19 aa, Staphylococcus aureus
WGIKYGLFIQSVIDFIIIA

SEQ ID NO: 1589808 - protein, 27 aa, Staphylococcus aureus
WSHLKWAIPLIGIALFIILTISKQLTI

SEQ ID NO: 1589809 - protein, 25 aa, Staphylococcus aureus
YFETSAVLITLILFGKYLEARAKSQ

SEQ ID NO: 1589810 - protein, 27 aa, Staphylococcus aureus
AFFFEAIFLSIYLYTWDRFKNKWTHFL

SEQ ID NO: 1589811 - protein, 19 aa, Staphylococcus aureus
AIGFLIYGPVMLIGLQALD

SEQ ID NO: 1589812 - protein, 21 aa, Staphylococcus aureus
AINGWILPITLGAILIASKKK

SEQ ID NO: 1589813 - protein, 19 aa, Staphylococcus aureus
AIYITLLLDFNKIVRALGI

SEQ ID NO: 1589814 - protein, 17 aa, Staphylococcus aureus
ALVVYALLPILRNTYTG

SEQ ID NO: 1589815 - protein, 28 aa, Staphylococcus aureus
AMVIKLVKLIFMLDYVLFHSIQKSYTTH

SEQ ID NO: 1589816 - protein, 24 aa, Staphylococcus aureus
ARLITEFFLLIWRFIDITKINVKL

SEQ ID NO: 1589817 - protein, 25 aa, Staphylococcus aureus
ASGNKTTTTFKYEVTRNSMSDSVST

SEQ ID NO: 1589818 - protein, 24 aa, Staphylococcus aureus
ATKIAMIVIYIIVALIVIKILNKM

SEQ ID NO: 1589819 - protein, 19 aa, Staphylococcus aureus
CMIVPWRAAMLYKYKKLKK

SEQ ID NO: 1589820 - protein, 23 aa, Staphylococcus aureus
DYKHPNWMFIFGIVAVLVTILTG

SEQ ID NO: 1589821 - protein, 23 aa, Staphylococcus aureus
EYYNKNAFAMDKSHPEPIEDNDK

SEQ ID NO: 1589822 - protein, 18 aa, Staphylococcus aureus
FFTRIPITEFLFSTTWNP

SEQ ID NO: 1589823 - protein, 23 aa, Staphylococcus aureus
FGAFFKIWIVIGLVIIGTYAFFV

SEQ ID NO: 1589824 - protein, 25 aa, Staphylococcus aureus
FQYKIFPVLMFLVSTGLGILVITQN

SEQ ID NO: 1589825 - protein, 26 aa, Staphylococcus aureus
GFLRLHIPNWLRRLITRSLAVIPVIV

SEQ ID NO: 1589826 - protein, 25 aa, Staphylococcus aureus
GIFGALFQIYFFDKFMKYFSELTFI

SEQ ID NO: 1589827 - protein, 21 aa, Staphylococcus aureus
GLFILIGLFVADWTIGLAAIV

SEQ ID NO: 1589828 - protein, 17 aa, Staphylococcus aureus
GLQSILSLILNSIAILI

SEQ ID NO: 1589829 - protein, 18 aa, Staphylococcus aureus
GVAFIIMIFAIGGVPPFS

SEQ ID NO: 1589830 - protein, 26 aa, Staphylococcus aureus
GVIIAIPVFVLVLTGLPWSGFMGSKI

SEQ ID NO: 1589831 - protein, 17 aa, Staphylococcus aureus
HFCVLLLLKYIGFKLFI

SEQ ID NO: 1589832 - protein, 35 aa, Staphylococcus aureus
IAVIIVVALLILFSFVPIGLWISALAAGVHVGIGT

SEQ ID NO: 1589833 - protein, 23 aa, Staphylococcus aureus
IFSFLGGLGIFLYGLKIMGDGLQ

SEQ ID NO: 1589834 - protein, 21 aa, Staphylococcus aureus
IIDTALFVAIAFIGSLPGTVV

SEQ ID NO: 1589835 - protein, 17 aa, Staphylococcus aureus
ILFFIIYVIHPINADWL

SEQ ID NO: 1589836 - protein, 23 aa, Staphylococcus aureus
IMNYLGVIPFLQDLITDGIIAGV

SEQ ID NO: 1589837 - protein, 28 aa, Staphylococcus aureus
IPSFWQGLLFILAFSLKLDILPPSYMPE

SEQ ID NO: 1589838 - protein, 21 aa, Staphylococcus aureus
KDLQVLAIFREMNAGTVLDPQ

SEQ ID NO: 1589839 - protein, 18 aa, Staphylococcus aureus
LALPLIIGGIRLSSVYVI

SEQ ID NO: 1589840 - protein, 17 aa, Staphylococcus aureus
LILSIILVFTYLKSGRN

SEQ ID NO: 1589841 - protein, 20 aa, Staphylococcus aureus
LKFSLWRYKKLTVAILVLIV

SEQ ID NO: 1589842 - protein, 30 aa, Staphylococcus aureus
LKVIERLLLALILPLIILIIGMYSFNTFAD

SEQ ID NO: 1589843 - protein, 31 aa, Staphylococcus aureus
LLTDQKYLLFWLLLGFIFGFFPPIQTTINSA

SEQ ID NO: 1589844 - protein, 17 aa, Staphylococcus aureus
MFGATVLVPFLTGLPIS

SEQ ID NO: 1589845 - protein, 25 aa, Staphylococcus aureus
MGTASIILGSLVYIGADSQQVNAAT

SEQ ID NO: 1589846 - protein, 23 aa, Staphylococcus aureus
MTLGIFMIIIGYGYIRIGLPKVH

SEQ ID NO: 1589847 - protein, 27 aa, Staphylococcus aureus
NFTWSFYGNLLYLLPLSILGLERYFQQ

SEQ ID NO: 1589848 - protein, 19 aa, Staphylococcus aureus
NQKLPVRLVSYSPVPEDHA

SEQ ID NO: 1589849 - protein, 19 aa, Staphylococcus aureus
NVLFGEFFGWVAGWALLAE

SEQ ID NO: 1589850 - protein, 25 aa, Staphylococcus aureus
NYDYTKLVFAKPIYNDPSLVKSDTN

SEQ ID NO: 1589851 - protein, 22 aa, Staphylococcus aureus
NYKIHTLNWFKNTWGYMNLGAS

SEQ ID NO: 1589852 - protein, 21 aa, Staphylococcus aureus
PNKVLPYKAPFYPLGPIIVIT

SEQ ID NO: 1589853 - protein, 29 aa, Staphylococcus aureus
RSNEQIIFTPQLVFVITDMSLIIDHVILE

SEQ ID NO: 1589854 - protein, 21 aa, Staphylococcus aureus
SIVIAFIAILLLKGTPEKVSQ

SEQ ID NO: 1589855 - protein, 23 aa, Staphylococcus aureus
SLLMVLWLVITAWKHIGYIKEIK

SEQ ID NO: 1589856 - protein, 24 aa, Staphylococcus aureus
SPHIPFALFMLFQMMFCTIAISIL

SEQ ID NO: 1589857 - protein, 35 aa, Staphylococcus aureus
SQVGSYFLFFIIIAFLLYANVLFIKRRSYELALYQ

SEQ ID NO: 1589858 - protein, 17 aa, Staphylococcus aureus
SVVLGIVILLVLIIGFK

SEQ ID NO: 1589859 - protein, 24 aa, Staphylococcus aureus
TGILLFVTSFLGITFLIAVCCIIY

SEQ ID NO: 1589860 - protein, 23 aa, Staphylococcus aureus
TIIFGWIFYFFLGAYMGYNYERV

SEQ ID NO: 1589861 - protein, 17 aa, Staphylococcus aureus
TLAIYITLLLDFNKIVR

SEQ ID NO: 1589862 - protein, 19 aa, Staphylococcus aureus
TLAVLAIMIPIFGVGKTPA

SEQ ID NO: 1589863 - protein, 20 aa, Staphylococcus aureus
VVIYFNFTWSFYGNLLYLLP

SEQ ID NO: 1589864 - protein, 25 aa, Staphylococcus aureus
VVTGFVFFDIPIQVLLIIASAYATW

SEQ ID NO: 1589865 - protein, 18 aa, Staphylococcus aureus
VWKQFALSVLIFAISQLI

SEQ ID NO: 1589866 - protein, 23 aa, Staphylococcus aureus
WLVLFIPLLNWLTPKRYIKISQE

SEQ ID NO: 1589867 - protein, 26 aa, Staphylococcus aureus
YFVVQFIITLFLIWLPTYLTEVFHVN

SEQ ID NO: 1589868 - protein, 24 aa, Staphylococcus aureus
AEDKDTIYVAKNKSPLLLGVGEGF

SEQ ID NO: 1589869 - protein, 21 aa, Staphylococcus aureus
AMYLFLFIRSFIRGRDAFNII

SEQ ID NO: 1589870 - protein, 21 aa, Staphylococcus aureus
AYTAQIAVLSILSQIVAKEHG

SEQ ID NO: 1589871 - protein, 28 aa, Staphylococcus aureus
DIDLAWLVPFMLFAIIGFIIDVFIRRPK

SEQ ID NO: 1589872 - protein, 18 aa, Staphylococcus aureus
DITSTLLEQGGINASKFG

SEQ ID NO: 1589873 - protein, 34 aa, Staphylococcus aureus
DKITWVRWVLYVVSFFLPLFIIYSMVRPPDKNNR

SEQ ID NO: 1589874 - protein, 23 aa, Staphylococcus aureus
DNAKELLLKGLEKLEYRGYDSAG

SEQ ID NO: 1589875 - protein, 17 aa, Staphylococcus aureus
ELEKMLIQLSTFHSYHD

SEQ ID NO: 1589876 - protein, 23 aa, Staphylococcus aureus
ELNKIQDKLPEKLKAEYKKKLED

SEQ ID NO: 1589877 - protein, 22 aa, Staphylococcus aureus
FSILPILMIIYGIVAKMIAVWF

SEQ ID NO: 1589878 - protein, 17 aa, Staphylococcus aureus
FVMALGFIIQKFSMRYL

SEQ ID NO: 1589879 - protein, 19 aa, Staphylococcus aureus
FVVLLITFGSVIAAGLPII

SEQ ID NO: 1589880 - protein, 25 aa, Staphylococcus aureus
GAIIIYPAILLLPPLFGAPAYSAYI

SEQ ID NO: 1589881 - protein, 26 aa, Staphylococcus aureus
GFDVSWGEWFLYAAPWSIVMSVALYF

SEQ ID NO: 1589882 - protein, 25 aa, Staphylococcus aureus
GGIPKDFIDYLFIDEAGQAIPQAAV

SEQ ID NO: 1589883 - protein, 17 aa, Staphylococcus aureus
GIKEKVPIIFSLRAVFE

SEQ ID NO: 1589884 - protein, 17 aa, Staphylococcus aureus
GIWAGIIIIVIAAIILG

SEQ ID NO: 1589885 - protein, 27 aa, Staphylococcus aureus
GMKSVPIFFILMFFSMQLVTLPKQMLP

SEQ ID NO: 1589886 - protein, 25 aa, Staphylococcus aureus
GNFETGLLFIAFQKATKQFIDIQNN

SEQ ID NO: 1589887 - protein, 19 aa, Staphylococcus aureus
GYVQPFWPLAIINVFEEFT

SEQ ID NO: 1589888 - protein, 20 aa, Staphylococcus aureus
HFFFIIFAYLYFGGFSFFTL

SEQ ID NO: 1589889 - protein, 39 aa, Staphylococcus aureus
HRIYHFEKIYKAIKHVIVFIFMIFIAIVAIAVIAMSLYF

SEQ ID NO: 1589890 - protein, 20 aa, Staphylococcus aureus
HVHELLTPLVSVVALQLISY

SEQ ID NO: 1589891 - protein, 30 aa, Staphylococcus aureus
IALHFSWYYLLLVLVILFVCVYILFSRYAN

SEQ ID NO: 1589892 - protein, 19 aa, Staphylococcus aureus
IAVPLLTLIYPVSIALVLI

SEQ ID NO: 1589893 - protein, 31 aa, Staphylococcus aureus
IEMHTSVLRYYFWLTILIIAIIIGMIAWLFD

SEQ ID NO: 1589894 - protein, 19 aa, Staphylococcus aureus
IIIALLALTLMFIKVKPSS

SEQ ID NO: 1589895 - protein, 19 aa, Staphylococcus aureus
IIIGCYYLYRLIFTYKYDI

SEQ ID NO: 1589896 - protein, 17 aa, Staphylococcus aureus
IVGLIFLMYMAWTIWHD

SEQ ID NO: 1589897 - protein, 22 aa, Staphylococcus aureus
IVRFIVRVLLPLSCLISILLMT

SEQ ID NO: 1589898 - protein, 27 aa, Staphylococcus aureus
KKNIHEPWLFSLPSLILMVLVPVIFFV

SEQ ID NO: 1589899 - protein, 21 aa, Staphylococcus aureus
KMLIQLSTFHSYHDLEFLFVT

SEQ ID NO: 1589900 - protein, 28 aa, Staphylococcus aureus
KRLLPPNYKYLIPFTALAGAILMIISDI

SEQ ID NO: 1589901 - protein, 20 aa, Staphylococcus aureus
KYAYNWAFFNPIRKIYYNIT

SEQ ID NO: 1589902 - protein, 19 aa, Staphylococcus aureus
LFGGLFAALGSLLLFGRRK

SEQ ID NO: 1589903 - protein, 18 aa, Staphylococcus aureus
LFIPMIFMFLLGAFTKSA

SEQ ID NO: 1589904 - protein, 19 aa, Staphylococcus aureus
LFIVSLYWHFLDVVWVFIF

SEQ ID NO: 1589905 - protein, 27 aa, Staphylococcus aureus
LFSLLASIIVLWLYFRKAIPKTFDDNN

SEQ ID NO: 1589906 - protein, 23 aa, Staphylococcus aureus
LGGFVLFFLMKFAHVMTPEMTQA

SEQ ID NO: 1589907 - protein, 20 aa, Staphylococcus aureus
LGMLLITKYAIDLLFIICVI

SEQ ID NO: 1589908 - protein, 26 aa, Staphylococcus aureus
LPGMIPWFMILFSHLRFRKLHPEELE

SEQ ID NO: 1589909 - protein, 21 aa, Staphylococcus aureus
LPRFYFYLTLFMFSMIGIVLS

SEQ ID NO: 1589910 - protein, 25 aa, Staphylococcus aureus
LVILLVITILLLPYLDVLLLGRAEA

SEQ ID NO: 1589911 - protein, 26 aa, Staphylococcus aureus
LVSVVALQLISYYAALHRDLDVDKPR

SEQ ID NO: 1589912 - protein, 35 aa, Staphylococcus aureus
NEGYNFTIYVPYGDDWFAYFMRRLAERPQNLSLAV

SEQ ID NO: 1589913 - protein, 20 aa, Staphylococcus aureus
NQLPLFIYLKRYISFVSVNW

SEQ ID NO: 1589914 - protein, 18 aa, Staphylococcus aureus
PAFLPVAFLLIVIVGPIV

SEQ ID NO: 1589915 - protein, 26 aa, Staphylococcus aureus
PTMNIILLALGYFVIPFVSAFIVHEL

SEQ ID NO: 1589916 - protein, 17 aa, Staphylococcus aureus
PVFIVMGLYICMYAVFA

SEQ ID NO: 1589917 - protein, 24 aa, Staphylococcus aureus
RAKLMFVFLFIILIFFCHSPLTYL

SEQ ID NO: 1589918 - protein, 23 aa, Staphylococcus aureus
RELLLELSYFFRANLQGSKQHTI

SEQ ID NO: 1589919 - protein, 23 aa, Staphylococcus aureus
RSNARIFLVLGLALTAIVNLLMG

SEQ ID NO: 1589920 - protein, 21 aa, Staphylococcus aureus
SKKVLSVRFLTKEMLADIEPY

SEQ ID NO: 1589921 - protein, 18 aa, Staphylococcus aureus
SPDKAIIGGAKFIRNEYF

SEQ ID NO: 1589922 - protein, 37 aa, Staphylococcus aureus
TDVISPTLFVLLMYLLSMITAYIFYSYERAKGQMNFI

SEQ ID NO: 1589923 - protein, 20 aa, Staphylococcus aureus
TILMYIFWELTSVSSFLLIS

SEQ ID NO: 1589924 - protein, 27 aa, Staphylococcus aureus
TTLILIAILLFYTFMGILLPLMHDDLQ

SEQ ID NO: 1589925 - protein, 23 aa, Staphylococcus aureus
TTRHRIAIIGLLILVYMLTLSIV

SEQ ID NO: 1589926 - protein, 17 aa, Staphylococcus aureus
VFVLFGALFHLMNHAIF

SEQ ID NO: 1589927 - protein, 25 aa, Staphylococcus aureus
WTSSSLIYMILLTSIILIVYIKTKD

SEQ ID NO: 1589928 - protein, 21 aa, Staphylococcus aureus
YFHMIWHIFIVIASLLHLIAI

SEQ ID NO: 1589929 - protein, 19 aa, Staphylococcus aureus
YTAKLFPFGPLFAGFLCIV

SEQ ID NO: 1589930 - protein, 17 aa, Staphylococcus aureus
AAQFIMCALFIAGTPIS

SEQ ID NO: 1589931 - protein, 17 aa, Staphylococcus aureus
AAQLLAYLKWSNLGIIA

SEQ ID NO: 1589932 - protein, 31 aa, Staphylococcus aureus
AGIGCYFWNQLLLLFTIITIVIIGLFVIKGY

SEQ ID NO: 1589933 - protein, 20 aa, Staphylococcus aureus
ALLFVSQLVFHFNSGIKAER

SEQ ID NO: 1589934 - protein, 19 aa, Staphylococcus aureus
ATVYAIRMVGIALGLIPVM

SEQ ID NO: 1589935 - protein, 27 aa, Staphylococcus aureus
DLASNWIVFFFPFINWLIPKTYVKITK

SEQ ID NO: 1589936 - protein, 45 aa, Staphylococcus aureus
DTNNAITIITIITAVIFLTITTVFAFFLSSRITKPLRRLRDQATR

SEQ ID NO: 1589937 - protein, 18 aa, Staphylococcus aureus
FIAFTLYTIMASSPFMLI

SEQ ID NO: 1589938 - protein, 22 aa, Staphylococcus aureus
FINSLITPIWILCLVGIMTHMI

SEQ ID NO: 1589939 - protein, 28 aa, Staphylococcus aureus
FKSMMVPLIIIIAMFFIHFNTALIMLIT

SEQ ID NO: 1589940 - protein, 24 aa, Staphylococcus aureus
FLSYLFTIILWGSAFPMIKIALND

SEQ ID NO: 1589941 - protein, 25 aa, Staphylococcus aureus
FTHSILFIAIIAFLLQIIQTPNYYM

SEQ ID NO: 1589942 - protein, 17 aa, Staphylococcus aureus
FVAIAFIGSLPGTVVFE

SEQ ID NO: 1589943 - protein, 23 aa, Staphylococcus aureus
GFTTLVMQDGFMKGLFGIETTGP

SEQ ID NO: 1589944 - protein, 22 aa, Staphylococcus aureus
GIFAFLIWIHLLCTMIKYFNNV

SEQ ID NO: 1589945 - protein, 30 aa, Staphylococcus aureus
GIHEIYFPYVLMRPLLFIAVILGGMTGVAT

SEQ ID NO: 1589946 - protein, 29 aa, Staphylococcus aureus
GILEFATWHWLFYINIPIAIIAIILVIWT

SEQ ID NO: 1589947 - protein, 18 aa, Staphylococcus aureus
GLIVVGFVMILFAFKTQF

SEQ ID NO: 1589948 - protein, 25 aa, Staphylococcus aureus
GMAKEDIIGYYMLSVLSLEDEFKLE

SEQ ID NO: 1589949 - protein, 25 aa, Staphylococcus aureus
GSIGTFIMALFYFVSVSVQLYQMKI

SEQ ID NO: 1589950 - protein, 28 aa, Staphylococcus aureus
GTKPKIMTAIVLWLFGSIASILGLCLSL

SEQ ID NO: 1589951 - protein, 26 aa, Staphylococcus aureus
HKWSAVIAWIVIVAAILIPLATNAPK

SEQ ID NO: 1589952 - protein, 24 aa, Staphylococcus aureus
HMILRLFMLLTLISGFWILIQSFM

SEQ ID NO: 1589953 - protein, 32 aa, Staphylococcus aureus
HVASEFVYNMPLLSEKPLFVYISQSGETADSR

SEQ ID NO: 1589954 - protein, 18 aa, Staphylococcus aureus
HWTNMFLIALIVVFTLPF

SEQ ID NO: 1589955 - protein, 19 aa, Staphylococcus aureus
IAVTLLISMLYLFVGIDFE

SEQ ID NO: 1589956 - protein, 25 aa, Staphylococcus aureus
IDNHQIIWVILNYEFNEARPTIGQS

SEQ ID NO: 1589957 - protein, 28 aa, Staphylococcus aureus
IFIALMLKWWLLLVISIIVLIIITVAMI

SEQ ID NO: 1589958 - protein, 26 aa, Staphylococcus aureus
IFSIIALILCLFLQSNKKAKATAQKL

SEQ ID NO: 1589959 - protein, 19 aa, Staphylococcus aureus
IGALVPLLFGQDSSILISK

SEQ ID NO: 1589960 - protein, 17 aa, Staphylococcus aureus
IGVLLIYGLFISSNPKE

SEQ ID NO: 1589961 - protein, 25 aa, Staphylococcus aureus
IILGFLLHYIFKINDKWLLILCVLV

SEQ ID NO: 1589962 - protein, 17 aa, Staphylococcus aureus
IIVMLVSVVLALLLTSI

SEQ ID NO: 1589963 - protein, 24 aa, Staphylococcus aureus
IRNKWRDFFNTPLIDHLMSFEHSY

SEQ ID NO: 1589964 - protein, 23 aa, Staphylococcus aureus
ISAWGYWFSAFLGNVAYATLLMS

SEQ ID NO: 1589965 - protein, 17 aa, Staphylococcus aureus
ISKKTYQGIFSFDVLGL

SEQ ID NO: 1589966 - protein, 30 aa, Staphylococcus aureus
IVFIVISTMIFLFIGKPISLLIIAGAINGW

SEQ ID NO: 1589967 - protein, 22 aa, Staphylococcus aureus
KGVKLFYPLPFNVKTPIQFKTG

SEQ ID NO: 1589968 - protein, 20 aa, Staphylococcus aureus
KKYYNFYGVGALDKDPIKTG

SEQ ID NO: 1589969 - protein, 29 aa, Staphylococcus aureus
KYMGYLIFVFFIFVFGLLFINVDTRRAIY

SEQ ID NO: 1589970 - protein, 23 aa, Staphylococcus aureus
LKSVIMLIVLFFLIIFGIVACST

SEQ ID NO: 1589971 - protein, 22 aa, Staphylococcus aureus
LMSIQLIEIYKLAIPLIIIVLV

SEQ ID NO: 1589972 - protein, 25 aa, Staphylococcus aureus
LSGTAWLMKLLPPVVVGPVIMVIGL

SEQ ID NO: 1589973 - protein, 26 aa, Staphylococcus aureus
MRMMFIGMMLLLVFALILLMVFKENN

SEQ ID NO: 1589974 - protein, 23 aa, Staphylococcus aureus
NISFLFISIITFILSIINPNISL

SEQ ID NO: 1589975 - protein, 21 aa, Staphylococcus aureus
NLIFFVFVAFIFVVIVLQFFV

SEQ ID NO: 1589976 - protein, 33 aa, Staphylococcus aureus
NNKKVLFISFLIIGLYMFIEIIGGLLANSLALL

SEQ ID NO: 1589977 - protein, 27 aa, Staphylococcus aureus
NQTKKDIDYILSPIVNRPSLLDRLNKN

SEQ ID NO: 1589978 - protein, 32 aa, Staphylococcus aureus
NTKIEMQYIPFNLLHLLSLKVVSIMIVLVACL

SEQ ID NO: 1589979 - protein, 23 aa, Staphylococcus aureus
PRKMITIALVWWSAFTILTGMIK

SEQ ID NO: 1589980 - protein, 22 aa, Staphylococcus aureus
PVSIFTGIIAFIFLMLARKSNA

SEQ ID NO: 1589981 - protein, 24 aa, Staphylococcus aureus
QFARTVLVILLLVPSIVVLSGQFD

SEQ ID NO: 1589982 - protein, 24 aa, Staphylococcus aureus
QIGPKRLLFIGLIALIITQLLYFI

SEQ ID NO: 1589983 - protein, 27 aa, Staphylococcus aureus
QVRFVVKFILFFTILNIIAVYIFDPEY

SEQ ID NO: 1589984 - protein, 17 aa, Staphylococcus aureus
RIVNDMALKMLGMAKED

SEQ ID NO: 1589985 - protein, 22 aa, Staphylococcus aureus
RLILATIILLPFVIIKKLPTPE

SEQ ID NO: 1589986 - protein, 20 aa, Staphylococcus aureus
RVKYILIPYILMGLFYSYSE

SEQ ID NO: 1589987 - protein, 24 aa, Staphylococcus aureus
SGELTYQRFLNGYPTFNKEGSNQI

SEQ ID NO: 1589988 - protein, 24 aa, Staphylococcus aureus
SLISLFLILFSCLTFFFGLDYERF

SEQ ID NO: 1589989 - protein, 19 aa, Staphylococcus aureus
SMETLWQTISPLEAFIRPN

SEQ ID NO: 1589990 - protein, 28 aa, Staphylococcus aureus
TAISLLITVILGFFIARTITKPITDMRN

SEQ ID NO: 1589991 - protein, 17 aa, Staphylococcus aureus
TALLLVIPIIISYKEGL

SEQ ID NO: 1589992 - protein, 24 aa, Staphylococcus aureus
TGSFMLFVLLVFGFDFLSAAGNAK

SEQ ID NO: 1589993 - protein, 52 aa, Staphylococcus aureus
TPVKRQNILFLCPFLPVISFAVIFINSQVGILLFLMSCLFNIILSATLKRTY

SEQ ID NO: 1589994 - protein, 24 aa, Staphylococcus aureus
VAMLLFSLFILYVNHIFIAGTLYA

SEQ ID NO: 1589995 - protein, 32 aa, Staphylococcus aureus
VITVVVLLAIGIAGFYFWNKTTSYVTTDNAKV

SEQ ID NO: 1589996 - protein, 17 aa, Staphylococcus aureus
VLLSWIVILIITTSIYL

SEQ ID NO: 1589997 - protein, 24 aa, Staphylococcus aureus
YHAGFLFALLITVVSFFCSFMLQG

SEQ ID NO: 1589998 - protein, 25 aa, Staphylococcus aureus
YHKVVLPPYLGFFGGSRFVPIVTAF

SEQ ID NO: 1589999 - protein, 17 aa, Staphylococcus aureus
YMTTSGNATYDQSTGIV

SEQ ID NO: 1590000 - protein, 28 aa, Staphylococcus aureus
YVDVTTGKDIIPPKTYSGNVDQVVTIDN

SEQ ID NO: 1590001 - protein, 23 aa, Staphylococcus aureus
AFIILIVLAIYFFIKKLFSRNAV

SEQ ID NO: 1590002 - protein, 19 aa, Staphylococcus aureus
AICLLYLAFYYFSPDKEEK

SEQ ID NO: 1590003 - protein, 17 aa, Staphylococcus aureus
AIYWAMWPTTAEVILII

SEQ ID NO: 1590004 - protein, 26 aa, Staphylococcus aureus
ASNTIPVYMPYITSYFMTRAIGDRPL

SEQ ID NO: 1590005 - protein, 22 aa, Staphylococcus aureus
AVEILFATIGLIIGLLISVMVS

SEQ ID NO: 1590006 - protein, 24 aa, Staphylococcus aureus
DNYHLIFALIFLAIVSVVSMMIGS

SEQ ID NO: 1590007 - protein, 24 aa, Staphylococcus aureus
DYAKILPLTALLGGILVLVADVIA

SEQ ID NO: 1590008 - protein, 23 aa, Staphylococcus aureus
EPLEFSFLFVAPVLYGIHVLLAG

SEQ ID NO: 1590009 - protein, 35 aa, Staphylococcus aureus
ESVLTTRQVFLGKAGFFIMLGMLQALIVSVGDLLI

SEQ ID NO: 1590010 - protein, 17 aa, Staphylococcus aureus
FITTLIVILAFPPLTVA

SEQ ID NO: 1590011 - protein, 37 aa, Staphylococcus aureus
FSVFVSYYILEPYFKTYSVKLLILAAISLFISHHISA

SEQ ID NO: 1590012 - protein, 17 aa, Staphylococcus aureus
FYIISFATLFIIAIAVH

SEQ ID NO: 1590013 - protein, 19 aa, Staphylococcus aureus
GGYLIWLWLREGQSSLVGL

SEQ ID NO: 1590014 - protein, 33 aa, Staphylococcus aureus
GISFDPFTPLLVAAALYFVLTFVLTRIMNMIEG

SEQ ID NO: 1590015 - protein, 23 aa, Staphylococcus aureus
GKQMGYVYFSWLLGLLVGMVFMN

SEQ ID NO: 1590016 - protein, 21 aa, Staphylococcus aureus
GSIYLFMGLAIFCFVMYIAFG

SEQ ID NO: 1590017 - protein, 28 aa, Staphylococcus aureus
HHQFNLLWFNMIFIIIIGLTLVIFCLLP

SEQ ID NO: 1590018 - protein, 26 aa, Staphylococcus aureus
HRPDQAHMYLFDFGTNGLMPVTDIPH

SEQ ID NO: 1590019 - protein, 24 aa, Staphylococcus aureus
IDHVLWFIFAVIVGSLVTMTTVLL

SEQ ID NO: 1590020 - protein, 25 aa, Staphylococcus aureus
IFLVTLLFVLWQPKGLDIGITALTG

SEQ ID NO: 1590021 - protein, 17 aa, Staphylococcus aureus
IIFVMLCGKVGLLTLLR

SEQ ID NO: 1590022 - protein, 34 aa, Staphylococcus aureus
IMMIAIFIALMFDFEKAYWIPLSAHTILLGTSTI

SEQ ID NO: 1590023 - protein, 20 aa, Staphylococcus aureus
IPFWGLVVILTIITIFLVVR

SEQ ID NO: 1590024 - protein, 17 aa, Staphylococcus aureus
IRILIFYVGALAVIMSI

SEQ ID NO: 1590025 - protein, 22 aa, Staphylococcus aureus
ITMFIIWTILQFYIDKKLKPVY

SEQ ID NO: 1590026 - protein, 18 aa, Staphylococcus aureus
IVTIILFIKQRHLAVWFV

SEQ ID NO: 1590027 - protein, 24 aa, Staphylococcus aureus
IVVYTLIYITFALIAFVHSNKLIK

SEQ ID NO: 1590028 - protein, 31 aa, Staphylococcus aureus
IYHSFLLKKWYLIIYLLFILAALLITLTTIQ

SEQ ID NO: 1590029 - protein, 44 aa, Staphylococcus aureus
KHESSTIILMIFLIGIILLSIWTRSFIIGFLAAIINVFVFNYFF

SEQ ID NO: 1590030 - protein, 22 aa, Staphylococcus aureus
KNNILFFLTWAVPAAISGIYIK

SEQ ID NO: 1590031 - protein, 30 aa, Staphylococcus aureus
KQTQFLQPILFLILGLFIVAIYLVIMLPMF

SEQ ID NO: 1590032 - protein, 18 aa, Staphylococcus aureus
KTTSLLGLLLGALAGLVV

SEQ ID NO: 1590033 - protein, 22 aa, Staphylococcus aureus
LLKIAIILYIPFMISKKMPRVL

SEQ ID NO: 1590034 - protein, 23 aa, Staphylococcus aureus
LLLISFVVFFFIYGMVSGASALE

SEQ ID NO: 1590035 - protein, 19 aa, Staphylococcus aureus
LMTILAILVLIIPLNMLIS

SEQ ID NO: 1590036 - protein, 19 aa, Staphylococcus aureus
LMWGSLLFHLGIIPVFFGH

SEQ ID NO: 1590037 - protein, 20 aa, Staphylococcus aureus
LPTALTTTISFAVSFIIVTY

SEQ ID NO: 1590038 - protein, 24 aa, Staphylococcus aureus
LSGFILYMILIFTLSMIVNIHIVW

SEQ ID NO: 1590039 - protein, 20 aa, Staphylococcus aureus
LVTFVLGLIIALFTALMRIS

SEQ ID NO: 1590040 - protein, 24 aa, Staphylococcus aureus
MIPLLILISIVVFSLAIIQPGDPF

SEQ ID NO: 1590041 - protein, 23 aa, Staphylococcus aureus
MLLSTSILILSSSSLGLATHTVE

SEQ ID NO: 1590042 - protein, 17 aa, Staphylococcus aureus
MPFLYFTTAWSIAGFAS

SEQ ID NO: 1590043 - protein, 23 aa, Staphylococcus aureus
NGTRYIFFDNMSFTAPTKQPIVK

SEQ ID NO: 1590044 - protein, 23 aa, Staphylococcus aureus
NILLVLLYFVYLGLTIVMIVFLC

SEQ ID NO: 1590045 - protein, 30 aa, Staphylococcus aureus
NIVTVLMTTLILLAFIFSAYRAWQMRHGQI

SEQ ID NO: 1590046 - protein, 18 aa, Staphylococcus aureus
NYLMLAIPSFIAGVFAIF

SEQ ID NO: 1590047 - protein, 29 aa, Staphylococcus aureus
QNKNGFTFFLNVLLPLVFISVLIGIFNYI

SEQ ID NO: 1590048 - protein, 23 aa, Staphylococcus aureus
RIGRSLGIHLILATQKPSGVVDD

SEQ ID NO: 1590049 - protein, 17 aa, Staphylococcus aureus
RTGLYIIDSQLLKGHVY

SEQ ID NO: 1590050 - protein, 17 aa, Staphylococcus aureus
SALIFLVLAVFYGSYFI

SEQ ID NO: 1590051 - protein, 33 aa, Staphylococcus aureus
SDTLKIFILIVIVWILVFILMGAGLKQVNLLQK

SEQ ID NO: 1590052 - protein, 22 aa, Staphylococcus aureus
SIPQILLMLFGSTLIMGGACAL

SEQ ID NO: 1590053 - protein, 22 aa, Staphylococcus aureus
SKWKIMLSILLSIISVFSGLVP

SEQ ID NO: 1590054 - protein, 31 aa, Staphylococcus aureus
STIHQSFNLPYWLSALILVAFILATLFLKFD

SEQ ID NO: 1590055 - protein, 28 aa, Staphylococcus aureus
TLILSILFPVIFYILFTSILELPEDVKP

SEQ ID NO: 1590056 - protein, 26 aa, Staphylococcus aureus
TYAINLSILILAIIFIGSYSIATGIN

SEQ ID NO: 1590057 - protein, 28 aa, Staphylococcus aureus
TYASYILITWLAIIFVLLIVAFRRARRL

SEQ ID NO: 1590058 - protein, 24 aa, Staphylococcus aureus
VAVVLIYFTGWRIIDPIISIVISL

SEQ ID NO: 1590059 - protein, 19 aa, Staphylococcus aureus
VGFVMILFAFKTQFGHASF

SEQ ID NO: 1590060 - protein, 23 aa, Staphylococcus aureus
VGKVSFRFWPFSEFKHNFNPENT

SEQ ID NO: 1590061 - protein, 17 aa, Staphylococcus aureus
VLLLLMTLTGNVFTLLM

SEQ ID NO: 1590062 - protein, 17 aa, Staphylococcus aureus
VTMTTVLLLKRNTPVIA

SEQ ID NO: 1590063 - protein, 20 aa, Staphylococcus aureus
VTVIVLAFISIGHALLIMVS

SEQ ID NO: 1590064 - protein, 20 aa, Staphylococcus aureus
YLYRIFSRAYFYLPFLLIYF

SEQ ID NO: 1590065 - protein, 17 aa, Staphylococcus aureus
AETLLIVLTIILIIILT

SEQ ID NO: 1590066 - protein, 24 aa, Staphylococcus aureus
DKWLLILCVLVIIINASWNTISRA

SEQ ID NO: 1590067 - protein, 19 aa, Staphylococcus aureus
DRVIKKRYKGIEYLIIKEP

SEQ ID NO: 1590068 - protein, 26 aa, Staphylococcus aureus
DVGQTLLILIILVAIIFYSGIGVNKV

SEQ ID NO: 1590069 - protein, 18 aa, Staphylococcus aureus
EHRYFDRVIKKRYKGIEY

SEQ ID NO: 1590070 - protein, 28 aa, Staphylococcus aureus
EPLEFSFLFVAPILYVIHAFFDGLAFMM

SEQ ID NO: 1590071 - protein, 20 aa, Staphylococcus aureus
FGIKKYFLGGLLSSLLLLVF

SEQ ID NO: 1590072 - protein, 21 aa, Staphylococcus aureus
FLHNIIFDVARHHRPDQAHMY

SEQ ID NO: 1590073 - protein, 40 aa, Staphylococcus aureus
FNFGKLIVIILFLDTIFRLMLPFSTYIFILIPLLGLTYMT

SEQ ID NO: 1590074 - protein, 22 aa, Staphylococcus aureus
FQLYVKLSCSTMMATSIILTNI

SEQ ID NO: 1590075 - protein, 20 aa, Staphylococcus aureus
GCLYGWIGLKLNLSSGRFSR

SEQ ID NO: 1590076 - protein, 17 aa, Staphylococcus aureus
GFLYVCKLQFYPESKNL

SEQ ID NO: 1590077 - protein, 20 aa, Staphylococcus aureus
GGAILLILYGLFAFILITFK

SEQ ID NO: 1590078 - protein, 24 aa, Staphylococcus aureus
GGSLWIIVYLIVLSILSFIGSKEF

SEQ ID NO: 1590079 - protein, 23 aa, Staphylococcus aureus
GKLLNYILEAFGIDFNSLTKGMG

SEQ ID NO: 1590080 - protein, 22 aa, Staphylococcus aureus
GQFFWPAILAFVLTGIGLPLLG

SEQ ID NO: 1590081 - protein, 20 aa, Staphylococcus aureus
GWVWTVTLVGLITLFWASLN

SEQ ID NO: 1590082 - protein, 22 aa, Staphylococcus aureus
HHHDFLHYKLGIANVEKSFKLD

SEQ ID NO: 1590083 - protein, 26 aa, Staphylococcus aureus
IGLVCLFMMKLVLAITFFAVSLSISL

SEQ ID NO: 1590084 - protein, 19 aa, Staphylococcus aureus
IITIPVLFITLIGLYLTLI

SEQ ID NO: 1590085 - protein, 23 aa, Staphylococcus aureus
ISVLIIILLVLIVAYIIGTIITM

SEQ ID NO: 1590086 - protein, 20 aa, Staphylococcus aureus
KKPFLFLKTLFMGVVFIFIG

SEQ ID NO: 1590087 - protein, 17 aa, Staphylococcus aureus
KKTYQGIFSFDVLGLQD

SEQ ID NO: 1590088 - protein, 24 aa, Staphylococcus aureus
LIPYLLWMVIFIIVPVVLLIYFSF

SEQ ID NO: 1590089 - protein, 18 aa, Staphylococcus aureus
LITLIYALIAFAVIAVVY

SEQ ID NO: 1590090 - protein, 24 aa, Staphylococcus aureus
LLAVYLIIVIFSLLNYWSVKLLTS

SEQ ID NO: 1590091 - protein, 30 aa, Staphylococcus aureus
LSFKLYRFYFYRLFAIVTWILFIGSLSQYF

SEQ ID NO: 1590092 - protein, 23 aa, Staphylococcus aureus
LSKFNIIYILMLEQLLIFIITAI

SEQ ID NO: 1590093 - protein, 21 aa, Staphylococcus aureus
NPIPIYITNFFGGAIAGLIIA

SEQ ID NO: 1590094 - protein, 24 aa, Staphylococcus aureus
NSIVLKSILSLGIIYGGTFGIYPK

SEQ ID NO: 1590095 - protein, 19 aa, Staphylococcus aureus
RIIFSAIFMIFILAVGQKQ

SEQ ID NO: 1590096 - protein, 28 aa, Staphylococcus aureus
RITEFVMLFPFLIFAIVLNAALGDKIKN

SEQ ID NO: 1590097 - protein, 18 aa, Staphylococcus aureus
SFLFGIPMFVGALITGMI

SEQ ID NO: 1590098 - protein, 24 aa, Staphylococcus aureus
SFPERRWVYILALSSSALCGLFIQ

SEQ ID NO: 1590099 - protein, 21 aa, Staphylococcus aureus
SLIVTSTLVFSSMPFQNAHAD

SEQ ID NO: 1590100 - protein, 35 aa, Staphylococcus aureus
TFSEFRTFLAVLLMLLLFISISLVIASTYSIIRPV

SEQ ID NO: 1590101 - protein, 21 aa, Staphylococcus aureus
TLFGGLFAALGSLLLFGRRKK

SEQ ID NO: 1590102 - protein, 18 aa, Staphylococcus aureus
TSPFIILFLTVVGAYLFF

SEQ ID NO: 1590103 - protein, 21 aa, Staphylococcus aureus
TVIDMWFVILPVVMSIGTIAT

SEQ ID NO: 1590104 - protein, 18 aa, Staphylococcus aureus
TYQGIFSFDVLGLQDIHR

SEQ ID NO: 1590105 - protein, 20 aa, Staphylococcus aureus
VAPILYVVHALLTGLSLFIA

SEQ ID NO: 1590106 - protein, 25 aa, Staphylococcus aureus
VIAIFFVVFLGILFFYLNLNRRLAL

SEQ ID NO: 1590107 - protein, 19 aa, Staphylococcus aureus
VLIAWILYYFVDVKLTNYN

SEQ ID NO: 1590108 - protein, 17 aa, Staphylococcus aureus
VNYALAPQYKYPTPLIQ

SEQ ID NO: 1590109 - protein, 46 aa, Staphylococcus aureus
VSTTYKKVLHWSLNHKWIVIILSTLILVATIVFGGPRLGTSFISAG

SEQ ID NO: 1590110 - protein, 18 aa, Staphylococcus aureus
VTLVGLITLFWASLNATK

SEQ ID NO: 1590111 - protein, 21 aa, Staphylococcus aureus
YKYNPYILNQINKLGKDYGEV

SEQ ID NO: 1590112 - protein, 24 aa, Staphylococcus aureus
YPLQLTFFILLLMSHSLLKQISLK

SEQ ID NO: 1590113 - protein, 23 aa, Staphylococcus aureus
DDPKLAFSIVYTNQPVPPPWLTG

SEQ ID NO: 1590114 - protein, 23 aa, Staphylococcus aureus
DVTIFILIAILLFVYTYKENEEI

SEQ ID NO: 1590115 - protein, 22 aa, Staphylococcus aureus
EPKKYIIPWALLGFALVMIYQM

SEQ ID NO: 1590116 - protein, 17 aa, Staphylococcus aureus
FDEILFYTLYLLLILIV

SEQ ID NO: 1590117 - protein, 25 aa, Staphylococcus aureus
FEWPHYLLYILLVLGALSTLKLFIK

SEQ ID NO: 1590118 - protein, 17 aa, Staphylococcus aureus
FIAWGFIAAIFIDNGWL

SEQ ID NO: 1590119 - protein, 17 aa, Staphylococcus aureus
FLTFGYVCVVALNATAF

SEQ ID NO: 1590120 - protein, 29 aa, Staphylococcus aureus
FVVLKSALFFYYLFTKLSLISVLVLHLKQ

SEQ ID NO: 1590121 - protein, 19 aa, Staphylococcus aureus
GFFIIMICILLLVYKMIRN

SEQ ID NO: 1590122 - protein, 31 aa, Staphylococcus aureus
GFSMSFLNAIFIALPIFLAAKIFNNVLSHKP

SEQ ID NO: 1590123 - protein, 17 aa, Staphylococcus aureus
GLKFKIMFNFGLPLVIA

SEQ ID NO: 1590124 - protein, 30 aa, Staphylococcus aureus
IFNYALAYGIIFLMFFIVLNYASQIAMEIA

SEQ ID NO: 1590125 - protein, 20 aa, Staphylococcus aureus
IFVIAIILLTSVIGIVGRYM

SEQ ID NO: 1590126 - protein, 17 aa, Staphylococcus aureus
IIALFTALMRISTSKIL

SEQ ID NO: 1590127 - protein, 21 aa, Staphylococcus aureus
INFLQIIRFYYKDIFVCFVAV

SEQ ID NO: 1590128 - protein, 18 aa, Staphylococcus aureus
IPKSQYRRKRREFFHNED

SEQ ID NO: 1590129 - protein, 31 aa, Staphylococcus aureus
ISKYGSFFLKGIKITILISLIGVALGSILGA

SEQ ID NO: 1590130 - protein, 17 aa, Staphylococcus aureus
ISMLYLFVGIDFEIFEY

SEQ ID NO: 1590131 - protein, 18 aa, Staphylococcus aureus
IVLINLIVTFPILRKFKI

SEQ ID NO: 1590132 - protein, 21 aa, Staphylococcus aureus
KDNLKQYMTTSGNATYDQSTG

SEQ ID NO: 1590133 - protein, 23 aa, Staphylococcus aureus
KPEHFHLMYLLEQHSPYFIDAEL

SEQ ID NO: 1590134 - protein, 23 aa, Staphylococcus aureus
MTATQLLLLVFFSSTFTACSVTM

SEQ ID NO: 1590135 - protein, 18 aa, Staphylococcus aureus
MVWLSYPLVTAIIGCLFV

SEQ ID NO: 1590136 - protein, 20 aa, Staphylococcus aureus
NIKTIKIGLSALGYKVDNES

SEQ ID NO: 1590137 - protein, 25 aa, Staphylococcus aureus
NIRDIKMWILGLIGTILSTFVIALL

SEQ ID NO: 1590138 - protein, 26 aa, Staphylococcus aureus
NVAGGGAFGAFVTTDSYGVATTYTSS

SEQ ID NO: 1590139 - protein, 22 aa, Staphylococcus aureus
NVKQFFVITFISVILTLILFST

SEQ ID NO: 1590140 - protein, 23 aa, Staphylococcus aureus
PELGSIYILPALIGSIILIAIVT

SEQ ID NO: 1590141 - protein, 23 aa, Staphylococcus aureus
QGQNIARTIALRAGLSDTVPGQT

SEQ ID NO: 1590142 - protein, 45 aa, Staphylococcus aureus
QQNQQYGQKKSKKGWFWGCGGCLVLFILIIIGISACTAGITGNLG

SEQ ID NO: 1590143 - protein, 25 aa, Staphylococcus aureus
QSALTAKGYNYTSVDSSYASTYNDT

SEQ ID NO: 1590144 - protein, 21 aa, Staphylococcus aureus
RQLIALAVFSILLFLGCTWSI

SEQ ID NO: 1590145 - protein, 22 aa, Staphylococcus aureus
SISWFPAFFVTGFLGGLTTFST

SEQ ID NO: 1590146 - protein, 24 aa, Staphylococcus aureus
SVQLYQMKISFLPALGFNQILLER

SEQ ID NO: 1590147 - protein, 23 aa, Staphylococcus aureus
SVRKMVALYLSYTTQFIYLHRRV

SEQ ID NO: 1590148 - protein, 26 aa, Staphylococcus aureus
SYHIFRIFFILFIIAPGINYFLKYRS

SEQ ID NO: 1590149 - protein, 29 aa, Staphylococcus aureus
TTAISIISIPLSLLMALIALKLSDVSLNI

SEQ ID NO: 1590150 - protein, 28 aa, Staphylococcus aureus
TVTNTVTGLPSGLSYDSATNSIIGTPTK

SEQ ID NO: 1590151 - protein, 23 aa, Staphylococcus aureus
VGFTLFIFTLIMNLLSQWISKRF

SEQ ID NO: 1590152 - protein, 25 aa, Staphylococcus aureus
VHAGWLHYFVGMTISFIIAITVTLI

SEQ ID NO: 1590153 - protein, 21 aa, Staphylococcus aureus
VIKFILNIILIRLSGIIGASI

SEQ ID NO: 1590154 - protein, 17 aa, Staphylococcus aureus
VLPPFFMATGALMYVVP

SEQ ID NO: 1590155 - protein, 18 aa, Staphylococcus aureus
VTFPILRKFKIATPVFKP

SEQ ID NO: 1590156 - protein, 27 aa, Staphylococcus aureus
WQMSGILLWIYIIVIICLLFTGQPSVF

SEQ ID NO: 1590157 - protein, 17 aa, Staphylococcus aureus
YIQLVLFLIAATTIILI

SEQ ID NO: 1590158 - protein, 18 aa, Staphylococcus aureus
YVVHALLTGLSLFIAATF

SEQ ID NO: 1590159 - protein, 17 aa, Staphylococcus aureus
YVVPPSRLINEIPYAMK

SEQ ID NO: 1590160 - protein, 24 aa, Staphylococcus aureus
AIFTVLFLSLFIFGIISIILGAIG

SEQ ID NO: 1590161 - protein, 28 aa, Staphylococcus aureus
AIQDHQGYWFLRFRAALVPVANLGSSLS

SEQ ID NO: 1590162 - protein, 17 aa, Staphylococcus aureus
AVPIILFLLCLTVFKMK

SEQ ID NO: 1590163 - protein, 17 aa, Staphylococcus aureus
DIFIPILPAIVTAGLLM

SEQ ID NO: 1590164 - protein, 23 aa, Staphylococcus aureus
DIGFIFLYIFLVNILPIIIVFLT

SEQ ID NO: 1590165 - protein, 17 aa, Staphylococcus aureus
DIIFLILLNILMCLRIY

SEQ ID NO: 1590166 - protein, 23 aa, Staphylococcus aureus
DQQSAFYEILNMPNLNEAQRNGF

SEQ ID NO: 1590167 - protein, 17 aa, Staphylococcus aureus
DSIHIPMIMSALKEIEK

SEQ ID NO: 1590168 - protein, 26 aa, Staphylococcus aureus
EPLEFTFLFIAPYLFVLHAVLAASMD

SEQ ID NO: 1590169 - protein, 19 aa, Staphylococcus aureus
EVEMTERPIKIYNSLGVKD

SEQ ID NO: 1590170 - protein, 19 aa, Staphylococcus aureus
FFLIALIALLPVIILGFLG

SEQ ID NO: 1590171 - protein, 20 aa, Staphylococcus aureus
FLTPLDYHYFFFSDGFYITI

SEQ ID NO: 1590172 - protein, 17 aa, Staphylococcus aureus
FLVVILHNVLGYTIGYW

SEQ ID NO: 1590173 - protein, 18 aa, Staphylococcus aureus
FVLAPDELFFTRDGLPIA

SEQ ID NO: 1590174 - protein, 29 aa, Staphylococcus aureus
GLQQQSNYFRFQYFNPLKSERYYRNLDEQ

SEQ ID NO: 1590175 - protein, 27 aa, Staphylococcus aureus
GNPGKAIAIVLLVLQIAGGGGTFPIQT

SEQ ID NO: 1590176 - protein, 23 aa, Staphylococcus aureus
GQGEILINPVQILSIYSALENNG

SEQ ID NO: 1590177 - protein, 25 aa, Staphylococcus aureus
GVGLPLFTALPIVSGMLEKYGIRDK

SEQ ID NO: 1590178 - protein, 18 aa, Staphylococcus aureus
IAMLSVIFLLIITIVSII

SEQ ID NO: 1590179 - protein, 23 aa, Staphylococcus aureus
IARKIPIFIFFVSIIGPLLEEYV

SEQ ID NO: 1590180 - protein, 29 aa, Staphylococcus aureus
IGDQSSEVYSPISPIKIATQDNSGNAVTN

SEQ ID NO: 1590181 - protein, 17 aa, Staphylococcus aureus
IILCLTLSIMTPYAQAT

SEQ ID NO: 1590182 - protein, 24 aa, Staphylococcus aureus
IVGLFLFYLLLQFKIVPLTWVEDG

SEQ ID NO: 1590183 - protein, 18 aa, Staphylococcus aureus
IVVSFMTFLLTYITNENP

SEQ ID NO: 1590184 - protein, 27 aa, Staphylococcus aureus
KDGSLLKYTEMKWLTPDGHYIHGKGIK

SEQ ID NO: 1590185 - protein, 19 aa, Staphylococcus aureus
KFMVPILAGYIAVSIADKP

SEQ ID NO: 1590186 - protein, 24 aa, Staphylococcus aureus
KRMLYTCFILFIYILGTNISIVSY

SEQ ID NO: 1590187 - protein, 22 aa, Staphylococcus aureus
KTVEIPFETKREFNPKLQPGEE

SEQ ID NO: 1590188 - protein, 18 aa, Staphylococcus aureus
LENVALLAAFIPIISGMS

SEQ ID NO: 1590189 - protein, 22 aa, Staphylococcus aureus
LGAISWFFLSLILSLTQFTPFT

SEQ ID NO: 1590190 - protein, 27 aa, Staphylococcus aureus
LGTLFTIILAIGFIINLVLAFIIIFLE

SEQ ID NO: 1590191 - protein, 17 aa, Staphylococcus aureus
LIITFLVLIANSVTFVF

SEQ ID NO: 1590192 - protein, 30 aa, Staphylococcus aureus
LKHYAMYLFSLFFSIVLYFSFTTLQFTKGV

SEQ ID NO: 1590193 - protein, 19 aa, Staphylococcus aureus
LPIIIVFLTFGLVAVFTQQ

SEQ ID NO: 1590194 - protein, 24 aa, Staphylococcus aureus
LSDSTSTSLSLSASMNQSGVDSNS

SEQ ID NO: 1590195 - protein, 24 aa, Staphylococcus aureus
MYGYSMLLLFLIAACIFLIVLFIL

SEQ ID NO: 1590196 - protein, 17 aa, Staphylococcus aureus
MYKLFYNRCQELILSRL

SEQ ID NO: 1590197 - protein, 33 aa, Staphylococcus aureus
NHKKQYMLFAAGIVLATILLISAHLYSRKRGNQ

SEQ ID NO: 1590198 - protein, 48 aa, Staphylococcus aureus
NICNFIKAIFEFILNFVIKPIMFAIWQVMQFIWPAVKALIVSTWENIK

SEQ ID NO: 1590199 - protein, 32 aa, Staphylococcus aureus
NYLKVMFLSAPFVILFFILEQFARAIGAPMIS

SEQ ID NO: 1590200 - protein, 28 aa, Staphylococcus aureus
PFDFIVIIIVALIFYYIGTTSSFESVYF

SEQ ID NO: 1590201 - protein, 27 aa, Staphylococcus aureus
PMLLPFLCALILVFLKNNDRISKYLYL

SEQ ID NO: 1590202 - protein, 31 aa, Staphylococcus aureus
QGIVLYYIVAIVIAFLLLNLPYVHKPGVEVN

SEQ ID NO: 1590203 - protein, 28 aa, Staphylococcus aureus
QRSLNLWTYVMLIFMTLAAILMGPLVVY

SEQ ID NO: 1590204 - protein, 48 aa, Staphylococcus aureus
QSISKKMTGYGLKTTAVIGGAFTVNMLHDQQAFAASDAPLTSELNTQS

SEQ ID NO: 1590205 - protein, 24 aa, Staphylococcus aureus
RYKRPVIIFIVPGIIPLVPGGAAY

SEQ ID NO: 1590206 - protein, 23 aa, Staphylococcus aureus
SAFLFWLVILTFGIAGIIFLMPY

SEQ ID NO: 1590207 - protein, 21 aa, Staphylococcus aureus
SDNIFFARVALELGSKKFEKG

SEQ ID NO: 1590208 - protein, 21 aa, Staphylococcus aureus
SDSGSLSVSTSLRKSESVSES

SEQ ID NO: 1590209 - protein, 23 aa, Staphylococcus aureus
SSLSYMIIMLGIILTAIGSAFGS

SEQ ID NO: 1590210 - protein, 26 aa, Staphylococcus aureus
TISVINLWTFLMLLNLNIANMIKGKQ

SEQ ID NO: 1590211 - protein, 23 aa, Staphylococcus aureus
TSYIALFYFIVMATIFVGLISVT

SEQ ID NO: 1590212 - protein, 27 aa, Staphylococcus aureus
VFEGHAIYNMLKMHPAKINIYVDALAA

SEQ ID NO: 1590213 - protein, 18 aa, Staphylococcus aureus
VFLAIFLAVLLGIGISYF

SEQ ID NO: 1590214 - protein, 33 aa, Staphylococcus aureus
VIIGLIFVAIYFFLFRFLILKFDIPLPGRKKTE

SEQ ID NO: 1590215 - protein, 21 aa, Staphylococcus aureus
VIIILILILGGIFLKMKYDEK

SEQ ID NO: 1590216 - protein, 24 aa, Staphylococcus aureus
VSTPSYDVYPFMYGMSNEEYNKLT

SEQ ID NO: 1590217 - protein, 18 aa, Staphylococcus aureus
YGLLYAPLVITGLHHMFL

SEQ ID NO: 1590218 - protein, 26 aa, Staphylococcus aureus
YTFEVYRFDYPITFIVSILTSILTSA

SEQ ID NO: 1590219 - protein, 17 aa, Staphylococcus aureus
YVLPLISILGGITTALI

SEQ ID NO: 1590220 - protein, 18 aa, Staphylococcus aureus
YVRKVGHTVFKWVAIGMT

SEQ ID NO: 1590221 - protein, 24 aa, Staphylococcus aureus
AGFFPIMMFGIPAAALAMYHTAKT

SEQ ID NO: 1590222 - protein, 22 aa, Staphylococcus aureus
AILTIIILYFLTNGISLNHAKN

SEQ ID NO: 1590223 - protein, 23 aa, Staphylococcus aureus
ATTAFFLVLAFRTYKELGTDNVE

SEQ ID NO: 1590224 - protein, 26 aa, Staphylococcus aureus
CIVGAIFVISYLYWYCKKIKNDPKAS

SEQ ID NO: 1590225 - protein, 19 aa, Staphylococcus aureus
DLILSLIIIIIPLLAITSN

SEQ ID NO: 1590226 - protein, 24 aa, Staphylococcus aureus
EGFPTINWLGFYPSYEPLIAQAAY

SEQ ID NO: 1590227 - protein, 49 aa, Staphylococcus aureus
FAMLAAIIIVYLILVITFKGGLAPFTILFSLPFTVIGVIIALLITGETI

SEQ ID NO: 1590228 - protein, 18 aa, Staphylococcus aureus
FVFPLMILKLTGSAFQVG

SEQ ID NO: 1590229 - protein, 23 aa, Staphylococcus aureus
FYTLYLLLILIVLYYLKKQVKHK

SEQ ID NO: 1590230 - protein, 27 aa, Staphylococcus aureus
GDNTVVYYDFLVVAPGLQINWSSIKGL

SEQ ID NO: 1590231 - protein, 24 aa, Staphylococcus aureus
GETGRQIGWFISYDKDNPNMMMAI

SEQ ID NO: 1590232 - protein, 28 aa, Staphylococcus aureus
GVFFICSILLFLGFIFNALLKYTNNNMI

SEQ ID NO: 1590233 - protein, 26 aa, Staphylococcus aureus
HGVILKWFMMLPLADIDLAWLVPFML

SEQ ID NO: 1590234 - protein, 19 aa, Staphylococcus aureus
IDYPLLVTYIVLSLIGLVM

SEQ ID NO: 1590235 - protein, 17 aa, Staphylococcus aureus
IIACMIWYLNKAHVSII

SEQ ID NO: 1590236 - protein, 17 aa, Staphylococcus aureus
IILFLTVVGAYLFFRSS

SEQ ID NO: 1590237 - protein, 20 aa, Staphylococcus aureus
IPFVIVSLNYPLFNLVDQFT

SEQ ID NO: 1590238 - protein, 25 aa, Staphylococcus aureus
ISAMQYIVRRYGWGGFKRAGDYAYA

SEQ ID NO: 1590239 - protein, 18 aa, Staphylococcus aureus
ISIKAFPLAIGALYLPVI

SEQ ID NO: 1590240 - protein, 30 aa, Staphylococcus aureus
IYQINIWVWVPLIVIIVCLLFKMATVPAML

SEQ ID NO: 1590241 - protein, 23 aa, Staphylococcus aureus
LILIVVVVGFGIYFYASKDKEIN

SEQ ID NO: 1590242 - protein, 31 aa, Staphylococcus aureus
LLVFVVFFTAATIIWFSYDKNKYGTKQYDKT

SEQ ID NO: 1590243 - protein, 21 aa, Staphylococcus aureus
LSHYAIYLFSLITSVVLYFSF

SEQ ID NO: 1590244 - protein, 18 aa, Staphylococcus aureus
LSSFLFGIALLGVVFHNI

SEQ ID NO: 1590245 - protein, 17 aa, Staphylococcus aureus
LSTFIYKIANERLFSRE

SEQ ID NO: 1590246 - protein, 17 aa, Staphylococcus aureus
LWIPVFSITFSLITLIT

SEQ ID NO: 1590247 - protein, 22 aa, Staphylococcus aureus
MLEQLLIFIITAILGIIIGIFG

SEQ ID NO: 1590248 - protein, 17 aa, Staphylococcus aureus
PFCFFLTASVTLLTSTL

SEQ ID NO: 1590249 - protein, 37 aa, Staphylococcus aureus
PIMTAFYCTFLVVILLFLWPLLYSWIVKFGESIVGLG

SEQ ID NO: 1590250 - protein, 25 aa, Staphylococcus aureus
QFIQYYFYLIIILGGLYLYTHHAFI

SEQ ID NO: 1590251 - protein, 22 aa, Staphylococcus aureus
RIFINNMLIYGLGGLIVPFLGI

SEQ ID NO: 1590252 - protein, 37 aa, Staphylococcus aureus
RLAKIQLWFLIKGLTPIFFFLIFTLMMHIFLTKGGYV

SEQ ID NO: 1590253 - protein, 20 aa, Staphylococcus aureus
SILLIGMAISNVSKGQYAKR

SEQ ID NO: 1590254 - protein, 24 aa, Staphylococcus aureus
SSLLIVYFIYYIFEKNINFKAYAI

SEQ ID NO: 1590255 - protein, 37 aa, Staphylococcus aureus
STTSTSTAPVKLRTFSRLAMSTFASAATTTAVTANTI

SEQ ID NO: 1590256 - protein, 25 aa, Staphylococcus aureus
SYDSATNSIIGTPTKIGQSTVTVVS

SEQ ID NO: 1590257 - protein, 21 aa, Staphylococcus aureus
VDVMIIFLREGLEVLLIVMTL

SEQ ID NO: 1590258 - protein, 20 aa, Staphylococcus aureus
WYIISSIVGYLLFGTGLGLY

SEQ ID NO: 1590259 - protein, 19 aa, Staphylococcus aureus
YLNVFFRMTLKYNQILYIA

SEQ ID NO: 1590260 - protein, 29 aa, Staphylococcus aureus
AKDKKLEVISSLFSVKKITFDLSDAKKTS

SEQ ID NO: 1590261 - protein, 24 aa, Staphylococcus aureus
AVTFVLVLLVFWGLGFEAKLYTLI

SEQ ID NO: 1590262 - protein, 26 aa, Staphylococcus aureus
DLVGFKWMYLICGMLVIVIMIMSFLK

SEQ ID NO: 1590263 - protein, 17 aa, Staphylococcus aureus
EFAFMFVAPILYVVHAL

SEQ ID NO: 1590264 - protein, 19 aa, Staphylococcus aureus
EQQNAFYEILHLPNLNEEQ

SEQ ID NO: 1590265 - protein, 21 aa, Staphylococcus aureus
FFCHSPLTYLWVFALILFIMR

SEQ ID NO: 1590266 - protein, 22 aa, Staphylococcus aureus
FGSTALWIGAGLMSLAVLFSIV

SEQ ID NO: 1590267 - protein, 20 aa, Staphylococcus aureus
FIDYPLLVTYIVLSLIGLVM

SEQ ID NO: 1590268 - protein, 17 aa, Staphylococcus aureus
FITLIIIAVLMGMLLIF

SEQ ID NO: 1590269 - protein, 20 aa, Staphylococcus aureus
FTLHSESFPRIFRITSRDTN

SEQ ID NO: 1590270 - protein, 20 aa, Staphylococcus aureus
GICMAIVSILLIGMAISNVS

SEQ ID NO: 1590271 - protein, 18 aa, Staphylococcus aureus
GILKLFEPLFTAADGWIG

SEQ ID NO: 1590272 - protein, 22 aa, Staphylococcus aureus
GLFAFILITFKRGIPIAVKSIM

SEQ ID NO: 1590273 - protein, 18 aa, Staphylococcus aureus
HELFIPAMILSLLILFFY

SEQ ID NO: 1590274 - protein, 20 aa, Staphylococcus aureus
IFRPVMRPLFTLPGRSTVDN

SEQ ID NO: 1590275 - protein, 18 aa, Staphylococcus aureus
IGTILSTFVIALLKTIFG

SEQ ID NO: 1590276 - protein, 26 aa, Staphylococcus aureus
IKSDYILFMIIIVLAVIGLIKLLMGT

SEQ ID NO: 1590277 - protein, 27 aa, Staphylococcus aureus
IKSDYILFMIIIVLAVIGLIKLLMGTI

SEQ ID NO: 1590278 - protein, 36 aa, Staphylococcus aureus
ISRLVSCFLVLFLGSAIFSLLGQSPIVLGIIVLLFI

SEQ ID NO: 1590279 - protein, 37 aa, Staphylococcus aureus
ISRLVSCFLVLFLGSAIFSLLGQSPIVLGIIVLLFIP

SEQ ID NO: 1590280 - protein, 17 aa, Staphylococcus aureus
IVLILIEALIGLRFLKA

SEQ ID NO: 1590281 - protein, 23 aa, Staphylococcus aureus
KADGLISFLSTKVPILGTVFTAL

SEQ ID NO: 1590282 - protein, 21 aa, Staphylococcus aureus
LIILNIAFIIYTFVNFRKLKK

SEQ ID NO: 1590283 - protein, 17 aa, Staphylococcus aureus
LPEVWYIISSIVGYLLF

SEQ ID NO: 1590284 - protein, 21 aa, Staphylococcus aureus
LSRPIAIIFWIIAELAIIATD

SEQ ID NO: 1590285 - protein, 19 aa, Staphylococcus aureus
MIFFAFFSIYYFLTGKSDE

SEQ ID NO: 1590286 - protein, 27 aa, Staphylococcus aureus
MRLSAVLFWIPIALVLLIAFNILNWLF

SEQ ID NO: 1590287 - protein, 25 aa, Staphylococcus aureus
NWVAVIIYLLAMLFIGVYFTKRASQ

SEQ ID NO: 1590288 - protein, 25 aa, Staphylococcus aureus
PAITFVLVLLVFWGLGFEAKLYTLI

SEQ ID NO: 1590289 - protein, 25 aa, Staphylococcus aureus
PMKIMYLAEDYFRKHKIRSNANVIY

SEQ ID NO: 1590290 - protein, 18 aa, Staphylococcus aureus
PNKLPNAVFWLKTYPERL

SEQ ID NO: 1590291 - protein, 17 aa, Staphylococcus aureus
PVRLVSYSPVPEDHAYI

SEQ ID NO: 1590292 - protein, 35 aa, Staphylococcus aureus
SPFIVLTVIVMIWSAPFFKNLFLPNGALSSLVFKF

SEQ ID NO: 1590293 - protein, 23 aa, Staphylococcus aureus
VFIAFFSHLTIHLLPLFAVLGGA

SEQ ID NO: 1590294 - protein, 25 aa, Staphylococcus aureus
YGPKWLYIISVIVFSLSYLILVIVN

SEQ ID NO: 1590295 - protein, 23 aa, Staphylococcus aureus
YQGFTKIIIVLIVSPIIAFCVGF

SEQ ID NO: 1590296 - protein, 45 aa, Staphylococcus aureus
YVRKVGHTVFKWVAIGMTTLSVLLIAFLAFLYFSVMKHNERIEKG

SEQ ID NO: 1590297 - protein, 27 aa, Staphylococcus aureus
YYGLDLLNPSYFLISAFFISAVTSVAT

SEQ ID NO: 1590298 - protein, 23 aa, Staphylococcus aureus
AGFFPIMMFGIPAAALAMYHTAK

SEQ ID NO: 1590299 - protein, 60 aa, Staphylococcus aureus
ALLIPFVIMIITAIVLMGVWFIFNSLIALIASIVLVVMIIVSIILFRQALMKMDSYVDGL

SEQ ID NO: 1590300 - protein, 20 aa, Staphylococcus aureus
ATVKLLFLLVVSISAMVTYD

SEQ ID NO: 1590301 - protein, 35 aa, Staphylococcus aureus
DENGKYRFDNLDSGKYKVIFEKPAGLTQTGTNTTE

SEQ ID NO: 1590302 - protein, 22 aa, Staphylococcus aureus
DIETIIQKIYYAKNRHLGTYTP

SEQ ID NO: 1590303 - protein, 19 aa, Staphylococcus aureus
DIFIVGILSLFGITALLLV

SEQ ID NO: 1590304 - protein, 17 aa, Staphylococcus aureus
FGHYVAIEYVKDSDLPQ

SEQ ID NO: 1590305 - protein, 18 aa, Staphylococcus aureus
FKLQIIFVILKMSETKML

SEQ ID NO: 1590306 - protein, 18 aa, Staphylococcus aureus
FLIALIALLPVIILGFLG

SEQ ID NO: 1590307 - protein, 19 aa, Staphylococcus aureus
FNYIFLANLIMYVVFALVA

SEQ ID NO: 1590308 - protein, 48 aa, Staphylococcus aureus
GIVTLTQDAYSQKGAITLGTRIDSNKSFHFSGKVNLGNKYEGHGNGGD

SEQ ID NO: 1590309 - protein, 19 aa, Staphylococcus aureus
GSFVYIYFMQGVQGFDFDH

SEQ ID NO: 1590310 - protein, 17 aa, Staphylococcus aureus
GSLFFGLEFMGDAVKPL

SEQ ID NO: 1590311 - protein, 28 aa, Staphylococcus aureus
IAACIFLIVLFILYIWLPQDRNQVKQSD

SEQ ID NO: 1590312 - protein, 18 aa, Staphylococcus aureus
IAAIFYVSNWWYIAKDVN

SEQ ID NO: 1590313 - protein, 17 aa, Staphylococcus aureus
IGNLLLSAAIFLYIMLI

SEQ ID NO: 1590314 - protein, 20 aa, Staphylococcus aureus
IKFILNIILIRLSGIIGASI

SEQ ID NO: 1590315 - protein, 38 aa, Staphylococcus aureus
IVVALAVYLFRFVWVYVLYPYFYLAISPFQKMMTKNDD

SEQ ID NO: 1590316 - protein, 25 aa, Staphylococcus aureus
KTLWASLIITLLFTVIEFVGGLVSN

SEQ ID NO: 1590317 - protein, 24 aa, Staphylococcus aureus
KYAIDLLFIICVILGILGLIISLF

SEQ ID NO: 1590318 - protein, 19 aa, Staphylococcus aureus
LENVALLAAFIPIISGMSG

SEQ ID NO: 1590319 - protein, 30 aa, Staphylococcus aureus
LLVFVVFFTAATIIWFSYDKNKYGTKQYDK

SEQ ID NO: 1590320 - protein, 25 aa, Staphylococcus aureus
LVLTIMLVITLYFSYIIKALAQEIA

SEQ ID NO: 1590321 - protein, 17 aa, Staphylococcus aureus
NTFYFSALIFLVLAVFY

SEQ ID NO: 1590322 - protein, 18 aa, Staphylococcus aureus
NVYNGIPHLLIPVVTNPH

SEQ ID NO: 1590323 - protein, 17 aa, Staphylococcus aureus
PFMDFILPKILLRSPEK

SEQ ID NO: 1590324 - protein, 19 aa, Staphylococcus aureus
PFVIVSLNYPLFNLVDQFT

SEQ ID NO: 1590325 - protein, 38 aa, Staphylococcus aureus
PIMTAFYCTFLVVILLFLWPLLYSWIVKFGESIVGLGS

SEQ ID NO: 1590326 - protein, 21 aa, Staphylococcus aureus
QETWRGDYLVKQLSQNPQLKK

SEQ ID NO: 1590327 - protein, 21 aa, Staphylococcus aureus
QRLHFYAAIFIAPLLITLTIS

SEQ ID NO: 1590328 - protein, 24 aa, Staphylococcus aureus
RIAVSILIIFILVSGLSMFVDQLP

SEQ ID NO: 1590329 - protein, 26 aa, Staphylococcus aureus
SETGELIFKFYRHCFRYNEINLKIQD

SEQ ID NO: 1590330 - protein, 21 aa, Staphylococcus aureus
SMLNGTLPRFSLGTMWKDIKS

SEQ ID NO: 1590331 - protein, 22 aa, Staphylococcus aureus
TFPGINKWLIPIGTSPIKGILA

SEQ ID NO: 1590332 - protein, 22 aa, Staphylococcus aureus
TITFIFITILMTIAFGLNGFFW

SEQ ID NO: 1590333 - protein, 25 aa, Staphylococcus aureus
TKAGVFPMFVWLPSAYYAPPIPIIA

SEQ ID NO: 1590334 - protein, 21 aa, Staphylococcus aureus
VLYIVIMVMSVFIIGCDKSSD

SEQ ID NO: 1590335 - protein, 23 aa, Staphylococcus aureus
VSLCFLFICIYLNMAIGSSKINF

SEQ ID NO: 1590336 - protein, 17 aa, Staphylococcus aureus
WFAGFYNYATSTLISLF

SEQ ID NO: 1590337 - protein, 17 aa, Staphylococcus aureus
YGLLYAPLVITGLHHMF

SEQ ID NO: 1590338 - protein, 20 aa, Staphylococcus aureus
YQGFTKIIIVLIVSPIIAFC

SEQ ID NO: 1590339 - protein, 22 aa, Staphylococcus aureus
AFIILIVLAIYFFIKKLFSRNA

SEQ ID NO: 1590340 - protein, 17 aa, Staphylococcus aureus
AKDVWINGFTPQYTMSV

SEQ ID NO: 1590341 - protein, 18 aa, Staphylococcus aureus
ALGWNYWFNWVVTVAADI

SEQ ID NO: 1590342 - protein, 22 aa, Staphylococcus aureus
ALITSYIPFLAPFQLVVRAQTS

SEQ ID NO: 1590343 - protein, 33 aa, Staphylococcus aureus
CLTIITMVLCGFLFPLAITLIGQIFFYQQANGS

SEQ ID NO: 1590344 - protein, 24 aa, Staphylococcus aureus
EMMRIYKDVDTFVVISHLGIDPST

SEQ ID NO: 1590345 - protein, 29 aa, Staphylococcus aureus
FAWQMSGILLWIYIIVIICLLFTGQPSVF

SEQ ID NO: 1590346 - protein, 38 aa, Staphylococcus aureus
FDEQVKWIFNLIRIVLPIIIIFIVFIVLYSVAPNVKTK

SEQ ID NO: 1590347 - protein, 20 aa, Staphylococcus aureus
FITMSLIGILLFLVPIPVEQ

SEQ ID NO: 1590348 - protein, 32 aa, Staphylococcus aureus
GADNMTLDSGFYKTPKYNLGNYVWEDTNKDGK

SEQ ID NO: 1590349 - protein, 30 aa, Staphylococcus aureus
GKDDMSLDTGFYKEPKYNLGDYVWEDTNKD

SEQ ID NO: 1590350 - protein, 31 aa, Staphylococcus aureus
GKDLPIPAFKLPLYPVLPAITFVLVLLVFWG

SEQ ID NO: 1590351 - protein, 23 aa, Staphylococcus aureus
GKKHVIPKSQYRRKRREFFHNED

SEQ ID NO: 1590352 - protein, 26 aa, Staphylococcus aureus
GNPGKAIAIVLLVLQIAGGGGTFPIQ

SEQ ID NO: 1590353 - protein, 20 aa, Staphylococcus aureus
HHHDFLHYKLGIANVEKSFK

SEQ ID NO: 1590354 - protein, 24 aa, Staphylococcus aureus
IHDIQPMPTLLMYGTKDLIVDTRA

SEQ ID NO: 1590355 - protein, 17 aa, Staphylococcus aureus
IILCLTLSIMTPYAQAA

SEQ ID NO: 1590356 - protein, 17 aa, Staphylococcus aureus
IKPILYLLKGNLKKQMF

SEQ ID NO: 1590357 - protein, 26 aa, Staphylococcus aureus
IQDHQGYWFLRFRAALVPVANLGSSL

SEQ ID NO: 1590358 - protein, 21 aa, Staphylococcus aureus
IYFVILMVLPLWAQHKVKSNY

SEQ ID NO: 1590359 - protein, 26 aa, Staphylococcus aureus
KDGSLLKYTEMKWLTPDGHYIHGKGI

SEQ ID NO: 1590360 - protein, 30 aa, Staphylococcus aureus
KDNDTIDSGFYKPTYNLGDYVWEDTNKNGV

SEQ ID NO: 1590361 - protein, 29 aa, Staphylococcus aureus
KHYAMYLFSLFFSIVLYFSFTTLQFTKGV

SEQ ID NO: 1590362 - protein, 29 aa, Staphylococcus aureus
KSIIAIISLGILTYTTMIGSVLADEIKYP

SEQ ID NO: 1590363 - protein, 42 aa, Staphylococcus aureus
KVGHTVFKWVAIGMTTLSVLLIAFLAFLYFSVMKHNERIEKG

SEQ ID NO: 1590364 - protein, 36 aa, Staphylococcus aureus
LAKIQLWFLIKGLTPIFFFLIFTLMMHIFLTKGGYV

SEQ ID NO: 1590365 - protein, 26 aa, Staphylococcus aureus
LIILVIITLFILLFIELVEVRIPYID

SEQ ID NO: 1590366 - protein, 19 aa, Staphylococcus aureus
LLHVIGFSFLWIAGKDHHI

SEQ ID NO: 1590367 - protein, 17 aa, Staphylococcus aureus
MMFNMFIMVFLSNSLYP

SEQ ID NO: 1590368 - protein, 18 aa, Staphylococcus aureus
MTILAILVLIIPLNMLIS

SEQ ID NO: 1590369 - protein, 40 aa, Staphylococcus aureus
NICTVIWIVLVIILSFKFLKALLYLKYLKKQSLYLNENEK

SEQ ID NO: 1590370 - protein, 23 aa, Staphylococcus aureus
PQFIRMAIVVTLLIPFMLILVGA

SEQ ID NO: 1590371 - protein, 21 aa, Staphylococcus aureus
RGEFLHMLLGVFLAALVSFVV

SEQ ID NO: 1590372 - protein, 24 aa, Staphylococcus aureus
RSMYIFKKDLLPKMYWYGMLKGLI

SEQ ID NO: 1590373 - protein, 25 aa, Staphylococcus aureus
SGKKQSLVFYHLKLDVEFASILGLT

SEQ ID NO: 1590374 - protein, 17 aa, Staphylococcus aureus
SHVDIKSELGYEGGQNS

SEQ ID NO: 1590375 - protein, 33 aa, Staphylococcus aureus
SLHTKLVIVYVLLIIIGMQIIGLYFTNNLEKEL

SEQ ID NO: 1590376 - protein, 24 aa, Staphylococcus aureus
TKAGVFPMFVWLPSAYYAPPIPII

SEQ ID NO: 1590377 - protein, 24 aa, Staphylococcus aureus
TSYIALFYFIVMATIFVGLISVTF

SEQ ID NO: 1590378 - protein, 17 aa, Staphylococcus aureus
TWFIISFIIFHLILFIM

SEQ ID NO: 1590379 - protein, 17 aa, Staphylococcus aureus
VIGIALISLVFLPGIFY

SEQ ID NO: 1590380 - protein, 28 aa, Staphylococcus aureus
VTLKELDHIIRFAHISYGLYMGEHLPKG

SEQ ID NO: 1590381 - protein, 24 aa, Staphylococcus aureus
WNATKSIFGFLFNSVKSIFTNMKN

SEQ ID NO: 1590382 - protein, 30 aa, Staphylococcus aureus
WNVMFYGMFIIGIIAILVGFVWFKLYQYTT

SEQ ID NO: 1590383 - protein, 18 aa, Staphylococcus aureus
YFLGGLLSSLLLLVFGVF

SEQ ID NO: 1590384 - protein, 19 aa, Staphylococcus aureus
YGWFAGFYNYATSTLISLF

SEQ ID NO: 1590385 - protein, 22 aa, Staphylococcus aureus
YNQILYIALIQFLGLLIGLFLY

SEQ ID NO: 1590386 - protein, 28 aa, Staphylococcus aureus
AAIFTVLFLFLFIFGIISIILGAIGMFK

SEQ ID NO: 1590387 - protein, 20 aa, Staphylococcus aureus
ATGVLLSFAWPPIQDGLNSL

SEQ ID NO: 1590388 - protein, 31 aa, Staphylococcus aureus
AVGIGGLSNAFGFKLDTYHNTSKPNSAAKAN

SEQ ID NO: 1590389 - protein, 17 aa, Staphylococcus aureus
AYIRFPVSDGTQELKIV

SEQ ID NO: 1590390 - protein, 25 aa, Staphylococcus aureus
DKAIQSINQALANKLKEIEASNATD

SEQ ID NO: 1590391 - protein, 26 aa, Staphylococcus aureus
DLVGFKWMYLICGMLVIVIMIMSLLK

SEQ ID NO: 1590392 - protein, 19 aa, Staphylococcus aureus
DMLHVTPPMGPLDVVKEST

SEQ ID NO: 1590393 - protein, 24 aa, Staphylococcus aureus
DNKYDMLMKAFQIDASVNPGNSGG

SEQ ID NO: 1590394 - protein, 23 aa, Staphylococcus aureus
DRKNTVLYLMHYHKRITDKQWED

SEQ ID NO: 1590395 - protein, 19 aa, Staphylococcus aureus
EGILKLFEPLFTAADGWIG

SEQ ID NO: 1590396 - protein, 20 aa, Staphylococcus aureus
FLHNIIFDVARHHRPDQAHM

SEQ ID NO: 1590397 - protein, 23 aa, Staphylococcus aureus
GAILTIIILYFLTNGISLNHAKN

SEQ ID NO: 1590398 - protein, 20 aa, Staphylococcus aureus
GSKESQLTEALFAEKPVAKN

SEQ ID NO: 1590399 - protein, 30 aa, Staphylococcus aureus
GYGIIYFGPLFFYLNLIANIFFAFLSEYII

SEQ ID NO: 1590400 - protein, 57 aa, Staphylococcus aureus
HDSLANEKTRVRLYKSGKNWVKSGIKEIEMFKIMGLPFISHSLVSQDNQSISKKMTG

SEQ ID NO: 1590401 - protein, 35 aa, Staphylococcus aureus
HGNGGDGIGFAFSPGVLGETGLNGAAVGIGGLSNA

SEQ ID NO: 1590402 - protein, 17 aa, Staphylococcus aureus
HWTNMFLIALIVVFTLP

SEQ ID NO: 1590403 - protein, 19 aa, Staphylococcus aureus
IEFAFMFVAPILYVVHALL

SEQ ID NO: 1590404 - protein, 17 aa, Staphylococcus aureus
IIIAIPTIGQERLKEIN

SEQ ID NO: 1590405 - protein, 24 aa, Staphylococcus aureus
IKPEHFHLMYLLEQHSPYFIDAEL

SEQ ID NO: 1590406 - protein, 18 aa, Staphylococcus aureus
ITGFLTTVFIFALSLFTV

SEQ ID NO: 1590407 - protein, 18 aa, Staphylococcus aureus
KFMVPILAGYIAVSIADK

SEQ ID NO: 1590408 - protein, 18 aa, Staphylococcus aureus
KKRYKGIEYLIIKEPITT

SEQ ID NO: 1590409 - protein, 25 aa, Staphylococcus aureus
KNIRDMKMWVLGLVGTIFGSLIIAL

SEQ ID NO: 1590410 - protein, 19 aa, Staphylococcus aureus
KRDVFIFNKKVNGYHVWIK

SEQ ID NO: 1590411 - protein, 17 aa, Staphylococcus aureus
LHYKLGIANVEKSFKLD

SEQ ID NO: 1590412 - protein, 19 aa, Staphylococcus aureus
LNVYNGIPHLLIPVVTNPH

SEQ ID NO: 1590413 - protein, 32 aa, Staphylococcus aureus
LTIITMVLCGFLFPLAITLIGQIFFYQQANGS

SEQ ID NO: 1590414 - protein, 17 aa, Staphylococcus aureus
LVIEIVILELIIGAILT

SEQ ID NO: 1590415 - protein, 17 aa, Staphylococcus aureus
NKLPNAVFWLKTYPERL

SEQ ID NO: 1590416 - protein, 23 aa, Staphylococcus aureus
PLQLTFFILLLMSHSLLKQISLK

SEQ ID NO: 1590417 - protein, 22 aa, Staphylococcus aureus
SKNYLVMIPLTFIIGADLLLLS

SEQ ID NO: 1590418 - protein, 18 aa, Staphylococcus aureus
SLDQVLASYLKTANLAKY

SEQ ID NO: 1590419 - protein, 23 aa, Staphylococcus aureus
TINFFVNFIVYLCMYLLLVVIAG

SEQ ID NO: 1590420 - protein, 23 aa, Staphylococcus aureus
TLQLPLILKIILNLALIGIVIIV

SEQ ID NO: 1590421 - protein, 29 aa, Staphylococcus aureus
VFSVHPMLSLFFFYSAFAVPFTFKNNVKK

SEQ ID NO: 1590422 - protein, 20 aa, Staphylococcus aureus
VPEDHAYIRFPVSDGTQELK

SEQ ID NO: 1590423 - protein, 17 aa, Staphylococcus aureus
WLIPIGTSPIKGILAID

SEQ ID NO: 1590424 - protein, 20 aa, Staphylococcus aureus
YMIFFAFFSIYYFLTGKSDE

SEQ ID NO: 1590425 - protein, 18 aa, Staphylococcus aureus
YVVPPSRLINEIPYAMKQ

SEQ ID NO: 1590426 - protein, 28 aa, Staphylococcus aureus
YYGLDLLNPSYFLISAFFISAVTSVATG

SEQ ID NO: 1590427 - protein, 20 aa, Staphylococcus aureus
ARIYFVIFQWPYYAENPSEI

SEQ ID NO: 1590428 - protein, 20 aa, Staphylococcus aureus
AVTQVRYVDVTTGKDIIPPK

SEQ ID NO: 1590429 - protein, 17 aa, Staphylococcus aureus
CINGIITSILLNAKPHE

SEQ ID NO: 1590430 - protein, 24 aa, Staphylococcus aureus
DDPKLAFSIVYTNQPVPPPWLTGG

SEQ ID NO: 1590431 - protein, 18 aa, Staphylococcus aureus
DVELPLALPLIIGGIRLS

SEQ ID NO: 1590432 - protein, 25 aa, Staphylococcus aureus
FIAWSLLYSVVVLILLVFANGYWSI

SEQ ID NO: 1590433 - protein, 17 aa, Staphylococcus aureus
FRCLVVVLVFVGAVVKT

SEQ ID NO: 1590434 - protein, 24 aa, Staphylococcus aureus
GLNVLFVMLFQLALALLFLIIAYA

SEQ ID NO: 1590435 - protein, 34 aa, Staphylococcus aureus
GSDTLKIFILIVIVWILVFILMGAGLKQVNLLQK

SEQ ID NO: 1590436 - protein, 21 aa, Staphylococcus aureus
HLHYGYYICLAVMFVIAVVLI

SEQ ID NO: 1590437 - protein, 25 aa, Staphylococcus aureus
HRPDQAHMYLFDFGTNGLMPVTDIP

SEQ ID NO: 1590438 - protein, 23 aa, Staphylococcus aureus
IALLYVLLSPTHPLALIVGIILL

SEQ ID NO: 1590439 - protein, 31 aa, Staphylococcus aureus
IFNYALAYGIIFLMFFIVLNYASQIAMEIAS

SEQ ID NO: 1590440 - protein, 18 aa, Staphylococcus aureus
ITALLLVVALPIYTVASY

SEQ ID NO: 1590441 - protein, 19 aa, Staphylococcus aureus
KCGGAPMKIMYLAEDYFRK

SEQ ID NO: 1590442 - protein, 40 aa, Staphylococcus aureus
KDFLTQWKLYIISAVVLIMVLIGFIFWRQDDYTSRNFENK

SEQ ID NO: 1590443 - protein, 29 aa, Staphylococcus aureus
KDNLSADLGIYKPKYNLGDYVWEDTNKNG

SEQ ID NO: 1590444 - protein, 48 aa, Staphylococcus aureus
KHTYQNEPLPNRKDFVVSFITGALVGSALGLYFKNKVYQKADDLKVKE

SEQ ID NO: 1590445 - protein, 27 aa, Staphylococcus aureus
KQNIVVFFIFIIFQLKDFDYTNPESYL

SEQ ID NO: 1590446 - protein, 35 aa, Staphylococcus aureus
LMIPDLSSDFTLFDFTYDLPLSTYLGQVLNMNAKV

SEQ ID NO: 1590447 - protein, 20 aa, Staphylococcus aureus
LMWGSLLFHLGIIPVFFGHV

SEQ ID NO: 1590448 - protein, 35 aa, Staphylococcus aureus
LNLAAIIIISIVVSGGMFLAMKWEQIHLKDGLKKV

SEQ ID NO: 1590449 - protein, 18 aa, Staphylococcus aureus
LWIPVFSITFSLITLITV

SEQ ID NO: 1590450 - protein, 26 aa, Staphylococcus aureus
MENHFECLWDLFRSIPSLEIDNASVL

SEQ ID NO: 1590451 - protein, 23 aa, Staphylococcus aureus
MMRIYKDVDTFVVISHLGIDPST

SEQ ID NO: 1590452 - protein, 28 aa, Staphylococcus aureus
PKNNSRTLIFPYIPDKAVYNAIVKVVVA

SEQ ID NO: 1590453 - protein, 26 aa, Staphylococcus aureus
QASWRVPFIIIVGIALVAFVFGLVSI

SEQ ID NO: 1590454 - protein, 20 aa, Staphylococcus aureus
QETWRGDYLVKQLSQNPQLK

SEQ ID NO: 1590455 - protein, 19 aa, Staphylococcus aureus
QLALALLFLIIAYASYKKY

SEQ ID NO: 1590456 - protein, 18 aa, Staphylococcus aureus
RIIFVVVLVPFISYFFHD

SEQ ID NO: 1590457 - protein, 19 aa, Staphylococcus aureus
RLVIEIVILELIIGAILTL

SEQ ID NO: 1590458 - protein, 27 aa, Staphylococcus aureus
RYTFEVYRFDYPITFIVSILTSILTSA

SEQ ID NO: 1590459 - protein, 20 aa, Staphylococcus aureus
SKPESQAERLANAAKQKQAK

SEQ ID NO: 1590460 - protein, 25 aa, Staphylococcus aureus
SSRFIKWLNDMNIIPGYYGVNSIDL

SEQ ID NO: 1590461 - protein, 25 aa, Staphylococcus aureus
STTTFTINVVDTTAPTVTPIGDQSS

SEQ ID NO: 1590462 - protein, 21 aa, Staphylococcus aureus
SVLDEFYWLNKEDPNYSRCRV

SEQ ID NO: 1590463 - protein, 32 aa, Staphylococcus aureus
TFFKFFIGILLLNLIIILFKTPVGYLISFNTQ

SEQ ID NO: 1590464 - protein, 17 aa, Staphylococcus aureus
TKERVEGFLNKSKNEQA

SEQ ID NO: 1590465 - protein, 23 aa, Staphylococcus aureus
TNRVILFIFRCLVVVLVFVGAVV

SEQ ID NO: 1590466 - protein, 18 aa, Staphylococcus aureus
TVEPATVIFTKTGPIIEL

SEQ ID NO: 1590467 - protein, 26 aa, Staphylococcus aureus
TVIGLILLSLTFLPEMWYIVSSIVGY

SEQ ID NO: 1590468 - protein, 19 aa, Staphylococcus aureus
VFITPVILTLVLSFGLSAF

SEQ ID NO: 1590469 - protein, 22 aa, Staphylococcus aureus
VIFIGTYIYMRLITSIFSHPTP

SEQ ID NO: 1590470 - protein, 23 aa, Staphylococcus aureus
VKGDTFKITVPKELNLNGVTSTA

SEQ ID NO: 1590471 - protein, 24 aa, Staphylococcus aureus
VYDVLGFLRLVFIPAMIVFFQDST

SEQ ID NO: 1590472 - protein, 23 aa, Staphylococcus aureus
YGYTLLFVILISSLSAMLLQSMT

SEQ ID NO: 1590473 - protein, 18 aa, Staphylococcus aureus
YLWVFALILFIMRLAKIQ

SEQ ID NO: 1590474 - protein, 21 aa, Staphylococcus aureus
ALITWFYTMLWSIVGVVWIVF

SEQ ID NO: 1590475 - protein, 30 aa, Staphylococcus aureus
ALVLTILMLIIAYILILFQSSLFLKRRSIL

SEQ ID NO: 1590476 - protein, 23 aa, Staphylococcus aureus
ARLITEFILLIWRFVDITKINVK

SEQ ID NO: 1590477 - protein, 19 aa, Staphylococcus aureus
ATVKLLFLLVVSISAMVTY

SEQ ID NO: 1590478 - protein, 32 aa, Staphylococcus aureus
AYLLALGVILLLLLIFIGIKYLSFVKTISQQQ

SEQ ID NO: 1590479 - protein, 26 aa, Staphylococcus aureus
CIVGAIFVISYLYWYCKKIKKDPKAS

SEQ ID NO: 1590480 - protein, 20 aa, Staphylococcus aureus
DVMIIFLREGLEVLLIVMTL

SEQ ID NO: 1590481 - protein, 18 aa, Staphylococcus aureus
DYHYFFFSDGFYITISIL

SEQ ID NO: 1590482 - protein, 25 aa, Staphylococcus aureus
EKPVAKNDLKEIPQLVTKKNDVSET

SEQ ID NO: 1590483 - protein, 18 aa, Staphylococcus aureus
FLALSAYILWGILPIYWQ

SEQ ID NO: 1590484 - protein, 17 aa, Staphylococcus aureus
FLSLILSLTQFTPFTLA

SEQ ID NO: 1590485 - protein, 25 aa, Staphylococcus aureus
FVVSFLLVNLLIKPFLVFSTYVIKS

SEQ ID NO: 1590486 - protein, 21 aa, Staphylococcus aureus
GEIFIYGDIVSDKWFESDVTA

SEQ ID NO: 1590487 - protein, 18 aa, Staphylococcus aureus
GFVMALGFIIQKFSMRYL

SEQ ID NO: 1590488 - protein, 25 aa, Staphylococcus aureus
IGGSLWIIVYLIVLSILSFIGSKEF

SEQ ID NO: 1590489 - protein, 28 aa, Staphylococcus aureus
IGLHPFAVFFPIIALLIIYYMIRFKMRA

SEQ ID NO: 1590490 - protein, 25 aa, Staphylococcus aureus
IHDIQPMPTLLMYGTKDLIVDTRAI

SEQ ID NO: 1590491 - protein, 24 aa, Staphylococcus aureus
ILAFRIIFSVIFMIFILAVGQKQR

SEQ ID NO: 1590492 - protein, 18 aa, Staphylococcus aureus
IVIGLIALLAWPMSASTG

SEQ ID NO: 1590493 - protein, 33 aa, Staphylococcus aureus
IVSFCFIFLLLLFFRYILKRYFNYMLNYKVWYL

SEQ ID NO: 1590494 - protein, 37 aa, Staphylococcus aureus
IVVALAVYLFRFVWVYVLYPYFYLAISPFQKMMTKND

SEQ ID NO: 1590495 - protein, 19 aa, Staphylococcus aureus
KAIIFAALFILIGFYDGFV

SEQ ID NO: 1590496 - protein, 22 aa, Staphylococcus aureus
KQMGYVYFSWLLGLLVGMVFMN

SEQ ID NO: 1590497 - protein, 43 aa, Staphylococcus aureus
KRLPDTGDSIKQNGLLGGVMTLLVGLGLMKRKKKKDENDQDDS

SEQ ID NO: 1590498 - protein, 24 aa, Staphylococcus aureus
KTGPIIELGLKTASTWKKFEVYEG

SEQ ID NO: 1590499 - protein, 21 aa, Staphylococcus aureus
LLKIAIILYIPFMISKKMPRV

SEQ ID NO: 1590500 - protein, 19 aa, Staphylococcus aureus
LNYYVVYLLLLKLLHIEYM

SEQ ID NO: 1590501 - protein, 21 aa, Staphylococcus aureus
MSIQLIEIYKLAIPLIIIVLV

SEQ ID NO: 1590502 - protein, 24 aa, Staphylococcus aureus
MTATQLLLLVFFSSTFTACSVTMT

SEQ ID NO: 1590503 - protein, 24 aa, Staphylococcus aureus
NLHKPFFYISYSIWFFLGCLIYFS

SEQ ID NO: 1590504 - protein, 17 aa, Staphylococcus aureus
NLRNSFSSLTFQRNLFS

SEQ ID NO: 1590505 - protein, 32 aa, Staphylococcus aureus
PEIELGLQSGQFWRKFEVYEGDKKLPIKLVSY

SEQ ID NO: 1590506 - protein, 34 aa, Staphylococcus aureus
PFIVLTVIVMIWSAPFFKNLFLPNGALSSLVFKF

SEQ ID NO: 1590507 - protein, 23 aa, Staphylococcus aureus
QIGPKRLLFIGLIALIITQLLYF

SEQ ID NO: 1590508 - protein, 20 aa, Staphylococcus aureus
QTIRDFYINPTAISTLAEAI

SEQ ID NO: 1590509 - protein, 20 aa, Staphylococcus aureus
QWIALAVFSILLFLGCTWSI

SEQ ID NO: 1590510 - protein, 28 aa, Staphylococcus aureus
RIENDFPHPFKKLIRWSNGIAAGADIQI

SEQ ID NO: 1590511 - protein, 23 aa, Staphylococcus aureus
RSVLWEHIIQLKMPFFDKNESGQ

SEQ ID NO: 1590512 - protein, 18 aa, Staphylococcus aureus
SAPLFYGMGTMLYSFYAH

SEQ ID NO: 1590513 - protein, 21 aa, Staphylococcus aureus
TLILLMLVVTLFFLNNSRYFN

SEQ ID NO: 1590514 - protein, 17 aa, Staphylococcus aureus
TSPFIILFLTVVGAYLF

SEQ ID NO: 1590515 - protein, 26 aa, Staphylococcus aureus
TTKILFLIKLIFSSLLLFISTIMLAD

SEQ ID NO: 1590516 - protein, 23 aa, Staphylococcus aureus
TYLALTIIGAYAALFILKTIDSH

SEQ ID NO: 1590517 - protein, 33 aa, Staphylococcus aureus
VITVVVLLAIGIAGFYFWNKTTSYITTDNAKVN

SEQ ID NO: 1590518 - protein, 17 aa, Staphylococcus aureus
WFVSLVVFIIGFIVSLT

SEQ ID NO: 1590519 - protein, 17 aa, Staphylococcus aureus
WNYWFNWVVTVAADITI

SEQ ID NO: 1590520 - protein, 18 aa, Staphylococcus aureus
YDSIGILMFILLSTVIGA

SEQ ID NO: 1590521 - protein, 18 aa, Staphylococcus aureus
YFFSAIFGFLTLGLLNIG

SEQ ID NO: 1590522 - protein, 20 aa, Staphylococcus aureus
ACWTIFMILSGTYLLIKKHL

SEQ ID NO: 1590523 - protein, 18 aa, Staphylococcus aureus
AIYWAMWPTTAEVILIII

SEQ ID NO: 1590524 - protein, 59 aa, Staphylococcus aureus
ALLIPFVIMIITAIVLMGVWFIFNSLIALIASIVLVVMIIVSIVLFRQALMKMDSYVDG

SEQ ID NO: 1590525 - protein, 18 aa, Staphylococcus aureus
AVPLLTLIYPVSIALVLI

SEQ ID NO: 1590526 - protein, 23 aa, Staphylococcus aureus
DGTQQFYHYASSVKPARVIFTDS

SEQ ID NO: 1590527 - protein, 28 aa, Staphylococcus aureus
DVVAKATYDILTKTYTFVFTDYVNNKEN

SEQ ID NO: 1590528 - protein, 26 aa, Staphylococcus aureus
EANAMLFFLIPFFASAIFNTQFTLFN

SEQ ID NO: 1590529 - protein, 26 aa, Staphylococcus aureus
EKPMANVLVTLTYPDGTTKSVRTDAN

SEQ ID NO: 1590530 - protein, 23 aa, Staphylococcus aureus
ELNKIQDKLPEKLKAEYKKKLEE

SEQ ID NO: 1590531 - protein, 21 aa, Staphylococcus aureus
EPKKYIIPWALLGFALVMIYQ

SEQ ID NO: 1590532 - protein, 18 aa, Staphylococcus aureus
FILPIITFIIFLGIWEMV

SEQ ID NO: 1590533 - protein, 21 aa, Staphylococcus aureus
FVYVLPLISILGGITAALIIF

SEQ ID NO: 1590534 - protein, 26 aa, Staphylococcus aureus
GFDVSWGEWFLYAAPWSIVMSIALYF

SEQ ID NO: 1590535 - protein, 31 aa, Staphylococcus aureus
GGIHEIYFPYVLMRPLLFIAVILGGMTGVAT

SEQ ID NO: 1590536 - protein, 23 aa, Staphylococcus aureus
GIFAIIIFVFFTISILIQKWQRG

SEQ ID NO: 1590537 - protein, 26 aa, Staphylococcus aureus
GSIGTFIMALFYFVSVSVQLYQMKIS

SEQ ID NO: 1590538 - protein, 20 aa, Staphylococcus aureus
GSIYLFMGLAIFCFVMYIAF

SEQ ID NO: 1590539 - protein, 25 aa, Staphylococcus aureus
GYHAGFLFALLITVISFFCSFMLQG

SEQ ID NO: 1590540 - protein, 18 aa, Staphylococcus aureus
HYYWKFVSILLISILIES

SEQ ID NO: 1590541 - protein, 26 aa, Staphylococcus aureus
IFSIIALILCLFLQSNKKAKATAQKI

SEQ ID NO: 1590542 - protein, 17 aa, Staphylococcus aureus
IIITFLIVLINLIVTFP

SEQ ID NO: 1590543 - protein, 48 aa, Staphylococcus aureus
IILRKSKLTTFLSWLTLCLCIAIALILYALPYLILGSNNWSFVLTWLP

SEQ ID NO: 1590544 - protein, 19 aa, Staphylococcus aureus
IISYFLLITLKKRGILQRF

SEQ ID NO: 1590545 - protein, 17 aa, Staphylococcus aureus
ITLIYALIAFAVIAVVY

SEQ ID NO: 1590546 - protein, 25 aa, Staphylococcus aureus
IVGKVSFRFWPFSEFKYNFNPENTK

SEQ ID NO: 1590547 - protein, 17 aa, Staphylococcus aureus
IVSSIVGYLLFGTGLGL

SEQ ID NO: 1590548 - protein, 22 aa, Staphylococcus aureus
KDTTFIRDIPKKTIFTEFDPDK

SEQ ID NO: 1590549 - protein, 19 aa, Staphylococcus aureus
KKTTSLLGLLLGALAGLVV

SEQ ID NO: 1590550 - protein, 21 aa, Staphylococcus aureus
KNIKTIKIGLSALGYKVDNES

SEQ ID NO: 1590551 - protein, 21 aa, Staphylococcus aureus
KPTILPIIPLLGISLGSLIGG

SEQ ID NO: 1590552 - protein, 28 aa, Staphylococcus aureus
KRLLPPNYKYLIPFTALTGAILMIISDI

SEQ ID NO: 1590553 - protein, 18 aa, Staphylococcus aureus
KVASFAMRLLLGSTLASI

SEQ ID NO: 1590554 - protein, 23 aa, Staphylococcus aureus
LGGFVLFFLMKYAHVMTPEMTQA

SEQ ID NO: 1590555 - protein, 20 aa, Staphylococcus aureus
LICVTSGFIGLILGVVFATI

SEQ ID NO: 1590556 - protein, 23 aa, Staphylococcus aureus
LLLFSFVVFFFIYGMVSGASALE

SEQ ID NO: 1590557 - protein, 17 aa, Staphylococcus aureus
LMVALRFLQGVTGGAAA

SEQ ID NO: 1590558 - protein, 26 aa, Staphylococcus aureus
LNLSLTMIFLILTYFKEVKLYKHFDK

SEQ ID NO: 1590559 - protein, 23 aa, Staphylococcus aureus
LNMKYYLIRTIPVSIIALLYVLL

SEQ ID NO: 1590560 - protein, 21 aa, Staphylococcus aureus
LNWVAVIIYLLAMLLIGVYFT

SEQ ID NO: 1590561 - protein, 26 aa, Staphylococcus aureus
LPGMIPWFMILFSHLRFRKLHPEEVE

SEQ ID NO: 1590562 - protein, 18 aa, Staphylococcus aureus
LVIPVLPVYLKDLGLTGS

SEQ ID NO: 1590563 - protein, 21 aa, Staphylococcus aureus
MLLGTFIVIIGIALISLVFLP

SEQ ID NO: 1590564 - protein, 26 aa, Staphylococcus aureus
NERYILIHDLLKPTILPIIPLLGISL

SEQ ID NO: 1590565 - protein, 32 aa, Staphylococcus aureus
NNKKVLFISFLIIGLYMFIEIIGGLLANSLAL

SEQ ID NO: 1590566 - protein, 25 aa, Staphylococcus aureus
PLEFTFLFIAPYLFVLHAVLAASMD

SEQ ID NO: 1590567 - protein, 24 aa, Staphylococcus aureus
QGWIWTVTLVGLITLFWASLNATK

SEQ ID NO: 1590568 - protein, 22 aa, Staphylococcus aureus
QRLHFYAAIFIAPLLITLTISG

SEQ ID NO: 1590569 - protein, 24 aa, Staphylococcus aureus
RDIGFIFLYIFLVNILPIIIVFLT

SEQ ID NO: 1590570 - protein, 18 aa, Staphylococcus aureus
RTGLYIIDSQLLKGHVYN

SEQ ID NO: 1590571 - protein, 21 aa, Staphylococcus aureus
RVKYILIPYILMGLFYSYSES

SEQ ID NO: 1590572 - protein, 32 aa, Staphylococcus aureus
SFMPVIIVIIVYTLIYIVFALIAFVHSNKLIK

SEQ ID NO: 1590573 - protein, 24 aa, Staphylococcus aureus
SGTAWLMKLLPPVVVGPVIMVIGL

SEQ ID NO: 1590574 - protein, 28 aa, Staphylococcus aureus
SKGQYAKRFFFFATSCLVLTLVVVSSLS

SEQ ID NO: 1590575 - protein, 25 aa, Staphylococcus aureus
SVKKMTWILLYCFLGNILGGFVLFF

SEQ ID NO: 1590576 - protein, 25 aa, Staphylococcus aureus
TGSFMLFVLLIFGFDFLSAAGNAKV

SEQ ID NO: 1590577 - protein, 27 aa, Staphylococcus aureus
VGTASILVGTTLIFGLSGHEAKAAEHT

SEQ ID NO: 1590578 - protein, 25 aa, Staphylococcus aureus
VLSTFLFILLLYITYRKNKIVYAPI

SEQ ID NO: 1590579 - protein, 36 aa, Staphylococcus aureus
VNPHNAQRVTLKYKWKFGEGIKAGDYFDFTLSDNVE

SEQ ID NO: 1590580 - protein, 25 aa, Staphylococcus aureus
VSVQLYQMKISFLPALGFNQILLER

SEQ ID NO: 1590581 - protein, 33 aa, Staphylococcus aureus
VVIGLIFVAIYFFLFRFLILKFDIPLPGRKKTE

SEQ ID NO: 1590582 - protein, 17 aa, Staphylococcus aureus
WKQFALSVLIFAISQLI

SEQ ID NO: 1590583 - protein, 26 aa, Staphylococcus aureus
YFENVLFHKFIIIKVILALPMFILLT

SEQ ID NO: 1590584 - protein, 33 aa, Staphylococcus aureus
YFLKSRMNWIFWILFLNLLMLGISLIDYDFPID

SEQ ID NO: 1590585 - protein, 17 aa, Staphylococcus aureus
YIDFIEYYFYASMFIYI

SEQ ID NO: 1590586 - protein, 29 aa, Staphylococcus aureus
YLCYIPLFFLFIALYPFLVFIAQRPIFQF

SEQ ID NO: 1590587 - protein, 18 aa, Staphylococcus aureus
YLYLLVTNILSLTKLQSS

SEQ ID NO: 1590588 - protein, 24 aa, Staphylococcus aureus
ADYWRWWIVHLWVEGIFEAFAVVL

SEQ ID NO: 1590589 - protein, 50 aa, Staphylococcus aureus
AFAMLAAIIIVYLILVITFKGGLAPFTILFSLPFTVIGVIIALLITGETI

SEQ ID NO: 1590590 - protein, 35 aa, Staphylococcus aureus
AISAWLYPNFILDFIFIIIMLFLVSLTNIFTNYLN

SEQ ID NO: 1590591 - protein, 19 aa, Staphylococcus aureus
ALFIPMIIMFLLGAFTKSA

SEQ ID NO: 1590592 - protein, 19 aa, Staphylococcus aureus
ARIYFVIFQWPYYAENPGE

SEQ ID NO: 1590593 - protein, 21 aa, Staphylococcus aureus
DIDYVLSPIVNRPSLLDRLNK

SEQ ID NO: 1590594 - protein, 23 aa, Staphylococcus aureus
DNKYDMLMKAFQIDASVNPGNSG

SEQ ID NO: 1590595 - protein, 26 aa, Staphylococcus aureus
DNLPRFYLYLTLFMFSMLGIVLADNT

SEQ ID NO: 1590596 - protein, 45 aa, Staphylococcus aureus
DQVNFRTELYGYPERAYKSYYVYGGYRLTWDNGLVLYSNKADGNG

SEQ ID NO: 1590597 - protein, 24 aa, Staphylococcus aureus
DRKNTVLYLMHYHKRITDKQWEDA

SEQ ID NO: 1590598 - protein, 25 aa, Staphylococcus aureus
DYAKILPLTALLGGILVLVADMIAR

SEQ ID NO: 1590599 - protein, 25 aa, Staphylococcus aureus
EHLSQFFFWGAWLSSTDRPGKTFSY

SEQ ID NO: 1590600 - protein, 19 aa, Staphylococcus aureus
EILAFRIIFSAIFMIFILA

SEQ ID NO: 1590601 - protein, 23 aa, Staphylococcus aureus
FARTVLVILLLIPSIIVLSGQFD

SEQ ID NO: 1590602 - protein, 20 aa, Staphylococcus aureus
FISIEVILLLTLFIVHVNGK

SEQ ID NO: 1590603 - protein, 18 aa, Staphylococcus aureus
FIVSLYWHFLDVVWVFIF

SEQ ID NO: 1590604 - protein, 17 aa, Staphylococcus aureus
FMVIIGYGYIRIGLPKV

SEQ ID NO: 1590605 - protein, 18 aa, Staphylococcus aureus
FNYIFLANLIMYVVFALV

SEQ ID NO: 1590606 - protein, 22 aa, Staphylococcus aureus
FSTHKWMLYGILLTGPASMLAI

SEQ ID NO: 1590607 - protein, 26 aa, Staphylococcus aureus
FTHSILFIAIIAFLLQIIQTPNYYMA

SEQ ID NO: 1590608 - protein, 29 aa, Staphylococcus aureus
FVVLKSSLFFYYLFTKLSLISVLVLHLKQ

SEQ ID NO: 1590609 - protein, 22 aa, Staphylococcus aureus
GEQQFYHYASSVKPARVIFTDS

SEQ ID NO: 1590610 - protein, 22 aa, Staphylococcus aureus
GFDIILTMFMLSLAIIMTAGGA

SEQ ID NO: 1590611 - protein, 17 aa, Staphylococcus aureus
GIFMVIIGYGYIRIGLP

SEQ ID NO: 1590612 - protein, 21 aa, Staphylococcus aureus
GIPFWGLVVILTIITIFLVVR

SEQ ID NO: 1590613 - protein, 24 aa, Staphylococcus aureus
GIVILLVLIIGFKLNTFISLIITS

SEQ ID NO: 1590614 - protein, 24 aa, Staphylococcus aureus
GTASIILGSLVYIGADSQQVNAAT

SEQ ID NO: 1590615 - protein, 27 aa, Staphylococcus aureus
GYENPDLGTFFLMDTTSRIIGHDAREE

SEQ ID NO: 1590616 - protein, 17 aa, Staphylococcus aureus
HHYLIGMRKYYAQDIYH

SEQ ID NO: 1590617 - protein, 17 aa, Staphylococcus aureus
HRYFDRVIKKRYKGIDY

SEQ ID NO: 1590618 - protein, 17 aa, Staphylococcus aureus
IGEWGHILGWIDSHWWL

SEQ ID NO: 1590619 - protein, 29 aa, Staphylococcus aureus
IIAVSVSILIGLLFGWIPARAASKKELID

SEQ ID NO: 1590620 - protein, 24 aa, Staphylococcus aureus
IICRGLIIRILFRNHLFLGFIVST

SEQ ID NO: 1590621 - protein, 18 aa, Staphylococcus aureus
IYIQLVLFLIAATTIILI

SEQ ID NO: 1590622 - protein, 49 aa, Staphylococcus aureus
KHTYQNEPLPNRKDFVVSFITGALVGSALGLYFKNKVYQKADDLKVKEQ

SEQ ID NO: 1590623 - protein, 18 aa, Staphylococcus aureus
KISILFAVAFFIINYIGM

SEQ ID NO: 1590624 - protein, 20 aa, Staphylococcus aureus
KISVIFAVAFFIINYIGMEK

SEQ ID NO: 1590625 - protein, 24 aa, Staphylococcus aureus
KQNIVVFFIFVIFQLKDFDYTNPE

SEQ ID NO: 1590626 - protein, 31 aa, Staphylococcus aureus
KQTQFLQPILFLILGLFIVAIYLVIMLPMFQ

SEQ ID NO: 1590627 - protein, 25 aa, Staphylococcus aureus
KSAAMLIVLFLFIIFGIVACSTHVN

SEQ ID NO: 1590628 - protein, 44 aa, Staphylococcus aureus
KVEPHAGQRVVLKYKLKFADGLKRGDYFDFTLSNNVNTYGVSTA

SEQ ID NO: 1590629 - protein, 23 aa, Staphylococcus aureus
KVIIYFLVFFYILSHHINIDISK

SEQ ID NO: 1590630 - protein, 27 aa, Staphylococcus aureus
LGMAKEDIIGYYMLSVLSLEDEFKLEE

SEQ ID NO: 1590631 - protein, 20 aa, Staphylococcus aureus
LIVTSTLVFSSMPFQNAHAD

SEQ ID NO: 1590632 - protein, 24 aa, Staphylococcus aureus
LKSIVKCYLLIFLPVAFLCALIEI

SEQ ID NO: 1590633 - protein, 25 aa, Staphylococcus aureus
LLAVYLIIVIFSLLNYWSVKLLTSF

SEQ ID NO: 1590634 - protein, 26 aa, Staphylococcus aureus
LLFVGAIAIPLFYLASLFIMPNSHVT

SEQ ID NO: 1590635 - protein, 20 aa, Staphylococcus aureus
LLHVIGFSFLWIAGKDHHIL

SEQ ID NO: 1590636 - protein, 18 aa, Staphylococcus aureus
LLYFALMIIIISVAAKTI

SEQ ID NO: 1590637 - protein, 17 aa, Staphylococcus aureus
LMYVFWELTSVSSFLLI

SEQ ID NO: 1590638 - protein, 25 aa, Staphylococcus aureus
LNILLVLLYFVYLGLTIVMIVFLCF

SEQ ID NO: 1590639 - protein, 24 aa, Staphylococcus aureus
LPNESYIDYIKRVSKSKIWTSDDN

SEQ ID NO: 1590640 - protein, 20 aa, Staphylococcus aureus
LRQSFNIPALKAWQSVKQNA

SEQ ID NO: 1590641 - protein, 26 aa, Staphylococcus aureus
LSIIPIPYLYFIPTISTIYSLSVIIG

SEQ ID NO: 1590642 - protein, 19 aa, Staphylococcus aureus
LTILVIVFSILLVGGWYIF

SEQ ID NO: 1590643 - protein, 31 aa, Staphylococcus aureus
LVAMLLFSIFILYINHIFIAGTFYALDVYTI

SEQ ID NO: 1590644 - protein, 23 aa, Staphylococcus aureus
LVEYFNWRSLFHVVAPIAAVTFL

SEQ ID NO: 1590645 - protein, 18 aa, Staphylococcus aureus
LVIFWVATTWLAAGIYIV

SEQ ID NO: 1590646 - protein, 32 aa, Staphylococcus aureus
MAGIGCYFWNQLLLLFTIITVVIIGLFVIKGY

SEQ ID NO: 1590647 - protein, 17 aa, Staphylococcus aureus
MGLAIFCFVMYIAFGKY

SEQ ID NO: 1590648 - protein, 23 aa, Staphylococcus aureus
MITALFITVISVLLAFHLKQHYD

SEQ ID NO: 1590649 - protein, 18 aa, Staphylococcus aureus
MTLGIFMVIIGYGYIRIG

SEQ ID NO: 1590650 - protein, 20 aa, Staphylococcus aureus
MYLFLFIRSFIRGRDAFNII

SEQ ID NO: 1590651 - protein, 21 aa, Staphylococcus aureus
NAAKLNVQPTNNTFQDFDINY

SEQ ID NO: 1590652 - protein, 22 aa, Staphylococcus aureus
NCFICLILIIVFYIIGMNIQDF

SEQ ID NO: 1590653 - protein, 18 aa, Staphylococcus aureus
NILNWLFWEILDNNISIV

SEQ ID NO: 1590654 - protein, 22 aa, Staphylococcus aureus
NISFLFISIITFILSIINPNIS

SEQ ID NO: 1590655 - protein, 30 aa, Staphylococcus aureus
NIVTVLMTTLILLAFIFSAYRAWQMRHGKI

SEQ ID NO: 1590656 - protein, 22 aa, Staphylococcus aureus
NPVFIFIGVIIILIWLVLDIYR

SEQ ID NO: 1590657 - protein, 30 aa, Staphylococcus aureus
PIINILRSLPFIILLIAIVPFTKLVVGTSI

SEQ ID NO: 1590658 - protein, 24 aa, Staphylococcus aureus
PKANAFIVIILLLLAQIFYFYIII

SEQ ID NO: 1590659 - protein, 21 aa, Staphylococcus aureus
QFFWPAILAFVLTGIGLPLLG

SEQ ID NO: 1590660 - protein, 20 aa, Staphylococcus aureus
QFYLYYIVSAFLFWLVILTF

SEQ ID NO: 1590661 - protein, 17 aa, Staphylococcus aureus
QILFIVGMVLWVIILCR

SEQ ID NO: 1590662 - protein, 34 aa, Staphylococcus aureus
QSIIIIVVLLIKAIITWLLLIPIFNFMTSFVEST

SEQ ID NO: 1590663 - protein, 23 aa, Staphylococcus aureus
QTIRLMEEFLRNGNKEEIAYHKA

SEQ ID NO: 1590664 - protein, 18 aa, Staphylococcus aureus
REDEVIQWFYKEVDWFEA

SEQ ID NO: 1590665 - protein, 22 aa, Staphylococcus aureus
RELLLELSYFFRANLQGSKQHT

SEQ ID NO: 1590666 - protein, 22 aa, Staphylococcus aureus
RGRIRIVNDMALKMLGMAKEDI

SEQ ID NO: 1590667 - protein, 22 aa, Staphylococcus aureus
RGVKLFYPLPFNVKTPIQFKTG

SEQ ID NO: 1590668 - protein, 41 aa, Staphylococcus aureus
RIAVLSWLTLCLCIAIALILYALPYLILGSNNWSFVLTWLP

SEQ ID NO: 1590669 - protein, 23 aa, Staphylococcus aureus
RVIKKRYKGIDYLIIKEPITTQD

SEQ ID NO: 1590670 - protein, 18 aa, Staphylococcus aureus
RWLFRIIALIVFAVLMFT

SEQ ID NO: 1590671 - protein, 27 aa, Staphylococcus aureus
SRAYFYLPFLLIYFLIQGYSIIQLEIL

SEQ ID NO: 1590672 - protein, 29 aa, Staphylococcus aureus
STNKGMLFGGLFSILGLALLRRNKKNHKA

SEQ ID NO: 1590673 - protein, 24 aa, Staphylococcus aureus
TGILLFVTSFLGISFLIAVCCIIY

SEQ ID NO: 1590674 - protein, 22 aa, Staphylococcus aureus
TIRALYFQLILLLGTGIVGMGH

SEQ ID NO: 1590675 - protein, 22 aa, Staphylococcus aureus
TRHRIAIIGLLILVYMLTLSIV

SEQ ID NO: 1590676 - protein, 23 aa, Staphylococcus aureus
TSSSLIYMILLTLLILIVYIKTK

SEQ ID NO: 1590677 - protein, 18 aa, Staphylococcus aureus
TVGWYYKVVSLNKMMWIL

SEQ ID NO: 1590678 - protein, 25 aa, Staphylococcus aureus
VFKQWLQYILLVTTIVIALVLIGMG

SEQ ID NO: 1590679 - protein, 22 aa, Staphylococcus aureus
VGMVLWVIILCRGFLPAIRNKV

SEQ ID NO: 1590680 - protein, 25 aa, Staphylococcus aureus
VHAGWLHYFVGMTISFIVAITVTLI

SEQ ID NO: 1590681 - protein, 17 aa, Staphylococcus aureus
VLAPDELFFTRDGLPIA

SEQ ID NO: 1590682 - protein, 20 aa, Staphylococcus aureus
VLVDILFWALIIVVMGSMIG

SEQ ID NO: 1590683 - protein, 19 aa, Staphylococcus aureus
VTFVLGLIIALFTALMRIS

SEQ ID NO: 1590684 - protein, 20 aa, Staphylococcus aureus
YFHMIWHIFIVIASLLHLIA

SEQ ID NO: 1590685 - protein, 29 aa, Staphylococcus aureus
YKVVSLNKMMWILLYCFLGNILGGFVLFF

SEQ ID NO: 1590686 - protein, 19 aa, Staphylococcus aureus
YLYRIFSRAYFYLPFLLIY

SEQ ID NO: 1590687 - protein, 27 aa, Staphylococcus aureus
YTPFIDWLGYIFYPFIYIFPIADQAVL

SEQ ID NO: 1590688 - protein, 18 aa, Staphylococcus aureus
YVQPFWPLAIINVFEEFT

SEQ ID NO: 1590689 - protein, 18 aa, Staphylococcus aureus
AAQFIMCALFIAGTPISA

SEQ ID NO: 1590690 - protein, 21 aa, Staphylococcus aureus
AETLLIILTIILIIILTTEQT

SEQ ID NO: 1590691 - protein, 28 aa, Staphylococcus aureus
ATLFGAMMALLGSLLLFRKRKQDHKEKA

SEQ ID NO: 1590692 - protein, 23 aa, Staphylococcus aureus
AVEILFATIGLIIGLLISVMVSF

SEQ ID NO: 1590693 - protein, 17 aa, Staphylococcus aureus
AWNFIVTKGMQWVSTIT

SEQ ID NO: 1590694 - protein, 17 aa, Staphylococcus aureus
AYLLALGVILLLLLIFI

SEQ ID NO: 1590695 - protein, 17 aa, Staphylococcus aureus
CFIGFLGVIFFYCYLNK

SEQ ID NO: 1590696 - protein, 20 aa, Staphylococcus aureus
DLQVLAIFREMNAGTVLDPQ

SEQ ID NO: 1590697 - protein, 22 aa, Staphylococcus aureus
DQALQNILNAKQALNGDERVAL

SEQ ID NO: 1590698 - protein, 23 aa, Staphylococcus aureus
DVELPLALPLILGGIRLSSVYVI

SEQ ID NO: 1590699 - protein, 17 aa, Staphylococcus aureus
EAKFENGVITRKADEKT

SEQ ID NO: 1590700 - protein, 20 aa, Staphylococcus aureus
EKTIPVVYNPGVSNSYTNVN

SEQ ID NO: 1590701 - protein, 31 aa, Staphylococcus aureus
EMHTSVLKYYFWITILIIAIIVGAIAWLFDY

SEQ ID NO: 1590702 - protein, 20 aa, Staphylococcus aureus
ETIIQKIYYAKNRHLGTYTP

SEQ ID NO: 1590703 - protein, 25 aa, Staphylococcus aureus
EVKGSLLLELAVVFGISALVTSFLK

SEQ ID NO: 1590704 - protein, 18 aa, Staphylococcus aureus
FAAQLLAYLKWSNLGIIA

SEQ ID NO: 1590705 - protein, 19 aa, Staphylococcus aureus
FDSITYFVAAVAGISLFIA

SEQ ID NO: 1590706 - protein, 26 aa, Staphylococcus aureus
FFFEAIFLSIYLYTWDRFKNKWTHFL

SEQ ID NO: 1590707 - protein, 38 aa, Staphylococcus aureus
FFSIGTPGIAIIPFSLSIYALSKLILVNKFVEPDLVTL

SEQ ID NO: 1590708 - protein, 30 aa, Staphylococcus aureus
FIILMLIMLFWIFMSFIFQKLLFPPSKNNL

SEQ ID NO: 1590709 - protein, 27 aa, Staphylococcus aureus
FKSMMVPLIIIIAMFFIHINTALIMLI

SEQ ID NO: 1590710 - protein, 23 aa, Staphylococcus aureus
GALFIIFMIYLLFELFRFNISGK

SEQ ID NO: 1590711 - protein, 24 aa, Staphylococcus aureus
GDYKHPNWMFIFGIVAVLVTILTG

SEQ ID NO: 1590712 - protein, 24 aa, Staphylococcus aureus
GKTYKGIMPNWEPGKKVHLVGHSM

SEQ ID NO: 1590713 - protein, 17 aa, Staphylococcus aureus
GLIVVFICSLVGFVYYE

SEQ ID NO: 1590714 - protein, 19 aa, Staphylococcus aureus
GLVWYVLFNRKNLGSVGMK

SEQ ID NO: 1590715 - protein, 19 aa, Staphylococcus aureus
HHVFLISFVAIFVGTALPL

SEQ ID NO: 1590716 - protein, 29 aa, Staphylococcus aureus
IALHFSWYYLLLVLVILFVCVYILFSRYA

SEQ ID NO: 1590717 - protein, 21 aa, Staphylococcus aureus
IALLIFIYLIIIFYFTRREQH

SEQ ID NO: 1590718 - protein, 35 aa, Staphylococcus aureus
IAVIIIVALLILFSFVPIGLWISALAAGVHVGIGT

SEQ ID NO: 1590719 - protein, 26 aa, Staphylococcus aureus
IESKDEDVPLLLAKKKNQKDNQSKDK

SEQ ID NO: 1590720 - protein, 17 aa, Staphylococcus aureus
IFYYLFTGFMSYGAFYL

SEQ ID NO: 1590721 - protein, 18 aa, Staphylococcus aureus
IIAIIVGAIAWLFDYQFS

SEQ ID NO: 1590722 - protein, 20 aa, Staphylococcus aureus
IIIGCYYLYRLIFTYKYDIV

SEQ ID NO: 1590723 - protein, 18 aa, Staphylococcus aureus
IMNYLGVIPFLQDLITDG

SEQ ID NO: 1590724 - protein, 18 aa, Staphylococcus aureus
IRMRNLVAMLLFSIFILY

SEQ ID NO: 1590725 - protein, 22 aa, Staphylococcus aureus
ISLLILLILIPIFAISAWLYPN

SEQ ID NO: 1590726 - protein, 18 aa, Staphylococcus aureus
IVITTLLFLLFGGSVEYI

SEQ ID NO: 1590727 - protein, 44 aa, Staphylococcus aureus
KHESSTIILMIFLIGIILLSIWTRSYIIGFLAAIINVFVFNYFF

SEQ ID NO: 1590728 - protein, 41 aa, Staphylococcus aureus
KNSERRGMLKGCGGCLISFILLIILLSACSMMFSNNDNSTS

SEQ ID NO: 1590729 - protein, 20 aa, Staphylococcus aureus
KPTILPIIPLLGISLGSLIG

SEQ ID NO: 1590730 - protein, 33 aa, Staphylococcus aureus
KQNNKYYFQAVLNNASFWKEYKFYNANNQELAT

SEQ ID NO: 1590731 - protein, 24 aa, Staphylococcus aureus
KRIAVSILIIFILASGLSMFVDQL

SEQ ID NO: 1590732 - protein, 32 aa, Staphylococcus aureus
KRYFNYMLNYKVWYLTLLAGLIPFIPIKFSLF

SEQ ID NO: 1590733 - protein, 20 aa, Staphylococcus aureus
KSDIFIIKKQNLHSFKVGRG

SEQ ID NO: 1590734 - protein, 20 aa, Staphylococcus aureus
KYSIRKYSIGVVSVLAATMF

SEQ ID NO: 1590735 - protein, 19 aa, Staphylococcus aureus
LFGIPPKDLSIAQSAYLIG

SEQ ID NO: 1590736 - protein, 21 aa, Staphylococcus aureus
LIIVFLYFFNLNTIDIIFLIL

SEQ ID NO: 1590737 - protein, 20 aa, Staphylococcus aureus
LKMFVYIILLGAIVAAFFAN

SEQ ID NO: 1590738 - protein, 17 aa, Staphylococcus aureus
LLQIIFGLLALGSLGLI

SEQ ID NO: 1590739 - protein, 17 aa, Staphylococcus aureus
LLVQWWHWMNHLLHFNL

SEQ ID NO: 1590740 - protein, 19 aa, Staphylococcus aureus
LRRSKRIAVLSWLTLCLCI

SEQ ID NO: 1590741 - protein, 25 aa, Staphylococcus aureus
LSALLIVYFIYYIFEKNINFKAYAI

SEQ ID NO: 1590742 - protein, 18 aa, Staphylococcus aureus
LVIPIIISYKEGLHIIKD

SEQ ID NO: 1590743 - protein, 17 aa, Staphylococcus aureus
LVPLLPIYMASLQNLSV

SEQ ID NO: 1590744 - protein, 17 aa, Staphylococcus aureus
NWLFWEILDNNISIVSS

SEQ ID NO: 1590745 - protein, 19 aa, Staphylococcus aureus
PLVTYIVMFILNISHIHLP

SEQ ID NO: 1590746 - protein, 28 aa, Staphylococcus aureus
PMLLPFLCALILVFLKNNDRISKYLYLG

SEQ ID NO: 1590747 - protein, 35 aa, Staphylococcus aureus
QGALNIILGFIKFFSSLFTGNWRGVWDGIVMILKG

SEQ ID NO: 1590748 - protein, 22 aa, Staphylococcus aureus
QLPWVSFIVHFSFSIVIAIIYC

SEQ ID NO: 1590749 - protein, 25 aa, Staphylococcus aureus
QYGYTLLFVILISSLSAMLLQSMTV

SEQ ID NO: 1590750 - protein, 26 aa, Staphylococcus aureus
RAYFYLPFLLIYFLVQGYSIIQLEIL

SEQ ID NO: 1590751 - protein, 17 aa, Staphylococcus aureus
RIQMKPFYETIFKERNV

SEQ ID NO: 1590752 - protein, 27 aa, Staphylococcus aureus
RITEFVMLFPFLIFAIVLNAALGDKIK

SEQ ID NO: 1590753 - protein, 23 aa, Staphylococcus aureus
RSNARIFLVLGLVLTAIVNLLMG

SEQ ID NO: 1590754 - protein, 22 aa, Staphylococcus aureus
RSVLWEHIIQLKMPFFDKNESG

SEQ ID NO: 1590755 - protein, 32 aa, Staphylococcus aureus
SIVFIFIALMLKWWLILAISIIVLIIITVAMI

SEQ ID NO: 1590756 - protein, 17 aa, Staphylococcus aureus
SSMTFLCGWLAFVGAIV

SEQ ID NO: 1590757 - protein, 36 aa, Staphylococcus aureus
SSVVYIHLYDYIPRLFWPIYYFIQAPMQKMMIHGFE

SEQ ID NO: 1590758 - protein, 32 aa, Staphylococcus aureus
STIHQSFNLPYWLSALILVVFILATLFLKFDR

SEQ ID NO: 1590759 - protein, 28 aa, Staphylococcus aureus
TAISIISIPLSLLMALIALKLSDVSLNI

SEQ ID NO: 1590760 - protein, 28 aa, Staphylococcus aureus
TFNKESNKFTHIAYIKPMNGNQSNTVSV

SEQ ID NO: 1590761 - protein, 34 aa, Staphylococcus aureus
TIMTIVMTIWTAIWTFLSTIWNTIITIATTIWNL

SEQ ID NO: 1590762 - protein, 23 aa, Staphylococcus aureus
TLVTVILFCAVLIGYQIPKQQVK

SEQ ID NO: 1590763 - protein, 20 aa, Staphylococcus aureus
TSPDKAILGGAKFIRNEYFE

SEQ ID NO: 1590764 - protein, 18 aa, Staphylococcus aureus
TVLLLKRNTPVIAVDAPA

SEQ ID NO: 1590765 - protein, 27 aa, Staphylococcus aureus
VATKLAMIIIYIIVALIVIKILDKMIA

SEQ ID NO: 1590766 - protein, 17 aa, Staphylococcus aureus
VFLAIFLAVLLGIGISY

SEQ ID NO: 1590767 - protein, 23 aa, Staphylococcus aureus
VGAMLLAFYFYRDNPDLKYAIMQ

SEQ ID NO: 1590768 - protein, 19 aa, Staphylococcus aureus
VIVIMIMSLLKKPTPRPAN

SEQ ID NO: 1590769 - protein, 21 aa, Staphylococcus aureus
VLSVILLFSIPTPVAVILMGI

SEQ ID NO: 1590770 - protein, 35 aa, Staphylococcus aureus
VQDNGSYSLNLDKLDKTYVIHYTGEYLQGSDQVNF

SEQ ID NO: 1590771 - protein, 26 aa, Staphylococcus aureus
VTNTVTGLPSGLTFDSTNNTISGTPT

SEQ ID NO: 1590772 - protein, 19 aa, Staphylococcus aureus
VVVMLLFLVQILLGELLAH

SEQ ID NO: 1590773 - protein, 18 aa, Staphylococcus aureus
WRRIVEVLLLLMALTGNV

SEQ ID NO: 1590774 - protein, 20 aa, Staphylococcus aureus
YISWLFMTMLFMLMNMHSII

SEQ ID NO: 1590775 - protein, 19 aa, Staphylococcus aureus
YVFVLFAALFHLMNHAIFK

SEQ ID NO: 1590776 - protein, 24 aa, Staphylococcus aureus
YVSKNYLVMIPLTFIIGADLLLLS

SEQ ID NO: 1590777 - protein, 34 aa, Staphylococcus aureus
YWTPLQGIPAWAWSALFLVIIFSLNSLSVRVYGE

SEQ ID NO: 1590778 - protein, 34 aa, Staphylococcus aureus
YWVTLIITQILLTTSVLWILNYTGNLDLFILRLV

SEQ ID NO: 1590779 - protein, 25 aa, Staphylococcus aureus
YYIVAIVVAFLLLNLPYVHKPGVEV

SEQ ID NO: 1590780 - protein, 25 aa, Staphylococcus aureus
AAIVILTVFIFRQLKLESPLLEFRV

SEQ ID NO: 1590781 - protein, 18 aa, Staphylococcus aureus
AAKDVWINGFTPQYTMSV

SEQ ID NO: 1590782 - protein, 18 aa, Staphylococcus aureus
AIGFLIYGPVMLIGLQAL

SEQ ID NO: 1590783 - protein, 25 aa, Staphylococcus aureus
AKTLGYIILSACMTFLFVIVGLCIK

SEQ ID NO: 1590784 - protein, 26 aa, Staphylococcus aureus
ALKRAFLIMCLIGFGVGILANAGNII

SEQ ID NO: 1590785 - protein, 41 aa, Staphylococcus aureus
ANITFAIGIKIIALLLVIPGWLTLWIAILSDMGATILVALN

SEQ ID NO: 1590786 - protein, 22 aa, Staphylococcus aureus
ARKIPLFIFFVSIVGPLLEEYV

SEQ ID NO: 1590787 - protein, 19 aa, Staphylococcus aureus
CLYGWIGLKLNLSSGLFSR

SEQ ID NO: 1590788 - protein, 25 aa, Staphylococcus aureus
DIDLAWLVPFMLFAIIGFIIDVVIR

SEQ ID NO: 1590789 - protein, 32 aa, Staphylococcus aureus
DKMFPILMGFFVFLFVFLISGIALLRERTTGT

SEQ ID NO: 1590790 - protein, 23 aa, Staphylococcus aureus
DVTTFILIAILLFVYTYKENEEI

SEQ ID NO: 1590791 - protein, 31 aa, Staphylococcus aureus
EGKDLPIPAFKLPLYPVLPAVTFVLVLLVFW

SEQ ID NO: 1590792 - protein, 25 aa, Staphylococcus aureus
ERFFKLVFFIFSISFIFVILIPKLT

SEQ ID NO: 1590793 - protein, 21 aa, Staphylococcus aureus
EVRWLFRLIALIVFAVLMFTI

SEQ ID NO: 1590794 - protein, 20 aa, Staphylococcus aureus
FFICQILAFLFPKFPHINLL

SEQ ID NO: 1590795 - protein, 19 aa, Staphylococcus aureus
FFTRIPITEFLFSTTWNPT

SEQ ID NO: 1590796 - protein, 20 aa, Staphylococcus aureus
FGVAFIIMIFAIGGVPPFSG

SEQ ID NO: 1590797 - protein, 17 aa, Staphylococcus aureus
FHALFITYLFGMTTYFI

SEQ ID NO: 1590798 - protein, 17 aa, Staphylococcus aureus
FIMIKVILALPMFILLT

SEQ ID NO: 1590799 - protein, 34 aa, Staphylococcus aureus
FIVNIIVVGFLLTVIVIGLIWLIKDKRQSQHSVL

SEQ ID NO: 1590800 - protein, 17 aa, Staphylococcus aureus
FYEILHLPNLNEEQRNG

SEQ ID NO: 1590801 - protein, 23 aa, Staphylococcus aureus
GFTTFVMQDGFMKGLFGIETTGP

SEQ ID NO: 1590802 - protein, 24 aa, Staphylococcus aureus
GGKTYFLFYVIRELFRRHSEVRLL

SEQ ID NO: 1590803 - protein, 23 aa, Staphylococcus aureus
GIFAFLIWIHLLCTMLKYFNNVK

SEQ ID NO: 1590804 - protein, 26 aa, Staphylococcus aureus
GIFGALFQIYFFDKFMKYFSELTFIA

SEQ ID NO: 1590805 - protein, 19 aa, Staphylococcus aureus
GIKEKVPIIFSFRAVFETL

SEQ ID NO: 1590806 - protein, 29 aa, Staphylococcus aureus
GILEFATWHWLFYINIPIAIIAIILVVWT

SEQ ID NO: 1590807 - protein, 18 aa, Staphylococcus aureus
GLIVVGFVMILFAYKTQF

SEQ ID NO: 1590808 - protein, 27 aa, Staphylococcus aureus
GMKSIPIFFILMFFSMQLVTLPKQMLP

SEQ ID NO: 1590809 - protein, 27 aa, Staphylococcus aureus
GNKYSNIDLGLTQWGFKQLPNESYIDY

SEQ ID NO: 1590810 - protein, 20 aa, Staphylococcus aureus
GPLIMQLIGNIARGLVAFAT

SEQ ID NO: 1590811 - protein, 19 aa, Staphylococcus aureus
GRNIFTMIGIIIGISSVIT

SEQ ID NO: 1590812 - protein, 25 aa, Staphylococcus aureus
GTTSVIVGATILFGIGNHQAQASEQ

SEQ ID NO: 1590813 - protein, 19 aa, Staphylococcus aureus
GVLSFIAFVGAIILIALIS

SEQ ID NO: 1590814 - protein, 17 aa, Staphylococcus aureus
GVYVLTLMFKKLRKFST

SEQ ID NO: 1590815 - protein, 24 aa, Staphylococcus aureus
HMVLRLFMLLTLISGFWILIQSFM

SEQ ID NO: 1590816 - protein, 23 aa, Staphylococcus aureus
IFLYSFIMMLGVELVFFLANLFL

SEQ ID NO: 1590817 - protein, 20 aa, Staphylococcus aureus
IFVIAIIILTSVIGIVGRYM

SEQ ID NO: 1590818 - protein, 23 aa, Staphylococcus aureus
IIGVILCICIVATVIYLKVKYDE

SEQ ID NO: 1590819 - protein, 29 aa, Staphylococcus aureus
IISQILLTTSVLWILNYTGNLDLFILRLV

SEQ ID NO: 1590820 - protein, 22 aa, Staphylococcus aureus
IIVIATLLFLLFGGSVEYILKD

SEQ ID NO: 1590821 - protein, 19 aa, Staphylococcus aureus
IKLPILIACVLILSGLSFG

SEQ ID NO: 1590822 - protein, 24 aa, Staphylococcus aureus
ILHSQYIMMIFATILVVQILLQIC

SEQ ID NO: 1590823 - protein, 20 aa, Staphylococcus aureus
ILITLLLETITFFTRIPITE

SEQ ID NO: 1590824 - protein, 18 aa, Staphylococcus aureus
ILLMLLGSTLIMGGACAL

SEQ ID NO: 1590825 - protein, 19 aa, Staphylococcus aureus
ILMGILIDHFALFGSPKIA

SEQ ID NO: 1590826 - protein, 28 aa, Staphylococcus aureus
IMTIAMTIWNAIWTFLQTLWNTIVTVAT

SEQ ID NO: 1590827 - protein, 28 aa, Staphylococcus aureus
INFHPHEVAFLLIDYKGGGMANLFKDLV

SEQ ID NO: 1590828 - protein, 17 aa, Staphylococcus aureus
IPIAIIAIILVVWTFHF

SEQ ID NO: 1590829 - protein, 25 aa, Staphylococcus aureus
ISTWISLFFPFINWFIPKRYVKISR

SEQ ID NO: 1590830 - protein, 23 aa, Staphylococcus aureus
ISVLIIILLVLIAAYIIGTIITM

SEQ ID NO: 1590831 - protein, 18 aa, Staphylococcus aureus
IYSVIVLVLLVIADGYWT

SEQ ID NO: 1590832 - protein, 30 aa, Staphylococcus aureus
KETLDDTKHLPLLFAKRRRKEDEEDVTVEE

SEQ ID NO: 1590833 - protein, 30 aa, Staphylococcus aureus
KKQSKLILIFICIFTFLLMVIQSQFLMGQS

SEQ ID NO: 1590834 - protein, 19 aa, Staphylococcus aureus
KMFVYIILLGAVVAAFFAN

SEQ ID NO: 1590835 - protein, 18 aa, Staphylococcus aureus
KVFALYFASIVTANIVVK

SEQ ID NO: 1590836 - protein, 19 aa, Staphylococcus aureus
KVPIIFSFRAVFETLLLIG

SEQ ID NO: 1590837 - protein, 22 aa, Staphylococcus aureus
LAPILILTLMYFIFNGDENDLK

SEQ ID NO: 1590838 - protein, 23 aa, Staphylococcus aureus
LCFLILPILLLTSVSAYAVSNPV

SEQ ID NO: 1590839 - protein, 24 aa, Staphylococcus aureus
LFKQWLQYILLVTTIVIALVLIGI

SEQ ID NO: 1590840 - protein, 28 aa, Staphylococcus aureus
LGVASVAISTLLLLMSNGEAQAAAEETG

SEQ ID NO: 1590841 - protein, 18 aa, Staphylococcus aureus
LIAAIICILVFKYKKVQL

SEQ ID NO: 1590842 - protein, 22 aa, Staphylococcus aureus
LISIIVTIILFIKQRHLAVWFV

SEQ ID NO: 1590843 - protein, 35 aa, Staphylococcus aureus
LNKITWVRWVLYAVSLFLPLFIIYSMVRPPDKNNR

SEQ ID NO: 1590844 - protein, 28 aa, Staphylococcus aureus
LQQQSNYFRFQYFNPLKSERYYRNLDEQ

SEQ ID NO: 1590845 - protein, 19 aa, Staphylococcus aureus
LQQYFGKDRFRLFNGWYYL

SEQ ID NO: 1590846 - protein, 24 aa, Staphylococcus aureus
LSHYAIYLFSLITSVVLFFSFVAL

SEQ ID NO: 1590847 - protein, 22 aa, Staphylococcus aureus
LSRPIAIIFWIIAELAIIATDI

SEQ ID NO: 1590848 - protein, 22 aa, Staphylococcus aureus
LVLTIMLVITLYFSYIIKTLAQ

SEQ ID NO: 1590849 - protein, 20 aa, Staphylococcus aureus
MFIIWTILQFYIDKKLKPVY

SEQ ID NO: 1590850 - protein, 34 aa, Staphylococcus aureus
MIPDLSSDFTLFDFTYDLPLSTYLGQVLNMNAKV

SEQ ID NO: 1590851 - protein, 25 aa, Staphylococcus aureus
MMFAYVALLGLFLFGLITSLSGVQF

SEQ ID NO: 1590852 - protein, 29 aa, Staphylococcus aureus
NDLKLFKISWIVLVILLFGYLISEFTKIP

SEQ ID NO: 1590853 - protein, 19 aa, Staphylococcus aureus
NGWILPITLGAILIASKKK

SEQ ID NO: 1590854 - protein, 22 aa, Staphylococcus aureus
NILPIIIVFLTFGLVAVFTQQA

SEQ ID NO: 1590855 - protein, 26 aa, Staphylococcus aureus
NKIAMLSIIFLLIITIVSIIAPLIAP

SEQ ID NO: 1590856 - protein, 30 aa, Staphylococcus aureus
NLDFDRIIDYLILLILICSGLSYSKAELQR

SEQ ID NO: 1590857 - protein, 20 aa, Staphylococcus aureus
NLIFFVFGAFIFVMIVLQFF

SEQ ID NO: 1590858 - protein, 20 aa, Staphylococcus aureus
NVCFTLFGYILFGGLTMLFL

SEQ ID NO: 1590859 - protein, 48 aa, Staphylococcus aureus
NYTGNLDLFILRLVLLSCLFILTISVINLWTFLMLLNLNIANMIKGKQ

SEQ ID NO: 1590860 - protein, 18 aa, Staphylococcus aureus
NYYVVYLLLLKLLHIEYM

SEQ ID NO: 1590861 - protein, 17 aa, Staphylococcus aureus
PAFLPVAFLLIVIVGPI

SEQ ID NO: 1590862 - protein, 51 aa, Staphylococcus aureus
PVKRHNILFLCPFLPVISFAVIFINSQVGILLFLMSCLFNIILSATLKRTY

SEQ ID NO: 1590863 - protein, 21 aa, Staphylococcus aureus
PVSIFTGIIAFIFLILARKSN

SEQ ID NO: 1590864 - protein, 26 aa, Staphylococcus aureus
QGVVIIPVLFIMNALFGLTGVIWSLL

SEQ ID NO: 1590865 - protein, 25 aa, Staphylococcus aureus
QILGVFMYPFALLLGLPYDEAWLVA

SEQ ID NO: 1590866 - protein, 26 aa, Staphylococcus aureus
QLNLLWFNMIFIIIIGLTLVIFCLLP

SEQ ID NO: 1590867 - protein, 29 aa, Staphylococcus aureus
QNAYFLNSIFIIVILFVMYKKRAQIINFV

SEQ ID NO: 1590868 - protein, 45 aa, Staphylococcus aureus
QQHQQYGQKKSKKGWFWGCGGCLVLFILIIIGISACTAGVTGNLG

SEQ ID NO: 1590869 - protein, 18 aa, Staphylococcus aureus
RAVVQLIILGFLLHYIFK

SEQ ID NO: 1590870 - protein, 22 aa, Staphylococcus aureus
RLFNGWYYLIKYAMPVVIILVF

SEQ ID NO: 1590871 - protein, 18 aa, Staphylococcus aureus
RMIIPNLFSLLASLLVLW

SEQ ID NO: 1590872 - protein, 29 aa, Staphylococcus aureus
RNLVAMFIPLFFLYKYHQPMFGRLSSQPL

SEQ ID NO: 1590873 - protein, 23 aa, Staphylococcus aureus
SFILAFPMALIWPTIQTGLNAFS

SEQ ID NO: 1590874 - protein, 21 aa, Staphylococcus aureus
SIGIAFIAILLLKGTPEKVSQ

SEQ ID NO: 1590875 - protein, 21 aa, Staphylococcus aureus
SIISYFLLLTLKKRGILQRFI

SEQ ID NO: 1590876 - protein, 25 aa, Staphylococcus aureus
SPHIPLALFMLFQMMFCTIAISILS

SEQ ID NO: 1590877 - protein, 21 aa, Staphylococcus aureus
STYMLKIYIANTPRLSEIKKD

SEQ ID NO: 1590878 - protein, 24 aa, Staphylococcus aureus
SVGKMLTVYLSYTTQFIYLHRRVG

SEQ ID NO: 1590879 - protein, 24 aa, Staphylococcus aureus
SVWLVLLFSAMGLWQVSSAAEQHT

SEQ ID NO: 1590880 - protein, 20 aa, Staphylococcus aureus
TAKVPPIMAGDQVLANGVID

SEQ ID NO: 1590881 - protein, 26 aa, Staphylococcus aureus
TEAVRKIMFALNRFMGNKYSNIDLGL

SEQ ID NO: 1590882 - protein, 21 aa, Staphylococcus aureus
TFEYTESAVTQVRYVDVTTGK

SEQ ID NO: 1590883 - protein, 19 aa, Staphylococcus aureus
TFVLLIVQQWLFLNPNHNL

SEQ ID NO: 1590884 - protein, 17 aa, Staphylococcus aureus
TIAFKSILKNKGRNIFT

SEQ ID NO: 1590885 - protein, 29 aa, Staphylococcus aureus
TKSIIAIISLCILTYTTMIGSVLADEIKY

SEQ ID NO: 1590886 - protein, 19 aa, Staphylococcus aureus
TLALMFLAPILILTLMYFI

SEQ ID NO: 1590887 - protein, 19 aa, Staphylococcus aureus
TLHSESFPRIFRITSRDTN

SEQ ID NO: 1590888 - protein, 28 aa, Staphylococcus aureus
TLITAVITVVAYIFINQKISGLNKTDQA

SEQ ID NO: 1590889 - protein, 36 aa, Staphylococcus aureus
TNSSKRVHLKRWQFISILIGTTLITAVITVVAYIFI

SEQ ID NO: 1590890 - protein, 26 aa, Staphylococcus aureus
TVIGLILLSLTFLPEVWYIISSIVGY

SEQ ID NO: 1590891 - protein, 18 aa, Staphylococcus aureus
TVYAIRMVGIALGLIPVM

SEQ ID NO: 1590892 - protein, 18 aa, Staphylococcus aureus
VAILSVLIFTDNANAENN

SEQ ID NO: 1590893 - protein, 26 aa, Staphylococcus aureus
VAMILIVLMFMLFIGNLTILPIYMQT

SEQ ID NO: 1590894 - protein, 31 aa, Staphylococcus aureus
VANYTPFIDWLGYIFYPFIYIFPIADQAVLA

SEQ ID NO: 1590895 - protein, 27 aa, Staphylococcus aureus
VAVYVIFYFIWLRFEWPHYLLYILLVL

SEQ ID NO: 1590896 - protein, 29 aa, Staphylococcus aureus
VFIVISTMIFLFIGKPISLLIIAGAINGW

SEQ ID NO: 1590897 - protein, 17 aa, Staphylococcus aureus
VFLLFRFYIKTDNFSIY

SEQ ID NO: 1590898 - protein, 24 aa, Staphylococcus aureus
VGFTLFIFTLIMNLLSQWISKRFR

SEQ ID NO: 1590899 - protein, 17 aa, Staphylococcus aureus
VMFILNISHIHLPHVAI

SEQ ID NO: 1590900 - protein, 17 aa, Staphylococcus aureus
VMLLLGSFIALISAIGI

SEQ ID NO: 1590901 - protein, 26 aa, Staphylococcus aureus
VSNTIPVYMPYITSYFMTRAIGDRPL

SEQ ID NO: 1590902 - protein, 23 aa, Staphylococcus aureus
VSRLLLSIILNLPVWVVLLNAIP

SEQ ID NO: 1590903 - protein, 23 aa, Staphylococcus aureus
VTPFLIVLVVLIAGVYLFKGHVS

SEQ ID NO: 1590904 - protein, 19 aa, Staphylococcus aureus
VTVIVLAFISIGHALLIMV

SEQ ID NO: 1590905 - protein, 18 aa, Staphylococcus aureus
VVLLITFGSVIAAGLPII

SEQ ID NO: 1590906 - protein, 18 aa, Staphylococcus aureus
WGIKYGLFIQSVIDFIII

SEQ ID NO: 1590907 - protein, 23 aa, Staphylococcus aureus
WTGLFILIGLFVADWTVGLAAMI

SEQ ID NO: 1590908 - protein, 25 aa, Staphylococcus aureus
YFETSAVLLTLILFGKYLEARAKSQ

SEQ ID NO: 1590909 - protein, 23 aa, Staphylococcus aureus
YGYSMLLLFLIAACIFLIVLFIL

SEQ ID NO: 1590910 - protein, 21 aa, Staphylococcus aureus
YTFGYLRFEILVAFLNGLALI

SEQ ID NO: 1590911 - protein, 43 aa, Staphylococcus aureus
ADIISGYFVPIVVGIALLIFIVWITLVTPGTFEPALVASISVL

SEQ ID NO: 1590912 - protein, 20 aa, Staphylococcus aureus
AFFLVLAFRTYKELGTDNVE

SEQ ID NO: 1590913 - protein, 19 aa, Staphylococcus aureus
AFIAWGFIAAIFIDNGWFP

SEQ ID NO: 1590914 - protein, 21 aa, Staphylococcus aureus
AGSFVYIYFMQGIQGFDFDHP

SEQ ID NO: 1590915 - protein, 25 aa, Staphylococcus aureus
AISKVWLYFMYYWIIFGIGCYLGQF

SEQ ID NO: 1590916 - protein, 48 aa, Staphylococcus aureus
ALAIVILIVFALLFRFIVRLIPIFYIFRVLSIFIFIMGFKMLGVSIQK

SEQ ID NO: 1590917 - protein, 21 aa, Staphylococcus aureus
ALGWNYWFNWVVTVAADITIA

SEQ ID NO: 1590918 - protein, 26 aa, Staphylococcus aureus
ALIISMVIIYLFIRRQFNITNVLLNL

SEQ ID NO: 1590919 - protein, 27 aa, Staphylococcus aureus
ALQAAWSFISNIWNTIWSFLSGILTTI

SEQ ID NO: 1590920 - protein, 18 aa, Staphylococcus aureus
ATTAFFLVLAFRTYKELG

SEQ ID NO: 1590921 - protein, 22 aa, Staphylococcus aureus
AYALIRFFTLLFDQHNGLIHPL

SEQ ID NO: 1590922 - protein, 19 aa, Staphylococcus aureus
AYCVAFLIKWIEKKVPEGL

SEQ ID NO: 1590923 - protein, 20 aa, Staphylococcus aureus
CHSPLTYLWMFALILFFMRL

SEQ ID NO: 1590924 - protein, 21 aa, Staphylococcus aureus
CMLFILYYRVNRIGGNRSFEI

SEQ ID NO: 1590925 - protein, 25 aa, Staphylococcus aureus
DFKKTLIMIFIQVLIVIFMMNTTIG

SEQ ID NO: 1590926 - protein, 24 aa, Staphylococcus aureus
DHASVLDEFYWLNKEDPNYSRCRV

SEQ ID NO: 1590927 - protein, 22 aa, Staphylococcus aureus
DIKWCRMIIRQILSNALKYSEN

SEQ ID NO: 1590928 - protein, 20 aa, Staphylococcus aureus
DITSTLLEQGGINASKFGVF

SEQ ID NO: 1590929 - protein, 24 aa, Staphylococcus aureus
DNYHLIFALIFLAIVSVVSMMVGS

SEQ ID NO: 1590930 - protein, 42 aa, Staphylococcus aureus
DTKGLTLFYVFIGLIMFALLNQQLLLLNFLSFILAIVVAMCL

SEQ ID NO: 1590931 - protein, 18 aa, Staphylococcus aureus
EFNMIWKAMLIPSMGYIV

SEQ ID NO: 1590932 - protein, 24 aa, Staphylococcus aureus
EFVKPAGLKRVGIIAALGATVMLC

SEQ ID NO: 1590933 - protein, 25 aa, Staphylococcus aureus
EIDNHQIIWVMLNYEFNEPRPTIGQ

SEQ ID NO: 1590934 - protein, 22 aa, Staphylococcus aureus
ELGSIYILPALIGSIIFIAIVT

SEQ ID NO: 1590935 - protein, 22 aa, Staphylococcus aureus
ELPWVSFIVHFSFSIVIAIIYC

SEQ ID NO: 1590936 - protein, 20 aa, Staphylococcus aureus
EQFKAQMKAANPTAKELAKR

SEQ ID NO: 1590937 - protein, 25 aa, Staphylococcus aureus
EVNGILLFLIPFFASAIFNTQFTLF

SEQ ID NO: 1590938 - protein, 17 aa, Staphylococcus aureus
FEKIYKAIKHVIVFIFM

SEQ ID NO: 1590939 - protein, 18 aa, Staphylococcus aureus
FGVPPKDLSIAQSAYLIG

SEQ ID NO: 1590940 - protein, 19 aa, Staphylococcus aureus
FIAKHKWSAVIAWIVIVAA

SEQ ID NO: 1590941 - protein, 19 aa, Staphylococcus aureus
FIANLFLEPTKLGYLIIII

SEQ ID NO: 1590942 - protein, 22 aa, Staphylococcus aureus
FIGILIFYVRLIKKSSLNIYNT

SEQ ID NO: 1590943 - protein, 18 aa, Staphylococcus aureus
FITLIIIAVLMGMLLIFN

SEQ ID NO: 1590944 - protein, 18 aa, Staphylococcus aureus
FIVIIFLILAQIFYFYII

SEQ ID NO: 1590945 - protein, 17 aa, Staphylococcus aureus
FKNQFWLFGVKKNKRHD

SEQ ID NO: 1590946 - protein, 18 aa, Staphylococcus aureus
FLCLLGIMLFIPNKSHYS

SEQ ID NO: 1590947 - protein, 26 aa, Staphylococcus aureus
FNVRIGWLILRLLAVVFAWMTFLRIG

SEQ ID NO: 1590948 - protein, 27 aa, Staphylococcus aureus
FSLIASILVLWLYFRKSIPKTFDTENL

SEQ ID NO: 1590949 - protein, 19 aa, Staphylococcus aureus
FVILFISIFLKFSFNIEFI

SEQ ID NO: 1590950 - protein, 17 aa, Staphylococcus aureus
FVLLKRNIYYFKAQHII

SEQ ID NO: 1590951 - protein, 20 aa, Staphylococcus aureus
GCVNGCMLFILYYRVNRIGG

SEQ ID NO: 1590952 - protein, 25 aa, Staphylococcus aureus
GFMGFITFVLLIVQQWLFLNPNHIL

SEQ ID NO: 1590953 - protein, 21 aa, Staphylococcus aureus
GICMAIVSILLIGMAISNVSK

SEQ ID NO: 1590954 - protein, 26 aa, Staphylococcus aureus
GIDHILWFIFAVIVGSLVTMITVLLL

SEQ ID NO: 1590955 - protein, 24 aa, Staphylococcus aureus
GIIILLVLIIGFKLNTFISLIITS

SEQ ID NO: 1590956 - protein, 39 aa, Staphylococcus aureus
GLTVFSFISNNMLFGIIFAVLTLVFVIGIIMSKSKEVYY

SEQ ID NO: 1590957 - protein, 40 aa, Staphylococcus aureus
GNVIKNAIGVVGISGLLASFWFFIAKRRRKEDEEEELEIR

SEQ ID NO: 1590958 - protein, 25 aa, Staphylococcus aureus
GRLALITSYIPFLAPFQLVVRAQTS

SEQ ID NO: 1590959 - protein, 30 aa, Staphylococcus aureus
GSNNWSFVLTWLPIEIKLTLTTAFIALFSM

SEQ ID NO: 1590960 - protein, 23 aa, Staphylococcus aureus
GSVSTMLVDWAYQNNKAGIKDKA

SEQ ID NO: 1590961 - protein, 23 aa, Staphylococcus aureus
GTFDNWFNMYLKEVKGSLLLELA

SEQ ID NO: 1590962 - protein, 22 aa, Staphylococcus aureus
GTRYIFFDNMSFTAPTKQPIVK

SEQ ID NO: 1590963 - protein, 32 aa, Staphylococcus aureus
GWSNIWFDLLILMIFIIVFIILNIVGLKRYRQ

SEQ ID NO: 1590964 - protein, 17 aa, Staphylococcus aureus
HELFIPAMILSLLILFF

SEQ ID NO: 1590965 - protein, 32 aa, Staphylococcus aureus
HKKQYMLFAVGIVLATILLISAHLYSRKRGNQ

SEQ ID NO: 1590966 - protein, 17 aa, Staphylococcus aureus
HNDYFVAMTIYYVVILL

SEQ ID NO: 1590967 - protein, 26 aa, Staphylococcus aureus
HPLAVFFPIIALLIIYYMIRFKMRAV

SEQ ID NO: 1590968 - protein, 25 aa, Staphylococcus aureus
HQDQKLYFYFSSPGKNQIIYKESLT

SEQ ID NO: 1590969 - protein, 31 aa, Staphylococcus aureus
HWNVMFYGMFIIGILAILVGFVWFKLYQYTT

SEQ ID NO: 1590970 - protein, 17 aa, Staphylococcus aureus
IAFNILNWLFWEILDNY

SEQ ID NO: 1590971 - protein, 22 aa, Staphylococcus aureus
IANTAFIFLPALIGWSSMRVFG

SEQ ID NO: 1590972 - protein, 25 aa, Staphylococcus aureus
IANYTPLFVILGKPFVPFLELMHIP

SEQ ID NO: 1590973 - protein, 17 aa, Staphylococcus aureus
ICCITFIGILIFYVRLI

SEQ ID NO: 1590974 - protein, 18 aa, Staphylococcus aureus
IDTAIFVAIAFIGSLPGT

SEQ ID NO: 1590975 - protein, 18 aa, Staphylococcus aureus
IFKNQFWLFGVKKNKRHD

SEQ ID NO: 1590976 - protein, 25 aa, Staphylococcus aureus
IFLVTLLFVLWQPKGLDIGFTALAG

SEQ ID NO: 1590977 - protein, 17 aa, Staphylococcus aureus
IFPYLCLVVFVAGHIAR

SEQ ID NO: 1590978 - protein, 18 aa, Staphylococcus aureus
IGALVPLLFGQDSSILIS

SEQ ID NO: 1590979 - protein, 25 aa, Staphylococcus aureus
IGKALMLPVAILPAAGLLLAIGTAI

SEQ ID NO: 1590980 - protein, 18 aa, Staphylococcus aureus
IIGIIQYSSILSSILMKN

SEQ ID NO: 1590981 - protein, 28 aa, Staphylococcus aureus
IISTWISLFFPFINWFIPKRYVKISKKE

SEQ ID NO: 1590982 - protein, 24 aa, Staphylococcus aureus
IIVLFSIYLLNINLAGSLWYVILI

SEQ ID NO: 1590983 - protein, 20 aa, Staphylococcus aureus
IIYMTSIVLMILTLFEQAVP

SEQ ID NO: 1590984 - protein, 26 aa, Staphylococcus aureus
ILSILFPVIFYILFTSILDLPEDVKP

SEQ ID NO: 1590985 - protein, 17 aa, Staphylococcus aureus
ILSLLGISPIRYIKKTL

SEQ ID NO: 1590986 - protein, 32 aa, Staphylococcus aureus
IMMIAIFIALMFDFEKAYWIPLSAHTVLLGTS

SEQ ID NO: 1590987 - protein, 24 aa, Staphylococcus aureus
INLISFVIILLYALGSIIAVYCIS

SEQ ID NO: 1590988 - protein, 33 aa, Staphylococcus aureus
INTKIEMQFIPFNLLHLLSLKVVSIMIVLVACL

SEQ ID NO: 1590989 - protein, 18 aa, Staphylococcus aureus
IVMMLFVNKLLRGDKNIA

SEQ ID NO: 1590990 - protein, 17 aa, Staphylococcus aureus
IVSVILIGMIVISYAHN

SEQ ID NO: 1590991 - protein, 30 aa, Staphylococcus aureus
IYTLGVLFIFLFLLGYFLPIGIDKVKNLSY

SEQ ID NO: 1590992 - protein, 26 aa, Staphylococcus aureus
KDSKLFKLSWIVLAVLLVGYLVSEFI

SEQ ID NO: 1590993 - protein, 17 aa, Staphylococcus aureus
KFIILYAYSMLVLLALV

SEQ ID NO: 1590994 - protein, 37 aa, Staphylococcus aureus
KLLNILKKNIKLLLILPAICLVVSTALTFFVMPDKYT

SEQ ID NO: 1590995 - protein, 27 aa, Staphylococcus aureus
KLTGETIPYVFILIDNFDAVKDSPFQE

SEQ ID NO: 1590996 - protein, 26 aa, Staphylococcus aureus
KNFCFTIFYYFLFGGLSIMALSMLLT

SEQ ID NO: 1590997 - protein, 22 aa, Staphylococcus aureus
KNLIFSLVIFPFLFVPYIIIDI

SEQ ID NO: 1590998 - protein, 18 aa, Staphylococcus aureus
KPFLFLKTLFMGVVFIFI

SEQ ID NO: 1590999 - protein, 19 aa, Staphylococcus aureus
KVFITPAILTLVLAFGLSA

SEQ ID NO: 1591000 - protein, 24 aa, Staphylococcus aureus
KVKSGDYFTIKYSDTVQVYGLNPE

SEQ ID NO: 1591001 - protein, 28 aa, Staphylococcus aureus
KYMGYLIFVFFIFVFGLLFINVETRRAI

SEQ ID NO: 1591002 - protein, 22 aa, Staphylococcus aureus
LAGLIPFIPIKFSLFKFNNVNN

SEQ ID NO: 1591003 - protein, 48 aa, Staphylococcus aureus
LAIVILIVFAVLFRFIVRLIPIFYIFRVLSIFIFIMGFKMLGVSIQKL

SEQ ID NO: 1591004 - protein, 20 aa, Staphylococcus aureus
LALAGFLKKIKGTYIETLLK

SEQ ID NO: 1591005 - protein, 25 aa, Staphylococcus aureus
LCIGISWLCWLILCRLILLCCRRCC

SEQ ID NO: 1591006 - protein, 20 aa, Staphylococcus aureus
LCILLLPIIFIPNPNHVFIN

SEQ ID NO: 1591007 - protein, 24 aa, Staphylococcus aureus
LDGLSFLTLYLLDVHLGYTFSGGF

SEQ ID NO: 1591008 - protein, 28 aa, Staphylococcus aureus
LFSLLASLLVLWLYFRKAIPKSFDANHI

SEQ ID NO: 1591009 - protein, 21 aa, Staphylococcus aureus
LGVLILFLFLNRKLRLEIYNN

SEQ ID NO: 1591010 - protein, 21 aa, Staphylococcus aureus
LIIFVILFSLFFDLIMYFYGN

SEQ ID NO: 1591011 - protein, 24 aa, Staphylococcus aureus
LNMKYYLIRTIPVSIIALLYVLLS

SEQ ID NO: 1591012 - protein, 19 aa, Staphylococcus aureus
LPGFILLYIRAIIPVFPLA

SEQ ID NO: 1591013 - protein, 28 aa, Staphylococcus aureus
LSALVMGILWLSILFCRLYFHAHYFSDV

SEQ ID NO: 1591014 - protein, 17 aa, Staphylococcus aureus
LVAILFTSLALTAGTVA

SEQ ID NO: 1591015 - protein, 23 aa, Staphylococcus aureus
LVEYLNWRSLFHVVAPIAAVTFL

SEQ ID NO: 1591016 - protein, 25 aa, Staphylococcus aureus
LVIILVITIFLLPYLDVLLLGRAEA

SEQ ID NO: 1591017 - protein, 22 aa, Staphylococcus aureus
LVIPVLPVYLKDLGLTGSDLGL

SEQ ID NO: 1591018 - protein, 23 aa, Staphylococcus aureus
MATSIILTNILPYDAQAVSEKDT

SEQ ID NO: 1591019 - protein, 18 aa, Staphylococcus aureus
MFYIYRKHIFMAAVGEVL

SEQ ID NO: 1591020 - protein, 19 aa, Staphylococcus aureus
MHGLNITAYLFWVIPCVAG

SEQ ID NO: 1591021 - protein, 24 aa, Staphylococcus aureus
MIVVAIIIVGVLAFQFMNHKGPFK

SEQ ID NO: 1591022 - protein, 35 aa, Staphylococcus aureus
MSNIYTILPWFLITIPIIILLSYQLDVLNLGDAVA

SEQ ID NO: 1591023 - protein, 17 aa, Staphylococcus aureus
MTFLCGWLAFVGAIVSI

SEQ ID NO: 1591024 - protein, 28 aa, Staphylococcus aureus
MVIVAVIPLLFLVIPKMKISILDDPVAI

SEQ ID NO: 1591025 - protein, 34 aa, Staphylococcus aureus
NELWYGLIPIQIIGFILVMLFAVYLGFKEQKRIK

SEQ ID NO: 1591026 - protein, 23 aa, Staphylococcus aureus
NIDQATKLQPIAELVDQATQLNQ

SEQ ID NO: 1591027 - protein, 22 aa, Staphylococcus aureus
NITAYLFWVIPCVAGALFGEYI

SEQ ID NO: 1591028 - protein, 28 aa, Staphylococcus aureus
NLLLTLFVFLILIFFLVFTAQKLANIPG

SEQ ID NO: 1591029 - protein, 21 aa, Staphylococcus aureus
NLYVSIFWLSLGLGGIGISMG

SEQ ID NO: 1591030 - protein, 17 aa, Staphylococcus aureus
NMELPWVSFIVHFSFSI

SEQ ID NO: 1591031 - protein, 18 aa, Staphylococcus aureus
PFCFFLTASVTLLTSTLG

SEQ ID NO: 1591032 - protein, 26 aa, Staphylococcus aureus
PIQIIGFILVMLFAVYLGFKEQKRIK

SEQ ID NO: 1591033 - protein, 29 aa, Staphylococcus aureus
PMALVLTIFMLIIAYVLILFQSALFLKRR

SEQ ID NO: 1591034 - protein, 21 aa, Staphylococcus aureus
PNKVLPYKAPFYPLGPIIVIA

SEQ ID NO: 1591035 - protein, 22 aa, Staphylococcus aureus
PRKMITIALVWWSAFTILTGMI

SEQ ID NO: 1591036 - protein, 19 aa, Staphylococcus aureus
PVGWAVIGGFVFGSVSTML

SEQ ID NO: 1591037 - protein, 33 aa, Staphylococcus aureus
QNKNGFTFFLNVLLPLVFISVLIGIFNYIKVLP

SEQ ID NO: 1591038 - protein, 27 aa, Staphylococcus aureus
QNVVKYIVWFIVVTTILSKFGISVEGV

SEQ ID NO: 1591039 - protein, 35 aa, Staphylococcus aureus
QSIIIIVVLLIKAIITWLLLIPIFNFMTSFVESTN

SEQ ID NO: 1591040 - protein, 26 aa, Staphylococcus aureus
QWVLWTILVTSFFSIGTPGIAIIPFS

SEQ ID NO: 1591041 - protein, 26 aa, Staphylococcus aureus
QYIQYYLYLLIILGGLYLFTHHAFIL

SEQ ID NO: 1591042 - protein, 21 aa, Staphylococcus aureus
RGEFLHMLLGVFLATLVSFVV

SEQ ID NO: 1591043 - protein, 25 aa, Staphylococcus aureus
RMMFIGMMVLLVFALILLMVFKENN

SEQ ID NO: 1591044 - protein, 23 aa, Staphylococcus aureus
SCLKLILILLFLLSILLVIYQTQ

SEQ ID NO: 1591045 - protein, 32 aa, Staphylococcus aureus
SETLTQAIFFKKMIYFWLSEGQLILMLLGDES

SEQ ID NO: 1591046 - protein, 21 aa, Staphylococcus aureus
SFAIILLYVLGSIIAVYCISH

SEQ ID NO: 1591047 - protein, 30 aa, Staphylococcus aureus
SILMKNKWPFLIALPFMIGYGIGITIYYQR

SEQ ID NO: 1591048 - protein, 21 aa, Staphylococcus aureus
SILPILMIIYGIVAKMIAVWF

SEQ ID NO: 1591049 - protein, 17 aa, Staphylococcus aureus
SIVLMILTLFEQAVPMT

SEQ ID NO: 1591050 - protein, 17 aa, Staphylococcus aureus
SLFQKSLTYYKSYSPGS

SEQ ID NO: 1591051 - protein, 20 aa, Staphylococcus aureus
SMETLWQTISPLESFIRPNS

SEQ ID NO: 1591052 - protein, 27 aa, Staphylococcus aureus
SMKWDEILTILPWLIGALIATVFIGRQ

SEQ ID NO: 1591053 - protein, 24 aa, Staphylococcus aureus
SNPVGWAVVGILTAGIIGSTVSDY

SEQ ID NO: 1591054 - protein, 24 aa, Staphylococcus aureus
SPLQIIRYFLIPEALGSLVLAITT

SEQ ID NO: 1591055 - protein, 28 aa, Staphylococcus aureus
SPVMHHVFWISFLAIFIGTALPLAGTVA

SEQ ID NO: 1591056 - protein, 30 aa, Staphylococcus aureus
SQVGSYFLFFIIVAFLLYANVLFLKRRSSE

SEQ ID NO: 1591057 - protein, 29 aa, Staphylococcus aureus
STNKGMLFGGLFSILGLALLRRNKKNNKA

SEQ ID NO: 1591058 - protein, 22 aa, Staphylococcus aureus
STSNRMSTIASLSTSVSTSESG

SEQ ID NO: 1591059 - protein, 24 aa, Staphylococcus aureus
SVNELWFGLIPIQIIGFILVMLFA

SEQ ID NO: 1591060 - protein, 17 aa, Staphylococcus aureus
SVVLGIIILLVLIIGFK

SEQ ID NO: 1591061 - protein, 17 aa, Staphylococcus aureus
TFIYLLTLFYLRRDQHE

SEQ ID NO: 1591062 - protein, 20 aa, Staphylococcus aureus
TGFLLLYPVVAFMIGAIRDR

SEQ ID NO: 1591063 - protein, 17 aa, Staphylococcus aureus
TIILGMVILAVVPLLFL

SEQ ID NO: 1591064 - protein, 25 aa, Staphylococcus aureus
TNRVILFIFRCFVVVLVFVGAVVKT

SEQ ID NO: 1591065 - protein, 25 aa, Staphylococcus aureus
TTKEKYFLLIFMCNAIIGVLQDWVK

SEQ ID NO: 1591066 - protein, 26 aa, Staphylococcus aureus
TTLILIAILLFYTFMGILLPIMHDDL

SEQ ID NO: 1591067 - protein, 23 aa, Staphylococcus aureus
TTRNAFFIGRTIDYNVSLEGALK

SEQ ID NO: 1591068 - protein, 23 aa, Staphylococcus aureus
TVMTNYFFLCIVRIFMAGIASLI

SEQ ID NO: 1591069 - protein, 19 aa, Staphylococcus aureus
TWIGYLPYLYSGLIFGLIY

SEQ ID NO: 1591070 - protein, 19 aa, Staphylococcus aureus
TWLTLFLPMINWLIPKKYV

SEQ ID NO: 1591071 - protein, 27 aa, Staphylococcus aureus
TWSHLKWAIPLISIALIIILTISKQLT

SEQ ID NO: 1591072 - protein, 26 aa, Staphylococcus aureus
VAGISPLMLFPYSIYPILLGVCGLVA

SEQ ID NO: 1591073 - protein, 28 aa, Staphylococcus aureus
VFIAFFSHLTIHLLPLFAVLGGAIAMVI

SEQ ID NO: 1591074 - protein, 29 aa, Staphylococcus aureus
VFSVHPMLSLFFFYSAFAIPFTFKNNVKK

SEQ ID NO: 1591075 - protein, 29 aa, Staphylococcus aureus
VGNQTIEVGKTMNPVVLTTTDNGTGTVTN

SEQ ID NO: 1591076 - protein, 32 aa, Staphylococcus aureus
VHRDDIITEQDILAHINLIDQLSAEVIDTPST

SEQ ID NO: 1591077 - protein, 18 aa, Staphylococcus aureus
VLMFILFATVIGAYLFFK

SEQ ID NO: 1591078 - protein, 45 aa, Staphylococcus aureus
VLPNKTQWWLVIPVGLVYAVIYYFVFRFLIVKLKYKTPGREDKQS

SEQ ID NO: 1591079 - protein, 25 aa, Staphylococcus aureus
VLSTFLFILLLYIAYRKNKIVYAPI

SEQ ID NO: 1591080 - protein, 23 aa, Staphylococcus aureus
VLTVIVVVVAILFFGAPTIFNFT

SEQ ID NO: 1591081 - protein, 28 aa, Staphylococcus aureus
VMRLSAVLFWIPIAFVLLIAFNILNWLF

SEQ ID NO: 1591082 - protein, 22 aa, Staphylococcus aureus
VPEDHAYIRFPVSDGTQELKIV

SEQ ID NO: 1591083 - protein, 18 aa, Staphylococcus aureus
VPIAFKIHILLGFTIMAC

SEQ ID NO: 1591084 - protein, 46 aa, Staphylococcus aureus
VSTTYKKVLHWSLNHKWIVIILSTLILVTTIVFGGPRLGTSFISAG

SEQ ID NO: 1591085 - protein, 26 aa, Staphylococcus aureus
VVTGFVFFDIPIQVLLIIASAYAAWI

SEQ ID NO: 1591086 - protein, 19 aa, Staphylococcus aureus
WLGIILMLFVSWFALFLFY

SEQ ID NO: 1591087 - protein, 33 aa, Staphylococcus aureus
WTPLQGIPAWAWSALFLVIIFSLNSLSVRVYGE

SEQ ID NO: 1591088 - protein, 40 aa, Staphylococcus aureus
YDFPIDSLFYIVSLNLSLTLIFLILTFFKEVKLYRHFEKD

SEQ ID NO: 1591089 - protein, 17 aa, Staphylococcus aureus
YLPFGYDAQDIDLNNIS

SEQ ID NO: 1591090 - protein, 21 aa, Staphylococcus aureus
YLPGFILLYIRAIIPVFPLAL

SEQ ID NO: 1591091 - protein, 19 aa, Staphylococcus aureus
YLTILILVTGTMLLVWLAD

SEQ ID NO: 1591092 - protein, 20 aa, Staphylococcus aureus
YLWMFALILFFMRLAKIQLW

SEQ ID NO: 1591093 - protein, 20 aa, Staphylococcus aureus
YMSKIYHTFLPALTLGLLST

SEQ ID NO: 1591094 - protein, 25 aa, Staphylococcus aureus
YNWKIPFYIIAIITFLCLLGIMLFI

SEQ ID NO: 1591095 - protein, 17 aa, Staphylococcus aureus
YTFGYLRFEILAAFLNG

SEQ ID NO: 1591096 - protein, 20 aa, Staphylococcus aureus
YVIIAILALILMFIKVKPTT

SEQ ID NO: 1591097 - protein, 17 aa, Staphylococcus aureus
AAAYFTAYLTNNLEFRN

SEQ ID NO: 1591098 - protein, 25 aa, Staphylococcus aureus
AFLTSIFGIIALDVSFLIDMSIGIV

SEQ ID NO: 1591099 - protein, 17 aa, Staphylococcus aureus
ASKFFFLNVLSLLEVLS

SEQ ID NO: 1591100 - protein, 22 aa, Staphylococcus aureus
AVFLSRFLLSLLVSSNIFKNQY

SEQ ID NO: 1591101 - protein, 26 aa, Staphylococcus aureus
DDIDPLHMRHFSNNFGNVIKNAIGVV

SEQ ID NO: 1591102 - protein, 28 aa, Staphylococcus aureus
DITRFIVRVLIPFALIISLFLISQGTPQ

SEQ ID NO: 1591103 - protein, 24 aa, Staphylococcus aureus
DIVRFIVRVLLPLSCLISILLMTQ

SEQ ID NO: 1591104 - protein, 17 aa, Staphylococcus aureus
DIYNIIRKQNFSGNAYL

SEQ ID NO: 1591105 - protein, 25 aa, Staphylococcus aureus
DKNNKPFIYAPTKKIDFKAPGVDVY

SEQ ID NO: 1591106 - protein, 27 aa, Staphylococcus aureus
DPTMNIILLALGYFVIPFVSAFIVHEL

SEQ ID NO: 1591107 - protein, 17 aa, Staphylococcus aureus
EFKLKKMDIAYDEYFSV

SEQ ID NO: 1591108 - protein, 25 aa, Staphylococcus aureus
EIGEIIFKFYRHCFRYNEINLKIQD

SEQ ID NO: 1591109 - protein, 33 aa, Staphylococcus aureus
ELANYVFFDIELKNLLLYGIFDESIFLKNITNN

SEQ ID NO: 1591110 - protein, 17 aa, Staphylococcus aureus
ELIIIVISLLQWIRFID

SEQ ID NO: 1591111 - protein, 31 aa, Staphylococcus aureus
ESVSRLYVFSIFIILLLTLVFANFSEALAEG

SEQ ID NO: 1591112 - protein, 39 aa, Staphylococcus aureus
FDEQVKWIFNLIRIVLPIIIIFIIFIVLYSVAPNVKTKL

SEQ ID NO: 1591113 - protein, 17 aa, Staphylococcus aureus
FEKDSLYIINDFKTYID

SEQ ID NO: 1591114 - protein, 22 aa, Staphylococcus aureus
FGAFFKIWIVIGLVIIGTYAFF

SEQ ID NO: 1591115 - protein, 19 aa, Staphylococcus aureus
FGILYTILMYTCAYVLIRM

SEQ ID NO: 1591116 - protein, 39 aa, Staphylococcus aureus
FKNRRKMIVICFYSLLAILLILLLASFIKATRANNDSKE

SEQ ID NO: 1591117 - protein, 17 aa, Staphylococcus aureus
FLLTLTFVIWQPKGLDI

SEQ ID NO: 1591118 - protein, 17 aa, Staphylococcus aureus
FLPQAFLSYAIGGVFDI

SEQ ID NO: 1591119 - protein, 17 aa, Staphylococcus aureus
FLTTVFIFALSLFTVLK

SEQ ID NO: 1591120 - protein, 25 aa, Staphylococcus aureus
FNEGQKVNIIIIASGLYSDTIGAFD

SEQ ID NO: 1591121 - protein, 25 aa, Staphylococcus aureus
FQLYVKLSCSTMMASSIILTNILPY

SEQ ID NO: 1591122 - protein, 18 aa, Staphylococcus aureus
FRKHLFLGLLVSSLVFAS

SEQ ID NO: 1591123 - protein, 25 aa, Staphylococcus aureus
FVAMFVMFIGFLVTCLYFEFAGNPV

SEQ ID NO: 1591124 - protein, 18 aa, Staphylococcus aureus
FYEILHLPNLNEEQRNGF

SEQ ID NO: 1591125 - protein, 25 aa, Staphylococcus aureus
GAIIIYPAILILPPLIGIPAYSAYI

SEQ ID NO: 1591126 - protein, 30 aa, Staphylococcus aureus; identical to SEQ ID NO: 1582661

SEQ ID NO: 1591127 - protein, 29 aa, Staphylococcus aureus
GFDEILFFTLYLLLILIVLYYLKKQLKNK

SEQ ID NO: 1591128 - protein, 23 aa, Staphylococcus aureus
GIFAIIIFVFFTISILIQKWQKG

SEQ ID NO: 1591129 - protein, 24 aa, Staphylococcus aureus
GNGLKMFVFIMLLGAIVAAFFAND

SEQ ID NO: 1591130 - protein, 24 aa, Staphylococcus aureus
GPTWLYIISVIVFSLSYLILVIVN

SEQ ID NO: 1591131 - protein, 17 aa, Staphylococcus aureus
GQNIARTIALRTGLSDT

SEQ ID NO: 1591132 - protein, 26 aa, Staphylococcus aureus
GTASILVGTTLIFGLGNQEAKAAENT

SEQ ID NO: 1591133 - protein, 28 aa, Staphylococcus aureus
GTKPKIMAAIVLWLFGSIASILGLCLSL

SEQ ID NO: 1591134 - protein, 17 aa, Staphylococcus aureus
GVYVLTLMFKKLRNFST

SEQ ID NO: 1591135 - protein, 23 aa, Staphylococcus aureus
GYYNKNAFAMDKSHPEPIEDNDK

SEQ ID NO: 1591136 - protein, 20 aa, Staphylococcus aureus
HHFKLEIVPIHYIHSDKPTN

SEQ ID NO: 1591137 - protein, 18 aa, Staphylococcus aureus
HLYLNIIGFVLAILVALR

SEQ ID NO: 1591138 - protein, 24 aa, Staphylococcus aureus
HMLYIIFGFLLMYGLDYLYDTFAP

SEQ ID NO: 1591139 - protein, 17 aa, Staphylococcus aureus
IFISKWLYRRKGSWVKV

SEQ ID NO: 1591140 - protein, 17 aa, Staphylococcus aureus
IFVPMLILIGFHPAFTQ

SEQ ID NO: 1591141 - protein, 21 aa, Staphylococcus aureus
IIFTVLCIGIVLWVVGLHPLA

SEQ ID NO: 1591142 - protein, 19 aa, Staphylococcus aureus
IINLFVCITLLVAIGMGFV

SEQ ID NO: 1591143 - protein, 26 aa, Staphylococcus aureus
INIDSKLILQVLFNLIDNALKHAESH

SEQ ID NO: 1591144 - protein, 22 aa, Staphylococcus aureus
ISKKTYQGIFSFDVLGLQDIHR

SEQ ID NO: 1591145 - protein, 25 aa, Staphylococcus aureus
ISTLLLIVILVVFSVLLIVNETKLF

SEQ ID NO: 1591146 - protein, 17 aa, Staphylococcus aureus
IVHQKWISIPSRFILNI

SEQ ID NO: 1591147 - protein, 22 aa, Staphylococcus aureus
IVMLLARYIPIVLQILIVSSLV

SEQ ID NO: 1591148 - protein, 21 aa, Staphylococcus aureus
IWISAGIIGIIQYSSILSSIL

SEQ ID NO: 1591149 - protein, 30 aa, Staphylococcus aureus
KATIRNIRQNLFWAFGYNIAGIPIAALGLL

SEQ ID NO: 1591150 - protein, 40 aa, Staphylococcus aureus
KDFLAQWKLYIISAVVLIMVLIGFIFWRQDDYTSRDFENK

SEQ ID NO: 1591151 - protein, 37 aa, Staphylococcus aureus
KKNIHEPWLFSLPSLILMVLVPVIFFVPNIFGKGIIV

SEQ ID NO: 1591152 - protein, 21 aa, Staphylococcus aureus
KKYYNFYGVGALDKDPIKTGA

SEQ ID NO: 1591153 - protein, 33 aa, Staphylococcus aureus
KQNNKYYFQTVLNNASFWKEYKFYNANNQELAT

SEQ ID NO: 1591154 - protein, 62 aa, Staphylococcus aureus
KSESSAIILLMFFIGIIVLSIWTQSYLIGFFASILNVFVFNYFFTVPRFTLEMYRFEYPITF

SEQ ID NO: 1591155 - protein, 26 aa, Staphylococcus aureus
KSKLKYTAKWFPFGPIFAAILCIVVI

SEQ ID NO: 1591156 - protein, 22 aa, Staphylococcus aureus
KTTLLVTWMFPVGVAIISYGIQ

SEQ ID NO: 1591157 - protein, 28 aa, Staphylococcus aureus
LAAILMGPLVVYWNWTWGITVAIILGIG

SEQ ID NO: 1591158 - protein, 17 aa, Staphylococcus aureus
LDFKRKGAELANFYTGI

SEQ ID NO: 1591159 - protein, 19 aa, Staphylococcus aureus
LFAHYVAIEYVKDSDLPQP

SEQ ID NO: 1591160 - protein, 27 aa, Staphylococcus aureus
LFFSSVLIIFIILLSGLTFLPDLMLGP

SEQ ID NO: 1591161 - protein, 17 aa, Staphylococcus aureus
LFKLLPKENNTNKAHLD

SEQ ID NO: 1591162 - protein, 20 aa, Staphylococcus aureus
LILLMLVVTLFFLNNSRYFN

SEQ ID NO: 1591163 - protein, 36 aa, Staphylococcus aureus
LKANQVQPLNKYPVVFVHGFLGLVGDNAPALYPNYW

SEQ ID NO: 1591164 - protein, 23 aa, Staphylococcus aureus
LKQIKFQYAITKKQLYRTDLLFQ

SEQ ID NO: 1591165 - protein, 30 aa, Staphylococcus aureus
LLALGVILLLLLIFIGIKYLSFVKTISQQQ

SEQ ID NO: 1591166 - protein, 33 aa, Staphylococcus aureus
LLTDQKYLLFWLLLGFIFGFFPPIQTTINSLLA

SEQ ID NO: 1591167 - protein, 29 aa, Staphylococcus aureus
LSALIFNALIIVLLIPIAMKGVKFKGAST

SEQ ID NO: 1591168 - protein, 26 aa, Staphylococcus aureus
LSFLVHPLLILVFSALAFIVPGASDA

SEQ ID NO: 1591169 - protein, 31 aa, Staphylococcus aureus
MIEMLVVMMLISIFLLLTLTSKGLSNLRVID

SEQ ID NO: 1591170 - protein, 17 aa, Staphylococcus aureus
MMDTFVKHPIKTGMLNG

SEQ ID NO: 1591171 - protein, 18 aa, Staphylococcus aureus
MSMLFLFGRMLSRHGKRV

SEQ ID NO: 1591172 - protein, 18 aa, Staphylococcus aureus
NLITPIWILCLVGIMMHM

SEQ ID NO: 1591173 - protein, 27 aa, Staphylococcus aureus
NLVAMFIPLFFIYKYHQPMFGKLSSQP

SEQ ID NO: 1591174 - protein, 24 aa, Staphylococcus aureus
NMELPWVSFIVHFSFSIVIAIIYC

SEQ ID NO: 1591175 - protein, 26 aa, Staphylococcus aureus
NTPQGSIFYFYLTVNPIEMEGAMDEN

SEQ ID NO: 1591176 - protein, 17 aa, Staphylococcus aureus
NTVYIIIALLALTLMFI

SEQ ID NO: 1591177 - protein, 26 aa, Staphylococcus aureus
NVTANITMPAYIDPENVTKTGNVTLT

SEQ ID NO: 1591178 - protein, 26 aa, Staphylococcus aureus
NYKVKAYLSLLNLKGKNLYLIDGIKI

SEQ ID NO: 1591179 - protein, 37 aa, Staphylococcus aureus
NYTGNLDLFILRLVLLSCLFILTISVINLWTFLMLLN

SEQ ID NO: 1591180 - protein, 17 aa, Staphylococcus aureus
PVVFGLGAFISTIGNAV

SEQ ID NO: 1591181 - protein, 23 aa, Staphylococcus aureus
QEKRIDLFFKYNLNHYKSLKVTR

SEQ ID NO: 1591182 - protein, 19 aa, Staphylococcus aureus
QGIVLYYIVAIVVAFLLLN

SEQ ID NO: 1591183 - protein, 32 aa, Staphylococcus aureus
QKRQKLLRTTFILLTLVGIGLTVFSFISNNML

SEQ ID NO: 1591184 - protein, 25 aa, Staphylococcus aureus
QQRQTLELILLLKDLGCALSDIDML

SEQ ID NO: 1591185 - protein, 28 aa, Staphylococcus aureus
QRSLNLWTYVMLIFMTLAAILTGPLVVY

SEQ ID NO: 1591186 - protein, 21 aa, Staphylococcus aureus
QTFNYTWFVGGLLGVGYLTGN

SEQ ID NO: 1591187 - protein, 20 aa, Staphylococcus aureus
QYSSIMSSILMKNKWPFLIA

SEQ ID NO: 1591188 - protein, 17 aa, Staphylococcus aureus
RFCLCVMNPIPISMNIK

SEQ ID NO: 1591189 - protein, 24 aa, Staphylococcus aureus
RNFSTHKWMLYGILLTGPASMLAI

SEQ ID NO: 1591190 - protein, 26 aa, Staphylococcus aureus
RYSHWLRFVWPVVAFVLIFGGGLLIT

SEQ ID NO: 1591191 - protein, 24 aa, Staphylococcus aureus
SGELTYQRFLNGYPTFNKEGANQI

SEQ ID NO: 1591192 - protein, 18 aa, Staphylococcus aureus
SGVYVLTLMFKKLRKFST

SEQ ID NO: 1591193 - protein, 32 aa, Staphylococcus aureus
SIGVAIFIISFSFYLLNQPNNWAWSSLNICIN

SEQ ID NO: 1591194 - protein, 20 aa, Staphylococcus aureus
SLGLGLYLVQLILKQHNSEL

SEQ ID NO: 1591195 - protein, 18 aa, Staphylococcus aureus
SLYIINDFKTYIDCTYIP

SEQ ID NO: 1591196 - protein, 17 aa, Staphylococcus aureus
SMMLIPGSLVFLFGRML

SEQ ID NO: 1591197 - protein, 17 aa, Staphylococcus aureus
SRTIVFFPIFYLGYIFT

SEQ ID NO: 1591198 - protein, 34 aa, Staphylococcus aureus
SSILMKNKWPFLIALPFMNCYGIGVTFYYQQKVA

SEQ ID NO: 1591199 - protein, 21 aa, Staphylococcus aureus
STLFLLLYFLVNGISLIIQGF

SEQ ID NO: 1591200 - protein, 20 aa, Staphylococcus aureus
SVLKLYPVYMIKNPIMFVVE

SEQ ID NO: 1591201 - protein, 37 aa, Staphylococcus aureus
TEVISPTLFVLLMYLLSMITAYIFYSYERAKGQMNFI

SEQ ID NO: 1591202 - protein, 34 aa, Staphylococcus aureus
TFSEFRTFLAVLLMLLLFISISLVIASTYSIIRP

SEQ ID NO: 1591203 - protein, 18 aa, Staphylococcus aureus
THFLISIPVIIGGSFSAF

SEQ ID NO: 1591204 - protein, 37 aa, Staphylococcus aureus
TIQSPITFWYGKYIILIPSSYFKSVIDKRLKYIILHE

SEQ ID NO: 1591205 - protein, 19 aa, Staphylococcus aureus
TLEMYRFEYPITFATSIFA

SEQ ID NO: 1591206 - protein, 36 aa, Staphylococcus aureus
TNSSKRVHLKRWQFISILIGTIIITAVITVVAYIFI

SEQ ID NO: 1591207 - protein, 17 aa, Staphylococcus aureus
VFILLSLIVSRYLYSVA

SEQ ID NO: 1591208 - protein, 18 aa, Staphylococcus aureus
VIFDWRRGVEYHSANPPL

SEQ ID NO: 1591209 - protein, 19 aa, Staphylococcus aureus
VIFSIVMMLFVNKLLRGDK

SEQ ID NO: 1591210 - protein, 27 aa, Staphylococcus aureus
VQEAYNNYFEPVLNYILEVIHSVETAV

SEQ ID NO: 1591211 - protein, 26 aa, Staphylococcus aureus
VRFVVKFILFFTILNIIAVYIFDPEY

SEQ ID NO: 1591212 - protein, 22 aa, Staphylococcus aureus
VVFTLPFLFKLLPKENNTNKAH

SEQ ID NO: 1591213 - protein, 28 aa, Staphylococcus aureus
WFVNIFDWRYLFLVVLLIGMIDFVFGYL

SEQ ID NO: 1591214 - protein, 25 aa, Staphylococcus aureus
YTINSIMVYIFIALITYISQVCCFG

SEQ ID NO: 1591215 - protein, 25 aa, Staphylococcus aureus
YTLAYILNIFIFTLITNISFYLIRR

SEQ ID NO: 1591216 - protein, 27 aa, Staphylococcus aureus
AACIFLIVLFILYIWLPQDRNQVKQSD

SEQ ID NO: 1591217 - protein, 18 aa, Staphylococcus aureus
AFAICMILGTLTATTPLV

SEQ ID NO: 1591218 - protein, 20 aa, Staphylococcus aureus
AGIIFLMPYGLCFLPLYKQK

SEQ ID NO: 1591219 - protein, 17 aa, Staphylococcus aureus
AMRLLLGSTLASIISGS

SEQ ID NO: 1591220 - protein, 29 aa, Staphylococcus aureus
AMVIKLVKLIFMLDYVLFHSIQKSYTTHI

SEQ ID NO: 1591221 - protein, 17 aa, Staphylococcus aureus
CNFSIIMWLFFSCSLLK

SEQ ID NO: 1591222 - protein, 17 aa, Staphylococcus aureus
DDNAAYDLTLNGSAKLN

SEQ ID NO: 1591223 - protein, 23 aa, Staphylococcus aureus
DKDYAYIRFPVSNGTRDVKIVSS

SEQ ID NO: 1591224 - protein, 19 aa, Staphylococcus aureus
DKEYIARRLANLIHVEHLK

SEQ ID NO: 1591225 - protein, 29 aa, Staphylococcus aureus
DNLLTPLLSIFITAFLTFSFVGPITRQLG

SEQ ID NO: 1591226 - protein, 27 aa, Staphylococcus aureus
EPLEFSFLFVAPILYVIHAFFDGLAFM

SEQ ID NO: 1591227 - protein, 17 aa, Staphylococcus aureus
ERYILIHDLLKPTILPI

SEQ ID NO: 1591228 - protein, 46 aa, Staphylococcus aureus
EVNFRTQLTGYPENRYKTYYYYNNGYTLTWDNGLVLYSNKANGDGK

SEQ ID NO: 1591229 - protein, 30 aa, Staphylococcus aureus
FFGGSWDTWVYQGLAVLVVGCPCALVISTP

SEQ ID NO: 1591230 - protein, 18 aa, Staphylococcus aureus
FIGLLILYYICRLISEER

SEQ ID NO: 1591231 - protein, 17 aa, Staphylococcus aureus
FKPRNIIQTLFIVSLIS

SEQ ID NO: 1591232 - protein, 17 aa, Staphylococcus aureus
FNKNLVEIYLTSIIDNL

SEQ ID NO: 1591233 - protein, 17 aa, Staphylococcus aureus
FSFLILVALVSKLILIF

SEQ ID NO: 1591234 - protein, 17 aa, Staphylococcus aureus
FTLFGYVFLIFWTVIFS

SEQ ID NO: 1591235 - protein, 21 aa, Staphylococcus aureus
GFDIILTMFMLSLAIIMTAGG

SEQ ID NO: 1591236 - protein, 35 aa, Staphylococcus aureus
GFSMSFLNAIFIALPIFLVAKIFNNVLSHKPIYMK

SEQ ID NO: 1591237 - protein, 19 aa, Staphylococcus aureus
GIFISKWLYRRKGSWVKVL

SEQ ID NO: 1591238 - protein, 17 aa, Staphylococcus aureus
GLFVIKGYLYVKHAGFK

SEQ ID NO: 1591239 - protein, 20 aa, Staphylococcus aureus
GVTLFLLLKAFSSGASSLTG

SEQ ID NO: 1591240 - protein, 30 aa, Staphylococcus aureus
HLSYYVTFLILWLLIIELLTTGLLNSISKV

SEQ ID NO: 1591241 - protein, 17 aa, Staphylococcus aureus
IAAIFYVSNWWYIAKDV

SEQ ID NO: 1591242 - protein, 19 aa, Staphylococcus aureus
IAKYFAILPAMFMAAMPAM

SEQ ID NO: 1591243 - protein, 29 aa, Staphylococcus aureus
IEMLVVMMLISIFLLLTMTSKGLSNLRVI

SEQ ID NO: 1591244 - protein, 22 aa, Staphylococcus aureus
IFLYSFIMMLGVELVFFLANLF

SEQ ID NO: 1591245 - protein, 18 aa, Staphylococcus aureus
IFTIALYLVIGPFFALPR

SEQ ID NO: 1591246 - protein, 17 aa, Staphylococcus aureus
IIGLFVIKGYLYVKHAG

SEQ ID NO: 1591247 - protein, 18 aa, Staphylococcus aureus
IIITFLIVLINLIVTFPV

SEQ ID NO: 1591248 - protein, 20 aa, Staphylococcus aureus
ILSLFGITALLLVVALPIYT

SEQ ID NO: 1591249 - protein, 27 aa, Staphylococcus aureus
IMGVTVIVLIAILFKFNLAHVATLASV

SEQ ID NO: 1591250 - protein, 20 aa, Staphylococcus aureus
ISCVPILTRSQKSLQGILVV

SEQ ID NO: 1591251 - protein, 30 aa, Staphylococcus aureus
ISKYGSFFLKGIKITILISLIGVALGSILG

SEQ ID NO: 1591252 - protein, 26 aa, Staphylococcus aureus
ITLVIITLFILLFIELVEVRIPYIDL

SEQ ID NO: 1591253 - protein, 21 aa, Staphylococcus aureus
ITVVAYIFINQKISGLNKTDQ

SEQ ID NO: 1591254 - protein, 26 aa, Staphylococcus aureus
IVAVGYIGLSLIIRGIAYLTTRRNLE

SEQ ID NO: 1591255 - protein, 18 aa, Staphylococcus aureus
IVLINLIVTFPVLRKFKI

SEQ ID NO: 1591256 - protein, 32 aa, Staphylococcus aureus
IYHSFLLKKWYLIIYLLFILAALLITLTTIQH

SEQ ID NO: 1591257 - protein, 17 aa, Staphylococcus aureus
KAKELCLSLLPINIIVV

SEQ ID NO: 1591258 - protein, 27 aa, Staphylococcus aureus
KDKKLEVISSLFSVKKITFDLSDAKKT

SEQ ID NO: 1591259 - protein, 17 aa, Staphylococcus aureus
KELPKTGLTSVDNFIST

SEQ ID NO: 1591260 - protein, 23 aa, Staphylococcus aureus
KFSTHKWMLYGILLTGPASMLAI

SEQ ID NO: 1591261 - protein, 22 aa, Staphylococcus aureus
KNFILMLIILFLMEFARGMYIL

SEQ ID NO: 1591262 - protein, 21 aa, Staphylococcus aureus
KNLCFVLFSYFFCGGLSIMFL

SEQ ID NO: 1591263 - protein, 41 aa, Staphylococcus aureus
KNSERRGMLKGCGGCLISFIILIILLSACSMMFSNNDNSTS

SEQ ID NO: 1591264 - protein, 34 aa, Staphylococcus aureus
KQNNKYYFQTVLNNASFWKEYKFYNANNQELATT

SEQ ID NO: 1591265 - protein, 21 aa, Staphylococcus aureus
KWKIMLSILLSIISVFSGLVP

SEQ ID NO: 1591266 - protein, 23 aa, Staphylococcus aureus
KYAIDLLFIICVILGILGVIISL

SEQ ID NO: 1591267 - protein, 20 aa, Staphylococcus aureus
LCFLLLPIIFIPNPNHVFIN

SEQ ID NO: 1591268 - protein, 26 aa, Staphylococcus aureus
LDNAMGAVQQYIDEQHLGVISSTNYI

SEQ ID NO: 1591269 - protein, 24 aa, Staphylococcus aureus
LGGLILLNLLEKVELPIEGMMLIS

SEQ ID NO: 1591270 - protein, 32 aa, Staphylococcus aureus
LGSNNWSFVLTWLPIEIKLALITTLIALFSTL

SEQ ID NO: 1591271 - protein, 24 aa, Staphylococcus aureus
LIAVTFLISMLYLFVGIDFDIFEY

SEQ ID NO: 1591272 - protein, 20 aa, Staphylococcus aureus
LIHDLLKPTILPIIPLLGIS

SEQ ID NO: 1591273 - protein, 18 aa, Staphylococcus aureus
LIITFLVLIANSVTFVFI

SEQ ID NO: 1591274 - protein, 23 aa, Staphylococcus aureus
LIPYLLWMVIFIIVPVVLLIYFS

SEQ ID NO: 1591275 - protein, 19 aa, Staphylococcus aureus
LISAIIIILVVYYIMPIVL

SEQ ID NO: 1591276 - protein, 21 aa, Staphylococcus aureus
LKFSLWRYKKLTVAILVLIVM

SEQ ID NO: 1591277 - protein, 19 aa, Staphylococcus aureus
LLFVSQLVFHFNSGIKAER

SEQ ID NO: 1591278 - protein, 20 aa, Staphylococcus aureus
LLNNNFLLQIKLDLDSLTAF

SEQ ID NO: 1591279 - protein, 30 aa, Staphylococcus aureus
LLSFKLYRFYFYRLFAIVTWVLFIGSLSQY

SEQ ID NO: 1591280 - protein, 25 aa, Staphylococcus aureus
LMIPLLILISIVVFSLAIIQPGDPF

SEQ ID NO: 1591281 - protein, 17 aa, Staphylococcus aureus
LPEMWYIVSSIVGYLLF

SEQ ID NO: 1591282 - protein, 26 aa, Staphylococcus aureus
LQSGQFWRKFEVYEGDKKLPIKLVSY

SEQ ID NO: 1591283 - protein, 20 aa, Staphylococcus aureus
LTLFLNFAILIISIVLIIFG

SEQ ID NO: 1591284 - protein, 23 aa, Staphylococcus aureus
LTSIMLIILISVASIYFKMKYDE

SEQ ID NO: 1591285 - protein, 19 aa, Staphylococcus aureus
LVTSMLFVGSIVIGGYSLF

SEQ ID NO: 1591286 - protein, 23 aa, Staphylococcus aureus
MASSIILTNILPYDAQAASEKDT

SEQ ID NO: 1591287 - protein, 17 aa, Staphylococcus aureus
MLLSTSMLILSSSSSLG

SEQ ID NO: 1591288 - protein, 20 aa, Staphylococcus aureus
NAAYDLTLNGSAKLNNMTSM

SEQ ID NO: 1591289 - protein, 62 aa, Staphylococcus aureus
NNTFQDFDINYNGDTKVMTVKYAGQTWTRNISDWIAKSGTTNFSLSMTASTGGATNLQQVQF

SEQ ID NO: 1591290 - protein, 24 aa, Staphylococcus aureus
NRQQSFANCKQLRQVYPNGVTADH

SEQ ID NO: 1591291 - protein, 20 aa, Staphylococcus aureus
NYLTILFLILVLVGMVFNVE

SEQ ID NO: 1591292 - protein, 21 aa, Staphylococcus aureus
PEIELGLQSGQFWRKFEVYEG

SEQ ID NO: 1591293 - protein, 17 aa, Staphylococcus aureus
PIVYGFKSFLIGSTYIF

SEQ ID NO: 1591294 - protein, 25 aa, Staphylococcus aureus
QDGKKLFFFLWDFVIFVFNVQLRKV

SEQ ID NO: 1591295 - protein, 24 aa, Staphylococcus aureus
QGLIPLFILLCFPFTPNTLINFVA

SEQ ID NO: 1591296 - protein, 23 aa, Staphylococcus aureus
RGFDIILTMFMLSLAIIMTAGGA

SEQ ID NO: 1591297 - protein, 17 aa, Staphylococcus aureus
RLIQMIVVLFVISTLAF

SEQ ID NO: 1591298 - protein, 23 aa, Staphylococcus aureus
RSEYWYMALWHLILMVPAVCVLI

SEQ ID NO: 1591299 - protein, 17 aa, Staphylococcus aureus
RSYIYLVQDNEIDKVKE

SEQ ID NO: 1591300 - protein, 25 aa, Staphylococcus aureus
SFPERRWVYILALSSSALCGLFIQH

SEQ ID NO: 1591301 - protein, 21 aa, Staphylococcus aureus
SGFMFFFIVYVLYISYFNSDK

SEQ ID NO: 1591302 - protein, 21 aa, Staphylococcus aureus
SIALPFCLIPLQLATSNKDLM

SEQ ID NO: 1591303 - protein, 17 aa, Staphylococcus aureus
SIIVTIILFIKQRHLAV

SEQ ID NO: 1591304 - protein, 17 aa, Staphylococcus aureus
SIKAFPLAIGALYLPII

SEQ ID NO: 1591305 - protein, 17 aa, Staphylococcus aureus
SILLIGMAISNVSKEQY

SEQ ID NO: 1591306 - protein, 25 aa, Staphylococcus aureus
SIVGLFLFYLLLQFKIVPLTWVEDG

SEQ ID NO: 1591307 - protein, 28 aa, Staphylococcus aureus
SKEQYAKRFFFFATSCLVLTLVVASSLS

SEQ ID NO: 1591308 - protein, 19 aa, Staphylococcus aureus
SLLVQWWHWMNHLLHFNLG

SEQ ID NO: 1591309 - protein, 22 aa, Staphylococcus aureus
SMTFGLIFLFSEEIGDLFSIKV

SEQ ID NO: 1591310 - protein, 26 aa, Staphylococcus aureus
SSWHFYALFLCFFIISYKLTEKIMKV

SEQ ID NO: 1591311 - protein, 36 aa, Staphylococcus aureus
TEALFAEKPVAKNDLKEIPLLVTKKNDVSETVNTDN

SEQ ID NO: 1591312 - protein, 26 aa, Staphylococcus aureus
TFTELMIIISIIYFKNLYIGRLDKPS

SEQ ID NO: 1591313 - protein, 17 aa, Staphylococcus aureus
TILIIWILDAGHLFRLN

SEQ ID NO: 1591314 - protein, 17 aa, Staphylococcus aureus
TIVIIGLFVIKGYLYVK

SEQ ID NO: 1591315 - protein, 46 aa, Staphylococcus aureus
TNNNYSAILKKFWMMYWPKLVILMGIIILIVILNAIFNNVNKNDRM

SEQ ID NO: 1591316 - protein, 51 aa, Staphylococcus aureus
TPNEIALFTLLMTLTIIFLVVILTMYPLAKFLNFNLSIAMLIALAVCLIPT

SEQ ID NO: 1591317 - protein, 24 aa, Staphylococcus aureus
TREGLALGVYIILSGSRSSAIKSA

SEQ ID NO: 1591318 - protein, 23 aa, Staphylococcus aureus
VAPILYVVHALLTGLSLFIAATF

SEQ ID NO: 1591319 - protein, 39 aa, Staphylococcus aureus
VAVYVIFYFIWLRFEWPQYLIYILFVLCTLTVLKLIIKP

SEQ ID NO: 1591320 - protein, 26 aa, Staphylococcus aureus
VGDNAPALYPNYWGGNKYKVIEELRK

SEQ ID NO: 1591321 - protein, 19 aa, Staphylococcus aureus
VIELGLKTASTWKKFEVYE

SEQ ID NO: 1591322 - protein, 20 aa, Staphylococcus aureus
VIGGYSLFKVGFQNLIRFDF

SEQ ID NO: 1591323 - protein, 19 aa, Staphylococcus aureus
VIQWFYKEVDWFEAKLKDD

SEQ ID NO: 1591324 - protein, 23 aa, Staphylococcus aureus
VLSVLSLPIFLYAVIKFFFSAKR

SEQ ID NO: 1591325 - protein, 33 aa, Staphylococcus aureus
VVIYFNFTWSFYGNLLYLLPLSILGLERYFQQR

SEQ ID NO: 1591326 - protein, 24 aa, Staphylococcus aureus
WDEILTILPWIIGALIVTIFIGRQ

SEQ ID NO: 1591327 - protein, 18 aa, Staphylococcus aureus
WHWMNHLLHFNLGKSFES

SEQ ID NO: 1591328 - protein, 26 aa, Staphylococcus aureus
WKRRLKRLIPAVLFLICVVLTFTLIF

SEQ ID NO: 1591329 - protein, 17 aa, Staphylococcus aureus
WMFIGFMIFGAVSSLIS

SEQ ID NO: 1591330 - protein, 19 aa, Staphylococcus aureus
YLSIIMYLLVLILSLIIHP

SEQ ID NO: 1591331 - protein, 18 aa, Staphylococcus aureus
YTILMYTCAYVLIRMFKN

SEQ ID NO: 1591332 - protein, 22 aa, Staphylococcus aureus
ALITWFYTMLWSIVGVVWIVFS

SEQ ID NO: 1591333 - protein, 20 aa, Staphylococcus aureus
AMTQLKQGIANKAQIKGSEN

SEQ ID NO: 1591334 - protein, 31 aa, Staphylococcus aureus
DEANTSLIWGLLASLGSLLLFRRKKENKDKK

SEQ ID NO: 1591335 - protein, 17 aa, Staphylococcus aureus
DEKSLIILADLESINFL

SEQ ID NO: 1591336 - protein, 22 aa, Staphylococcus aureus
DFSHYLLLIILFSLVILQYILV

SEQ ID NO: 1591337 - protein, 22 aa, Staphylococcus aureus
DMHIMANIFLPKDGFNNIERIS

SEQ ID NO: 1591338 - protein, 32 aa, Staphylococcus aureus
DSVKEGDTFTFKYGQYFRPGSVRLPSQTQNLY

SEQ ID NO: 1591339 - protein, 18 aa, Staphylococcus aureus
EFWPVYLVVTGIAIVVPC

SEQ ID NO: 1591340 - protein, 28 aa, Staphylococcus aureus
ENNKYVVVEYPYFTPIPDSQLNKAKMVE

SEQ ID NO: 1591341 - protein, 22 aa, Staphylococcus aureus
ENPKIIYVILPLAIGILNISLI

SEQ ID NO: 1591342 - protein, 23 aa, Staphylococcus aureus
EQLDQAMERLINGIQDKDQVKQS

SEQ ID NO: 1591343 - protein, 18 aa, Staphylococcus aureus
EQQNAFYEILHLPNLNEE

SEQ ID NO: 1591344 - protein, 22 aa, Staphylococcus aureus
ETLPVHLLKYEDNKYKMFITVK

SEQ ID NO: 1591345 - protein, 24 aa, Staphylococcus aureus
ETTRNAFFIGRTIDYNVSLEGALK

SEQ ID NO: 1591346 - protein, 23 aa, Staphylococcus aureus
FGILFQLPILFIGLAKFGLIDIT

SEQ ID NO: 1591347 - protein, 19 aa, Staphylococcus aureus
FGVLVGIPVAFLTSIFGII

SEQ ID NO: 1591348 - protein, 17 aa, Staphylococcus aureus
FIAARIYFVIFQWPYYA

SEQ ID NO: 1591349 - protein, 18 aa, Staphylococcus aureus
FIKGGDGFDFGHVERFIQ

SEQ ID NO: 1591350 - protein, 32 aa, Staphylococcus aureus
FIVNIIIIGFLLTVMVIGLIWLIKDKRQSQHS

SEQ ID NO: 1591351 - protein, 20 aa, Staphylococcus aureus
GAISWFFLSLILSLTQFTPF

SEQ ID NO: 1591352 - protein, 28 aa, Staphylococcus aureus
GFILAFTSLFLVIWFPASPFVIIFSAMM

SEQ ID NO: 1591353 - protein, 22 aa, Staphylococcus aureus
GPLVVYWNWAWGITVIVIYGIG

SEQ ID NO: 1591354 - protein, 17 aa, Staphylococcus aureus
GSLLLFTSIFGKLGKKL

SEQ ID NO: 1591355 - protein, 31 aa, Staphylococcus aureus
GSNNWSFVLTWLPIEIKLALITTLIALFSTL

SEQ ID NO: 1591356 - protein, 25 aa, Staphylococcus aureus
GTRNVEVPVKVYPVANAKAPSRDVK

SEQ ID NO: 1591357 - protein, 17 aa, Staphylococcus aureus
GVTSTAKVPPIMAGDQV

SEQ ID NO: 1591358 - protein, 17 aa, Staphylococcus aureus
HALAEKDNTKRSVNYTD

SEQ ID NO: 1591359 - protein, 18 aa, Staphylococcus aureus
HDYRFIDRENADSGTFNY

SEQ ID NO: 1591360 - protein, 17 aa, Staphylococcus aureus
HVYFDTYDPKKDSYKVF

SEQ ID NO: 1591361 - protein, 18 aa, Staphylococcus aureus
IHKWIQFLFIVIVAMVIS

SEQ ID NO: 1591362 - protein, 22 aa, Staphylococcus aureus
IIALLYVLLSPTHPLALIVGII

SEQ ID NO: 1591363 - protein, 17 aa, Staphylococcus aureus
IIIVLIVSPIIAFCVGF

SEQ ID NO: 1591364 - protein, 17 aa, Staphylococcus aureus
IMLFHTPGAILSTSIAL

SEQ ID NO: 1591365 - protein, 22 aa, Staphylococcus aureus
ISAWGYWFSAFLGNVAYATLLM

SEQ ID NO: 1591366 - protein, 23 aa, Staphylococcus aureus
ISISWFPAFFVTGFLGGLTTFST

SEQ ID NO: 1591367 - protein, 17 aa, Staphylococcus aureus
IVILAFPPLTVALALMT

SEQ ID NO: 1591368 - protein, 27 aa, Staphylococcus aureus
KDLTAELNLNLFIDPTTVTKQGSQKVE

SEQ ID NO: 1591369 - protein, 17 aa, Staphylococcus aureus
KHFLLFNGLMGGLSFVL

SEQ ID NO: 1591370 - protein, 19 aa, Staphylococcus aureus
KISMPNVENMSFAIPVNEV

SEQ ID NO: 1591371 - protein, 27 aa, Staphylococcus aureus
KVEVTANLEINLFIDPKTVQSNGEQKI

SEQ ID NO: 1591372 - protein, 25 aa, Staphylococcus aureus
LAFFSVVSVFIFLLTLSLFSGQNNV

SEQ ID NO: 1591373 - protein, 20 aa, Staphylococcus aureus
LAIAFLLRPIGGVVFGIIGD

SEQ ID NO: 1591374 - protein, 19 aa, Staphylococcus aureus
LDGTRLLDQAKQTAKQQLN

SEQ ID NO: 1591375 - protein, 25 aa, Staphylococcus aureus
LDVSFLIDMSIGIVGFLMTYLPIQK

SEQ ID NO: 1591376 - protein, 17 aa, Staphylococcus aureus
LFGEFFGWVAGWALLAE

SEQ ID NO: 1591377 - protein, 19 aa, Staphylococcus aureus
LRQSFNIPALKAWQSVKQN

SEQ ID NO: 1591378 - protein, 25 aa, Staphylococcus aureus
LTGETIPHVFILIDNFDAVKDSPFQ

SEQ ID NO: 1591379 - protein, 23 aa, Staphylococcus aureus
LTSIILIILISVASIYFKMKYDE

SEQ ID NO: 1591380 - protein, 19 aa, Staphylococcus aureus
LVGLILLRLFKINLFSFKK

SEQ ID NO: 1591381 - protein, 20 aa, Staphylococcus aureus
LVLCNFVSAILWFVSAISIL

SEQ ID NO: 1591382 - protein, 30 aa, Staphylococcus aureus
LVVITIFIIIFLYFKIRLYSVFLVMVTQII

SEQ ID NO: 1591383 - protein, 17 aa, Staphylococcus aureus
MFVVEVGMILTLILICF

SEQ ID NO: 1591384 - protein, 18 aa, Staphylococcus aureus
MLPKSIWENFKSQNFENM

SEQ ID NO: 1591385 - protein, 23 aa, Staphylococcus aureus
NINFLQIIRFYYKDIFVCFVAVV

SEQ ID NO: 1591386 - protein, 27 aa, Staphylococcus aureus
NKQNKYSIRRFTVGTTSVIVGATILFG

SEQ ID NO: 1591387 - protein, 22 aa, Staphylococcus aureus
NTAMGNLKHALAEKDNTKRSVN

SEQ ID NO: 1591388 - protein, 25 aa, Staphylococcus aureus
NVILLILSIFTWNLFHWGTNPTVQY

SEQ ID NO: 1591389 - protein, 17 aa, Staphylococcus aureus
NVLFGEFFGWVAGWALL

SEQ ID NO: 1591390 - protein, 33 aa, Staphylococcus aureus; identical to SEQ ID NO: 1573552

SEQ ID NO: 1591391 - protein, 25 aa, Staphylococcus aureus
PLIAAIICILVFKYKKIQLAGLKFS

SEQ ID NO: 1591392 - protein, 25 aa, Staphylococcus aureus
PRAKLMFVFLFIILIFFCHSPLTYL

SEQ ID NO: 1591393 - protein, 19 aa, Staphylococcus aureus
PTDGGLSWSDDHKSLIYRY

SEQ ID NO: 1591394 - protein, 22 aa, Staphylococcus aureus
PTIVFGFFALTFVTPVLRSFIS

SEQ ID NO: 1591395 - protein, 38 aa, Staphylococcus aureus
QNFENMINYHSKFDILSWLQDPFATPTLGKRVNLETGV

SEQ ID NO: 1591396 - protein, 18 aa, Staphylococcus aureus
QTLNTAMKGLRDSIANEA

SEQ ID NO: 1591397 - protein, 26 aa, Staphylococcus aureus
RNELQAFFDANYHDYRFIDRENADSG

SEQ ID NO: 1591398 - protein, 26 aa, Staphylococcus aureus
RTKIQEIDRVLASHPDVATIRQNVTA

SEQ ID NO: 1591399 - protein, 26 aa, Staphylococcus aureus
RTTDKYGYYNYAGYSNFIVTSNDTGG

SEQ ID NO: 1591400 - protein, 24 aa, Staphylococcus aureus
SDKDYAYIRFPVSNGAREVKIVSS

SEQ ID NO: 1591401 - protein, 19 aa, Staphylococcus aureus
SGLLYIGFVIYTLTIGSYD

SEQ ID NO: 1591402 - protein, 18 aa, Staphylococcus aureus
SKKVLSVRFLTKEMLADI

SEQ ID NO: 1591403 - protein, 24 aa, Staphylococcus aureus
SVWLVLLFSVMGLWQVSNAAEQYT

SEQ ID NO: 1591404 - protein, 24 aa, Staphylococcus aureus
TEPLEFSFLFVAPVLYGIHVLLAG

SEQ ID NO: 1591405 - protein, 21 aa, Staphylococcus aureus
TFPGINKWLIPIGTSPIKGIL

SEQ ID NO: 1591406 - protein, 24 aa, Staphylococcus aureus
TGLSIPTIYAFKKSLDALPNKKTT

SEQ ID NO: 1591407 - protein, 21 aa, Staphylococcus aureus
TILLIVAWINQFLAIKHISPI

SEQ ID NO: 1591408 - protein, 33 aa, Staphylococcus aureus
TLSIMFNFWLYVILYWFIPLLTTFQIIRYWAEM

SEQ ID NO: 1591409 - protein, 17 aa, Staphylococcus aureus
TVAMFITLIIIAVLMGM

SEQ ID NO: 1591410 - protein, 23 aa, Staphylococcus aureus
TVKVYEYLGKKDELPQSVYANTS

SEQ ID NO: 1591411 - protein, 25 aa, Staphylococcus aureus
VFIVLPIFLVVYVSISYALAYILNR

SEQ ID NO: 1591412 - protein, 20 aa, Staphylococcus aureus
VFVALALYLVPGLGLIFALF

SEQ ID NO: 1591413 - protein, 18 aa, Staphylococcus aureus
VGIPVAFLTSIFGIIALD

SEQ ID NO: 1591414 - protein, 27 aa, Staphylococcus aureus
VIAALIAIFVLLWNKNEGFRNFIINAW

SEQ ID NO: 1591415 - protein, 17 aa, Staphylococcus aureus
VLSVRFLTKEMLADIEP

SEQ ID NO: 1591416 - protein, 35 aa, Staphylococcus aureus
VNELWYGLIPIQIIGFILVMLFAVYLGFKEQKRIK

SEQ ID NO: 1591417 - protein, 25 aa, Staphylococcus aureus
VVVALLIVLIVIAYAFHKSKKEHYI

SEQ ID NO: 1591418 - protein, 20 aa, Staphylococcus aureus
WIQFLFIVIVAMVISASMRV

SEQ ID NO: 1591419 - protein, 32 aa, Staphylococcus aureus
WTPLQGIPAWAWSALFLVIIFSLNSLSVRVYG

SEQ ID NO: 1591420 - protein, 27 aa, Staphylococcus aureus
YASYILITWLVIIFALLIVAFRRARRL

SEQ ID NO: 1591421 - protein, 23 aa, Staphylococcus aureus
YHNIFALIFDWLVILGSACISIY

SEQ ID NO: 1591422 - protein, 20 aa, Staphylococcus aureus
YIELGKFWQILFIVGMVLWV

SEQ ID NO: 1591423 - protein, 20 aa, Staphylococcus aureus
YLGVIPFLQDLITDGIIAGV

SEQ ID NO: 1591424 - protein, 31 aa, Staphylococcus aureus
YLKVMFLSAPFVILFFILEQFARAIGAPMIS

SEQ ID NO: 1591425 - protein, 26 aa, Staphylococcus aureus
YTINSIMVYIFIVLIAYISQVCCFGA

SEQ ID NO: 1591426 - protein, 46 aa, Staphylococcus aureus
AKDLNFRTHLSGYHKYYPYYPYYPYYPVQLTWNNGVAFYSNNAKGD

SEQ ID NO: 1591427 - protein, 17 aa, Staphylococcus aureus
ANYTPFIDWLGYIFYPF

SEQ ID NO: 1591428 - protein, 35 aa, Staphylococcus aureus
DADNMTLDSGFYKTPKYSLGDYVWYDSNKDGKQDS

SEQ ID NO: 1591429 - protein, 34 aa, Staphylococcus aureus
DENGKYRFDNLDSGKYKVIFEKPAGLTQTVTNTT

SEQ ID NO: 1591430 - protein, 35 aa, Staphylococcus aureus
EPVLTTRQVFLGKAGFFIMLGMLQALIVSVGDLLI

SEQ ID NO: 1591431 - protein, 18 aa, Staphylococcus aureus
FIAPLLITLTISGIGYLF

SEQ ID NO: 1591432 - protein, 19 aa, Staphylococcus aureus
FLALSAYILWGILPIYWQF

SEQ ID NO: 1591433 - protein, 20 aa, Staphylococcus aureus
FLTPLDYHYFFFSDGFFITI

SEQ ID NO: 1591434 - protein, 26 aa, Staphylococcus aureus
GQVINERTIRYTFTDYINNKKDLTAE

SEQ ID NO: 1591435 - protein, 30 aa, Staphylococcus aureus
GTEFAAYNFLYTFSFSMILGELIRATKGRT

SEQ ID NO: 1591436 - protein, 20 aa, Staphylococcus aureus
GVVAAKISMPNVENMSFAIP

SEQ ID NO: 1591437 - protein, 17 aa, Staphylococcus aureus
IIACMIWYFNKSHVSII

SEQ ID NO: 1591438 - protein, 17 aa, Staphylococcus aureus
IIIVLVQVVVMILFAVL

SEQ ID NO: 1591439 - protein, 25 aa, Staphylococcus aureus
ILIFFTFILSIFFILIKSSRLNNIL

SEQ ID NO: 1591440 - protein, 18 aa, Staphylococcus aureus
ILMFILLSTVIGAYLFFK

SEQ ID NO: 1591441 - protein, 37 aa, Staphylococcus aureus
ILMSLPVLQLFIYIVGLFFLLYMAWSLWKEKPNTLEN

SEQ ID NO: 1591442 - protein, 24 aa, Staphylococcus aureus
INLKGASLFLRLGARIFKTGIAII

SEQ ID NO: 1591443 - protein, 17 aa, Staphylococcus aureus
IPIAIIAIILVIWTFHF

SEQ ID NO: 1591444 - protein, 20 aa, Staphylococcus aureus
IQPKLIIKLFLTLIIIVTYT

SEQ ID NO: 1591445 - protein, 20 aa, Staphylococcus aureus
ISAIILNFFFNGIKYKQTEE

SEQ ID NO: 1591446 - protein, 18 aa, Staphylococcus aureus
ITAVITVVAYIFINQKIS

SEQ ID NO: 1591447 - protein, 29 aa, Staphylococcus aureus
ITSYHIFRIFFILFIIAPGINYFLKYRSN

SEQ ID NO: 1591448 - protein, 19 aa, Staphylococcus aureus
IVITTLLFLLFGGSVEYIL

SEQ ID NO: 1591449 - protein, 25 aa, Staphylococcus aureus
IVSEFLFLLVIFTFGIAGIIFLMPY

SEQ ID NO: 1591450 - protein, 18 aa, Staphylococcus aureus
KEDGMWKLDWDHSVIIPG

SEQ ID NO: 1591451 - protein, 26 aa, Staphylococcus aureus
KFVLSVLSLPLFLYAVIKFFFSAKRK

SEQ ID NO: 1591452 - protein, 25 aa, Staphylococcus aureus
KQYSLLFLGIIILLSILIFIYSQFT

SEQ ID NO: 1591453 - protein, 18 aa, Staphylococcus aureus
LAPLFQWSADWLDRLGQS

SEQ ID NO: 1591454 - protein, 19 aa, Staphylococcus aureus
LFCIATIMVSWLWFFLLAI

SEQ ID NO: 1591455 - protein, 29 aa, Staphylococcus aureus
LGISLIAIMLIVCIVLVIMMMTGGKKDTY

SEQ ID NO: 1591456 - protein, 28 aa, Staphylococcus aureus
LGVASVAISTLLLLMSNGEAKAAEETGV

SEQ ID NO: 1591457 - protein, 26 aa, Staphylococcus aureus
LIILGFLLHYIFKINDKWLLVLCVFV

SEQ ID NO: 1591458 - protein, 20 aa, Staphylococcus aureus
LNQLAPYFKGFDGSFVLYNE

SEQ ID NO: 1591459 - protein, 17 aa, Staphylococcus aureus
LPLISILGGITTALIIF

SEQ ID NO: 1591460 - protein, 28 aa, Staphylococcus aureus
LSNKLNKYSIRKFTVGTASILIGSLMYL

SEQ ID NO: 1591461 - protein, 18 aa, Staphylococcus aureus
LSQFLPLLIVKKLPFVQY

SEQ ID NO: 1591462 - protein, 23 aa, Staphylococcus aureus
LTNIMLIILISVAGIYFKMKYDE

SEQ ID NO: 1591463 - protein, 17 aa, Staphylococcus aureus
LYGSLFLSGILVIIIAP

SEQ ID NO: 1591464 - protein, 24 aa, Staphylococcus aureus
MGIFAIIIFVFFTISILIQKWQRG

SEQ ID NO: 1591465 - protein, 22 aa, Staphylococcus aureus
MLISIILWLLIGVVFFLGDFIF

SEQ ID NO: 1591466 - protein, 17 aa, Staphylococcus aureus
MQRIQMKPFYETIFKER

SEQ ID NO: 1591467 - protein, 17 aa, Staphylococcus aureus
MVILFVVGGFLFLVSKG

SEQ ID NO: 1591468 - protein, 24 aa, Staphylococcus aureus
NFCFTIFYYFLFGGLSIMALSMLL

SEQ ID NO: 1591469 - protein, 38 aa, Staphylococcus aureus
NINQIFIVGTAISLLITVILGFFIARTITKPITDMRNQ

SEQ ID NO: 1591470 - protein, 24 aa, Staphylococcus aureus
NIRDIKMWILGLIGTIFSTIVIAL

SEQ ID NO: 1591471 - protein, 25 aa, Staphylococcus aureus
NKQQSFANCKQLRQVYPNGVTADHP

SEQ ID NO: 1591472 - protein, 17 aa, Staphylococcus aureus
NLLIFVLLTVFICSLMV

SEQ ID NO: 1591473 - protein, 25 aa, Staphylococcus aureus
NLLVFIMWIIITIFFFLISMGSISN

SEQ ID NO: 1591474 - protein, 20 aa, Staphylococcus aureus
NVFTQLAPLFQWSADWLDRL

SEQ ID NO: 1591475 - protein, 18 aa, Staphylococcus aureus
QLPLFIYLKRYISFVSVN

SEQ ID NO: 1591476 - protein, 22 aa, Staphylococcus aureus
RIGRSLGIHLILATQKPSGVVD

SEQ ID NO: 1591477 - protein, 21 aa, Staphylococcus aureus
SGFIFFFIVYVLCISYFNNDK

SEQ ID NO: 1591478 - protein, 17 aa, Staphylococcus aureus
SIPQILLMLLGSTLIMG

SEQ ID NO: 1591479 - protein, 17 aa, Staphylococcus aureus
SKESQLTEALFAEKPVA

SEQ ID NO: 1591480 - protein, 22 aa, Staphylococcus aureus
SLLMVLWLVITAWKHIGYIKEI

SEQ ID NO: 1591481 - protein, 25 aa, Staphylococcus aureus
SLTAKVEVTLLDGSKVIVNVPVKVV

SEQ ID NO: 1591482 - protein, 28 aa, Staphylococcus aureus
SPVMHHVFWISFLAIFIGTALPLAGTIA

SEQ ID NO: 1591483 - protein, 36 aa, Staphylococcus aureus
SVFVSYYILEPYFKTYSVKLLILAAISLFISHHISA

SEQ ID NO: 1591484 - protein, 27 aa, Staphylococcus aureus
TFDKEKNKFTHVAYIKPINGNNSDSVT

SEQ ID NO: 1591485 - protein, 18 aa, Staphylococcus aureus
TIFYYLFTGFMSYGAFYL

SEQ ID NO: 1591486 - protein, 26 aa, Staphylococcus aureus
TIMVSWLWFFLLAILGKVLGSIDRTG

SEQ ID NO: 1591487 - protein, 21 aa, Staphylococcus aureus
TLLYFALMIIIISLAAKTITK

SEQ ID NO: 1591488 - protein, 37 aa, Staphylococcus aureus
TNSSKRVHLKRWQFISILIGTILITAVITVVAYIFIN

SEQ ID NO: 1591489 - protein, 36 aa, Staphylococcus aureus
TTANKTVLVDYEKYGKFYNLSIKGTIDQIDKTNNTY

SEQ ID NO: 1591490 - protein, 25 aa, Staphylococcus aureus
TVIIQNNLDLFFNYGKRLANDHYNT

SEQ ID NO: 1591491 - protein, 21 aa, Staphylococcus aureus
VHQHLMLAKSLGAKVKVVYSQ

SEQ ID NO: 1591492 - protein, 19 aa, Staphylococcus aureus
VKEDGMWKLDWDHSVIIPG

SEQ ID NO: 1591493 - protein, 17 aa, Staphylococcus aureus
VKPEEKLYKIGDYVWED

SEQ ID NO: 1591494 - protein, 17 aa, Staphylococcus aureus
VLFIFFKAPDLALTQFV

SEQ ID NO: 1591495 - protein, 28 aa, Staphylococcus aureus
VLKDNEHSPLLFAKRRKDKEEDVETTTS

SEQ ID NO: 1591496 - protein, 23 aa, Staphylococcus aureus
VQHLNVDVTYPGISAAKRVPVTV

SEQ ID NO: 1591497 - protein, 39 aa, Staphylococcus aureus
VQPHEGQRVVLKYKLKFQDGLKTGDYFDFTLSNNVNTHG

SEQ ID NO: 1591498 - protein, 25 aa, Staphylococcus aureus
YFHKIRGLLAFWIGALLIAFTLLSN

SEQ ID NO: 1591499 - protein, 25 aa, Staphylococcus aureus
YTINSIMVYIFIALIAYISQVCCFG

SEQ ID NO: 1591500 - protein, 17 aa, Staphylococcus aureus
ACMIWYFNKSHVSIIGI

SEQ ID NO: 1591501 - protein, 23 aa, Staphylococcus aureus
AGIIFLMPYGLCFLPFYKQKKKK

SEQ ID NO: 1591502 - protein, 20 aa, Staphylococcus aureus
AKYFDISCVPILTRSQKSLQ

SEQ ID NO: 1591503 - protein, 47 aa, Staphylococcus aureus
ARERNIELVGNLLPGDYFGTIRFGRKEQLFEIRVKPHTPTITTTAEQ

SEQ ID NO: 1591504 - protein, 32 aa, Staphylococcus aureus
ASKTVLIDYEKYGQFHNLSIKGTIDQIDKTNN

SEQ ID NO: 1591505 - protein, 20 aa, Staphylococcus aureus
AVQQLNRTGTTTGKKPASIT

SEQ ID NO: 1591506 - protein, 30 aa, Staphylococcus aureus
AYKELEQAVALIRTMPQRQQTSRRSNRIQT

SEQ ID NO: 1591507 - protein, 51 aa, Staphylococcus aureus
DASYTISFKTQGPTVNKLYYAAGGRALEYNQLFMYSQLYVESTQDHQQRLN

SEQ ID NO: 1591508 - protein, 19 aa, Staphylococcus aureus
DFLNNFLRNGTHAGGILKM

SEQ ID NO: 1591509 - protein, 37 aa, Staphylococcus aureus
DGFDFGHVERFIQNPPHGATVAWHDSPDTWKNTVGNT

SEQ ID NO: 1591510 - protein, 24 aa, Staphylococcus aureus
DKFGFYIILILSLLIFVTLLLVNK

SEQ ID NO: 1591511 - protein, 21 aa, Staphylococcus aureus
DKIEYIYFYLLQQNQKSNNSD

SEQ ID NO: 1591512 - protein, 28 aa, Staphylococcus aureus
DLVSTWFVYFFPFINWFIPKKYAIISEE

SEQ ID NO: 1591513 - protein, 29 aa, Staphylococcus aureus
DSGTFNYVKGIFDKINTLLGSNDPINNKD

SEQ ID NO: 1591514 - protein, 27 aa, Staphylococcus aureus
DTKGITLFYIFIGLIMFALLNQQHLYL

SEQ ID NO: 1591515 - protein, 23 aa, Staphylococcus aureus
EIAGVFGIPLHKFGIETANMSIT

SEQ ID NO: 1591516 - protein, 26 aa, Staphylococcus aureus
EKGIKGVYVILKDSNGKELDRTTTDE

SEQ ID NO: 1591517 - protein, 28 aa, Staphylococcus aureus
EPQNIIIFIYWIMMTMLFFLLNMTSIGN

SEQ ID NO: 1591518 - protein, 19 aa, Staphylococcus aureus
ERMIRLVNDLLQLSKMDNE

SEQ ID NO: 1591519 - protein, 18 aa, Staphylococcus aureus
EVALLQLRIAIHKSPLDT

SEQ ID NO: 1591520 - protein, 20 aa, Staphylococcus aureus
EVQESIFTKADKRELITAKN

SEQ ID NO: 1591521 - protein, 27 aa, Staphylococcus aureus
FDFIVIIVVALIFYYIGTTSSFESVYF

SEQ ID NO: 1591522 - protein, 18 aa, Staphylococcus aureus
FEKDSLYIINDFKTFIDC

SEQ ID NO: 1591523 - protein, 39 aa, Staphylococcus aureus
FETSNITYMILLIWVFGSLLCLFYMIKAFRQIDVIKSSS

SEQ ID NO: 1591524 - protein, 45 aa, Staphylococcus aureus
FGGGVLGFYLLELSVPLISLFGVCIITILLLCSSVILLTNHQHRE

SEQ ID NO: 1591525 - protein, 18 aa, Staphylococcus aureus
FGILFQLPILFMGLAKFD

SEQ ID NO: 1591526 - protein, 18 aa, Staphylococcus aureus
FGIPPKDLSIAQSAYLIG

SEQ ID NO: 1591527 - protein, 17 aa, Staphylococcus aureus
FKNKAVLTGLVGALLLF

SEQ ID NO: 1591528 - protein, 18 aa, Staphylococcus aureus
GKLTIYLGYSPGVGKTYE

SEQ ID NO: 1591529 - protein, 27 aa, Staphylococcus aureus
HDTANNLITYTFTDYVDRFNSVQMGIN

SEQ ID NO: 1591530 - protein, 19 aa, Staphylococcus aureus
IARTIALRTGLSDTVPGQT

SEQ ID NO: 1591531 - protein, 21 aa, Staphylococcus aureus
IFLYSFIMMLGVEAVFFIANL

SEQ ID NO: 1591532 - protein, 23 aa, Staphylococcus aureus
IIGVILCICIVATVIHFKMKYDE

SEQ ID NO: 1591533 - protein, 20 aa, Staphylococcus aureus
IIITLLLAVLLFKGFNKWSG

SEQ ID NO: 1591534 - protein, 17 aa, Staphylococcus aureus
IIWFVIRGVAKLTLFDV

SEQ ID NO: 1591535 - protein, 22 aa, Staphylococcus aureus
ILIIILIIAILMMFAYMSHKQK

SEQ ID NO: 1591536 - protein, 19 aa, Staphylococcus aureus
ILMLVVLVVFWIVGKKLEQ

SEQ ID NO: 1591537 - protein, 17 aa, Staphylococcus aureus
ILTFIIWLFNSHTIITY

SEQ ID NO: 1591538 - protein, 17 aa, Staphylococcus aureus
IMMLGVEAVFFIANLFL

SEQ ID NO: 1591539 - protein, 36 aa, Staphylococcus aureus
ISFAKLIFSTFALFLFLFLVFSWIVSFIPGFELSVF

SEQ ID NO: 1591540 - protein, 33 aa, Staphylococcus aureus
ISFDPFTPLIVAAALYFVLTFVLTRIMNMIEGR

SEQ ID NO: 1591541 - protein, 18 aa, Staphylococcus aureus
IVMLWLTIILNTLICQLI

SEQ ID NO: 1591542 - protein, 18 aa, Staphylococcus aureus
KEATLFHYLFSENQYKDN

SEQ ID NO: 1591543 - protein, 38 aa, Staphylococcus aureus
KFSIRKYTVGTFSTVIATLVFLGFNTSQAHAAETNQPA

SEQ ID NO: 1591544 - protein, 18 aa, Staphylococcus aureus
KIIIVLIVSPIIAFCVGF

SEQ ID NO: 1591545 - protein, 32 aa, Staphylococcus aureus
KIYKAIKHVIVFIFMIFIAIVAIAVIAMSLYF

SEQ ID NO: 1591546 - protein, 25 aa, Staphylococcus aureus
KVKSGDYFTAKLPDSLTGNGDVDYS

SEQ ID NO: 1591547 - protein, 28 aa, Staphylococcus aureus
KYNSLKQAIAGLTPDLAPLQTAKTQLQN

SEQ ID NO: 1591548 - protein, 21 aa, Staphylococcus aureus
LEIVLLCLVIYAGAAQFIMCA

SEQ ID NO: 1591549 - protein, 19 aa, Staphylococcus aureus
LFIFPPIFKILIFSNTINF

SEQ ID NO: 1591550 - protein, 35 aa, Staphylococcus aureus
LGISLIDYDFPIDSLFYIVSLNLSLTMIFLILTYF

SEQ ID NO: 1591551 - protein, 18 aa, Staphylococcus aureus
LIGSIIFIAIVTLILRAV

SEQ ID NO: 1591552 - protein, 18 aa, Staphylococcus aureus
LILAFFGIKKYFLGGLLS

SEQ ID NO: 1591553 - protein, 20 aa, Staphylococcus aureus
LITAVITVVAYIFINQKISG

SEQ ID NO: 1591554 - protein, 21 aa, Staphylococcus aureus
LKMFVYIILLGAIVAAFFAND

SEQ ID NO: 1591555 - protein, 17 aa, Staphylococcus aureus
LLIFSILMLFGGINEVT

SEQ ID NO: 1591556 - protein, 17 aa, Staphylococcus aureus
LLMVWLSYPLVTAIIGC

SEQ ID NO: 1591557 - protein, 18 aa, Staphylococcus aureus
LLSIILNLPVWVVLLNAI

SEQ ID NO: 1591558 - protein, 49 aa, Staphylococcus aureus
LMTAKQTGDGYQWVIKFNKGHAPHQNMIFWFALPADQVPVGRTDFVTVN

SEQ ID NO: 1591559 - protein, 19 aa, Staphylococcus aureus
LPTALTTTISFAVSFIIVT

SEQ ID NO: 1591560 - protein, 24 aa, Staphylococcus aureus
LSKFNIIYILMFEQLLIFSITAIL

SEQ ID NO: 1591561 - protein, 29 aa, Staphylococcus aureus
LSWSDDHKSLIYRYDATLGTQITTNDILT

SEQ ID NO: 1591562 - protein, 17 aa, Staphylococcus aureus
LTLFLPMINWLIPKKYV

SEQ ID NO: 1591563 - protein, 18 aa, Staphylococcus aureus
LVSEILYYLYTRIKQLYG

SEQ ID NO: 1591564 - protein, 21 aa, Staphylococcus aureus
LYIIVMVVSVFIIGCNKSSDT

SEQ ID NO: 1591565 - protein, 18 aa, Staphylococcus aureus
MGNLRQAVADKDQVKRTE

SEQ ID NO: 1591566 - protein, 27 aa, Staphylococcus aureus
MLLISSILIISFVTLGIIIHASITYVL

SEQ ID NO: 1591567 - protein, 24 aa, Staphylococcus aureus
MMATSIILTNILPYDAQAASEKDT

SEQ ID NO: 1591568 - protein, 17 aa, Staphylococcus aureus
MPLMQFTLFTLFSKEHR

SEQ ID NO: 1591569 - protein, 32 aa, Staphylococcus aureus
NASSKGAPYNLPTTPWNTLKASDSKEIALMTA

SEQ ID NO: 1591570 - protein, 20 aa, Staphylococcus aureus
NFIINAWNAIKTFMVTVWNV

SEQ ID NO: 1591571 - protein, 18 aa, Staphylococcus aureus
NFLEGYKYVVENRYIYQF

SEQ ID NO: 1591572 - protein, 30 aa, Staphylococcus aureus
NKENINGQFSLPLFTDRAKAPKSGTYDANI

SEQ ID NO: 1591573 - protein, 20 aa, Staphylococcus aureus
NPIPIYITNFFGGAIAGLII

SEQ ID NO: 1591574 - protein, 17 aa, Staphylococcus aureus
NRTGTTTGKKPASITAY

SEQ ID NO: 1591575 - protein, 18 aa, Staphylococcus aureus
NTVYIIIALLALTLMFIK

SEQ ID NO: 1591576 - protein, 26 aa, Staphylococcus aureus
PAESPGVPKVYTFIGQGDASYTISFK

SEQ ID NO: 1591577 - protein, 19 aa, Staphylococcus aureus
QEIFFHNLIYFFSAIFGFL

SEQ ID NO: 1591578 - protein, 35 aa, Staphylococcus aureus
QKVPVNISGIPLDPSALVYLVAPTNQTTNGGSEAD

SEQ ID NO: 1591579 - protein, 33 aa, Staphylococcus aureus
QNKLTFIDIFMFAIFISLIVFSIVKLFKHNHLD

SEQ ID NO: 1591580 - protein, 25 aa, Staphylococcus aureus
QTIDQLNRGLNLGLDDIRNTHVWEV

SEQ ID NO: 1591581 - protein, 22 aa, Staphylococcus aureus
QTLDHAMELLRNSVADNQTTLA

SEQ ID NO: 1591582 - protein, 23 aa, Staphylococcus aureus
RIFINNMLIYGLGGLIVPFLGIK

SEQ ID NO: 1591583 - protein, 17 aa, Staphylococcus aureus
RMRNIVAMLLFSLFILY

SEQ ID NO: 1591584 - protein, 27 aa, Staphylococcus aureus
SHPASVILLIIFILSVAFLIYVEFSLL

SEQ ID NO: 1591585 - protein, 20 aa, Staphylococcus aureus
SLLIFIYLIIIFYFTRREQH

SEQ ID NO: 1591586 - protein, 23 aa, Staphylococcus aureus
SLNIGVLLLSYSRFVIMKVTMNK

SEQ ID NO: 1591587 - protein, 22 aa, Staphylococcus aureus
SNFDVSLFYLKVPELKEILREY

SEQ ID NO: 1591588 - protein, 24 aa, Staphylococcus aureus
TAEQLRGTALQKVPVNISGIPLDP

SEQ ID NO: 1591589 - protein, 24 aa, Staphylococcus aureus
TARQGLTLDRQPALTTLHGASNLN

SEQ ID NO: 1591590 - protein, 24 aa, Staphylococcus aureus
TDANLDYLSTLKPYITCVCAELNF

SEQ ID NO: 1591591 - protein, 32 aa, Staphylococcus aureus
TFFKFFIGILLLNLVIILFKTPVGYLISFNTQ

SEQ ID NO: 1591592 - protein, 20 aa, Staphylococcus aureus
TFIAKHKWSAVIAWIVIVAA

SEQ ID NO: 1591593 - protein, 20 aa, Staphylococcus aureus
TGIWVGIIIIVIAAIILGNL

SEQ ID NO: 1591594 - protein, 25 aa, Staphylococcus aureus
TGKKPASITAYNNSIRALQSDLTSA

SEQ ID NO: 1591595 - protein, 30 aa, Staphylococcus aureus
TGNTTDAINIYFVPSDLVNPTISVGNYTNH

SEQ ID NO: 1591596 - protein, 25 aa, Staphylococcus aureus
TKRFPLYILMFEQIISILWVYIVLL

SEQ ID NO: 1591597 - protein, 19 aa, Staphylococcus aureus
TLLILLFIIIAYIATTLTF

SEQ ID NO: 1591598 - protein, 22 aa, Staphylococcus aureus
TNQFNIPSGKELDWAKASHEKY

SEQ ID NO: 1591599 - protein, 28 aa, Staphylococcus aureus
TQITTNDILTMLKATTTVPGLRNNITGN

SEQ ID NO: 1591600 - protein, 18 aa, Staphylococcus aureus
TTSFNVTVKPLRDKYRVG

SEQ ID NO: 1591601 - protein, 17 aa, Staphylococcus aureus
VIPVLPVYLKDLGLTGS

SEQ ID NO: 1591602 - protein, 17 aa, Staphylococcus aureus
VLAVILKFSLWRYKKLT

SEQ ID NO: 1591603 - protein, 23 aa, Staphylococcus aureus
VLIGIVLLRLFKINLLSFKKLTM

SEQ ID NO: 1591604 - protein, 20 aa, Staphylococcus aureus
VPNETSLNLTFATAGKETSQ

SEQ ID NO: 1591605 - protein, 17 aa, Staphylococcus aureus
VSRLLLSIILNLPVWVV

SEQ ID NO: 1591606 - protein, 20 aa, Staphylococcus aureus
VVDMWFVILPVVMSIGTIAT

SEQ ID NO: 1591607 - protein, 18 aa, Staphylococcus aureus
WISAGIIGIIQYSSIISA

SEQ ID NO: 1591608 - protein, 20 aa, Staphylococcus aureus
WKTILYFEIITTIAIGLGII

SEQ ID NO: 1591609 - protein, 23 aa, Staphylococcus aureus
YHKVVLPPYLGFFGGSRFVPIVT

SEQ ID NO: 1591610 - protein, 21 aa, Staphylococcus aureus
YITLLFNIWPIAFIPIVLCMA

SEQ ID NO: 1591611 - protein, 23 aa, Staphylococcus aureus
YKRPVIIFIVPGIIPLVPGGAAY

SEQ ID NO: 1591612 - protein, 17 aa, Staphylococcus aureus
YSSIISAILMKNKWPFL

SEQ ID NO: 1591613 - protein, 34 aa, Staphylococcus aureus
AIDLVLSIVLLFLTFPIMFIFAIAIVIDSPGNPI

SEQ ID NO: 1591614 - protein, 33 aa, Staphylococcus aureus
ATFVLGSNPVGWVILAGLAMSTVFALGTDLIYQ

SEQ ID NO: 1591615 - protein, 24 aa, Staphylococcus aureus
AVTDLNQLNGLNNPQRQALESQIN

SEQ ID NO: 1591616 - protein, 21 aa, Staphylococcus aureus
AWGITVIVIYGIGYYASMKIE

SEQ ID NO: 1591617 - protein, 19 aa, Staphylococcus aureus
CFIGFLEIIFFYCYLNKKL

SEQ ID NO: 1591618 - protein, 17 aa, Staphylococcus aureus
CQEWLYHLGVPTDKIED

SEQ ID NO: 1591619 - protein, 19 aa, Staphylococcus aureus
CWTIFMILSGTYLLIKKHL

SEQ ID NO: 1591620 - protein, 22 aa, Staphylococcus aureus
DKDYAYIRFPVSNGTREVKIVS

SEQ ID NO: 1591621 - protein, 28 aa, Staphylococcus aureus
DQASWRVPFIIIVGIALVAFIFGLISIS

SEQ ID NO: 1591622 - protein, 18 aa, Staphylococcus aureus
DRENADSGTFNYVKGIFD

SEQ ID NO: 1591623 - protein, 25 aa, Staphylococcus aureus
DVGQTLLILIILVAIIFYSGIGVNK

SEQ ID NO: 1591624 - protein, 32 aa, Staphylococcus aureus
EDEANTSLIWGLLASLGSLLLFRRKKENKDKK

SEQ ID NO: 1591625 - protein, 25 aa, Staphylococcus aureus
EDVTNSVNITFPNPNQYKVEFNTPD

SEQ ID NO: 1591626 - protein, 19 aa, Staphylococcus aureus
EGDQRVYRTSTYDLTTDEI

SEQ ID NO: 1591627 - protein, 23 aa, Staphylococcus aureus
ELKNPQTLDLPQSSPQTISNAQG

SEQ ID NO: 1591628 - protein, 28 aa, Staphylococcus aureus
EWGHILGWIDSHWWLFGHFGWEYIELGK

SEQ ID NO: 1591629 - protein, 17 aa, Staphylococcus aureus
FMTYSFSIFLLSSFTMT

SEQ ID NO: 1591630 - protein, 21 aa, Staphylococcus aureus
FNKFEWLAILFAFIGVLYMTL

SEQ ID NO: 1591631 - protein, 20 aa, Staphylococcus aureus
FSLIIWILLVVLVIYFTIRL

SEQ ID NO: 1591632 - protein, 26 aa, Staphylococcus aureus
FTDLNPLLMSILISVAFSLLMVTPIS

SEQ ID NO: 1591633 - protein, 24 aa, Staphylococcus aureus
FYPVFMSIYWIVGSIYFYFTREIR

SEQ ID NO: 1591634 - protein, 30 aa, Staphylococcus aureus
GFSIYFFVDTIWLFILLYAIFQGLFAPAMP

SEQ ID NO: 1591635 - protein, 26 aa, Staphylococcus aureus
GLKANILFLFIFVLTVFVFNPLIVKF

SEQ ID NO: 1591636 - protein, 18 aa, Staphylococcus aureus
GMIIAIPVTLIAGPIFNK

SEQ ID NO: 1591637 - protein, 22 aa, Staphylococcus aureus
GSKVIVNVPVKVVEKELSVVKQ

SEQ ID NO: 1591638 - protein, 28 aa, Staphylococcus aureus
GTFMIAVFILNFKLIFTLPLTILNRQSL

SEQ ID NO: 1591639 - protein, 25 aa, Staphylococcus aureus
GVILKWFMMLPLADIDLAWLVPFML

SEQ ID NO: 1591640 - protein, 32 aa, Staphylococcus aureus
HNASDAVYKAQLYLTPYGPKQYVEHLNQNTGN

SEQ ID NO: 1591641 - protein, 19 aa, Staphylococcus aureus
HTRTLLIYGAIFGGLFYFS

SEQ ID NO: 1591642 - protein, 17 aa, Staphylococcus aureus
IAKLNQLKEQAIQAIQR

SEQ ID NO: 1591643 - protein, 26 aa, Staphylococcus aureus
IGFIITLFMSIVFLSISFAKLIFSTF

SEQ ID NO: 1591644 - protein, 27 aa, Staphylococcus aureus
IGIIIAIPVFVLVLTGLPWSGFMGSKI

SEQ ID NO: 1591645 - protein, 22 aa, Staphylococcus aureus
IIDRLFIYFNYHLEYYENMLFI

SEQ ID NO: 1591646 - protein, 29 aa, Staphylococcus aureus
IIIQSFLTLLFLIFLILSATGIIQPELTT

SEQ ID NO: 1591647 - protein, 28 aa, Staphylococcus aureus
IISTWISLFFPFINWFIPKEYVKISREE

SEQ ID NO: 1591648 - protein, 30 aa, Staphylococcus aureus
IIVVGFMLTVIVIGLIWLIKDKRQSQHSVL

SEQ ID NO: 1591649 - protein, 17 aa, Staphylococcus aureus
IPKGVLLVGPPGTGKTL

SEQ ID NO: 1591650 - protein, 73 aa, Staphylococcus aureus
IQGALNIILGLIKFFSSLFTGDWRGVWDAIVMILKGVVQLIWNLIQLWFVGKILGVVRYFGGLLKGLIAGIWD

SEQ ID NO: 1591651 - protein, 28 aa, Staphylococcus aureus
IQYFVVQFIITLFLIWLPTYLTEVFHVN

SEQ ID NO: 1591652 - protein, 18 aa, Staphylococcus aureus
IRPILFSCWLFILNMILS

SEQ ID NO: 1591653 - protein, 19 aa, Staphylococcus aureus
ISLDQVLASYLKTANIAKY

SEQ ID NO: 1591654 - protein, 22 aa, Staphylococcus aureus
ITVVAYIFINQKISGLNKTDQA

SEQ ID NO: 1591655 - protein, 20 aa, Staphylococcus aureus
IVKFIIWLINITRKFMKLDC

SEQ ID NO: 1591656 - protein, 23 aa, Staphylococcus aureus
KKLDLCILIILLVIIFCFVCEII

SEQ ID NO: 1591657 - protein, 20 aa, Staphylococcus aureus
KNLNLIQLLTGLKANILFLF

SEQ ID NO: 1591658 - protein, 17 aa, Staphylococcus aureus
KQGIANKAQIKGSENYH

SEQ ID NO: 1591659 - protein, 25 aa, Staphylococcus aureus
KRILYTCFILFIYILGTNISIVSYN

SEQ ID NO: 1591660 - protein, 19 aa, Staphylococcus aureus
KSLGWWDLFFAIPIFLLFA

SEQ ID NO: 1591661 - protein, 33 aa, Staphylococcus aureus
KTFFKFFIGILLLNLIIILFKTPVGYLISFNTQ

SEQ ID NO: 1591662 - protein, 25 aa, Staphylococcus aureus
KWDEILTILPWIIGALIVTIFIGRQ

SEQ ID NO: 1591663 - protein, 20 aa, Staphylococcus aureus
LEIIFFYCYLNKKLTLNIYN

SEQ ID NO: 1591664 - protein, 25 aa, Staphylococcus aureus
LFAYPLIEVIWPKTGLIYFVMADIG

SEQ ID NO: 1591665 - protein, 20 aa, Staphylococcus aureus
LLIYGAIFGGLFYFSIGVFK

SEQ ID NO: 1591666 - protein, 17 aa, Staphylococcus aureus
LMGILIDHFGLFGSPKI

SEQ ID NO: 1591667 - protein, 34 aa, Staphylococcus aureus
LNTRPNPMYNGYIFKLVVFVSALLTSHGYIEITR

SEQ ID NO: 1591668 - protein, 20 aa, Staphylococcus aureus
LQMMVQTLPGFQGTKLRQYK

SEQ ID NO: 1591669 - protein, 26 aa, Staphylococcus aureus
MIISSIIIYLFIRRQFNISNALLNLS

SEQ ID NO: 1591670 - protein, 18 aa, Staphylococcus aureus
MKAANPTAKELAKRKQEA

SEQ ID NO: 1591671 - protein, 31 aa, Staphylococcus aureus
NDKENINGQFSLPLFTDRAKAPKSGTYDANI

SEQ ID NO: 1591672 - protein, 33 aa, Staphylococcus aureus
NDSIIKTALKRLPWLIILTFLGMITATILGRFE

SEQ ID NO: 1591673 - protein, 24 aa, Staphylococcus aureus
NGLRQVVNRTYRIGTTKRVEVSQG

SEQ ID NO: 1591674 - protein, 23 aa, Staphylococcus aureus
NGVSFMVPFIVVGGLLIAIALTL

SEQ ID NO: 1591675 - protein, 26 aa, Staphylococcus aureus
NITNTLIQLPFVAGLAWIVTKLVPGK

SEQ ID NO: 1591676 - protein, 28 aa, Staphylococcus aureus
NLVAMFIPLFFIYKYHQPMFGRLSSQPL

SEQ ID NO: 1591677 - protein, 17 aa, Staphylococcus aureus
NTAMTGLKRGVANHNQV

SEQ ID NO: 1591678 - protein, 23 aa, Staphylococcus aureus
NVSRRLFKNLFYEDIKSFEDTDK

SEQ ID NO: 1591679 - protein, 21 aa, Staphylococcus aureus
PIFRPVMRPLFTLPGRSTVDN

SEQ ID NO: 1591680 - protein, 26 aa, Staphylococcus aureus
PTLKNFCLTLFRYAFFILWTVIFSYA

SEQ ID NO: 1591681 - protein, 32 aa, Staphylococcus aureus
QIISILWVYIVLLYLGYLFITANFLDYTFMTY

SEQ ID NO: 1591682 - protein, 24 aa, Staphylococcus aureus
QIIVGLFTALIQLLTGDFSGAWET

SEQ ID NO: 1591683 - protein, 28 aa, Staphylococcus aureus
QNIAEKPFSKQAGHPVFYVYAGNQGNAS

SEQ ID NO: 1591684 - protein, 18 aa, Staphylococcus aureus
QYLILFIALLIFIYLIII

SEQ ID NO: 1591685 - protein, 32 aa, Staphylococcus aureus
RAIDLILSIVLLFLTLPIMVIFAIAIVIDSPG

SEQ ID NO: 1591686 - protein, 17 aa, Staphylococcus aureus
RLLLSIILNLPVWVVLL

SEQ ID NO: 1591687 - protein, 30 aa, Staphylococcus aureus
RSNEQIIFTPQLVFVITDMSLIIDHVILEY

SEQ ID NO: 1591688 - protein, 20 aa, Staphylococcus aureus
RYAFFILWTVIFSYALLSMS

SEQ ID NO: 1591689 - protein, 31 aa, Staphylococcus aureus
SAAKRVPVTVNVYQFEFPQTTYTTTVGGTLA

SEQ ID NO: 1591690 - protein, 37 aa, Staphylococcus aureus
SASFKWYDFVYFIDTLVYLFILIFKTKWLDTKAFSKK

SEQ ID NO: 1591691 - protein, 23 aa, Staphylococcus aureus
SGFILYMILIFTLSMIVNIHIVW

SEQ ID NO: 1591692 - protein, 23 aa, Staphylococcus aureus
SGYLIEIFPKKLLVLIYQATMVI

SEQ ID NO: 1591693 - protein, 20 aa, Staphylococcus aureus
SIEDAIQHMIDEIKARTDLT

SEQ ID NO: 1591694 - protein, 34 aa, Staphylococcus aureus
SIFNHFIPVIITILLCYFGFQFGLKKRDEMLMFL

SEQ ID NO: 1591695 - protein, 20 aa, Staphylococcus aureus
SIYIFIKITLIIYLFSLNLS

SEQ ID NO: 1591696 - protein, 26 aa, Staphylococcus aureus
SLDKVKHTPFFLPKRRRKEDEEDVEV

SEQ ID NO: 1591697 - protein, 18 aa, Staphylococcus aureus
TALLLVIPIIISYKEGLH

SEQ ID NO: 1591698 - protein, 22 aa, Staphylococcus aureus
TNQIPIFIVMGLYICMYAIFAM

SEQ ID NO: 1591699 - protein, 23 aa, Staphylococcus aureus
TQQSFANCKQLRQVYPNGVTADH

SEQ ID NO: 1591700 - protein, 32 aa, Staphylococcus aureus
TVFAFIMIISILLAYVFKWLGLVDDVLLMVII

SEQ ID NO: 1591701 - protein, 20 aa, Staphylococcus aureus
VFIFVGVIIILIWLVLDIYR

SEQ ID NO: 1591702 - protein, 24 aa, Staphylococcus aureus
VRGQNNQWTIANKPDYVTLDAQTG

SEQ ID NO: 1591703 - protein, 19 aa, Staphylococcus aureus
VRWLFRIIVLIVFAVVMFT

SEQ ID NO: 1591704 - protein, 19 aa, Staphylococcus aureus
VVVKPLFAKPNALASIFGI

SEQ ID NO: 1591705 - protein, 25 aa, Staphylococcus aureus
WIAYFLPMINWFIPKKYAKISREEF

SEQ ID NO: 1591706 - protein, 19 aa, Staphylococcus aureus
WQKWHAMIGIIIAIPVFVL

SEQ ID NO: 1591707 - protein, 18 aa, Staphylococcus aureus
YIGDHIYVEGIWLEVQAD

SEQ ID NO: 1591708 - protein, 20 aa, Staphylococcus aureus
YKISIFYLNQSFFEEPCIVV

SEQ ID NO: 1591709 - protein, 18 aa, Staphylococcus aureus
YRNVLVPPFLIQILVENA

SEQ ID NO: 1591710 - protein, 26 aa, Staphylococcus aureus
AANAILFFLIPFFASAIFNTQFTLFN

SEQ ID NO: 1591711 - protein, 21 aa, Staphylococcus aureus
AIIFMVTGIIPLVPGGLAYDA

SEQ ID NO: 1591712 - protein, 22 aa, Staphylococcus aureus
ALEVVPLCLLIWEAYTHYRLYK

SEQ ID NO: 1591713 - protein, 26 aa, Staphylococcus aureus
ALNNGIARISAVQIVISDRAKQSSST

SEQ ID NO: 1591714 - protein, 21 aa, Staphylococcus aureus
ANLLTFIVWLISGVSVLRYNK

SEQ ID NO: 1591715 - protein, 23 aa, Staphylococcus aureus
ATVILPVVIFLLGLFFRQKIGAA

SEQ ID NO: 1591716 - protein, 35 aa, Staphylococcus aureus
DENGKYRFDNLDSGKYKVIFEKPTGLTQTGTNTTE

SEQ ID NO: 1591717 - protein, 25 aa, Staphylococcus aureus
DFIALAFLFLTIALLLIALFYVCFY

SEQ ID NO: 1591718 - protein, 24 aa, Staphylococcus aureus
DGTQQFYHYASSVKPARVIFTDSK

SEQ ID NO: 1591719 - protein, 23 aa, Staphylococcus aureus
DTFPGINKWLIPIGTSPIKGILA

SEQ ID NO: 1591720 - protein, 18 aa, Staphylococcus aureus
DTIILGMVILAVVPLLFL

SEQ ID NO: 1591721 - protein, 25 aa, Staphylococcus aureus
DVTNQVRISFPNANQYKVEFPTDDD

SEQ ID NO: 1591722 - protein, 33 aa, Staphylococcus aureus
EAYLLALGVILLLLLIFIGIKYLSFVKTISQQQ

SEQ ID NO: 1591723 - protein, 26 aa, Staphylococcus aureus
EEDTTPPIVPPTPPTPEVPSEPETPT

SEQ ID NO: 1591724 - protein, 17 aa, Staphylococcus aureus
EFHVKQNPLYNRMTIRI

SEQ ID NO: 1591725 - protein, 17 aa, Staphylococcus aureus
ERYYRNLDEQVLALITG

SEQ ID NO: 1591726 - protein, 40 aa, Staphylococcus aureus
FDEQVKWIFNLIRIVLPIIIIFIIFIVLYSVAPNVKTKLK

SEQ ID NO: 1591727 - protein, 18 aa, Staphylococcus aureus
FHALFITYLFGMTTYFIM

SEQ ID NO: 1591728 - protein, 25 aa, Staphylococcus aureus
FHEDYDYTLMVFAQPITNNPDDYVD

SEQ ID NO: 1591729 - protein, 21 aa, Staphylococcus aureus
FIGILIFYVRLIKKSSLNIYN

SEQ ID NO: 1591730 - protein, 18 aa, Staphylococcus aureus
FITVISVLLAFHLKQHYD

SEQ ID NO: 1591731 - protein, 27 aa, Staphylococcus aureus
FNQLYVVFKMIFWFNPALYISKTMMDN

SEQ ID NO: 1591732 - protein, 25 aa, Staphylococcus aureus
GLVCLFMMKLVLAITFFAVSLSISL

SEQ ID NO: 1591733 - protein, 24 aa, Staphylococcus aureus
GNDFVSQRFLALANGAYKYNPYIL

SEQ ID NO: 1591734 - protein, 25 aa, Staphylococcus aureus
GNFETGLLFIAFQKATQQFIDIQNN

SEQ ID NO: 1591735 - protein, 27 aa, Staphylococcus aureus
GVASVAISTLLLLMSNGEAQAAAEETG

SEQ ID NO: 1591736 - protein, 24 aa, Staphylococcus aureus
GVSLFFNVIILLLLFIFSIFIKDV

SEQ ID NO: 1591737 - protein, 27 aa, Staphylococcus aureus
HDTANNLITYTFTDYVDRFNSVKMGIN

SEQ ID NO: 1591738 - protein, 22 aa, Staphylococcus aureus
IAFLVHCFLVFIIAYIGDLIIN

SEQ ID NO: 1591739 - protein, 21 aa, Staphylococcus aureus
IAIIGLFVLGQRTASALLPNV

SEQ ID NO: 1591740 - protein, 20 aa, Staphylococcus aureus
IAIIGLFVLGQRTASALLPY

SEQ ID NO: 1591741 - protein, 20 aa, Staphylococcus aureus
IFLALSAYILWGILPIYWQF

SEQ ID NO: 1591742 - protein, 18 aa, Staphylococcus aureus
IGVLLIYGLFISSNPKEI

SEQ ID NO: 1591743 - protein, 22 aa, Staphylococcus aureus
IIGIFTLWYYWRKRKHNIDRMV

SEQ ID NO: 1591744 - protein, 17 aa, Staphylococcus aureus
IIGIIQYSSIISAILMK

SEQ ID NO: 1591745 - protein, 24 aa, Staphylococcus aureus
IIITLLLAVLLFKGFNKWSGRTIK

SEQ ID NO: 1591746 - protein, 18 aa, Staphylococcus aureus
IIQKPIRTVQEVQSALTN

SEQ ID NO: 1591747 - protein, 17 aa, Staphylococcus aureus
IISIYIFIKITLIIYLF

SEQ ID NO: 1591748 - protein, 27 aa, Staphylococcus aureus
IISTWISLFFPFINWFIPKRYVKISRE

SEQ ID NO: 1591749 - protein, 26 aa, Staphylococcus aureus
ILGVLVLSVILLFSIPTPVAVILMGI

SEQ ID NO: 1591750 - protein, 19 aa, Staphylococcus aureus
ILNWLFWEILDNYISIVSS

SEQ ID NO: 1591751 - protein, 20 aa, Staphylococcus aureus
INSAYIIKVVSKYTPTSDGE

SEQ ID NO: 1591752 - protein, 20 aa, Staphylococcus aureus
IVIIGIALISLVFLPGIFYV

SEQ ID NO: 1591753 - protein, 20 aa, Staphylococcus aureus
KISVLFAVAFFIINYIGMEK

SEQ ID NO: 1591754 - protein, 20 aa, Staphylococcus aureus
KKAILFAALFILIGFYDGFV

SEQ ID NO: 1591755 - protein, 17 aa, Staphylococcus aureus
KNKALWPAIGSILLFGT

SEQ ID NO: 1591756 - protein, 22 aa, Staphylococcus aureus
KVKQAFINANRDVITLAEGDIS

SEQ ID NO: 1591757 - protein, 26 aa, Staphylococcus aureus
KYEDIKARLTLYSYIDKQAVPNETSL

SEQ ID NO: 1591758 - protein, 20 aa, Staphylococcus aureus
LFGGLFAALGSLLLFGRRKK

SEQ ID NO: 1591759 - protein, 19 aa, Staphylococcus aureus
LFVIFLFFLFLNMCSLYDN

SEQ ID NO: 1591760 - protein, 25 aa, Staphylococcus aureus
LIAFNILNWLFWEILDNHLSIVSSV

SEQ ID NO: 1591761 - protein, 18 aa, Staphylococcus aureus
LIGTIFSTIVIALLRTVF

SEQ ID NO: 1591762 - protein, 18 aa, Staphylococcus aureus
LIRFDFDMKTLMTVAVIG

SEQ ID NO: 1591763 - protein, 26 aa, Staphylococcus aureus
LIVWFILFLLFWYLLQPVIMSIGGLM

SEQ ID NO: 1591764 - protein, 21 aa, Staphylococcus aureus
LTEALFAEKPVAKNDLKEIPQ

SEQ ID NO: 1591765 - protein, 38 aa, Staphylococcus aureus
LTKSFASNLANMNFLRWVNFPQDYTVTWTNAKIANRPT

SEQ ID NO: 1591766 - protein, 23 aa, Staphylococcus aureus
LTSIMLIILISVAGIYLKVKYDE

SEQ ID NO: 1591767 - protein, 17 aa, Staphylococcus aureus
LYLIFPIAGIFFNEVYG

SEQ ID NO: 1591768 - protein, 19 aa, Staphylococcus aureus
MILALIIIIATFSNTANAA

SEQ ID NO: 1591769 - protein, 20 aa, Staphylococcus aureus
MITALFITVISVLLAFHLKQ

SEQ ID NO: 1591770 - protein, 20 aa, Staphylococcus aureus
MTTVLLLKRNTPVIAVDAPA

SEQ ID NO: 1591771 - protein, 27 aa, Staphylococcus aureus
NDEKQSIITAFMNKNQNIRGYLASTDP

SEQ ID NO: 1591772 - protein, 32 aa, Staphylococcus aureus
NERYILIHDLLKPTILPIIPLLGISLGSLIGG

SEQ ID NO: 1591773 - protein, 21 aa, Staphylococcus aureus
NGNVTLHYRDGSSTTLDATNV

SEQ ID NO: 1591774 - protein, 25 aa, Staphylococcus aureus
NGRIRYTFTDYIKDKVNVTANLEIN

SEQ ID NO: 1591775 - protein, 17 aa, Staphylococcus aureus
NHYDLFNYWLMGTISII

SEQ ID NO: 1591776 - protein, 36 aa, Staphylococcus aureus
NIMSHKIWLLVLVSTLIPLIPFYKISNFTFSKDMMN

SEQ ID NO: 1591777 - protein, 21 aa, Staphylococcus aureus
NKTTTTFKYEVTRNSMSDSVS

SEQ ID NO: 1591778 - protein, 22 aa, Staphylococcus aureus
NNTYRQTIYVNPSGDNVIAPVL

SEQ ID NO: 1591779 - protein, 22 aa, Staphylococcus aureus
NSFSMYVLLISPLVFLCFAIFT

SEQ ID NO: 1591780 - protein, 25 aa, Staphylococcus aureus
NTIIFGWIFYFFLGAYMGYNYERVL

SEQ ID NO: 1591781 - protein, 17 aa, Staphylococcus aureus
NTMILALIIIIATFSNT

SEQ ID NO: 1591782 - protein, 28 aa, Staphylococcus aureus
NVKKNLVGIAFIFSSVAVLIFELNTIEE

SEQ ID NO: 1591783 - protein, 32 aa, Staphylococcus aureus
NYLKVMFLSAPFVILFFILEQFARAIGAPMVS

SEQ ID NO: 1591784 - protein, 18 aa, Staphylococcus aureus
PVVFGLGAFISTVGNAVT

SEQ ID NO: 1591785 - protein, 19 aa, Staphylococcus aureus
QSFESQITQAPLVTDVTTI

SEQ ID NO: 1591786 - protein, 18 aa, Staphylococcus aureus
RDVLANRHQFGEAASLLE

SEQ ID NO: 1591787 - protein, 21 aa, Staphylococcus aureus
SGYPVGTYINASSKGAPYNLP

SEQ ID NO: 1591788 - protein, 29 aa, Staphylococcus aureus
SIPSFWQGLLFILAFSLKLDILPPSYMPE

SEQ ID NO: 1591789 - protein, 17 aa, Staphylococcus aureus
SLNTAMGNLKHALAEKD

SEQ ID NO: 1591790 - protein, 28 aa, Staphylococcus aureus
SRAYFYLPFLLIYFLIQGYSIIQLEILM

SEQ ID NO: 1591791 - protein, 24 aa, Staphylococcus aureus
SSRFIKWLNDMNVIPGYYGVNSID

SEQ ID NO: 1591792 - protein, 26 aa, Staphylococcus aureus
SVKKMTWILLYCFLGNILGGFVLFFL

SEQ ID NO: 1591793 - protein, 17 aa, Staphylococcus aureus
SVPIRILIFYVGALAVI

SEQ ID NO: 1591794 - protein, 23 aa, Staphylococcus aureus
TIAYILNIFLFTLITNLTFYLIR

SEQ ID NO: 1591795 - protein, 27 aa, Staphylococcus aureus
TKVLIFLLYFILVINSALFIWINSAFY

SEQ ID NO: 1591796 - protein, 24 aa, Staphylococcus aureus
TNVLDTIWQYMQSVWESIIGFLTG

SEQ ID NO: 1591797 - protein, 29 aa, Staphylococcus aureus
TSILDLLIVWYVLYLLITVFKGTKAIQLL

SEQ ID NO: 1591798 - protein, 36 aa, Staphylococcus aureus
TSNITYMILLIWVFGSLLCLFYMIKAFRQIDVIKSS

SEQ ID NO: 1591799 - protein, 26 aa, Staphylococcus aureus
VERFFKLVFFIFSVSFIFVILIPKLT

SEQ ID NO: 1591800 - protein, 24 aa, Staphylococcus aureus
VGQTLLILIILVAIIFYSGIGVNK

SEQ ID NO: 1591801 - protein, 23 aa, Staphylococcus aureus
VIGIFLYVMTLQKTSLFGILKAQ

SEQ ID NO: 1591802 - protein, 20 aa, Staphylococcus aureus
VIQWGVLALIVIFQPEIRRA

SEQ ID NO: 1591803 - protein, 27 aa, Staphylococcus aureus
VLVSTLIPLIPFYKISNFTFSKDMMNR

SEQ ID NO: 1591804 - protein, 17 aa, Staphylococcus aureus
VMPLVPGILITNAIRDL

SEQ ID NO: 1591805 - protein, 23 aa, Staphylococcus aureus
VPVKHVIPEIVAHSHYTVQGQDF

SEQ ID NO: 1591806 - protein, 32 aa, Staphylococcus aureus
VTIDSGTTVYPHQAGYVKLNYGFSVPNSAVKG

SEQ ID NO: 1591807 - protein, 21 aa, Staphylococcus aureus
VTPIGNFIPGTYRIPAMKSTE

SEQ ID NO: 1591808 - protein, 18 aa, Staphylococcus aureus
WIGYLPYLYSGLIFGLIY

SEQ ID NO: 1591809 - protein, 21 aa, Staphylococcus aureus
YKIHTLNWFKNTWGYMNLGAS

SEQ ID NO: 1591810 - protein, 24 aa, Staphylococcus aureus
YLVEYFNWRSLFHVVAPIAAVTFL

SEQ ID NO: 1591811 - protein, 18 aa, Staphylococcus aureus
YYRNLDEQVLALITGEIG

SEQ ID NO: 1591812 - protein, 24 aa, Staphylococcus aureus
AISIYLALIFITFTSYLVIILYTS

SEQ ID NO: 1591813 - protein, 33 aa, Staphylococcus aureus
ATAPTSVAPKRLNAKMRFAVAQPAAVASNNVND

SEQ ID NO: 1591814 - protein, 25 aa, Staphylococcus aureus
AVTDLNQLNGLNNPQRQALESQINN

SEQ ID NO: 1591815 - protein, 21 aa, Staphylococcus aureus
DFSHYLLLIILFSLVILQYIL

SEQ ID NO: 1591816 - protein, 17 aa, Staphylococcus aureus
DLQLAYKELEQAVALIR

SEQ ID NO: 1591817 - protein, 25 aa, Staphylococcus aureus
DNLKANYDNAIANAAHELDKVQGNA

SEQ ID NO: 1591818 - protein, 22 aa, Staphylococcus aureus
DNVIAPVLTGNLKPNTDSNALI

SEQ ID NO: 1591819 - protein, 26 aa, Staphylococcus aureus
DQITTPYIVVVNGHIDPASTGDLALR

SEQ ID NO: 1591820 - protein, 25 aa, Staphylococcus aureus
DVLTLLVFAIVLMIVSVLGSLFSIL

SEQ ID NO: 1591821 - protein, 23 aa, Staphylococcus aureus
EGFPTINWLGFYPSYEPLIAQAA

SEQ ID NO: 1591822 - protein, 23 aa, Staphylococcus aureus
EGFPTINWLGFYPSYEPLIAQGA

SEQ ID NO: 1591823 - protein, 25 aa, Staphylococcus aureus
EKGIKGVYVILKDSNGKELDRTTTD

SEQ ID NO: 1591824 - protein, 20 aa, Staphylococcus aureus
ELEKKVEEIPFKKERKFNPD

SEQ ID NO: 1591825 - protein, 30 aa, Staphylococcus aureus
ETTSSQSWWGLYALLGMLALFIPKFRKESK

SEQ ID NO: 1591826 - protein, 23 aa, Staphylococcus aureus
FGLLFQLPILFMGLAKFGLIDTT

SEQ ID NO: 1591827 - protein, 19 aa, Staphylococcus aureus
FISIEVILLLTLFIVHVNG

SEQ ID NO: 1591828 - protein, 21 aa, Staphylococcus aureus
FKPIVFGFKSFLIGSTYIFTA

SEQ ID NO: 1591829 - protein, 24 aa, Staphylococcus aureus
FLRLHIPNWLRRLITRSLAVIPVI

SEQ ID NO: 1591830 - protein, 21 aa, Staphylococcus aureus
GAISWFFLSLILSLTQFTPFT

SEQ ID NO: 1591831 - protein, 25 aa, Staphylococcus aureus
GFMGFITFVLLIVQQWLFLNPNHNL

SEQ ID NO: 1591832 - protein, 23 aa, Staphylococcus aureus
GPNKDVVGISTRLIRVTYDNRQT

SEQ ID NO: 1591833 - protein, 19 aa, Staphylococcus aureus
GRYEILYLSIPLLALTYLF

SEQ ID NO: 1591834 - protein, 24 aa, Staphylococcus aureus
GVGLPLFTALPIVSGMLEKYGIRD

SEQ ID NO: 1591835 - protein, 32 aa, Staphylococcus aureus
GVIITLVGAFRFLIPIILAVSNFMGGGLIGRI

SEQ ID NO: 1591836 - protein, 19 aa, Staphylococcus aureus
HGSGFSSVVTVSDALPNGG

SEQ ID NO: 1591837 - protein, 29 aa, Staphylococcus aureus
IADEMFNNKITYNYSSPIAGIDKPNGANI

SEQ ID NO: 1591838 - protein, 17 aa, Staphylococcus aureus
IALATFLRPIGGILGDK

SEQ ID NO: 1591839 - protein, 18 aa, Staphylococcus aureus
IDANSVTYKAGLTNQEIK

SEQ ID NO: 1591840 - protein, 18 aa, Staphylococcus aureus
IELIIIVISLLQWIRFID

SEQ ID NO: 1591841 - protein, 25 aa, Staphylococcus aureus
IFDKRFLIFFLSAVVLHGIWDTSLT

SEQ ID NO: 1591842 - protein, 21 aa, Staphylococcus aureus
IFRPVMRPLFTLPGRSTVDNL

SEQ ID NO: 1591843 - protein, 19 aa, Staphylococcus aureus
IGGAVAAVLVTRKDSRDKL

SEQ ID NO: 1591844 - protein, 18 aa, Staphylococcus aureus
IITLLFTVIEFVGGLVSN

SEQ ID NO: 1591845 - protein, 26 aa, Staphylococcus aureus
IIVTILFILFINWYLNVNLWNGRQIS

SEQ ID NO: 1591846 - protein, 23 aa, Staphylococcus aureus
IKNPIMFVVEVGMLLTLILICFP

SEQ ID NO: 1591847 - protein, 29 aa, Staphylococcus aureus
ILLGLMTLIIILLLQRFTTGFIKSIAILI

SEQ ID NO: 1591848 - protein, 21 aa, Staphylococcus aureus
ILLIVLAVILKFSLWRYKKLT

SEQ ID NO: 1591849 - protein, 18 aa, Staphylococcus aureus
ILYLIFPIAGIFFNEVYG

SEQ ID NO: 1591850 - protein, 24 aa, Staphylococcus aureus
IPQFIRMAIVVTLLIPFMLILVGA

SEQ ID NO: 1591851 - protein, 24 aa, Staphylococcus aureus
IPQFIRMVIVVTLLIPFMLILVGA

SEQ ID NO: 1591852 - protein, 19 aa, Staphylococcus aureus
IRWLFTFGLLFQLPILFMG

SEQ ID NO: 1591853 - protein, 43 aa, Staphylococcus aureus
ITKTATYKVVRTVPKHVFETARGVLYPGVSDMYDAKQYVKPVN

SEQ ID NO: 1591854 - protein, 24 aa, Staphylococcus aureus
ITYLLQVILYLLIVIALVMIGFET

SEQ ID NO: 1591855 - protein, 18 aa, Staphylococcus aureus
IVMFILNISHIHLPHVAI

SEQ ID NO: 1591856 - protein, 23 aa, Staphylococcus aureus
IYLDNWWIVTFIFVAQVILSLSY

SEQ ID NO: 1591857 - protein, 23 aa, Staphylococcus aureus
KANAFIVIIFLLLAQIFYFYIII

SEQ ID NO: 1591858 - protein, 19 aa, Staphylococcus aureus
KDRFRLFNGWYYLIKYAMP

SEQ ID NO: 1591859 - protein, 17 aa, Staphylococcus aureus
KEYIARRLANLIHVEHL

SEQ ID NO: 1591860 - protein, 21 aa, Staphylococcus aureus
KIKKIIIAIPTIGQERLKEIN

SEQ ID NO: 1591861 - protein, 26 aa, Staphylococcus aureus
KKTLWASLIITLLFTVIEFVGGLVSN

SEQ ID NO: 1591862 - protein, 22 aa, Staphylococcus aureus
KMLIQLSTFHSYHDLEFLFVTR

SEQ ID NO: 1591863 - protein, 25 aa, Staphylococcus aureus
KNIRDMKMWILGLIGTIFSTIVIAL

SEQ ID NO: 1591864 - protein, 19 aa, Staphylococcus aureus
KTIYYWIRYLNFDIVNREK

SEQ ID NO: 1591865 - protein, 22 aa, Staphylococcus aureus
KTLWASLIITLLFTVIEFVGGL

SEQ ID NO: 1591866 - protein, 19 aa, Staphylococcus aureus
KVEAYHPKYPTNIGQINQN

SEQ ID NO: 1591867 - protein, 29 aa, Staphylococcus aureus
LCYIPLVFLFIALYPFLVFIAQRPIFQFS

SEQ ID NO: 1591868 - protein, 27 aa, Staphylococcus aureus
LDNAMGAVQQYIDEQHLGVISSTNYIN

SEQ ID NO: 1591869 - protein, 20 aa, Staphylococcus aureus
LFMILFSCLTFFFGLDYERF

SEQ ID NO: 1591870 - protein, 24 aa, Staphylococcus aureus
LFTFLFLLGYFLPIGIDKVKSLSY

SEQ ID NO: 1591871 - protein, 18 aa, Staphylococcus aureus
LIGTIFSTIVIALLRTIF

SEQ ID NO: 1591872 - protein, 27 aa, Staphylococcus aureus
LIILVIITLFILLFIELVEVRIPYIDL

SEQ ID NO: 1591873 - protein, 17 aa, Staphylococcus aureus
LIKYAMPVVIILVFIVQ

SEQ ID NO: 1591874 - protein, 17 aa, Staphylococcus aureus
LIPNLPNGDYRVEFSNL

SEQ ID NO: 1591875 - protein, 23 aa, Staphylococcus aureus
LLIYVPFCFFLTASVTLLTSTLG

SEQ ID NO: 1591876 - protein, 20 aa, Staphylococcus aureus
LNYYVVYLLLLKLLHIEYMI

SEQ ID NO: 1591877 - protein, 41 aa, Staphylococcus aureus
LPDTGDSIKQNGLLGGVMTLLVGLGLMKRKKKKDENDQDDS

SEQ ID NO: 1591878 - protein, 54 aa, Staphylococcus aureus
LPQALEGLKPTLIYPLLTVTATGLLMIYAFNPPASWLNHLLLDGLNNLSGSNIV

SEQ ID NO: 1591879 - protein, 46 aa, Staphylococcus aureus
LRRSKRIAVLSWLSLCICIALALILYALPYLILGSNNWSFVLTWLP

SEQ ID NO: 1591880 - protein, 19 aa, Staphylococcus aureus
LSVILLFSIPTPVAVILMG

SEQ ID NO: 1591881 - protein, 23 aa, Staphylococcus aureus
LTACWMIFMILSGTYLLIKKHLI

SEQ ID NO: 1591882 - protein, 19 aa, Staphylococcus aureus
LTLILICFPDIFGTSYLSR

SEQ ID NO: 1591883 - protein, 18 aa, Staphylococcus aureus
MGLYIFIVLTIGASMLVA

SEQ ID NO: 1591884 - protein, 22 aa, Staphylococcus aureus
MKYAYNWAFFNPIRKIYYNITI

SEQ ID NO: 1591885 - protein, 24 aa, Staphylococcus aureus
MLFITNFNWIYMIGALIAIIVFAL

SEQ ID NO: 1591886 - protein, 25 aa, Staphylococcus aureus
MLKGLLLKITFNFGLPLLIAILHAV

SEQ ID NO: 1591887 - protein, 23 aa, Staphylococcus aureus
MTVPLFLIALIVFIGMFYGVVTN

SEQ ID NO: 1591888 - protein, 34 aa, Staphylococcus aureus
NGNGGDGIGFAFSPGVLGETGLNGAAVGIGGLSN

SEQ ID NO: 1591889 - protein, 22 aa, Staphylococcus aureus
NLKANYDNAIANAAHELDKVQG

SEQ ID NO: 1591890 - protein, 23 aa, Staphylococcus aureus
NNTYRQTIYVNPSGDNVVLPALT

SEQ ID NO: 1591891 - protein, 32 aa, Staphylococcus aureus
NRKGMIPNRLNKFSIRKYSVGTASILVGTTLI

SEQ ID NO: 1591892 - protein, 24 aa, Staphylococcus aureus
NRQTEDLTILSKVKPDPPRIDANS

SEQ ID NO: 1591893 - protein, 25 aa, Staphylococcus aureus
NSSNIFDWLVKLTSQFRAWSEQVGQ

SEQ ID NO: 1591894 - protein, 25 aa, Staphylococcus aureus
NVVLPALTGNLIPNTKSNALIDAKN

SEQ ID NO: 1591895 - protein, 39 aa, Staphylococcus aureus
PASTGDLALRSTFYGYDSNFIWRSMSWDNEVAFNNGSGS

SEQ ID NO: 1591896 - protein, 43 aa, Staphylococcus aureus
PIGVKLKLAKVIIILCVVAFFTFPVIVMFLLAPDSNKDKDDAG

SEQ ID NO: 1591897 - protein, 19 aa, Staphylococcus aureus
PWLFSRVFIAFTVTFIGLW

SEQ ID NO: 1591898 - protein, 28 aa, Staphylococcus aureus
QAVNPSTPRMRAFSLAAVAADAPAAGTD

SEQ ID NO: 1591899 - protein, 22 aa, Staphylococcus aureus
QLTEALFAEKPVAKNDLKEIPQ

SEQ ID NO: 1591900 - protein, 31 aa, Staphylococcus aureus
QQMRNQLPISYLYEGVGILETPFGPIVSLNE

SEQ ID NO: 1591901 - protein, 22 aa, Staphylococcus aureus
QSQQPKPYFTTGANQSETSKNE

SEQ ID NO: 1591902 - protein, 24 aa, Staphylococcus aureus
RASDYFSEAGATPATKAFGRQNFE

SEQ ID NO: 1591903 - protein, 20 aa, Staphylococcus aureus
SALTAKGYNYTSVDSSYAST

SEQ ID NO: 1591904 - protein, 26 aa, Staphylococcus aureus
SAVFDYWWMFGISFLFFALASLLTFF

SEQ ID NO: 1591905 - protein, 17 aa, Staphylococcus aureus
SGLLYIGFVIYTLTIGS

SEQ ID NO: 1591906 - protein, 17 aa, Staphylococcus aureus
SIFGFLYNSVKSIFTNM

SEQ ID NO: 1591907 - protein, 18 aa, Staphylococcus aureus
SMGTFIVIVFFAAQLLAY

SEQ ID NO: 1591908 - protein, 37 aa, Staphylococcus aureus
STTSTSTAPIKLRTFSRLAMSTFASAATTSAVTANTI

SEQ ID NO: 1591909 - protein, 28 aa, Staphylococcus aureus
SVAGKSWLFMPYLILVLLGGILHNRIWL

SEQ ID NO: 1591910 - protein, 24 aa, Staphylococcus aureus
SVWLVLLFSVMGLWQVSNAAEQHT

SEQ ID NO: 1591911 - protein, 48 aa, Staphylococcus aureus
TEYQDYFLQFEWFQPLLISLAALLILIGLILVFSIFKPTHRKPGLYKD

SEQ ID NO: 1591912 - protein, 24 aa, Staphylococcus aureus
TIIGALLLYLPFTGKKPISFLDAL

SEQ ID NO: 1591913 - protein, 21 aa, Staphylococcus aureus
TIKQRALNRMAVNTVAAPQQG

SEQ ID NO: 1591914 - protein, 17 aa, Staphylococcus aureus
TVYVNQPKKTYTKETFV

SEQ ID NO: 1591915 - protein, 18 aa, Staphylococcus aureus
VDSIHIPMIMSALKEIEK

SEQ ID NO: 1591916 - protein, 27 aa, Staphylococcus aureus
VEALQNIYLRVYYPPVVIGLTALVTVI

SEQ ID NO: 1591917 - protein, 18 aa, Staphylococcus aureus
VFITPVILTLVLSFGLSA

SEQ ID NO: 1591918 - protein, 24 aa, Staphylococcus aureus
VFKQWLQYILLVTTIVIALVLIGI

SEQ ID NO: 1591919 - protein, 26 aa, Staphylococcus aureus
VFSGLVPYWAVFKIILMMINNTYTIN

SEQ ID NO: 1591920 - protein, 28 aa, Staphylococcus aureus
VGIGGLSNAFGFKLDTYHNTSKPNAAAK

SEQ ID NO: 1591921 - protein, 29 aa, Staphylococcus aureus
VIGLHPFAVFFPIIALLIIYYMIRFKMRA

SEQ ID NO: 1591922 - protein, 24 aa, Staphylococcus aureus
VINLVLCIILIYFYGIYGAAIARL

SEQ ID NO: 1591923 - protein, 35 aa, Staphylococcus aureus
VKSHDLIFNQLYVVFKMIFWFNPALYISKTMMDND

SEQ ID NO: 1591924 - protein, 21 aa, Staphylococcus aureus
VLVGLILLRLFKINLFSFKKL

SEQ ID NO: 1591925 - protein, 34 aa, Staphylococcus aureus
WNVMFYGMFIIGIIAILIGFVWFKLYQYTTNPKA

SEQ ID NO: 1591926 - protein, 25 aa, Staphylococcus aureus
YASIGIIIYVSLRFEWRMGLSSVLA

SEQ ID NO: 1591927 - protein, 24 aa, Staphylococcus aureus
YGYTLLFVILISSLSAMLLQSMTV

SEQ ID NO: 1591928 - protein, 25 aa, Staphylococcus aureus
YHLYAMRRFFINVVLGMVFMSIVVQ

SEQ ID NO: 1591929 - protein, 35 aa, Staphylococcus aureus
YQKYIDFMFAGVLAFIFLVYRIYILFIDYKSVNKK

SEQ ID NO: 1591930 - protein, 26 aa, Staphylococcus aureus
ACIFLIVLFILYIWLPQDRNQVKQSD

SEQ ID NO: 1591931 - protein, 27 aa, Staphylococcus aureus
AGAGANKPLQQMWEYGVNDPDRSHDFK

SEQ ID NO: 1591932 - protein, 23 aa, Staphylococcus aureus
AGAKNLYDVYISKGLDTPKKIGP

SEQ ID NO: 1591933 - protein, 22 aa, Staphylococcus aureus
AGSFVYIYFMQGVQRFDFDHPN

SEQ ID NO: 1591934 - protein, 19 aa, Staphylococcus aureus
AIVIGLIALLAWPMSASTG

SEQ ID NO: 1591935 - protein, 25 aa, Staphylococcus aureus
ALILSMVIIYLFIRRQFNITNALLN

SEQ ID NO: 1591936 - protein, 27 aa, Staphylococcus aureus
APYTIVFYFSLFSVIVLIPFTAYTYEP

SEQ ID NO: 1591937 - protein, 18 aa, Staphylococcus aureus
ARTIALRTGLSDTVPGQT

SEQ ID NO: 1591938 - protein, 18 aa, Staphylococcus aureus
DFGDINSAYIIKVVSKYT

SEQ ID NO: 1591939 - protein, 35 aa, Staphylococcus aureus
DFKIRNRSGQVIYSWPTVHVYSLEDLSRASDYFSE

SEQ ID NO: 1591940 - protein, 24 aa, Staphylococcus aureus
DGETYTVKFETPAGYLPTKVNGTT

SEQ ID NO: 1591941 - protein, 23 aa, Staphylococcus aureus
DLIYQNNIFGLKDKVDWVGHKID

SEQ ID NO: 1591942 - protein, 17 aa, Staphylococcus aureus
DLRVLMDAIYELNDHQD

SEQ ID NO: 1591943 - protein, 25 aa, Staphylococcus aureus
DNALNAVTRAKAALNGAENLRNAKT

SEQ ID NO: 1591944 - protein, 22 aa, Staphylococcus aureus
DNKYDMLMKAFQIDASVNPGNS

SEQ ID NO: 1591945 - protein, 21 aa, Staphylococcus aureus
DRPSIGIGLINLKDIPEEERE

SEQ ID NO: 1591946 - protein, 21 aa, Staphylococcus aureus
DSATNSIIGTPTKIGQSTVTV

SEQ ID NO: 1591947 - protein, 18 aa, Staphylococcus aureus
DYHYFFFSDGFFITISIL

SEQ ID NO: 1591948 - protein, 24 aa, Staphylococcus aureus
EEHPLFTIIGGTCLVAGLALIVHM

SEQ ID NO: 1591949 - protein, 25 aa, Staphylococcus aureus
EEQFYIFFPVILVTLLLTIKKRYKI

SEQ ID NO: 1591950 - protein, 24 aa, Staphylococcus aureus
EIDPLHMRHFGDRIGNVIKNALGV

SEQ ID NO: 1591951 - protein, 18 aa, Staphylococcus aureus
ELEKMLIQLSTFHSYHDL

SEQ ID NO: 1591952 - protein, 26 aa, Staphylococcus aureus
EMRRYLMRFVHHISGLADFSALKFTK

SEQ ID NO: 1591953 - protein, 28 aa, Staphylococcus aureus
ERLTQAINQLVPLADNSALRTAKTKLDE

SEQ ID NO: 1591954 - protein, 24 aa, Staphylococcus aureus
ESYLWIGIVFVFFLISYISQIVGI

SEQ ID NO: 1591955 - protein, 18 aa, Staphylococcus aureus
EYTESAVTQVRYVDVTTG

SEQ ID NO: 1591956 - protein, 17 aa, Staphylococcus aureus
FAWQMSGILLWIYIIVI

SEQ ID NO: 1591957 - protein, 20 aa, Staphylococcus aureus
FGGEKIPQGHKDIFDPNLPT

SEQ ID NO: 1591958 - protein, 28 aa, Staphylococcus aureus
FGLPALTLPFIIVTWILLFAGIKHDKVD

SEQ ID NO: 1591959 - protein, 25 aa, Staphylococcus aureus
FIAWSLLYSVVVLILLVFANDYWSI

SEQ ID NO: 1591960 - protein, 17 aa, Staphylococcus aureus
FILIVICPLILNYTLTL

SEQ ID NO: 1591961 - protein, 17 aa, Staphylococcus aureus
FIVLTVVTPLFGIGSIV

SEQ ID NO: 1591962 - protein, 18 aa, Staphylococcus aureus
FLLNLTFKENIKLGNPEA

SEQ ID NO: 1591963 - protein, 31 aa, Staphylococcus aureus
FSNLLMVCHPLLFMFFTKIFIQSWKQMHRYG

SEQ ID NO: 1591964 - protein, 32 aa, Staphylococcus aureus
FVALMKLSKIKIISWIASIYIEILRGTPMLVQ

SEQ ID NO: 1591965 - protein, 24 aa, Staphylococcus aureus
FVLSVLSLPIFLYAVIKFFFSAKR

SEQ ID NO: 1591966 - protein, 17 aa, Staphylococcus aureus
GAPWNIVLFSIGMYIVV

SEQ ID NO: 1591967 - protein, 17 aa, Staphylococcus aureus
GEDNLVTSMLFVGSIVI

SEQ ID NO: 1591968 - protein, 25 aa, Staphylococcus aureus
GFLRLHIPNWLRRLITRSLAVIPVI

SEQ ID NO: 1591969 - protein, 17 aa, Staphylococcus aureus
GGLSFVLLLIQQWLFLN

SEQ ID NO: 1591970 - protein, 20 aa, Staphylococcus aureus
GIFLFFLYLNQKLKLQIYNE

SEQ ID NO: 1591971 - protein, 18 aa, Staphylococcus aureus
GLLLLFFLLRQAILKEPR

SEQ ID NO: 1591972 - protein, 32 aa, Staphylococcus aureus
GLSKNQAYNFLITSSQRWGLNQGINANGWMRT

SEQ ID NO: 1591973 - protein, 22 aa, Staphylococcus aureus
GPALLIPLYVQNSLALSALLSG

SEQ ID NO: 1591974 - protein, 26 aa, Staphylococcus aureus
GTLFTIILAIGFIINLVLAFIIIFLE

SEQ ID NO: 1591975 - protein, 25 aa, Staphylococcus aureus
GVMTQGWWFPVMASAFLIFTIVIMF

SEQ ID NO: 1591976 - protein, 24 aa, Staphylococcus aureus
HSNIVLMMLIFILAGAFSNTAEKM

SEQ ID NO: 1591977 - protein, 32 aa, Staphylococcus aureus
IDLVLSIVLLFLTFPIMFIFAIAIVIDSPGNP

SEQ ID NO: 1591978 - protein, 18 aa, Staphylococcus aureus
IENNVMLGVIYLKDVIKD

SEQ ID NO: 1591979 - protein, 21 aa, Staphylococcus aureus
IETIIQKIYYAKNRHLGTYTP

SEQ ID NO: 1591980 - protein, 18 aa, Staphylococcus aureus
IFISKWLYRRKGSWVKVL

SEQ ID NO: 1591981 - protein, 18 aa, Staphylococcus aureus
IGQGDASYTISFKTQGPT

SEQ ID NO: 1591982 - protein, 25 aa, Staphylococcus aureus
IIGAIFVISYLFWYCKKIKKDPKSS

SEQ ID NO: 1591983 - protein, 20 aa, Staphylococcus aureus
IIGVILCICTVSTVMHFKMK

SEQ ID NO: 1591984 - protein, 17 aa, Staphylococcus aureus
IIIGLLVIILTGMSVSI

SEQ ID NO: 1591985 - protein, 17 aa, Staphylococcus aureus
IQTICVLLGIWVYNLDK

SEQ ID NO: 1591986 - protein, 31 aa, Staphylococcus aureus
ITNVMNIIQGLWTLITIAFQAIGTVISVAVQ

SEQ ID NO: 1591987 - protein, 25 aa, Staphylococcus aureus
IVAIVLIYFTGWRIIDPIISIVISL

SEQ ID NO: 1591988 - protein, 23 aa, Staphylococcus aureus
IVAMLVFLLFRFYIKTDNFSIYL

SEQ ID NO: 1591989 - protein, 19 aa, Staphylococcus aureus
IVIIGIALISLVFLPGIFY

SEQ ID NO: 1591990 - protein, 46 aa, Staphylococcus aureus
IVMILKGTVQLIWNLIQLWFVGKILGVVRYFGGLLKGLISGIWGVI

SEQ ID NO: 1591991 - protein, 20 aa, Staphylococcus aureus
IVMLLTIAIILGFGALEIAT

SEQ ID NO: 1591992 - protein, 35 aa, Staphylococcus aureus
IVTLTQDAYSQKGAITLGTRIDSNKSFHFSGKVNL

SEQ ID NO: 1591993 - protein, 40 aa, Staphylococcus aureus
KDFLTQWKLYILSAVVLIMVLIGFIFWRQDDYTSRNFENK

SEQ ID NO: 1591994 - protein, 20 aa, Staphylococcus aureus
KDQLNQGLNLGLDDIRNTHV

SEQ ID NO: 1591995 - protein, 25 aa, Staphylococcus aureus
KFANFFKMLWLRLKAMKHYKALNKE

SEQ ID NO: 1591996 - protein, 21 aa, Staphylococcus aureus
KLPMYLLVFMAFTAVILIMMY

SEQ ID NO: 1591997 - protein, 36 aa, Staphylococcus aureus; identical to SEQ ID NO: 1583480

SEQ ID NO: 1591998 - protein, 41 aa, Staphylococcus aureus
KNSERRGMLKGCGGCLISFILLIILLSACSMMFSNNDNSTN

SEQ ID NO: 1591999 - protein, 18 aa, Staphylococcus aureus
KPQLLITLIYALIAFAVI

SEQ ID NO: 1592000 - protein, 31 aa, Staphylococcus aureus
KSAIISALIFNALIIVALIPIAMKGVKVKGY

SEQ ID NO: 1592001 - protein, 29 aa, Staphylococcus aureus
KSMYGGIPRDFIDYLFIDEAGQAIPQAAV

SEQ ID NO: 1592002 - protein, 29 aa, Staphylococcus aureus
KVLKDNEHSPLLFAKRRKDKEEDVETTTS

SEQ ID NO: 1592003 - protein, 25 aa, Staphylococcus aureus
KVMMPLLFVFLIVIVIKSLTLDGAL

SEQ ID NO: 1592004 - protein, 43 aa, Staphylococcus aureus
LFASVIVVLAFFLLMIVFRSILIPLKAVLGFVLSLMATLGFTT

SEQ ID NO: 1592005 - protein, 22 aa, Staphylococcus aureus
LFDAFVVRMMLIPALTKLFGKG

SEQ ID NO: 1592006 - protein, 20 aa, Staphylococcus aureus
LFLCLLVILIATAYISFVTG

SEQ ID NO: 1592007 - protein, 17 aa, Staphylococcus aureus
LFNYWLMGTISIIISYL

SEQ ID NO: 1592008 - protein, 25 aa, Staphylococcus aureus
LGVTPIARFVGFKAVGVDPKIMGIG

SEQ ID NO: 1592009 - protein, 17 aa, Staphylococcus aureus
LGWNYWFNWVVTVAADI

SEQ ID NO: 1592010 - protein, 17 aa, Staphylococcus aureus
LIELIRWLFTFGILFQL

SEQ ID NO: 1592011 - protein, 19 aa, Staphylococcus aureus
LIGRIIALVSKFGLLRAGL

SEQ ID NO: 1592012 - protein, 25 aa, Staphylococcus aureus
LIKAIITWLLLIPIFNFMTSFVEST

SEQ ID NO: 1592013 - protein, 31 aa, Staphylococcus aureus
LIPTFSSIIFLFFKLKYYAIVTILVTMIIMY

SEQ ID NO: 1592014 - protein, 17 aa, Staphylococcus aureus
LLPLLTKPAPKTVIGNM

SEQ ID NO: 1592015 - protein, 18 aa, Staphylococcus aureus
LQAIIYIVGLIFLMYMAW

SEQ ID NO: 1592016 - protein, 22 aa, Staphylococcus aureus
LSFVLLLIQQWLFLNPNHNLNQ

SEQ ID NO: 1592017 - protein, 25 aa, Staphylococcus aureus
LVISIVLFLIIFFIDIPNVEKGIVK

SEQ ID NO: 1592018 - protein, 24 aa, Staphylococcus aureus
LVLTIMLVITLYFSYIIKALAQEI

SEQ ID NO: 1592019 - protein, 25 aa, Staphylococcus aureus
MENHFECLWDLFRSIPSLEIDHASV

SEQ ID NO: 1592020 - protein, 17 aa, Staphylococcus aureus
MMVISPIMIIWISLSSA

SEQ ID NO: 1592021 - protein, 40 aa, Staphylococcus aureus
NAGTQLYHIVASNAYHKDTEDFYISLKIVDVKQPEGDQRV

SEQ ID NO: 1592022 - protein, 18 aa, Staphylococcus aureus
NIHILWIIALAIGLMYGI

SEQ ID NO: 1592023 - protein, 29 aa, Staphylococcus aureus
NKENINGQFSLPLFTDRAKAPKSGTYDAN

SEQ ID NO: 1592024 - protein, 17 aa, Staphylococcus aureus
NLFVFFEVFLMSSYFLL

SEQ ID NO: 1592025 - protein, 31 aa, Staphylococcus aureus
NTNATLFDAMVALLGSLLLFRKRKQDHKEKA

SEQ ID NO: 1592026 - protein, 22 aa, Staphylococcus aureus
NWRGVWDGIVMILKGTVQLIWN

SEQ ID NO: 1592027 - protein, 24 aa, Staphylococcus aureus
PAILLPLYILSFSSVSLLATYLVR

SEQ ID NO: 1592028 - protein, 26 aa, Staphylococcus aureus
PVTNRDYSIFGWNNENVVRYGGGSAD

SEQ ID NO: 1592029 - protein, 17 aa, Staphylococcus aureus
QAIIYIVGLIFLMYMAW

SEQ ID NO: 1592030 - protein, 18 aa, Staphylococcus aureus
QALKDRINQILQQGHNGI

SEQ ID NO: 1592031 - protein, 18 aa, Staphylococcus aureus
QFWDIFVSKLFLALTVFA

SEQ ID NO: 1592032 - protein, 31 aa, Staphylococcus aureus
QIYQINIWVWVPLIVIIVCLLFKMATVPAMV

SEQ ID NO: 1592033 - protein, 17 aa, Staphylococcus aureus
QVPLFWINATVGGFIFI

SEQ ID NO: 1592034 - protein, 30 aa, Staphylococcus aureus
RIDTLNKEEGKFSHFAYVKPNNQSLTSVTV

SEQ ID NO: 1592035 - protein, 25 aa, Staphylococcus aureus
RKKIILTLFVLPFPIMVWGVMTQGW

SEQ ID NO: 1592036 - protein, 18 aa, Staphylococcus aureus
RQSFNIPALKAWQSVKQN

SEQ ID NO: 1592037 - protein, 37 aa, Staphylococcus aureus
RRGIWQVKPIIQGWDHVDFIGVDFLDFKRKGAELANF

SEQ ID NO: 1592038 - protein, 17 aa, Staphylococcus aureus
SGNKTTTTFKYEVTRNS

SEQ ID NO: 1592039 - protein, 23 aa, Staphylococcus aureus
SGTTNFSLSMTASTGGATNLQQV

SEQ ID NO: 1592040 - protein, 25 aa, Staphylococcus aureus
SSRFIKWLNDMNIIPGYYGVNSINL

SEQ ID NO: 1592041 - protein, 17 aa, Staphylococcus aureus
STSLSLSASMNQSGVDS

SEQ ID NO: 1592042 - protein, 27 aa, Staphylococcus aureus
SVILALLVLMSVVLTYMVWNFSPDIAN

SEQ ID NO: 1592043 - protein, 30 aa, Staphylococcus aureus
TAVRHIYEISSLIYKVTMKIKIKAMGINVD

SEQ ID NO: 1592044 - protein, 18 aa, Staphylococcus aureus
TLAVLAIMIPIFGVGKTP

SEQ ID NO: 1592045 - protein, 26 aa, Staphylococcus aureus
TLILGMFMFLILLPLEKLFKLSSYYL

SEQ ID NO: 1592046 - protein, 20 aa, Staphylococcus aureus
TLLEPFGLPALTLPFIIVTW

SEQ ID NO: 1592047 - protein, 21 aa, Staphylococcus aureus
TSNRMSTIASLSTSVSTSESG

SEQ ID NO: 1592048 - protein, 21 aa, Staphylococcus aureus
TTLLAVAIIIGSIIMVVFSQR

SEQ ID NO: 1592049 - protein, 31 aa, Staphylococcus aureus
TVGNQTIEVGKTMNPIVLTTTDNGTGTVTNT

SEQ ID NO: 1592050 - protein, 21 aa, Staphylococcus aureus
TVTGLPSGLTFDSTNNTISGT

SEQ ID NO: 1592051 - protein, 23 aa, Staphylococcus aureus
TYLVLTIIGAYAALFILKTIDSH

SEQ ID NO: 1592052 - protein, 25 aa, Staphylococcus aureus
VDEPLHFQGGLTKRSYFNKNGHVTI

SEQ ID NO: 1592053 - protein, 26 aa, Staphylococcus aureus
VDVTTGKDIIPPKTYSGNVDQVVTID

SEQ ID NO: 1592054 - protein, 19 aa, Staphylococcus aureus
VFAVLSALTLLPALISIFH

SEQ ID NO: 1592055 - protein, 36 aa, Staphylococcus aureus
VIDNDLLVPFIFLGVLYLLYFLYDRGYNLKFYAIQK

SEQ ID NO: 1592056 - protein, 41 aa, Staphylococcus aureus
VRRDHNLMIPDLNSDFILFDFTYDLPLSTYLGQVLNMNAKV

SEQ ID NO: 1592057 - protein, 19 aa, Staphylococcus aureus
VRRDYEFNVNSPEFQDLEL

SEQ ID NO: 1592058 - protein, 25 aa, Staphylococcus aureus
VTLGFLIFFTYFSILVYLPTLLNNT

SEQ ID NO: 1592059 - protein, 18 aa, Staphylococcus aureus
VTQVRYVDVTTGKDIIPP

SEQ ID NO: 1592060 - protein, 18 aa, Staphylococcus aureus
WLLVLCVFVIIVNASWNT

SEQ ID NO: 1592061 - protein, 19 aa, Staphylococcus aureus
WLLVLCVFVIIVNASWNTI

SEQ ID NO: 1592062 - protein, 17 aa, Staphylococcus aureus
YFIVVIMQFFILSYIIF

SEQ ID NO: 1592063 - protein, 22 aa, Staphylococcus aureus
YGIIVFLWMILGGLIIKKYPIY

SEQ ID NO: 1592064 - protein, 24 aa, Staphylococcus aureus
YHKVVLPPYLGFFGGSRFVPIVTA

SEQ ID NO: 1592065 - protein, 19 aa, Staphylococcus aureus
YIVVVNGHIDPNSKGDLAL

SEQ ID NO: 1592066 - protein, 17 aa, Staphylococcus aureus
YRMVFNTISVEKMNAIL

SEQ ID NO: 1592067 - protein, 18 aa, Staphylococcus aureus
YTFGYLRFEILAAFLNGL

SEQ ID NO: 1592068 - protein, 17 aa, Staphylococcus aureus
AIILLYALGSIIAVYCI

SEQ ID NO: 1592069 - protein, 24 aa, Staphylococcus aureus
ARIGRSLGIHLILATQKPSGVVDD

SEQ ID NO: 1592070 - protein, 21 aa, Staphylococcus aureus
AVPIILFLLCLTVFKMKGIYA

SEQ ID NO: 1592071 - protein, 26 aa, Staphylococcus aureus
AVYVIFYFIWLRFEWPHYLLYILLVL

SEQ ID NO: 1592072 - protein, 24 aa, Staphylococcus aureus
DALANLDTLRDLNQPQRDALRNQI

SEQ ID NO: 1592073 - protein, 18 aa, Staphylococcus aureus
DALNGDAKLIAAQNAAKQ

SEQ ID NO: 1592074 - protein, 31 aa, Staphylococcus aureus
DEANTSLIWGLLASIGSLLLFRRKKENKDKK

SEQ ID NO: 1592075 - protein, 17 aa, Staphylococcus aureus
DGSYLIPNLPNGDYRVE

SEQ ID NO: 1592076 - protein, 18 aa, Staphylococcus aureus
DIIFQIGPGLFGVRDKEG

SEQ ID NO: 1592077 - protein, 21 aa, Staphylococcus aureus
DKVMDPAKKPAPGKVVLLLAH

SEQ ID NO: 1592078 - protein, 27 aa, Staphylococcus aureus
DLVSTWLVLFFPFINWLIPKKYVQISR

SEQ ID NO: 1592079 - protein, 29 aa, Staphylococcus aureus
DPKNNSRTLIFPYIPDKAVYNAIVKVVVA

SEQ ID NO: 1592080 - protein, 40 aa, Staphylococcus aureus
DPNSKGDLALRSTLYGYNSNIIWRSMSWDNEVAFNNGSGS

SEQ ID NO: 1592081 - protein, 41 aa, Staphylococcus aureus; identical to SEQ ID NO: 1587691

SEQ ID NO: 1592082 - protein, 24 aa, Staphylococcus aureus
DRIFINNMLIYGLGGLIVPFLGIK

SEQ ID NO: 1592083 - protein, 24 aa, Staphylococcus aureus
DRLILVFNGFFILCIVSLVITILT

SEQ ID NO: 1592084 - protein, 25 aa, Staphylococcus aureus
DSNKSFHFSGKVNLGNKYEGNGNGG

SEQ ID NO: 1592085 - protein, 19 aa, Staphylococcus aureus
DTIILGMVILAVVPLLFLV

SEQ ID NO: 1592086 - protein, 24 aa, Staphylococcus aureus
DVIRTWLVYFFPFINWFIPKRCAK

SEQ ID NO: 1592087 - protein, 29 aa, Staphylococcus aureus
DWFDIFIAGILRLFGVIALMLVVISPIYT

SEQ ID NO: 1592088 - protein, 18 aa, Staphylococcus aureus
EAWLWVLVLVAFSIVVIS

SEQ ID NO: 1592089 - protein, 32 aa, Staphylococcus aureus
EHPIGLVLVILTVLVIIGFVLNMFIKHFKKER

SEQ ID NO: 1592090 - protein, 38 aa, Staphylococcus aureus
EKLALVYARPLFYFGNIMKPLIWLMNGSARVIIRMFGV

SEQ ID NO: 1592091 - protein, 22 aa, Staphylococcus aureus
EQFTMIILLIALGYFLKRINFI

SEQ ID NO: 1592092 - protein, 22 aa, Staphylococcus aureus
EQFTMIILLIALGYFLKRINYI

SEQ ID NO: 1592093 - protein, 24 aa, Staphylococcus aureus
ESKDEDVPLLLAKKKNQKDNQSKG

SEQ ID NO: 1592094 - protein, 25 aa, Staphylococcus aureus
ESKSASAFLSELLSESTSASTSESL

SEQ ID NO: 1592095 - protein, 20 aa, Staphylococcus aureus
EYWYMALWHLILMVPAVCVL

SEQ ID NO: 1592096 - protein, 18 aa, Staphylococcus aureus
FAISRLFQAIGCGIIPLV

SEQ ID NO: 1592097 - protein, 22 aa, Staphylococcus aureus
FENVLFHKFIMIKVILALPMFI

SEQ ID NO: 1592098 - protein, 20 aa, Staphylococcus aureus
FEYTESAVTQVRYVDVTTGK

SEQ ID NO: 1592099 - protein, 19 aa, Staphylococcus aureus
FILPIITFIIFLGIWEMVI

SEQ ID NO: 1592100 - protein, 21 aa, Staphylococcus aureus
FIVLILLFFIINDETNWIYDG

SEQ ID NO: 1592101 - protein, 21 aa, Staphylococcus aureus
FLGMLLITKYAIDLLFIICVI

SEQ ID NO: 1592102 - protein, 35 aa, Staphylococcus aureus
FNLIGVIIFTIFLPVVIHLISLLQDLWHLKPAMTI

SEQ ID NO: 1592103 - protein, 25 aa, Staphylococcus aureus
FQYKIFPVFMFLVSTGLGILVITQN

SEQ ID NO: 1592104 - protein, 18 aa, Staphylococcus aureus
FRYAIFKGLGLGGAMTTG

SEQ ID NO: 1592105 - protein, 20 aa, Staphylococcus aureus
FSHYLLLIILFSLVILQYIL

SEQ ID NO: 1592106 - protein, 25 aa, Staphylococcus aureus
FTINFFVNFIVYLCMYLLLVVIAGY

SEQ ID NO: 1592107 - protein, 28 aa, Staphylococcus aureus
GDQSSEVYSPISPIKIATQDNSGNAVTN

SEQ ID NO: 1592108 - protein, 26 aa, Staphylococcus aureus
GINYLLLTMLLYIPALLVYTIVQKNN

SEQ ID NO: 1592109 - protein, 17 aa, Staphylococcus aureus
HAMIGIIIAIPVFVLVL

SEQ ID NO: 1592110 - protein, 23 aa, Staphylococcus aureus
HINLYFQIFIYSLCFYLLFTHKE

SEQ ID NO: 1592111 - protein, 25 aa, Staphylococcus aureus
IAGVFAIFIFSFELQWFPFQGSVDI

SEQ ID NO: 1592112 - protein, 17 aa, Staphylococcus aureus
ICCLLITAILYYTLDGF

SEQ ID NO: 1592113 - protein, 18 aa, Staphylococcus aureus
ICITMVFYFINRKLKLKL

SEQ ID NO: 1592114 - protein, 18 aa, Staphylococcus aureus
IFISKWLYRRKGSWVKLL

SEQ ID NO: 1592115 - protein, 22 aa, Staphylococcus aureus
IFSFLGGLGIFLYGLKIMGDGL

SEQ ID NO: 1592116 - protein, 24 aa, Staphylococcus aureus
IGAFIGVLVYLWKTNENFRNTITE

SEQ ID NO: 1592117 - protein, 21 aa, Staphylococcus aureus
IIELIIIIISLLQWIRFIDFE

SEQ ID NO: 1592118 - protein, 22 aa, Staphylococcus aureus
IIPTMFLYYFYGSRAVLIPTFS

SEQ ID NO: 1592119 - protein, 18 aa, Staphylococcus aureus
ILFIFFITANMIVLNLII

SEQ ID NO: 1592120 - protein, 17 aa, Staphylococcus aureus
ILKPLIIIALSSVFIFT

SEQ ID NO: 1592121 - protein, 17 aa, Staphylococcus aureus
ILKYVCFSGLIAAILLG

SEQ ID NO: 1592122 - protein, 17 aa, Staphylococcus aureus
IPPLAIATAMLIFRRKF

SEQ ID NO: 1592123 - protein, 30 aa, Staphylococcus aureus
IYQINIWVWVPLIVIIVCLLFKMATVPAMV

SEQ ID NO: 1592124 - protein, 21 aa, Staphylococcus aureus
KDYVFIDDGWAKHGTYCVVRR

SEQ ID NO: 1592125 - protein, 32 aa, Staphylococcus aureus
KEVTDQFKNRIYYEHPNVASIKFGDITKTYVV

SEQ ID NO: 1592126 - protein, 27 aa, Staphylococcus aureus
KGQYAKRFFYFATSCLVLTLVVVSSLS

SEQ ID NO: 1592127 - protein, 33 aa, Staphylococcus aureus
KKQSKLILIFICIFTFFIMIIQSQFLMGQSLTD

SEQ ID NO: 1592128 - protein, 17 aa, Staphylococcus aureus
KKRYKIGFIFWGVSIIS

SEQ ID NO: 1592129 - protein, 40 aa, Staphylococcus aureus
KNWVKSGIKEIEMFKIMGLPFISHSLVSQDNQSISKKITG

SEQ ID NO: 1592130 - protein, 28 aa, Staphylococcus aureus
KQNIVVFFIFIIFQLKDFDYTNPESYLW

SEQ ID NO: 1592131 - protein, 25 aa, Staphylococcus aureus
KWSAVIAWIVIVAAILIPLATNAPK

SEQ ID NO: 1592132 - protein, 20 aa, Staphylococcus aureus
KYAEEPINFILKSSTKLKAD

SEQ ID NO: 1592133 - protein, 17 aa, Staphylococcus aureus
LAVLAIMIPIFGVGKTP

SEQ ID NO: 1592134 - protein, 25 aa, Staphylococcus aureus
LGIVILLVLIIGFKLNKFISLIITS

SEQ ID NO: 1592135 - protein, 26 aa, Staphylococcus aureus
LGYTSLWFFGLIAIVIVAFFIFLNVE

SEQ ID NO: 1592136 - protein, 22 aa, Staphylococcus aureus
LIIFILLIALTTVFVGSEFALV

SEQ ID NO: 1592137 - protein, 26 aa, Staphylococcus aureus
LIIVFLYFFNLNIIDIIFLILLNILM

SEQ ID NO: 1592138 - protein, 24 aa, Staphylococcus aureus
LLISGLLFLFFFKENEEIIPESSN

SEQ ID NO: 1592139 - protein, 28 aa, Staphylococcus aureus
LPEIFYVICCIIGYLFFGLGLGIYATPS

SEQ ID NO: 1592140 - protein, 26 aa, Staphylococcus aureus
LQDNEHSPVLIAKRLKDKDGNVETTT

SEQ ID NO: 1592141 - protein, 18 aa, Staphylococcus aureus
LSDSTSTSLSLSASMNQS

SEQ ID NO: 1592142 - protein, 20 aa, Staphylococcus aureus
LSRPIAIIFWIIAELAIIAT

SEQ ID NO: 1592143 - protein, 23 aa, Staphylococcus aureus
LVITFVLVPVLIPTLKKLKFGQS

SEQ ID NO: 1592144 - protein, 18 aa, Staphylococcus aureus
LVTYIVMFILNISHIHLP

SEQ ID NO: 1592145 - protein, 18 aa, Staphylococcus aureus
LWDLFRSIPSLEIDHASV

SEQ ID NO: 1592146 - protein, 22 aa, Staphylococcus aureus
MENHFECLWDLFRSIPSLEIDH

SEQ ID NO: 1592147 - protein, 26 aa, Staphylococcus aureus
MRLSAVLFWIPIALVLLIAFNILNWL

SEQ ID NO: 1592148 - protein, 22 aa, Staphylococcus aureus
MTVPLFLIALIVFIGMFYGVVT

SEQ ID NO: 1592149 - protein, 17 aa, Staphylococcus aureus
NLKQYMTTSGNATYDQS

SEQ ID NO: 1592150 - protein, 40 aa, Staphylococcus aureus
NMSNAVTILPDDIPPTINNPVGINAKYYRGDEVNFTMGVS

SEQ ID NO: 1592151 - protein, 22 aa, Staphylococcus aureus
NPIPIYITNFFGGAIAGLIIAM

SEQ ID NO: 1592152 - protein, 20 aa, Staphylococcus aureus
NVLSHKPIYMKDILNVVIIM

SEQ ID NO: 1592153 - protein, 17 aa, Staphylococcus aureus
NYLMLAIPSFIAGVFAI

SEQ ID NO: 1592154 - protein, 39 aa, Staphylococcus aureus
NYNGDTKVMTVTYAGQTWTRNISDWIAKSGTTNFSLSMT

SEQ ID NO: 1592155 - protein, 31 aa, Staphylococcus aureus
PALTKLFGKGSWYLPAWLNRIIPRVDIEGHA

SEQ ID NO: 1592156 - protein, 24 aa, Staphylococcus aureus
PAPGKVVLLLAHRGTVSSGTEGSG

SEQ ID NO: 1592157 - protein, 19 aa, Staphylococcus aureus
PHELFIPAMILSLLILFFY

SEQ ID NO: 1592158 - protein, 39 aa, Staphylococcus aureus
PKFNDWIFIVFIISVYYIFWLLAKRKYILVTFWTIIILT

SEQ ID NO: 1592159 - protein, 31 aa, Staphylococcus aureus
PMALVLTIFMLIIAYVLILFKSALFLKRRSI

SEQ ID NO: 1592160 - protein, 17 aa, Staphylococcus aureus
PTALTTTISFAVSFIIV

SEQ ID NO: 1592161 - protein, 53 aa, Staphylococcus aureus
QKNNTVIWRSIIPPLVIIALTVVIFLVRPIGIYILMMIGMSTVTIVFGITTYF

SEQ ID NO: 1592162 - protein, 26 aa, Staphylococcus aureus
QQQFVKKPIPTLFLHGFGGSANSEKF

SEQ ID NO: 1592163 - protein, 47 aa, Staphylococcus aureus
QSISKKITGYGLKTTAVIGGAFTVNMLHDQQAFAASDAPLTSELNTQ

SEQ ID NO: 1592164 - protein, 26 aa, Staphylococcus aureus
QSSSPEAMFVLLAGIGLIATVRRRKA

SEQ ID NO: 1592165 - protein, 22 aa, Staphylococcus aureus
RGEFLHMLLGVFLAALVSFVVA

SEQ ID NO: 1592166 - protein, 55 aa, Staphylococcus aureus
RNKTPNEIALFTLLTTLTIIFLVVIVTLYPIASYLHLILPIAMLIALTVCLIPTT

SEQ ID NO: 1592167 - protein, 20 aa, Staphylococcus aureus
RVLVTIFYKEQIVRFNKIAQ

SEQ ID NO: 1592168 - protein, 23 aa, Staphylococcus aureus
SGNIITFALWLISGIKLLTNNKP

SEQ ID NO: 1592169 - protein, 25 aa, Staphylococcus aureus
SIDLPTLIMISIFSFVIFDSVENIN

SEQ ID NO: 1592170 - protein, 22 aa, Staphylococcus aureus
SIFEVIIMFFIGGVFSLLSTMV

SEQ ID NO: 1592171 - protein, 21 aa, Staphylococcus aureus
SKILLFIIMSIAIIQHLLQIA

SEQ ID NO: 1592172 - protein, 30 aa, Staphylococcus aureus
SLANEKTRVRLYKSGKNWVKSGIKEIEMFK

SEQ ID NO: 1592173 - protein, 26 aa, Staphylococcus aureus
SSRFIKWLNYMNVIPGYYGVNSIDLM

SEQ ID NO: 1592174 - protein, 17 aa, Staphylococcus aureus
TAIPISVIIIYATLRGI

SEQ ID NO: 1592175 - protein, 27 aa, Staphylococcus aureus
TELNTAMTALKRAIADKADTKASGNYV

SEQ ID NO: 1592176 - protein, 23 aa, Staphylococcus aureus
TFKKAVLFAALFILIGFYDGFVG

SEQ ID NO: 1592177 - protein, 20 aa, Staphylococcus aureus
TFQDFDINYNGDTKVMTVTY

SEQ ID NO: 1592178 - protein, 17 aa, Staphylococcus aureus
TISFAVSFIIVTYLHVV

SEQ ID NO: 1592179 - protein, 29 aa, Staphylococcus aureus
TLAAILMGPLVVYWNWTWGVTVAIILGIG

SEQ ID NO: 1592180 - protein, 26 aa, Staphylococcus aureus
TNYDYTKLVFAKPIYNDPSLVKSDTN

SEQ ID NO: 1592181 - protein, 22 aa, Staphylococcus aureus
TVTGLPSGLSYDSATNSIIGTP

SEQ ID NO: 1592182 - protein, 24 aa, Staphylococcus aureus
TYFENLLFHKFIMIKVILALPMFI

SEQ ID NO: 1592183 - protein, 25 aa, Staphylococcus aureus
VAGGGAFGAFVTTDSYGVATTYTSS

SEQ ID NO: 1592184 - protein, 23 aa, Staphylococcus aureus
VDDQIWSNSKFKLALKVQDRQDS

SEQ ID NO: 1592185 - protein, 17 aa, Staphylococcus aureus
VFLLFRFYIKTNNFSIY

SEQ ID NO: 1592186 - protein, 34 aa, Staphylococcus aureus
VIQENIDPATGKDYSIFGWNNENVVRYGGGSADG

SEQ ID NO: 1592187 - protein, 33 aa, Staphylococcus aureus
VNLIGPLFLGLVVALIYIFFKVIFDKRIKDEED

SEQ ID NO: 1592188 - protein, 22 aa, Staphylococcus aureus
VSTWLVYFFPFINWFIPKRYAK

SEQ ID NO: 1592189 - protein, 24 aa, Staphylococcus aureus
WIDFPHIYLPFKDYVPSFHLGLVL

SEQ ID NO: 1592190 - protein, 19 aa, Staphylococcus aureus
WRGVWDGIVMILKGTVQLI

SEQ ID NO: 1592191 - protein, 20 aa, Staphylococcus aureus
YEFILFVLTLLAITAIFIND

SEQ ID NO: 1592192 - protein, 23 aa, Staphylococcus aureus
YFENLLFHKFIMIKVILALPMFI

SEQ ID NO: 1592193 - protein, 20 aa, Staphylococcus aureus
YKIGFIFWGVSIISLGLMMF

SEQ ID NO: 1592194 - protein, 33 aa, Staphylococcus aureus
YKSKDFKITLYISLFISLFILYNEFRSGNLGES

SEQ ID NO: 1592195 - protein, 19 aa, Staphylococcus aureus
YLSSLLFGIALLGVVFHNI

SEQ ID NO: 1592196 - protein, 34 aa, Staphylococcus aureus
YWVTLIITQILLTTSVLWILNYTGNLDLFILRIV

SEQ ID NO: 1592197 - protein, 28 aa, Staphylococcus aureus
ADEMFNNKITYNYSSPIAGIDKPNGANI

SEQ ID NO: 1592198 - protein, 46 aa, Staphylococcus aureus
AGFIKATFEFIFNFIIKPIMFAIWQVMQFIWPAVKALIVSTWENIK

SEQ ID NO: 1592199 - protein, 28 aa, Staphylococcus aureus
AGTLIAMIFYVIQLSMPLINLSTLVTDY

SEQ ID NO: 1592200 - protein, 34 aa, Staphylococcus aureus
AILMKNKWPFLIALPFMIGYGIGVTFYYQQKVAY

SEQ ID NO: 1592201 - protein, 17 aa, Staphylococcus aureus
ALFILKTIDSHCITDQF

SEQ ID NO: 1592202 - protein, 34 aa, Staphylococcus aureus
APAQAFVDKFAKYYTPIIMVIAALVAVVPPLFFG

SEQ ID NO: 1592203 - protein, 25 aa, Staphylococcus aureus
AVTMVAITWLLLGDPLATLIGLSLG

SEQ ID NO: 1592204 - protein, 18 aa, Staphylococcus aureus
DAKRTAYSQAVNAAATIL

SEQ ID NO: 1592205 - protein, 24 aa, Staphylococcus aureus
DAMTQLKQGIANKAQIKGSENYHD

SEQ ID NO: 1592206 - protein, 34 aa, Staphylococcus aureus
DENGKYRFDNLDSGKYKVIFEKPAGLTQTGTNTT

SEQ ID NO: 1592207 - protein, 24 aa, Staphylococcus aureus
DGETYTVKFETPAGYLPTKENGTT

SEQ ID NO: 1592208 - protein, 28 aa, Staphylococcus aureus
DPKQPPFFFSVLLPIVFISAIIGILQYT

SEQ ID NO: 1592209 - protein, 21 aa, Staphylococcus aureus
DQLKKLEGMLDFPMLSTNVYK

SEQ ID NO: 1592210 - protein, 24 aa, Staphylococcus aureus
DSLIPYALVFIGLIIFISVVILIM

SEQ ID NO: 1592211 - protein, 17 aa, Staphylococcus aureus
DVELPLALPLIIGGIRL

SEQ ID NO: 1592212 - protein, 26 aa, Staphylococcus aureus
EDVTDSVNITFPNPNQYKVEFNTPDD

SEQ ID NO: 1592213 - protein, 17 aa, Staphylococcus aureus
EGRTTIVIAHRLSTIKK

SEQ ID NO: 1592214 - protein, 18 aa, Staphylococcus aureus
EIFFHNLIYFFSAIFGFL

SEQ ID NO: 1592215 - protein, 25 aa, Staphylococcus aureus
ELEKMLIQLSTFHSYHDLEFLFVTR

SEQ ID NO: 1592216 - protein, 20 aa, Staphylococcus aureus
ERMIRLVNDLLQLSKMDNES

SEQ ID NO: 1592217 - protein, 29 aa, Staphylococcus aureus
EWGHILGWIDSHWWLFGHFGWEYIELGKF

SEQ ID NO: 1592218 - protein, 21 aa, Staphylococcus aureus
EYWYMALWHLILMVPAVCVLI

SEQ ID NO: 1592219 - protein, 20 aa, Staphylococcus aureus
FAPFAFLVGVPWQDAVQAGS

SEQ ID NO: 1592220 - protein, 21 aa, Staphylococcus aureus
FDFDMKTLMTVAVIGAAIIGE

SEQ ID NO: 1592221 - protein, 20 aa, Staphylococcus aureus
FDFGYDQLKKLEGMLDFPML

SEQ ID NO: 1592222 - protein, 17 aa, Staphylococcus aureus
FDMKTLMTVAVIGATII

SEQ ID NO: 1592223 - protein, 27 aa, Staphylococcus aureus
FFGGQLALFIWFFKLKYSFGHIINSKI

SEQ ID NO: 1592224 - protein, 24 aa, Staphylococcus aureus
FISIKKQLPYIPKQRLYTLTASAM

SEQ ID NO: 1592225 - protein, 32 aa, Staphylococcus aureus
FISKYGSFFLKGIKITILISLIGVALGSILGA

SEQ ID NO: 1592226 - protein, 30 aa, Staphylococcus aureus
FLGFIRNDLIDYLDCKVLFIGNLDELNKKA

SEQ ID NO: 1592227 - protein, 17 aa, Staphylococcus aureus
GGLFYFSIGVFKNFYMM

SEQ ID NO: 1592228 - protein, 17 aa, Staphylococcus aureus
GILFFYLNLNRRLALSV

SEQ ID NO: 1592229 - protein, 24 aa, Staphylococcus aureus
GILGGVFWALMAPIVAISSVLTNV

SEQ ID NO: 1592230 - protein, 19 aa, Staphylococcus aureus
GILMFILLSTVIGAYLFFK

SEQ ID NO: 1592231 - protein, 34 aa, Staphylococcus aureus
GISFDPFTPLLVAAALYFVLTFVLTRIMNMIEGR

SEQ ID NO: 1592232 - protein, 30 aa, Staphylococcus aureus
GKDLPIPAFKLPLYPVLPAVTFVLVLLVFW

SEQ ID NO: 1592233 - protein, 20 aa, Staphylococcus aureus
GKDRFRLFNGWYYLIKYAMP

SEQ ID NO: 1592234 - protein, 27 aa, Staphylococcus aureus
GLKANIWFLIIFVLTVLVFNPLIVKFI

SEQ ID NO: 1592235 - protein, 31 aa, Staphylococcus aureus
GLSKNQAYNFLITSSQRWGLNQGINANGWMR

SEQ ID NO: 1592236 - protein, 19 aa, Staphylococcus aureus
GSVTSIQPLRINLTSNENF

SEQ ID NO: 1592237 - protein, 32 aa, Staphylococcus aureus
GTFIAKYKWSAVIAWIVIVAAILIPLATNAPK

SEQ ID NO: 1592238 - protein, 21 aa, Staphylococcus aureus
IAALVAVVPPLFFGGSWDTWV

SEQ ID NO: 1592239 - protein, 17 aa, Staphylococcus aureus
IAWILYYFVDVKLTNYN

SEQ ID NO: 1592240 - protein, 19 aa, Staphylococcus aureus
IGIAFYQAYKRSETFRNIV

SEQ ID NO: 1592241 - protein, 18 aa, Staphylococcus aureus
IIIIGFIITFIGILSIFA

SEQ ID NO: 1592242 - protein, 30 aa, Staphylococcus aureus
IKVILALPMFILLTFYLQPLVRYIFERIVM

SEQ ID NO: 1592243 - protein, 19 aa, Staphylococcus aureus
ILVQLFLISMLFTQSAYQF

SEQ ID NO: 1592244 - protein, 27 aa, Staphylococcus aureus
IPNRLNKFSIRKYSVGTASILVGTTLI

SEQ ID NO: 1592245 - protein, 19 aa, Staphylococcus aureus
IQIIVFILTAIAGYSMWKQ

SEQ ID NO: 1592246 - protein, 19 aa, Staphylococcus aureus
IQPKLIIKLFLTLIIIVTY

SEQ ID NO: 1592247 - protein, 19 aa, Staphylococcus aureus
ISLDQVLASYLKTANLAKY

SEQ ID NO: 1592248 - protein, 18 aa, Staphylococcus aureus
ITFALTYYLLLAPKWYIA

SEQ ID NO: 1592249 - protein, 48 aa, Staphylococcus aureus
IVTLVGSLIMLFILDWKMTLLTFITIPIFVLIMIPLGRIMQKISTSTQ

SEQ ID NO: 1592250 - protein, 25 aa, Staphylococcus aureus
KADGKFSHFAYVKPNNQSLSSVTVT

SEQ ID NO: 1592251 - protein, 29 aa, Staphylococcus aureus
KAVLTGLVGALLLFIKQITDLFGLDLSTQ

SEQ ID NO: 1592252 - protein, 28 aa, Staphylococcus aureus
KDDVKATLTMPAYIDPENVTKTGNVTLA

SEQ ID NO: 1592253 - protein, 28 aa, Staphylococcus aureus
KDKKLEVISSLFSVKKITFDLSDAKKTS

SEQ ID NO: 1592254 - protein, 20 aa, Staphylococcus aureus
KEQQNAFYEILHLPNLNEEQ

SEQ ID NO: 1592255 - protein, 29 aa, Staphylococcus aureus
KGPIKLVTAIFQLLFGKIGLIRNAITGLV

SEQ ID NO: 1592256 - protein, 29 aa, Staphylococcus aureus
KGQSFNIGDIKQYFTLSNGQAIPNGTFTN

SEQ ID NO: 1592257 - protein, 47 aa, Staphylococcus aureus
KKLDILTLFAYFKPHLLYLLIGTAIIFVICKLIAQFLIRFKTKDLAE

SEQ ID NO: 1592258 - protein, 25 aa, Staphylococcus aureus
KLGETFFLYLTWYSIGRFFIEGLRT

SEQ ID NO: 1592259 - protein, 20 aa, Staphylococcus aureus
KNLVEIYLTSIIDNLHNAQK

SEQ ID NO: 1592260 - protein, 20 aa, Staphylococcus aureus
KQNKKWYLPFGYDAQDIDLN

SEQ ID NO: 1592261 - protein, 21 aa, Staphylococcus aureus
KQNKKWYLPFGYDAQDIDLNN

SEQ ID NO: 1592262 - protein, 28 aa, Staphylococcus aureus
KSIIAIISLGILTYTTMIGSVLADEIKY

SEQ ID NO: 1592263 - protein, 32 aa, Staphylococcus aureus
KSKDFKITLYISLFISLFILYNEFRSGNLGES

SEQ ID NO: 1592264 - protein, 27 aa, Staphylococcus aureus
KVNVTANLEINLFIDPKTVQSNGQQTI

SEQ ID NO: 1592265 - protein, 17 aa, Staphylococcus aureus
KYAYNWAFFNPIRKIYY

SEQ ID NO: 1592266 - protein, 23 aa, Staphylococcus aureus
LAGLLLLFFLLRQAILKEPRDES

SEQ ID NO: 1592267 - protein, 17 aa, Staphylococcus aureus
LDITLLQNIFTLMSAAG

SEQ ID NO: 1592268 - protein, 34 aa, Staphylococcus aureus
LGISLIDYDFPIDSLFYIVSLNLSLTMIFLILTY

SEQ ID NO: 1592269 - protein, 46 aa, Staphylococcus aureus
LGISLIDYDFPIDSLFYIVSLNLSLTMIFLLLTYFKEVKLYKHFDK

SEQ ID NO: 1592270 - protein, 26 aa, Staphylococcus aureus
LKELDHIIRFAHISYGLYMGEHLPKG

SEQ ID NO: 1592271 - protein, 22 aa, Staphylococcus aureus
LKNLSLLQLLTGLKANIWFLII

SEQ ID NO: 1592272 - protein, 19 aa, Staphylococcus aureus
LLASMFYIYRKHIFMAAVG

SEQ ID NO: 1592273 - protein, 21 aa, Staphylococcus aureus
LNLAAIIIISIVVSGDMFLAM

SEQ ID NO: 1592274 - protein, 18 aa, Staphylococcus aureus
LSSLLFGIALLGVVFHNI

SEQ ID NO: 1592275 - protein, 24 aa, Staphylococcus aureus
LSYIDNMFFNYLNAEHPIGLVLVI

SEQ ID NO: 1592276 - protein, 40 aa, Staphylococcus aureus
LTILKGAFMLLKGPLKIISVIFQLLFGKIGLIRNAITGLV

SEQ ID NO: 1592277 - protein, 18 aa, Staphylococcus aureus
LYIINDFKTFIDCTYIPE

SEQ ID NO: 1592278 - protein, 19 aa, Staphylococcus aureus
MWLTTFMFIFVMGGLSFTK

SEQ ID NO: 1592279 - protein, 19 aa, Staphylococcus aureus
NATKSIFGFLYNSVKSIFT

SEQ ID NO: 1592280 - protein, 35 aa, Staphylococcus aureus
NEGYNFTIYVPYGDDWFAYFMRRLAERPQNLSLAA

SEQ ID NO: 1592281 - protein, 24 aa, Staphylococcus aureus
NGVIWRILIFYLGAIFVIVSVYPW

SEQ ID NO: 1592282 - protein, 26 aa, Staphylococcus aureus
NHQDQKLYFYFSSPGKDQIIYKESLT

SEQ ID NO: 1592283 - protein, 21 aa, Staphylococcus aureus
NHYDLFNYWLMGSISIIISYL

SEQ ID NO: 1592284 - protein, 48 aa, Staphylococcus aureus
NICNFIKAIFEFIINFVIKPIMFAIWQVMQFIWPAVKALIVSTWENIK

SEQ ID NO: 1592285 - protein, 23 aa, Staphylococcus aureus
NLKANYDNAIANAAHELDKVQGN

SEQ ID NO: 1592286 - protein, 19 aa, Staphylococcus aureus
NQLPLFIYLKRYISFVSVN

SEQ ID NO: 1592287 - protein, 32 aa, Staphylococcus aureus
NRAPSIVDFLYDFWWLFFPVAGFLVWAIHSFM

SEQ ID NO: 1592288 - protein, 20 aa, Staphylococcus aureus
NSAFIVIWLIFFIAGRYYER

SEQ ID NO: 1592289 - protein, 24 aa, Staphylococcus aureus
NTIIFGWIFYFFLGAYMGYNYERV

SEQ ID NO: 1592290 - protein, 19 aa, Staphylococcus aureus
NTVKQQVNFTDADQGKKDA

SEQ ID NO: 1592291 - protein, 22 aa, Staphylococcus aureus
NVKFEDMLDIKFYSLDGINGLS

SEQ ID NO: 1592292 - protein, 17 aa, Staphylococcus aureus
PQLLITLIYALIAFAVI

SEQ ID NO: 1592293 - protein, 17 aa, Staphylococcus aureus
PSIVTLVGSLIMLFILD

SEQ ID NO: 1592294 - protein, 22 aa, Staphylococcus aureus
PTKLGYLIIIILGVTVGILIYG

SEQ ID NO: 1592295 - protein, 31 aa, Staphylococcus aureus
QAVNTSAPRMRAFSLAAVAADAPAAGKDITN

SEQ ID NO: 1592296 - protein, 17 aa, Staphylococcus aureus
QMGINYSIYMDADTIPV

SEQ ID NO: 1592297 - protein, 29 aa, Staphylococcus aureus
QNILLMVGIFILVAILGASLSFIKLFKVD

SEQ ID NO: 1592298 - protein, 24 aa, Staphylococcus aureus
QSIIIIVVLLIKAIITWLLLIPIF

SEQ ID NO: 1592299 - protein, 18 aa, Staphylococcus aureus
RIIIGLLVIILTGMSVSI

SEQ ID NO: 1592300 - protein, 25 aa, Staphylococcus aureus
RYKRPVIIFIVPGIIPLVPGGAAYQ

SEQ ID NO: 1592301 - protein, 21 aa, Staphylococcus aureus
SAVTQVRYVDVTTGKDIIPPK

SEQ ID NO: 1592302 - protein, 20 aa, Staphylococcus aureus
SGDYFTAKLPDSVTGNGDVD

SEQ ID NO: 1592303 - protein, 21 aa, Staphylococcus aureus
SIISYFLLITLKKRGILQRFI

SEQ ID NO: 1592304 - protein, 26 aa, Staphylococcus aureus
SIVVSGDMFLAMKWEQIHLKDGLKKV

SEQ ID NO: 1592305 - protein, 30 aa, Staphylococcus aureus
SNENFTDKDWQITGIPRTLHIENSTNRTNN

SEQ ID NO: 1592306 - protein, 22 aa, Staphylococcus aureus
SVLDEFYWLNKEDPNYSRCRVI

SEQ ID NO: 1592307 - protein, 25 aa, Staphylococcus aureus
TAKGYYFVRTFYRKDKLPDRKNYKV

SEQ ID NO: 1592308 - protein, 19 aa, Staphylococcus aureus
TALLLVIPIIISYKEGLHI

SEQ ID NO: 1592309 - protein, 24 aa, Staphylococcus aureus
TASILVGTTLIFGLGNQEAKAAES

SEQ ID NO: 1592310 - protein, 29 aa, Staphylococcus aureus
TEPLEFSFLFVAPILYVIHAFFDGLAFMM

SEQ ID NO: 1592311 - protein, 17 aa, Staphylococcus aureus
TISDSLTAKVEVTLLDG

SEQ ID NO: 1592312 - protein, 31 aa, Staphylococcus aureus
TLAIINFIIPFLLIFIIDGFRGVKETLPAIL

SEQ ID NO: 1592313 - protein, 29 aa, Staphylococcus aureus
TSLNTAMGNLKHALAEKDNTKRSVNYTDA

SEQ ID NO: 1592314 - protein, 20 aa, Staphylococcus aureus
TWYNVIALTILVIVLSSFTT

SEQ ID NO: 1592315 - protein, 23 aa, Staphylococcus aureus
TYLAFTIIGAYAALFILKTIDSH

SEQ ID NO: 1592316 - protein, 24 aa, Staphylococcus aureus
TYLAFTIIGAYAALFILKTIDSHC

SEQ ID NO: 1592317 - protein, 20 aa, Staphylococcus aureus
TYLIFIFLELFIIFLHIKYK

SEQ ID NO: 1592318 - protein, 24 aa, Staphylococcus aureus
VAGGGAFGAFVTTDSYGVATTYTS

SEQ ID NO: 1592319 - protein, 27 aa, Staphylococcus aureus
VAGKSWLFMPYLILVLLGGILHNRIWL

SEQ ID NO: 1592320 - protein, 25 aa, Staphylococcus aureus
VAQKLAEAKALDQAMQALRNSIQDQ

SEQ ID NO: 1592321 - protein, 25 aa, Staphylococcus aureus
VAVVLIYFTGWRIIDPIISIVISLI

SEQ ID NO: 1592322 - protein, 24 aa, Staphylococcus aureus
VDQALQNILNAKQALNGDERVALA

SEQ ID NO: 1592323 - protein, 17 aa, Staphylococcus aureus
VFVLLFHTSKRLYYLCY

SEQ ID NO: 1592324 - protein, 18 aa, Staphylococcus aureus
VGFLMTYLPIQKLTSRKY

SEQ ID NO: 1592325 - protein, 17 aa, Staphylococcus aureus
VIFDWRRGVEYHSANPP

SEQ ID NO: 1592326 - protein, 20 aa, Staphylococcus aureus
VIVWIAWIKPLAHINEIFGL

SEQ ID NO: 1592327 - protein, 20 aa, Staphylococcus aureus
VLSVILLFSIPTPVAVILMG

SEQ ID NO: 1592328 - protein, 21 aa, Staphylococcus aureus
VPEKWILGLLGLIPIYLGIKV

SEQ ID NO: 1592329 - protein, 33 aa, Staphylococcus aureus
VQNNGSYSLNFDKLDKTYVIHYTGDYLNGTSEV

SEQ ID NO: 1592330 - protein, 27 aa, Staphylococcus aureus
VTNTVTGLPSGLTFDSTNNTISGTPTN

SEQ ID NO: 1592331 - protein, 29 aa, Staphylococcus aureus
WLSVLLIVVAFFVVPFVTAWLADIIYRKV

SEQ ID NO: 1592332 - protein, 25 aa, Staphylococcus aureus
YAINLSILILAIIFIGSYSIATGIN

SEQ ID NO: 1592333 - protein, 17 aa, Staphylococcus aureus
YDAIGVLMFILFATVIG

SEQ ID NO: 1592334 - protein, 34 aa, Staphylococcus aureus
YFLKSRMNWIFWILFLNFLMLGISLIDYDFPIDS

SEQ ID NO: 1592335 - protein, 17 aa, Staphylococcus aureus
YIVFTLFVAVAIIMNVW

SEQ ID NO: 1592336 - protein, 17 aa, Staphylococcus aureus
YLRFEILAAFLNGLALI

SEQ ID NO: 1592337 - protein, 17 aa, Staphylococcus aureus
YLYLLVTNILSLTKLQS

SEQ ID NO: 1592338 - protein, 32 aa, Staphylococcus aureus
YTPFIDWLGYIFYPFIYIFPIADQALLAKASA

SEQ ID NO: 1592339 - protein, 21 aa, Staphylococcus aureus
YTYLIVVYAIRMFSVSLLMMP

SEQ ID NO: 1592340 - protein, 26 aa, Staphylococcus aureus
ADQIPSGYTILATGTPDGVHNTITIR

SEQ ID NO: 1592341 - protein, 19 aa, Staphylococcus aureus
AEQVIKLNDAVTAAKKALN

SEQ ID NO: 1592342 - protein, 24 aa, Staphylococcus aureus
AKETAKRALASYSNLNNAQSTAAT

SEQ ID NO: 1592343 - protein, 26 aa, Staphylococcus aureus
ASWRVPFIIIVGIAILAFVFGLVSIS

SEQ ID NO: 1592344 - protein, 33 aa, Staphylococcus aureus
DADNMTLDSGFYKTPKYSLGDYVWYDSNKDGKQ

SEQ ID NO: 1592345 - protein, 17 aa, Staphylococcus aureus
DAKRTAYSQAVNAAATI

SEQ ID NO: 1592346 - protein, 26 aa, Staphylococcus aureus
DFIVIIVVALIFYYIGTTSSFESVYF

SEQ ID NO: 1592347 - protein, 17 aa, Staphylococcus aureus
DFSTLLLISGLLFLFFF

SEQ ID NO: 1592348 - protein, 33 aa, Staphylococcus aureus
DKKKGSIEGTKHLPLLFAKRRRKEDEEDAIVEE

SEQ ID NO: 1592349 - protein, 28 aa, Staphylococcus aureus
DKVNVTANLEINLFIDPKTVQSNGQQTI

SEQ ID NO: 1592350 - protein, 21 aa, Staphylococcus aureus
DLNQLNGLNNPQRQALESQIN

SEQ ID NO: 1592351 - protein, 25 aa, Staphylococcus aureus
DLTAELSLNLFIDPTTVTKQGKQKV

SEQ ID NO: 1592352 - protein, 20 aa, Staphylococcus aureus
DQLTHLNNAQRQLAIQQINN

SEQ ID NO: 1592353 - protein, 26 aa, Staphylococcus aureus
DQTTIINSLTFTSNAPNRNYATASAN

SEQ ID NO: 1592354 - protein, 46 aa, Staphylococcus aureus
DTNNAITIITIITAVIFLTITTVFAFFLSSRITKPLRRLRDQATRV

SEQ ID NO: 1592355 - protein, 19 aa, Staphylococcus aureus
DVKYKDGIGNYYANLNGSI

SEQ ID NO: 1592356 - protein, 25 aa, Staphylococcus aureus
DVTTGKDIIPPKTYSGNVDQVVTID

SEQ ID NO: 1592357 - protein, 17 aa, Staphylococcus aureus
DYFDFTLSNNVNTHGVA

SEQ ID NO: 1592358 - protein, 21 aa, Staphylococcus aureus
DYKISIFYLNQSFFEEPCIVV

SEQ ID NO: 1592359 - protein, 29 aa, Staphylococcus aureus
EANTSLIWGLLASLGSLLLFRRKKENKDK

SEQ ID NO: 1592360 - protein, 25 aa, Staphylococcus aureus
EIWEWLLFFEITLATLIVLRVFLGY

SEQ ID NO: 1592361 - protein, 25 aa, Staphylococcus aureus
EKGSSQTYILLGYPTKAQKNSHSKY

SEQ ID NO: 1592362 - protein, 28 aa, Staphylococcus aureus
EKKNMAGLIFVSWYPTVYWIINAAVVLV

SEQ ID NO: 1592363 - protein, 25 aa, Staphylococcus aureus
ESVMDGFVEHPFYTATLNGQKYVVM

SEQ ID NO: 1592364 - protein, 18 aa, Staphylococcus aureus
EVAQPRTALESKPRVTRS

SEQ ID NO: 1592365 - protein, 36 aa, Staphylococcus aureus
EWGTVIVQVLTFIVLLALLKKFAWGPLKDVMDKRER

SEQ ID NO: 1592366 - protein, 18 aa, Staphylococcus aureus
FIAARIYFVIFQWPYYAE

SEQ ID NO: 1592367 - protein, 23 aa, Staphylococcus aureus
FIGHNHFFILIFGRLVQGVGSAA

SEQ ID NO: 1592368 - protein, 21 aa, Staphylococcus aureus
FIYGLLFTFIIAVISLLGSKL

SEQ ID NO: 1592369 - protein, 17 aa, Staphylococcus aureus
FLIFLLLVFMTYPLHKS

SEQ ID NO: 1592370 - protein, 17 aa, Staphylococcus aureus
FMFGLFISVMGNAMTVL

SEQ ID NO: 1592371 - protein, 17 aa, Staphylococcus aureus
FNMIWKAMLIPSMGYIV

SEQ ID NO: 1592372 - protein, 31 aa, Staphylococcus aureus
FNPVFALWFLITLFFFHVILVIVRRFNPYKV

SEQ ID NO: 1592373 - protein, 24 aa, Staphylococcus aureus
FVVFLCILIFFVLLNRKLKLKVFD

SEQ ID NO: 1592374 - protein, 17 aa, Staphylococcus aureus
FYYKDIFVCFVAVVFFN

SEQ ID NO: 1592375 - protein, 17 aa, Staphylococcus aureus
GAKYTPTSILYFNLKNE

SEQ ID NO: 1592376 - protein, 44 aa, Staphylococcus aureus
GFIKATFEFIFNFIIKPIMFAIWQVMQFIWPAVKALIVSTWENI

SEQ ID NO: 1592377 - protein, 31 aa, Staphylococcus aureus
GFQFSFIISFFIMLLFPFLQQLSKLQSLFII

SEQ ID NO: 1592378 - protein, 17 aa, Staphylococcus aureus
GGKLVLILDDGLEIEVE

SEQ ID NO: 1592379 - protein, 17 aa, Staphylococcus aureus
GIAFYQAYKRSETFRNI

SEQ ID NO: 1592380 - protein, 36 aa, Staphylococcus aureus
GITHSIPFTILWPILITFLIFTFFSGTHPFHVWMWA

SEQ ID NO: 1592381 - protein, 23 aa, Staphylococcus aureus
GKDYSIFGWNNENVVRYGGGSAD

SEQ ID NO: 1592382 - protein, 20 aa, Staphylococcus aureus
GKNIPFMLGLFSGGLIFSIV

SEQ ID NO: 1592383 - protein, 19 aa, Staphylococcus aureus
GNGSSAADYFKLSNGSAIP

SEQ ID NO: 1592384 - protein, 20 aa, Staphylococcus aureus
GSVTSIQPLRINLTSNENFT

SEQ ID NO: 1592385 - protein, 25 aa, Staphylococcus aureus
GTASILIGSLMYLGTQQEAEAAENN

SEQ ID NO: 1592386 - protein, 26 aa, Staphylococcus aureus
GTASILVGTTLIFGLGNQEAKAAEST

SEQ ID NO: 1592387 - protein, 27 aa, Staphylococcus aureus
GTPMLVQVFIVFFGITAALGLDISALV

SEQ ID NO: 1592388 - protein, 18 aa, Staphylococcus aureus
GVLLSFAWPPIQDGLNSL

SEQ ID NO: 1592389 - protein, 36 aa, Staphylococcus aureus
HGNFKSKFFISLIFAIPIIILSPMMGVKLPFQISFT

SEQ ID NO: 1592390 - protein, 33 aa, Staphylococcus aureus
HNAERVTLKYKWKFGEGIKAGDYFDFTLSDNVE

SEQ ID NO: 1592391 - protein, 21 aa, Staphylococcus aureus
HPFHVWMWAQLAVFLHVFVDI

SEQ ID NO: 1592392 - protein, 17 aa, Staphylococcus aureus
IALFKYLYKNNELANYV

SEQ ID NO: 1592393 - protein, 20 aa, Staphylococcus aureus
IFALFIWVHLLCTILNNFKN

SEQ ID NO: 1592394 - protein, 29 aa, Staphylococcus aureus
IFHNIHIKIIYWLVLTTIFFIANILIIHI

SEQ ID NO: 1592395 - protein, 17 aa, Staphylococcus aureus
IGLIIFISVVILIMSLF

SEQ ID NO: 1592396 - protein, 22 aa, Staphylococcus aureus
IIGSWLFLLGIGLLYKTVGTLN

SEQ ID NO: 1592397 - protein, 17 aa, Staphylococcus aureus
IKLFLTLIIIVTYTFVS

SEQ ID NO: 1592398 - protein, 20 aa, Staphylococcus aureus
IKWCRMIIRQILSNALKYSE

SEQ ID NO: 1592399 - protein, 24 aa, Staphylococcus aureus
INIILGIIKVFSSLFTGNWRGVWD

SEQ ID NO: 1592400 - protein, 23 aa, Staphylococcus aureus
INRIEWIFILIAIALVLTVEALN

SEQ ID NO: 1592401 - protein, 25 aa, Staphylococcus aureus
IPQFIRMVIVVTLLIPFMLILVGAF

SEQ ID NO: 1592402 - protein, 18 aa, Staphylococcus aureus
IQTICVLLGIWVYNLDKS

SEQ ID NO: 1592403 - protein, 22 aa, Staphylococcus aureus
ISQFYLYYIVSAFLFWLVILTF

SEQ ID NO: 1592404 - protein, 23 aa, Staphylococcus aureus
ISSLTLPITLIVGALVGIGIAFY

SEQ ID NO: 1592405 - protein, 24 aa, Staphylococcus aureus
IVILAPLARLIAVLLTPVVNSTLI

SEQ ID NO: 1592406 - protein, 19 aa, Staphylococcus aureus
IVRRYGWDGFKRAGDYAYA

SEQ ID NO: 1592407 - protein, 19 aa, Staphylococcus aureus
IYRVPEGYTLNKGYDVNTN

SEQ ID NO: 1592408 - protein, 22 aa, Staphylococcus aureus
KAGGLISFLSTKVPILGTVFTA

SEQ ID NO: 1592409 - protein, 27 aa, Staphylococcus aureus
KDKAIQSINQALANKLKEIEASNATDQ

SEQ ID NO: 1592410 - protein, 45 aa, Staphylococcus aureus
KDLNFRTHLSGYHKNYPYYPYYSYYPVQLTWNNGVAFYSNNAQGD

SEQ ID NO: 1592411 - protein, 19 aa, Staphylococcus aureus
KELWLPVLTICFILAISKI

SEQ ID NO: 1592412 - protein, 33 aa, Staphylococcus aureus
KIPFYKKHSTLLFATLLIAFGYLSHFVNGEDNL

SEQ ID NO: 1592413 - protein, 26 aa, Staphylococcus aureus
KQNIDQATKLQPIAELVDQATQLNQS

SEQ ID NO: 1592414 - protein, 22 aa, Staphylococcus aureus
KQSFESQITQAPLVTDVTTINQ

SEQ ID NO: 1592415 - protein, 21 aa, Staphylococcus aureus
KQTIDQLTHLNADQIATAKQN

SEQ ID NO: 1592416 - protein, 24 aa, Staphylococcus aureus
KRILYTCFILFIYILGTNISIVSY

SEQ ID NO: 1592417 - protein, 23 aa, Staphylococcus aureus
KTGPIIELGLKTASTWKKFEVYE

SEQ ID NO: 1592418 - protein, 17 aa, Staphylococcus aureus
KVASFAMRLLLGSTLAS

SEQ ID NO: 1592419 - protein, 26 aa, Staphylococcus aureus
KVLSTFLFILLLYITYRKNKIVYAPI

SEQ ID NO: 1592420 - protein, 26 aa, Staphylococcus aureus
KVMAIGEVIAERKIRYTFTDYIDNKK

SEQ ID NO: 1592421 - protein, 19 aa, Staphylococcus aureus
KWCRMIIRQILSNALKYSE

SEQ ID NO: 1592422 - protein, 18 aa, Staphylococcus aureus
KWQMLVTLLFVIPCHELY

SEQ ID NO: 1592423 - protein, 18 aa, Staphylococcus aureus
KYLDAEPSKKSAYDQAVN

SEQ ID NO: 1592424 - protein, 17 aa, Staphylococcus aureus
KYQFLDLSKYQGIDKNR

SEQ ID NO: 1592425 - protein, 48 aa, Staphylococcus aureus
LELDFLMFIRRFIVLLFVFACITTLLWLISYSLLLKLSIPLTLKGKKG

SEQ ID NO: 1592426 - protein, 20 aa, Staphylococcus aureus
LEVVPLCLLIWEAYTHYRLY

SEQ ID NO: 1592427 - protein, 17 aa, Staphylococcus aureus
LIGFVFAPFAFLVGVPW

SEQ ID NO: 1592428 - protein, 18 aa, Staphylococcus aureus
LIYGVTLPLGRPFLTACI

SEQ ID NO: 1592429 - protein, 24 aa, Staphylococcus aureus
LKNKLIEFFAGYSLANNAAFNQSD

SEQ ID NO: 1592430 - protein, 39 aa, Staphylococcus aureus
LSDKVAGYLFYFAVSIGLISFIVWMLIQNNVDFALERLV

SEQ ID NO: 1592431 - protein, 24 aa, Staphylococcus aureus
LSGFILYMILIFTLSMIVNIHILW

SEQ ID NO: 1592432 - protein, 30 aa, Staphylococcus aureus
LSIPSFWQGLLFILAFSLKLDILPPSYMPE

SEQ ID NO: 1592433 - protein, 25 aa, Staphylococcus aureus
LTHGTNAIDYITFDPNTNTNGITAA

SEQ ID NO: 1592434 - protein, 23 aa, Staphylococcus aureus
LVSTWLVYFFPFINWFIPKRYAK

SEQ ID NO: 1592435 - protein, 17 aa, Staphylococcus aureus
LVTYIVMFILNISHIHL

SEQ ID NO: 1592436 - protein, 21 aa, Staphylococcus aureus
LYIIVMVLSVFIIGCDKSSDT

SEQ ID NO: 1592437 - protein, 27 aa, Staphylococcus aureus
MENHFECLWDLFRSIPSLEIDNASVLD

SEQ ID NO: 1592438 - protein, 42 aa, Staphylococcus aureus
MILKGTVQLIWNLIQLWFVGKILGVVRYFGGLLKGLISGIWG

SEQ ID NO: 1592439 - protein, 30 aa, Staphylococcus aureus
MITSYHIFRIFFILFIIAPGINYFLKYRSN

SEQ ID NO: 1592440 - protein, 21 aa, Staphylococcus aureus
MLEQLLIFIITAILGIIIGIF

SEQ ID NO: 1592441 - protein, 24 aa, Staphylococcus aureus
MSISIICFMLFTTNYNWTFLILFT

SEQ ID NO: 1592442 - protein, 28 aa, Staphylococcus aureus
MTNAGQSVTYYFTDVKAPTVTVGNQTIE

SEQ ID NO: 1592443 - protein, 24 aa, Staphylococcus aureus
MVKAGIFLLLRFTPLLGLSNMYVY

SEQ ID NO: 1592444 - protein, 23 aa, Staphylococcus aureus
NENNADIILPKSTAPKSLNTRMR

SEQ ID NO: 1592445 - protein, 27 aa, Staphylococcus aureus
NGVTSTAKVPPIMAGDQVLANGVIDSD

SEQ ID NO: 1592446 - protein, 18 aa, Staphylococcus aureus
NINQIFIVGTAISLLITV

SEQ ID NO: 1592447 - protein, 48 aa, Staphylococcus aureus
NKKLDIWTLFAYFKPHLLYLLIGTAIIFVICKLIAQLLIRFKTKDLAE

SEQ ID NO: 1592448 - protein, 21 aa, Staphylococcus aureus
NQKLPVRLVSYSPVPEDHAYI

SEQ ID NO: 1592449 - protein, 20 aa, Staphylococcus aureus
NRKGMIPNRLNKFSIRKYSV

SEQ ID NO: 1592450 - protein, 19 aa, Staphylococcus aureus
NVCFTLFGYILFGGLTMLF

SEQ ID NO: 1592451 - protein, 21 aa, Staphylococcus aureus
NWRGVWDGIVMILKGTVQLIW

SEQ ID NO: 1592452 - protein, 33 aa, Staphylococcus aureus
PAQAFVDKFAKYYTPIIMVIAALVAVVPPLFFG

SEQ ID NO: 1592453 - protein, 20 aa, Staphylococcus aureus
PYFIQLWDTIKGVFTFDLGT

SEQ ID NO: 1592454 - protein, 19 aa, Staphylococcus aureus
QAGQGYRGYGAFVKNDSSG

SEQ ID NO: 1592455 - protein, 23 aa, Staphylococcus aureus
QAIIIIVVTILFIASAWSGLSKG

SEQ ID NO: 1592456 - protein, 19 aa, Staphylococcus aureus
QALKDRINQILQQGHNDIN

SEQ ID NO: 1592457 - protein, 27 aa, Staphylococcus aureus
QASWRVPFIIIVGIALVAFIFGLISIS

SEQ ID NO: 1592458 - protein, 34 aa, Staphylococcus aureus
QISFTGSDWIVLILATILFFYGGKPFLSGAKDEI

SEQ ID NO: 1592459 - protein, 31 aa, Staphylococcus aureus
QQMRNQLPISYLYEGVGILETPFGPIVSLSE

SEQ ID NO: 1592460 - protein, 26 aa, Staphylococcus aureus
QTLLLGVILAFLWPPFKLKNDPPKVV

SEQ ID NO: 1592461 - protein, 19 aa, Staphylococcus aureus
QVFLAIFLAVLLGIGISYF

SEQ ID NO: 1592462 - protein, 36 aa, Staphylococcus aureus
QVVNAKYDVIYNGHTFATSLPAKFVVKDVQPAKPTV

SEQ ID NO: 1592463 - protein, 19 aa, Staphylococcus aureus
QYLILFIALLIFIYLIIIF

SEQ ID NO: 1592464 - protein, 17 aa, Staphylococcus aureus
RSEYWYMALWHLILMVP

SEQ ID NO: 1592465 - protein, 19 aa, Staphylococcus aureus
SALTAKGYNYTSVDSSYAS

SEQ ID NO: 1592466 - protein, 17 aa, Staphylococcus aureus
SEILFFINIVLVLYYIY

SEQ ID NO: 1592467 - protein, 33 aa, Staphylococcus aureus
SGLFAFLRTKIASLVKLFPILGVSISSLTLPIT

SEQ ID NO: 1592468 - protein, 25 aa, Staphylococcus aureus
SGLPTDGFTYKWNRDTTGTNDANWA

SEQ ID NO: 1592469 - protein, 29 aa, Staphylococcus aureus
SIQLAVVGFGLFVAVLGPLVFMFGLFISV

SEQ ID NO: 1592470 - protein, 27 aa, Staphylococcus aureus
SKKTLWASLIITLLFTVIEFVGGLVSN

SEQ ID NO: 1592471 - protein, 34 aa, Staphylococcus aureus
SLHTKLVIVYVLLIIIGMQIIGLYFTNNLEKELL

SEQ ID NO: 1592472 - protein, 19 aa, Staphylococcus aureus
SLYIINDFKTFIDCTYIPE

SEQ ID NO: 1592473 - protein, 24 aa, Staphylococcus aureus
SQDKSLLISQILQTKLGKAEADKL

SEQ ID NO: 1592474 - protein, 23 aa, Staphylococcus aureus
SSKRLLKLAIILYGLKLNIYDVI

SEQ ID NO: 1592475 - protein, 23 aa, Staphylococcus aureus
SSRLFIKKLLSFSYKFVLYTSAL

SEQ ID NO: 1592476 - protein, 34 aa, Staphylococcus aureus
SSTHTMDFFWELATLILIMLLGHWIEMNAVGNAG

SEQ ID NO: 1592477 - protein, 24 aa, Staphylococcus aureus
STNAQHMNFQFVGTYGPNKDVVGI

SEQ ID NO: 1592478 - protein, 19 aa, Staphylococcus aureus
STYLHWTNMFLIALIVVFT

SEQ ID NO: 1592479 - protein, 28 aa, Staphylococcus aureus
SYDQIGLWAPILLLLARVLQGFSTGGEY

SEQ ID NO: 1592480 - protein, 24 aa, Staphylococcus aureus
TASILVGTTLIFGLGNQEAKAAEN

SEQ ID NO: 1592481 - protein, 29 aa, Staphylococcus aureus
TAVRHIYEISSLIYKVTMKIKIKAMGINV

SEQ ID NO: 1592482 - protein, 28 aa, Staphylococcus aureus
TELNTAMGQLQHAIADKTNTLASSKYVN

SEQ ID NO: 1592483 - protein, 19 aa, Staphylococcus aureus
TFLTMRTILTLKGYRYIAA

SEQ ID NO: 1592484 - protein, 19 aa, Staphylococcus aureus
TLVALGISVAYIYSLYAFY

SEQ ID NO: 1592485 - protein, 19 aa, Staphylococcus aureus
TLVDIIFYSALFGFIAARI

SEQ ID NO: 1592486 - protein, 44 aa, Staphylococcus aureus
TNLNIDDFVDDPLSYVKTPSNKVLGFYPTNANTNAFRPGGVQEL

SEQ ID NO: 1592487 - protein, 25 aa, Staphylococcus aureus
TNRVILFIFRCLVVVLVFVGAVVKT

SEQ ID NO: 1592488 - protein, 25 aa, Staphylococcus aureus
TNVYNFIMIVWNQIAAYLQGLWNGI

SEQ ID NO: 1592489 - protein, 33 aa, Staphylococcus aureus
TPFYKKHSTLLFATLLIAFGYLSHFVNGEDNLV

SEQ ID NO: 1592490 - protein, 18 aa, Staphylococcus aureus
TPVPPTPEVPAEPGKPVP

SEQ ID NO: 1592491 - protein, 17 aa, Staphylococcus aureus
TQVKQVYDEAVDKAKQA

SEQ ID NO: 1592492 - protein, 35 aa, Staphylococcus aureus
TTDGQRQFTLNGQVIQILDIINPSNGYGGQPVTNS

SEQ ID NO: 1592493 - protein, 24 aa, Staphylococcus aureus
TTTFTINVVDTTAPTVTPIGDQSS

SEQ ID NO: 1592494 - protein, 17 aa, Staphylococcus aureus
VGIAGRLWDRVRNIFGS

SEQ ID NO: 1592495 - protein, 26 aa, Staphylococcus aureus
VGTASILIGSLMYLGTQQEAEAAENN

SEQ ID NO: 1592496 - protein, 39 aa, Staphylococcus aureus
VIKLWLTIILIVTTVLILLSIALITFMQYYFTQETENAI

SEQ ID NO: 1592497 - protein, 20 aa, Staphylococcus aureus
VIMFICITLIGLFSQWARTT

SEQ ID NO: 1592498 - protein, 23 aa, Staphylococcus aureus
VKSGDYFTIKYSDTVQVYGLNPE

SEQ ID NO: 1592499 - protein, 27 aa, Staphylococcus aureus
VLAQFFYFYIIFKLPKLLKEPFSPVFS

SEQ ID NO: 1592500 - protein, 17 aa, Staphylococcus aureus
VTDLNQLNGLNNPQRQA

SEQ ID NO: 1592501 - protein, 19 aa, Staphylococcus aureus
VTTFTRRNNTSPWVKEASA

SEQ ID NO: 1592502 - protein, 31 aa, Staphylococcus aureus; identical to SEQ ID NO: 1585350

SEQ ID NO: 1592503 - protein, 17 aa, Staphylococcus aureus
VYGLNPEDIKNIGDIKD

SEQ ID NO: 1592504 - protein, 30 aa, Staphylococcus aureus
YLCYIPLFFLFIALYPFLVFIAQRPIFQFS

SEQ ID NO: 1592505 - protein, 19 aa, Staphylococcus aureus
YMKDILNVVIIMVLLVIGR

SEQ ID NO: 1592506 - protein, 28 aa, Staphylococcus aureus
ADEMFDNKITYNYSSPIAGIDKPNGANI

SEQ ID NO: 1592507 - protein, 23 aa, Staphylococcus aureus
AIAIIIKLFAFGGIFYISLIVPV

SEQ ID NO: 1592508 - protein, 37 aa, Staphylococcus aureus
AIQSPITFWYGKYIILIPSSYFKSVIDKRLKYIILHE

SEQ ID NO: 1592509 - protein, 38 aa, Staphylococcus aureus
ASNLEFQTHLFGYYNYYYTSNLTWKNGVAFYSNNAQGD

SEQ ID NO: 1592510 - protein, 17 aa, Staphylococcus aureus
ASTWKKFEVYEGDKKLP

SEQ ID NO: 1592511 - protein, 23 aa, Staphylococcus aureus
ATETLNNLSNLNTPQRQALENQI

SEQ ID NO: 1592512 - protein, 17 aa, Staphylococcus aureus
ATGVLLSFAWPPIQDGL

SEQ ID NO: 1592513 - protein, 24 aa, Staphylococcus aureus
DDIYILLIIWMYLVLRIIKKRSCC

SEQ ID NO: 1592514 - protein, 23 aa, Staphylococcus aureus
DDYGIIAKWFTWGIPLHEGHLFG

SEQ ID NO: 1592515 - protein, 28 aa, Staphylococcus aureus
DIITEQDILAHINLIDQLTAEIIDTPST

SEQ ID NO: 1592516 - protein, 25 aa, Staphylococcus aureus
DIVVKTLLFFIIGSLVYITGYRQYQ

SEQ ID NO: 1592517 - protein, 29 aa, Staphylococcus aureus
DKENINGQFSLPLFTDRAKAPKSGTYDAN

SEQ ID NO: 1592518 - protein, 17 aa, Staphylococcus aureus
DLDKRYVIRVNNNKYRL

SEQ ID NO: 1592519 - protein, 17 aa, Staphylococcus aureus
DMWFVILPVVMSIGTIA

SEQ ID NO: 1592520 - protein, 29 aa, Staphylococcus aureus
DPKNNSRTLIFPYVPDKAIYNAIVKVVVA

SEQ ID NO: 1592521 - protein, 33 aa, Staphylococcus aureus
DSVKEGDTFTFKYGQYFRPGSVRLPSQTQNLYN

SEQ ID NO: 1592522 - protein, 29 aa, Staphylococcus aureus
DVVAKATYDILTKTYTFVFTDYVNDKENI

SEQ ID NO: 1592523 - protein, 19 aa, Staphylococcus aureus
DYHYFFFSDGFYITISILT

SEQ ID NO: 1592524 - protein, 31 aa, Staphylococcus aureus
EAMGYLKRFALYISVMILIFAIAGCGKGNET

SEQ ID NO: 1592525 - protein, 17 aa, Staphylococcus aureus
EFNTPDDQITTPYIVVV

SEQ ID NO: 1592526 - protein, 20 aa, Staphylococcus aureus
EIIGERKVRYTFKEYVQEKK

SEQ ID NO: 1592527 - protein, 24 aa, Staphylococcus aureus
ELTACWTIFMILSGTYLLIKKHLI

SEQ ID NO: 1592528 - protein, 38 aa, Staphylococcus aureus
EPHAGQRAVLKYKLKFENGLHQGDYFDFTLSNNVNTHG

SEQ ID NO: 1592529 - protein, 17 aa, Staphylococcus aureus
ESIIAGLNNPTINKGNV

SEQ ID NO: 1592530 - protein, 24 aa, Staphylococcus aureus
ESKDEDVPLLLAKKKNQKDNQSKD

SEQ ID NO: 1592531 - protein, 30 aa, Staphylococcus aureus
EVTDQFKNRIYYEHPNVASIKFGDITKTYV

SEQ ID NO: 1592532 - protein, 19 aa, Staphylococcus aureus
EVTLLDGSKVIVNVPVKVV

SEQ ID NO: 1592533 - protein, 20 aa, Staphylococcus aureus
FEILAFRIIFSAIFMIFILA

SEQ ID NO: 1592534 - protein, 17 aa, Staphylococcus aureus
FGLVIMPGAIINGIMSV

SEQ ID NO: 1592535 - protein, 17 aa, Staphylococcus aureus
FILLIIFSPRGPIGQFF

SEQ ID NO: 1592536 - protein, 25 aa, Staphylococcus aureus
FIMLIGMLIFYFYLNKKLTLKIFNT

SEQ ID NO: 1592537 - protein, 22 aa, Staphylococcus aureus
FLGMLLITKYAIDLLFIICVIL

SEQ ID NO: 1592538 - protein, 20 aa, Staphylococcus aureus
FNYLMLAIPSFIAGVFAIFI

SEQ ID NO: 1592539 - protein, 23 aa, Staphylococcus aureus
FPERRWVYILALSSSALCGLFIQ

SEQ ID NO: 1592540 - protein, 18 aa, Staphylococcus aureus
FTALPIVSGMLEKYGIRD

SEQ ID NO: 1592541 - protein, 21 aa, Staphylococcus aureus
FTLHSESFPRIFRITSRDTNL

SEQ ID NO: 1592542 - protein, 27 aa, Staphylococcus aureus
FTVIGLILLSLTFLPEVWYIISSIVGY

SEQ ID NO: 1592543 - protein, 20 aa, Staphylococcus aureus
FVLFVLTQMILMFTIPAIIS

SEQ ID NO: 1592544 - protein, 17 aa, Staphylococcus aureus
GEFFGWVAGWALLAEYF

SEQ ID NO: 1592545 - protein, 20 aa, Staphylococcus aureus
GEIFIYGDIVSDKWFESDVT

SEQ ID NO: 1592546 - protein, 47 aa, Staphylococcus aureus
GIVTLTQDAYSQKGAITLGTRIDSNKSFHFSGKVNLGNKYEGNGNGG

SEQ ID NO: 1592547 - protein, 26 aa, Staphylococcus aureus
GNQPKVRIFEYLGNNEDIAKSVYANT

SEQ ID NO: 1592548 - protein, 23 aa, Staphylococcus aureus
GQKYVVMKTKDDSYWKDLIVEGK

SEQ ID NO: 1592549 - protein, 18 aa, Staphylococcus aureus
GQNIARTIALRTGLSDTV

SEQ ID NO: 1592550 - protein, 30 aa, Staphylococcus aureus
GQSNSHLHVGYGTVNHPFNSSPIGHKKKLD

SEQ ID NO: 1592551 - protein, 19 aa, Staphylococcus aureus
GTGLGLFICKMIIEEHGGS

SEQ ID NO: 1592552 - protein, 21 aa, Staphylococcus aureus
GVGLPLFTALPIVSGMLEKYG

SEQ ID NO: 1592553 - protein, 22 aa, Staphylococcus aureus
HILRNSLIPIITFLGADIVSIL

SEQ ID NO: 1592554 - protein, 21 aa, Staphylococcus aureus
HITWMNWFLAALVPGLISLIV

SEQ ID NO: 1592555 - protein, 18 aa, Staphylococcus aureus
HKDTLVDIIFYSALFGFI

SEQ ID NO: 1592556 - protein, 24 aa, Staphylococcus aureus
HTRTLLIYGAIFGGLFYFSIGVFK

SEQ ID NO: 1592557 - protein, 20 aa, Staphylococcus aureus
IAALVAVVPPLFFGGSWDTW

SEQ ID NO: 1592558 - protein, 24 aa, Staphylococcus aureus
IASIYAIWLIYAAGINYLLLTMLL

SEQ ID NO: 1592559 - protein, 25 aa, Staphylococcus aureus
IAVLMGMLLIFNLFSINFQRPITYQ

SEQ ID NO: 1592560 - protein, 27 aa, Staphylococcus aureus
IAYIILAFFFFVFILLFFSDETRAAIY

SEQ ID NO: 1592561 - protein, 18 aa, Staphylococcus aureus
ICLSLFAYILFGGLSTMA

SEQ ID NO: 1592562 - protein, 19 aa, Staphylococcus aureus
IELIIIVISLLQWIRFIDF

SEQ ID NO: 1592563 - protein, 25 aa, Staphylococcus aureus
IFIDDYYLIFLLQGIYIIGAELDIS

SEQ ID NO: 1592564 - protein, 24 aa, Staphylococcus aureus
IFSFLGGLGIFLYGLKIMGDGLQA

SEQ ID NO: 1592565 - protein, 25 aa, Staphylococcus aureus
IHDIQPMPTLLMYGTKDLIVETRAI

SEQ ID NO: 1592566 - protein, 19 aa, Staphylococcus aureus
IINLFVCIALLVAIGMGFV

SEQ ID NO: 1592567 - protein, 24 aa, Staphylococcus aureus
IISSIIIYLFIRRQFNISNALLNL

SEQ ID NO: 1592568 - protein, 30 aa, Staphylococcus aureus
ILFFGAPTIFNFTLALFIGLISGVFSSIFI

SEQ ID NO: 1592569 - protein, 17 aa, Staphylococcus aureus
ILYCANYMYIVIYAYIT

SEQ ID NO: 1592570 - protein, 20 aa, Staphylococcus aureus
IPALEYYALYLGVIGAFIGG

SEQ ID NO: 1592571 - protein, 25 aa, Staphylococcus aureus
ISTIFLLIMVPFFLIYMLKDHEKFI

SEQ ID NO: 1592572 - protein, 18 aa, Staphylococcus aureus
ISVAYIYSLYAFYMNNFS

SEQ ID NO: 1592573 - protein, 35 aa, Staphylococcus aureus
ITEPLEFSFLFVAPLLFFIHAVLDGLSFLTLYLLD

SEQ ID NO: 1592574 - protein, 17 aa, Staphylococcus aureus
IVLINLIVTFPILRKFK

SEQ ID NO: 1592575 - protein, 18 aa, Staphylococcus aureus
IVWLSYPLVTAIIGCLFV

SEQ ID NO: 1592576 - protein, 31 aa, Staphylococcus aureus
IYKAIKHVIVFIFMIFIAIVAIAVIAMSLYF

SEQ ID NO: 1592577 - protein, 19 aa, Staphylococcus aureus
KDLINKTTDPTLAKSIIDQ

SEQ ID NO: 1592578 - protein, 26 aa, Staphylococcus aureus
KDLTAELSLNLFIDPTTVTQKGNQNV

SEQ ID NO: 1592579 - protein, 24 aa, Staphylococcus aureus
KGLFYSVLFWLCILSFFSVLNEMV

SEQ ID NO: 1592580 - protein, 17 aa, Staphylococcus aureus
KKKGSIEGTKHLPLLFA

SEQ ID NO: 1592581 - protein, 19 aa, Staphylococcus aureus
KKRYKGIEYLIIKEPITTQ

SEQ ID NO: 1592582 - protein, 23 aa, Staphylococcus aureus
KLKEPIIEHSTPIELEFKSEPPV

SEQ ID NO: 1592583 - protein, 18 aa, Staphylococcus aureus
KRVDFLSNKLNKYSIRKF

SEQ ID NO: 1592584 - protein, 17 aa, Staphylococcus aureus
KSDSTSMSLSMSQSISG

SEQ ID NO: 1592585 - protein, 22 aa, Staphylococcus aureus
KSFRKYFAKGYSYNSTGLSFLK

SEQ ID NO: 1592586 - protein, 35 aa, Staphylococcus aureus
KVQNNGSYSLNFDKLDKTYVIHYTGDYLNGTSEVN

SEQ ID NO: 1592587 - protein, 18 aa, Staphylococcus aureus
KWILGLLGLIPIYLGIKV

SEQ ID NO: 1592588 - protein, 28 aa, Staphylococcus aureus
KWVFFTSFIVLLFPIFFLGQAQTPGMLM

SEQ ID NO: 1592589 - protein, 23 aa, Staphylococcus aureus
KYYTIFLFFHINLATIGGILGLV

SEQ ID NO: 1592590 - protein, 22 aa, Staphylococcus aureus
LIGIVLLRLFKINLLSFKKLTM

SEQ ID NO: 1592591 - protein, 30 aa, Staphylococcus aureus
LIGVPVIFFVIYLMLMIPIANLGLSSVLTK

SEQ ID NO: 1592592 - protein, 27 aa, Staphylococcus aureus
LIILTSFIIIMYFVKIKWYSILLIMTS

SEQ ID NO: 1592593 - protein, 18 aa, Staphylococcus aureus
LIKPILYLLKGNLKKQMF

SEQ ID NO: 1592594 - protein, 21 aa, Staphylococcus aureus
LLDFITNLAGFIAKLFETHPA

SEQ ID NO: 1592595 - protein, 20 aa, Staphylococcus aureus
LLIPLYVQNSLALSALLFGL

SEQ ID NO: 1592596 - protein, 36 aa, Staphylococcus aureus
LSNLIFVPYYSIILFPLSILFFITSHFIVGLTPLNY

SEQ ID NO: 1592597 - protein, 20 aa, Staphylococcus aureus
LSVRWYGIIIAVGILLGYFV

SEQ ID NO: 1592598 - protein, 18 aa, Staphylococcus aureus
LTVLVPLLPIYMASLQNL

SEQ ID NO: 1592599 - protein, 20 aa, Staphylococcus aureus
LVGLILLRLFKINLFSFKKL

SEQ ID NO: 1592600 - protein, 25 aa, Staphylococcus aureus
LYQRSWLMMLLICNILGMIYGYIWY

SEQ ID NO: 1592601 - protein, 17 aa, Staphylococcus aureus
MATGEIIGERKVRYTFK

SEQ ID NO: 1592602 - protein, 23 aa, Staphylococcus aureus
MMGVKLPFQISFTGSDWIVLILA

SEQ ID NO: 1592603 - protein, 25 aa, Staphylococcus aureus
MTIQLLPITGIPLPFISYGGSALWS

SEQ ID NO: 1592604 - protein, 38 aa, Staphylococcus aureus
MWITEKLGWYYLILTTIIVFFCIFLIFSPIGKLKLGKP

SEQ ID NO: 1592605 - protein, 35 aa, Staphylococcus aureus
NAIGVVGISGLLASFWFFIAKRRRKEDEEEELEIR

SEQ ID NO: 1592606 - protein, 19 aa, Staphylococcus aureus
NAIKALANAKRDQINSNPD

SEQ ID NO: 1592607 - protein, 27 aa, Staphylococcus aureus
NDPVSKYIPWFKTSKPIPLKDLMLHQS

SEQ ID NO: 1592608 - protein, 35 aa, Staphylococcus aureus
NGNGGDGIGFAFSPGVLGETGLNGAAVGIGGLSNA

SEQ ID NO: 1592609 - protein, 30 aa, Staphylococcus aureus
NIADEMFNNKITYNYSSPIAGIDKPNGANI

SEQ ID NO: 1592610 - protein, 19 aa, Staphylococcus aureus
NICLSLFAYILFGGLSTMA

SEQ ID NO: 1592611 - protein, 22 aa, Staphylococcus aureus
NIIVYPAFIMLFLSFVCLISSY

SEQ ID NO: 1592612 - protein, 20 aa, Staphylococcus aureus
NILNWLFWEILDNYISIVSS

SEQ ID NO: 1592613 - protein, 26 aa, Staphylococcus aureus
NINFLQIIRFYYKDIFVCFVAVVFFN

SEQ ID NO: 1592614 - protein, 18 aa, Staphylococcus aureus
NNRFSHVAFIKPNNGKTT

SEQ ID NO: 1592615 - protein, 17 aa, Staphylococcus aureus
NSWIRWILGTIISISIA

SEQ ID NO: 1592616 - protein, 22 aa, Staphylococcus aureus
NTAIDALTQLNTPQKAKLKEQV

SEQ ID NO: 1592617 - protein, 61 aa, Staphylococcus aureus
NTFQDFDINYNGDTKVMTVKYAGQTWTRNISDWIAKSGTTNFSLSMTASTGGATNLQQVQF

SEQ ID NO: 1592618 - protein, 25 aa, Staphylococcus aureus
NTMKKMVQNLWWGAGYNVIAVPLAA

SEQ ID NO: 1592619 - protein, 17 aa, Staphylococcus aureus
PALKIIVSAFSKVVTWV

SEQ ID NO: 1592620 - protein, 20 aa, Staphylococcus aureus
PDEYRYGFYVKPTLNRLNGG

SEQ ID NO: 1592621 - protein, 39 aa, Staphylococcus aureus
PDTGDSIKQNGLLGGVMTLLVGLGLMKRKKKKDENDQDD

SEQ ID NO: 1592622 - protein, 17 aa, Staphylococcus aureus
PIPLKDLMLHQSGLYKY

SEQ ID NO: 1592623 - protein, 27 aa, Staphylococcus aureus
PKNNSRTLIFPYVPDKAIYNAIVKVVV

SEQ ID NO: 1592624 - protein, 26 aa, Staphylococcus aureus
PSGDNVIAPVLTGNLKPNTDSNALID

SEQ ID NO: 1592625 - protein, 17 aa, Staphylococcus aureus
QAEAGGRPNFRTTGYSQ

SEQ ID NO: 1592626 - protein, 28 aa, Staphylococcus aureus
QDYPLMMALTLFFSFLGLLGNLISDITY

SEQ ID NO: 1592627 - protein, 35 aa, Staphylococcus aureus
QGAINIILGIIKVFSSLFTGNWRGVWDGIVMILKG

SEQ ID NO: 1592628 - protein, 35 aa, Staphylococcus aureus
QIFIVGTAISLLITVILGFFIARTITKPITDMRNQ

SEQ ID NO: 1592629 - protein, 31 aa, Staphylococcus aureus
QIYQINIWVWVPLIVIIVCLLFKMATVPAML

SEQ ID NO: 1592630 - protein, 29 aa, Staphylococcus aureus
QRLHFYAAIFIAPLLITLTISGIGYLFFP

SEQ ID NO: 1592631 - protein, 21 aa, Staphylococcus aureus
RIKTRPLYLAAMGTFLVGSIV

SEQ ID NO: 1592632 - protein, 42 aa, Staphylococcus aureus
RLPDTGDSIKQNGLLGGVMTLLVGLGLMKRKKKKDENDQDDS

SEQ ID NO: 1592633 - protein, 36 aa, Staphylococcus aureus
RRGIWQVKPIIQGWDHVDFIGVDFLDFKRKGAELAN

SEQ ID NO: 1592634 - protein, 22 aa, Staphylococcus aureus
RVTIARMILKDAPIIVLDEATA

SEQ ID NO: 1592635 - protein, 17 aa, Staphylococcus aureus
RWLFTFGILFQLPILFI

SEQ ID NO: 1592636 - protein, 17 aa, Staphylococcus aureus
SALLFGLVIMPGAIING

SEQ ID NO: 1592637 - protein, 25 aa, Staphylococcus aureus
SFGWRIPFLLGLFLGLFGLYLRRKL

SEQ ID NO: 1592638 - protein, 20 aa, Staphylococcus aureus
SFNYIFLANLIMYVVFALVA

SEQ ID NO: 1592639 - protein, 18 aa, Staphylococcus aureus
SGLLYIGFVIYTLTIGSY

SEQ ID NO: 1592640 - protein, 17 aa, Staphylococcus aureus
SIVVFSLAIIQPGDPFS

SEQ ID NO: 1592641 - protein, 21 aa, Staphylococcus aureus
SLTAKVEVTLLDGSKVIVNVP

SEQ ID NO: 1592642 - protein, 31 aa, Staphylococcus aureus
SRSNEQIIFTPQLVFVITDMSLIIDHVILEY

SEQ ID NO: 1592643 - protein, 19 aa, Staphylococcus aureus
STMIVISIPRFEEYMKARH

SEQ ID NO: 1592644 - protein, 23 aa, Staphylococcus aureus
STQETWRGDYLVKQLSQNPQLKK

SEQ ID NO: 1592645 - protein, 28 aa, Staphylococcus aureus
SVAPKRVNAKIRFAVAQPAAVASNNVND

SEQ ID NO: 1592646 - protein, 25 aa, Staphylococcus aureus
TELNTAMGTLKHAIADKTNTLASSK

SEQ ID NO: 1592647 - protein, 34 aa, Staphylococcus aureus
TFSEFRTFLAVLLILLLFISISLVIASTYSIIRP

SEQ ID NO: 1592648 - protein, 24 aa, Staphylococcus aureus
TIEQQIYVNPLKKTATNTKVDIAG

SEQ ID NO: 1592649 - protein, 19 aa, Staphylococcus aureus
TIGFGLMLYAFSSAGDLGF

SEQ ID NO: 1592650 - protein, 26 aa, Staphylococcus aureus
TIPASIIGLLVWFIVGFQFKGHSNDK

SEQ ID NO: 1592651 - protein, 40 aa, Staphylococcus aureus
TKGLTLFYVFIGLIMFALLNQQLLLLNFLSFILAIVVAMC

SEQ ID NO: 1592652 - protein, 37 aa, Staphylococcus aureus
TNVIAIRMLFHPFKPYYIFKFRVPFTPGLIPKRREEI

SEQ ID NO: 1592653 - protein, 35 aa, Staphylococcus aureus
TSLKNHPWGWKEHLPYLLMLTLSLVALILGVLSAI

SEQ ID NO: 1592654 - protein, 21 aa, Staphylococcus aureus
TTIKPRTLNRMAVNTVAAPQQ

SEQ ID NO: 1592655 - protein, 25 aa, Staphylococcus aureus
TVILQNNLDLFFNYGKRLANDHYNT

SEQ ID NO: 1592656 - protein, 24 aa, Staphylococcus aureus
TYNLQKLLAPYHKAKTLERQVYEL

SEQ ID NO: 1592657 - protein, 27 aa, Staphylococcus aureus
VAPKRVNAKMRFAVAQPAAVASNNVND

SEQ ID NO: 1592658 - protein, 27 aa, Staphylococcus aureus
VDVTAELEINLFIDPKTVQTNGNQTIT

SEQ ID NO: 1592659 - protein, 20 aa, Staphylococcus aureus
VEFNTPDDQITTPYIVVVNG

SEQ ID NO: 1592660 - protein, 18 aa, Staphylococcus aureus
VEQALQRVNTAKTALNGD

SEQ ID NO: 1592661 - protein, 19 aa, Staphylococcus aureus
VEVAQPRTALESKPRVTRS

SEQ ID NO: 1592662 - protein, 25 aa, Staphylococcus aureus
VFILFLICSFGVLIGLYQYRHTKTV

SEQ ID NO: 1592663 - protein, 32 aa, Staphylococcus aureus
VGIDSGTTVYPHQAGYVKLNYGFSVPNSAVKG

SEQ ID NO: 1592664 - protein, 29 aa, Staphylococcus aureus
VGNQTIEVGKTMNPIVLTTTDNGTGTVTN

SEQ ID NO: 1592665 - protein, 27 aa, Staphylococcus aureus
VIHACVLLFIIISIGLVFHRLQTKTNS

SEQ ID NO: 1592666 - protein, 18 aa, Staphylococcus aureus
VPEKWILGLLGLIPIYLG

SEQ ID NO: 1592667 - protein, 26 aa, Staphylococcus aureus
VPYFILTEMPPFVAGLLIAAIFAAAQ

SEQ ID NO: 1592668 - protein, 17 aa, Staphylococcus aureus
VPYFLINIDINFTYLLA

SEQ ID NO: 1592669 - protein, 18 aa, Staphylococcus aureus
VSMLVIMLILLCFTFYNI

SEQ ID NO: 1592670 - protein, 17 aa, Staphylococcus aureus
VSNHPLMLLVQGVVFFI

SEQ ID NO: 1592671 - protein, 17 aa, Staphylococcus aureus
VTFPILRKFKIATPVFK

SEQ ID NO: 1592672 - protein, 19 aa, Staphylococcus aureus
VTGLPSGLTFDSTNNTISG

SEQ ID NO: 1592673 - protein, 17 aa, Staphylococcus aureus
VTNTVTGLPSGLSYDSA

SEQ ID NO: 1592674 - protein, 23 aa, Staphylococcus aureus
VVFLCILIFFVLLNRKLKLKVFD

SEQ ID NO: 1592675 - protein, 20 aa, Staphylococcus aureus
YGFYVKPTLNRLNGGLFGQV

SEQ ID NO: 1592676 - protein, 18 aa, Staphylococcus aureus
YILSLAINFHPHEVAFLL

SEQ ID NO: 1592677 - protein, 19 aa, Staphylococcus aureus
YIVMFILNISHIHLPHVAI

SEQ ID NO: 1592678 - protein, 21 aa, Staphylococcus aureus
YNQILYIALIQFLGLLIGLFL

SEQ ID NO: 1592679 - protein, 35 aa, Staphylococcus aureus
YTGNLDLFILRIVLLSCLFILTISVINLWTFLMLL

SEQ ID NO: 1592680 - protein, 32 aa, Staphylococcus aureus
YTKQTFVTNLTGYKFNPNAKNFKIYEVTDQNQ

SEQ ID NO: 1592681 - protein, 23 aa, Staphylococcus aureus
YVIKYEGYYDSNASNLEFQTHLF

SEQ ID NO: 1592682 - protein, 21 aa, Staphylococcus aureus
YYMSKIYHTFLPALTLGLLST

SEQ ID NO: 1592683 - protein, 20 aa, Staphylococcus aureus
YYNQVVYVNPMDKDLKGAKL

SEQ ID NO: 1592684 - protein, 25 aa, Staphylococcus aureus
ADQIPSGYTILATGTPDGVHNTVTI

SEQ ID NO: 1592685 - protein, 18 aa, Staphylococcus aureus
AEIIAQAQALNEAMKALK

SEQ ID NO: 1592686 - protein, 37 aa, Staphylococcus aureus
AKVVNAKYDVIYNGHTFATSLPAKFVVKDVQPAKPTV

SEQ ID NO: 1592687 - protein, 29 aa, Staphylococcus aureus
AMRYIVGKWVPRTGSWRAAFKRAGDYAYA

SEQ ID NO: 1592688 - protein, 27 aa, Staphylococcus aureus
ATTMGWRWIFIFSIIVAVLSMLLIKGT

SEQ ID NO: 1592689 - protein, 18 aa, Staphylococcus aureus
AYNWAFFNPIRKIYYNIT

SEQ ID NO: 1592690 - protein, 20 aa, Staphylococcus aureus
DAMNYITFDPNTNTNGITAA

SEQ ID NO: 1592691 - protein, 27 aa, Staphylococcus aureus
DDIITEQDILAHINLIDQLSAEVIDTP

SEQ ID NO: 1592692 - protein, 27 aa, Staphylococcus aureus
DDQITTPYIVVVNGHIDPNSKGDLALR

SEQ ID NO: 1592693 - protein, 28 aa, Staphylococcus aureus
DLVSTWLVLFFPFINWLIPKKYVQISRE

SEQ ID NO: 1592694 - protein, 25 aa, Staphylococcus aureus
DNALNAVTRAKAALNGADNLRNAKT

SEQ ID NO: 1592695 - protein, 23 aa, Staphylococcus aureus
DNEHSPVLIAKRLKDKDGNVETT

SEQ ID NO: 1592696 - protein, 19 aa, Staphylococcus aureus
DNTKRSVNYTDADQPKQQA

SEQ ID NO: 1592697 - protein, 26 aa, Staphylococcus aureus
DQSSEVYSPISPIKIATQDNSGNAVT

SEQ ID NO: 1592698 - protein, 21 aa, Staphylococcus aureus
DSGFIFFFIVYVLCISCFNSD

SEQ ID NO: 1592699 - protein, 19 aa, Staphylococcus aureus
DSTSMSLSMSQSISGSTSV

SEQ ID NO: 1592700 - protein, 28 aa, Staphylococcus aureus
DTKGITLFYIFIGLIMFALLNQQHLYLN

SEQ ID NO: 1592701 - protein, 41 aa, Staphylococcus aureus
DTKGLTLFYVFIGLIMFALLNQQLLLLNFLSFILAIVVAMC

SEQ ID NO: 1592702 - protein, 30 aa, Staphylococcus aureus
DVVAKATYDILTKTYTFVFTDYVNDKENIN

SEQ ID NO: 1592703 - protein, 18 aa, Staphylococcus aureus
EAKFENGVITRKADEKTT

SEQ ID NO: 1592704 - protein, 26 aa, Staphylococcus aureus
EDVTNQVRISFPNANQYKVEFPTDDD

SEQ ID NO: 1592705 - protein, 25 aa, Staphylococcus aureus
EDYKAEKLLAPYKKAKTLERQVYEL

SEQ ID NO: 1592706 - protein, 34 aa, Staphylococcus aureus
ELQYRRAMLFLRAMILHKLLLIANNTTIYYAIND

SEQ ID NO: 1592707 - protein, 24 aa, Staphylococcus aureus
EQLDQAMERLINGIQDKDQVKQSV

SEQ ID NO: 1592708 - protein, 17 aa, Staphylococcus aureus
EVKKGYFPIKRAIDLVL

SEQ ID NO: 1592709 - protein, 18 aa, Staphylococcus aureus
FAILIISIVLIIFGVPIY

SEQ ID NO: 1592710 - protein, 19 aa, Staphylococcus aureus
FDNWFNMYIDEVKGHLLLE

SEQ ID NO: 1592711 - protein, 26 aa, Staphylococcus aureus
FFIMLIGMLIFYFYLNKKLTLKIFNT

SEQ ID NO: 1592712 - protein, 17 aa, Staphylococcus aureus
FGQYAMLFLAPTGLVMA

SEQ ID NO: 1592713 - protein, 18 aa, Staphylococcus aureus
FIDYLFIDEAGQAIPQAA

SEQ ID NO: 1592714 - protein, 18 aa, Staphylococcus aureus
FIYIFPIADQAVLAKASA

SEQ ID NO: 1592715 - protein, 23 aa, Staphylococcus aureus
FKDKISYKYDNVASINFGDINKT

SEQ ID NO: 1592716 - protein, 18 aa, Staphylococcus aureus
FKNKAVLTGLVGALLLFI

SEQ ID NO: 1592717 - protein, 17 aa, Staphylococcus aureus
FLAIILTVSHIKGWLTI

SEQ ID NO: 1592718 - protein, 24 aa, Staphylococcus aureus
FLAMFLIFTIFVGLPLLIMEFTVG

SEQ ID NO: 1592719 - protein, 17 aa, Staphylococcus aureus
FLIVLINLIVTFPVLRK

SEQ ID NO: 1592720 - protein, 21 aa, Staphylococcus aureus
FLKDKTMHLQLLFGQANRQDE

SEQ ID NO: 1592721 - protein, 24 aa, Staphylococcus aureus
FLTPLDYHYFFFSDGFYITISILT

SEQ ID NO: 1592722 - protein, 18 aa, Staphylococcus aureus
FLYLLFKLNSNSSNLKQY

SEQ ID NO: 1592723 - protein, 18 aa, Staphylococcus aureus
FMAANFKVTGQVKSGDYF

SEQ ID NO: 1592724 - protein, 41 aa, Staphylococcus aureus
FNFGKLIVIILFLDTIFRLMLPFSTYIFILIPLLGLTYMTQ

SEQ ID NO: 1592725 - protein, 18 aa, Staphylococcus aureus
FNMYHRAWEYASVSELIL

SEQ ID NO: 1592726 - protein, 19 aa, Staphylococcus aureus
FNRKIIIILALLMGALGFS

SEQ ID NO: 1592727 - protein, 25 aa, Staphylococcus aureus
FQYKIFPVLMFLVSTGLGIIVITQN

SEQ ID NO: 1592728 - protein, 17 aa, Staphylococcus aureus
FSHVAFIKPNNGKTTSV

SEQ ID NO: 1592729 - protein, 30 aa, Staphylococcus aureus
GDSLIPYALVFIGLIIFISVVILIMSLFTL

SEQ ID NO: 1592730 - protein, 23 aa, Staphylococcus aureus
GFIITVFMSIVFLSISFAKLIFS

SEQ ID NO: 1592731 - protein, 25 aa, Staphylococcus aureus
GFSSNFTMPFAFLSPLSASVLNFVL

SEQ ID NO: 1592732 - protein, 22 aa, Staphylococcus aureus
GFTLFIFTLIMNLLSQWISKRF

SEQ ID NO: 1592733 - protein, 20 aa, Staphylococcus aureus
GGIPKDFIDYLFIDEAGQAI

SEQ ID NO: 1592734 - protein, 50 aa, Staphylococcus aureus
GIALAIVILIIFALLFRFIVKLIPIFYIFRVLSIFIFIMGFKMLGVSIQK

SEQ ID NO: 1592735 - protein, 51 aa, Staphylococcus aureus
GIALAIVILIIFALLFRFIVKLIPIFYIFRVLSIFIFIMGFKMLGVSIQKL

SEQ ID NO: 1592736 - protein, 20 aa, Staphylococcus aureus
GLASLAAAFFLIRDGQMEGS

SEQ ID NO: 1592737 - protein, 26 aa, Staphylococcus aureus
GLITIIWVAIIGVFKKSLSAIWNATK

SEQ ID NO: 1592738 - protein, 30 aa, Staphylococcus aureus
GNGGDGIGFAFSPGVLGETGLNGAAVGIGG

SEQ ID NO: 1592739 - protein, 24 aa, Staphylococcus aureus
GNQTIEVGKTMNPIVLTTTDNGTG

SEQ ID NO: 1592740 - protein, 18 aa, Staphylococcus aureus
GQDNFLLNLTFKENIKLG

SEQ ID NO: 1592741 - protein, 31 aa, Staphylococcus aureus
GRIDTLNKEEGKFSHFAYVKPNNQSLTSVTV

SEQ ID NO: 1592742 - protein, 42 aa, Staphylococcus aureus
GVHNTITIRPQDYVVFIPPVGKQIRAVVYYNKVVASNMSNAV

SEQ ID NO: 1592743 - protein, 24 aa, Staphylococcus aureus
GVVGWLTELWGKIQSTLQPIMPIL

SEQ ID NO: 1592744 - protein, 18 aa, Staphylococcus aureus
GYYPIKRAIDLVLSIVLL

SEQ ID NO: 1592745 - protein, 18 aa, Staphylococcus aureus
HFCVLLLLKYIGFKLFIY

SEQ ID NO: 1592746 - protein, 17 aa, Staphylococcus aureus
HFLISIPVIIGGSFSAF

SEQ ID NO: 1592747 - protein, 25 aa, Staphylococcus aureus
HPGKLLNYILEAFGIDFNSLTKGMG

SEQ ID NO: 1592748 - protein, 27 aa, Staphylococcus aureus
HQFNLLWFNMIFIIIIGLTLVIFCLLP

SEQ ID NO: 1592749 - protein, 30 aa, Staphylococcus aureus
IADEMFDNKITYNYSSPIAGIDKPNGANIS

SEQ ID NO: 1592750 - protein, 27 aa, Staphylococcus aureus
IALTTYIYLTLVAFNFISGVLTLPGLA

SEQ ID NO: 1592751 - protein, 23 aa, Staphylococcus aureus
IAVSILIIFILVSGLSMFVDQLP

SEQ ID NO: 1592752 - protein, 18 aa, Staphylococcus aureus
ICLPFQNLLEKVGFPRWA

SEQ ID NO: 1592753 - protein, 23 aa, Staphylococcus aureus
IDLPYIPLLVLFAGVANLIPFLG

SEQ ID NO: 1592754 - protein, 24 aa, Staphylococcus aureus
IFLFFKLKYYAIVTILVTMIIMYL

SEQ ID NO: 1592755 - protein, 23 aa, Staphylococcus aureus
IFLYSFIMMLGVEAVFFIANLFL

SEQ ID NO: 1592756 - protein, 23 aa, Staphylococcus aureus
IGSVFLPFLISGFLFYICLPFQN

SEQ ID NO: 1592757 - protein, 18 aa, Staphylococcus aureus
IIALFTALMRISTSKILR

SEQ ID NO: 1592758 - protein, 17 aa, Staphylococcus aureus
IILIALSLILPAFAVGN

SEQ ID NO: 1592759 - protein, 20 aa, Staphylococcus aureus
IISYFLLITLKKRGILQRFI

SEQ ID NO: 1592760 - protein, 19 aa, Staphylococcus aureus
IITAVITVVAYIFINQKIS

SEQ ID NO: 1592761 - protein, 17 aa, Staphylococcus aureus
ILIFFCHSPLTYLWVFA

SEQ ID NO: 1592762 - protein, 19 aa, Staphylococcus aureus
ILIILCCLLTIIVFKRSEK

SEQ ID NO: 1592763 - protein, 20 aa, Staphylococcus aureus
ILVSEILYYLYTRIKQLYGK

SEQ ID NO: 1592764 - protein, 17 aa, Staphylococcus aureus
IPVPFKFSGFSFDVTST

SEQ ID NO: 1592765 - protein, 17 aa, Staphylococcus aureus
IQKKYVNILPSKEGYML

SEQ ID NO: 1592766 - protein, 18 aa, Staphylococcus aureus
ISDWNRVGWGEIPMSLGF

SEQ ID NO: 1592767 - protein, 17 aa, Staphylococcus aureus
ITMFIIWTILQFYIDKK

SEQ ID NO: 1592768 - protein, 17 aa, Staphylococcus aureus
IVLSLIALLLIASFFIT

SEQ ID NO: 1592769 - protein, 49 aa, Staphylococcus aureus
IVMILKGTVQLIWNLIQLWFVGKILGVVRYFGGLLKGLITIIWVAIIGV

SEQ ID NO: 1592770 - protein, 17 aa, Staphylococcus aureus
IVPAQDYLSLKSQITVD

SEQ ID NO: 1592771 - protein, 27 aa, Staphylococcus aureus
IVTFIVFMILLITKFSQVWPILIFLPF

SEQ ID NO: 1592772 - protein, 17 aa, Staphylococcus aureus
KAALNGTQNLEKAKQHA

SEQ ID NO: 1592773 - protein, 23 aa, Staphylococcus aureus
KAGGLISFLSTKVPILGTVFTAL

SEQ ID NO: 1592774 - protein, 20 aa, Staphylococcus aureus
KAIIFAALFILIGFYDGFVG

SEQ ID NO: 1592775 - protein, 29 aa, Staphylococcus aureus
KAVLTGLVGALLLFIKQITDLFGFDLSTQ

SEQ ID NO: 1592776 - protein, 29 aa, Staphylococcus aureus
KAVLTGLVGALLLFIKQVTDLFGLDLSTQ

SEQ ID NO: 1592777 - protein, 25 aa, Staphylococcus aureus
KDAVQIVPLIIKYASELKLYGKTLK

SEQ ID NO: 1592778 - protein, 28 aa, Staphylococcus aureus
KDDVKATLTMPAYIDPENVKKTGNVTLA

SEQ ID NO: 1592779 - protein, 20 aa, Staphylococcus aureus
KDLINQTGNPTLDKSQVEQL

SEQ ID NO: 1592780 - protein, 24 aa, Staphylococcus aureus
KGHLLLELAVIFGISALVTSFLKH

SEQ ID NO: 1592781 - protein, 17 aa, Staphylococcus aureus
KGHYFVTTFYRNGKLPD

SEQ ID NO: 1592782 - protein, 29 aa, Staphylococcus aureus
KGSIEGTKHLPLLFAKRRRKEDEEDAIVE

SEQ ID NO: 1592783 - protein, 21 aa, Staphylococcus aureus
KKGYFPIKRAIDLVLSIVLLF

SEQ ID NO: 1592784 - protein, 27 aa, Staphylococcus aureus
KKNMAGLIFVSWYPTVYWIINAAVVLV

SEQ ID NO: 1592785 - protein, 20 aa, Staphylococcus aureus
KKTYQGIFSFDVLGLQDIHR

SEQ ID NO: 1592786 - protein, 21 aa, Staphylococcus aureus
KMGINYSIYMDADTIPVDKKD

SEQ ID NO: 1592787 - protein, 19 aa, Staphylococcus aureus
KTTTTFKYEVTRNSMSDSV

SEQ ID NO: 1592788 - protein, 36 aa, Staphylococcus aureus
LEPVLTTRQVFLGKAGFFIMLGMLQALIVSVGDLLI

SEQ ID NO: 1592789 - protein, 30 aa, Staphylococcus aureus
LGETTVSKIFNIQYLGGVRDNWGVTANGRI

SEQ ID NO: 1592790 - protein, 18 aa, Staphylococcus aureus
LGIFLYIGYSIIDLPYIP

SEQ ID NO: 1592791 - protein, 19 aa, Staphylococcus aureus
LIGVLLIYGLFISSNPKEI

SEQ ID NO: 1592792 - protein, 25 aa, Staphylococcus aureus
LIQLDQLLVSILQPYEQRIKHENRT

SEQ ID NO: 1592793 - protein, 18 aa, Staphylococcus aureus
LISMLYLFVGIDFEIFEY

SEQ ID NO: 1592794 - protein, 20 aa, Staphylococcus aureus
LIYFTGWRIIDSIISIVISL

SEQ ID NO: 1592795 - protein, 21 aa, Staphylococcus aureus
LLMVLWLVITAWKHIGYIKEI

SEQ ID NO: 1592796 - protein, 17 aa, Staphylococcus aureus
LNEYQLSQLFTDQKLQE

SEQ ID NO: 1592797 - protein, 17 aa, Staphylococcus aureus
LNKFTIEKLALGLARYL

SEQ ID NO: 1592798 - protein, 18 aa, Staphylococcus aureus
LPVITIGILFGLAMDYEV

SEQ ID NO: 1592799 - protein, 25 aa, Staphylococcus aureus
LSKFNIIYILMFEQLLIFSITAILG

SEQ ID NO: 1592800 - protein, 22 aa, Staphylococcus aureus
LVAIIACMIWYLNKAHVSIIGI

SEQ ID NO: 1592801 - protein, 23 aa, Staphylococcus aureus
MGIMIHMIIFSIKYLKGFSLENV

SEQ ID NO: 1592802 - protein, 17 aa, Staphylococcus aureus
MLAGWRKHTVKLDFDTT

SEQ ID NO: 1592803 - protein, 22 aa, Staphylococcus aureus
MRIFLQIMLPLAKPILAVVALF

SEQ ID NO: 1592804 - protein, 25 aa, Staphylococcus aureus
MVKAGIFLLLRFTPLLGLSNMYVYI

SEQ ID NO: 1592805 - protein, 17 aa, Staphylococcus aureus
NAKDLINQTGNPTLDKS

SEQ ID NO: 1592806 - protein, 32 aa, Staphylococcus aureus
NENNADIILPKSTAPKRLNTRMRIAAVQPSST

SEQ ID NO: 1592807 - protein, 26 aa, Staphylococcus aureus
NGVTSTAKVPPIMAGDQVLANGVIDS

SEQ ID NO: 1592808 - protein, 42 aa, Staphylococcus aureus
NNAITIITIITAVIFLTITTVFAFFLSSRITKPLRRLRDQAT

SEQ ID NO: 1592809 - protein, 17 aa, Staphylococcus aureus
NNGSYSLNIENLDKTYV

SEQ ID NO: 1592810 - protein, 22 aa, Staphylococcus aureus
NNKIVPAQDYLALKSQIKVDDK

SEQ ID NO: 1592811 - protein, 21 aa, Staphylococcus aureus
NSFSVNLPWTTPGPLGIIMGT

SEQ ID NO: 1592812 - protein, 34 aa, Staphylococcus aureus
NTCEKYCLGAVFFYFWGVFLYNSLHKCKGFSFHV

SEQ ID NO: 1592813 - protein, 39 aa, Staphylococcus aureus
NTYKQTVFVNPKQRVLGNTWVYIKGYQDKIEESSGKVSA

SEQ ID NO: 1592814 - protein, 23 aa, Staphylococcus aureus
NVFTQLAPLFQWSADWLDRLGQS

SEQ ID NO: 1592815 - protein, 29 aa, Staphylococcus aureus
NVKKNLVGIAFIFSSVAVLIFELNTIEEM

SEQ ID NO: 1592816 - protein, 18 aa, Staphylococcus aureus
NVNYALAPQYKYPTPLIQ

SEQ ID NO: 1592817 - protein, 38 aa, Staphylococcus aureus
NWVKSGIKEIEMFKIMGLPFISHSLVSQDNQSISKKIT

SEQ ID NO: 1592818 - protein, 37 aa, Staphylococcus aureus
NYNGDTKVMTVTYAGQTWTRNISDWIAKSGTTNFSLS

SEQ ID NO: 1592819 - protein, 25 aa, Staphylococcus aureus
PAILLPLYILSFSSVSLLATYLVRI

SEQ ID NO: 1592820 - protein, 28 aa, Staphylococcus aureus
PKNNSRTLIFPYVPDKAIYNAIVKVVVA

SEQ ID NO: 1592821 - protein, 22 aa, Staphylococcus aureus
PLEFSFLFVAPVLYGIHVLLAG

SEQ ID NO: 1592822 - protein, 28 aa, Staphylococcus aureus
PNEAVQGDTFKITVPKELNLNGVTSTAK

SEQ ID NO: 1592823 - protein, 21 aa, Staphylococcus aureus
PNVKIYEYVGVENGLPQSVYA

SEQ ID NO: 1592824 - protein, 20 aa, Staphylococcus aureus
PQRDALRNQINQAQALATVE

SEQ ID NO: 1592825 - protein, 21 aa, Staphylococcus aureus
PTKLGYLIIIILGVTVGILIY

SEQ ID NO: 1592826 - protein, 17 aa, Staphylococcus aureus
PVYALFVGIFFKENQSL

SEQ ID NO: 1592827 - protein, 28 aa, Staphylococcus aureus
QAVNTSAPRMRAFSLAAVAADAPAAGTD

SEQ ID NO: 1592828 - protein, 26 aa, Staphylococcus aureus
QFIQYYFYLIIILGGLYLYTHHAFIL

SEQ ID NO: 1592829 - protein, 27 aa, Staphylococcus aureus
QLIILGFLLHYIFKINDKWLLVLCVFV

SEQ ID NO: 1592830 - protein, 24 aa, Staphylococcus aureus
QLLAFAFIIMFILNPLVVYDIGFQ

SEQ ID NO: 1592831 - protein, 20 aa, Staphylococcus aureus
QRLIKLLGDIFIPILPAIVT

SEQ ID NO: 1592832 - protein, 45 aa, Staphylococcus aureus
QSISKKITGYGLKTTAVIGGAFTVNMLHDQQAFAASDAPLTSELN

SEQ ID NO: 1592833 - protein, 24 aa, Staphylococcus aureus
QSLNNAMKGLRYSIANETTVKASQ

SEQ ID NO: 1592834 - protein, 24 aa, Staphylococcus aureus
QTIDQLNRGLNLGLDDIRNTHVWE

SEQ ID NO: 1592835 - protein, 23 aa, Staphylococcus aureus
QTLNTAMKGLRDSIANEATIKAG

SEQ ID NO: 1592836 - protein, 24 aa, Staphylococcus aureus
QVKSGDYFTAKLPDSVTGNGDVDY

SEQ ID NO: 1592837 - protein, 20 aa, Staphylococcus aureus
RHLLLFPGILLQGAAIAALV

SEQ ID NO: 1592838 - protein, 31 aa, Staphylococcus aureus
RIDTLNKVDGKFSHFAYMKPNNQSLSSVTVT

SEQ ID NO: 1592839 - protein, 19 aa, Staphylococcus aureus
RIYFVIFQWPYYAENPSEI

SEQ ID NO: 1592840 - protein, 22 aa, Staphylococcus aureus
RLKNNPKAFFKEEKSKFTEYDN

SEQ ID NO: 1592841 - protein, 20 aa, Staphylococcus aureus
RLLILALIDSLIVTFSVFVS

SEQ ID NO: 1592842 - protein, 19 aa, Staphylococcus aureus
RVGWGEIPMSLGFTYSSNT

SEQ ID NO: 1592843 - protein, 26 aa, Staphylococcus aureus
SDGKFHGQRLNDVILTYVASTGKMRA

SEQ ID NO: 1592844 - protein, 24 aa, Staphylococcus aureus
SETNWKYEFKDLPKYDEGKKIEYT

SEQ ID NO: 1592845 - protein, 17 aa, Staphylococcus aureus
SGNTFMAANFKVTGQVK

SEQ ID NO: 1592846 - protein, 20 aa, Staphylococcus aureus
SHYAIYLFSLITSVVLYFSF

SEQ ID NO: 1592847 - protein, 18 aa, Staphylococcus aureus
SIFEVIIMFFIGGVFSLL

SEQ ID NO: 1592848 - protein, 20 aa, Staphylococcus aureus
SIIVTIILFIKQRHLAVWFV

SEQ ID NO: 1592849 - protein, 38 aa, Staphylococcus aureus
SISFAKLIFSTFALFLFLFLVFSWIVSFIPGFELSVFS

SEQ ID NO: 1592850 - protein, 28 aa, Staphylococcus aureus
SLANEKTRVRLYKSGKNWVKSGIKEIEM

SEQ ID NO: 1592851 - protein, 22 aa, Staphylococcus aureus
SLITPLWLLCLMGIMIHMIIFS

SEQ ID NO: 1592852 - protein, 23 aa, Staphylococcus aureus
SNKSFHFSGKVNLGNKYEGNGNG

SEQ ID NO: 1592853 - protein, 36 aa, Staphylococcus aureus
SPFIVLTVIVMIWSAPFFKNLFLPNGALSSLVFKFN

SEQ ID NO: 1592854 - protein, 17 aa, Staphylococcus aureus
SPFYSHLITLTNHYPFT

SEQ ID NO: 1592855 - protein, 17 aa, Staphylococcus aureus
SQFLPLLIVKKLPFVQY

SEQ ID NO: 1592856 - protein, 37 aa, Staphylococcus aureus
STTANKTVLVDYEKYGKFYNLSIKGTIDQIDKTNNTY

SEQ ID NO: 1592857 - protein, 17 aa, Staphylococcus aureus
SVAMFITLIIIAVLMGM

SEQ ID NO: 1592858 - protein, 23 aa, Staphylococcus aureus
SVINLWTFLMLLNLNIANMIKGK

SEQ ID NO: 1592859 - protein, 21 aa, Staphylococcus aureus
SYYPIKRAIDLILSIVLLFLT

SEQ ID NO: 1592860 - protein, 19 aa, Staphylococcus aureus
TAKVPPIMAGDQVLANGVI

SEQ ID NO: 1592861 - protein, 17 aa, Staphylococcus aureus
TAYLTNNLEFRNDLPHI

SEQ ID NO: 1592862 - protein, 25 aa, Staphylococcus aureus
TGLPTDGFTYKWNRDTTGTNDANWS

SEQ ID NO: 1592863 - protein, 24 aa, Staphylococcus aureus
TIEQQIYVNPLKKSATNTKVDIAG

SEQ ID NO: 1592864 - protein, 25 aa, Staphylococcus aureus
TIEQQIYVNPLKKTATNTKVDIAGS

SEQ ID NO: 1592865 - protein, 23 aa, Staphylococcus aureus
TIGYRIHFLNLYPVLYEVKKVDK

SEQ ID NO: 1592866 - protein, 21 aa, Staphylococcus aureus
TLITWFYTMLWSIVGVVWIVF

SEQ ID NO: 1592867 - protein, 18 aa, Staphylococcus aureus
TNAVSRAETILNKTQGAN

SEQ ID NO: 1592868 - protein, 44 aa, Staphylococcus aureus
TNNAITIITIITAVIFLTITTVFAFFLSSRITKPLRRLRDQATR

SEQ ID NO: 1592869 - protein, 26 aa, Staphylococcus aureus
TNYNWTFLILFTIFFVIFIKHISRVS

SEQ ID NO: 1592870 - protein, 17 aa, Staphylococcus aureus
TSKAMLAGWRKHTVKLD

SEQ ID NO: 1592871 - protein, 34 aa, Staphylococcus aureus
TTDGQRQFTLNGQVIQVLDIINPSNGYGGQPVTN

SEQ ID NO: 1592872 - protein, 20 aa, Staphylococcus aureus
TTNFSLSMTASTGGATNLQQ

SEQ ID NO: 1592873 - protein, 23 aa, Staphylococcus aureus
TTNKYNYSSYAGYTNTILSTTDS

SEQ ID NO: 1592874 - protein, 36 aa, Staphylococcus aureus
TTSTSTAPIKLRTFSRLAMSTFASAATTSAVTANTI

SEQ ID NO: 1592875 - protein, 20 aa, Staphylococcus aureus
TVLAPLLASIAKAGGLISFL

SEQ ID NO: 1592876 - protein, 20 aa, Staphylococcus aureus
TVVAYIFINQKISGLNKTDQ

SEQ ID NO: 1592877 - protein, 32 aa, Staphylococcus aureus
TYTKETFVTNLTGYKFNPDAKNFKIYEVTDQN

SEQ ID NO: 1592878 - protein, 33 aa, Staphylococcus aureus
TYTKETFVTNLTGYKFNPDAKNFKIYEVTDQNQ

SEQ ID NO: 1592879 - protein, 20 aa, Staphylococcus aureus
VAPILYVVHALLTGLSLFIV

SEQ ID NO: 1592880 - protein, 18 aa, Staphylococcus aureus
VCFTLFGYILFGGLTMLF

SEQ ID NO: 1592881 - protein, 24 aa, Staphylococcus aureus
VDNYKIHTLNWFKNTWGYMNLGAS

SEQ ID NO: 1592882 - protein, 26 aa, Staphylococcus aureus
VEVTANLEINLFIDPKTVQSNGEQKI

SEQ ID NO: 1592883 - protein, 24 aa, Staphylococcus aureus
VFIAFFSHLTIHLLPLFAVLGGAV

SEQ ID NO: 1592884 - protein, 17 aa, Staphylococcus aureus
VFLVLIVPFIKPFITFI

SEQ ID NO: 1592885 - protein, 27 aa, Staphylococcus aureus
VGIGGLSNAFGFKLDTYHNTSKPNAAA

SEQ ID NO: 1592886 - protein, 41 aa, Staphylococcus aureus
VHNTVTIRPQDYVVFIPPVGKQIRAVVYYNKVVASNMSNAV

SEQ ID NO: 1592887 - protein, 20 aa, Staphylococcus aureus
VHRRCLKPMFTIANQIAYNN

SEQ ID NO: 1592888 - protein, 29 aa, Staphylococcus aureus
VIGVGLFIHWIWPDLPIGAAFAIAAILCP

SEQ ID NO: 1592889 - protein, 20 aa, Staphylococcus aureus
VIQWFYKEVDWFEAKLKDET

SEQ ID NO: 1592890 - protein, 23 aa, Staphylococcus aureus
VKMGINYSIYMDADTIPVDKKDV

SEQ ID NO: 1592891 - protein, 22 aa, Staphylococcus aureus
VKSGDYFTAKLPDSVTGNGDVD

SEQ ID NO: 1592892 - protein, 18 aa, Staphylococcus aureus
VMAPLSFVLASLAIYWAM

SEQ ID NO: 1592893 - protein, 33 aa, Staphylococcus aureus
VNLIGALFLGLVVALIYIFFKVIFDKRIKDEED

SEQ ID NO: 1592894 - protein, 19 aa, Staphylococcus aureus
VTGLPSGLSYDSATNSIIG

SEQ ID NO: 1592895 - protein, 39 aa, Staphylococcus aureus
VTGNRPFFRLYLITWMMHLILIGGSRLFWRIYRKYLGGK

SEQ ID NO: 1592896 - protein, 26 aa, Staphylococcus aureus
VTTFTRRNNTSPWVKEASAATVAGIA

SEQ ID NO: 1592897 - protein, 20 aa, Staphylococcus aureus
WITYFFPMINWFLPKKYAKI

SEQ ID NO: 1592898 - protein, 25 aa, Staphylococcus aureus
YALQLMRDRLPLSELYEGVGILETP

SEQ ID NO: 1592899 - protein, 21 aa, Staphylococcus aureus
YFKTYSVKLLILAAISLFISH

SEQ ID NO: 1592900 - protein, 38 aa, Staphylococcus aureus
YFNYSLNYKVWYLTVLAGLIPFIPIKFSFIKFNNVNNQ

SEQ ID NO: 1592901 - protein, 21 aa, Staphylococcus aureus
YIELGKFWQILFIVGMVLWVI

SEQ ID NO: 1592902 - protein, 20 aa, Staphylococcus aureus
YLSSLLFGIALLGVVFHNIV

SEQ ID NO: 1592903 - protein, 19 aa, Staphylococcus aureus
YMGLFGAILFIIIVGATTI

SEQ ID NO: 1592904 - protein, 35 aa, Staphylococcus aureus
YQKYIDFMFASVLAFIFLVYRIYILFIDYKSVNKK

SEQ ID NO: 1592905 - protein, 43 aa, Staphylococcus aureus
YQLSQLFTDQKLQEAARTRNPIRLMIGFDYPDGYGNSETLVPV

SEQ ID NO: 1592906 - protein, 17 aa, Staphylococcus aureus
YRMIITLCLLFFDDLIF

SEQ ID NO: 1592907 - protein, 19 aa, Staphylococcus aureus
YRNVLVPPFLIQILVENAI

SEQ ID NO: 1592908 - protein, 19 aa, Staphylococcus aureus
YTKILPLIINVLGFLISKI

SEQ ID NO: 1592909 - protein, 18 aa, Staphylococcus aureus
YVLLSPTHPLALIVGIIL

SEQ ID NO: 1592910 - protein, 18 aa, Staphylococcus aureus
AFIAWGFIAAIFIDNGWL

SEQ ID NO: 1592911 - protein, 19 aa, Staphylococcus aureus
AFSKKFVPVVMAASVALFF

SEQ ID NO: 1592912 - protein, 17 aa, Staphylococcus aureus
AGLALIVHMIINRLFRK

SEQ ID NO: 1592913 - protein, 19 aa, Staphylococcus aureus
AIIGLFVLGQRTASALLPY

SEQ ID NO: 1592914 - protein, 28 aa, Staphylococcus aureus
AIISALIFNALIIVALIPIAMKGVKVKG

SEQ ID NO: 1592915 - protein, 33 aa, Staphylococcus aureus
AILMKNKWPFLIALPFMIGYGIGVTFYYQQKVA

SEQ ID NO: 1592916 - protein, 17 aa, Staphylococcus aureus
AINGWILPITLGAILIA

SEQ ID NO: 1592917 - protein, 20 aa, Staphylococcus aureus
AISKIKDISTDKIDRIRNST

SEQ ID NO: 1592918 - protein, 23 aa, Staphylococcus aureus
AITGFLTTVFIFALSLFTVLKMN

SEQ ID NO: 1592919 - protein, 25 aa, Staphylococcus aureus
ALIISMVIIYLFIRRQFNITNALLN

SEQ ID NO: 1592920 - protein, 20 aa, Staphylococcus aureus
ALIITQLLYFIDGSLAFLIF

SEQ ID NO: 1592921 - protein, 23 aa, Staphylococcus aureus
ASVSFLEVLVYIVGLGLVMSNLD

SEQ ID NO: 1592922 - protein, 28 aa, Staphylococcus aureus
ASYAALITMYIIHLIILSLLGISPIRYI

SEQ ID NO: 1592923 - protein, 18 aa, Staphylococcus aureus
ATITLLCTFLIVTLTMTL

SEQ ID NO: 1592924 - protein, 19 aa, Staphylococcus aureus
ATLFPIRIVVINSLGFSSN

SEQ ID NO: 1592925 - protein, 24 aa, Staphylococcus aureus
AVKGDTFKITVPKELNLNGVTSTA

SEQ ID NO: 1592926 - protein, 18 aa, Staphylococcus aureus
AVLNFVVVFILSASFIAY

SEQ ID NO: 1592927 - protein, 17 aa, Staphylococcus aureus
CLVSLLTILLLAISNMY

SEQ ID NO: 1592928 - protein, 20 aa, Staphylococcus aureus
CQNLFFKFKLLLFEVNQMQY

SEQ ID NO: 1592929 - protein, 25 aa, Staphylococcus aureus
DAIANLDTLRDLNQPQRDALRNQIN

SEQ ID NO: 1592930 - protein, 20 aa, Staphylococcus aureus
DDAKRTAYSQAVNAAATILN

SEQ ID NO: 1592931 - protein, 35 aa, Staphylococcus aureus
DENGKYCFDNLDSGKYKVIFEKPAGLTQTGTNTTE

SEQ ID NO: 1592932 - protein, 30 aa, Staphylococcus aureus
DESLDKVKHTPFFLPKRRRKEDEEDVEVTN

SEQ ID NO: 1592933 - protein, 18 aa, Staphylococcus aureus
DFSTLLLISGLLFLFFFK

SEQ ID NO: 1592934 - protein, 17 aa, Staphylococcus aureus
DILTTRNLPSLIKYGYS

SEQ ID NO: 1592935 - protein, 22 aa, Staphylococcus aureus
DNAAKLNVQPTNNTFQDFDINY

SEQ ID NO: 1592936 - protein, 17 aa, Staphylococcus aureus
DNAITQAESYLNKDHGA

SEQ ID NO: 1592937 - protein, 25 aa, Staphylococcus aureus
DNAMGAVQQYIDEQHLGVISSTNYI

SEQ ID NO: 1592938 - protein, 24 aa, Staphylococcus aureus
DNYHLIFALIFLAIVSVVSMMSGS

SEQ ID NO: 1592939 - protein, 37 aa, Staphylococcus aureus
DSLTAKVEVTLLDGSKVIVNVPVKVVEKELTVVKQQA

SEQ ID NO: 1592940 - protein, 28 aa, Staphylococcus aureus
DVVAKATYDILTKTYTFVFTDYVNDKEN

SEQ ID NO: 1592941 - protein, 19 aa, Staphylococcus aureus
EEKYDYTLMEFAQPIYNSA

SEQ ID NO: 1592942 - protein, 34 aa, Staphylococcus aureus
EGYNFTIYAPYGDDWFAYFMRRLAERPQNLSLAA

SEQ ID NO: 1592943 - protein, 33 aa, Staphylococcus aureus
EHPIGLALVILTVLVIIGFVLNMFIKHFKKERL

SEQ ID NO: 1592944 - protein, 34 aa, Staphylococcus aureus
EKMGYLKRIGMCISLLIVIIFVTSCGGGNKITGD

SEQ ID NO: 1592945 - protein, 21 aa, Staphylococcus aureus
EKVLRNIFISIASYIKDAAKS

SEQ ID NO: 1592946 - protein, 33 aa, Staphylococcus aureus
EMFRPFALAIAFSLLASLLVSITLVPALAATLF

SEQ ID NO: 1592947 - protein, 27 aa, Staphylococcus aureus
EPLEFTFLFIAPYLFVLHAVLAASMDT

SEQ ID NO: 1592948 - protein, 21 aa, Staphylococcus aureus
ERTLFKPIVYGFESFLKGSTL

SEQ ID NO: 1592949 - protein, 29 aa, Staphylococcus aureus
ESLDKVKHTPFFLPKRRRKEDEEDVEVTN

SEQ ID NO: 1592950 - protein, 17 aa, Staphylococcus aureus
ETIAPGHRDEFDPKLPT

SEQ ID NO: 1592951 - protein, 38 aa, Staphylococcus aureus
ETSNITYMILLIWVFGSLLCLFYMIKAFRQIDVIKSSS

SEQ ID NO: 1592952 - protein, 21 aa, Staphylococcus aureus
EVIQWFYKEVDWFEAKLKDET

SEQ ID NO: 1592953 - protein, 19 aa, Staphylococcus aureus
FEYTESAVTQVRYVDVTTG

SEQ ID NO: 1592954 - protein, 19 aa, Staphylococcus aureus
FGILFQLPILFMGLAKFDL

SEQ ID NO: 1592955 - protein, 18 aa, Staphylococcus aureus
FGYILFLALIDRFFKIFY

SEQ ID NO: 1592956 - protein, 17 aa, Staphylococcus aureus
FIYIFPIADQAVLAKAS

SEQ ID NO: 1592957 - protein, 36 aa, Staphylococcus aureus
FKWYDFVYFIDTLVYLFILIFKTKWLDTKAFSKKFV

SEQ ID NO: 1592958 - protein, 23 aa, Staphylococcus aureus
FKYIVMSLFLWLMWSHQTFFTNR

SEQ ID NO: 1592959 - protein, 17 aa, Staphylococcus aureus
FLGGLLSSLLLLVFGVF

SEQ ID NO: 1592960 - protein, 24 aa, Staphylococcus aureus
FLTPLDYHYFFFSDGFFITISILT

SEQ ID NO: 1592961 - protein, 20 aa, Staphylococcus aureus
FLVNFIVYLCMYLLLVVIAG

SEQ ID NO: 1592962 - protein, 28 aa, Staphylococcus aureus
FNHDGEVFAYYELIPYNYSFLSSDEKIQ

SEQ ID NO: 1592963 - protein, 37 aa, Staphylococcus aureus
FNYSLNYKVWYLTMLAGLIPFIPIKFSFIKFNNVNNQ

SEQ ID NO: 1592964 - protein, 24 aa, Staphylococcus aureus
FQYKIFPVLMFLVSTGLGIIVITQ

SEQ ID NO: 1592965 - protein, 22 aa, Staphylococcus aureus
FSNVVAFLALGLSAYSIFYTRS

SEQ ID NO: 1592966 - protein, 19 aa, Staphylococcus aureus
FVLAPDELFFTRDGLPIAK

SEQ ID NO: 1592967 - protein, 17 aa, Staphylococcus aureus
GGFWTKGIRRRKLKDYE

SEQ ID NO: 1592968 - protein, 19 aa, Staphylococcus aureus
GIDFLAVMGFASAISVIFA

SEQ ID NO: 1592969 - protein, 27 aa, Staphylococcus aureus
GIIGSIFMFLIFGVFIRRVTNAIIGLE

SEQ ID NO: 1592970 - protein, 26 aa, Staphylococcus aureus
GLVNILTQLMPLFKFVSQGLQNMSIA

SEQ ID NO: 1592971 - protein, 31 aa, Staphylococcus aureus
GNSETLVPVNLTVLPEIQHNIKFFKNDDTQN

SEQ ID NO: 1592972 - protein, 19 aa, Staphylococcus aureus
GQDNFLLNLTFKENIKLGN

SEQ ID NO: 1592973 - protein, 24 aa, Staphylococcus aureus
GRLALITSYIPFLAPFQLVVRAQT

SEQ ID NO: 1592974 - protein, 19 aa, Staphylococcus aureus
GSKESQLTEALFAEKPVAK

SEQ ID NO: 1592975 - protein, 21 aa, Staphylococcus aureus
GTRYIFFDNMSFTAPTKQPIV

SEQ ID NO: 1592976 - protein, 24 aa, Staphylococcus aureus
GTTSVIVGATILFGIGNHQAQASE

SEQ ID NO: 1592977 - protein, 33 aa, Staphylococcus aureus
GYNFTIYAPYGDDWFAYFMRRLAERPQNLSLAA

SEQ ID NO: 1592978 - protein, 17 aa, Staphylococcus aureus
HIEQFNPDQFTIDQAKS

SEQ ID NO: 1592979 - protein, 25 aa, Staphylococcus aureus
HQDQKLYFYFSSPGKDQIIYKESLT

SEQ ID NO: 1592980 - protein, 17 aa, Staphylococcus aureus
IAPLLITLTISGIGYLF

SEQ ID NO: 1592981 - protein, 20 aa, Staphylococcus aureus
IARISAVQIVISDRAKQSSS

SEQ ID NO: 1592982 - protein, 19 aa, Staphylococcus aureus
IDLNDAMETLKHLVDNEIP

SEQ ID NO: 1592983 - protein, 19 aa, Staphylococcus aureus
IFFIINFILISYLYDKQYV

SEQ ID NO: 1592984 - protein, 18 aa, Staphylococcus aureus
IFIFSFELQWFPFQGSVD

SEQ ID NO: 1592985 - protein, 30 aa, Staphylococcus aureus
IIAHYIHWSYLLILPMITIVTIPFLIKVMV

SEQ ID NO: 1592986 - protein, 21 aa, Staphylococcus aureus
IIITLLLAVLLFKGFNKWSGR

SEQ ID NO: 1592987 - protein, 18 aa, Staphylococcus aureus
IIVLILIEALIGLRFLKA

SEQ ID NO: 1592988 - protein, 24 aa, Staphylococcus aureus
IKNTTITTLPSGWTSNLTKSDNKN

SEQ ID NO: 1592989 - protein, 27 aa, Staphylococcus aureus
IKPKSTAPKRLNTRMRMAAVQPSSTDS

SEQ ID NO: 1592990 - protein, 21 aa, Staphylococcus aureus
ILLHVIGFSFLWIAGKDHHIL

SEQ ID NO: 1592991 - protein, 19 aa, Staphylococcus aureus
ILLLTFSLFFFYSQINSDE

SEQ ID NO: 1592992 - protein, 21 aa, Staphylococcus aureus
ILSLFGITALLLVVALPIYTV

SEQ ID NO: 1592993 - protein, 25 aa, Staphylococcus aureus
INEKYIRSLSYALQLMRDRLPLSEL

SEQ ID NO: 1592994 - protein, 20 aa, Staphylococcus aureus
INGLQHLTTAQKDKLKQQVQ

SEQ ID NO: 1592995 - protein, 45 aa, Staphylococcus aureus
IPLFATVIVVLAFFLLMIVFRSILIPLKAVLGFVLSLMATLGFTT

SEQ ID NO: 1592996 - protein, 36 aa, Staphylococcus aureus
IQGALNIILGLIKFFSSLFTGDWRGVWDAIVMILKG

SEQ ID NO: 1592997 - protein, 28 aa, Staphylococcus aureus
IQSTLQPIMPILQVLGQIFMQVLGVLVI

SEQ ID NO: 1592998 - protein, 23 aa, Staphylococcus aureus
ISTRKSESLSASTSLSGSTSESE

SEQ ID NO: 1592999 - protein, 23 aa, Staphylococcus aureus
ITMFIIWTILQFYIDKKLKPVYI

SEQ ID NO: 1593000 - protein, 21 aa, Staphylococcus aureus
ITPMMPYLPLLLTYAQKYDKR

SEQ ID NO: 1593001 - protein, 35 aa, Staphylococcus aureus
IVHRDDIITEQDILAHINLIDQLTAEIIDTPSTAT

SEQ ID NO: 1593002 - protein, 20 aa, Staphylococcus aureus
KCGGAPMKIMYLAEDYFRKH

SEQ ID NO: 1593003 - protein, 18 aa, Staphylococcus aureus
KELPWGVLILFGGGLALA

SEQ ID NO: 1593004 - protein, 17 aa, Staphylococcus aureus
KFVLFQKIPLLIKRHVY

SEQ ID NO: 1593005 - protein, 20 aa, Staphylococcus aureus
KFVPVVMAASVALFFLNLAF

SEQ ID NO: 1593006 - protein, 21 aa, Staphylococcus aureus
KLGRVFLLIPLSIILILIMRK

SEQ ID NO: 1593007 - protein, 23 aa, Staphylococcus aureus
KMGKYFAGIYIPSKFTHEITGTL

SEQ ID NO: 1593008 - protein, 35 aa, Staphylococcus aureus
KNDNPIRYVIAILVVVLMVLGVFQLGIIGRLIDSF

SEQ ID NO: 1593009 - protein, 20 aa, Staphylococcus aureus
KNYLVMIPLTFIIGADLLLL

SEQ ID NO: 1593010 - protein, 19 aa, Staphylococcus aureus
KPFLFLKTLFMGVVFIFIG

SEQ ID NO: 1593011 - protein, 17 aa, Staphylococcus aureus
KSAQFPFYIWLPDAMEA

SEQ ID NO: 1593012 - protein, 19 aa, Staphylococcus aureus
KSDIGRLTDLNNAQRTAAN

SEQ ID NO: 1593013 - protein, 17 aa, Staphylococcus aureus
KTETLNSINFTDADQAK

SEQ ID NO: 1593014 - protein, 63 aa, Staphylococcus aureus
KTISRLGTVFFLFVFNIGISIFVFLLTGIMIFSQVLFIIFAMFLPISFLLSMLPSFDGMGRHA

SEQ ID NO: 1593015 - protein, 24 aa, Staphylococcus aureus
KVKSGDYFTAKLPDSLTGNGDVDY

SEQ ID NO: 1593016 - protein, 18 aa, Staphylococcus aureus
KVMNPAKQPAPSKVVLLP

SEQ ID NO: 1593017 - protein, 27 aa, Staphylococcus aureus
KYEDIKSRLTLYSYIDKKTVPNETSLN

SEQ ID NO: 1593018 - protein, 23 aa, Staphylococcus aureus
LALITSYIPFLAPFQLVVRAQTS

SEQ ID NO: 1593019 - protein, 17 aa, Staphylococcus aureus
LFGMTTYFIMLMLRSVR

SEQ ID NO: 1593020 - protein, 40 aa, Staphylococcus aureus
LGTLFTIILAIAFIINLVLAFIIIFLERNRRTASSTWAWL

SEQ ID NO: 1593021 - protein, 18 aa, Staphylococcus aureus
LHYSWITLLCVGVILLLL

SEQ ID NO: 1593022 - protein, 20 aa, Staphylococcus aureus
LIDEIDRNPILTDKEKQALK

SEQ ID NO: 1593023 - protein, 17 aa, Staphylococcus aureus
LIGSIIFIAIVTLILRA

SEQ ID NO: 1593024 - protein, 19 aa, Staphylococcus aureus
LIILNIAFIIYTFVNYRKL

SEQ ID NO: 1593025 - protein, 28 aa, Staphylococcus aureus
LIKRWLIAIVVLAIIIWAFAGVPSLELK

SEQ ID NO: 1593026 - protein, 17 aa, Staphylococcus aureus
LIPVIAGLVPAIMAVLN

SEQ ID NO: 1593027 - protein, 20 aa, Staphylococcus aureus
LIRFDFDMKTLMTVAVIGAT

SEQ ID NO: 1593028 - protein, 20 aa, Staphylococcus aureus
LKDKTMHLQLLFGQANRQDE

SEQ ID NO: 1593029 - protein, 17 aa, Staphylococcus aureus
LKNPQTLDLPQSSPQTI

SEQ ID NO: 1593030 - protein, 17 aa, Staphylococcus aureus
LLMLLGSTLIMGGACAL

SEQ ID NO: 1593031 - protein, 29 aa, Staphylococcus aureus
LLTICVIFLVRMLYIKYTQNIMSHKIWLL

SEQ ID NO: 1593032 - protein, 46 aa, Staphylococcus aureus
LNEYQLSQLFTDQKLQEAARTRNPIRLMIGFDYPDGYGNSETLVPV

SEQ ID NO: 1593033 - protein, 24 aa, Staphylococcus aureus
LNGVIIYALGNKFLKLFRITNPIA

SEQ ID NO: 1593034 - protein, 27 aa, Staphylococcus aureus
LNWVAVIIYLLAMLFIGVYFTKRASQS

SEQ ID NO: 1593035 - protein, 27 aa, Staphylococcus aureus
LQQQSNYFRFQYFNPLKSERYYRNLDE

SEQ ID NO: 1593036 - protein, 26 aa, Staphylococcus aureus
LSASSPFFMIMFLQIVTFAGIYFKLG

SEQ ID NO: 1593037 - protein, 23 aa, Staphylococcus aureus
LSFIGIISLFSWGLGYFGQPHII

SEQ ID NO: 1593038 - protein, 26 aa, Staphylococcus aureus
LTALPSYWIASILIIYVSVKLNILPT

SEQ ID NO: 1593039 - protein, 19 aa, Staphylococcus aureus
LTLPKTISRLGTVFFLFVF

SEQ ID NO: 1593040 - protein, 18 aa, Staphylococcus aureus
LVFISVLIGIFNYIKVLP

SEQ ID NO: 1593041 - protein, 19 aa, Staphylococcus aureus
LVLIVPFIKPFITFIPRYG

SEQ ID NO: 1593042 - protein, 19 aa, Staphylococcus aureus
LVSEILYYLYTRIKQLYGK

SEQ ID NO: 1593043 - protein, 20 aa, Staphylococcus aureus
LVVPFMLMWMTKSKRNKAIG

SEQ ID NO: 1593044 - protein, 25 aa, Staphylococcus aureus
MGGLSFVLLLIQQWLFLNPNHNLNQ

SEQ ID NO: 1593045 - protein, 24 aa, Staphylococcus aureus
MKSPFYSHLITLTNHYPFTLDEKD

SEQ ID NO: 1593046 - protein, 21 aa, Staphylococcus aureus
MTGIWVGIIIIVIAAIILGNL

SEQ ID NO: 1593047 - protein, 17 aa, Staphylococcus aureus
MTTVLLLKRNTPVIAVD

SEQ ID NO: 1593048 - protein, 25 aa, Staphylococcus aureus
MYGLYAITNFIWTISLYLSNATGYL

SEQ ID NO: 1593049 - protein, 25 aa, Staphylococcus aureus
MYGYSMLLLFLIAACIFLIVLFILY

SEQ ID NO: 1593050 - protein, 17 aa, Staphylococcus aureus
NAESIIAGLNNPTINKG

SEQ ID NO: 1593051 - protein, 23 aa, Staphylococcus aureus
NDYALMVVIPKKGPNAESTNDLV

SEQ ID NO: 1593052 - protein, 23 aa, Staphylococcus aureus
NEHSPLLFAKRRKDKEEDVETTT

SEQ ID NO: 1593053 - protein, 21 aa, Staphylococcus aureus
NFLVNFIVYLCMYLLLVVIAG

SEQ ID NO: 1593054 - protein, 24 aa, Staphylococcus aureus
NIVHQKWISIPSRFILNIVRTIPD

SEQ ID NO: 1593055 - protein, 24 aa, Staphylococcus aureus
NKGLLDPYVILKLPKDSESLAIDI

SEQ ID NO: 1593056 - protein, 50 aa, Staphylococcus aureus
NKHTYQNEPLPNRKDFVVSFITGALVGSALGLYFKNKVYQKADDLKVKEQ

SEQ ID NO: 1593057 - protein, 24 aa, Staphylococcus aureus
NKQQSFANCKQLRQVYPNGVTADH

SEQ ID NO: 1593058 - protein, 27 aa, Staphylococcus aureus
NLVAMFIPLFFIYKYHQPMFGRLSSQP

SEQ ID NO: 1593059 - protein, 24 aa, Staphylococcus aureus
NNVKDLMMLLPFTLLSILIVIFIF

SEQ ID NO: 1593060 - protein, 21 aa, Staphylococcus aureus
NQIPIFIVMGLYICMYAIFAM

SEQ ID NO: 1593061 - protein, 32 aa, Staphylococcus aureus
NQQIKINNVLSSSSIKLFKADNTPLTITNTTY

SEQ ID NO: 1593062 - protein, 23 aa, Staphylococcus aureus
NRDYSIFGWNNENVVRYGGGSAD

SEQ ID NO: 1593063 - protein, 24 aa, Staphylococcus aureus
NSILLKSILSLGIIYGGTFGIYPK

SEQ ID NO: 1593064 - protein, 21 aa, Staphylococcus aureus
NTMILALIIIIATFSNTANAA

SEQ ID NO: 1593065 - protein, 24 aa, Staphylococcus aureus
NTTGADGWGFLFSKGNAEEYLTNG

SEQ ID NO: 1593066 - protein, 20 aa, Staphylococcus aureus
NTYRQTIYVNPSGDNVIAPV

SEQ ID NO: 1593067 - protein, 21 aa, Staphylococcus aureus
NVLFGEFFGWVAGWALLAEYF

SEQ ID NO: 1593068 - protein, 36 aa, Staphylococcus aureus
NYTGNLDLFILRLVLLSCLFILTISVINLWTFLMLL

SEQ ID NO: 1593069 - protein, 24 aa, Staphylococcus aureus
PFDFVAMFITLIIIAVLMGMLLIF

SEQ ID NO: 1593070 - protein, 44 aa, Staphylococcus aureus
PIGVKLKLAKVIIILCVVAFFIFPVIIMFLLAPDLNKGKDDAGC

SEQ ID NO: 1593071 - protein, 18 aa, Staphylococcus aureus
PLALSFFSGKRLVPIMTA

SEQ ID NO: 1593072 - protein, 23 aa, Staphylococcus aureus
PLSYIDNMFFNYLNAEHPIGLAL

SEQ ID NO: 1593073 - protein, 28 aa, Staphylococcus aureus
PMALVLTIFMLIIAYVLILFQSALFLKR

SEQ ID NO: 1593074 - protein, 34 aa, Staphylococcus aureus
PNHKKQYILFAAGIVLATILLISAHLYSRKRGNQ

SEQ ID NO: 1593075 - protein, 24 aa, Staphylococcus aureus
PSTFLGILPVGMYLISINQLNYAE

SEQ ID NO: 1593076 - protein, 21 aa, Staphylococcus aureus
PTIVIHYDIRHLSTEFAQIIA

SEQ ID NO: 1593077 - protein, 32 aa, Staphylococcus aureus
PTSIQLAVVGFGLFAAVLGPLVFMFGLFISVM

SEQ ID NO: 1593078 - protein, 23 aa, Staphylococcus aureus
PVCIIAILYVLLSPTHPLALIVG

SEQ ID NO: 1593079 - protein, 17 aa, Staphylococcus aureus
QALIPVIAGLVPAIMAV

SEQ ID NO: 1593080 - protein, 17 aa, Staphylococcus aureus
QENIDPATGKDYSIFGW

SEQ ID NO: 1593081 - protein, 17 aa, Staphylococcus aureus
QFHPIFEELLHAFDTRP

SEQ ID NO: 1593082 - protein, 17 aa, Staphylococcus aureus
QIVAYLQGLWNGIIAIA

SEQ ID NO: 1593083 - protein, 37 aa, Staphylococcus aureus
QNIMSHKIWLLVLVSTLIPLIPFYKISNFTFSKDMMN

SEQ ID NO: 1593084 - protein, 32 aa, Staphylococcus aureus
QQGIVLYYIVAIVIAFLLLNLPYVHKPGVEVN

SEQ ID NO: 1593085 - protein, 20 aa, Staphylococcus aureus
QSFESQITQAPLVTDVTTIN

SEQ ID NO: 1593086 - protein, 24 aa, Staphylococcus aureus
QVKGLMIASIQALIPVIAGLVPAI

SEQ ID NO: 1593087 - protein, 21 aa, Staphylococcus aureus
QYSFIFIGITIFLSILTFVIS

SEQ ID NO: 1593088 - protein, 23 aa, Staphylococcus aureus
RAKLMFVFLFIILIFFCHSPLTY

SEQ ID NO: 1593089 - protein, 23 aa, Staphylococcus aureus
RLKNNPKAFFKEEKSKFTEYDNK

SEQ ID NO: 1593090 - protein, 17 aa, Staphylococcus aureus
RYYPFDFVAMFITLIII

SEQ ID NO: 1593091 - protein, 24 aa, Staphylococcus aureus
SDGLTWLYEFGGAIGGLIFGLLYA

SEQ ID NO: 1593092 - protein, 21 aa, Staphylococcus aureus
SGFIFFFIVYVLCISYFNSDK

SEQ ID NO: 1593093 - protein, 23 aa, Staphylococcus aureus
SGKSYFILTLIESLLHTNAKLYI

SEQ ID NO: 1593094 - protein, 21 aa, Staphylococcus aureus
SLAIDILTFLTGISSRDSEKF

SEQ ID NO: 1593095 - protein, 41 aa, Staphylococcus aureus
SNMSNAVTILPDDIPPTINNPVGINAKYYRGDEVNFTMGVS

SEQ ID NO: 1593096 - protein, 30 aa, Staphylococcus aureus
SSSGFYVGFLLLFILIVGIYVAYTGLVKRE

SEQ ID NO: 1593097 - protein, 20 aa, Staphylococcus aureus
SWITLLCVGVILLLLGTLGN

SEQ ID NO: 1593098 - protein, 23 aa, Staphylococcus aureus
TASILVGTTLIFGIGSQEAKAAE

SEQ ID NO: 1593099 - protein, 28 aa, Staphylococcus aureus
TELNTAMTALKRAIADKADTKASGNYVN

SEQ ID NO: 1593100 - protein, 25 aa, Staphylococcus aureus
TELNTAMTALKRAIADKAETKASGN

SEQ ID NO: 1593101 - protein, 24 aa, Staphylococcus aureus
TFDHKYLVKYLGPYNFTVYDGVKT

SEQ ID NO: 1593102 - protein, 31 aa, Staphylococcus aureus
TFFKFFIGILLLNLVIILFKTPVGYLISFNT

SEQ ID NO: 1593103 - protein, 24 aa, Staphylococcus aureus
TFGILFQLPILFIGLAKFGLIDIT

SEQ ID NO: 1593104 - protein, 17 aa, Staphylococcus aureus
TFSFVGPITRQLGYWLS

SEQ ID NO: 1593105 - protein, 39 aa, Staphylococcus aureus
TIVVALAVYLFRFVWVYVLYPYFYLAISPFQKMMTKNDD

SEQ ID NO: 1593106 - protein, 25 aa, Staphylococcus aureus
TKTGPIIELGLKTASTWKKFEVYEG

SEQ ID NO: 1593107 - protein, 25 aa, Staphylococcus aureus
TKYAIDLLFIICVILGILGLIISLF

SEQ ID NO: 1593108 - protein, 27 aa, Staphylococcus aureus
TLDDTKHLPLLFAKRRRKEDEEDVTVE

SEQ ID NO: 1593109 - protein, 22 aa, Staphylococcus aureus
TLILLMLVVTLFFLNNSRYFNP

SEQ ID NO: 1593110 - protein, 25 aa, Staphylococcus aureus
TLITFFIRLTLQFKIILIVILSKIT

SEQ ID NO: 1593111 - protein, 20 aa, Staphylococcus aureus
TLSLFLFKMFDSASLIILTS

SEQ ID NO: 1593112 - protein, 17 aa, Staphylococcus aureus
TNAVSRAEAILNKTQGA

SEQ ID NO: 1593113 - protein, 45 aa, Staphylococcus aureus
TNNIKMRKMVPWAIVFFILILIIILFFLLRNFNSPEAQTKILVNA

SEQ ID NO: 1593114 - protein, 26 aa, Staphylococcus aureus
TNVYNFIMIVWNQIVAYLQGLWNGII

SEQ ID NO: 1593115 - protein, 32 aa, Staphylococcus aureus
TPQQVEAALNNGIARILAVQIVTSDHSKPSSN

SEQ ID NO: 1593116 - protein, 24 aa, Staphylococcus aureus
TRLSIPTIYAFKKSLDALPNKKTT

SEQ ID NO: 1593117 - protein, 29 aa, Staphylococcus aureus
TTLLNFFHGWPWYAVWLVMLGFGGGMIIP

SEQ ID NO: 1593118 - protein, 23 aa, Staphylococcus aureus
TTSVIVGATILFGIGNHQAQASE

SEQ ID NO: 1593119 - protein, 19 aa, Staphylococcus aureus
TVEPATVIFTKTGPIIELG

SEQ ID NO: 1593120 - protein, 32 aa, Staphylococcus aureus
TVGNQTIEVGKTMNPIVLTTTDNGTGTVTNTV

SEQ ID NO: 1593121 - protein, 22 aa, Staphylococcus aureus
TVKVYEYLGKKDELPQSVYANT

SEQ ID NO: 1593122 - protein, 22 aa, Staphylococcus aureus
TVPMFLLFVYLPNYNFITIFIN

SEQ ID NO: 1593123 - protein, 23 aa, Staphylococcus aureus
TVVALLIILTFAKLAQFANDVIL

SEQ ID NO: 1593124 - protein, 35 aa, Staphylococcus aureus
VANYTPFIDWLGYIFYPFIYIFPIADQALLAKASA

SEQ ID NO: 1593125 - protein, 22 aa, Staphylococcus aureus
VAQVLLPLLTKPAPKTVIGNMS

SEQ ID NO: 1593126 - protein, 25 aa, Staphylococcus aureus
VFKQWLQYILLVTTIVIALVLIGIG

SEQ ID NO: 1593127 - protein, 51 aa, Staphylococcus aureus
VGVIITLVGAFRFLIAPILAVMDFLGPLAARLVALVTKFGWAKTGTLVLSK

SEQ ID NO: 1593128 - protein, 34 aa, Staphylococcus aureus
VIIGLIFVAIYFFLFRFLILKFDIPLPGRKKTEE

SEQ ID NO: 1593129 - protein, 17 aa, Staphylococcus aureus
VKFETPTGYLPTKVNGT

SEQ ID NO: 1593130 - protein, 23 aa, Staphylococcus aureus
VLNGDLFRFYKNPDFKKVNPSKY

SEQ ID NO: 1593131 - protein, 34 aa, Staphylococcus aureus
VQLDTFFYQLHTPYFWSSILTALFVCGLISWLYY

SEQ ID NO: 1593132 - protein, 28 aa, Staphylococcus aureus
VTAEMMRIYKDVDTFVVISHLGIDPSTQ

SEQ ID NO: 1593133 - protein, 17 aa, Staphylococcus aureus
VVHALLTGLSLFIVATF

SEQ ID NO: 1593134 - protein, 32 aa, Staphylococcus aureus
VVSFCFIFLLLVFFKYILKRYFNYSLNYKVWY

SEQ ID NO: 1593135 - protein, 17 aa, Staphylococcus aureus
VVVFILSASFIAYAPDY

SEQ ID NO: 1593136 - protein, 18 aa, Staphylococcus aureus
VVVNPLFAKPNALAGIFG

SEQ ID NO: 1593137 - protein, 17 aa, Staphylococcus aureus
VWIAWIKPLAHINEIFG

SEQ ID NO: 1593138 - protein, 18 aa, Staphylococcus aureus
WAVFKLLYQNKGRFSINA

SEQ ID NO: 1593139 - protein, 20 aa, Staphylococcus aureus
WGITVIVIYGIGYYASMKIE

SEQ ID NO: 1593140 - protein, 24 aa, Staphylococcus aureus
YDSATNSIIGTPTKIGQSTVTVVS

SEQ ID NO: 1593141 - protein, 18 aa, Staphylococcus aureus
YIVSSIVGYLLFGTGLGL

SEQ ID NO: 1593142 - protein, 24 aa, Staphylococcus aureus
YKRPVIIFIVPGIIPLVPGGAAYQ

SEQ ID NO: 1593143 - protein, 19 aa, Staphylococcus aureus
YLGVIPFLQDLITDGIIAG

SEQ ID NO: 1593144 - protein, 18 aa, Staphylococcus aureus
YLIPNLPNGDYRVEFSNL

SEQ ID NO: 1593145 - protein, 19 aa, Staphylococcus aureus
YLSSFLFGIALLGVVFHNI

SEQ ID NO: 1593146 - protein, 18 aa, Staphylococcus aureus
YMGLFGAILFIIIVGATT

SEQ ID NO: 1593147 - protein, 43 aa, Staphylococcus aureus
YNNDITEMHWTLWKYLILTCLVVLICLYFASRSFKRTLIRPIQ

SEQ ID NO: 1593148 - protein, 18 aa, Staphylococcus aureus
YRVPEGYTLNKGYDVNTN

SEQ ID NO: 1593149 - protein, 18 aa, Staphylococcus aureus
YTLGVLFIFLFLLGYFLP

SEQ ID NO: 1593150 - protein, 19 aa, Staphylococcus aureus
YTNAVAHAEGILSKANGSN

SEQ ID NO: 1593151 - protein, 26 aa, Staphylococcus aureus
YTTMELLSVAMLIVISTFALDFIHSD

SEQ ID NO: 1593152 - protein, 19 aa, Staphylococcus aureus
YVLLSPTHPLALIVGIILL

SEQ ID NO: 1593153 - protein, 17 aa, Staphylococcus aureus
YVTLLLDFNKIVRALGV

SEQ ID NO: 1593154 - protein, 18 aa, Staphylococcus aureus
YYNQVVYVNPMDKDLKGA

SEQ ID NO: 1593155 - protein, 23 aa, Staphylococcus aureus
AAIVFLIYQPLKRLNLPLFVIKG

SEQ ID NO: 1593156 - protein, 18 aa, Staphylococcus aureus
AETLLIVLTIILIIILTT

SEQ ID NO: 1593157 - protein, 22 aa, Staphylococcus aureus
AFCVGFLMYSIFKVIFKNANLT

SEQ ID NO: 1593158 - protein, 21 aa, Staphylococcus aureus
AFEILAFRIIFSAIFMIFILA

SEQ ID NO: 1593159 - protein, 27 aa, Staphylococcus aureus
AGAGANKPLQQMWEYGVNDPHRSHDFK

SEQ ID NO: 1593160 - protein, 25 aa, Staphylococcus aureus
AGGTRIRPILMTAIATIGALVPLLF

SEQ ID NO: 1593161 - protein, 22 aa, Staphylococcus aureus
AIAIIIKLFAFGGIFYISLIVP

SEQ ID NO: 1593162 - protein, 22 aa, Staphylococcus aureus
AIFFVVFLGILFFYLNLNRRLA

SEQ ID NO: 1593163 - protein, 17 aa, Staphylococcus aureus
AIILLYALGSILAVYCI

SEQ ID NO: 1593164 - protein, 27 aa, Staphylococcus aureus
AIIYIGMVLVILLFNLDQIVPMIGTII

SEQ ID NO: 1593165 - protein, 36 aa, Staphylococcus aureus
AIVIVIFALFGLMFYLYHLPLEAYLLALGVILLLLL

SEQ ID NO: 1593166 - protein, 19 aa, Staphylococcus aureus
ALAATLFKKGVKRRNKQHQ

SEQ ID NO: 1593167 - protein, 29 aa, Staphylococcus aureus
ALIVTLIIIIAIVSMIFFVQTKYGDQSEK

SEQ ID NO: 1593168 - protein, 25 aa, Staphylococcus aureus
ALPLKKTLFLTPLLQCLLLSLIASL

SEQ ID NO: 1593169 - protein, 27 aa, Staphylococcus aureus
ALTLPILNFIIPFVLVFIVDGMKGIKE

SEQ ID NO: 1593170 - protein, 21 aa, Staphylococcus aureus
ANLTSQIERGTTVAGVQGIQA

SEQ ID NO: 1593171 - protein, 29 aa, Staphylococcus aureus
ANYTPFIDWLGYIFYPFIYIFPIADQAVL

SEQ ID NO: 1593172 - protein, 17 aa, Staphylococcus aureus
AQAKQDAIANLDTLRDL

SEQ ID NO: 1593173 - protein, 17 aa, Staphylococcus aureus
AQAKQEALANLDTLRDL

SEQ ID NO: 1593174 - protein, 32 aa, Staphylococcus aureus
AQTKDQLNQGLNLGLDDIRNTHVWEVDAQPAV

SEQ ID NO: 1593175 - protein, 24 aa, Staphylococcus aureus
AQTLNTAMKGLRDSIANEATIKAE

SEQ ID NO: 1593176 - protein, 24 aa, Staphylococcus aureus
AQTLNTAMKGLRDSIANEATIKAG

SEQ ID NO: 1593177 - protein, 31 aa, Staphylococcus aureus
ATELNTAMGQLQHAIADKTTTLASSKFVNAD

SEQ ID NO: 1593178 - protein, 21 aa, Staphylococcus aureus
ATPEQILVNGELIVHRDDIIT

SEQ ID NO: 1593179 - protein, 20 aa, Staphylococcus aureus
ATVYAIRMVGIALGLIPVMT

SEQ ID NO: 1593180 - protein, 28 aa, Staphylococcus aureus
AVTNTVTGLPSGLTFDSTNNTISGTPTN

SEQ ID NO: 1593181 - protein, 20 aa, Staphylococcus aureus
AYSQAVNAAATILNKTSGGN

SEQ ID NO: 1593182 - protein, 18 aa, Staphylococcus aureus
AYTQILLLISYFNKIHEI

SEQ ID NO: 1593183 - protein, 18 aa, Staphylococcus aureus
AYYYGLLMALFSIGLIVG

SEQ ID NO: 1593184 - protein, 18 aa, Staphylococcus aureus
CHWNNSHFILLKKVKRNN

SEQ ID NO: 1593185 - protein, 18 aa, Staphylococcus aureus
DANWSAMNKPNVAKVVNA

SEQ ID NO: 1593186 - protein, 20 aa, Staphylococcus aureus
DDRIPINVWTGDSIARTGKG

SEQ ID NO: 1593187 - protein, 27 aa, Staphylococcus aureus
DEMFDNKITYNYSSPIAGIDKPNGANI

SEQ ID NO: 1593188 - protein, 35 aa, Staphylococcus aureus
DENGKYRFDNLDSGKYKVIFEKPAGLTQTVTNTTE

SEQ ID NO: 1593189 - protein, 36 aa, Staphylococcus aureus
DFKIRNRSGQVIYDWPTVHIYSLEDLSRASDYFSEA

SEQ ID NO: 1593190 - protein, 19 aa, Staphylococcus aureus
DGLPNLTQLQKDNLKHQVE

SEQ ID NO: 1593191 - protein, 35 aa, Staphylococcus aureus
DIDELYNGWFSINLFLPFAIAIQYYTIDKLISAYK

SEQ ID NO: 1593192 - protein, 17 aa, Staphylococcus aureus
DILTTQKLPSLMKYGFS

SEQ ID NO: 1593193 - protein, 22 aa, Staphylococcus aureus
DISTDKIDRIRNSTIGTAEERQ

SEQ ID NO: 1593194 - protein, 23 aa, Staphylococcus aureus
DKDYAYIRFPVSNGTREVKIVSS

SEQ ID NO: 1593195 - protein, 18 aa, Staphylococcus aureus
DKEYIARRLANLIHVEHL

SEQ ID NO: 1593196 - protein, 18 aa, Staphylococcus aureus
DLILSLIIIIIPLLAITS

SEQ ID NO: 1593197 - protein, 17 aa, Staphylococcus aureus
DLNDAMETLKHLVDNEI

SEQ ID NO: 1593198 - protein, 20 aa, Staphylococcus aureus
DNEHSPVLIAKRLKDKDGNV

SEQ ID NO: 1593199 - protein, 41 aa, Staphylococcus aureus
DPASTGDLALRSTFYGYDSNFIWRSMSWDNEVAFNNGSGSG

SEQ ID NO: 1593200 - protein, 28 aa, Staphylococcus aureus
DQITTPYIVVVNGHIDPASTGDLALRST

SEQ ID NO: 1593201 - protein, 26 aa, Staphylococcus aureus
DQITTPYIVVVNGHIDPNSKGDLALR

SEQ ID NO: 1593202 - protein, 18 aa, Staphylococcus aureus
DQTLGLFQYPKTATIILF

SEQ ID NO: 1593203 - protein, 18 aa, Staphylococcus aureus
DRINQILQQGHNDINNAM

SEQ ID NO: 1593204 - protein, 56 aa, Staphylococcus aureus
DSLANEKTRVRLYKSGKNWVKSGIKEIEMFKIMGLPFISHSLVSQDNQSISKKMTG

SEQ ID NO: 1593205 - protein, 37 aa, Staphylococcus aureus
DSLTAKVEVTLLDGSKVIVNVPVKVVEKELSVVKQQA

SEQ ID NO: 1593206 - protein, 25 aa, Staphylococcus aureus
DVTSTLVFFILAIVSLIESTGVYHA

SEQ ID NO: 1593207 - protein, 51 aa, Staphylococcus aureus
DWRGVWDAIVMILKGVVQLIWNLIQLWFVGKILGVVRYFGGLLKGLIAGIW

SEQ ID NO: 1593208 - protein, 18 aa, Staphylococcus aureus
DYFDFTLSNNVNTHGVST

SEQ ID NO: 1593209 - protein, 19 aa, Staphylococcus aureus
DYHYFFFSDGFFITISILT

SEQ ID NO: 1593210 - protein, 17 aa, Staphylococcus aureus
DYKNIVLAGKYNSRMTS

SEQ ID NO: 1593211 - protein, 29 aa, Staphylococcus aureus
DYLGYILVALFLITWLISSLIWKFGRIGH

SEQ ID NO: 1593212 - protein, 20 aa, Staphylococcus aureus
EAIAKLNQLKEQAIQAIQRA

SEQ ID NO: 1593213 - protein, 21 aa, Staphylococcus aureus
EAISRIKDFSNEKINSIRNSE

SEQ ID NO: 1593214 - protein, 24 aa, Staphylococcus aureus
EALANLDTLRDLNQPQRDALRNQI

SEQ ID NO: 1593215 - protein, 19 aa, Staphylococcus aureus
EALTTWLKGMQGANIIILA

SEQ ID NO: 1593216 - protein, 26 aa, Staphylococcus aureus
EANGILFFLIPFFASGIFNTQFTLFN

SEQ ID NO: 1593217 - protein, 17 aa, Staphylococcus aureus
EATLFHYLFSENQYKDN

SEQ ID NO: 1593218 - protein, 22 aa, Staphylococcus aureus
EATPEQILVNGELIVHRDDIIT

SEQ ID NO: 1593219 - protein, 20 aa, Staphylococcus aureus
ENALNGDANLQRAKTEATQA

SEQ ID NO: 1593220 - protein, 28 aa, Staphylococcus aureus
ENFTDKGWQITGIPRTLHIENSTNRTNN

SEQ ID NO: 1593221 - protein, 23 aa, Staphylococcus aureus
EQSQQPKPYFATGANQANTSKDK

SEQ ID NO: 1593222 - protein, 27 aa, Staphylococcus aureus
ERLTQAINQLVPLADNSALKTAKTKLD

SEQ ID NO: 1593223 - protein, 19 aa, Staphylococcus aureus
ESLNTAMGNLINAIADHQA

SEQ ID NO: 1593224 - protein, 17 aa, Staphylococcus aureus
ETAIVIVIFALFGLMFY

SEQ ID NO: 1593225 - protein, 38 aa, Staphylococcus aureus
ETIQSPITFWYGKYIILIPSSYFKSVIDKRLKYIILHE

SEQ ID NO: 1593226 - protein, 39 aa, Staphylococcus aureus
ETIQSPITFWYGKYIILIPSSYFKSVIDKRLKYIILHEY

SEQ ID NO: 1593227 - protein, 28 aa, Staphylococcus aureus
ETLDDTKHLPLLFAKRRRKEDEEDVTVE

SEQ ID NO: 1593228 - protein, 27 aa, Staphylococcus aureus
EVKYLTGFILILLLEGIFTNSASAIEY

SEQ ID NO: 1593229 - protein, 32 aa, Staphylococcus aureus
EYMKFWFPELPTWIPGIIAILLLMAANLFSVK

SEQ ID NO: 1593230 - protein, 21 aa, Staphylococcus aureus
FCHSPLTYLWVFALILFFMRL

SEQ ID NO: 1593231 - protein, 17 aa, Staphylococcus aureus
FCIATIMVSWLWFFLLA

SEQ ID NO: 1593232 - protein, 27 aa, Staphylococcus aureus
FDFIVIIIVALIFYYIGTTSSFESVYF

SEQ ID NO: 1593233 - protein, 23 aa, Staphylococcus aureus
FDKKNTNFLTRALKHTRWNAYSF

SEQ ID NO: 1593234 - protein, 19 aa, Staphylococcus aureus
FESLTTWLKSMQGANIIIL

SEQ ID NO: 1593235 - protein, 29 aa, Staphylococcus aureus
FGDGLINIFTQLMPLFKFVSQGLQNMSIA

SEQ ID NO: 1593236 - protein, 23 aa, Staphylococcus aureus
FGILFQLPILFMGLAKFGLIDTY

SEQ ID NO: 1593237 - protein, 29 aa, Staphylococcus aureus
FHNIHLKIIYWLILTSIFFIANILIIHIA

SEQ ID NO: 1593238 - protein, 19 aa, Staphylococcus aureus
FIGQGDASYTISFKTQGPT

SEQ ID NO: 1593239 - protein, 18 aa, Staphylococcus aureus
FIGYLHFFLKKEKQDKFL

SEQ ID NO: 1593240 - protein, 17 aa, Staphylococcus aureus
FILITIGALIYLVSMIF

SEQ ID NO: 1593241 - protein, 19 aa, Staphylococcus aureus
FIVIIFLILAQIFYFYIII

SEQ ID NO: 1593242 - protein, 41 aa, Staphylococcus aureus
FLMFVRRFIVLLFVFACITTLLWLISYSLLLKLNIPLTLKG

SEQ ID NO: 1593243 - protein, 23 aa, Staphylococcus aureus
FLTFPIMFIFAIAIVIDSPGNPI

SEQ ID NO: 1593244 - protein, 17 aa, Staphylococcus aureus
FLTMRTILTLKGYRYIA

SEQ ID NO: 1593245 - protein, 26 aa, Staphylococcus aureus
FLVSKIILLFLWIQTLSVIAWLLTLM

SEQ ID NO: 1593246 - protein, 18 aa, Staphylococcus aureus
FLVVILHNVLGYTIGYWL

SEQ ID NO: 1593247 - protein, 20 aa, Staphylococcus aureus
FNKFEWLAILFAFIGVLYMT

SEQ ID NO: 1593248 - protein, 24 aa, Staphylococcus aureus
FNTSPYMIIIFITAILLVSLQIIY

SEQ ID NO: 1593249 - protein, 35 aa, Staphylococcus aureus
FQLYVKLSCSTMLATSIILTNILPYDAQAASEKDT

SEQ ID NO: 1593250 - protein, 21 aa, Staphylococcus aureus
FSILPILMIIYGIVAKMIAVW

SEQ ID NO: 1593251 - protein, 23 aa, Staphylococcus aureus
FSLLLIIAIFIYNAFSYLLKSRR

SEQ ID NO: 1593252 - protein, 18 aa, Staphylococcus aureus
FSNFIQFIQPFIDSVKNV

SEQ ID NO: 1593253 - protein, 21 aa, Staphylococcus aureus
FTLEVLRLPRITLAILAGGAL

SEQ ID NO: 1593254 - protein, 17 aa, Staphylococcus aureus
FWDIFVSKLLLSLTVFA

SEQ ID NO: 1593255 - protein, 18 aa, Staphylococcus aureus
GAPWNIVLFSIGMYIVVF

SEQ ID NO: 1593256 - protein, 28 aa, Staphylococcus aureus
GDSFELRLPSIFSALLLGAMYLNRNDFT

SEQ ID NO: 1593257 - protein, 18 aa, Staphylococcus aureus
GEKIPQGHKDIFDPNLPT

SEQ ID NO: 1593258 - protein, 17 aa, Staphylococcus aureus
GFDIFIVGILSLFGIFA

SEQ ID NO: 1593259 - protein, 22 aa, Staphylococcus aureus
GFSWFAFLLIIQASTIISMEFH

SEQ ID NO: 1593260 - protein, 50 aa, Staphylococcus aureus
GIALAIVILIIFALLFRFIVRLIPIFYIFRVLSIFIFIMGFKMLGVSIQK

SEQ ID NO: 1593261 - protein, 22 aa, Staphylococcus aureus
GIALIMLFILIKLFMEVHEVFT

SEQ ID NO: 1593262 - protein, 26 aa, Staphylococcus aureus
GIASVTLGTLLISGGVTPAANAAQHD

SEQ ID NO: 1593263 - protein, 17 aa, Staphylococcus aureus
GIFLQIFFKLPLIVTAV

SEQ ID NO: 1593264 - protein, 25 aa, Staphylococcus aureus
GIKNTTITTLPNGWTSNLTKADKNN

SEQ ID NO: 1593265 - protein, 18 aa, Staphylococcus aureus
GIRMFKRYAVITTSAKIL

SEQ ID NO: 1593266 - protein, 23 aa, Staphylococcus aureus
GKSTLINLIPRFYDVTSGQILID

SEQ ID NO: 1593267 - protein, 74 aa, Staphylococcus aureus
GLIVGLIAMNKFHVLAGYRAKFILMVILTMMVFVLINTYLLRQVKSIGMFLMIAALGLYFVAMNNLKAAGQGVT

SEQ ID NO: 1593268 - protein, 24 aa, Staphylococcus aureus
GLSKFNIIYILMLEQLLIFIITAI

SEQ ID NO: 1593269 - protein, 21 aa, Staphylococcus aureus
GLTWLYEFGGAIGGLIFGLLY

SEQ ID NO: 1593270 - protein, 26 aa, Staphylococcus aureus
GLVNIFTQLMPLFKFVSQGLQNMSIA

SEQ ID NO: 1593271 - protein, 30 aa, Staphylococcus aureus
GNSETLVPVNLTVLPEIQHNIKFFKNDDTQ

SEQ ID NO: 1593272 - protein, 30 aa, Staphylococcus aureus
GPLVVYWNWAWGITVIVIYGIGFYASMKID

SEQ ID NO: 1593273 - protein, 27 aa, Staphylococcus aureus
GSFYITAFYRFVLVMIGVISSSLVNFV

SEQ ID NO: 1593274 - protein, 19 aa, Staphylococcus aureus
GSKVIVNVPVKVVEKELSV

SEQ ID NO: 1593275 - protein, 28 aa, Staphylococcus aureus
GSNNWSFVLTWLPIEIKLTLTTTFIALF

SEQ ID NO: 1593276 - protein, 27 aa, Staphylococcus aureus
GVASVAISTLLLLMSNGEAKAAEETGV

SEQ ID NO: 1593277 - protein, 38 aa, Staphylococcus aureus
GVIKDADNWTLDSGFYKTPKYSLGDYVWYDSNKDGKQD

SEQ ID NO: 1593278 - protein, 26 aa, Staphylococcus aureus
GVLFIFLFLLGYFLPIGIDKVKSLSY

SEQ ID NO: 1593279 - protein, 22 aa, Staphylococcus aureus
GYLIEIFPKKLLVLIYQATMVI

SEQ ID NO: 1593280 - protein, 20 aa, Staphylococcus aureus
GYPVGTYINASSKGAPYNLP

SEQ ID NO: 1593281 - protein, 24 aa, Staphylococcus aureus
HAGWLHYFVGMTISFIIAITVTLI

SEQ ID NO: 1593282 - protein, 34 aa, Staphylococcus aureus
HGNGGDGIGFAFSPGVLGETGLNGAAVGIGGLSN

SEQ ID NO: 1593283 - protein, 25 aa, Staphylococcus aureus
HIAAIVFLIYKPLKRLNLPLFVIKG

SEQ ID NO: 1593284 - protein, 17 aa, Staphylococcus aureus
HYVILFLALLTIIFGCV

SEQ ID NO: 1593285 - protein, 19 aa, Staphylococcus aureus
IASIIFFISTPYRSLPKIE

SEQ ID NO: 1593286 - protein, 17 aa, Staphylococcus aureus
ICFPDIFGTSYLSRGYL

SEQ ID NO: 1593287 - protein, 19 aa, Staphylococcus aureus
IGILIFYVRLIKKSSLNIY

SEQ ID NO: 1593288 - protein, 25 aa, Staphylococcus aureus
IGVFIGILVYLWKTNENFRKTITEA

SEQ ID NO: 1593289 - protein, 18 aa, Staphylococcus aureus
IIAGLNNPTINKGNVSSA

SEQ ID NO: 1593290 - protein, 18 aa, Staphylococcus aureus
IIAGLNNPTINKGNVTSA

SEQ ID NO: 1593291 - protein, 31 aa, Staphylococcus aureus
IIAHYIHWSYLLILPMITIVTIPFLIKVMVP

SEQ ID NO: 1593292 - protein, 26 aa, Staphylococcus aureus
IIGHICLSLPFALIGLFTSMFFIIIG

SEQ ID NO: 1593293 - protein, 17 aa, Staphylococcus aureus
IILALIIGAMIAFDMGG

SEQ ID NO: 1593294 - protein, 22 aa, Staphylococcus aureus
IIQYLLQIAYIKYLEKYFKDLM

SEQ ID NO: 1593295 - protein, 23 aa, Staphylococcus aureus
IITSWITWVFIGILGLYLILRKR

SEQ ID NO: 1593296 - protein, 27 aa, Staphylococcus aureus
IIVGIVLAILLIFLKELLDKRIKTEED

SEQ ID NO: 1593297 - protein, 26 aa, Staphylococcus aureus
IKEPKLLIIIPILIVAFIISKLIPVM

SEQ ID NO: 1593298 - protein, 31 aa, Staphylococcus aureus
IKETLDDTKHLPLLFAKRRRKEDEEDVTVEE

SEQ ID NO: 1593299 - protein, 17 aa, Staphylococcus aureus
ILTYVASTGKMRAEYAG

SEQ ID NO: 1593300 - protein, 18 aa, Staphylococcus aureus
IMIFAIGGVPPFSGFPGK

SEQ ID NO: 1593301 - protein, 25 aa, Staphylococcus aureus
IMVSWLWFFLLAILGKVLGSIDRTG

SEQ ID NO: 1593302 - protein, 21 aa, Staphylococcus aureus
INNLITPIWILCLVGIMTHMI

SEQ ID NO: 1593303 - protein, 26 aa, Staphylococcus aureus
INQLNYAEFFLCIVLSLGVVAPIKNF

SEQ ID NO: 1593304 - protein, 19 aa, Staphylococcus aureus
IPALEYYALYLGVIGAFIG

SEQ ID NO: 1593305 - protein, 19 aa, Staphylococcus aureus
IPTMFFFGGLIIGIVPYLL

SEQ ID NO: 1593306 - protein, 23 aa, Staphylococcus aureus
IRNKWRDFFNKPLIDHLMSFEHS

SEQ ID NO: 1593307 - protein, 23 aa, Staphylococcus aureus
ISKFMMKIFDLPLSFFINRSTGD

SEQ ID NO: 1593308 - protein, 26 aa, Staphylococcus aureus
ITEFVMLFPFLIFAIVLNAALGDKIK

SEQ ID NO: 1593309 - protein, 19 aa, Staphylococcus aureus
IVDSIHIPMIMSALKEIEK

SEQ ID NO: 1593310 - protein, 18 aa, Staphylococcus aureus
IVGLIFLMYMAWTIWHDK

SEQ ID NO: 1593311 - protein, 33 aa, Staphylococcus aureus
IVHRDDIITEQDILAHINLIDQLSAEVIDTPST

SEQ ID NO: 1593312 - protein, 17 aa, Staphylococcus aureus
IVVSFMTFLLTYITNEN

SEQ ID NO: 1593313 - protein, 31 aa, Staphylococcus aureus
IYHSFLLKKWYLIIYLLFILAALVITLTTIQ

SEQ ID NO: 1593314 - protein, 38 aa, Staphylococcus aureus
KALHWQKWHAMIGIIIAIPVFVLVLTGLPWSGFMGSKI

SEQ ID NO: 1593315 - protein, 41 aa, Staphylococcus aureus
KAMAPIMPIIIIPIISSVIVGLIFIFLIGAPISSIFEALTT

SEQ ID NO: 1593316 - protein, 41 aa, Staphylococcus aureus
KAMAPIMPIIIIPIISSVVVGLIFIFLIGAPISNIFESLTT

SEQ ID NO: 1593317 - protein, 25 aa, Staphylococcus aureus
KAQALDHAMELLRNSVADNQATLAS

SEQ ID NO: 1593318 - protein, 25 aa, Staphylococcus aureus
KAQTLDHAMELLRNSVADNQTTLAS

SEQ ID NO: 1593319 - protein, 37 aa, Staphylococcus aureus
KASGLFAFLRTKIASLVKLFPILGVSISSLTLPITLI

SEQ ID NO: 1593320 - protein, 17 aa, Staphylococcus aureus
KATSHLLGYVGPINSEE

SEQ ID NO: 1593321 - protein, 21 aa, Staphylococcus aureus
KDKISYKYDNVASINFGDINK

SEQ ID NO: 1593322 - protein, 20 aa, Staphylococcus aureus
KERLLIIRALITWFYTMLWS

SEQ ID NO: 1593323 - protein, 21 aa, Staphylococcus aureus
KFILPIVVGLLIWALTPIKPE

SEQ ID NO: 1593324 - protein, 24 aa, Staphylococcus aureus
KFQEKWYGIFLEKINIYKKRGKFS

SEQ ID NO: 1593325 - protein, 18 aa, Staphylococcus aureus
KFVLFQKIPLLIKRHVYS

SEQ ID NO: 1593326 - protein, 27 aa, Staphylococcus aureus
KIPVWKLIIIWFLRVALSLLITIPVAL

SEQ ID NO: 1593327 - protein, 23 aa, Staphylococcus aureus
KKRYKIGFIFWGVSIISLGLMMF

SEQ ID NO: 1593328 - protein, 23 aa, Staphylococcus aureus
KLGMLLIRWMLATSFLVHGTLKF

SEQ ID NO: 1593329 - protein, 21 aa, Staphylococcus aureus
KLNQLAPYFKGFDGSFVLYNE

SEQ ID NO: 1593330 - protein, 18 aa, Staphylococcus aureus
KNTRLFILITIGALIYLV

SEQ ID NO: 1593331 - protein, 26 aa, Staphylococcus aureus
KQRLSIARIFLNNPPILILDEATSAL

SEQ ID NO: 1593332 - protein, 29 aa, Staphylococcus aureus
KQSKLIPIFICIFTFLLIVIQSQFLMGQS

SEQ ID NO: 1593333 - protein, 19 aa, Staphylococcus aureus
KQVQALIDEIDRNPILTDK

SEQ ID NO: 1593334 - protein, 19 aa, Staphylococcus aureus
KQVQALIDEIDRNPNLTDK

SEQ ID NO: 1593335 - protein, 34 aa, Staphylococcus aureus
KSHDLIFNQLYVVFKMIFWFNPALYISKTMMDND

SEQ ID NO: 1593336 - protein, 18 aa, Staphylococcus aureus
KSYFLRWIPSFHILQSGQ

SEQ ID NO: 1593337 - protein, 17 aa, Staphylococcus aureus
KWQMLVTLLFVIPCHEL

SEQ ID NO: 1593338 - protein, 31 aa, Staphylococcus aureus
KWTDIFMYISFFTLPLILIIELYYVVYIVYK

SEQ ID NO: 1593339 - protein, 27 aa, Staphylococcus aureus
KYKKARNFYSMLYDWRINKNPLYKGVY

SEQ ID NO: 1593340 - protein, 31 aa, Staphylococcus aureus
LDEDDDIDPLHMRHFSNNFGNVIKNAIGVVG

SEQ ID NO: 1593341 - protein, 20 aa, Staphylococcus aureus
LDFITNLAGFIAKLFETHPA

SEQ ID NO: 1593342 - protein, 18 aa, Staphylococcus aureus
LDMQPAHLFFMIAAPEGG

SEQ ID NO: 1593343 - protein, 25 aa, Staphylococcus aureus
LEQFKAQMKAANPTAKELAKRKQEA

SEQ ID NO: 1593344 - protein, 20 aa, Staphylococcus aureus
LFGIFALLLVITLPIYTVAS

SEQ ID NO: 1593345 - protein, 30 aa, Staphylococcus aureus
LGFEAKLYTLIWFIVGIILYLSYGLRHSKK

SEQ ID NO: 1593346 - protein, 29 aa, Staphylococcus aureus
LGTIVAIIVILLFLRNIRTTAISIISIPL

SEQ ID NO: 1593347 - protein, 25 aa, Staphylococcus aureus
LGYTSFWFFSLIAIVIVAFFMFLKV

SEQ ID NO: 1593348 - protein, 19 aa, Staphylococcus aureus
LHFCVLLLLKYIGFKLFIY

SEQ ID NO: 1593349 - protein, 27 aa, Staphylococcus aureus
LHRVLPGRFYVITLYRIIKLVIIFLIE

SEQ ID NO: 1593350 - protein, 18 aa, Staphylococcus aureus
LIAWILYYFVDVKLTNYN

SEQ ID NO: 1593351 - protein, 26 aa, Staphylococcus aureus
LIKRYPVLGWSFFIAALSLAGIPPLS

SEQ ID NO: 1593352 - protein, 21 aa, Staphylococcus aureus
LILLMLVVTLFFLNNSRYFNP

SEQ ID NO: 1593353 - protein, 20 aa, Staphylococcus aureus
LISAIIIILVVYYIMPIVLG

SEQ ID NO: 1593354 - protein, 45 aa, Staphylococcus aureus
LITTILDMLFLTLYTVLLIKYSLKLFFISLVLLSLIIIISIWHSK

SEQ ID NO: 1593355 - protein, 19 aa, Staphylococcus aureus
LIVMLWLTIILNTLICQLI

SEQ ID NO: 1593356 - protein, 25 aa, Staphylococcus aureus
LIVWFILFLLFWYLLQPVIMSIGGL

SEQ ID NO: 1593357 - protein, 20 aa, Staphylococcus aureus
LLILAFFGIKKYFLGGLLSS

SEQ ID NO: 1593358 - protein, 17 aa, Staphylococcus aureus
LLLIIVSIAIIQYLLQI

SEQ ID NO: 1593359 - protein, 19 aa, Staphylococcus aureus
LLLLFLMIIFGGRKGFISY

SEQ ID NO: 1593360 - protein, 18 aa, Staphylococcus aureus
LMIMIIPTWINLLLKTYA

SEQ ID NO: 1593361 - protein, 20 aa, Staphylococcus aureus
LMSLPVLQLFIYIVGLFFLL

SEQ ID NO: 1593362 - protein, 21 aa, Staphylococcus aureus
LNEAMNQLRQSIASKDATKAS

SEQ ID NO: 1593363 - protein, 46 aa, Staphylococcus aureus
LNEYQLSQLFTDQKLQEAARTRNPIRLMIGFDYPDAYGNSETLVPV

SEQ ID NO: 1593364 - protein, 33 aa, Staphylococcus aureus; identical to SEQ ID NO: 1583907

SEQ ID NO: 1593365 - protein, 28 aa, Staphylococcus aureus
LPMLLPFLCALILVFLKNNDRISKYLYL

SEQ ID NO: 1593366 - protein, 30 aa, Staphylococcus aureus
LQLFIYIVGLFFLLYMAWSLWKEKPNTLEN

SEQ ID NO: 1593367 - protein, 27 aa, Staphylococcus aureus
LQRVKTAKNALNGDAKLIAAQNAAKQH

SEQ ID NO: 1593368 - protein, 17 aa, Staphylococcus aureus
LRKIHGYSLFSSNVRYL

SEQ ID NO: 1593369 - protein, 43 aa, Staphylococcus aureus
LRRKRQKRIQYSVITILVLLIAVILIYMFSPLSKIAHVNINGN

SEQ ID NO: 1593370 - protein, 29 aa, Staphylococcus aureus
LSFKLYRFYFYRLFAIVTWVLFIGSLSQY

SEQ ID NO: 1593371 - protein, 23 aa, Staphylococcus aureus
LSIALIVIGIAVVCLMIFSSQKT

SEQ ID NO: 1593372 - protein, 17 aa, Staphylococcus aureus
LVLAFRTYKELGTDNVE

SEQ ID NO: 1593373 - protein, 20 aa, Staphylococcus aureus
LVLFIPLLNWLTPKRYIKIS

SEQ ID NO: 1593374 - protein, 20 aa, Staphylococcus aureus
MALLQIIFGLLALGSLGLII

SEQ ID NO: 1593375 - protein, 26 aa, Staphylococcus aureus
MKWDEILTILPWLIGALIATIFIGRQ

SEQ ID NO: 1593376 - protein, 29 aa, Staphylococcus aureus
MKWDEILTILPWLIGALIVTIFIGRQLTI

SEQ ID NO: 1593377 - protein, 23 aa, Staphylococcus aureus
MNQINEIVLETIRDINNAHTLQQ

SEQ ID NO: 1593378 - protein, 23 aa, Staphylococcus aureus
MRYIVGKWVPRTGSWRAAFKRAG

SEQ ID NO: 1593379 - protein, 28 aa, Staphylococcus aureus
MSLYDILKDVWFLILIPIVISIVKLLNK

SEQ ID NO: 1593380 - protein, 20 aa, Staphylococcus aureus
NADIILPKSTAPKSLNTRMR

SEQ ID NO: 1593381 - protein, 41 aa, Staphylococcus aureus
NAGTQLYHITATNAYHKDSEDFYISLKIIDVKQPEGDQRVY

SEQ ID NO: 1593382 - protein, 21 aa, Staphylococcus aureus
NAMDQLKQAIADHDTIVAGGN

SEQ ID NO: 1593383 - protein, 28 aa, Staphylococcus aureus
NAQTIDQLNRGLNLGLDDIRNTHVWEVD

SEQ ID NO: 1593384 - protein, 18 aa, Staphylococcus aureus
NATKSIFGFLYNSVKSIF

SEQ ID NO: 1593385 - protein, 40 aa, Staphylococcus aureus
NDKHLVYHFVLISLLVVFLVVLLPFHWRALQSVNWQAVQL

SEQ ID NO: 1593386 - protein, 18 aa, Staphylococcus aureus
NERYILIHDLLKPTILPI

SEQ ID NO: 1593387 - protein, 24 aa, Staphylococcus aureus
NESNSHLTIGYGTANHPFNSSTIG

SEQ ID NO: 1593388 - protein, 40 aa, Staphylococcus aureus
NICTVVWIVLVIILSFKFLKSLLYLKYLKKQSLYLNENEK

SEQ ID NO: 1593389 - protein, 20 aa, Staphylococcus aureus
NIDPATGKDYSIFGWNNENV

SEQ ID NO: 1593390 - protein, 17 aa, Staphylococcus aureus
NMDDRIPINVWTGDSIA

SEQ ID NO: 1593391 - protein, 29 aa, Staphylococcus aureus
NNQIHLIFSIFIFSFIMQIIGLLVPLATQ

SEQ ID NO: 1593392 - protein, 36 aa, Staphylococcus aureus
NNQNEILLINFGFSFDLIILLRKYVKYINFNYNEKE

SEQ ID NO: 1593393 - protein, 33 aa, Staphylococcus aureus
NNRVPFIVDFLYDFWWLFFPVAVFLVWAIHSSL

SEQ ID NO: 1593394 - protein, 21 aa, Staphylococcus aureus
NNTYRQTIYVNPSGDNVIAPV

SEQ ID NO: 1593395 - protein, 24 aa, Staphylococcus aureus
NNTYRQTIYVNPSGDNVVLPALTG

SEQ ID NO: 1593396 - protein, 17 aa, Staphylococcus aureus
NPDQFTIDQAKSNAIKS

SEQ ID NO: 1593397 - protein, 17 aa, Staphylococcus aureus
NPLIVKFIIWLINETRK

SEQ ID NO: 1593398 - protein, 30 aa, Staphylococcus aureus
NPSGDNVVLPALTGNLIPNTKSNALIDAKN

SEQ ID NO: 1593399 - protein, 26 aa, Staphylococcus aureus
NQSSSPAAMFVLVAGIGLIATVRRRK

SEQ ID NO: 1593400 - protein, 29 aa, Staphylococcus aureus
NSETLVPVNLTVLPEIQHNIKFFKNDDTQ

SEQ ID NO: 1593401 - protein, 24 aa, Staphylococcus aureus
NSSNIFDWLVKLTSQFRAWSEQVG

SEQ ID NO: 1593402 - protein, 23 aa, Staphylococcus aureus
NTAIDQLPNLNQPQKTALKDQVS

SEQ ID NO: 1593403 - protein, 24 aa, Staphylococcus aureus
NTEFIKILLRTFKNENYKEECLRA

SEQ ID NO: 1593404 - protein, 29 aa, Staphylococcus aureus
NTVYQSLHQIYLKTILSLYIDISSTNKIG

SEQ ID NO: 1593405 - protein, 24 aa, Staphylococcus aureus
NVIAIIIKLFAFGGLFYISTIVPN

SEQ ID NO: 1593406 - protein, 23 aa, Staphylococcus aureus
NVKFEDMLDIKFYSLDGINGLSL

SEQ ID NO: 1593407 - protein, 22 aa, Staphylococcus aureus
PIFRPVMRPLFTLPGRSTVDNL

SEQ ID NO: 1593408 - protein, 22 aa, Staphylococcus aureus
PKYLANISILSILGYVFALIQS

SEQ ID NO: 1593409 - protein, 19 aa, Staphylococcus aureus
PNETSLNLTFATAGKETSQ

SEQ ID NO: 1593410 - protein, 31 aa, Staphylococcus aureus
PQQVEAALNNGIARILAVQIVTSDHSKPSSN

SEQ ID NO: 1593411 - protein, 22 aa, Staphylococcus aureus
PVCIIAILYVLLSPTHPLALIV

SEQ ID NO: 1593412 - protein, 25 aa, Staphylococcus aureus
PYLLTLLYLAIFITLYLIYGSGDTH

SEQ ID NO: 1593413 - protein, 30 aa, Staphylococcus aureus
QAVNPSTPRMRAFSLAAVAADAPAAGTDIT

SEQ ID NO: 1593414 - protein, 18 aa, Staphylococcus aureus
QDAYSQKGAITLGTRIDS

SEQ ID NO: 1593415 - protein, 22 aa, Staphylococcus aureus
QENIDPATGKDYSIFGWNNENV

SEQ ID NO: 1593416 - protein, 23 aa, Staphylococcus aureus
QEYDVLLTFINTTQVRIIDLSVS

SEQ ID NO: 1593417 - protein, 26 aa, Staphylococcus aureus
QFIQYYLYLLIILGGLYLFTHHAFIL

SEQ ID NO: 1593418 - protein, 19 aa, Staphylococcus aureus
QIANGIPTPVLTPDTVTQA

SEQ ID NO: 1593419 - protein, 22 aa, Staphylococcus aureus
QIANGTPTPVLTPDAVTQAVTT

SEQ ID NO: 1593420 - protein, 24 aa, Staphylococcus aureus
QIDQSPEIAIVNQVKQTATSLDHA

SEQ ID NO: 1593421 - protein, 24 aa, Staphylococcus aureus
QKWLGIVFAILITITFAFVFNTVQ

SEQ ID NO: 1593422 - protein, 52 aa, Staphylococcus aureus
QLAFAMLAAIIIVYLILVITFKGGLAPFTILFSLPFTVIGVIIALLITGETI

SEQ ID NO: 1593423 - protein, 26 aa, Staphylococcus aureus
QLSYAPPYYYLLITITIFGIICSIIF

SEQ ID NO: 1593424 - protein, 25 aa, Staphylococcus aureus
QNIDQATKLQPIAELVDQATQLNQS

SEQ ID NO: 1593425 - protein, 30 aa, Staphylococcus aureus
QNKNGFTFFLNVLLPLVFISVLIGIFNYIK

SEQ ID NO: 1593426 - protein, 22 aa, Staphylococcus aureus
QPNVKIYEYVGVENGLPQSVYA

SEQ ID NO: 1593427 - protein, 23 aa, Staphylococcus aureus
QPNVKIYEYVGVENGLPQSVYAN

SEQ ID NO: 1593428 - protein, 22 aa, Staphylococcus aureus
QQNAFYQVLNMPNLNADQRNGF

SEQ ID NO: 1593429 - protein, 34 aa, Staphylococcus aureus
QSIIIIVVLLIKAIITWLLLIPVFNFMTSFVEST

SEQ ID NO: 1593430 - protein, 27 aa, Staphylococcus aureus
QSTLQPIMPILQVLGQIFMQVLGVLVI

SEQ ID NO: 1593431 - protein, 18 aa, Staphylococcus aureus
QTLDLPQSSPQTISNAQG

SEQ ID NO: 1593432 - protein, 23 aa, Staphylococcus aureus
QVKGLMIASIQALIPVIAGLVPA

SEQ ID NO: 1593433 - protein, 17 aa, Staphylococcus aureus
QVQALIDEIDRNPNLTD

SEQ ID NO: 1593434 - protein, 21 aa, Staphylococcus aureus
QYFIAFFFQIFYNIIALLMIG

SEQ ID NO: 1593435 - protein, 19 aa, Staphylococcus aureus
RGKQGTGLGLFICKMIIEE

SEQ ID NO: 1593436 - protein, 21 aa, Staphylococcus aureus
RKMITIALVWWSAFTILTGMI

SEQ ID NO: 1593437 - protein, 20 aa, Staphylococcus aureus
RKVRYTFKEYVQEKKDLTAE

SEQ ID NO: 1593438 - protein, 17 aa, Staphylococcus aureus
RLFILITIGALIYLVSM

SEQ ID NO: 1593439 - protein, 27 aa, Staphylococcus aureus
RSLNLWAYVMLIFMTLATILTGPLVVY

SEQ ID NO: 1593440 - protein, 21 aa, Staphylococcus aureus
SAWGYWFSAFLGNVAYATLLM

SEQ ID NO: 1593441 - protein, 17 aa, Staphylococcus aureus
SCSTMMATSIILTNILP

SEQ ID NO: 1593442 - protein, 28 aa, Staphylococcus aureus
SDGKFHGQRLNDVILTYVASTGKMRAEY

SEQ ID NO: 1593443 - protein, 44 aa, Staphylococcus aureus
SFNSKPLRMMIYLGLFIFSISALYIIYLFINIMISGVNIPGYFS

SEQ ID NO: 1593444 - protein, 27 aa, Staphylococcus aureus
SFSIGDIKQYFTLSNGQPIPSGTFTNI

SEQ ID NO: 1593445 - protein, 23 aa, Staphylococcus aureus
SGELTYQRFLNGYPTFNKEGSNQ

SEQ ID NO: 1593446 - protein, 33 aa, Staphylococcus aureus
SHDLIFNQLYVVFKMIFWFNPALYISKTMMDND

SEQ ID NO: 1593447 - protein, 28 aa, Staphylococcus aureus
SIESKDEDVPLLLAKKKNQKDNQSKDKK

SEQ ID NO: 1593448 - protein, 28 aa, Staphylococcus aureus
SIESKDEDVPLLLAKKKNQKDNQSKGKK

SEQ ID NO: 1593449 - protein, 20 aa, Staphylococcus aureus
SKKVLSVRFLTKEMLADIEP

SEQ ID NO: 1593450 - protein, 24 aa, Staphylococcus aureus
SKLDYFFIIVISTLSLFLFKMFDS

SEQ ID NO: 1593451 - protein, 18 aa, Staphylococcus aureus
SLDQVLASYLKTANIAKY

SEQ ID NO: 1593452 - protein, 25 aa, Staphylococcus aureus
SLSDSTSTSLSLSASMNQSGVDSNS

SEQ ID NO: 1593453 - protein, 28 aa, Staphylococcus aureus
SMPEYWLAILFIYYLGVRWQLLPFVGSD

SEQ ID NO: 1593454 - protein, 30 aa, Staphylococcus aureus
SNENFTDKDWQITGIPRTLHIENSTNRPNN

SEQ ID NO: 1593455 - protein, 17 aa, Staphylococcus aureus
SNFIQFIQPFIDSVKNV

SEQ ID NO: 1593456 - protein, 26 aa, Staphylococcus aureus
SNVYNFIMIVWNQIVAYLQGLWNGII

SEQ ID NO: 1593457 - protein, 26 aa, Staphylococcus aureus
SSWHFYALFLCFFIISYKLTEKITKV

SEQ ID NO: 1593458 - protein, 18 aa, Staphylococcus aureus
STLIVISIPRFEEYMKVR

SEQ ID NO: 1593459 - protein, 23 aa, Staphylococcus aureus
STNAQHMNFQFVGTYGPNKDVVG

SEQ ID NO: 1593460 - protein, 26 aa, Staphylococcus aureus
STNRVILFIFRCLVVVLVFVGAVVKT

SEQ ID NO: 1593461 - protein, 38 aa, Staphylococcus aureus
STTSTSTAPVKLRTFSRLAMSTFASAATTSAVTANTIT

SEQ ID NO: 1593462 - protein, 17 aa, Staphylococcus aureus
SVPIVPELLKSLNFNQF

SEQ ID NO: 1593463 - protein, 25 aa, Staphylococcus aureus
TAKLNAKTYLNTLTSITDAQKNNLI

SEQ ID NO: 1593464 - protein, 24 aa, Staphylococcus aureus
TALFVCGLISWLYYHYRIDSIKQL

SEQ ID NO: 1593465 - protein, 33 aa, Staphylococcus aureus
TASKTVLIDYEKYGQFHNLSIKGTIDQIDKTNN

SEQ ID NO: 1593466 - protein, 23 aa, Staphylococcus aureus
TDIKWCRMIIRQILSNALKYSEN

SEQ ID NO: 1593467 - protein, 24 aa, Staphylococcus aureus
TDLIYQNNIFGLKDKVDWVGHKID

SEQ ID NO: 1593468 - protein, 25 aa, Staphylococcus aureus
TFGILFQLPILFIGLAKFGLIDTTS

SEQ ID NO: 1593469 - protein, 17 aa, Staphylococcus aureus
TGFLTTVFIFALSLFTV

SEQ ID NO: 1593470 - protein, 20 aa, Staphylococcus aureus
TIGALVPLLFGQDSSILISK

SEQ ID NO: 1593471 - protein, 17 aa, Staphylococcus aureus
TIGYWLARLLKLDRQDQ

SEQ ID NO: 1593472 - protein, 22 aa, Staphylococcus aureus
TIISFLYMAMYKITSYIYAKVI

SEQ ID NO: 1593473 - protein, 36 aa, Staphylococcus aureus
TIKQYSLLFLGIIILLSILIFIYSQFTLKEMKYKRN

SEQ ID NO: 1593474 - protein, 21 aa, Staphylococcus aureus
TITFIFITILMTIAFGLNGFF

SEQ ID NO: 1593475 - protein, 17 aa, Staphylococcus aureus
TLFKPIVFGFKSFLIGS

SEQ ID NO: 1593476 - protein, 33 aa, Staphylococcus aureus
TLQMLNMRYSHWFRFVWPVVAFVLIFGGGLLIT

SEQ ID NO: 1593477 - protein, 18 aa, Staphylococcus aureus
TMLALAVFSKKFQPKHIY

SEQ ID NO: 1593478 - protein, 25 aa, Staphylococcus aureus
TNKGMLFGGLFSILGLALLRRNKKN

SEQ ID NO: 1593479 - protein, 32 aa, Staphylococcus aureus
TNLNIDDFVDDPLSYVKTPSNKVLGFYSNNAN

SEQ ID NO: 1593480 - protein, 23 aa, Staphylococcus aureus
TNVLDTIWQYMQSVWESIIGFLT

SEQ ID NO: 1593481 - protein, 39 aa, Staphylococcus aureus
TQMVGHPEQLYKYYYDRGYTLTWDNGLVLYSNKANGNGK

SEQ ID NO: 1593482 - protein, 25 aa, Staphylococcus aureus
TREGLALGVYIILSGSRSSAIKSAI

SEQ ID NO: 1593483 - protein, 30 aa, Staphylococcus aureus
TTAISIISIPLSLLMALIALKLSDVSLNIL

SEQ ID NO: 1593484 - protein, 22 aa, Staphylococcus aureus
TTGADGWGFLFSKGNAEEYLTN

SEQ ID NO: 1593485 - protein, 27 aa, Staphylococcus aureus
TTIINSLTFTETVPNRSYARASANEIT

SEQ ID NO: 1593486 - protein, 20 aa, Staphylococcus aureus
TVEIPFETKREFNPKLQPGE

SEQ ID NO: 1593487 - protein, 35 aa, Staphylococcus aureus
TVGTLAAFVGYLELLFGPLRRLVASFTTLTQSFAS

SEQ ID NO: 1593488 - protein, 23 aa, Staphylococcus aureus
TVIYIMPIIILIFGLLEISNQEM

SEQ ID NO: 1593489 - protein, 18 aa, Staphylococcus aureus
TWYNVIALTILVIVLSSF

SEQ ID NO: 1593490 - protein, 19 aa, Staphylococcus aureus
TWYNVIALTILVIVLSSFT

SEQ ID NO: 1593491 - protein, 25 aa, Staphylococcus aureus
VAMMVISIILLIVPDLIRLSKTFLI

SEQ ID NO: 1593492 - protein, 26 aa, Staphylococcus aureus
VCTATAIMILLYSGLKFGDNAPQGVA

SEQ ID NO: 1593493 - protein, 22 aa, Staphylococcus aureus
VDVMIIFLREGLEVLLIVMTLT

SEQ ID NO: 1593494 - protein, 17 aa, Staphylococcus aureus
VEAALNNGIARISAVQI

SEQ ID NO: 1593495 - protein, 19 aa, Staphylococcus aureus
VEFNTPDDQITTPYIVVVN

SEQ ID NO: 1593496 - protein, 18 aa, Staphylococcus aureus
VEIPFETKREFNPKLQPG

SEQ ID NO: 1593497 - protein, 18 aa, Staphylococcus aureus
VFFSLIFPIIMIIVIILS

SEQ ID NO: 1593498 - protein, 20 aa, Staphylococcus aureus
VFIAFFSHLTIHLLPLFAVI

SEQ ID NO: 1593499 - protein, 17 aa, Staphylococcus aureus
VFICSLVGFVYYENKIK

SEQ ID NO: 1593500 - protein, 41 aa, Staphylococcus aureus
VGHTVFKWVAIGMTTLSVLLIAFLAFLYFSVMKHNERIEKG

SEQ ID NO: 1593501 - protein, 32 aa, Staphylococcus aureus
VGIDSGDTVYPHQAGYVKLNYGFSVPNEAVQG

SEQ ID NO: 1593502 - protein, 37 aa, Staphylococcus aureus; identical to SEQ ID NO: 1578125

SEQ ID NO: 1593503 - protein, 26 aa, Staphylococcus aureus
VGIDYALFILFRYRQVMKTETDYVKG

SEQ ID NO: 1593504 - protein, 28 aa, Staphylococcus aureus
VGNQTIEVGKTMNPIVLTTTDNGTGTVT

SEQ ID NO: 1593505 - protein, 27 aa, Staphylococcus aureus
VGTASILIGSLMYLGTQQEAEAAENNI

SEQ ID NO: 1593506 - protein, 32 aa, Staphylococcus aureus
VIDNDLLVPFIFLGVLYLLYYLYDRGHHLKFY

SEQ ID NO: 1593507 - protein, 18 aa, Staphylococcus aureus
VIGIALISLVFLPGIFYV

SEQ ID NO: 1593508 - protein, 36 aa, Staphylococcus aureus
VIGNLLLSAAIFLYIMLIDWRMASALLVTIPISIFA

SEQ ID NO: 1593509 - protein, 18 aa, Staphylococcus aureus
VIIMFFIGGVFSLLSTMV

SEQ ID NO: 1593510 - protein, 18 aa, Staphylococcus aureus
VIVIMIMSLLKKPTPRPA

SEQ ID NO: 1593511 - protein, 17 aa, Staphylococcus aureus
VIVWIAWIKPLAHINEI

SEQ ID NO: 1593512 - protein, 19 aa, Staphylococcus aureus
VIYTFTDYVNTKDDVKATL

SEQ ID NO: 1593513 - protein, 28 aa, Staphylococcus aureus
VLGGIDHILWFILAVIVGSLVTMVTVLL

SEQ ID NO: 1593514 - protein, 29 aa, Staphylococcus aureus
VLGGPGAVFWMWVIAFIGAASAFIEATLA

SEQ ID NO: 1593515 - protein, 18 aa, Staphylococcus aureus
VLLLLMTLTGNVFTLLMF

SEQ ID NO: 1593516 - protein, 18 aa, Staphylococcus aureus
VLSFIAFVGAFILIALIS

SEQ ID NO: 1593517 - protein, 44 aa, Staphylococcus aureus
VMILKGTVQLIWNLIQLWFVGKILGVVRYFGGLLKGLISGIWGV

SEQ ID NO: 1593518 - protein, 19 aa, Staphylococcus aureus
VMIPLTAYLMDRIKTRPLY

SEQ ID NO: 1593519 - protein, 34 aa, Staphylococcus aureus
VNLIGALFLGLVVALIYIFFKVIFDKRIKDEEDV

SEQ ID NO: 1593520 - protein, 27 aa, Staphylococcus aureus
VNYIPRNFFIILFPVAFMTISITNISL

SEQ ID NO: 1593521 - protein, 20 aa, Staphylococcus aureus
VPRTGSWRAAFKRAGDYAYA

SEQ ID NO: 1593522 - protein, 18 aa, Staphylococcus aureus
VPYFLINIDINFTYLLAL

SEQ ID NO: 1593523 - protein, 19 aa, Staphylococcus aureus
VQMGINYSIYMDADTIPVS

SEQ ID NO: 1593524 - protein, 23 aa, Staphylococcus aureus
VSKNYLVMIPLTFIIGADLLLLS

SEQ ID NO: 1593525 - protein, 46 aa, Staphylococcus aureus
VSTTYKKVLHWSLNHKWIVIILSTLILVVTIVFGGPRLGTSFISAG

SEQ ID NO: 1593526 - protein, 24 aa, Staphylococcus aureus
VSTYIIIFLVSSAAFAIFLLSANI

SEQ ID NO: 1593527 - protein, 19 aa, Staphylococcus aureus
VTIIILFGVALVSPIYTLS

SEQ ID NO: 1593528 - protein, 17 aa, Staphylococcus aureus
VTNTVTGLPSGLTFDST

SEQ ID NO: 1593529 - protein, 21 aa, Staphylococcus aureus
VTVIVLAFISIGHALLIMVSM

SEQ ID NO: 1593530 - protein, 17 aa, Staphylococcus aureus
VTVKPLRDKYRVGTSST

SEQ ID NO: 1593531 - protein, 26 aa, Staphylococcus aureus
VTWCEKGVFDYRRSLLRTDVVLNSED

SEQ ID NO: 1593532 - protein, 17 aa, Staphylococcus aureus
WLFSRVFIAFTVTFIGL

SEQ ID NO: 1593533 - protein, 21 aa, Staphylococcus aureus
WLMVLTIFIINICYVTFLTMR

SEQ ID NO: 1593534 - protein, 40 aa, Staphylococcus aureus
YDFPIDSLFYIVSLNLSLTMIFLLLTYFKEVKLYKHFDKD

SEQ ID NO: 1593535 - protein, 17 aa, Staphylococcus aureus
YDLFNYWLMGTISIIIS

SEQ ID NO: 1593536 - protein, 17 aa, Staphylococcus aureus
YEMRWNGRHRDPLPWLR

SEQ ID NO: 1593537 - protein, 25 aa, Staphylococcus aureus
YFVVQFIITLFLIWLPTYLTEVFHV

SEQ ID NO: 1593538 - protein, 27 aa, Staphylococcus aureus
YIGIYKIILIILLTSVLYYLIYVSREY

SEQ ID NO: 1593539 - protein, 20 aa, Staphylococcus aureus
YLNVFFRMTLKYNQILYIAL

SEQ ID NO: 1593540 - protein, 18 aa, Staphylococcus aureus
YLWVFALILFFMRLAKIQ

SEQ ID NO: 1593541 - protein, 19 aa, Staphylococcus aureus
YLWVFALILFIMRLAKIQL

SEQ ID NO: 1593542 - protein, 29 aa, Staphylococcus aureus
YPNFILDFIFIIIMLFLVSLTNIFTNYLN

SEQ ID NO: 1593543 - protein, 17 aa, Staphylococcus aureus
YVNPLKLNAKNTNVTIK

SEQ ID NO: 1593544 - protein, 21 aa, Staphylococcus aureus
YVVEFFEWFNTLETFKNWKKK

SEQ ID NO: 1593545 - protein, 18 aa, Staphylococcus aureus
YYVDNSWGWLPWNWSDGI

SEQ ID NO: 1593546 - protein, 22 aa, Staphylococcus aureus
AAGILAFIGLILSPAIGAILMS

SEQ ID NO: 1593547 - protein, 28 aa, Staphylococcus aureus
AALNNGIARISAVQIVISDRAKQSSSTG

SEQ ID NO: 1593548 - protein, 19 aa, Staphylococcus aureus
AAQFIMCALFIAGTPISAI

SEQ ID NO: 1593549 - protein, 28 aa, Staphylococcus aureus
ADEMFNNQITYNYSSPIAGIDKPNGANI

SEQ ID NO: 1593550 - protein, 26 aa, Staphylococcus aureus
ADIDLAWLVPFILLAIIGFIIDVVIR

SEQ ID NO: 1593551 - protein, 17 aa, Staphylococcus aureus
ADYFKLSNGSAIPDATI

SEQ ID NO: 1593552 - protein, 25 aa, Staphylococcus aureus
AEQLDQAMERLINGIQDKDQVKQSV

SEQ ID NO: 1593553 - protein, 20 aa, Staphylococcus aureus
AGVFPMFVWLPSAYYAPPIP

SEQ ID NO: 1593554 - protein, 21 aa, Staphylococcus aureus
AIDNLTHLNTPQKTALKQQVN

SEQ ID NO: 1593555 - protein, 19 aa, Staphylococcus aureus
AIFIFSFELQWFPFQGSVD

SEQ ID NO: 1593556 - protein, 22 aa, Staphylococcus aureus
AILTIIILYFLTNGISLNHAKS

SEQ ID NO: 1593557 - protein, 21 aa, Staphylococcus aureus
AIQGVVDWLTQLWGKIQSTLQ

SEQ ID NO: 1593558 - protein, 27 aa, Staphylococcus aureus
AKLVLAIVFIFIIVYSNLYYIRLSFYV

SEQ ID NO: 1593559 - protein, 27 aa, Staphylococcus aureus
AKSGTTNFSLSMTASTGGATNLQQVQF

SEQ ID NO: 1593560 - protein, 19 aa, Staphylococcus aureus
AKYFDISCVPILTRSQKSL

SEQ ID NO: 1593561 - protein, 49 aa, Staphylococcus aureus
ALAIVILIVFALLFRFIVRLIPIFYIFRVLSIFIFIMGFKMLGVSIQKL

SEQ ID NO: 1593562 - protein, 21 aa, Staphylococcus aureus
ALIITQLLYFIDGSLAFLIFV

SEQ ID NO: 1593563 - protein, 25 aa, Staphylococcus aureus
ALLHDVFIIVAIFSLFRIEVDLTFI

SEQ ID NO: 1593564 - protein, 18 aa, Staphylococcus aureus
ALNRVMDQLSQEITGNEG

SEQ ID NO: 1593565 - protein, 26 aa, Staphylococcus aureus
ALTLPILNFIIPFVLVFVIDGMKGIK

SEQ ID NO: 1593566 - protein, 45 aa, Staphylococcus aureus
ALYFRQWILNFKRSIAIIYRTELLPSLYLYLYLKNNNDFKSPQYI

SEQ ID NO: 1593567 - protein, 20 aa, Staphylococcus aureus
AMFITLIIIAVLMGMLLIFN

SEQ ID NO: 1593568 - protein, 19 aa, Staphylococcus aureus
APIAFLMGIPWSEAVPAGS

SEQ ID NO: 1593569 - protein, 19 aa, Staphylococcus aureus
APPKPPNPNYPFNGGVHHG

SEQ ID NO: 1593570 - protein, 23 aa, Staphylococcus aureus
AQKLAEAKALDQAMQALRNSIQD

SEQ ID NO: 1593571 - protein, 25 aa, Staphylococcus aureus
AQTKDQLNQGLNLGLDDIRNTHVWE

SEQ ID NO: 1593572 - protein, 21 aa, Staphylococcus aureus
ARKIPLFIFFVSIVGPLLEEY

SEQ ID NO: 1593573 - protein, 22 aa, Staphylococcus aureus
ASIYTIWLVYAAGLDYLLLTML

SEQ ID NO: 1593574 - protein, 28 aa, Staphylococcus aureus
ASYAALITMYIIHLIILSLLGISPIRYV

SEQ ID NO: 1593575 - protein, 26 aa, Staphylococcus aureus
ASYAALITMYIIHLVILSLLGISPIR

SEQ ID NO: 1593576 - protein, 30 aa, Staphylococcus aureus
ATELNTAMGQLQHAIADKTNTLASSKYVNA

SEQ ID NO: 1593577 - protein, 17 aa, Staphylococcus aureus
ATKDIFIKLRNWMSNIW

SEQ ID NO: 1593578 - protein, 30 aa, Staphylococcus aureus
AVGIGGLSNAFGFKLDTYHNTSKPNSAAKA

SEQ ID NO: 1593579 - protein, 18 aa, Staphylococcus aureus
AVIMWFYVKPDQPLIVSD

SEQ ID NO: 1593580 - protein, 18 aa, Staphylococcus aureus
AWLNIIAIWILHKPAVNA

SEQ ID NO: 1593581 - protein, 17 aa, Staphylococcus aureus
AYNWAFFNPIRKIYYNI

SEQ ID NO: 1593582 - protein, 24 aa, Staphylococcus aureus
AYSQAVNAAATILNKTAGGNTPKA

SEQ ID NO: 1593583 - protein, 17 aa, Staphylococcus aureus
CFIGYNMYLLYNNTINT

SEQ ID NO: 1593584 - protein, 24 aa, Staphylococcus aureus
CGIFAFLIWIHLLCTMLKYFNNVK

SEQ ID NO: 1593585 - protein, 25 aa, Staphylococcus aureus
CISVSWLWFFLLAILGEMVGSIDKT

SEQ ID NO: 1593586 - protein, 26 aa, Staphylococcus aureus
CIVGAIFVISYLYWYCKTIKNDPKAS

SEQ ID NO: 1593587 - protein, 21 aa, Staphylococcus aureus
CQNLFFKFKLLLFEVNQMQYV

SEQ ID NO: 1593588 - protein, 18 aa, Staphylococcus aureus
CVIVFYFNLNRKLKLKVF

SEQ ID NO: 1593589 - protein, 21 aa, Staphylococcus aureus
DAIDKLILLDFRLPRMMITIL

SEQ ID NO: 1593590 - protein, 25 aa, Staphylococcus aureus
DAMTQLKQGIANKAQIKGSENYHDA

SEQ ID NO: 1593591 - protein, 21 aa, Staphylococcus aureus
DDAKRTAYSQAVNAAATILNK

SEQ ID NO: 1593592 - protein, 29 aa, Staphylococcus aureus
DDIITEQDILAHINLIDQLTAEIIDTPST

SEQ ID NO: 1593593 - protein, 23 aa, Staphylococcus aureus
DDKGGYLIPNLPNGDYRVEFSNL

SEQ ID NO: 1593594 - protein, 24 aa, Staphylococcus aureus
DDKGGYLIPNLPNGDYRVEFSNLP

SEQ ID NO: 1593595 - protein, 26 aa, Staphylococcus aureus
DEMFNNKITYNYSSPIAGIDKPNGAN

SEQ ID NO: 1593596 - protein, 35 aa, Staphylococcus aureus
DENGKYHFDNLDSGKYKVIFEKPAGLTQTGTNTTE

SEQ ID NO: 1593597 - protein, 35 aa, Staphylococcus aureus
DENGKYRFDNLDSGKYKVIFEKPAGLKQTGTNTTE

SEQ ID NO: 1593598 - protein, 25 aa, Staphylococcus aureus
DGKFHGQRLNDVILTYVASTGKMRA

SEQ ID NO: 1593599 - protein, 22 aa, Staphylococcus aureus
DGSYLIPNLPNGDYRVEFSNLP

SEQ ID NO: 1593600 - protein, 24 aa, Staphylococcus aureus
DIDPLHMRHFSNNFGNVIKNAIGV

SEQ ID NO: 1593601 - protein, 18 aa, Staphylococcus aureus
DIIFLILLNILMCLRIYL

SEQ ID NO: 1593602 - protein, 25 aa, Staphylococcus aureus
DISTDKIDRIRNSTIGTAEERQAAM

SEQ ID NO: 1593603 - protein, 19 aa, Staphylococcus aureus
DLINQTNNPTLDKAQVEQL

SEQ ID NO: 1593604 - protein, 38 aa, Staphylococcus aureus
DLLILKAGVESPVLFVLITIFCSIIFNSIVYTCVSLLG

SEQ ID NO: 1593605 - protein, 18 aa, Staphylococcus aureus
DLNKKSSYIYEQYLNKFF

SEQ ID NO: 1593606 - protein, 17 aa, Staphylococcus aureus
DMLPEDTTHVRWFLNIN

SEQ ID NO: 1593607 - protein, 23 aa, Staphylococcus aureus
DNAAKLKVQPTNNTFQDFDINYN

SEQ ID NO: 1593608 - protein, 20 aa, Staphylococcus aureus
DNLKQYMTTSGNATYDQSTG

SEQ ID NO: 1593609 - protein, 40 aa, Staphylococcus aureus
DPASTGDLALRSTFYGYDSNFIWRSMSWDNEVAFNNGSGS

SEQ ID NO: 1593610 - protein, 28 aa, Staphylococcus aureus
DPVTNRDYSIFGWNNENVVRYGGGSADG

SEQ ID NO: 1593611 - protein, 27 aa, Staphylococcus aureus
DQITTPYIVVVNGHIDPASTGDLALRS

SEQ ID NO: 1593612 - protein, 19 aa, Staphylococcus aureus
DQLNRGLNLGLDDIRNTHV

SEQ ID NO: 1593613 - protein, 18 aa, Staphylococcus aureus
DRINQILQQGHNDINNAL

SEQ ID NO: 1593614 - protein, 17 aa, Staphylococcus aureus
DRMEFQMLYGFRSELAE

SEQ ID NO: 1593615 - protein, 20 aa, Staphylococcus aureus
DRPSIGIGLINLKDIPEEER

SEQ ID NO: 1593616 - protein, 56 aa, Staphylococcus aureus
DSLANEKTRVRLYKSGKNWVKSGIKEIEMFKIMGLPFISHSIVSQDNQSISKKMTG

SEQ ID NO: 1593617 - protein, 18 aa, Staphylococcus aureus
DSTSMSLSMSQSISGSTS

SEQ ID NO: 1593618 - protein, 29 aa, Staphylococcus aureus
DVDNALNAVTRAKAALNGADNLRNAKTSA

SEQ ID NO: 1593619 - protein, 18 aa, Staphylococcus aureus
DVFIVFYVALFLGMILLG

SEQ ID NO: 1593620 - protein, 24 aa, Staphylococcus aureus
DVISTWLVYFFPFINWFIPKRCAK

SEQ ID NO: 1593621 - protein, 24 aa, Staphylococcus aureus
DVTIFILIAILLFVYTYKENEEIL

SEQ ID NO: 1593622 - protein, 23 aa, Staphylococcus aureus
DVTITDHDDFILDNGYFEEDTSD

SEQ ID NO: 1593623 - protein, 24 aa, Staphylococcus aureus
DVTTFILIAILLFVYTYKENEEIL

SEQ ID NO: 1593624 - protein, 23 aa, Staphylococcus aureus
DYAKILPLTALLGGILVLVADVI

SEQ ID NO: 1593625 - protein, 17 aa, Staphylococcus aureus
DYFDFTLSNNVNTHGVS

SEQ ID NO: 1593626 - protein, 32 aa, Staphylococcus aureus
EAMGYLKRFALYISVMILIFAIAGCGKGNETK

SEQ ID NO: 1593627 - protein, 22 aa, Staphylococcus aureus
EAQALDQLMDALQQSIADKDAT

SEQ ID NO: 1593628 - protein, 24 aa, Staphylococcus aureus
EDTTPPIVPPTPPTPEVPSEPETP

SEQ ID NO: 1593629 - protein, 42 aa, Staphylococcus aureus
EEKQSVFVSILSTLIPVVVIALLFIFFLSQAQGGGSGGRMMN

SEQ ID NO: 1593630 - protein, 18 aa, Staphylococcus aureus
EFAFMFVAPILYVVHALL

SEQ ID NO: 1593631 - protein, 20 aa, Staphylococcus aureus
EGILKLFEPLFTAADGWIGV

SEQ ID NO: 1593632 - protein, 25 aa, Staphylococcus aureus
EGTQKVKPTIYFKLYKQDDNQNTTP

SEQ ID NO: 1593633 - protein, 17 aa, Staphylococcus aureus
EKQEAIAKLNQLKEQAI

SEQ ID NO: 1593634 - protein, 29 aa, Staphylococcus aureus
ELEKMLIQLSIFHSYHDLEFLFVTREDEV

SEQ ID NO: 1593635 - protein, 21 aa, Staphylococcus aureus
ELGSIYILPALIGSIILIAIV

SEQ ID NO: 1593636 - protein, 20 aa, Staphylococcus aureus
ELKNPQTLDLPQSSPQTISN

SEQ ID NO: 1593637 - protein, 34 aa, Staphylococcus aureus
ELPKTGMKIITSWITWVFIGILGLYLILRKRFNS

SEQ ID NO: 1593638 - protein, 28 aa, Staphylococcus aureus
EMENHFECLWDLFRSIPSLEIDNASVLD

SEQ ID NO: 1593639 - protein, 19 aa, Staphylococcus aureus
EMGSRIPKGVLLVGPPGTG

SEQ ID NO: 1593640 - protein, 28 aa, Staphylococcus aureus
ENNKYVVVEYPYFTPIPDSQLNQAKMVE

SEQ ID NO: 1593641 - protein, 27 aa, Staphylococcus aureus
ENVTANITMPAYIDPENVTKTGNVTLT

SEQ ID NO: 1593642 - protein, 26 aa, Staphylococcus aureus
EQQNAFYEILHLPNLTEEQRNGFIQS

SEQ ID NO: 1593643 - protein, 38 aa, Staphylococcus aureus
ESIHSPITFWYGKYIILIPSLYFKSINDKKLKYIILHE

SEQ ID NO: 1593644 - protein, 28 aa, Staphylococcus aureus
ESYLWIGIVFVFFLISYISQIIGIMNTR

SEQ ID NO: 1593645 - protein, 25 aa, Staphylococcus aureus
ESYLWIGIVFVFFLISYISQIVGIM

SEQ ID NO: 1593646 - protein, 42 aa, Staphylococcus aureus
EVKKGYFPIKRAIDLILSIVLLFLTLPIMVIFAIAIVIDSPG

SEQ ID NO: 1593647 - protein, 18 aa, Staphylococcus aureus
FAMRLLLGSTLASIISGS

SEQ ID NO: 1593648 - protein, 23 aa, Staphylococcus aureus
FAPIAFLMGIPWSEAVPAGSLMA

SEQ ID NO: 1593649 - protein, 20 aa, Staphylococcus aureus
FCHSPLTYLWVFALILFIMR

SEQ ID NO: 1593650 - protein, 20 aa, Staphylococcus aureus
FCMIVPWRAAMLYKYKKLKK

SEQ ID NO: 1593651 - protein, 23 aa, Staphylococcus aureus
FENRTLMILTLMTLTLMILRIMI

SEQ ID NO: 1593652 - protein, 18 aa, Staphylococcus aureus
FGYLISLDKVLKSIQFNQ

SEQ ID NO: 1593653 - protein, 17 aa, Staphylococcus aureus
FHSYHDLEFLFVTREDE

SEQ ID NO: 1593654 - protein, 34 aa, Staphylococcus aureus
FIFQFLYTLFYEPLKFFIWLLDKILIDPNSISSD

SEQ ID NO: 1593655 - protein, 20 aa, Staphylococcus aureus
FILPIITFIIFLGIWEMVII

SEQ ID NO: 1593656 - protein, 24 aa, Staphylococcus aureus
FIMLIGMLIFYFYLNKKLTLKIFN

SEQ ID NO: 1593657 - protein, 18 aa, Staphylococcus aureus
FITVISVLLTFHLKQHYD

SEQ ID NO: 1593658 - protein, 17 aa, Staphylococcus aureus
FKHLSFTVPENNFIAIV

SEQ ID NO: 1593659 - protein, 27 aa, Staphylococcus aureus
FKLGGKLLLLYFMFCAIISVIQNIVGV

SEQ ID NO: 1593660 - protein, 17 aa, Staphylococcus aureus
FKPLFAWQMSGILLWIY

SEQ ID NO: 1593661 - protein, 17 aa, Staphylococcus aureus
FLAQAICYFIAALLCLP

SEQ ID NO: 1593662 - protein, 24 aa, Staphylococcus aureus
FLAVFTLFLYLNKKLKLHMFEDNK

SEQ ID NO: 1593663 - protein, 20 aa, Staphylococcus aureus
FLIVLINLIVTFPVLRKFKI

SEQ ID NO: 1593664 - protein, 17 aa, Staphylococcus aureus
FLLIVIQSQFLMGQSIT

SEQ ID NO: 1593665 - protein, 18 aa, Staphylococcus aureus
FLMGIPWSEAVPAGSLMA

SEQ ID NO: 1593666 - protein, 24 aa, Staphylococcus aureus
FMGLITFVLLIVQQWLFLNPNHNL

SEQ ID NO: 1593667 - protein, 19 aa, Staphylococcus aureus
FMLGKYWIQLLIATVIISL

SEQ ID NO: 1593668 - protein, 19 aa, Staphylococcus aureus
FMLGVTVFVLIYWLNPPGN

SEQ ID NO: 1593669 - protein, 21 aa, Staphylococcus aureus
FNGHFMVFLLILLGAFIFGYG

SEQ ID NO: 1593670 - protein, 30 aa, Staphylococcus aureus
FQFSFIISFFIMLLFPFLQQLSKLQSLFII

SEQ ID NO: 1593671 - protein, 24 aa, Staphylococcus aureus
FTINFFVNFIVYLCMYLLLVVIAG

SEQ ID NO: 1593672 - protein, 19 aa, Staphylococcus aureus
FTKERVEGFLNKSKNEQAA

SEQ ID NO: 1593673 - protein, 30 aa, Staphylococcus aureus
FVFSVHPMLSLFFFYSAFAVPFTFKNNVKK

SEQ ID NO: 1593674 - protein, 19 aa, Staphylococcus aureus
FVIYSFIFVLLLPNTFYMV

SEQ ID NO: 1593675 - protein, 17 aa, Staphylococcus aureus
FWPVYLVVTGIAIVVPC

SEQ ID NO: 1593676 - protein, 21 aa, Staphylococcus aureus
FYTLSWLIISISLILNLIKVL

SEQ ID NO: 1593677 - protein, 25 aa, Staphylococcus aureus
GALVGSALGLYFKNKVYQKADDLKV

SEQ ID NO: 1593678 - protein, 31 aa, Staphylococcus aureus
GEENPFIGTTVFGGLSLALGAALLAGRRREL

SEQ ID NO: 1593679 - protein, 30 aa, Staphylococcus aureus
GFSMSFLNAIFIALPIFLAAKIFNNVLSHK

SEQ ID NO: 1593680 - protein, 19 aa, Staphylococcus aureus
GGEKIPQGHKDIFDPNLPT

SEQ ID NO: 1593681 - protein, 24 aa, Staphylococcus aureus
GGLSFVLLLIQQWLFLNPNHNLNQ

SEQ ID NO: 1593682 - protein, 17 aa, Staphylococcus aureus
GGSLFYLLALLSFPMPV

SEQ ID NO: 1593683 - protein, 18 aa, Staphylococcus aureus
GGYAMMLPKQDRFLMTEQ

SEQ ID NO: 1593684 - protein, 27 aa, Staphylococcus aureus
GICMAIVSMLLIGMAISNVSKGQYAKR

SEQ ID NO: 1593685 - protein, 28 aa, Staphylococcus aureus
GILEFATWHWLFYINIPIAIIAIILVIW

SEQ ID NO: 1593686 - protein, 21 aa, Staphylococcus aureus
GISLDQVLASYLKTANIAKYD

SEQ ID NO: 1593687 - protein, 21 aa, Staphylococcus aureus
GISLDQVLASYLKTANLAKYD

SEQ ID NO: 1593688 - protein, 47 aa, Staphylococcus aureus
GIVMILKGTVQLIWNLIQLWFVGKILGVVRYFGGLLKGLISGIWGVI

SEQ ID NO: 1593689 - protein, 24 aa, Staphylococcus aureus
GLADIIPWVVIVLAITMIVIFVKR

SEQ ID NO: 1593690 - protein, 25 aa, Staphylococcus aureus
GLDYLLLTMLLYIPGLLVYSYVQRD

SEQ ID NO: 1593691 - protein, 19 aa, Staphylococcus aureus
GLINFMVFPPKYYGQVEEK

SEQ ID NO: 1593692 - protein, 18 aa, Staphylococcus aureus
GLLIQKRRGLNKPNILYL

SEQ ID NO: 1593693 - protein, 19 aa, Staphylococcus aureus
GMMNFIFQFLYTLFYEPLK

SEQ ID NO: 1593694 - protein, 43 aa, Staphylococcus aureus
GNFKVKFFVSLIFAIPIILLSPLMGVNLPFQFTFPGSEWVVLI

SEQ ID NO: 1593695 - protein, 19 aa, Staphylococcus aureus
GPFALDSFGWKETIPPKKD

SEQ ID NO: 1593696 - protein, 28 aa, Staphylococcus aureus
GSIAGIIILLLWLYITSFIIIVGAEINA

SEQ ID NO: 1593697 - protein, 17 aa, Staphylococcus aureus
GSKVIVNVPVKVVEKEL

SEQ ID NO: 1593698 - protein, 27 aa, Staphylococcus aureus
GTKPKIMAAIVLWLFGSIASILGLCLS

SEQ ID NO: 1593699 - protein, 28 aa, Staphylococcus aureus
GVFFICSILLFLGFIFNALLKYTNISMI

SEQ ID NO: 1593700 - protein, 19 aa, Staphylococcus aureus
GVITFWLFAQSLVNLVVPL

SEQ ID NO: 1593701 - protein, 18 aa, Staphylococcus aureus
GVVGWLTELWGKIQSTLQ

SEQ ID NO: 1593702 - protein, 23 aa, Staphylococcus aureus
GWVWTVTLVGLITLFWASLNATK

SEQ ID NO: 1593703 - protein, 32 aa, Staphylococcus aureus
HALLIMVSMLFTLLVVPWLSSKKARTLKKHAA

SEQ ID NO: 1593704 - protein, 24 aa, Staphylococcus aureus
HDGSRLLFYYAPVAILISLLSVTA

SEQ ID NO: 1593705 - protein, 19 aa, Staphylococcus aureus
HFFFIIFAYLYFGGFSFFT

SEQ ID NO: 1593706 - protein, 18 aa, Staphylococcus aureus
HIFISPSAKFIKKVSVGS

SEQ ID NO: 1593707 - protein, 17 aa, Staphylococcus aureus
HITLIYIVPFIYSFQIL

SEQ ID NO: 1593708 - protein, 31 aa, Staphylococcus aureus
HLSYYVTFLILWLLIIELLTTGLLNSISKVI

SEQ ID NO: 1593709 - protein, 23 aa, Staphylococcus aureus
HMLYIIFGFLLMYGLDYLYDMFA

SEQ ID NO: 1593710 - protein, 43 aa, Staphylococcus aureus
HQLRRSLFASTIFPVFLVIIIGLVSFYAIYIWIEHRTIHQHVN

SEQ ID NO: 1593711 - protein, 18 aa, Staphylococcus aureus
HRHFLIPSIIVIAMAGIG

SEQ ID NO: 1593712 - protein, 22 aa, Staphylococcus aureus
HRKLLVIKKLFGYSTLRANYQY

SEQ ID NO: 1593713 - protein, 23 aa, Staphylococcus aureus
HRKLLVIKKLYGYSTLRANYRYL

SEQ ID NO: 1593714 - protein, 35 aa, Staphylococcus aureus
HWQKWHAMIGIIIAIPVFVLVLTGLPWSGFMGSKI

SEQ ID NO: 1593715 - protein, 17 aa, Staphylococcus aureus
HYIMMLFATILVVQILL

SEQ ID NO: 1593716 - protein, 18 aa, Staphylococcus aureus
IAAIICIVIFKYKKVQLA

SEQ ID NO: 1593717 - protein, 17 aa, Staphylococcus aureus
IALFIVGGLLFLVSKGP

SEQ ID NO: 1593718 - protein, 19 aa, Staphylococcus aureus
ICLVSLLTILLLAISNMYV

SEQ ID NO: 1593719 - protein, 39 aa, Staphylococcus aureus
ICTVVWIVLVIILSFKFLKSLLYLKYLKKQSLYLNENEK

SEQ ID NO: 1593720 - protein, 18 aa, Staphylococcus aureus
IDLNDAMETLKHLVDNEI

SEQ ID NO: 1593721 - protein, 24 aa, Staphylococcus aureus
IDNHQIIWVMLNYEFNEARPTIGQ

SEQ ID NO: 1593722 - protein, 20 aa, Staphylococcus aureus
IDQLNRGLNLGLDDIRNTHV

SEQ ID NO: 1593723 - protein, 17 aa, Staphylococcus aureus
IDSSMFKLKSGDKTFEA

SEQ ID NO: 1593724 - protein, 26 aa, Staphylococcus aureus
IESKDEDVPLLLAKKKNQKDNQSKGK

SEQ ID NO: 1593725 - protein, 27 aa, Staphylococcus aureus
IESKDEDVPLLLAKKKNQKDNQSKGKK

SEQ ID NO: 1593726 - protein, 21 aa, Staphylococcus aureus
IFFVVFLGILFFYLNLNRRLA

SEQ ID NO: 1593727 - protein, 17 aa, Staphylococcus aureus
IFGLFYLLSGSTADYSI

SEQ ID NO: 1593728 - protein, 26 aa, Staphylococcus aureus
IFLALSAYILWGILPIYWQFVDEIGA

SEQ ID NO: 1593729 - protein, 24 aa, Staphylococcus aureus
IFLVTLLFVLWQPKGLDIGITALT

SEQ ID NO: 1593730 - protein, 19 aa, Staphylococcus aureus
IFVIAIIPLTSVIGIVGRY

SEQ ID NO: 1593731 - protein, 28 aa, Staphylococcus aureus
IGDNQVDYRFFIGFKLYLNEQEVSVKNV

SEQ ID NO: 1593732 - protein, 19 aa, Staphylococcus aureus
IGIFTLWYYWRKRKHNIDR

SEQ ID NO: 1593733 - protein, 33 aa, Staphylococcus aureus
IGLIIAVVIALIFFVLFLVTLGSKKKVKRQTEE

SEQ ID NO: 1593734 - protein, 18 aa, Staphylococcus aureus
IGLIIFISVVILIMSLFT

SEQ ID NO: 1593735 - protein, 30 aa, Staphylococcus aureus
IGSVILILIFLFLIFHLIRLATKIEDQFNK

SEQ ID NO: 1593736 - protein, 17 aa, Staphylococcus aureus
IGYSIIDLPYIPLLVLF

SEQ ID NO: 1593737 - protein, 23 aa, Staphylococcus aureus
IHKWIQFLFIVIVAMVISASMRV

SEQ ID NO: 1593738 - protein, 19 aa, Staphylococcus aureus
IIAAIFYVSNWWYIAKDVN

SEQ ID NO: 1593739 - protein, 17 aa, Staphylococcus aureus
IIACMIWYFNKAHVSII

SEQ ID NO: 1593740 - protein, 23 aa, Staphylococcus aureus
IIALLYVLLSPTHPLALIVGIIL

SEQ ID NO: 1593741 - protein, 26 aa, Staphylococcus aureus
IIAVLMGMLLIFNLFSINFQRPITYQ

SEQ ID NO: 1593742 - protein, 20 aa, Staphylococcus aureus
IIGLFVIKGYLYVKHAGFKM

SEQ ID NO: 1593743 - protein, 24 aa, Staphylococcus aureus
IIGVILCICIVASVIYLKMKYDEK

SEQ ID NO: 1593744 - protein, 23 aa, Staphylococcus aureus
IIGVILCICIVVTAIHFKIKYDE

SEQ ID NO: 1593745 - protein, 17 aa, Staphylococcus aureus
IIIAPFFSHLVKFFPPV

SEQ ID NO: 1593746 - protein, 19 aa, Staphylococcus aureus
IIIITFLIVLINLIVTFPV

SEQ ID NO: 1593747 - protein, 24 aa, Staphylococcus aureus
IINQTTNPMLNPDDITRALTQVTD

SEQ ID NO: 1593748 - protein, 26 aa, Staphylococcus aureus
IIRALITWFYTMLWSIVGVVWIVFSI

SEQ ID NO: 1593749 - protein, 23 aa, Staphylococcus aureus
IIVGLFTALIQLLTGDFSGAWET

SEQ ID NO: 1593750 - protein, 18 aa, Staphylococcus aureus
IIVLILIESLIGLRFLKG

SEQ ID NO: 1593751 - protein, 19 aa, Staphylococcus aureus
IIYILMAVIIICINIQEVP

SEQ ID NO: 1593752 - protein, 25 aa, Staphylococcus aureus
IKEPKLLIIIPILIVAFIVSKLIPV

SEQ ID NO: 1593753 - protein, 23 aa, Staphylococcus aureus
IKNTTITTLPSGWTSNLTKSDNK

SEQ ID NO: 1593754 - protein, 24 aa, Staphylococcus aureus
IKSIEDAIQHMIDEIKARTDLTDK

SEQ ID NO: 1593755 - protein, 17 aa, Staphylococcus aureus
ILFVIYEAIFRKPVNKK

SEQ ID NO: 1593756 - protein, 17 aa, Staphylococcus aureus
ILGLIIFGGVRSIANVA

SEQ ID NO: 1593757 - protein, 20 aa, Staphylococcus aureus
ILLSLTFLPEMWYIVSSIVG

SEQ ID NO: 1593758 - protein, 18 aa, Staphylococcus aureus
ILMLVVLIVFWIVGKKLE

SEQ ID NO: 1593759 - protein, 19 aa, Staphylococcus aureus
ILSLFGITALLLVVALPIY

SEQ ID NO: 1593760 - protein, 21 aa, Staphylococcus aureus
ILVSEILYYLYTRIKQLYGKI

SEQ ID NO: 1593761 - protein, 33 aa, Staphylococcus aureus
IMIAATNRPDILDPALLRPGRFDRQIQVGRPDV

SEQ ID NO: 1593762 - protein, 25 aa, Staphylococcus aureus
INFLQIIRFYYIDIFVCFVAVVFFN

SEQ ID NO: 1593763 - protein, 23 aa, Staphylococcus aureus
INSAFIVIWLIFFIAGRYYERFA

SEQ ID NO: 1593764 - protein, 21 aa, Staphylococcus aureus
INSAYIIKVVSKYTPTSDGEL

SEQ ID NO: 1593765 - protein, 40 aa, Staphylococcus aureus
INYNGDTKVMTVKYAGQTWTRNISDWIAKSGTTNFSLSMT

SEQ ID NO: 1593766 - protein, 32 aa, Staphylococcus aureus
IPIIVVLLLIGGIAWGVYAFFANTPKNTYLKS

SEQ ID NO: 1593767 - protein, 19 aa, Staphylococcus aureus
IRLKYIYIITFLEYVLLYF

SEQ ID NO: 1593768 - protein, 17 aa, Staphylococcus aureus
IRTYLYFDKYKPFLSQY

SEQ ID NO: 1593769 - protein, 18 aa, Staphylococcus aureus
ISIFALGISIYTVFYQRK

SEQ ID NO: 1593770 - protein, 32 aa, Staphylococcus aureus
ISQFYLYYIVSALLFWLVILTFGIAGIIFLMP

SEQ ID NO: 1593771 - protein, 27 aa, Staphylococcus aureus
ISQILLTTSVLWILNYTGNLDLFILRL

SEQ ID NO: 1593772 - protein, 20 aa, Staphylococcus aureus
ITFILFFIIYVIHPINADWL

SEQ ID NO: 1593773 - protein, 17 aa, Staphylococcus aureus
ITIPVLFITLIGLYLTL

SEQ ID NO: 1593774 - protein, 32 aa, Staphylococcus aureus
ITKLFLGIILFFFIIFVHNFDFMLYITILMLV

SEQ ID NO: 1593775 - protein, 18 aa, Staphylococcus aureus
IVFGFFALTYVTPVLRSF

SEQ ID NO: 1593776 - protein, 17 aa, Staphylococcus aureus
IVIFKYKKVQLAGLKFS

SEQ ID NO: 1593777 - protein, 17 aa, Staphylococcus aureus
IVMLWLTIILNTLICQL

SEQ ID NO: 1593778 - protein, 17 aa, Staphylococcus aureus
IVPYMIFFAFFSIYYFL

SEQ ID NO: 1593779 - protein, 23 aa, Staphylococcus aureus
IVRFIVRVLLPLSCLISILLMTQ

SEQ ID NO: 1593780 - protein, 31 aa, Staphylococcus aureus
IYGTFMIAVFILNFKLIFTLPLTILNRQSLF

SEQ ID NO: 1593781 - protein, 18 aa, Staphylococcus aureus
IYIPFMILPIFNSMKAIP

SEQ ID NO: 1593782 - protein, 18 aa, Staphylococcus aureus
IYTFTDYVNTKDDVKATL

SEQ ID NO: 1593783 - protein, 18 aa, Staphylococcus aureus
KALHWQKWHAMIGIIIAI

SEQ ID NO: 1593784 - protein, 26 aa, Staphylococcus aureus
KALIFLLYFILVINSALFIWINSAFY

SEQ ID NO: 1593785 - protein, 20 aa, Staphylococcus aureus
KDLINQTGNPTLDKAQVEQL

SEQ ID NO: 1593786 - protein, 27 aa, Staphylococcus aureus
KENSKIHHLAYINPKKSDMTSITINGF

SEQ ID NO: 1593787 - protein, 25 aa, Staphylococcus aureus
KFGQGLFHLLFFWTGIPTIISIIHA

SEQ ID NO: 1593788 - protein, 26 aa, Staphylococcus aureus
KFGQGLFHLLFFWTGIPTIISIIHAI

SEQ ID NO: 1593789 - protein, 22 aa, Staphylococcus aureus
KFILPIVVGLLIWALTPFKPDA

SEQ ID NO: 1593790 - protein, 18 aa, Staphylococcus aureus
KGFSFHVLLSLTEILKGC

SEQ ID NO: 1593791 - protein, 19 aa, Staphylococcus aureus
KGLITGIWDVIKSIFSKSL

SEQ ID NO: 1593792 - protein, 20 aa, Staphylococcus aureus
KIRYTFTDYINNKNNLMAEL

SEQ ID NO: 1593793 - protein, 17 aa, Staphylococcus aureus
KKDVFIFNKKVNGYHVW

SEQ ID NO: 1593794 - protein, 31 aa, Staphylococcus aureus
KKKGSIEGTKHLPLLFAKRRRKEDEEDAIVE

SEQ ID NO: 1593795 - protein, 25 aa, Staphylococcus aureus
KLDYTLFIFIIVLAIIGIVRLITGN

SEQ ID NO: 1593796 - protein, 22 aa, Staphylococcus aureus
KLGRVFLLIPLSIILILIMRKK

SEQ ID NO: 1593797 - protein, 19 aa, Staphylococcus aureus
KLNYGFSVPNEAVQGDTFK

SEQ ID NO: 1593798 - protein, 27 aa, Staphylococcus aureus
KNNLMAELNLNLFIDPTTVTKQGKQTV

SEQ ID NO: 1593799 - protein, 18 aa, Staphylococcus aureus
KNRIKCMLVDRPTLLKHT

SEQ ID NO: 1593800 - protein, 42 aa, Staphylococcus aureus
KNSERRGMLKGCGGCLISFILLIILLSACSMMFSNKDNSTSN

SEQ ID NO: 1593801 - protein, 22 aa, Staphylococcus aureus
KPYFGLSLIVFIVLLSGLTFIP

SEQ ID NO: 1593802 - protein, 24 aa, Staphylococcus aureus
KQDLTEVQALDQLMDALQQSIADK

SEQ ID NO: 1593803 - protein, 17 aa, Staphylococcus aureus
KQGAYTDAYNAAKNIVN

SEQ ID NO: 1593804 - protein, 21 aa, Staphylococcus aureus
KQSFESQITQAPLVTDVTTIN

SEQ ID NO: 1593805 - protein, 31 aa, Staphylococcus aureus
KQSKLIPIFICIFTFLLMVIQSQFLMGQSIT

SEQ ID NO: 1593806 - protein, 40 aa, Staphylococcus aureus
KRYFNYMLNYKVWYLTLLAGLIPFIPIKFSFFKFNNLNNQ

SEQ ID NO: 1593807 - protein, 20 aa, Staphylococcus aureus
KSDIGRLTDLNNAQRTAANA

SEQ ID NO: 1593808 - protein, 21 aa, Staphylococcus aureus
KSGDYFTAKLPDSVTGNGDVD

SEQ ID NO: 1593809 - protein, 25 aa, Staphylococcus aureus
KSKLKYTAKWFPFGPIFAAILCIVV

SEQ ID NO: 1593810 - protein, 29 aa, Staphylococcus aureus
KSNEQIIFTPQLVFVITDMSLIIDHVILE

SEQ ID NO: 1593811 - protein, 28 aa, Staphylococcus aureus
KSYFNGAPWLFFFPGVLLGGFALLCQII

SEQ ID NO: 1593812 - protein, 26 aa, Staphylococcus aureus
KVAGYLFYFAVSVGVISFIVWMLIQN

SEQ ID NO: 1593813 - protein, 29 aa, Staphylococcus aureus
KVIERILLALILPLIILIIGMYSFNTFAD

SEQ ID NO: 1593814 - protein, 17 aa, Staphylococcus aureus
KVRPVTLTLSRADTKKI

SEQ ID NO: 1593815 - protein, 19 aa, Staphylococcus aureus
KVRYTFKEYVQEKKDLTAE

SEQ ID NO: 1593816 - protein, 20 aa, Staphylococcus aureus
KVVLLPTHRGTVSSGTEGSG

SEQ ID NO: 1593817 - protein, 34 aa, Staphylococcus aureus
KYIIFGIVLAITLLIVGIAYYLISLNNAKGQVKE

SEQ ID NO: 1593818 - protein, 29 aa, Staphylococcus aureus
KYMGYLIFVFFIFVFGLLFINVETRRAIY

SEQ ID NO: 1593819 - protein, 19 aa, Staphylococcus aureus
KYNPYILNQINKLGKDYGE

SEQ ID NO: 1593820 - protein, 28 aa, Staphylococcus aureus
LAAILMGPLVVYWNWTWGVTVAIILGIG

SEQ ID NO: 1593821 - protein, 17 aa, Staphylococcus aureus
LALIYASIGIIIYVSLR

SEQ ID NO: 1593822 - protein, 19 aa, Staphylococcus aureus
LAQAKQDALANLDTLRDLN

SEQ ID NO: 1593823 - protein, 27 aa, Staphylococcus aureus
LAVVEFGLFVAVLGPLVFMFGLFISVM

SEQ ID NO: 1593824 - protein, 19 aa, Staphylococcus aureus
LDFITNLAGFIAKLFEAHP

SEQ ID NO: 1593825 - protein, 18 aa, Staphylococcus aureus
LEETVAFTKERVEGFLNK

SEQ ID NO: 1593826 - protein, 19 aa, Staphylococcus aureus
LETPFGYLISLDKVLKSIQ

SEQ ID NO: 1593827 - protein, 19 aa, Staphylococcus aureus
LFEWKYFTYLLLGVFLAIY

SEQ ID NO: 1593828 - protein, 30 aa, Staphylococcus aureus
LGGLSWPIVLVILILFYFYSHYLFASSTAH

SEQ ID NO: 1593829 - protein, 25 aa, Staphylococcus aureus
LGIVILLVLIIGFKLNTFISLIITS

SEQ ID NO: 1593830 - protein, 28 aa, Staphylococcus aureus
LGMKSIPIFFILMFFSMQLVTLPKQMLP

SEQ ID NO: 1593831 - protein, 28 aa, Staphylococcus aureus
LGVASVAISTLLLLMSNGEAKAAEETGG

SEQ ID NO: 1593832 - protein, 26 aa, Staphylococcus aureus
LGYTSLWFFGLIAIVIVAFFIFLKVE

SEQ ID NO: 1593833 - protein, 18 aa, Staphylococcus aureus
LHLIIFHIFSIAMSYNPL

SEQ ID NO: 1593834 - protein, 19 aa, Staphylococcus aureus
LHMRHFSNNFGNVIKNAIG

SEQ ID NO: 1593835 - protein, 18 aa, Staphylococcus aureus
LILSIILVFTYLKSGRNL

SEQ ID NO: 1593836 - protein, 18 aa, Staphylococcus aureus
LINQTNNPTLDKAQVEQL

SEQ ID NO: 1593837 - protein, 24 aa, Staphylococcus aureus
LIPIFLVIICMIVVFNFSTFKSGF

SEQ ID NO: 1593838 - protein, 32 aa, Staphylococcus aureus
LITIKKNGKTFFFIDKLEFKPKLTSVYVKEFN

SEQ ID NO: 1593839 - protein, 17 aa, Staphylococcus aureus
LIVFIVLLSGLTFIPVL

SEQ ID NO: 1593840 - protein, 34 aa, Staphylococcus aureus
LKEVTDQFKNRIYYEHPNVASIKFGDITKTYVVL

SEQ ID NO: 1593841 - protein, 29 aa, Staphylococcus aureus
LLALGVILLLLLIFIGIKYLSFVKTISQQ

SEQ ID NO: 1593842 - protein, 17 aa, Staphylococcus aureus
LLDFRLPRMMITILAGA

SEQ ID NO: 1593843 - protein, 19 aa, Staphylococcus aureus
LLIILTFAKLAQFANDVIL

SEQ ID NO: 1593844 - protein, 19 aa, Staphylococcus aureus
LLIPLYVQNSLALSALLSG

SEQ ID NO: 1593845 - protein, 17 aa, Staphylococcus aureus
LLIVWLSYPLVTAIIGC

SEQ ID NO: 1593846 - protein, 25 aa, Staphylococcus aureus
LLLISGLLFLFFFKESEEIIPESSN

SEQ ID NO: 1593847 - protein, 18 aa, Staphylococcus aureus
LLMTFYYIKLFYEDKHNI

SEQ ID NO: 1593848 - protein, 17 aa, Staphylococcus aureus
LLTYVFDIPNVTLTLAV

SEQ ID NO: 1593849 - protein, 17 aa, Staphylococcus aureus
LLYFALMIIIISVAAKT

SEQ ID NO: 1593850 - protein, 18 aa, Staphylococcus aureus
LMPFLYFTTAWSIAGFAS

SEQ ID NO: 1593851 - protein, 28 aa, Staphylococcus aureus
LNEVAGWNLTLFIVFRLISGAVVAGVLS

SEQ ID NO: 1593852 - protein, 23 aa, Staphylococcus aureus
LNFDFMRYSLISGILIGFIAPLI

SEQ ID NO: 1593853 - protein, 26 aa, Staphylococcus aureus
LNWVAVIIYLLAMLFIGVYFTKRASQ

SEQ ID NO: 1593854 - protein, 27 aa, Staphylococcus aureus
LPEDTTHVRWFLNINNEKRYVSKDITI

SEQ ID NO: 1593855 - protein, 29 aa, Staphylococcus aureus
LPEILYVICCIIGYLFFGLGLGIYATPST

SEQ ID NO: 1593856 - protein, 29 aa, Staphylococcus aureus
LPMLLPFLCALILVFLKNNDRISKYLYLG

SEQ ID NO: 1593857 - protein, 25 aa, Staphylococcus aureus
LPNRKDFVVSFITGALVGSALGLYF

SEQ ID NO: 1593858 - protein, 20 aa, Staphylococcus aureus
LPVYLLVFMAFTAVILIMMY

SEQ ID NO: 1593859 - protein, 19 aa, Staphylococcus aureus
LRAIVQLIILGFLLHYIFK

SEQ ID NO: 1593860 - protein, 19 aa, Staphylococcus aureus
LSISIIILVAISIAIHITL

SEQ ID NO: 1593861 - protein, 34 aa, Staphylococcus aureus
LTHKYIGMPIFLAIMWLIFQTTFTWIGTPLSDQL

SEQ ID NO: 1593862 - protein, 18 aa, Staphylococcus aureus
LTILIYSIGIIILLLLCN

SEQ ID NO: 1593863 - protein, 25 aa, Staphylococcus aureus
LTIYVLVALMYWVVCFIISIIQGIY

SEQ ID NO: 1593864 - protein, 18 aa, Staphylococcus aureus
LTQERYLRLLQKHSKLKF

SEQ ID NO: 1593865 - protein, 17 aa, Staphylococcus aureus
LVEGLIVGLIAMNKFHV

SEQ ID NO: 1593866 - protein, 52 aa, Staphylococcus aureus
LVGVIITLVGAFRFLIAPILAVMDFLGPLAARLVALVTKFGWAKTGTLVLSK

SEQ ID NO: 1593867 - protein, 18 aa, Staphylococcus aureus
LVIEIVILELIIGAILTL

SEQ ID NO: 1593868 - protein, 20 aa, Staphylococcus aureus
LVIVIMIMSLLKKPTPRPAS

SEQ ID NO: 1593869 - protein, 20 aa, Staphylococcus aureus
LVTIPISIFAFKKVMSGFNE

SEQ ID NO: 1593870 - protein, 24 aa, Staphylococcus aureus
LVTMVLFALLLFQVIFKIGQFSIY

SEQ ID NO: 1593871 - protein, 21 aa, Staphylococcus aureus
LYISIMVLSIFIIGCGKGNEI

SEQ ID NO: 1593872 - protein, 24 aa, Staphylococcus aureus
MEGRTTIVIAHRLSTIKKAGQIIF

SEQ ID NO: 1593873 - protein, 18 aa, Staphylococcus aureus
MFIMYFFGHPLSYSTMAL

SEQ ID NO: 1593874 - protein, 20 aa, Staphylococcus aureus
MITALFITVISVLLTFHLKQ

SEQ ID NO: 1593875 - protein, 21 aa, Staphylococcus aureus
MIVPWRVAMLYKYKKLKKTLI

SEQ ID NO: 1593876 - protein, 18 aa, Staphylococcus aureus
MLHVTPPMGPLDVVKEST

SEQ ID NO: 1593877 - protein, 17 aa, Staphylococcus aureus
MNKLRYLYGHTAAYTRE

SEQ ID NO: 1593878 - protein, 18 aa, Staphylococcus aureus
MNLLIFVLLTVFICSLMV

SEQ ID NO: 1593879 - protein, 17 aa, Staphylococcus aureus
MPFLYFTTAWSLAGFAS

SEQ ID NO: 1593880 - protein, 17 aa, Staphylococcus aureus
MSNLQRGINDEAATKAA

SEQ ID NO: 1593881 - protein, 28 aa, Staphylococcus aureus
MTPFYTALSVWVGALLMVSLLTVDNKHK

SEQ ID NO: 1593882 - protein, 18 aa, Staphylococcus aureus
MVLFLNRNIKKATGYYYT

SEQ ID NO: 1593883 - protein, 20 aa, Staphylococcus aureus
NAIIQKPIRSVQEVQTALTN

SEQ ID NO: 1593884 - protein, 17 aa, Staphylococcus aureus
NAKDLINQTGNPTLDKA

SEQ ID NO: 1593885 - protein, 22 aa, Staphylococcus aureus
NAKDLINQTGNPTLDKSQVEQL

SEQ ID NO: 1593886 - protein, 17 aa, Staphylococcus aureus
NAKDLINQTNNPTLDKA

SEQ ID NO: 1593887 - protein, 20 aa, Staphylococcus aureus
NAMDQLKQAIGDHDTIVAGG

SEQ ID NO: 1593888 - protein, 18 aa, Staphylococcus aureus
NCQHIFSPSLWQVIKAKH

SEQ ID NO: 1593889 - protein, 43 aa, Staphylococcus aureus
NDKELLFRTNLHGYHANYGYYYYYPVSLTWDNGVAFYSNNAQG

SEQ ID NO: 1593890 - protein, 34 aa, Staphylococcus aureus
NDNPIRYVIAILVVVLMVLGVFQLGIIGRLIDSF

SEQ ID NO: 1593891 - protein, 35 aa, Staphylococcus aureus
NDNPIRYVIAILVVVLMVLGVFQLGIIGRLIDSFF

SEQ ID NO: 1593892 - protein, 42 aa, Staphylococcus aureus
NFGNVIKNAIGVVGISGLLASFWFFIAKRRRKEDEEEELEIR

SEQ ID NO: 1593893 - protein, 20 aa, Staphylococcus aureus
NGFIQSLKDDPSQSANLLAE

SEQ ID NO: 1593894 - protein, 21 aa, Staphylococcus aureus
NGIANIKALPSGDYILKEIEA

SEQ ID NO: 1593895 - protein, 24 aa, Staphylococcus aureus
NGRIRYTFTDYIKDKVNVTANLEI

SEQ ID NO: 1593896 - protein, 20 aa, Staphylococcus aureus
NGVIIYALGNKFLKLFRITN

SEQ ID NO: 1593897 - protein, 40 aa, Staphylococcus aureus
NICTVIWIVLVIILSFKFLNSLLYLKYLKKQSLYLNEKEK

SEQ ID NO: 1593898 - protein, 19 aa, Staphylococcus aureus
NIDPATGKDYSIFGWNNEN

SEQ ID NO: 1593899 - protein, 21 aa, Staphylococcus aureus
NIKTIKIGLSALGYKVDNETT

SEQ ID NO: 1593900 - protein, 23 aa, Staphylococcus aureus
NILLMIMIIPTWINLLLKTYAFI

SEQ ID NO: 1593901 - protein, 24 aa, Staphylococcus aureus
NKDVTKIKIYQAPKDYVLNKGYDV

SEQ ID NO: 1593902 - protein, 25 aa, Staphylococcus aureus
NKDVTKIKIYQAPKDYVLNKGYDVN

SEQ ID NO: 1593903 - protein, 23 aa, Staphylococcus aureus
NKFRLVIEIVILELIIGAILTLI

SEQ ID NO: 1593904 - protein, 23 aa, Staphylococcus aureus
NKYSYRKLFLVALVLFTIGSLIC

SEQ ID NO: 1593905 - protein, 24 aa, Staphylococcus aureus
NLEQYKLLIMSTLSQYTFDKYYRN

SEQ ID NO: 1593906 - protein, 20 aa, Staphylococcus aureus
NLKANYDNAIANAAHELDKV

SEQ ID NO: 1593907 - protein, 32 aa, Staphylococcus aureus
NNGESLDKVKHTPFFLPKRRRKEDEEDVEVTN

SEQ ID NO: 1593908 - protein, 22 aa, Staphylococcus aureus
NNGIARISAVQIVTSDRAKQSS

SEQ ID NO: 1593909 - protein, 23 aa, Staphylococcus aureus
NNGIARISAVQIVTSDRAKQSSS

SEQ ID NO: 1593910 - protein, 62 aa, Staphylococcus aureus
NNTFQDFDINYNGDTKVMTVTYAGQTWTRNISDWIAKSGTTNFSLSMTASTGGATNLQQVQF

SEQ ID NO: 1593911 - protein, 25 aa, Staphylococcus aureus
NNTYRQTIYVNPSGDNVVLPALTGN

SEQ ID NO: 1593912 - protein, 17 aa, Staphylococcus aureus
NPGKLLNYVLKAFGVDF

SEQ ID NO: 1593913 - protein, 21 aa, Staphylococcus aureus
NPKIIYVILPLAIGILNISLI

SEQ ID NO: 1593914 - protein, 25 aa, Staphylococcus aureus
NQLNYAEFFICIVLSLGVVAPIKNF

SEQ ID NO: 1593915 - protein, 18 aa, Staphylococcus aureus
NRKIIIILALLMGALGFS

SEQ ID NO: 1593916 - protein, 32 aa, Staphylococcus aureus
NRVPSIVDFLYDFWWLFFPVAGFLVWAIHSFM

SEQ ID NO: 1593917 - protein, 18 aa, Staphylococcus aureus
NSAYALGGPKLLRKTLDK

SEQ ID NO: 1593918 - protein, 19 aa, Staphylococcus aureus
NSAYIIKVVSKYTPTSDGE

SEQ ID NO: 1593919 - protein, 48 aa, Staphylococcus aureus
NTFQDFDINYNGDTKVMTVKYAGQTWTRNISDWIAKSGTTNFSLSMTA

SEQ ID NO: 1593920 - protein, 24 aa, Staphylococcus aureus
NTINGLPHLTQLQKDNLKHQVEQA

SEQ ID NO: 1593921 - protein, 23 aa, Staphylococcus aureus
NTINGLPNLTQLQKDNLKHQVEQ

SEQ ID NO: 1593922 - protein, 39 aa, Staphylococcus aureus; identical to SEQ ID NO: 1584299

SEQ ID NO: 1593923 - protein, 25 aa, Staphylococcus aureus
NTMRKMVQNLWWGAGYNIVAVPLAA

SEQ ID NO: 1593924 - protein, 18 aa, Staphylococcus aureus
NVETHGISPLRKVPDIKS

SEQ ID NO: 1593925 - protein, 23 aa, Staphylococcus aureus
NVFTLLMFVSIRRYQRTSQIHSY

SEQ ID NO: 1593926 - protein, 24 aa, Staphylococcus aureus
NVILLILSIFTWNLFHWGTNPTVQ

SEQ ID NO: 1593927 - protein, 18 aa, Staphylococcus aureus
NWGVTVNGRITLLDKENS

SEQ ID NO: 1593928 - protein, 35 aa, Staphylococcus aureus
NYTGNLDLFILRLVLLSCLFILTISVINLWTFLML

SEQ ID NO: 1593929 - protein, 20 aa, Staphylococcus aureus
PFSAVIIILYALDLVIRNSF

SEQ ID NO: 1593930 - protein, 30 aa, Staphylococcus aureus
PIGDQSSEVFSPISPIKIATQDNSGNAVTN

SEQ ID NO: 1593931 - protein, 19 aa, Staphylococcus aureus
PIILFLLCLTVFKMKGIYA

SEQ ID NO: 1593932 - protein, 20 aa, Staphylococcus aureus
PIITNIMFLGVILSILLVII

SEQ ID NO: 1593933 - protein, 19 aa, Staphylococcus aureus
PINFILKSSTKLKADIDFD

SEQ ID NO: 1593934 - protein, 19 aa, Staphylococcus aureus
PIVPELLKSLNFNQFNLVD

SEQ ID NO: 1593935 - protein, 17 aa, Staphylococcus aureus
PLIVNQIFEPSHYDDMF

SEQ ID NO: 1593936 - protein, 23 aa, Staphylococcus aureus
PNKLPNAVFWLKTYPERLKQARA

SEQ ID NO: 1593937 - protein, 20 aa, Staphylococcus aureus
PNVKIYEYVGVENGLPQSVY

SEQ ID NO: 1593938 - protein, 31 aa, Staphylococcus aureus
PQGHKDEFDPNLPIDGTEEVPGKPGIKNPET

SEQ ID NO: 1593939 - protein, 29 aa, Staphylococcus aureus
PSGDNVVLPALTGNLIPNTKSNALIDAKN

SEQ ID NO: 1593940 - protein, 22 aa, Staphylococcus aureus
PTAWYMFAIFVATIIACITQPM

SEQ ID NO: 1593941 - protein, 25 aa, Staphylococcus aureus
PTMNIILLALGYFVIPFVSAFIVHE

SEQ ID NO: 1593942 - protein, 19 aa, Staphylococcus aureus
PTVKVYEYLRSDELPESVY

SEQ ID NO: 1593943 - protein, 18 aa, Staphylococcus aureus
PVLIAKRLKDKDGNVETT

SEQ ID NO: 1593944 - protein, 17 aa, Staphylococcus aureus
QAIADHDTIVAGGNYTN

SEQ ID NO: 1593945 - protein, 52 aa, Staphylococcus aureus
QALQNICNFIKVIFEFILNFVIKPIMFAIWQVMQFIWPAVKALIVSTWENIK

SEQ ID NO: 1593946 - protein, 29 aa, Staphylococcus aureus
QAVNPSTPRMRAFSLAAVAADAPAAGTDI

SEQ ID NO: 1593947 - protein, 26 aa, Staphylococcus aureus
QDALANLDTLRDLNQPQRDALRNQIN

SEQ ID NO: 1593948 - protein, 17 aa, Staphylococcus aureus
QFKAQLKAANPFAKELE

SEQ ID NO: 1593949 - protein, 33 aa, Staphylococcus aureus
QFTFPGSEWVVLILSTILFFYGGKPFLSGGKDE

SEQ ID NO: 1593950 - protein, 19 aa, Staphylococcus aureus
QGFTKIIIVLIVSPIIAFC

SEQ ID NO: 1593951 - protein, 20 aa, Staphylococcus aureus
QGIVLYYIVAIVVAFLLLNL

SEQ ID NO: 1593952 - protein, 24 aa, Staphylococcus aureus
QIANGTPTPVLAPDTVTKAVTTMN

SEQ ID NO: 1593953 - protein, 17 aa, Staphylococcus aureus
QIIFLDKGQVTGKGTHS

SEQ ID NO: 1593954 - protein, 18 aa, Staphylococcus aureus
QIVISDRAKQSSSTGNES

SEQ ID NO: 1593955 - protein, 23 aa, Staphylococcus aureus
QKGAITLGTRIDSNKSFHFSGKV

SEQ ID NO: 1593956 - protein, 24 aa, Staphylococcus aureus
QKGAITLGTRIDSNKSFHFSGKVN

SEQ ID NO: 1593957 - protein, 53 aa, Staphylococcus aureus
QKNNTVIWRSIIPPLVMIALTVVIFLVRPIGIYILMMIGMSSVTIVFGITTYF

SEQ ID NO: 1593958 - protein, 23 aa, Staphylococcus aureus
QLTEALFAEKPVAKNDLKEIPQL

SEQ ID NO: 1593959 - protein, 18 aa, Staphylococcus aureus
QLTHLNNAQRQLAIQQIN

SEQ ID NO: 1593960 - protein, 30 aa, Staphylococcus aureus
QMRNQLPISYLYEGVGILETPFGPIVSLSE

SEQ ID NO: 1593961 - protein, 38 aa, Staphylococcus aureus
QMVGHPEQLYKYYYDRGYTLTWDNGLVLYSNKANGNGK

SEQ ID NO: 1593962 - protein, 18 aa, Staphylococcus aureus
QNAESIIAGLNNPTINKG

SEQ ID NO: 1593963 - protein, 29 aa, Staphylococcus aureus
QPISGIVMLLTIAIILGFGALEIATGAIT

SEQ ID NO: 1593964 - protein, 22 aa, Staphylococcus aureus
QPQRDALRNQINQAQALATVEQ

SEQ ID NO: 1593965 - protein, 26 aa, Staphylococcus aureus
QQEQAYIEQFNPEQFTIEQAKSNAIK

SEQ ID NO: 1593966 - protein, 28 aa, Staphylococcus aureus
QQVKGLMIASIQALIPVIAGLVPAIMAV

SEQ ID NO: 1593967 - protein, 30 aa, Staphylococcus aureus
QQVKGLMIASIQALIPVIAGLVPAIMAVLN

SEQ ID NO: 1593968 - protein, 18 aa, Staphylococcus aureus
QRIDIARSFVKNPDILLL

SEQ ID NO: 1593969 - protein, 24 aa, Staphylococcus aureus
QSGNTFMAANFKVAGKVKSGDYFT

SEQ ID NO: 1593970 - protein, 31 aa, Staphylococcus aureus
QSIDEIAQQLEQFKAQLKAANPFAKELENRK

SEQ ID NO: 1593971 - protein, 25 aa, Staphylococcus aureus
QSSSPAAMFVLVTGIGLIATVRRRK

SEQ ID NO: 1593972 - protein, 28 aa, Staphylococcus aureus
QTAIINSLTFTETVPNRSYARASANEIT

SEQ ID NO: 1593973 - protein, 25 aa, Staphylococcus aureus
QVDQALQNILNAKQALNGDERVALA

SEQ ID NO: 1593974 - protein, 18 aa, Staphylococcus aureus
QVQWLTTAFLLTNGIVIP

SEQ ID NO: 1593975 - protein, 27 aa, Staphylococcus aureus
QYFVVQFIITLFLIWLPTYLTEVFHVN

SEQ ID NO: 1593976 - protein, 20 aa, Staphylococcus aureus
RANYRYLLINNIVVVFIGIL

SEQ ID NO: 1593977 - protein, 17 aa, Staphylococcus aureus
RAQSIDEIAQQLEQFKA

SEQ ID NO: 1593978 - protein, 18 aa, Staphylococcus aureus
RGKQGTGLGLFICKMIIE

SEQ ID NO: 1593979 - protein, 42 aa, Staphylococcus aureus
RIGNVIKNALGVVGISGLLASFWFFIAKRRRKEDEEEELEIR

SEQ ID NO: 1593980 - protein, 38 aa, Staphylococcus aureus
RILKSYPYMLSGGMLQRLMIALALALKPKLIIADEPTT

SEQ ID NO: 1593981 - protein, 19 aa, Staphylococcus aureus
RIPKGVLLVGPPGTGKTLL

SEQ ID NO: 1593982 - protein, 26 aa, Staphylococcus aureus
RKYILVTFWTIIILTLLITFPTNSHH

SEQ ID NO: 1593983 - protein, 20 aa, Staphylococcus aureus
RSLMLPVAILPAAAIIAGIG

SEQ ID NO: 1593984 - protein, 31 aa, Staphylococcus aureus
RTILDQYVNYFMFFNVIATLLTLYVIANYLD

SEQ ID NO: 1593985 - protein, 29 aa, Staphylococcus aureus
RVEALQNIYLRVYYPPVVIGLTALVTVIV

SEQ ID NO: 1593986 - protein, 20 aa, Staphylococcus aureus
RYYYYFSVLFMLIGIIGAFT

SEQ ID NO: 1593987 - protein, 35 aa, Staphylococcus aureus
SAILMKNKWPFLIALPFMIGYGIGVTFYYQQKVAY

SEQ ID NO: 1593988 - protein, 27 aa, Staphylococcus aureus
SAKLVLAIVLIFIIVCSNLYYIRLSFY

SEQ ID NO: 1593989 - protein, 23 aa, Staphylococcus aureus
SALLIVYFIYYIFEKNINFKAYA

SEQ ID NO: 1593990 - protein, 17 aa, Staphylococcus aureus
SAWGLFSGVFGKSTNIN

SEQ ID NO: 1593991 - protein, 22 aa, Staphylococcus aureus
SAWGYWFAAFLGNVAYATLLMS

SEQ ID NO: 1593992 - protein, 23 aa, Staphylococcus aureus
SDGLTWLYEFGGAIGGLIFGLLY

SEQ ID NO: 1593993 - protein, 23 aa, Staphylococcus aureus
SDKDYAYIRFPVSNGAREVKIVS

SEQ ID NO: 1593994 - protein, 36 aa, Staphylococcus aureus
SDMTSITINGFFAKGGLYTGNVPTVKVYEYLRSDEL

SEQ ID NO: 1593995 - protein, 20 aa, Staphylococcus aureus
SEMYYFYDLNKKSSYIYEQY

SEQ ID NO: 1593996 - protein, 20 aa, Staphylococcus aureus
SGFIFFFIVYVLCISCFNSD

SEQ ID NO: 1593997 - protein, 22 aa, Staphylococcus aureus
SGFILYMILIFTLSMIVNIHIL

SEQ ID NO: 1593998 - protein, 22 aa, Staphylococcus aureus
SGGILMAIVFLFGVDSFKPKSS

SEQ ID NO: 1593999 - protein, 17 aa, Staphylococcus aureus
SIKAFPLAIGALYLPVI

SEQ ID NO: 1594000 - protein, 39 aa, Staphylococcus aureus
SISLIICLIVLGLLMPLFGLSLILVFIIELILYIKDRRA

SEQ ID NO: 1594001 - protein, 21 aa, Staphylococcus aureus
SKEFDIKYLDGVKDNWGVTVN

SEQ ID NO: 1594002 - protein, 19 aa, Staphylococcus aureus
SLFYLLALLSFPMPVKVIR

SEQ ID NO: 1594003 - protein, 17 aa, Staphylococcus aureus
SLNTAMGNLINAIADHQ

SEQ ID NO: 1594004 - protein, 26 aa, Staphylococcus aureus
SLTAKVEVTLLDGSKVIVNVPVKVVE

SEQ ID NO: 1594005 - protein, 24 aa, Staphylococcus aureus
SQTLNTAMKGLRDSIANEATIKAG

SEQ ID NO: 1594006 - protein, 21 aa, Staphylococcus aureus
SSIVYLIFPIAGIFFNEVYGP

SEQ ID NO: 1594007 - protein, 23 aa, Staphylococcus aureus
SSTMIVISIPRFEEYMKARHKKW

SEQ ID NO: 1594008 - protein, 30 aa, Staphylococcus aureus
STIHQSFNLPYWLSALILVAFILATLFLKF

SEQ ID NO: 1594009 - protein, 20 aa, Staphylococcus aureus
STLFLLLYFLVNGISLIIQG

SEQ ID NO: 1594010 - protein, 19 aa, Staphylococcus aureus
STLSQYTFDKYYRNKFEVL

SEQ ID NO: 1594011 - protein, 25 aa, Staphylococcus aureus
SVAGGGAFGAFVTTDSTGVATTYTS

SEQ ID NO: 1594012 - protein, 25 aa, Staphylococcus aureus
SVFDSFRILQPYSAPPKPPNPNYPF

SEQ ID NO: 1594013 - protein, 20 aa, Staphylococcus aureus
SVPIRILIFYVGALAVIMSI

SEQ ID NO: 1594014 - protein, 23 aa, Staphylococcus aureus
SVQLYQMKISFLPALGFNQILLE

SEQ ID NO: 1594015 - protein, 17 aa, Staphylococcus aureus
SWFYLPITYATRYVYMF

SEQ ID NO: 1594016 - protein, 17 aa, Staphylococcus aureus
SYIRRLFGYTAIHFIIT

SEQ ID NO: 1594017 - protein, 32 aa, Staphylococcus aureus
TAGTLIAMIFYVIQLSMPLINLSTLVTDYKKA

SEQ ID NO: 1594018 - protein, 23 aa, Staphylococcus aureus
TDIPFYILGFLAAFTVGLIAIKT

SEQ ID NO: 1594019 - protein, 38 aa, Staphylococcus aureus
TEVISPTLFVLLMYLLSMITAYIFYSYERAKGQMNFIK

SEQ ID NO: 1594020 - protein, 17 aa, Staphylococcus aureus
TFALTYYLLLAPKWYIA

SEQ ID NO: 1594021 - protein, 22 aa, Staphylococcus aureus
TFDNWYNMYLKEVKGSLLLELA

SEQ ID NO: 1594022 - protein, 33 aa, Staphylococcus aureus
TGHTMDFFWELATLILIMLLGHWIEMNAVGNAG

SEQ ID NO: 1594023 - protein, 24 aa, Staphylococcus aureus
TGIIWLVLIYLAQILAYALNTLSN

SEQ ID NO: 1594024 - protein, 24 aa, Staphylococcus aureus
TGKDYSIFGWNNENVVRYGGGSAD

SEQ ID NO: 1594025 - protein, 22 aa, Staphylococcus aureus
TGKIYLQVKLKGQIDKEQLVFQ

SEQ ID NO: 1594026 - protein, 40 aa, Staphylococcus aureus
TGVIKDADNWTLDSGFYKTPKYSLGDYVWYDSNKDGKQDS

SEQ ID NO: 1594027 - protein, 18 aa, Staphylococcus aureus
TIDQLTHLNADQIATAKQ

SEQ ID NO: 1594028 - protein, 27 aa, Staphylococcus aureus
TILGLALMMLLIFNNIGIISITDFTNR

SEQ ID NO: 1594029 - protein, 39 aa, Staphylococcus aureus
TILKGAFMLLKGPLKIISVIFQLLFGKIGLIRNAITGLV

SEQ ID NO: 1594030 - protein, 21 aa, Staphylococcus aureus
TINGLQHLTTAQKDKLKQQVQ

SEQ ID NO: 1594031 - protein, 38 aa, Staphylococcus aureus
TKFNDWIFIIFIISVYYIFWLLAKRKYILVTVWTIIIL

SEQ ID NO: 1594032 - protein, 24 aa, Staphylococcus aureus
TKHEVEQTIYVNPLKLNAKNTNVT

SEQ ID NO: 1594033 - protein, 22 aa, Staphylococcus aureus
TLITWFYTMLWSIVGVVWIVFS

SEQ ID NO: 1594034 - protein, 17 aa, Staphylococcus aureus
TLMFKKLRNFSTHKWML

SEQ ID NO: 1594035 - protein, 18 aa, Staphylococcus aureus
TLNHITNAQRTALEGQIN

SEQ ID NO: 1594036 - protein, 21 aa, Staphylococcus aureus
TLNQAMNQLRQSIASKDATKS

SEQ ID NO: 1594037 - protein, 34 aa, Staphylococcus aureus
TMGYLKGFALYISILILIVFIAGCGKSDKTKEDS

SEQ ID NO: 1594038 - protein, 17 aa, Staphylococcus aureus
TMLALAVFSKKFQPKHI

SEQ ID NO: 1594039 - protein, 24 aa, Staphylococcus aureus
TNRDYSIFGWNNENVVRYGGGSAD

SEQ ID NO: 1594040 - protein, 35 aa, Staphylococcus aureus
TNSSKRVHLKRWQFISILIGTIIITAVITVVAYIF

SEQ ID NO: 1594041 - protein, 27 aa, Staphylococcus aureus
TNVMNIIQGLWTLITIAFQAIGTVISV

SEQ ID NO: 1594042 - protein, 25 aa, Staphylococcus aureus
TNYNWTFLILFTIFFVIFIKHISRV

SEQ ID NO: 1594043 - protein, 17 aa, Staphylococcus aureus
TQKLPSLMKYGFSINEK

SEQ ID NO: 1594044 - protein, 38 aa, Staphylococcus aureus
TRRGIWQVKPIIQGWDHVDFIGVDFLDFKRKGAELANF

SEQ ID NO: 1594045 - protein, 32 aa, Staphylococcus aureus
TSDGKFHGQRLNDVILTYVASTGKMRAEYAGK

SEQ ID NO: 1594046 - protein, 20 aa, Staphylococcus aureus
TTIKPRTLNRMAVNTVAAPQ

SEQ ID NO: 1594047 - protein, 27 aa, Staphylococcus aureus
TTKHEVEQTIYVNPLKLNAKNTNVTIK

SEQ ID NO: 1594048 - protein, 36 aa, Staphylococcus aureus
TTSTSTAPVKLRTFSRLAMSTFASAATTTAVTANTI

SEQ ID NO: 1594049 - protein, 20 aa, Staphylococcus aureus
TTTISFAVSFIIVTYLHVVL

SEQ ID NO: 1594050 - protein, 24 aa, Staphylococcus aureus
TTTNKYNYSSYAGYTNTILSTTDS

SEQ ID NO: 1594051 - protein, 21 aa, Staphylococcus aureus
TVEIPFETKREFNPKLQPGEE

SEQ ID NO: 1594052 - protein, 20 aa, Staphylococcus aureus
TVIGLILLSLTFLPEMWYIV

SEQ ID NO: 1594053 - protein, 25 aa, Staphylococcus aureus
TVIGLILLSLTFLPEVWYIISSIVG

SEQ ID NO: 1594054 - protein, 22 aa, Staphylococcus aureus
TVKQFFVITFISVILTLILFST

SEQ ID NO: 1594055 - protein, 26 aa, Staphylococcus aureus
TVLDVFLLLFIMKYGFRKIEAIVGTF

SEQ ID NO: 1594056 - protein, 17 aa, Staphylococcus aureus
TVLFIFIFEVYISSPQL

SEQ ID NO: 1594057 - protein, 27 aa, Staphylococcus aureus
TVTNTVTGLPSGLSYDSATNSIIGTPT

SEQ ID NO: 1594058 - protein, 18 aa, Staphylococcus aureus
TVVALLIILTFAKLAQFA

SEQ ID NO: 1594059 - protein, 27 aa, Staphylococcus aureus
TVVIYFNFTWSFYGSLLYLLPLSILGL

SEQ ID NO: 1594060 - protein, 21 aa, Staphylococcus aureus
TWLTLFLPMMNWLIPKKYVKI

SEQ ID NO: 1594061 - protein, 22 aa, Staphylococcus aureus
VAIIACMIWYFNKSHVSIIGII

SEQ ID NO: 1594062 - protein, 38 aa, Staphylococcus aureus
VAVYVIFYFIWLRFEWPHYLLYILLVLGALSTLKLCIK

SEQ ID NO: 1594063 - protein, 18 aa, Staphylococcus aureus
VDMWFVILPVVMSIGTIA

SEQ ID NO: 1594064 - protein, 28 aa, Staphylococcus aureus
VDNALNAVTRAKAALNGAENLRNAKTSA

SEQ ID NO: 1594065 - protein, 28 aa, Staphylococcus aureus
VFIAFFSHLTIHLLPLFAVLGGAIAMMI

SEQ ID NO: 1594066 - protein, 26 aa, Staphylococcus aureus
VGDNAPALYPNYWGGNKFKVIEELRK

SEQ ID NO: 1594067 - protein, 43 aa, Staphylococcus aureus
VGGIVPEILITKLIILTLFGIGFFVVGLILKPVTDPLMKRVSE

SEQ ID NO: 1594068 - protein, 36 aa, Staphylococcus aureus
VGIDSGDTVYPHQAGYVKLNYGFSVPNEAVQGDTFK

SEQ ID NO: 1594069 - protein, 27 aa, Staphylococcus aureus
VGIGGLSNAFGFKLDTYHNTSKPNSAA

SEQ ID NO: 1594070 - protein, 24 aa, Staphylococcus aureus
VGQDNFLLNLTFKENIKLGNPEAS

SEQ ID NO: 1594071 - protein, 17 aa, Staphylococcus aureus
VGVMQFHPIFEELLHAF

SEQ ID NO: 1594072 - protein, 24 aa, Staphylococcus aureus
VHITWMNWFLAALVPGLVSLIVVP

SEQ ID NO: 1594073 - protein, 41 aa, Staphylococcus aureus
VHNTITIRPQDYVVFIPPVGKQIRAVVYYNKVVASNMSNAV

SEQ ID NO: 1594074 - protein, 33 aa, Staphylococcus aureus
VHRDDIITEQDILAHINLIDQLTAEIIDTPSTA

SEQ ID NO: 1594075 - protein, 27 aa, Staphylococcus aureus
VIAALIAIFVLFWNKNEGFRNFIINAW

SEQ ID NO: 1594076 - protein, 17 aa, Staphylococcus aureus
VIAIFFVVFLGILFFYL

SEQ ID NO: 1594077 - protein, 21 aa, Staphylococcus aureus
VICYGLIFGLFYLLSGSTADY

SEQ ID NO: 1594078 - protein, 17 aa, Staphylococcus aureus
VIFSIVMTFIIAKVIKL

SEQ ID NO: 1594079 - protein, 27 aa, Staphylococcus aureus
VIGILGGVFWALMAPIAAVSSVLSNVF

SEQ ID NO: 1594080 - protein, 17 aa, Staphylococcus aureus
VIIMFFIGGVFSLLSTM

SEQ ID NO: 1594081 - protein, 31 aa, Staphylococcus aureus
VKMTNAGQSVTYYFTDVKAPTVTVGNQTIEV

SEQ ID NO: 1594082 - protein, 17 aa, Staphylococcus aureus
VKPYKYRIFATIIVGII

SEQ ID NO: 1594083 - protein, 18 aa, Staphylococcus aureus
VLAVILKFSLWRYKKLTV

SEQ ID NO: 1594084 - protein, 17 aa, Staphylococcus aureus
VLFHPLVGGFLLAAILA

SEQ ID NO: 1594085 - protein, 21 aa, Staphylococcus aureus
VLITWFYTMLWSIVGVVWIVF

SEQ ID NO: 1594086 - protein, 19 aa, Staphylococcus aureus
VMDERKIRYTFTDYINNKN

SEQ ID NO: 1594087 - protein, 20 aa, Staphylococcus aureus
VMIPLTAYLMDRIKTRPLYL

SEQ ID NO: 1594088 - protein, 35 aa, Staphylococcus aureus
VNELWYGLIPIQIIGFILIMLFAVYLGFKEQKRIK

SEQ ID NO: 1594089 - protein, 19 aa, Staphylococcus aureus
VQVYGLNPEDIKNIGDIKD

SEQ ID NO: 1594090 - protein, 34 aa, Staphylococcus aureus
VTIDSGTTVYPHQAGYVKLNYGFSVPNSAVKGDT

SEQ ID NO: 1594091 - protein, 28 aa, Staphylococcus aureus
VTLKYKWKFEDGIKPGDYFDFTLSNNVE

SEQ ID NO: 1594092 - protein, 23 aa, Staphylococcus aureus
VTPIGNFILGTYRIPAMKSTENG

SEQ ID NO: 1594093 - protein, 17 aa, Staphylococcus aureus
VVFGLGAFISTVGNAVT

SEQ ID NO: 1594094 - protein, 17 aa, Staphylococcus aureus
VVTFFFCIIIGACNLFV

SEQ ID NO: 1594095 - protein, 18 aa, Staphylococcus aureus
VVVNPLFAKPNALASILG

SEQ ID NO: 1594096 - protein, 17 aa, Staphylococcus aureus
VWLYHFLERVLIPTGLH

SEQ ID NO: 1594097 - protein, 17 aa, Staphylococcus aureus
WINLLLKTYAFIGLLSH

SEQ ID NO: 1594098 - protein, 21 aa, Staphylococcus aureus
WLRNFMQAFFVVFFVYMAMYL

SEQ ID NO: 1594099 - protein, 20 aa, Staphylococcus aureus
WLTELWGKIQSTLQPIMPIL

SEQ ID NO: 1594100 - protein, 20 aa, Staphylococcus aureus
WLTTAFLLTNGIVIPLSALV

SEQ ID NO: 1594101 - protein, 27 aa, Staphylococcus aureus
WPTTAEVILIIILGLPIYFFYEYRMNW

SEQ ID NO: 1594102 - protein, 17 aa, Staphylococcus aureus
WTSLLIEQLINNALKYA

SEQ ID NO: 1594103 - protein, 26 aa, Staphylococcus aureus
YASYILITWLVIIFALLIVAFRRARR

SEQ ID NO: 1594104 - protein, 17 aa, Staphylococcus aureus
YDNAIANAAHELDKVQG

SEQ ID NO: 1594105 - protein, 28 aa, Staphylococcus aureus
YDNHQTQIIKILAKVKPDPPRIDGNSVT

SEQ ID NO: 1594106 - protein, 29 aa, Staphylococcus aureus
YFNYSLNYKVWYLTVLAGLIPFIPIKFSF

SEQ ID NO: 1594107 - protein, 20 aa, Staphylococcus aureus
YFQIAYIVLMAITLCGFVIC

SEQ ID NO: 1594108 - protein, 23 aa, Staphylococcus aureus
YGLFAFILITFKRGIPIAVKSIM

SEQ ID NO: 1594109 - protein, 17 aa, Staphylococcus aureus
YGWFAGFYNYATSTLIS

SEQ ID NO: 1594110 - protein, 17 aa, Staphylococcus aureus
YIIIFSYIITISHSVFI

SEQ ID NO: 1594111 - protein, 23 aa, Staphylococcus aureus
YILIHDLLKPTILPIIPLLGISL

SEQ ID NO: 1594112 - protein, 27 aa, Staphylococcus aureus
YKNVSTYIIIFLVSSAAFAIFLLSANV

SEQ ID NO: 1594113 - protein, 17 aa, Staphylococcus aureus
YLTILILVTGTMLLVWL

SEQ ID NO: 1594114 - protein, 21 aa, Staphylococcus aureus
YLTLFLNFAILIISIVLIIFG

SEQ ID NO: 1594115 - protein, 25 aa, Staphylococcus aureus
YTIAYILNIFIFTLITNISFYLIRR

SEQ ID NO: 1594116 - protein, 20 aa, Staphylococcus aureus
YTKILPLIINVLGFLISKIN

SEQ ID NO: 1594117 - protein, 17 aa, Staphylococcus aureus
YVNILPSKEGYMLPINK

SEQ ID NO: 1594118 - protein, 25 aa, Staphylococcus aureus
AADPEYIFYAYKRFNFELKDPNFTS

SEQ ID NO: 1594119 - protein, 17 aa, Staphylococcus aureus
AAKAILNKQHGPNTAQN

SEQ ID NO: 1594120 - protein, 25 aa, Staphylococcus aureus
AALLILIGLILVFSIFKPTHRKPGL

SEQ ID NO: 1594121 - protein, 19 aa, Staphylococcus aureus
AASKFFFLNVLSLLEVLSL

SEQ ID NO: 1594122 - protein, 25 aa, Staphylococcus aureus
ACIFLIVLFILYIWLPQDRNQVKQS

SEQ ID NO: 1594123 - protein, 75 aa, Staphylococcus aureus
ADNAAKLKVQPTNNTFQNFDITYNGDTKVMTVTYAGQTWTRNISDWIAKSGTTNFSLSMTASTGGATNLQQVQFG

SEQ ID NO: 1594124 - protein, 27 aa, Staphylococcus aureus
ADQTAIINSLTFTSNAPNRNYATASAN

SEQ ID NO: 1594125 - protein, 19 aa, Staphylococcus aureus
AEIIAQAQALNEAMKALKE

SEQ ID NO: 1594126 - protein, 25 aa, Staphylococcus aureus
AEISSILYLIFPIACIFFNEVYGPK

SEQ ID NO: 1594127 - protein, 18 aa, Staphylococcus aureus
AEQVIKLNDAVTAAKKAL

SEQ ID NO: 1594128 - protein, 19 aa, Staphylococcus aureus
AFIAWGFIAAIFIDNGWLP

SEQ ID NO: 1594129 - protein, 17 aa, Staphylococcus aureus
AFISIGHALLIMVSMLF

SEQ ID NO: 1594130 - protein, 22 aa, Staphylococcus aureus
AFNILNWLFWEILDNYISIVGS

SEQ ID NO: 1594131 - protein, 36 aa, Staphylococcus aureus
AGGIFAFLRTKIASLVKLFPILGVSISSLTLPITLI

SEQ ID NO: 1594132 - protein, 23 aa, Staphylococcus aureus
AGILRLFGVIALMLVVISPIYTV

SEQ ID NO: 1594133 - protein, 21 aa, Staphylococcus aureus
AGIVLIFMIIVLGGLVVQVPM

SEQ ID NO: 1594134 - protein, 21 aa, Staphylococcus aureus
AGLIPFIPIKFSLFKFNNVNN

SEQ ID NO: 1594135 - protein, 23 aa, Staphylococcus aureus
AIANLDTLRDLNQPQRDALRNQI

SEQ ID NO: 1594136 - protein, 19 aa, Staphylococcus aureus
AIIGLFVLGQRTASALLPN

SEQ ID NO: 1594137 - protein, 20 aa, Staphylococcus aureus
AIIGLFVLGQRTASALLPNV

SEQ ID NO: 1594138 - protein, 29 aa, Staphylococcus aureus
AIINFIIPFLLIFIVDGFRGVKETLPAIL

SEQ ID NO: 1594139 - protein, 17 aa, Staphylococcus aureus
AIKALANAKRDQINSNP

SEQ ID NO: 1594140 - protein, 33 aa, Staphylococcus aureus
AILMKNKWPFLIALPFMICYGIGVTFYYQQKVA

SEQ ID NO: 1594141 - protein, 25 aa, Staphylococcus aureus
AIRSVLWEHIIQLKMPFFDKNESGQ

SEQ ID NO: 1594142 - protein, 19 aa, Staphylococcus aureus
AISKIKDISTDKIDRIRNS

SEQ ID NO: 1594143 - protein, 27 aa, Staphylococcus aureus
AITLIVVDIIIYYPFLKVYDSEILDEE

SEQ ID NO: 1594144 - protein, 37 aa, Staphylococcus aureus
AIVKIYKYIFFIVSLFLFIIFVWYFYDKQDAYNYTKV

SEQ ID NO: 1594145 - protein, 17 aa, Staphylococcus aureus
AIVVIGVTLGLFAGYKK

SEQ ID NO: 1594146 - protein, 20 aa, Staphylococcus aureus
AIYPIGMMLLIIGGGGTFKQ

SEQ ID NO: 1594147 - protein, 21 aa, Staphylococcus aureus
ALEVVPLCLLIWEAYTHYRLY

SEQ ID NO: 1594148 - protein, 26 aa, Staphylococcus aureus
ALIVTLIIIIAIVSMIFFVQTKYGDQ

SEQ ID NO: 1594149 - protein, 21 aa, Staphylococcus aureus
ALLHDVFIIVAIFSLFRIEVD

SEQ ID NO: 1594150 - protein, 26 aa, Staphylococcus aureus
ALPSGDYILKEIEAPAPYTFDKDKEY

SEQ ID NO: 1594151 - protein, 27 aa, Staphylococcus aureus
ALQAAWSFISNIWNTIWSFLSSILTTI

SEQ ID NO: 1594152 - protein, 17 aa, Staphylococcus aureus
AMDQLKQAIADHDTIVA

SEQ ID NO: 1594153 - protein, 21 aa, Staphylococcus aureus
AMGNLRQAVADKEQVKRTEDY

SEQ ID NO: 1594154 - protein, 17 aa, Staphylococcus aureus
AMLIALTVCLIPTTIGG

SEQ ID NO: 1594155 - protein, 17 aa, Staphylococcus aureus
AMMVISITLLIVPDLIR

SEQ ID NO: 1594156 - protein, 24 aa, Staphylococcus aureus
AMRYIVGKWVPRTGSWRAAFKRAG

SEQ ID NO: 1594157 - protein, 29 aa, Staphylococcus aureus
AMVIKLVKLIFMLDYVLFHSIQKSYTTHM

SEQ ID NO: 1594158 - protein, 20 aa, Staphylococcus aureus
ANLLTFIAWLISGISVLRYN

SEQ ID NO: 1594159 - protein, 17 aa, Staphylococcus aureus
ANWSAMNKPNVAKVVNA

SEQ ID NO: 1594160 - protein, 41 aa, Staphylococcus aureus
APAQAFVDKFAKYYTPIIMVIAALVAVVPPLFFGGSWDTWV

SEQ ID NO: 1594161 - protein, 35 aa, Staphylococcus aureus
APLYALMILVVTVKLFGFLRAITRYVERLISHKAT

SEQ ID NO: 1594162 - protein, 24 aa, Staphylococcus aureus
APTIFNFTLALFIGLISGVFSSIF

SEQ ID NO: 1594163 - protein, 23 aa, Staphylococcus aureus
AQALDHAMELLRNSVADNQATLA

SEQ ID NO: 1594164 - protein, 21 aa, Staphylococcus aureus
AQALDQLMDALQQSIADKDAT

SEQ ID NO: 1594165 - protein, 26 aa, Staphylococcus aureus
AQTKDQLNQGLNLGLDDIRNTHVWEV

SEQ ID NO: 1594166 - protein, 37 aa, Staphylococcus aureus
AQVINAKYDVIYNGHTFATSLPAKFVVKDVQPAKPTV

SEQ ID NO: 1594167 - protein, 24 aa, Staphylococcus aureus
ARELLLELSYFFRANLQGSKQHTI

SEQ ID NO: 1594168 - protein, 48 aa, Staphylococcus aureus
ARERNIELVGNLLPGDYFGTIRFGRKEQLFEIRVKPHTPRITTTAEEL

SEQ ID NO: 1594169 - protein, 18 aa, Staphylococcus aureus
ARGLGTILGVLVLSVILL

SEQ ID NO: 1594170 - protein, 19 aa, Staphylococcus aureus
ASAFLSESLSESTSESTSE

SEQ ID NO: 1594171 - protein, 18 aa, Staphylococcus aureus
ASDYFSEAGATAATKAFG

SEQ ID NO: 1594172 - protein, 24 aa, Staphylococcus aureus
ASTSLLQRQFRIGYNRASRLMDDL

SEQ ID NO: 1594173 - protein, 23 aa, Staphylococcus aureus
ASVLDEFYWLNKEDPNYSRCRVI

SEQ ID NO: 1594174 - protein, 29 aa, Staphylococcus aureus
ATELNTAMTALKRAIADKADTKASGNYVN

SEQ ID NO: 1594175 - protein, 19 aa, Staphylococcus aureus
ATETLNNLSNLNTPQRQAL

SEQ ID NO: 1594176 - protein, 47 aa, Staphylococcus aureus
ATNNNYSAILKKFWMMYWPKLVILMGIIILIVILNAIFNNVNKNDRM

SEQ ID NO: 1594177 - protein, 24 aa, Staphylococcus aureus
ATTSFNVTIKPLRDKYRVGTSSTA

SEQ ID NO: 1594178 - protein, 32 aa, Staphylococcus aureus
AVGIGGLSNAFGFKLDTYHNTSKPNSAAKANA

SEQ ID NO: 1594179 - protein, 17 aa, Staphylococcus aureus
AVIAVIMWFYVKPDQPL

SEQ ID NO: 1594180 - protein, 26 aa, Staphylococcus aureus
AVLLQYVFAVKLRWFPVAGWEGFSTA

SEQ ID NO: 1594181 - protein, 28 aa, Staphylococcus aureus
AVNTSAPRMRAFSLSAVAADAPAAGKDI

SEQ ID NO: 1594182 - protein, 35 aa, Staphylococcus aureus
AVYGIGSFLYYRKIKFYMFISKIFKFNKTTEITLN

SEQ ID NO: 1594183 - protein, 29 aa, Staphylococcus aureus
AYKELEQAVALIRTMPQRQQTSRRSSRIQ

SEQ ID NO: 1594184 - protein, 19 aa, Staphylococcus aureus
CFIGFLGIIFFYCHLNKKL

SEQ ID NO: 1594185 - protein, 18 aa, Staphylococcus aureus
CFILFIYILGTNISIVSY

SEQ ID NO: 1594186 - protein, 18 aa, Staphylococcus aureus
CFTLFGYVFLIFWTVIFS

SEQ ID NO: 1594187 - protein, 20 aa, Staphylococcus aureus
CKGFSFHVLLSLTEILKGCL

SEQ ID NO: 1594188 - protein, 23 aa, Staphylococcus aureus
CLKLILILLFYFQYFWSYIKLNL

SEQ ID NO: 1594189 - protein, 20 aa, Staphylococcus aureus
CLPMLIQLPIIMGLYFVLKD

SEQ ID NO: 1594190 - protein, 20 aa, Staphylococcus aureus
CPNCQYIFSPSLWAVIKAKH

SEQ ID NO: 1594191 - protein, 17 aa, Staphylococcus aureus
CVKVFKLDIKWPFLLSE

SEQ ID NO: 1594192 - protein, 25 aa, Staphylococcus aureus
DAIANLDTLRDLNQPQRDALRNHIN

SEQ ID NO: 1594193 - protein, 27 aa, Staphylococcus aureus
DDDIDPLHMRHFSNNFGNVIKNAIGVV

SEQ ID NO: 1594194 - protein, 28 aa, Staphylococcus aureus
DDEIDPLHMRHFGDRIGNVIKNALGVVG

SEQ ID NO: 1594195 - protein, 19 aa, Staphylococcus aureus
DDRIPINVWTGDSIARTGK

SEQ ID NO: 1594196 - protein, 29 aa, Staphylococcus aureus
DDVKATLTVPAYIDPEYVTHTGNVTLATG

SEQ ID NO: 1594197 - protein, 26 aa, Staphylococcus aureus
DEKQSIITAFMNKNQNIRGYLASTDP

SEQ ID NO: 1594198 - protein, 17 aa, Staphylococcus aureus
DFDINYNGDTKVMTVKY

SEQ ID NO: 1594199 - protein, 17 aa, Staphylococcus aureus
DFLSNKLNKYSIRKFTV

SEQ ID NO: 1594200 - protein, 23 aa, Staphylococcus aureus
DGETYTVKFETPAGYLPTKVNGT

SEQ ID NO: 1594201 - protein, 37 aa, Staphylococcus aureus
DGFDFGHVERFIQNPPHGATVAWHDNPDTWKNTVGNT

SEQ ID NO: 1594202 - protein, 25 aa, Staphylococcus aureus
DGSKVIVNVPVKVVEKELTVVKQQA

SEQ ID NO: 1594203 - protein, 33 aa, Staphylococcus aureus
DKKKGSIEGTKHLPLLFAKRRRKEDEEDVEVTN

SEQ ID NO: 1594204 - protein, 26 aa, Staphylococcus aureus
DKVKSGDYFTAKLPDSLTGNGDVDYS

SEQ ID NO: 1594205 - protein, 23 aa, Staphylococcus aureus
DKWLLILCVLVIIINASWNTISR

SEQ ID NO: 1594206 - protein, 18 aa, Staphylococcus aureus
DLINKTTDPTLAKSIIDQ

SEQ ID NO: 1594207 - protein, 18 aa, Staphylococcus aureus
DLLAKCYLSCLKLADQYS

SEQ ID NO: 1594208 - protein, 18 aa, Staphylococcus aureus
DLNEIPQLVTKKNDVSET

SEQ ID NO: 1594209 - protein, 17 aa, Staphylococcus aureus
DLRVLMDAVYELNDHQD

SEQ ID NO: 1594210 - protein, 27 aa, Staphylococcus aureus
DLVGFKWMYLICGMLVIVIMIMSLLKK

SEQ ID NO: 1594211 - protein, 26 aa, Staphylococcus aureus
DLVSTWLVLFFPFINWLIPKRYVQIS

SEQ ID NO: 1594212 - protein, 22 aa, Staphylococcus aureus
DNAAKLKVQPTNNTFQDFDINY

SEQ ID NO: 1594213 - protein, 24 aa, Staphylococcus aureus
DNEHSPLLFAKRRKDKEEDVETTT

SEQ ID NO: 1594214 - protein, 20 aa, Staphylococcus aureus
DNTKRSVNYTDADQPKQQAY

SEQ ID NO: 1594215 - protein, 23 aa, Staphylococcus aureus
DNYHLIFALIFLAIVSVVSMMSG

SEQ ID NO: 1594216 - protein, 40 aa, Staphylococcus aureus
DPNSKGDLALRSTLYGYDSRFVWRSMSWDNEVAFNNGSGS

SEQ ID NO: 1594217 - protein, 26 aa, Staphylococcus aureus
DQSSSPAAMFVLVAGIGLIATVRRRK

SEQ ID NO: 1594218 - protein, 19 aa, Staphylococcus aureus
DQTLGLFQYPKTATIILFT

SEQ ID NO: 1594219 - protein, 43 aa, Staphylococcus aureus
DRIGNVIKNALGVVGISGLLASFWFFIAKRRRKEDEEEELEIR

SEQ ID NO: 1594220 - protein, 20 aa, Staphylococcus aureus
DSGSLSVSTSLRKSESVSES

SEQ ID NO: 1594221 - protein, 32 aa, Staphylococcus aureus
DSIIKTALKRLPWLIILTFLGMVTATILGRFE

SEQ ID NO: 1594222 - protein, 56 aa, Staphylococcus aureus
DSLANEKTRVRLYKSGKNWVKSGIKEIEMFKIMGLPFISHSLVSQDNQSISKKITG

SEQ ID NO: 1594223 - protein, 25 aa, Staphylococcus aureus
DSNKSFHFSGKVNLGNKYEGHGNGG

SEQ ID NO: 1594224 - protein, 23 aa, Staphylococcus aureus
DSTSTSLSLSTSGSISGSTSTSA

SEQ ID NO: 1594225 - protein, 32 aa, Staphylococcus aureus
DSVKEGDIFTFKYGQYFRPGSVRLPSQTQNLY

SEQ ID NO: 1594226 - protein, 30 aa, Staphylococcus aureus
DTEFAAYNFLYTFSFSMILGELIRATKGRT

SEQ ID NO: 1594227 - protein, 25 aa, Staphylococcus aureus
DVKATLTMPAYIDPENVTKTGNVTL

SEQ ID NO: 1594228 - protein, 24 aa, Staphylococcus aureus
DVSFLIDMSIGIVGFLMTYLPIQK

SEQ ID NO: 1594229 - protein, 29 aa, Staphylococcus aureus
DVVAKATYDILTKTYTFVFTDYVNNKENI

SEQ ID NO: 1594230 - protein, 30 aa, Staphylococcus aureus
DWFDIFIAGILRLFGVIALMLVVVSPIYAV

SEQ ID NO: 1594231 - protein, 30 aa, Staphylococcus aureus
DWFDIFIVGILRLFGVIALMLVVISPIYTV

SEQ ID NO: 1594232 - protein, 17 aa, Staphylococcus aureus
DYALMVVIPKQGPNAES

SEQ ID NO: 1594233 - protein, 21 aa, Staphylococcus aureus
DYPLIQGIVIFIIVFIMLMNY

SEQ ID NO: 1594234 - protein, 47 aa, Staphylococcus aureus
EAIPLFATVIVVLAFFLLMIVFRSILIPLKAVLGFVLSLMATLGFTT

SEQ ID NO: 1594235 - protein, 38 aa, Staphylococcus aureus
EAIQSPITFWYGKYIILIPSSYFKSVIDKRLKYIILHE

SEQ ID NO: 1594236 - protein, 31 aa, Staphylococcus aureus
EAMGYLKRLSWYISILILIVVIAGCGKGNKV

SEQ ID NO: 1594237 - protein, 17 aa, Staphylococcus aureus
EDALYDEAYLFVVEQQK

SEQ ID NO: 1594238 - protein, 20 aa, Staphylococcus aureus
EDLWELYRGLANVRPALPVS

SEQ ID NO: 1594239 - protein, 18 aa, Staphylococcus aureus
EEIAIRRAFGAKSRDIEL

SEQ ID NO: 1594240 - protein, 20 aa, Staphylococcus aureus
EFAPAVMFIIANRSALSVGT

SEQ ID NO: 1594241 - protein, 32 aa, Staphylococcus aureus
EGKDLPIPAFKLPLYPVLPAITFVLVLLVFWG

SEQ ID NO: 1594242 - protein, 32 aa, Staphylococcus aureus
EHPIGLALVILTVLVIIGFVLNMFVKHFKKER

SEQ ID NO: 1594243 - protein, 17 aa, Staphylococcus aureus
EIAIVNQVKQTATSLDH

SEQ ID NO: 1594244 - protein, 51 aa, Staphylococcus aureus
EIALITAKQTGDGYQWVIKFNKGHAPHENMIYWFALPAGQTPVGRTEFVTV

SEQ ID NO: 1594245 - protein, 19 aa, Staphylococcus aureus
EIANFSGLLGRVLTEMRLV

SEQ ID NO: 1594246 - protein, 26 aa, Staphylococcus aureus
EIAQQLEQFKAQLKAANPFAKELENR

SEQ ID NO: 1594247 - protein, 32 aa, Staphylococcus aureus
EKKNMAGLIFVSWYPTVYWIINAAVVLVAFPK

SEQ ID NO: 1594248 - protein, 22 aa, Staphylococcus aureus
EKLNKLLLIISLLSIFQVVEIF

SEQ ID NO: 1594249 - protein, 27 aa, Staphylococcus aureus
EKPMANVLVTLTYPDGTTKSVRTDAKG

SEQ ID NO: 1594250 - protein, 17 aa, Staphylococcus aureus
EKYDYTLMEFAQPIYNS

SEQ ID NO: 1594251 - protein, 28 aa, Staphylococcus aureus
EKYNGLKQAIAGLTPDLAPLQAAKTQLQ

SEQ ID NO: 1594252 - protein, 18 aa, Staphylococcus aureus
ELKNPQTLDLPQSSPQTI

SEQ ID NO: 1594253 - protein, 21 aa, Staphylococcus aureus
ELNVYNGIPHLLIPVVTNPHK

SEQ ID NO: 1594254 - protein, 25 aa, Staphylococcus aureus
EMMRIYKDVDTFVVISHLGIDPSTQ

SEQ ID NO: 1594255 - protein, 25 aa, Staphylococcus aureus
ENVTLFHCIILILAFLYEFTANRTL

SEQ ID NO: 1594256 - protein, 28 aa, Staphylococcus aureus
ENYDNIVKSLYIIALAFGVIATIITATI

SEQ ID NO: 1594257 - protein, 17 aa, Staphylococcus aureus
EQILVNGELIVHRDDII

SEQ ID NO: 1594258 - protein, 25 aa, Staphylococcus aureus
EQYQGPMVLQLKKAGHIALIGSPGY

SEQ ID NO: 1594259 - protein, 26 aa, Staphylococcus aureus
ERPYKVPLYPIIPLIAILAGSFVLIN

SEQ ID NO: 1594260 - protein, 27 aa, Staphylococcus aureus
ESLDKVKHTPFFLPKRRRKEDEEDVEV

SEQ ID NO: 1594261 - protein, 28 aa, Staphylococcus aureus
ESLDKVKHTPFFLPKRRRKEDEEDVEVT

SEQ ID NO: 1594262 - protein, 19 aa, Staphylococcus aureus
ESLNTAMGNLINAIADHQT

SEQ ID NO: 1594263 - protein, 17 aa, Staphylococcus aureus
EVAQPRTALESKPRVTR

SEQ ID NO: 1594264 - protein, 19 aa, Staphylococcus aureus
EVIILIPISLIITLASAIT

SEQ ID NO: 1594265 - protein, 23 aa, Staphylococcus aureus
EVKKGYFPIKRAIDLVLSIVLLF

SEQ ID NO: 1594266 - protein, 29 aa, Staphylococcus aureus
EVTDQFKNRIYYEHPNVASIKFGDITKTY

SEQ ID NO: 1594267 - protein, 23 aa, Staphylococcus aureus
FANKNIIGKLGKLLKLGGKALKP

SEQ ID NO: 1594268 - protein, 18 aa, Staphylococcus aureus
FAPAVMFIIANRSALSVG

SEQ ID NO: 1594269 - protein, 24 aa, Staphylococcus aureus
FAPIAFLMGIPWSEAVPAGSLMAT

SEQ ID NO: 1594270 - protein, 19 aa, Staphylococcus aureus
FCMFNYLSSILWVVCGIFL

SEQ ID NO: 1594271 - protein, 28 aa, Staphylococcus aureus
FDEILFFTLYLLLILIVLYYLKKQLKNK

SEQ ID NO: 1594272 - protein, 34 aa, Staphylococcus aureus
FDKEKNKFTHVAYVKPLNQFKLGTVTVSGTVTQG

SEQ ID NO: 1594273 - protein, 17 aa, Staphylococcus aureus
FDQYKYVKILPKGEQRI

SEQ ID NO: 1594274 - protein, 20 aa, Staphylococcus aureus
FEALTTWLKSMQGANIIILA

SEQ ID NO: 1594275 - protein, 17 aa, Staphylococcus aureus
FEKDSLYIINDFKTFID

SEQ ID NO: 1594276 - protein, 19 aa, Staphylococcus aureus
FEKDSLYIINDFKTYIDCT

SEQ ID NO: 1594277 - protein, 17 aa, Staphylococcus aureus
FEVPAFLPVAFLLIVIV

SEQ ID NO: 1594278 - protein, 31 aa, Staphylococcus aureus
FFGGSWDTWVYQGLAVLVVGCPCALVISTPI

SEQ ID NO: 1594279 - protein, 26 aa, Staphylococcus aureus
FFKYIVMSLFLWLMWSHQTFFTNRFG

SEQ ID NO: 1594280 - protein, 23 aa, Staphylococcus aureus
FFSVRLLLSLVFINLTSPVGMHL

SEQ ID NO: 1594281 - protein, 17 aa, Staphylococcus aureus
FGDINSAYIIKVVSKYT

SEQ ID NO: 1594282 - protein, 41 aa, Staphylococcus aureus
FGNVIKNAIGVVGISGLLASFWFFIAKRRRKEDEEEELEIR

SEQ ID NO: 1594283 - protein, 23 aa, Staphylococcus aureus
FGSTALWIGAGLMSLAVLFSIVT

SEQ ID NO: 1594284 - protein, 19 aa, Staphylococcus aureus
FGVAFIIMIFAIGGVPPFS

SEQ ID NO: 1594285 - protein, 18 aa, Staphylococcus aureus
FGVLVGIPVAFLTSIFGI

SEQ ID NO: 1594286 - protein, 28 aa, Staphylococcus aureus
FHNIHIKIIYWLVLTAIFFIANILIIHI

SEQ ID NO: 1594287 - protein, 19 aa, Staphylococcus aureus
FIFPPIFIILIFSNTINFK

SEQ ID NO: 1594288 - protein, 26 aa, Staphylococcus aureus
FIGTTVFGGLSLALGAALLAGRRREL

SEQ ID NO: 1594289 - protein, 19 aa, Staphylococcus aureus
FIIFALTYYLLLAPKWYIA

SEQ ID NO: 1594290 - protein, 19 aa, Staphylococcus aureus
FIIVAIFSLFRIEVDLTFI

SEQ ID NO: 1594291 - protein, 17 aa, Staphylococcus aureus
FILIVICPLIFNYALTL

SEQ ID NO: 1594292 - protein, 21 aa, Staphylococcus aureus
FIQIFLGMLLFITPIPVQFNF

SEQ ID NO: 1594293 - protein, 28 aa, Staphylococcus aureus
FIVISTMIFLFIGKPISLLIIAGAINGW

SEQ ID NO: 1594294 - protein, 23 aa, Staphylococcus aureus
FKDKITYKYQNVASINFGDINKT

SEQ ID NO: 1594295 - protein, 17 aa, Staphylococcus aureus
FKYTFGDAKKFFDTADM

SEQ ID NO: 1594296 - protein, 17 aa, Staphylococcus aureus
FLFGIPMFVGALITGMI

SEQ ID NO: 1594297 - protein, 21 aa, Staphylococcus aureus
FLFKKLTWPVGLIVAAITISS

SEQ ID NO: 1594298 - protein, 18 aa, Staphylococcus aureus
FLQIIRFYYKDIFVCFVA

SEQ ID NO: 1594299 - protein, 18 aa, Staphylococcus aureus
FLVHCFLVYIIAYIGELI

SEQ ID NO: 1594300 - protein, 17 aa, Staphylococcus aureus
FLYLLFKLNSNSSNLKQ

SEQ ID NO: 1594301 - protein, 17 aa, Staphylococcus aureus
FMIVVGAIIGGITNVIA

SEQ ID NO: 1594302 - protein, 23 aa, Staphylococcus aureus
FNMKYYLIRTIPVSIIALLYVLL

SEQ ID NO: 1594303 - protein, 34 aa, Staphylococcus aureus
FSMSFLNAIFIALPIFLVAKIFNNVLSHKPIYMK

SEQ ID NO: 1594304 - protein, 26 aa, Staphylococcus aureus
FTSISWPILAVVAVIGVFIGILVYLW

SEQ ID NO: 1594305 - protein, 29 aa, Staphylococcus aureus
FTYASYILITWLAIIFVLLIVAFRRARRL

SEQ ID NO: 1594306 - protein, 20 aa, Staphylococcus aureus
FVDIWHFFSLVNRYENEDKY

SEQ ID NO: 1594307 - protein, 23 aa, Staphylococcus aureus
FVDVMIIFLREGLEVLLIVMTLT

SEQ ID NO: 1594308 - protein, 25 aa, Staphylococcus aureus
FVSTLTGYKFNPDAKNFKIYEVTDQ

SEQ ID NO: 1594309 - protein, 18 aa, Staphylococcus aureus
FYIISFATLFIIAIAVHP

SEQ ID NO: 1594310 - protein, 61 aa, Staphylococcus aureus
GAGAGANKPLPEMWPYGVNDSRSWDYKIRNRSGQVIYDWPTVHINSLKDLARASDYFSEAG

SEQ ID NO: 1594311 - protein, 22 aa, Staphylococcus aureus
GAKNLYDVYISKGLDTPKKIGP

SEQ ID NO: 1594312 - protein, 36 aa, Staphylococcus aureus
GAPLYALMILVVTVKLFGFLRAITRYVERLISHKAT

SEQ ID NO: 1594313 - protein, 26 aa, Staphylococcus aureus
GASFSPLVLFALYWKGLTRAGAVSGM

SEQ ID NO: 1594314 - protein, 24 aa, Staphylococcus aureus
GDNVIAPVLTGNLKPNTDSNALID

SEQ ID NO: 1594315 - protein, 25 aa, Staphylococcus aureus
GDSLIPYALVFIGLIIFISVVILIM

SEQ ID NO: 1594316 - protein, 31 aa, Staphylococcus aureus
GEANMSLIWGLLASLGSLLLFRRKKENKDKK

SEQ ID NO: 1594317 - protein, 24 aa, Staphylococcus aureus
GEVWAMLCISLLLVAYLMLKRHKI

SEQ ID NO: 1594318 - protein, 17 aa, Staphylococcus aureus
GFDIFIVGILSLFGITA

SEQ ID NO: 1594319 - protein, 20 aa, Staphylococcus aureus
GFIFFFIVYVLCISYFNSDK

SEQ ID NO: 1594320 - protein, 26 aa, Staphylococcus aureus
GFMGFITFVLLIVQQWLFLNPNHNLN

SEQ ID NO: 1594321 - protein, 17 aa, Staphylococcus aureus
GFPTINWLGFYPTYEPL

SEQ ID NO: 1594322 - protein, 20 aa, Staphylococcus aureus
GGIFVINALLSGLGLYLLSK

SEQ ID NO: 1594323 - protein, 30 aa, Staphylococcus aureus
GIALFFEVGLVLLIPLVFTVAKRANVSVLK

SEQ ID NO: 1594324 - protein, 25 aa, Staphylococcus aureus
GICLVLLIILIVGYVIMTKINSRSA

SEQ ID NO: 1594325 - protein, 30 aa, Staphylococcus aureus
GIDSGDTVYPHQAGYVKLNYGFSVPNEAVQ

SEQ ID NO: 1594326 - protein, 19 aa, Staphylococcus aureus
GIFLFFLYLNQKLKLQIYN

SEQ ID NO: 1594327 - protein, 19 aa, Staphylococcus aureus
GIGCIMAVYLLINATFLLT

SEQ ID NO: 1594328 - protein, 23 aa, Staphylococcus aureus
GIKEKVPIIFSFRAVFETLLLIG

SEQ ID NO: 1594329 - protein, 18 aa, Staphylococcus aureus
GIKEKVPIIFSLRAVFET

SEQ ID NO: 1594330 - protein, 21 aa, Staphylococcus aureus
GIKLPVLIAFVLILAGLSFGY

SEQ ID NO: 1594331 - protein, 24 aa, Staphylococcus aureus
GIKNTTITTLPNGWTSNLTKSDNK

SEQ ID NO: 1594332 - protein, 34 aa, Staphylococcus aureus
GISLIDYDFPIDSLFYIVSLNLSLTLIFLILTFF

SEQ ID NO: 1594333 - protein, 19 aa, Staphylococcus aureus
GISVAYIYSLYAFYMNNFS

SEQ ID NO: 1594334 - protein, 24 aa, Staphylococcus aureus
GIVILLVLIIGFKLNKFISLIITS

SEQ ID NO: 1594335 - protein, 25 aa, Staphylococcus aureus
GLDKSEAYNFLITSSQRQGTSQGVY

SEQ ID NO: 1594336 - protein, 22 aa, Staphylococcus aureus
GLFIFIEVILLLTLFIVHVNGK

SEQ ID NO: 1594337 - protein, 18 aa, Staphylococcus aureus
GLGWLGEPTFEKLLHPIF

SEQ ID NO: 1594338 - protein, 27 aa, Staphylococcus aureus
GLHPFAVFFPIIALLIIYYMIRFKMRA

SEQ ID NO: 1594339 - protein, 18 aa, Staphylococcus aureus
GLLLSGSYALIRFLSNAF

SEQ ID NO: 1594340 - protein, 24 aa, Staphylococcus aureus
GLMNLLIYVLLTLFICSLMVGKTP

SEQ ID NO: 1594341 - protein, 23 aa, Staphylococcus aureus
GLRQVVNRTYRIGTTKRVEVSQG

SEQ ID NO: 1594342 - protein, 27 aa, Staphylococcus aureus
GLSKFNIIYILMFEQLLIFSITAILGI

SEQ ID NO: 1594343 - protein, 27 aa, Staphylococcus aureus
GLVNIFTQLMPLFKFMSQGLQNMSIDF

SEQ ID NO: 1594344 - protein, 21 aa, Staphylococcus aureus
GNEYLQKGGILGPKGMENSAG

SEQ ID NO: 1594345 - protein, 29 aa, Staphylococcus aureus
GNKYSNIDLGLTQWGFKQLPNESYIDYIK

SEQ ID NO: 1594346 - protein, 48 aa, Staphylococcus aureus
GNLLLSAAIFLYIMLIDWRMACALLVTIPIALFAFNKLMSGFNETYAK

SEQ ID NO: 1594347 - protein, 20 aa, Staphylococcus aureus
GNVTLQYRDGSSTTLDATNV

SEQ ID NO: 1594348 - protein, 18 aa, Staphylococcus aureus
GPALLIPLYVQNSLALSA

SEQ ID NO: 1594349 - protein, 20 aa, Staphylococcus aureus
GPFALDSFGWKETIPPKKDG

SEQ ID NO: 1594350 - protein, 23 aa, Staphylococcus aureus
GQDNFLLNLTFKENIKLGNPEAT

SEQ ID NO: 1594351 - protein, 17 aa, Staphylococcus aureus
GRTTFLHNIIFDVARHH

SEQ ID NO: 1594352 - protein, 22 aa, Staphylococcus aureus
GSKVIVNVPVKVVEKELTVVKQ

SEQ ID NO: 1594353 - protein, 29 aa, Staphylococcus aureus
GSNNATLFGGLFAALGSLLLFGRRKKQNK

SEQ ID NO: 1594354 - protein, 25 aa, Staphylococcus aureus
GTAIPLPIVGTVAGALAGAAVGIAL

SEQ ID NO: 1594355 - protein, 25 aa, Staphylococcus aureus
GTASILVGTTLIFGLGNQEAKAAES

SEQ ID NO: 1594356 - protein, 33 aa, Staphylococcus aureus
GTFIAKHKWSALIAWVIIVAAIFIPIATNAPKF

SEQ ID NO: 1594357 - protein, 27 aa, Staphylococcus aureus
GTFNYVKGIFEKINTLLGSNDPINNKD

SEQ ID NO: 1594358 - protein, 27 aa, Staphylococcus aureus
GTLIAMIFYVIQLSMPLINLSTLVTDY

SEQ ID NO: 1594359 - protein, 28 aa, Staphylococcus aureus
GTQITTNDILTLLKATTTVPGLRNNIAG

SEQ ID NO: 1594360 - protein, 19 aa, Staphylococcus aureus
GTTLIFGLGNQEAKAAEST

SEQ ID NO: 1594361 - protein, 21 aa, Staphylococcus aureus
GTTNFSLSMTASTGGATNLQQ

SEQ ID NO: 1594362 - protein, 24 aa, Staphylococcus aureus
GTTVFGGLSLALGAALLAGRRREL

SEQ ID NO: 1594363 - protein, 40 aa, Staphylococcus aureus
GTVTNTVTGLPSGLSYDSATNSIIGTPTKIGQSTVTVVST

SEQ ID NO: 1594364 - protein, 27 aa, Staphylococcus aureus
GVASVAISTLLLLMSNGEAQAAEETGG

SEQ ID NO: 1594365 - protein, 30 aa, Staphylococcus aureus
GVFTSISWPVLLVIAIIAAFIGVVVYLWKT

SEQ ID NO: 1594366 - protein, 44 aa, Staphylococcus aureus
GVHSTITIRPEDYVVFIPPVGNQIRALIFYNNVVASNMSNAVTI

SEQ ID NO: 1594367 - protein, 25 aa, Staphylococcus aureus
GVILKWFMMLPLADIDLAWLVPFIL

SEQ ID NO: 1594368 - protein, 29 aa, Staphylococcus aureus
GVIPVIFAMAFFLLPRTLTLFYPDKEWAQ

SEQ ID NO: 1594369 - protein, 26 aa, Staphylococcus aureus
GVLITFLPLLFLPFLGELGGAATTFS

SEQ ID NO: 1594370 - protein, 21 aa, Staphylococcus aureus
GVMLNFMLVFLTLKAFGYSKD

SEQ ID NO: 1594371 - protein, 24 aa, Staphylococcus aureus
GVSLFFNVIILVLLFIFSIFIKDV

SEQ ID NO: 1594372 - protein, 18 aa, Staphylococcus aureus
GVWLYHFLERVLIPTGLH

SEQ ID NO: 1594373 - protein, 17 aa, Staphylococcus aureus
GYFSTIAAILLLGGIQL

SEQ ID NO: 1594374 - protein, 17 aa, Staphylococcus aureus
GYLIEIFPKKLLVLIYQ

SEQ ID NO: 1594375 - protein, 19 aa, Staphylococcus aureus
GYYNFISFIIFAISIASIT

SEQ ID NO: 1594376 - protein, 27 aa, Staphylococcus aureus
HALILFVAMFFIFIAILTLTMWSEYRG

SEQ ID NO: 1594377 - protein, 17 aa, Staphylococcus aureus
HALLIMVSMLFTLLIVP

SEQ ID NO: 1594378 - protein, 28 aa, Staphylococcus aureus
HANDIINGNAQHPVITPSDVNNALSNVT

SEQ ID NO: 1594379 - protein, 27 aa, Staphylococcus aureus
HASNTIPVYMPYITSYFMTRAIGDRPL

SEQ ID NO: 1594380 - protein, 22 aa, Staphylococcus aureus
HELNTYIHYFLNSLQKIPNTDA

SEQ ID NO: 1594381 - protein, 31 aa, Staphylococcus aureus
HGNGGDGIGFAFSPGVLGETGLNGAAVGIGG

SEQ ID NO: 1594382 - protein, 25 aa, Staphylococcus aureus
HIAAIVFLIYQPLKRLNLPLFVIKG

SEQ ID NO: 1594383 - protein, 17 aa, Staphylococcus aureus
HLIIFNIFSIIMSYNPL

SEQ ID NO: 1594384 - protein, 30 aa, Staphylococcus aureus
HLTIAIGIALFIFVIVRPPVEFIRQYLAQW

SEQ ID NO: 1594385 - protein, 17 aa, Staphylococcus aureus
HPLFTIIGGACLVAGLA

SEQ ID NO: 1594386 - protein, 32 aa, Staphylococcus aureus
HPLMLLVQGVVFFILYYVIFRVVIQVFNLNTI

SEQ ID NO: 1594387 - protein, 30 aa, Staphylococcus aureus
HRDDIITEQDILAHINLIDQLSAEVIDTPS

SEQ ID NO: 1594388 - protein, 17 aa, Staphylococcus aureus
HRKLLVIKKLYGYSTLR

SEQ ID NO: 1594389 - protein, 17 aa, Staphylococcus aureus
HVKSVEYKKKGNVGVIT

SEQ ID NO: 1594390 - protein, 19 aa, Staphylococcus aureus
HYFESPLFKGKYSVNNSDL

SEQ ID NO: 1594391 - protein, 19 aa, Staphylococcus aureus
HYFVTTFYRNGKLPDEKNY

SEQ ID NO: 1594392 - protein, 20 aa, Staphylococcus aureus
HYFVTTFYRNGKLPDEKNYK

SEQ ID NO: 1594393 - protein, 20 aa, Staphylococcus aureus
IAAFIGVVVYLWKTNETFRK

SEQ ID NO: 1594394 - protein, 18 aa, Staphylococcus aureus
IAIIPFSLSIYALSKLIL

SEQ ID NO: 1594395 - protein, 19 aa, Staphylococcus aureus
IANGTPTPVLTPDAVTQAV

SEQ ID NO: 1594396 - protein, 25 aa, Staphylococcus aureus
IASLGIIFVLLIFGISYNGYMKGGS

SEQ ID NO: 1594397 - protein, 22 aa, Staphylococcus aureus
IASTAFIFLPALIGWSSMRVFG

SEQ ID NO: 1594398 - protein, 27 aa, Staphylococcus aureus
IATKLAMIIIYIIVALIVIKILDKMIA

SEQ ID NO: 1594399 - protein, 30 aa, Staphylococcus aureus
IAVIAIVIIVYIALKYAPFLKEQDWNPVNH

SEQ ID NO: 1594400 - protein, 24 aa, Staphylococcus aureus
ICYGLIFGLFYLLSGSKVDYLIVT

SEQ ID NO: 1594401 - protein, 24 aa, Staphylococcus aureus
ICYGVIFGLFYLLSGSTADYLIVT

SEQ ID NO: 1594402 - protein, 33 aa, Staphylococcus aureus
IDLVLSIVLLFLTFPIMFIFAIAIVIDSPGNPI

SEQ ID NO: 1594403 - protein, 17 aa, Staphylococcus aureus
IDQSPEIAIVNQVKQTA

SEQ ID NO: 1594404 - protein, 17 aa, Staphylococcus aureus
IENNVMLGVIYLKDVIK

SEQ ID NO: 1594405 - protein, 25 aa, Staphylococcus aureus
IESNDDAPLLLAKKKNQKDNQSKGK

SEQ ID NO: 1594406 - protein, 20 aa, Staphylococcus aureus
IFDSITYFVAAVAGISLFIA

SEQ ID NO: 1594407 - protein, 18 aa, Staphylococcus aureus
IFFAFFSIYYFLTGKSDE

SEQ ID NO: 1594408 - protein, 20 aa, Staphylococcus aureus
IFFVYFVMVGFRRGFWLSMI

SEQ ID NO: 1594409 - protein, 19 aa, Staphylococcus aureus
IFIIILVVMFFLILLICYK

SEQ ID NO: 1594410 - protein, 17 aa, Staphylococcus aureus
IFIVGILSLFGIFALLL

SEQ ID NO: 1594411 - protein, 18 aa, Staphylococcus aureus
IFIVGILSLFGIFALLLV

SEQ ID NO: 1594412 - protein, 25 aa, Staphylococcus aureus
IFLVTLLFVLWQPKGLDIGFTALTG

SEQ ID NO: 1594413 - protein, 17 aa, Staphylococcus aureus
IFPYLCLVVFVGGHIAR

SEQ ID NO: 1594414 - protein, 22 aa, Staphylococcus aureus
IGAIFMVVIMILVTWNDIRRYF

SEQ ID NO: 1594415 - protein, 17 aa, Staphylococcus aureus
IGALQLKNKIDFSKDFN

SEQ ID NO: 1594416 - protein, 29 aa, Staphylococcus aureus
IGDNQVDYRFFIGFKLYLNEQEVSVKNVG

SEQ ID NO: 1594417 - protein, 17 aa, Staphylococcus aureus
IGHKKKLDQDDEIDPLH

SEQ ID NO: 1594418 - protein, 21 aa, Staphylococcus aureus
IGIFTLWYYWRKRKHNIDRMV

SEQ ID NO: 1594419 - protein, 24 aa, Staphylococcus aureus
IGQSIFMFILLLTIYIKGFSIICI

SEQ ID NO: 1594420 - protein, 19 aa, Staphylococcus aureus
IGSIILIALVTLILRAVRK

SEQ ID NO: 1594421 - protein, 19 aa, Staphylococcus aureus
IGSLLLFTSIFGKLGKKLV

SEQ ID NO: 1594422 - protein, 17 aa, Staphylococcus aureus
IGTILSTFVIALLKTIF

SEQ ID NO: 1594423 - protein, 23 aa, Staphylococcus aureus
IHNYIFKVLAYGILLWSLTTTGS

SEQ ID NO: 1594424 - protein, 20 aa, Staphylococcus aureus
IHWISILPVIIFNKGSRLVK

SEQ ID NO: 1594425 - protein, 19 aa, Staphylococcus aureus
IIACMIWYFNKSHVSIIGI

SEQ ID NO: 1594426 - protein, 24 aa, Staphylococcus aureus
IIARKIPIFIFFVSIIGPLLEEYV

SEQ ID NO: 1594427 - protein, 18 aa, Staphylococcus aureus
IIGIIQYSSIISAILMKN

SEQ ID NO: 1594428 - protein, 24 aa, Staphylococcus aureus
IIGVILCICIVATVIYLKVKHDEK

SEQ ID NO: 1594429 - protein, 22 aa, Staphylococcus aureus
IIHGGTFGIYPKADASTQNSSS

SEQ ID NO: 1594430 - protein, 18 aa, Staphylococcus aureus
IIIFVMLCGKVGLLTLLR

SEQ ID NO: 1594431 - protein, 29 aa, Staphylococcus aureus
IIIQSFLTLLFLLFLILSATGIIQPELTT

SEQ ID NO: 1594432 - protein, 19 aa, Staphylococcus aureus
IIITIILISFLYLICKKKK

SEQ ID NO: 1594433 - protein, 18 aa, Staphylococcus aureus
IILIFFCHSPLTYLWVFA

SEQ ID NO: 1594434 - protein, 25 aa, Staphylococcus aureus
IISIAIALVIFAIIGKFIVTPYTIK

SEQ ID NO: 1594435 - protein, 31 aa, Staphylococcus aureus
IISILWVYIVLLYLCYLFITANFLDYTFMTY

SEQ ID NO: 1594436 - protein, 26 aa, Staphylococcus aureus
IIVGIVLAILIIFLKELLDKRIKTEK

SEQ ID NO: 1594437 - protein, 23 aa, Staphylococcus aureus
IIVIATLLFLLFGGSVEYILKDQ

SEQ ID NO: 1594438 - protein, 19 aa, Staphylococcus aureus
ILILLCGIVTLLIRIIPFI

SEQ ID NO: 1594439 - protein, 30 aa, Staphylococcus aureus
ILISGAVFIVFLLLPARWFTGLVTEKTVDD

SEQ ID NO: 1594440 - protein, 22 aa, Staphylococcus aureus
ILKFSLWRYKKLTVAILVLIVM

SEQ ID NO: 1594441 - protein, 17 aa, Staphylococcus aureus
ILKIDFKKALITGLLIY

SEQ ID NO: 1594442 - protein, 24 aa, Staphylococcus aureus
ILLLFSFVVFFFIYGMVSGASALE

SEQ ID NO: 1594443 - protein, 22 aa, Staphylococcus aureus
ILLVLLYLIYFGLTVTMIVFLC

SEQ ID NO: 1594444 - protein, 21 aa, Staphylococcus aureus
ILPIIIVFLTFGLVAVFTQQA

SEQ ID NO: 1594445 - protein, 24 aa, Staphylococcus aureus
ILSLFGITALLLVVALPIYTVASY

SEQ ID NO: 1594446 - protein, 25 aa, Staphylococcus aureus
ILTGPLIVYWNWAWGITVIVIYGIG

SEQ ID NO: 1594447 - protein, 19 aa, Staphylococcus aureus
ILVQLFLISMLFTDSAYQF

SEQ ID NO: 1594448 - protein, 20 aa, Staphylococcus aureus
IMIHMIIFSIKYLKDFSLEN

SEQ ID NO: 1594449 - protein, 27 aa, Staphylococcus aureus
IMVSMLFTLLIVPCLSSKKARTLKKHA

SEQ ID NO: 1594450 - protein, 27 aa, Staphylococcus aureus
INANTFLYFLTPIINCPDNLLPKYINI

SEQ ID NO: 1594451 - protein, 21 aa, Staphylococcus aureus
INGLPHLTQLQKDNLKHQVEQ

SEQ ID NO: 1594452 - protein, 18 aa, Staphylococcus aureus
INGYILISVLILSLLVVS

SEQ ID NO: 1594453 - protein, 22 aa, Staphylococcus aureus
INQTTNPMLNPDDITRALTQVT

SEQ ID NO: 1594454 - protein, 23 aa, Staphylococcus aureus
INQTTNPMLNPDDITRALTQVTD

SEQ ID NO: 1594455 - protein, 32 aa, Staphylococcus aureus
IPALTKLFGKGSWYLPAWLNRIIPRVDIEGHA

SEQ ID NO: 1594456 - protein, 17 aa, Staphylococcus aureus
IPEIVAHSHYTVQGQDF

SEQ ID NO: 1594457 - protein, 28 aa, Staphylococcus aureus
IPEYILSFIYALMYWATIPFDYIGNKAD

SEQ ID NO: 1594458 - protein, 18 aa, Staphylococcus aureus
IPFWGLVVILTIITIFLV

SEQ ID NO: 1594459 - protein, 26 aa, Staphylococcus aureus
IPIIIVLLLIGGIAWGVYAFFANTPK

SEQ ID NO: 1594460 - protein, 24 aa, Staphylococcus aureus
IPVCIIAILYVLLSPTHPLALIVG

SEQ ID NO: 1594461 - protein, 28 aa, Staphylococcus aureus
IPVCIIALLYVLLSPTHPLALIVGIILL

SEQ ID NO: 1594462 - protein, 18 aa, Staphylococcus aureus
IPVFIVMGLYICMYAVFA

SEQ ID NO: 1594463 - protein, 33 aa, Staphylococcus aureus
IQENIDPATGKDYSIFGWNNENVVRYGGGSADG

SEQ ID NO: 1594464 - protein, 42 aa, Staphylococcus aureus
IQGALNIILGLIKFFSSLFVGDWRGVWDGIVMILKGTVQLIW

SEQ ID NO: 1594465 - protein, 72 aa, Staphylococcus aureus
IQGTLNIILGLIKFFSSLFTGDWRGVWDAIIMILKGVVQLIWNLIQLWFVGKILGVVRYFGGLLKGLITGIW

SEQ ID NO: 1594466 - protein, 19 aa, Staphylococcus aureus
IQGVVDWLTQLWGKIQSTL

SEQ ID NO: 1594467 - protein, 24 aa, Staphylococcus aureus
IQLPLQVFTFFGGINLFFGAKLDV

SEQ ID NO: 1594468 - protein, 29 aa, Staphylococcus aureus
IQNATGLPTDGFTYKWNNAATGTNDANWA

SEQ ID NO: 1594469 - protein, 17 aa, Staphylococcus aureus
IRRLFGYTAIHFIITSD

SEQ ID NO: 1594470 - protein, 23 aa, Staphylococcus aureus
IRTTTFAILILFLINFSNNANKT

SEQ ID NO: 1594471 - protein, 19 aa, Staphylococcus aureus
IRWLFTFGILFQLPILFIG

SEQ ID NO: 1594472 - protein, 24 aa, Staphylococcus aureus
ISGKPWIWMPPAIMITLTILSINF

SEQ ID NO: 1594473 - protein, 20 aa, Staphylococcus aureus
ISLLILLILIPIFAISACLY

SEQ ID NO: 1594474 - protein, 22 aa, Staphylococcus aureus
ISTLFLLLYFLVNGISLIIQGF

SEQ ID NO: 1594475 - protein, 18 aa, Staphylococcus aureus
ISWIFMTMLFMFMNMHSI

SEQ ID NO: 1594476 - protein, 32 aa, Staphylococcus aureus
ITEPLEFSFLFVAPLLYGIHVLLAGTSFLVMH

SEQ ID NO: 1594477 - protein, 23 aa, Staphylococcus aureus
ITHQILWDFVKAPHALITGVTGG

SEQ ID NO: 1594478 - protein, 17 aa, Staphylococcus aureus
ITIAFQAIGTVISVAVQ

SEQ ID NO: 1594479 - protein, 26 aa, Staphylococcus aureus
ITILGGDLMLIPKAIYASKATIRNIR

SEQ ID NO: 1594480 - protein, 29 aa, Staphylococcus aureus
ITKTATYKVVRTVPKQVFETARGVLYPGV

SEQ ID NO: 1594481 - protein, 28 aa, Staphylococcus aureus
ITLKELDHIIRFAHISYGLYMGEHLPKG

SEQ ID NO: 1594482 - protein, 19 aa, Staphylococcus aureus
ITLLLYAITSYVFGILLCY

SEQ ID NO: 1594483 - protein, 29 aa, Staphylococcus aureus
ITSYHIFRIFFILFIIAPGINYFLKFRSN

SEQ ID NO: 1594484 - protein, 17 aa, Staphylococcus aureus
ITTPTLKNPLTGVIISK

SEQ ID NO: 1594485 - protein, 17 aa, Staphylococcus aureus
ITVIVIYGIGYYAAMKI

SEQ ID NO: 1594486 - protein, 30 aa, Staphylococcus aureus
IVGFKVLAPIMKFIMYILSVAVESLVHAHL

SEQ ID NO: 1594487 - protein, 19 aa, Staphylococcus aureus
IVTFFVLSPKYQANTQILV

SEQ ID NO: 1594488 - protein, 19 aa, Staphylococcus aureus
IVVLLIKAIITWLLLIPIF

SEQ ID NO: 1594489 - protein, 26 aa, Staphylococcus aureus
IVYTIHVIILIILLKEFRKYKSINVN

SEQ ID NO: 1594490 - protein, 19 aa, Staphylococcus aureus
IYTFTDYVNTKDDVKATLT

SEQ ID NO: 1594491 - protein, 27 aa, Staphylococcus aureus
IYTLGVLFIFLFLLGCFLPIGIDKVKS

SEQ ID NO: 1594492 - protein, 18 aa, Staphylococcus aureus
IYTLSEVIILIPISLIIT

SEQ ID NO: 1594493 - protein, 19 aa, Staphylococcus aureus
KALNRVMDQLSQEITGNEG

SEQ ID NO: 1594494 - protein, 35 aa, Staphylococcus aureus
KANQVQPLNKYPVVFVHGFLGLVGDNAPALYPNYW

SEQ ID NO: 1594495 - protein, 26 aa, Staphylococcus aureus
KANTVAKSMWAEHPLFTIIGGACLVA

SEQ ID NO: 1594496 - protein, 17 aa, Staphylococcus aureus
KDFNFKVRVANNHQSNT

SEQ ID NO: 1594497 - protein, 26 aa, Staphylococcus aureus
KDISTDKIDRIRNSTIGTAEERQAAM

SEQ ID NO: 1594498 - protein, 24 aa, Staphylococcus aureus
KDNLKQYMTTSGNATYDQSTGIVT

SEQ ID NO: 1594499 - protein, 24 aa, Staphylococcus aureus
KEEIPFEKKREFNPDLKPGEEKVT

SEQ ID NO: 1594500 - protein, 30 aa, Staphylococcus aureus
KELAIVFVPFLLFLTIAFGVTFLMGLLNLI

SEQ ID NO: 1594501 - protein, 24 aa, Staphylococcus aureus
KELKLIMSLGFILGGIIGFFQGLV

SEQ ID NO: 1594502 - protein, 25 aa, Staphylococcus aureus
KETYSWKWTALAVAYPLVIAYVLTF

SEQ ID NO: 1594503 - protein, 37 aa, Staphylococcus aureus
KEVLQKNLKILIILPLLFLIISAIVTFFVLSPKYQAN

SEQ ID NO: 1594504 - protein, 33 aa, Staphylococcus aureus
KEVTDQFKNRIYYEHPNVASIKFGDITKTYVVL

SEQ ID NO: 1594505 - protein, 24 aa, Staphylococcus aureus
KEYKELIILMTKVKISKIVAKELR

SEQ ID NO: 1594506 - protein, 38 aa, Staphylococcus aureus
KFSIRKYTVGTFSTVIATLVFLGLNTSQAQAAETNQPA

SEQ ID NO: 1594507 - protein, 29 aa, Staphylococcus aureus
KGQSFNIGDIKQYFTLSNGQAIPSGTFTN

SEQ ID NO: 1594508 - protein, 43 aa, Staphylococcus aureus
KHESSTIILMIFLIGIILLSIWTRSYIIGFLAAIINVFVFNYF

SEQ ID NO: 1594509 - protein, 26 aa, Staphylococcus aureus
KIAMLSIIFLLIITIISIIAPLIAPF

SEQ ID NO: 1594510 - protein, 23 aa, Staphylococcus aureus
KIDRPSIGIGLINLKDIPEEERE

SEQ ID NO: 1594511 - protein, 19 aa, Staphylococcus aureus
KIFEVPALLPVAFLLIVIV

SEQ ID NO: 1594512 - protein, 32 aa, Staphylococcus aureus
KIFNYALAYGIIFLMFFIVLNYASQIAMEIAS

SEQ ID NO: 1594513 - protein, 19 aa, Staphylococcus aureus
KIIIVLFIISFIISGIIDM

SEQ ID NO: 1594514 - protein, 19 aa, Staphylococcus aureus
KISYKYDNVASINFGDINK

SEQ ID NO: 1594515 - protein, 21 aa, Staphylococcus aureus
KKAILFAALFILIGFYDGFVG

SEQ ID NO: 1594516 - protein, 20 aa, Staphylococcus aureus
KKALLFAALFILIGFYDGFV

SEQ ID NO: 1594517 - protein, 31 aa, Staphylococcus aureus
KKEVVAKATYDILTKTYTFVFTDYVNDKENI

SEQ ID NO: 1594518 - protein, 32 aa, Staphylococcus aureus
KKKGSIEGTKHLPLLFAKRRRKEDEEDVIFEE

SEQ ID NO: 1594519 - protein, 47 aa, Staphylococcus aureus
KKLDILTLFAYFKPHLLYLLIGTAIIFVICKLIAQLLIRFKTKDLAE

SEQ ID NO: 1594520 - protein, 37 aa, Staphylococcus aureus
KKNIHEPWLFSLPSLILMVLVPLIFFVPNIFGKGIIV

SEQ ID NO: 1594521 - protein, 28 aa, Staphylococcus aureus
KKNIHEPWLFSLPSLILMVLVPVIFFVP

SEQ ID NO: 1594522 - protein, 26 aa, Staphylococcus aureus
KKNMAGLIFVSWYPTVYWIINAAVVL

SEQ ID NO: 1594523 - protein, 23 aa, Staphylococcus aureus
KKPASITAYNNSMHALQAELTSA

SEQ ID NO: 1594524 - protein, 21 aa, Staphylococcus aureus
KKSDIFIIKKQNLHSFKVGRG

SEQ ID NO: 1594525 - protein, 32 aa, Staphylococcus aureus
KLGKLLKLGGKALKPLGFITAITDNIGKKSWQ

SEQ ID NO: 1594526 - protein, 31 aa, Staphylococcus aureus
KLIGVPVIFFVIYLMLMIPIANLGLSSVLTK

SEQ ID NO: 1594527 - protein, 20 aa, Staphylococcus aureus
KLLHPIFEAINLPTALTTTI

SEQ ID NO: 1594528 - protein, 24 aa, Staphylococcus aureus
KLNGMYCISIFVLTRLLSLTARLK

SEQ ID NO: 1594529 - protein, 23 aa, Staphylococcus aureus
KLRLDMREIPKSSIKPEHFHLMY

SEQ ID NO: 1594530 - protein, 28 aa, Staphylococcus aureus
KMKPHQFEQLFLIFIDNAIKYDVKNKKI

SEQ ID NO: 1594531 - protein, 17 aa, Staphylococcus aureus
KMKSWYERFGFGKSTKG

SEQ ID NO: 1594532 - protein, 26 aa, Staphylococcus aureus
KNFCFTLFYYFLFGGLSIMALSMLLT

SEQ ID NO: 1594533 - protein, 21 aa, Staphylococcus aureus
KNYLVMIPLTFIIGADLLLLS

SEQ ID NO: 1594534 - protein, 18 aa, Staphylococcus aureus
KPIVYGFKSFLIGSTYIF

SEQ ID NO: 1594535 - protein, 24 aa, Staphylococcus aureus
KPVAKNDLKEIPQLVTKKNDVSET

SEQ ID NO: 1594536 - protein, 20 aa, Staphylococcus aureus
KQAGQGYRGYGAFVKNDSSG

SEQ ID NO: 1594537 - protein, 25 aa, Staphylococcus aureus
KQRITTAFMNKNQNIRGYLASSNPV

SEQ ID NO: 1594538 - protein, 18 aa, Staphylococcus aureus
KQVQALIDEIDRNPNLTD

SEQ ID NO: 1594539 - protein, 17 aa, Staphylococcus aureus
KRALASYSNLNNAQSTA

SEQ ID NO: 1594540 - protein, 18 aa, Staphylococcus aureus
KRDVFIFNKKVNGYHVWI

SEQ ID NO: 1594541 - protein, 23 aa, Staphylococcus aureus
KRFPLYILMFEQIISILWVYIVL

SEQ ID NO: 1594542 - protein, 21 aa, Staphylococcus aureus
KRILYTCFILFIYILGTNISI

SEQ ID NO: 1594543 - protein, 23 aa, Staphylococcus aureus
KRKLFIMMFLFIVSIILLFFAHR

SEQ ID NO: 1594544 - protein, 25 aa, Staphylococcus aureus
KRKRKIKIFIKKIPEYILSFIYALM

SEQ ID NO: 1594545 - protein, 25 aa, Staphylococcus aureus
KRMLYTCFILFIYILGTNISIVSYN

SEQ ID NO: 1594546 - protein, 33 aa, Staphylococcus aureus
KRVDFLSNKLNKYSIRKFTVGTASILIGSLMYL

SEQ ID NO: 1594547 - protein, 32 aa, Staphylococcus aureus
KSAIISALIFNALIIVALIPIAMKGVKVKGYS

SEQ ID NO: 1594548 - protein, 23 aa, Staphylococcus aureus
KSDSTSMSLSMSQSISGSTSVST

SEQ ID NO: 1594549 - protein, 23 aa, Staphylococcus aureus
KSFIWIVYCMLFTLVLKFTGLSP

SEQ ID NO: 1594550 - protein, 21 aa, Staphylococcus aureus
KSIEDAIQHMIDEIKARTDLT

SEQ ID NO: 1594551 - protein, 37 aa, Staphylococcus aureus
KTATYKVVSTVPKHVFETNRGAVFPGVSDVYDAKQYV

SEQ ID NO: 1594552 - protein, 17 aa, Staphylococcus aureus
KTGIAIILAMYIASLLP

SEQ ID NO: 1594553 - protein, 17 aa, Staphylococcus aureus
KTVHFTSLKTGPMGDAV

SEQ ID NO: 1594554 - protein, 22 aa, Staphylococcus aureus
KVKQAFINANRDVITLAEGNIS

SEQ ID NO: 1594555 - protein, 18 aa, Staphylococcus aureus
KVMDPAKQPAPSKVVLLP

SEQ ID NO: 1594556 - protein, 29 aa, Staphylococcus aureus
KVTILLFISLIVAVAFFFGLKTYQGHKNI

SEQ ID NO: 1594557 - protein, 17 aa, Staphylococcus aureus
KVVLLPAHRGTVSSGRE

SEQ ID NO: 1594558 - protein, 24 aa, Staphylococcus aureus
KWTGLFILIGLFVANWTVGLAAMI

SEQ ID NO: 1594559 - protein, 21 aa, Staphylococcus aureus
KYAYNWAFFNPIRKIYYNITI

SEQ ID NO: 1594560 - protein, 24 aa, Staphylococcus aureus
KYKIKKIIIAIPTIGQERLKEINN

SEQ ID NO: 1594561 - protein, 22 aa, Staphylococcus aureus
LAGLIPFIPIKFSFIKLNNVNN

SEQ ID NO: 1594562 - protein, 49 aa, Staphylococcus aureus
LAIVILIVFAVLFRFIVRLIPIFYIFRVLSIFIFIMGFKMLGVSIQKLQ

SEQ ID NO: 1594563 - protein, 27 aa, Staphylococcus aureus
LATIIIFLSLLFTIIYIDDIQKWLNQY

SEQ ID NO: 1594564 - protein, 18 aa, Staphylococcus aureus
LATIPFVVAFIVGAARGN

SEQ ID NO: 1594565 - protein, 17 aa, Staphylococcus aureus
LDDIRNTHVWEVDAQPA

SEQ ID NO: 1594566 - protein, 19 aa, Staphylococcus aureus
LDNWWIVTFIFVAQVILSL

SEQ ID NO: 1594567 - protein, 59 aa, Staphylococcus aureus
LDQDDEIDPLHMRHFGDRIGNVIKNALGVVGISGLLASFWFFIAKRRRKEDEEEELEIR

SEQ ID NO: 1594568 - protein, 60 aa, Staphylococcus aureus
LDQDDEIDPLHMRHFGDRIGNVIKNALGVVGISGLLASFWFFIAKRRRKEDEEEELEIRD

SEQ ID NO: 1594569 - protein, 31 aa, Staphylococcus aureus
LDQDDEIDPLHMRHFGVRIGNVIKNALGVVG

SEQ ID NO: 1594570 - protein, 19 aa, Staphylococcus aureus
LDYKRLFGAIGKNLTGGFG

SEQ ID NO: 1594571 - protein, 37 aa, Staphylococcus aureus
LEPVLTTRQVFLGKAGFFIMLGMLQALIVSVGDLLIL

SEQ ID NO: 1594572 - protein, 22 aa, Staphylococcus aureus
LETPFGYLISLDKVLKSIQFNQ

SEQ ID NO: 1594573 - protein, 25 aa, Staphylococcus aureus
LFAYPLIEVIWPKTGLVYFGMADIG

SEQ ID NO: 1594574 - protein, 29 aa, Staphylococcus aureus
LFFGAPTIFNFTLALFIGLISGVFSSIFI

SEQ ID NO: 1594575 - protein, 18 aa, Staphylococcus aureus
LFGIFALLLVVTLPIYTV

SEQ ID NO: 1594576 - protein, 18 aa, Staphylococcus aureus
LFILYYRVNRIGGNRNFE

SEQ ID NO: 1594577 - protein, 26 aa, Staphylococcus aureus
LFNEGQKVNIIIIASGLYSDTIGAFD

SEQ ID NO: 1594578 - protein, 28 aa, Staphylococcus aureus
LFSLLASIIVLWLYFRKAIPKSFDANHI

SEQ ID NO: 1594579 - protein, 25 aa, Staphylococcus aureus
LFTYASYILITWLAIIFALLIVAFR

SEQ ID NO: 1594580 - protein, 30 aa, Staphylococcus aureus
LFVVLKSALFFYYLFTKLSLISVLVLHLKQ

SEQ ID NO: 1594581 - protein, 24 aa, Staphylococcus aureus
LFYTLYLLLILIVLYYLKKQVKHK

SEQ ID NO: 1594582 - protein, 24 aa, Staphylococcus aureus
LGFTTFVMQDGFMKGLFGIETTGP

SEQ ID NO: 1594583 - protein, 21 aa, Staphylococcus aureus
LGIFLFFLYLNQKLKLQIYNE

SEQ ID NO: 1594584 - protein, 26 aa, Staphylococcus aureus
LGILGGAFWALMAPIAAVSSVLSNVF

SEQ ID NO: 1594585 - protein, 21 aa, Staphylococcus aureus
LGMLLITKYAINLLFIICVIL

SEQ ID NO: 1594586 - protein, 25 aa, Staphylococcus aureus
LGYTSLWFFGLIAIVIVAFFMFLKV

SEQ ID NO: 1594587 - protein, 20 aa, Staphylococcus aureus
LIEIFPKKLLVLIYQATMVI

SEQ ID NO: 1594588 - protein, 17 aa, Staphylococcus aureus
LIFFMKLNQKLKLKVFN

SEQ ID NO: 1594589 - protein, 19 aa, Staphylococcus aureus
LIFLLNFILVINSALFIWI

SEQ ID NO: 1594590 - protein, 25 aa, Staphylococcus aureus
LIHWISILPVIIFIKGSRLVKYINV

SEQ ID NO: 1594591 - protein, 26 aa, Staphylococcus aureus
LIHWISILPVIIFNKGPRLVKYINIF

SEQ ID NO: 1594592 - protein, 17 aa, Staphylococcus aureus
LIIACLMTWFCSDFYLM

SEQ ID NO: 1594593 - protein, 20 aa, Staphylococcus aureus
LIIMIMIFDLIIGLLLNFQI

SEQ ID NO: 1594594 - protein, 21 aa, Staphylococcus aureus
LIIVFLYFFNLSTIDIIFLIL

SEQ ID NO: 1594595 - protein, 17 aa, Staphylococcus aureus
LILALNNYMPKIEKALN

SEQ ID NO: 1594596 - protein, 17 aa, Staphylococcus aureus
LINQTGNPTLDKSQVEQ

SEQ ID NO: 1594597 - protein, 18 aa, Staphylococcus aureus
LISMLYLFVGIDFDIFEY

SEQ ID NO: 1594598 - protein, 18 aa, Staphylococcus aureus
LITWFYTMLWSIVGVVWI

SEQ ID NO: 1594599 - protein, 25 aa, Staphylococcus aureus
LITYLLQVILYLLIVIALVMIGFET

SEQ ID NO: 1594600 - protein, 18 aa, Staphylococcus aureus
LITYMGIPVFLAFFIYHK

SEQ ID NO: 1594601 - protein, 18 aa, Staphylococcus aureus
LIVLFIFTLFIMAQYAKH

SEQ ID NO: 1594602 - protein, 37 aa, Staphylococcus aureus
LKANQVQPLNKYPVVFVHGFLGLVGDNAPALYPNYWG

SEQ ID NO: 1594603 - protein, 26 aa, Staphylococcus aureus
LKGKKLTFIISPQWFTNHGLTNENFD

SEQ ID NO: 1594604 - protein, 22 aa, Staphylococcus aureus
LLAFAFIIMFILNPLVVYDIGF

SEQ ID NO: 1594605 - protein, 25 aa, Staphylococcus aureus
LLAVYLIIVIFSLLNYWSIKLLTSF

SEQ ID NO: 1594606 - protein, 18 aa, Staphylococcus aureus
LLFTIIFSLKCKIHLFFN

SEQ ID NO: 1594607 - protein, 17 aa, Staphylococcus aureus
LLLSGSYALIRFLSNAF

SEQ ID NO: 1594608 - protein, 17 aa, Staphylococcus aureus
LLNILVFYIYLNQKVKL

SEQ ID NO: 1594609 - protein, 35 aa, Staphylococcus aureus
LLPLLKLVLVVVFAMLFFVFVVLGIVAWMCGINIM

SEQ ID NO: 1594610 - protein, 19 aa, Staphylococcus aureus
LLSKAFAPLAGVFTSISWP

SEQ ID NO: 1594611 - protein, 30 aa, Staphylococcus aureus
LLTDQKYLLFWLLLGFIFGFFPPIQTTINS

SEQ ID NO: 1594612 - protein, 30 aa, Staphylococcus aureus
LLTNQKHLIFWLLLGFTFGFFPPIQTTINS

SEQ ID NO: 1594613 - protein, 20 aa, Staphylococcus aureus
LMILLTVVLYYFAKRLQQKY

SEQ ID NO: 1594614 - protein, 17 aa, Staphylococcus aureus
LMRNIIFYLVLIIAAIG

SEQ ID NO: 1594615 - protein, 17 aa, Staphylococcus aureus
LMYMAWTIWHDKPSTDG

SEQ ID NO: 1594616 - protein, 21 aa, Staphylococcus aureus
LNEKAKLILALNNYMPKIEKA

SEQ ID NO: 1594617 - protein, 23 aa, Staphylococcus aureus
LNEYQLSQLFTDDKLQQAARTGS

SEQ ID NO: 1594618 - protein, 26 aa, Staphylococcus aureus
LNLSLTLIFLILTFFKEVKLYRHFEK

SEQ ID NO: 1594619 - protein, 25 aa, Staphylococcus aureus
LNNGIARISAVQIVISDRAKQSSST

SEQ ID NO: 1594620 - protein, 40 aa, Staphylococcus aureus
LPDTGDSIKQNGLLGGVMTLLVGLGLMKRKKKKDENDQDD

SEQ ID NO: 1594621 - protein, 17 aa, Staphylococcus aureus
LPEIQHNIKFFKNDDTQ

SEQ ID NO: 1594622 - protein, 17 aa, Staphylococcus aureus
LPIIFIPNPNHVFINHI

SEQ ID NO: 1594623 - protein, 20 aa, Staphylococcus aureus
LPLILKFILNLALIGIVIIV

SEQ ID NO: 1594624 - protein, 19 aa, Staphylococcus aureus
LPQSVYLDASDKNKYKDVT

SEQ ID NO: 1594625 - protein, 19 aa, Staphylococcus aureus
LQMMVQTLPGFQGTKLREY

SEQ ID NO: 1594626 - protein, 33 aa, Staphylococcus aureus
LQQAARTGSPIRLMIGFDYPDAFGNGETLVPVN

SEQ ID NO: 1594627 - protein, 21 aa, Staphylococcus aureus
LRGTALQKVPVTVTDIPLDPS

SEQ ID NO: 1594628 - protein, 30 aa, Staphylococcus aureus
LSFKLYRFYFYRLFAIVTWLLFIGSLSQYF

SEQ ID NO: 1594629 - protein, 23 aa, Staphylococcus aureus
LSIALVVIGIAVVCLMIFSSQKT

SEQ ID NO: 1594630 - protein, 22 aa, Staphylococcus aureus
LSIFVQNLLHRSALDSGLTLLP

SEQ ID NO: 1594631 - protein, 20 aa, Staphylococcus aureus
LSILNYFVLLPLYGMIFNLA

SEQ ID NO: 1594632 - protein, 20 aa, Staphylococcus aureus
LSIPEFIIMIALASFFQPSL

SEQ ID NO: 1594633 - protein, 23 aa, Staphylococcus aureus
LSLIALLLIASFFITSADSATFV

SEQ ID NO: 1594634 - protein, 30 aa, Staphylococcus aureus
LSWSDDHKSLIYRYDATLGTQITTNDILTL

SEQ ID NO: 1594635 - protein, 19 aa, Staphylococcus aureus
LTAKVEVTLLDGSKVIVNV

SEQ ID NO: 1594636 - protein, 19 aa, Staphylococcus aureus
LTATLPVILMLVSTITQLV

SEQ ID NO: 1594637 - protein, 34 aa, Staphylococcus aureus
LTIITMVLCGFLFPLAITLIGQLFFYQQANGSLI

SEQ ID NO: 1594638 - protein, 23 aa, Staphylococcus aureus
LTLTFHLPLWVLLIAFFLNVCPV

SEQ ID NO: 1594639 - protein, 24 aa, Staphylococcus aureus
LTSIMLIILISVAGIHFKMKYDEK

SEQ ID NO: 1594640 - protein, 23 aa, Staphylococcus aureus
LTSIMLIILISVAGIYFKMKYDE

SEQ ID NO: 1594641 - protein, 17 aa, Staphylococcus aureus
LTVFLYALLPIIKNTYT

SEQ ID NO: 1594642 - protein, 17 aa, Staphylococcus aureus
LVAILFTSLVLTAGTVA

SEQ ID NO: 1594643 - protein, 19 aa, Staphylococcus aureus
LVASISVLVIACPCALGLA

SEQ ID NO: 1594644 - protein, 21 aa, Staphylococcus aureus
LVEYFNWRSLFHVVASIAAVT

SEQ ID NO: 1594645 - protein, 21 aa, Staphylococcus aureus
LVIVIMIMSFLKKPTPRPASS

SEQ ID NO: 1594646 - protein, 20 aa, Staphylococcus aureus
LVTFALGLIIALFTALMRIS

SEQ ID NO: 1594647 - protein, 17 aa, Staphylococcus aureus
LVVGCPCALVISTPISI

SEQ ID NO: 1594648 - protein, 20 aa, Staphylococcus aureus
LYILILYVILMGINAIYLVV

SEQ ID NO: 1594649 - protein, 22 aa, Staphylococcus aureus
LYISIMVLSIFIIGCNSSSENA

SEQ ID NO: 1594650 - protein, 17 aa, Staphylococcus aureus
LYLNIIGFVLAILVALR

SEQ ID NO: 1594651 - protein, 19 aa, Staphylococcus aureus
LYYYPYINTWWEFIPALIL

SEQ ID NO: 1594652 - protein, 17 aa, Staphylococcus aureus
MAANFKVTGQVKSGDYF

SEQ ID NO: 1594653 - protein, 30 aa, Staphylococcus aureus
MAGSQIMFILFILLILVFTVVFIFQFVSRI

SEQ ID NO: 1594654 - protein, 17 aa, Staphylococcus aureus
MAIMYFIAYAFIVLTII

SEQ ID NO: 1594655 - protein, 19 aa, Staphylococcus aureus
MIIISIVVYLLIPKSLDIT

SEQ ID NO: 1594656 - protein, 25 aa, Staphylococcus aureus
MIISSIIIYLFIRRQFNISNALLNL

SEQ ID NO: 1594657 - protein, 17 aa, Staphylococcus aureus
MKAANPTAKELAKRKQE

SEQ ID NO: 1594658 - protein, 25 aa, Staphylococcus aureus
MLKGLLLKITFNFGLPLLVAILHAV

SEQ ID NO: 1594659 - protein, 24 aa, Staphylococcus aureus
MMASSIILTNILPYDAQAASEKDT

SEQ ID NO: 1594660 - protein, 18 aa, Staphylococcus aureus
MPYLRLLFTIIFSLKCKI

SEQ ID NO: 1594661 - protein, 19 aa, Staphylococcus aureus
MTGIWAGIIIIVIAAIILG

SEQ ID NO: 1594662 - protein, 17 aa, Staphylococcus aureus
MVVIPKQGPNAESTNDL

SEQ ID NO: 1594663 - protein, 18 aa, Staphylococcus aureus
MWMFIGFMIFGAVSSLIS

SEQ ID NO: 1594664 - protein, 41 aa, Staphylococcus aureus
NAGTQLYHIVATNAYHKDTEDFYITLKIIDVKQPEGDQRVY

SEQ ID NO: 1594665 - protein, 24 aa, Staphylococcus aureus
NAPFLMFMPIWIDSIVTSILLFFA

SEQ ID NO: 1594666 - protein, 22 aa, Staphylococcus aureus
NDFVSQRFLALANGAYKYNPYI

SEQ ID NO: 1594667 - protein, 25 aa, Staphylococcus aureus
NDKFGFYIILILSLLIFVTLLLVNK

SEQ ID NO: 1594668 - protein, 31 aa, Staphylococcus aureus
NDKQNINGKFSLPLFTDRAKAPKSGTYDANI

SEQ ID NO: 1594669 - protein, 26 aa, Staphylococcus aureus
NEAVQGDTFKITVPKELNLNGVTSTA

SEQ ID NO: 1594670 - protein, 35 aa, Staphylococcus aureus
NEGYNFTIYVPYGDYWFAYFMRRLAERPQNLSLAV

SEQ ID NO: 1594671 - protein, 31 aa, Staphylococcus aureus
NENNADIILPKSTAPKRLNTRMRIAAVQPSS

SEQ ID NO: 1594672 - protein, 31 aa, Staphylococcus aureus
NEVVAKATYDILTKTYTFVFTDYVNDKQNIN

SEQ ID NO: 1594673 - protein, 18 aa, Staphylococcus aureus
NFKLLKRNIYYFKAHHII

SEQ ID NO: 1594674 - protein, 32 aa, Staphylococcus aureus
NGETLVPVNLTVLPEIQHNIKFFKNDDGQNIA

SEQ ID NO: 1594675 - protein, 26 aa, Staphylococcus aureus
NGILITFLPLLFLPFSGELGGAATTF

SEQ ID NO: 1594676 - protein, 24 aa, Staphylococcus aureus
NGTDAINYITFDPNTNTNGITAVW

SEQ ID NO: 1594677 - protein, 24 aa, Staphylococcus aureus
NGVSFMVPFIVVGGLLIAIALTLG

SEQ ID NO: 1594678 - protein, 19 aa, Staphylococcus aureus
NGVTSTAKVPPIMAGDQVL

SEQ ID NO: 1594679 - protein, 24 aa, Staphylococcus aureus
NIIQTLFIVSLISLGLMIVIHFMT

SEQ ID NO: 1594680 - protein, 21 aa, Staphylococcus aureus
NILMWFVSLVVFIIGFIVSLT

SEQ ID NO: 1594681 - protein, 25 aa, Staphylococcus aureus
NILVFIMWIIITIFFFLISMGSISN

SEQ ID NO: 1594682 - protein, 21 aa, Staphylococcus aureus
NIPLLLTIIIIILGSVLAIKV

SEQ ID NO: 1594683 - protein, 25 aa, Staphylococcus aureus
NIRDIKMWILGLIGTILSTFVIAIL

SEQ ID NO: 1594684 - protein, 24 aa, Staphylococcus aureus
NIRDIKMWILGLVGTIFSTIVIAL

SEQ ID NO: 1594685 - protein, 25 aa, Staphylococcus aureus
NISMLLFLFIFYMQTQSYFYNIFSM

SEQ ID NO: 1594686 - protein, 17 aa, Staphylococcus aureus
NIVIMFICITLIGLFSQ

SEQ ID NO: 1594687 - protein, 25 aa, Staphylococcus aureus
NKIAMLSIIFLLIITIVSIIAPLIA

SEQ ID NO: 1594688 - protein, 34 aa, Staphylococcus aureus
NKRVDFLSNKLNKYSIRKFTVGTASILIGSLMYL

SEQ ID NO: 1594689 - protein, 19 aa, Staphylococcus aureus
NKVLPYKAPFYPLGQIIVI

SEQ ID NO: 1594690 - protein, 21 aa, Staphylococcus aureus
NLDGTRLLDQAKQTAKQQLNN

SEQ ID NO: 1594691 - protein, 44 aa, Staphylococcus aureus
NLNIDGFVDDPLSYVKTPSNKVLGFYPTNATTNAFRPGGVQELN

SEQ ID NO: 1594692 - protein, 22 aa, Staphylococcus aureus
NMDDRIPINVWTGDSIARTGKG

SEQ ID NO: 1594693 - protein, 41 aa, Staphylococcus aureus
NMSNAVTILPDDIPPTINNPVGLNAKYYRGDEVSFTMGVSD

SEQ ID NO: 1594694 - protein, 23 aa, Staphylococcus aureus
NMYLFSTHRLKFKNSTYMLKIYM

SEQ ID NO: 1594695 - protein, 41 aa, Staphylococcus aureus
NNAITIITIITAVIFLTITTVFAFFLSSRITKPLRRLRDQA

SEQ ID NO: 1594696 - protein, 19 aa, Staphylococcus aureus
NNIYLLTIAKLILPIIYPY

SEQ ID NO: 1594697 - protein, 62 aa, Staphylococcus aureus
NNTFQNFDITYNGDTKVMTVTYAGQTWTRNISDWIAKSGTTNFSLSMTASTGGATNLQQVQF

SEQ ID NO: 1594698 - protein, 19 aa, Staphylococcus aureus
NPDLTLEQKAKALKEIDEA

SEQ ID NO: 1594699 - protein, 19 aa, Staphylococcus aureus
NPIPIYITNFFGGAIAGLI

SEQ ID NO: 1594700 - protein, 17 aa, Staphylococcus aureus
NPLFLYDALMDYQNKHQ

SEQ ID NO: 1594701 - protein, 18 aa, Staphylococcus aureus
NPLGLQFANSVTSGIISA

SEQ ID NO: 1594702 - protein, 29 aa, Staphylococcus aureus
NQMNEKIIKLYFRIIIAYLKDDDGIIDSK

SEQ ID NO: 1594703 - protein, 49 aa, Staphylococcus aureus
NQSISKKITGYGLKTTAVIGGAFTVNMLHDQQAFAASDAPLTSELNTQS

SEQ ID NO: 1594704 - protein, 25 aa, Staphylococcus aureus
NRDTLHLIIFNIFSIIMSYNPLVHI

SEQ ID NO: 1594705 - protein, 22 aa, Staphylococcus aureus
NRDYSIFGWNNENVVRYGGGSA

SEQ ID NO: 1594706 - protein, 18 aa, Staphylococcus aureus
NRKGMIPNRLNKFSIRKY

SEQ ID NO: 1594707 - protein, 19 aa, Staphylococcus aureus
NRKGMIPNRLNKFSIRKYS

SEQ ID NO: 1594708 - protein, 27 aa, Staphylococcus aureus
NSETLVPVNLTVLPEIQHNIKFFKNDD

SEQ ID NO: 1594709 - protein, 18 aa, Staphylococcus aureus
NSHVDIKSELGYEGGQNS

SEQ ID NO: 1594710 - protein, 21 aa, Staphylococcus aureus
NSIVLKSILSLGIIHGGTFGI

SEQ ID NO: 1594711 - protein, 27 aa, Staphylococcus aureus
NTARQGLTLDRQPAFTTLHGASNLNQA

SEQ ID NO: 1594712 - protein, 39 aa, Staphylococcus aureus
NTDVISPTLFVLLMYLLSMITAYIFYSYERAKGQMNFIK

SEQ ID NO: 1594713 - protein, 27 aa, Staphylococcus aureus
NTEAVRKIMFALNRFMGNKYSNIDLGL

SEQ ID NO: 1594714 - protein, 25 aa, Staphylococcus aureus
NTINGLPHLTQLQKDNLKHQVEQAQ

SEQ ID NO: 1594715 - protein, 21 aa, Staphylococcus aureus
NTKLYPGQVWTIADLLQITVS

SEQ ID NO: 1594716 - protein, 23 aa, Staphylococcus aureus
NTTGADGWGFLFSKGNAEEYLTN

SEQ ID NO: 1594717 - protein, 24 aa, Staphylococcus aureus
NTVTGLPSGLTFDSTNNTISGTPT

SEQ ID NO: 1594718 - protein, 21 aa, Staphylococcus aureus
NVFSMTLLNVVKRILDLTRIT

SEQ ID NO: 1594719 - protein, 23 aa, Staphylococcus aureus
NVKDLMMLLPFTLLSILIVIFIF

SEQ ID NO: 1594720 - protein, 22 aa, Staphylococcus aureus
NVKFEDMLDIKFYSLDDINGLS

SEQ ID NO: 1594721 - protein, 17 aa, Staphylococcus aureus
NWLSEKLSHFAEKLKHS

SEQ ID NO: 1594722 - protein, 38 aa, Staphylococcus aureus
NWVKSGIKEIEMFKIMGLPFISHSLVSQDNQSISKKMT

SEQ ID NO: 1594723 - protein, 21 aa, Staphylococcus aureus
NYIIEDINWLSEKLSHFAEKL

SEQ ID NO: 1594724 - protein, 23 aa, Staphylococcus aureus
PADHHYYQPLWTLVGAGVSSLKS

SEQ ID NO: 1594725 - protein, 41 aa, Staphylococcus aureus
PASISLIICLIILGLLMPLFGLSLILVFIIELILYIKDRRA

SEQ ID NO: 1594726 - protein, 22 aa, Staphylococcus aureus
PASKQAGHPVFYVYAGNQGNAS

SEQ ID NO: 1594727 - protein, 24 aa, Staphylococcus aureus
PEGDQRVYRMSTYDITTDEISKVK

SEQ ID NO: 1594728 - protein, 23 aa, Staphylococcus aureus
PEIGRIYILPALIGSIILIAIVT

SEQ ID NO: 1594729 - protein, 23 aa, Staphylococcus aureus
PEIGRIYILPALIGSIILIALVT

SEQ ID NO: 1594730 - protein, 17 aa, Staphylococcus aureus
PEKWILGLLGLIPIYLG

SEQ ID NO: 1594731 - protein, 24 aa, Staphylococcus aureus
PEMTRYFMTIPEASRLVLQAGALA

SEQ ID NO: 1594732 - protein, 17 aa, Staphylococcus aureus
PFFLCVAIMYLSIGLQY

SEQ ID NO: 1594733 - protein, 23 aa, Staphylococcus aureus
PFLGMLLITKYPIDLLFIICVIL

SEQ ID NO: 1594734 - protein, 18 aa, Staphylococcus aureus
PGFILLYIRAIIPVFPLA

SEQ ID NO: 1594735 - protein, 23 aa, Staphylococcus aureus
PGVTLFLLLKAFSSGASSLTGVE

SEQ ID NO: 1594736 - protein, 31 aa, Staphylococcus aureus
PIGDQSSEVFSPISPIKIATQDNSGNAVTNT

SEQ ID NO: 1594737 - protein, 44 aa, Staphylococcus aureus
PIGVKLKLAKVIIILCVVAFFTFPVIVMFLLAPDLNKGKDDAGC

SEQ ID NO: 1594738 - protein, 20 aa, Staphylococcus aureus
PINFILKSSTKLKADIDFDD

SEQ ID NO: 1594739 - protein, 51 aa, Staphylococcus aureus
PKFNDWIFIVFIISVYYIFWLLAKRKYILVTFWTIIILTLLITFPTNSHHK

SEQ ID NO: 1594740 - protein, 21 aa, Staphylococcus aureus
PLHMRHFSNNFGNVIKNAIGV

SEQ ID NO: 1594741 - protein, 19 aa, Staphylococcus aureus
PLILKTILNLSLIGIVIIV

SEQ ID NO: 1594742 - protein, 23 aa, Staphylococcus aureus
PLSFAYVIFIVFLQVGFSNAVNL

SEQ ID NO: 1594743 - protein, 26 aa, Staphylococcus aureus
PNMVKYPILMLPILTTAIVSGLVSAL

SEQ ID NO: 1594744 - protein, 25 aa, Staphylococcus aureus
PNRLNKFSIRKYSVGTASILVGTTL

SEQ ID NO: 1594745 - protein, 26 aa, Staphylococcus aureus
PNRLNKFSIRKYSVGTASILVGTTLI

SEQ ID NO: 1594746 - protein, 37 aa, Staphylococcus aureus
PNSKGDLALRSTLYGYNSNIIWRSMSWDNEVAFNNGS

SEQ ID NO: 1594747 - protein, 17 aa, Staphylococcus aureus
PPFFMATGALMYVVPYF

SEQ ID NO: 1594748 - protein, 20 aa, Staphylococcus aureus
PPNPNYPFNGGVHHGVDYDT

SEQ ID NO: 1594749 - protein, 26 aa, Staphylococcus aureus
PQIMPAFLSLILYRFELNLRSASILG

SEQ ID NO: 1594750 - protein, 23 aa, Staphylococcus aureus
PQRDALRNHINQAQALATVEQTK

SEQ ID NO: 1594751 - protein, 27 aa, Staphylococcus aureus
PSFWQGLLFILAFSLKLDILPPSYMPE

SEQ ID NO: 1594752 - protein, 68 aa, Staphylococcus aureus
PTESPGVPKVYTFIGKGDASYTISFKTQGPTIDKLYYAAGGRALEYNQLFMYSQLYVESTQDYQQRLN

SEQ ID NO: 1594753 - protein, 22 aa, Staphylococcus aureus
PTFNHFCFVLFSYLFSGFFSIM

SEQ ID NO: 1594754 - protein, 22 aa, Staphylococcus aureus
PTINWLGFYPTYEPLIAQAAYI

SEQ ID NO: 1594755 - protein, 20 aa, Staphylococcus aureus
PVKHVIPEIVAHSHYTVQGQ

SEQ ID NO: 1594756 - protein, 27 aa, Staphylococcus aureus
PVTNRDYSIFGWNNENVVRYGGGSADG

SEQ ID NO: 1594757 - protein, 18 aa, Staphylococcus aureus
QAGQGYRGYGAFVKNDSS

SEQ ID NO: 1594758 - protein, 17 aa, Staphylococcus aureus
QAIGDHDTIVAGGNYTN

SEQ ID NO: 1594759 - protein, 20 aa, Staphylococcus aureus
QALDHAMELLRNSVADNQAT

SEQ ID NO: 1594760 - protein, 19 aa, Staphylococcus aureus
QALDQLMDALQQSIADKDA

SEQ ID NO: 1594761 - protein, 23 aa, Staphylococcus aureus
QALKDRINQILQQGHNDINNAMT

SEQ ID NO: 1594762 - protein, 28 aa, Staphylococcus aureus
QASWRVPFIIILGIAILAFVFGLVSISS

SEQ ID NO: 1594763 - protein, 17 aa, Staphylococcus aureus
QDAYSQKGAITLGTRID

SEQ ID NO: 1594764 - protein, 26 aa, Staphylococcus aureus
QDGKKLFFFLWDFVIFVFNVQLRKVK

SEQ ID NO: 1594765 - protein, 18 aa, Staphylococcus aureus
QFKAQMKAANPTAKELAK

SEQ ID NO: 1594766 - protein, 24 aa, Staphylococcus aureus
QFKDKITYKYQNVASINFGDINKT

SEQ ID NO: 1594767 - protein, 19 aa, Staphylococcus aureus
QGIVLYYIVAIIVAFLLLN

SEQ ID NO: 1594768 - protein, 27 aa, Staphylococcus aureus
QHEEEYYHKNAFAMDKSHPEPIEDNDK

SEQ ID NO: 1594769 - protein, 24 aa, Staphylococcus aureus
QHIDVFIFSLIKKYLVLIKRFSSV

SEQ ID NO: 1594770 - protein, 18 aa, Staphylococcus aureus
QHMNFQFTNSYGPSKDVV

SEQ ID NO: 1594771 - protein, 19 aa, Staphylococcus aureus
QIDQSPEIAIVNQVKQTAT

SEQ ID NO: 1594772 - protein, 21 aa, Staphylococcus aureus
QIEVALLQLRIAIHKSPLDTA

SEQ ID NO: 1594773 - protein, 33 aa, Staphylococcus aureus
QIISILWVYIVLLYLCYLFITANFLDYTFMTYS

SEQ ID NO: 1594774 - protein, 32 aa, Staphylococcus aureus
QIPSFFIFTYLLIFIYFLILTSRKGSPIVVIS

SEQ ID NO: 1594775 - protein, 23 aa, Staphylococcus aureus
QKNLIFSLVIFPFLFVPYIIIDI

SEQ ID NO: 1594776 - protein, 36 aa, Staphylococcus aureus
QKVPVTVTDIPLDPSALVYLVIPTSQTRDGGSEADQ

SEQ ID NO: 1594777 - protein, 38 aa, Staphylococcus aureus
QNIMSHKIWLLVLVSTLIPLIPFYKISNFTFSKDMMNR

SEQ ID NO: 1594778 - protein, 19 aa, Staphylococcus aureus
QNKKWYLPFGYDAQDIDLN

SEQ ID NO: 1594779 - protein, 37 aa, Staphylococcus aureus
QPHEGQRVVLKYKLKFQDGLKTGDYFDFTLSNNVNTH

SEQ ID NO: 1594780 - protein, 45 aa, Staphylococcus aureus
QQNQQYRQKKSKKGWFWGCGGCLVLFILIIIGISACTAGITGNLG

SEQ ID NO: 1594781 - protein, 25 aa, Staphylococcus aureus
QQVKGLMIASIQALIPVIAGLVPAI

SEQ ID NO: 1594782 - protein, 34 aa, Staphylococcus aureus
QRAQSIDEIAQQLEQFKAQLKAANPFAKELENRK

SEQ ID NO: 1594783 - protein, 28 aa, Staphylococcus aureus
QRSLNLWTYVMLIFMTLAAILTGPLIVY

SEQ ID NO: 1594784 - protein, 24 aa, Staphylococcus aureus
QSALTAKGYNYTSVDSSYASTYND

SEQ ID NO: 1594785 - protein, 20 aa, Staphylococcus aureus
QSIIIIVVLLIKAIITWLLL

SEQ ID NO: 1594786 - protein, 48 aa, Staphylococcus aureus
QSISKKMTGYGLKTTAVIGGAFTINMLHDQQAFAASDAPLTSELNTQS

SEQ ID NO: 1594787 - protein, 45 aa, Staphylococcus aureus
QSISKKMTGYGLKTTAVIGGAFTVNMLHDQQAFAASDAPLTSELN

SEQ ID NO: 1594788 - protein, 24 aa, Staphylococcus aureus
QSLNTAMTGLKRGVANHNQVVQSD

SEQ ID NO: 1594789 - protein, 28 aa, Staphylococcus aureus
QSNSHLHVGYGTVNHPFNSSPIGHKKKL

SEQ ID NO: 1594790 - protein, 25 aa, Staphylococcus aureus
QSSEVYSPISPIKIATQDNSGNAVT

SEQ ID NO: 1594791 - protein, 22 aa, Staphylococcus aureus
QTFNYTWFVGGLLGVGYLTGNL

SEQ ID NO: 1594792 - protein, 23 aa, Staphylococcus aureus
QVHQHLMLAKSLGAKVKVVYSQT

SEQ ID NO: 1594793 - protein, 18 aa, Staphylococcus aureus
QVSPHFFFNSINTISALV

SEQ ID NO: 1594794 - protein, 21 aa, Staphylococcus aureus
QWIALAVFSILLFLGCTWSIT

SEQ ID NO: 1594795 - protein, 20 aa, Staphylococcus aureus
QWVIWTILVTSFFSIGTPGI

SEQ ID NO: 1594796 - protein, 26 aa, Staphylococcus aureus
QWVIWTILVTSFFSIGTPGIAIIPFS

SEQ ID NO: 1594797 - protein, 22 aa, Staphylococcus aureus
QYSFIFIGITIFLSILTFVISQ

SEQ ID NO: 1594798 - protein, 21 aa, Staphylococcus aureus
QYTFDKYYRNKFEVLSKEKDD

SEQ ID NO: 1594799 - protein, 24 aa, Staphylococcus aureus
RASDYFSEAGATPATKAFGRQTFE

SEQ ID NO: 1594800 - protein, 35 aa, Staphylococcus aureus
RDIGFIFLYIFLVNILPIIIVFLTFGLVAVFTQQA

SEQ ID NO: 1594801 - protein, 17 aa, Staphylococcus aureus
RDQLQAVTTVNALPNLN

SEQ ID NO: 1594802 - protein, 33 aa, Staphylococcus aureus
RETRKKYIRNLILGFVGIAIVISLISFMIINGK

SEQ ID NO: 1594803 - protein, 19 aa, Staphylococcus aureus
RGLKFKIMFNFGLPLVIAL

SEQ ID NO: 1594804 - protein, 21 aa, Staphylococcus aureus
RHLLLFPGILLQGAAIAALVP

SEQ ID NO: 1594805 - protein, 18 aa, Staphylococcus aureus
RHNNTSPWVKEASAANVA

SEQ ID NO: 1594806 - protein, 34 aa, Staphylococcus aureus
RKIKQPLYIIKFSLLLYALIYISIGIIILLYNDY

SEQ ID NO: 1594807 - protein, 22 aa, Staphylococcus aureus
RKVIYLLSFTLLLVSSIIISFG

SEQ ID NO: 1594808 - protein, 17 aa, Staphylococcus aureus
RLVSYSPVPEDHAYIRF

SEQ ID NO: 1594809 - protein, 25 aa, Staphylococcus aureus
RMMFISMMVLLVFALILLMVFKENN

SEQ ID NO: 1594810 - protein, 19 aa, Staphylococcus aureus
RNFEIFINSIFFIEIKKAN

SEQ ID NO: 1594811 - protein, 23 aa, Staphylococcus aureus
RNKIFFTLAMLVIFKIGTYIPAP

SEQ ID NO: 1594812 - protein, 56 aa, Staphylococcus aureus
RNKTPNEIALFTLLTTLTIIFLVVIVTLYPIASYLHLILPIAMLIALTVCLIPTTI

SEQ ID NO: 1594813 - protein, 22 aa, Staphylococcus aureus
RNMKPLIVNQIFEPSHYDDMFI

SEQ ID NO: 1594814 - protein, 24 aa, Staphylococcus aureus
RTINVAVEPGYKSLTTKVHIVVPQ

SEQ ID NO: 1594815 - protein, 26 aa, Staphylococcus aureus
RTTDKYGYYNYAGYSNFIVTSNDSGG

SEQ ID NO: 1594816 - protein, 30 aa, Staphylococcus aureus
RVEALQNIYLRVYYPPVVIGLTALVTVIVL

SEQ ID NO: 1594817 - protein, 28 aa, Staphylococcus aureus
RVEALQNIYLRVYYPPVVIGLTVLVTVI

SEQ ID NO: 1594818 - protein, 18 aa, Staphylococcus aureus
RVGVMQFHPIFEELLHAF

SEQ ID NO: 1594819 - protein, 17 aa, Staphylococcus aureus
RYEILYLSIPLLALTYL

SEQ ID NO: 1594820 - protein, 32 aa, Staphylococcus aureus
RYNHAKPPKFLVRFWTLASGTILGLALMMLLI

SEQ ID NO: 1594821 - protein, 21 aa, Staphylococcus aureus
RYSLITILLIVSIFISLCLGS

SEQ ID NO: 1594822 - protein, 30 aa, Staphylococcus aureus
SAAKRVPVTVNVYQFEFPQTSYTTTVGGTL

SEQ ID NO: 1594823 - protein, 23 aa, Staphylococcus aureus
SAEFVIAIRFLLGIAGALIMPTT

SEQ ID NO: 1594824 - protein, 17 aa, Staphylococcus aureus
SAFLSESLSESTSESTS

SEQ ID NO: 1594825 - protein, 23 aa, Staphylococcus aureus
SALTAKGYNYTSVDSSYASTYND

SEQ ID NO: 1594826 - protein, 20 aa, Staphylococcus aureus
SATNSIIGTPTKIGQSTVTV

SEQ ID NO: 1594827 - protein, 36 aa, Staphylococcus aureus
SAVVYIHLYDYIPRLFWPIYYFIQAPMQKMMIHGFE

SEQ ID NO: 1594828 - protein, 19 aa, Staphylococcus aureus
SAWGYWFSAFLGNVAYATL

SEQ ID NO: 1594829 - protein, 25 aa, Staphylococcus aureus
SAYILWGILPIYWQFVDAIGAFEIL

SEQ ID NO: 1594830 - protein, 30 aa, Staphylococcus aureus
SDGKFHGQRLNDVILTYVASTGKMRAEYAG

SEQ ID NO: 1594831 - protein, 18 aa, Staphylococcus aureus
SDSLSTSGSLSTSGSTSV

SEQ ID NO: 1594832 - protein, 18 aa, Staphylococcus aureus
SDSTSMSLSMSQSTSGST

SEQ ID NO: 1594833 - protein, 24 aa, Staphylococcus aureus
SDSTSTSLSLSTSGSISGSTSTSA

SEQ ID NO: 1594834 - protein, 45 aa, Staphylococcus aureus
SEERLPDTGDSIKQNGLLGGVMTLLVGLGLMKRKKKKDENEQDDS

SEQ ID NO: 1594835 - protein, 17 aa, Staphylococcus aureus
SEIIQSYILSLAINFHP

SEQ ID NO: 1594836 - protein, 18 aa, Staphylococcus aureus
SESKSASAFLSESLSEST

SEQ ID NO: 1594837 - protein, 24 aa, Staphylococcus aureus
SETNWKYEFKNLPKYDEGKKIEYT

SEQ ID NO: 1594838 - protein, 30 aa, Staphylococcus aureus
SFIGVELIYLFMLGFYRLPGLVAIIALTTY

SEQ ID NO: 1594839 - protein, 23 aa, Staphylococcus aureus
SFKNDFEFNIRVANNHQSVTTGA

SEQ ID NO: 1594840 - protein, 21 aa, Staphylococcus aureus
SFLGGLGIFLYGLKIMGDGLQ

SEQ ID NO: 1594841 - protein, 21 aa, Staphylococcus aureus
SFSMYVLLISPLVFLCFAIFT

SEQ ID NO: 1594842 - protein, 19 aa, Staphylococcus aureus
SFYLSFIALLIINLAVLVW

SEQ ID NO: 1594843 - protein, 24 aa, Staphylococcus aureus
SGKSVCINGIITSILLNAKPHEVK

SEQ ID NO: 1594844 - protein, 27 aa, Staphylococcus aureus
SGLKSTTITTLPSGWTSNLTKSDKKNG

SEQ ID NO: 1594845 - protein, 19 aa, Staphylococcus aureus
SHYAIYLFSLITSVVLFFS

SEQ ID NO: 1594846 - protein, 27 aa, Staphylococcus aureus
SIDRIFINNMLIYGLGGLIVPFLGIKL

SEQ ID NO: 1594847 - protein, 23 aa, Staphylococcus aureus
SIGWLILEYIFKKTTSLLGLLLG

SEQ ID NO: 1594848 - protein, 19 aa, Staphylococcus aureus
SIPITLVTFALGLIIALFT

SEQ ID NO: 1594849 - protein, 24 aa, Staphylococcus aureus
SISVLIIILLVLIVAYIIGTIITM

SEQ ID NO: 1594850 - protein, 21 aa, Staphylococcus aureus
SISWFPAFFVTGFLGGLTTFS

SEQ ID NO: 1594851 - protein, 21 aa, Staphylococcus aureus
SIVIAFIAIFLLKGTPEKVSQ

SEQ ID NO: 1594852 - protein, 17 aa, Staphylococcus aureus
SIVTSILLFFAFRTSNN

SEQ ID NO: 1594853 - protein, 24 aa, Staphylococcus aureus
SKLDYFFIIGISTLSLFLFKMFDS

SEQ ID NO: 1594854 - protein, 29 aa, Staphylococcus aureus
SKRLLPPNYKYLIPFTALAGAILMIISDI

SEQ ID NO: 1594855 - protein, 23 aa, Staphylococcus aureus
SKVKQAFINANRDAISFAEGDIS

SEQ ID NO: 1594856 - protein, 29 aa, Staphylococcus aureus
SLANEKTRVRLYKSGKNWVKSGIKEIEMF

SEQ ID NO: 1594857 - protein, 21 aa, Staphylococcus aureus
SLCFLFICVYLNMAIGSSKIN

SEQ ID NO: 1594858 - protein, 25 aa, Staphylococcus aureus
SLDKVKHTPFFLPKRRRKEDEEDVE

SEQ ID NO: 1594859 - protein, 20 aa, Staphylococcus aureus
SLFGIPPKDLSIAQSAYLIG

SEQ ID NO: 1594860 - protein, 22 aa, Staphylococcus aureus
SLFLIIFSSWYLHYSQQAIFNY

SEQ ID NO: 1594861 - protein, 21 aa, Staphylococcus aureus
SLILLGAIPAALLAIIFDLIL

SEQ ID NO: 1594862 - protein, 24 aa, Staphylococcus aureus
SLISIVMVAVLIWIAIKTYKDSVL

SEQ ID NO: 1594863 - protein, 23 aa, Staphylococcus aureus
SLITPLWLLCLMGIMIHMIIFSI

SEQ ID NO: 1594864 - protein, 19 aa, Staphylococcus aureus
SLLILLILIPIFAISACLY

SEQ ID NO: 1594865 - protein, 22 aa, Staphylococcus aureus
SLLIVYFIYYIFEKNINFKAYA

SEQ ID NO: 1594866 - protein, 26 aa, Staphylococcus aureus
SLSDSTSTSLSLSASMNQSGVDSNSA

SEQ ID NO: 1594867 - protein, 23 aa, Staphylococcus aureus
SLVGLLCILYTFLGGFEGVVWSD

SEQ ID NO: 1594868 - protein, 19 aa, Staphylococcus aureus
SLYIINDFKTYIDCTYIPE

SEQ ID NO: 1594869 - protein, 23 aa, Staphylococcus aureus
SMYIFKKDLLPKMYWYGMLKGLI

SEQ ID NO: 1594870 - protein, 29 aa, Staphylococcus aureus
SNKQNKYSIRRFTVGTTSVIVGATILFGI

SEQ ID NO: 1594871 - protein, 24 aa, Staphylococcus aureus
SNKSFHFSGKVNLGNKYEGHGNGG

SEQ ID NO: 1594872 - protein, 20 aa, Staphylococcus aureus
SNPDLTLEQKAKALKEIDEA

SEQ ID NO: 1594873 - protein, 22 aa, Staphylococcus aureus
SPLILALIVVFICSLVGFVYYE

SEQ ID NO: 1594874 - protein, 21 aa, Staphylococcus aureus
SQFYLYYIVSAFLFWLVILTF

SEQ ID NO: 1594875 - protein, 25 aa, Staphylococcus aureus
SQKGAITLGTRIDSNKSFHFSGKVN

SEQ ID NO: 1594876 - protein, 17 aa, Staphylococcus aureus
SQLPLILKTILNLSLIG

SEQ ID NO: 1594877 - protein, 18 aa, Staphylococcus aureus
SQLVFHFNSGIKAEREPV

SEQ ID NO: 1594878 - protein, 21 aa, Staphylococcus aureus
SQQPKPYFATGANQANTSKDK

SEQ ID NO: 1594879 - protein, 20 aa, Staphylococcus aureus
SQQPKPYFATGTNQANTSKD

SEQ ID NO: 1594880 - protein, 24 aa, Staphylococcus aureus
SSFVNLILFRKLNIGGPSKAFAVC

SEQ ID NO: 1594881 - protein, 24 aa, Staphylococcus aureus
SSWIVFFLPMINWFIPKKYVKISK

SEQ ID NO: 1594882 - protein, 25 aa, Staphylococcus aureus
STQKGLIFSSIIGIAGLMLLARRRK

SEQ ID NO: 1594883 - protein, 26 aa, Staphylococcus aureus
STTTFTINVVDTTAPTVTPIGDQSSE

SEQ ID NO: 1594884 - protein, 25 aa, Staphylococcus aureus
STWISLFFPFINWFITKRYVKISRE

SEQ ID NO: 1594885 - protein, 17 aa, Staphylococcus aureus
SVAYIYSLYAFYMNNFS

SEQ ID NO: 1594886 - protein, 24 aa, Staphylococcus aureus
SVGKMLTVYLSYTTQFIHLHRRVG

SEQ ID NO: 1594887 - protein, 17 aa, Staphylococcus aureus
SVIGFIITLFMSIVFLS

SEQ ID NO: 1594888 - protein, 18 aa, Staphylococcus aureus
SVLFIFFKAPDLALTQFV

SEQ ID NO: 1594889 - protein, 20 aa, Staphylococcus aureus
SVLTNVFGLSLFGVIKQILS

SEQ ID NO: 1594890 - protein, 24 aa, Staphylococcus aureus
SVWLVLLFSVMGLWHVSNAAEQHT

SEQ ID NO: 1594891 - protein, 23 aa, Staphylococcus aureus
SYLWIGIVFVFFLISYISQIVGI

SEQ ID NO: 1594892 - protein, 38 aa, Staphylococcus aureus
SYYPIKRAIDLILSIVLLFLTLPIMVIFAIAIVIDSPG

SEQ ID NO: 1594893 - protein, 18 aa, Staphylococcus aureus
TAAKAILNKQHGPNTAQN

SEQ ID NO: 1594894 - protein, 22 aa, Staphylococcus aureus
TACWMIFMILSGTYLLIKKHLI

SEQ ID NO: 1594895 - protein, 19 aa, Staphylococcus aureus
TAFFCSMYWLIVQLNIANL

SEQ ID NO: 1594896 - protein, 21 aa, Staphylococcus aureus
TAKNALNGDAKLIAAQNAAKQ

SEQ ID NO: 1594897 - protein, 34 aa, Staphylococcus aureus
TANKTVLVDYEKYGKFYNLSIKGTIDQIDKTNNT

SEQ ID NO: 1594898 - protein, 25 aa, Staphylococcus aureus
TARQGLTLDRQPAFTTLHGASNLNQ

SEQ ID NO: 1594899 - protein, 18 aa, Staphylococcus aureus
TASTWKKFEVYEGDKKLP

SEQ ID NO: 1594900 - protein, 34 aa, Staphylococcus aureus
TAVIGGAFTINMLHDQQAFAASDAPLTSELNTQS

SEQ ID NO: 1594901 - protein, 30 aa, Staphylococcus aureus
TDNTNEAINIYFVPSDLVNPTISVGNYTNH

SEQ ID NO: 1594902 - protein, 24 aa, Staphylococcus aureus
TDTKLRIFEVNDISKLSDSYYADP

SEQ ID NO: 1594903 - protein, 18 aa, Staphylococcus aureus
TEALFAEKPVAKNDLKEI

SEQ ID NO: 1594904 - protein, 23 aa, Staphylococcus aureus
TEEVQESIFTKVDKRELITAKNH

SEQ ID NO: 1594905 - protein, 25 aa, Staphylococcus aureus
TEINTAMTALKRAIADKADTKTSGN

SEQ ID NO: 1594906 - protein, 29 aa, Staphylococcus aureus
TEKVLGWLCWVMLLVLTVITMFIALVSFS

SEQ ID NO: 1594907 - protein, 29 aa, Staphylococcus aureus
TELNTAMGQLQHAIADKTTTLASSKFVNA

SEQ ID NO: 1594908 - protein, 27 aa, Staphylococcus aureus
TEMSPILLAWIVAAVLRIALGSATVAA

SEQ ID NO: 1594909 - protein, 41 aa, Staphylococcus aureus
TFEYTESAVTQVRYVDVTTGKDIIPPKTYSGNVDQVVTIDN

SEQ ID NO: 1594910 - protein, 20 aa, Staphylococcus aureus
TFMTYSFSIFLLSSFTMTFI

SEQ ID NO: 1594911 - protein, 18 aa, Staphylococcus aureus
TFSFALVLILFTNSELLT

SEQ ID NO: 1594912 - protein, 18 aa, Staphylococcus aureus
TGIIKNNIPSRIAFAVSS

SEQ ID NO: 1594913 - protein, 17 aa, Staphylococcus aureus
TGKKPASITAYNNSMHA

SEQ ID NO: 1594914 - protein, 23 aa, Staphylococcus aureus
TGPLVVYWNWAWGITVIVIYGIG

SEQ ID NO: 1594915 - protein, 22 aa, Staphylococcus aureus
TIDQLNRGLNLGLDDIRNTHVW

SEQ ID NO: 1594916 - protein, 23 aa, Staphylococcus aureus
TIGYRMHFLNLYPVLYEVKKVDK

SEQ ID NO: 1594917 - protein, 17 aa, Staphylococcus aureus
TIIIIILGSVLAIKVDW

SEQ ID NO: 1594918 - protein, 17 aa, Staphylococcus aureus
TIKTVHFTSLKTGPMGD

SEQ ID NO: 1594919 - protein, 31 aa, Staphylococcus aureus
TILGVLVLSVILLFSIPTPVAVILMGIAALF

SEQ ID NO: 1594920 - protein, 35 aa, Staphylococcus aureus
TILKRRIIMIGFITLPLYYLLFYNQFLLNKNTDIG

SEQ ID NO: 1594921 - protein, 20 aa, Staphylococcus aureus
TILLLTFSLFFFYSQINSDE

SEQ ID NO: 1594922 - protein, 23 aa, Staphylococcus aureus
TILSTSILILSSSSLGLATHTVE

SEQ ID NO: 1594923 - protein, 19 aa, Staphylococcus aureus
TIVIHYDIRHLSTEFAQII

SEQ ID NO: 1594924 - protein, 49 aa, Staphylococcus aureus
TIVTGNRPFFRLYLITWMMHLILIGGSRLFWRIYRKYLGGKSFNKKPTL

SEQ ID NO: 1594925 - protein, 23 aa, Staphylococcus aureus
TIWFVIPIIIVAALAIPTVKTLY

SEQ ID NO: 1594926 - protein, 18 aa, Staphylococcus aureus
TKAALNGTQNLEKAKQHA

SEQ ID NO: 1594927 - protein, 18 aa, Staphylococcus aureus
TKERVEGFLNKSKNEQAA

SEQ ID NO: 1594928 - protein, 40 aa, Staphylococcus aureus
TKGLTLFYVFIGLIMFALLNQQLLLLNFLSFILAIVVAIR

SEQ ID NO: 1594929 - protein, 25 aa, Staphylococcus aureus
TKKQTIPAFFKGNAPYIFAHRGGMA

SEQ ID NO: 1594930 - protein, 27 aa, Staphylococcus aureus
TKKQTIPAFFKGNAPYIFAHRGGMVLR

SEQ ID NO: 1594931 - protein, 17 aa, Staphylococcus aureus
TKNMYLFSTHRLKFKNS

SEQ ID NO: 1594932 - protein, 37 aa, Staphylococcus aureus
TKSFASNLANMNFLRWVNFPQDYTVTWTNAKIANRPT

SEQ ID NO: 1594933 - protein, 37 aa, Staphylococcus aureus
TKSFTSNLNNMNFLRWVNFPQDYTVTWTNAKIANRPT

SEQ ID NO: 1594934 - protein, 25 aa, Staphylococcus aureus
TKYAIDLLFIICVILGILGVIISLF

SEQ ID NO: 1594935 - protein, 25 aa, Staphylococcus aureus
TKYAINLLFIICVILGILGLIISLF

SEQ ID NO: 1594936 - protein, 25 aa, Staphylococcus aureus
TKYPIDLLFIICVILGILGLIISLF

SEQ ID NO: 1594937 - protein, 20 aa, Staphylococcus aureus
TLDQAMNTLRQSIANKDATK

SEQ ID NO: 1594938 - protein, 27 aa, Staphylococcus aureus
TLFGAMMALLGSLLLFRKRKQDHKEKA

SEQ ID NO: 1594939 - protein, 17 aa, Staphylococcus aureus
TLFPIRIVVINSLGFSS

SEQ ID NO: 1594940 - protein, 20 aa, Staphylococcus aureus
TLFVIFLFFLFLNMCSLYDN

SEQ ID NO: 1594941 - protein, 17 aa, Staphylococcus aureus
TLIGVLIYFIVNTGFFS

SEQ ID NO: 1594942 - protein, 24 aa, Staphylococcus aureus
TLILIAILLFYTFMGILLPLMHDD

SEQ ID NO: 1594943 - protein, 24 aa, Staphylococcus aureus
TLLLGVILAFLWPPFKLKNDPPKV

SEQ ID NO: 1594944 - protein, 17 aa, Staphylococcus aureus
TLNNIYLLTIAKLILPI

SEQ ID NO: 1594945 - protein, 21 aa, Staphylococcus aureus
TLSLFLFKMFDSASLIILTSF

SEQ ID NO: 1594946 - protein, 27 aa, Staphylococcus aureus
TLTTTFIALFSMLITILLVLHTTTIKK

SEQ ID NO: 1594947 - protein, 25 aa, Staphylococcus aureus
TLVIITLFILLFIELVEVRIPYIDL

SEQ ID NO: 1594948 - protein, 17 aa, Staphylococcus aureus
TMLAAMCGFLFLASDPA

SEQ ID NO: 1594949 - protein, 18 aa, Staphylococcus aureus
TMLAAMCGFLFLASDPAK

SEQ ID NO: 1594950 - protein, 29 aa, Staphylococcus aureus
TMLIYIIITLLLAVLLFKGFNKWSGRTIK

SEQ ID NO: 1594951 - protein, 18 aa, Staphylococcus aureus
TNAFRPGGVNPLNEYQLS

SEQ ID NO: 1594952 - protein, 17 aa, Staphylococcus aureus
TNAVAHAEGILSKANGS

SEQ ID NO: 1594953 - protein, 45 aa, Staphylococcus aureus
TNEVNFRTQMFGYPEQRYGYYYNSYQLTWDNGLVLYSNKADGNGK

SEQ ID NO: 1594954 - protein, 24 aa, Staphylococcus aureus
TNLIKKLHAILLEGTRGKEKNPGN

SEQ ID NO: 1594955 - protein, 46 aa, Staphylococcus aureus
TNLNIDDFMDDPLSYVKTPSNKVLGFYPTSANTNAFRPGGVNPLNE

SEQ ID NO: 1594956 - protein, 30 aa, Staphylococcus aureus
TNVMNIIQGLWTLITIAFQAIGTVISVAVQ

SEQ ID NO: 1594957 - protein, 21 aa, Staphylococcus aureus
TNYYFVFHIIIYQLELILNKK

SEQ ID NO: 1594958 - protein, 32 aa, Staphylococcus aureus
TPFYKKHSTLLFATLLIAFGYLSHFVNGEDNL

SEQ ID NO: 1594959 - protein, 40 aa, Staphylococcus aureus
TPKKKSTRKIVLLSLIFSLLMIALVSFVAMAMFGNKYEET

SEQ ID NO: 1594960 - protein, 17 aa, Staphylococcus aureus
TPVLTPDAVTQAVTTMN

SEQ ID NO: 1594961 - protein, 24 aa, Staphylococcus aureus
TQQLDQFKAQLKAANPFAKELEKR

SEQ ID NO: 1594962 - protein, 19 aa, Staphylococcus aureus
TRQVFLVDISIFFLGTLLG

SEQ ID NO: 1594963 - protein, 31 aa, Staphylococcus aureus
TSDGKFHGQRLNDVILTYVASTGKMRAEYAG

SEQ ID NO: 1594964 - protein, 34 aa, Staphylococcus aureus
TSDGQRQFTLNGQVIQIMDIINPSNGFGGQPVTN

SEQ ID NO: 1594965 - protein, 24 aa, Staphylococcus aureus
TSISWPILAVVAVIGVFIGILVYL

SEQ ID NO: 1594966 - protein, 25 aa, Staphylococcus aureus
TSLLRIIKKMLDLTGIPKLLSKAFA

SEQ ID NO: 1594967 - protein, 35 aa, Staphylococcus aureus
TTANKTVLVDYEKYGKFYNLSIKGTIDQVDKTNNT

SEQ ID NO: 1594968 - protein, 26 aa, Staphylococcus aureus
TTDGKFHGQLLNNLKLAYNEKSGIMR

SEQ ID NO: 1594969 - protein, 25 aa, Staphylococcus aureus
TTENTEQQFPPRNAQRRKRRRDLAT

SEQ ID NO: 1594970 - protein, 23 aa, Staphylococcus aureus
TTQDFKGYSLLIHSLENYDNIVK

SEQ ID NO: 1594971 - protein, 23 aa, Staphylococcus aureus
TTTFTINVVDTTAPTVTPIGDQS

SEQ ID NO: 1594972 - protein, 23 aa, Staphylococcus aureus
TTTIKPRTLNRMAVNTVAAPQQG

SEQ ID NO: 1594973 - protein, 31 aa, Staphylococcus aureus
TVGNQTIEVGKTMNLIVLTTTDNGTGTVTNT

SEQ ID NO: 1594974 - protein, 27 aa, Staphylococcus aureus
TVKNKVFKLIFLACTLFGLVVLIALLT

SEQ ID NO: 1594975 - protein, 20 aa, Staphylococcus aureus
TVKPDEKLYKIGDYVWEDVD

SEQ ID NO: 1594976 - protein, 26 aa, Staphylococcus aureus
TVQKGRTFLWFMHLSEQLRRTGEQIK

SEQ ID NO: 1594977 - protein, 25 aa, Staphylococcus aureus
TWGEKVVFDYRRSLLRTDVVLNSED

SEQ ID NO: 1594978 - protein, 28 aa, Staphylococcus aureus
TWSHLKWAIPLIGIALFIILTISKQLTI

SEQ ID NO: 1594979 - protein, 26 aa, Staphylococcus aureus
TYIGWRSIFVVSILLTLLAMYLIKYA

SEQ ID NO: 1594980 - protein, 25 aa, Staphylococcus aureus
TYLLQVILYLLIVIALLMIGFETYL

SEQ ID NO: 1594981 - protein, 21 aa, Staphylococcus aureus
TYSWKWTALAVVYPLVTAYVL

SEQ ID NO: 1594982 - protein, 23 aa, Staphylococcus aureus
VAEIIAQAQALNEAIKALKESIK

SEQ ID NO: 1594983 - protein, 24 aa, Staphylococcus aureus
VALLIITIYLLPYLDVLLLGRAEA

SEQ ID NO: 1594984 - protein, 23 aa, Staphylococcus aureus
VAPILYVVHALLTGLSLFIVATF

SEQ ID NO: 1594985 - protein, 33 aa, Staphylococcus aureus
VATGITIAADWAYENNMWGLKDKTDWVGHKIDD

SEQ ID NO: 1594986 - protein, 38 aa, Staphylococcus aureus
VAVYVIFYFIWLRFEWPQYLIYILFVLCTLTVLKLIIK

SEQ ID NO: 1594987 - protein, 21 aa, Staphylococcus aureus
VDISIFFLGTLLGGLSPHFAT

SEQ ID NO: 1594988 - protein, 27 aa, Staphylococcus aureus
VDNALNAVTRAKAALNGADNLRNAKTS

SEQ ID NO: 1594989 - protein, 27 aa, Staphylococcus aureus
VFETARGVLYPGVSDMYDAKQYVKPVN

SEQ ID NO: 1594990 - protein, 25 aa, Staphylococcus aureus
VFILFLICSFGVLIGLYQYRHAKTV

SEQ ID NO: 1594991 - protein, 17 aa, Staphylococcus aureus
VFISVLIGIFNYIKVLP

SEQ ID NO: 1594992 - protein, 24 aa, Staphylococcus aureus
VFNYWLGIILMLFVSWFALFLFYK

SEQ ID NO: 1594993 - protein, 20 aa, Staphylococcus aureus
VFSMTLLNVVKRILDLTRIT

SEQ ID NO: 1594994 - protein, 24 aa, Staphylococcus aureus
VGICAGVWIVLKKLPGIDDPMVKN

SEQ ID NO: 1594995 - protein, 32 aa, Staphylococcus aureus
VGIDSGDTVYPHQAGYVKLNYGFSVPNSAVKG

SEQ ID NO: 1594996 - protein, 28 aa, Staphylococcus aureus
VGIGGLSNAFGFKLDTYHNTSKPNSAAK

SEQ ID NO: 1594997 - protein, 24 aa, Staphylococcus aureus
VGKVSFRFWPFSEFKHNFNPENTK

SEQ ID NO: 1594998 - protein, 28 aa, Staphylococcus aureus
VGNQTIEVGKTMNPVVLTTTDNGTGTVT

SEQ ID NO: 1594999 - protein, 24 aa, Staphylococcus aureus
VGQDNFLLNLTFKENIKLGNPEAT

SEQ ID NO: 1595000 - protein, 17 aa, Staphylococcus aureus
VGTIFSTIVIALLRTIF

SEQ ID NO: 1595001 - protein, 24 aa, Staphylococcus aureus
VGVISFIVWMLIQNDVDFALERLV

SEQ ID NO: 1595002 - protein, 17 aa, Staphylococcus aureus
VGWGEIPMSLGFTYSSN

SEQ ID NO: 1595003 - protein, 23 aa, Staphylococcus aureus
VHITWMNWFLAALVPGLVSLIVV

SEQ ID NO: 1595004 - protein, 17 aa, Staphylococcus aureus
VHQLNRTGTTTGKKPAS

SEQ ID NO: 1595005 - protein, 34 aa, Staphylococcus aureus
VHRDDIITEQDILAHINLIDQLTAEIIDTPSTAT

SEQ ID NO: 1595006 - protein, 22 aa, Staphylococcus aureus
VIAALVAVVPPLFFGGSWDTWV

SEQ ID NO: 1595007 - protein, 26 aa, Staphylococcus aureus
VIGILGGVFWALMAPIAAVSSVLSNV

SEQ ID NO: 1595008 - protein, 27 aa, Staphylococcus aureus
VIGVGLFIHWIWPDLPIGAAFAIAAIL

SEQ ID NO: 1595009 - protein, 22 aa, Staphylococcus aureus
VIIILILILGGIFLKMKYNEKK

SEQ ID NO: 1595010 - protein, 17 aa, Staphylococcus aureus
VIPFAMMILLAFPPIIA

SEQ ID NO: 1595011 - protein, 17 aa, Staphylococcus aureus
VISDAVHIGWKGWVYMD

SEQ ID NO: 1595012 - protein, 22 aa, Staphylococcus aureus
VKMMFYNKYKNVSTYIIIFLVS

SEQ ID NO: 1595013 - protein, 37 aa, Staphylococcus aureus
VKNNLRYGIRKHKLGAASVFLGTMIVVGMGQDKEAAA

SEQ ID NO: 1595014 - protein, 23 aa, Staphylococcus aureus
VKSGDYFTAKLPDSLTGNGDVDY

SEQ ID NO: 1595015 - protein, 17 aa, Staphylococcus aureus
VLAIIVAFLFWMSSDRS

SEQ ID NO: 1595016 - protein, 24 aa, Staphylococcus aureus
VLAPIVNVWIFKLFVEVLGMNSFS

SEQ ID NO: 1595017 - protein, 25 aa, Staphylococcus aureus
VLFDAFVVRMMLIPALTKLFGKGSW

SEQ ID NO: 1595018 - protein, 17 aa, Staphylococcus aureus
VLMAVICIFAFDLKDLL

SEQ ID NO: 1595019 - protein, 33 aa, Staphylococcus aureus
VLSLLILNVVTIIILFGVALVSPIYTLSEVIIL

SEQ ID NO: 1595020 - protein, 22 aa, Staphylococcus aureus
VLSVLSLPIFLYAVIKFFFSAK

SEQ ID NO: 1595021 - protein, 43 aa, Staphylococcus aureus
VMILKGTVQLIWNLIQLWFVGKILGVVRYFGGLLKGLISGIWS

SEQ ID NO: 1595022 - protein, 27 aa, Staphylococcus aureus
VMTHTILFLLVLLAVSLYLSQPLSLIF

SEQ ID NO: 1595023 - protein, 17 aa, Staphylococcus aureus
VNEIFDATPEQILVNGE

SEQ ID NO: 1595024 - protein, 23 aa, Staphylococcus aureus
VNILPIIIVFLTFGLVAVFTQQA

SEQ ID NO: 1595025 - protein, 33 aa, Staphylococcus aureus
VNRVNDRLTLAINQLVPLADNSALRTAKTKLDE

SEQ ID NO: 1595026 - protein, 18 aa, Staphylococcus aureus
VPCYLCAIIAIIYGFTGI

SEQ ID NO: 1595027 - protein, 19 aa, Staphylococcus aureus
VPRTGSWRAAFKRAGDYAY

SEQ ID NO: 1595028 - protein, 19 aa, Staphylococcus aureus
VPVKRVIPEIVAHSHYTVQ

SEQ ID NO: 1595029 - protein, 23 aa, Staphylococcus aureus
VQGDTFKITVPKELNLNGVTSTA

SEQ ID NO: 1595030 - protein, 37 aa, Staphylococcus aureus
VQLTKFEKVLYITLITVIAMLSIYMLSLKMDAYNTRG

SEQ ID NO: 1595031 - protein, 17 aa, Staphylococcus aureus
VQVYGLNPEDIKNIGDI

SEQ ID NO: 1595032 - protein, 25 aa, Staphylococcus aureus
VRGQNNQWTIANKPDYVTLDAHTGK

SEQ ID NO: 1595033 - protein, 23 aa, Staphylococcus aureus
VSDSGSLSVSTSLRKSESVSESS

SEQ ID NO: 1595034 - protein, 20 aa, Staphylococcus aureus
VSIFTGIIALIFLILARKSN

SEQ ID NO: 1595035 - protein, 22 aa, Staphylococcus aureus
VSKPESQAERLANAAKQKQAKL

SEQ ID NO: 1595036 - protein, 33 aa, Staphylococcus aureus
VSLRNIWDIPWIIPLVLILILIAFSMAAHINIL

SEQ ID NO: 1595037 - protein, 31 aa, Staphylococcus aureus
VSNVYNFIMIIWNQIVAYLQGLWNGIIAIAT

SEQ ID NO: 1595038 - protein, 17 aa, Staphylococcus aureus
VSPHFFFNSINTISALV

SEQ ID NO: 1595039 - protein, 27 aa, Staphylococcus aureus
VSSWIVFFLPMINWFIPKNYVKISKEE

SEQ ID NO: 1595040 - protein, 23 aa, Staphylococcus aureus
VSTLTGYKFNPDAKNFKIYEVTD

SEQ ID NO: 1595041 - protein, 27 aa, Staphylococcus aureus
VSVYVIFYFIWLRFEWPHYLLYILLVL

SEQ ID NO: 1595042 - protein, 25 aa, Staphylococcus aureus
VSYVVPPLTLLNQPAKQKATSKAEV

SEQ ID NO: 1595043 - protein, 18 aa, Staphylococcus aureus
VTAEMMRIYKDVDTFVVI

SEQ ID NO: 1595044 - protein, 30 aa, Staphylococcus aureus
VTAFAAIFLGILMFFIWPSIQAGIYHVGGF

SEQ ID NO: 1595045 - protein, 23 aa, Staphylococcus aureus
VTGFVFFDIPIQVLLIIASAYAT

SEQ ID NO: 1595046 - protein, 20 aa, Staphylococcus aureus
VTGLPSGLSYDSATNSIIGT

SEQ ID NO: 1595047 - protein, 32 aa, Staphylococcus aureus
VTIDSGTTVYPHQAGYVKLNYGFSVPNSPVKG

SEQ ID NO: 1595048 - protein, 29 aa, Staphylococcus aureus
VTLKELDHIIRFAHISYGLYMGEHLPKGN

SEQ ID NO: 1595049 - protein, 26 aa, Staphylococcus aureus
VTLKVAFILPIILISLSIRACLENLR

SEQ ID NO: 1595050 - protein, 18 aa, Staphylococcus aureus
VTLTLSRADTKKITLAVL

SEQ ID NO: 1595051 - protein, 22 aa, Staphylococcus aureus
VTLTQDAYSQKGAITLGTRIDS

SEQ ID NO: 1595052 - protein, 47 aa, Staphylococcus aureus
VTLVGSLIMLFILDWKMTLLTFITIPIFVLIMIPLGRIMQKISTSTQ

SEQ ID NO: 1595053 - protein, 17 aa, Staphylococcus aureus
VTQVRYVDVTTGKDIIP

SEQ ID NO: 1595054 - protein, 26 aa, Staphylococcus aureus
VTSGLFALAFTLSTGTLFVGLAAITS

SEQ ID NO: 1595055 - protein, 25 aa, Staphylococcus aureus
VTTGADGWGFLFSKGDGNEYLQKGG

SEQ ID NO: 1595056 - protein, 35 aa, Staphylococcus aureus
VVALAVYLFRFVWVYVLYPYFYLAISPFQKMMTKN

SEQ ID NO: 1595057 - protein, 24 aa, Staphylococcus aureus
VVMILFAVLILFRGLGKDYDAAVM

SEQ ID NO: 1595058 - protein, 19 aa, Staphylococcus aureus
VVMVNTKFQYTTSESPTLV

SEQ ID NO: 1595059 - protein, 37 aa, Staphylococcus aureus
VVYVIFYFIWLRFEWPQYLIYILLVLGALSTLKLFIK

SEQ ID NO: 1595060 - protein, 25 aa, Staphylococcus aureus
VYANGWMRTDLNNSTFKLTPNLVNK

SEQ ID NO: 1595061 - protein, 17 aa, Staphylococcus aureus
WCGVALMLFISWLGLFL

SEQ ID NO: 1595062 - protein, 27 aa, Staphylococcus aureus
WFVNIFDWRYLFLVVLLIGMVDFVFGY

SEQ ID NO: 1595063 - protein, 24 aa, Staphylococcus aureus
WGENVVFDYRRSLLRTDVVLNSED

SEQ ID NO: 1595064 - protein, 26 aa, Staphylococcus aureus
WGVMTQGWWFLVMASAFLIFTIIIMF

SEQ ID NO: 1595065 - protein, 17 aa, Staphylococcus aureus
WISAGIIGIIQYSSIIS

SEQ ID NO: 1595066 - protein, 17 aa, Staphylococcus aureus
WLALFFPMINWLIPKKY

SEQ ID NO: 1595067 - protein, 21 aa, Staphylococcus aureus
WLGIVFAMLITITFAFVFNTV

SEQ ID NO: 1595068 - protein, 23 aa, Staphylococcus aureus
WNATKSIFGFLFNSVKSIFTNMK

SEQ ID NO: 1595069 - protein, 18 aa, Staphylococcus aureus
WNYWFNWVVTVAADITIA

SEQ ID NO: 1595070 - protein, 25 aa, Staphylococcus aureus
WRLIVISMLLLLFWSTEKVLHPIDS

SEQ ID NO: 1595071 - protein, 32 aa, Staphylococcus aureus
WVTLIITQILLTTSVLWILNYTGNLDLFILRL

SEQ ID NO: 1595072 - protein, 18 aa, Staphylococcus aureus
YAEEPINFILKSSTKLKA

SEQ ID NO: 1595073 - protein, 22 aa, Staphylococcus aureus
YAVSAGYKWFFAYPDEHIETVN

SEQ ID NO: 1595074 - protein, 19 aa, Staphylococcus aureus
YDLFNYWLMGTISIIISYL

SEQ ID NO: 1595075 - protein, 22 aa, Staphylococcus aureus
YDMTEPQRMLLGKPVASEQPAK

SEQ ID NO: 1595076 - protein, 27 aa, Staphylococcus aureus
YDNHQTQIIKILSKVKPDPPRIDGNSV

SEQ ID NO: 1595077 - protein, 26 aa, Staphylococcus aureus
YDQIGLWAPILLLLARVLQGFSTGGE

SEQ ID NO: 1595078 - protein, 18 aa, Staphylococcus aureus
YDQSTGIVTLTQDAYSQK

SEQ ID NO: 1595079 - protein, 22 aa, Staphylococcus aureus
YEPLAMCWMLVPETLRGLWKQR

SEQ ID NO: 1595080 - protein, 33 aa, Staphylococcus aureus
YFLKSRKNWIFWILFLNILMLGISLIDYDFPID

SEQ ID NO: 1595081 - protein, 18 aa, Staphylococcus aureus
YFVTTFYRNGKLPDEKNY

SEQ ID NO: 1595082 - protein, 20 aa, Staphylococcus aureus
YGGKLVLILDDGLEIEVERI

SEQ ID NO: 1595083 - protein, 20 aa, Staphylococcus aureus
YGLFAFILITFKRGIPIAVK

SEQ ID NO: 1595084 - protein, 19 aa, Staphylococcus aureus
YGMIIAIPVTLIAGPIFNK

SEQ ID NO: 1595085 - protein, 20 aa, Staphylococcus aureus
YGSLLYLLPLSILGLERYFQ

SEQ ID NO: 1595086 - protein, 22 aa, Staphylococcus aureus
YGYSMLLLFLIAACIFLIVLFI

SEQ ID NO: 1595087 - protein, 19 aa, Staphylococcus aureus
YIGVWWRELLAISIQLPLQ

SEQ ID NO: 1595088 - protein, 17 aa, Staphylococcus aureus
YIKPFPKSVTDDYMKHI

SEQ ID NO: 1595089 - protein, 17 aa, Staphylococcus aureus
YILFFAVIIIGTCIVAL

SEQ ID NO: 1595090 - protein, 24 aa, Staphylococcus aureus
YILVTVWTIIILTLLITFPTNSHH

SEQ ID NO: 1595091 - protein, 19 aa, Staphylococcus aureus
YIVIFIACAYVIYRRIEEV

SEQ ID NO: 1595092 - protein, 26 aa, Staphylococcus aureus
YIVSEFLFLLVIFTFGIAGIIFLMPY

SEQ ID NO: 1595093 - protein, 20 aa, Staphylococcus aureus
YIYEQYLNKFFLIKNNHYIN

SEQ ID NO: 1595094 - protein, 18 aa, Staphylococcus aureus
YIYIITFLEYVLLYFTMF

SEQ ID NO: 1595095 - protein, 20 aa, Staphylococcus aureus
YKVKPVTLTLSRADTKKITL

SEQ ID NO: 1595096 - protein, 28 aa, Staphylococcus aureus
YLCYIPLFFLFIALYPFLVFIAQRPIFQ

SEQ ID NO: 1595097 - protein, 30 aa, Staphylococcus aureus
YLCYIPLVFLFIALYPFLVFIAQRPIFQFS

SEQ ID NO: 1595098 - protein, 19 aa, Staphylococcus aureus
YLIPNLPNGDYRVEFSNLP

SEQ ID NO: 1595099 - protein, 20 aa, Staphylococcus aureus
YLNKFFLIKNNHYINEVDVI

SEQ ID NO: 1595100 - protein, 18 aa, Staphylococcus aureus
YLSIPLLALTYLFANHFT

SEQ ID NO: 1595101 - protein, 19 aa, Staphylococcus aureus
YLWVFALILFFMRLAKIQL

SEQ ID NO: 1595102 - protein, 22 aa, Staphylococcus aureus
YNLQKLLAPYHKAKTLERQVYE

SEQ ID NO: 1595103 - protein, 40 aa, Staphylococcus aureus
YNTTQFVIWLQNGIWAIIVYLIVCLLISFLALISMNIRIL

SEQ ID NO: 1595104 - protein, 18 aa, Staphylococcus aureus
YSSIISAILMKNKWPFLI

SEQ ID NO: 1595105 - protein, 18 aa, Staphylococcus aureus
YSSIMSAILMKNKWPFLI

SEQ ID NO: 1595106 - protein, 36 aa, Staphylococcus aureus
YTGNLDLFILRIVLLSCLFILTISVINLWTFLMLLN

SEQ ID NO: 1595107 - protein, 21 aa, Staphylococcus aureus
YTLIIYVLLLTLYPFYIMLDS

SEQ ID NO: 1595108 - protein, 17 aa, Staphylococcus aureus
YVALFLGMILLGIVAFY

SEQ ID NO: 1595109 - protein, 24 aa, Staphylococcus aureus
YVKPVNDSWTQNAQRMNFQFTNSY

SEQ ID NO: 1595110 - protein, 19 aa, Staphylococcus aureus
YVLPLISILGGITTALIIF

SEQ ID NO: 1595111 - protein, 17 aa, Staphylococcus aureus
YWFSAFLGNVAYATLLM

SEQ ID NO: 1595112 - protein, 26 aa, Staphylococcus aureus
YYIVAIIVAFLLLNLPYVHKPGVEVN

SEQ ID NO: 1595113 - protein, 18 aa, Staphylococcus aureus
YYYPYINTWWEFIPALIL

SEQ ID NO: 1595114 - protein, 20 aa, Staphylococcus aureus
AAAMIAMSFLYLQGGKLIDV

SEQ ID NO: 1595115 - protein, 17 aa, Staphylococcus aureus
AAFIIPLGIIVNVVLLV

SEQ ID NO: 1595116 - protein, 23 aa, Staphylococcus aureus
AAILFMYYYLLYKSPEYNQHKRF

SEQ ID NO: 1595117 - protein, 22 aa, Staphylococcus aureus
AAILFMYYYLLYKSPEYNQRKR

SEQ ID NO: 1595118 - protein, 27 aa, Staphylococcus aureus
AAILMGPLVVYWNWAWGITVIVIYGIG

SEQ ID NO: 1595119 - protein, 21 aa, Staphylococcus aureus
AALLYNFVSAILWFIVAISLF

SEQ ID NO: 1595120 - protein, 31 aa, Staphylococcus aureus
AAPGPLSYSLTLYALLFALSSGRTFIGQTTF

SEQ ID NO: 1595121 - protein, 20 aa, Staphylococcus aureus
AAQFIMCALLIAGTPISAIV

SEQ ID NO: 1595122 - protein, 22 aa, Staphylococcus aureus
AASVFLGTMIVVGMGQDKEAAA

SEQ ID NO: 1595123 - protein, 22 aa, Staphylococcus aureus
AATSLLPIVLLPLGHILTPEQV

SEQ ID NO: 1595124 - protein, 23 aa, Staphylococcus aureus
AAVFALTFFLIYASRTILSVIQH

SEQ ID NO: 1595125 - protein, 20 aa, Staphylococcus aureus
ADALGYVLLAFATRGWMAFP

SEQ ID NO: 1595126 - protein, 22 aa, Staphylococcus aureus
ADIPFYILGFLAAFTVGLIAIK

SEQ ID NO: 1595127 - protein, 17 aa, Staphylococcus aureus
ADKPASKQAGHPVFYVY

SEQ ID NO: 1595128 - protein, 29 aa, Staphylococcus aureus
ADLAILLGINWLAILLYIEAFVSPVGTGV

SEQ ID NO: 1595129 - protein, 19 aa, Staphylococcus aureus
AEDTILNIKVAIKAIFIPP

SEQ ID NO: 1595130 - protein, 18 aa, Staphylococcus aureus
AEDYFRKHKIRSNANVIY

SEQ ID NO: 1595131 - protein, 33 aa, Staphylococcus aureus
AEHPIGLVLVILTVLVIIGFVLNMFIKHFKKER

SEQ ID NO: 1595132 - protein, 23 aa, Staphylococcus aureus
AEIKNFKFFVQYGNFKDLKNYKD

SEQ ID NO: 1595133 - protein, 25 aa, Staphylococcus aureus
AEKAEIEKVLPKDISNLSNEEIKKI

SEQ ID NO: 1595134 - protein, 17 aa, Staphylococcus aureus
AERYLPFFTIGMGWIVP

SEQ ID NO: 1595135 - protein, 49 aa, Staphylococcus aureus
AFAMLAAIIIVYLILVITFKGGLAPFTILFSIPFTVIGVIIALLITGET

SEQ ID NO: 1595136 - protein, 17 aa, Staphylococcus aureus
AFEIPLRYKIMGIVGSV

SEQ ID NO: 1595137 - protein, 17 aa, Staphylococcus aureus
AFGNGETLVPVNLTVLP

SEQ ID NO: 1595138 - protein, 20 aa, Staphylococcus aureus
AFLLLVVLLFAGMAATYKNV

SEQ ID NO: 1595139 - protein, 29 aa, Staphylococcus aureus
AFSFVAVVVLLLFVVLSAGVALSVSVTGL

SEQ ID NO: 1595140 - protein, 18 aa, Staphylococcus aureus
AFTIACISVSWLWFFLLA

SEQ ID NO: 1595141 - protein, 25 aa, Staphylococcus aureus
AFTLIEMLLVLLIISLLLILIIPNI

SEQ ID NO: 1595142 - protein, 23 aa, Staphylococcus aureus
AFVGIFLVIDLLVKNLGPAAQAM

SEQ ID NO: 1595143 - protein, 18 aa, Staphylococcus aureus
AFYEILNMPNLNEEQRNG

SEQ ID NO: 1595144 - protein, 18 aa, Staphylococcus aureus
AGAIFPLFSPVLGWIGVF

SEQ ID NO: 1595145 - protein, 21 aa, Staphylococcus aureus
AGGLISFLSTKVPILGTVFTA

SEQ ID NO: 1595146 - protein, 21 aa, Staphylococcus aureus
AGIIFLMPYGLCFLPLYKQKK

SEQ ID NO: 1595147 - protein, 39 aa, Staphylococcus aureus
AGINIYIIRILKLPFLISLRFYVFFFVGVLITGVVKMFF

SEQ ID NO: 1595148 - protein, 25 aa, Staphylococcus aureus
AGLALIVHMIINRLFRKRKIKHTKN

SEQ ID NO: 1595149 - protein, 20 aa, Staphylococcus aureus
AGMALFVWFLGGIITICAGL

SEQ ID NO: 1595150 - protein, 25 aa, Staphylococcus aureus
AGPSSTFFIVTFSLPINLPIAPEEA

SEQ ID NO: 1595151 - protein, 36 aa, Staphylococcus aureus
AGSIFAFLRTKIASLVKLFPILGVSISSLTLPITLI

SEQ ID NO: 1595152 - protein, 22 aa, Staphylococcus aureus
AGWLGIPVPFKISGFSFDVTST

SEQ ID NO: 1595153 - protein, 17 aa, Staphylococcus aureus
AGWLHYFVGMTISFTVA

SEQ ID NO: 1595154 - protein, 31 aa, Staphylococcus aureus
AHGDIIHKTYKEEFPNEGTLTAFNTNFNPNT

SEQ ID NO: 1595155 - protein, 18 aa, Staphylococcus aureus
AHLFFMIAAPEGGAQTHL

SEQ ID NO: 1595156 - protein, 20 aa, Staphylococcus aureus
AIFLIVFMAFILIITKSSNG

SEQ ID NO: 1595157 - protein, 27 aa, Staphylococcus aureus
AIFTVLFLFLFIFGIISIILGAIGMFK

SEQ ID NO: 1595158 - protein, 26 aa, Staphylococcus aureus
AIFTVLFLSLFIFGIISIILGAIGMF

SEQ ID NO: 1595159 - protein, 23 aa, Staphylococcus aureus
AIGAIFMVVIMILVTWNDIRRYF

SEQ ID NO: 1595160 - protein, 17 aa, Staphylococcus aureus
AIGLIALLAWPMSASTG

SEQ ID NO: 1595161 - protein, 17 aa, Staphylococcus aureus
AIGLIALLAWPMSVSTG

SEQ ID NO: 1595162 - protein, 18 aa, Staphylococcus aureus
AIIGLFVLGQRTASVLLP

SEQ ID NO: 1595163 - protein, 18 aa, Staphylococcus aureus
AIIMFIMIVWFFIDALLI

SEQ ID NO: 1595164 - protein, 25 aa, Staphylococcus aureus
AIKSIEDAIQHMIDEIKARTDLTDK

SEQ ID NO: 1595165 - protein, 17 aa, Staphylococcus aureus
AIKSVHFTSLKTGPMGD

SEQ ID NO: 1595166 - protein, 18 aa, Staphylococcus aureus
AILEEIGYFDTKAASIAQ

SEQ ID NO: 1595167 - protein, 17 aa, Staphylococcus aureus
AILFLTLGFWKTVLIIV

SEQ ID NO: 1595168 - protein, 18 aa, Staphylococcus aureus
AILFMYYCLLYKSPEYNQ

SEQ ID NO: 1595169 - protein, 17 aa, Staphylococcus aureus
AILGIGGAVAAVLFTRK

SEQ ID NO: 1595170 - protein, 20 aa, Staphylococcus aureus
AILIGLIIIAYGHNKQIKYH

SEQ ID NO: 1595171 - protein, 23 aa, Staphylococcus aureus
AILLIFRSIFFLKKYIDMIISTI

SEQ ID NO: 1595172 - protein, 21 aa, Staphylococcus aureus
AILLPLYILSFSSVSLLATYL

SEQ ID NO: 1595173 - protein, 18 aa, Staphylococcus aureus
AILMGPLVVYWNWTWGIT

SEQ ID NO: 1595174 - protein, 17 aa, Staphylococcus aureus
AILSIGGAVAAVLVTRK

SEQ ID NO: 1595175 - protein, 27 aa, Staphylococcus aureus
AIMATTPVLWILYAGRIVAGITGATGA

SEQ ID NO: 1595176 - protein, 20 aa, Staphylococcus aureus
AIMILLYSGLKFGESAPQGV

SEQ ID NO: 1595177 - protein, 25 aa, Staphylococcus aureus
AIMLSALTYWLFAQSFINIGPLVGQ

SEQ ID NO: 1595178 - protein, 36 aa, Staphylococcus aureus
AIMMIAIFIALMFDFEKAYWIPLSAHTILLGTSTIH

SEQ ID NO: 1595179 - protein, 34 aa, Staphylococcus aureus
AIMMIAIFIALMFDFEKAYWIPLSAHTVLLGTST

SEQ ID NO: 1595180 - protein, 20 aa, Staphylococcus aureus
AIQGVVDWLTQLWGKIQSTL

SEQ ID NO: 1595181 - protein, 19 aa, Staphylococcus aureus
AISRIKDFSNEKINSIRNS

SEQ ID NO: 1595182 - protein, 18 aa, Staphylococcus aureus
AITAIVLSAFFYVMTIQK

SEQ ID NO: 1595183 - protein, 17 aa, Staphylococcus aureus
AITILIAIAIYACRFVW

SEQ ID NO: 1595184 - protein, 26 aa, Staphylococcus aureus
AITLIVVDIIIYYPFLKVYDSEILDE

SEQ ID NO: 1595185 - protein, 30 aa, Staphylococcus aureus
AITVFFIMLIGILIFYFYLNKKLKLKIFNT

SEQ ID NO: 1595186 - protein, 20 aa, Staphylococcus aureus
AIVFLIYQPLKRLNLPLFVI

SEQ ID NO: 1595187 - protein, 20 aa, Staphylococcus aureus
AIVFLIYQPLKRLNSPLFVI

SEQ ID NO: 1595188 - protein, 21 aa, Staphylococcus aureus
AIVLLIYQPLKRLNLPLFVIK

SEQ ID NO: 1595189 - protein, 20 aa, Staphylococcus aureus
AIWNFLFLRRALPLTKQELG

SEQ ID NO: 1595190 - protein, 28 aa, Staphylococcus aureus
AKDKKLEVISSLFSVKKITFDLSDAKKT

SEQ ID NO: 1595191 - protein, 24 aa, Staphylococcus aureus
AKESAKRALASYSNLNNAQSTAAT

SEQ ID NO: 1595192 - protein, 23 aa, Staphylococcus aureus
AKGHYFVTTFYRNGKLPDEKNYK

SEQ ID NO: 1595193 - protein, 27 aa, Staphylococcus aureus
AKGKVTRYDLISVLPFGNTVAQIDVKG

SEQ ID NO: 1595194 - protein, 25 aa, Staphylococcus aureus
AKLVLAIVLIFIIVCSNLYYIRLSF

SEQ ID NO: 1595195 - protein, 19 aa, Staphylococcus aureus
AKMFVMMFGVTIFAFMGYE

SEQ ID NO: 1595196 - protein, 19 aa, Staphylococcus aureus
AKPQLLITLIYALIAFAVI

SEQ ID NO: 1595197 - protein, 21 aa, Staphylococcus aureus
AKQVIKLNDAVTAAKKALNGE

SEQ ID NO: 1595198 - protein, 26 aa, Staphylococcus aureus
AKTLGYIILSACMTFLFVIVGLCIKL

SEQ ID NO: 1595199 - protein, 33 aa, Staphylococcus aureus
AKVINAKYDVIYNGHTFASSLPAKFVVKDVQPA

SEQ ID NO: 1595200 - protein, 20 aa, Staphylococcus aureus
AKYKWHIIISFTLSIVLFLL

SEQ ID NO: 1595201 - protein, 21 aa, Staphylococcus aureus
AKYKWHIIISFTLSIVLFLLL

SEQ ID NO: 1595202 - protein, 25 aa, Staphylococcus aureus
ALAAVLLGLIILVAAAIPVSHMRLG

SEQ ID NO: 1595203 - protein, 17 aa, Staphylococcus aureus
ALAFICVIVFYFNLNRK

SEQ ID NO: 1595204 - protein, 18 aa, Staphylococcus aureus
ALAFICVIVFYFNLNRKL

SEQ ID NO: 1595205 - protein, 29 aa, Staphylococcus aureus
ALDDALYDGLIFKNPAYKVNYKAGKPTKS

SEQ ID NO: 1595206 - protein, 20 aa, Staphylococcus aureus
ALEFFYIMYLETFATTSRKT

SEQ ID NO: 1595207 - protein, 23 aa, Staphylococcus aureus
ALGIIVLYVFLGLATPLVTFYDP

SEQ ID NO: 1595208 - protein, 22 aa, Staphylococcus aureus
ALGWNYWFNWVVTVAADIMIAA

SEQ ID NO: 1595209 - protein, 23 aa, Staphylococcus aureus
ALIGALIAMKFDLSPLAIAVVSS

SEQ ID NO: 1595210 - protein, 32 aa, Staphylococcus aureus
ALIGSLWLMLSIIPLLIILGIGTAIYLEEYAK

SEQ ID NO: 1595211 - protein, 17 aa, Staphylococcus aureus
ALISFTFKVDEKIKKYP

SEQ ID NO: 1595212 - protein, 21 aa, Staphylococcus aureus
ALITMNIIHLIILSLLGISPI

SEQ ID NO: 1595213 - protein, 24 aa, Staphylococcus aureus
ALKSRAMVLYINRNTRTAKGYFLI

SEQ ID NO: 1595214 - protein, 47 aa, Staphylococcus aureus
ALLAIIFDLILRFMAKLSYKKLLITLGVIVMIIILAIAIPMFAQKGD

SEQ ID NO: 1595215 - protein, 17 aa, Staphylococcus aureus
ALLFGMFIAILNQTLLN

SEQ ID NO: 1595216 - protein, 17 aa, Staphylococcus aureus
ALLFVSQLVFHFNSGIK

SEQ ID NO: 1595217 - protein, 59 aa, Staphylococcus aureus
ALLIPFVIMIITAIVLMGVWFIFNSLIALIVSIVLVVMIIVSIVLFRQALMKMDSYVDG

SEQ ID NO: 1595218 - protein, 24 aa, Staphylococcus aureus
ALLLQLIMIFISSTYLILLFNMML

SEQ ID NO: 1595219 - protein, 37 aa, Staphylococcus aureus
ALLPLLKLVLVVVFAMVFFVFAILGLVAWMCVINIMN

SEQ ID NO: 1595220 - protein, 25 aa, Staphylococcus aureus
ALNNGIARISAVQIVTSDRAKQSSS

SEQ ID NO: 1595221 - protein, 22 aa, Staphylococcus aureus
ALNRVMDQLSQGITGNEGRTKG

SEQ ID NO: 1595222 - protein, 19 aa, Staphylococcus aureus
ALNTKDKPVNKIIYADNTT

SEQ ID NO: 1595223 - protein, 22 aa, Staphylococcus aureus
ALPSGDYILKEIEAPAPYTFDK

SEQ ID NO: 1595224 - protein, 17 aa, Staphylococcus aureus
ALQLRFILDWNSQAHRP

SEQ ID NO: 1595225 - protein, 17 aa, Staphylococcus aureus
ALQNILNAKQALNGDER

SEQ ID NO: 1595226 - protein, 17 aa, Staphylococcus aureus
ALRWQKWHAMIGVIIAI

SEQ ID NO: 1595227 - protein, 27 aa, Staphylococcus aureus
ALTLPILNFIIPFVLVFIVDDMKGIKE

SEQ ID NO: 1595228 - protein, 21 aa, Staphylococcus aureus
ALTMTLLILPIIIVSSQEAIR

SEQ ID NO: 1595229 - protein, 20 aa, Staphylococcus aureus
ALVCFIFFAIFGASAIYLQD

SEQ ID NO: 1595230 - protein, 20 aa, Staphylococcus aureus
AMGYLGFLLFFVGAYMIIMY

SEQ ID NO: 1595231 - protein, 46 aa, Staphylococcus aureus
AMLAAIIIVYLILVITFKGGLAPFTILFSLPFTVIGVIIALLITGE

SEQ ID NO: 1595232 - protein, 21 aa, Staphylococcus aureus
AMLLIYPHELFIPAMILSLLI

SEQ ID NO: 1595233 - protein, 24 aa, Staphylococcus aureus
AMMFVIILYPLLWTFGISLNPGTN

SEQ ID NO: 1595234 - protein, 24 aa, Staphylococcus aureus
AMMFVIILYPLLWTFGISLNTGTN

SEQ ID NO: 1595235 - protein, 18 aa, Staphylococcus aureus
AMTGLKRGVANHNQVVQS

SEQ ID NO: 1595236 - protein, 36 aa, Staphylococcus aureus
ANEDYIFTIYVPYGDDWFAYFMRRLAERPQNLSLAV

SEQ ID NO: 1595237 - protein, 28 aa, Staphylococcus aureus
ANFANYFSILKFFKITIPFDQYFSVDLA

SEQ ID NO: 1595238 - protein, 24 aa, Staphylococcus aureus
ANGILFFLIPFFVSAIFNTQFTLF

SEQ ID NO: 1595239 - protein, 26 aa, Staphylococcus aureus
ANHFLQFFIILYTYRMIITLCLLIFD

SEQ ID NO: 1595240 - protein, 21 aa, Staphylococcus aureus
ANLLTFIAWLISGISVLRYNK

SEQ ID NO: 1595241 - protein, 24 aa, Staphylococcus aureus
ANNRFTHVAFIKPNNGKTTSVTVT

SEQ ID NO: 1595242 - protein, 23 aa, Staphylococcus aureus
ANTAIDALTQLNTPQKAKLKEQV

SEQ ID NO: 1595243 - protein, 24 aa, Staphylococcus aureus
ANTAIDQLPNLNQPQKTALKDQVS

SEQ ID NO: 1595244 - protein, 30 aa, Staphylococcus aureus
ANWQTYIMIAVYFLILIVIGFYGYKQATVN

SEQ ID NO: 1595245 - protein, 20 aa, Staphylococcus aureus
APGIYLVKLLQKVPGLNKLD

SEQ ID NO: 1595246 - protein, 18 aa, Staphylococcus aureus
APIFGLSEKSKFNIPLSF

SEQ ID NO: 1595247 - protein, 22 aa, Staphylococcus aureus
APLNMMIVSLFAITAIVLSAFF

SEQ ID NO: 1595248 - protein, 23 aa, Staphylococcus aureus
APRGEFLHMLLGVFLSALVSFVV

SEQ ID NO: 1595249 - protein, 26 aa, Staphylococcus aureus
APSEAIHFCFTYRHALRLVSPDTLFA

SEQ ID NO: 1595250 - protein, 24 aa, Staphylococcus aureus
AQALDHAMELLRNSVADNQATLAS

SEQ ID NO: 1595251 - protein, 19 aa, Staphylococcus aureus
AQFPFHRWLIESVTASTPV

SEQ ID NO: 1595252 - protein, 26 aa, Staphylococcus aureus
AQTIDQLNRGLNLGLDDIRNTHVWEV

SEQ ID NO: 1595253 - protein, 28 aa, Staphylococcus aureus
AQTKDQLNQGLNLGLDDIRNTHVWEVDA

SEQ ID NO: 1595254 - protein, 24 aa, Staphylococcus aureus
AQTLDHAMELLRNSVADNQTTLAS

SEQ ID NO: 1595255 - protein, 27 aa, Staphylococcus aureus
ARCQLCIIFSLFALMSNLTGIVIDHQH

SEQ ID NO: 1595256 - protein, 24 aa, Staphylococcus aureus
ARTLGYIILSACMTFLFVVIGFSI

SEQ ID NO: 1595257 - protein, 19 aa, Staphylococcus aureus
ASDYFSEAGATAATKAFGR

SEQ ID NO: 1595258 - protein, 23 aa, Staphylococcus aureus
ASFIGMLILYYICRLISEERLYR

SEQ ID NO: 1595259 - protein, 22 aa, Staphylococcus aureus
ASIYAIWLIYAAGINYLLLTML

SEQ ID NO: 1595260 - protein, 19 aa, Staphylococcus aureus
ASNLRLIFKHILPNTLGAI

SEQ ID NO: 1595261 - protein, 41 aa, Staphylococcus aureus
ASTAYSKSWLAIVCSMMVIFSIMLFLFVKRNKKKNKNESQR

SEQ ID NO: 1595262 - protein, 41 aa, Staphylococcus aureus
ASTAYSKSWLAIVCSMMVVFSIMLFLFVKRNKKKIKTNHSD

SEQ ID NO: 1595263 - protein, 41 aa, Staphylococcus aureus
ASTAYSKSWLAIVCSMMVVFSIMLFLFVKRNKKKNKNESQQ

SEQ ID NO: 1595264 - protein, 40 aa, Staphylococcus aureus
ASTLEFQTHLFGYYNYYYYNTSNLTWKNGVAFYSNNAQGD

SEQ ID NO: 1595265 - protein, 20 aa, Staphylococcus aureus
ASVFLGTMIVVGMGQEKEAA

SEQ ID NO: 1595266 - protein, 24 aa, Staphylococcus aureus
ATDARSYIFLVQDNEIDKVKEIVK

SEQ ID NO: 1595267 - protein, 30 aa, Staphylococcus aureus
ATELNTAMGTLKHAIADKTNTLASSKYVNA

SEQ ID NO: 1595268 - protein, 20 aa, Staphylococcus aureus
ATETLNNLSNLNTPQRQALE

SEQ ID NO: 1595269 - protein, 23 aa, Staphylococcus aureus
ATITLLCIFLIVTLTMTLTTYRD

SEQ ID NO: 1595270 - protein, 18 aa, Staphylococcus aureus
ATKHPFFEYARSFDFIIV

SEQ ID NO: 1595271 - protein, 17 aa, Staphylococcus aureus
ATLSVVLILLFVEKLRI

SEQ ID NO: 1595272 - protein, 20 aa, Staphylococcus aureus
ATNLQQVQFGTFEYTESAVT

SEQ ID NO: 1595273 - protein, 24 aa, Staphylococcus aureus
ATNLQQVQFGTFEYTESAVTQVRY

SEQ ID NO: 1595274 - protein, 18 aa, Staphylococcus aureus
ATQLLLLVFFSSTFTVCS

SEQ ID NO: 1595275 - protein, 19 aa, Staphylococcus aureus
ATTWFLLANGIMVPLSAFL

SEQ ID NO: 1595276 - protein, 20 aa, Staphylococcus aureus
ATVKLLFLLVVSISAMVTYE

SEQ ID NO: 1595277 - protein, 29 aa, Staphylococcus aureus
ATVLGIIALFFYIFRFNVLTYKELTYLPF

SEQ ID NO: 1595278 - protein, 17 aa, Staphylococcus aureus
AVDLISLIALPMIIVNS

SEQ ID NO: 1595279 - protein, 23 aa, Staphylococcus aureus
AVFLSRFLLSLLVSSNIFKNQFW

SEQ ID NO: 1595280 - protein, 23 aa, Staphylococcus aureus
AVFLSRFLLSLLVSSNIFKNQYW

SEQ ID NO: 1595281 - protein, 32 aa, Staphylococcus aureus
AVGIGGLSNAFGFKLDTYHNTSTPNASAKAKA

SEQ ID NO: 1595282 - protein, 25 aa, Staphylococcus aureus
AVIIFFMVMVFGFSLFLAGHYAPGG

SEQ ID NO: 1595283 - protein, 23 aa, Staphylococcus aureus
AVKQYLTEAQALDQLMNTLQQSI

SEQ ID NO: 1595284 - protein, 19 aa, Staphylococcus aureus
AVLFILLIQHRVGSMALIV

SEQ ID NO: 1595285 - protein, 24 aa, Staphylococcus aureus
AVLIALVIILILTLPPILTAINLE

SEQ ID NO: 1595286 - protein, 26 aa, Staphylococcus aureus
AVNTSAPRMRAFSLAAVAADAPAAGK

SEQ ID NO: 1595287 - protein, 27 aa, Staphylococcus aureus
AVNTSAPRMRAFSLAAVAADAPAAGKD

SEQ ID NO: 1595288 - protein, 26 aa, Staphylococcus aureus
AVNTSAPRMRAFSLAAVAADAPAAGT

SEQ ID NO: 1595289 - protein, 27 aa, Staphylococcus aureus
AVNTSAPRMRAFSLAAVAADAPAAGTD

SEQ ID NO: 1595290 - protein, 27 aa, Staphylococcus aureus
AVNTSAPRMRAFSLSAVAADAPAAGKD

SEQ ID NO: 1595291 - protein, 17 aa, Staphylococcus aureus
AVPLLTLIYPVSIALVL

SEQ ID NO: 1595292 - protein, 17 aa, Staphylococcus aureus
AVSLATITLLCTFLIVT

SEQ ID NO: 1595293 - protein, 25 aa, Staphylococcus aureus
AVSSIYSLYPLIKHNLIENNNIILD

SEQ ID NO: 1595294 - protein, 19 aa, Staphylococcus aureus
AVTQVRYVDVTTGKDIIPP

SEQ ID NO: 1595295 - protein, 26 aa, Staphylococcus aureus
AVYVIFYFIWIRFEWPHYLLYILLVL

SEQ ID NO: 1595296 - protein, 17 aa, Staphylococcus aureus
AWGVYAFFANTPKNTYL

SEQ ID NO: 1595297 - protein, 17 aa, Staphylococcus aureus
AWLNIIAIWILHKPAVN

SEQ ID NO: 1595298 - protein, 17 aa, Staphylococcus aureus
AYDLTLDGSAKLNNMTS

SEQ ID NO: 1595299 - protein, 21 aa, Staphylococcus aureus
AYMIIMYFIIVPVAIGVVLHM

SEQ ID NO: 1595300 - protein, 17 aa, Staphylococcus aureus
AYSLYLFFDFAGYSLFA

SEQ ID NO: 1595301 - protein, 25 aa, Staphylococcus aureus
AYSQAVNAAATILNKTAGGNTPKAD

SEQ ID NO: 1595302 - protein, 21 aa, Staphylococcus aureus
CFIFLLLLFFRYILKRYFNYM

SEQ ID NO: 1595303 - protein, 17 aa, Staphylococcus aureus
CFILFIYILGTNISIVS

SEQ ID NO: 1595304 - protein, 19 aa, Staphylococcus aureus
CFTLFGYVFLIFWTVIFSY

SEQ ID NO: 1595305 - protein, 19 aa, Staphylococcus aureus
CFTLFGYVFLIFWTVVFSY

SEQ ID NO: 1595306 - protein, 23 aa, Staphylococcus aureus
CIFLIVLVILYIWLPEDQNQSVR

SEQ ID NO: 1595307 - protein, 26 aa, Staphylococcus aureus
CISVSWLWFFLLAILGKMIGSIDKTG

SEQ ID NO: 1595308 - protein, 35 aa, Staphylococcus aureus
CLKALYDLWRWDFGKLLIPFRIFLSTFPVVLVLEI

SEQ ID NO: 1595309 - protein, 24 aa, Staphylococcus aureus
CLKLILILLFYFQYFWSYIKLNLH

SEQ ID NO: 1595310 - protein, 34 aa, Staphylococcus aureus
CLTIITMVLCGFLFPLAITLIGQIFFCQQANGSL

SEQ ID NO: 1595311 - protein, 18 aa, Staphylococcus aureus
CLVSLLTILLLAISNMYV

SEQ ID NO: 1595312 - protein, 17 aa, Staphylococcus aureus
CMLLILTMRVESLTVSV

SEQ ID NO: 1595313 - protein, 19 aa, Staphylococcus aureus
CNFSIIMWLFFSCSLLKER

SEQ ID NO: 1595314 - protein, 17 aa, Staphylococcus aureus
CNKIFFTLAMLVIFKIG

SEQ ID NO: 1595315 - protein, 26 aa, Staphylococcus aureus
CTTPLQFVLVRLLQGLFGGVVDASSA

SEQ ID NO: 1595316 - protein, 18 aa, Staphylococcus aureus
CVKVFKLDIKWPFLLSEL

SEQ ID NO: 1595317 - protein, 17 aa, Staphylococcus aureus
CWTIFMILSGTYLLIKK

SEQ ID NO: 1595318 - protein, 34 aa, Staphylococcus aureus
DADNMTLDRGFYKTPKYSLGDYVWYDSNKDGKQD

SEQ ID NO: 1595319 - protein, 35 aa, Staphylococcus aureus
DADNMTLDRGFYKTPKYSLGDYVWYDSNKDGKQDS

SEQ ID NO: 1595320 - protein, 32 aa, Staphylococcus aureus
DADNMTLDSGFYKTPKYNLGNYVWEDTNKDGK

SEQ ID NO: 1595321 - protein, 19 aa, Staphylococcus aureus
DADNMTLDSGFYKTPKYSL

SEQ ID NO: 1595322 - protein, 34 aa, Staphylococcus aureus
DADNMTLDSGFYKTSKYSLGDYVWYDSNKDGKQD

SEQ ID NO: 1595323 - protein, 18 aa, Staphylococcus aureus
DALAKLRTVFKADGTVTA

SEQ ID NO: 1595324 - protein, 25 aa, Staphylococcus aureus
DALANLDTLRDLNQPQRDALRNQIN

SEQ ID NO: 1595325 - protein, 17 aa, Staphylococcus aureus
DALNGDAKLIAAQNAAK

SEQ ID NO: 1595326 - protein, 19 aa, Staphylococcus aureus
DASALELLLACGLSFASSV

SEQ ID NO: 1595327 - protein, 20 aa, Staphylococcus aureus
DCYYLVMEYIEGPTLSEYIE

SEQ ID NO: 1595328 - protein, 28 aa, Staphylococcus aureus
DDDIDPLHMRHFSNNFGNVIKNAIGVVG

SEQ ID NO: 1595329 - protein, 56 aa, Staphylococcus aureus
DDEIDPLHMRHFGDRIGNVIKNALGVVGISGLLASFWFFIAKRRRKEDEEEELEIR

SEQ ID NO: 1595330 - protein, 27 aa, Staphylococcus aureus
DDIITEQDILAHINLIDQITAEVIDTP

SEQ ID NO: 1595331 - protein, 21 aa, Staphylococcus aureus
DDQIWSNSKFKLALKVQDRQD

SEQ ID NO: 1595332 - protein, 17 aa, Staphylococcus aureus
DDRIPINVWTGDSIART

SEQ ID NO: 1595333 - protein, 23 aa, Staphylococcus aureus
DDTALKNMFENYGLIALKDNHIE

SEQ ID NO: 1595334 - protein, 28 aa, Staphylococcus aureus
DDVEVTKQPIPHKTIREFDPTLEPGSPD

SEQ ID NO: 1595335 - protein, 27 aa, Staphylococcus aureus
DDVKATLTMPAYIDPENVKKTGNVTLA

SEQ ID NO: 1595336 - protein, 28 aa, Staphylococcus aureus
DDVKATLTVPAYIDPEYVTHTGNVTLAT

SEQ ID NO: 1595337 - protein, 31 aa, Staphylococcus aureus
DEANSSLIWGLLASLGSLLLFRRKKENKDKK

SEQ ID NO: 1595338 - protein, 19 aa, Staphylococcus aureus
DEDGYFWFQGRVDDVIMTA

SEQ ID NO: 1595339 - protein, 26 aa, Staphylococcus aureus
DEIDPLHMRHFGDRIGNVIKNALGVV

SEQ ID NO: 1595340 - protein, 20 aa, Staphylococcus aureus
DELFFTRDGLPIAKTRGLQN

SEQ ID NO: 1595341 - protein, 34 aa, Staphylococcus aureus
DENGKYCFDNLDSGKYKVIFEKPAGLTQTVTNTT

SEQ ID NO: 1595342 - protein, 34 aa, Staphylococcus aureus
DENGKYRFDNLDSGKYKVIFEKPAGLKQTGTNTT

SEQ ID NO: 1595343 - protein, 24 aa, Staphylococcus aureus
DEQYRIRDYWQQALKNKDILEEKR

SEQ ID NO: 1595344 - protein, 19 aa, Staphylococcus aureus
DEYRYGFYVKPTLNRLNGG

SEQ ID NO: 1595345 - protein, 22 aa, Staphylococcus aureus
DFEKAYWIPLSAHTILLGTSTI

SEQ ID NO: 1595346 - protein, 26 aa, Staphylococcus aureus
DFIALAFLFFTIALLLIALFYVCFYK

SEQ ID NO: 1595347 - protein, 26 aa, Staphylococcus aureus
DFIALAFLFLTIALLLIALFYVCFYK

SEQ ID NO: 1595348 - protein, 25 aa, Staphylococcus aureus
DFIVIIIVALIFYYIGTTSSFESVY

SEQ ID NO: 1595349 - protein, 19 aa, Staphylococcus aureus
DFKKALITGLLIYIVGYSG

SEQ ID NO: 1595350 - protein, 28 aa, Staphylococcus aureus
DFLGVFGIRLFALVSKFGLLRAGLTILK

SEQ ID NO: 1595351 - protein, 18 aa, Staphylococcus aureus
DFMLYITILMLVFLLMFK

SEQ ID NO: 1595352 - protein, 29 aa, Staphylococcus aureus
DFNNYIYYTSIYYGKYIRTVILQNNLDLF

SEQ ID NO: 1595353 - protein, 23 aa, Staphylococcus aureus
DGFDIFIVGILSLFGITALLLVV

SEQ ID NO: 1595354 - protein, 17 aa, Staphylococcus aureus
DGGRILFVIYEAIFRKP

SEQ ID NO: 1595355 - protein, 30 aa, Staphylococcus aureus
DGLVNVFTQLAPLFLWVANGLDSLGQKFQN

SEQ ID NO: 1595356 - protein, 26 aa, Staphylococcus aureus
DGRLALITSYIPFLAPFQLVVRAQTS

SEQ ID NO: 1595357 - protein, 24 aa, Staphylococcus aureus
DGSKVIVNVPVKVVEKELSVVKQQ

SEQ ID NO: 1595358 - protein, 18 aa, Staphylococcus aureus
DGSYLIPNLPNGDYRVEF

SEQ ID NO: 1595359 - protein, 23 aa, Staphylococcus aureus
DHASVLDEFYWLNKEEPNYSRCR

SEQ ID NO: 1595360 - protein, 17 aa, Staphylococcus aureus
DHPLVYWATFSNASDLL

SEQ ID NO: 1595361 - protein, 26 aa, Staphylococcus aureus
DIAWRDLLIIPIIGVLIFALNIAAYI

SEQ ID NO: 1595362 - protein, 28 aa, Staphylococcus aureus
DIDLAWLVPFMLFAIIGFIIDVLIRRPK

SEQ ID NO: 1595363 - protein, 18 aa, Staphylococcus aureus
DIDPLHMRHFSNNFGNVI

SEQ ID NO: 1595364 - protein, 26 aa, Staphylococcus aureus
DIENYYCLVIYDWRVIESETIMSNFE

SEQ ID NO: 1595365 - protein, 17 aa, Staphylococcus aureus
DIGRLTDLNNAQRTAAN

SEQ ID NO: 1595366 - protein, 20 aa, Staphylococcus aureus
DIHIILVQILCVTAVVIFSI

SEQ ID NO: 1595367 - protein, 29 aa, Staphylococcus aureus
DIISTWISLFFPFINWFIPKRYVKISREE

SEQ ID NO: 1595368 - protein, 20 aa, Staphylococcus aureus
DIKMWILGLIGTILSTFVIA

SEQ ID NO: 1595369 - protein, 17 aa, Staphylococcus aureus
DIKYLDGVKDRMGVTVN

SEQ ID NO: 1595370 - protein, 24 aa, Staphylococcus aureus
DILGYLFPIIGIVGSVFTFVYSIK

SEQ ID NO: 1595371 - protein, 18 aa, Staphylococcus aureus
DILTTRNLPSLIKYGYSI

SEQ ID NO: 1595372 - protein, 19 aa, Staphylococcus aureus
DITSTLLEQGGINASKFGV

SEQ ID NO: 1595373 - protein, 18 aa, Staphylococcus aureus
DIYNIIRKQNFSGNAYLN

SEQ ID NO: 1595374 - protein, 27 aa, Staphylococcus aureus
DIYSIGIVLYEMLVGEPPFNGETAVSI

SEQ ID NO: 1595375 - protein, 26 aa, Staphylococcus aureus
DKAIQSINQALTYKLKEIEASNATEQ

SEQ ID NO: 1595376 - protein, 24 aa, Staphylococcus aureus
DKDYAYIRFPVSNGTRDVKIVSSI

SEQ ID NO: 1595377 - protein, 17 aa, Staphylococcus aureus
DKFGFYIILILSLLIFV

SEQ ID NO: 1595378 - protein, 39 aa, Staphylococcus aureus
DKGDRIFIFMSRTPELYFALLGVLKIGAIVGPLFEAFME

SEQ ID NO: 1595379 - protein, 33 aa, Staphylococcus aureus
DKKKGSIEGTKHLPLLFAKRRRKEDEENVEVTN

SEQ ID NO: 1595380 - protein, 23 aa, Staphylococcus aureus
DKNRIKRMLVDRPTLLKHTDDFL

SEQ ID NO: 1595381 - protein, 26 aa, Staphylococcus aureus
DKQVQALIDEIDRNPILTDKEKQALK

SEQ ID NO: 1595382 - protein, 22 aa, Staphylococcus aureus
DKVMDPAKKPAPGKVVLLLAHR

SEQ ID NO: 1595383 - protein, 28 aa, Staphylococcus aureus
DKYEDIKSRLTLYSYIDKKTVPNETSLN

SEQ ID NO: 1595384 - protein, 18 aa, Staphylococcus aureus
DLAIVKFSPNEQNKHIGE

SEQ ID NO: 1595385 - protein, 17 aa, Staphylococcus aureus
DLINKTTDPTLAKSIID

SEQ ID NO: 1595386 - protein, 17 aa, Staphylococcus aureus
DLISLIALPMIIVNSVG

SEQ ID NO: 1595387 - protein, 36 aa, Staphylococcus aureus
DLKKQSKLILIFICIFTFFIMIIQSQFLMGQSLTDY

SEQ ID NO: 1595388 - protein, 25 aa, Staphylococcus aureus
DLTEAQALDQLMDALQQSIADKDAT

SEQ ID NO: 1595389 - protein, 27 aa, Staphylococcus aureus
DLVGFKWMYLICGMLVIVIMIMSFLKK

SEQ ID NO: 1595390 - protein, 32 aa, Staphylococcus aureus
DLVLSIVLLFLTFPIMFIFAIAIVIDSPGNPI

SEQ ID NO: 1595391 - protein, 23 aa, Staphylococcus aureus
DLVSIWLVYFLPCINWFIPKKYA

SEQ ID NO: 1595392 - protein, 25 aa, Staphylococcus aureus
DLVSIWLVYFLPFINWFIPKRYAII

SEQ ID NO: 1595393 - protein, 19 aa, Staphylococcus aureus
DMETRGMVLYINRNTRTTK

SEQ ID NO: 1595394 - protein, 20 aa, Staphylococcus aureus
DMSKLRYLYGHTAAYTRETG

SEQ ID NO: 1595395 - protein, 25 aa, Staphylococcus aureus
DMTGKIYLQVKLKGKIDKEQLVFQN

SEQ ID NO: 1595396 - protein, 17 aa, Staphylococcus aureus
DMYIIYKTVKNIITSEG

SEQ ID NO: 1595397 - protein, 25 aa, Staphylococcus aureus
DNAAKLKVQPTNNTFQNFDITYNGD

SEQ ID NO: 1595398 - protein, 26 aa, Staphylococcus aureus
DNAAKLKVQPTNNTFQNFDITYNGDT

SEQ ID NO: 1595399 - protein, 73 aa, Staphylococcus aureus
DNAAKLNVQPTNNAFQDFDINYNGDTKVMTVTYAGQTWTRNISDWIAKSGTTNFSLSMTASTGGATNLQQVQF

SEQ ID NO: 1595400 - protein, 26 aa, Staphylococcus aureus
DNGRIRYTFTDYIKDKVNVTANLEIN

SEQ ID NO: 1595401 - protein, 17 aa, Staphylococcus aureus
DNLIMRILDVVFAIPSL

SEQ ID NO: 1595402 - protein, 28 aa, Staphylococcus aureus
DNLSADLGIYKPKYNLGDYVWEDTNKNG

SEQ ID NO: 1595403 - protein, 23 aa, Staphylococcus aureus
DNPKLAFSIVYTNQPVPPPWLTG

SEQ ID NO: 1595404 - protein, 17 aa, Staphylococcus aureus
DNQQSALTAKGYNYTSV

SEQ ID NO: 1595405 - protein, 22 aa, Staphylococcus aureus
DNSYYYPVIKDDKIVYTLTLSP

SEQ ID NO: 1595406 - protein, 21 aa, Staphylococcus aureus
DNWLSIIVVSISILLIALVMA

SEQ ID NO: 1595407 - protein, 24 aa, Staphylococcus aureus
DNYHLIFALIFLAIISVVSMMVGS

SEQ ID NO: 1595408 - protein, 26 aa, Staphylococcus aureus
DPAILLPLYILSFSSVSLLATYLVRI

SEQ ID NO: 1595409 - protein, 28 aa, Staphylococcus aureus
DPKNNSRTLIFPYVPDKSVYNAIVKVVV

SEQ ID NO: 1595410 - protein, 25 aa, Staphylococcus aureus
DPMAKIIRQKLKKLGIRKGIPVVFS

SEQ ID NO: 1595411 - protein, 41 aa, Staphylococcus aureus
DPNSKGDLALRSTLYGYDSRFVWRSMSWDNEVAFNNGSGSG

SEQ ID NO: 1595412 - protein, 21 aa, Staphylococcus aureus
DQALQNILNAKQALNGDERVA

SEQ ID NO: 1595413 - protein, 21 aa, Staphylococcus aureus
DQALQNILNAKQALTGDERVA

SEQ ID NO: 1595414 - protein, 30 aa, Staphylococcus aureus
DQASWRVPFIIILGIAILAFVFGLVSISSY

SEQ ID NO: 1595415 - protein, 58 aa, Staphylococcus aureus
DQDDEIDPLHMRHFGDRIGNVIKNALGVVGISGLLASFWFFIAKRRRKEDEEEELEIR

SEQ ID NO: 1595416 - protein, 25 aa, Staphylococcus aureus
DQIPSGYTILATGTPDGVHNTITIR

SEQ ID NO: 1595417 - protein, 25 aa, Staphylococcus aureus
DQITTPYIVVVNGHIDPNSKGDLAL

SEQ ID NO: 1595418 - protein, 24 aa, Staphylococcus aureus
DQQSAFYEILNMPNLNEAQRNGFI

SEQ ID NO: 1595419 - protein, 17 aa, Staphylococcus aureus
DQRVYRTSTYDLTTDEI

SEQ ID NO: 1595420 - protein, 25 aa, Staphylococcus aureus
DQSNPIILLLFVTIGFGLIGFIDDY

SEQ ID NO: 1595421 - protein, 26 aa, Staphylococcus aureus
DQSSSPAVMFVLVAGIGLIATVRRRK

SEQ ID NO: 1595422 - protein, 26 aa, Staphylococcus aureus
DQSSSPVAMFVLVAGIGLIATVRRRK

SEQ ID NO: 1595423 - protein, 19 aa, Staphylococcus aureus
DRINQILQQGHNDINNAMT

SEQ ID NO: 1595424 - protein, 23 aa, Staphylococcus aureus
DRKNTVLYLMHYHKRITDKQWQD

SEQ ID NO: 1595425 - protein, 19 aa, Staphylococcus aureus
DRVGIILIGLILMVAIVDL

SEQ ID NO: 1595426 - protein, 31 aa, Staphylococcus aureus
DSLANEKTRVRLYKSGKNWVKSGIKEIEMFK

SEQ ID NO: 1595427 - protein, 25 aa, Staphylococcus aureus
DSTQFSRRTFLKMLGIGGASVAIGA

SEQ ID NO: 1595428 - protein, 17 aa, Staphylococcus aureus
DSTSMSLSMSQSISGST

SEQ ID NO: 1595429 - protein, 24 aa, Staphylococcus aureus
DSTYKIYLALFGLDRHIISDKNSR

SEQ ID NO: 1595430 - protein, 41 aa, Staphylococcus aureus
DTKGLTLFYVFIGLIMFALLNQQLLLLNFLSFILAIVVTMC

SEQ ID NO: 1595431 - protein, 28 aa, Staphylococcus aureus
DTKNNSRTLIFPYVPDKAVYNAIVKVVV

SEQ ID NO: 1595432 - protein, 18 aa, Staphylococcus aureus
DVFLIFAAVVFILMYFQE

SEQ ID NO: 1595433 - protein, 24 aa, Staphylococcus aureus
DVIRTWLVYFFPFINRFIPKRCAK

SEQ ID NO: 1595434 - protein, 24 aa, Staphylococcus aureus
DVISTWLVYFFHLLIGSFQKHMSK

SEQ ID NO: 1595435 - protein, 29 aa, Staphylococcus aureus
DVISTWLVYFFPFINWFIPKTYVKITKND

SEQ ID NO: 1595436 - protein, 31 aa, Staphylococcus aureus
DVRTLALLLIAPILLLSLLYYIFTVADNTNG

SEQ ID NO: 1595437 - protein, 23 aa, Staphylococcus aureus
DVTIFILISILLFVYTYKENEEI

SEQ ID NO: 1595438 - protein, 18 aa, Staphylococcus aureus
DVTNQYLQKITYGDNNSA

SEQ ID NO: 1595439 - protein, 28 aa, Staphylococcus aureus
DVTSSWIFFFIPMLNWGVPKKFAKISQS

SEQ ID NO: 1595440 - protein, 27 aa, Staphylococcus aureus
DVVAKATYDILTKTYTFVFTDYVNNKE

SEQ ID NO: 1595441 - protein, 29 aa, Staphylococcus aureus
DWFDIFIAGILRLFGVIALMLVVALPIYT

SEQ ID NO: 1595442 - protein, 30 aa, Staphylococcus aureus
DWFDIFIAGILRLFGVIALMLVVISPIYTV

SEQ ID NO: 1595443 - protein, 29 aa, Staphylococcus aureus
DWFDIFIVGILRLFGVIALMLVVISPIYT

SEQ ID NO: 1595444 - protein, 52 aa, Staphylococcus aureus
DWRGVWDAIVMILKGVVQLIWNLIQLWFVGKILGVVRYFGGLLKGLIAGIWD

SEQ ID NO: 1595445 - protein, 24 aa, Staphylococcus aureus
DYAKILPLTALLGGILVLVADMIA

SEQ ID NO: 1595446 - protein, 26 aa, Staphylococcus aureus
DYFLQFEWFQPLLISLAALLILIGLI

SEQ ID NO: 1595447 - protein, 18 aa, Staphylococcus aureus
DYFTAKLPDSVTGNGDVD

SEQ ID NO: 1595448 - protein, 24 aa, Staphylococcus aureus
DYKAEKLLAPYKKAETLERQVYEL

SEQ ID NO: 1595449 - protein, 27 aa, Staphylococcus aureus
DYLGYILVALFLITWLISSLILKFGRI

SEQ ID NO: 1595450 - protein, 22 aa, Staphylococcus aureus
DYPLIQGIVIFIIVFIMLMNYL

SEQ ID NO: 1595451 - protein, 19 aa, Staphylococcus aureus
DYYVDNSWGWLPWNWSDGI

SEQ ID NO: 1595452 - protein, 19 aa, Staphylococcus aureus
EAIAKLNQLKEQAIQAIQR

SEQ ID NO: 1595453 - protein, 25 aa, Staphylococcus aureus
EAIKELWLPILTISAILAIAKVMTY

SEQ ID NO: 1595454 - protein, 20 aa, Staphylococcus aureus
EAKDSKEPLPDTGSEDEANT

SEQ ID NO: 1595455 - protein, 27 aa, Staphylococcus aureus
EALKRGFLIFCLIGFGVGVLANASFII

SEQ ID NO: 1595456 - protein, 31 aa, Staphylococcus aureus
EAMGYIKRIGLYISIFILIVMVAGCGKDNEI

SEQ ID NO: 1595457 - protein, 32 aa, Staphylococcus aureus
EAMGYLKRFSLYISVMILIFAIAGCGKGNETK

SEQ ID NO: 1595458 - protein, 28 aa, Staphylococcus aureus
EAPYTIVFYFSLFSVIVLIPFTAYTYEP

SEQ ID NO: 1595459 - protein, 25 aa, Staphylococcus aureus
EAVQGDTFKITVPKELNLNGVTSTA

SEQ ID NO: 1595460 - protein, 24 aa, Staphylococcus aureus
EDDKLKLDYALDFDQDKYTYAGAK

SEQ ID NO: 1595461 - protein, 32 aa, Staphylococcus aureus; identical to SEQ ID NO: 1582227

SEQ ID NO: 1595462 - protein, 32 aa, Staphylococcus aureus; identical to SEQ ID NO: 1578327

SEQ ID NO: 1595463 - protein, 27 aa, Staphylococcus aureus
EDEVETLKWARWLPHMTLRDQNIRGFV

SEQ ID NO: 1595464 - protein, 28 aa, Staphylococcus aureus
EDEVETLKWARWLPHMTLRSQNIRGFVY

SEQ ID NO: 1595465 - protein, 26 aa, Staphylococcus aureus
EDTTPPIVPPTPPTPEVPIVPPTPPT

SEQ ID NO: 1595466 - protein, 25 aa, Staphylococcus aureus
EDVTDSVNITFPNPNQYKVEFNTPD

SEQ ID NO: 1595467 - protein, 27 aa, Staphylococcus aureus
EEAVAFYPILVPIFIALGYDSIVSVGA

SEQ ID NO: 1595468 - protein, 26 aa, Staphylococcus aureus
EEDTTPPIVPPTPPTPEVPSEPEVPT

SEQ ID NO: 1595469 - protein, 19 aa, Staphylococcus aureus
EEHPLLTIIGGTCLVAGLA

SEQ ID NO: 1595470 - protein, 24 aa, Staphylococcus aureus
EEIKILLSQNQLLASAGTLIEEEE

SEQ ID NO: 1595471 - protein, 22 aa, Staphylococcus aureus
EEKFWILHYSFLRVLILGFFIG

SEQ ID NO: 1595472 - protein, 24 aa, Staphylococcus aureus
EEKYDYTLMEFAQPIYNSADKFKT

SEQ ID NO: 1595473 - protein, 29 aa, Staphylococcus aureus
EEQFYLLFPLVITFLLHRFRPRNIIQTLF

SEQ ID NO: 1595474 - protein, 32 aa, Staphylococcus aureus
EERIMEGLSLIPLPGMGFLKGAGKSLMKLGFK

SEQ ID NO: 1595475 - protein, 17 aa, Staphylococcus aureus
EERLPDTGDSIKQNGLL

SEQ ID NO: 1595476 - protein, 44 aa, Staphylococcus aureus
EERLPDTGDSIKQNGLLGGVMTLLVGLGLMKRKKKKDENEQDDS

SEQ ID NO: 1595477 - protein, 44 aa, Staphylococcus aureus
EERLPDTGESIKQNGLLGGIMTLLVGLGLMKRKKKKDENDQDDS

SEQ ID NO: 1595478 - protein, 21 aa, Staphylococcus aureus
EFAPAVMFIIANRSALSVGTL

SEQ ID NO: 1595479 - protein, 18 aa, Staphylococcus aureus
EFEKMLIQLSTFHSYHDL

SEQ ID NO: 1595480 - protein, 24 aa, Staphylococcus aureus
EFKDKITYKYQNVASINFGDINKT

SEQ ID NO: 1595481 - protein, 17 aa, Staphylococcus aureus
EFNMIWKAMLIPSMGYI

SEQ ID NO: 1595482 - protein, 22 aa, Staphylococcus aureus
EFSFNYIFLANLIMYVVFALVA

SEQ ID NO: 1595483 - protein, 17 aa, Staphylococcus aureus
EGDQRVYRTSTYDLTTD

SEQ ID NO: 1595484 - protein, 24 aa, Staphylococcus aureus
EGFPTINWLGFYPSYEPLIVQAAY

SEQ ID NO: 1595485 - protein, 17 aa, Staphylococcus aureus
EGGKIRYTFTNDIEDKV

SEQ ID NO: 1595486 - protein, 17 aa, Staphylococcus aureus
EGKLIGVVVAKISMPNV

SEQ ID NO: 1595487 - protein, 17 aa, Staphylococcus aureus
EGMLYEPKPKKKSTRKI

SEQ ID NO: 1595488 - protein, 20 aa, Staphylococcus aureus
EGTLYEPKPKKKSTRKIVLL

SEQ ID NO: 1595489 - protein, 23 aa, Staphylococcus aureus
EGYNFTIYVPYGDDWLAYFMRRL

SEQ ID NO: 1595490 - protein, 28 aa, Staphylococcus aureus
EHRYFDRVIKKRYKGIEYLIIKEPITTQ

SEQ ID NO: 1595491 - protein, 20 aa, Staphylococcus aureus
EHSPLLFAKRRKDKEEDVET

SEQ ID NO: 1595492 - protein, 23 aa, Staphylococcus aureus
EIAGVFGIPLHKFGIETSNMSIT

SEQ ID NO: 1595493 - protein, 25 aa, Staphylococcus aureus
EIDPLHMRHFGDRIGNVIKNALGVV

SEQ ID NO: 1595494 - protein, 17 aa, Staphylococcus aureus
EIELPLALSFFSGKRLV

SEQ ID NO: 1595495 - protein, 27 aa, Staphylococcus aureus
EIETLPFDQNLAQLFKLNLKGETKTKY

SEQ ID NO: 1595496 - protein, 25 aa, Staphylococcus aureus
EIGDLFSIKVIAISTAIVAVGYIGL

SEQ ID NO: 1595497 - protein, 18 aa, Staphylococcus aureus
EILAFRIIFSAIFMIFIL

SEQ ID NO: 1595498 - protein, 17 aa, Staphylococcus aureus
EIPFETKREFNPKLQPG

SEQ ID NO: 1595499 - protein, 27 aa, Staphylococcus aureus
EKFAKIGGLIFIFLIGTVTIAAIVGVV

SEQ ID NO: 1595500 - protein, 35 aa, Staphylococcus aureus
EKIPFYKKHSTLLFATLLIAFGYLSHFVNGEDNLV

SEQ ID NO: 1595501 - protein, 31 aa, Staphylococcus aureus
EKKNMAGLIFVSWYPTVYWIINATVVLVAFP

SEQ ID NO: 1595502 - protein, 27 aa, Staphylococcus aureus
EKPMANVLVTLTYPDGTTKSVRTDDKG

SEQ ID NO: 1595503 - protein, 25 aa, Staphylococcus aureus
EKPVAKNDLKEIPQLVTKKNDVSES

SEQ ID NO: 1595504 - protein, 18 aa, Staphylococcus aureus
EKQEAIAKLNQLKEQAIQ

SEQ ID NO: 1595505 - protein, 22 aa, Staphylococcus aureus
EKRIDLFFKYNLNHYKSLKVTR

SEQ ID NO: 1595506 - protein, 44 aa, Staphylococcus aureus
EKRLPDTGDSIKQNGLLGGVMTLLVGLGLMKRKKKKDENDQDDS

SEQ ID NO: 1595507 - protein, 18 aa, Staphylococcus aureus
EKSLAKNDLKEIPQLVTK

SEQ ID NO: 1595508 - protein, 17 aa, Staphylococcus aureus
EKTLTLGKGNGLLSGLL

SEQ ID NO: 1595509 - protein, 24 aa, Staphylococcus aureus
EKVASFAMRLLLGSTLASIISGSI

SEQ ID NO: 1595510 - protein, 23 aa, Staphylococcus aureus
EKVKAVAPTKQKQSKKFELPGTG

SEQ ID NO: 1595511 - protein, 18 aa, Staphylococcus aureus
EKYDYTLMEFAQPIYNSA

SEQ ID NO: 1595512 - protein, 22 aa, Staphylococcus aureus
EKYEVNVIYLVSHALVETGNGK

SEQ ID NO: 1595513 - protein, 23 aa, Staphylococcus aureus
EKYKSYFIGDWYVSGDSAYKDED

SEQ ID NO: 1595514 - protein, 35 aa, Staphylococcus aureus
ELDFLMFIRRFIVLLFVFACITTLLWLISYSLLLK

SEQ ID NO: 1595515 - protein, 19 aa, Staphylococcus aureus
ELEIKILPVLPQYNYIQSA

SEQ ID NO: 1595516 - protein, 24 aa, Staphylococcus aureus
ELEKMLIQLSTYHSYHDLEFLFVT

SEQ ID NO: 1595517 - protein, 18 aa, Staphylococcus aureus
ELFFTRDGLPIAKTRGLQ

SEQ ID NO: 1595518 - protein, 20 aa, Staphylococcus aureus
ELGSIYILPALIGSIILIAL

SEQ ID NO: 1595519 - protein, 21 aa, Staphylococcus aureus
ELGSIYILPALIGSIILIALV

SEQ ID NO: 1595520 - protein, 19 aa, Staphylococcus aureus
ELKNPQSLDLPQSSPQTIS

SEQ ID NO: 1595521 - protein, 19 aa, Staphylococcus aureus
ELKNPQTLDLPQSSPQTIS

SEQ ID NO: 1595522 - protein, 27 aa, Staphylococcus aureus
EMFRPFALAIAFSLLASLLVSITLVPA

SEQ ID NO: 1595523 - protein, 34 aa, Staphylococcus aureus
EMHTSVLKYYFWITILIIAIIVGAIAWLFDYQFS

SEQ ID NO: 1595524 - protein, 19 aa, Staphylococcus aureus
EMKLVFLEGIFKTLLNKNS

SEQ ID NO: 1595525 - protein, 18 aa, Staphylococcus aureus
EMLMFLPENIARSMSQHT

SEQ ID NO: 1595526 - protein, 21 aa, Staphylococcus aureus
ENALNGDANLQRAKTEAIQAI

SEQ ID NO: 1595527 - protein, 19 aa, Staphylococcus aureus
ENALNGDANLQRAKTEATQ

SEQ ID NO: 1595528 - protein, 26 aa, Staphylococcus aureus
ENGLHQGDFFDFTLSKNVNTHGVSTA

SEQ ID NO: 1595529 - protein, 23 aa, Staphylococcus aureus
ENPKIIYVILPLAIGILNISLIV

SEQ ID NO: 1595530 - protein, 19 aa, Staphylococcus aureus
EPDHPLVYWATFSNASDLL

SEQ ID NO: 1595531 - protein, 19 aa, Staphylococcus aureus
EPGKPLPPAKEEPKKPSKP

SEQ ID NO: 1595532 - protein, 26 aa, Staphylococcus aureus
EPHAGQRAVLKYKLKFEDGLHQGDYF

SEQ ID NO: 1595533 - protein, 41 aa, Staphylococcus aureus
EPHAGQRAVLKYKLKFENGLHQGDYFDFTLSNNVNTHGVST

SEQ ID NO: 1595534 - protein, 30 aa, Staphylococcus aureus
EPHEGQRAILKYKLKFENGLHQGDFFDFTL

SEQ ID NO: 1595535 - protein, 18 aa, Staphylococcus aureus
EPIRLIYSGSNLTIEGQY

SEQ ID NO: 1595536 - protein, 22 aa, Staphylococcus aureus
EPKLLIIIPILIVAFIISKLIP

SEQ ID NO: 1595537 - protein, 17 aa, Staphylococcus aureus
EPLPDTGSEDEANTSLI

SEQ ID NO: 1595538 - protein, 22 aa, Staphylococcus aureus
EPNKYIIPWALLGFALVMVYQF

SEQ ID NO: 1595539 - protein, 25 aa, Staphylococcus aureus
EQANPIILLLFVTIGFGLIGFIDDY

SEQ ID NO: 1595540 - protein, 24 aa, Staphylococcus aureus
EQFKAQMKAANPTAKELAKRKQEA

SEQ ID NO: 1595541 - protein, 22 aa, Staphylococcus aureus
EQQKIFEPFYTRSNKYFKDNQK

SEQ ID NO: 1595542 - protein, 24 aa, Staphylococcus aureus
EQQNAFYEILHLPNLTEEQRNGFI

SEQ ID NO: 1595543 - protein, 25 aa, Staphylococcus aureus
EQQNAFYEILHLPNLTEEQRNGFIQ

SEQ ID NO: 1595544 - protein, 42 aa, Staphylococcus aureus
ERKKGGMAKVLLPLIAAVLIIGALAIFGGMALNNHNNGTKEN

SEQ ID NO: 1595545 - protein, 21 aa, Staphylococcus aureus
ERQFYHYASTVEPATVIFTKT

SEQ ID NO: 1595546 - protein, 24 aa, Staphylococcus aureus
ESAEFVIAIRFLLGIAGALIMPTT

SEQ ID NO: 1595547 - protein, 20 aa, Staphylococcus aureus
ESIIAGLNNPTINKGNVTSA

SEQ ID NO: 1595548 - protein, 22 aa, Staphylococcus aureus
ESIYEYLSIIEFNIFKVLKTSF

SEQ ID NO: 1595549 - protein, 25 aa, Staphylococcus aureus
ESKDEDVPLLLAKKKNQKDNQSKDK

SEQ ID NO: 1595550 - protein, 23 aa, Staphylococcus aureus
ESMMDAFVKHPIKTGMLNGKKYM

SEQ ID NO: 1595551 - protein, 33 aa, Staphylococcus aureus
ESQQAYFLNVIFLMIVLFVLYKKRREIIDFVTR

SEQ ID NO: 1595552 - protein, 28 aa, Staphylococcus aureus
ESVLVWAPLLLAVLFIINFILFNARSEH

SEQ ID NO: 1595553 - protein, 21 aa, Staphylococcus aureus
ESYFLMWVHQIKTPITASKLL

SEQ ID NO: 1595554 - protein, 17 aa, Staphylococcus aureus
ETELPLALSFFSGKRLV

SEQ ID NO: 1595555 - protein, 18 aa, Staphylococcus aureus
EVEYFGTIFSFMGNSSTG

SEQ ID NO: 1595556 - protein, 17 aa, Staphylococcus aureus
EVILIIILGLPIYFFYE

SEQ ID NO: 1595557 - protein, 17 aa, Staphylococcus aureus
EVIPPKGKNDQQKSIRL

SEQ ID NO: 1595558 - protein, 26 aa, Staphylococcus aureus
EVKGSLLLELAVVFGISALVTSFLKH

SEQ ID NO: 1595559 - protein, 19 aa, Staphylococcus aureus
EVPAEPGKPLPPAKEEPKK

SEQ ID NO: 1595560 - protein, 28 aa, Staphylococcus aureus
EVTEAFLKYHLLGGRYYQPLAQTFQMPT

SEQ ID NO: 1595561 - protein, 29 aa, Staphylococcus aureus
EYDFIALAFLFLTIALLLIALFYVCFYKI

SEQ ID NO: 1595562 - protein, 18 aa, Staphylococcus aureus
FAAQLLAFLKWSNLGIIA

SEQ ID NO: 1595563 - protein, 28 aa, Staphylococcus aureus
FAFIMIISILLAYVFKWLGLVDDVLLMV

SEQ ID NO: 1595564 - protein, 36 aa, Staphylococcus aureus
FAIDMFKMILIQIICVMMGLWIYQLDKHESSTIILM

SEQ ID NO: 1595565 - protein, 35 aa, Staphylococcus aureus
FAIDMLKMILIQIICVMMGLWIYQLDKHESSTIIL

SEQ ID NO: 1595566 - protein, 17 aa, Staphylococcus aureus
FAISRLFQAIGCGIIPL

SEQ ID NO: 1595567 - protein, 20 aa, Staphylococcus aureus
FALDSFGWKETKPPKKDGDR

SEQ ID NO: 1595568 - protein, 48 aa, Staphylococcus aureus
FAMLAAIIIVYLILVITFKGGLAPFTILFSLPFTVIGVIIALLITGET

SEQ ID NO: 1595569 - protein, 23 aa, Staphylococcus aureus
FARTALVILLLIPSIIVLSGQFD

SEQ ID NO: 1595570 - protein, 25 aa, Staphylococcus aureus
FAVAMIAMSFLYLQGGRLIDVLTAI

SEQ ID NO: 1595571 - protein, 23 aa, Staphylococcus aureus
FCFIFLLLVFFKYILKRYFNYSL

SEQ ID NO: 1595572 - protein, 22 aa, Staphylococcus aureus
FCFIFLLLVFFRYILKRYFNYS

SEQ ID NO: 1595573 - protein, 19 aa, Staphylococcus aureus
FDFMLYITILMLVFLLMFN

SEQ ID NO: 1595574 - protein, 24 aa, Staphylococcus aureus
FDKEKNKFTHVAYIKPINGNNSDS

SEQ ID NO: 1595575 - protein, 24 aa, Staphylococcus aureus
FEIELPGIFSALLLGAMYSYRMDF

SEQ ID NO: 1595576 - protein, 18 aa, Staphylococcus aureus
FEIMETYKPYAVYHAAAH

SEQ ID NO: 1595577 - protein, 18 aa, Staphylococcus aureus
FFASKLPLLNFRMNNRNH

SEQ ID NO: 1595578 - protein, 22 aa, Staphylococcus aureus
FFCHSPLTYLWVFALILFFMRL

SEQ ID NO: 1595579 - protein, 22 aa, Staphylococcus aureus
FFCHSPLTYLWVFALILFITRL

SEQ ID NO: 1595580 - protein, 26 aa, Staphylococcus aureus
FFELRKLYIFAIMILASGSLLCAIAP

SEQ ID NO: 1595581 - protein, 18 aa, Staphylococcus aureus
FFFIIFAYLYFGGFSFFT

SEQ ID NO: 1595582 - protein, 29 aa, Staphylococcus aureus
FFGGSWDTWVYQGLAVLVVGCPCALVITT

SEQ ID NO: 1595583 - protein, 18 aa, Staphylococcus aureus
FFIINFILISYLYDKQYV

SEQ ID NO: 1595584 - protein, 18 aa, Staphylococcus aureus
FFIKNNFSDSLRVPFKDL

SEQ ID NO: 1595585 - protein, 19 aa, Staphylococcus aureus
FFIWTVPCYLCAIIAIIYG

SEQ ID NO: 1595586 - protein, 24 aa, Staphylococcus aureus
FFIWTVPCYLCAIIAIIYGFTGIG

SEQ ID NO: 1595587 - protein, 19 aa, Staphylococcus aureus
FFKIWIVIGLVIIGTYAFF

SEQ ID NO: 1595588 - protein, 18 aa, Staphylococcus aureus
FFLGMIFAAIYYYTKNLL

SEQ ID NO: 1595589 - protein, 21 aa, Staphylococcus aureus
FFSMFAYFAVLVFVPLLVVEV

SEQ ID NO: 1595590 - protein, 19 aa, Staphylococcus aureus
FFWPAILAFVLTGIGLLLL

SEQ ID NO: 1595591 - protein, 18 aa, Staphylococcus aureus
FGAFFKIWIVIGLVIIGT

SEQ ID NO: 1595592 - protein, 18 aa, Staphylococcus aureus
FGAFLKIWIVIGLVIIGT

SEQ ID NO: 1595593 - protein, 17 aa, Staphylococcus aureus
FGAFVTTDSTGVASTYT

SEQ ID NO: 1595594 - protein, 29 aa, Staphylococcus aureus
FGDGLINIFTQLMPLFKFASQGLQNMSIA

SEQ ID NO: 1595595 - protein, 17 aa, Staphylococcus aureus
FGFGLGISLIAIMLIVC

SEQ ID NO: 1595596 - protein, 22 aa, Staphylococcus aureus
FGFYIILILSLLIFVTLLLVNK

SEQ ID NO: 1595597 - protein, 46 aa, Staphylococcus aureus
FGGGVLGFYLLELSVPLISLFGVCIITILLLCSSVILLTNHQHREV

SEQ ID NO: 1595598 - protein, 18 aa, Staphylococcus aureus
FGGLIIGIFPYLLKISNY

SEQ ID NO: 1595599 - protein, 23 aa, Staphylococcus aureus
FGGSVVIWLLSYIGPHGINVNIN

SEQ ID NO: 1595600 - protein, 23 aa, Staphylococcus aureus
FGGSVVIWLLSYVGPHGINVNIN

SEQ ID NO: 1595601 - protein, 24 aa, Staphylococcus aureus
FGIAIWVLFHLIIMPIMHTVPAMW

SEQ ID NO: 1595602 - protein, 20 aa, Staphylococcus aureus
FGIKKYFLGGLLSSLLLLIF

SEQ ID NO: 1595603 - protein, 23 aa, Staphylococcus aureus
FGIKKYFLGGLLSSLLLLVFGVF

SEQ ID NO: 1595604 - protein, 24 aa, Staphylococcus aureus
FGILYTILMYTCAYVLIRMFKNKP

SEQ ID NO: 1595605 - protein, 17 aa, Staphylococcus aureus
FGIPPKDLSIAQSAYLI

SEQ ID NO: 1595606 - protein, 26 aa, Staphylococcus aureus
FGIVITVILYAIKLPGSIFIGMIITA

SEQ ID NO: 1595607 - protein, 18 aa, Staphylococcus aureus
FGMLVQLLGFGTWQAGAT

SEQ ID NO: 1595608 - protein, 18 aa, Staphylococcus aureus
FGRRPVLLASLLGATIDY

SEQ ID NO: 1595609 - protein, 24 aa, Staphylococcus aureus
FGSKILLFIIMSIAIIQHLLQIAY

SEQ ID NO: 1595610 - protein, 33 aa, Staphylococcus aureus
FGTSYLSRSYLITIFIILLITILFANFSEAFAE

SEQ ID NO: 1595611 - protein, 23 aa, Staphylococcus aureus
FGVAFIIMIFAIGGVPPFSGFRE

SEQ ID NO: 1595612 - protein, 19 aa, Staphylococcus aureus
FGWFAGFYNYATSTLISLF

SEQ ID NO: 1595613 - protein, 21 aa, Staphylococcus aureus
FGYVFLIFWTVVFSYALLSMS

SEQ ID NO: 1595614 - protein, 27 aa, Staphylococcus aureus
FHASMTFGLIFLFSEEIGDLFSIKVIA

SEQ ID NO: 1595615 - protein, 26 aa, Staphylococcus aureus
FHEDYDYTLMVFAQPITNNPDDYVDE

SEQ ID NO: 1595616 - protein, 28 aa, Staphylococcus aureus
FHNIHIKIIYWLVLTTIFFIANILIIHI

SEQ ID NO: 1595617 - protein, 17 aa, Staphylococcus aureus
FHVLLSLTEILKGCLAT

SEQ ID NO: 1595618 - protein, 17 aa, Staphylococcus aureus
FIAAFGAPFFIYLLTVK

SEQ ID NO: 1595619 - protein, 17 aa, Staphylococcus aureus
FIANLFLEPTKLGYLII

SEQ ID NO: 1595620 - protein, 18 aa, Staphylococcus aureus
FIAPIVFILLMVAQGYIA

SEQ ID NO: 1595621 - protein, 18 aa, Staphylococcus aureus
FIDKVFVNIIYFQGMFYT

SEQ ID NO: 1595622 - protein, 19 aa, Staphylococcus aureus
FIDYVLLGVLPNKTQWWLV

SEQ ID NO: 1595623 - protein, 18 aa, Staphylococcus aureus
FIFLALLLVPGSPAALTA

SEQ ID NO: 1595624 - protein, 24 aa, Staphylococcus aureus
FIGKSILSIAAISLTVSTFAGESH

SEQ ID NO: 1595625 - protein, 18 aa, Staphylococcus aureus
FIIFALTYYLLLAPKWYI

SEQ ID NO: 1595626 - protein, 20 aa, Staphylococcus aureus
FIIYSFIFVLLLPNTFYMVT

SEQ ID NO: 1595627 - protein, 17 aa, Staphylococcus aureus
FILFINWYLNVNEWNGR

SEQ ID NO: 1595628 - protein, 18 aa, Staphylococcus aureus
FILFINWYLNVNEWNGRQ

SEQ ID NO: 1595629 - protein, 17 aa, Staphylococcus aureus
FIMFPPEKRGMAMGMFG

SEQ ID NO: 1595630 - protein, 18 aa, Staphylococcus aureus
FISVIFSVLGFGGLLYGT

SEQ ID NO: 1595631 - protein, 17 aa, Staphylococcus aureus
FITFPRRYRNVFLMMVV

SEQ ID NO: 1595632 - protein, 26 aa, Staphylococcus aureus
FITILTLIAIVIIGVTLGLLAGYKKG

SEQ ID NO: 1595633 - protein, 19 aa, Staphylococcus aureus
FITMSLIGILLFLVPIPVE

SEQ ID NO: 1595634 - protein, 18 aa, Staphylococcus aureus
FITTLIVILAFPPLTVAL

SEQ ID NO: 1595635 - protein, 18 aa, Staphylococcus aureus
FIVFVLSFFISIILYSSH

SEQ ID NO: 1595636 - protein, 29 aa, Staphylococcus aureus
FIVLKSSLFFYYLFTKLSLISVLVLHLKQ

SEQ ID NO: 1595637 - protein, 17 aa, Staphylococcus aureus
FIWTVPCYLCAIIAIIY

SEQ ID NO: 1595638 - protein, 29 aa, Staphylococcus aureus
FIYMLISLFIIITITFFLMKLIPGSPFND

SEQ ID NO: 1595639 - protein, 23 aa, Staphylococcus aureus
FIYPLAITLILLTLVSPLINHST

SEQ ID NO: 1595640 - protein, 22 aa, Staphylococcus aureus
FIYSTIWIIFNLYAVNILLKYT

SEQ ID NO: 1595641 - protein, 22 aa, Staphylococcus aureus
FKDKISYKYDNVASINFGDINK

SEQ ID NO: 1595642 - protein, 22 aa, Staphylococcus aureus
FKELWLPVLTICFILAISKITT

SEQ ID NO: 1595643 - protein, 18 aa, Staphylococcus aureus
FKFFVQYGNFKDLSKYKD

SEQ ID NO: 1595644 - protein, 22 aa, Staphylococcus aureus
FKKALLFAALFILIGFYDGFVG

SEQ ID NO: 1595645 - protein, 23 aa, Staphylococcus aureus
FKKTLIMIFIQVLIVLFMMNTTI

SEQ ID NO: 1595646 - protein, 19 aa, Staphylococcus aureus
FKNTWGYMNLGASVRPSTF

SEQ ID NO: 1595647 - protein, 18 aa, Staphylococcus aureus
FKNTWVYMNLGASVLPST

SEQ ID NO: 1595648 - protein, 25 aa, Staphylococcus aureus
FKRNYLFFVFLFLLGSIMGLLSFDL

SEQ ID NO: 1595649 - protein, 19 aa, Staphylococcus aureus
FKVTLLNEKGEVIGTTKTD

SEQ ID NO: 1595650 - protein, 31 aa, Staphylococcus aureus
FLDGNGRLGRILIILMLVNAGVIDKPVFLLV

SEQ ID NO: 1595651 - protein, 17 aa, Staphylococcus aureus
FLFFFKESEEIIPKSSN

SEQ ID NO: 1595652 - protein, 17 aa, Staphylococcus aureus
FLFGLLPGSLLGSFISR

SEQ ID NO: 1595653 - protein, 19 aa, Staphylococcus aureus
FLFHIVYICFFYFMDSYFL

SEQ ID NO: 1595654 - protein, 20 aa, Staphylococcus aureus
FLFKKLSWPVGPIVAAITIS

SEQ ID NO: 1595655 - protein, 24 aa, Staphylococcus aureus
FLFLFLVFSWIVSFIPGFELSVFS

SEQ ID NO: 1595656 - protein, 24 aa, Staphylococcus aureus
FLFLVLVILTLFTYKAPNGMRAMG

SEQ ID NO: 1595657 - protein, 17 aa, Staphylococcus aureus
FLGGLLSSLLLLIFGVF

SEQ ID NO: 1595658 - protein, 20 aa, Staphylococcus aureus
FLIVTSTLVFSSMPFQNAHA

SEQ ID NO: 1595659 - protein, 26 aa, Staphylococcus aureus
FLIVWFILFLLFWYLLQSVIMSIGGL

SEQ ID NO: 1595660 - protein, 20 aa, Staphylococcus aureus
FLKIWIVIGLVIIGTYAFFV

SEQ ID NO: 1595661 - protein, 20 aa, Staphylococcus aureus
FLKTKHEVEYFGTIFSFMGN

SEQ ID NO: 1595662 - protein, 25 aa, Staphylococcus aureus
FLLYVKLSCSTMMASSIILTNILPY

SEQ ID NO: 1595663 - protein, 18 aa, Staphylococcus aureus
FLNNFLRNGTHAGGILKM

SEQ ID NO: 1595664 - protein, 18 aa, Staphylococcus aureus
FLPEVWYIISSIVGYLLF

SEQ ID NO: 1595665 - protein, 26 aa, Staphylococcus aureus
FLRLYILTLMFFSVNAILNVFIPLRG

SEQ ID NO: 1595666 - protein, 27 aa, Staphylococcus aureus
FLSIFFPAIFYILFTSILDLPSDVKLR

SEQ ID NO: 1595667 - protein, 17 aa, Staphylococcus aureus
FLSLPPKDIFLASVLIG

SEQ ID NO: 1595668 - protein, 27 aa, Staphylococcus aureus
FLTSGFICLFLVLLILNSQFIKNQNNH

SEQ ID NO: 1595669 - protein, 18 aa, Staphylococcus aureus
FLVHCFLVYIIAYIGDLI

SEQ ID NO: 1595670 - protein, 17 aa, Staphylococcus aureus
FLWLMWSHQTFFTNRFG

SEQ ID NO: 1595671 - protein, 18 aa, Staphylococcus aureus
FLWPPFKLKNDPPKVVKY

SEQ ID NO: 1595672 - protein, 19 aa, Staphylococcus aureus
FMAAKFTVTGQVKAGDYFT

SEQ ID NO: 1595673 - protein, 19 aa, Staphylococcus aureus
FMILFILTVVAVIATWIIP

SEQ ID NO: 1595674 - protein, 18 aa, Staphylococcus aureus
FMILPIFNSMKAIPNNLL

SEQ ID NO: 1595675 - protein, 18 aa, Staphylococcus aureus
FMLGKYWIQLLIATVIIS

SEQ ID NO: 1595676 - protein, 31 aa, Staphylococcus aureus
FNDIYIYLIVLFAFFIFLLILNIIGMKRYRK

SEQ ID NO: 1595677 - protein, 27 aa, Staphylococcus aureus
FNIISTIMVSMLILSLGAFANNNKAKA

SEQ ID NO: 1595678 - protein, 17 aa, Staphylococcus aureus
FNILFIDFYYYIYNVHL

SEQ ID NO: 1595679 - protein, 22 aa, Staphylococcus aureus
FNIPLLLTIIIILLGSVLAIKV

SEQ ID NO: 1595680 - protein, 27 aa, Staphylococcus aureus
FNKESNKFTHIAYIKPMNGNQSNTVSV

SEQ ID NO: 1595681 - protein, 34 aa, Staphylococcus aureus
FNLIGVIIFTIFLPVVIHLISLLQDLWHLKPAMT

SEQ ID NO: 1595682 - protein, 17 aa, Staphylococcus aureus
FNLNIIDIIFLILLNIL

SEQ ID NO: 1595683 - protein, 17 aa, Staphylococcus aureus
FNMYIDEVKGHLLLELA

SEQ ID NO: 1595684 - protein, 27 aa, Staphylococcus aureus
FNPVFALWFLITLFFFHVILVIVRRFN

SEQ ID NO: 1595685 - protein, 24 aa, Staphylococcus aureus
FNTSPYMIIIFITAILLVILQIIY

SEQ ID NO: 1595686 - protein, 32 aa, Staphylococcus aureus
FNTTLIMLITAPFIPLFYIIFGLKTRDESKDQ

SEQ ID NO: 1595687 - protein, 23 aa, Staphylococcus aureus
FNYWLGIILMLFVSWFALFLFYK

SEQ ID NO: 1595688 - protein, 20 aa, Staphylococcus aureus
FPERRWVYILALSSSALCGL

SEQ ID NO: 1595689 - protein, 20 aa, Staphylococcus aureus
FPGINKWLIPIGTSPIKGIL

SEQ ID NO: 1595690 - protein, 17 aa, Staphylococcus aureus
FPLIFKFGAENSNVIMI

SEQ ID NO: 1595691 - protein, 35 aa, Staphylococcus aureus
FQLYVKLSCSTMMAISIILTNILPYDAQAASENDT

SEQ ID NO: 1595692 - protein, 43 aa, Staphylococcus aureus
FQRIQILTQVQIVVQILAAILIQIAVQIRVVILHQIVVQIQRA

SEQ ID NO: 1595693 - protein, 45 aa, Staphylococcus aureus
FQRIQILTQVQIVVQILAAILIQIAVQIRVVILHQIVVQIQRAIQ

SEQ ID NO: 1595694 - protein, 17 aa, Staphylococcus aureus
FQRYLIIIFLMISLFVI

SEQ ID NO: 1595695 - protein, 18 aa, Staphylococcus aureus
FQYAITKKQLYRTDLLFQ

SEQ ID NO: 1595696 - protein, 25 aa, Staphylococcus aureus
FQYKIFPVLMFLVSTGLGILVIAQN

SEQ ID NO: 1595697 - protein, 23 aa, Staphylococcus aureus
FQYKIFPVLMFLVSTGLGILVIT

SEQ ID NO: 1595698 - protein, 19 aa, Staphylococcus aureus
FRKHLFLGLLVSSLVFASL

SEQ ID NO: 1595699 - protein, 20 aa, Staphylococcus aureus
FRLVIEIVILELIIGAILTL

SEQ ID NO: 1595700 - protein, 22 aa, Staphylococcus aureus
FRLYVKLSCSTMMATSIILTNI

SEQ ID NO: 1595701 - protein, 22 aa, Staphylococcus aureus
FRNFIINVWNAIKTFMVTVWNV

SEQ ID NO: 1595702 - protein, 25 aa, Staphylococcus aureus
FRNKITWLQIISGFFFAFGALTYLI

SEQ ID NO: 1595703 - protein, 17 aa, Staphylococcus aureus
FRPRNIIQTLFIVSLIS

SEQ ID NO: 1595704 - protein, 20 aa, Staphylococcus aureus
FRVVLIPVFILFALVDFGFG

SEQ ID NO: 1595705 - protein, 18 aa, Staphylococcus aureus
FSDSLRVPFKDLLSAKHS

SEQ ID NO: 1595706 - protein, 18 aa, Staphylococcus aureus
FSFLIAITILIAIAIYAC

SEQ ID NO: 1595707 - protein, 20 aa, Staphylococcus aureus
FSFMSVFFRLAGDLPVFQKS

SEQ ID NO: 1595708 - protein, 23 aa, Staphylococcus aureus
FSIIALILCLFLQSNKKEKATAQ

SEQ ID NO: 1595709 - protein, 18 aa, Staphylococcus aureus
FSILIPIIASVVPVVFAL

SEQ ID NO: 1595710 - protein, 31 aa, Staphylococcus aureus
FSNLLMVCHPLLFMFFTKIFIQSWKQTHRYG

SEQ ID NO: 1595711 - protein, 32 aa, Staphylococcus aureus
FSNLLMVCHPLLFMFFTKIFIQSWRQTHCYGV

SEQ ID NO: 1595712 - protein, 17 aa, Staphylococcus aureus
FSQIIIAIILIIIILFD

SEQ ID NO: 1595713 - protein, 22 aa, Staphylococcus aureus
FSRMFIPNLFSLLASIIVLWLY

SEQ ID NO: 1595714 - protein, 17 aa, Staphylococcus aureus
FSWFAFLLIIQASTIIS

SEQ ID NO: 1595715 - protein, 27 aa, Staphylococcus aureus
FSYIYIFQFMILISLFGVYWIITENYI

SEQ ID NO: 1595716 - protein, 17 aa, Staphylococcus aureus
FTRIPITEFLFSTTWNP

SEQ ID NO: 1595717 - protein, 26 aa, Staphylococcus aureus
FTTGKYLFMMFGLPAAAFAIYKNARP

SEQ ID NO: 1595718 - protein, 18 aa, Staphylococcus aureus
FVAIAFIGSLPGTVVFEI

SEQ ID NO: 1595719 - protein, 18 aa, Staphylococcus aureus
FVALALYLVPGLGLIFAL

SEQ ID NO: 1595720 - protein, 21 aa, Staphylococcus aureus
FVGALYFLFITIKGVKEYDDN

SEQ ID NO: 1595721 - protein, 23 aa, Staphylococcus aureus
FVIELILILLYLKAGFNTLTGLI

SEQ ID NO: 1595722 - protein, 25 aa, Staphylococcus aureus
FVLAPDELFFTRDGLPIAKTRGLQN

SEQ ID NO: 1595723 - protein, 31 aa, Staphylococcus aureus
FVLGSNPVGWVILAGLAMSTVFALGTDLIYQ

SEQ ID NO: 1595724 - protein, 22 aa, Staphylococcus aureus
FVNIIYFQGMFYTQIFGIPVFL

SEQ ID NO: 1595725 - protein, 21 aa, Staphylococcus aureus
FVNLWLNMYAYSLYLFFDFAG

SEQ ID NO: 1595726 - protein, 18 aa, Staphylococcus aureus
FVPVIIALILSLFEFGTS

SEQ ID NO: 1595727 - protein, 18 aa, Staphylococcus aureus
FVVIWTALVYSPVAHWVW

SEQ ID NO: 1595728 - protein, 26 aa, Staphylococcus aureus
FVVLELILAILYFKLGFHYIVSVISG

SEQ ID NO: 1595729 - protein, 18 aa, Staphylococcus aureus
FVVYVTISILFLYIINRV

SEQ ID NO: 1595730 - protein, 20 aa, Staphylococcus aureus
FVYGFILRLLGPLGLHHIFY

SEQ ID NO: 1595731 - protein, 21 aa, Staphylococcus aureus
FVYVLPLISILGGITTALIIF

SEQ ID NO: 1595732 - protein, 17 aa, Staphylococcus aureus
FWFGLLYLSILASFLAW

SEQ ID NO: 1595733 - protein, 21 aa, Staphylococcus aureus
FWGIKYGLFIQSVIDFIIIAF

SEQ ID NO: 1595734 - protein, 20 aa, Staphylococcus aureus
FYFIILSILLALMALIGSVL

SEQ ID NO: 1595735 - protein, 20 aa, Staphylococcus aureus
FYLIGVCACLLYLSILLCVF

SEQ ID NO: 1595736 - protein, 34 aa, Staphylococcus aureus
FYTQIFGIPVFLFLNLIIILLCIIVGSVLAYKIN

SEQ ID NO: 1595737 - protein, 24 aa, Staphylococcus aureus
GAAKVGYGTFVKNGADGVTNQVGQ

SEQ ID NO: 1595738 - protein, 23 aa, Staphylococcus aureus
GAASVFLGTMIVVGMGQDKEAAA

SEQ ID NO: 1595739 - protein, 24 aa, Staphylococcus aureus
GAGKSLMKLGFKGGEKFAVKTGLQ

SEQ ID NO: 1595740 - protein, 19 aa, Staphylococcus aureus
GAIFMVVIMILVTWNDIRR

SEQ ID NO: 1595741 - protein, 25 aa, Staphylococcus aureus
GAIGWLILEYIFKKTTSLLGLLLGA

SEQ ID NO: 1595742 - protein, 25 aa, Staphylococcus aureus
GAIGWLILEYILKKTTSLLGLLLGA

SEQ ID NO: 1595743 - protein, 22 aa, Staphylococcus aureus
GAINGWILPITLGAILIASKKK

SEQ ID NO: 1595744 - protein, 34 aa, Staphylococcus aureus
GAINIILGIIKVFSSLFTGNWRGVWDGIVMILKG

SEQ ID NO: 1595745 - protein, 17 aa, Staphylococcus aureus
GAKNLYDVYISKGLDTP

SEQ ID NO: 1595746 - protein, 29 aa, Staphylococcus aureus
GALEYNDKIDFNKDFTITVPVANNNQGNT

SEQ ID NO: 1595747 - protein, 17 aa, Staphylococcus aureus
GAPWFGAIIQLIIAIIM

SEQ ID NO: 1595748 - protein, 19 aa, Staphylococcus aureus
GASLFLRLGARIFKTGIAI

SEQ ID NO: 1595749 - protein, 39 aa, Staphylococcus aureus
GCLIDSFFNYLFGYSRYLTYILVLLATGFITYSKRIPKT

SEQ ID NO: 1595750 - protein, 18 aa, Staphylococcus aureus
GCLIVFVYLFLGSASIFT

SEQ ID NO: 1595751 - protein, 17 aa, Staphylococcus aureus
GDGLVNIFTQLMPLFKF

SEQ ID NO: 1595752 - protein, 22 aa, Staphylococcus aureus
GDKPVATMWESKGKITYLKGEA

SEQ ID NO: 1595753 - protein, 23 aa, Staphylococcus aureus
GDNVIAPVLTGNLKPNTDSNALI

SEQ ID NO: 1595754 - protein, 27 aa, Staphylococcus aureus
GDQSSEVYSPISPIKIATQDNSGNAVT

SEQ ID NO: 1595755 - protein, 33 aa, Staphylococcus aureus
GDSLIPYALVFIGLIIFISVVILIMSLFTLKEM

SEQ ID NO: 1595756 - protein, 31 aa, Staphylococcus aureus
GEANTSLIWGLLASLGSLLLFRRKKENKDKK

SEQ ID NO: 1595757 - protein, 18 aa, Staphylococcus aureus
GEDNLVTSMLFVSSIVIG

SEQ ID NO: 1595758 - protein, 29 aa, Staphylococcus aureus
GESLDKVKHTPFFLPKRRRKEEEEDVEVT

SEQ ID NO: 1595759 - protein, 17 aa, Staphylococcus aureus
GETKVIPGKDGLKDPET

SEQ ID NO: 1595760 - protein, 27 aa, Staphylococcus aureus
GETMATWLAIIFIVAALILGLIGGFLL

SEQ ID NO: 1595761 - protein, 22 aa, Staphylococcus aureus
GFAVLFTYLFGDQSPFTYALSA

SEQ ID NO: 1595762 - protein, 54 aa, Staphylococcus aureus
GFIDYFLLGILPNKTQWWLVIPVGLVYAVIYYFVFRFLIVKLKYKTPGREDKQS

SEQ ID NO: 1595763 - protein, 29 aa, Staphylococcus aureus
GFILAFTSLFLVIWFPASPFIIIFSAMML

SEQ ID NO: 1595764 - protein, 18 aa, Staphylococcus aureus
GFILLIIFSPRGPIGQFF

SEQ ID NO: 1595765 - protein, 17 aa, Staphylococcus aureus
GFISLSLLCLCLFFSKL

SEQ ID NO: 1595766 - protein, 23 aa, Staphylococcus aureus
GFKRSIVIFGGIAAAIGPVVFGL

SEQ ID NO: 1595767 - protein, 25 aa, Staphylococcus aureus
GFMGFITFVLLIVQQWLFFNPNHNL

SEQ ID NO: 1595768 - protein, 24 aa, Staphylococcus aureus
GFPTINWLGFYPTYEPLIAQAAYI

SEQ ID NO: 1595769 - protein, 24 aa, Staphylococcus aureus
GFQFSFIYFIFYYVTFSFFTAIVE

SEQ ID NO: 1595770 - protein, 26 aa, Staphylococcus aureus
GFSSNFTMPFAFLSPLSASVLNFALL

SEQ ID NO: 1595771 - protein, 29 aa, Staphylococcus aureus
GFTMSFLNAIFIALPIFLASQIFNNVVSH

SEQ ID NO: 1595772 - protein, 22 aa, Staphylococcus aureus
GFTTFAMQDGFMKGLFGIETTG

SEQ ID NO: 1595773 - protein, 27 aa, Staphylococcus aureus
GFVAVILTVCLIGLLILATNEDALAKV

SEQ ID NO: 1595774 - protein, 27 aa, Staphylococcus aureus
GFVGMELFRLLQNHPFFRVTFISSESM

SEQ ID NO: 1595775 - protein, 17 aa, Staphylococcus aureus
GFVMILFAFKTQFGHAS

SEQ ID NO: 1595776 - protein, 17 aa, Staphylococcus aureus
GFYVKPTLNRLNGGFFG

SEQ ID NO: 1595777 - protein, 25 aa, Staphylococcus aureus
GGGKTYFLFYMIRELFKRDAEVRLL

SEQ ID NO: 1595778 - protein, 25 aa, Staphylococcus aureus
GGGKTYFLFYMIRELFKRNAEVRLL

SEQ ID NO: 1595779 - protein, 29 aa, Staphylococcus aureus
GGGVLGFYLLELSVPLISLFGVCIITILL

SEQ ID NO: 1595780 - protein, 35 aa, Staphylococcus aureus
GGIFAFLRTKIASLVKLFPILGMSISSLTLPITLI

SEQ ID NO: 1595781 - protein, 41 aa, Staphylococcus aureus
GGIVPEILITKLIILTLFGMGFFVVGLILKPVTDPLMKRVS

SEQ ID NO: 1595782 - protein, 23 aa, Staphylococcus aureus
GGSLWIIVYLIVLSILSFIGSKE

SEQ ID NO: 1595783 - protein, 17 aa, Staphylococcus aureus
GGTFGIYPKADASTQKS

SEQ ID NO: 1595784 - protein, 30 aa, Staphylococcus aureus
GGTKPKIMTAIVLWLFGSIASILGLCLSLK

SEQ ID NO: 1595785 - protein, 17 aa, Staphylococcus aureus
GHKKKLDEDDDIDPLHM

SEQ ID NO: 1595786 - protein, 18 aa, Staphylococcus aureus
GIAMFTLIITISVSVIFL

SEQ ID NO: 1595787 - protein, 18 aa, Staphylococcus aureus
GIANIKALPSGDYILKEI

SEQ ID NO: 1595788 - protein, 23 aa, Staphylococcus aureus
GICAGVWIVLKKLPGIDDPMVKN

SEQ ID NO: 1595789 - protein, 17 aa, Staphylococcus aureus
GIDFLAVMGFASAISVI

SEQ ID NO: 1595790 - protein, 20 aa, Staphylococcus aureus
GIDFLAVMGFASAISVIFAV

SEQ ID NO: 1595791 - protein, 21 aa, Staphylococcus aureus
GIDFLAVMGFASAISVIFAVF

SEQ ID NO: 1595792 - protein, 23 aa, Staphylococcus aureus
GIFAIIIFVFFTISILIQKWQRA

SEQ ID NO: 1595793 - protein, 26 aa, Staphylococcus aureus
GIFSRRFWPSFTFLIPIIIGVLLAMG

SEQ ID NO: 1595794 - protein, 21 aa, Staphylococcus aureus
GIGGAVAAVLVTRKDSRDKLK

SEQ ID NO: 1595795 - protein, 41 aa, Staphylococcus aureus
GIGLTAFSFISNNVLFGIIFAVLTLVFVIGIIMSKSKEVDY

SEQ ID NO: 1595796 - protein, 27 aa, Staphylococcus aureus
GIIAAIAFLILCIGIVAVLNSVKKNLN

SEQ ID NO: 1595797 - protein, 22 aa, Staphylococcus aureus
GIIFTIPVLFITLIGLYLTLII

SEQ ID NO: 1595798 - protein, 41 aa, Staphylococcus aureus
GIIGRLIDSFFNYLFGYSRYLTYILVLLATGFITYSKRIPK

SEQ ID NO: 1595799 - protein, 23 aa, Staphylococcus aureus
GIIGSIVSDYLYQNNYFGIKDKV

SEQ ID NO: 1595800 - protein, 22 aa, Staphylococcus aureus
GIILIMILILFLSLKRQPETLD

SEQ ID NO: 1595801 - protein, 20 aa, Staphylococcus aureus
GIIVAFVVLLITFGSVIAAG

SEQ ID NO: 1595802 - protein, 24 aa, Staphylococcus aureus
GIIVAFVVLLITFGSVIAAGLPII

SEQ ID NO: 1595803 - protein, 17 aa, Staphylococcus aureus
GIKKYFLGGLLSSVLLL

SEQ ID NO: 1595804 - protein, 25 aa, Staphylococcus aureus
GILGGAFWALMAPVVAISSVLTNVF

SEQ ID NO: 1595805 - protein, 17 aa, Staphylococcus aureus
GILIFYVRLIKKSSLNI

SEQ ID NO: 1595806 - protein, 25 aa, Staphylococcus aureus
GILIHWILFFLMILFVLVVLSTPTY

SEQ ID NO: 1595807 - protein, 17 aa, Staphylococcus aureus
GIPVAFLTSIFGIIALD

SEQ ID NO: 1595808 - protein, 18 aa, Staphylococcus aureus
GIRMFKRYATITTSARIL

SEQ ID NO: 1595809 - protein, 19 aa, Staphylococcus aureus
GIRMFKRYAVITTSAKILG

SEQ ID NO: 1595810 - protein, 19 aa, Staphylococcus aureus
GIRMFKRYAVITTSAQILG

SEQ ID NO: 1595811 - protein, 26 aa, Staphylococcus aureus
GISAMQYFVRRYGWGGFKRAGDYAYA

SEQ ID NO: 1595812 - protein, 34 aa, Staphylococcus aureus
GISFDPFTPLIVAAALYFVLTFVLTRIMNMIEGR

SEQ ID NO: 1595813 - protein, 19 aa, Staphylococcus aureus
GISIFFLGTLLGGLSPHFA

SEQ ID NO: 1595814 - protein, 20 aa, Staphylococcus aureus
GISLDQVLASYLKTANIAKY

SEQ ID NO: 1595815 - protein, 27 aa, Staphylococcus aureus
GISLIAIMLIVCIVLVIMMMTGGKKDT

SEQ ID NO: 1595816 - protein, 22 aa, Staphylococcus aureus
GITLLIVMAVVLVLLVIFGFIS

SEQ ID NO: 1595817 - protein, 26 aa, Staphylococcus aureus
GITSMLFIFLLIISIGTFILFVVLEM

SEQ ID NO: 1595818 - protein, 24 aa, Staphylococcus aureus
GIVLGVITFWLFAQSLVNVVPNLQ

SEQ ID NO: 1595819 - protein, 47 aa, Staphylococcus aureus
GIVMILKGTVQLIWNLIQLWFVGKILGVVRYFGGLLKGLISGIWGVV

SEQ ID NO: 1595820 - protein, 36 aa, Staphylococcus aureus
GIVTLTQNAYSQKGAITLGTRIDSNKSFHFSGKVNL

SEQ ID NO: 1595821 - protein, 25 aa, Staphylococcus aureus
GKDIFNVVIIMIILVLGRFITAYLK

SEQ ID NO: 1595822 - protein, 21 aa, Staphylococcus aureus
GKILEDGKIRYTFTNDVEHKV

SEQ ID NO: 1595823 - protein, 25 aa, Staphylococcus aureus
GKKQSLVFYHLKLDEKFASILGLTK

SEQ ID NO: 1595824 - protein, 23 aa, Staphylococcus aureus
GKLLKYILEAFGIDFNSLTKGMG

SEQ ID NO: 1595825 - protein, 26 aa, Staphylococcus aureus
GKMTFFFIITIIILIALVYFFINDAQ

SEQ ID NO: 1595826 - protein, 19 aa, Staphylococcus aureus
GKNIPFMLGLFSGGLIFSI

SEQ ID NO: 1595827 - protein, 26 aa, Staphylococcus aureus
GKPKTIVFYHLKLDKSYAPIFGLSEK

SEQ ID NO: 1595828 - protein, 23 aa, Staphylococcus aureus
GKTYKGIMPNWEPGKKVHLVGHS

SEQ ID NO: 1595829 - protein, 18 aa, Staphylococcus aureus
GKYLVVVMLLFLIQILLG

SEQ ID NO: 1595830 - protein, 18 aa, Staphylococcus aureus
GLDDIRNTHVWEVDAQPA

SEQ ID NO: 1595831 - protein, 17 aa, Staphylococcus aureus
GLDLLNPSYFLISAFFI

SEQ ID NO: 1595832 - protein, 19 aa, Staphylococcus aureus
GLFLTILKMLIHILKPIKI

SEQ ID NO: 1595833 - protein, 21 aa, Staphylococcus aureus
GLGILLAYMIFGKGTAKTTSY

SEQ ID NO: 1595834 - protein, 25 aa, Staphylococcus aureus
GLGIVLFVSMIYWGIHYMNFKKEQT

SEQ ID NO: 1595835 - protein, 29 aa, Staphylococcus aureus
GLGTILCVLVLSVILLFSIPTPVAVILMG

SEQ ID NO: 1595836 - protein, 19 aa, Staphylococcus aureus
GLHQGDYFDFTLSNNVNTH

SEQ ID NO: 1595837 - protein, 27 aa, Staphylococcus aureus
GLIISVLGAWLGWTLLAGELPFIVAKD

SEQ ID NO: 1595838 - protein, 17 aa, Staphylococcus aureus
GLILLRLFKINLFSFKK

SEQ ID NO: 1595839 - protein, 22 aa, Staphylococcus aureus
GLIMIILFALFAPAVSQHNSTE

SEQ ID NO: 1595840 - protein, 18 aa, Staphylococcus aureus
GLIPFLIIIVLHSKFRFN

SEQ ID NO: 1595841 - protein, 23 aa, Staphylococcus aureus
GLISIIIPLLSLSNIFILGGVII

SEQ ID NO: 1595842 - protein, 74 aa, Staphylococcus aureus
GLIVGLIAMKKFHVLAGYRAKFILMVILTMMVFVLINTYLLRQVKSIGMFLMIAALGLYFVAMNNLKAAGQGVT

SEQ ID NO: 1595843 - protein, 17 aa, Staphylococcus aureus
GLKFKIMFNFGLPLVIV

SEQ ID NO: 1595844 - protein, 27 aa, Staphylococcus aureus
GLLAVYLIIVIFSLLNYWSVKLLTSFT

SEQ ID NO: 1595845 - protein, 18 aa, Staphylococcus aureus
GLLFKYKRQRPHPFLGRQ

SEQ ID NO: 1595846 - protein, 17 aa, Staphylococcus aureus
GLLLLLNNVLTYSLAIL

SEQ ID NO: 1595847 - protein, 24 aa, Staphylococcus aureus
GLNFKQLIGYVFAPIAFLMGIPWS

SEQ ID NO: 1595848 - protein, 18 aa, Staphylococcus aureus
GLQSILSLILNSIAILIA

SEQ ID NO: 1595849 - protein, 26 aa, Staphylococcus aureus
GLSFIGIISLFLWGLGYFGQPHIIVR

SEQ ID NO: 1595850 - protein, 79 aa, Staphylococcus aureus
GLVEGLIVGLIAMNKFHVLAGYRAKFILMVILTMMVFVLINTYLLRQVKSIGMFLMIAALGLYFVAMNNLKAAGQGVTN

SEQ ID NO: 1595851 - protein, 27 aa, Staphylococcus aureus
GLVNIFTQLMPLFKFVSQGLQNLSIAF

SEQ ID NO: 1595852 - protein, 20 aa, Staphylococcus aureus
GLYICMYAIFAITAYNHSKR

SEQ ID NO: 1595853 - protein, 17 aa, Staphylococcus aureus
GMNVPLPIDDHSYISWI

SEQ ID NO: 1595854 - protein, 23 aa, Staphylococcus aureus
GNGLKMFVFIMLLGAIVAAFFAN

SEQ ID NO: 1595855 - protein, 26 aa, Staphylococcus aureus
GNGQDFLNQGGILRDKGMANASGFKI

SEQ ID NO: 1595856 - protein, 22 aa, Staphylococcus aureus
GNLLLELAVIFGVSSLVTAFLK

SEQ ID NO: 1595857 - protein, 17 aa, Staphylococcus aureus
GNLRQAVADKEQVKRTE

SEQ ID NO: 1595858 - protein, 28 aa, Staphylococcus aureus
GNTTGADGWGFMFTQGNGQDFLNQGGIL

SEQ ID NO: 1595859 - protein, 20 aa, Staphylococcus aureus
GNVTLHYRDGSSTTLDATNV

SEQ ID NO: 1595860 - protein, 25 aa, Staphylococcus aureus
GNYETGLLFIAFQKATKQFIDIQNN

SEQ ID NO: 1595861 - protein, 24 aa, Staphylococcus aureus
GPIKVLRFILIINAIALIIYGFTG

SEQ ID NO: 1595862 - protein, 28 aa, Staphylococcus aureus
GPLGLHHIFYLPFWQTALGGTLEVKGHL

SEQ ID NO: 1595863 - protein, 23 aa, Staphylococcus aureus
GPSILLTYIIIGFMLFMFMRGLG

SEQ ID NO: 1595864 - protein, 17 aa, Staphylococcus aureus
GQIFMQVLGVLVIGIIT

SEQ ID NO: 1595865 - protein, 32 aa, Staphylococcus aureus
GRIDTLNKVDGKFSHFAYMKPNNQSLSSVTVT

SEQ ID NO: 1595866 - protein, 23 aa, Staphylococcus aureus
GRIRYTFTDYIKDKVNVTANLEI

SEQ ID NO: 1595867 - protein, 23 aa, Staphylococcus aureus
GRSLMLPVAILPAAAIIAGIGNT

SEQ ID NO: 1595868 - protein, 25 aa, Staphylococcus aureus
GRYGWKTFLYFEIITTIAIGLGIIF

SEQ ID NO: 1595869 - protein, 34 aa, Staphylococcus aureus; identical to SEQ ID NO: 1582798

SEQ ID NO: 1595870 - protein, 26 aa, Staphylococcus aureus
GSIFTGIVWCLLLSGSYALIRFLSNA

SEQ ID NO: 1595871 - protein, 24 aa, Staphylococcus aureus
GSIGWLILEYIFKKTTSLLGLLLG

SEQ ID NO: 1595872 - protein, 20 aa, Staphylococcus aureus
GSKESQLTEVLFAEKPVAKN

SEQ ID NO: 1595873 - protein, 22 aa, Staphylococcus aureus
GSKILLFIIMSIAIIQHLLQIA

SEQ ID NO: 1595874 - protein, 27 aa, Staphylococcus aureus
GSMSNSIRHFTSLSTSGLMSLSDSNSM

SEQ ID NO: 1595875 - protein, 21 aa, Staphylococcus aureus
GSVFLPFLISGFLFYICLPFQ

SEQ ID NO: 1595876 - protein, 24 aa, Staphylococcus aureus
GSVFLPFLISGFLFYICLPFQNSL

SEQ ID NO: 1595877 - protein, 22 aa, Staphylococcus aureus
GSVFLPFLISGFLFYICLPFRN

SEQ ID NO: 1595878 - protein, 24 aa, Staphylococcus aureus
GSVLADEIKYPLAKFNQPEAKDKT

SEQ ID NO: 1595879 - protein, 30 aa, Staphylococcus aureus
GTAISLLITVILGFFIARTITKPITDMRNQ

SEQ ID NO: 1595880 - protein, 20 aa, Staphylococcus aureus
GTALAFYFFIDSLQYISAKE

SEQ ID NO: 1595881 - protein, 22 aa, Staphylococcus aureus
GTALAFYFFIDSLQYISAKETT

SEQ ID NO: 1595882 - protein, 25 aa, Staphylococcus aureus
GTASILVGTTLIFGLSGHEAKAAEH

SEQ ID NO: 1595883 - protein, 23 aa, Staphylococcus aureus
GTFEDWWQMYLDEVKGNLLLELA

SEQ ID NO: 1595884 - protein, 25 aa, Staphylococcus aureus
GTFMIAVFILNFKLIFTLPLTILNR

SEQ ID NO: 1595885 - protein, 27 aa, Staphylococcus aureus
GTKPKIMAAIVLWLFGSIASIVGLCLS

SEQ ID NO: 1595886 - protein, 25 aa, Staphylococcus aureus
GTLTAFNTNFNPNTGTKGALEYNDK

SEQ ID NO: 1595887 - protein, 27 aa, Staphylococcus aureus
GTPMLVQVFIVFFGITAALGLDISTLV

SEQ ID NO: 1595888 - protein, 24 aa, Staphylococcus aureus
GTQKVKPTIYFKLYKQDDNQNTTP

SEQ ID NO: 1595889 - protein, 21 aa, Staphylococcus aureus
GTRIRPILMTAIATIGALVPL

SEQ ID NO: 1595890 - protein, 26 aa, Staphylococcus aureus
GTSAAYFYSIYEMIRWLNGSTTQPHL

SEQ ID NO: 1595891 - protein, 18 aa, Staphylococcus aureus
GTTLIFGIGSQEAKAAEV

SEQ ID NO: 1595892 - protein, 18 aa, Staphylococcus aureus
GTTLIFGLGNQEAKAAES

SEQ ID NO: 1595893 - protein, 23 aa, Staphylococcus aureus
GVASVIVSTLFLITSQHQAQAAE

SEQ ID NO: 1595894 - protein, 19 aa, Staphylococcus aureus
GVASVIVSTVFLITSQHQA

SEQ ID NO: 1595895 - protein, 19 aa, Staphylococcus aureus
GVFPMFVWLPSAYYAPPIP

SEQ ID NO: 1595896 - protein, 30 aa, Staphylococcus aureus
GVGSYFIAFALFFFAFTAILSYYYITETNV

SEQ ID NO: 1595897 - protein, 19 aa, Staphylococcus aureus
GVIDSFGNVIYTFTDYVNT

SEQ ID NO: 1595898 - protein, 24 aa, Staphylococcus aureus
GVIHIWTIVIIIDLIICISYFVWP

SEQ ID NO: 1595899 - protein, 20 aa, Staphylococcus aureus
GVKLFYPLPFNVKTPIQFKT

SEQ ID NO: 1595900 - protein, 26 aa, Staphylococcus aureus
GVLFIFLFLLGYFLPIGIDKVKNLSY

SEQ ID NO: 1595901 - protein, 18 aa, Staphylococcus aureus
GVLILFGGGLALAKGISE

SEQ ID NO: 1595902 - protein, 25 aa, Staphylococcus aureus
GVMTQGWWFPVMASAFLIFTIIIMF

SEQ ID NO: 1595903 - protein, 24 aa, Staphylococcus aureus
GVNLILLLILAIIFFIVLKIFKYV

SEQ ID NO: 1595904 - protein, 28 aa, Staphylococcus aureus
GVPEEKVLLMLLLYRFAYYFVPVIIALI

SEQ ID NO: 1595905 - protein, 25 aa, Staphylococcus aureus
GVSLFFNVIILLLLFIFSIFIKDVM

SEQ ID NO: 1595906 - protein, 18 aa, Staphylococcus aureus
GVTSTAKVPPIMAGDQVL

SEQ ID NO: 1595907 - protein, 19 aa, Staphylococcus aureus
GVVGWLTELWGKIQSTLQP

SEQ ID NO: 1595908 - protein, 28 aa, Staphylococcus aureus
GWIGFTIIFGAFALFWFVGIHGPSIVEP

SEQ ID NO: 1595909 - protein, 35 aa, Staphylococcus aureus
GWRFAWQFWGILILLLFIPIVWLFTYNKPEELKLL

SEQ ID NO: 1595910 - protein, 25 aa, Staphylococcus aureus
GYHAGFLFALLITVVSFFCSFMLQG

SEQ ID NO: 1595911 - protein, 17 aa, Staphylococcus aureus
HAIADKTNTLASSKYVN

SEQ ID NO: 1595912 - protein, 29 aa, Staphylococcus aureus
HAKSPKFLVRFWTLASGTILGLALMMLLI

SEQ ID NO: 1595913 - protein, 22 aa, Staphylococcus aureus
HEEFLKRRFPNNNVPVNFNLDT

SEQ ID NO: 1595914 - protein, 22 aa, Staphylococcus aureus
HEFMLIVFVSILMIIGGTLCGI

SEQ ID NO: 1595915 - protein, 18 aa, Staphylococcus aureus
HFFILIFGRLVQGVGSAA

SEQ ID NO: 1595916 - protein, 26 aa, Staphylococcus aureus
HGVILKWFMMLPLADIDLAWLVPFIL

SEQ ID NO: 1595917 - protein, 39 aa, Staphylococcus aureus
HHIYHFEKIYKAIKHVIVFIFMIFIAIVAIAVIAMSLYF

SEQ ID NO: 1595918 - protein, 17 aa, Staphylococcus aureus
HIFLMFFVTAISLYAIL

SEQ ID NO: 1595919 - protein, 20 aa, Staphylococcus aureus
HILLLILIMLICALNGYYPT

SEQ ID NO: 1595920 - protein, 27 aa, Staphylococcus aureus
HIMIISSLIIFGIALIICLFRLIKGPT

SEQ ID NO: 1595921 - protein, 24 aa, Staphylococcus aureus
HITKRFYEGFSAIFNLMTVVGMNV

SEQ ID NO: 1595922 - protein, 32 aa, Staphylococcus aureus
HKKQYMLFAAGIVLATILLISAHLYSRKRGNQ

SEQ ID NO: 1595923 - protein, 67 aa, Staphylococcus aureus
HKLIKLIISTVLSLPLLMLMFVHLFNMHIPALFTNPWFQFILATPVQFIIGWQFYVGAYKNLRNGGA

SEQ ID NO: 1595924 - protein, 23 aa, Staphylococcus aureus
HLDGQFHGQRLNDVVLNYDAATS

SEQ ID NO: 1595925 - protein, 32 aa, Staphylococcus aureus
HLTIAIGIALFIFVIVRPPIEFICQYLAQWTS

SEQ ID NO: 1595926 - protein, 19 aa, Staphylococcus aureus
HLYILVMPVLIAVIGFFGI

SEQ ID NO: 1595927 - protein, 17 aa, Staphylococcus aureus
HLYTFIVMILSPLTLTY

SEQ ID NO: 1595928 - protein, 23 aa, Staphylococcus aureus
HMLYIIFGFLLMYGLDYLYDTFA

SEQ ID NO: 1595929 - protein, 18 aa, Staphylococcus aureus
HMRHFSNNFGNVIKNAIG

SEQ ID NO: 1595930 - protein, 19 aa, Staphylococcus aureus
HMVLRLFMLLMLISGFWIL

SEQ ID NO: 1595931 - protein, 32 aa, Staphylococcus aureus
HNAADAVYKAQLYLSPYGPKQYVEHLNQNTDN

SEQ ID NO: 1595932 - protein, 32 aa, Staphylococcus aureus
HNASDVVYKAQLYLTPYGPKQYVEHLNQNTGN

SEQ ID NO: 1595933 - protein, 22 aa, Staphylococcus aureus
HNIFALIFDWLVILGSACISIY

SEQ ID NO: 1595934 - protein, 29 aa, Staphylococcus aureus
HNLIITLIGGIFVWIGWYGFNVGSAFTFD

SEQ ID NO: 1595935 - protein, 21 aa, Staphylococcus aureus
HPFFEYARSFDFIIVSDIGLI

SEQ ID NO: 1595936 - protein, 23 aa, Staphylococcus aureus
HPPMIVHYFFDLMVMMGILCFVI

SEQ ID NO: 1595937 - protein, 22 aa, Staphylococcus aureus
HPSFYPSFIALLIINLAVLVWR

SEQ ID NO: 1595938 - protein, 18 aa, Staphylococcus aureus
HQFFFFIGIILVIVGIFY

SEQ ID NO: 1595939 - protein, 20 aa, Staphylococcus aureus
HQHLMLAKSLGAKVKVVYSQ

SEQ ID NO: 1595940 - protein, 19 aa, Staphylococcus aureus
HQIIVYLPDTYKTTPELSF

SEQ ID NO: 1595941 - protein, 31 aa, Staphylococcus aureus
HRDDIITEQDILAHINLIDQLSAEVIDTPST

SEQ ID NO: 1595942 - protein, 31 aa, Staphylococcus aureus
HRDDIITEQDILAHINLIDQLTAEVIDTPST

SEQ ID NO: 1595943 - protein, 31 aa, Staphylococcus aureus
HRDDIITEQDVLAHINLIDQLTAEVIDTPST

SEQ ID NO: 1595944 - protein, 26 aa, Staphylococcus aureus
HRVLPGRFYVITLYRIIKLIIIFLIE

SEQ ID NO: 1595945 - protein, 29 aa, Staphylococcus aureus
HSGIKNTTITTLPNGWISNLTKSDNKNGS

SEQ ID NO: 1595946 - protein, 18 aa, Staphylococcus aureus
HSPLTYLWVFALILFFMR

SEQ ID NO: 1595947 - protein, 47 aa, Staphylococcus aureus
HTYQNEPLPNRKDFVVSFITGALVGSALGLYFKNKVYQKADDLKVKE

SEQ ID NO: 1595948 - protein, 22 aa, Staphylococcus aureus
HTYVWWFMFAVYVSNSLFTLIN

SEQ ID NO: 1595949 - protein, 18 aa, Staphylococcus aureus
HVFLISFVAIFVGTALPL

SEQ ID NO: 1595950 - protein, 17 aa, Staphylococcus aureus
HVVAPIAAVTFLIGFKT

SEQ ID NO: 1595951 - protein, 18 aa, Staphylococcus aureus
HYEMRWNGRHRDPLPWLR

SEQ ID NO: 1595952 - protein, 18 aa, Staphylococcus aureus
HYFVGMTISFTVAITVTL

SEQ ID NO: 1595953 - protein, 26 aa, Staphylococcus aureus
IAALAGMVVLSCINPVAGAVAIGAYS

SEQ ID NO: 1595954 - protein, 21 aa, Staphylococcus aureus
IAALVTVVPPLFFGGSWDTWV

SEQ ID NO: 1595955 - protein, 30 aa, Staphylococcus aureus
IADEMFNNQITYNYSSPIAGIDKPNGANIS

SEQ ID NO: 1595956 - protein, 17 aa, Staphylococcus aureus
IADMLLAIPSFIIALVI

SEQ ID NO: 1595957 - protein, 18 aa, Staphylococcus aureus
IAFLLRPIGGVVFGIIGD

SEQ ID NO: 1595958 - protein, 23 aa, Staphylococcus aureus
IAFNILNWLFWEILDNYISIVSS

SEQ ID NO: 1595959 - protein, 21 aa, Staphylococcus aureus
IAIIGLFVLGQRTASALLPYV

SEQ ID NO: 1595960 - protein, 23 aa, Staphylococcus aureus
IAIIGLFVLGQRTASALLPYVMA

SEQ ID NO: 1595961 - protein, 25 aa, Staphylococcus aureus
IAIIVVLFITLFYKELFILSFDEEY

SEQ ID NO: 1595962 - protein, 20 aa, Staphylococcus aureus
IAIKTFLHLINKIKLIPFAI

SEQ ID NO: 1595963 - protein, 21 aa, Staphylococcus aureus
IAILGLFVLGQRTASALLPNV

SEQ ID NO: 1595964 - protein, 29 aa, Staphylococcus aureus
IAIYVCRFVWVYFWYKDFYFPKNIQSYLD

SEQ ID NO: 1595965 - protein, 20 aa, Staphylococcus aureus
IAKYFAILPAMFMAAMPAMN

SEQ ID NO: 1595966 - protein, 25 aa, Staphylococcus aureus
IALGIIVLYVFLGLAAPLVTFYDPN

SEQ ID NO: 1595967 - protein, 30 aa, Staphylococcus aureus
IALHFSWYYLLLVLVILFVCVYILFSRYAS

SEQ ID NO: 1595968 - protein, 17 aa, Staphylococcus aureus
IALLAWPMSVSTGRNDG

SEQ ID NO: 1595969 - protein, 24 aa, Staphylococcus aureus
IALMLKWWLLLVISIIVLIIITVA

SEQ ID NO: 1595970 - protein, 29 aa, Staphylococcus aureus
IALTTYIYLTLVAFNFISGILTLPGLAAL

SEQ ID NO: 1595971 - protein, 17 aa, Staphylococcus aureus
IAMLSVIFLLIITIVSI

SEQ ID NO: 1595972 - protein, 25 aa, Staphylococcus aureus
IANIFIPLIPAFIGAGLIGGIAAVL

SEQ ID NO: 1595973 - protein, 29 aa, Staphylococcus aureus
IANTILRWLSIFVIPLFGIIISKLVDRNN

SEQ ID NO: 1595974 - protein, 25 aa, Staphylococcus aureus
IAQQLEQFKAQLKAANPFAKELENR

SEQ ID NO: 1595975 - protein, 18 aa, Staphylococcus aureus
IASLFIPFGASIGLNTMA

SEQ ID NO: 1595976 - protein, 22 aa, Staphylococcus aureus
IAVITYFKLWKYLYKEWFTSVD

SEQ ID NO: 1595977 - protein, 19 aa, Staphylococcus aureus
IAWSLLYSVVVLILLVFAN

SEQ ID NO: 1595978 - protein, 19 aa, Staphylococcus aureus
IAYFLPMINWFIPKKYAKI

SEQ ID NO: 1595979 - protein, 23 aa, Staphylococcus aureus
IAYFLPMINWFIPKKYVKISREE

SEQ ID NO: 1595980 - protein, 26 aa, Staphylococcus aureus
IAYIILAFFFFVFILLFFSDETRTAI

SEQ ID NO: 1595981 - protein, 29 aa, Staphylococcus aureus
IAYIILAFFFFVFILLFFSYETRAAIYIS

SEQ ID NO: 1595982 - protein, 34 aa, Staphylococcus aureus
IAYMAIIALLIYIFTLFFGSLFGFLYLLTGNEIG

SEQ ID NO: 1595983 - protein, 19 aa, Staphylococcus aureus
ICITMVFYFINRKLKLKLE

SEQ ID NO: 1595984 - protein, 17 aa, Staphylococcus aureus
ICLSLFAYILFGGLSTM

SEQ ID NO: 1595985 - protein, 46 aa, Staphylococcus aureus
ICNFIKAIFEFILNFVIKPIMFAIWQVMQFIWPAVKALIVSTWENI

SEQ ID NO: 1595986 - protein, 30 aa, Staphylococcus aureus
IDEIAQQLEQFKAQLKAANPFAKELKNRKK

SEQ ID NO: 1595987 - protein, 31 aa, Staphylococcus aureus
IDEIAQQLEQFKAQLKAANPFAKELKNRKKA

SEQ ID NO: 1595988 - protein, 17 aa, Staphylococcus aureus
IDFIFAGVFAFIFLAYR

SEQ ID NO: 1595989 - protein, 22 aa, Staphylococcus aureus
IDFKIALVFGLLFYIVGYSGIT

SEQ ID NO: 1595990 - protein, 17 aa, Staphylococcus aureus
IDIPLRIEKGKTASYIV

SEQ ID NO: 1595991 - protein, 17 aa, Staphylococcus aureus
IDKVIEFFIILIAANFA

SEQ ID NO: 1595992 - protein, 25 aa, Staphylococcus aureus
IDNHQIIWVMLNYEFNEARPTIGQT

SEQ ID NO: 1595993 - protein, 22 aa, Staphylococcus aureus
IDNKDIIELIIFDSFISNTDRN

SEQ ID NO: 1595994 - protein, 20 aa, Staphylococcus aureus
IDNLTHLNTPQKTALKQQVN

SEQ ID NO: 1595995 - protein, 18 aa, Staphylococcus aureus
IDPATGKDYSIFGWNNEN

SEQ ID NO: 1595996 - protein, 42 aa, Staphylococcus aureus
IDPNSKGDLALRSTLYGYNSNIIWRSMSWDNEVAFNNGSGSG

SEQ ID NO: 1595997 - protein, 25 aa, Staphylococcus aureus
IDRIFINNMLIYGLGGLIVPFLGIK

SEQ ID NO: 1595998 - protein, 26 aa, Staphylococcus aureus
IDRIFINNMLIYGLGGLIVPFLGIKL

SEQ ID NO: 1595999 - protein, 24 aa, Staphylococcus aureus
IDTPSTATIFDSLTAKVEVTLLDG

SEQ ID NO: 1596000 - protein, 20 aa, Staphylococcus aureus
IDYVLSPIVNRPSLLDRLNK

SEQ ID NO: 1596001 - protein, 17 aa, Staphylococcus aureus
IEDAIQHMIDEIKARTD

SEQ ID NO: 1596002 - protein, 18 aa, Staphylococcus aureus
IEDAIQHMIDEIKARTDL

SEQ ID NO: 1596003 - protein, 26 aa, Staphylococcus aureus
IEDNRFYEHGALDYKRLFGAIGKNLT

SEQ ID NO: 1596004 - protein, 30 aa, Staphylococcus aureus
IEDNRFYEHGALDYKRLFGAIGKNLTGGFG

SEQ ID NO: 1596005 - protein, 27 aa, Staphylococcus aureus
IEEDTTPPIVPPTPPTPEVPSEPETPT

SEQ ID NO: 1596006 - protein, 18 aa, Staphylococcus aureus
IELGLKTASTWKKFEVYE

SEQ ID NO: 1596007 - protein, 17 aa, Staphylococcus aureus
IEMPDKMIKRLNLSSGA

SEQ ID NO: 1596008 - protein, 27 aa, Staphylococcus aureus
IESKDEDVPLLLAKKKNQKDNQSKDKK

SEQ ID NO: 1596009 - protein, 18 aa, Staphylococcus aureus
IEYTKINLPKIGKIFGNV

SEQ ID NO: 1596010 - protein, 26 aa, Staphylococcus aureus
IFAGVFAFIFLAYRILTLWQDYIRQQ

SEQ ID NO: 1596011 - protein, 17 aa, Staphylococcus aureus
IFASFIGFAYLRVARKQ

SEQ ID NO: 1596012 - protein, 21 aa, Staphylococcus aureus
IFAVFSALTLLPALISIFHKH

SEQ ID NO: 1596013 - protein, 17 aa, Staphylococcus aureus
IFFLVIGIMYFIITLIL

SEQ ID NO: 1596014 - protein, 24 aa, Staphylococcus aureus
IFFLYFVIVGFRRGFWLSMIHLSA

SEQ ID NO: 1596015 - protein, 20 aa, Staphylococcus aureus
IFFVVFLGILFFYLNLNRRL

SEQ ID NO: 1596016 - protein, 21 aa, Staphylococcus aureus
IFFVYFVMVGFRRGFWLSMIH

SEQ ID NO: 1596017 - protein, 24 aa, Staphylococcus aureus
IFGALFQIYFFDKFMKYFSELTFI

SEQ ID NO: 1596018 - protein, 27 aa, Staphylococcus aureus
IFGIVITVILYAIKLPGSIFIGMIITA

SEQ ID NO: 1596019 - protein, 34 aa, Staphylococcus aureus
IFGTNYLSRGYLITIFIILLITILFANFSEAFAE

SEQ ID NO: 1596020 - protein, 27 aa, Staphylococcus aureus
IFIALMLKWWLLLVISIIVLIIITVAM

SEQ ID NO: 1596021 - protein, 28 aa, Staphylococcus aureus
IFIALMLKWWLLLVISIIVLIIITVAMT

SEQ ID NO: 1596022 - protein, 21 aa, Staphylococcus aureus
IFIGTYIYMRLITSIFSHPTP

SEQ ID NO: 1596023 - protein, 20 aa, Staphylococcus aureus
IFIIILVVMFFLILLICYKI

SEQ ID NO: 1596024 - protein, 31 aa, Staphylococcus aureus
IFLALSAYILWGILPIYWQFVDAIGAFEILA

SEQ ID NO: 1596025 - protein, 24 aa, Staphylococcus aureus
IFLFIFFLPFFCIGFFIITLIRDL

SEQ ID NO: 1596026 - protein, 17 aa, Staphylococcus aureus
IFLVDMLYIIIDPRIRI

SEQ ID NO: 1596027 - protein, 28 aa, Staphylococcus aureus
IFNIISIIMVSMLILSLGAFANNNKAKA

SEQ ID NO: 1596028 - protein, 32 aa, Staphylococcus aureus
IFPNWNFFIIFFVIITIIFWFRCRRRFLRMIW

SEQ ID NO: 1596029 - protein, 17 aa, Staphylococcus aureus
IFPYLCLVVFIAGHIAR

SEQ ID NO: 1596030 - protein, 19 aa, Staphylococcus aureus
IFPYTGVVAFKSATGFVVG

SEQ ID NO: 1596031 - protein, 18 aa, Staphylococcus aureus
IFSVLFKSSISALFSKKL

SEQ ID NO: 1596032 - protein, 20 aa, Staphylococcus aureus
IFVIAIILLTSVIGIVGRFM

SEQ ID NO: 1596033 - protein, 18 aa, Staphylococcus aureus
IFVPMLILIGFHPAFTQV

SEQ ID NO: 1596034 - protein, 17 aa, Staphylococcus aureus
IFYMYFAVTDNGLGIDK

SEQ ID NO: 1596035 - protein, 20 aa, Staphylococcus aureus
IGACIVGAIFVISYLYWYCK

SEQ ID NO: 1596036 - protein, 25 aa, Staphylococcus aureus
IGAFIGILVYLWKTNENFRKTITEA

SEQ ID NO: 1596037 - protein, 17 aa, Staphylococcus aureus
IGDHIYVEGIWLEVQAD

SEQ ID NO: 1596038 - protein, 30 aa, Staphylococcus aureus
IGDQSSEVYSPISPIKIATQDNSGNAVTNT

SEQ ID NO: 1596039 - protein, 28 aa, Staphylococcus aureus
IGDSNNIVLGEPILVVGNPLGVDFKGTV

SEQ ID NO: 1596040 - protein, 25 aa, Staphylococcus aureus
IGEALFLLFFVATYLYIFSPIFIIL

SEQ ID NO: 1596041 - protein, 22 aa, Staphylococcus aureus
IGFIFLYIFLVNILPIIIVFLT

SEQ ID NO: 1596042 - protein, 25 aa, Staphylococcus aureus
IGFIITLFMSIVFLSISFAKLIFST

SEQ ID NO: 1596043 - protein, 52 aa, Staphylococcus aureus
IGIALAIMILIIFALLFRFIVRLIPIFYIFRVLSIFIFIMGFKMLGVSIQKL

SEQ ID NO: 1596044 - protein, 18 aa, Staphylococcus aureus
IGIFLQIFFKLPLIVTAV

SEQ ID NO: 1596045 - protein, 18 aa, Staphylococcus aureus
IGILIFYVRLIKKSSLNI

SEQ ID NO: 1596046 - protein, 20 aa, Staphylococcus aureus
IGILIFYVRLIKKSSLNIYN

SEQ ID NO: 1596047 - protein, 32 aa, Staphylococcus aureus
IGILLAILYIPIFFLMFYSFNSAGNVIHFEHF

SEQ ID NO: 1596048 - protein, 25 aa, Staphylococcus aureus
IGIPRWIQFLFIVIVAMVISASMRV

SEQ ID NO: 1596049 - protein, 18 aa, Staphylococcus aureus
IGLCAAMILLISISRVYL

SEQ ID NO: 1596050 - protein, 25 aa, Staphylococcus aureus
IGLIVVGFVMILFAFKTQFGHASFT

SEQ ID NO: 1596051 - protein, 19 aa, Staphylococcus aureus
IGLSMILLITLFISILIGD

SEQ ID NO: 1596052 - protein, 33 aa, Staphylococcus aureus
IGNLLLSAAIFLYIMLIDWRMACALLVTIPIAL

SEQ ID NO: 1596053 - protein, 17 aa, Staphylococcus aureus
IGSIILIALVTLILRAV

SEQ ID NO: 1596054 - protein, 27 aa, Staphylococcus aureus
IGVLAMISYLLFLLSGLANGLINMNKE

SEQ ID NO: 1596055 - protein, 17 aa, Staphylococcus aureus
IGVLLIYGLFISTNPKE

SEQ ID NO: 1596056 - protein, 21 aa, Staphylococcus aureus
IGVLMFILFATVIGAYLFFKS

SEQ ID NO: 1596057 - protein, 27 aa, Staphylococcus aureus
IGVLTMISYLLFLLSGLTNGLINMNKE

SEQ ID NO: 1596058 - protein, 17 aa, Staphylococcus aureus
IHKLILSRFSKKGKQFD

SEQ ID NO: 1596059 - protein, 24 aa, Staphylococcus aureus
IIDRLFIYFNYYLEYYENMLFIDN

SEQ ID NO: 1596060 - protein, 21 aa, Staphylococcus aureus
IIFTVLCIGIVLWVIGLHPFA

SEQ ID NO: 1596061 - protein, 20 aa, Staphylococcus aureus
IIFTVLCIGIVLWVVGLHPL

SEQ ID NO: 1596062 - protein, 24 aa, Staphylococcus aureus
IIFVYFVIVGFRRGFWLSMIHLSA

SEQ ID NO: 1596063 - protein, 17 aa, Staphylococcus aureus
IIGCYYLYRLIFTYKYD

SEQ ID NO: 1596064 - protein, 18 aa, Staphylococcus aureus
IIGGACLVAGLALIVHMI

SEQ ID NO: 1596065 - protein, 19 aa, Staphylococcus aureus
IIGIFLQIFFKLPLIVTAV

SEQ ID NO: 1596066 - protein, 17 aa, Staphylococcus aureus
IIGIPLYFTLFVPHLSI

SEQ ID NO: 1596067 - protein, 17 aa, Staphylococcus aureus
IIGLFVLGQRTASALVP

SEQ ID NO: 1596068 - protein, 17 aa, Staphylococcus aureus
IIGLLFSTVLILTSRFE

SEQ ID NO: 1596069 - protein, 17 aa, Staphylococcus aureus
IIGVIGILGGVFWALMA

SEQ ID NO: 1596070 - protein, 22 aa, Staphylococcus aureus
IIGVILCICIVATVICLKVKYD

SEQ ID NO: 1596071 - protein, 18 aa, Staphylococcus aureus
IIGVILCICIVATVIYLK

SEQ ID NO: 1596072 - protein, 26 aa, Staphylococcus aureus
IIIARKIPIFIFFVSIIGPLLEEYVF

SEQ ID NO: 1596073 - protein, 18 aa, Staphylococcus aureus
IIIFLMISLFVIALNNNL

SEQ ID NO: 1596074 - protein, 18 aa, Staphylococcus aureus
IIIITFLIVLINLIITFP

SEQ ID NO: 1596075 - protein, 20 aa, Staphylococcus aureus
IIILLVLIVVYIIGTIITMI

SEQ ID NO: 1596076 - protein, 17 aa, Staphylococcus aureus
IIIVFLTFGLVAVFTQQ

SEQ ID NO: 1596077 - protein, 27 aa, Staphylococcus aureus
IIKFGIPMLIPLLIKYAIDGVINNHEL

SEQ ID NO: 1596078 - protein, 24 aa, Staphylococcus aureus
IILFITWIMLVIMFLLSNVALVVN

SEQ ID NO: 1596079 - protein, 25 aa, Staphylococcus aureus
IILFITWIMLVIMFLLSNVALVVNK

SEQ ID NO: 1596080 - protein, 17 aa, Staphylococcus aureus
IILFLLCLTVFKMKGIY

SEQ ID NO: 1596081 - protein, 20 aa, Staphylococcus aureus
IILFLTLSIMTPYAQAANSD

SEQ ID NO: 1596082 - protein, 26 aa, Staphylococcus aureus
IILFPLSILFFITSHFIVGLTPLNYL

SEQ ID NO: 1596083 - protein, 18 aa, Staphylococcus aureus
IILINNATTRDKVAEIIA

SEQ ID NO: 1596084 - protein, 25 aa, Staphylococcus aureus
IILPPLAAMLFIKIGYHPIAGLTMA

SEQ ID NO: 1596085 - protein, 18 aa, Staphylococcus aureus
IILSLLGISPIRYVKKTL

SEQ ID NO: 1596086 - protein, 19 aa, Staphylococcus aureus
IIMIMIFDLIIGLLLNFQI

SEQ ID NO: 1596087 - protein, 23 aa, Staphylococcus aureus
IIMLLSRYIPIILQLLIASSLVN

SEQ ID NO: 1596088 - protein, 19 aa, Staphylococcus aureus
IIMSILISMVFSLIIISPL

SEQ ID NO: 1596089 - protein, 18 aa, Staphylococcus aureus
IINLFVCITLLVAIGMGF

SEQ ID NO: 1596090 - protein, 23 aa, Staphylococcus aureus
IIPTMFLYYFYGSRAVLIPTFSS

SEQ ID NO: 1596091 - protein, 18 aa, Staphylococcus aureus
IIQKPIRSVQEVQTALTN

SEQ ID NO: 1596092 - protein, 18 aa, Staphylococcus aureus
IIQQVAYPDNTSTDNGKI

SEQ ID NO: 1596093 - protein, 25 aa, Staphylococcus aureus
IIRALITWFYTMLWSIVGVVWIMFS

SEQ ID NO: 1596094 - protein, 21 aa, Staphylococcus aureus
IISFITLGIIIHASITYVLSE

SEQ ID NO: 1596095 - protein, 26 aa, Staphylococcus aureus
IISTLFLLFYFLINGISLIIQGITAE

SEQ ID NO: 1596096 - protein, 26 aa, Staphylococcus aureus
IISTWISLFFPFINWFIPKEYVKISR

SEQ ID NO: 1596097 - protein, 28 aa, Staphylococcus aureus
IISTWISLFFPFINWFIPKRYIKISREE

SEQ ID NO: 1596098 - protein, 27 aa, Staphylococcus aureus
IISTWISLFFPFINWFIPKRYVKISKE

SEQ ID NO: 1596099 - protein, 24 aa, Staphylococcus aureus
IISVLGAWLGWTLLAGELPFIVAK

SEQ ID NO: 1596100 - protein, 20 aa, Staphylococcus aureus
IITFIVTFYLFKILHFKRST

SEQ ID NO: 1596101 - protein, 20 aa, Staphylococcus aureus
IITFPILRKFKIATPVFKPL

SEQ ID NO: 1596102 - protein, 33 aa, Staphylococcus aureus
IITKLFLGIILFFLIIFVHNFDFMLYITILMLV

SEQ ID NO: 1596103 - protein, 28 aa, Staphylococcus aureus
IITMVLCGFLFPLAITLIGQIFFYQQAN

SEQ ID NO: 1596104 - protein, 19 aa, Staphylococcus aureus
IIVIILFILFINWYLNVNE

SEQ ID NO: 1596105 - protein, 24 aa, Staphylococcus aureus
IIVLFSIYLLNINLTGSLWYVILI

SEQ ID NO: 1596106 - protein, 19 aa, Staphylococcus aureus
IIVLILIEALIGLRFLKAY

SEQ ID NO: 1596107 - protein, 18 aa, Staphylococcus aureus
IIVLLVILILMNGVAIIL

SEQ ID NO: 1596108 - protein, 19 aa, Staphylococcus aureus
IIVYPAFIMLFLSFVCLIS

SEQ ID NO: 1596109 - protein, 17 aa, Staphylococcus aureus
IIYMFPIKQRGTAMGLS

SEQ ID NO: 1596110 - protein, 18 aa, Staphylococcus aureus
IIYVVMPLAIGILNISLI

SEQ ID NO: 1596111 - protein, 21 aa, Staphylococcus aureus
IIYVVWQVLLIMFYYHSKPKN

SEQ ID NO: 1596112 - protein, 17 aa, Staphylococcus aureus
IKDFKVTLLNEKGEVIG

SEQ ID NO: 1596113 - protein, 23 aa, Staphylococcus aureus
IKKIALSEVLKETANKENAQPRA

SEQ ID NO: 1596114 - protein, 18 aa, Staphylococcus aureus
IKKIINYPGKEDVSVIQV

SEQ ID NO: 1596115 - protein, 24 aa, Staphylococcus aureus
IKKMFSIMFSLVNIGIFLSVFELK

SEQ ID NO: 1596116 - protein, 24 aa, Staphylococcus aureus
IKKRYKIGFIFWGVSIISLGLIMF

SEQ ID NO: 1596117 - protein, 20 aa, Staphylococcus aureus
IKLIPFAIYRIILASILAFI

SEQ ID NO: 1596118 - protein, 37 aa, Staphylococcus aureus; identical to SEQ ID NO: 1580173

SEQ ID NO: 1596119 - protein, 37 aa, Staphylococcus aureus
IKNALGVVGISGLLASFWFFIAKRRRKEDEEEELEIR

SEQ ID NO: 1596120 - protein, 31 aa, Staphylococcus aureus
IKQTQFLQPILFLYFRFIYCRNLFSNYVTNV

SEQ ID NO: 1596121 - protein, 28 aa, Staphylococcus aureus
IKSSYNLKCLLLKLTYRYLDNQPLNDAD

SEQ ID NO: 1596122 - protein, 20 aa, Staphylococcus aureus
IKSYFLRWIPSFHILQSGLF

SEQ ID NO: 1596123 - protein, 19 aa, Staphylococcus aureus
IKWFHREHDWFKTQLNNET

SEQ ID NO: 1596124 - protein, 25 aa, Staphylococcus aureus
ILAIFLILYGFLKLIKNMFLKNTRN

SEQ ID NO: 1596125 - protein, 18 aa, Staphylococcus aureus
ILCICIVATVIYLKVKYD

SEQ ID NO: 1596126 - protein, 19 aa, Staphylococcus aureus
ILDITLLQNIFTLMSAAGS

SEQ ID NO: 1596127 - protein, 24 aa, Staphylococcus aureus
ILDKRFLIFFLSAVGLHGIWDTSL

SEQ ID NO: 1596128 - protein, 29 aa, Staphylococcus aureus
ILDQYVNYFMFFNVIATLLTLYVIANYLY

SEQ ID NO: 1596129 - protein, 17 aa, Staphylococcus aureus
ILFFTLYLLLILIILYY

SEQ ID NO: 1596130 - protein, 17 aa, Staphylococcus aureus
ILFINWYLNVNEWNGRQ

SEQ ID NO: 1596131 - protein, 18 aa, Staphylococcus aureus
ILFLIISLSYYLTLNHYM

SEQ ID NO: 1596132 - protein, 36 aa, Staphylococcus aureus
ILGIFLYIGYSIIDLPYIPLLVLFAGVANLIPFLGS

SEQ ID NO: 1596133 - protein, 20 aa, Staphylococcus aureus
ILGIILIISGYYYSLRIVHY

SEQ ID NO: 1596134 - protein, 25 aa, Staphylococcus aureus
ILGLALMMLLIFNNIGIISITDFTN

SEQ ID NO: 1596135 - protein, 25 aa, Staphylococcus aureus
ILIARKIPIFIFFVSIIGPLLEEYV

SEQ ID NO: 1596136 - protein, 21 aa, Staphylococcus aureus
ILICFPDIFGTNYLSRGYLIT

SEQ ID NO: 1596137 - protein, 17 aa, Staphylococcus aureus
ILIDSNKTLKIFDFGIA

SEQ ID NO: 1596138 - protein, 19 aa, Staphylococcus aureus
ILIGLLFGWIPARAASKKE

SEQ ID NO: 1596139 - protein, 18 aa, Staphylococcus aureus
ILIIILGLPIYFFYEYRM

SEQ ID NO: 1596140 - protein, 22 aa, Staphylococcus aureus
ILIILNIAFIIYTFVNFRKLKK

SEQ ID NO: 1596141 - protein, 20 aa, Staphylococcus aureus
ILILLCGIITLLIRIIPFIM

SEQ ID NO: 1596142 - protein, 18 aa, Staphylococcus aureus
ILILLCGIVTLLIRIIPF

SEQ ID NO: 1596143 - protein, 30 aa, Staphylococcus aureus
ILISGAVFIVFLLLPARWFTGLVTEKTVED

SEQ ID NO: 1596144 - protein, 28 aa, Staphylococcus aureus
ILITYLLQVILYLLIVIALLMIGFETYL

SEQ ID NO: 1596145 - protein, 19 aa, Staphylococcus aureus
ILIVIVITIFVLFLTEVTS

SEQ ID NO: 1596146 - protein, 19 aa, Staphylococcus aureus
ILKEIEAPAPYTFDKDKEY

SEQ ID NO: 1596147 - protein, 17 aa, Staphylococcus aureus
ILLAIFLGALVRSYFGF

SEQ ID NO: 1596148 - protein, 26 aa, Staphylococcus aureus
ILLGINWLAILLYIEAFVSPFGTGVS

SEQ ID NO: 1596149 - protein, 21 aa, Staphylococcus aureus
ILLHVIGFGFLWIAGKDHHIL

SEQ ID NO: 1596150 - protein, 20 aa, Staphylococcus aureus
ILLHVIGFSFLWIAGKDYHI

SEQ ID NO: 1596151 - protein, 21 aa, Staphylococcus aureus
ILLLFSFVVFFFIYGMVSGES

SEQ ID NO: 1596152 - protein, 29 aa, Staphylococcus aureus
ILLMVFAVILKFSLWRYKKLTVAILVLIV

SEQ ID NO: 1596153 - protein, 22 aa, Staphylococcus aureus
ILLPTLVTIMALRWGISVGIAS

SEQ ID NO: 1596154 - protein, 17 aa, Staphylococcus aureus
ILMVIMLFWIFMTFILQ

SEQ ID NO: 1596155 - protein, 19 aa, Staphylococcus aureus
ILMYIFWELTSVSSFLLIS

SEQ ID NO: 1596156 - protein, 20 aa, Staphylococcus aureus
ILNIKVAIKAIFIPPREKEE

SEQ ID NO: 1596157 - protein, 25 aa, Staphylococcus aureus
ILPIFVQNLLHRSALDSGLTLLPGA

SEQ ID NO: 1596158 - protein, 49 aa, Staphylococcus aureus
ILPLIFALIIPILYRFFKRIHLGWFVLPIPIVIFIYMLTLIKTTMSGNT

SEQ ID NO: 1596159 - protein, 49 aa, Staphylococcus aureus
ILPLIFVLIIPILYRFFKRIHLGWFVLPVPIVIFIYMLTLIKTTMSGNT

SEQ ID NO: 1596160 - protein, 22 aa, Staphylococcus aureus
ILREFYIFRFIIGKQPYKLNIN

SEQ ID NO: 1596161 - protein, 20 aa, Staphylococcus aureus
ILSGFLFLISAIVTIPLVLL

SEQ ID NO: 1596162 - protein, 18 aa, Staphylococcus aureus
ILSLFGITALLLVVALPI

SEQ ID NO: 1596163 - protein, 25 aa, Staphylococcus aureus
ILSLFGITALLLVVALPIYTVASYQ

SEQ ID NO: 1596164 - protein, 26 aa, Staphylococcus aureus
ILTASVATLLLVSGLFLAFRRRSTNK

SEQ ID NO: 1596165 - protein, 25 aa, Staphylococcus aureus
ILTGPLIVYWNWAWGITVMVIYGIG

SEQ ID NO: 1596166 - protein, 20 aa, Staphylococcus aureus
ILVQLFLISMLFTDSAYQFA

SEQ ID NO: 1596167 - protein, 19 aa, Staphylococcus aureus
ILYLCCCFILLKGFTIYVI

SEQ ID NO: 1596168 - protein, 23 aa, Staphylococcus aureus
ILYQNWFFITHWKLSLYNLTFLL

SEQ ID NO: 1596169 - protein, 24 aa, Staphylococcus aureus
ILYSRYIMMIFATILVVQILLQIC

SEQ ID NO: 1596170 - protein, 20 aa, Staphylococcus aureus
ILYWFIPLLTTFQIIRYWAE

SEQ ID NO: 1596171 - protein, 23 aa, Staphylococcus aureus
IMAVYLLINATFLLTLPIELLAG

SEQ ID NO: 1596172 - protein, 17 aa, Staphylococcus aureus
IMICILLLVYKMIRNYD

SEQ ID NO: 1596173 - protein, 20 aa, Staphylococcus aureus
IMIIISIVVYLLIPKSLDIT

SEQ ID NO: 1596174 - protein, 24 aa, Staphylococcus aureus
IMLAYTTHILFGSKILLFIIMSIA

SEQ ID NO: 1596175 - protein, 24 aa, Staphylococcus aureus
IMLFWIFMTFILQKILFPPSKNDL

SEQ ID NO: 1596176 - protein, 27 aa, Staphylococcus aureus
IMMIAIFIALMFDFEKAYWIPLSAHTI

SEQ ID NO: 1596177 - protein, 33 aa, Staphylococcus aureus
IMMIAIFIALMFDFEKAYWIPLSAHTVLLGTST

SEQ ID NO: 1596178 - protein, 28 aa, Staphylococcus aureus
IMPTLVFINPMWFGILFAIVGALLIEKL

SEQ ID NO: 1596179 - protein, 28 aa, Staphylococcus aureus
IMTITMTIWNAIWTFLQTLWNTIVTVAT

SEQ ID NO: 1596180 - protein, 25 aa, Staphylococcus aureus
IMTLGIFMIIIGYGYIRIGLPKVHQ

SEQ ID NO: 1596181 - protein, 29 aa, Staphylococcus aureus
INANTFLYFLTPIINCPDNLLPKYINISP

SEQ ID NO: 1596182 - protein, 28 aa, Staphylococcus aureus
INDPVSKYLPWFKTSKPIPLKDLMLHQS

SEQ ID NO: 1596183 - protein, 17 aa, Staphylococcus aureus
INEIVLETIRDINNAHT

SEQ ID NO: 1596184 - protein, 24 aa, Staphylococcus aureus
INESYIRDLSYALQLMRDELPTSD

SEQ ID NO: 1596185 - protein, 18 aa, Staphylococcus aureus
INFILKSSTKLKADIDFN

SEQ ID NO: 1596186 - protein, 22 aa, Staphylococcus aureus
INFPMLLLVRSIQALGAGILMP

SEQ ID NO: 1596187 - protein, 18 aa, Staphylococcus aureus
INHIVKVLFLFHVPKYVL

SEQ ID NO: 1596188 - protein, 24 aa, Staphylococcus aureus
INISFLFISIITFILSIINPNISL

SEQ ID NO: 1596189 - protein, 25 aa, Staphylococcus aureus
INLKKKNIYSIRKLGVGIASVTLGT

SEQ ID NO: 1596190 - protein, 39 aa, Staphylococcus aureus
INNHHIFLTCYVLAVIIISFLYMAMYKITSYIYAKVIHQ

SEQ ID NO: 1596191 - protein, 36 aa, Staphylococcus aureus
INNNFMVSLPIIIILLIWLSWRFYKYSKFVKMMNNL

SEQ ID NO: 1596192 - protein, 18 aa, Staphylococcus aureus
INPTQVMDIAYTEKVGNG

SEQ ID NO: 1596193 - protein, 17 aa, Staphylococcus aureus
INSPFDLRVLMDAVYEL

SEQ ID NO: 1596194 - protein, 18 aa, Staphylococcus aureus
INSPFDLRVLMDAVYELN

SEQ ID NO: 1596195 - protein, 17 aa, Staphylococcus aureus
INVVDTTAPTVTPIGDQ

SEQ ID NO: 1596196 - protein, 17 aa, Staphylococcus aureus
INWFIPKTYVKITKNDY

SEQ ID NO: 1596197 - protein, 41 aa, Staphylococcus aureus
INYNGDTKVMTVTYAGQTWTRNISDWIAKSGTTNFSLSMTA

SEQ ID NO: 1596198 - protein, 54 aa, Staphylococcus aureus
INYNGDTKVMTVTYAGQTWTRNISDWIAKSGTTNFSLSMTASTGGATNLQQVQF

SEQ ID NO: 1596199 - protein, 25 aa, Staphylococcus aureus
IPASIIGLLVWFIAGFQFKGHSNDK

SEQ ID NO: 1596200 - protein, 21 aa, Staphylococcus aureus
IPFSAVIIILYALDLVIRNSF

SEQ ID NO: 1596201 - protein, 30 aa, Staphylococcus aureus
IPFYKKHSTLLFATLLIAFGYLSHFVNGED

SEQ ID NO: 1596202 - protein, 36 aa, Staphylococcus aureus
IPIIIVLLLIGGIAWGVYAFFANTLKNTYLKSEQQT

SEQ ID NO: 1596203 - protein, 27 aa, Staphylococcus aureus
IPIIIVLLLIGGIAWGVYAFFANTPKN

SEQ ID NO: 1596204 - protein, 32 aa, Staphylococcus aureus
IPQFIRMAIVVTLLIPFMLILVGSFNKYGKDI

SEQ ID NO: 1596205 - protein, 29 aa, Staphylococcus aureus
IPTFSSIIFLFFKLKYYAIVTILVTMIIM

SEQ ID NO: 1596206 - protein, 19 aa, Staphylococcus aureus
IPTMFFFGGLIIGIFPYLL

SEQ ID NO: 1596207 - protein, 24 aa, Staphylococcus aureus
IPTMFFFGGLIIGILPYLLKISNY

SEQ ID NO: 1596208 - protein, 19 aa, Staphylococcus aureus
IPVFILFALVDFGFGNVSF

SEQ ID NO: 1596209 - protein, 19 aa, Staphylococcus aureus
IPVIIIALLYVLLSPTHPL

SEQ ID NO: 1596210 - protein, 17 aa, Staphylococcus aureus
IPYFYFGVILSVSYLIT

SEQ ID NO: 1596211 - protein, 31 aa, Staphylococcus aureus
IPYREDYLIHLTFVPLLFLSRFTNMVYTLSA

SEQ ID NO: 1596212 - protein, 17 aa, Staphylococcus aureus
IQFDTYFNFLQTTMLVV

SEQ ID NO: 1596213 - protein, 73 aa, Staphylococcus aureus
IQGTLNIILGLIKFFSSLFTGDWRGVWDAIIMILKGVVQLIWNLIQLWFVGKILGVVRYFGGLLKGLITGIWD

SEQ ID NO: 1596214 - protein, 54 aa, Staphylococcus aureus
IQKNNTVIWRSIIPPLVIIALTVVIFLVRPIGIYILMMIGMSTVTIVFGITTYF

SEQ ID NO: 1596215 - protein, 17 aa, Staphylococcus aureus
IQLPLQVFTFFGGINLF

SEQ ID NO: 1596216 - protein, 32 aa, Staphylococcus aureus
IQNALPLIKFENYLSFILFDVDKDVFDAPKFL

SEQ ID NO: 1596217 - protein, 41 aa, Staphylococcus aureus
IQNKNGFTFFLNVLLPLVFISVLIGIFNYIKVLPFIIKYVG

SEQ ID NO: 1596218 - protein, 18 aa, Staphylococcus aureus
IQPYFKHIDFIFAGVFAF

SEQ ID NO: 1596219 - protein, 29 aa, Staphylococcus aureus
IQSTLQPIMPILQVLGQIFMQVLGVLVIG

SEQ ID NO: 1596220 - protein, 24 aa, Staphylococcus aureus
IQVQWLTTAFLLTNGIVIPLSALV

SEQ ID NO: 1596221 - protein, 22 aa, Staphylococcus aureus
IRLSSPILIKNKFLDPKSGVEK

SEQ ID NO: 1596222 - protein, 17 aa, Staphylococcus aureus
IRMFKRYAVITTSAKIL

SEQ ID NO: 1596223 - protein, 19 aa, Staphylococcus aureus
IRMRNLVAMLLFSIFILYI

SEQ ID NO: 1596224 - protein, 23 aa, Staphylococcus aureus
IRNQYFDMALYKPYLIMNYGTVN

SEQ ID NO: 1596225 - protein, 24 aa, Staphylococcus aureus
IRNQYFDMTLYKPYLIMNYGTVNE

SEQ ID NO: 1596226 - protein, 20 aa, Staphylococcus aureus
IRSLSYALQLMRDRLPLSEL

SEQ ID NO: 1596227 - protein, 18 aa, Staphylococcus aureus
ISATVIGIFLYVMTLQKT

SEQ ID NO: 1596228 - protein, 21 aa, Staphylococcus aureus
ISGFFFAFGALTYLISAQPNM

SEQ ID NO: 1596229 - protein, 17 aa, Staphylococcus aureus
ISIFFLGTLLGGLSPHF

SEQ ID NO: 1596230 - protein, 17 aa, Staphylococcus aureus
ISIILWLLIGVVFFLGD

SEQ ID NO: 1596231 - protein, 18 aa, Staphylococcus aureus
ISIKAFPLAIGALYLPII

SEQ ID NO: 1596232 - protein, 24 aa, Staphylococcus aureus
ISLAIALTLPYFLAGHHAFTYRND

SEQ ID NO: 1596233 - protein, 26 aa, Staphylococcus aureus
ISLDAMLHLAILSVLYELNIEIPKDV

SEQ ID NO: 1596234 - protein, 19 aa, Staphylococcus aureus
ISLFFPFINWFIPKRYVKI

SEQ ID NO: 1596235 - protein, 26 aa, Staphylococcus aureus
ISLLIILFIILFRLYINKKLTIKNFH

SEQ ID NO: 1596236 - protein, 20 aa, Staphylococcus aureus
ISLSLLCLCLFFSKLLKFNF

SEQ ID NO: 1596237 - protein, 19 aa, Staphylococcus aureus
ISMLILLFLLILFGITACS

SEQ ID NO: 1596238 - protein, 18 aa, Staphylococcus aureus
ISMPNVENMSFAIPVNEV

SEQ ID NO: 1596239 - protein, 17 aa, Staphylococcus aureus
ISSKNALDGVERLAQDK

SEQ ID NO: 1596240 - protein, 18 aa, Staphylococcus aureus
ISTALILVPITVLLAVIL

SEQ ID NO: 1596241 - protein, 22 aa, Staphylococcus aureus
ISTALILVPITVLLAVILPGNQ

SEQ ID NO: 1596242 - protein, 19 aa, Staphylococcus aureus
ISTDKIDRIRNSTIGTAEE

SEQ ID NO: 1596243 - protein, 20 aa, Staphylococcus aureus
ISTDKIDRIRNSTIGTAEER

SEQ ID NO: 1596244 - protein, 24 aa, Staphylococcus aureus
ISTLFLLFYFLINGISLIIQGITA

SEQ ID NO: 1596245 - protein, 26 aa, Staphylococcus aureus
ISTWISLFFPFINWFIPKRYVKISRE

SEQ ID NO: 1596246 - protein, 37 aa, Staphylococcus aureus
ISTYIYVIVTLLIVYIIPRFFKAIPAPLIAIIVLTAL

SEQ ID NO: 1596247 - protein, 18 aa, Staphylococcus aureus
ISVIFAVAFFIINYIGME

SEQ ID NO: 1596248 - protein, 17 aa, Staphylococcus aureus
ISVIFSVLGFGGLLYGT

SEQ ID NO: 1596249 - protein, 22 aa, Staphylococcus aureus
ISVLIIILLVLIVEYIIGTIIT

SEQ ID NO: 1596250 - protein, 25 aa, Staphylococcus aureus
ITDANLDYLSTLKPYITCVCAELNF

SEQ ID NO: 1596251 - protein, 34 aa, Staphylococcus aureus
ITENEIIALVKYKGKYLPLLENGKLLKDSNDVKI

SEQ ID NO: 1596252 - protein, 36 aa, Staphylococcus aureus
ITEPLEFSFLFVAPLLFFIHAVLDGLSFLTLYLLDV

SEQ ID NO: 1596253 - protein, 17 aa, Staphylococcus aureus
ITFIIFLGIWEMVIIIG

SEQ ID NO: 1596254 - protein, 21 aa, Staphylococcus aureus
ITFILFFIIYVIHPINADWLL

SEQ ID NO: 1596255 - protein, 20 aa, Staphylococcus aureus
ITFSFALVLILFTNSELLTS

SEQ ID NO: 1596256 - protein, 17 aa, Staphylococcus aureus
ITIALFITLYYFNKIGF

SEQ ID NO: 1596257 - protein, 22 aa, Staphylococcus aureus
ITIIWVAIIGVFKKSLSAIWNA

SEQ ID NO: 1596258 - protein, 31 aa, Staphylococcus aureus
ITIKKNGKNFFFIDKLEFKPKLTSVYVKEFN

SEQ ID NO: 1596259 - protein, 18 aa, Staphylococcus aureus
ITIPVLFITLIGLYLTLI

SEQ ID NO: 1596260 - protein, 17 aa, Staphylococcus aureus
ITITFFLMKLMPGSPFN

SEQ ID NO: 1596261 - protein, 31 aa, Staphylococcus aureus
ITKIQLSYTPPYYYLLITITIFGIICSIIFT

SEQ ID NO: 1596262 - protein, 39 aa, Staphylococcus aureus
ITKTATYKVVSTVPKHVFETNRGAVFPGVSDVYDAKQYV

SEQ ID NO: 1596263 - protein, 19 aa, Staphylococcus aureus
ITLLFNIWPIAFIPIVLCM

SEQ ID NO: 1596264 - protein, 18 aa, Staphylococcus aureus
ITMVFVTIVTGNRPFFRL

SEQ ID NO: 1596265 - protein, 17 aa, Staphylococcus aureus
ITSILLNAKPHEVKLML

SEQ ID NO: 1596266 - protein, 18 aa, Staphylococcus aureus
ITSILLNAKPHEVKLMLI

SEQ ID NO: 1596267 - protein, 20 aa, Staphylococcus aureus
ITSKRWLMISVSIFIVMMLL

SEQ ID NO: 1596268 - protein, 17 aa, Staphylococcus aureus
ITSPWMLLKLAVVWTLV

SEQ ID NO: 1596269 - protein, 19 aa, Staphylococcus aureus
ITTLLWLISYSLLLKLSIP

SEQ ID NO: 1596270 - protein, 26 aa, Staphylococcus aureus
ITTSTYLFLFIIGVLAILLFEHNHAF

SEQ ID NO: 1596271 - protein, 26 aa, Staphylococcus aureus
ITTSTYLFLFVVGVLAILLFEHNHAF

SEQ ID NO: 1596272 - protein, 23 aa, Staphylococcus aureus
ITYLLQVILYLLIVIALVMIGFE

SEQ ID NO: 1596273 - protein, 17 aa, Staphylococcus aureus
ITYMGIPVFLAFFIYHK

SEQ ID NO: 1596274 - protein, 18 aa, Staphylococcus aureus
IVAFLFWISSDRSAYEVL

SEQ ID NO: 1596275 - protein, 17 aa, Staphylococcus aureus
IVAFLFWVSSDRSAYEV

SEQ ID NO: 1596276 - protein, 21 aa, Staphylococcus aureus
IVFFFPFINWLIPKTYVKITK

SEQ ID NO: 1596277 - protein, 19 aa, Staphylococcus aureus
IVFLPLVFVSGSVGEMFRP

SEQ ID NO: 1596278 - protein, 18 aa, Staphylococcus aureus
IVFVYLFLGSASIFTLAI

SEQ ID NO: 1596279 - protein, 27 aa, Staphylococcus aureus
IVGATIVWLMYLPHWKATEEAGAKLGV

SEQ ID NO: 1596280 - protein, 17 aa, Staphylococcus aureus
IVGIALVAFIFGLISIS

SEQ ID NO: 1596281 - protein, 32 aa, Staphylococcus aureus
IVGLFVLALFLISLLLLFCPIILLASAISRGI

SEQ ID NO: 1596282 - protein, 22 aa, Staphylococcus aureus
IVHQKWISIPSRFILNIVRTIP

SEQ ID NO: 1596283 - protein, 17 aa, Staphylococcus aureus
IVIFGGIAAAIGPVVFG

SEQ ID NO: 1596284 - protein, 17 aa, Staphylococcus aureus
IVIGIFLLGFFLSTYEA

SEQ ID NO: 1596285 - protein, 17 aa, Staphylococcus aureus
IVIGVIAALIAIFVLLW

SEQ ID NO: 1596286 - protein, 30 aa, Staphylococcus aureus
IVINGYILISVLILSLLVVSWQVALLACIG

SEQ ID NO: 1596287 - protein, 31 aa, Staphylococcus aureus
IVINGYILISVLILSLLVVSWQVALLACIGV

SEQ ID NO: 1596288 - protein, 17 aa, Staphylococcus aureus
IVIVFFAAQLLAFLKWS

SEQ ID NO: 1596289 - protein, 19 aa, Staphylococcus aureus
IVIVFIVISTMIFLIIGKP

SEQ ID NO: 1596290 - protein, 26 aa, Staphylococcus aureus
IVIYPALLLLPPLFGLPTYSAYIASG

SEQ ID NO: 1596291 - protein, 21 aa, Staphylococcus aureus
IVLIFAVMYFLMIRPQQKRAK

SEQ ID NO: 1596292 - protein, 18 aa, Staphylococcus aureus
IVLINLIITFPILRKFKI

SEQ ID NO: 1596293 - protein, 20 aa, Staphylococcus aureus
IVLMAFICVFAFDLKDLLQG

SEQ ID NO: 1596294 - protein, 17 aa, Staphylococcus aureus
IVLPIFLVVYVSISYAL

SEQ ID NO: 1596295 - protein, 19 aa, Staphylococcus aureus
IVLVACLLFIHNSIDLPTF

SEQ ID NO: 1596296 - protein, 45 aa, Staphylococcus aureus
IVMILKGTVQLIWNLIQLWFVGKILGVVRYFGGLLKGLISGIWGV

SEQ ID NO: 1596297 - protein, 18 aa, Staphylococcus aureus
IVMTFIIAKVIKLITPLS

SEQ ID NO: 1596298 - protein, 18 aa, Staphylococcus aureus
IVNVPVKVVEKELSVVKQ

SEQ ID NO: 1596299 - protein, 18 aa, Staphylococcus aureus
IVNVPVKVVEKELTVVKQ

SEQ ID NO: 1596300 - protein, 23 aa, Staphylococcus aureus
IVPYMIFFAFFSIYYFLTGKSDE

SEQ ID NO: 1596301 - protein, 25 aa, Staphylococcus aureus
IVQILLVVIIIIFGYKIVQTYMEDK

SEQ ID NO: 1596302 - protein, 25 aa, Staphylococcus aureus
IVSEFLFFLVIFTFGIAGIIFLMPY

SEQ ID NO: 1596303 - protein, 29 aa, Staphylococcus aureus
IVSFCFIFLLLLFFRYILKRYFNYMLNYK

SEQ ID NO: 1596304 - protein, 18 aa, Staphylococcus aureus
IVSVILIGMIVIAYAHNK

SEQ ID NO: 1596305 - protein, 17 aa, Staphylococcus aureus
IVSVILIGMIVIAYVHN

SEQ ID NO: 1596306 - protein, 27 aa, Staphylococcus aureus
IVTFIVFIILLITKFSQVWPILIFLPF

SEQ ID NO: 1596307 - protein, 19 aa, Staphylococcus aureus
IVTMPMACGALIFNRRHQL

SEQ ID NO: 1596308 - protein, 25 aa, Staphylococcus aureus
IVVAILILLIVIVYVFHKSKKEHYI

SEQ ID NO: 1596309 - protein, 19 aa, Staphylococcus aureus
IVVVIIIGLVVIAYAHNKQ

SEQ ID NO: 1596310 - protein, 18 aa, Staphylococcus aureus
IVVVIIIGLVVVACVTHK

SEQ ID NO: 1596311 - protein, 18 aa, Staphylococcus aureus
IVYAPISLFLIIFSSWYL

SEQ ID NO: 1596312 - protein, 19 aa, Staphylococcus aureus
IVYAPISLFLIIFSSWYLH

SEQ ID NO: 1596313 - protein, 18 aa, Staphylococcus aureus
IVYPAFIMLFLSFVCLIS

SEQ ID NO: 1596314 - protein, 34 aa, Staphylococcus aureus
IWGDEWPFVIAFLPWVLIIIPYLLFKSNTLNIIH

SEQ ID NO: 1596315 - protein, 21 aa, Staphylococcus aureus
IWSKEFILLNLEIVLFICIAI

SEQ ID NO: 1596316 - protein, 19 aa, Staphylococcus aureus
IYFTGWRIIDSIISIVISL

SEQ ID NO: 1596317 - protein, 17 aa, Staphylococcus aureus
IYGGTFGIYPKADASTQ

SEQ ID NO: 1596318 - protein, 17 aa, Staphylococcus aureus
IYIITFLEYVLLYFTMF

SEQ ID NO: 1596319 - protein, 19 aa, Staphylococcus aureus
IYIPFMILPIFNSMKAIPN

SEQ ID NO: 1596320 - protein, 18 aa, Staphylococcus aureus
IYIVILTCALFYFILFMY

SEQ ID NO: 1596321 - protein, 23 aa, Staphylococcus aureus
IYLALTIIGAYAALFILKTIDSH

SEQ ID NO: 1596322 - protein, 17 aa, Staphylococcus aureus
IYLQVKLQGQIDKEQLV

SEQ ID NO: 1596323 - protein, 18 aa, Staphylococcus aureus
IYLTYICLVSLLTILLLA

SEQ ID NO: 1596324 - protein, 17 aa, Staphylococcus aureus
IYMLLYSLATFIPNLAL

SEQ ID NO: 1596325 - protein, 26 aa, Staphylococcus aureus
IYSIGIVLYEMLVGEPPFNGETAVSI

SEQ ID NO: 1596326 - protein, 17 aa, Staphylococcus aureus
IYTFTDYVNTKDDVKAT

SEQ ID NO: 1596327 - protein, 21 aa, Staphylococcus aureus
KAFGRQTFEYINGERPTESPG

SEQ ID NO: 1596328 - protein, 22 aa, Staphylococcus aureus
KAFGRQTFEYINGERPTESPGV

SEQ ID NO: 1596329 - protein, 37 aa, Staphylococcus aureus
KAGGLFAFLRTKIASLVKLFPILGVSISSLTLPITLI

SEQ ID NO: 1596330 - protein, 20 aa, Staphylococcus aureus
KAIITWLLVIPIFNFMTSFV

SEQ ID NO: 1596331 - protein, 26 aa, Staphylococcus aureus
KAIKQVFWRILLFYALSIAVIGAIIP

SEQ ID NO: 1596332 - protein, 24 aa, Staphylococcus aureus
KAIQSINQALANKLKEIEASNATD

SEQ ID NO: 1596333 - protein, 23 aa, Staphylococcus aureus
KAKSFVIFMIIIAASMIGLSNID

SEQ ID NO: 1596334 - protein, 23 aa, Staphylococcus aureus
KALNRVMDQLSQGITGNEGRTKG

SEQ ID NO: 1596335 - protein, 40 aa, Staphylococcus aureus
KALSKILKPVIAIVIGFFLLIFIMIAYLVGSFTKEINESG

SEQ ID NO: 1596336 - protein, 39 aa, Staphylococcus aureus
KALSKILKPVIVIVIGFFLLIFIMVAYLVGSFTKEINES

SEQ ID NO: 1596337 - protein, 42 aa, Staphylococcus aureus
KAMAPIMPIIIIPIISSVVVGLIFIFLIGAPISNIFETLTTW

SEQ ID NO: 1596338 - protein, 23 aa, Staphylococcus aureus
KANTFIVIILLLLAQIFYFYIII

SEQ ID NO: 1596339 - protein, 26 aa, Staphylococcus aureus
KANTVAKSMWAEHPLFTIIGGACLVV

SEQ ID NO: 1596340 - protein, 17 aa, Staphylococcus aureus
KAQPLISSTNYINNEDL

SEQ ID NO: 1596341 - protein, 30 aa, Staphylococcus aureus
KCIVLVFLIHPILILVFSALAFMIPAASES

SEQ ID NO: 1596342 - protein, 30 aa, Staphylococcus aureus
KCIVLVFLIHPILILVFSALTFMIPGASES

SEQ ID NO: 1596343 - protein, 36 aa, Staphylococcus aureus
KDADNMTLDSGFYKTPKYSLGDYVWYDSNKDGKQDS

SEQ ID NO: 1596344 - protein, 37 aa, Staphylococcus aureus; identical to SEQ ID NO: 1583337

SEQ ID NO: 1596345 - protein, 25 aa, Staphylococcus aureus
KDAVQIVPLIIKYASEFKIIWQNIE

SEQ ID NO: 1596346 - protein, 40 aa, Staphylococcus aureus
KDFLAQWKLYTISAVVLIMVLIGFIFWRQDDYTSRDFENK

SEQ ID NO: 1596347 - protein, 40 aa, Staphylococcus aureus
KDFLTQWKLYIISAVVLIMVLIGFIFWRQDDYTSRDFENK

SEQ ID NO: 1596348 - protein, 40 aa, Staphylococcus aureus
KDFLTQWKLYIISTVVLIMVLIGFIFWRQDDYTSRNFENK

SEQ ID NO: 1596349 - protein, 39 aa, Staphylococcus aureus
KDFLTQWKLYILSAVVLIMVLIGFIFWRQDDYTSRNFEN

SEQ ID NO: 1596350 - protein, 22 aa, Staphylococcus aureus
KDIFNVVIIMIILVLGRFITAY

SEQ ID NO: 1596351 - protein, 19 aa, Staphylococcus aureus
KDIPYKLLANFLNEFDKNV

SEQ ID NO: 1596352 - protein, 26 aa, Staphylococcus aureus
KDKAIQSINQALANKLKEIEASNATD

SEQ ID NO: 1596353 - protein, 17 aa, Staphylococcus aureus
KDKITYKYQNVASINFG

SEQ ID NO: 1596354 - protein, 17 aa, Staphylococcus aureus
KDKKLEVISSLFSVKKI

SEQ ID NO: 1596355 - protein, 19 aa, Staphylococcus aureus
KDLINQTGNPTLDKSQVEQ

SEQ ID NO: 1596356 - protein, 44 aa, Staphylococcus aureus
KDLNFRTHLSGYHKNYPYYPNYYYPVQLTWNNGVAFYSNSAQGD

SEQ ID NO: 1596357 - protein, 45 aa, Staphylococcus aureus
KDLNFRTHLSGYHKYYPYYPYYPYYPVQLTWNNGVAFYSNNAKGD

SEQ ID NO: 1596358 - protein, 26 aa, Staphylococcus aureus
KDNEHSPLLIAKRRKDKEEDVETTSI

SEQ ID NO: 1596359 - protein, 18 aa, Staphylococcus aureus
KDRMEFQMLYGFRSELAE

SEQ ID NO: 1596360 - protein, 17 aa, Staphylococcus aureus
KDTLVDIIFYSALFGFI

SEQ ID NO: 1596361 - protein, 17 aa, Staphylococcus aureus
KDVIIGFFIIFESQFDV

SEQ ID NO: 1596362 - protein, 23 aa, Staphylococcus aureus
KEAKFENGVIIRKADEKTTNNTA

SEQ ID NO: 1596363 - protein, 18 aa, Staphylococcus aureus
KEATLFHYLFSENQYKDD

SEQ ID NO: 1596364 - protein, 22 aa, Staphylococcus aureus
KEATLFHYLFSENQYKDNVYQK

SEQ ID NO: 1596365 - protein, 25 aa, Staphylococcus aureus
KEGGKFSHFAYVKPNNQSLTSVTVT

SEQ ID NO: 1596366 - protein, 28 aa, Staphylococcus aureus
KEKPMANVLVTLTYPDGTTKSVRTDANG

SEQ ID NO: 1596367 - protein, 30 aa, Staphylococcus aureus
KELAIVFVPFLLFLAIAFGVTFLMGLLNLI

SEQ ID NO: 1596368 - protein, 20 aa, Staphylococcus aureus
KELPWGVLILFGGGLALAKG

SEQ ID NO: 1596369 - protein, 23 aa, Staphylococcus aureus
KELPWGVLILFGGGLALAKGISE

SEQ ID NO: 1596370 - protein, 31 aa, Staphylococcus aureus
KEMFDKFLHPSRLPDGRWPSQTEFRLSLMQQ

SEQ ID NO: 1596371 - protein, 28 aa, Staphylococcus aureus
KENINGQFSLPLFTDRAKAPKSGTYDAN

SEQ ID NO: 1596372 - protein, 18 aa, Staphylococcus aureus
KENPGYYKQTIYINPSEN

SEQ ID NO: 1596373 - protein, 25 aa, Staphylococcus aureus
KEQQNAFYEILHLPNLNEEQRNGFI

SEQ ID NO: 1596374 - protein, 30 aa, Staphylococcus aureus
KESDKIFYKSINQYFLAPSSSFVHDVSLTV

SEQ ID NO: 1596375 - protein, 30 aa, Staphylococcus aureus
KETLDDTKHLPLLFAKRHRKEEEEDVTVEE

SEQ ID NO: 1596376 - protein, 31 aa, Staphylococcus aureus
KEVTDQFKNRIYYEHPNVASIKFGDITKTYV

SEQ ID NO: 1596377 - protein, 29 aa, Staphylococcus aureus
KEVVAKATYDILTKTYTFVFTDYVNDKEN

SEQ ID NO: 1596378 - protein, 25 aa, Staphylococcus aureus
KFAKIGSLIFVFLIGTVTIAAIVGV

SEQ ID NO: 1596379 - protein, 25 aa, Staphylococcus aureus
KFANFFKMLWLRLKAMKHYKSLNKE

SEQ ID NO: 1596380 - protein, 23 aa, Staphylococcus aureus
KFANFFQMLWLKLKAMKHYKALN

SEQ ID NO: 1596381 - protein, 19 aa, Staphylococcus aureus
KFIILYAYSMLVLLALVVS

SEQ ID NO: 1596382 - protein, 21 aa, Staphylococcus aureus
KFILPIVVGLLIWALTPFKPY

SEQ ID NO: 1596383 - protein, 27 aa, Staphylococcus aureus
KFLNPVFLVLLALILLFAFIHPLGGIS

SEQ ID NO: 1596384 - protein, 19 aa, Staphylococcus aureus
KFMVPILAGYIAVSTADKP

SEQ ID NO: 1596385 - protein, 30 aa, Staphylococcus aureus
KFQWLQNWTIFYWAWWISWAPFVGIFIARV

SEQ ID NO: 1596386 - protein, 21 aa, Staphylococcus aureus
KFRLVIEIVILELIIGAILTL

SEQ ID NO: 1596387 - protein, 28 aa, Staphylococcus aureus
KFSQVWPILIFLPFVVIFFLKINKHYRD

SEQ ID NO: 1596388 - protein, 30 aa, Staphylococcus aureus
KFSQVWPILIFLPFVVIFFLKINKHYRDIA

SEQ ID NO: 1596389 - protein, 23 aa, Staphylococcus aureus
KGAKNLYDLYISKGLTTPEKIGP

SEQ ID NO: 1596390 - protein, 19 aa, Staphylococcus aureus
KGFSFHVLLSLTEILKGCL

SEQ ID NO: 1596391 - protein, 24 aa, Staphylococcus aureus
KGLFFSVLFWLCILSFFSVLNEMV

SEQ ID NO: 1596392 - protein, 23 aa, Staphylococcus aureus
KGQKAKLFPLDYTHIFPGECIWF

SEQ ID NO: 1596393 - protein, 29 aa, Staphylococcus aureus
KGQSFNIGDIKQYFTLSNGQAIPSSSFTN

SEQ ID NO: 1596394 - protein, 30 aa, Staphylococcus aureus
KGQSFNIGDIKQYFTLSNGQAIPSSSFTNI

SEQ ID NO: 1596395 - protein, 24 aa, Staphylococcus aureus
KGQTMTFRLLLVDTPETKHPKKGV

SEQ ID NO: 1596396 - protein, 18 aa, Staphylococcus aureus
KGRTIYIATTFHASMTFG

SEQ ID NO: 1596397 - protein, 28 aa, Staphylococcus aureus
KGSIEGTKHLPLLFAKRRRKEDEEDAIV

SEQ ID NO: 1596398 - protein, 25 aa, Staphylococcus aureus
KGTFKDWLNMYINEVKGHLLLELAV

SEQ ID NO: 1596399 - protein, 24 aa, Staphylococcus aureus
KGTFKDWLNMYMNEVKGHLLLELA

SEQ ID NO: 1596400 - protein, 29 aa, Staphylococcus aureus
KGVYVLAITLWIATWWITEAIPIAATSLL

SEQ ID NO: 1596401 - protein, 43 aa, Staphylococcus aureus
KHESSTIILMIFLIGIILLSIWTRSFIIGFLAAIINVFVFNYF

SEQ ID NO: 1596402 - protein, 21 aa, Staphylococcus aureus
KHFFFIIFAYLYFGGFSFFTL

SEQ ID NO: 1596403 - protein, 21 aa, Staphylococcus aureus
KHYFESPLFKGKYSVNNSDLL

SEQ ID NO: 1596404 - protein, 25 aa, Staphylococcus aureus
KIAMLSIIFLLIITIVSIIAPLIAP

SEQ ID NO: 1596405 - protein, 27 aa, Staphylococcus aureus
KIEKMNLPGISLLPETERFYPNGNFAS

SEQ ID NO: 1596406 - protein, 29 aa, Staphylococcus aureus
KIEMQYIPFNLLHLLSLKVTSILIVLVAC

SEQ ID NO: 1596407 - protein, 21 aa, Staphylococcus aureus
KIFFTLAMLVIFKIGTYIPAP

SEQ ID NO: 1596408 - protein, 20 aa, Staphylococcus aureus
KIFTINFLVNFIVYLCMYLL

SEQ ID NO: 1596409 - protein, 19 aa, Staphylococcus aureus
KIGFIFWGVSIISLGLMMF

SEQ ID NO: 1596410 - protein, 20 aa, Staphylococcus aureus
KIHTLNWFKNTWGYMNLGAS

SEQ ID NO: 1596411 - protein, 22 aa, Staphylococcus aureus
KIHTLNWFKNTWVYMNLGASVL

SEQ ID NO: 1596412 - protein, 17 aa, Staphylococcus aureus
KIKSYFLRWIPSFHILQ

SEQ ID NO: 1596413 - protein, 20 aa, Staphylococcus aureus
KIKSYFLRWIPSFHILQSGQ

SEQ ID NO: 1596414 - protein, 19 aa, Staphylococcus aureus
KILEDGKIRYTFTNDVEHK

SEQ ID NO: 1596415 - protein, 32 aa, Staphylococcus aureus
KIQEDLIIKFPLVLLILEFELNFESKIKWGCE

SEQ ID NO: 1596416 - protein, 34 aa, Staphylococcus aureus
KIQSTLQPIMPILQMLGQIFMQVLGVLVIGIITN

SEQ ID NO: 1596417 - protein, 19 aa, Staphylococcus aureus
KISIFYLNQSFFEEPCIVV

SEQ ID NO: 1596418 - protein, 25 aa, Staphylococcus aureus
KISKQFDIKYLDGVKDRMGVTVNGR

SEQ ID NO: 1596419 - protein, 20 aa, Staphylococcus aureus
KITPIGSLATLLWLHVLTQK

SEQ ID NO: 1596420 - protein, 19 aa, Staphylococcus aureus
KITYKYQNVASINFGDINK

SEQ ID NO: 1596421 - protein, 19 aa, Staphylococcus aureus
KITYKYQNVASINFGDITK

SEQ ID NO: 1596422 - protein, 28 aa, Staphylococcus aureus
KKDLTAELTLNLFIDPTTVTKQGMEKVE

SEQ ID NO: 1596423 - protein, 18 aa, Staphylococcus aureus
KKDVFIFNKKVNGYHVWI

SEQ ID NO: 1596424 - protein, 32 aa, Staphylococcus aureus
KKEVVAKATYDILTKTYTFVFTDYVNDKENIN

SEQ ID NO: 1596425 - protein, 24 aa, Staphylococcus aureus
KKGWPSMMYRIWKNPEKYKSYFIG

SEQ ID NO: 1596426 - protein, 22 aa, Staphylococcus aureus
KKIGVMYLICAVLMFVRGGIDA

SEQ ID NO: 1596427 - protein, 22 aa, Staphylococcus aureus
KKIILTLFVLPFPIMVWGVMTQ

SEQ ID NO: 1596428 - protein, 18 aa, Staphylococcus aureus
KKIPLYRKRILSILVVVV

SEQ ID NO: 1596429 - protein, 37 aa, Staphylococcus aureus
KKKKIRKLPIILLIVVILLIALIVYIVHSYNSGVEYA

SEQ ID NO: 1596430 - protein, 38 aa, Staphylococcus aureus
KKKKIRKLPIILLIVVILLIALIVYIVHSYNSGVEYAK

SEQ ID NO: 1596431 - protein, 39 aa, Staphylococcus aureus
KKKSKRILLKILLTILIIIALFIGIMYFLSTRDNVGELR

SEQ ID NO: 1596432 - protein, 46 aa, Staphylococcus aureus
KKLDILTLFAYFKPHLLYLLIGTAIIFVICKLIAQLLIRFKTKDLA

SEQ ID NO: 1596433 - protein, 25 aa, Staphylococcus aureus
KKLEVISSLFSVKKITFDLSDAKKT

SEQ ID NO: 1596434 - protein, 22 aa, Staphylococcus aureus
KKLNKLFTSLRSKYYLFVSDPV

SEQ ID NO: 1596435 - protein, 29 aa, Staphylococcus aureus
KKMIKQILRLLFLLAMYELGKYVTEQVYI

SEQ ID NO: 1596436 - protein, 38 aa, Staphylococcus aureus
KKNKIGAVLLVGLFGLLFFILVLRISYIMITGHSNGQD

SEQ ID NO: 1596437 - protein, 23 aa, Staphylococcus aureus
KKNLIFSLVIFPFLFVPYIIIDI

SEQ ID NO: 1596438 - protein, 20 aa, Staphylococcus aureus
KKNSLLILNMLIVTLILLME

SEQ ID NO: 1596439 - protein, 43 aa, Staphylococcus aureus
KKPWPKFLTLFAGPLFNFILALVLFIGLAYYQGTPTSTVEQVA

SEQ ID NO: 1596440 - protein, 32 aa, Staphylococcus aureus
KKQSKLILIFICIFTFFLMVIQSQFLMGQSLT

SEQ ID NO: 1596441 - protein, 31 aa, Staphylococcus aureus
KKQYMLFAAGIVLATILLISAHLYSRKRGNQ

SEQ ID NO: 1596442 - protein, 19 aa, Staphylococcus aureus
KKRDEMLMFLPENIARSMS

SEQ ID NO: 1596443 - protein, 25 aa, Staphylococcus aureus
KKRTRSLLALFIMICTGCRVSGARN

SEQ ID NO: 1596444 - protein, 24 aa, Staphylococcus aureus
KKYYTIFLFFHINLATIGGVLGLV

SEQ ID NO: 1596445 - protein, 21 aa, Staphylococcus aureus
KLALAGFLKKIKGTYIETLLK

SEQ ID NO: 1596446 - protein, 25 aa, Staphylococcus aureus
KLGETFFLYLTWYSFGRFFIEGLRT

SEQ ID NO: 1596447 - protein, 26 aa, Staphylococcus aureus
KLGGKVLLLYFMFCTIISVIQNIVGV

SEQ ID NO: 1596448 - protein, 25 aa, Staphylococcus aureus
KLGRVFLLIPLTIVLILIMRFCSSE

SEQ ID NO: 1596449 - protein, 23 aa, Staphylococcus aureus
KLGWLKIIFIESLPLRAYSLEWF

SEQ ID NO: 1596450 - protein, 34 aa, Staphylococcus aureus
KLKNMDWFDIFIAGILRLFGVIALMLVVISPIYT

SEQ ID NO: 1596451 - protein, 22 aa, Staphylococcus aureus
KLPLYIVFTLFVAVAIIMNVWF

SEQ ID NO: 1596452 - protein, 55 aa, Staphylococcus aureus
KLPQALEGLKPTLIYPLLTVTATGLLMIYAFNPPASWLNHLLLDGLNNLSGSNIV

SEQ ID NO: 1596453 - protein, 17 aa, Staphylococcus aureus
KLPVRLVSYSPVPEDHA

SEQ ID NO: 1596454 - protein, 24 aa, Staphylococcus aureus
KLQKNPWIVLGMLLVKLKILLAII

SEQ ID NO: 1596455 - protein, 22 aa, Staphylococcus aureus
KLRLDMREIPKSSIKSEHFHLM

SEQ ID NO: 1596456 - protein, 28 aa, Staphylococcus aureus
KLTGETIPYVFILIDNFDAVKDSPFQEV

SEQ ID NO: 1596457 - protein, 25 aa, Staphylococcus aureus
KLTSNRFWIGIAAPTVVSIIGIIIG

SEQ ID NO: 1596458 - protein, 22 aa, Staphylococcus aureus
KLTYKYRRFVTPVTIRIKASDR

SEQ ID NO: 1596459 - protein, 21 aa, Staphylococcus aureus
KMMFYNKYKNVSTYIIIFLVS

SEQ ID NO: 1596460 - protein, 25 aa, Staphylococcus aureus
KMPGAFMILFILTVVAVIATWVIPA

SEQ ID NO: 1596461 - protein, 18 aa, Staphylococcus aureus
KMPNVIGLPKEQALQKLK

SEQ ID NO: 1596462 - protein, 41 aa, Staphylococcus aureus
KMSTTVKVVSIATVLLLLGGLVFAIFAYVDHSNKAKERMLN

SEQ ID NO: 1596463 - protein, 36 aa, Staphylococcus aureus; identical to SEQ ID NO: 1581170

SEQ ID NO: 1596464 - protein, 25 aa, Staphylococcus aureus
KNALLYLLFCWTGIPGVIGMVEGVL

SEQ ID NO: 1596465 - protein, 20 aa, Staphylococcus aureus
KNDLKEIPQLVTKKNDVSET

SEQ ID NO: 1596466 - protein, 37 aa, Staphylococcus aureus
KNDNPIRYVIAILVVVLMVLGVFQLGIIGCLIDSFFN

SEQ ID NO: 1596467 - protein, 25 aa, Staphylococcus aureus
KNGFTFFLNVLLPLVFISVLIGIFN

SEQ ID NO: 1596468 - protein, 24 aa, Staphylococcus aureus
KNGGYQVMIVIPENFSKLAMQLDA

SEQ ID NO: 1596469 - protein, 20 aa, Staphylococcus aureus
KNICLSLFAYILFGGLSTMA

SEQ ID NO: 1596470 - protein, 26 aa, Staphylococcus aureus
KNIHEPWLFSLPSLILMVLVPVIFFV

SEQ ID NO: 1596471 - protein, 37 aa, Staphylococcus aureus
KNIHEPWLFSLPSLLLMGLIPIIFFVPNILGKGIIVP

SEQ ID NO: 1596472 - protein, 25 aa, Staphylococcus aureus
KNIRDIKMWILGLIGTIFSTIVIAI

SEQ ID NO: 1596473 - protein, 17 aa, Staphylococcus aureus
KNMIENYGLIALKDDYI

SEQ ID NO: 1596474 - protein, 29 aa, Staphylococcus aureus
KNNLSADLGIYKPKYNLGDYVWEDTNKNG

SEQ ID NO: 1596475 - protein, 41 aa, Staphylococcus aureus
KNSERRGMLKGCGGCLISFILLIILLSACSMMFSNNDNSTI

SEQ ID NO: 1596476 - protein, 26 aa, Staphylococcus aureus
KNTMKKMLQNLWWGAGYNVIAVPLAA

SEQ ID NO: 1596477 - protein, 31 aa, Staphylococcus aureus
KNTMKKMVQNLWWGAGYNVIAVPLAAGILAS

SEQ ID NO: 1596478 - protein, 22 aa, Staphylococcus aureus
KNVCFTLFGYILFGGLTMLFLN

SEQ ID NO: 1596479 - protein, 40 aa, Staphylococcus aureus
KNWVKSGIKEIEMFKIMGLPFISHSLVSQDNQSISKKMTG

SEQ ID NO: 1596480 - protein, 25 aa, Staphylococcus aureus
KPAPGKVVLLLAHRGTVSSGTEGSG

SEQ ID NO: 1596481 - protein, 22 aa, Staphylococcus aureus
KPEHFHLMYLLEQHSPYFIDAE

SEQ ID NO: 1596482 - protein, 17 aa, Staphylococcus aureus
KPESQAERLANAAKQKQ

SEQ ID NO: 1596483 - protein, 20 aa, Staphylococcus aureus
KPIILLPLVPFIFISFFINS

SEQ ID NO: 1596484 - protein, 17 aa, Staphylococcus aureus
KPISTYWFHAQFWNDRA

SEQ ID NO: 1596485 - protein, 18 aa, Staphylococcus aureus
KPISTYWFHAQYWNDRAK

SEQ ID NO: 1596486 - protein, 19 aa, Staphylococcus aureus
KPIVYGFKSFLIGSTYIFS

SEQ ID NO: 1596487 - protein, 41 aa, Staphylococcus aureus
KPKKKSTRKIVLLSLIFSLLMIALVSFVAMAMFGNKYEGTP

SEQ ID NO: 1596488 - protein, 40 aa, Staphylococcus aureus
KPKKKSTRKIVLLSLIFSLLMIALVSFVAMSMFGNKYEET

SEQ ID NO: 1596489 - protein, 25 aa, Staphylococcus aureus
KPKSTAPKRLNTRMRMAAVQPSSTD

SEQ ID NO: 1596490 - protein, 29 aa, Staphylococcus aureus
KPQNLTLNFMISFLFVISATVIGIFLYVM

SEQ ID NO: 1596491 - protein, 41 aa, Staphylococcus aureus
KPWPKFLTLFAGPLFNFILALVLFIGLAYYQGTPTSTVEQV

SEQ ID NO: 1596492 - protein, 18 aa, Staphylococcus aureus
KQAIADHDTIVAGGNYTN

SEQ ID NO: 1596493 - protein, 18 aa, Staphylococcus aureus
KQAIADHDTIVASGNYTN

SEQ ID NO: 1596494 - protein, 28 aa, Staphylococcus aureus
KQEKKIFPYILMSVGAFLTLGFVIFSIH

SEQ ID NO: 1596495 - protein, 17 aa, Staphylococcus aureus
KQGVNFTDADKAKRDAY

SEQ ID NO: 1596496 - protein, 34 aa, Staphylococcus aureus
KQKRQKLLRTTFILLTLVGIGLTVFSFISNNMLF

SEQ ID NO: 1596497 - protein, 17 aa, Staphylococcus aureus
KQMGYVYFSWLLGLLVG

SEQ ID NO: 1596498 - protein, 26 aa, Staphylococcus aureus
KQNIVVFFIFVIFHLKDFDYTNPESY

SEQ ID NO: 1596499 - protein, 34 aa, Staphylococcus aureus
KQNNKYYFQAVLNNASFWKEYKFYNANNQELATT

SEQ ID NO: 1596500 - protein, 35 aa, Staphylococcus aureus
KQNNKYYFQAVLNNASFWKEYKFYNVNNQELATTV

SEQ ID NO: 1596501 - protein, 26 aa, Staphylococcus aureus
KQSFESQITQAPLVTDVTIINQKAQA

SEQ ID NO: 1596502 - protein, 42 aa, Staphylococcus aureus
KQTPIGIKFRLLKIGLILFCVLFFLFPVILMFVFSPEEDKQT

SEQ ID NO: 1596503 - protein, 20 aa, Staphylococcus aureus
KQVQALIDEIDRNPILTDKE

SEQ ID NO: 1596504 - protein, 26 aa, Staphylococcus aureus
KQVQALIDEIDRNPILTDKEKQALKD

SEQ ID NO: 1596505 - protein, 33 aa, Staphylococcus aureus
KQYKPFWIVMSFIILIVVLLLPTPSSLPIMAKA

SEQ ID NO: 1596506 - protein, 26 aa, Staphylococcus aureus
KQYSLLFLGIIILLSILIFISSQFTL

SEQ ID NO: 1596507 - protein, 17 aa, Staphylococcus aureus
KRDVFIFNKKVNGYHVW

SEQ ID NO: 1596508 - protein, 24 aa, Staphylococcus aureus
KRFPLYILMFEQIISILWVYIVLL

SEQ ID NO: 1596509 - protein, 25 aa, Staphylococcus aureus
KRIAVSILIIFILASGLSMFVDQLP

SEQ ID NO: 1596510 - protein, 31 aa, Staphylococcus aureus
KRLNEIVICISFLFLTIFIGGCGTGKEAEIK

SEQ ID NO: 1596511 - protein, 35 aa, Staphylococcus aureus
KRLNTLMFYILLIIHYFIICYFVFSVHPMLSLFFF

SEQ ID NO: 1596512 - protein, 21 aa, Staphylococcus aureus
KRMLYTCFILFIYILGTNISI

SEQ ID NO: 1596513 - protein, 27 aa, Staphylococcus aureus
KRWLIPLLILYILIVLKFTLSIQFGAF

SEQ ID NO: 1596514 - protein, 21 aa, Staphylococcus aureus
KRYYNFFGIGAFDSSAVRSGK

SEQ ID NO: 1596515 - protein, 17 aa, Staphylococcus aureus
KSDYVAEPPLFFFSGRL

SEQ ID NO: 1596516 - protein, 23 aa, Staphylococcus aureus
KSEHFHLMYLLEQHSPYFIDAEL

SEQ ID NO: 1596517 - protein, 19 aa, Staphylococcus aureus
KSEIIQSYILSLAINFHPH

SEQ ID NO: 1596518 - protein, 19 aa, Staphylococcus aureus
KSFIWIVYCMLFTLVLKFT

SEQ ID NO: 1596519 - protein, 22 aa, Staphylococcus aureus
KSGDYFTAKLPDSLTGNGDVDY

SEQ ID NO: 1596520 - protein, 20 aa, Staphylococcus aureus
KSGNIFYTWDKVFGMPETTN

SEQ ID NO: 1596521 - protein, 26 aa, Staphylococcus aureus
KSGTTNFSLSMTASTGGATNLQQVQF

SEQ ID NO: 1596522 - protein, 19 aa, Staphylococcus aureus
KSHLLYEVLMIYRLLDSRY

SEQ ID NO: 1596523 - protein, 22 aa, Staphylococcus aureus
KSIEDAIQHMIDEIKARTDLTD

SEQ ID NO: 1596524 - protein, 31 aa, Staphylococcus aureus
KSIGVASVLVGTLIGFGLLSSKEADASENSM

SEQ ID NO: 1596525 - protein, 31 aa, Staphylococcus aureus
KSIGVASVLVGTLIGFGLLSSKEADASENSV

SEQ ID NO: 1596526 - protein, 30 aa, Staphylococcus aureus
KSIIAIISLGILTYTTMIGSVLADEIKYPL

SEQ ID NO: 1596527 - protein, 28 aa, Staphylococcus aureus
KSILKNKGRNIFTMIGIIIGISSVITIM

SEQ ID NO: 1596528 - protein, 25 aa, Staphylococcus aureus
KSMLLIYPHELFIPATILSLLILFF

SEQ ID NO: 1596529 - protein, 25 aa, Staphylococcus aureus
KSMMVPLIIMIAMFFIHFNTTLIML

SEQ ID NO: 1596530 - protein, 24 aa, Staphylococcus aureus
KSRDIELLFLIESILICVTSGFIG

SEQ ID NO: 1596531 - protein, 26 aa, Staphylococcus aureus
KSTIQAFIHSILFGFPTKKSKEPRLE

SEQ ID NO: 1596532 - protein, 18 aa, Staphylococcus aureus
KSVHFTSLKTGPMGDAVI

SEQ ID NO: 1596533 - protein, 28 aa, Staphylococcus aureus
KSYFNGAPWLFFFPGVLLGGFALLCQMI

SEQ ID NO: 1596534 - protein, 22 aa, Staphylococcus aureus
KSYYNFFGIGAFDSSAVRSGKS

SEQ ID NO: 1596535 - protein, 25 aa, Staphylococcus aureus
KTENTEQQFPPRNAQRRKRRRDLAT

SEQ ID NO: 1596536 - protein, 18 aa, Staphylococcus aureus
KTILYFEIITTIAIGLGI

SEQ ID NO: 1596537 - protein, 19 aa, Staphylococcus aureus
KTIPVVYNPGVSNSYTNVN

SEQ ID NO: 1596538 - protein, 25 aa, Staphylococcus aureus
KTKLRLYMREIPKSSIKPEHFHLMY

SEQ ID NO: 1596539 - protein, 24 aa, Staphylococcus aureus
KTKSIVFYHLKLDKDLAPIFGLSS

SEQ ID NO: 1596540 - protein, 23 aa, Staphylococcus aureus
KTYIFFNIIFIDFYYYIYNVHLM

SEQ ID NO: 1596541 - protein, 23 aa, Staphylococcus aureus
KVASFAMRLLLGSTLASIISGSI

SEQ ID NO: 1596542 - protein, 21 aa, Staphylococcus aureus
KVEFNTPDDQITTPYIVVVNG

SEQ ID NO: 1596543 - protein, 28 aa, Staphylococcus aureus
KVEVTANLEINLFIDPKTFQSNGEEKVT

SEQ ID NO: 1596544 - protein, 18 aa, Staphylococcus aureus
KVFALYFVSIVTANIIVK

SEQ ID NO: 1596545 - protein, 17 aa, Staphylococcus aureus
KVIVNVPVKVVEKELTV

SEQ ID NO: 1596546 - protein, 26 aa, Staphylococcus aureus
KVLSTFFFILLLYITYRKNKIVYAPI

SEQ ID NO: 1596547 - protein, 26 aa, Staphylococcus aureus
KVLSTFLFILLLYIAYRKNKIVYAPI

SEQ ID NO: 1596548 - protein, 26 aa, Staphylococcus aureus
KVMANGQVIGERKIRYTFTDYIDNKK

SEQ ID NO: 1596549 - protein, 25 aa, Staphylococcus aureus
KVMMPLLFVFLIVIVIKSLTLDGVL

SEQ ID NO: 1596550 - protein, 34 aa, Staphylococcus aureus
KVQNNGSYSLNFDKLDKTYVIHYTGDYLNGTSEV

SEQ ID NO: 1596551 - protein, 18 aa, Staphylococcus aureus
KVSSFAMRLLLGSTLASI

SEQ ID NO: 1596552 - protein, 17 aa, Staphylococcus aureus
KVVLLPTHRGTVSSGRE

SEQ ID NO: 1596553 - protein, 21 aa, Staphylococcus aureus
KVVLLPTHRGTVSSGTEGSGR

SEQ ID NO: 1596554 - protein, 30 aa, Staphylococcus aureus
KVYTSAKQFFSTVLIPLSTSMKTLSDLTKQ

SEQ ID NO: 1596555 - protein, 20 aa, Staphylococcus aureus
KWIACLLVAFPIFTSFTTYC

SEQ ID NO: 1596556 - protein, 17 aa, Staphylococcus aureus
KWILGLLGLIPIYLGIK

SEQ ID NO: 1596557 - protein, 22 aa, Staphylococcus aureus
KWLGIVFAILITITFAFVFNTV

SEQ ID NO: 1596558 - protein, 19 aa, Staphylococcus aureus
KWLLVLCVFVIIVNASWNT

SEQ ID NO: 1596559 - protein, 24 aa, Staphylococcus aureus
KWTGLFILIGLFVANWTVGLAAML

SEQ ID NO: 1596560 - protein, 24 aa, Staphylococcus aureus
KYAINLLFIICVILGILGLIISLF

SEQ ID NO: 1596561 - protein, 34 aa, Staphylococcus aureus
KYIIFGVILVITLLIIGIAYYLISLNNAKGQIKE

SEQ ID NO: 1596562 - protein, 25 aa, Staphylococcus aureus
KYILVTFWTIIILTLLITFPTNSHH

SEQ ID NO: 1596563 - protein, 25 aa, Staphylococcus aureus
KYILVTVWTIIILTLLITFPTNSHH

SEQ ID NO: 1596564 - protein, 17 aa, Staphylococcus aureus
KYKWHILISFTLSIVLF

SEQ ID NO: 1596565 - protein, 22 aa, Staphylococcus aureus
KYMGLFGAILFIIIVGATAILL

SEQ ID NO: 1596566 - protein, 24 aa, Staphylococcus aureus
KYPIDLLFIICVILGILGLIISLF

SEQ ID NO: 1596567 - protein, 21 aa, Staphylococcus aureus
KYRDVLVPPFLIQILVENAIK

SEQ ID NO: 1596568 - protein, 40 aa, Staphylococcus aureus
KYRNHRKKIVIIFYTILVLLTILLIASFIRASKANNESKE

SEQ ID NO: 1596569 - protein, 23 aa, Staphylococcus aureus
KYRNVLVPPFLIQILVENAIKHA

SEQ ID NO: 1596570 - protein, 21 aa, Staphylococcus aureus
KYSIRKYSIGVVSMLAATMFV

SEQ ID NO: 1596571 - protein, 17 aa, Staphylococcus aureus
LAAVLLGLIILVAAAIP

SEQ ID NO: 1596572 - protein, 23 aa, Staphylococcus aureus
LAGDPYYSGMALLSDISSPAQKL

SEQ ID NO: 1596573 - protein, 17 aa, Staphylococcus aureus
LAGLIFWYPKMMGYKLN

SEQ ID NO: 1596574 - protein, 18 aa, Staphylococcus aureus
LAILLMPFLYFTTAWSIA

SEQ ID NO: 1596575 - protein, 28 aa, Staphylococcus aureus
LAIVCSMMVVFSIMLFLFVKRNKKKNKN

SEQ ID NO: 1596576 - protein, 21 aa, Staphylococcus aureus
LAKMFVMMFGVTIFAFMGYEH

SEQ ID NO: 1596577 - protein, 18 aa, Staphylococcus aureus
LALAGFLKKVKGTYIETL

SEQ ID NO: 1596578 - protein, 20 aa, Staphylococcus aureus
LALAGFLKKVKGTYIETLLK

SEQ ID NO: 1596579 - protein, 27 aa, Staphylococcus aureus
LALLHDVFIIVAIFSLFRIEVDLTFIA

SEQ ID NO: 1596580 - protein, 18 aa, Staphylococcus aureus
LALSAYILWGILPIYWQF

SEQ ID NO: 1596581 - protein, 18 aa, Staphylococcus aureus
LANYTPFIDWLGYIFYPF

SEQ ID NO: 1596582 - protein, 18 aa, Staphylococcus aureus
LAQAKQDAIANLDTLRDL

SEQ ID NO: 1596583 - protein, 19 aa, Staphylococcus aureus
LAQAKQEALANLDTLRDLN

SEQ ID NO: 1596584 - protein, 31 aa, Staphylococcus aureus
LAQAKQEALANLDTLRDLNQPQRDALRNQIN

SEQ ID NO: 1596585 - protein, 25 aa, Staphylococcus aureus
LARTLGYIILSTCVSFLFVVIGLSI

SEQ ID NO: 1596586 - protein, 17 aa, Staphylococcus aureus
LASLLVSITLVPALAAT

SEQ ID NO: 1596587 - protein, 22 aa, Staphylococcus aureus
LASNLAFTFLLLKASKDFLATL

SEQ ID NO: 1596588 - protein, 32 aa, Staphylococcus aureus
LATEIIIPVWKLIIIWFLRVALSLLITIPVAL

SEQ ID NO: 1596589 - protein, 30 aa, Staphylococcus aureus
LATIIIFLSLLFMIIYIDDIQKWFNQYTDK

SEQ ID NO: 1596590 - protein, 29 aa, Staphylococcus aureus
LATIIIFLSLLFTFIYIDDIQKWFNQYTD

SEQ ID NO: 1596591 - protein, 18 aa, Staphylococcus aureus
LAVLAIMIPIFGVGKTPT

SEQ ID NO: 1596592 - protein, 26 aa, Staphylococcus aureus
LAVLLQFVFAVKLRWFPVAGWEGIST

SEQ ID NO: 1596593 - protein, 28 aa, Staphylococcus aureus
LAVLLQYVFAVKLRWFPVAGWEGFSTAV

SEQ ID NO: 1596594 - protein, 23 aa, Staphylococcus aureus
LCFLILPFFLITGATADAVANPV

SEQ ID NO: 1596595 - protein, 21 aa, Staphylococcus aureus
LCFLILPLCLVMGATAYAVAN

SEQ ID NO: 1596596 - protein, 25 aa, Staphylococcus aureus
LCLTLILLMLVVTLFFLNNSRYFNP

SEQ ID NO: 1596597 - protein, 17 aa, Staphylococcus aureus
LCLTLILLMLVVTLFFS

SEQ ID NO: 1596598 - protein, 36 aa, Staphylococcus aureus
LCTFVSWLLIPHKITRYILGTLFTLALTLTIIGITA

SEQ ID NO: 1596599 - protein, 42 aa, Staphylococcus aureus
LDFLPNKLNKYSIRRFTVGTASILVGATLIFGVANDQAEAAE

SEQ ID NO: 1596600 - protein, 29 aa, Staphylococcus aureus
LDGNGRLGRILIILMLVNAGVIDKPVFLL

SEQ ID NO: 1596601 - protein, 26 aa, Staphylococcus aureus
LDKVKHTPFFLPKRHKEDVKVTNENT

SEQ ID NO: 1596602 - protein, 24 aa, Staphylococcus aureus
LDKWHWLFIINIISSMLCLLLGYF

SEQ ID NO: 1596603 - protein, 19 aa, Staphylococcus aureus
LDMQPAHLFFMIAAPEGGA

SEQ ID NO: 1596604 - protein, 25 aa, Staphylococcus aureus
LDNAMGAVHQYIDEQHLGVISSTNY

SEQ ID NO: 1596605 - protein, 18 aa, Staphylococcus aureus
LDNWWIVTFIFVAQVILS

SEQ ID NO: 1596606 - protein, 23 aa, Staphylococcus aureus
LDTLDKSYVIHYSGEYLNGTNEV

SEQ ID NO: 1596607 - protein, 17 aa, Staphylococcus aureus
LEGIFKTLLNKNSQVVF

SEQ ID NO: 1596608 - protein, 44 aa, Staphylococcus aureus
LELDFLMFIRRFIVLLFVFACITTLLWLISYSLLLKLSIPLILK

SEQ ID NO: 1596609 - protein, 18 aa, Staphylococcus aureus
LERYRIWFQKDEDWNPFG

SEQ ID NO: 1596610 - protein, 37 aa, Staphylococcus aureus
LESVLTTRQVFLGKAGFFIMLGMLQALIVSVGDLLIL

SEQ ID NO: 1596611 - protein, 17 aa, Staphylococcus aureus
LETPFGYLISLDKVLNS

SEQ ID NO: 1596612 - protein, 17 aa, Staphylococcus aureus
LFFFHVILVIVRRFNPY

SEQ ID NO: 1596613 - protein, 25 aa, Staphylococcus aureus
LFGFILLIPILYKGLIKRITGKSNI

SEQ ID NO: 1596614 - protein, 25 aa, Staphylococcus aureus
LFGFTLLIPVLYKGLIKRITGKSHI

SEQ ID NO: 1596615 - protein, 17 aa, Staphylococcus aureus
LFGMLQMFMTKESIADR

SEQ ID NO: 1596616 - protein, 19 aa, Staphylococcus aureus
LFGVCIITILLLCSSVILL

SEQ ID NO: 1596617 - protein, 18 aa, Staphylococcus aureus
LFIMFPPEKRGMAMGMFG

SEQ ID NO: 1596618 - protein, 30 aa, Staphylococcus aureus
LFIVLKSSLFFYYLFTKLSLISVLVLHLKQ

SEQ ID NO: 1596619 - protein, 20 aa, Staphylococcus aureus
LFIVSLYWHFLDVVWVFIFT

SEQ ID NO: 1596620 - protein, 18 aa, Staphylococcus aureus
LFKNLFYEDIKSFEDTDK

SEQ ID NO: 1596621 - protein, 17 aa, Staphylococcus aureus
LFLPAAATLSVALETLL

SEQ ID NO: 1596622 - protein, 22 aa, Staphylococcus aureus
LFMPMIFMFLLGAFTKSAQFPF

SEQ ID NO: 1596623 - protein, 20 aa, Staphylococcus aureus
LFNIIMMYVIGLIVTLGIGS

SEQ ID NO: 1596624 - protein, 21 aa, Staphylococcus aureus
LFSIIMMYVIGLIVTLGIGSS

SEQ ID NO: 1596625 - protein, 28 aa, Staphylococcus aureus
LFSLLASLLVLWLYFRKAIPKTFEDNKI

SEQ ID NO: 1596626 - protein, 17 aa, Staphylococcus aureus
LFTIIFSLKCKIHLFFN

SEQ ID NO: 1596627 - protein, 20 aa, Staphylococcus aureus
LFYCLVIFPMTIVVYLRVSQ

SEQ ID NO: 1596628 - protein, 18 aa, Staphylococcus aureus
LGAAILFSFMRFSNVMTP

SEQ ID NO: 1596629 - protein, 21 aa, Staphylococcus aureus
LGAISWFFLSLILSLTQFTPF

SEQ ID NO: 1596630 - protein, 17 aa, Staphylococcus aureus
LGALAITGAVGGLGMGV

SEQ ID NO: 1596631 - protein, 26 aa, Staphylococcus aureus
LGETTVSKIFNIQYLGGVRDNWRVTA

SEQ ID NO: 1596632 - protein, 19 aa, Staphylococcus aureus
LGFIFLMFLSGLEIDFKAF

SEQ ID NO: 1596633 - protein, 28 aa, Staphylococcus aureus
LGFIRNDLIDYLDCKVLFIGNLDELNKK

SEQ ID NO: 1596634 - protein, 32 aa, Staphylococcus aureus
LGFSIYFFVDTIWLFILLYAIFQGLFAPAMPQ

SEQ ID NO: 1596635 - protein, 31 aa, Staphylococcus aureus
LGGLSWPIVLVILILFYFYSHYLFASSTAHI

SEQ ID NO: 1596636 - protein, 26 aa, Staphylococcus aureus
LGICLVLLIILIVGYVIMTKINSRSA

SEQ ID NO: 1596637 - protein, 26 aa, Staphylococcus aureus
LGICLVLLIILIVGYVIMTKTNGRNA

SEQ ID NO: 1596638 - protein, 27 aa, Staphylococcus aureus
LGIGGAVAAVLFTRKDSRDKLKAEYNK

SEQ ID NO: 1596639 - protein, 27 aa, Staphylococcus aureus
LGIILFFFIIFVHNFDFMLYITILMLV

SEQ ID NO: 1596640 - protein, 17 aa, Staphylococcus aureus
LGIILIISGYYYSLRIV

SEQ ID NO: 1596641 - protein, 19 aa, Staphylococcus aureus
LGIILIISGYYYSLRIVHY

SEQ ID NO: 1596642 - protein, 29 aa, Staphylococcus aureus
LGISLIAIMLIVCIVLVIMMMTGGKKDKY

SEQ ID NO: 1596643 - protein, 22 aa, Staphylococcus aureus
LGITWLYLRYVAFRHDLKYLPG

SEQ ID NO: 1596644 - protein, 33 aa, Staphylococcus aureus
LGLSKNQAYNFLITSSQRWGLNQGINANGWMRT

SEQ ID NO: 1596645 - protein, 20 aa, Staphylococcus aureus
LGMLLITKYAINLLFIICVI

SEQ ID NO: 1596646 - protein, 19 aa, Staphylococcus aureus
LGMLLITKYTIDLLFIICV

SEQ ID NO: 1596647 - protein, 24 aa, Staphylococcus aureus
LGMYLLSFWMINALLRISFDIKGL

SEQ ID NO: 1596648 - protein, 20 aa, Staphylococcus aureus
LGNIKWFEYLYNNKDIFSVL

SEQ ID NO: 1596649 - protein, 29 aa, Staphylococcus aureus
LGSAGAARLLLFFGLLDAGSAIATSSGLF

SEQ ID NO: 1596650 - protein, 33 aa, Staphylococcus aureus
LGSNNWSFVLTWLPIEIKLALITTLIALFSTLI

SEQ ID NO: 1596651 - protein, 17 aa, Staphylococcus aureus
LGTLLISGGVTPAANAA

SEQ ID NO: 1596652 - protein, 28 aa, Staphylococcus aureus
LGVASVAISTLLLLMSNGEAQAAEETGG

SEQ ID NO: 1596653 - protein, 25 aa, Staphylococcus aureus
LGVASVIVSTLFLITSQHQAHAAEN

SEQ ID NO: 1596654 - protein, 48 aa, Staphylococcus aureus
LGVLPNKTQWWLVIPVGLVYAVIYYFVFRFLIVKLKYKTPGREDKQSQ

SEQ ID NO: 1596655 - protein, 21 aa, Staphylococcus aureus
LHLYILVMPILFAVIGFFGIH

SEQ ID NO: 1596656 - protein, 23 aa, Staphylococcus aureus
LHPPMIVHYFFDLMVTMGILCFV

SEQ ID NO: 1596657 - protein, 20 aa, Staphylococcus aureus
LHYGYYICLAVMFVIAVVLI

SEQ ID NO: 1596658 - protein, 24 aa, Staphylococcus aureus
LIAFNILNWLFWEILDNHISIVSS

SEQ ID NO: 1596659 - protein, 25 aa, Staphylococcus aureus
LIAIKTFLHLINKIKLIPFAIYRIV

SEQ ID NO: 1596660 - protein, 17 aa, Staphylococcus aureus
LIALFYVCFYKITKYPI

SEQ ID NO: 1596661 - protein, 17 aa, Staphylococcus aureus
LIDVTDKFKITYSNDNK

SEQ ID NO: 1596662 - protein, 19 aa, Staphylococcus aureus
LIFRGFLLRVFFRKHLFIG

SEQ ID NO: 1596663 - protein, 25 aa, Staphylococcus aureus
LIGFFVFFFTFLISGIGLLKERTSG

SEQ ID NO: 1596664 - protein, 31 aa, Staphylococcus aureus
LIGLILGPLLFLLTLLFFHPQDLPWEGVYVL

SEQ ID NO: 1596665 - protein, 30 aa, Staphylococcus aureus
LIGLILGPLLFLLTLLFFHPQDLPWKGVYV

SEQ ID NO: 1596666 - protein, 19 aa, Staphylococcus aureus
LIGMLMLIGIVVTNAIVLI

SEQ ID NO: 1596667 - protein, 20 aa, Staphylococcus aureus
LIGMLMLIGIVVTNAIVLID

SEQ ID NO: 1596668 - protein, 18 aa, Staphylococcus aureus
LIGRIIALVSKFGLLRAG

SEQ ID NO: 1596669 - protein, 26 aa, Staphylococcus aureus
LIGSLWLMLSIIPLSIILGIGKAIYL

SEQ ID NO: 1596670 - protein, 19 aa, Staphylococcus aureus
LIGTILSTFVIALLKTIFG

SEQ ID NO: 1596671 - protein, 18 aa, Staphylococcus aureus
LIGVAYFLTAAQNLILVL

SEQ ID NO: 1596672 - protein, 27 aa, Staphylococcus aureus
LIGVVVAKISMPNVENMSFAIPVNEVQ

SEQ ID NO: 1596673 - protein, 17 aa, Staphylococcus aureus
LIGYVFAPIAFLMGIPW

SEQ ID NO: 1596674 - protein, 25 aa, Staphylococcus aureus
LIHWISILPVIIFNKGPRVVKYINI

SEQ ID NO: 1596675 - protein, 18 aa, Staphylococcus aureus
LIIFSSWYLHYSQQAIFN

SEQ ID NO: 1596676 - protein, 18 aa, Staphylococcus aureus
LIIIAFVISFVALADLFD

SEQ ID NO: 1596677 - protein, 25 aa, Staphylococcus aureus
LIIILAYVLMNIPYFKNLMNRRRTW

SEQ ID NO: 1596678 - protein, 18 aa, Staphylococcus aureus
LIILCCLLTIIVFKRSEK

SEQ ID NO: 1596679 - protein, 20 aa, Staphylococcus aureus
LIITQLLYFIDESLAFLIFV

SEQ ID NO: 1596680 - protein, 23 aa, Staphylococcus aureus
LIIVFLYFFNLNIIDIIFLILLN

SEQ ID NO: 1596681 - protein, 19 aa, Staphylococcus aureus
LILAQIVLPLITPSAEDTT

SEQ ID NO: 1596682 - protein, 20 aa, Staphylococcus aureus
LILIVVVVGFGIYFYASKDK

SEQ ID NO: 1596683 - protein, 19 aa, Staphylococcus aureus
LILLFILLCFPFTPNTLIN

SEQ ID NO: 1596684 - protein, 19 aa, Staphylococcus aureus
LILLMLVVTLFFSNNSRYF

SEQ ID NO: 1596685 - protein, 18 aa, Staphylococcus aureus
LILTIIYMLLYSLATFIP

SEQ ID NO: 1596686 - protein, 17 aa, Staphylococcus aureus
LILVFMLTLSIVSQFTF

SEQ ID NO: 1596687 - protein, 27 aa, Staphylococcus aureus
LIMLITAPFIPLFYIIFGLKTRDEAKD

SEQ ID NO: 1596688 - protein, 25 aa, Staphylococcus aureus
LIPQQWVIGLLGLLPLYLGVKIWIK

SEQ ID NO: 1596689 - protein, 17 aa, Staphylococcus aureus
LIPTFKNICLSLFAYIL

SEQ ID NO: 1596690 - protein, 21 aa, Staphylococcus aureus
LIPYALVFIGLIIFISVVILI

SEQ ID NO: 1596691 - protein, 19 aa, Staphylococcus aureus
LIPYARKLEVLYEDAFIII

SEQ ID NO: 1596692 - protein, 21 aa, Staphylococcus aureus
LIPYLLWMVIFIIVPVVLLIY

SEQ ID NO: 1596693 - protein, 24 aa, Staphylococcus aureus
LIRFDFDMKTLMTVAVIGAAIIGE

SEQ ID NO: 1596694 - protein, 20 aa, Staphylococcus aureus
LISGLLFLFFFKENEEIIPE

SEQ ID NO: 1596695 - protein, 18 aa, Staphylococcus aureus
LISLFGVCIITILLLCSS

SEQ ID NO: 1596696 - protein, 22 aa, Staphylococcus aureus
LISLFLILFSCLTFFFGLDYER

SEQ ID NO: 1596697 - protein, 17 aa, Staphylococcus aureus
LISLYIVIGFSIYIVDV

SEQ ID NO: 1596698 - protein, 31 aa, Staphylococcus aureus
LISTIFLLIMVPFFLIYMLKDHEKFIPAVAK

SEQ ID NO: 1596699 - protein, 19 aa, Staphylococcus aureus
LISVLILSLLVVSWQVALL

SEQ ID NO: 1596700 - protein, 23 aa, Staphylococcus aureus
LISVLILSLLVVSWQVALLSFLA

SEQ ID NO: 1596701 - protein, 28 aa, Staphylococcus aureus
LITAVITVVAYIFINQKINGLNKTDQAN

SEQ ID NO: 1596702 - protein, 19 aa, Staphylococcus aureus
LITAVITVVAYIFINQKIS

SEQ ID NO: 1596703 - protein, 24 aa, Staphylococcus aureus
LITNKALLPRVPVDKLPNLKKIVV

SEQ ID NO: 1596704 - protein, 20 aa, Staphylococcus aureus
LITWFYTMLWSIVGVVWIVF

SEQ ID NO: 1596705 - protein, 23 aa, Staphylococcus aureus
LIVLVACLLFIHNSIDLPTFIMI

SEQ ID NO: 1596706 - protein, 17 aa, Staphylococcus aureus
LIVLVGLILLRLFKINL

SEQ ID NO: 1596707 - protein, 17 aa, Staphylococcus aureus
LIYQNNIFGLKDKVDWV

SEQ ID NO: 1596708 - protein, 31 aa, Staphylococcus aureus
LKETKVFPMWLRWSLFIILVGVDTYIAITCL

SEQ ID NO: 1596709 - protein, 20 aa, Staphylococcus aureus
LKGIILAIVGACLWGLGGTV

SEQ ID NO: 1596710 - protein, 23 aa, Staphylococcus aureus
LKGYVQPFWPLVIINVFEEFTST

SEQ ID NO: 1596711 - protein, 19 aa, Staphylococcus aureus
LKIFLLCFAGNILGAAILF

SEQ ID NO: 1596712 - protein, 35 aa, Staphylococcus aureus
LKKQSKLILIFICIFTFFIMIIQSQFLMGQSLTDY

SEQ ID NO: 1596713 - protein, 19 aa, Staphylococcus aureus
LKQIKFQYAITKKQLYRTD

SEQ ID NO: 1596714 - protein, 24 aa, Staphylococcus aureus
LKQIKFQYAITKRQLYRTDLLFQF

SEQ ID NO: 1596715 - protein, 32 aa, Staphylococcus aureus
LKSERSFSIFLSISLVLIITGSIVFNLCKNGE

SEQ ID NO: 1596716 - protein, 24 aa, Staphylococcus aureus
LKSVIMLIVLFFLIIFGIVACSTN

SEQ ID NO: 1596717 - protein, 29 aa, Staphylococcus aureus
LKTSFTFMLIIVLIIWSFIYTGFNFGDLM

SEQ ID NO: 1596718 - protein, 20 aa, Staphylococcus aureus
LKVEAYHPKYPTNIGQINQN

SEQ ID NO: 1596719 - protein, 18 aa, Staphylococcus aureus
LKVGRLMKFIPHSVMIGF

SEQ ID NO: 1596720 - protein, 20 aa, Staphylococcus aureus
LKVGRLMKFIPRPVMIGFVN

SEQ ID NO: 1596721 - protein, 19 aa, Staphylococcus aureus
LKVGRLMKFIPRSVMIGFV

SEQ ID NO: 1596722 - protein, 28 aa, Staphylococcus aureus
LKVIERLLLALILPLVILIIGMYSFNTF

SEQ ID NO: 1596723 - protein, 19 aa, Staphylococcus aureus
LLAIFAFLVILLLVPKNQT

SEQ ID NO: 1596724 - protein, 17 aa, Staphylococcus aureus
LLANGIMVPLSAFLATR

SEQ ID NO: 1596725 - protein, 20 aa, Staphylococcus aureus
LLASFFKSVFCAVSCALASI

SEQ ID NO: 1596726 - protein, 19 aa, Staphylococcus aureus
LLASLLVSITLVPALAATL

SEQ ID NO: 1596727 - protein, 18 aa, Staphylococcus aureus
LLASNPVGWAVLGGFAVA

SEQ ID NO: 1596728 - protein, 21 aa, Staphylococcus aureus
LLFLIISAIVTFFVLSPKYQA

SEQ ID NO: 1596729 - protein, 23 aa, Staphylococcus aureus
LLGITWLYLRYVAFRHDLKYLPG

SEQ ID NO: 1596730 - protein, 19 aa, Staphylococcus aureus
LLGLIILVAAAIPDSHMRL

SEQ ID NO: 1596731 - protein, 18 aa, Staphylococcus aureus
LLHPIFEAINLPTALTTT

SEQ ID NO: 1596732 - protein, 18 aa, Staphylococcus aureus
LLHPIILDSLFAYTNIFE

SEQ ID NO: 1596733 - protein, 18 aa, Staphylococcus aureus
LLIFVVVFPLIFMFGVAF

SEQ ID NO: 1596734 - protein, 19 aa, Staphylococcus aureus
LLIGVAYFLTAAQNLILVL

SEQ ID NO: 1596735 - protein, 17 aa, Staphylococcus aureus
LLINNIVVIFIGILTNV

SEQ ID NO: 1596736 - protein, 17 aa, Staphylococcus aureus
LLITLIYLSVYFGHLQG

SEQ ID NO: 1596737 - protein, 27 aa, Staphylococcus aureus
LLKIAIILYIPFLISKKMPRVLSKPKL

SEQ ID NO: 1596738 - protein, 25 aa, Staphylococcus aureus
LLLISGLLFLFFFKENEEIIPESSN

SEQ ID NO: 1596739 - protein, 23 aa, Staphylococcus aureus
LLLISGLLFLFFFKESEEIIPKS

SEQ ID NO: 1596740 - protein, 18 aa, Staphylococcus aureus
LLLLVFFSSTFTVCSVTM

SEQ ID NO: 1596741 - protein, 17 aa, Staphylococcus aureus
LLQIIFGLLSLGSLGLI

SEQ ID NO: 1596742 - protein, 18 aa, Staphylococcus aureus
LLRKIHGYSLFSSNVRYL

SEQ ID NO: 1596743 - protein, 17 aa, Staphylococcus aureus
LLRLFKINLFSFKKLTL

SEQ ID NO: 1596744 - protein, 41 aa, Staphylococcus aureus
LLSDKVAGYLFYFAVSIGLISFIVWMLIQNNVDFALERLVT

SEQ ID NO: 1596745 - protein, 20 aa, Staphylococcus aureus
LLSNLCNLLKYGFTLYQSFQ

SEQ ID NO: 1596746 - protein, 18 aa, Staphylococcus aureus
LLSVILNLPVWVVLLNAI

SEQ ID NO: 1596747 - protein, 18 aa, Staphylococcus aureus
LLTLLYLAIFITLYLIYG

SEQ ID NO: 1596748 - protein, 19 aa, Staphylococcus aureus
LLVIKKLYGYSTLRANYQY

SEQ ID NO: 1596749 - protein, 21 aa, Staphylococcus aureus
LLVTIPISIFAFKKVMSGFNE

SEQ ID NO: 1596750 - protein, 17 aa, Staphylococcus aureus
LLYLFVGIDFEIFEYQF

SEQ ID NO: 1596751 - protein, 20 aa, Staphylococcus aureus
LLYSVVVLILLVFANGYWSI

SEQ ID NO: 1596752 - protein, 18 aa, Staphylococcus aureus
LMEIRTIYRMILKLHNIM

SEQ ID NO: 1596753 - protein, 17 aa, Staphylococcus aureus
LMGLIQLILGLLKVGRL

SEQ ID NO: 1596754 - protein, 19 aa, Staphylococcus aureus
LMGLIQLILGLLKVGRLMK

SEQ ID NO: 1596755 - protein, 19 aa, Staphylococcus aureus
LMKLNPFWTILLSIVFLHE

SEQ ID NO: 1596756 - protein, 23 aa, Staphylococcus aureus
LMPLTLLGMIAFYIAIFTINNPD

SEQ ID NO: 1596757 - protein, 23 aa, Staphylococcus aureus
LMPMTLLGMIAFYIAIFTINNPD

SEQ ID NO: 1596758 - protein, 25 aa, Staphylococcus aureus
LMTATLFISLLYLFVGIDFEIFEYQ

SEQ ID NO: 1596759 - protein, 18 aa, Staphylococcus aureus
LMVALRFLQGVTGGAAAV

SEQ ID NO: 1596760 - protein, 25 aa, Staphylococcus aureus
LNDELFKYDIELIYPFDLVEVDSSQ

SEQ ID NO: 1596761 - protein, 20 aa, Staphylococcus aureus
LNEAMNQLRQSIASKDATKA

SEQ ID NO: 1596762 - protein, 23 aa, Staphylococcus aureus
LNEKAKLILALNNYMPKIEKALN

SEQ ID NO: 1596763 - protein, 32 aa, Staphylococcus aureus
LNFSQIIIAIILIIIILFDVKYYFEQHRKLLV

SEQ ID NO: 1596764 - protein, 25 aa, Staphylococcus aureus
LNILLVLLYFVYLGLKIVMIVFLCF

SEQ ID NO: 1596765 - protein, 25 aa, Staphylococcus aureus
LNKITWVRWVLYAVSLFLPLFIIYS

SEQ ID NO: 1596766 - protein, 19 aa, Staphylococcus aureus
LNLAAIIIISIVVSGDMFL

SEQ ID NO: 1596767 - protein, 33 aa, Staphylococcus aureus
LNNGESLDKVKHTPFFLPKRRRKEDEEDVEVKN

SEQ ID NO: 1596768 - protein, 24 aa, Staphylococcus aureus
LNNGIARISAVQIVTSDRAKQSSS

SEQ ID NO: 1596769 - protein, 33 aa, Staphylococcus aureus
LNNRPNPMYNGYIFKLVVFASALLTSHGYVEIA

SEQ ID NO: 1596770 - protein, 19 aa, Staphylococcus aureus
LNPSYFLISAFFISAVTSV

SEQ ID NO: 1596771 - protein, 21 aa, Staphylococcus aureus
LNQLPLFIYLKRYITFVSVNW

SEQ ID NO: 1596772 - protein, 33 aa, Staphylococcus aureus
LNTRPNPMYNGYIFKLVVFASALLTSHGYVEIT

SEQ ID NO: 1596773 - protein, 20 aa, Staphylococcus aureus
LNWIRPYKVRMILGFSMSFL

SEQ ID NO: 1596774 - protein, 18 aa, Staphylococcus aureus
LNYGFSVPNEAVQGDTFK

SEQ ID NO: 1596775 - protein, 20 aa, Staphylococcus aureus
LNYILFFAVIIIGTCIVALS

SEQ ID NO: 1596776 - protein, 29 aa, Staphylococcus aureus
LPEIFYVICCIIGYLFFGLGLGIYATPST

SEQ ID NO: 1596777 - protein, 20 aa, Staphylococcus aureus
LPGFILLYIRAIIPVFPLAL

SEQ ID NO: 1596778 - protein, 22 aa, Staphylococcus aureus
LPLFLLAIFFFSHSLCYIFDNY

SEQ ID NO: 1596779 - protein, 21 aa, Staphylococcus aureus
LPLILKIILNLALIGIVIIVL

SEQ ID NO: 1596780 - protein, 22 aa, Staphylococcus aureus
LPLQVFTFFGGINLFFGAKLDV

SEQ ID NO: 1596781 - protein, 18 aa, Staphylococcus aureus
LPLVLIMTFALLFSSYTC

SEQ ID NO: 1596782 - protein, 19 aa, Staphylococcus aureus
LPLVLIMTFALLFSSYTCG

SEQ ID NO: 1596783 - protein, 20 aa, Staphylococcus aureus
LPRFYFYLTLFMFSMIGIVL

SEQ ID NO: 1596784 - protein, 22 aa, Staphylococcus aureus
LPRFYFYLTLFMFSMIGIVLSD

SEQ ID NO: 1596785 - protein, 19 aa, Staphylococcus aureus
LPSGDYILKEIEAPAPYTF

SEQ ID NO: 1596786 - protein, 25 aa, Staphylococcus aureus
LPSTFLGILPVGMYLISINQLNYAE

SEQ ID NO: 1596787 - protein, 33 aa, Staphylococcus aureus
LPTSIQLAVVGFGLFVAVLGPLVFMFGLFISVM

SEQ ID NO: 1596788 - protein, 20 aa, Staphylococcus aureus
LPWVSFIVHLSFSIVIAIIY

SEQ ID NO: 1596789 - protein, 18 aa, Staphylococcus aureus
LPYIVVIVDELADLMMVA

SEQ ID NO: 1596790 - protein, 19 aa, Staphylococcus aureus
LPYIVVIVDELADLMMVAG

SEQ ID NO: 1596791 - protein, 18 aa, Staphylococcus aureus
LQLFMGSILFFKLLTEFI

SEQ ID NO: 1596792 - protein, 18 aa, Staphylococcus aureus
LQLPYFIPDNSYINAIKI

SEQ ID NO: 1596793 - protein, 17 aa, Staphylococcus aureus
LRKRYEISTKEAPKLLL

SEQ ID NO: 1596794 - protein, 44 aa, Staphylococcus aureus
LRRKRQKRIQYSVITILVLLIGVILIYMFSPLSKIAHVNINGNN

SEQ ID NO: 1596795 - protein, 46 aa, Staphylococcus aureus
LRRSKRIAVLSWLSLCICIALALALYALPYLILGSNNWSFVLTWLP

SEQ ID NO: 1596796 - protein, 20 aa, Staphylococcus aureus
LRRSKRIAVLSWLTLCLCIA

SEQ ID NO: 1596797 - protein, 30 aa, Staphylococcus aureus
LRRYTLIIYFLLLTLYPFYIMLDSTKFFYL

SEQ ID NO: 1596798 - protein, 18 aa, Staphylococcus aureus
LSALIPIHNKIFINELKL

SEQ ID NO: 1596799 - protein, 20 aa, Staphylococcus aureus
LSAWLLIESLSPREVNFTAE

SEQ ID NO: 1596800 - protein, 23 aa, Staphylococcus aureus
LSEEALIKIIPSYHALIVRSQTT

SEQ ID NO: 1596801 - protein, 25 aa, Staphylococcus aureus
LSFIVLILLFFIINDETNWIYDGGF

SEQ ID NO: 1596802 - protein, 30 aa, Staphylococcus aureus
LSFKLYRFYFYRLFAIITWILFIGSLSQYF

SEQ ID NO: 1596803 - protein, 31 aa, Staphylococcus aureus
LSFKLYRFYFYRLFAIVTWLLFIGSLSQYFD

SEQ ID NO: 1596804 - protein, 25 aa, Staphylococcus aureus
LSGETIPHVFILIDNFDAVKDSPFQ

SEQ ID NO: 1596805 - protein, 24 aa, Staphylococcus aureus
LSIALIVIGIAVVCLMIFSSQKTT

SEQ ID NO: 1596806 - protein, 19 aa, Staphylococcus aureus
LSIIMYLLVLILSLIIHPF

SEQ ID NO: 1596807 - protein, 32 aa, Staphylococcus aureus
LSIMFNFWLYVILYWFIPLLTTFQIIRYWAEM

SEQ ID NO: 1596808 - protein, 17 aa, Staphylococcus aureus
LSIPLLALTYLFANHFT

SEQ ID NO: 1596809 - protein, 17 aa, Staphylococcus aureus
LSIPLLALTYLFTNHFT

SEQ ID NO: 1596810 - protein, 21 aa, Staphylococcus aureus
LSISIIIIVAISIAIYITLNS

SEQ ID NO: 1596811 - protein, 22 aa, Staphylococcus aureus
LSISIIILVAISIAIYITLNSN

SEQ ID NO: 1596812 - protein, 21 aa, Staphylococcus aureus
LSIVYFIYYIFEKNINFKAYA

SEQ ID NO: 1596813 - protein, 22 aa, Staphylococcus aureus
LSKFNIIYILMLEQLLIFIITA

SEQ ID NO: 1596814 - protein, 19 aa, Staphylococcus aureus
LSLALMSIQLIEIYKLAIP

SEQ ID NO: 1596815 - protein, 20 aa, Staphylococcus aureus
LSLFLTLRFIQGLTGGGVIV

SEQ ID NO: 1596816 - protein, 25 aa, Staphylococcus aureus
LSLIPDNLIIVGLFVICMFVSISMG

SEQ ID NO: 1596817 - protein, 36 aa, Staphylococcus aureus
LSNLIFVPYYSIILFPLSILFFITSHFIVGLTSLNY

SEQ ID NO: 1596818 - protein, 23 aa, Staphylococcus aureus
LSPIVNVWIFKLFVEVLGMNSFS

SEQ ID NO: 1596819 - protein, 21 aa, Staphylococcus aureus
LSQFLPLLIVKKLPFAQYSGI

SEQ ID NO: 1596820 - protein, 30 aa, Staphylococcus aureus
LSSDFTLFDFTYDLPLSTYLGQVLNMNAKV

SEQ ID NO: 1596821 - protein, 22 aa, Staphylococcus aureus
LSTFLFILLLYIAYRKNKIVYA

SEQ ID NO: 1596822 - protein, 23 aa, Staphylococcus aureus
LSTFQFLFIFKKTSLNMFEVEFF

SEQ ID NO: 1596823 - protein, 24 aa, Staphylococcus aureus
LSTLGFIFLMFLSGLEIDFKAFKK

SEQ ID NO: 1596824 - protein, 18 aa, Staphylococcus aureus
LSTLWIPVFSITFSLITL

SEQ ID NO: 1596825 - protein, 21 aa, Staphylococcus aureus
LSVITFWLFAQSLVNVVLILE

SEQ ID NO: 1596826 - protein, 17 aa, Staphylococcus aureus
LSVVLILLFVEKLRIIQ

SEQ ID NO: 1596827 - protein, 23 aa, Staphylococcus aureus
LSYIDNMFFNYLNAEHPIGLVLV

SEQ ID NO: 1596828 - protein, 27 aa, Staphylococcus aureus
LSYSTIMSCISFLYTLDFITKSLTKNN

SEQ ID NO: 1596829 - protein, 19 aa, Staphylococcus aureus
LSYYYSLSPLMWLNFLFIK

SEQ ID NO: 1596830 - protein, 18 aa, Staphylococcus aureus
LTAKVEVTLLDGSKVIVN

SEQ ID NO: 1596831 - protein, 27 aa, Staphylococcus aureus
LTASIAALLLVSGLFLAFRRRSTNKKT

SEQ ID NO: 1596832 - protein, 20 aa, Staphylococcus aureus
LTEALFAEKPVAKNDLKEIP

SEQ ID NO: 1596833 - protein, 19 aa, Staphylococcus aureus
LTELWGKIQSTLQPIMPIL

SEQ ID NO: 1596834 - protein, 22 aa, Staphylococcus aureus
LTFRFIAFGVIFVFLGLFGIFV

SEQ ID NO: 1596835 - protein, 20 aa, Staphylococcus aureus
LTIVILIAILYRHFRGYPEQ

SEQ ID NO: 1596836 - protein, 22 aa, Staphylococcus aureus
LTLLVFAVVLMIVSVLGSLFSI

SEQ ID NO: 1596837 - protein, 18 aa, Staphylococcus aureus
LTLMFKKLRNFSTHKWML

SEQ ID NO: 1596838 - protein, 24 aa, Staphylococcus aureus
LTLPILNFIIPFVLVFIVDGMKGI

SEQ ID NO: 1596839 - protein, 28 aa, Staphylococcus aureus
LTLYLNIATLILFIINLTRKNYSFILTK

SEQ ID NO: 1596840 - protein, 19 aa, Staphylococcus aureus
LTMLALAVFSKKFQPKHIY

SEQ ID NO: 1596841 - protein, 35 aa, Staphylococcus aureus
LTTIITSCLTLLICSIFINPLIQKIKQFNIKTKQF

SEQ ID NO: 1596842 - protein, 26 aa, Staphylococcus aureus
LTTKEKYFLLIFMSNAIIGVLQDWVK

SEQ ID NO: 1596843 - protein, 20 aa, Staphylococcus aureus
LTVLVPLLPIYMASLQNLSV

SEQ ID NO: 1596844 - protein, 20 aa, Staphylococcus aureus
LVAGLALIVHMIINRLFRKR

SEQ ID NO: 1596845 - protein, 18 aa, Staphylococcus aureus
LVALGISVAYIYSLYAFY

SEQ ID NO: 1596846 - protein, 17 aa, Staphylococcus aureus
LVCFIFFAVFGASAIYL

SEQ ID NO: 1596847 - protein, 23 aa, Staphylococcus aureus
LVCNFCFIIWLLYTNTLLKECKI

SEQ ID NO: 1596848 - protein, 23 aa, Staphylococcus aureus
LVCNFCFIIWLLYTNTLLKECKT

SEQ ID NO: 1596849 - protein, 21 aa, Staphylococcus aureus
LVCNFCIIMWLLFSCSLLKER

SEQ ID NO: 1596850 - protein, 18 aa, Staphylococcus aureus
LVEGLIVGLIAMKKFHVL

SEQ ID NO: 1596851 - protein, 77 aa, Staphylococcus aureus
LVEGLIVGLIAMNKFHVLAGYRAKFILMVILTMMVFVLINTYLLRQVKSIGMFLMIAAVGLYFVAMNNLKAAGQGVT

SEQ ID NO: 1596852 - protein, 20 aa, Staphylococcus aureus
LVFVPQIVVLFFLISLLEDS

SEQ ID NO: 1596853 - protein, 27 aa, Staphylococcus aureus
LVGDNAPALYPNYWGGNKYKVIEELRK

SEQ ID NO: 1596854 - protein, 28 aa, Staphylococcus aureus
LVGDNAPALYPNYWGGSKFKVIEELRKQ

SEQ ID NO: 1596855 - protein, 18 aa, Staphylococcus aureus
LVGTIFGSLIIALLRMLM

SEQ ID NO: 1596856 - protein, 26 aa, Staphylococcus aureus
LVGWRYTFLFLIIVSIIVGFLMVIYL

SEQ ID NO: 1596857 - protein, 18 aa, Staphylococcus aureus
LVIKKLYGYSTLRANYQY

SEQ ID NO: 1596858 - protein, 21 aa, Staphylococcus aureus
LVIKLIPIIVIVIFGIFQSGD

SEQ ID NO: 1596859 - protein, 24 aa, Staphylococcus aureus
LVILLAITILLLPYLDVLLLGRAE

SEQ ID NO: 1596860 - protein, 25 aa, Staphylococcus aureus
LVIVFILGLLLLLPSLILLLRLFVF

SEQ ID NO: 1596861 - protein, 21 aa, Staphylococcus aureus
LVLCNFVSAILWFVSAISILG

SEQ ID NO: 1596862 - protein, 22 aa, Staphylococcus aureus
LVLFIPLLNWLTPKRYIKISQE

SEQ ID NO: 1596863 - protein, 17 aa, Staphylococcus aureus
LVLGLLISSAMGYINPT

SEQ ID NO: 1596864 - protein, 19 aa, Staphylococcus aureus
LVNFIVYLCMYLLLVVIAG

SEQ ID NO: 1596865 - protein, 18 aa, Staphylococcus aureus
LVNFVFLPPKFETKIYYN

SEQ ID NO: 1596866 - protein, 23 aa, Staphylococcus aureus
LVSIWLVYFLPFINWFIPKRYAI

SEQ ID NO: 1596867 - protein, 24 aa, Staphylococcus aureus
LVSRLLLSIILNLPVWVVLLNAIP

SEQ ID NO: 1596868 - protein, 19 aa, Staphylococcus aureus
LVTSMLFVSSIVIGGYSLF

SEQ ID NO: 1596869 - protein, 25 aa, Staphylococcus aureus
LVVAQVLLPLLTKPAPKTVIGNMSF

SEQ ID NO: 1596870 - protein, 21 aa, Staphylococcus aureus
LVVIGIAVVCLMIFSSQKTTY

SEQ ID NO: 1596871 - protein, 25 aa, Staphylococcus aureus
LVVLYHFCLPFLIVLMHKYLSSNCR

SEQ ID NO: 1596872 - protein, 19 aa, Staphylococcus aureus
LVVSWQVALLSFLAIQLLE

SEQ ID NO: 1596873 - protein, 21 aa, Staphylococcus aureus
LVVVMLLFLIQILLGELLAHY

SEQ ID NO: 1596874 - protein, 32 aa, Staphylococcus aureus
LVYPIINICVIVFRPITLLLNKLTDSINRSLS

SEQ ID NO: 1596875 - protein, 19 aa, Staphylococcus aureus
LWEHIIQLKMPFFDKNESG

SEQ ID NO: 1596876 - protein, 17 aa, Staphylococcus aureus
LWIPVFSITFSLITLII

SEQ ID NO: 1596877 - protein, 19 aa, Staphylococcus aureus
LWIPVFSITFSLITLITVL

SEQ ID NO: 1596878 - protein, 22 aa, Staphylococcus aureus
LWLRNFMQAFFVVFFVYMAMYL

SEQ ID NO: 1596879 - protein, 17 aa, Staphylococcus aureus
LWVFALILFIMRLAKIQ

SEQ ID NO: 1596880 - protein, 25 aa, Staphylococcus aureus
LYAVSLFLPLFIIYSMVRPPDKNNR

SEQ ID NO: 1596881 - protein, 31 aa, Staphylococcus aureus
LYFLMSIFLFPFTFLYLLAYHHFEDKQHFLT

SEQ ID NO: 1596882 - protein, 22 aa, Staphylococcus aureus
LYISIIVLSIFIIGCGKGNEIK

SEQ ID NO: 1596883 - protein, 18 aa, Staphylococcus aureus
LYISIMVLSIFIIGCGKG

SEQ ID NO: 1596884 - protein, 20 aa, Staphylococcus aureus
LYLFYFYLIGVCACLLYLSI

SEQ ID NO: 1596885 - protein, 34 aa, Staphylococcus aureus
LYLSQPLSLIFYLKSLLLILIYEMGIVFILFHIQ

SEQ ID NO: 1596886 - protein, 21 aa, Staphylococcus aureus
LYRIVMVLSVFIIGCDKSSDT

SEQ ID NO: 1596887 - protein, 32 aa, Staphylococcus aureus
MAGIGCYFWNQLLLLFTIITIVIIGLFVIKGY

SEQ ID NO: 1596888 - protein, 31 aa, Staphylococcus aureus
MAGSQIMFILFILLILVFTVIFIFQFVSRIA

SEQ ID NO: 1596889 - protein, 25 aa, Staphylococcus aureus
MAITLLFSTLFIVSIFIVDILYGVI

SEQ ID NO: 1596890 - protein, 25 aa, Staphylococcus aureus
MATTILFSSFFIVSIFLVDMLYIII

SEQ ID NO: 1596891 - protein, 21 aa, Staphylococcus aureus
MAVYLLINATFLLTLPIELLA

SEQ ID NO: 1596892 - protein, 20 aa, Staphylococcus aureus
MDTMTSFWIPQLGGQKYAMT

SEQ ID NO: 1596893 - protein, 22 aa, Staphylococcus aureus
MDTMTSFWIPQLGGQKYAMTGM

SEQ ID NO: 1596894 - protein, 18 aa, Staphylococcus aureus
METLWQTISPLEAFIRPN

SEQ ID NO: 1596895 - protein, 28 aa, Staphylococcus aureus
MFGMAKEDIIGYYMLSVLSLEDEFKLEE

SEQ ID NO: 1596896 - protein, 18 aa, Staphylococcus aureus
MFIGVILGLILGVAAATK

SEQ ID NO: 1596897 - protein, 18 aa, Staphylococcus aureus
MFIIELIKGIILGIVEGL

SEQ ID NO: 1596898 - protein, 19 aa, Staphylococcus aureus
MFITLIIIAVLMGMLLIFN

SEQ ID NO: 1596899 - protein, 25 aa, Staphylococcus aureus
MFLCTLLVWLMTPGLSLFYGGLVES

SEQ ID NO: 1596900 - protein, 24 aa, Staphylococcus aureus
MFLCTLLVWLMTPGLSLFYGGLVQ

SEQ ID NO: 1596901 - protein, 24 aa, Staphylococcus aureus
MFRPFALAIAFSLLASLLVSITLV

SEQ ID NO: 1596902 - protein, 17 aa, Staphylococcus aureus
MGGLFPLSTFQFLFIFK

SEQ ID NO: 1596903 - protein, 26 aa, Staphylococcus aureus
MGILGGVFWALMAPIAAVSSVLSNVF

SEQ ID NO: 1596904 - protein, 22 aa, Staphylococcus aureus
MGKYFAGIYIPSKFTHEITGTL

SEQ ID NO: 1596905 - protein, 22 aa, Staphylococcus aureus
MGPLVVYWNWTWGITVAIILGI

SEQ ID NO: 1596906 - protein, 21 aa, Staphylococcus aureus
MGVKLPFQISFTGSDWIVLIL

SEQ ID NO: 1596907 - protein, 25 aa, Staphylococcus aureus
MGVTVIVLIAILFKFNLAHVATLAS

SEQ ID NO: 1596908 - protein, 20 aa, Staphylococcus aureus
MGYVYFSWLLGLLVGMVFMN

SEQ ID NO: 1596909 - protein, 29 aa, Staphylococcus aureus
MHEALKRVFLIFCLIGFGVGVLANASFVI

SEQ ID NO: 1596910 - protein, 30 aa, Staphylococcus aureus
MHHNAIIETIWFVIPIIIVAALAIPTVKTL

SEQ ID NO: 1596911 - protein, 26 aa, Staphylococcus aureus
MHMMFIGMMLLLVFALILLMVFKENN

SEQ ID NO: 1596912 - protein, 23 aa, Staphylococcus aureus
MIFKAIKLLPLVPFIFISFFINS

SEQ ID NO: 1596913 - protein, 28 aa, Staphylococcus aureus
MIGIIIAIPVFVLVLTGLPWSGFMGSKI

SEQ ID NO: 1596914 - protein, 17 aa, Staphylococcus aureus
MIGIIIGISSVITIMSL

SEQ ID NO: 1596915 - protein, 18 aa, Staphylococcus aureus
MIGLFVGAIYMIIADKYS

SEQ ID NO: 1596916 - protein, 17 aa, Staphylococcus aureus
MIGSVLADEIKYPLAKF

SEQ ID NO: 1596917 - protein, 18 aa, Staphylococcus aureus
MIIGVLIGLILGVASAAK

SEQ ID NO: 1596918 - protein, 25 aa, Staphylococcus aureus
MIISSIIIYLFIRRQFNISNALLNF

SEQ ID NO: 1596919 - protein, 31 aa, Staphylococcus aureus
MIKVILALPMFILLTIYLQPLVRYIFERIVM

SEQ ID NO: 1596920 - protein, 18 aa, Staphylococcus aureus
MILLITLFISILIGDAKI

SEQ ID NO: 1596921 - protein, 17 aa, Staphylococcus aureus
MIPMRKLLDQLREKFKH

SEQ ID NO: 1596922 - protein, 28 aa, Staphylococcus aureus
MISAFSFFIYLFIYLLHPIILDSLFAYT

SEQ ID NO: 1596923 - protein, 23 aa, Staphylococcus aureus
MITAFFIAVISVLLAFHLKQHYD

SEQ ID NO: 1596924 - protein, 17 aa, Staphylococcus aureus
MKVTDFHKNPMGGYFVV

SEQ ID NO: 1596925 - protein, 17 aa, Staphylococcus aureus
MLCLLLGYFLLTKEEYL

SEQ ID NO: 1596926 - protein, 25 aa, Staphylococcus aureus
MLFAAGIVLATILLISAHLYSRKRG

SEQ ID NO: 1596927 - protein, 23 aa, Staphylococcus aureus
MLGVTAFVLIYWLNPPGNAWLDN

SEQ ID NO: 1596928 - protein, 17 aa, Staphylococcus aureus
MLILLCFTFYNINYYLF

SEQ ID NO: 1596929 - protein, 27 aa, Staphylococcus aureus
MLLLSSILIISFVTLGIIIHASITYVL

SEQ ID NO: 1596930 - protein, 24 aa, Staphylococcus aureus
MLLSTSILILSSSSLGLATYTVEA

SEQ ID NO: 1596931 - protein, 23 aa, Staphylococcus aureus
MLLSTSMLILSSSSIGLATHTVE

SEQ ID NO: 1596932 - protein, 17 aa, Staphylococcus aureus
MLLSTSMLILSSSSSSL

SEQ ID NO: 1596933 - protein, 18 aa, Staphylococcus aureus
MLLSTSMLILSSSSSSLG

SEQ ID NO: 1596934 - protein, 19 aa, Staphylococcus aureus
MLNYKVWYLTLLAGLIPFI

SEQ ID NO: 1596935 - protein, 23 aa, Staphylococcus aureus
MLQFGLFLIALIGLVIKLIELSN

SEQ ID NO: 1596936 - protein, 18 aa, Staphylococcus aureus
MLYEPKPKKKSTRKIVLL

SEQ ID NO: 1596937 - protein, 30 aa, Staphylococcus aureus
MMIHSRKLRIWLYLVLLAVFIGACGMKKEE

SEQ ID NO: 1596938 - protein, 17 aa, Staphylococcus aureus
MMLWHLIFILPAFFVFF

SEQ ID NO: 1596939 - protein, 19 aa, Staphylococcus aureus
MMPLLQIIIIYMFPIKQRG

SEQ ID NO: 1596940 - protein, 23 aa, Staphylococcus aureus
MMPVTMPFYLTTQNILLMVGIFI

SEQ ID NO: 1596941 - protein, 21 aa, Staphylococcus aureus
MMVPLIIIIAMFFIHFNTALI

SEQ ID NO: 1596942 - protein, 17 aa, Staphylococcus aureus
MNIRILSGFLFLISAIV

SEQ ID NO: 1596943 - protein, 28 aa, Staphylococcus aureus
MNLGTLFYLGFLVLFLFAALTSSISLLE

SEQ ID NO: 1596944 - protein, 24 aa, Staphylococcus aureus
MQGFLHLIFFWTVIPHILAIISAI

SEQ ID NO: 1596945 - protein, 26 aa, Staphylococcus aureus
MRMMFIGMMVLLVFALILLMVFKENN

SEQ ID NO: 1596946 - protein, 26 aa, Staphylococcus aureus
MRYSHWFRFVWPVVAFVLIFGGGVLI

SEQ ID NO: 1596947 - protein, 25 aa, Staphylococcus aureus
MSIPLIAVIFSWWLATKTANEKFEE

SEQ ID NO: 1596948 - protein, 23 aa, Staphylococcus aureus
MSISIICFMLFTTNYNWTFLILF

SEQ ID NO: 1596949 - protein, 19 aa, Staphylococcus aureus
MSKLRYLYGHTAAYTRETG

SEQ ID NO: 1596950 - protein, 34 aa, Staphylococcus aureus
MSLPKKIFLWVFGILVILAIIAVVYVAAKIFITG

SEQ ID NO: 1596951 - protein, 26 aa, Staphylococcus aureus
MSVGKMLTVYLSYTTQFIYLHRRVGQ

SEQ ID NO: 1596952 - protein, 23 aa, Staphylococcus aureus
MTAIQLLLLVFFSSTFTACSVTM

SEQ ID NO: 1596953 - protein, 17 aa, Staphylococcus aureus
MTFLFVIVGLCIKLANS

SEQ ID NO: 1596954 - protein, 25 aa, Staphylococcus aureus
MTIQLLPIIGIPLPFISYGGSALWS

SEQ ID NO: 1596955 - protein, 28 aa, Staphylococcus aureus
MTLDSGFYKTPKYSLGDYVWYDSNKDGK

SEQ ID NO: 1596956 - protein, 18 aa, Staphylococcus aureus
MTMYLTLEAVNKGQLSLD

SEQ ID NO: 1596957 - protein, 19 aa, Staphylococcus aureus
MVILAVVPLLFLVISKMKI

SEQ ID NO: 1596958 - protein, 18 aa, Staphylococcus aureus
MVSVILIGMIVIAYAHNK

SEQ ID NO: 1596959 - protein, 24 aa, Staphylococcus aureus
MVVYIVLIILFTYFYSFVQVNPEK

SEQ ID NO: 1596960 - protein, 39 aa, Staphylococcus aureus
MYGYSMLLLFLIAACIFLIVLFILYIWLPQDRNQVKQSD

SEQ ID NO: 1596961 - protein, 19 aa, Staphylococcus aureus
MYILVMILSLIIHPFYAQF

SEQ ID NO: 1596962 - protein, 18 aa, Staphylococcus aureus
MYLLVMILSLIIHPFYAQ

SEQ ID NO: 1596963 - protein, 19 aa, Staphylococcus aureus
MYLLVMILSLIIHPFYAQF

SEQ ID NO: 1596964 - protein, 20 aa, Staphylococcus aureus
NAAKLNVQPTNNTFQDFDIN

SEQ ID NO: 1596965 - protein, 27 aa, Staphylococcus aureus
NAERVTLKYKWKFGEDVKPGDYFDFTL

SEQ ID NO: 1596966 - protein, 29 aa, Staphylococcus aureus
NAFKNFLPLIILVLIYFIHKIIHKTKFVK

SEQ ID NO: 1596967 - protein, 34 aa, Staphylococcus aureus
NAGTLAYIYAIPVASLALLIAITLFVRKKSKGNV

SEQ ID NO: 1596968 - protein, 34 aa, Staphylococcus aureus
NAIGVVGISGLLASFWFFIAKRRRKEDEEEELEI

SEQ ID NO: 1596969 - protein, 17 aa, Staphylococcus aureus
NAIIQKPIRSVQEVQTA

SEQ ID NO: 1596970 - protein, 17 aa, Staphylococcus aureus
NAITFLLQNIQPHQNLI

SEQ ID NO: 1596971 - protein, 24 aa, Staphylococcus aureus
NALQLMRQSLPLSSLYTGVGVLNT

SEQ ID NO: 1596972 - protein, 24 aa, Staphylococcus aureus
NAMDQLKQAIADHDTIVAGGNYTN

SEQ ID NO: 1596973 - protein, 21 aa, Staphylococcus aureus
NAMDQLKQAIADHDTIVASGN

SEQ ID NO: 1596974 - protein, 33 aa, Staphylococcus aureus
NASSKGAPYNLPTTPWNTLKASDAKEIALITAK

SEQ ID NO: 1596975 - protein, 34 aa, Staphylococcus aureus
NASSKGAPYNLPTTPWNTLKASDAKEIALITAKQ

SEQ ID NO: 1596976 - protein, 18 aa, Staphylococcus aureus
NATFLLTLPIELLAGNLN

SEQ ID NO: 1596977 - protein, 29 aa, Staphylococcus aureus
NATLFGAMMALLGSLLLFRKRKQDHKEKA

SEQ ID NO: 1596978 - protein, 26 aa, Staphylococcus aureus
NAVTNTVTRLPSGLTFDSTNNTISGT

SEQ ID NO: 1596979 - protein, 22 aa, Staphylococcus aureus
NDANWAAMNKPNAAKVINAKYD

SEQ ID NO: 1596980 - protein, 24 aa, Staphylococcus aureus
NDDYVNYFFSTAVIAVCYVASCLA

SEQ ID NO: 1596981 - protein, 17 aa, Staphylococcus aureus
NDFKFIPVYFGMGVIFS

SEQ ID NO: 1596982 - protein, 30 aa, Staphylococcus aureus
NDKENINGQFSLPLFTDRAKAPKSGTYDAN

SEQ ID NO: 1596983 - protein, 40 aa, Staphylococcus aureus
NDKHLVYHFVLISLLVVFLVVLLPFHWRTLQSVNWQAVQL

SEQ ID NO: 1596984 - protein, 17 aa, Staphylococcus aureus
NDKKEVVAKATYDILTK

SEQ ID NO: 1596985 - protein, 31 aa, Staphylococcus aureus
NDKQNINGKFSLPLFTDRAKAPKSGIYDANI

SEQ ID NO: 1596986 - protein, 33 aa, Staphylococcus aureus
NDSIIKAALKRLPWLIILTFLGMITATILGRFE

SEQ ID NO: 1596987 - protein, 28 aa, Staphylococcus aureus
NDTIDSGFYKPTYNLGDYVWEDTNKNGV

SEQ ID NO: 1596988 - protein, 22 aa, Staphylococcus aureus
NDVPTLIHSWMNSGIHRSRLLN

SEQ ID NO: 1596989 - protein, 18 aa, Staphylococcus aureus
NDVVLNYDAATSTITATY

SEQ ID NO: 1596990 - protein, 25 aa, Staphylococcus aureus
NDYNILYFYLYILSLLMGGIISFIN

SEQ ID NO: 1596991 - protein, 31 aa, Staphylococcus aureus
NDYNILYFYLYILSLLMGGLFPLSTFQFLFI

SEQ ID NO: 1596992 - protein, 19 aa, Staphylococcus aureus
NEAWLWVLVLVAFSIVVIS

SEQ ID NO: 1596993 - protein, 20 aa, Staphylococcus aureus
NEAWLWVLVLVAFSIVVIST

SEQ ID NO: 1596994 - protein, 18 aa, Staphylococcus aureus
NEHSPVLIAKRRKEKDGD

SEQ ID NO: 1596995 - protein, 23 aa, Staphylococcus aureus
NEHSPVLIAKRRKEKDGDVETTT

SEQ ID NO: 1596996 - protein, 34 aa, Staphylococcus aureus
NENNADIILPKSTAPKRLNTRMRIAAVQPSSTEA

SEQ ID NO: 1596997 - protein, 17 aa, Staphylococcus aureus
NENNADIILPKSTAPKS

SEQ ID NO: 1596998 - protein, 26 aa, Staphylococcus aureus
NESVMDGFVEHPFYTATLNGQKYVVM

SEQ ID NO: 1596999 - protein, 20 aa, Staphylococcus aureus
NETLYTIRLLPVGGYVRMAG

SEQ ID NO: 1597000 - protein, 30 aa, Staphylococcus aureus
NEVVAKATYDILTKTYTFVFTDYVNDKQNI

SEQ ID NO: 1597001 - protein, 20 aa, Staphylococcus aureus
NFARFIIIIAGIFCFGMSLY

SEQ ID NO: 1597002 - protein, 43 aa, Staphylococcus aureus
NFGNVIKNAIGVVGISGLLASFWFFIAKRRRKEDEEEELEIRD

SEQ ID NO: 1597003 - protein, 22 aa, Staphylococcus aureus
NFHPHEVAFLLIDYKGGGYGEL

SEQ ID NO: 1597004 - protein, 18 aa, Staphylococcus aureus
NFHQLQWVGFLSNLIFVP

SEQ ID NO: 1597005 - protein, 17 aa, Staphylococcus aureus
NFKLIFTLPLTILNRQS

SEQ ID NO: 1597006 - protein, 23 aa, Staphylococcus aureus
NFSFLIVITILIAIAIYACRFVW

SEQ ID NO: 1597007 - protein, 24 aa, Staphylococcus aureus
NFSFLIVITILIAIAIYVCRFVWV

SEQ ID NO: 1597008 - protein, 21 aa, Staphylococcus aureus
NFSHYLLLIILFSLVILQYIL

SEQ ID NO: 1597009 - protein, 21 aa, Staphylococcus aureus
NFVNMPVLHLHYGYYICLAVM

SEQ ID NO: 1597010 - protein, 26 aa, Staphylococcus aureus
NGAVRDDAWLQKKLNYISKKTYQGIF

SEQ ID NO: 1597011 - protein, 24 aa, Staphylococcus aureus
NGKKQSLVFYHLKLDSEYASIFGL

SEQ ID NO: 1597012 - protein, 23 aa, Staphylococcus aureus
NGLKMFVYIILLCAIVAAFFAND

SEQ ID NO: 1597013 - protein, 31 aa, Staphylococcus aureus
NGLQQQSNYFRFQYFNPLKSERYYRNLDEQV

SEQ ID NO: 1597014 - protein, 21 aa, Staphylococcus aureus
NGLRQVVNRTYRIGTTKRVEV

SEQ ID NO: 1597015 - protein, 26 aa, Staphylococcus aureus
NGSIENSFFLQRINPDSTAQGKIVFD

SEQ ID NO: 1597016 - protein, 24 aa, Staphylococcus aureus
NGTDAINYITFDPNTNTNGITAAW

SEQ ID NO: 1597017 - protein, 24 aa, Staphylococcus aureus
NGTRYIFFDNMSFTAPTKQPIVKP

SEQ ID NO: 1597018 - protein, 28 aa, Staphylococcus aureus
NGVTSTAKVPPIMAGDQVLANGVIDSDG

SEQ ID NO: 1597019 - protein, 33 aa, Staphylococcus aureus
NHKKQYILFAAGIVLATILLISAHLYSRKRGNQ

SEQ ID NO: 1597020 - protein, 26 aa, Staphylococcus aureus
NHQDQKLYFYFSSPGKDQIIYKESIT

SEQ ID NO: 1597021 - protein, 17 aa, Staphylococcus aureus
NIAYISIFLILVVFIFK

SEQ ID NO: 1597022 - protein, 47 aa, Staphylococcus aureus
NICNFIKAIFEFILNFVIKPIMFAIWQVMQFIWPAVKALIVSTWENI

SEQ ID NO: 1597023 - protein, 40 aa, Staphylococcus aureus
NICTVIWIVLVIILSFKFLKSLLYLKYLKRQSLYLNENEK

SEQ ID NO: 1597024 - protein, 20 aa, Staphylococcus aureus
NIDQATKLQPIAELVDQATQ

SEQ ID NO: 1597025 - protein, 22 aa, Staphylococcus aureus
NIFETLTTWLKSMQGANIIILA

SEQ ID NO: 1597026 - protein, 26 aa, Staphylococcus aureus
NIFSRRFWPSFTFLIPIIIGMLLAMG

SEQ ID NO: 1597027 - protein, 26 aa, Staphylococcus aureus
NIILFITWIMLVIMFLLSNVALVVNK

SEQ ID NO: 1597028 - protein, 17 aa, Staphylococcus aureus
NIILIRLSGIIGASISA

SEQ ID NO: 1597029 - protein, 21 aa, Staphylococcus aureus
NIIVYPAFIMLLLSFVCLISS

SEQ ID NO: 1597030 - protein, 25 aa, Staphylococcus aureus
NIIYMTSIVLMILTLFEQAVPMTNV

SEQ ID NO: 1597031 - protein, 25 aa, Staphylococcus aureus
NIIYMTSIVLMVLILFEQAVPMTNV

SEQ ID NO: 1597032 - protein, 24 aa, Staphylococcus aureus
NIKQAFPHFLIPNVPFNLETLQII

SEQ ID NO: 1597033 - protein, 25 aa, Staphylococcus aureus
NIKQTLPHFLIPNIPFNLETLQIIF

SEQ ID NO: 1597034 - protein, 17 aa, Staphylococcus aureus
NIKVAIKAIFIPPREKE

SEQ ID NO: 1597035 - protein, 24 aa, Staphylococcus aureus
NILIDSNKTLKIFDFGIAKALSET

SEQ ID NO: 1597036 - protein, 19 aa, Staphylococcus aureus
NIPFIFWLIVGISMWFFVN

SEQ ID NO: 1597037 - protein, 24 aa, Staphylococcus aureus
NIRDMKMWVLGLVGTIFGSLIIAL

SEQ ID NO: 1597038 - protein, 34 aa, Staphylococcus aureus
NITCLLLVPTIIWLTNRFVFPNLIELFRKSMNNA

SEQ ID NO: 1597039 - protein, 28 aa, Staphylococcus aureus
NIVAMFIPLFFIYKYHQPMFGRLSSQPL

SEQ ID NO: 1597040 - protein, 30 aa, Staphylococcus aureus
NIVTVLMTTLILLAFIFSAYRAWQIRHGQI

SEQ ID NO: 1597041 - protein, 29 aa, Staphylococcus aureus
NIVTVLMTTLILLSFIFSAYRAWQMRHGK

SEQ ID NO: 1597042 - protein, 23 aa, Staphylococcus aureus
NKDITNWFQTYNKSLLSANSDTF

SEQ ID NO: 1597043 - protein, 29 aa, Staphylococcus aureus
NKEQQNAFYEILHLPNLTEEQRNGFIQSL

SEQ ID NO: 1597044 - protein, 27 aa, Staphylococcus aureus
NKIAMLSIIFLLIITIISIIAPLIAPF

SEQ ID NO: 1597045 - protein, 18 aa, Staphylococcus aureus
NKIVPAQDYLSLKSQITV

SEQ ID NO: 1597046 - protein, 17 aa, Staphylococcus aureus
NKLLASFFKSVFCAVSC

SEQ ID NO: 1597047 - protein, 20 aa, Staphylococcus aureus
NKVLPYKAPFYPLGPIIVIA

SEQ ID NO: 1597048 - protein, 18 aa, Staphylococcus aureus
NLDEFLNNLKTASPILVK

SEQ ID NO: 1597049 - protein, 30 aa, Staphylococcus aureus
NLDFDRIIDYLILLILICSGLSYSKTELQR

SEQ ID NO: 1597050 - protein, 24 aa, Staphylococcus aureus
NLDTLDKSYVIHYSGEYLNGTNEV

SEQ ID NO: 1597051 - protein, 45 aa, Staphylococcus aureus
NLELDFLMFIRKFIVLLFVFACITTLLWLISYSLLLKLSIPLILK

SEQ ID NO: 1597052 - protein, 17 aa, Staphylococcus aureus
NLKGASLFLRLGARIFK

SEQ ID NO: 1597053 - protein, 24 aa, Staphylococcus aureus
NLKKKNIYSIRKLGVGIASVTLGT

SEQ ID NO: 1597054 - protein, 36 aa, Staphylococcus aureus
NLKKQSKLILIFICIFTFLLMVIQSQFLMGQSITDY

SEQ ID NO: 1597055 - protein, 28 aa, Staphylococcus aureus
NLLTPLLSIFITAFLTFSFVGPITRQLG

SEQ ID NO: 1597056 - protein, 19 aa, Staphylococcus aureus
NLTSQIERGTTVAGVQGIQ

SEQ ID NO: 1597057 - protein, 17 aa, Staphylococcus aureus
NLYDVYISKGLDTPKKI

SEQ ID NO: 1597058 - protein, 25 aa, Staphylococcus aureus
NLYFGIFLIFVAILLMIRNKIKPFK

SEQ ID NO: 1597059 - protein, 20 aa, Staphylococcus aureus
NLYLMLLSYIIFGGLSILAF

SEQ ID NO: 1597060 - protein, 20 aa, Staphylococcus aureus
NMKVADFHKTPMGGYFIVGY

SEQ ID NO: 1597061 - protein, 22 aa, Staphylococcus aureus
NMNVWILLGVTLILSLFGQLGD

SEQ ID NO: 1597062 - protein, 21 aa, Staphylococcus aureus
NNADIILPKSTAPKSLNTRMR

SEQ ID NO: 1597063 - protein, 18 aa, Staphylococcus aureus
NNGIARISAVQIVISDRA

SEQ ID NO: 1597064 - protein, 23 aa, Staphylococcus aureus
NNGIARISAVQIVISDRAKQSSS

SEQ ID NO: 1597065 - protein, 22 aa, Staphylococcus aureus
NNGIARISAVQIVTSDRAKQSL

SEQ ID NO: 1597066 - protein, 33 aa, Staphylococcus aureus
NNKKTIMLYLSSYWFAELGFTFFNYHYTAKLIK

SEQ ID NO: 1597067 - protein, 19 aa, Staphylococcus aureus
NNLITPIWILCLVGIMMHM

SEQ ID NO: 1597068 - protein, 18 aa, Staphylococcus aureus
NNLSNLNTPQRQALENQI

SEQ ID NO: 1597069 - protein, 62 aa, Staphylococcus aureus
NNTFQDFDINYNGDTKVMTVKYAGQTWTRNISDWIAKSGTANFSLSMTASTGGATNLQQVQF

SEQ ID NO: 1597070 - protein, 23 aa, Staphylococcus aureus
NNTLTFIQLLTPFVVYFLAEEVH

SEQ ID NO: 1597071 - protein, 23 aa, Staphylococcus aureus
NNTYRQTIYVNPSGDNVIAPVLT

SEQ ID NO: 1597072 - protein, 23 aa, Staphylococcus aureus
NPILLLILAIIFFIILKIFKYVS

SEQ ID NO: 1597073 - protein, 17 aa, Staphylococcus aureus
NPLGLQFANSVTSGIIS

SEQ ID NO: 1597074 - protein, 19 aa, Staphylococcus aureus
NPLGVDFKGTVTEGIISGL

SEQ ID NO: 1597075 - protein, 23 aa, Staphylococcus aureus
NPVFIFVGVIIILIWLVLDIYRK

SEQ ID NO: 1597076 - protein, 19 aa, Staphylococcus aureus
NPVGWAVLGGFAVATGITI

SEQ ID NO: 1597077 - protein, 21 aa, Staphylococcus aureus
NQIPIFIVMGLYICMYAIFAI

SEQ ID NO: 1597078 - protein, 25 aa, Staphylococcus aureus
NQLNYAEFFLCIVLSLGVVAPIKNF

SEQ ID NO: 1597079 - protein, 25 aa, Staphylococcus aureus
NQPKVRVFEYLGNNEDIAKSVYANT

SEQ ID NO: 1597080 - protein, 46 aa, Staphylococcus aureus
NQQYQQYGQKKSKKGWFWGCGGCLVLFILIIIGISACTAGITGNLG

SEQ ID NO: 1597081 - protein, 27 aa, Staphylococcus aureus
NQSSSPEAMFVLLAGIGLIATVRRRKA

SEQ ID NO: 1597082 - protein, 24 aa, Staphylococcus aureus
NQTFNYTWFVGGLLGVGYLTGNLL

SEQ ID NO: 1597083 - protein, 20 aa, Staphylococcus aureus
NSHLTIGYGTANHPFNSSTI

SEQ ID NO: 1597084 - protein, 19 aa, Staphylococcus aureus
NSHVDIKSELGYEGGQNNG

SEQ ID NO: 1597085 - protein, 36 aa, Staphylococcus aureus
NSIFNHFIPVIITILLCYFGFQFGLKKRDEMLMFLP

SEQ ID NO: 1597086 - protein, 28 aa, Staphylococcus aureus
NSIMQVLTLVSVIFSPLTFIAGIYGMNF

SEQ ID NO: 1597087 - protein, 27 aa, Staphylococcus aureus
NSQVGILLFLMSCLFNIILSATLKRTY

SEQ ID NO: 1597088 - protein, 23 aa, Staphylococcus aureus
NSVPIRILIFYVGALAVIMSIIP

SEQ ID NO: 1597089 - protein, 22 aa, Staphylococcus aureus
NTAMDWDRKYPYGDTLRGIFGD

SEQ ID NO: 1597090 - protein, 21 aa, Staphylococcus aureus
NTFQDFDINYNGDTKVMTVTY

SEQ ID NO: 1597091 - protein, 22 aa, Staphylococcus aureus
NTFQDFDINYNGDTKVMTVTYA

SEQ ID NO: 1597092 - protein, 21 aa, Staphylococcus aureus
NTIKSVHFTSLKTGPMGDAVI

SEQ ID NO: 1597093 - protein, 23 aa, Staphylococcus aureus
NTIKTALIALKPFISGVAQSMEQ

SEQ ID NO: 1597094 - protein, 19 aa, Staphylococcus aureus
NTKLYPGQVWTIADLLQIT

SEQ ID NO: 1597095 - protein, 17 aa, Staphylococcus aureus
NTKRSVNYTDADQPKQQ

SEQ ID NO: 1597096 - protein, 21 aa, Staphylococcus aureus
NTMILALIIIIATFSNSANAA

SEQ ID NO: 1597097 - protein, 24 aa, Staphylococcus aureus
NTSPTLILVLYAVRMFGVAILMMP

SEQ ID NO: 1597098 - protein, 39 aa, Staphylococcus aureus
NTTQFVIWLQNGIWAIIVYFIVCLLISFLALISMNIRIL

SEQ ID NO: 1597099 - protein, 23 aa, Staphylococcus aureus
NTVTGLPSGLSYDSATNSIIGTP

SEQ ID NO: 1597100 - protein, 22 aa, Staphylococcus aureus
NTVTGLPSGLTFDSTNNTISGT

SEQ ID NO: 1597101 - protein, 23 aa, Staphylococcus aureus
NTVTGLPSGLTFDSTNNTISGTP

SEQ ID NO: 1597102 - protein, 19 aa, Staphylococcus aureus
NTYGKDIPYKLLANFLNEF

SEQ ID NO: 1597103 - protein, 24 aa, Staphylococcus aureus
NTYGKDIPYKLLANFLNEFDKNVD

SEQ ID NO: 1597104 - protein, 19 aa, Staphylococcus aureus
NTYRQTIYVNPSGDNVIAP

SEQ ID NO: 1597105 - protein, 30 aa, Staphylococcus aureus
NVDPATGKDYSIFGWNNENVVRYGGGSADG

SEQ ID NO: 1597106 - protein, 21 aa, Staphylococcus aureus
NVIAPVLTGNLKPNTDSNALI

SEQ ID NO: 1597107 - protein, 21 aa, Staphylococcus aureus
NVIAPVLTGNLKPNTESNALI

SEQ ID NO: 1597108 - protein, 25 aa, Staphylococcus aureus
NVIYGMVVLLIICGCIPKLGALANI

SEQ ID NO: 1597109 - protein, 22 aa, Staphylococcus aureus
NVLFVMLFQLTLALLFLIIAYA

SEQ ID NO: 1597110 - protein, 25 aa, Staphylococcus aureus
NVRIGWLILRLLAVIFAWMTFLQIG

SEQ ID NO: 1597111 - protein, 20 aa, Staphylococcus aureus
NVSRRLFKNLFYEDIKSFED

SEQ ID NO: 1597112 - protein, 25 aa, Staphylococcus aureus
NVSTYIIIFLVSSAAFAIFLLSANI

SEQ ID NO: 1597113 - protein, 26 aa, Staphylococcus aureus
NVTANITMPAYIDPENVTKTGNVTLA

SEQ ID NO: 1597114 - protein, 25 aa, Staphylococcus aureus
NVTANLEINLFIDPKTVQSNGQQTI

SEQ ID NO: 1597115 - protein, 17 aa, Staphylococcus aureus
NVTLHYRDGSSTTLDAT

SEQ ID NO: 1597116 - protein, 20 aa, Staphylococcus aureus
NVYFTLFGYILFGGLTMLFL

SEQ ID NO: 1597117 - protein, 25 aa, Staphylococcus aureus
NWISALFCVLLLMSFNLLSARLFGE

SEQ ID NO: 1597118 - protein, 54 aa, Staphylococcus aureus
NWRGVWDGIVMILKGTVQLIWNLIQLWFVGKILGVVRYFGGLLKGLISGIWGVV

SEQ ID NO: 1597119 - protein, 19 aa, Staphylococcus aureus
NWVSPYKTRMILGFIMSFL

SEQ ID NO: 1597120 - protein, 19 aa, Staphylococcus aureus
NYDAATSTITATYAGKTWK

SEQ ID NO: 1597121 - protein, 42 aa, Staphylococcus aureus
NYDITEMHWTLWKYLILTCLVVLICLYFASRSFKRTLIRPIQ

SEQ ID NO: 1597122 - protein, 25 aa, Staphylococcus aureus
NYHNIFALIFDWLVILGSACISIYM

SEQ ID NO: 1597123 - protein, 19 aa, Staphylococcus aureus
NYQFGGHNIVDFEEDTLPK

SEQ ID NO: 1597124 - protein, 26 aa, Staphylococcus aureus
NYVILPIFLSIFILTLFVIKQLKSKD

SEQ ID NO: 1597125 - protein, 18 aa, Staphylococcus aureus
PALKIIVSAFNKVVTWVT

SEQ ID NO: 1597126 - protein, 17 aa, Staphylococcus aureus
PALLPVAFLLIVIVGPI

SEQ ID NO: 1597127 - protein, 29 aa, Staphylococcus aureus
PAQAFVDKFAKYYTPIIMVIAALVTVVPP

SEQ ID NO: 1597128 - protein, 23 aa, Staphylococcus aureus
PASIIGLLVWFIAGFQFKGHSND

SEQ ID NO: 1597129 - protein, 21 aa, Staphylococcus aureus
PASVILLIIFILSVAFLIYVE

SEQ ID NO: 1597130 - protein, 28 aa, Staphylococcus aureus
PATILSLLILFFYLFSDGLRDAFDPKMR

SEQ ID NO: 1597131 - protein, 18 aa, Staphylococcus aureus
PDHPLVYWATFSNASDLL

SEQ ID NO: 1597132 - protein, 17 aa, Staphylococcus aureus
PDLTLEQKAKALKEIDE

SEQ ID NO: 1597133 - protein, 18 aa, Staphylococcus aureus
PEDHAYIRFPVSDGTQEL

SEQ ID NO: 1597134 - protein, 19 aa, Staphylococcus aureus
PEDHAYIRFPVSDGTQELK

SEQ ID NO: 1597135 - protein, 26 aa, Staphylococcus aureus
PEDTTHVRWFLNINNEKRYVSKDITI

SEQ ID NO: 1597136 - protein, 26 aa, Staphylococcus aureus
PEEKFWILYYSFLRALILGFFIGFIP

SEQ ID NO: 1597137 - protein, 48 aa, Staphylococcus aureus
PEGTLYEPKPKKKSTRKIVLLSLIFSLLMIALVSFVAMAMFGNKYEET

SEQ ID NO: 1597138 - protein, 20 aa, Staphylococcus aureus
PEKWILGLLGLIPIYLGIKV

SEQ ID NO: 1597139 - protein, 18 aa, Staphylococcus aureus
PEQILVNGELIVHRDDII

SEQ ID NO: 1597140 - protein, 24 aa, Staphylococcus aureus
PFEKYSLYIINDFKTFIDCTYIPE

SEQ ID NO: 1597141 - protein, 32 aa, Staphylococcus aureus
PFIIIANFFMALLTFIFIFYANHFMMSQRRKE

SEQ ID NO: 1597142 - protein, 19 aa, Staphylococcus aureus
PFIYIFPIADQAVLAKASA

SEQ ID NO: 1597143 - protein, 22 aa, Staphylococcus aureus
PFLGMLLITKYPIDLLFIICVI

SEQ ID NO: 1597144 - protein, 17 aa, Staphylococcus aureus
PFLIIIVLHSKFRFNAV

SEQ ID NO: 1597145 - protein, 25 aa, Staphylococcus aureus
PGICLVLLIILIGGYVIMTKTNGRN

SEQ ID NO: 1597146 - protein, 19 aa, Staphylococcus aureus
PGIYLVKLLQRVPGLNKLD

SEQ ID NO: 1597147 - protein, 34 aa, Staphylococcus aureus
PHELFIPAMILSLLILFFYLFSDGLRDAFDPKMR

SEQ ID NO: 1597148 - protein, 29 aa, Staphylococcus aureus
PHNAQRVTLKYKWKFGEGIKAGDYFDFTL

SEQ ID NO: 1597149 - protein, 25 aa, Staphylococcus aureus
PHQFEQLFLIFIDNAIKYDVKNKKI

SEQ ID NO: 1597150 - protein, 23 aa, Staphylococcus aureus
PIAIVFLFLQRYLVSGLTTGATK

SEQ ID NO: 1597151 - protein, 24 aa, Staphylococcus aureus
PIAWAPFVVLWFGIGSLSAIAIIF

SEQ ID NO: 1597152 - protein, 21 aa, Staphylococcus aureus
PIDEIVNYAPEIIPHGTREEI

SEQ ID NO: 1597153 - protein, 30 aa, Staphylococcus aureus
PIGDQSSEVFSPISPIKIATQDNSGNVVTN

SEQ ID NO: 1597154 - protein, 19 aa, Staphylococcus aureus
PIHNKIFINELKLLRADKW

SEQ ID NO: 1597155 - protein, 24 aa, Staphylococcus aureus
PIKGTIFFIFFISFISVFYSFLNI

SEQ ID NO: 1597156 - protein, 30 aa, Staphylococcus aureus
PIRYVIAILVVVLMVLGVFQLGIIGRLIDS

SEQ ID NO: 1597157 - protein, 18 aa, Staphylococcus aureus
PISNIFETLTTWLKSMQG

SEQ ID NO: 1597158 - protein, 17 aa, Staphylococcus aureus
PIVPELLKSLNFNQFNL

SEQ ID NO: 1597159 - protein, 19 aa, Staphylococcus aureus
PIYLDVFLIFAAVVFILMY

SEQ ID NO: 1597160 - protein, 51 aa, Staphylococcus aureus
PKFNDWIFIIFIISVYYIFWLLAKRKYILVTFWTIIILTLLITFPTNSHHK

SEQ ID NO: 1597161 - protein, 50 aa, Staphylococcus aureus
PKFNDWIFIIFIISVYYIFWLLAKRKYILVTFWTIIILTLLITLPTNSHH

SEQ ID NO: 1597162 - protein, 38 aa, Staphylococcus aureus
PKFNDWIFIIFIISVYYIFWLLAKRKYILVTVWTIIIL

SEQ ID NO: 1597163 - protein, 35 aa, Staphylococcus aureus
PKFNDWIFIISVYYIFWLLAKRKYILVTFWTIIIL

SEQ ID NO: 1597164 - protein, 38 aa, Staphylococcus aureus
PKKKSTRKIVLLSLIFSLLMIALVSFVAMAMFGNKYEE

SEQ ID NO: 1597165 - protein, 20 aa, Staphylococcus aureus
PKKYIIPWALLGFALVMIYQ

SEQ ID NO: 1597166 - protein, 43 aa, Staphylococcus aureus
PLFATVIVVLAFFLLMIVFRSILIPLKAVLGFVLSLMATLGFT

SEQ ID NO: 1597167 - protein, 20 aa, Staphylococcus aureus
PLHMRHFSNNFGNVIKNAIG

SEQ ID NO: 1597168 - protein, 19 aa, Staphylococcus aureus
PLIAAIICILVFKYKKVQL

SEQ ID NO: 1597169 - protein, 24 aa, Staphylococcus aureus
PLILIVVVVGFGIYFYASKDKEIN

SEQ ID NO: 1597170 - protein, 20 aa, Staphylococcus aureus
PLIQGIVVFIIVLIMFINYL

SEQ ID NO: 1597171 - protein, 17 aa, Staphylococcus aureus
PLLLIIGRLIQGLSAAC

SEQ ID NO: 1597172 - protein, 17 aa, Staphylococcus aureus
PLLPIYMASLQNLSVVE

SEQ ID NO: 1597173 - protein, 18 aa, Staphylococcus aureus
PLPLFFTIKWVILNNGYL

SEQ ID NO: 1597174 - protein, 26 aa, Staphylococcus aureus
PLSAYAFMIFILLYIPCVSTVVAIRK

SEQ ID NO: 1597175 - protein, 26 aa, Staphylococcus aureus
PLSYIDNMFFNYLNAEHPIGLVLVIL

SEQ ID NO: 1597176 - protein, 31 aa, Staphylococcus aureus
PLTSTILAIAYILMWFNGHMTLTLTLTTIIT

SEQ ID NO: 1597177 - protein, 28 aa, Staphylococcus aureus
PLVILCDILIILELLYTGNFRPILVAQL

SEQ ID NO: 1597178 - protein, 25 aa, Staphylococcus aureus
PLVLNPVFFIPFVLSPIVNVWIFKL

SEQ ID NO: 1597179 - protein, 18 aa, Staphylococcus aureus
PMFKSNLFSEKILDEFIS

SEQ ID NO: 1597180 - protein, 22 aa, Staphylococcus aureus
PMKIMYLAEDYFRKHKIRSNAN

SEQ ID NO: 1597181 - protein, 22 aa, Staphylococcus aureus
PMLLGTFIVIIGIALISLVFLP

SEQ ID NO: 1597182 - protein, 18 aa, Staphylococcus aureus
PNAVFWLKTYPERLKQAR

SEQ ID NO: 1597183 - protein, 19 aa, Staphylococcus aureus
PNCQHIFSPSLWQVIKAKH

SEQ ID NO: 1597184 - protein, 27 aa, Staphylococcus aureus
PNEAVQGDTFKITVPKELNLNGVTSTA

SEQ ID NO: 1597185 - protein, 22 aa, Staphylococcus aureus
PNKRFGQIGVLLYFGDVTLTHK

SEQ ID NO: 1597186 - protein, 25 aa, Staphylococcus aureus
PNLIIVILFVLIFEPSIWTIILAMS

SEQ ID NO: 1597187 - protein, 26 aa, Staphylococcus aureus
PNMVKYPILMLPILTTAIASGLVSAL

SEQ ID NO: 1597188 - protein, 18 aa, Staphylococcus aureus
PNPNYPFNGGVHHGVDYD

SEQ ID NO: 1597189 - protein, 38 aa, Staphylococcus aureus
PNSKGDLALRSTLYGYNSNIIWRSMSWDNEVAFNNGSG

SEQ ID NO: 1597190 - protein, 18 aa, Staphylococcus aureus
PNVKIYEYVGVENGLPQS

SEQ ID NO: 1597191 - protein, 19 aa, Staphylococcus aureus
PPNPNYPFNGGVHHGVDYD

SEQ ID NO: 1597192 - protein, 18 aa, Staphylococcus aureus
PQRDALRNQINQAQALAT

SEQ ID NO: 1597193 - protein, 25 aa, Staphylococcus aureus
PQYHPRMLLSIILCAYIQGVYSGRQ

SEQ ID NO: 1597194 - protein, 25 aa, Staphylococcus aureus
PRAKLMFVFLFIILIFVCHSPLTYL

SEQ ID NO: 1597195 - protein, 23 aa, Staphylococcus aureus
PRGEFLHMLLGVFLAALVSFVVA

SEQ ID NO: 1597196 - protein, 26 aa, Staphylococcus aureus
PSFWQGILFILAFSLKLDILPPSYMP

SEQ ID NO: 1597197 - protein, 20 aa, Staphylococcus aureus
PSFYLSFIALLIINLAVLVW

SEQ ID NO: 1597198 - protein, 17 aa, Staphylococcus aureus
PSGDNVIAPVLTGNLKP

SEQ ID NO: 1597199 - protein, 24 aa, Staphylococcus aureus
PSIQIFMYWFIFGLGFRNNRTVEN

SEQ ID NO: 1597200 - protein, 33 aa, Staphylococcus aureus
PSQAFVDKFAKYYTPIIMVIAALVAVVPPLFFG

SEQ ID NO: 1597201 - protein, 29 aa, Staphylococcus aureus
PTFKLGCFLVFWIYFCWKFFDIYTNCPYD

SEQ ID NO: 1597202 - protein, 27 aa, Staphylococcus aureus
PTFSSIIFLFFKLKYYAIVTILVTMII

SEQ ID NO: 1597203 - protein, 31 aa, Staphylococcus aureus
PTLKFMLNAPFVYSFWWFKHTCFLYVYHRRY

SEQ ID NO: 1597204 - protein, 19 aa, Staphylococcus aureus
PTLLPIIPLLGISLGSLIG

SEQ ID NO: 1597205 - protein, 23 aa, Staphylococcus aureus
PTLVFSFFGMNVPLPIDDHSYIS

SEQ ID NO: 1597206 - protein, 18 aa, Staphylococcus aureus
PTMFLYYFYGSRAVLIPT

SEQ ID NO: 1597207 - protein, 25 aa, Staphylococcus aureus
PTMNIILLSLGYFVIPFVSAFIVHE

SEQ ID NO: 1597208 - protein, 21 aa, Staphylococcus aureus
PTPEVPIVPPTPPTPEVPSEP

SEQ ID NO: 1597209 - protein, 25 aa, Staphylococcus aureus
PTTAEVILIIILGLPIYFFYEYRMN

SEQ ID NO: 1597210 - protein, 21 aa, Staphylococcus aureus
PTWIPGVIAILLLMAANLFSV

SEQ ID NO: 1597211 - protein, 20 aa, Staphylococcus aureus
PVAHWVWGGGWINKLGVLDF

SEQ ID NO: 1597212 - protein, 18 aa, Staphylococcus aureus
PVAKNDLKEIPQLVTKKN

SEQ ID NO: 1597213 - protein, 25 aa, Staphylococcus aureus
PVDEIVHFAPEEVPQGHKDEFDPNL

SEQ ID NO: 1597214 - protein, 17 aa, Staphylococcus aureus
PVGWAVLGGFAVATGIT

SEQ ID NO: 1597215 - protein, 39 aa, Staphylococcus aureus
PVKRQNILFLCPFLPVISFVVIFINSQVGILLFLMSCLF

SEQ ID NO: 1597216 - protein, 18 aa, Staphylococcus aureus
PVLNQYYGELLFLLNSEP

SEQ ID NO: 1597217 - protein, 19 aa, Staphylococcus aureus
PVLPVYLKDLGLTGSDLGL

SEQ ID NO: 1597218 - protein, 21 aa, Staphylococcus aureus
PVSIFTGIIAFIFLMLARKSN

SEQ ID NO: 1597219 - protein, 28 aa, Staphylococcus aureus
PVSIGKLFMIFLIRTIITLPIISLMAHF

SEQ ID NO: 1597220 - protein, 28 aa, Staphylococcus aureus
PVSIGKLFMIFLIRTIITLPLISLMAHL

SEQ ID NO: 1597221 - protein, 17 aa, Staphylococcus aureus
PWGVLILFGGGLALAKG

SEQ ID NO: 1597222 - protein, 19 aa, Staphylococcus aureus
PWMLLKLAVVWTLVQFVEG

SEQ ID NO: 1597223 - protein, 20 aa, Staphylococcus aureus
PYIVVVNGHIDPNSKGDLAL

SEQ ID NO: 1597224 - protein, 37 aa, Staphylococcus aureus
PYQKYIDFMFAGALAFIFLIYRIYILFIDYKSVNKKL

SEQ ID NO: 1597225 - protein, 21 aa, Staphylococcus aureus
PYQLDAKAWRKTFPPKKDGDK

SEQ ID NO: 1597226 - protein, 22 aa, Staphylococcus aureus
QAIDNLTHLNTPQKTALKQQVN

SEQ ID NO: 1597227 - protein, 18 aa, Staphylococcus aureus
QALDQLMDALQQSIADKD

SEQ ID NO: 1597228 - protein, 18 aa, Staphylococcus aureus
QALKDRINQILQQGHNDI

SEQ ID NO: 1597229 - protein, 23 aa, Staphylococcus aureus
QALKDRINQILQQGHNDINNALT

SEQ ID NO: 1597230 - protein, 22 aa, Staphylococcus aureus
QALKDRINQILQQGHNDINNAM

SEQ ID NO: 1597231 - protein, 17 aa, Staphylococcus aureus
QALKDRINQILQQGHNG

SEQ ID NO: 1597232 - protein, 23 aa, Staphylococcus aureus
QAQQIANGIPTPVLTPDTVTQAV

SEQ ID NO: 1597233 - protein, 26 aa, Staphylococcus aureus
QASLIRRMIVLLRGALLKRRVQTRVN

SEQ ID NO: 1597234 - protein, 29 aa, Staphylococcus aureus
QAVNPSAPRMRAFSLAAVAADAPAAGTDI

SEQ ID NO: 1597235 - protein, 30 aa, Staphylococcus aureus
QAVNPSAPRMRAFSLAAVAADAPAAGTDIT

SEQ ID NO: 1597236 - protein, 29 aa, Staphylococcus aureus
QAVNTSAPRMRAFSLAAVAADAPAAGKDI

SEQ ID NO: 1597237 - protein, 32 aa, Staphylococcus aureus; identical to SEQ ID NO: 1584455

SEQ ID NO: 1597238 - protein, 30 aa, Staphylococcus aureus
QAVNTSAPRMRAFSLAAVAADAPAAGTDIT

SEQ ID NO: 1597239 - protein, 25 aa, Staphylococcus aureus
QDGKKLIFFLWDFMMYVFNIQMRNV

SEQ ID NO: 1597240 - protein, 24 aa, Staphylococcus aureus
QDGKKLVFFLWDFITYVFNIQMRN

SEQ ID NO: 1597241 - protein, 26 aa, Staphylococcus aureus
QDIYGIVWIFMLFLSLAMMHYVLNVL

SEQ ID NO: 1597242 - protein, 23 aa, Staphylococcus aureus
QDKSLLISQILQTKLGKSEADKL

SEQ ID NO: 1597243 - protein, 26 aa, Staphylococcus aureus
QDNEHSPLLIAKRRKDKEVDVETTTS

SEQ ID NO: 1597244 - protein, 26 aa, Staphylococcus aureus
QEALANLDTLRDLNQPQRDALRNQIN

SEQ ID NO: 1597245 - protein, 24 aa, Staphylococcus aureus
QEKKIFPYILMSVGAFLTLGFVIF

SEQ ID NO: 1597246 - protein, 22 aa, Staphylococcus aureus
QEKRIDLYFKYNLNNYHGLKIT

SEQ ID NO: 1597247 - protein, 23 aa, Staphylococcus aureus
QEKRINLYFKYNLNHYKSLKVTR

SEQ ID NO: 1597248 - protein, 30 aa, Staphylococcus aureus
QELQDGIGLPLFTALPIVSGMLEKYGIRDK

SEQ ID NO: 1597249 - protein, 20 aa, Staphylococcus aureus
QFIYLHQRVGQFSNLLMVCH

SEQ ID NO: 1597250 - protein, 28 aa, Staphylococcus aureus
QFSFIISFFIMLLFPFLQQLSKLQSLFI

SEQ ID NO: 1597251 - protein, 32 aa, Staphylococcus aureus
QFSKLLMVCHPLLFMFFTKIFIQSWKQTHRYG

SEQ ID NO: 1597252 - protein, 17 aa, Staphylococcus aureus
QFYHYASTVEPATVIFT

SEQ ID NO: 1597253 - protein, 30 aa, Staphylococcus aureus
QFYLYYIVSAFLFWLVIFTFGIAGIIFLMP

SEQ ID NO: 1597254 - protein, 28 aa, Staphylococcus aureus
QGALNIILGFIKFFSSLFTGNWRGVWDG

SEQ ID NO: 1597255 - protein, 18 aa, Staphylococcus aureus
QGDTFKITVPKELNLNGV

SEQ ID NO: 1597256 - protein, 24 aa, Staphylococcus aureus
QGFFKGFLSLIPVLVGIIVGYMVA

SEQ ID NO: 1597257 - protein, 25 aa, Staphylococcus aureus
QGVVIIPVLFIMNALFGLTGVMWSL

SEQ ID NO: 1597258 - protein, 26 aa, Staphylococcus aureus
QGVVIIPVLFIMNTLFGLTGVIWSLL

SEQ ID NO: 1597259 - protein, 17 aa, Staphylococcus aureus
QHAGWLGGAIYGLLYAP

SEQ ID NO: 1597260 - protein, 24 aa, Staphylococcus aureus
QHRKLLVIKKLYGYSTLRANYQYL

SEQ ID NO: 1597261 - protein, 20 aa, Staphylococcus aureus
QHYTYYKLNTLQSLDQRIAN

SEQ ID NO: 1597262 - protein, 17 aa, Staphylococcus aureus
QIALLFVSQLVFHFNSG

SEQ ID NO: 1597263 - protein, 21 aa, Staphylococcus aureus
QIANGTPTPVLTPDAVTQAVT

SEQ ID NO: 1597264 - protein, 23 aa, Staphylococcus aureus
QIDQSPEIAIVNQVKQTATSLDH

SEQ ID NO: 1597265 - protein, 20 aa, Staphylococcus aureus
QIFIVGTAISLLITVILGFF

SEQ ID NO: 1597266 - protein, 27 aa, Staphylococcus aureus
QIIIAIILIIIILFDVKYYFEQHRKLL

SEQ ID NO: 1597267 - protein, 27 aa, Staphylococcus aureus
QIIIVIILVIIILFDVKYYFEQHRKLL

SEQ ID NO: 1597268 - protein, 21 aa, Staphylococcus aureus
QILMGILIDHFALFGSPKIAM

SEQ ID NO: 1597269 - protein, 20 aa, Staphylococcus aureus
QILTLIYSMVKERIQAVRER

SEQ ID NO: 1597270 - protein, 20 aa, Staphylococcus aureus
QINEIVLETIRDINNAHTLQ

SEQ ID NO: 1597271 - protein, 18 aa, Staphylococcus aureus
QIPVYVYFIDISLTIIFA

SEQ ID NO: 1597272 - protein, 19 aa, Staphylococcus aureus
QITTPYIVVVNGHIDPNSK

SEQ ID NO: 1597273 - protein, 32 aa, Staphylococcus aureus
QIYQINIWVWVPLIVIIVCLLFKMATVPAMLI

SEQ ID NO: 1597274 - protein, 18 aa, Staphylococcus aureus
QKLPVRLVSYSPVPEDHA

SEQ ID NO: 1597275 - protein, 52 aa, Staphylococcus aureus
QKNNTVIWRSIIPPLVMIALTVVIFLVRPIGIYILMMIGMSTVTIVFGITTY

SEQ ID NO: 1597276 - protein, 32 aa, Staphylococcus aureus
QKRQKLLRTTFILLTLVGIGLTAFSFISNNVL

SEQ ID NO: 1597277 - protein, 34 aa, Staphylococcus aureus
QKYTDFMFASVLAFIFLVYRIYILFIDYKSVNKK

SEQ ID NO: 1597278 - protein, 24 aa, Staphylococcus aureus
QLALITSYIPFLAPFQLVVRAQTS

SEQ ID NO: 1597279 - protein, 23 aa, Staphylococcus aureus
QLEQFKAQMKAANPLAKELAKRK

SEQ ID NO: 1597280 - protein, 20 aa, Staphylococcus aureus
QLIALAVFSILLFLGCTWSI

SEQ ID NO: 1597281 - protein, 17 aa, Staphylococcus aureus
QLPTWQLYLRLPMQFVL

SEQ ID NO: 1597282 - protein, 17 aa, Staphylococcus aureus
QLPYIPKQRLYTLTASA

SEQ ID NO: 1597283 - protein, 26 aa, Staphylococcus aureus
QLSYTPPYYYLLIKITIFGIICSIIF

SEQ ID NO: 1597284 - protein, 26 aa, Staphylococcus aureus
QLSYTPPYYYLLITITILGIICSIIF

SEQ ID NO: 1597285 - protein, 23 aa, Staphylococcus aureus
QLTEALFAEKSLAKNDLKEIPQL

SEQ ID NO: 1597286 - protein, 38 aa, Staphylococcus aureus
QLTEVLFAEKPVAKNDLKEIPLLVTKKNDVSETVNTDN

SEQ ID NO: 1597287 - protein, 19 aa, Staphylococcus aureus
QLTHLNNAQRQLAIQQINN

SEQ ID NO: 1597288 - protein, 19 aa, Staphylococcus aureus
QLTLALLFLIIAYASYKKY

SEQ ID NO: 1597289 - protein, 19 aa, Staphylococcus aureus
QMKQLRFYMEEIPELIRET

SEQ ID NO: 1597290 - protein, 26 aa, Staphylococcus aureus
QMNPVIFFILNFILISYLYDKQYVQF

SEQ ID NO: 1597291 - protein, 26 aa, Staphylococcus aureus
QMSGILLWIYIIVIICLLFTGQPSVF

SEQ ID NO: 1597292 - protein, 25 aa, Staphylococcus aureus
QMYHESLLDWLKIANEYKIPTYVLG

SEQ ID NO: 1597293 - protein, 28 aa, Staphylococcus aureus
QNATGLPTDGFTYKWNNAATGTNDANWA

SEQ ID NO: 1597294 - protein, 43 aa, Staphylococcus aureus
QNEPLPNRKDFVVSFITGALVGSALGLYFKNKVYQKADDLKVK

SEQ ID NO: 1597295 - protein, 27 aa, Staphylococcus aureus
QNIAEKPFSKQAGHPVFYVYAGNQGNA

SEQ ID NO: 1597296 - protein, 24 aa, Staphylococcus aureus
QNIDQATKLQPIAELVDQATQLNQ

SEQ ID NO: 1597297 - protein, 26 aa, Staphylococcus aureus
QNIIIFICWIMMTMLFFLLNMAAIGN

SEQ ID NO: 1597298 - protein, 25 aa, Staphylococcus aureus
QNIIIFICWIMMTMLFFLLNMASIG

SEQ ID NO: 1597299 - protein, 25 aa, Staphylococcus aureus
QNILLMIMIIPTWINLLLKTCAFIG

SEQ ID NO: 1597300 - protein, 17 aa, Staphylococcus aureus
QNILNAKQALNGDERVA

SEQ ID NO: 1597301 - protein, 18 aa, Staphylococcus aureus
QNKKWYLSFGYDAEDIDL

SEQ ID NO: 1597302 - protein, 40 aa, Staphylococcus aureus
QNKNGFTFFLNVLLPLVFISVLIGIFNYIKVLPFIIKYVG

SEQ ID NO: 1597303 - protein, 37 aa, Staphylococcus aureus
QNKQEKKIFPYILMSVGALLTLGFVIFSIHKGRRTKN

SEQ ID NO: 1597304 - protein, 23 aa, Staphylococcus aureus
QNQYQYVPPQQQAPTKQRPAKGE

SEQ ID NO: 1597305 - protein, 25 aa, Staphylococcus aureus
QPKGTFESWWQMYLDEVKGNLLLEL

SEQ ID NO: 1597306 - protein, 24 aa, Staphylococcus aureus
QQFVKKPIPTLFLHGFGGSANSEK

SEQ ID NO: 1597307 - protein, 25 aa, Staphylococcus aureus
QQFVKKPIPTLFLHGFGGSANSEKF

SEQ ID NO: 1597308 - protein, 20 aa, Staphylococcus aureus
QQIANGIPTPVLTPDTVTQA

SEQ ID NO: 1597309 - protein, 45 aa, Staphylococcus aureus
QQNQQYGQKKSKKGWFWGCGGCLLLFILIIIGISACTAGITGNLG

SEQ ID NO: 1597310 - protein, 44 aa, Staphylococcus aureus
QQNQQYGQKKSKKGWFWGCGGCLVLFILIIIGISACTAGITGNL

SEQ ID NO: 1597311 - protein, 23 aa, Staphylococcus aureus
QQQTLELILLLKDLGCALSDIDM

SEQ ID NO: 1597312 - protein, 17 aa, Staphylococcus aureus
QQSAFYEILNMPNLNEV

SEQ ID NO: 1597313 - protein, 30 aa, Staphylococcus aureus
QQSALTAKGYNYTSVDISYASTYNDTNKTV

SEQ ID NO: 1597314 - protein, 25 aa, Staphylococcus aureus
QQTQKEVWVWKSDLYKSLLSFDESE

SEQ ID NO: 1597315 - protein, 30 aa, Staphylococcus aureus
QQVEAALNNGIARILAVQIVTSDHSKHSSN

SEQ ID NO: 1597316 - protein, 29 aa, Staphylococcus aureus
QQVEAALNNGIARILAVQIVTSDHSKPSS

SEQ ID NO: 1597317 - protein, 26 aa, Staphylococcus aureus
QQVKGLMIASIQALIPVIAGLVPAIM

SEQ ID NO: 1597318 - protein, 18 aa, Staphylococcus aureus
QRFKHLIIPLLSQNIRKA

SEQ ID NO: 1597319 - protein, 38 aa, Staphylococcus aureus
QRNKKYKRRNKWFGFIIIILVILLVALGVKSCSNNDET

SEQ ID NO: 1597320 - protein, 28 aa, Staphylococcus aureus
QRSLNLWAYVMLIFMTLAAILTGPLIVY

SEQ ID NO: 1597321 - protein, 23 aa, Staphylococcus aureus
QSDSTSMSLSMSQSISGSTSTST

SEQ ID NO: 1597322 - protein, 25 aa, Staphylococcus aureus
QSGNTFMAANFKVAGKVKSGDYFTA

SEQ ID NO: 1597323 - protein, 20 aa, Staphylococcus aureus
QSIFSPFKRLILYGIILIAM

SEQ ID NO: 1597324 - protein, 33 aa, Staphylococcus aureus
QSIIIIVVLLIKAIITWLLLIPVFNIMTSFVES

SEQ ID NO: 1597325 - protein, 46 aa, Staphylococcus aureus
QSISKKMTGYGLKTTAVIGGAFTVNMLHDQQAFAASDAPLTSELNT

SEQ ID NO: 1597326 - protein, 25 aa, Staphylococcus aureus
QSNSHLHVGYGTVNHPFNSSPIGHK

SEQ ID NO: 1597327 - protein, 36 aa, Staphylococcus aureus
QSPITFWYGKYIILIPSSYFKSVIDKRLKYIILHEY

SEQ ID NO: 1597328 - protein, 25 aa, Staphylococcus aureus
QSVTAEMMRIYKGVDTFVVISHLGI

SEQ ID NO: 1597329 - protein, 20 aa, Staphylococcus aureus
QSYQHSHFPNFGGGVLGFYL

SEQ ID NO: 1597330 - protein, 20 aa, Staphylococcus aureus
QTIDQLTHLNADQIATAKQN

SEQ ID NO: 1597331 - protein, 23 aa, Staphylococcus aureus
QTKDQLNQGLNLGLDDIRNTHVW

SEQ ID NO: 1597332 - protein, 24 aa, Staphylococcus aureus
QTKDQLNQGLNLGLDDIRNTHVWE

SEQ ID NO: 1597333 - protein, 19 aa, Staphylococcus aureus
QTLFSPHRIILAGAAIAML

SEQ ID NO: 1597334 - protein, 28 aa, Staphylococcus aureus
QTLLLGVILAFLWPPFKLKKDPPKVVKY

SEQ ID NO: 1597335 - protein, 29 aa, Staphylococcus aureus
QTQFLQPILFLILGLFIVAIYLVIMLPMF

SEQ ID NO: 1597336 - protein, 18 aa, Staphylococcus aureus
QVFKIEPIRLIYSGSNLT

SEQ ID NO: 1597337 - protein, 17 aa, Staphylococcus aureus
QVFLVGISIFFLGTLLG

SEQ ID NO: 1597338 - protein, 22 aa, Staphylococcus aureus
QVINERTIRYTFTDYINNKKDL

SEQ ID NO: 1597339 - protein, 18 aa, Staphylococcus aureus
QVQALIDEIDRNPNLTDK

SEQ ID NO: 1597340 - protein, 19 aa, Staphylococcus aureus
QVQFGTFEYTESAVTQVRY

SEQ ID NO: 1597341 - protein, 20 aa, Staphylococcus aureus
QVVVKPLFAKPNALASIFGI

SEQ ID NO: 1597342 - protein, 22 aa, Staphylococcus aureus
QVWLGFPFVFALFTGVLQSISS

SEQ ID NO: 1597343 - protein, 21 aa, Staphylococcus aureus
QWFKDEHHWFKAKLKSEANNT

SEQ ID NO: 1597344 - protein, 19 aa, Staphylococcus aureus
QWLTTIFMLGINFPMLLVG

SEQ ID NO: 1597345 - protein, 20 aa, Staphylococcus aureus
QWVGFLSNLIFVPYYSIILF

SEQ ID NO: 1597346 - protein, 17 aa, Staphylococcus aureus
QYGFISLSLLCLCLFFS

SEQ ID NO: 1597347 - protein, 25 aa, Staphylococcus aureus
QYKPKIIMSIILLATFSGALMQTSL

SEQ ID NO: 1597348 - protein, 32 aa, Staphylococcus aureus
QYLGWNALFWFTFLLAIMIVIGAYYALPTIKP

SEQ ID NO: 1597349 - protein, 19 aa, Staphylococcus aureus
QYSSIMSSILMKNKWPFLI

SEQ ID NO: 1597350 - protein, 21 aa, Staphylococcus aureus
QYSSIMSSILMKNKWPFLIAL

SEQ ID NO: 1597351 - protein, 20 aa, Staphylococcus aureus
QYTFDKYYRNKFEVLSKEKD

SEQ ID NO: 1597352 - protein, 17 aa, Staphylococcus aureus
RAEAILNKTQGANTSKQ

SEQ ID NO: 1597353 - protein, 33 aa, Staphylococcus aureus
RALCMLFIPQLYFYLPLLSFIGGLIPFLIIIVL

SEQ ID NO: 1597354 - protein, 26 aa, Staphylococcus aureus
RANRLFWAFALCLLPFSLMLVGGERA

SEQ ID NO: 1597355 - protein, 21 aa, Staphylococcus aureus
RANYQYLLINNIVVIFIGILT

SEQ ID NO: 1597356 - protein, 31 aa, Staphylococcus aureus
RAVVQLIILGFLLHYIFKISDKWLLVLCVFV

SEQ ID NO: 1597357 - protein, 24 aa, Staphylococcus aureus
RCQDGIVLFWPIDGEIELQKFRKS

SEQ ID NO: 1597358 - protein, 28 aa, Staphylococcus aureus
RDDIITEQDILAHINLIDQITAEVIDTP

SEQ ID NO: 1597359 - protein, 25 aa, Staphylococcus aureus
RDIGFIFLYIFLVNILPIIIVFLTF

SEQ ID NO: 1597360 - protein, 22 aa, Staphylococcus aureus
RDKKDFWIQLHPKKAQAMMTKE

SEQ ID NO: 1597361 - protein, 17 aa, Staphylococcus aureus
RDQILTLIYSMVKERIQ

SEQ ID NO: 1597362 - protein, 17 aa, Staphylococcus aureus
REDEVIQWFYKEVDWFE

SEQ ID NO: 1597363 - protein, 23 aa, Staphylococcus aureus
REDEVIQWFYKEVDWFEAKLNSE

SEQ ID NO: 1597364 - protein, 17 aa, Staphylococcus aureus
RENADSGTFNYVKGIFD

SEQ ID NO: 1597365 - protein, 32 aa, Staphylococcus aureus
RETRKKYIRNLILGFVGIAIVISLISFMIING

SEQ ID NO: 1597366 - protein, 25 aa, Staphylococcus aureus
RFEWPHYLLYILLVLGALSTIKLFI

SEQ ID NO: 1597367 - protein, 17 aa, Staphylococcus aureus
RFKHLIIPLLSQNIRKA

SEQ ID NO: 1597368 - protein, 23 aa, Staphylococcus aureus
RGFDIILTIFMLSLAIIMTAGGA

SEQ ID NO: 1597369 - protein, 21 aa, Staphylococcus aureus
RGGAILLILYGLFAFILITFK

SEQ ID NO: 1597370 - protein, 23 aa, Staphylococcus aureus
RGKQGTGLGLFICKMIIEEHGGS

SEQ ID NO: 1597371 - protein, 17 aa, Staphylococcus aureus
RGVWDGIVMILKGTVQL

SEQ ID NO: 1597372 - protein, 26 aa, Staphylococcus aureus
RHQFQGLWIVLFILLGVLLLRATVQF

SEQ ID NO: 1597373 - protein, 32 aa, Staphylococcus aureus
RHTVDGQENLYRIAIQYYGSGSPENVEKIRRA

SEQ ID NO: 1597374 - protein, 24 aa, Staphylococcus aureus
RIAVSILIIFILVSGLSMFVDQLS

SEQ ID NO: 1597375 - protein, 20 aa, Staphylococcus aureus
RIEWIFILIAIALVLTVEAL

SEQ ID NO: 1597376 - protein, 46 aa, Staphylococcus aureus
RILSGFLFLISAFVTIPLVLLIVTLIIPILFFIIAMMMFIRKDKVE

SEQ ID NO: 1597377 - protein, 22 aa, Staphylococcus aureus
RIMYVVIIIAVIYFAIRYIGKR

SEQ ID NO: 1597378 - protein, 18 aa, Staphylococcus aureus
RINEIVLETIRDINNAHT

SEQ ID NO: 1597379 - protein, 17 aa, Staphylococcus aureus
RINQILQQGHNDINNAM

SEQ ID NO: 1597380 - protein, 17 aa, Staphylococcus aureus
RIPINVWTGDSIARTGK

SEQ ID NO: 1597381 - protein, 42 aa, Staphylococcus aureus
RIQPYFKYIDFIFAGVFAFIFLAYRILMLWQGYISQQKALNV

SEQ ID NO: 1597382 - protein, 20 aa, Staphylococcus aureus
RIVLVIFIAILYFGFGIGKG

SEQ ID NO: 1597383 - protein, 25 aa, Staphylococcus aureus
RKETYSWRWTALAVAYPLVTAYVLT

SEQ ID NO: 1597384 - protein, 37 aa, Staphylococcus aureus
RLAKIQLWFLIKGLTPIFFFLIFTLMMHIFLTKGGNV

SEQ ID NO: 1597385 - protein, 20 aa, Staphylococcus aureus
RLDMREIPKSSIKPEHFHLM

SEQ ID NO: 1597386 - protein, 17 aa, Staphylococcus aureus
RLEPRLGNQYGGKLVLI

SEQ ID NO: 1597387 - protein, 17 aa, Staphylococcus aureus
RLFKINLFSFKKLTLSQ

SEQ ID NO: 1597388 - protein, 25 aa, Staphylococcus aureus
RLLKSMEILWQTLSPLEAFIRPNSH

SEQ ID NO: 1597389 - protein, 42 aa, Staphylococcus aureus
RLPDTGDSIKQNGLLGGVMTLLVGLGLMKRKKKKDENEQDDS

SEQ ID NO: 1597390 - protein, 25 aa, Staphylococcus aureus
RMFKRYATIMVSARILERVIATPID

SEQ ID NO: 1597391 - protein, 22 aa, Staphylococcus aureus
RNFDMLPYFIIFDEVTAFTSTL

SEQ ID NO: 1597392 - protein, 21 aa, Staphylococcus aureus
RNFIINAWNAIKTFMVTVWNV

SEQ ID NO: 1597393 - protein, 19 aa, Staphylococcus aureus
RNFLEGYKYVVENRYIYQF

SEQ ID NO: 1597394 - protein, 25 aa, Staphylococcus aureus
RNFSTHKWMLYGILLTGPASMLAIE

SEQ ID NO: 1597395 - protein, 25 aa, Staphylococcus aureus
RNIIQTLFIVSLISLGLMIVIHFIT

SEQ ID NO: 1597396 - protein, 27 aa, Staphylococcus aureus
RNKSQKWYLIIILNTINIIQFDTYFNF

SEQ ID NO: 1597397 - protein, 38 aa, Staphylococcus aureus
RNKTPNEIALFTLLTTLTIIFLVVIVTLYPIASYLHLI

SEQ ID NO: 1597398 - protein, 58 aa, Staphylococcus aureus
RNKTPNEIALFTLLTTLTIIFLVVIVTLYPIASYLHLILPIAMLIALTVCLIPTTIGG

SEQ ID NO: 1597399 - protein, 26 aa, Staphylococcus aureus
RNQMTFLFAIPITVALIHTLISSNIV

SEQ ID NO: 1597400 - protein, 43 aa, Staphylococcus aureus
RNVIQLMYVLYQLEIILRWVLMMQVMLLMNLLNQKFLYRFIMI

SEQ ID NO: 1597401 - protein, 20 aa, Staphylococcus aureus
RPDTTMDALAKLRTVFKADG

SEQ ID NO: 1597402 - protein, 24 aa, Staphylococcus aureus
RPDTTMEALAKLRTVFKADDTVTA

SEQ ID NO: 1597403 - protein, 24 aa, Staphylococcus aureus
RPDTTMEALAKLRTVFKADGTMTA

SEQ ID NO: 1597404 - protein, 25 aa, Staphylococcus aureus
RPSTFLGILPVGMYLISINQLNYAE

SEQ ID NO: 1597405 - protein, 19 aa, Staphylococcus aureus
RQFYHYASTVEPATVIFTK

SEQ ID NO: 1597406 - protein, 24 aa, Staphylococcus aureus
RRDHNLMIPGLSSDFTLFDFTYDL

SEQ ID NO: 1597407 - protein, 24 aa, Staphylococcus aureus
RRKLLIIAMIIFTLASLGIVFVHN

SEQ ID NO: 1597408 - protein, 25 aa, Staphylococcus aureus
RRKPLIIAMIIFTLASLGIVFVHNI

SEQ ID NO: 1597409 - protein, 22 aa, Staphylococcus aureus
RSFYSIRKSTLGVASVIVSTLF

SEQ ID NO: 1597410 - protein, 27 aa, Staphylococcus aureus
RSLNLWTYVMLIFITLAAILMGPLVVY

SEQ ID NO: 1597411 - protein, 26 aa, Staphylococcus aureus
RSLNLWTYVMLIFMTLAAILMGPLVV

SEQ ID NO: 1597412 - protein, 18 aa, Staphylococcus aureus
RSVLWEHIIQLKMPFFDK

SEQ ID NO: 1597413 - protein, 38 aa, Staphylococcus aureus
RTASSTWAWLFVLFVLPLIGFILYLFFGRTVSARKLNK

SEQ ID NO: 1597414 - protein, 19 aa, Staphylococcus aureus
RTGLYIIDSQLLKGHIYNG

SEQ ID NO: 1597415 - protein, 17 aa, Staphylococcus aureus
RTIYRMILKLHNIMLNV

SEQ ID NO: 1597416 - protein, 24 aa, Staphylococcus aureus
RTLITWFYTMLWSIVGVVWIVFSI

SEQ ID NO: 1597417 - protein, 32 aa, Staphylococcus aureus
RTTAISIISIPLSLLMALIALKLSDVSLNILT

SEQ ID NO: 1597418 - protein, 17 aa, Staphylococcus aureus
RVAFIIIVGIALVAFIF

SEQ ID NO: 1597419 - protein, 18 aa, Staphylococcus aureus
RVGIILIGLVLMVAIVDL

SEQ ID NO: 1597420 - protein, 19 aa, Staphylococcus aureus
RVILFVFRCLVVVLVFVGA

SEQ ID NO: 1597421 - protein, 23 aa, Staphylococcus aureus
RVIQIQRVIPIQQAIQIQIVTQT

SEQ ID NO: 1597422 - protein, 19 aa, Staphylococcus aureus
RWMFALAFFFIGVIAYMDR

SEQ ID NO: 1597423 - protein, 17 aa, Staphylococcus aureus
RYTFTDYINNKKDLTAE

SEQ ID NO: 1597424 - protein, 19 aa, Staphylococcus aureus
RYYYYFSVLFMLIGIIGAF

SEQ ID NO: 1597425 - protein, 21 aa, Staphylococcus aureus
SAFALIIPILSGFIARSIADK

SEQ ID NO: 1597426 - protein, 22 aa, Staphylococcus aureus
SAFLFWLVILTFGIAGIIFLMP

SEQ ID NO: 1597427 - protein, 29 aa, Staphylococcus aureus
SAIAFLLTFIKFPIPFLPPYLTLDFSDVP

SEQ ID NO: 1597428 - protein, 30 aa, Staphylococcus aureus
SAIAFVLTFIKFPIPFLPPYLTLDFSDVPS

SEQ ID NO: 1597429 - protein, 30 aa, Staphylococcus aureus
SAIISALIFNALIIVALIPIAMKGVKVKGY

SEQ ID NO: 1597430 - protein, 29 aa, Staphylococcus aureus
SAITFVLTFIKFPIPFLPPYLTLDFSDVP

SEQ ID NO: 1597431 - protein, 38 aa, Staphylococcus aureus
SAIVTIPLVLLIVTLIIPILFFIIAMMLFIRKDKVEMV

SEQ ID NO: 1597432 - protein, 17 aa, Staphylococcus aureus
SAKRALASYSNLNNAQS

SEQ ID NO: 1597433 - protein, 25 aa, Staphylococcus aureus
SAQTFLLIIWILLVVLVIYFTIRLS

SEQ ID NO: 1597434 - protein, 24 aa, Staphylococcus aureus
SAVEILFATIGLIIGLLISVMVSF

SEQ ID NO: 1597435 - protein, 26 aa, Staphylococcus aureus
SAVFDYWWMFAISFLFFALASLLTLF

SEQ ID NO: 1597436 - protein, 19 aa, Staphylococcus aureus
SAWGYWFSAFLGNVAYVTL

SEQ ID NO: 1597437 - protein, 23 aa, Staphylococcus aureus
SCLKLILILLFLLSIILVIYQTQ

SEQ ID NO: 1597438 - protein, 23 aa, Staphylococcus aureus
SDDNAAYDLTLNGSAKLNNMTSM

SEQ ID NO: 1597439 - protein, 27 aa, Staphylococcus aureus
SDGKFHGQRLNDVILTYVASTGKMRAE

SEQ ID NO: 1597440 - protein, 21 aa, Staphylococcus aureus
SDGWFLLNLISTIGALLMAIG

SEQ ID NO: 1597441 - protein, 24 aa, Staphylococcus aureus
SDHKIFILMIILNIIMLASSITQI

SEQ ID NO: 1597442 - protein, 24 aa, Staphylococcus aureus
SDKDYAYIRFPVSNGTRDVKIVSS

SEQ ID NO: 1597443 - protein, 33 aa, Staphylococcus aureus
SDTLKIFILIVVVWILVFILMGAGLKQVNLLQK

SEQ ID NO: 1597444 - protein, 26 aa, Staphylococcus aureus
SEKLNKLLLIISLLSIFQVVEIFSVI

SEQ ID NO: 1597445 - protein, 26 aa, Staphylococcus aureus
SEKRKRFDIFLKYYYENLTSKQVFKI

SEQ ID NO: 1597446 - protein, 23 aa, Staphylococcus aureus
SEMLMVWDRLTGGLIFVGGVVSI

SEQ ID NO: 1597447 - protein, 24 aa, Staphylococcus aureus
SENISFKLRFKLSSLPASLPIDLV

SEQ ID NO: 1597448 - protein, 25 aa, Staphylococcus aureus
SERYILMHDLLKPTLLPIIPLLGIS

SEQ ID NO: 1597449 - protein, 25 aa, Staphylococcus aureus
SESGSNNNVVPPNSPKNGTNASNKN

SEQ ID NO: 1597450 - protein, 27 aa, Staphylococcus aureus
SESVMDGFVEHPFYTATLNGQKYVVMK

SEQ ID NO: 1597451 - protein, 32 aa, Staphylococcus aureus
SETLTQAIFLKKMIYFWLSEGQLILMLLGDES

SEQ ID NO: 1597452 - protein, 23 aa, Staphylococcus aureus
SETNWKYEFKNLPKYDEGKKIEY

SEQ ID NO: 1597453 - protein, 23 aa, Staphylococcus aureus
SETNWKYKFKDLPKYDEGKKIEY

SEQ ID NO: 1597454 - protein, 25 aa, Staphylococcus aureus
SFGYGFFIPIFFIMVGVDLNIPSLI

SEQ ID NO: 1597455 - protein, 20 aa, Staphylococcus aureus
SFIGLLILYYICRLISEERL

SEQ ID NO: 1597456 - protein, 19 aa, Staphylococcus aureus
SFIIIMYFVKIKWYSILLI

SEQ ID NO: 1597457 - protein, 24 aa, Staphylococcus aureus
SFILAFPMALIWPTIQSELNAFST

SEQ ID NO: 1597458 - protein, 29 aa, Staphylococcus aureus
SFKENGDWYKLEKLWEKAIKSGKPIENIK

SEQ ID NO: 1597459 - protein, 22 aa, Staphylococcus aureus
SFLAWFFYLKLINNIGAAVSGY

SEQ ID NO: 1597460 - protein, 20 aa, Staphylococcus aureus
SFLGGLGIFLYGLKIMGDGL

SEQ ID NO: 1597461 - protein, 22 aa, Staphylococcus aureus
SFLGGLGIFLYGLKIMGDGLQA

SEQ ID NO: 1597462 - protein, 25 aa, Staphylococcus aureus
SFLISLLILLILIPILAISAWLYPN

SEQ ID NO: 1597463 - protein, 22 aa, Staphylococcus aureus
SFLNAIFIALPIFLASQIFNNV

SEQ ID NO: 1597464 - protein, 31 aa, Staphylococcus aureus
SFMPVIIVIVVYTLIYIAFALIAFVHSNKLI

SEQ ID NO: 1597465 - protein, 26 aa, Staphylococcus aureus
SFNLYFGIFLIFVAILLMVRNKIKPF

SEQ ID NO: 1597466 - protein, 24 aa, Staphylococcus aureus
SFSLLLIIAIFIYNAFSYLLKRRR

SEQ ID NO: 1597467 - protein, 20 aa, Staphylococcus aureus
SFSMYVLLISPLVFLCFAIF

SEQ ID NO: 1597468 - protein, 18 aa, Staphylococcus aureus
SFVYIYFMQGVQGFDFDH

SEQ ID NO: 1597469 - protein, 17 aa, Staphylococcus aureus
SFWIPQLGGQKYAMTGM

SEQ ID NO: 1597470 - protein, 17 aa, Staphylococcus aureus
SFYLSFIALLIINLAVL

SEQ ID NO: 1597471 - protein, 21 aa, Staphylococcus aureus
SGDYFTAKLPDSLTGNGDVDY

SEQ ID NO: 1597472 - protein, 22 aa, Staphylococcus aureus
SGFILYMILIFTLSMIVNIHIV

SEQ ID NO: 1597473 - protein, 21 aa, Staphylococcus aureus
SGFMFFFIVYVLCISYFNSDK

SEQ ID NO: 1597474 - protein, 25 aa, Staphylococcus aureus
SGNAIWDFLLKFINNEPINTPFYIS

SEQ ID NO: 1597475 - protein, 22 aa, Staphylococcus aureus
SGNIITFALWLVSGIKLLTNNK

SEQ ID NO: 1597476 - protein, 23 aa, Staphylococcus aureus
SGNKTTTTFKYEVTRNSMSDSVS

SEQ ID NO: 1597477 - protein, 23 aa, Staphylococcus aureus
SGNTFMAANFKVAGKVKSGDYFT

SEQ ID NO: 1597478 - protein, 26 aa, Staphylococcus aureus
SGPLFIIVLLFIFFCLGFIVPSSSGL

SEQ ID NO: 1597479 - protein, 18 aa, Staphylococcus aureus
SGRFITMMFGLCGAALAI

SEQ ID NO: 1597480 - protein, 19 aa, Staphylococcus aureus
SGVYVLTLMFKKLRNFSTH

SEQ ID NO: 1597481 - protein, 27 aa, Staphylococcus aureus
SGWTDVFIVFYIALFLGMILLGIVAFY

SEQ ID NO: 1597482 - protein, 17 aa, Staphylococcus aureus
SHFPNFGGGVLGFYLLE

SEQ ID NO: 1597483 - protein, 17 aa, Staphylococcus aureus
SHVDIKSELGYEGGQNI

SEQ ID NO: 1597484 - protein, 25 aa, Staphylococcus aureus
SHYLALIYIILLIIIPRYAILPFSN

SEQ ID NO: 1597485 - protein, 36 aa, Staphylococcus aureus
SIATYIYVIITLLIVYVIPRFYKAIPAPLIAIIVLT

SEQ ID NO: 1597486 - protein, 24 aa, Staphylococcus aureus
SIDLPTFIMISIFSFVIFDSVENI

SEQ ID NO: 1597487 - protein, 25 aa, Staphylococcus aureus
SIDLPTFIMISIFSFVIFDSVENIN

SEQ ID NO: 1597488 - protein, 17 aa, Staphylococcus aureus
SIFEVIIMFFIGGVFSL

SEQ ID NO: 1597489 - protein, 19 aa, Staphylococcus aureus
SIFEVIIMFFIGGVFSLLS

SEQ ID NO: 1597490 - protein, 19 aa, Staphylococcus aureus
SIFVVSILLTLLAMYLIKH

SEQ ID NO: 1597491 - protein, 19 aa, Staphylococcus aureus
SIIFAALFILIGFYDGFVG

SEQ ID NO: 1597492 - protein, 24 aa, Staphylococcus aureus
SIKQALPHFLIPNVPFNLETLQII

SEQ ID NO: 1597493 - protein, 33 aa, Staphylococcus aureus
SIKQNGLLGGVMTLLVGLGLMKRKKKKDENDQD

SEQ ID NO: 1597494 - protein, 34 aa, Staphylococcus aureus
SILMKNKWPFLIALPFMIGYGIGVTFYYQQKVAY

SEQ ID NO: 1597495 - protein, 30 aa, Staphylococcus aureus
SIMFNFWLYVILYWFIPLLTTFQIIRYWAE

SEQ ID NO: 1597496 - protein, 24 aa, Staphylococcus aureus
SIMSYLLIALVLTAGTAFLIWLGD

SEQ ID NO: 1597497 - protein, 18 aa, Staphylococcus aureus
SIPEFIIMIALASFFQPS

SEQ ID NO: 1597498 - protein, 21 aa, Staphylococcus aureus
SIRRFTVGTTSVIVGATILFG

SEQ ID NO: 1597499 - protein, 32 aa, Staphylococcus aureus
SISLIICLIVLGLLMPLFGLSLILVFIIELIL

SEQ ID NO: 1597500 - protein, 24 aa, Staphylococcus aureus
SISSLTLPITLIVGALVGIGIAFY

SEQ ID NO: 1597501 - protein, 40 aa, Staphylococcus aureus
SISTYIYVIITLLIVYIIPRFFKAIPAPLIAIIVLTALYM

SEQ ID NO: 1597502 - protein, 22 aa, Staphylococcus aureus
SIVIAFIAILLLKGTPEKVSQH

SEQ ID NO: 1597503 - protein, 25 aa, Staphylococcus aureus
SIWLALFFPMINWLIPKKYVKISEK

SEQ ID NO: 1597504 - protein, 21 aa, Staphylococcus aureus
SKDEDVPLLLAKKKNQKDNQS

SEQ ID NO: 1597505 - protein, 34 aa, Staphylococcus aureus
SKDFKITLYISLFISLFISLFILYNEFRSGNLGE

SEQ ID NO: 1597506 - protein, 18 aa, Staphylococcus aureus
SKDFNFKVRVANNHQSNT

SEQ ID NO: 1597507 - protein, 19 aa, Staphylococcus aureus
SKDFNFKVRVANNHQSNTT

SEQ ID NO: 1597508 - protein, 28 aa, Staphylococcus aureus
SKEQYTKRFFFFATSCLVLTLVVASSLS

SEQ ID NO: 1597509 - protein, 21 aa, Staphylococcus aureus
SKERLLIIRTLITWFYTMLWS

SEQ ID NO: 1597510 - protein, 18 aa, Staphylococcus aureus
SKESQLTEALFAEKPVAK

SEQ ID NO: 1597511 - protein, 18 aa, Staphylococcus aureus
SKESQLTEALFAEKSLAK

SEQ ID NO: 1597512 - protein, 17 aa, Staphylococcus aureus
SKKVLSVRFLTKEMLAD

SEQ ID NO: 1597513 - protein, 23 aa, Staphylococcus aureus
SKLDYFFIIGISTLSLFLFKMFD

SEQ ID NO: 1597514 - protein, 17 aa, Staphylococcus aureus
SKLLDFITNLAGFIAKL

SEQ ID NO: 1597515 - protein, 21 aa, Staphylococcus aureus
SKPESQAERLANAAKQKQAKL

SEQ ID NO: 1597516 - protein, 22 aa, Staphylococcus aureus
SKSFMLPIAILPAAGLLLGIGG

SEQ ID NO: 1597517 - protein, 25 aa, Staphylococcus aureus
SLATITLLCTFLIVTLTMTLTTYRD

SEQ ID NO: 1597518 - protein, 24 aa, Staphylococcus aureus
SLDKVKHTPFFLPKRHKEDEEDVK

SEQ ID NO: 1597519 - protein, 19 aa, Staphylococcus aureus
SLDQVLASFLKTANLAKYD

SEQ ID NO: 1597520 - protein, 17 aa, Staphylococcus aureus
SLEWFPVAIIATILGYL

SEQ ID NO: 1597521 - protein, 18 aa, Staphylococcus aureus
SLFTGNWRGVWDGIVMIL

SEQ ID NO: 1597522 - protein, 19 aa, Staphylococcus aureus
SLGALAITGAVGGLGMGVT

SEQ ID NO: 1597523 - protein, 26 aa, Staphylococcus aureus
SLGFTMGWLYWALWSLVTSVDVTVAS

SEQ ID NO: 1597524 - protein, 28 aa, Staphylococcus aureus
SLGNKFTIFLMVVLVVLGGVYASAKLKL

SEQ ID NO: 1597525 - protein, 30 aa, Staphylococcus aureus
SLGTIVAIIVILLFLRNIRTTAISIISIPL

SEQ ID NO: 1597526 - protein, 23 aa, Staphylococcus aureus
SLILMVLVPVIFFVPNIFGKGII

SEQ ID NO: 1597527 - protein, 18 aa, Staphylococcus aureus
SLILVFIIELILYVKDRR

SEQ ID NO: 1597528 - protein, 19 aa, Staphylococcus aureus
SLLATYLVRISLKKLKKSY

SEQ ID NO: 1597529 - protein, 24 aa, Staphylococcus aureus
SLLMVLWLVITAWKHIGYIKEIKP

SEQ ID NO: 1597530 - protein, 18 aa, Staphylococcus aureus
SLNTAMGNLINAIADHQT

SEQ ID NO: 1597531 - protein, 24 aa, Staphylococcus aureus
SLQLPLILKFILNLALIGIVIIVL

SEQ ID NO: 1597532 - protein, 32 aa, Staphylococcus aureus
SLRNIWDITWIIPLVLILILIAFSMAAHINIL

SEQ ID NO: 1597533 - protein, 26 aa, Staphylococcus aureus
SLSPLMWLNFLFIKIVETVGIFNPTT

SEQ ID NO: 1597534 - protein, 24 aa, Staphylococcus aureus
SLVYRLLLSIILNLPVWVVLLNAI

SEQ ID NO: 1597535 - protein, 41 aa, Staphylococcus aureus
SMCLNMNLQLIRLLLHMIKLLLHLIWVLQQSKLKKKWQFLF

SEQ ID NO: 1597536 - protein, 22 aa, Staphylococcus aureus
SMMDTFVKHPIKTGMLNGKKYM

SEQ ID NO: 1597537 - protein, 19 aa, Staphylococcus aureus
SMNIRILSGFLFLISAFVT

SEQ ID NO: 1597538 - protein, 20 aa, Staphylococcus aureus
SMTKLMTMYLTLEAVNKGQL

SEQ ID NO: 1597539 - protein, 24 aa, Staphylococcus aureus
SNEDDAPLLLAKKKNQKDNQSKGK

SEQ ID NO: 1597540 - protein, 20 aa, Staphylococcus aureus
SNFMYFTVGLYYKVIKPTRV

SEQ ID NO: 1597541 - protein, 24 aa, Staphylococcus aureus
SNFRILWLSQFIAIAGLTVLVPLL

SEQ ID NO: 1597542 - protein, 20 aa, Staphylococcus aureus
SNIPLLLIIGRLIQGLSAAC

SEQ ID NO: 1597543 - protein, 17 aa, Staphylococcus aureus
SNKQKFLSFLGPGLLVA

SEQ ID NO: 1597544 - protein, 39 aa, Staphylococcus aureus
SNKQNKYSIRRFTVGTTSVIVGATILFGIGNHQAQASEQ

SEQ ID NO: 1597545 - protein, 18 aa, Staphylococcus aureus
SNKQYIIQQVAYPDNTST

SEQ ID NO: 1597546 - protein, 18 aa, Staphylococcus aureus
SNKTLKIFDFGIAKALSE

SEQ ID NO: 1597547 - protein, 34 aa, Staphylococcus aureus
SNLIFVPYYSIILFPLSILFFITSHFIVGLTPLN

SEQ ID NO: 1597548 - protein, 25 aa, Staphylococcus aureus
SNPVGWAVVGILTAGIIGSIVSDYL

SEQ ID NO: 1597549 - protein, 21 aa, Staphylococcus aureus
SNSAPLIYKTLSALYHNFDGF

SEQ ID NO: 1597550 - protein, 25 aa, Staphylococcus aureus
SNSNWIWIFTYLAIILLIVGFFYVF

SEQ ID NO: 1597551 - protein, 24 aa, Staphylococcus aureus
SNTKLYPGQVWTIADLLQITVSNS

SEQ ID NO: 1597552 - protein, 22 aa, Staphylococcus aureus
SNVFGMTLLNVVKRILDLTRIT

SEQ ID NO: 1597553 - protein, 21 aa, Staphylococcus aureus
SNYFRFQYFNPLKSERYYRNL

SEQ ID NO: 1597554 - protein, 18 aa, Staphylococcus aureus
SPLIWLNFLFIKIGETVG

SEQ ID NO: 1597555 - protein, 17 aa, Staphylococcus aureus
SPTLVQMVTLSSNNSKS

SEQ ID NO: 1597556 - protein, 25 aa, Staphylococcus aureus
SPVQSIICYLALHRLHKVPMMMEGK

SEQ ID NO: 1597557 - protein, 26 aa, Staphylococcus aureus
SQELFYLFNLILKYISTVPLALIFSF

SEQ ID NO: 1597558 - protein, 21 aa, Staphylococcus aureus
SQFHLLMGMGFKKYIDTLKIG

SEQ ID NO: 1597559 - protein, 26 aa, Staphylococcus aureus
SQKLPSLIMYGFSINEKYIKSLSNAL

SEQ ID NO: 1597560 - protein, 25 aa, Staphylococcus aureus
SQKYSWLLLVLVYVLSIIKFAIVQS

SEQ ID NO: 1597561 - protein, 31 aa, Staphylococcus aureus
SQNAYFLNSIFIIVILFVMYKKRAQIINFVS

SEQ ID NO: 1597562 - protein, 31 aa, Staphylococcus aureus
SQQAYFLNVIFLMIILFVLYKKRSEIIDFVT

SEQ ID NO: 1597563 - protein, 32 aa, Staphylococcus aureus
SQVGSYFLFFIIIAFLLYANVLFIKQRSYELA

SEQ ID NO: 1597564 - protein, 30 aa, Staphylococcus aureus
SQVGSYFLFFIIIAFLLYANVLFLKRRSSE

SEQ ID NO: 1597565 - protein, 35 aa, Staphylococcus aureus
SSILMKNKWPFLIALPFMNCYGIGVTFYYQQKVAY

SEQ ID NO: 1597566 - protein, 27 aa, Staphylococcus aureus
SSKKMLWASLIITLLFTVIEFVGGLVS

SEQ ID NO: 1597567 - protein, 22 aa, Staphylococcus aureus
SSLFVATLTTATLVSSPAANAL

SEQ ID NO: 1597568 - protein, 27 aa, Staphylococcus aureus
SSLGFTMGWLYWALWSLVTSVDVIVAS

SEQ ID NO: 1597569 - protein, 23 aa, Staphylococcus aureus
SSLLIVYFIYYIFEKNINFKAYA

SEQ ID NO: 1597570 - protein, 19 aa, Staphylococcus aureus
SSLPAKFVVKDVQPAKPTV

SEQ ID NO: 1597571 - protein, 19 aa, Staphylococcus aureus
SSMIVISIPRFEEYMKARH

SEQ ID NO: 1597572 - protein, 19 aa, Staphylococcus aureus
SSMTFLCGWLAFVGAIVTI

SEQ ID NO: 1597573 - protein, 20 aa, Staphylococcus aureus
SSNPVGWTVLAGLAVGSGLA

SEQ ID NO: 1597574 - protein, 25 aa, Staphylococcus aureus
SSRFIKWLNDMNIVPGYYGVNSIDL

SEQ ID NO: 1597575 - protein, 25 aa, Staphylococcus aureus
SSWIVFFLPMINWFIPKNYVKISKE

SEQ ID NO: 1597576 - protein, 33 aa, Staphylococcus aureus
STAIVAVGYIGLSLIIRGIAYLTTRRNLEELEP

SEQ ID NO: 1597577 - protein, 22 aa, Staphylococcus aureus
STAKVPPIMAGDQVLANGVIDS

SEQ ID NO: 1597578 - protein, 22 aa, Staphylococcus aureus
STALMLMLLMFIGGAPLSAAGG

SEQ ID NO: 1597579 - protein, 23 aa, Staphylococcus aureus
STALMLMLLMFIGGAPLSAAGGI

SEQ ID NO: 1597580 - protein, 40 aa, Staphylococcus aureus; identical to SEQ ID NO: 1574549

SEQ ID NO: 1597581 - protein, 29 aa, Staphylococcus aureus
STNKGMLFGGLFSILGLALLRRNKKNHKV

SEQ ID NO: 1597582 - protein, 29 aa, Staphylococcus aureus
STNKGMLFGGLFSILGLTLLRRNKKNNKA

SEQ ID NO: 1597583 - protein, 28 aa, Staphylococcus aureus
STRLLHVYSYGALLFGLILTAIAPSNQD

SEQ ID NO: 1597584 - protein, 19 aa, Staphylococcus aureus
STSIRMSTIVSESVSESTS

SEQ ID NO: 1597585 - protein, 20 aa, Staphylococcus aureus
STSTSLSLSASMNQSGVDSN

SEQ ID NO: 1597586 - protein, 30 aa, Staphylococcus aureus
STTLLNFFHGWPWYAVWLVMLGFGGGMIIP

SEQ ID NO: 1597587 - protein, 44 aa, Staphylococcus aureus
STTYKKVLHWSLNHKWIVIILSTLILVATIVFGGPRLGTSFISA

SEQ ID NO: 1597588 - protein, 45 aa, Staphylococcus aureus
STTYKKVLHWSLNHKWIVIILSTLILVATIVFGGPRLGTSFISAG

SEQ ID NO: 1597589 - protein, 22 aa, Staphylococcus aureus
STVIFFLVFFYALDLGITALKN

SEQ ID NO: 1597590 - protein, 25 aa, Staphylococcus aureus
STWLALFFPMINWLIPKKYVKISEK

SEQ ID NO: 1597591 - protein, 21 aa, Staphylococcus aureus
STYIGYAPIDNPKLAFSIVYT

SEQ ID NO: 1597592 - protein, 17 aa, Staphylococcus aureus
STYLHWTNMFLIALIVV

SEQ ID NO: 1597593 - protein, 28 aa, Staphylococcus aureus
SVAAQIIVGLFTALIQLLTGDFSGAWET

SEQ ID NO: 1597594 - protein, 26 aa, Staphylococcus aureus
SVAGGGAFGAFVTTDSYGVASTYTSS

SEQ ID NO: 1597595 - protein, 28 aa, Staphylococcus aureus
SVAPKRLNAKMRFAVAQPAAVASNNVND

SEQ ID NO: 1597596 - protein, 29 aa, Staphylococcus aureus
SVAPKRVNAKIRFAVAQPAAVASNNVNDL

SEQ ID NO: 1597597 - protein, 24 aa, Staphylococcus aureus
SVFDSFRILQPYSAPPKPPNPNYP

SEQ ID NO: 1597598 - protein, 19 aa, Staphylococcus aureus
SVFLIFTIIIMFIAGTGKS

SEQ ID NO: 1597599 - protein, 25 aa, Staphylococcus aureus
SVGKMLTVYLSYTTQFIYLHRRVGQ

SEQ ID NO: 1597600 - protein, 25 aa, Staphylococcus aureus
SVGVISFIVWMLIQNDVDFALERLV

SEQ ID NO: 1597601 - protein, 23 aa, Staphylococcus aureus
SVIGFLQSAFWTASILSAPLWGR

SEQ ID NO: 1597602 - protein, 22 aa, Staphylococcus aureus
SVILSHFILPVITLSLGMCAYI

SEQ ID NO: 1597603 - protein, 20 aa, Staphylococcus aureus
SVITFWLFAQSLVNVVPILE

SEQ ID NO: 1597604 - protein, 23 aa, Staphylococcus aureus
SVLFFLMCVGLAILTWLVSLFNV

SEQ ID NO: 1597605 - protein, 19 aa, Staphylococcus aureus
SVLTNVFGLSLFSVVKKIL

SEQ ID NO: 1597606 - protein, 21 aa, Staphylococcus aureus
SVPIVPELLKSLNFNQFNLVD

SEQ ID NO: 1597607 - protein, 23 aa, Staphylococcus aureus
SVRKMVALYLSYTTQFIYLHQRV

SEQ ID NO: 1597608 - protein, 18 aa, Staphylococcus aureus
SVRTRAVRSLAVAEPVVN

SEQ ID NO: 1597609 - protein, 19 aa, Staphylococcus aureus
SVRTRAVRSLAVAEPVVNA

SEQ ID NO: 1597610 - protein, 17 aa, Staphylococcus aureus
SVRTRAVRSLAVTEPVV

SEQ ID NO: 1597611 - protein, 17 aa, Staphylococcus aureus
SVSLLMALIVVSLIFIT

SEQ ID NO: 1597612 - protein, 28 aa, Staphylococcus aureus
SVSVLIIILLVLILAYIIRTIITMIRFY

SEQ ID NO: 1597613 - protein, 30 aa, Staphylococcus aureus
SVTFLAWLLIFLMFALPIGIAYQFSDWFQN

SEQ ID NO: 1597614 - protein, 25 aa, Staphylococcus aureus
SVVNRAPRFLILPTIILIGILGSTA

SEQ ID NO: 1597615 - protein, 24 aa, Staphylococcus aureus
SVWLVLLFSAMGLWHVSNAAEQHT

SEQ ID NO: 1597616 - protein, 21 aa, Staphylococcus aureus
SWLKHLLSYIIGTGILHLIVY

SEQ ID NO: 1597617 - protein, 31 aa, Staphylococcus aureus
SWRNIFVLPIIIIAIAFILSFFFMKDVIPNR

SEQ ID NO: 1597618 - protein, 17 aa, Staphylococcus aureus
SYIRKYKLTIINKLIRS

SEQ ID NO: 1597619 - protein, 21 aa, Staphylococcus aureus
SYSLYLWHFAVISFVHSYYVD

SEQ ID NO: 1597620 - protein, 17 aa, Staphylococcus aureus
SYTGDGGYSLDFSDLDN

SEQ ID NO: 1597621 - protein, 24 aa, Staphylococcus aureus
SYVAPPLTLLNQPAKQKATSKAEV

SEQ ID NO: 1597622 - protein, 23 aa, Staphylococcus aureus
SYVVPPLTLLNQPAKQKATSKAE

SEQ ID NO: 1597623 - protein, 19 aa, Staphylococcus aureus
SYYYSLSPLIWLNFLFIKI

SEQ ID NO: 1597624 - protein, 18 aa, Staphylococcus aureus
TAFFCSMYWLIVQLNIAN

SEQ ID NO: 1597625 - protein, 18 aa, Staphylococcus aureus
TAFLIERFTLRSLFFNAT

SEQ ID NO: 1597626 - protein, 22 aa, Staphylococcus aureus
TAGMALFVWFLGGIITICAGLT

SEQ ID NO: 1597627 - protein, 25 aa, Staphylococcus aureus
TAISIISIPLSLLMALIALKLSDVS

SEQ ID NO: 1597628 - protein, 17 aa, Staphylococcus aureus
TAKVEVTLLDGSKVIVN

SEQ ID NO: 1597629 - protein, 19 aa, Staphylococcus aureus
TALFVCGLISWLYYHYRID

SEQ ID NO: 1597630 - protein, 30 aa, Staphylococcus aureus
TALIMLITAPFIPLFYIIFGLKTRDESKNQ

SEQ ID NO: 1597631 - protein, 17 aa, Staphylococcus aureus
TAPTSVAPKRLNAKMRF

SEQ ID NO: 1597632 - protein, 23 aa, Staphylococcus aureus
TASIAALLLVSGLFLAFRRRSTN

SEQ ID NO: 1597633 - protein, 17 aa, Staphylococcus aureus
TASLNAYNQKLQAARQK

SEQ ID NO: 1597634 - protein, 18 aa, Staphylococcus aureus
TASLNAYNQKLQAARQKL

SEQ ID NO: 1597635 - protein, 33 aa, Staphylococcus aureus
TCEKYCLGAVFFYFWGVFLYNSLHKCKGFSFHV

SEQ ID NO: 1597636 - protein, 20 aa, Staphylococcus aureus
TCVFVPIIFKKLFPVPDEFN

SEQ ID NO: 1597637 - protein, 27 aa, Staphylococcus aureus
TDELFNTLLTLISWFVRPALYVTEFAS

SEQ ID NO: 1597638 - protein, 24 aa, Staphylococcus aureus
TDKTIPIFLITLPFLITATFIGKK

SEQ ID NO: 1597639 - protein, 38 aa, Staphylococcus aureus
TDVISPTLFVLLMYLLSMITAYIFYSYERAKGQMNFIK

SEQ ID NO: 1597640 - protein, 17 aa, Staphylococcus aureus
TEALFAEKPVAKNDLKE

SEQ ID NO: 1597641 - protein, 26 aa, Staphylococcus aureus
TEDNRFYEHGALDYKRLFGAIGKNLT

SEQ ID NO: 1597642 - protein, 24 aa, Staphylococcus aureus
TEFNRIILPPLILSISNEIKYIGV

SEQ ID NO: 1597643 - protein, 25 aa, Staphylococcus aureus
TELNPLLMSILISVAFSLLMVTPIS

SEQ ID NO: 1597644 - protein, 27 aa, Staphylococcus aureus
TELNTAMTALKRAIADKAETKASGNYV

SEQ ID NO: 1597645 - protein, 17 aa, Staphylococcus aureus
TEYDYYPTLFYKRKRKS

SEQ ID NO: 1597646 - protein, 17 aa, Staphylococcus aureus
TFALWLISGIKLLTNNK

SEQ ID NO: 1597647 - protein, 28 aa, Staphylococcus aureus
TFDKEKNKFTHVAYIKPINGNNSDSVTL

SEQ ID NO: 1597648 - protein, 24 aa, Staphylococcus aureus
TFEVYRFDYPITFIVSILTSILTS

SEQ ID NO: 1597649 - protein, 25 aa, Staphylococcus aureus
TFEVYRFDYPITFIVSILTSILTSA

SEQ ID NO: 1597650 - protein, 28 aa, Staphylococcus aureus
TFEYTESAVTQVRYVDVTTGKDIIPPKT

SEQ ID NO: 1597651 - protein, 31 aa, Staphylococcus aureus
TFIAKHKWSTLIAWVIIVAAIFIPIATNTPK

SEQ ID NO: 1597652 - protein, 19 aa, Staphylococcus aureus
TFIAPIVFILLMVAQGYIT

SEQ ID NO: 1597653 - protein, 19 aa, Staphylococcus aureus
TFIAPIVFILLMVAQGYLA

SEQ ID NO: 1597654 - protein, 31 aa, Staphylococcus aureus
TFIILMLIMLFWIFMSFIFQKLLFPPSKNNL

SEQ ID NO: 1597655 - protein, 19 aa, Staphylococcus aureus
TFILFFIIYVIHPINADWL

SEQ ID NO: 1597656 - protein, 24 aa, Staphylococcus aureus
TFKELWLPVLTICFILAISKITTY

SEQ ID NO: 1597657 - protein, 17 aa, Staphylococcus aureus
TFLLLKASKDFLATLIV

SEQ ID NO: 1597658 - protein, 20 aa, Staphylococcus aureus
TFQDFDINYNGDTKVMTVKY

SEQ ID NO: 1597659 - protein, 34 aa, Staphylococcus aureus
TFSEFRTFLAVLLMLLLFISISLVIASTHSIIRP

SEQ ID NO: 1597660 - protein, 19 aa, Staphylococcus aureus
TFVFPLMILKLTGSAFQVG

SEQ ID NO: 1597661 - protein, 32 aa, Staphylococcus aureus
TFVLGSNPVGWVILAGLAMSTVFALGTDLIYQ

SEQ ID NO: 1597662 - protein, 19 aa, Staphylococcus aureus
TFVLMVLMYRFFGKQGFNC

SEQ ID NO: 1597663 - protein, 28 aa, Staphylococcus aureus
TFVSNLTGYKFNPNAKNFKIYEVTDQNQ

SEQ ID NO: 1597664 - protein, 28 aa, Staphylococcus aureus
TFVSTLTGYKFNPDAKNFKIYEVTDQNQ

SEQ ID NO: 1597665 - protein, 30 aa, Staphylococcus aureus
TFVTILFGILYIILMYTSAYVLIRMFKNKP

SEQ ID NO: 1597666 - protein, 22 aa, Staphylococcus aureus
TFVYGFILRLLGPLGLHHIFYL

SEQ ID NO: 1597667 - protein, 27 aa, Staphylococcus aureus
TGEFNNRIFYEHPNVASINFGDINKTY

SEQ ID NO: 1597668 - protein, 26 aa, Staphylococcus aureus
TGETKFIDWVVFLVLGIFIGSYIAAR

SEQ ID NO: 1597669 - protein, 41 aa, Staphylococcus aureus
TGETTSSQSWWGLYALLGMLALFIPKFRKESKYLTKYSICM

SEQ ID NO: 1597670 - protein, 23 aa, Staphylococcus aureus
TGILLFVTSFLGITFLIAVCCII

SEQ ID NO: 1597671 - protein, 18 aa, Staphylococcus aureus
TGIPKLLSKAFAPLAGVF

SEQ ID NO: 1597672 - protein, 19 aa, Staphylococcus aureus
TGIPKLLSKAFAPLAGVFT

SEQ ID NO: 1597673 - protein, 48 aa, Staphylococcus aureus
TGIVTLTQDAYSQKGAITLGTRIDSNKSFHFSGKVNLGNKYEGNGNGG

SEQ ID NO: 1597674 - protein, 49 aa, Staphylococcus aureus
TGIVTLTQDAYSQKGAITLGTRIDSNKSFHFSGKVNLGNKYEGNGNGGD

SEQ ID NO: 1597675 - protein, 18 aa, Staphylococcus aureus
TGIWAGIIIIVIAAIILG

SEQ ID NO: 1597676 - protein, 25 aa, Staphylococcus aureus
TGKDYSIFGWNNENVVRYGGGSADG

SEQ ID NO: 1597677 - protein, 25 aa, Staphylococcus aureus
TGNDFVSQRFLALANGAYKYNPYIL

SEQ ID NO: 1597678 - protein, 25 aa, Staphylococcus aureus
TGPMLAFLLVITIGILFGLAMDYEV

SEQ ID NO: 1597679 - protein, 24 aa, Staphylococcus aureus
TGTEYFKWYFPEYPDKIKTLKIED

SEQ ID NO: 1597680 - protein, 41 aa, Staphylococcus aureus
TGVIKDADNWTLDSGFYKTPKYSLGDYVWYDSNKDGKQDST

SEQ ID NO: 1597681 - protein, 23 aa, Staphylococcus aureus
TGVLFFTLLPKLFITFPRRYRNV

SEQ ID NO: 1597682 - protein, 19 aa, Staphylococcus aureus
TGWPLYRNILFPGAFKQIM

SEQ ID NO: 1597683 - protein, 26 aa, Staphylococcus aureus
THDNTLNLFFLTLTIFNNGTFVVEII

SEQ ID NO: 1597684 - protein, 25 aa, Staphylococcus aureus
THENTLNLFFLTLTIFNNGTFVIEI

SEQ ID NO: 1597685 - protein, 21 aa, Staphylococcus aureus
THIFYFLFRAYIGYGDVLLII

SEQ ID NO: 1597686 - protein, 33 aa, Staphylococcus aureus
THNAADAVYKAQLYLSPYGPKQYVEHLNQNTDN

SEQ ID NO: 1597687 - protein, 25 aa, Staphylococcus aureus
THSILFIVIIAFLLQIIQTPNYYMV

SEQ ID NO: 1597688 - protein, 19 aa, Staphylococcus aureus
TIAFKSILKNKGRNIFTMI

SEQ ID NO: 1597689 - protein, 22 aa, Staphylococcus aureus
TIDLLIMFIAIYPITLLMFSSN

SEQ ID NO: 1597690 - protein, 30 aa, Staphylococcus aureus
TIDSGTTVYPHQAGYVKLNYGFSVPNSAVK

SEQ ID NO: 1597691 - protein, 19 aa, Staphylococcus aureus
TIFKPKNSFLMIHNSWVMT

SEQ ID NO: 1597692 - protein, 24 aa, Staphylococcus aureus
TIGYRIHFLNLYPVLYEVKKVDKK

SEQ ID NO: 1597693 - protein, 17 aa, Staphylococcus aureus
TIIIILLGSVLAIKVDW

SEQ ID NO: 1597694 - protein, 19 aa, Staphylococcus aureus
TIISLIFLVAFSAKAALVL

SEQ ID NO: 1597695 - protein, 21 aa, Staphylococcus aureus
TIIWVAIIGVFKKSLSAIWNA

SEQ ID NO: 1597696 - protein, 19 aa, Staphylococcus aureus
TIKPRTLNRMAVNTVAAPQ

SEQ ID NO: 1597697 - protein, 30 aa, Staphylococcus aureus
TILDQYVNYFMFFNVIATLLTLYVIANYLD

SEQ ID NO: 1597698 - protein, 26 aa, Staphylococcus aureus
TILFGILYIILMYTCAYVLIRMFKNK

SEQ ID NO: 1597699 - protein, 39 aa, Staphylococcus aureus
TILKGAFMLLKGPLKIISVIFQLLFGKIGLIRNAVTGLV

SEQ ID NO: 1597700 - protein, 18 aa, Staphylococcus aureus
TILLLCSSVILLTNHQHR

SEQ ID NO: 1597701 - protein, 19 aa, Staphylococcus aureus
TILMLVFLLMFKGTQFKIT

SEQ ID NO: 1597702 - protein, 21 aa, Staphylococcus aureus
TILMYIFWELTSVSSFLLISY

SEQ ID NO: 1597703 - protein, 18 aa, Staphylococcus aureus
TILTLKGYRYIAASVSFL

SEQ ID NO: 1597704 - protein, 24 aa, Staphylococcus aureus
TINFFVNFIVYLCMYLLFVVIAGY

SEQ ID NO: 1597705 - protein, 24 aa, Staphylococcus aureus
TINSIMVYTFIALIAYISQVCCFG

SEQ ID NO: 1597706 - protein, 23 aa, Staphylococcus aureus
TINVAVEPGYKSLTTKVHIVVPQ

SEQ ID NO: 1597707 - protein, 26 aa, Staphylococcus aureus
TIPASIIGLLVWFIAGFQFKGHSNDK

SEQ ID NO: 1597708 - protein, 19 aa, Staphylococcus aureus
TISAFFKGNAPYIFAHRGG

SEQ ID NO: 1597709 - protein, 24 aa, Staphylococcus aureus
TISHRLFMIFIYALAMGIVYLTIF

SEQ ID NO: 1597710 - protein, 52 aa, Staphylococcus aureus
TISVSVIFLAISFAKVIFSAFALFLFLFLVFSWLLSFLPNLELSVFKALART

SEQ ID NO: 1597711 - protein, 23 aa, Staphylococcus aureus
TITATYAGKTWKATTDDLGIDKS

SEQ ID NO: 1597712 - protein, 17 aa, Staphylococcus aureus
TIVGFKVLAPVMKFIMY

SEQ ID NO: 1597713 - protein, 18 aa, Staphylococcus aureus
TIVPAQDYLSLKSQITVD

SEQ ID NO: 1597714 - protein, 27 aa, Staphylococcus aureus
TKALIFLLYFILVINSALFIWINSAFY

SEQ ID NO: 1597715 - protein, 29 aa, Staphylococcus aureus
TKDDVKATLTMPAYIDPENVTKTGNVTLA

SEQ ID NO: 1597716 - protein, 25 aa, Staphylococcus aureus
TKEEIPYETKRVLDPTMEPGSPDKV

SEQ ID NO: 1597717 - protein, 41 aa, Staphylococcus aureus
TKGLTLFYVFIGLIMFALLNQQLLLLNFLSFILAILVAIRL

SEQ ID NO: 1597718 - protein, 27 aa, Staphylococcus aureus
TKHEVEQTIYVSPLKLNAKNTNVTIKS

SEQ ID NO: 1597719 - protein, 30 aa, Staphylococcus aureus
TKIEMQYIPFNLLHLLSLKVTSILIVLVAC

SEQ ID NO: 1597720 - protein, 38 aa, Staphylococcus aureus
TKLFLGIILFFFIIFVHNFDFMLYITTLMLVFLLLFNG

SEQ ID NO: 1597721 - protein, 28 aa, Staphylococcus aureus
TKNNSRTLIFPYIPDKAVYNAIVKVVVA

SEQ ID NO: 1597722 - protein, 30 aa, Staphylococcus aureus
TKTGPIIELGLKTALTWKKLEVYEGDKKLP

SEQ ID NO: 1597723 - protein, 21 aa, Staphylococcus aureus
TKVLSILYIIPGLYAIPFYFR

SEQ ID NO: 1597724 - protein, 20 aa, Staphylococcus aureus
TKWCRMIIRQILSNALKYSE

SEQ ID NO: 1597725 - protein, 24 aa, Staphylococcus aureus
TLAYILNIFIFTLITNISFYLIRR

SEQ ID NO: 1597726 - protein, 26 aa, Staphylococcus aureus
TLDDTKHLPLLFAKRRRKEDEEDVTV

SEQ ID NO: 1597727 - protein, 21 aa, Staphylococcus aureus
TLDQAMNQLRQSIASKDATKS

SEQ ID NO: 1597728 - protein, 17 aa, Staphylococcus aureus
TLFHYLFSENQYKDDVY

SEQ ID NO: 1597729 - protein, 19 aa, Staphylococcus aureus
TLFIIICLNAFIIYSVKGN

SEQ ID NO: 1597730 - protein, 21 aa, Staphylococcus aureus
TLHLIIFNIFSIIMSYNPLVH

SEQ ID NO: 1597731 - protein, 17 aa, Staphylococcus aureus
TLHYRDGSSTTLDATNV

SEQ ID NO: 1597732 - protein, 51 aa, Staphylococcus aureus
TLIITIALSIIFLSISFAKVIFSAFALILFLFLAFSWLISFIPGFEISVFK

SEQ ID NO: 1597733 - protein, 25 aa, Staphylococcus aureus
TLILGMFMFLILLPLEKLFKLSSYY

SEQ ID NO: 1597734 - protein, 28 aa, Staphylococcus aureus
TLILSILFPVIFYILFTSILNLPEDVKP

SEQ ID NO: 1597735 - protein, 22 aa, Staphylococcus aureus
TLILVATVVFGGPRLGTSFISA

SEQ ID NO: 1597736 - protein, 20 aa, Staphylococcus aureus
TLIVILAFPPLTVALALMTT

SEQ ID NO: 1597737 - protein, 17 aa, Staphylococcus aureus
TLKKFLFHIVYICFFYF

SEQ ID NO: 1597738 - protein, 25 aa, Staphylococcus aureus
TLKNFCFTLFIYAFFILWTVIFSYS

SEQ ID NO: 1597739 - protein, 23 aa, Staphylococcus aureus
TLLIITIYLVPYLDVLLLGRAEA

SEQ ID NO: 1597740 - protein, 20 aa, Staphylococcus aureus
TLLIVMAVVLVLLVIFGFIS

SEQ ID NO: 1597741 - protein, 22 aa, Staphylococcus aureus
TLLLASSLTFTGFSATANAEDG

SEQ ID NO: 1597742 - protein, 17 aa, Staphylococcus aureus
TLLLYAITSYVFGILLC

SEQ ID NO: 1597743 - protein, 23 aa, Staphylococcus aureus
TLMLFIGFFLIRLFGQGSMTLIP

SEQ ID NO: 1597744 - protein, 17 aa, Staphylococcus aureus
TLMLVFLLLFNGTQFKI

SEQ ID NO: 1597745 - protein, 18 aa, Staphylococcus aureus
TLNIPYIIALIPTVILSI

SEQ ID NO: 1597746 - protein, 17 aa, Staphylococcus aureus
TLNSINFTDADQAKKDA

SEQ ID NO: 1597747 - protein, 24 aa, Staphylococcus aureus
TLQLPLILKIILNLALIGIVIIVL

SEQ ID NO: 1597748 - protein, 17 aa, Staphylococcus aureus
TLQQVEAALNNGIARIS

SEQ ID NO: 1597749 - protein, 18 aa, Staphylococcus aureus
TLQYPLILVSIFIAMIII

SEQ ID NO: 1597750 - protein, 19 aa, Staphylococcus aureus
TLTFIQLLTPFVVYFLAEE

SEQ ID NO: 1597751 - protein, 25 aa, Staphylococcus aureus
TLVFINPMWFGILFAIVGALLIEKL

SEQ ID NO: 1597752 - protein, 20 aa, Staphylococcus aureus
TLYLLLILIILYYLKKQVKT

SEQ ID NO: 1597753 - protein, 20 aa, Staphylococcus aureus
TLYLLLILIVLYYLKKQVKG

SEQ ID NO: 1597754 - protein, 29 aa, Staphylococcus aureus
TMEWAKLGILIALLFFPTSHILLKLVFAV

SEQ ID NO: 1597755 - protein, 23 aa, Staphylococcus aureus
TMIFKPIKLLPLVPFIFISFFIN

SEQ ID NO: 1597756 - protein, 17 aa, Staphylococcus aureus
TMKSVHFTSLKTGPMGD

SEQ ID NO: 1597757 - protein, 21 aa, Staphylococcus aureus
TMVAITWLLLGDPLATLIGLS

SEQ ID NO: 1597758 - protein, 17 aa, Staphylococcus aureus
TNGSYSLNLENLDKTYV

SEQ ID NO: 1597759 - protein, 17 aa, Staphylococcus aureus
TNHQVFSGETFTNTITA

SEQ ID NO: 1597760 - protein, 24 aa, Staphylococcus aureus
TNKDKPSYQFGGHNGIDFVEDTLP

SEQ ID NO: 1597761 - protein, 24 aa, Staphylococcus aureus
TNKGMLFGGLFSILGLVLLRRNKK

SEQ ID NO: 1597762 - protein, 45 aa, Staphylococcus aureus
TNLNIDDFVDDPLSYVKTPSNKVLGFYPTNATTNAFRPGGVQELN

SEQ ID NO: 1597763 - protein, 22 aa, Staphylococcus aureus
TNQIPIFIVMGLYICMYAIFAI

SEQ ID NO: 1597764 - protein, 20 aa, Staphylococcus aureus
TNRFSSRPVLLWTLLIFIIG

SEQ ID NO: 1597765 - protein, 31 aa, Staphylococcus aureus
TNRFSSRPVLLWTLLIFIIGNGIIAVAPNFS

SEQ ID NO: 1597766 - protein, 26 aa, Staphylococcus aureus
TNRVILFIFRCLVVVLVFMGAVAKTE

SEQ ID NO: 1597767 - protein, 37 aa, Staphylococcus aureus
TNSSKRVHLKRWHFISILIGTILITAVITVVAYIFIN

SEQ ID NO: 1597768 - protein, 26 aa, Staphylococcus aureus
TNSTYLYINLISILTFIITCFSIIQV

SEQ ID NO: 1597769 - protein, 25 aa, Staphylococcus aureus
TNTIDGLPNLTQLQKDNLKHQVEQA

SEQ ID NO: 1597770 - protein, 25 aa, Staphylococcus aureus
TNVLDTIWQYMQSVWDSIIGFLTGV

SEQ ID NO: 1597771 - protein, 31 aa, Staphylococcus aureus
TNVYNFIMIVWNQIVAYLQVLWNGIIAIATT

SEQ ID NO: 1597772 - protein, 32 aa, Staphylococcus aureus
TNVYNFIMIVWNQIVAYLQVLWNGIIAIATTV

SEQ ID NO: 1597773 - protein, 23 aa, Staphylococcus aureus
TNYILLTIFIIEIGLLLLLNNVL

SEQ ID NO: 1597774 - protein, 22 aa, Staphylococcus aureus
TNYLTILFLILVLVGMVFNVET

SEQ ID NO: 1597775 - protein, 20 aa, Staphylococcus aureus
TPEQILVNGELIVHRDDIIT

SEQ ID NO: 1597776 - protein, 18 aa, Staphylococcus aureus
TPEQLLVNGELIVHRDDI

SEQ ID NO: 1597777 - protein, 26 aa, Staphylococcus aureus
TPFYTALSVWVGALLMVSLLTVDNKH

SEQ ID NO: 1597778 - protein, 31 aa, Staphylococcus aureus
TPLQGIPAWAWSALFLVIIFSLNSLSVRVYG

SEQ ID NO: 1597779 - protein, 27 aa, Staphylococcus aureus
TPLSVYAFMIFILLYIPCVSTVAAIRK

SEQ ID NO: 1597780 - protein, 50 aa, Staphylococcus aureus
TPNEIALFTLLMTLTIIFLVVILTMYPLAKFLNFNLSIAMLIALAVCLIP

SEQ ID NO: 1597781 - protein, 24 aa, Staphylococcus aureus
TQEKRIDLYFKYNLNHYSSMKVTS

SEQ ID NO: 1597782 - protein, 24 aa, Staphylococcus aureus
TQKGLIFSSIIGIAGLMLLARRRK

SEQ ID NO: 1597783 - protein, 40 aa, Staphylococcus aureus
TQMVGHPEQLYKYYYDRGYTLTWDNGLVLYSNKANGNGKN

SEQ ID NO: 1597784 - protein, 33 aa, Staphylococcus aureus
TQNILLMVGIFILVAILGASLSFIKLFKVDPIE

SEQ ID NO: 1597785 - protein, 24 aa, Staphylococcus aureus
TQQLDQFKAQLKVANPFAKELEKR

SEQ ID NO: 1597786 - protein, 24 aa, Staphylococcus aureus
TQQSFANCKQLRQVYPNGVTADHP

SEQ ID NO: 1597787 - protein, 25 aa, Staphylococcus aureus
TQSIIIFVVLLIKAIITWLLVIPIF

SEQ ID NO: 1597788 - protein, 24 aa, Staphylococcus aureus
TRKQTIPAFFKGNAPYIFAHRGGM

SEQ ID NO: 1597789 - protein, 18 aa, Staphylococcus aureus
TSFKLNKNLCLSVSMLDN

SEQ ID NO: 1597790 - protein, 34 aa, Staphylococcus aureus
TSIFGIIALDVSFLIDMSIGIVGFLMTYLPIQKL

SEQ ID NO: 1597791 - protein, 24 aa, Staphylococcus aureus
TSISWPILAVVAVIGAFIGILVYL

SEQ ID NO: 1597792 - protein, 17 aa, Staphylococcus aureus
TSLYIKHKGYWKGAIFT

SEQ ID NO: 1597793 - protein, 19 aa, Staphylococcus aureus
TSPFIILFLTVVGAYLFFR

SEQ ID NO: 1597794 - protein, 24 aa, Staphylococcus aureus
TSQLPLILKIILNLALIGIVIIVF

SEQ ID NO: 1597795 - protein, 25 aa, Staphylococcus aureus
TSSQSWWGLYALLGMLALFIPKFRK

SEQ ID NO: 1597796 - protein, 25 aa, Staphylococcus aureus
TSSWIFFFIPMLNWGVPKKFAKISQ

SEQ ID NO: 1597797 - protein, 25 aa, Staphylococcus aureus
TSSWIFFFIPMLNWGVPKKYAKISQ

SEQ ID NO: 1597798 - protein, 25 aa, Staphylococcus aureus
TSTLLLIVILVVFAVLLIVNETKLF

SEQ ID NO: 1597799 - protein, 24 aa, Staphylococcus aureus
TSVIGMFILFLFGGVVILPGVVAH

SEQ ID NO: 1597800 - protein, 17 aa, Staphylococcus aureus
TSYGIFAPWLNGATNCI

SEQ ID NO: 1597801 - protein, 28 aa, Staphylococcus aureus
TSYHIFRIFFILFIIAPGINYFLKYRSN

SEQ ID NO: 1597802 - protein, 17 aa, Staphylococcus aureus
TSYVPFLAPFQLVVRAQ

SEQ ID NO: 1597803 - protein, 21 aa, Staphylococcus aureus
TSYYLLAFSLMLILPSAIYAD

SEQ ID NO: 1597804 - protein, 18 aa, Staphylococcus aureus
TTAFLLTNGIVIPLSALV

SEQ ID NO: 1597805 - protein, 24 aa, Staphylococcus aureus
TTAIAGTLLLTGLNAPQAKAESNI

SEQ ID NO: 1597806 - protein, 35 aa, Staphylococcus aureus
TTANKTVLVDYEKYGKFYNLSIKGTIDQIDKTNNT

SEQ ID NO: 1597807 - protein, 35 aa, Staphylococcus aureus
TTDGQRQFTLNGQVIQVLDIINPSNGYGGQPVTNS

SEQ ID NO: 1597808 - protein, 25 aa, Staphylococcus aureus
TTGADGWGFLFSKGNAEEYLTNGRI

SEQ ID NO: 1597809 - protein, 25 aa, Staphylococcus aureus
TTIIGALLLYLPFTGKKQISFLDAL

SEQ ID NO: 1597810 - protein, 22 aa, Staphylococcus aureus
TTIKPRTLNRMAVNTVAAPQQG

SEQ ID NO: 1597811 - protein, 26 aa, Staphylococcus aureus
TTIMLLLYLMIWLAFHILAMVSVVLA

SEQ ID NO: 1597812 - protein, 18 aa, Staphylococcus aureus
TTISFAVSFIIVTYLHVV

SEQ ID NO: 1597813 - protein, 25 aa, Staphylococcus aureus
TTKHEVEQTIYVNPLKLNAKNTNVT

SEQ ID NO: 1597814 - protein, 28 aa, Staphylococcus aureus
TTKHEVEQTIYVNPLKLNAKNTNVTIKS

SEQ ID NO: 1597815 - protein, 24 aa, Staphylococcus aureus
TTKQTIPAFFKGNAPYIFAHRGGM

SEQ ID NO: 1597816 - protein, 26 aa, Staphylococcus aureus
TTLILIAILLFYTFMGILLPLMHDDL

SEQ ID NO: 1597817 - protein, 27 aa, Staphylococcus aureus
TTLITFFIRLTLQFKIILIVILSKITK

SEQ ID NO: 1597818 - protein, 23 aa, Staphylococcus aureus
TTNQIPIFIVMGLYICMYAIFAI

SEQ ID NO: 1597819 - protein, 23 aa, Staphylococcus aureus
TTNQIPIFIVMGLYICMYAIFAM

SEQ ID NO: 1597820 - protein, 17 aa, Staphylococcus aureus
TTPYIVVVNGHIDPNSK

SEQ ID NO: 1597821 - protein, 22 aa, Staphylococcus aureus
TTQFIYLHRRVGQFSKLLMVCH

SEQ ID NO: 1597822 - protein, 22 aa, Staphylococcus aureus
TTQFIYLHRRVGQFSNLLMVCH

SEQ ID NO: 1597823 - protein, 24 aa, Staphylococcus aureus
TTQKLPRLVMFSFSINETYIKSLS

SEQ ID NO: 1597824 - protein, 25 aa, Staphylococcus aureus
TTRHRIAIIGLLILVFMLTLSIVSQ

SEQ ID NO: 1597825 - protein, 24 aa, Staphylococcus aureus
TTRHRIAIIGLLILVYILTLSIVS

SEQ ID NO: 1597826 - protein, 29 aa, Staphylococcus aureus
TTSSQSWWGLYALLGMLALLIPKFRKESK

SEQ ID NO: 1597827 - protein, 29 aa, Staphylococcus aureus
TTSSQSWWSLYALLGMLALFIPKFRKESK

SEQ ID NO: 1597828 - protein, 37 aa, Staphylococcus aureus
TTSTSTAPVKIRTFSRLAMSTFASAATTSAVTANTIT

SEQ ID NO: 1597829 - protein, 19 aa, Staphylococcus aureus
TVFFIMQLVGQVPAALWVI

SEQ ID NO: 1597830 - protein, 21 aa, Staphylococcus aureus
TVIDMWFVILPVVMSIGIIAT

SEQ ID NO: 1597831 - protein, 24 aa, Staphylococcus aureus
TVIGIFLYVMTLQKTSLFGILKAQ

SEQ ID NO: 1597832 - protein, 21 aa, Staphylococcus aureus
TVKPDEKLYKIGDYVWEDVDK

SEQ ID NO: 1597833 - protein, 31 aa, Staphylococcus aureus
TVLSYPVYLFIIGLVILIFIGTFRVATGDIQ

SEQ ID NO: 1597834 - protein, 27 aa, Staphylococcus aureus
TVQKGRTFLWFMHLSEQLRRTGEQIKA

SEQ ID NO: 1597835 - protein, 23 aa, Staphylococcus aureus
TVTKLVAFILLTFGFYVFFAGHN

SEQ ID NO: 1597836 - protein, 18 aa, Staphylococcus aureus
TVTNTVTGLPSGLSYDSA

SEQ ID NO: 1597837 - protein, 20 aa, Staphylococcus aureus
TVWTIIILTLLITFPTNSHH

SEQ ID NO: 1597838 - protein, 17 aa, Staphylococcus aureus
TVYIIIALLALTLMFIK

SEQ ID NO: 1597839 - protein, 25 aa, Staphylococcus aureus
TWGEKGAFDYRRSLLRTDVVLNSED

SEQ ID NO: 1597840 - protein, 19 aa, Staphylococcus aureus
TWIAYFLPMINWNSPKKYA

SEQ ID NO: 1597841 - protein, 19 aa, Staphylococcus aureus
TWSFYGNLLYLLPLSILGL

SEQ ID NO: 1597842 - protein, 28 aa, Staphylococcus aureus
TWSHLKWAIPLIGIVLFIILTISKQLTI

SEQ ID NO: 1597843 - protein, 27 aa, Staphylococcus aureus
TWVNIISWTLIIILSILNIYLIVQTFQ

SEQ ID NO: 1597844 - protein, 28 aa, Staphylococcus aureus
TYASYILITWLVIIFALLIVAFRRARRL

SEQ ID NO: 1597845 - protein, 22 aa, Staphylococcus aureus
TYLWVFALILFITRLAKIQLWF

SEQ ID NO: 1597846 - protein, 23 aa, Staphylococcus aureus
TYNLQKLLAPYHKAKTLERQVYE

SEQ ID NO: 1597847 - protein, 22 aa, Staphylococcus aureus
VAEIIAQAQALNEAIKALKESI

SEQ ID NO: 1597848 - protein, 19 aa, Staphylococcus aureus
VAGGGAFGAFVTTDSTGVA

SEQ ID NO: 1597849 - protein, 24 aa, Staphylococcus aureus
VAGGGAFGAFVTTDSTGVATTYTS

SEQ ID NO: 1597850 - protein, 18 aa, Staphylococcus aureus
VAHWVWGGGWINKLGVLD

SEQ ID NO: 1597851 - protein, 18 aa, Staphylococcus aureus
VAHWVWGGSWINKLGVLD

SEQ ID NO: 1597852 - protein, 19 aa, Staphylococcus aureus
VAILSVLIFTDNANAENNK

SEQ ID NO: 1597853 - protein, 21 aa, Staphylococcus aureus
VAKYVSFWFPEIPNWISALFC

SEQ ID NO: 1597854 - protein, 21 aa, Staphylococcus aureus
VALAMGILGILGGAFWALMAP

SEQ ID NO: 1597855 - protein, 31 aa, Staphylococcus aureus
VALMKLSKIKIISWIPSIYIEILRGTPMLVQ

SEQ ID NO: 1597856 - protein, 26 aa, Staphylococcus aureus
VAMMVISIILLIVPDLIRLSKTFLIE

SEQ ID NO: 1597857 - protein, 31 aa, Staphylococcus aureus
VASEFVYNMPLLSEKPLFVYISQSGETADSR

SEQ ID NO: 1597858 - protein, 27 aa, Staphylococcus aureus
VATLLGWRWIFIISIVISLIALFLIKG

SEQ ID NO: 1597859 - protein, 38 aa, Staphylococcus aureus
VAVYVIFYFIWLRFEWPQYLIYILLVLGALSTLKLFIK

SEQ ID NO: 1597860 - protein, 17 aa, Staphylococcus aureus
VCFLFICVYLNMAIGSS

SEQ ID NO: 1597861 - protein, 20 aa, Staphylococcus aureus
VCGLISWLYYHYRIDSIKQL

SEQ ID NO: 1597862 - protein, 19 aa, Staphylococcus aureus
VCTATAIMILLYSGLKFGE

SEQ ID NO: 1597863 - protein, 26 aa, Staphylococcus aureus
VDLAINIILIQIFYKFLSSLLHRTHI

SEQ ID NO: 1597864 - protein, 17 aa, Staphylococcus aureus
VDMLYIIIDPRIRIQGG

SEQ ID NO: 1597865 - protein, 28 aa, Staphylococcus aureus
VDNALNAVTRAKAALNGADNLRNAKTSA

SEQ ID NO: 1597866 - protein, 26 aa, Staphylococcus aureus
VDNYKIHTLNWFKNTWGYMNLGASVR

SEQ ID NO: 1597867 - protein, 29 aa, Staphylococcus aureus
VDPATGKDYSIFGWNNENVVRYGGGSADG

SEQ ID NO: 1597868 - protein, 23 aa, Staphylococcus aureus
VDQALQNILNAKQALNGDERVAL

SEQ ID NO: 1597869 - protein, 26 aa, Staphylococcus aureus
VDVTAELEINLFIDPKTVQTNGNQTI

SEQ ID NO: 1597870 - protein, 27 aa, Staphylococcus aureus
VDVTTGKDIIPPKTYSGNVDQVVTIDN

SEQ ID NO: 1597871 - protein, 17 aa, Staphylococcus aureus
VEAALNNGIARILAVQI

SEQ ID NO: 1597872 - protein, 17 aa, Staphylococcus aureus
VEGLIVGLIAMNKFHVL

SEQ ID NO: 1597873 - protein, 29 aa, Staphylococcus aureus
VEKFANFFKMLWLRLKAMKHYKALNKESK

SEQ ID NO: 1597874 - protein, 17 aa, Staphylococcus aureus
VEPATVIFTKTGPIIEL

SEQ ID NO: 1597875 - protein, 17 aa, Staphylococcus aureus
VEQALQRVNTAKTALNG

SEQ ID NO: 1597876 - protein, 22 aa, Staphylococcus aureus
VEQALQRVNTAKTALNGDERLN

SEQ ID NO: 1597877 - protein, 17 aa, Staphylococcus aureus
VEQLSMCLNMNLQLIRL

SEQ ID NO: 1597878 - protein, 26 aa, Staphylococcus aureus
VERFFKLVFFIFSISFIFVILIPKLT

SEQ ID NO: 1597879 - protein, 27 aa, Staphylococcus aureus
VEVTANLEINLFIDPKTFQSNGEEKVT

SEQ ID NO: 1597880 - protein, 37 aa, Staphylococcus aureus
VEWGTVIVQVLTFIVLLALLEKFAWGPLKDVMDKRER

SEQ ID NO: 1597881 - protein, 38 aa, Staphylococcus aureus
VEWGTVIVQVLTFIVLLALLKKFAWGPLKDIMDKRERD

SEQ ID NO: 1597882 - protein, 23 aa, Staphylococcus aureus
VEWVILVKIFNRKIPFLDKVILK

SEQ ID NO: 1597883 - protein, 25 aa, Staphylococcus aureus
VFAPIAFLMGIPWSEAVPAGSLMAT

SEQ ID NO: 1597884 - protein, 26 aa, Staphylococcus aureus
VFGIVIWVLFHLIIMPIMHTVPAVWD

SEQ ID NO: 1597885 - protein, 32 aa, Staphylococcus aureus
VFGMTLLIVTVIPFYIFTALKIAGPSSTFFIV

SEQ ID NO: 1597886 - protein, 24 aa, Staphylococcus aureus
VFIIIILILVGIFLKIKYDEKKYY

SEQ ID NO: 1597887 - protein, 18 aa, Staphylococcus aureus
VFIIVLIMFINYLGDIII

SEQ ID NO: 1597888 - protein, 19 aa, Staphylococcus aureus
VFITPVILTLVLSLGLSAF

SEQ ID NO: 1597889 - protein, 24 aa, Staphylococcus aureus
VFKQWLQYILLVTTIVIALVLIGM

SEQ ID NO: 1597890 - protein, 29 aa, Staphylococcus aureus
VFKSMMVPLIIIIAMFFIHFNTALIMLIT

SEQ ID NO: 1597891 - protein, 28 aa, Staphylococcus aureus
VFNIISIIMVSMLILSLGAFANNNKAKS

SEQ ID NO: 1597892 - protein, 28 aa, Staphylococcus aureus
VFNIISIIMVSMLILSLGAFTNNNKAKA

SEQ ID NO: 1597893 - protein, 27 aa, Staphylococcus aureus
VFQIVPRWFWFYIVLVSIVFPFEIGKE

SEQ ID NO: 1597894 - protein, 34 aa, Staphylococcus aureus
VFSDDFFNSNFWIYWKMMFAFEPWHSAMEMRRYL

SEQ ID NO: 1597895 - protein, 34 aa, Staphylococcus aureus
VFSDDFFNSNFWIYWKTMFAFEPWHSAMEMRRYL

SEQ ID NO: 1597896 - protein, 18 aa, Staphylococcus aureus
VFVLFAALFHLMNHAIFK

SEQ ID NO: 1597897 - protein, 20 aa, Staphylococcus aureus
VFWISLVICTIFVAFGAIFP

SEQ ID NO: 1597898 - protein, 29 aa, Staphylococcus aureus
VGFKVLAPVMKFIMYILSVAVESLVHAHL

SEQ ID NO: 1597899 - protein, 19 aa, Staphylococcus aureus
VGFLMTYLPIQKLTSRKYL

SEQ ID NO: 1597900 - protein, 17 aa, Staphylococcus aureus
VGFLSNLIFVPYYSIIL

SEQ ID NO: 1597901 - protein, 33 aa, Staphylococcus aureus
VGIDSGDTVYPHQAGYVKLNYGFSVPNSAVKGD

SEQ ID NO: 1597902 - protein, 38 aa, Staphylococcus aureus
VGIDSGDTVYPHQAGYVKLNYGFSVPNSAVQGDTFKIT

SEQ ID NO: 1597903 - protein, 32 aa, Staphylococcus aureus
VGIESGDTVYPHQAGYVKLNYGFSVPNSAVKG

SEQ ID NO: 1597904 - protein, 33 aa, Staphylococcus aureus
VGIESGDTVYPHQAGYVKLNYGFSVPNSAVKGD

SEQ ID NO: 1597905 - protein, 30 aa, Staphylococcus aureus
VGIGGLSNAFGFKLDTYHNTSKPNSAAKAN

SEQ ID NO: 1597906 - protein, 29 aa, Staphylococcus aureus
VGIGGLSNAFGFKLDTYHNTSTPNASAKA

SEQ ID NO: 1597907 - protein, 18 aa, Staphylococcus aureus
VGLALIVHMIINRLFRKR

SEQ ID NO: 1597908 - protein, 30 aa, Staphylococcus aureus
VGNQTIEVGKTMNPIVLTTTDNGTGTVTNT

SEQ ID NO: 1597909 - protein, 19 aa, Staphylococcus aureus
VGPALLIPLYVQNSLALSA

SEQ ID NO: 1597910 - protein, 24 aa, Staphylococcus aureus
VGSGLAFAADWAYQTNKLGLKDKT

SEQ ID NO: 1597911 - protein, 18 aa, Staphylococcus aureus
VGTLKMYFTNPNDLTFVE

SEQ ID NO: 1597912 - protein, 29 aa, Staphylococcus aureus
VGVGYFIHWIWPALPMPAAFAIAAILCPT

SEQ ID NO: 1597913 - protein, 32 aa, Staphylococcus aureus
VGVIITLVGAFRFLIAPILATIDFLGVFGIRL

SEQ ID NO: 1597914 - protein, 53 aa, Staphylococcus aureus
VGVIITLVGAFRFLIAPILAVMDFLGPLAARLVALVTRFGWAKTGTLVLSKAM

SEQ ID NO: 1597915 - protein, 29 aa, Staphylococcus aureus
VGVLFLVGFLIYLFYSPRLKFDVLENPNK

SEQ ID NO: 1597916 - protein, 30 aa, Staphylococcus aureus
VGVLFLVGFLIYLFYSPRLKFDVLENPNKS

SEQ ID NO: 1597917 - protein, 28 aa, Staphylococcus aureus
VGVPVIFFVIYLMLMIPIANLGLSSVLT

SEQ ID NO: 1597918 - protein, 24 aa, Staphylococcus aureus
VGWRYTFLFLIIVSVIVGFLMMIY

SEQ ID NO: 1597919 - protein, 17 aa, Staphylococcus aureus
VHFVFDLSLMEIRTIYR

SEQ ID NO: 1597920 - protein, 26 aa, Staphylococcus aureus
VIAALIAIFVLLWNKNEGFRNFIINA

SEQ ID NO: 1597921 - protein, 27 aa, Staphylococcus aureus
VIAALIAIFVLLWNKNEGFRNFIINVW

SEQ ID NO: 1597922 - protein, 28 aa, Staphylococcus aureus
VIAIFFVVFLGILFFYLNLNRRLALSVF

SEQ ID NO: 1597923 - protein, 18 aa, Staphylococcus aureus
VIALLIILVIITLFILLF

SEQ ID NO: 1597924 - protein, 25 aa, Staphylococcus aureus
VICYGLIFGLFYLLSGSTADYLIVT

SEQ ID NO: 1597925 - protein, 22 aa, Staphylococcus aureus
VIDFIIIAFALFIFVKIANTLM

SEQ ID NO: 1597926 - protein, 20 aa, Staphylococcus aureus
VIDFIIIAFALFVFVKIANT

SEQ ID NO: 1597927 - protein, 22 aa, Staphylococcus aureus
VIFAVFSALTLLPALISIFHKH

SEQ ID NO: 1597928 - protein, 19 aa, Staphylococcus aureus
VIFDWRRGVEYHSANPPLY

SEQ ID NO: 1597929 - protein, 25 aa, Staphylococcus aureus
VIFFVIYLMLMIPIANLGLSSVLTK

SEQ ID NO: 1597930 - protein, 18 aa, Staphylococcus aureus
VIFSIVMMLFVNKLLRGD

SEQ ID NO: 1597931 - protein, 26 aa, Staphylococcus aureus
VIGAFIGILVYLWKTNENFRKTITEA

SEQ ID NO: 1597932 - protein, 22 aa, Staphylococcus aureus
VIGGYSLFKVGFQNLIRFDFDM

SEQ ID NO: 1597933 - protein, 24 aa, Staphylococcus aureus
VIGIFILGFFLLTYEATMPGSLPT

SEQ ID NO: 1597934 - protein, 30 aa, Staphylococcus aureus
VIGLHPFAVFFPIIALLIIYYMIRFKMRAV

SEQ ID NO: 1597935 - protein, 49 aa, Staphylococcus aureus
VIGNLLLSAAIFLYIMLIDWRMACALLVTIPIALFAFNKLMSGFNETYA

SEQ ID NO: 1597936 - protein, 26 aa, Staphylococcus aureus
VIGVGLFIHWIWPDLPIGAAFAIAAI

SEQ ID NO: 1597937 - protein, 28 aa, Staphylococcus aureus
VIHVCVLLFIIISIALIFHRLQTKTHSI

SEQ ID NO: 1597938 - protein, 30 aa, Staphylococcus aureus
VIIAVSVSILIGLLFGWIPARAASKKELID

SEQ ID NO: 1597939 - protein, 18 aa, Staphylococcus aureus
VIIGIALISLVFLPGIFY

SEQ ID NO: 1597940 - protein, 18 aa, Staphylococcus aureus
VIIMFFIGGVFSLLSTML

SEQ ID NO: 1597941 - protein, 22 aa, Staphylococcus aureus
VIITIIITKLKWKSAGALLVEA

SEQ ID NO: 1597942 - protein, 18 aa, Staphylococcus aureus
VIIVGLISGALWAFGQAN

SEQ ID NO: 1597943 - protein, 36 aa, Staphylococcus aureus
VIKDADNWTLDSGFYKTPKYSLGDYVWYDSNKDGKQ

SEQ ID NO: 1597944 - protein, 19 aa, Staphylococcus aureus
VIKPTRVLKIFLLCFAGNI

SEQ ID NO: 1597945 - protein, 18 aa, Staphylococcus aureus
VILCMLLILTMRVESLTV

SEQ ID NO: 1597946 - protein, 25 aa, Staphylococcus aureus
VILHSHYIMMLFATILVVQILLQIC

SEQ ID NO: 1597947 - protein, 19 aa, Staphylococcus aureus
VILHYHYIMMIFATIIVVQ

SEQ ID NO: 1597948 - protein, 27 aa, Staphylococcus aureus
VILIFFTFILSIFFILIKSSRLNNILT

SEQ ID NO: 1597949 - protein, 17 aa, Staphylococcus aureus
VILILMNGVAIILRNKF

SEQ ID NO: 1597950 - protein, 17 aa, Staphylococcus aureus
VILILMNGVAIILRNKY

SEQ ID NO: 1597951 - protein, 22 aa, Staphylococcus aureus
VILLHIIGFSFLWIAGKDHHIL

SEQ ID NO: 1597952 - protein, 28 aa, Staphylococcus aureus
VILTCALFYFILFMYNVPMQAYMIGLGI

SEQ ID NO: 1597953 - protein, 20 aa, Staphylococcus aureus
VIMILLFLILPQLTQYVLRI

SEQ ID NO: 1597954 - protein, 26 aa, Staphylococcus aureus
VIMLFWIFMTFILQKILFPPSKNDLT

SEQ ID NO: 1597955 - protein, 26 aa, Staphylococcus aureus
VIMSFIIVFFIAFLMNVKLLSNIKVQ

SEQ ID NO: 1597956 - protein, 17 aa, Staphylococcus aureus
VIPIIISYKEGLHIIKD

SEQ ID NO: 1597957 - protein, 28 aa, Staphylococcus aureus
VIPQIMPAFLSLILYRFELNLRSASILG

SEQ ID NO: 1597958 - protein, 47 aa, Staphylococcus aureus
VIQHTPIGVKLRLLKWIFIVLCISFFLFPVILLFVFSPEKEEEQTDG

SEQ ID NO: 1597959 - protein, 19 aa, Staphylococcus aureus
VIQIQRVIPIQQAIQIQIV

SEQ ID NO: 1597960 - protein, 25 aa, Staphylococcus aureus
VISTMIFLIIGKPISLLIIAGAING

SEQ ID NO: 1597961 - protein, 17 aa, Staphylococcus aureus
VIYFVFVFLFHTSKRLY

SEQ ID NO: 1597962 - protein, 23 aa, Staphylococcus aureus
VKAGIFLLLRFTPLLGLSNMYVY

SEQ ID NO: 1597963 - protein, 24 aa, Staphylococcus aureus
VKATLTMPAYIDPENVTKTGNVTL

SEQ ID NO: 1597964 - protein, 18 aa, Staphylococcus aureus
VKAYPILDITLLQNIFTL

SEQ ID NO: 1597965 - protein, 17 aa, Staphylococcus aureus
VKEQYLYLTGRQHDMLI

SEQ ID NO: 1597966 - protein, 17 aa, Staphylococcus aureus
VKEVRWLFRLIALIVFA

SEQ ID NO: 1597967 - protein, 28 aa, Staphylococcus aureus
VKFDVLTLLVFAIVLMIVSVLGSLFSIL

SEQ ID NO: 1597968 - protein, 26 aa, Staphylococcus aureus
VKGHLLLELAVIFGISALVTAFLKHK

SEQ ID NO: 1597969 - protein, 24 aa, Staphylococcus aureus
VKGHLLLELAVVFGISALVTSFLK

SEQ ID NO: 1597970 - protein, 24 aa, Staphylococcus aureus
VKGNLLLELAVVFGISSLVTAFLK

SEQ ID NO: 1597971 - protein, 20 aa, Staphylococcus aureus
VKLFALIGIPFAAGLINFVV

SEQ ID NO: 1597972 - protein, 24 aa, Staphylococcus aureus
VKLKSILLAILFTSLALTAGTVAD

SEQ ID NO: 1597973 - protein, 22 aa, Staphylococcus aureus
VKMGINYSIYMDADTIPVDKKD

SEQ ID NO: 1597974 - protein, 31 aa, Staphylococcus aureus
VKNGWEFMARYWWIIFPIGGFLSWLIPELTG

SEQ ID NO: 1597975 - protein, 29 aa, Staphylococcus aureus
VKNNLRYGIRKHKLGAASVFLGTMIVVGM

SEQ ID NO: 1597976 - protein, 18 aa, Staphylococcus aureus
VKQSVKFTDADKAKRDAY

SEQ ID NO: 1597977 - protein, 29 aa, Staphylococcus aureus
VKSNLRYGIRKHKLGAASVFLGTMIVVGM

SEQ ID NO: 1597978 - protein, 21 aa, Staphylococcus aureus
VKVYEYLGKKDELPQSVYANT

SEQ ID NO: 1597979 - protein, 24 aa, Staphylococcus aureus
VLAGLIPFIPIKFSFIKFNNVNNQ

SEQ ID NO: 1597980 - protein, 19 aa, Staphylococcus aureus
VLAIFLLILLSSISHKMKT

SEQ ID NO: 1597981 - protein, 17 aa, Staphylococcus aureus
VLAIIVAFLFWVSSDRS

SEQ ID NO: 1597982 - protein, 25 aa, Staphylococcus aureus
VLAITLWIATWWITEAIPIAATSLL

SEQ ID NO: 1597983 - protein, 17 aa, Staphylococcus aureus
VLANHQIIVYLPDTYKT

SEQ ID NO: 1597984 - protein, 24 aa, Staphylococcus aureus
VLANHQIIVYLPDTYKTTPELSFA

SEQ ID NO: 1597985 - protein, 19 aa, Staphylococcus aureus
VLASLLWITREFLLKKWEV

SEQ ID NO: 1597986 - protein, 28 aa, Staphylococcus aureus
VLDGLSFLTLYLLDLHLGYTFSGGFIDY

SEQ ID NO: 1597987 - protein, 28 aa, Staphylococcus aureus
VLDGLSFLTLYLLDVHLGYTFSGGFIDY

SEQ ID NO: 1597988 - protein, 19 aa, Staphylococcus aureus
VLFVPALVCFIFFAIFGAS

SEQ ID NO: 1597989 - protein, 28 aa, Staphylococcus aureus
VLGGIDHILWFILAVIVGSLVTMITVLI

SEQ ID NO: 1597990 - protein, 30 aa, Staphylococcus aureus
VLGGPGAVFWMWIIAFIGAASAFIEATLAQ

SEQ ID NO: 1597991 - protein, 22 aa, Staphylococcus aureus
VLGVITFWLFAQSLVNLVVPLQ

SEQ ID NO: 1597992 - protein, 17 aa, Staphylococcus aureus
VLIAKRLKDKDGNVETT

SEQ ID NO: 1597993 - protein, 17 aa, Staphylococcus aureus
VLIAKRRKEKDGDVETT

SEQ ID NO: 1597994 - protein, 20 aa, Staphylococcus aureus
VLIAWILYYFVDVKLTNYNT

SEQ ID NO: 1597995 - protein, 18 aa, Staphylococcus aureus
VLIVPFIKPFITFIPRYG

SEQ ID NO: 1597996 - protein, 17 aa, Staphylococcus aureus
VLKIDFKKALITGLLIY

SEQ ID NO: 1597997 - protein, 21 aa, Staphylococcus aureus
VLKIFLLCFAGNILGAAILFS

SEQ ID NO: 1597998 - protein, 17 aa, Staphylococcus aureus
VLLILLFVEKLRIIQRS

SEQ ID NO: 1597999 - protein, 21 aa, Staphylococcus aureus
VLLLFLMIIFGGKKGFISYLT

SEQ ID NO: 1598000 - protein, 18 aa, Staphylococcus aureus
VLLSWIVILIITTSIYLF

SEQ ID NO: 1598001 - protein, 20 aa, Staphylococcus aureus
VLMPFLYFTTAWSIAGFASI

SEQ ID NO: 1598002 - protein, 20 aa, Staphylococcus aureus
VLQQSKLKKKWQFLFQMKSS

SEQ ID NO: 1598003 - protein, 23 aa, Staphylococcus aureus
VLSAFFYVMTIQKISQIGILKAI

SEQ ID NO: 1598004 - protein, 18 aa, Staphylococcus aureus
VLSIFLLILLSSISHKMK

SEQ ID NO: 1598005 - protein, 18 aa, Staphylococcus aureus
VLSVLSLPIFLYAVINFF

SEQ ID NO: 1598006 - protein, 19 aa, Staphylococcus aureus
VLSVLSLPIFLYAVINFFF

SEQ ID NO: 1598007 - protein, 18 aa, Staphylococcus aureus
VLSVRFLTKEMLADIEPY

SEQ ID NO: 1598008 - protein, 27 aa, Staphylococcus aureus
VLTALPSYWIASILIIYVSVKLNILPT

SEQ ID NO: 1598009 - protein, 26 aa, Staphylococcus aureus
VLTHSTLLLVVLWAVSLYMSQPLSLV

SEQ ID NO: 1598010 - protein, 38 aa, Staphylococcus aureus
VLTWGYFLCSFICSVYLFLCKLCIIYVIVLINRRIDMV

SEQ ID NO: 1598011 - protein, 22 aa, Staphylococcus aureus
VLVIGIFLMMYYKQVSEAYANQ

SEQ ID NO: 1598012 - protein, 18 aa, Staphylococcus aureus
VLVTRKDSRDKLKAEYNK

SEQ ID NO: 1598013 - protein, 18 aa, Staphylococcus aureus
VMATGKILEDGKIRYTFT

SEQ ID NO: 1598014 - protein, 18 aa, Staphylococcus aureus
VMHPANLFFKNIEDIKIG

SEQ ID NO: 1598015 - protein, 19 aa, Staphylococcus aureus
VMIGLFVGAIYMIIADKYS

SEQ ID NO: 1598016 - protein, 48 aa, Staphylococcus aureus
VMILKGTVQLIWNLIQLWFIGKILGVVRYFGGLLKGLITIIWVAIIGV

SEQ ID NO: 1598017 - protein, 42 aa, Staphylococcus aureus
VMILKGTVQLIWNLIQLWFVGKILGVVRYFGGLLKGLIAGIW

SEQ ID NO: 1598018 - protein, 43 aa, Staphylococcus aureus
VMILKGTVQLIWNLIQLWFVGKILGVVRYFGGLLKGLISGIWG

SEQ ID NO: 1598019 - protein, 48 aa, Staphylococcus aureus
VMILKGTVQLIWNLIQLWFVGKILGVVRYFGGLLKGLITIIWVAIIGV

SEQ ID NO: 1598020 - protein, 31 aa, Staphylococcus aureus
VMKCLSKWAFYISFLILVISITAGCGIGKEA

SEQ ID NO: 1598021 - protein, 17 aa, Staphylococcus aureus
VMKLPLISGYFQLFKTY

SEQ ID NO: 1598022 - protein, 17 aa, Staphylococcus aureus
VMLLAFISLMEAINIMF

SEQ ID NO: 1598023 - protein, 21 aa, Staphylococcus aureus
VNFCRLVPILLLSVWAGAIAD

SEQ ID NO: 1598024 - protein, 49 aa, Staphylococcus aureus
VNKKWDILTLFEYFKPHLLYLLIGTAIIFVICKLIAQFLIRFKTKDLAE

SEQ ID NO: 1598025 - protein, 34 aa, Staphylococcus aureus
VNLIGPLFLGLVVALIYIFFKVIFDKRIKDEEDV

SEQ ID NO: 1598026 - protein, 18 aa, Staphylococcus aureus
VNLSYTGDGGYSLDFSDL

SEQ ID NO: 1598027 - protein, 24 aa, Staphylococcus aureus
VNVIYIIIALLALILMFIKVTPST

SEQ ID NO: 1598028 - protein, 20 aa, Staphylococcus aureus
VNYIQLVLFLIAATTIILIN

SEQ ID NO: 1598029 - protein, 19 aa, Staphylococcus aureus
VPCYLCAIIAIIYGFTGIG

SEQ ID NO: 1598030 - protein, 22 aa, Staphylococcus aureus
VPEKWILGLLGLIPIYLGIKVT

SEQ ID NO: 1598031 - protein, 18 aa, Staphylococcus aureus
VPGILITNAIRDLLAGEL

SEQ ID NO: 1598032 - protein, 34 aa, Staphylococcus aureus
VPKAIKQVFWRILLFYILAIFVIGMLIPYDSSAL

SEQ ID NO: 1598033 - protein, 52 aa, Staphylococcus aureus
VPKFNDWIFIIFIISVYYIFWLLAKRKYILVTFWTIIILTLLITFPTNSHHK

SEQ ID NO: 1598034 - protein, 26 aa, Staphylococcus aureus
VPYGDDWLAYFMRRLAERPQNLSLAA

SEQ ID NO: 1598035 - protein, 34 aa, Staphylococcus aureus
VQDNGSYSLNLDKLDKTYVIHYTGEYLQGSDQVN

SEQ ID NO: 1598036 - protein, 23 aa, Staphylococcus aureus
VQFIITLFLIWLPTYLTEVFHVN

SEQ ID NO: 1598037 - protein, 31 aa, Staphylococcus aureus
VQGKKDLKAELDLNLFIDPTTVTKRGNQNIE

SEQ ID NO: 1598038 - protein, 50 aa, Staphylococcus aureus
VQHLNVDVTYPGISAAKRVPVTLNVYQFEFPQTIYTTTVGGTLASGTQAS

SEQ ID NO: 1598039 - protein, 25 aa, Staphylococcus aureus
VQKGRTFLWFMHLSEQLRRTGEQIK

SEQ ID NO: 1598040 - protein, 24 aa, Staphylococcus aureus
VQKKSDIFIIKKQNLHSFKVGRGF

SEQ ID NO: 1598041 - protein, 29 aa, Staphylococcus aureus
VQNNGSYSLNFDKLDKTYVIHYTGDYLNG

SEQ ID NO: 1598042 - protein, 17 aa, Staphylococcus aureus
VRTRAVRSLAVAEPVVN

SEQ ID NO: 1598043 - protein, 19 aa, Staphylococcus aureus
VRWLFRIIALIVFAVLMFT

SEQ ID NO: 1598044 - protein, 23 aa, Staphylococcus aureus
VSGLLYIGFVIYTLTIGSYDVLP

SEQ ID NO: 1598045 - protein, 18 aa, Staphylococcus aureus
VSILLIGMAISNVSKEQY

SEQ ID NO: 1598046 - protein, 24 aa, Staphylococcus aureus
VSILTIRLFLKLINRIKLIPFAIY

SEQ ID NO: 1598047 - protein, 26 aa, Staphylococcus aureus
VSINKMMWILLYCFLGNILGGFVLFF

SEQ ID NO: 1598048 - protein, 19 aa, Staphylococcus aureus
VSIPGMMTGLIIGGVPPLQ

SEQ ID NO: 1598049 - protein, 20 aa, Staphylococcus aureus
VSKEFDIKYLDGVKDRMGVT

SEQ ID NO: 1598050 - protein, 26 aa, Staphylococcus aureus
VSKIITLFIISLIYFVITIIASIVIG

SEQ ID NO: 1598051 - protein, 29 aa, Staphylococcus aureus
VSNNATLFGGLFAALGSLLLFGRRKKQNK

SEQ ID NO: 1598052 - protein, 25 aa, Staphylococcus aureus
VSNPVGWAVVGILTAGIIGSTVSDY

SEQ ID NO: 1598053 - protein, 28 aa, Staphylococcus aureus
VSNVYNFIMIIWNQIVAYLQGLWNGIIT

SEQ ID NO: 1598054 - protein, 25 aa, Staphylococcus aureus
VSNWVFIIFSFIVIPIGLRIERNIS

SEQ ID NO: 1598055 - protein, 17 aa, Staphylococcus aureus
VSRLLLSVILNLPVWVV

SEQ ID NO: 1598056 - protein, 37 aa, Staphylococcus aureus
VSTTYKKVLHWSLNHKWIVIILSTLILVATVVFGGPR

SEQ ID NO: 1598057 - protein, 24 aa, Staphylococcus aureus
VSTWITYFFPLINWFMPKKYAKIS

SEQ ID NO: 1598058 - protein, 29 aa, Staphylococcus aureus
VTAFAAIFLGVLMFFIWPSIQAGIYHVGG

SEQ ID NO: 1598059 - protein, 28 aa, Staphylococcus aureus
VTDQFKNRIYYEHPNVASIKFGDITKTY

SEQ ID NO: 1598060 - protein, 30 aa, Staphylococcus aureus
VTEAFLKYHLLGGRYYQPLAQTFQLPTHFK

SEQ ID NO: 1598061 - protein, 20 aa, Staphylococcus aureus
VTFIAKHKWSAVIAWIVIVA

SEQ ID NO: 1598062 - protein, 29 aa, Staphylococcus aureus
VTFIATFLLMVLMYRFFGKQGLIAWVAIG

SEQ ID NO: 1598063 - protein, 25 aa, Staphylococcus aureus
VTFIVFMILLITKFSQVWPILIFLP

SEQ ID NO: 1598064 - protein, 17 aa, Staphylococcus aureus
VTFYLFKILHFKRSTNM

SEQ ID NO: 1598065 - protein, 21 aa, Staphylococcus aureus
VTGLPSGLSYDSATNSIIGTP

SEQ ID NO: 1598066 - protein, 24 aa, Staphylococcus aureus
VTGWTYWFCWIITGMAEVTAVAKY

SEQ ID NO: 1598067 - protein, 33 aa, Staphylococcus aureus
VTIDSGTTVYPHQAGYVKLNYGFSVPNSAVKGD

SEQ ID NO: 1598068 - protein, 17 aa, Staphylococcus aureus
VTLLDGSKVIVNVPVKV

SEQ ID NO: 1598069 - protein, 23 aa, Staphylococcus aureus
VTLVIKLIPIIVIVIFGIFQSGD

SEQ ID NO: 1598070 - protein, 18 aa, Staphylococcus aureus
VTMSMACGALIFNRRHQL

SEQ ID NO: 1598071 - protein, 32 aa, Staphylococcus aureus
VTPAIALLIVGLLTIFIFMPLAGFVSDSLVSV

SEQ ID NO: 1598072 - protein, 17 aa, Staphylococcus aureus
VTSGLINFMVFPPKYYG

SEQ ID NO: 1598073 - protein, 26 aa, Staphylococcus aureus
VTSSWIFFFIPMLNWGVPKKFAKISQ

SEQ ID NO: 1598074 - protein, 26 aa, Staphylococcus aureus
VTTFTRRNNTSPWVKEASAANVTGIV

SEQ ID NO: 1598075 - protein, 23 aa, Staphylococcus aureus
VTVIVLAFISIGHALLIMVSMLF

SEQ ID NO: 1598076 - protein, 23 aa, Staphylococcus aureus
VVAQVLLLLLTKPAPKTVIGNMS

SEQ ID NO: 1598077 - protein, 23 aa, Staphylococcus aureus
VVAQVLLPLLTKPAPKTVIGNMS

SEQ ID NO: 1598078 - protein, 28 aa, Staphylococcus aureus
VVCSNLLYSIILYVIRIIQLHYRRRIGL

SEQ ID NO: 1598079 - protein, 38 aa, Staphylococcus aureus
VVEVYQYFKPHFLYLVIGTAIVFLIAKLFSQFVLRFRE

SEQ ID NO: 1598080 - protein, 30 aa, Staphylococcus aureus
VVGVGYFIHWIWPALPMPAAFAIAAILCPT

SEQ ID NO: 1598081 - protein, 19 aa, Staphylococcus aureus
VVIFSIVMTFIIAKVIKLI

SEQ ID NO: 1598082 - protein, 23 aa, Staphylococcus aureus
VVIKSLATLTILTSVTGIGTTLV

SEQ ID NO: 1598083 - protein, 26 aa, Staphylococcus aureus
VVITIFIIIFLYFKIRLYSVFLVMVT

SEQ ID NO: 1598084 - protein, 24 aa, Staphylococcus aureus
VVITILITKLKWKSAGALLVEAIK

SEQ ID NO: 1598085 - protein, 18 aa, Staphylococcus aureus
VVIWLLSYVGPHGINVNI

SEQ ID NO: 1598086 - protein, 20 aa, Staphylococcus aureus
VVLFFLISLLEDSGYMARIA

SEQ ID NO: 1598087 - protein, 17 aa, Staphylococcus aureus
VVLILLFVEKLRIIQRS

SEQ ID NO: 1598088 - protein, 28 aa, Staphylococcus aureus
VVLKSALFFYYLFTKLSLISVLVLHLKQ

SEQ ID NO: 1598089 - protein, 17 aa, Staphylococcus aureus
VVMILCALALICVIVFY

SEQ ID NO: 1598090 - protein, 19 aa, Staphylococcus aureus
VVPLLFLVISKMKISILDD

SEQ ID NO: 1598091 - protein, 26 aa, Staphylococcus aureus
VVRGQNNQWTIANKPDYVTLDAHTGK

SEQ ID NO: 1598092 - protein, 32 aa, Staphylococcus aureus; identical to SEQ ID NO: 1578471

SEQ ID NO: 1598093 - protein, 23 aa, Staphylococcus aureus
VVTFLLSIPALLPLYKALNMNKY

SEQ ID NO: 1598094 - protein, 24 aa, Staphylococcus aureus
VVTGFVFFDIPIQVLLIIASAYAT

SEQ ID NO: 1598095 - protein, 19 aa, Staphylococcus aureus
VVTPVIEINEKVKPVAPTK

SEQ ID NO: 1598096 - protein, 18 aa, Staphylococcus aureus
VVVAILIGLIIIAYGHNK

SEQ ID NO: 1598097 - protein, 25 aa, Staphylococcus aureus
VVVGFFIVFLFIWFSFKTIQLQCFS

SEQ ID NO: 1598098 - protein, 23 aa, Staphylococcus aureus
VVYAIFLFPLFIKEKKYYEVELT

SEQ ID NO: 1598099 - protein, 20 aa, Staphylococcus aureus
VVYIVLIILFTYFYAFVQVN

SEQ ID NO: 1598100 - protein, 17 aa, Staphylococcus aureus
VYAPISLFLIIFSAWYL

SEQ ID NO: 1598101 - protein, 24 aa, Staphylococcus aureus
VYDVLGFLRLVFIPSMIVFFQDST

SEQ ID NO: 1598102 - protein, 18 aa, Staphylococcus aureus
VYLKRYLLRAMMAGFIIG

SEQ ID NO: 1598103 - protein, 30 aa, Staphylococcus aureus
VYQYFKPHFLYLAIGTLVIFIIAKLSSQLI

SEQ ID NO: 1598104 - protein, 25 aa, Staphylococcus aureus
VYTIHIIILIILLKEFRKYKSINVN

SEQ ID NO: 1598105 - protein, 24 aa, Staphylococcus aureus
WAGWLIFAGIIFFSGSLYILVLTQ

SEQ ID NO: 1598106 - protein, 17 aa, Staphylococcus aureus
WAWGITVIVIYGIGFYA

SEQ ID NO: 1598107 - protein, 22 aa, Staphylococcus aureus
WEEHPLFTIIGGACLVAGLALI

SEQ ID NO: 1598108 - protein, 30 aa, Staphylococcus aureus
WEGVYVLAITLWIATWWITEAIPIAATSLL

SEQ ID NO: 1598109 - protein, 17 aa, Staphylococcus aureus
WFAFLLIIQASTIISME

SEQ ID NO: 1598110 - protein, 17 aa, Staphylococcus aureus
WFSIIKIATIIGLIVVG

SEQ ID NO: 1598111 - protein, 17 aa, Staphylococcus aureus
WFVSLVVFIIGFIASLT

SEQ ID NO: 1598112 - protein, 19 aa, Staphylococcus aureus
WGITVIVIYGIGFYASMKI

SEQ ID NO: 1598113 - protein, 24 aa, Staphylococcus aureus
WGPIAWAIYVLPALPIGYLVFVKK

SEQ ID NO: 1598114 - protein, 27 aa, Staphylococcus aureus
WGVMTQGWWFPVMASVFLIFTIIIMFI

SEQ ID NO: 1598115 - protein, 19 aa, Staphylococcus aureus
WIGYLPYLYSGVIFGLIYL

SEQ ID NO: 1598116 - protein, 18 aa, Staphylococcus aureus
WISAGIIGIIQYSSILSS

SEQ ID NO: 1598117 - protein, 17 aa, Staphylococcus aureus
WISNLTKSDNKNGSLAI

SEQ ID NO: 1598118 - protein, 22 aa, Staphylococcus aureus
WITYFFPMINWFLPKKYAKISE

SEQ ID NO: 1598119 - protein, 17 aa, Staphylococcus aureus
WIVISIVLAIFLLILLS

SEQ ID NO: 1598120 - protein, 17 aa, Staphylococcus aureus
WIVLVIILSFKFLKALL

SEQ ID NO: 1598121 - protein, 19 aa, Staphylococcus aureus
WIVYCMLFTLVLKFTGLSP

SEQ ID NO: 1598122 - protein, 36 aa, Staphylococcus aureus
WKATTDDLGIDKSQKYNFLITSSHMQNRYSNGIMRT

SEQ ID NO: 1598123 - protein, 25 aa, Staphylococcus aureus
WKILIIACLMTWFYSDFYLMDCFLF

SEQ ID NO: 1598124 - protein, 20 aa, Staphylococcus aureus
WLISYSLLLKLSIPLTLKGK

SEQ ID NO: 1598125 - protein, 17 aa, Staphylococcus aureus
WLMISVSIFIVMMLLMN

SEQ ID NO: 1598126 - protein, 17 aa, Staphylococcus aureus
WLRFGFKLKRYTGLSKE

SEQ ID NO: 1598127 - protein, 20 aa, Staphylococcus aureus
WLTEDSWYEVIPPKGKNDQQ

SEQ ID NO: 1598128 - protein, 20 aa, Staphylococcus aureus
WLTTAFLLTNGIVIPLSVLC

SEQ ID NO: 1598129 - protein, 22 aa, Staphylococcus aureus
WNATKSIFGFLFNSVKSIFTNM

SEQ ID NO: 1598130 - protein, 35 aa, Staphylococcus aureus
WNVMFYGMFIIGIIAILVGFIWFKLYQYTTNPKAD

SEQ ID NO: 1598131 - protein, 29 aa, Staphylococcus aureus
WRMACALLVTIPIALFAFNKLMSGFNETY

SEQ ID NO: 1598132 - protein, 30 aa, Staphylococcus aureus
WSNIWFDLLILMIFIMVFIILNIVGLKRYR

SEQ ID NO: 1598133 - protein, 23 aa, Staphylococcus aureus
WTLIIFAAVFFAIVYWISLNPSK

SEQ ID NO: 1598134 - protein, 32 aa, Staphylococcus aureus
WVTLIITQILLTTSVLWILNYTGNLDLFILRI

SEQ ID NO: 1598135 - protein, 22 aa, Staphylococcus aureus
WYISILILIVVIAGCGKGNEIK

SEQ ID NO: 1598136 - protein, 17 aa, Staphylococcus aureus
YAALFILKTIDSHCITD

SEQ ID NO: 1598137 - protein, 18 aa, Staphylococcus aureus
YDAIGVLMFILFATVIGA

SEQ ID NO: 1598138 - protein, 27 aa, Staphylococcus aureus
YDFIALAFLFLTIALLLIALFYVCFYK

SEQ ID NO: 1598139 - protein, 40 aa, Staphylococcus aureus
YDFPIDSLFYIVSLNLSLTMIFLILTYFKEVKLYKHFDKD

SEQ ID NO: 1598140 - protein, 23 aa, Staphylococcus aureus
YDMTEPQRMLLGKPVASEQPAKG

SEQ ID NO: 1598141 - protein, 18 aa, Staphylococcus aureus
YDNTPQNLKLSFKKSQIT

SEQ ID NO: 1598142 - protein, 23 aa, Staphylococcus aureus
YDSATNSIIGTPTKIGQSTVTVV

SEQ ID NO: 1598143 - protein, 24 aa, Staphylococcus aureus
YDYTKLVFAKPIYNDPSLVKSDTN

SEQ ID NO: 1598144 - protein, 25 aa, Staphylococcus aureus
YEEIKILLSQNQLLASAGTLIEEEE

SEQ ID NO: 1598145 - protein, 31 aa, Staphylococcus aureus
YEHRYFDRVIKKRYKGIDYLIIKEPITTQDF

SEQ ID NO: 1598146 - protein, 31 aa, Staphylococcus aureus
YEHRYFDRVIKKRYKGIEYLIIKEPITTQDF

SEQ ID NO: 1598147 - protein, 23 aa, Staphylococcus aureus
YERWIVPIVFIGLGIYILFENGT

SEQ ID NO: 1598148 - protein, 19 aa, Staphylococcus aureus
YFGDHIYVEGIWLEVQADG

SEQ ID NO: 1598149 - protein, 19 aa, Staphylococcus aureus
YFGVSLIVFIVLLSGLTFI

SEQ ID NO: 1598150 - protein, 20 aa, Staphylococcus aureus
YFNIFLIFLGIGLVIPVLPV

SEQ ID NO: 1598151 - protein, 30 aa, Staphylococcus aureus
YFNIFLIFVLYFNIFLIFLGIGLVIPVLPV

SEQ ID NO: 1598152 - protein, 20 aa, Staphylococcus aureus
YFVFVFLFHTSKRLYYLCYI

SEQ ID NO: 1598153 - protein, 17 aa, Staphylococcus aureus
YFWKCIFFKINTVVSTE

SEQ ID NO: 1598154 - protein, 22 aa, Staphylococcus aureus
YFYFMLFFSTTIIGALLLYLPF

SEQ ID NO: 1598155 - protein, 17 aa, Staphylococcus aureus
YFYPRFKRSMIGIIVAM

SEQ ID NO: 1598156 - protein, 19 aa, Staphylococcus aureus
YGDFWGFLSGWAQSFIYFP

SEQ ID NO: 1598157 - protein, 22 aa, Staphylococcus aureus
YGGKLVLILDDGLEIEVERIKG

SEQ ID NO: 1598158 - protein, 18 aa, Staphylococcus aureus
YGIFAPWLNGATNCIAGG

SEQ ID NO: 1598159 - protein, 24 aa, Staphylococcus aureus
YGKKQSLVFYHLKLDSEYASIFGL

SEQ ID NO: 1598160 - protein, 25 aa, Staphylococcus aureus
YGLDLLNPSYFLISAFFISAVTSVA

SEQ ID NO: 1598161 - protein, 26 aa, Staphylococcus aureus
YGLDLLNPSYFLISAFFISAVTSVAT

SEQ ID NO: 1598162 - protein, 20 aa, Staphylococcus aureus
YGNLLYLLPLSILGLERYFQ

SEQ ID NO: 1598163 - protein, 26 aa, Staphylococcus aureus
YGPKWLYIISVIVFSLSYLILVIVNN

SEQ ID NO: 1598164 - protein, 21 aa, Staphylococcus aureus
YGSLLYLLPLSILGLERYFQQ

SEQ ID NO: 1598165 - protein, 17 aa, Staphylococcus aureus
YHYFFFSDGFFITISIL

SEQ ID NO: 1598166 - protein, 18 aa, Staphylococcus aureus
YIAIVILLHIIGFSFLWI

SEQ ID NO: 1598167 - protein, 26 aa, Staphylococcus aureus
YIALLGWLIIGLIFFVIRYPKLKNMD

SEQ ID NO: 1598168 - protein, 17 aa, Staphylococcus aureus
YIATTFHASMTFGLIFL

SEQ ID NO: 1598169 - protein, 17 aa, Staphylococcus aureus
YICMYAIFAITAYNHSK

SEQ ID NO: 1598170 - protein, 17 aa, Staphylococcus aureus
YIFNFLSRTLTAIIGLV

SEQ ID NO: 1598171 - protein, 25 aa, Staphylococcus aureus
YIFSPIFIILIFFNTINFKTTLSNL

SEQ ID NO: 1598172 - protein, 24 aa, Staphylococcus aureus
YIGWRSIFVVSILLTLLAMYLIKH

SEQ ID NO: 1598173 - protein, 19 aa, Staphylococcus aureus
YIGYVPIDDPKLAFSIVYT

SEQ ID NO: 1598174 - protein, 25 aa, Staphylococcus aureus
YIIITLLLAVLLFKGFNKWSGRTIK

SEQ ID NO: 1598175 - protein, 27 aa, Staphylococcus aureus
YIILALIIVGVINLFLIRSRKKGKRQQ

SEQ ID NO: 1598176 - protein, 22 aa, Staphylococcus aureus
YILIHDLLKPTILPIIPLLGIS

SEQ ID NO: 1598177 - protein, 22 aa, Staphylococcus aureus
YILTIFLIIIFIELIELDIYLK

SEQ ID NO: 1598178 - protein, 19 aa, Staphylococcus aureus
YILVTVWTIIILTLLITFP

SEQ ID NO: 1598179 - protein, 24 aa, Staphylococcus aureus
YIQKRDFFIFNKKVNGYHVWIKGY

SEQ ID NO: 1598180 - protein, 24 aa, Staphylococcus aureus
YISKKTYQGIFSFDVLGLQDIHRN

SEQ ID NO: 1598181 - protein, 18 aa, Staphylococcus aureus
YITAFYRFVLVMIGVISS

SEQ ID NO: 1598182 - protein, 24 aa, Staphylococcus aureus
YITKVLYRLTFVGSIFLAVISILP

SEQ ID NO: 1598183 - protein, 20 aa, Staphylococcus aureus
YIVRRYGWDGFKRAGDYAYA

SEQ ID NO: 1598184 - protein, 25 aa, Staphylococcus aureus
YIYEQYLNKFFLIKNNHYINEVDVI

SEQ ID NO: 1598185 - protein, 25 aa, Staphylococcus aureus
YKIFLVFIAIIFFAFPFVLLFVHNL

SEQ ID NO: 1598186 - protein, 18 aa, Staphylococcus aureus
YKIYLALFGLDRHIISDK

SEQ ID NO: 1598187 - protein, 25 aa, Staphylococcus aureus
YKMFLVFIAIIFFAFPFVLLFVHNL

SEQ ID NO: 1598188 - protein, 39 aa, Staphylococcus aureus
YKNRRKMIVICFYSLLAILLILLLASFIKATRANNDSKE

SEQ ID NO: 1598189 - protein, 27 aa, Staphylococcus aureus
YKNVSTYIIIFLVSSAAFAIFLLSANI

SEQ ID NO: 1598190 - protein, 41 aa, Staphylococcus aureus
YKQEWCIVLSLLFLFPLGLFLMWKFSKWPSLVRTIITVVIV

SEQ ID NO: 1598191 - protein, 37 aa, Staphylococcus aureus
YKQTVFVNPKQRVLGNTWLYIKGYQDKIEESSGKVSA

SEQ ID NO: 1598192 - protein, 36 aa, Staphylococcus aureus
YKQTVFVNPKQRVLGNTWVYIKGYQDKIEESSGKVS

SEQ ID NO: 1598193 - protein, 37 aa, Staphylococcus aureus
YKQTVFVNPKQRVLGNTWVYIKGYQDKIEESSGKVSA

SEQ ID NO: 1598194 - protein, 26 aa, Staphylococcus aureus
YKRQRPHPFLGRQVLTWGYFLCSFIC

SEQ ID NO: 1598195 - protein, 36 aa, Staphylococcus aureus
YKTRMILGFIMSFLNAIFIALPIFLASQIFNNVVSH

SEQ ID NO: 1598196 - protein, 23 aa, Staphylococcus aureus
YKVAMFLVPTMIKSLLLVYNNEH

SEQ ID NO: 1598197 - protein, 20 aa, Staphylococcus aureus
YLFFRSSVLLIFKTLKKSKN

SEQ ID NO: 1598198 - protein, 17 aa, Staphylococcus aureus
YLHWTNMFLIALIVVFT

SEQ ID NO: 1598199 - protein, 19 aa, Staphylococcus aureus
YLIITFLVLIANSVTFVFI

SEQ ID NO: 1598200 - protein, 20 aa, Staphylococcus aureus
YLIRTIPVIIIALLYVLLSP

SEQ ID NO: 1598201 - protein, 22 aa, Staphylococcus aureus
YLLQVILYLLIVIALLMIGFET

SEQ ID NO: 1598202 - protein, 21 aa, Staphylococcus aureus
YLTILVTILISIFLSLTESWQ

SEQ ID NO: 1598203 - protein, 21 aa, Staphylococcus aureus
YLTIYVLVALMYWVVCFIMSI

SEQ ID NO: 1598204 - protein, 25 aa, Staphylococcus aureus
YLVEYFNWRSLFHVVAPIAAVTFLI

SEQ ID NO: 1598205 - protein, 24 aa, Staphylococcus aureus
YLVEYFNWRSLFHVVAPIAAVTFS

SEQ ID NO: 1598206 - protein, 25 aa, Staphylococcus aureus
YLVEYLNWRSLFHVVAPIAAVTFLI

SEQ ID NO: 1598207 - protein, 20 aa, Staphylococcus aureus
YMIIISFVLFATFAFFYIYS

SEQ ID NO: 1598208 - protein, 24 aa, Staphylococcus aureus
YMKFWFSELPTWIPGVIAILLLMA

SEQ ID NO: 1598209 - protein, 25 aa, Staphylococcus aureus
YMLNYKVWYLTLLAGLIPFIPIKFS

SEQ ID NO: 1598210 - protein, 34 aa, Staphylococcus aureus
YMSQPLSLVFYLKSLLLILVYEIGIVFILFHIQT

SEQ ID NO: 1598211 - protein, 17 aa, Staphylococcus aureus
YNFSLIYHYHYIQYIIL

SEQ ID NO: 1598212 - protein, 17 aa, Staphylococcus aureus
YNGGFYIISFATLFIIA

SEQ ID NO: 1598213 - protein, 40 aa, Staphylococcus aureus
YNTTQFVIWLQNGIWAIIVYFIVCLLISFLALISMNIRIL

SEQ ID NO: 1598214 - protein, 17 aa, Staphylococcus aureus
YPILDITLLQNIFTLMS

SEQ ID NO: 1598215 - protein, 20 aa, Staphylococcus aureus
YPILMLPILTTAIVSGLVSA

SEQ ID NO: 1598216 - protein, 23 aa, Staphylococcus aureus
YPVLKFLLFFIPPVGNFLNLFNK

SEQ ID NO: 1598217 - protein, 23 aa, Staphylococcus aureus
YPYWLDSTAWYELIRAKNKNDED

SEQ ID NO: 1598218 - protein, 17 aa, Staphylococcus aureus
YPYWLTEDSWYEVIPPK

SEQ ID NO: 1598219 - protein, 18 aa, Staphylococcus aureus
YQDKLKIEKMNLPGISLL

SEQ ID NO: 1598220 - protein, 30 aa, Staphylococcus aureus
YQINIWVWVPLIVIIVCLLFKMATVPAMVI

SEQ ID NO: 1598221 - protein, 19 aa, Staphylococcus aureus
YQINIWVWVPLIVIIVCYL

SEQ ID NO: 1598222 - protein, 36 aa, Staphylococcus aureus
YQKYIDFMFAGVLAFIFLIYRIYSLFSGYKVVNKKW

SEQ ID NO: 1598223 - protein, 23 aa, Staphylococcus aureus
YQRSWLMMLLICNILGMIYGYIW

SEQ ID NO: 1598224 - protein, 23 aa, Staphylococcus aureus
YQSYQHSHFPNFGGGVLGFYLLE

SEQ ID NO: 1598225 - protein, 29 aa, Staphylococcus aureus
YRNDLLFIASFMVLISLILAQIVLPLITP

SEQ ID NO: 1598226 - protein, 38 aa, Staphylococcus aureus
YRNHRKKIVVIFYTVLIILTVLLLAAFVRASKANNESK

SEQ ID NO: 1598227 - protein, 25 aa, Staphylococcus aureus
YSLTIYMMILFPIIGLVCALLAKKP

SEQ ID NO: 1598228 - protein, 26 aa, Staphylococcus aureus
YSMIEDFKVTIWYTAPTALRMLMSAG

SEQ ID NO: 1598229 - protein, 20 aa, Staphylococcus aureus
YSWKWTALAVVYPLVTAYVL

SEQ ID NO: 1598230 - protein, 20 aa, Staphylococcus aureus
YTAKLFPFGPIFAAILCIVV

SEQ ID NO: 1598231 - protein, 36 aa, Staphylococcus aureus
YTCNLDLFILRLVLLSCLFILTISVINLWTFLMLLN

SEQ ID NO: 1598232 - protein, 47 aa, Staphylococcus aureus
YTGNLDLFILRIVLLSCLFILTISVINLWTFLILLNLNIANMIKGKQ

SEQ ID NO: 1598233 - protein, 34 aa, Staphylococcus aureus
YTGNLDLFILRIVLLSCLFILTISVINLWTFLML

SEQ ID NO: 1598234 - protein, 23 aa, Staphylococcus aureus
YTIDLLFIICVILGILGLIISLF

SEQ ID NO: 1598235 - protein, 17 aa, Staphylococcus aureus
YTILMYTCAYVLIRMFK

SEQ ID NO: 1598236 - protein, 33 aa, Staphylococcus aureus
YTKETFVSTLTGYKFNPDAKNFKIYEVTDQNQF

SEQ ID NO: 1598237 - protein, 33 aa, Staphylococcus aureus
YTKQTFVTNLTGYKFNPNAKNFKIYEVTDQNQF

SEQ ID NO: 1598238 - protein, 29 aa, Staphylococcus aureus
YTLGVLFIFLFLLGYFLPIGIDKVKSLSY

SEQ ID NO: 1598239 - protein, 27 aa, Staphylococcus aureus
YTLYELYNLMLLKEEKLFYKCVNNELS

SEQ ID NO: 1598240 - protein, 20 aa, Staphylococcus aureus
YTNAVSRAEAILNKTQGANT

SEQ ID NO: 1598241 - protein, 19 aa, Staphylococcus aureus
YTNAVSRAETILNKTQGAN

SEQ ID NO: 1598242 - protein, 27 aa, Staphylococcus aureus
YTSAKQFFSTVLIPLSTSMKTLSDLTK

SEQ ID NO: 1598243 - protein, 17 aa, Staphylococcus aureus
YTSLWFFGLIAVVVVAF

SEQ ID NO: 1598244 - protein, 18 aa, Staphylococcus aureus
YVFLIFWTVIFSYALLSM

SEQ ID NO: 1598245 - protein, 19 aa, Staphylococcus aureus
YVGVWWRELLAISIQLPLQ

SEQ ID NO: 1598246 - protein, 24 aa, Staphylococcus aureus
YVICCIIGYLFFGLGLGIYATPST

SEQ ID NO: 1598247 - protein, 17 aa, Staphylococcus aureus
YVISDAVHIGWKGWVYM

SEQ ID NO: 1598248 - protein, 25 aa, Staphylococcus aureus
YVKPVNDSWTQNAQRMNFQFTNSYG

SEQ ID NO: 1598249 - protein, 17 aa, Staphylococcus aureus
YWKDFMVEGERVRTISK

SEQ ID NO: 1598250 - protein, 30 aa, Staphylococcus aureus
YWVTLIITQILLTTSVLWILNYTCNLDLFI

SEQ ID NO: 1598251 - protein, 24 aa, Staphylococcus aureus
YYDAFGVLMFILFATVIGAYLFFK

SEQ ID NO: 1598252 - protein, 25 aa, Staphylococcus aureus
YYDAFGVLMFILFATVIGAYLFFKS

SEQ ID NO: 1598253 - protein, 28 aa, Staphylococcus aureus
YYGLDLLNPSYFLISAFFINAVTSVATG

SEQ ID NO: 1598254 - protein, 27 aa, Staphylococcus aureus
YYGLDLLNPSYFLISAFFISAVTSVVT

SEQ ID NO: 1598255 - protein, 23 aa, Staphylococcus aureus
YYGMRALLIFYMYFAVTDNGLGI

SEQ ID NO: 1598256 - protein, 18 aa, Staphylococcus aureus
YYLLAFSLMLILPSAIYA

SEQ ID NO: 1598257 - protein, 19 aa, Staphylococcus aureus
YYLLAFSLMLILPSAIYAD

SEQ ID NO: 1598258 - protein, 21 aa, Staphylococcus aureus
YYNKNAFAMDKSHPEPIEDND

SEQ ID NO: 1598259 - protein, 19 aa, Staphylococcus aureus
YYNQVVYVNPMDKDLKGAK

SEQ ID NO: 1598260 - protein, 17 aa, Staphylococcus aureus
YYRNLDEQVLALITGEI

SEQ ID NO: 1598261 - protein, 17 aa, Staphylococcus aureus
MQAILRILFYFSPILWL

SEQ ID NO: 1598262 - protein, 24 aa, Staphylococcus aureus
ASTIFPVFLVIIIGLVSFYAIYIW

SEQ ID NO: 1598263 - protein, 20 aa, Staphylococcus aureus
FTYLLIFIYFLILTSRKGSP

SEQ ID NO: 1598264 - protein, 24 aa, Staphylococcus aureus
IKSYFAFYLILFGASLMIGLVVTT

SEQ ID NO: 1598265 - protein, 22 aa, Staphylococcus aureus
IPLLIYFYVPFFKKLKVTSAYE

SEQ ID NO: 1598266 - protein, 21 aa, Staphylococcus aureus
LFIFVFILVNIVLVSIYVNKV

SEQ ID NO: 1598267 - protein, 18 aa, Staphylococcus aureus
LFPILLIVPLFDILMYFN

SEQ ID NO: 1598268 - protein, 32 aa, Staphylococcus aureus
SILSTLIPVVVIALLFIFFLSQAQGGGSGGRM

SEQ ID NO: 1598269 - protein, 23 aa, Staphylococcus aureus
VFDYILIFFLFGIAVTMIAGAGA

SEQ ID NO: 1598270 - protein, 19 aa, Staphylococcus aureus
LFPLLLFVALFLGVGIITG

SEQ ID NO: 1598271 - protein, 19 aa, Staphylococcus aureus
PFTLLPILIGFSAAKRFGG

SEQ ID NO: 1598272 - protein, 23 aa, Staphylococcus aureus
RVSMFIWLIILLPVPLLLINLGV

SEQ ID NO: 1598273 - protein, 23 aa, Staphylococcus aureus
STVAFATLALLGSLSLLLFKRKE

SEQ ID NO: 1598274 - protein, 18 aa, Staphylococcus aureus
VITVVVLLAIGIAGFYFW

SEQ ID NO: 1598275 - protein, 27 aa, Staphylococcus aureus
AGYRAKFILMVILTMMVFVLINTYLLR

SEQ ID NO: 1598276 - protein, 19 aa, Staphylococcus aureus
AIAFLILCIGIVAVLNSVK

SEQ ID NO: 1598277 - protein, 18 aa, Staphylococcus aureus
DSGFYKTPKYSLGDYVWY

SEQ ID NO: 1598278 - protein, 21 aa, Staphylococcus aureus
FLFLVLVIFTLFTYKAPNGMR

SEQ ID NO: 1598279 - protein, 30 aa, Staphylococcus aureus
FYCTFLVVILLFLWPLLYSWIVKFGESIVG

SEQ ID NO: 1598280 - protein, 23 aa, Staphylococcus aureus
GLTPIFFFLIFTLMMHIFLTKGG

SEQ ID NO: 1598281 - protein, 25 aa, Staphylococcus aureus
GTIVAIIVILLFLRNIRTTAISIIS

SEQ ID NO: 1598282 - protein, 19 aa, Staphylococcus aureus
IFALIIPILYRFFKRIHLG

SEQ ID NO: 1598283 - protein, 22 aa, Staphylococcus aureus
IIVIILIAVGVLFYLRSNKRQI

SEQ ID NO: 1598284 - protein, 20 aa, Staphylococcus aureus
IVYYFLFDFAIRKFKLKTPG

SEQ ID NO: 1598285 - protein, 35 aa, Staphylococcus aureus
KSRRSKKWLYIIIAILLIIVAIFVTRALLNNDSDK

SEQ ID NO: 1598286 - protein, 24 aa, Staphylococcus aureus
LSLPLLMLMFVHLFNMHIPALFTN

SEQ ID NO: 1598287 - protein, 23 aa, Staphylococcus aureus
MFYKFRYILITLIILLLSIMVLF

SEQ ID NO: 1598288 - protein, 18 aa, Staphylococcus aureus
MPILALGAFLIFFFKRSK

SEQ ID NO: 1598289 - protein, 28 aa, Staphylococcus aureus
MSLPKKIFLWVFGILVILAIVAVVYVAA

SEQ ID NO: 1598290 - protein, 21 aa, Staphylococcus aureus
PYALLFFDMIVVAISLTVIPL

SEQ ID NO: 1598291 - protein, 23 aa, Staphylococcus aureus
QFQGLWIVLFILLGVLLLRATVQ

SEQ ID NO: 1598292 - protein, 23 aa, Staphylococcus aureus
QSINPLFILLLAPIISLLWQKLG

SEQ ID NO: 1598293 - protein, 24 aa, Staphylococcus aureus
TFLAWLLIFLMFALPIGIAYQFSD

SEQ ID NO: 1598294 - protein, 25 aa, Staphylococcus aureus
VDNLWFFLIFLLFFGLFLFLITLAS

SEQ ID NO: 1598295 - protein, 24 aa, Staphylococcus aureus
VNRNIFWILLIGMLVIFIALQIRI

SEQ ID NO: 1598296 - protein, 20 aa, Staphylococcus aureus
YFPYVLMRPLLFIAVILGGM

SEQ ID NO: 1598297 - protein, 24 aa, Staphylococcus aureus
YISPFWFIFLFFFYKKYKTNAEKL

SEQ ID NO: 1598298 - protein, 21 aa, Staphylococcus aureus
ENLYRIAIQYYGSGSPENVEK

SEQ ID NO: 1598299 - protein, 18 aa, Staphylococcus aureus
FMMFGLPAAAFAIYKNAR

SEQ ID NO: 1598300 - protein, 17 aa, Staphylococcus aureus
GIIAAIAFLILCIGIVA

SEQ ID NO: 1598301 - protein, 18 aa, Staphylococcus aureus
IHPLTIIFILLCAGKLLG

SEQ ID NO: 1598302 - protein, 28 aa, Staphylococcus aureus
IVQVLTFIVLLALLKKFAWGPLKDVMDK

SEQ ID NO: 1598303 - protein, 36 aa, Staphylococcus aureus
KKGGMAKVLLPLIAAVLIIGALAIFGGMALNNHNNG

SEQ ID NO: 1598304 - protein, 27 aa, Staphylococcus aureus
KQEKKIFPYILMSVGAFLTLGFVIFSI

SEQ ID NO: 1598305 - protein, 31 aa, Staphylococcus aureus
KRILLKILLTILIIIALFIGIMYFLSTRDNV

SEQ ID NO: 1598306 - protein, 23 aa, Staphylococcus aureus
LLVFVVFFTAATIIWFSYDKNKY

SEQ ID NO: 1598307 - protein, 21 aa, Staphylococcus aureus
NTRTIIFPYVEGKTLYDAIVK

SEQ ID NO: 1598308 - protein, 23 aa, Staphylococcus aureus
QLLVIMGITVLITLLLWIMLVLI

SEQ ID NO: 1598309 - protein, 24 aa, Staphylococcus aureus
SAKQFFSTVLIPLSTSMKTLSDLT

SEQ ID NO: 1598310 - protein, 24 aa, Staphylococcus aureus
SQVWPILIFLPFVVIFFLKINKHY

SEQ ID NO: 1598311 - protein, 24 aa, Staphylococcus aureus
SSTLVTIIVFLPLVFVSGSVGEMF

SEQ ID NO: 1598312 - protein, 20 aa, Staphylococcus aureus
TGKYPFMMFGLPAAAFAIYK

SEQ ID NO: 1598313 - protein, 29 aa, Staphylococcus aureus
VGVLFLVGFLIYLFYSPRLKFDVLENPNK

SEQ ID NO: 1598314 - protein, 24 aa, Staphylococcus aureus
VIIILFISLIVAVAFFFGLKTYQG

SEQ ID NO: 1598315 - protein, 24 aa, Staphylococcus aureus
VSIGKLFMIFLIRTIITLPIISLM

SEQ ID NO: 1598316 - protein, 24 aa, Staphylococcus aureus
YFIHWIWPALPMPAAFAIAAILCP

SEQ ID NO: 1598317 - protein, 19 aa, Staphylococcus aureus
FSRRTFLKMLGIGGAGVAI

SEQ ID NO: 1598318 - protein, 19 aa, Staphylococcus aureus
IFSFVFFVIAWFFARKPSR

SEQ ID NO: 1598319 - protein, 18 aa, Staphylococcus aureus
IIIANFFMALLTFIFIFY

SEQ ID NO: 1598320 - protein, 25 aa, Staphylococcus aureus
IYACRFVWVYFWYKDFYFPKNIQSY

SEQ ID NO: 1598321 - protein, 17 aa, Staphylococcus aureus
LFIWFFKLKYSFGHIIN

SEQ ID NO: 1598322 - protein, 20 aa, Staphylococcus aureus
NFFHGWPWYAVWLVMLGFGG

SEQ ID NO: 1598323 - protein, 22 aa, Staphylococcus aureus
PGAVFWMWVIAFIGAASAFIEA

SEQ ID NO: 1598324 - protein, 25 aa, Staphylococcus aureus
TALKRLPWLIILTFLGMITATILGR

SEQ ID NO: 1598325 - protein, 17 aa, Staphylococcus aureus
TQFSRRTFLKMLGIGGA

SEQ ID NO: 1598326 - protein, 30 aa, Staphylococcus aureus
TTMITFVTIFLFCLIIIFFLKDTLHNSELD

SEQ ID NO: 1598327 - protein, 26 aa, Staphylococcus aureus
VISPTLFVLLMYLLSMITAYIFYSYE

SEQ ID NO: 1598328 - protein, 20 aa, Staphylococcus aureus
YAFMIFILLYIPCVSTVAAI

SEQ ID NO: 1598329 - protein, 20 aa, Staphylococcus aureus
YFYLMLFFSTTIIGALLLYL

SEQ ID NO: 1598330 - protein, 21 aa, Staphylococcus aureus
YIPIFFLMFYSFNSAGNMIHF

SEQ ID NO: 1598331 - protein, 20 aa, Staphylococcus aureus
ALIYLFMLGFYRLPGLVAII

SEQ ID NO: 1598332 - protein, 25 aa, Staphylococcus aureus
FFNSNFWIYWKTMFAFEPWHSAMEM

SEQ ID NO: 1598333 - protein, 19 aa, Staphylococcus aureus
IAFALFFFAFTTILSYYYI

SEQ ID NO: 1598334 - protein, 31 aa, Staphylococcus aureus
IAIRMLFHPFKPYYIFKFRVPFTPGLIPKRR

SEQ ID NO: 1598335 - protein, 18 aa, Staphylococcus aureus
IIIYLIIGSALGIIIIPE

SEQ ID NO: 1598336 - protein, 18 aa, Staphylococcus aureus
IISAVLSLPLLMLMFVHL

SEQ ID NO: 1598337 - protein, 24 aa, Staphylococcus aureus
IYTILPWFLITIPIIILLSYQLDV

SEQ ID NO: 1598338 - protein, 30 aa, Staphylococcus aureus
KKIRKLPIILLIVVILLIALVVYIVHSYNS

SEQ ID NO: 1598339 - protein, 27 aa, Staphylococcus aureus
LAAIIIVYLILVITFKGGLAPFTILFS

SEQ ID NO: 1598340 - protein, 26 aa, Staphylococcus aureus
LTDQKYLLFWLLLGFIFGFFPPIQTT

SEQ ID NO: 1598341 - protein, 23 aa, Staphylococcus aureus
VILILIFLFLIFHLIRLAAKIED

SEQ ID NO: 1598342 - protein, 18 aa, Staphylococcus aureus
ALIVTLIIIIAIVSMIFF

SEQ ID NO: 1598343 - protein, 20 aa, Staphylococcus aureus
ALSIMFFLDVKLTLAALFIF

SEQ ID NO: 1598344 - protein, 27 aa, Staphylococcus aureus
EILITKLIILTLFGIGFFVVGLILKPV

SEQ ID NO: 1598345 - protein, 24 aa, Staphylococcus aureus
IPIIIVLLLIGGIAWGVYAFFANT

SEQ ID NO: 1598346 - protein, 23 aa, Staphylococcus aureus
IWSQYLIGLLLTAGFFFTISSKF

SEQ ID NO: 1598347 - protein, 24 aa, Staphylococcus aureus
KFIPYLLFVVIWTALVYSPVAHWV

SEQ ID NO: 1598348 - protein, 18 aa, Staphylococcus aureus
KVFKLIFLACTLLGLVVL

SEQ ID NO: 1598349 - protein, 20 aa, Staphylococcus aureus
LGFYLLELSVPLISLFGVCI

SEQ ID NO: 1598350 - protein, 19 aa, Staphylococcus aureus
LIIIIAIVSMIFFVQTKYG

SEQ ID NO: 1598351 - protein, 29 aa, Staphylococcus aureus
SQTPRYRRPKFPWFKTVIVALIAGIIGAL

SEQ ID NO: 1598352 - protein, 24 aa, Staphylococcus aureus
SSLPWLLMFFLILSAGAISDRVLG

SEQ ID NO: 1598353 - protein, 26 aa, Staphylococcus aureus
TLAALFIFPFYILTVYVFFGRLRKLT

SEQ ID NO: 1598354 - protein, 19 aa, Staphylococcus aureus
VLINTYLLRQVKSIGMFLM

SEQ ID NO: 1598355 - protein, 25 aa, Staphylococcus aureus
VSMLFTLLIVPWLSSKKARTLKKHA

SEQ ID NO: 1598356 - protein, 34 aa, Staphylococcus aureus
AKVVSIATVLLLLGGLVFAIFAYVDHSNKAKERM

SEQ ID NO: 1598357 - protein, 24 aa, Staphylococcus aureus
FKGKKAFWFMFIGGFLLTFLLYAN

SEQ ID NO: 1598358 - protein, 18 aa, Staphylococcus aureus
IIPILFFIIAMMLFIRKD

SEQ ID NO: 1598359 - protein, 27 aa, Staphylococcus aureus
ILISGAVFIVFLLLPASWFTGLVNEKT

SEQ ID NO: 1598360 - protein, 30 aa, Staphylococcus aureus
KRINFIFGVIVFIFAVLVLRLGYLQIAQGS

SEQ ID NO: 1598361 - protein, 20 aa, Staphylococcus aureus
LEDDLRFRQIIFSHKDDLKS

SEQ ID NO: 1598362 - protein, 19 aa, Staphylococcus aureus
LILYALPYLILGSNNWSFV

SEQ ID NO: 1598363 - protein, 19 aa, Staphylococcus aureus
PILLAWIVAAVLRIALGSA

SEQ ID NO: 1598364 - protein, 20 aa, Staphylococcus aureus
TILLCYFGFQFGLKKRDEML

SEQ ID NO: 1598365 - protein, 21 aa, Staphylococcus aureus
DSSLLHLSFNRDYNWYGSMIG

SEQ ID NO: 1598366 - protein, 27 aa, Staphylococcus aureus
QIFGIPVFLFLNLIIILLCIIVGSVLA

SEQ ID NO: 1598367 - protein, 24 aa, Staphylococcus aureus
TSFTFMLIIVLIIWSFIYTGFNFG

SEQ ID NO: 1598368 - protein, 23 aa, Staphylococcus aureus
YSHWFRFVWPVVAFVLIFGGGVL

SEQ ID NO: 1598369 - protein, 24 aa, Staphylococcus aureus
AIGIALFIFVIVRPPIEFIRQYLA

SEQ ID NO: 1598370 - protein, 37 aa, Staphylococcus aureus
ALLIPFVIMIITAIVLMGVWFIFNSLIALIASIVLVV

SEQ ID NO: 1598371 - protein, 22 aa, Staphylococcus aureus
IDYALFILFRYRQVMKTETDYI

SEQ ID NO: 1598372 - protein, 20 aa, Staphylococcus aureus
ILLLLLIFIGIKYLSFVKTI

SEQ ID NO: 1598373 - protein, 25 aa, Staphylococcus aureus
LRMMIYLGLFIFSISVLYIIYLFIN

SEQ ID NO: 1598374 - protein, 38 aa, Staphylococcus aureus
MRKMVPWAIGFFILILIIILFFLLRNFNSPEAQTKILV

SEQ ID NO: 1598375 - protein, 20 aa, Staphylococcus aureus
MVCHPLLFMFFTKIFIQSWK

SEQ ID NO: 1598376 - protein, 31 aa, Staphylococcus aureus
VALAVYLFRFVWVYVLYPYFYLAISPFQKMM

SEQ ID NO: 1598377 - protein, 18 aa, Staphylococcus aureus
FVDTIWLFILLYAIFQGL

SEQ ID NO: 1598378 - protein, 24 aa, Staphylococcus aureus
IIGSIFMFLIFGVFIRRVTNAIKG

SEQ ID NO: 1598379 - protein, 33 aa, Staphylococcus aureus
RIQYSVITILVLLIAVILIYMFSPLSKIAHVNI

SEQ ID NO: 1598380 - protein, 19 aa, Staphylococcus aureus
WPILITFLIFTFFSGTNPF

SEQ ID NO: 1598381 - protein, 18 aa, Staphylococcus aureus
AFLLLVVLLFAGMAATYK

SEQ ID NO: 1598382 - protein, 19 aa, Staphylococcus aureus
ILPSFYAWFNLWAMWDPYG

SEQ ID NO: 1598383 - protein, 23 aa, Staphylococcus aureus
QNRWVVFILFLICSFGVLIGLYQ

SEQ ID NO: 1598384 - protein, 17 aa, Staphylococcus aureus
RLLILALIDSLIVTFSV

SEQ ID NO: 1598385 - protein, 42 aa, Staphylococcus aureus
RTIIKIIGFMIIAFFVVLLLGILLFAYYAWKAPAFTEAKLQD

SEQ ID NO: 1598386 - protein, 17 aa, Staphylococcus aureus
FRILWLSQFIAIAGLTV

SEQ ID NO: 1598387 - protein, 19 aa, Staphylococcus aureus
GIIALFFYIFRFNVLTYKE

SEQ ID NO: 1598388 - protein, 19 aa, Staphylococcus aureus
LIIHYFIICYFVFSVHPML

SEQ ID NO: 1598389 - protein, 17 aa, Staphylococcus aureus
SAYAFMIFILLYIPCVS

SEQ ID NO: 1598390 - protein, 22 aa, Staphylococcus aureus
ATGLLMIYVFNPPASWLNHLLL

SEQ ID NO: 1598391 - protein, 18 aa, Staphylococcus aureus
FIISFFIMLLFPFLQQLS

SEQ ID NO: 1598392 - protein, 25 aa, Staphylococcus aureus
NAGQSVTYYFTDVKAPTVTVGNQTI

SEQ ID NO: 1598393 - protein, 21 aa, Staphylococcus aureus
TIPIFVLIMIPLGRIMQKIST

SEQ ID NO: 1598394 - protein, 17 aa, Staphylococcus aureus
GAFLIFFFKRSKINNIG

SEQ ID NO: 1598395 - protein, 19 aa, Staphylococcus aureus
IETIWFVIPIIIVAALAIP

SEQ ID NO: 1598396 - protein, 23 aa, Staphylococcus aureus
LFGLMFYLYHLPLEAYLLALGVI

SEQ ID NO: 1598397 - protein, 20 aa, Staphylococcus aureus
TLFYLGFLVLFLFAALTSSI

SEQ ID NO: 1598398 - protein, 17 aa, Staphylococcus aureus
DWKMTLLTFITIPIFVL

SEQ ID NO: 1598399 - protein, 17 aa, Staphylococcus aureus
FIFIFYANHFMMSQRRK

SEQ ID NO: 1598400 - protein, 18 aa, Staphylococcus aureus
IAALGLLAPWVAGAAMAL

SEQ ID NO: 1598401 - protein, 22 aa, Staphylococcus aureus
KFEKVLYITLITVIAMLSIYML

SEQ ID NO: 1598402 - protein, 17 aa, Staphylococcus aureus
PIMPIIIIPIISSVVVG

SEQ ID NO: 1598403 - protein, 21 aa, Staphylococcus aureus
SITVILFSALISFVLTNVYYH

SEQ ID NO: 1598404 - protein, 17 aa, Staphylococcus aureus
FLFKKLSWPVGLIVAAI

SEQ ID NO: 1598405 - protein, 20 aa, Staphylococcus aureus
LFNFILALVLFIGLAYYQGT

SEQ ID NO: 1598406 - protein, 26 aa, Staphylococcus aureus
NFVIKPIMFAIWQVMQFIWPAVKALI

SEQ ID NO: 1598407 - protein, 32 aa, Staphylococcus aureus
TGNRPFFRLYLITWMMHLILIGGSRLFWRIYR

SEQ ID NO: 1598408 - protein, 20 aa, Staphylococcus aureus
TLFAGPLFNFILALVLFIGL

SEQ ID NO: 1598409 - protein, 19 aa, Staphylococcus aureus
YLHLILPIAMLIALTVCLI

SEQ ID NO: 1598410 - protein, 24 aa, Staphylococcus aureus
YLSRGYLITIFIILLITILFANFS

SEQ ID NO: 1598411 - protein, 24 aa, Staphylococcus aureus
AIPFIILILLLIPFTSLILGTISG

SEQ ID NO: 1598412 - protein, 23 aa, Staphylococcus aureus
FSFLFVAPLLFFIHAVLDGLSFL

SEQ ID NO: 1598413 - protein, 24 aa, Staphylococcus aureus
ISILWVYIVLLYLGYLFITANFLD

SEQ ID NO: 1598414 - protein, 19 aa, Staphylococcus aureus
RSFYSIRKSTLGVASVIVS

SEQ ID NO: 1598415 - protein, 33 aa, Staphylococcus aureus
RSIIPPLVMIALTVVIFLVRPIGIYILMMIGMS

SEQ ID NO: 1598416 - protein, 25 aa, Staphylococcus aureus
IAVVIALIFFVLFLVALGSKKKVKR

SEQ ID NO: 1598417 - protein, 21 aa, Staphylococcus aureus
KLYYLSYWYFITFGAFVAFGI

SEQ ID NO: 1598418 - protein, 31 aa, Staphylococcus aureus
ASSTWAWLFVLFVLPLIGFILYLFFGRTVSA

SEQ ID NO: 1598419 - protein, 19 aa, Staphylococcus aureus
IQIICVMMGLWIYQLDKHE

SEQ ID NO: 1598420 - protein, 18 aa, Staphylococcus aureus
LFVLITIFCSIIFNSIVY

SEQ ID NO: 1598421 - protein, 20 aa, Staphylococcus aureus
LRSLPFIILLIAIVPFTKLV

SEQ ID NO: 1598422 - protein, 23 aa, Staphylococcus aureus
SLIMLFILDWKMTLLTFITIPIF

SEQ ID NO: 1598423 - protein, 19 aa, Staphylococcus aureus
TMIILVIFSLAFYPAYNPK

SEQ ID NO: 1598424 - protein, 20 aa, Staphylococcus aureus
YYIFWLLAKRKYILVTFWTI

SEQ ID NO: 1598425 - protein, 24 aa, Staphylococcus aureus
ARPLFYFGNIMKPLIWLMNGSARV

SEQ ID NO: 1598426 - protein, 26 aa, Staphylococcus aureus
KILIILPLLFLIISAIVTFFVLSPKY

SEQ ID NO: 1598427 - protein, 17 aa, Staphylococcus aureus
LKMILIQIICVMMGLWI

SEQ ID NO: 1598428 - protein, 41 aa, Staphylococcus aureus
NYSDILKKFWMMYWPKLVILMGIIILIVILNAIFNNVNKND

SEQ ID NO: 1598429 - protein, 19 aa, Staphylococcus aureus
PKFLTLFAGPLFNFILALV

SEQ ID NO: 1598430 - protein, 19 aa, Staphylococcus aureus
VIYYFVFRFLIVKLKYKTP

SEQ ID NO: 1598431 - protein, 23 aa, Staphylococcus aureus
GSSLKPFLAYGPAIENMKWATNH

SEQ ID NO: 1598432 - protein, 27 aa, Staphylococcus aureus
IFVAIYFFLFRFLILKFDIPLPGRKKT

SEQ ID NO: 1598433 - protein, 23 aa, Staphylococcus aureus
LSLLILFFYLFSDGLRDAFDPKM

SEQ ID NO: 1598434 - protein, 27 aa, Staphylococcus aureus
ESNKDMTLPLMALLALSSIVAFVLPRK

SEQ ID NO: 1598435 - protein, 23 aa, Staphylococcus aureus
ISTLLLIVILVVFAVLLIVNETK

SEQ ID NO: 1598436 - protein, 23 aa, Staphylococcus aureus
IVWTVFVIIWFLLGIPVGPGGPI

SEQ ID NO: 1598437 - protein, 22 aa, Staphylococcus aureus
LDVFLLLFIMKYGFRKIEAIVG

SEQ ID NO: 1598438 - protein, 23 aa, Staphylococcus aureus
LEFATWHWLFYINIPIAIIAIIL

SEQ ID NO: 1598439 - protein, 32 aa, Staphylococcus aureus
NDITEMHWTLWKYLILTCLVVLICLYFASRSF

SEQ ID NO: 1598440 - protein, 17 aa, Staphylococcus aureus
SFFIMLLFPFLQQLSKL

SEQ ID NO: 1598441 - protein, 20 aa, Staphylococcus aureus
VETLKWARWLPHMTLRGQNI

SEQ ID NO: 1598442 - protein, 24 aa, Staphylococcus aureus
FMINVLPIVLVPLIVERKRIKQHP

SEQ ID NO: 1598443 - protein, 33 aa, Staphylococcus aureus
IAVIIVVALLILFSFVPIGLWISALAAGVHVGI

SEQ ID NO: 1598444 - protein, 20 aa, Staphylococcus aureus
LFNSLLYFLILLKPRKLNTI

SEQ ID NO: 1598445 - protein, 21 aa, Staphylococcus aureus
LLRTTFILLTLVGIGLTAFSF

SEQ ID NO: 1598446 - protein, 20 aa, Staphylococcus aureus
VKYIVWFIVITTILSKFGIS

SEQ ID NO: 1598447 - protein, 24 aa, Staphylococcus aureus
AKPPKFLVRFWTLASGTILGLALM

SEQ ID NO: 1598448 - protein, 17 aa, Staphylococcus aureus
IERLLLALILPLIILII

SEQ ID NO: 1598449 - protein, 17 aa, Staphylococcus aureus
IGAFILNLLFAFTIIFM

SEQ ID NO: 1598450 - protein, 17 aa, Staphylococcus aureus
IGIPLWVHRRCLKPMFT

SEQ ID NO: 1598451 - protein, 22 aa, Staphylococcus aureus
KKMTWILLYCFLGNILGGFVLF

SEQ ID NO: 1598452 - protein, 19 aa, Staphylococcus aureus
MFLCTLLVWLMTPGLSLFY

SEQ ID NO: 1598453 - protein, 31 aa, Staphylococcus aureus
NMHIPALFTNPWFQFILATPVQFIIGWQFYV

SEQ ID NO: 1598454 - protein, 22 aa, Staphylococcus aureus
SVSWLWFFLLAILGKMVGSIDK

SEQ ID NO: 1598455 - protein, 24 aa, Staphylococcus aureus
VLAFFLLMIVFRSILIPLKAVLGF

SEQ ID NO: 1598456 - protein, 17 aa, Staphylococcus aureus
AGLAILPSFYAWFNLWA

SEQ ID NO: 1598457 - protein, 17 aa, Staphylococcus aureus
AVFWMWITAFLGASSAF

SEQ ID NO: 1598458 - protein, 25 aa, Staphylococcus aureus
HTKLVIVYVLLIIIGMQIIGLYFTN

SEQ ID NO: 1598459 - protein, 25 aa, Staphylococcus aureus
KNNSRTLIFPYIPDKAVYNAIVKVV

SEQ ID NO: 1598460 - protein, 26 aa, Staphylococcus aureus
LANEKTRVRLYKSGKNWVKSGIKEIE

SEQ ID NO: 1598461 - protein, 17 aa, Staphylococcus aureus
LLICSIFINPLIQKIKQ

SEQ ID NO: 1598462 - protein, 20 aa, Staphylococcus aureus
PPFFFSVLLPIVFISAIIGI

SEQ ID NO: 1598463 - protein, 17 aa, Staphylococcus aureus
SPYLPFTYAIDSLRETV

SEQ ID NO: 1598464 - protein, 29 aa, Staphylococcus aureus
SSTIILMIFLIGIILLSIWTRSFIIGFLA

SEQ ID NO: 1598465 - protein, 30 aa, Staphylococcus aureus
VKRQNILFLCPFLPVISFAVIFINSQVGIL

SEQ ID NO: 1598466 - protein, 21 aa, Staphylococcus aureus
FFMALLTFIFIFYANHFMMSQ

SEQ ID NO: 1598467 - protein, 17 aa, Staphylococcus aureus
FTIILWGSAFPMIKIAL

SEQ ID NO: 1598468 - protein, 19 aa, Staphylococcus aureus
IGIVLYEMLVGEPPFNGET

SEQ ID NO: 1598469 - protein, 19 aa, Staphylococcus aureus
QPILFLILGLFIVAIYLVI

SEQ ID NO: 1598470 - protein, 22 aa, Staphylococcus aureus
TYLLYFLICLLLIGLLVIPESP

SEQ ID NO: 1598471 - protein, 21 aa, Staphylococcus aureus
VLRYYFWLTILIIAIIIGMIA

SEQ ID NO: 1598472 - protein, 17 aa, Staphylococcus aureus
WLTILIIAIIIGMIAWL

SEQ ID NO: 1598473 - protein, 20 aa, Staphylococcus aureus
FQLYVKLSCSTMMATSIILT

SEQ ID NO: 1598474 - protein, 33 aa, Staphylococcus aureus
IGAVLLVGLFGLLFFILVLRISYIMITGHSNGQ

SEQ ID NO: 1598475 - protein, 19 aa, Staphylococcus aureus
KLIYWNPWDTELSIQDADS

SEQ ID NO: 1598476 - protein, 23 aa, Staphylococcus aureus
KSALFFYYLFTKLSLISVLVLHL

SEQ ID NO: 1598477 - protein, 20 aa, Staphylococcus aureus
LYRFYFYRLFAIVTWILFIG

SEQ ID NO: 1598478 - protein, 28 aa, Staphylococcus aureus
NSIWAWLLVLVFLPLFGFILYLLLGRQI

SEQ ID NO: 1598479 - protein, 26 aa, Staphylococcus aureus
RRAMLFLRAMILHKLLLIANNTTIYY

SEQ ID NO: 1598480 - protein, 17 aa, Staphylococcus aureus
YVFAVKLRWFPVAGWEG

SEQ ID NO: 1598481 - protein, 38 aa, Staphylococcus aureus
DTGDSIKQNGLLGGVMTLLVGLGLMKRKKKKDENDQDD

SEQ ID NO: 1598482 - protein, 25 aa, Staphylococcus aureus
GIGGLSNAFGFKLDTYHNTSKPNSA

SEQ ID NO: 1598483 - protein, 26 aa, Staphylococcus aureus
HWSLNHKWIVIILSTLILVATIVFGG

SEQ ID NO: 1598484 - protein, 17 aa, Staphylococcus aureus
LSYLFTIILWGSAFPMI

SEQ ID NO: 1598485 - protein, 24 aa, Staphylococcus aureus
NFIKAIFEFILNFVIKPIMFAIWQ

SEQ ID NO: 1598486 - protein, 22 aa, Staphylococcus aureus
NGKYRFDNLDSGKYKVIFEKPA

SEQ ID NO: 1598487 - protein, 20 aa, Staphylococcus aureus
PLLMSILISVAFSLLMVTPI

SEQ ID NO: 1598488 - protein, 20 aa, Staphylococcus aureus
SVILALLVLMSVVLTYMVWN

SEQ ID NO: 1598489 - protein, 19 aa, Staphylococcus aureus
GPLLFLLTLLFFHPQDLPW

SEQ ID NO: 1598490 - protein, 34 aa, Staphylococcus aureus
KELLYVALRISLIKVLRPYYPFPLIVDDAFVHFD

SEQ ID NO: 1598491 - protein, 23 aa, Staphylococcus aureus
LERVGLIIILAYVLMNIPYFKNL

SEQ ID NO: 1598492 - protein, 21 aa, Staphylococcus aureus
NFIIPFLLIFIIDGFRGVKET

SEQ ID NO: 1598493 - protein, 23 aa, Staphylococcus aureus
NNMLFGIIFAVLTLVFVIGIIMS

SEQ ID NO: 1598494 - protein, 23 aa, Staphylococcus aureus
QDHQGYWFLRFRAALVPVANLGS

SEQ ID NO: 1598495 - protein, 28 aa, Staphylococcus aureus
RTFLAVLLMLLLFISISLVIASTYSIIR

SEQ ID NO: 1598496 - protein, 27 aa, Staphylococcus aureus
SNNATLFGGLFAALGSLLLFGRRKKQN

SEQ ID NO: 1598497 - protein, 23 aa, Staphylococcus aureus
TLLGWRWIFILSIIISLIALFLI

SEQ ID NO: 1598498 - protein, 19 aa, Staphylococcus aureus
VESPVLFVLITIFCSIIFN

SEQ ID NO: 1598499 - protein, 34 aa, Staphylococcus aureus
VKSGIKEIEMFKIMGLPFISHSLVSQDNQSISKK

SEQ ID NO: 1598500 - protein, 20 aa, Staphylococcus aureus
LILIVVVVGFGIYFYASKDK

SEQ ID NO: 1598501 - protein, 20 aa, Staphylococcus aureus
NSIVLKSILSLGIIYGGTFG

SEQ ID NO: 1598502 - protein, 30 aa, Staphylococcus aureus
STSTAPVKLRTFSRLAMSTFASAATTTAVT

SEQ ID NO: 1598503 - protein, 19 aa, Staphylococcus aureus
FLMIAALGLYFVAMNNLKA

SEQ ID NO: 1598504 - protein, 18 aa, Staphylococcus aureus
SEFVYNMPLLSEKPLFVY

SEQ ID NO: 1598505 - protein, 32 aa, Staphylococcus aureus
SKKGWFWGCGGCLVLFILIIIGISACTAGITG

SEQ ID NO: 1598506 - protein, 21 aa, Staphylococcus aureus
TLAQNKWLVGAIWALVTIVMI

SEQ ID NO: 1598507 - protein, 17 aa, Staphylococcus aureus
TVNMLHDQQAFAASDAP

SEQ ID NO: 1598508 - protein, 18 aa, Staphylococcus aureus
WLAILLYIEAFVSPFGTG

SEQ ID NO: 1598509 - protein, 35 aa, Staphylococcus aureus
KKSTRKIVLLSLIFSLLMIALVSFVAMAMFGNKYE

SEQ ID NO: 1598510 - protein, 22 aa, Staphylococcus aureus
VVVGLIFIFLIGAPISNIFEAL

SEQ ID NO: 1598511 - protein, 17 aa, Staphylococcus aureus
YFRFQYFNPLKSERYYR

SEQ ID NO: 1598512 - protein, 17 aa, Staphylococcus aureus
FVILFIVGKFIVTPYTI

SEQ ID NO: 1598513 - protein, 20 aa, Staphylococcus aureus
FWRILLFYILAIFVIGMLIP

SEQ ID NO: 1598514 - protein, 24 aa, Staphylococcus aureus
IKHVIVFIFMIFIAIVAIAVIAMS

SEQ ID NO: 1598515 - protein, 19 aa, Staphylococcus aureus
IYFVILMVLPLWAQHKVKS

SEQ ID NO: 1598516 - protein, 17 aa, Staphylococcus aureus
LERVGLIIILAYVLMNI

SEQ ID NO: 1598517 - protein, 23 aa, Staphylococcus aureus
LKKWYLIIYLLFILAALLITLTT

SEQ ID NO: 1598518 - protein, 24 aa, Staphylococcus aureus
NGGDGIGFAFSPGVLGETGLNGAA

SEQ ID NO: 1598519 - protein, 21 aa, Staphylococcus aureus
RVGLIIILAYVLMNIPYFKNL

SEQ ID NO: 1598520 - protein, 24 aa, Staphylococcus aureus
TLLGWRWIFILSIIISLIALFLIK

SEQ ID NO: 1598521 - protein, 20 aa, Staphylococcus aureus
YYFQTVLNNASFWKEYKFYN

SEQ ID NO: 1598522 - protein, 18 aa, Staphylococcus aureus
FAAGIVLATILLISAHLY

SEQ ID NO: 1598523 - protein, 17 aa, Staphylococcus aureus
IFRIFFILFIIAPGINY

SEQ ID NO: 1598524 - protein, 20 aa, Staphylococcus aureus
KFAIFLMVVLVVLGGVYASA

SEQ ID NO: 1598525 - protein, 19 aa, Staphylococcus aureus
LVGAIWALVTIVMIAVITA

SEQ ID NO: 1598526 - protein, 22 aa, Staphylococcus aureus
NNMLFGIIFAVLTLVFVIGIIM

SEQ ID NO: 1598527 - protein, 18 aa, Staphylococcus aureus
PLLFLLTLLFFHPQDLPW

SEQ ID NO: 1598528 - protein, 18 aa, Staphylococcus aureus
YVFAVKLRWFPVAGWEGF

SEQ ID NO: 1598529 - protein, 18 aa, Staphylococcus aureus
ESPVLFVLITIFCSIIFN

SEQ ID NO: 1598530 - protein, 19 aa, Staphylococcus aureus
FAIFLMVVLVVLGGVYASA

SEQ ID NO: 1598531 - protein, 34 aa, Staphylococcus aureus
KKSTRKIVLLSLIFSLLMIALVSFVAMAMFGNKY

SEQ ID NO: 1598532 - protein, 20 aa, Staphylococcus aureus
MFLMIAALGLYFVAMNNLKA

SEQ ID NO: 1598533 - protein, 21 aa, Staphylococcus aureus
SSWTLYYWGWWLSWSPFVGVF

SEQ ID NO: 1598534 - protein, 21 aa, Staphylococcus aureus
TYLLYFLICLLLIGLLVIPES

SEQ ID NO: 1598535 - protein, 24 aa, Staphylococcus aureus
VGIALLTFIVWITLVTPGTFEPAL

SEQ ID NO: 1598536 - protein, 18 aa, Staphylococcus aureus
VVVGLIFIFLIGAPISNI

SEQ ID NO: 1598537 - protein, 33 aa, Staphylococcus aureus
YNGDTKVMTVKYAGQTWTRNISDWIAKSGTTNF

SEQ ID NO: 1598538 - protein, 25 aa, Staphylococcus aureus
AIVCSMMVVFSIMLFLFVKRNKKKN

SEQ ID NO: 1598539 - protein, 23 aa, Staphylococcus aureus
ANAMLFFLIPFFASAIFNTQFTL

SEQ ID NO: 1598540 - protein, 22 aa, Staphylococcus aureus
FFMALLTFIFIFYANHFMMSQR

SEQ ID NO: 1598541 - protein, 19 aa, Staphylococcus aureus
FLSWLTLCLCIAIALILYA

SEQ ID NO: 1598542 - protein, 22 aa, Staphylococcus aureus
KKWYLIIYLLFILAALLITLTT

SEQ ID NO: 1598543 - protein, 28 aa, Staphylococcus aureus
KSRMNWIFWILFLNLLMLGISLIDYDFP

SEQ ID NO: 1598544 - protein, 17 aa, Staphylococcus aureus
LAILLYIEAFVSPFGTG

SEQ ID NO: 1598545 - protein, 24 aa, Staphylococcus aureus
LTASIAALLLVSGLFLAFRRRSTN

SEQ ID NO: 1598546 - protein, 33 aa, Staphylococcus aureus
MLKGCGGCLISFILLIILLSACSMMFSNNDNST

SEQ ID NO: 1598547 - protein, 19 aa, Staphylococcus aureus
PLSLIFYLKSLLLILIYEI

SEQ ID NO: 1598548 - protein, 27 aa, Staphylococcus aureus
SIWAWLLVLVFLPLFGFILYLLLGRQI

SEQ ID NO: 1598549 - protein, 24 aa, Staphylococcus aureus
SSTIILMIFLIGIILLSIWTRSYI

SEQ ID NO: 1598550 - protein, 20 aa, Staphylococcus aureus
YFGPLFFYLNLIANIFFAFL

SEQ ID NO: 1598551 - protein, 29 aa, Staphylococcus aureus
EPHAGQRVVLKYKLKFADGLKRGDYFDFT

SEQ ID NO: 1598552 - protein, 22 aa, Staphylococcus aureus
FNDWIFIIFIISVYYIFWLLAK

SEQ ID NO: 1598553 - protein, 32 aa, Staphylococcus aureus
FNMHIPALFTNPWFQFILATPVQFIIGWQFYV

SEQ ID NO: 1598554 - protein, 19 aa, Staphylococcus aureus
HFSWYYLLLVLVILFVCVY

SEQ ID NO: 1598555 - protein, 17 aa, Staphylococcus aureus
IGNISLRYYPFSKWTIQ

SEQ ID NO: 1598556 - protein, 23 aa, Staphylococcus aureus
KFNDWIFIIFIISVYYIFWLLAK

SEQ ID NO: 1598557 - protein, 20 aa, Staphylococcus aureus
LQPILFLILGLFIVAIYLVI

SEQ ID NO: 1598558 - protein, 17 aa, Staphylococcus aureus
LVLFIGLAYYQGTPTST

SEQ ID NO: 1598559 - protein, 17 aa, Staphylococcus aureus
SAPFVILFFILEQFARA

SEQ ID NO: 1598560 - protein, 20 aa, Staphylococcus aureus
SIGIVLYEMLVGEPPFNGET

SEQ ID NO: 1598561 - protein, 26 aa, Staphylococcus aureus
SNNATLFGGLFAALGSLLLFGRRKKQ

SEQ ID NO: 1598562 - protein, 26 aa, Staphylococcus aureus
TGALVGSALGLYFKNKVYQKADDLKV

SEQ ID NO: 1598563 - protein, 18 aa, Staphylococcus aureus
TLLICSIFINPLIQKIKQ

SEQ ID NO: 1598564 - protein, 24 aa, Staphylococcus aureus
TQKGLIFSSIIGIAGLMLLARRRK

SEQ ID NO: 1598565 - protein, 22 aa, Staphylococcus aureus
TVTKLVVFILLTFGFYVFFAGH

SEQ ID NO: 1598566 - protein, 21 aa, Staphylococcus aureus
VFWRILLFYILAIFVIGMLIP

SEQ ID NO: 1598567 - protein, 25 aa, Staphylococcus aureus
VVLAFFLLMIVFRSILIPLKAVLGF

SEQ ID NO: 1598568 - protein, 18 aa, Staphylococcus aureus
AVFWMWITAFLGASSAFI

SEQ ID NO: 1598569 - protein, 33 aa, Staphylococcus aureus
IAVIIIVALLILFSFVPIGLWISALAAGVHVGI

SEQ ID NO: 1598570 - protein, 31 aa, Staphylococcus aureus
IDSFFNYLFGYSRYLTYILVLLATGFITYSK

SEQ ID NO: 1598571 - protein, 38 aa, Staphylococcus aureus
IVILIVFALLFRFIVRLIPIFYIFRVLSIFIFIMGFKM

SEQ ID NO: 1598572 - protein, 23 aa, Staphylococcus aureus
KSSLFFYYLFTKLSLISVLVLHL

SEQ ID NO: 1598573 - protein, 17 aa, Staphylococcus aureus
LDVFLLLFIMKYGFRKI

SEQ ID NO: 1598574 - protein, 20 aa, Staphylococcus aureus
LYRFYFYRLFAIVTWVLFIG

SEQ ID NO: 1598575 - protein, 18 aa, Staphylococcus aureus
MFLCTLLVWLMTPGLSLF

SEQ ID NO: 1598576 - protein, 23 aa, Staphylococcus aureus
MLNYKVWYLTLLAGLIPFIPIKF

SEQ ID NO: 1598577 - protein, 41 aa, Staphylococcus aureus
NEPLPNRKDFVVSFITGALVGSALGLYFKNKVYQKADDLKV

SEQ ID NO: 1598578 - protein, 27 aa, Staphylococcus aureus
PLPNRKDFVVSFITGALVGSALGLYFK

SEQ ID NO: 1598579 - protein, 19 aa, Staphylococcus aureus
SVILALLVLMSVVLTYMVW

SEQ ID NO: 1598580 - protein, 23 aa, Staphylococcus aureus
TASIAALLLVSGLFLAFRQRSTN

SEQ ID NO: 1598581 - protein, 35 aa, Staphylococcus aureus
TKELLYVALRISLIKVLRPYYPFPLIVDDAFVHFD

SEQ ID NO: 1598582 - protein, 17 aa, Staphylococcus aureus
TLVTVILFCAVLIGYQI

SEQ ID NO: 1598583 - protein, 20 aa, Staphylococcus aureus
VFLLLFIMKYGFRKIEAIVG

SEQ ID NO: 1598584 - protein, 33 aa, Staphylococcus aureus
AIGVVGISGLLASFWFFIAKRRRKEDEEEELEI

SEQ ID NO: 1598585 - protein, 26 aa, Staphylococcus aureus
AIKHVIVFIFMIFIAIVAIAVIAMSL

SEQ ID NO: 1598586 - protein, 18 aa, Staphylococcus aureus
FIPLFFLYKYHQPMFGRL

SEQ ID NO: 1598587 - protein, 18 aa, Staphylococcus aureus
HFSWYYLLLVLVILFVCV

SEQ ID NO: 1598588 - protein, 26 aa, Staphylococcus aureus
IFVAIYFFLFRFLILKFDIPLPGRKK

SEQ ID NO: 1598589 - protein, 29 aa, Staphylococcus aureus
ILKGTVQLIWNLIQLWFVGKILGVVRYFG

SEQ ID NO: 1598590 - protein, 24 aa, Staphylococcus aureus
ISKKMTGYGLKTTAVIGGAFTVNM

SEQ ID NO: 1598591 - protein, 21 aa, Staphylococcus aureus
KLILIFICIFTFLLMVIQSQF

SEQ ID NO: 1598592 - protein, 23 aa, Staphylococcus aureus
KPPKFLVRFWTLASGTILGLALM

SEQ ID NO: 1598593 - protein, 29 aa, Staphylococcus aureus
KRHNILFLCPFLPVISFAVIFINSQVGIL

SEQ ID NO: 1598594 - protein, 21 aa, Staphylococcus aureus
LCFLILPILLLTSVSAYAVSN

SEQ ID NO: 1598595 - protein, 30 aa, Staphylococcus aureus
NSSKRVHLKRWQFISILIGTTLITAVITVV

SEQ ID NO: 1598596 - protein, 31 aa, Staphylococcus aureus
PERAYKSYYVYGGYRLTWDNGLVLYSNKADG

SEQ ID NO: 1598597 - protein, 31 aa, Staphylococcus aureus
SEFRTFLAVLLMLLLFISISLVIASTYSIIR

SEQ ID NO: 1598598 - protein, 29 aa, Staphylococcus aureus
SIGTPGIAIIPFSLSIYALSKLILVNKFV

SEQ ID NO: 1598599 - protein, 20 aa, Staphylococcus aureus
SSWTLYYWGWWLSWSPFVGV

SEQ ID NO: 1598600 - protein, 23 aa, Staphylococcus aureus
SVWLVLLFSAMGLWQVSSAAEQH

SEQ ID NO: 1598601 - protein, 29 aa, Staphylococcus aureus
ESNTAIMALFIGLILLVVSLVTRFIKLNS

SEQ ID NO: 1598602 - protein, 20 aa, Staphylococcus aureus
FLLTVIVIGLIWLIKDKRQS

SEQ ID NO: 1598603 - protein, 25 aa, Staphylococcus aureus
FMINVLPIVLVPLIVERKRIKQHPD

SEQ ID NO: 1598604 - protein, 17 aa, Staphylococcus aureus
FVFLILIFFLVFTAQKL

SEQ ID NO: 1598605 - protein, 18 aa, Staphylococcus aureus
FYILLIIHYFIICYFVFS

SEQ ID NO: 1598606 - protein, 30 aa, Staphylococcus aureus
IDSFFNYLFGYSRYLTYILVLLATGFITYS

SEQ ID NO: 1598607 - protein, 25 aa, Staphylococcus aureus
ILEFATWHWLFYINIPIAIIAIILV

SEQ ID NO: 1598608 - protein, 34 aa, Staphylococcus aureus
IVFAVLFRFIVRLIPIFYIFRVLSIFIFIMGFKM

SEQ ID NO: 1598609 - protein, 23 aa, Staphylococcus aureus
KNKWPFLIALPFMIGYGIGITIY

SEQ ID NO: 1598610 - protein, 23 aa, Staphylococcus aureus
LSLTLIFLILTFFKEVKLYRHFE

SEQ ID NO: 1598611 - protein, 17 aa, Staphylococcus aureus
LVLWLYFRKAIPKSFDA

SEQ ID NO: 1598612 - protein, 17 aa, Staphylococcus aureus
NISPYLPFTYAIDSLRE

SEQ ID NO: 1598613 - protein, 34 aa, Staphylococcus aureus
NRRKMIVICFYSLLAILLILLLASFIKATRANND

SEQ ID NO: 1598614 - protein, 19 aa, Staphylococcus aureus
PAFKLPLYPVLPAITFVLV

SEQ ID NO: 1598615 - protein, 17 aa, Staphylococcus aureus
PIFFILMFFSMQLVTLP

SEQ ID NO: 1598616 - protein, 17 aa, Staphylococcus aureus
PYVFILIDNFDAVKDSP

SEQ ID NO: 1598617 - protein, 21 aa, Staphylococcus aureus
QNKYSIRRFTVGTTSVIVGAT

SEQ ID NO: 1598618 - protein, 21 aa, Staphylococcus aureus
QWVLWTILVTSFFSIGTPGIA

SEQ ID NO: 1598619 - protein, 32 aa, Staphylococcus aureus
SKKGWFWGCGGCLVLFILIIIGISACTAGVTG

SEQ ID NO: 1598620 - protein, 29 aa, Staphylococcus aureus
SSKRVHLKRWQFISILIGTIIITAVITVV

SEQ ID NO: 1598621 - protein, 18 aa, Staphylococcus aureus
VAKTPAVWIILAGLAILP

SEQ ID NO: 1598622 - protein, 23 aa, Staphylococcus aureus
VGSYFLFFIIVAFLLYANVLFLK

SEQ ID NO: 1598623 - protein, 20 aa, Staphylococcus aureus
VIYYFVFRFLIVKLKYKTPG

SEQ ID NO: 1598624 - protein, 26 aa, Staphylococcus aureus
VVGIALLIFIVWITLVTPGTFEPALV

SEQ ID NO: 1598625 - protein, 21 aa, Staphylococcus aureus
WTVFVIIWFLLGIPVGPGGPI

SEQ ID NO: 1598626 - protein, 29 aa, Staphylococcus aureus
YIHLYDYIPRLFWPIYYFIQAPMQKMMIH

SEQ ID NO: 1598627 - protein, 27 aa, Staphylococcus aureus
YRRAMLFLRAMILHKLLLIANNTTIYY

SEQ ID NO: 1598628 - protein, 23 aa, Staphylococcus aureus
ALNIILGLIKFFSSLFTGDWRGV

SEQ ID NO: 1598629 - protein, 17 aa, Staphylococcus aureus
APIATMIILVIFSLAFY

SEQ ID NO: 1598630 - protein, 20 aa, Staphylococcus aureus
ATMIILVIFSLAFYPAYNPK

SEQ ID NO: 1598631 - protein, 22 aa, Staphylococcus aureus
DNAPALYPNYWGGNKYKVIEEL

SEQ ID NO: 1598632 - protein, 25 aa, Staphylococcus aureus
ESSAIILLMFFIGIIVLSIWTQSYL

SEQ ID NO: 1598633 - protein, 20 aa, Staphylococcus aureus
FQLYVKLSCSTMMASSIILT

SEQ ID NO: 1598634 - protein, 21 aa, Staphylococcus aureus
FSSVLIIFIILLSGLTFLPDL

SEQ ID NO: 1598635 - protein, 18 aa, Staphylococcus aureus
GLIFIFLIGAPISNIFEA

SEQ ID NO: 1598636 - protein, 25 aa, Staphylococcus aureus
IFIISFSFYLLNQPNNWAWSSLNIC

SEQ ID NO: 1598637 - protein, 29 aa, Staphylococcus aureus
ILKGVVQLIWNLIQLWFVGKILGVVRYFG

SEQ ID NO: 1598638 - protein, 20 aa, Staphylococcus aureus
ITEQDILAHINLIDQLSAEV

SEQ ID NO: 1598639 - protein, 23 aa, Staphylococcus aureus
LIFNALIIVLLIPIAMKGVKFKG

SEQ ID NO: 1598640 - protein, 21 aa, Staphylococcus aureus
LLRTTFILLTLVGIGLTVFSF

SEQ ID NO: 1598641 - protein, 19 aa, Staphylococcus aureus
LRSLPFIILLIAIVPFTKL

SEQ ID NO: 1598642 - protein, 31 aa, Staphylococcus aureus
NDITEMHWTLWKYLILTCLVVLICLYFASRS

SEQ ID NO: 1598643 - protein, 20 aa, Staphylococcus aureus
QAIFFKKMIYFWLSEGQLIL

SEQ ID NO: 1598644 - protein, 17 aa, Staphylococcus aureus
RAFLIMCLIGFGVGILA

SEQ ID NO: 1598645 - protein, 23 aa, Staphylococcus aureus
SILNVFVFNYFFTVPRFTLEMYR

SEQ ID NO: 1598646 - protein, 23 aa, Staphylococcus aureus
SRLYVFSIFIILLLTLVFANFSE

SEQ ID NO: 1598647 - protein, 25 aa, Staphylococcus aureus
SVLKYYFWITILIIAIIVGAIAWLF

SEQ ID NO: 1598648 - protein, 19 aa, Staphylococcus aureus
VETLKWARWLPHMTLRGQN

SEQ ID NO: 1598649 - protein, 18 aa, Staphylococcus aureus
VIIILILILGGIFLKMKY

SEQ ID NO: 1598650 - protein, 21 aa, Staphylococcus aureus
VLIMVLIGFIFWRQDDYTSRD

SEQ ID NO: 1598651 - protein, 26 aa, Staphylococcus aureus
AIVCSMMVVFSIMLFLFVKRNKKKNK

SEQ ID NO: 1598652 - protein, 17 aa, Staphylococcus aureus
ELKNLLLYGIFDESIFL

SEQ ID NO: 1598653 - protein, 32 aa, Staphylococcus aureus
GAVLLVGLFGLLFFILVLRISYIMITGHSNGQ

SEQ ID NO: 1598654 - protein, 17 aa, Staphylococcus aureus
ILRILFYFSPILWLPKN

SEQ ID NO: 1598655 - protein, 20 aa, Staphylococcus aureus
KLYYLSYWYFITFGAFVAFG

SEQ ID NO: 1598656 - protein, 18 aa, Staphylococcus aureus
KTTAVIGGAFTVNMLHDQ

SEQ ID NO: 1598657 - protein, 24 aa, Staphylococcus aureus
MKNKWPFLIALPFMIGYGIGVTFY

SEQ ID NO: 1598658 - protein, 20 aa, Staphylococcus aureus
NFIIPFLLIFIIDGFRGVKE

SEQ ID NO: 1598659 - protein, 26 aa, Staphylococcus aureus
QVGSYFLFFIIIAFLLYANVLFIKRR

SEQ ID NO: 1598660 - protein, 17 aa, Staphylococcus aureus
RFDNLDSGKYKVIFEKP

SEQ ID NO: 1598661 - protein, 18 aa, Staphylococcus aureus
TVLVDYEKYGKFYNLSIK

SEQ ID NO: 1598662 - protein, 27 aa, Staphylococcus aureus
VGISGLLASFWFFIAKRRRKEDEEEEL

SEQ ID NO: 1598663 - protein, 24 aa, Staphylococcus aureus
VNTSAPRMRAFSLAAVAADAPAAG

SEQ ID NO: 1598664 - protein, 20 aa, Staphylococcus aureus
DHKSLIYRYDATLGTQITTN

SEQ ID NO: 1598665 - protein, 21 aa, Staphylococcus aureus
FLFVAPLLFFIHAVLDGLSFL

SEQ ID NO: 1598666 - protein, 18 aa, Staphylococcus aureus
FNFWLYVILYWFIPLLTT

SEQ ID NO: 1598667 - protein, 19 aa, Staphylococcus aureus
FYFIWLRFEWPQYLIYILF

SEQ ID NO: 1598668 - protein, 18 aa, Staphylococcus aureus
IPIWFILLAFMYLRYKRI

SEQ ID NO: 1598669 - protein, 18 aa, Staphylococcus aureus
IQIICVMMGLWIYQLDKH

SEQ ID NO: 1598670 - protein, 17 aa, Staphylococcus aureus
KDEDVPLLLAKKKNQKD

SEQ ID NO: 1598671 - protein, 21 aa, Staphylococcus aureus
KDFLAQWKLYIISAVVLIMVL

SEQ ID NO: 1598672 - protein, 21 aa, Staphylococcus aureus
KFSIRKYTVGTFSTVIATLVF

SEQ ID NO: 1598673 - protein, 22 aa, Staphylococcus aureus
KNDLKEIPLLVTKKNDVSETVN

SEQ ID NO: 1598674 - protein, 17 aa, Staphylococcus aureus
LIMVLIGFIFWRQDDYT

SEQ ID NO: 1598675 - protein, 25 aa, Staphylococcus aureus
LLPGDYFGTIRFGRKEQLFEIRVKP

SEQ ID NO: 1598676 - protein, 26 aa, Staphylococcus aureus
MINYHSKFDILSWLQDPFATPTLGKR

SEQ ID NO: 1598677 - protein, 17 aa, Staphylococcus aureus
PIWFILLAFMYLRYKRI

SEQ ID NO: 1598678 - protein, 19 aa, Staphylococcus aureus
PPFFFSVLLPIVFISAIIG

SEQ ID NO: 1598679 - protein, 17 aa, Staphylococcus aureus
SHWLRFVWPVVAFVLIF

SEQ ID NO: 1598680 - protein, 24 aa, Staphylococcus aureus
SLDKVKHTPFFLPKRRRKEDEEDV

SEQ ID NO: 1598681 - protein, 23 aa, Staphylococcus aureus
SVWLVLLFSVMGLWQVSNAAEQY

SEQ ID NO: 1598682 - protein, 23 aa, Staphylococcus aureus
TDKYGYYNYAGYSNFIVTSNDTG

SEQ ID NO: 1598683 - protein, 22 aa, Staphylococcus aureus
TIFIIIFLYFKIRLYSVFLVMV

SEQ ID NO: 1598684 - protein, 17 aa, Staphylococcus aureus
VITIFIIIFLYFKIRLY

SEQ ID NO: 1598685 - protein, 23 aa, Staphylococcus aureus
AIPFIILILLLIPFTSLILGTIS

SEQ ID NO: 1598686 - protein, 19 aa, Staphylococcus aureus
AIQSINQALANKLKEIEAS

SEQ ID NO: 1598687 - protein, 19 aa, Staphylococcus aureus
ALMLKWWLILAISIIVLII

SEQ ID NO: 1598688 - protein, 17 aa, Staphylococcus aureus
EFRTFLAVLLMLLLFIS

SEQ ID NO: 1598689 - protein, 25 aa, Staphylococcus aureus
FCFIFLLLLFFRYILKRYFNYMLNY

SEQ ID NO: 1598690 - protein, 23 aa, Staphylococcus aureus
FDRIIDYLILLILICSGLSYSKA

SEQ ID NO: 1598691 - protein, 18 aa, Staphylococcus aureus
FIGAFILNLLFAFTIIFM

SEQ ID NO: 1598692 - protein, 17 aa, Staphylococcus aureus
FLFIIIVIFLMYANHLF

SEQ ID NO: 1598693 - protein, 28 aa, Staphylococcus aureus
FSTFALFLFLFLVFSWIVSFIPGFELSV

SEQ ID NO: 1598694 - protein, 26 aa, Staphylococcus aureus
HWSLNHKWIVIILSTLILVTTIVFGG

SEQ ID NO: 1598695 - protein, 21 aa, Staphylococcus aureus
KDFLTQWKLYIISAVVLIMVL

SEQ ID NO: 1598696 - protein, 24 aa, Staphylococcus aureus
LDDTKHLPLLFAKRRRKEDEEDVT

SEQ ID NO: 1598697 - protein, 27 aa, Staphylococcus aureus
LKILIILPLLFLIISAIVTFFVLSPKY

SEQ ID NO: 1598698 - protein, 41 aa, Staphylococcus aureus
LNFRTHLSGYHKYYPYYPYYPYYPVQLTWNNGVAFYSNNAK

SEQ ID NO: 1598699 - protein, 21 aa, Staphylococcus aureus
NPLLMSILISVAFSLLMVTPI

SEQ ID NO: 1598700 - protein, 18 aa, Staphylococcus aureus
SAPFVILFFILEQFARAI

SEQ ID NO: 1598701 - protein, 18 aa, Staphylococcus aureus
SEFRTFLAVLLMLLLFIS

SEQ ID NO: 1598702 - protein, 30 aa, Staphylococcus aureus
STSTAPIKLRTFSRLAMSTFASAATTSAVT

SEQ ID NO: 1598703 - protein, 24 aa, Staphylococcus aureus
TGDLALRSTFYGYDSNFIWRSMSW

SEQ ID NO: 1598704 - protein, 25 aa, Staphylococcus aureus
TNKGMLFGGLFSILGLVLLRRNKKN

SEQ ID NO: 1598705 - protein, 17 aa, Staphylococcus aureus
VAKTPAVWIILAGLAIL

SEQ ID NO: 1598706 - protein, 20 aa, Staphylococcus aureus
VFVNPKQRVLGNTWVYIKGY

SEQ ID NO: 1598707 - protein, 18 aa, Staphylococcus aureus
YNGHTFATSLPAKFVVKD

SEQ ID NO: 1598708 - protein, 18 aa, Staphylococcus aureus
ASITAYNNSIRALQSDLT

SEQ ID NO: 1598709 - protein, 17 aa, Staphylococcus aureus
FLIMCLIGFGVGILANA

SEQ ID NO: 1598710 - protein, 26 aa, Staphylococcus aureus
FSTVIATLVFLGFNTSQAHAAETNQP

SEQ ID NO: 1598711 - protein, 17 aa, Staphylococcus aureus
IISIAVAFVILFIVGKF

SEQ ID NO: 1598712 - protein, 17 aa, Staphylococcus aureus
ISFLIIGLYMFIEIIGG

SEQ ID NO: 1598713 - protein, 18 aa, Staphylococcus aureus
IVAIVCLLSFLSTYCSHS

SEQ ID NO: 1598714 - protein, 17 aa, Staphylococcus aureus
KTIYYWIRYLNFDIVSR

SEQ ID NO: 1598715 - protein, 19 aa, Staphylococcus aureus
LFVLITIFCSIIFNSIVYT

SEQ ID NO: 1598716 - protein, 19 aa, Staphylococcus aureus
LFYLGFLVLFLFAALTSSI

SEQ ID NO: 1598717 - protein, 19 aa, Staphylococcus aureus
LLCLFYMIKAFRQIDVIKS

SEQ ID NO: 1598718 - protein, 19 aa, Staphylococcus aureus
LYIIVMVVSVFIIGCNKSS

SEQ ID NO: 1598719 - protein, 19 aa, Staphylococcus aureus
NLDLFILRLVLLSCLFILT

SEQ ID NO: 1598720 - protein, 25 aa, Staphylococcus aureus
NQLYVVFKMIFWFNPALYISKTMMD

SEQ ID NO: 1598721 - protein, 17 aa, Staphylococcus aureus
PVNISGIPLDPSALVYL

SEQ ID NO: 1598722 - protein, 29 aa, Staphylococcus aureus
SNLANMNFLRWVNFPQDYTVTWTNAKIAN

SEQ ID NO: 1598723 - protein, 23 aa, Staphylococcus aureus
VGIALLTFIVWITLVTPGTFEPA

SEQ ID NO: 1598724 - protein, 22 aa, Staphylococcus aureus
YGYDSNFIWRSMSWDNEVAFNN

SEQ ID NO: 1598725 - protein, 20 aa, Staphylococcus aureus
YYFQAVLNNASFWKEYKFYN

SEQ ID NO: 1598726 - protein, 22 aa, Staphylococcus aureus
ALEYNQLFMYSQLYVESTQDHQ

SEQ ID NO: 1598727 - protein, 24 aa, Staphylococcus aureus
AVVIALIFFVLFLVALGSKKKVKR

SEQ ID NO: 1598728 - protein, 20 aa, Staphylococcus aureus
FLLTVMVIGLIWLIKDKRQS

SEQ ID NO: 1598729 - protein, 22 aa, Staphylococcus aureus
GDTFTFKYGQYFRPGSVRLPSQ

SEQ ID NO: 1598730 - protein, 17 aa, Staphylococcus aureus
GIKGVYVILKDSNGKEL

SEQ ID NO: 1598731 - protein, 17 aa, Staphylococcus aureus
HFSWYYLLLVLVILFVC

SEQ ID NO: 1598732 - protein, 17 aa, Staphylococcus aureus
IAALGLLAPWVAGAAMA

SEQ ID NO: 1598733 - protein, 17 aa, Staphylococcus aureus
IFLVYRIYILFIDYKSV

SEQ ID NO: 1598734 - protein, 19 aa, Staphylococcus aureus
ILIIILIIAILMMFAYMSH

SEQ ID NO: 1598735 - protein, 17 aa, Staphylococcus aureus
ISYLLFLLSGLANGLIN

SEQ ID NO: 1598736 - protein, 24 aa, Staphylococcus aureus
IVCSMMVVFSIMLFLFVKRNKKKN

SEQ ID NO: 1598737 - protein, 21 aa, Staphylococcus aureus
KFEKVLYITLITVIAMLSIYM

SEQ ID NO: 1598738 - protein, 43 aa, Staphylococcus aureus
KQTGDGYQWVIKFNKGHAPHQNMIFWFALPADQVPVGRTDFVT

SEQ ID NO: 1598739 - protein, 19 aa, Staphylococcus aureus
LFNSLLYFLILLKPRKLNT

SEQ ID NO: 1598740 - protein, 17 aa, Staphylococcus aureus
LTLLFLIFLILSATGII

SEQ ID NO: 1598741 - protein, 19 aa, Staphylococcus aureus
MTIWNAIWTFLQTLWNTIV

SEQ ID NO: 1598742 - protein, 21 aa, Staphylococcus aureus
NGKYRFDNLDSGKYKVIFEKP

SEQ ID NO: 1598743 - protein, 17 aa, Staphylococcus aureus
NLWTYVMLIFMTLAAIL

SEQ ID NO: 1598744 - protein, 26 aa, Staphylococcus aureus
PMYNGYIFKLVVFVSALLTSHGYIEI

SEQ ID NO: 1598745 - protein, 26 aa, Staphylococcus aureus
SDAVYKAQLYLTPYGPKQYVEHLNQN

SEQ ID NO: 1598746 - protein, 20 aa, Staphylococcus aureus
SITVILFSALISFVLTNVYY

SEQ ID NO: 1598747 - protein, 22 aa, Staphylococcus aureus
SLLILFFYLFSDGLRDAFDPKM

SEQ ID NO: 1598748 - protein, 29 aa, Staphylococcus aureus
SSKRVHLKRWQFISILIGTILITAVITVV

SEQ ID NO: 1598749 - protein, 19 aa, Staphylococcus aureus
SSWTLYYWGWWLSWSPFVG

SEQ ID NO: 1598750 - protein, 25 aa, Staphylococcus aureus
VGSYFLFFIIIAFLLYANVLFIKRR

SEQ ID NO: 1598751 - protein, 18 aa, Staphylococcus aureus
ARISAVQIVISDRAKQSS

SEQ ID NO: 1598752 - protein, 17 aa, Staphylococcus aureus
DLFILRLVLLSCLFILT

SEQ ID NO: 1598753 - protein, 18 aa, Staphylococcus aureus
FYPVFMSIYWIVGSIYFY

SEQ ID NO: 1598754 - protein, 18 aa, Staphylococcus aureus
GIIALFFYIFRFNVLTYK

SEQ ID NO: 1598755 - protein, 21 aa, Staphylococcus aureus
GTTVYPHQAGYVKLNYGFSVP

SEQ ID NO: 1598756 - protein, 28 aa, Staphylococcus aureus
IDSFFNYLFGYSRYLTYILVLLATGFIT

SEQ ID NO: 1598757 - protein, 17 aa, Staphylococcus aureus
IGIYILMMIGMSTVTIV

SEQ ID NO: 1598758 - protein, 17 aa, Staphylococcus aureus
ILTVLVIIGFVLNMFIK

SEQ ID NO: 1598759 - protein, 17 aa, Staphylococcus aureus
IVLLFLTFPIMFIFAIA

SEQ ID NO: 1598760 - protein, 27 aa, Staphylococcus aureus
KIIALLLVIPGWLTLWIAILSDMGATI

SEQ ID NO: 1598761 - protein, 17 aa, Staphylococcus aureus
KNIKLLLILPAICLVVS

SEQ ID NO: 1598762 - protein, 19 aa, Staphylococcus aureus
LDPSALVYLVAPTNQTTNG

SEQ ID NO: 1598763 - protein, 22 aa, Staphylococcus aureus
LFGLMFYLYHLPLEAYLLALGV

SEQ ID NO: 1598764 - protein, 17 aa, Staphylococcus aureus
LVLWLYFRKSIPKTFDT

SEQ ID NO: 1598765 - protein, 18 aa, Staphylococcus aureus
LYVVFKMIFWFNPALYIS

SEQ ID NO: 1598766 - protein, 19 aa, Staphylococcus aureus
NGKYRFDNLDSGKYKVIFE

SEQ ID NO: 1598767 - protein, 17 aa, Staphylococcus aureus
NNGSYSLNFDKLDKTYV

SEQ ID NO: 1598768 - protein, 41 aa, Staphylococcus aureus
NYSAILKKFWMMYWPKLVILMGIIILIVILNAIFNNVNKND

SEQ ID NO: 1598769 - protein, 24 aa, Staphylococcus aureus
PIASYLHLILPIAMLIALTVCLIP

SEQ ID NO: 1598770 - protein, 25 aa, Staphylococcus aureus
SNITYMILLIWVFGSLLCLFYMIKA

SEQ ID NO: 1598771 - protein, 20 aa, Staphylococcus aureus
SVSWLWFFLLAILGKMVGSI

SEQ ID NO: 1598772 - protein, 17 aa, Staphylococcus aureus
YGQYFRPGSVRLPSQTQ

SEQ ID NO: 1598773 - protein, 17 aa, Staphylococcus aureus
YISLFISLFILYNEFRS

SEQ ID NO: 1598774 - protein, 17 aa, Staphylococcus aureus
YVILYWFIPLLTTFQII

SEQ ID NO: 1598775 - protein, 39 aa, Staphylococcus aureus
AIVILIIFALLFRFIVKLIPIFYIFRVLSIFIFIMGFKM

SEQ ID NO: 1598776 - protein, 23 aa, Staphylococcus aureus
ANAILFFLIPFFASAIFNTQFTL

SEQ ID NO: 1598777 - protein, 17 aa, Staphylococcus aureus
FYILLIIHYFIICYFVF

SEQ ID NO: 1598778 - protein, 19 aa, Staphylococcus aureus
GVLAFIFLVYRIYILFIDY

SEQ ID NO: 1598779 - protein, 28 aa, Staphylococcus aureus
IILCVVAFFTFPVIVMFLLAPDSNKDKD

SEQ ID NO: 1598780 - protein, 17 aa, Staphylococcus aureus
IIPPKTYSGNVDQVVTI

SEQ ID NO: 1598781 - protein, 23 aa, Staphylococcus aureus
ISILWVYIVLLYLGYLFITANFL

SEQ ID NO: 1598782 - protein, 21 aa, Staphylococcus aureus
ISTLLLIVILVVFSVLLIVNE

SEQ ID NO: 1598783 - protein, 21 aa, Staphylococcus aureus
KDFLTQWKLYILSAVVLIMVL

SEQ ID NO: 1598784 - protein, 17 aa, Staphylococcus aureus
KTIYYWIRYLNFDIVNR

SEQ ID NO: 1598785 - protein, 17 aa, Staphylococcus aureus
LCICIALALILYALPYL

SEQ ID NO: 1598786 - protein, 18 aa, Staphylococcus aureus
LIVWYVLYLLITVFKGTK

SEQ ID NO: 1598787 - protein, 18 aa, Staphylococcus aureus
LIYWNPWDTELSIQDADS

SEQ ID NO: 1598788 - protein, 33 aa, Staphylococcus aureus
MLKGCGGCLISFIILIILLSACSMMFSNNDNST

SEQ ID NO: 1598789 - protein, 24 aa, Staphylococcus aureus
PHEGQRVVLKYKLKFQDGLKTGDY

SEQ ID NO: 1598790 - protein, 17 aa, Staphylococcus aureus
QLCIIFSLFALMSNLTG

SEQ ID NO: 1598791 - protein, 22 aa, Staphylococcus aureus
QNKYSIRRFTVGTTSVIVGATI

SEQ ID NO: 1598792 - protein, 18 aa, Staphylococcus aureus
SFFIMLLFPFLQQLSKLQ

SEQ ID NO: 1598793 - protein, 26 aa, Staphylococcus aureus
SNKDMTLPLMALIALSSIVAFVLPRK

SEQ ID NO: 1598794 - protein, 23 aa, Staphylococcus aureus
SVWLVLLFSVMGLWQVSNAAEQH

SEQ ID NO: 1598795 - protein, 23 aa, Staphylococcus aureus
TASIAALLLVSGLFLAFRRRSTN

SEQ ID NO: 1598796 - protein, 17 aa, Staphylococcus aureus
TNDILTMLKATTTVPGL

SEQ ID NO: 1598797 - protein, 18 aa, Staphylococcus aureus
VFGSLLCLFYMIKAFRQI

SEQ ID NO: 1598798 - protein, 19 aa, Staphylococcus aureus
VIIILILILGGIFLKMKYD

SEQ ID NO: 1598799 - protein, 23 aa, Staphylococcus aureus
VNIFDWRYLFLVVLLIGMIDFVF

SEQ ID NO: 1598800 - protein, 21 aa, Staphylococcus aureus
VYYIFWLLAKRKYILVTFWTI

SEQ ID NO: 1598801 - protein, 21 aa, Staphylococcus aureus
YFLQFEWFQPLLISLAALLIL

SEQ ID NO: 1598802 - protein, 25 aa, Staphylococcus aureus
AIKHVIVFIFMIFIAIVAIAVIAMS

SEQ ID NO: 1598803 - protein, 24 aa, Staphylococcus aureus
ALNIILGFIKFFSSLFTGNWRGVW

SEQ ID NO: 1598804 - protein, 24 aa, Staphylococcus aureus
ANEKTRVRLYKSGKNWVKSGIKEI

SEQ ID NO: 1598805 - protein, 17 aa, Staphylococcus aureus
ASYLHLILPIAMLIALT

SEQ ID NO: 1598806 - protein, 18 aa, Staphylococcus aureus
DIIPPKTYSGNVDQVVTI

SEQ ID NO: 1598807 - protein, 29 aa, Staphylococcus aureus
EAARTRNPIRLMIGFDYPDGYGNSETLVP

SEQ ID NO: 1598808 - protein, 22 aa, Staphylococcus aureus
FKPHLLYLLIGTAIIFVICKLI

SEQ ID NO: 1598809 - protein, 22 aa, Staphylococcus aureus
GSSLKPFLAYGPAIENMKWATN

SEQ ID NO: 1598810 - protein, 19 aa, Staphylococcus aureus
IGVASVLVGTLIGFGLLSS

SEQ ID NO: 1598811 - protein, 20 aa, Staphylococcus aureus
KDFLTQWKLYIISAVVLIMV

SEQ ID NO: 1598812 - protein, 25 aa, Staphylococcus aureus
KIITSWITWVFIGILGLYLILRKRF

SEQ ID NO: 1598813 - protein, 21 aa, Staphylococcus aureus
LAFTSLFLVIWFPASPFVIIF

SEQ ID NO: 1598814 - protein, 24 aa, Staphylococcus aureus
LSIVLLFLTLPIMVIFAIAIVIDS

SEQ ID NO: 1598815 - protein, 23 aa, Staphylococcus aureus
NNSRTLIFPYVPDKAIYNAIVKV

SEQ ID NO: 1598816 - protein, 30 aa, Staphylococcus aureus
PKFLTLFAGPLFNFILALVLFIGLAYYQGT

SEQ ID NO: 1598817 - protein, 21 aa, Staphylococcus aureus
PKRLNAKMRFAVAQPAAVASN

SEQ ID NO: 1598818 - protein, 33 aa, Staphylococcus aureus; identical to SEQ ID NO: 1597493

SEQ ID NO: 1598819 - protein, 23 aa, Staphylococcus aureus
SKKMTGYGLKTTAVIGGAFTVNM

SEQ ID NO: 1598820 - protein, 17 aa, Staphylococcus aureus
TLTIIFLVVILTMYPLA

SEQ ID NO: 1598821 - protein, 17 aa, Staphylococcus aureus
TMLLYIPALLVYSIVQK

SEQ ID NO: 1598822 - protein, 33 aa, Staphylococcus aureus
VKSGIKEIEMFKIMGLPFISHSLVSQDNQSISK

SEQ ID NO: 1598823 - protein, 18 aa, Staphylococcus aureus
WIGIPLWVHRRCLKPMFT

SEQ ID NO: 1598824 - protein, 34 aa, Staphylococcus aureus
WRSIIPPLVIIALTVVIFLVRPIGIYILMMIGMS

SEQ ID NO: 1598825 - protein, 23 aa, Staphylococcus aureus
ALNIILGFIKFFSSLFTGNWRGV

SEQ ID NO: 1598826 - protein, 18 aa, Staphylococcus aureus
AMTALKRAIADKADTKAS

SEQ ID NO: 1598827 - protein, 25 aa, Staphylococcus aureus
ASSKGAPYNLPTTPWNTLKASDSKE

SEQ ID NO: 1598828 - protein, 18 aa, Staphylococcus aureus
EKYGKFYNLSIKGTIDQI

SEQ ID NO: 1598829 - protein, 31 aa, Staphylococcus aureus
ENRYKTYYYYNNGYTLTWDNGLVLYSNKANG

SEQ ID NO: 1598830 - protein, 18 aa, Staphylococcus aureus
FAVGIVLATILLISAHLY

SEQ ID NO: 1598831 - protein, 20 aa, Staphylococcus aureus
FFVDTIWLFILLYAIFQGLF

SEQ ID NO: 1598832 - protein, 17 aa, Staphylococcus aureus
FNDWIFIVFIISVYYIF

SEQ ID NO: 1598833 - protein, 17 aa, Staphylococcus aureus
FSFLFVAPLLFFIHAVL

SEQ ID NO: 1598834 - protein, 34 aa, Staphylococcus aureus
GMLKGCGGCLISFILLIILLSACSMMFSNNDNST

SEQ ID NO: 1598835 - protein, 23 aa, Staphylococcus aureus
IGGLSNAFGFKLDTYHNTSKPNA

SEQ ID NO: 1598836 - protein, 17 aa, Staphylococcus aureus
IVAIVCLLSFLSTYCSH

SEQ ID NO: 1598837 - protein, 17 aa, Staphylococcus aureus
IVTVIPFYIFTALKIAG

SEQ ID NO: 1598838 - protein, 18 aa, Staphylococcus aureus
KEEGKFSHFAYVKPNNQS

SEQ ID NO: 1598839 - protein, 19 aa, Staphylococcus aureus
KHSTLLFATLLIAFGYLSH

SEQ ID NO: 1598840 - protein, 19 aa, Staphylococcus aureus
LFLGLVVALIYIFFKVIFD

SEQ ID NO: 1598841 - protein, 20 aa, Staphylococcus aureus
LIIFILLIALTTVFVGSEFA

SEQ ID NO: 1598842 - protein, 28 aa, Staphylococcus aureus
LKGTVQLIWNLIQLWFVGKILGVVRYFG

SEQ ID NO: 1598843 - protein, 17 aa, Staphylococcus aureus
LVPFIFLGVLYLLYFLY

SEQ ID NO: 1598844 - protein, 19 aa, Staphylococcus aureus
MLTVIVIGLIWLIKDKRQS

SEQ ID NO: 1598845 - protein, 22 aa, Staphylococcus aureus
NPSTPRMRAFSLAAVAADAPAA

SEQ ID NO: 1598846 - protein, 19 aa, Staphylococcus aureus
NYFRFQYFNPLKSERYYRN

SEQ ID NO: 1598847 - protein, 20 aa, Staphylococcus aureus
SNYFRFQYFNPLKSERYYRN

SEQ ID NO: 1598848 - protein, 23 aa, Staphylococcus aureus
TATGLLMIYAFNPPASWLNHLLL

SEQ ID NO: 1598849 - protein, 21 aa, Staphylococcus aureus
TDAINIYFVPSDLVNPTISVG

SEQ ID NO: 1598850 - protein, 19 aa, Staphylococcus aureus
TVGTFSTVIATLVFLGFNT

SEQ ID NO: 1598851 - protein, 17 aa, Staphylococcus aureus
YAKRFFFFATSCLVLTL

SEQ ID NO: 1598852 - protein, 21 aa, Staphylococcus aureus
YYFQTVLNNASFWKEYKFYNA

SEQ ID NO: 1598853 - protein, 18 aa, Staphylococcus aureus
AMGNLKHALAEKDNTKRS

SEQ ID NO: 1598854 - protein, 17 aa, Staphylococcus aureus
DSGFYKTPKYNLGNYVW

SEQ ID NO: 1598855 - protein, 25 aa, Staphylococcus aureus
FIRNDLIDYLDCKVLFIGNLDELNK

SEQ ID NO: 1598856 - protein, 21 aa, Staphylococcus aureus
GDTFTFKYGQYFRPGSVRLPS

SEQ ID NO: 1598857 - protein, 19 aa, Staphylococcus aureus
IFNALIIVALIPIAMKGVK

SEQ ID NO: 1598858 - protein, 35 aa, Staphylococcus aureus
IKATFEFIFNFIIKPIMFAIWQVMQFIWPAVKALI

SEQ ID NO: 1598859 - protein, 20 aa, Staphylococcus aureus
KITGYGLKTTAVIGGAFTVN

SEQ ID NO: 1598860 - protein, 18 aa, Staphylococcus aureus
KLKFQDGLKTGDYFDFTL

SEQ ID NO: 1598861 - protein, 23 aa, Staphylococcus aureus
KQPPFFFSVLLPIVFISAIIGIL

SEQ ID NO: 1598862 - protein, 28 aa, Staphylococcus aureus
KSRMNWIFWILFLNFLMLGISLIDYDFP

SEQ ID NO: 1598863 - protein, 21 aa, Staphylococcus aureus
KVMTVTYAGQTWTRNISDWIA

SEQ ID NO: 1598864 - protein, 18 aa, Staphylococcus aureus
KYSIRRFTVGTTSVIVGA

SEQ ID NO: 1598865 - protein, 17 aa, Staphylococcus aureus
LFNSLLYFLILLKPRKL

SEQ ID NO: 1598866 - protein, 18 aa, Staphylococcus aureus
LIFLLYFILVINSALFIW

SEQ ID NO: 1598867 - protein, 18 aa, Staphylococcus aureus
LIMVLIGFIFWRQDDYTS

SEQ ID NO: 1598868 - protein, 19 aa, Staphylococcus aureus
LKTTAVIGGAFTVNMLHDQ

SEQ ID NO: 1598869 - protein, 30 aa, Staphylococcus aureus
LVGSLIMLFILDWKMTLLTFITIPIFVLIM

SEQ ID NO: 1598870 - protein, 24 aa, Staphylococcus aureus
NFIKAIFEFIINFVIKPIMFAIWQ

SEQ ID NO: 1598871 - protein, 22 aa, Staphylococcus aureus
NNSRTLIFPYVPDKAIYNAIVK

SEQ ID NO: 1598872 - protein, 17 aa, Staphylococcus aureus
NSLLYFLILLKPRKLNT

SEQ ID NO: 1598873 - protein, 19 aa, Staphylococcus aureus
SIIFLFFKLKYYAIVTILV

SEQ ID NO: 1598874 - protein, 27 aa, Staphylococcus aureus
STNKGMLFGGLFSILGLALLRRNKKNH

SEQ ID NO: 1598875 - protein, 20 aa, Staphylococcus aureus
TTVYPHQAGYVKLNYGFSVP

SEQ ID NO: 1598876 - protein, 22 aa, Staphylococcus aureus
TVFVNPKQRVLGNTWVYIKGYQ

SEQ ID NO: 1598877 - protein, 18 aa, Staphylococcus aureus
VFILFLICSFGVLIGLYQ

SEQ ID NO: 1598878 - protein, 21 aa, Staphylococcus aureus
VFVNPKQRVLGNTWVYIKGYQ

SEQ ID NO: 1598879 - protein, 20 aa, Staphylococcus aureus
VGAFRFLIPIILAVSNFMGG

SEQ ID NO: 1598880 - protein, 17 aa, Staphylococcus aureus
VLVGTLIGFGLLSSKEA

SEQ ID NO: 1598881 - protein, 17 aa, Staphylococcus aureus
VVFILLTFGFYVFFAGH

SEQ ID NO: 1598882 - protein, 19 aa, Staphylococcus aureus
YKIFPVFMFLVSTGLGILV

SEQ ID NO: 1598883 - protein, 17 aa, Staphylococcus aureus
AFKLPLYPVLPAITFVL

SEQ ID NO: 1598884 - protein, 17 aa, Staphylococcus aureus
ALVTIVMIAVITASITA

SEQ ID NO: 1598885 - protein, 17 aa, Staphylococcus aureus
APFIPLFYIIFGLKTRD

SEQ ID NO: 1598886 - protein, 19 aa, Staphylococcus aureus
FLTITTVFAFFLSSRITKP

SEQ ID NO: 1598887 - protein, 17 aa, Staphylococcus aureus
FQNISPYLPFTYAIDSL

SEQ ID NO: 1598888 - protein, 39 aa, Staphylococcus aureus
FRTHLSGYHKNYPYYPYYSYYPVQLTWNNGVAFYSNNAQ

SEQ ID NO: 1598889 - protein, 17 aa, Staphylococcus aureus
GIGFAFSPGVLGETGLN

SEQ ID NO: 1598890 - protein, 18 aa, Staphylococcus aureus
IGIYILMMIGMSTVTIVF

SEQ ID NO: 1598891 - protein, 20 aa, Staphylococcus aureus
IHIKIIYWLVLTTIFFIANI

SEQ ID NO: 1598892 - protein, 23 aa, Staphylococcus aureus
ITIPIFVLIMIPLGRIMQKISTS

SEQ ID NO: 1598893 - protein, 17 aa, Staphylococcus aureus
ITYMILLIWVFGSLLCL

SEQ ID NO: 1598894 - protein, 23 aa, Staphylococcus aureus
KAIQSINQALANKLKEIEASNAT

SEQ ID NO: 1598895 - protein, 22 aa, Staphylococcus aureus
KATFEFIFNFIIKPIMFAIWQV

SEQ ID NO: 1598896 - protein, 27 aa, Staphylococcus aureus
KTQGPTVNKLYYAAGGRALEYNQLFMY

SEQ ID NO: 1598897 - protein, 18 aa, Staphylococcus aureus
LFATLLIAFGYLSHFVNG

SEQ ID NO: 1598898 - protein, 22 aa, Staphylococcus aureus
LNPLLMSILISVAFSLLMVTPI

SEQ ID NO: 1598899 - protein, 20 aa, Staphylococcus aureus
LYIIVMVLSVFIIGCDKSSD

SEQ ID NO: 1598900 - protein, 26 aa, Staphylococcus aureus
NFKSKFFISLIFAIPIIILSPMMGVK

SEQ ID NO: 1598901 - protein, 25 aa, Staphylococcus aureus
NKDMTLPLMALIALSSIVAFVLPRK

SEQ ID NO: 1598902 - protein, 18 aa, Staphylococcus aureus
NYFRFQYFNPLKSERYYR

SEQ ID NO: 1598903 - protein, 19 aa, Staphylococcus aureus
RFALYISVMILIFAIAGCG

SEQ ID NO: 1598904 - protein, 26 aa, Staphylococcus aureus
SNNGTLFGGLFAALGSLLLFGRRKKQ

SEQ ID NO: 1598905 - protein, 18 aa, Staphylococcus aureus
VGAIWALVTIVMIAVITA

SEQ ID NO: 1598906 - protein, 25 aa, Staphylococcus aureus
VIKLWLTIILIVTTVLILLSIALIT

SEQ ID NO: 1598907 - protein, 17 aa, Staphylococcus aureus
VLGFYPTNANTNAFRPG

SEQ ID NO: 1598908 - protein, 21 aa, Staphylococcus aureus
YYFQAVLNNASFWKEYKFYNA

SEQ ID NO: 1598909 - protein, 25 aa, Staphylococcus aureus
ARPLFYFGNIMKPLIWLMNGSARVI

SEQ ID NO: 1598910 - protein, 24 aa, Staphylococcus aureus
AYFKPHLLYLLIGTAIIFVICKLI

SEQ ID NO: 1598911 - protein, 17 aa, Staphylococcus aureus
DLGIYKPKYNLGDYVWE

SEQ ID NO: 1598912 - protein, 18 aa, Staphylococcus aureus
DSGFYKTPKYNLGNYVWE

SEQ ID NO: 1598913 - protein, 17 aa, Staphylococcus aureus
DSGFYKTPKYSLGDYVW

SEQ ID NO: 1598914 - protein, 30 aa, Staphylococcus aureus
DTKVMTVTYAGQTWTRNISDWIAKSGTTNF

SEQ ID NO: 1598915 - protein, 40 aa, Staphylococcus aureus
EPLPNRKDFVVSFITGALVGSALGLYFKNKVYQKADDLKV

SEQ ID NO: 1598916 - protein, 32 aa, Staphylococcus aureus
FSEFRTFLAVLLILLLFISISLVIASTYSIIR

SEQ ID NO: 1598917 - protein, 26 aa, Staphylococcus aureus
FTGSDWIVLILATILFFYGGKPFLSG

SEQ ID NO: 1598918 - protein, 17 aa, Staphylococcus aureus
GAVQQYIDEQHLGVISS

SEQ ID NO: 1598919 - protein, 23 aa, Staphylococcus aureus
GDLALRSTLYGYNSNIIWRSMSW

SEQ ID NO: 1598920 - protein, 18 aa, Staphylococcus aureus
GYWFLRFRAALVPVANLG

SEQ ID NO: 1598921 - protein, 17 aa, Staphylococcus aureus
IGSLMYLGTQQEAEAAE

SEQ ID NO: 1598922 - protein, 17 aa, Staphylococcus aureus
IIIFIYWIMMTMLFFLL

SEQ ID NO: 1598923 - protein, 17 aa, Staphylococcus aureus
IISVIFQLLFGKIGLIR

SEQ ID NO: 1598924 - protein, 18 aa, Staphylococcus aureus
ILIFICIFTFFIMIIQSQ

SEQ ID NO: 1598925 - protein, 20 aa, Staphylococcus aureus
ISTLLLIVILVVFSVLLIVN

SEQ ID NO: 1598926 - protein, 26 aa, Staphylococcus aureus
ITIRPQDYVVFIPPVGKQIRAVVYYN

SEQ ID NO: 1598927 - protein, 17 aa, Staphylococcus aureus
IYWNPWDTELSIQDADS

SEQ ID NO: 1598928 - protein, 21 aa, Staphylococcus aureus
KGTVQLIWNLIQLWFVGKILG

SEQ ID NO: 1598929 - protein, 26 aa, Staphylococcus aureus
KIIALLLVIPGWLTLWIAILSDMGAT

SEQ ID NO: 1598930 - protein, 35 aa, Staphylococcus aureus
KRIQYSVITILVLLIAVILIYMFSPLSKIAHVNIN

SEQ ID NO: 1598931 - protein, 17 aa, Staphylococcus aureus
KTTAVIGGAFTVNMLHD

SEQ ID NO: 1598932 - protein, 19 aa, Staphylococcus aureus
LDSGFYKTPKYSLGDYVWY

SEQ ID NO: 1598933 - protein, 18 aa, Staphylococcus aureus
NAMGAVQQYIDEQHLGVI

SEQ ID NO: 1598934 - protein, 23 aa, Staphylococcus aureus
NFIIPFLLIFIIDGFRGVKETLP

SEQ ID NO: 1598935 - protein, 18 aa, Staphylococcus aureus
NFRILWLSQFIAIAGLTV

SEQ ID NO: 1598936 - protein, 22 aa, Staphylococcus aureus
NQAYNFLITSSQRWGLNQGINA

SEQ ID NO: 1598937 - protein, 27 aa, Staphylococcus aureus
NRSGQVIYSWPTVHVYSLEDLSRASDY

SEQ ID NO: 1598938 - protein, 17 aa, Staphylococcus aureus
PLIPFYKISNFTFSKDM

SEQ ID NO: 1598939 - protein, 22 aa, Staphylococcus aureus
QKGLIFSSIIGIAGLMLLARRR

SEQ ID NO: 1598940 - protein, 21 aa, Staphylococcus aureus
SLLILFFYLFSDGLRDAFDPK

SEQ ID NO: 1598941 - protein, 24 aa, Staphylococcus aureus
SNITYMILLIWVFGSLLCLFYMIK

SEQ ID NO: 1598942 - protein, 20 aa, Staphylococcus aureus
TAMTALKRAIADKADTKASG

SEQ ID NO: 1598943 - protein, 22 aa, Staphylococcus aureus
TLFGGLFAALGSLLLFGRRKKQ

SEQ ID NO: 1598944 - protein, 30 aa, Staphylococcus aureus
VGHPEQLYKYYYDRGYTLTWDNGLVLYSNK

SEQ ID NO: 1598945 - protein, 17 aa, Staphylococcus aureus
VGWVILAGLAMSTVFAL

SEQ ID NO: 1598946 - protein, 26 aa, Staphylococcus aureus
VIHACVLLFIIISIGLVFHRLQTKTN

SEQ ID NO: 1598947 - protein, 21 aa, Staphylococcus aureus
VILLLLLIFIGIKYLSFVKTI

SEQ ID NO: 1598948 - protein, 22 aa, Staphylococcus aureus
VNIFDWRYLFLVVLLIGMIDFV

SEQ ID NO: 1598949 - protein, 34 aa, Staphylococcus aureus
WRSIIPPLVMIALTVVIFLVRPIGIYILMMIGMS

SEQ ID NO: 1598950 - protein, 40 aa, Staphylococcus aureus
YSAILKKFWMMYWPKLVILMGIIILIVILNAIFNNVNKND

SEQ ID NO: 1598951 - protein, 18 aa, Staphylococcus aureus
AFVILFIVGKFIVTPYTI

SEQ ID NO: 1598952 - protein, 23 aa, Staphylococcus aureus
AGQSVTYYFTDVKAPTVTVGNQT

SEQ ID NO: 1598953 - protein, 17 aa, Staphylococcus aureus
AMGTLKHAIADKTNTLA

SEQ ID NO: 1598954 - protein, 29 aa, Staphylococcus aureus
ASSTWAWLFVLFVLPLIGFILYLFFGRTV

SEQ ID NO: 1598955 - protein, 22 aa, Staphylococcus aureus
DFLYDFWWLFFPVAGFLVWAIH

SEQ ID NO: 1598956 - protein, 18 aa, Staphylococcus aureus
ETIWFVIPIIIVAALAIP

SEQ ID NO: 1598957 - protein, 24 aa, Staphylococcus aureus
FCFIFLLLVFFRYILKRYFNYSLN

SEQ ID NO: 1598958 - protein, 17 aa, Staphylococcus aureus
FFVILGKPFVPFLELMQ

SEQ ID NO: 1598959 - protein, 23 aa, Staphylococcus aureus
FTDKDWQITGIPRTLHIENSTNR

SEQ ID NO: 1598960 - protein, 17 aa, Staphylococcus aureus
FYNLSIKGTIDQIDKTN

SEQ ID NO: 1598961 - protein, 20 aa, Staphylococcus aureus
ILPSFYAWFNLWAMWDPYGN

SEQ ID NO: 1598962 - protein, 22 aa, Staphylococcus aureus
IQYYFYLIIILGGLYLYTHHAF

SEQ ID NO: 1598963 - protein, 23 aa, Staphylococcus aureus
KANIWFLIIFVLTVLVFNPLIVK

SEQ ID NO: 1598964 - protein, 17 aa, Staphylococcus aureus
KEEGKFSHFAYVKPNNQ

SEQ ID NO: 1598965 - protein, 20 aa, Staphylococcus aureus
KHSTLLFATLLIAFGYLSHF

SEQ ID NO: 1598966 - protein, 18 aa, Staphylococcus aureus
LDLFILRLVLLSCLFILT

SEQ ID NO: 1598967 - protein, 21 aa, Staphylococcus aureus
LLEDDLRFRQIIFSHKDDLKS

SEQ ID NO: 1598968 - protein, 17 aa, Staphylococcus aureus
MMPLLFVFLIIIVIKSL

SEQ ID NO: 1598969 - protein, 18 aa, Staphylococcus aureus
MTIWNAIWTFLQTLWNTI

SEQ ID NO: 1598970 - protein, 23 aa, Staphylococcus aureus
NRPFFRLYLITWMMHLILIGGSR

SEQ ID NO: 1598971 - protein, 18 aa, Staphylococcus aureus
PFFVILGKPFVPFLELMQ

SEQ ID NO: 1598972 - protein, 18 aa, Staphylococcus aureus
PVGWVILAGLAMSTVFAL

SEQ ID NO: 1598973 - protein, 17 aa, Staphylococcus aureus
SEFVYNMPLLSEKPLFV

SEQ ID NO: 1598974 - protein, 25 aa, Staphylococcus aureus
SGDTVYPHQAGYVKLNYGFSVPNEA

SEQ ID NO: 1598975 - protein, 27 aa, Staphylococcus aureus
SNNGTLFGGLFAALGSLLLFGRRKKQN

SEQ ID NO: 1598976 - protein, 19 aa, Staphylococcus aureus
SVLAFIFLVYRIYILFIDY

SEQ ID NO: 1598977 - protein, 19 aa, Staphylococcus aureus
SVLVGTLIGFGLLSSKEAD

SEQ ID NO: 1598978 - protein, 21 aa, Staphylococcus aureus
SVSWLWFFLLAILGKMVGSID

SEQ ID NO: 1598979 - protein, 31 aa, Staphylococcus aureus
TGNRPFFRLYLITWMMHLILIGGSRLFWRIY

SEQ ID NO: 1598980 - protein, 17 aa, Staphylococcus aureus
TGYGLKTTAVIGGAFTV

SEQ ID NO: 1598981 - protein, 19 aa, Staphylococcus aureus
TRVRLYKSGKNWVKSGIKE

SEQ ID NO: 1598982 - protein, 23 aa, Staphylococcus aureus
TVFVNPKQRVLGNTWVYIKGYQD

SEQ ID NO: 1598983 - protein, 25 aa, Staphylococcus aureus
TVFVNPKQRVLGNTWVYIKGYQDKI

SEQ ID NO: 1598984 - protein, 32 aa, Staphylococcus aureus
VALAVYLFRFVWVYVLYPYFYLAISPFQKMMT

SEQ ID NO: 1598985 - protein, 23 aa, Staphylococcus aureus
VDFLYDFWWLFFPVAGFLVWAIH

SEQ ID NO: 1598986 - protein, 24 aa, Staphylococcus aureus
VGSYFLFFIIIAFLLYANVLFIKR

SEQ ID NO: 1598987 - protein, 19 aa, Staphylococcus aureus
VMTVTYAGQTWTRNISDWI

SEQ ID NO: 1598988 - protein, 28 aa, Staphylococcus aureus
YCLGAVFFYFWGVFLYNSLHKCKGFSFH

SEQ ID NO: 1598989 - protein, 19 aa, Staphylococcus aureus
YFGNIMKPLIWLMNGSARV

SEQ ID NO: 1598990 - protein, 18 aa, Staphylococcus aureus
AIQSINQALANKLKEIEA

SEQ ID NO: 1598991 - protein, 26 aa, Staphylococcus aureus
ASSKGAPYNLPTTPWNTLKASDSKEI

SEQ ID NO: 1598992 - protein, 18 aa, Staphylococcus aureus
AYNFLITSSQRWGLNQGI

SEQ ID NO: 1598993 - protein, 20 aa, Staphylococcus aureus
DAINIYFVPSDLVNPTISVG

SEQ ID NO: 1598994 - protein, 23 aa, Staphylococcus aureus
DLNSDFILFDFTYDLPLSTYLGQ

SEQ ID NO: 1598995 - protein, 24 aa, Staphylococcus aureus
EIDPLHMRHFGDRIGNVIKNALGV

SEQ ID NO: 1598996 - protein, 23 aa, Staphylococcus aureus
ENGKYRFDNLDSGKYKVIFEKPA

SEQ ID NO: 1598997 - protein, 24 aa, Staphylococcus aureus
ESKDEDVPLLLAKKKNQKDNQSKG

SEQ ID NO: 1598998 - protein, 17 aa, Staphylococcus aureus
FAVGIVLATILLISAHL

SEQ ID NO: 1598999 - protein, 24 aa, Staphylococcus aureus
FCFIFLLLLFFRYILKRYFNYMLN

SEQ ID NO: 1599000 - protein, 25 aa, Staphylococcus aureus
FIDTLVYLFILIFKTKWLDTKAFSK

SEQ ID NO: 1599001 - protein, 17 aa, Staphylococcus aureus
FLYIMLIDWRMASALLV

SEQ ID NO: 1599002 - protein, 22 aa, Staphylococcus aureus
FTDKDWQITGIPRTLHIENSTN

SEQ ID NO: 1599003 - protein, 20 aa, Staphylococcus aureus
FVLINTYLLRQVKSIGMFLM

SEQ ID NO: 1599004 - protein, 21 aa, Staphylococcus aureus
GDTVYPHQAGYVKLNYGFSVP

SEQ ID NO: 1599005 - protein, 20 aa, Staphylococcus aureus
GLSNAFGFKLDTYHNTSKPN

SEQ ID NO: 1599006 - protein, 23 aa, Staphylococcus aureus
HEGQRVVLKYKLKFQDGLKTGDY

SEQ ID NO: 1599007 - protein, 17 aa, Staphylococcus aureus
HLPYLLMLTLSLVALIL

SEQ ID NO: 1599008 - protein, 29 aa, Staphylococcus aureus
IFSTFALFLFLFLVFSWIVSFIPGFELSV

SEQ ID NO: 1599009 - protein, 18 aa, Staphylococcus aureus
IGVASVLVGTLIGFGLLS

SEQ ID NO: 1599010 - protein, 24 aa, Staphylococcus aureus
IIGSIFMFLIFGVFIRRVTNAIIG

SEQ ID NO: 1599011 - protein, 31 aa, Staphylococcus aureus
IIILCVVAFFIFPVIIMFLLAPDLNKGKDDA

SEQ ID NO: 1599012 - protein, 32 aa, Staphylococcus aureus; identical to SEQ ID NO: 1583089

SEQ ID NO: 1599013 - protein, 21 aa, Staphylococcus aureus
KATYDILTKTYTFVFTDYVND

SEQ ID NO: 1599014 - protein, 26 aa, Staphylococcus aureus
KELLYVALRISLIKVLRPYYPFPLIV

SEQ ID NO: 1599015 - protein, 25 aa, Staphylococcus aureus
KGDLALRSTLYGYNSNIIWRSMSWD

SEQ ID NO: 1599016 - protein, 30 aa, Staphylococcus aureus
KGDLALRSTLYGYNSNIIWRSMSWDNEVAF

SEQ ID NO: 1599017 - protein, 19 aa, Staphylococcus aureus
KIISVIFQLLFGKIGLIRN

SEQ ID NO: 1599018 - protein, 17 aa, Staphylococcus aureus
KKKGSIEGTKHLPLLFA

SEQ ID NO: 1599019 - protein, 35 aa, Staphylococcus aureus
KNALGVVGISGLLASFWFFIAKRRRKEDEEEELEI

SEQ ID NO: 1599020 - protein, 23 aa, Staphylococcus aureus
KQNKYSIRRFTVGTTSVIVGATI

SEQ ID NO: 1599021 - protein, 17 aa, Staphylococcus aureus
KRFFFFATSCLVLTLVV

SEQ ID NO: 1599022 - protein, 20 aa, Staphylococcus aureus
KRVNAKMRFAVAQPAAVASN

SEQ ID NO: 1599023 - protein, 32 aa, Staphylococcus aureus
KSGIKEIEMFKIMGLPFISHSLVSQDNQSISK

SEQ ID NO: 1599024 - protein, 19 aa, Staphylococcus aureus
KTVLVDYEKYGKFYNLSIK

SEQ ID NO: 1599025 - protein, 22 aa, Staphylococcus aureus
LDKVKHTPFFLPKRRRKEDEED

SEQ ID NO: 1599026 - protein, 19 aa, Staphylococcus aureus
LFAVGIVLATILLISAHLY

SEQ ID NO: 1599027 - protein, 17 aa, Staphylococcus aureus
LFMFFTKIFIQSWKQTH

SEQ ID NO: 1599028 - protein, 17 aa, Staphylococcus aureus
LIFLLYFILVINSALFI

SEQ ID NO: 1599029 - protein, 23 aa, Staphylococcus aureus
LIKVLRPYYPFPLIVDDAFVHFD

SEQ ID NO: 1599030 - protein, 18 aa, Staphylococcus aureus
LYISLFISLFILYNEFRS

SEQ ID NO: 1599031 - protein, 17 aa, Staphylococcus aureus
MLKWWLLLVISIIVLII

SEQ ID NO: 1599032 - protein, 38 aa, Staphylococcus aureus
MRKMVPWAIVFFILILIIILFFLLRNFNSPEAQTKILV

SEQ ID NO: 1599033 - protein, 34 aa, Staphylococcus aureus; identical to SEQ ID NO: 1596968

SEQ ID NO: 1599034 - protein, 30 aa, Staphylococcus aureus
NLEFQTHLFGYYNYYYTSNLTWKNGVAFYS

SEQ ID NO: 1599035 - protein, 18 aa, Staphylococcus aureus
NLWTYVMLIFMTLAAILT

SEQ ID NO: 1599036 - protein, 24 aa, Staphylococcus aureus
NQLYVVFKMIFWFNPALYISKTMM

SEQ ID NO: 1599037 - protein, 19 aa, Staphylococcus aureus
PAAMFVLVAGIGLIATVRR

SEQ ID NO: 1599038 - protein, 17 aa, Staphylococcus aureus
QAGYVKLNYGFSVPNSA

SEQ ID NO: 1599039 - protein, 18 aa, Staphylococcus aureus
QLNQGLNLGLDDIRNTHV

SEQ ID NO: 1599040 - protein, 24 aa, Staphylococcus aureus
QVLFIIFAMFLPISFLLSMLPSFD

SEQ ID NO: 1599041 - protein, 18 aa, Staphylococcus aureus
RTQLTGYPENRYKTYYYY

SEQ ID NO: 1599042 - protein, 24 aa, Staphylococcus aureus
SFCFIFLLLVFFKYILKRYFNYSL

SEQ ID NO: 1599043 - protein, 25 aa, Staphylococcus aureus
SLDKVKHTPFFLPKRRRKEDEEDVE

SEQ ID NO: 1599044 - protein, 26 aa, Staphylococcus aureus
SLDKVKHTPFFLPKRRRKEDEEDVEV

SEQ ID NO: 1599045 - protein, 18 aa, Staphylococcus aureus
SSSPAAMFVLVAGIGLIA

SEQ ID NO: 1599046 - protein, 20 aa, Staphylococcus aureus
TASILIGSLMYLGTQQEAEA

SEQ ID NO: 1599047 - protein, 26 aa, Staphylococcus aureus
TLDDTKHLPLLFAKRRRKEDEEDVTV

SEQ ID NO: 1599048 - protein, 23 aa, Staphylococcus aureus
TLVGAFRFLIAPILAVMDFLGPL

SEQ ID NO: 1599049 - protein, 17 aa, Staphylococcus aureus
TMISYLLFLLSGLANGL

SEQ ID NO: 1599050 - protein, 20 aa, Staphylococcus aureus
TMISYLLFLLSGLANGLINM

SEQ ID NO: 1599051 - protein, 17 aa, Staphylococcus aureus
VAKATYDILTKTYTFVF

SEQ ID NO: 1599052 - protein, 17 aa, Staphylococcus aureus
VGNLLPGDYFGTIRFGR

SEQ ID NO: 1599053 - protein, 18 aa, Staphylococcus aureus
VGTFSTVIATLVFLGFNT

SEQ ID NO: 1599054 - protein, 20 aa, Staphylococcus aureus
VLIMVLIGFIFWRQDDYTSR

SEQ ID NO: 1599055 - protein, 19 aa, Staphylococcus aureus
WRILLFYILAIFVIGMLIP

SEQ ID NO: 1599056 - protein, 21 aa, Staphylococcus aureus
YEKYGKFYNLSIKGTIDQIDK

SEQ ID NO: 1599057 - protein, 17 aa, Staphylococcus aureus
YSLLFLGIIILLSILIF

SEQ ID NO: 1599058 - protein, 17 aa, Staphylococcus aureus
AAILIWAFGWTIADPIA

SEQ ID NO: 1599059 - protein, 21 aa, Staphylococcus aureus
AIFLYIMLIDWRMASALLVTI

SEQ ID NO: 1599060 - protein, 39 aa, Staphylococcus aureus
AIVILIIFALLFRFIVRLIPIFYIFRVLSIFIFIMGFKM

SEQ ID NO: 1599061 - protein, 17 aa, Staphylococcus aureus
AMGQLQHAIADKTNTLA

SEQ ID NO: 1599062 - protein, 18 aa, Staphylococcus aureus
AMGQLQHAIADKTNTLAS

SEQ ID NO: 1599063 - protein, 17 aa, Staphylococcus aureus
AMVFFVFAILGLVAWMC

SEQ ID NO: 1599064 - protein, 24 aa, Staphylococcus aureus
APIMPIIIIPIISSVIVGLIFIFL

SEQ ID NO: 1599065 - protein, 27 aa, Staphylococcus aureus
DDIITEQDILAHINLIDQLSAEVIDTP

SEQ ID NO: 1599066 - protein, 24 aa, Staphylococcus aureus
DFDRIIDYLILLILICSGLSYSKA

SEQ ID NO: 1599067 - protein, 19 aa, Staphylococcus aureus
DFILFDFTYDLPLSTYLGQ

SEQ ID NO: 1599068 - protein, 19 aa, Staphylococcus aureus
DLNSDFILFDFTYDLPLST

SEQ ID NO: 1599069 - protein, 17 aa, Staphylococcus aureus
DNDLLVPFIFLGVLYLL

SEQ ID NO: 1599070 - protein, 18 aa, Staphylococcus aureus
DQLNRGLNLGLDDIRNTH

SEQ ID NO: 1599071 - protein, 38 aa, Staphylococcus aureus
DTGDSIKQNGLLGGVMTLLVGLGLMKRKKKKDENEQDD

SEQ ID NO: 1599072 - protein, 17 aa, Staphylococcus aureus
DTTPPIVPPTPPTPEVP

SEQ ID NO: 1599073 - protein, 29 aa, Staphylococcus aureus
EAARTRNPIRLMIGFDYPDAYGNSETLVP

SEQ ID NO: 1599074 - protein, 24 aa, Staphylococcus aureus
EDTTPPIVPPTPPTPEVPSEPETP

SEQ ID NO: 1599075 - protein, 20 aa, Staphylococcus aureus
EKYGKFYNLSIKGTIDQIDK

SEQ ID NO: 1599076 - protein, 24 aa, Staphylococcus aureus
ESKDEDVPLLLAKKKNQKDNQSKD

SEQ ID NO: 1599077 - protein, 17 aa, Staphylococcus aureus
FATLLIAFGYLSHFVNG

SEQ ID NO: 1599078 - protein, 20 aa, Staphylococcus aureus
FIFSFVFFVIAWFFARKPSR

SEQ ID NO: 1599079 - protein, 22 aa, Staphylococcus aureus
FIISFFIMLLFPFLQQLSKLQS

SEQ ID NO: 1599080 - protein, 29 aa, Staphylococcus aureus
FKTQGPTVNKLYYAAGGRALEYNQLFMYS

SEQ ID NO: 1599081 - protein, 17 aa, Staphylococcus aureus
FLTFPIMFIFAIAIVID

SEQ ID NO: 1599082 - protein, 17 aa, Staphylococcus aureus
FLTLPIMVIFAIAIVID

SEQ ID NO: 1599083 - protein, 18 aa, Staphylococcus aureus
FLTLPIMVIFAIAIVIDS

SEQ ID NO: 1599084 - protein, 21 aa, Staphylococcus aureus
FQLYVKLSCSTMLATSIILTN

SEQ ID NO: 1599085 - protein, 23 aa, Staphylococcus aureus
FTDKGWQITGIPRTLHIENSTNR

SEQ ID NO: 1599086 - protein, 17 aa, Staphylococcus aureus
GIGFFVVGLILKPVTDP

SEQ ID NO: 1599087 - protein, 23 aa, Staphylococcus aureus
GIYKIILIILLTSVLYYLIYVSR

SEQ ID NO: 1599088 - protein, 24 aa, Staphylococcus aureus
GSLIMLFILDWKMTLLTFITIPIF

SEQ ID NO: 1599089 - protein, 23 aa, Staphylococcus aureus
HKDSEDFYISLKIIDVKQPEGDQ

SEQ ID NO: 1599090 - protein, 26 aa, Staphylococcus aureus
HWSLNHKWIVIILSTLILVVTIVFGG

SEQ ID NO: 1599091 - protein, 18 aa, Staphylococcus aureus
IDSLFYIVSLNLSLTMIF

SEQ ID NO: 1599092 - protein, 22 aa, Staphylococcus aureus
IDYALFILFRYRQVMKTETDYV

SEQ ID NO: 1599093 - protein, 19 aa, Staphylococcus aureus
IFLFFKLKYYAIVTILVTM

SEQ ID NO: 1599094 - protein, 23 aa, Staphylococcus aureus
IGMFLMIAALGLYFVAMNNLKAA

SEQ ID NO: 1599095 - protein, 23 aa, Staphylococcus aureus
IHLKIIYWLILTSIFFIANILII

SEQ ID NO: 1599096 - protein, 19 aa, Staphylococcus aureus
IMFAIWQVMQFIWPAVKAL

SEQ ID NO: 1599097 - protein, 19 aa, Staphylococcus aureus
IPLIPFYKISNFTFSKDMM

SEQ ID NO: 1599098 - protein, 17 aa, Staphylococcus aureus
IVMIWSAPFFKNLFLPN

SEQ ID NO: 1599099 - protein, 17 aa, Staphylococcus aureus
IVPPTPPTPEVPSEPET

SEQ ID NO: 1599100 - protein, 18 aa, Staphylococcus aureus
KNIKLLLILPAICLVVSA

SEQ ID NO: 1599101 - protein, 25 aa, Staphylococcus aureus
KQYSLLFLGIIILLSILIFIYSQFT

SEQ ID NO: 1599102 - protein, 18 aa, Staphylococcus aureus
KYIVWFIVITTILSKFGI

SEQ ID NO: 1599103 - protein, 22 aa, Staphylococcus aureus
LAFTSLFLVIWFPASPFVIIFS

SEQ ID NO: 1599104 - protein, 19 aa, Staphylococcus aureus
LALFIWFFKLKYSFGHIIN

SEQ ID NO: 1599105 - protein, 23 aa, Staphylococcus aureus
LDDTKHLPLLFAKRRRKEDEEDV

SEQ ID NO: 1599106 - protein, 21 aa, Staphylococcus aureus
LGTVFFLFVFNIGISIFVFLL

SEQ ID NO: 1599107 - protein, 20 aa, Staphylococcus aureus
LIFNALIIVALIPIAMKGVK

SEQ ID NO: 1599108 - protein, 18 aa, Staphylococcus aureus
LILYALPYLILGSNNWSF

SEQ ID NO: 1599109 - protein, 20 aa, Staphylococcus aureus
LIPIFICIFTFLLIVIQSQF

SEQ ID NO: 1599110 - protein, 18 aa, Staphylococcus aureus
LIVTVIPFYIFTALKIAG

SEQ ID NO: 1599111 - protein, 18 aa, Staphylococcus aureus
LMLKWWLILAISIIVLII

SEQ ID NO: 1599112 - protein, 24 aa, Staphylococcus aureus
LRMMIYLGLFIFSISALYIIYLFI

SEQ ID NO: 1599113 - protein, 23 aa, Staphylococcus aureus
LSIVLLFLTFPIMFIFAIAIVID

SEQ ID NO: 1599114 - protein, 24 aa, Staphylococcus aureus
LSIVLLFLTFPIMFIFAIAIVIDS

SEQ ID NO: 1599115 - protein, 17 aa, Staphylococcus aureus
LVIWFPASPFVIIFSAM

SEQ ID NO: 1599116 - protein, 17 aa, Staphylococcus aureus
LVPFIFLGVLYLLYYLY

SEQ ID NO: 1599117 - protein, 18 aa, Staphylococcus aureus
MLTVIVIGLIWLIKDKRQ

SEQ ID NO: 1599118 - protein, 21 aa, Staphylococcus aureus
NFIIKPIMFAIWQVMQFIWPA

SEQ ID NO: 1599119 - protein, 25 aa, Staphylococcus aureus
NFIIKPIMFAIWQVMQFIWPAVKAL

SEQ ID NO: 1599120 - protein, 17 aa, Staphylococcus aureus
NGKYRFDNLDSGKYKVI

SEQ ID NO: 1599121 - protein, 20 aa, Staphylococcus aureus
NLDLFILRLVLLSCLFILTI

SEQ ID NO: 1599122 - protein, 24 aa, Staphylococcus aureus
NLSLTMIFLLLTYFKEVKLYKHFD

SEQ ID NO: 1599123 - protein, 29 aa, Staphylococcus aureus
NRYKTYYYYNNGYTLTWDNGLVLYSNKAN

SEQ ID NO: 1599124 - protein, 30 aa, Staphylococcus aureus
NRYKTYYYYNNGYTLTWDNGLVLYSNKANG

SEQ ID NO: 1599125 - protein, 18 aa, Staphylococcus aureus
PKFLTLFAGPLFNFILAL

SEQ ID NO: 1599126 - protein, 17 aa, Staphylococcus aureus
PLIGFILYLFFGRTVSA

SEQ ID NO: 1599127 - protein, 17 aa, Staphylococcus aureus
QAGYVKLNYGFSVPNEA

SEQ ID NO: 1599128 - protein, 20 aa, Staphylococcus aureus
QAYNFLITSSQRWGLNQGIN

SEQ ID NO: 1599129 - protein, 24 aa, Staphylococcus aureus
QDNEHSPVLIAKRLKDKDGNVETT

SEQ ID NO: 1599130 - protein, 29 aa, Staphylococcus aureus
RNRSGQVIYDWPTVHIYSLEDLSRASDYF

SEQ ID NO: 1599131 - protein, 28 aa, Staphylococcus aureus
RNRSGQVIYSWPTVHVYSLEDLSRASDY

SEQ ID NO: 1599132 - protein, 26 aa, Staphylococcus aureus
SFCFIFLLLLFFRYILKRYFNYMLNY

SEQ ID NO: 1599133 - protein, 23 aa, Staphylococcus aureus
SGDTVYPHQAGYVKLNYGFSVPN

SEQ ID NO: 1599134 - protein, 20 aa, Staphylococcus aureus
SIGVASVLVGTLIGFGLLSS

SEQ ID NO: 1599135 - protein, 23 aa, Staphylococcus aureus
SIVLLFLTFPIMFIFAIAIVIDS

SEQ ID NO: 1599136 - protein, 19 aa, Staphylococcus aureus
SIVLLFLTLPIMVIFAIAI

SEQ ID NO: 1599137 - protein, 20 aa, Staphylococcus aureus
SIVLLFLTLPIMVIFAIAIV

SEQ ID NO: 1599138 - protein, 23 aa, Staphylococcus aureus
SLPWLLMFFLILSAGAISDRVLG

SEQ ID NO: 1599139 - protein, 33 aa, Staphylococcus aureus
STSTAPVKLRTFSRLAMSTFASAATTSAVTANT

SEQ ID NO: 1599140 - protein, 20 aa, Staphylococcus aureus
TAMGQLQHAIADKTTTLASS

SEQ ID NO: 1599141 - protein, 25 aa, Staphylococcus aureus
TIRPQDYVVFIPPVGKQIRAVVYYN

SEQ ID NO: 1599142 - protein, 22 aa, Staphylococcus aureus
TLAQNKWLVGAIWALVTIVMIA

SEQ ID NO: 1599143 - protein, 26 aa, Staphylococcus aureus
TNNGMLFGGLFSILGLALLRRNKKNH

SEQ ID NO: 1599144 - protein, 17 aa, Staphylococcus aureus
TPLLVAAALYFVLTFVL

SEQ ID NO: 1599145 - protein, 19 aa, Staphylococcus aureus
VCHPLLFMFFTKIFIQSWK

SEQ ID NO: 1599146 - protein, 24 aa, Staphylococcus aureus
VDFLYDFWWLFFPVAVFLVWAIHS

SEQ ID NO: 1599147 - protein, 17 aa, Staphylococcus aureus
VGIVLAILLIFLKELLD

SEQ ID NO: 1599148 - protein, 18 aa, Staphylococcus aureus
VILALLVLMSVVLTYMVW

SEQ ID NO: 1599149 - protein, 24 aa, Staphylococcus aureus
VLKYYFWITILIIAIIVGAIAWLF

SEQ ID NO: 1599150 - protein, 24 aa, Staphylococcus aureus
VNPSTPRMRAFSLAAVAADAPAAG

SEQ ID NO: 1599151 - protein, 19 aa, Staphylococcus aureus
VTRYDLISVLPFGNTIAQI

SEQ ID NO: 1599152 - protein, 18 aa, Staphylococcus aureus
YFGNIMKPLIWLMNGSAR

SEQ ID NO: 1599153 - protein, 19 aa, Staphylococcus aureus
YGYNSNIIWRSMSWDNEVA

SEQ ID NO: 1599154 - protein, 23 aa, Staphylococcus aureus
YIPRNFFIILFPVAFMTISITNI

SEQ ID NO: 1599155 - protein, 23 aa, Staphylococcus aureus
YSHWFRFVWPVVAFVLIFGGGLL

SEQ ID NO: 1599156 - protein, 19 aa, Staphylococcus aureus
YSLKLFFISLVLLSLIIII

SEQ ID NO: 1599157 - protein, 18 aa, Staphylococcus aureus
YVILYWFIPLLTTFQIIR

SEQ ID NO: 1599158 - protein, 17 aa, Staphylococcus aureus
YWFLRFRAALVPVANLG

SEQ ID NO: 1599159 - protein, 25 aa, Staphylococcus aureus
AAFVGYLELLFGPLRRLVASFTTLT

SEQ ID NO: 1599160 - protein, 20 aa, Staphylococcus aureus
ALNAVTRAKAALNGAENLRN

SEQ ID NO: 1599161 - protein, 22 aa, Staphylococcus aureus
ANGILFFLIPFFASGIFNTQFT

SEQ ID NO: 1599162 - protein, 22 aa, Staphylococcus aureus
ATGLLMIYAFNPPASWLNHLLL

SEQ ID NO: 1599163 - protein, 29 aa, Staphylococcus aureus
DDIITEQDILAHINLIDQLTAEIIDTPST

SEQ ID NO: 1599164 - protein, 17 aa, Staphylococcus aureus
DIDPLHMRHFSNNFGNV

SEQ ID NO: 1599165 - protein, 27 aa, Staphylococcus aureus
DIITEQDILAHINLIDQLTAEIIDTPS

SEQ ID NO: 1599166 - protein, 23 aa, Staphylococcus aureus
DQSSEVFSPISPIKIATQDNSGN

SEQ ID NO: 1599167 - protein, 25 aa, Staphylococcus aureus
DQYVNYFMFFNVIATLLTLYVIANY

SEQ ID NO: 1599168 - protein, 27 aa, Staphylococcus aureus
DVISPTLFVLLMYLLSMITAYIFYSYE

SEQ ID NO: 1599169 - protein, 17 aa, Staphylococcus aureus
FAAGIVLATILLISAHL

SEQ ID NO: 1599170 - protein, 25 aa, Staphylococcus aureus
FGFSFDLIILLRKYVKYINFNYNEK

SEQ ID NO: 1599171 - protein, 20 aa, Staphylococcus aureus
FIAFALFFFAFTTILSYYYI

SEQ ID NO: 1599172 - protein, 23 aa, Staphylococcus aureus
FMINVLPIVLVPLIVERKRIKQH

SEQ ID NO: 1599173 - protein, 17 aa, Staphylococcus aureus
FVIWLFYCMSFVAVIIL

SEQ ID NO: 1599174 - protein, 21 aa, Staphylococcus aureus
FVSLIFAIPIILLSPLMGVNL

SEQ ID NO: 1599175 - protein, 18 aa, Staphylococcus aureus
FYSMLYDWRINKNPLYKG

SEQ ID NO: 1599176 - protein, 30 aa, Staphylococcus aureus
GCGGCLISFIILIILLSACSMMFSNNDNST

SEQ ID NO: 1599177 - protein, 21 aa, Staphylococcus aureus
GFLLTVMVIGLIWLIKDKRQS

SEQ ID NO: 1599178 - protein, 21 aa, Staphylococcus aureus
GGKLLLLYFMFCAIISVIQNI

SEQ ID NO: 1599179 - protein, 19 aa, Staphylococcus aureus
GLIFIFLIGAPISNIFEAL

SEQ ID NO: 1599180 - protein, 34 aa, Staphylococcus aureus
GMLKGCGGCLISFIILIILLSACSMMFSNNDNST

SEQ ID NO: 1599181 - protein, 34 aa, Staphylococcus aureus
GMLKGCGGCLISFILLIILLSACSMMFSNKDNST

SEQ ID NO: 1599182 - protein, 20 aa, Staphylococcus aureus
GMLQRLMIALALALKPKLII

SEQ ID NO: 1599183 - protein, 21 aa, Staphylococcus aureus
GNLDLFILRLVLLSCLFILTI

SEQ ID NO: 1599184 - protein, 22 aa, Staphylococcus aureus
GTTVYPHQAGYVKLNYGFSVPN

SEQ ID NO: 1599185 - protein, 22 aa, Staphylococcus aureus
GVGLFIHWIWPDLPIGAAFAIA

SEQ ID NO: 1599186 - protein, 20 aa, Staphylococcus aureus
IARISAVQIVISDRAKQSSS

SEQ ID NO: 1599187 - protein, 25 aa, Staphylococcus aureus
IAVVIALIFFVLFLVTLGSKKKVKR

SEQ ID NO: 1599188 - protein, 23 aa, Staphylococcus aureus
IDYALFILFRYRQVMKTETDYIK

SEQ ID NO: 1599189 - protein, 20 aa, Staphylococcus aureus
IETIWFVIPIIIVAALAIPT

SEQ ID NO: 1599190 - protein, 17 aa, Staphylococcus aureus
IISFFIMLLFPFLQQLS

SEQ ID NO: 1599191 - protein, 19 aa, Staphylococcus aureus
IITAVIFLTITTVFAFFLS

SEQ ID NO: 1599192 - protein, 28 aa, Staphylococcus aureus
ILISGAVFIVFLLLPARWFTGLVTEKTV

SEQ ID NO: 1599193 - protein, 18 aa, Staphylococcus aureus
ILVLWLYFRKSIPKTFDT

SEQ ID NO: 1599194 - protein, 19 aa, Staphylococcus aureus
ILVLWLYFRKSIPKTFDTE

SEQ ID NO: 1599195 - protein, 18 aa, Staphylococcus aureus
IPIFICIFTFLLMVIQSQ

SEQ ID NO: 1599196 - protein, 23 aa, Staphylococcus aureus
IPIIIVLLLIGGIAWGVYAFFAN

SEQ ID NO: 1599197 - protein, 25 aa, Staphylococcus aureus
ITLVGAFRFLIAPILAVMDFLGPLA

SEQ ID NO: 1599198 - protein, 25 aa, Staphylococcus aureus
IYTILPWFLITIPIIILLSYQLDVL

SEQ ID NO: 1599199 - protein, 22 aa, Staphylococcus aureus
KANIWFLIIFVLTVLVFNPLIV

SEQ ID NO: 1599200 - protein, 17 aa, Staphylococcus aureus
KARNFYSMLYDWRINKN

SEQ ID NO: 1599201 - protein, 21 aa, Staphylococcus aureus
KFAIFLMVVLVVLGGVYASAK

SEQ ID NO: 1599202 - protein, 28 aa, Staphylococcus aureus
KGSIEGTKHLPLLFAKRRRKEDEEDAIV

SEQ ID NO: 1599203 - protein, 31 aa, Staphylococcus aureus
KKGWFWGCGGCLVLFILIIIGISACTAGITG

SEQ ID NO: 1599204 - protein, 21 aa, Staphylococcus aureus
KKHSTLLFATLLIAFGYLSHF

SEQ ID NO: 1599205 - protein, 36 aa, Staphylococcus aureus
KKKSTRKIVLLSLIFSLLMIALVSFVAMAMFGNKYE

SEQ ID NO: 1599206 - protein, 24 aa, Staphylococcus aureus
KNGKTFFFIDKLEFKPKLTSVYVK

SEQ ID NO: 1599207 - protein, 24 aa, Staphylococcus aureus
KNQAYNFLITSSQRWGLNQGINAN

SEQ ID NO: 1599208 - protein, 31 aa, Staphylococcus aureus
KQNGLLGGVMTLLVGLGLMKRKKKKDENDQD

SEQ ID NO: 1599209 - protein, 31 aa, Staphylococcus aureus
KSGIKEIEMFKIMGLPFISHSLVSQDNQSIS

SEQ ID NO: 1599210 - protein, 28 aa, Staphylococcus aureus
KTQGPTVNKLYYAAGGRALEYNQLFMYS

SEQ ID NO: 1599211 - protein, 28 aa, Staphylococcus aureus
KYIIFGIVLAITLLIVGIAYYLISLNNA

SEQ ID NO: 1599212 - protein, 17 aa, Staphylococcus aureus
LCLCIAIALILYALPYL

SEQ ID NO: 1599213 - protein, 17 aa, Staphylococcus aureus
LFAKRRKDKEEDVETTT

SEQ ID NO: 1599214 - protein, 19 aa, Staphylococcus aureus
LFIHWIWPDLPIGAAFAIA

SEQ ID NO: 1599215 - protein, 18 aa, Staphylococcus aureus
LFKLSWIVLAVLLVGYLV

SEQ ID NO: 1599216 - protein, 29 aa, Staphylococcus aureus
LHGYHANYGYYYYYPVSLTWDNGVAFYSN

SEQ ID NO: 1599217 - protein, 19 aa, Staphylococcus aureus
LIMVLIGFIFWRQDDYTSR

SEQ ID NO: 1599218 - protein, 26 aa, Staphylococcus aureus
LKGFALYISILILIVFIAGCGKSDKT

SEQ ID NO: 1599219 - protein, 24 aa, Staphylococcus aureus
LKSSLFFYYLFTKLSLISVLVLHL

SEQ ID NO: 1599220 - protein, 17 aa, Staphylococcus aureus
LLAWIVAAVLRIALGSA

SEQ ID NO: 1599221 - protein, 18 aa, Staphylococcus aureus
LNAVTRAKAALNGADNLR

SEQ ID NO: 1599222 - protein, 26 aa, Staphylococcus aureus
LRMMIYLGLFIFSISVLYIIYLFINI

SEQ ID NO: 1599223 - protein, 18 aa, Staphylococcus aureus
LYISIMVLSIFIIGCGKG

SEQ ID NO: 1599224 - protein, 21 aa, Staphylococcus aureus
LYRFYFYRLFAIVTWLLFIGS

SEQ ID NO: 1599225 - protein, 30 aa, Staphylococcus aureus
MILKGVVQLIWNLIQLWFVGKILGVVRYFG

SEQ ID NO: 1599226 - protein, 18 aa, Staphylococcus aureus
MLKGCGGCLISFIILIIL

SEQ ID NO: 1599227 - protein, 22 aa, Staphylococcus aureus
MLNYKVWYLTLLAGLIPFIPIK

SEQ ID NO: 1599228 - protein, 23 aa, Staphylococcus aureus
MSHKIWLLVLVSTLIPLIPFYKI

SEQ ID NO: 1599229 - protein, 34 aa, Staphylococcus aureus
NALGVVGISGLLASFWFFIAKRRRKEDEEEELEI

SEQ ID NO: 1599230 - protein, 21 aa, Staphylococcus aureus
NEHSPLLFAKRRKDKEEDVET

SEQ ID NO: 1599231 - protein, 18 aa, Staphylococcus aureus
NEIALFTLLTTLTIIFLV

SEQ ID NO: 1599232 - protein, 31 aa, Staphylococcus aureus
NESNTAIMALFIGLILLVVSLVTRFIKLNSH

SEQ ID NO: 1599233 - protein, 23 aa, Staphylococcus aureus
NGGDGIGFAFSPGVLGETGLNGA

SEQ ID NO: 1599234 - protein, 25 aa, Staphylococcus aureus
NGGDGIGFAFSPGVLGETGLNGAAV

SEQ ID NO: 1599235 - protein, 23 aa, Staphylococcus aureus
NHQTQIIKILAKVKPDPPRIDGN

SEQ ID NO: 1599236 - protein, 18 aa, Staphylococcus aureus
NNGIARISAVQIVISDRA

SEQ ID NO: 1599237 - protein, 21 aa, Staphylococcus aureus
NNGMLFGGLFSILGLALLRRN

SEQ ID NO: 1599238 - protein, 21 aa, Staphylococcus aureus
NSILLKSILSLGIIYGGTFGI

SEQ ID NO: 1599239 - protein, 21 aa, Staphylococcus aureus
NSIVLKSILSLGIIYGGTFGI

SEQ ID NO: 1599240 - protein, 23 aa, Staphylococcus aureus
NVYNFIMIIWNQIVAYLQGLWNG

SEQ ID NO: 1599241 - protein, 20 aa, Staphylococcus aureus
PIGIYILMMIGMSSVTIVFG

SEQ ID NO: 1599242 - protein, 17 aa, Staphylococcus aureus
PILLAWIVAAVLRIALG

SEQ ID NO: 1599243 - protein, 20 aa, Staphylococcus aureus
PLHMRHFSNNFGNVIKNAIG

SEQ ID NO: 1599244 - protein, 19 aa, Staphylococcus aureus
PLLMSILISVAFSLLMVTP

SEQ ID NO: 1599245 - protein, 18 aa, Staphylococcus aureus
PLSLIFYLKSLLLILIYE

SEQ ID NO: 1599246 - protein, 18 aa, Staphylococcus aureus
PRMRAFSLSAVAADAPAA

SEQ ID NO: 1599247 - protein, 24 aa, Staphylococcus aureus
QFFQNISPYLPFTYAIDSLRETVG

SEQ ID NO: 1599248 - protein, 23 aa, Staphylococcus aureus
QVFWRILLFYILAIFVIGMLIPY

SEQ ID NO: 1599249 - protein, 37 aa, Staphylococcus aureus
RKMVPWAIGFFILILIIILFFLLRNFNSPEAQTKILV

SEQ ID NO: 1599250 - protein, 18 aa, Staphylococcus aureus
RPLFYFGNIMKPLIWLMN

SEQ ID NO: 1599251 - protein, 20 aa, Staphylococcus aureus
RSFYSIRKSILGVASVIVST

SEQ ID NO: 1599252 - protein, 21 aa, Staphylococcus aureus
SEWVVLILSTILFFYGGKPFL

SEQ ID NO: 1599253 - protein, 25 aa, Staphylococcus aureus
SFCFIFLLLVFFRYILKRYFNYSLN

SEQ ID NO: 1599254 - protein, 19 aa, Staphylococcus aureus
SKIFNIQYLGGVRDNWGVT

SEQ ID NO: 1599255 - protein, 17 aa, Staphylococcus aureus
SVPIFFILMFFSMQLVT

SEQ ID NO: 1599256 - protein, 20 aa, Staphylococcus aureus
TAMGQLQHAIADKTNTLASS

SEQ ID NO: 1599257 - protein, 17 aa, Staphylococcus aureus
TAVIFLTITTVFAFFLS

SEQ ID NO: 1599258 - protein, 33 aa, Staphylococcus aureus
TGDLALRSTFYGYDSNFIWRSMSWDNEVAFNNG

SEQ ID NO: 1599259 - protein, 22 aa, Staphylococcus aureus
TGIIWLVLIYLAQILAYALNTL

SEQ ID NO: 1599260 - protein, 21 aa, Staphylococcus aureus
TLFGGLFAALGSLLLFGRRKK

SEQ ID NO: 1599261 - protein, 24 aa, Staphylococcus aureus
TLIAMIFYVIQLSMPLINLSTLVT

SEQ ID NO: 1599262 - protein, 23 aa, Staphylococcus aureus
TLNIILGLIKFFSSLFTGDWRGV

SEQ ID NO: 1599263 - protein, 19 aa, Staphylococcus aureus
TMISYLLFLLSGLANGLIN

SEQ ID NO: 1599264 - protein, 26 aa, Staphylococcus aureus
TNKGILFGGLFSILGFALLRRNKKNH

SEQ ID NO: 1599265 - protein, 25 aa, Staphylococcus aureus
TNNGMLFGGLFSILGLALLRRNKKN

SEQ ID NO: 1599266 - protein, 21 aa, Staphylococcus aureus
TQFSRRTFLKMLGIGGAGVAI

SEQ ID NO: 1599267 - protein, 18 aa, Staphylococcus aureus
TRYDLISVLPFGNTIAQI

SEQ ID NO: 1599268 - protein, 28 aa, Staphylococcus aureus
TTSSQSWWGLYALLGMLALFIPKFRKES

SEQ ID NO: 1599269 - protein, 24 aa, Staphylococcus aureus
VESPVLFVLITIFCSIIFNSIVYT

SEQ ID NO: 1599270 - protein, 17 aa, Staphylococcus aureus
VFWALMAPIAAVSSVLS

SEQ ID NO: 1599271 - protein, 19 aa, Staphylococcus aureus
VGAFRFLIPIILAVSNFMG

SEQ ID NO: 1599272 - protein, 18 aa, Staphylococcus aureus
VGNLLPGDYFGTIRFGRK

SEQ ID NO: 1599273 - protein, 23 aa, Staphylococcus aureus
VILILIFLFLIFHLIRLATKIED

SEQ ID NO: 1599274 - protein, 19 aa, Staphylococcus aureus
VILTVLVIIGFVLNMFIKH

SEQ ID NO: 1599275 - protein, 23 aa, Staphylococcus aureus
VNPSTPRMRAFSLAAVAADAPAA

SEQ ID NO: 1599276 - protein, 24 aa, Staphylococcus aureus
VSMLFTLLVVPWLSSKKARTLKKH

SEQ ID NO: 1599277 - protein, 17 aa, Staphylococcus aureus
VTAIFQLLFGKIGLIRN

SEQ ID NO: 1599278 - protein, 18 aa, Staphylococcus aureus
VVFDYRRSLLRTDVVLNS

SEQ ID NO: 1599279 - protein, 17 aa, Staphylococcus aureus
VVVPVIYEILFTLKKRF

SEQ ID NO: 1599280 - protein, 18 aa, Staphylococcus aureus
YDFVYFIDTLVYLFILIF

SEQ ID NO: 1599281 - protein, 19 aa, Staphylococcus aureus
YFGPLFFYLNLIANIFFAF

SEQ ID NO: 1599282 - protein, 17 aa, Staphylococcus aureus
YFIWLRFEWPHYLLYIL

SEQ ID NO: 1599283 - protein, 18 aa, Staphylococcus aureus
YFIWLRFEWPQYLIYILF

SEQ ID NO: 1599284 - protein, 18 aa, Staphylococcus aureus
YGQYFRPGSVRLPSQTQN

SEQ ID NO: 1599285 - protein, 23 aa, Staphylococcus aureus
YIQYYLYLLIILGGLYLFTHHAF

SEQ ID NO: 1599286 - protein, 26 aa, Staphylococcus aureus
AAIIIVYLILVITFKGGLAPFTILFS

SEQ ID NO: 1599287 - protein, 25 aa, Staphylococcus aureus
ADAVYKAQLYLSPYGPKQYVEHLNQ

SEQ ID NO: 1599288 - protein, 24 aa, Staphylococcus aureus
AGQSVTYYFTDVKAPTVTVGNQTI

SEQ ID NO: 1599289 - protein, 20 aa, Staphylococcus aureus
AIQSINQALANKLKEIEASN

SEQ ID NO: 1599290 - protein, 18 aa, Staphylococcus aureus
AKRFFFFATSCLVLTLVV

SEQ ID NO: 1599291 - protein, 27 aa, Staphylococcus aureus
ALAVYLFRFVWVYVLYPYFYLAISPFQ

SEQ ID NO: 1599292 - protein, 19 aa, Staphylococcus aureus
ALEYNQLFMYSQLYVESTQ

SEQ ID NO: 1599293 - protein, 18 aa, Staphylococcus aureus
AMGQLQHAIADKTTTLAS

SEQ ID NO: 1599294 - protein, 17 aa, Staphylococcus aureus
APWLFFFPGVLLGGFAL

SEQ ID NO: 1599295 - protein, 18 aa, Staphylococcus aureus
APWLFFFPGVLLGGFALL

SEQ ID NO: 1599296 - protein, 28 aa, Staphylococcus aureus
ASSKGAPYNLPTTPWNTLKASDAKEIAL

SEQ ID NO: 1599297 - protein, 17 aa, Staphylococcus aureus
CFTLFYYFLFGGLSIMA

SEQ ID NO: 1599298 - protein, 27 aa, Staphylococcus aureus
CVVAFFTFPVIVMFLLAPDLNKGKDDA

SEQ ID NO: 1599299 - protein, 22 aa, Staphylococcus aureus
DNAPALYPNYWGGNKFKVIEEL

SEQ ID NO: 1599300 - protein, 20 aa, Staphylococcus aureus
DNEHSPVLIAKRLKDKDGNV

SEQ ID NO: 1599301 - protein, 18 aa, Staphylococcus aureus
DRGFYKTPKYSLGDYVWY

SEQ ID NO: 1599302 - protein, 25 aa, Staphylococcus aureus
DTKVMTVKYAGQTWTRNISDWIAKS

SEQ ID NO: 1599303 - protein, 23 aa, Staphylococcus aureus
DTTPPIVPPTPPTPEVPSEPETP

SEQ ID NO: 1599304 - protein, 21 aa, Staphylococcus aureus
DVTIFILIAILLFVYTYKENE

SEQ ID NO: 1599305 - protein, 17 aa, Staphylococcus aureus
DYRFFIGFKLYLNEQEV

SEQ ID NO: 1599306 - protein, 29 aa, Staphylococcus aureus
EAMGYLKRLSWYISILILIVVIAGCGKGN

SEQ ID NO: 1599307 - protein, 29 aa, Staphylococcus aureus
EANTSLIWGLLASIGSLLLFRRKKENKDK

SEQ ID NO: 1599308 - protein, 17 aa, Staphylococcus aureus
EEKVLLMLLLYRFAYYF

SEQ ID NO: 1599309 - protein, 22 aa, Staphylococcus aureus
EIDPLHMRHFGVRIGNVIKNAL

SEQ ID NO: 1599310 - protein, 20 aa, Staphylococcus aureus
ELIYLFMLGFYRLPGLVAII

SEQ ID NO: 1599311 - protein, 24 aa, Staphylococcus aureus
ENGKYRFDNLDSGKYKVIFEKPAG

SEQ ID NO: 1599312 - protein, 29 aa, Staphylococcus aureus
ERAYKSYYVYGGYRLTWDNGLVLYSNKAD

SEQ ID NO: 1599313 - protein, 29 aa, Staphylococcus aureus
ETTSSLSWWGLYALLGMLALFIPKFRKES

SEQ ID NO: 1599314 - protein, 17 aa, Staphylococcus aureus
FFILMFFSMQLVTLPKQ

SEQ ID NO: 1599315 - protein, 21 aa, Staphylococcus aureus
FIISFFIMLLFPFLQQLSKLQ

SEQ ID NO: 1599316 - protein, 17 aa, Staphylococcus aureus
FIISPQWFTNHGLTNEN

SEQ ID NO: 1599317 - protein, 18 aa, Staphylococcus aureus
FISFLIIGLYMFIEIIGG

SEQ ID NO: 1599318 - protein, 24 aa, Staphylococcus aureus
FITIPIFVLIMIPLGRIMQKISTS

SEQ ID NO: 1599319 - protein, 17 aa, Staphylococcus aureus
FLFKKLTWPVGLIVAAI

SEQ ID NO: 1599320 - protein, 17 aa, Staphylococcus aureus
FLLVLLAVSLYLSQPLS

SEQ ID NO: 1599321 - protein, 18 aa, Staphylococcus aureus
FYNLSIKGTIDQIDKTNN

SEQ ID NO: 1599322 - protein, 24 aa, Staphylococcus aureus
GANKPLPEMWPYGVNDSRSWDYKI

SEQ ID NO: 1599323 - protein, 24 aa, Staphylococcus aureus
GDQSSEVFSPISPIKIATQDNSGN

SEQ ID NO: 1599324 - protein, 22 aa, Staphylococcus aureus
GDTVYPHQAGYVKLNYGFSVPN

SEQ ID NO: 1599325 - protein, 17 aa, Staphylococcus aureus
GGKALKPLGFITAITDN

SEQ ID NO: 1599326 - protein, 25 aa, Staphylococcus aureus
GGVLGFYLLELSVPLISLFGVCIIT

SEQ ID NO: 1599327 - protein, 22 aa, Staphylococcus aureus
GICLVLLIILIVGYVIMTKINS

SEQ ID NO: 1599328 - protein, 26 aa, Staphylococcus aureus
GISGLLASFWFFIAKRRRKEDEEEEL

SEQ ID NO: 1599329 - protein, 20 aa, Staphylococcus aureus
GKDIIPPKTYSGNVDQVVTI

SEQ ID NO: 1599330 - protein, 19 aa, Staphylococcus aureus
GLIFIFLIGAPISNIFESL

SEQ ID NO: 1599331 - protein, 21 aa, Staphylococcus aureus
GLSNAFGFKLDTYHNTSKPNS

SEQ ID NO: 1599332 - protein, 28 aa, Staphylococcus aureus
GNGGDGIGFAFSPGVLGETGLNGAAVGI

SEQ ID NO: 1599333 - protein, 27 aa, Staphylococcus aureus
GQVIYDWPTVHINSLKDLARASDYFSE

SEQ ID NO: 1599334 - protein, 26 aa, Staphylococcus aureus
GSIEGTKHLPLLFAKRRRKEDEEDAI

SEQ ID NO: 1599335 - protein, 26 aa, Staphylococcus aureus
GSLIMLFILDWKMTLLTFITIPIFVL

SEQ ID NO: 1599336 - protein, 25 aa, Staphylococcus aureus
HKDTEDFYITLKIIDVKQPEGDQRV

SEQ ID NO: 1599337 - protein, 26 aa, Staphylococcus aureus
ICNFIKVIFEFILNFVIKPIMFAIWQ

SEQ ID NO: 1599338 - protein, 18 aa, Staphylococcus aureus
IFLFFKLKYYAIVTILVT

SEQ ID NO: 1599339 - protein, 17 aa, Staphylococcus aureus
IFNIQYLGGVRDNWGVT

SEQ ID NO: 1599340 - protein, 24 aa, Staphylococcus aureus
IGGLSNAFGFKLDTYHNTSKPNSA

SEQ ID NO: 1599341 - protein, 22 aa, Staphylococcus aureus
IGIALFIFVIVRPPVEFIRQYL

SEQ ID NO: 1599342 - protein, 23 aa, Staphylococcus aureus
IHIKIIYWLVLTAIFFIANILII

SEQ ID NO: 1599343 - protein, 17 aa, Staphylococcus aureus
IIALILCLFLQSNKKAK

SEQ ID NO: 1599344 - protein, 20 aa, Staphylococcus aureus
IILGLIKFFSSLFVGDWRGV

SEQ ID NO: 1599345 - protein, 19 aa, Staphylococcus aureus
IISAVLSLPLLMLMFVHLF

SEQ ID NO: 1599346 - protein, 23 aa, Staphylococcus aureus
IPIIVVLLLIGGIAWGVYAFFAN

SEQ ID NO: 1599347 - protein, 17 aa, Staphylococcus aureus
IQSINQALANKLKEIEA

SEQ ID NO: 1599348 - protein, 24 aa, Staphylococcus aureus
ISKKITGYGLKTTAVIGGAFTVNM

SEQ ID NO: 1599349 - protein, 24 aa, Staphylococcus aureus
ISKKMTGYGLKTTAVIGGAFTINM

SEQ ID NO: 1599350 - protein, 18 aa, Staphylococcus aureus
ITAVIFLTITTVFAFFLS

SEQ ID NO: 1599351 - protein, 23 aa, Staphylococcus aureus
ITEQDILAHINLIDQLTAEIIDT

SEQ ID NO: 1599352 - protein, 21 aa, Staphylococcus aureus
KAIQSINQALANKLKEIEASN

SEQ ID NO: 1599353 - protein, 20 aa, Staphylococcus aureus
KATYDILTKTYTFVFTDYVN

SEQ ID NO: 1599354 - protein, 22 aa, Staphylococcus aureus
KDFLAQWKLYIISAVVLIMVLI

SEQ ID NO: 1599355 - protein, 23 aa, Staphylococcus aureus
KFIPYLLFVVIWTALVYSPVAHW

SEQ ID NO: 1599356 - protein, 29 aa, Staphylococcus aureus
KGDLALRSTLYGYNSNIIWRSMSWDNEVA

SEQ ID NO: 1599357 - protein, 28 aa, Staphylococcus aureus
KGHAPHENMIYWFALPAGQTPVGRTEFV

SEQ ID NO: 1599358 - protein, 31 aa, Staphylococcus aureus
KKIRKLPIILLIVVILLIALIVYIVHSYNSG

SEQ ID NO: 1599359 - protein, 31 aa, Staphylococcus aureus; identical to SEQ ID NO: 1593794

SEQ ID NO: 1599360 - protein, 18 aa, Staphylococcus aureus
KLGILIALLFFPTGHILL

SEQ ID NO: 1599361 - protein, 21 aa, Staphylococcus aureus
KNDLKEIPLLVTKKNDVSETV

SEQ ID NO: 1599362 - protein, 20 aa, Staphylococcus aureus
KRLNAKMRFAVAQPAAVASN

SEQ ID NO: 1599363 - protein, 27 aa, Staphylococcus aureus
KSRKNWIFWILFLNILMLGISLIDYDF

SEQ ID NO: 1599364 - protein, 20 aa, Staphylococcus aureus
KTRVRLYKSGKNWVKSGIKE

SEQ ID NO: 1599365 - protein, 20 aa, Staphylococcus aureus
KVAFILPIILISLSIRACLE

SEQ ID NO: 1599366 - protein, 19 aa, Staphylococcus aureus
KVLGFYPTNATTNAFRPGG

SEQ ID NO: 1599367 - protein, 25 aa, Staphylococcus aureus
KVTILLFISLIVAVAFFFGLKTYQG

SEQ ID NO: 1599368 - protein, 28 aa, Staphylococcus aureus
LAGYRAKFILMVILTMMVFVLINTYLLR

SEQ ID NO: 1599369 - protein, 17 aa, Staphylococcus aureus
LHQIYLKTILSLYIDIS

SEQ ID NO: 1599370 - protein, 17 aa, Staphylococcus aureus
LITFLPLLFLPFSGELG

SEQ ID NO: 1599371 - protein, 28 aa, Staphylococcus aureus
LKILIILPLLFLIISAIVTFFVLSPKYQ

SEQ ID NO: 1599372 - protein, 23 aa, Staphylococcus aureus
LKKWYLIIYLLFILAALVITLTT

SEQ ID NO: 1599373 - protein, 24 aa, Staphylococcus aureus
LKKWYLIIYLLFILAALVITLTTI

SEQ ID NO: 1599374 - protein, 24 aa, Staphylococcus aureus
LKSALFFYYLFTKLSLISVLVLHL

SEQ ID NO: 1599375 - protein, 22 aa, Staphylococcus aureus
LLRTTFILLTLVGIGLTAFSFI

SEQ ID NO: 1599376 - protein, 17 aa, Staphylococcus aureus
LMLKWWLILAISIIVLI

SEQ ID NO: 1599377 - protein, 25 aa, Staphylococcus aureus
LTDQKYLLFWLLLGFIFGFFPPIQT

SEQ ID NO: 1599378 - protein, 19 aa, Staphylococcus aureus
LVGNLLPGDYFGTIRFGRK

SEQ ID NO: 1599379 - protein, 22 aa, Staphylococcus aureus
LYIPIFFLMFYSFNSAGNMIHF

SEQ ID NO: 1599380 - protein, 19 aa, Staphylococcus aureus
LYISIMVLSIFIIGCNSSS

SEQ ID NO: 1599381 - protein, 22 aa, Staphylococcus aureus
LYNGWFSINLFLPFAIAIQYYT

SEQ ID NO: 1599382 - protein, 23 aa, Staphylococcus aureus
LYNGWFSINLFLPFAIAIQYYTI

SEQ ID NO: 1599383 - protein, 18 aa, Staphylococcus aureus
MILIVLMFMLFIGNLTIL

SEQ ID NO: 1599384 - protein, 24 aa, Staphylococcus aureus
MSHKIWLLVLVSTLIPLIPFYKIS

SEQ ID NO: 1599385 - protein, 22 aa, Staphylococcus aureus
MSPILLAWIVAAVLRIALGSAT

SEQ ID NO: 1599386 - protein, 18 aa, Staphylococcus aureus
MTGYGLKTTAVIGGAFTV

SEQ ID NO: 1599387 - protein, 22 aa, Staphylococcus aureus
MVFIMLLNIITPLFNKNEALAA

SEQ ID NO: 1599388 - protein, 17 aa, Staphylococcus aureus
NAVTRAKAALNGADNLR

SEQ ID NO: 1599389 - protein, 17 aa, Staphylococcus aureus
NEHSPVLIAKRLKDKDG

SEQ ID NO: 1599390 - protein, 42 aa, Staphylococcus aureus
NEPLPNRKDFVVSFITGALVGSALGLYFKNKVYQKADDLKVK

SEQ ID NO: 1599391 - protein, 24 aa, Staphylococcus aureus
NFIIPFLLIFIIDGFRGVKETLPA

SEQ ID NO: 1599392 - protein, 21 aa, Staphylococcus aureus
NFIIPFLLIFIVDGFRGVKET

SEQ ID NO: 1599393 - protein, 26 aa, Staphylococcus aureus
NGGDGIGFAFSPGVLGETGLNGAAVG

SEQ ID NO: 1599394 - protein, 18 aa, Staphylococcus aureus
NGKFSLPLFTDRAKAPKS

SEQ ID NO: 1599395 - protein, 18 aa, Staphylococcus aureus
NGKYRFDNLDSGKYKVIF

SEQ ID NO: 1599396 - protein, 23 aa, Staphylococcus aureus
NHQTQIIKILSKVKPDPPRIDGN

SEQ ID NO: 1599397 - protein, 31 aa, Staphylococcus aureus
NKRINFIFGVIIFIFAVLVLRLGYLQIAQGS

SEQ ID NO: 1599398 - protein, 17 aa, Staphylococcus aureus
NKSFHFSGKVNLGNKYE

SEQ ID NO: 1599399 - protein, 20 aa, Staphylococcus aureus
NKVLGFYPTSANTNAFRPGG

SEQ ID NO: 1599400 - protein, 31 aa, Staphylococcus aureus
NLEFQTHLFGYYNYYYTSNLTWKNGVAFYSN

SEQ ID NO: 1599401 - protein, 23 aa, Staphylococcus aureus
NQKHLIFWLLLGFTFGFFPPIQT

SEQ ID NO: 1599402 - protein, 22 aa, Staphylococcus aureus
NSILLKSILSLGIIYGGTFGIY

SEQ ID NO: 1599403 - protein, 30 aa, Staphylococcus aureus
NSSKRVHLKRWQFISILIGTIIITAVITVV

SEQ ID NO: 1599404 - protein, 30 aa, Staphylococcus aureus
NSSKRVHLKRWQFISILIGTILITAVITVV

SEQ ID NO: 1599405 - protein, 17 aa, Staphylococcus aureus
NVYQFEFPQTSYTTTVG

SEQ ID NO: 1599406 - protein, 24 aa, Staphylococcus aureus
PDLNSDFILFDFTYDLPLSTYLGQ

SEQ ID NO: 1599407 - protein, 31 aa, Staphylococcus aureus
PEILITKLIILTLFGIGFFVVGLILKPVTDP

SEQ ID NO: 1599408 - protein, 29 aa, Staphylococcus aureus
PEQRYGYYYNSYQLTWDNGLVLYSNKADG

SEQ ID NO: 1599409 - protein, 19 aa, Staphylococcus aureus
PIGIYILMMIGMSTVTIVF

SEQ ID NO: 1599410 - protein, 24 aa, Staphylococcus aureus
PKFLTLFAGPLFNFILALVLFIGL

SEQ ID NO: 1599411 - protein, 21 aa, Staphylococcus aureus
PLDPSALVYLVIPTSQTRDGG

SEQ ID NO: 1599412 - protein, 21 aa, Staphylococcus aureus
PLFNFILALVLFIGLAYYQGT

SEQ ID NO: 1599413 - protein, 21 aa, Staphylococcus aureus
PSTPRMRAFSLAAVAADAPAA

SEQ ID NO: 1599414 - protein, 23 aa, Staphylococcus aureus
PYGDYWFAYFMRRLAERPQNLSL

SEQ ID NO: 1599415 - protein, 29 aa, Staphylococcus aureus
QAARTGSPIRLMIGFDYPDAFGNGETLVP

SEQ ID NO: 1599416 - protein, 35 aa, Staphylococcus aureus
QKKSKKGWFWGCGGCLVLFILIIIGISACTAGITG

SEQ ID NO: 1599417 - protein, 31 aa, Staphylococcus aureus
QKNLKILIILPLLFLIISAIVTFFVLSPKYQ

SEQ ID NO: 1599418 - protein, 23 aa, Staphylococcus aureus
QTGDGYQWVIKFNKGHAPHENMI

SEQ ID NO: 1599419 - protein, 21 aa, Staphylococcus aureus
QTIEVGKTMNLIVLTTTDNGT

SEQ ID NO: 1599420 - protein, 21 aa, Staphylococcus aureus
QWVIWTILVTSFFSIGTPGIA

SEQ ID NO: 1599421 - protein, 24 aa, Staphylococcus aureus
QYVNYFMFFNVIATLLTLYVIANY

SEQ ID NO: 1599422 - protein, 20 aa, Staphylococcus aureus
RAFLIMCLIGFGVGILANAG

SEQ ID NO: 1599423 - protein, 29 aa, Staphylococcus aureus
RINFIFGVIVFIFAVLVLRLGYLQIAQGS

SEQ ID NO: 1599424 - protein, 18 aa, Staphylococcus aureus
RKEQLFEIRVKPHTPRIT

SEQ ID NO: 1599425 - protein, 17 aa, Staphylococcus aureus
RTQLTGYPENRYKTYYY

SEQ ID NO: 1599426 - protein, 17 aa, Staphylococcus aureus
RVLGNTWVYIKGYQDKI

SEQ ID NO: 1599427 - protein, 19 aa, Staphylococcus aureus
RVNAKMRFAVAQPAAVASN

SEQ ID NO: 1599428 - protein, 22 aa, Staphylococcus aureus
SHKIWLLVLVSTLIPLIPFYKI

SEQ ID NO: 1599429 - protein, 20 aa, Staphylococcus aureus
SIIFLFFKLKYYAIVTILVT

SEQ ID NO: 1599430 - protein, 25 aa, Staphylococcus aureus
SILWVYIVLLYLCYLFITANFLDYT

SEQ ID NO: 1599431 - protein, 17 aa, Staphylococcus aureus
SIRRFTVGTTSVIVGAT

SEQ ID NO: 1599432 - protein, 22 aa, Staphylococcus aureus
SIVLLFLTFPIMFIFAIAIVID

SEQ ID NO: 1599433 - protein, 22 aa, Staphylococcus aureus
SKDEDVPLLLAKKKNQKDNQSK

SEQ ID NO: 1599434 - protein, 25 aa, Staphylococcus aureus
SKGDLALRSTLYGYDSRFVWRSMSW

SEQ ID NO: 1599435 - protein, 29 aa, Staphylococcus aureus
SNLNNMNFLRWVNFPQDYTVTWTNAKIAN

SEQ ID NO: 1599436 - protein, 25 aa, Staphylococcus aureus
SNNATLFGGLFAALGSLLLFGRRKK

SEQ ID NO: 1599437 - protein, 18 aa, Staphylococcus aureus
SNNGTLFGGLFAALGSLL

SEQ ID NO: 1599438 - protein, 17 aa, Staphylococcus aureus
SSPEAMFVLLAGIGLIA

SEQ ID NO: 1599439 - protein, 28 aa, Staphylococcus aureus
STNKGMLFGGLFSILGLALLRRNKKNHK

SEQ ID NO: 1599440 - protein, 28 aa, Staphylococcus aureus
STNKGMLFGGLFSILGLVLLRRNKKNNK

SEQ ID NO: 1599441 - protein, 25 aa, Staphylococcus aureus
SVKEGDIFTFKYGQYFRPGSVRLPS

SEQ ID NO: 1599442 - protein, 23 aa, Staphylococcus aureus
SVWLVLLFSVMGLWHVSNAAEQH

SEQ ID NO: 1599443 - protein, 25 aa, Staphylococcus aureus
TALKRLPWLIILTFLGMVTATILGR

SEQ ID NO: 1599444 - protein, 18 aa, Staphylococcus aureus
TASILIGSLMYLGTQQEA

SEQ ID NO: 1599445 - protein, 22 aa, Staphylococcus aureus
TASILIGSLMYLGTQQEAEAAE

SEQ ID NO: 1599446 - protein, 23 aa, Staphylococcus aureus
TASILIGSLMYLGTQQEAEAAEN

SEQ ID NO: 1599447 - protein, 27 aa, Staphylococcus aureus
TAVIGGAFTINMLHDQQAFAASDAPLT

SEQ ID NO: 1599448 - protein, 21 aa, Staphylococcus aureus
TDKDWQITGIPRTLHIENSTN

SEQ ID NO: 1599449 - protein, 23 aa, Staphylococcus aureus
TDKYGYYNYAGYSNFIVTSNDSG

SEQ ID NO: 1599450 - protein, 17 aa, Staphylococcus aureus
TFLILWLLIIELLTTGL

SEQ ID NO: 1599451 - protein, 22 aa, Staphylococcus aureus
TGLPTDGFTYKWNNAATGTNDA

SEQ ID NO: 1599452 - protein, 27 aa, Staphylococcus aureus
TIRPEDYVVFIPPVGNQIRALIFYNNV

SEQ ID NO: 1599453 - protein, 21 aa, Staphylococcus aureus
TIWFVIPIIIVAALAIPTVKT

SEQ ID NO: 1599454 - protein, 17 aa, Staphylococcus aureus
TIWNAIWTFLQTLWNTI

SEQ ID NO: 1599455 - protein, 27 aa, Staphylococcus aureus
TNAGQSVTYYFTDVKAPTVTVGNQTIE

SEQ ID NO: 1599456 - protein, 22 aa, Staphylococcus aureus
TNEAINIYFVPSDLVNPTISVG

SEQ ID NO: 1599457 - protein, 23 aa, Staphylococcus aureus
TNKGMLFGGLFSILGLALLRRNK

SEQ ID NO: 1599458 - protein, 25 aa, Staphylococcus aureus
TNKGMLFGGLFSILGLALLRRNKKN

SEQ ID NO: 1599459 - protein, 28 aa, Staphylococcus aureus
TSTAPVKLRTFSRLAMSTFASAATTTAV

SEQ ID NO: 1599460 - protein, 34 aa, Staphylococcus aureus
TSTSTAPIKLRTFSRLAMSTFASAATTSAVTANT

SEQ ID NO: 1599461 - protein, 22 aa, Staphylococcus aureus
TTNDILTLLKATTTVPGLRNNI

SEQ ID NO: 1599462 - protein, 17 aa, Staphylococcus aureus
TVYPHQAGYVKLNYGFS

SEQ ID NO: 1599463 - protein, 18 aa, Staphylococcus aureus
VETLKWARWLPHMTLRGQ

SEQ ID NO: 1599464 - protein, 17 aa, Staphylococcus aureus
VFGSLLCLFYMIKAFRQ

SEQ ID NO: 1599465 - protein, 28 aa, Staphylococcus aureus
VGSLIMLFILDWKMTLLTFITIPIFVLI

SEQ ID NO: 1599466 - protein, 33 aa, Staphylococcus aureus
VIAIRMLFHPFKPYYIFKFRVPFTPGLIPKRRE

SEQ ID NO: 1599467 - protein, 19 aa, Staphylococcus aureus
VIIILILILGGIFLKMKYN

SEQ ID NO: 1599468 - protein, 18 aa, Staphylococcus aureus
VILTVLVIIGFVLNMFIK

SEQ ID NO: 1599469 - protein, 18 aa, Staphylococcus aureus
VIQIMDIINPSNGFGGQP

SEQ ID NO: 1599470 - protein, 33 aa, Staphylococcus aureus
VKSGIKEIEMFKIMGLPFISHSIVSQDNQSISK

SEQ ID NO: 1599471 - protein, 28 aa, Staphylococcus aureus
VLHWSLNHKWIVIILSTLILVTTIVFGG

SEQ ID NO: 1599472 - protein, 17 aa, Staphylococcus aureus
VLIAKRLKDKDGNVETT

SEQ ID NO: 1599473 - protein, 23 aa, Staphylococcus aureus
VLRYYFWLTILIIAIIIGMIAWL

SEQ ID NO: 1599474 - protein, 19 aa, Staphylococcus aureus
VNIFDWRYLFLVVLLIGMV

SEQ ID NO: 1599475 - protein, 17 aa, Staphylococcus aureus
VNPKQRVLGNTWVYIKG

SEQ ID NO: 1599476 - protein, 18 aa, Staphylococcus aureus
VTANLEINLFIDPKTFQS

SEQ ID NO: 1599477 - protein, 34 aa, Staphylococcus aureus
VTGNRPFFRLYLITWMMHLILIGGSRLFWRIYRK

SEQ ID NO: 1599478 - protein, 26 aa, Staphylococcus aureus
VTIRPQDYVVFIPPVGKQIRAVVYYN

SEQ ID NO: 1599479 - protein, 29 aa, Staphylococcus aureus
VVGISGLLASFWFFIAKRRRKEDEEEELE

SEQ ID NO: 1599480 - protein, 18 aa, Staphylococcus aureus
VVIPVIYEILFTLKKRFT

SEQ ID NO: 1599481 - protein, 30 aa, Staphylococcus aureus
VYIHLYDYIPRLFWPIYYFIQAPMQKMMIH

SEQ ID NO: 1599482 - protein, 20 aa, Staphylococcus aureus
VYIVLLYLCYLFITANFLDY

SEQ ID NO: 1599483 - protein, 18 aa, Staphylococcus aureus
WIFIVFIISVYYIFWLLA

SEQ ID NO: 1599484 - protein, 20 aa, Staphylococcus aureus
YALLFFDMIVVAISLTVIPL

SEQ ID NO: 1599485 - protein, 26 aa, Staphylococcus aureus
YARPLFYFGNIMKPLIWLMNGSARVI

SEQ ID NO: 1599486 - protein, 17 aa, Staphylococcus aureus
YDFPIDSLFYIVSLNLS

SEQ ID NO: 1599487 - protein, 24 aa, Staphylococcus aureus
YEKYGKFYNLSIKGTIDQIDKTNN

SEQ ID NO: 1599488 - protein, 28 aa, Staphylococcus aureus
YIHLYDYIPRLFWPIYYFIQAPMQKMMI

SEQ ID NO: 1599489 - protein, 32 aa, Staphylococcus aureus
YNGDTKVMTVKYAGQTWTRNISDWIAKSGTTN

SEQ ID NO: 1599490 - protein, 23 aa, Staphylococcus aureus
YRKIKFYMFISKIFKFNKTTEIT

SEQ ID NO: 1599491 - protein, 30 aa, Staphylococcus aureus
YTISFKTQGPTIDKLYYAAGGRALEYNQLF

SEQ ID NO: 1599492 - protein, 31 aa, Staphylococcus aureus
YTVGTFSTVIATLVFLGLNTSQAQAAETNQP

SEQ ID NO: 1599493 - protein, 25 aa, Staphylococcus aureus
AALKRLPWLIILTFLGMITATILGR

SEQ ID NO: 1599494 - protein, 18 aa, Staphylococcus aureus
AAMFVLVAGIGLIATVRR

SEQ ID NO: 1599495 - protein, 21 aa, Staphylococcus aureus
AARLLLFFGLLDAGSAIATSS

SEQ ID NO: 1599496 - protein, 22 aa, Staphylococcus aureus
AFSFFIYLFIYLLHPIILDSLF

SEQ ID NO: 1599497 - protein, 24 aa, Staphylococcus aureus
AFVGYLELLFGPLRRLVASFTTLT

SEQ ID NO: 1599498 - protein, 19 aa, Staphylococcus aureus
AFVILFIVGKFIVTPYTIK

SEQ ID NO: 1599499 - protein, 25 aa, Staphylococcus aureus
AGVLAFIFLIYRIYSLFSGYKVVNK

SEQ ID NO: 1599500 - protein, 19 aa, Staphylococcus aureus
AIFFKKMIYFWLSEGQLIL

SEQ ID NO: 1599501 - protein, 21 aa, Staphylococcus aureus
AIGIALFIFVIVRPPIEFICQ

SEQ ID NO: 1599502 - protein, 25 aa, Staphylococcus aureus
AIIIVYLILVITFKGGLAPFTILFS

SEQ ID NO: 1599503 - protein, 23 aa, Staphylococcus aureus
AIQSINQALTYKLKEIEASNATE

SEQ ID NO: 1599504 - protein, 25 aa, Staphylococcus aureus
AIVCSMMVVFSIMLFLFVKRNKKKI

SEQ ID NO: 1599505 - protein, 39 aa, Staphylococcus aureus
AIVILIVFALLFRFIVRLIPIFYIFRVLSIFIFIMGFKM

SEQ ID NO: 1599506 - protein, 25 aa, Staphylococcus aureus
AKPPKFLVRFWTLASGTILGLALMM

SEQ ID NO: 1599507 - protein, 21 aa, Staphylococcus aureus
AKQFFSTVLIPLSTSMKTLSD

SEQ ID NO: 1599508 - protein, 20 aa, Staphylococcus aureus
ALALYALPYLILGSNNWSFV

SEQ ID NO: 1599509 - protein, 26 aa, Staphylococcus aureus
ALAVYLFRFVWVYVLYPYFYLAISPF

SEQ ID NO: 1599510 - protein, 21 aa, Staphylococcus aureus
ALEYNQLFMYSQLYVESTQDH

SEQ ID NO: 1599511 - protein, 32 aa, Staphylococcus aureus
ALGVVGISGLLASFWFFIAKRRRKEDEEEELE

SEQ ID NO: 1599512 - protein, 37 aa, Staphylococcus aureus
ALLIPFVIMIITAIVLMGVWFIFNSLIALIVSIVLVV

SEQ ID NO: 1599513 - protein, 18 aa, Staphylococcus aureus
ALTAKGYNYTSVDISYAS

SEQ ID NO: 1599514 - protein, 18 aa, Staphylococcus aureus
ALVGSALGLYFKNKVYQK

SEQ ID NO: 1599515 - protein, 18 aa, Staphylococcus aureus
AMGTLKHAIADKTNTLAS

SEQ ID NO: 1599516 - protein, 20 aa, Staphylococcus aureus
AMISYLLFLLSGLANGLINM

SEQ ID NO: 1599517 - protein, 18 aa, Staphylococcus aureus
AMMALLGSLLLFRKRKQD

SEQ ID NO: 1599518 - protein, 19 aa, Staphylococcus aureus
AMPILALGAFLIFFFKRSK

SEQ ID NO: 1599519 - protein, 20 aa, Staphylococcus aureus
AMPILALGAFLIFFFKRSKI

SEQ ID NO: 1599520 - protein, 18 aa, Staphylococcus aureus
AMTALKRAIADKAETKAS

SEQ ID NO: 1599521 - protein, 23 aa, Staphylococcus aureus
ANTILRWLSIFVIPLFGIIISKL

SEQ ID NO: 1599522 - protein, 32 aa, Staphylococcus aureus
AQNNGTLFGSLFAALGGLFLVGRRRKNKNNEE

SEQ ID NO: 1599523 - protein, 19 aa, Staphylococcus aureus
ARPLFYFGNIMKPLIWLMN

SEQ ID NO: 1599524 - protein, 21 aa, Staphylococcus aureus
ARWQLCIIFSLFALMSNLTGI

SEQ ID NO: 1599525 - protein, 21 aa, Staphylococcus aureus
ASYLHLILPIAMLIALTVCLI

SEQ ID NO: 1599526 - protein, 25 aa, Staphylococcus aureus
ATLFDAMVALLGSLLLFRKRKQDHK

SEQ ID NO: 1599527 - protein, 17 aa, Staphylococcus aureus
ATLTMPAYIDPENVTKT

SEQ ID NO: 1599528 - protein, 18 aa, Staphylococcus aureus
AVGYIGLSLIIRGIAYLT

SEQ ID NO: 1599529 - protein, 24 aa, Staphylococcus aureus
AVIYYFVFRFLIVKLKYKTPGRED

SEQ ID NO: 1599530 - protein, 17 aa, Staphylococcus aureus
AVLKYKLKFENGLHQGD

SEQ ID NO: 1599531 - protein, 18 aa, Staphylococcus aureus
AVMFVLVAGIGLIATVRR

SEQ ID NO: 1599532 - protein, 25 aa, Staphylococcus aureus
AVNPSAPRMRAFSLAAVAADAPAAG

SEQ ID NO: 1599533 - protein, 17 aa, Staphylococcus aureus
AVWIILAGLAILPSFYA

SEQ ID NO: 1599534 - protein, 27 aa, Staphylococcus aureus
CLGAVFFYFWGVFLYNSLHKCKGFSFH

SEQ ID NO: 1599535 - protein, 17 aa, Staphylococcus aureus
CLVIYDWRVIESETIMS

SEQ ID NO: 1599536 - protein, 25 aa, Staphylococcus aureus
CNFIKVIFEFILNFVIKPIMFAIWQ

SEQ ID NO: 1599537 - protein, 28 aa, Staphylococcus aureus
DDIITEQDILAHINLIDQLTAEIIDTPS

SEQ ID NO: 1599538 - protein, 21 aa, Staphylococcus aureus
DDTKHLPLLFAKRRRKEDEED

SEQ ID NO: 1599539 - protein, 25 aa, Staphylococcus aureus
DFDRIIDYLILLILICSGLSYSKTE

SEQ ID NO: 1599540 - protein, 27 aa, Staphylococcus aureus
DFFNSNFWIYWKMMFAFEPWHSAMEMR

SEQ ID NO: 1599541 - protein, 19 aa, Staphylococcus aureus
DFVVSFITGALVGSALGLY

SEQ ID NO: 1599542 - protein, 17 aa, Staphylococcus aureus
DFVYFIDTLVYLFILIF

SEQ ID NO: 1599543 - protein, 18 aa, Staphylococcus aureus
DIDPLHMRHFSNNFGNVI

SEQ ID NO: 1599544 - protein, 22 aa, Staphylococcus aureus
DIIHKTYKEEFPNEGTLTAFNT

SEQ ID NO: 1599545 - protein, 25 aa, Staphylococcus aureus
DIITEQDILAHINLIDQLSAEVIDT

SEQ ID NO: 1599546 - protein, 22 aa, Staphylococcus aureus
DKVAGYLFYFAVSIGLISFIVW

SEQ ID NO: 1599547 - protein, 19 aa, Staphylococcus aureus
DKVKHTPFFLPKRRRKEDE

SEQ ID NO: 1599548 - protein, 18 aa, Staphylococcus aureus
DLALRSTLYGYNSNIIWR

SEQ ID NO: 1599549 - protein, 18 aa, Staphylococcus aureus
DLWRWDFGKLLIPFRIFL

SEQ ID NO: 1599550 - protein, 23 aa, Staphylococcus aureus
DNAPALYPNYWGGSKFKVIEELR

SEQ ID NO: 1599551 - protein, 23 aa, Staphylococcus aureus
DNEHSPVLIAKRLKDKDGNVETT

SEQ ID NO: 1599552 - protein, 30 aa, Staphylococcus aureus
DSFFNYLFGYSRYLTYILVLLATGFITYSK

SEQ ID NO: 1599553 - protein, 20 aa, Staphylococcus aureus
DTFTFKYGQYFRPGSVRLPS

SEQ ID NO: 1599554 - protein, 17 aa, Staphylococcus aureus
DTGFYKEPKYNLGDYVW

SEQ ID NO: 1599555 - protein, 18 aa, Staphylococcus aureus
DTKHLPLLFAKRRRKEDE

SEQ ID NO: 1599556 - protein, 27 aa, Staphylococcus aureus
DTKVMTVKYAGQTWTRNISDWIAKSGT

SEQ ID NO: 1599557 - protein, 29 aa, Staphylococcus aureus
DTKVMTVTYAGQTWTRNISDWIAKSGTTN

SEQ ID NO: 1599558 - protein, 22 aa, Staphylococcus aureus
DTTPPIVPPTPPTPEVPSEPET

SEQ ID NO: 1599559 - protein, 22 aa, Staphylococcus aureus
DTTPPIVPPTPPTPEVPSEPEV

SEQ ID NO: 1599560 - protein, 19 aa, Staphylococcus aureus
DTVYPHQAGYVKLNYGFSV

SEQ ID NO: 1599561 - protein, 22 aa, Staphylococcus aureus
DVTIFILIAILLFVYTYKENEE

SEQ ID NO: 1599562 - protein, 25 aa, Staphylococcus aureus
DVVYKAQLYLTPYGPKQYVEHLNQN

SEQ ID NO: 1599563 - protein, 25 aa, Staphylococcus aureus
EFSFLFVAPLLFFIHAVLDGLSFLT

SEQ ID NO: 1599564 - protein, 20 aa, Staphylococcus aureus
EHSPLLFAKRRKDKEEDVET

SEQ ID NO: 1599565 - protein, 27 aa, Staphylococcus aureus
EILITKLIILTLFGMGFFVVGLILKPV

SEQ ID NO: 1599566 - protein, 20 aa, Staphylococcus aureus
EKLIYWNPWDTELSIQDADS

SEQ ID NO: 1599567 - protein, 17 aa, Staphylococcus aureus
EKYGKFYNLSIKGTIDQ

SEQ ID NO: 1599568 - protein, 19 aa, Staphylococcus aureus
EKYGKFYNLSIKGTIDQID

SEQ ID NO: 1599569 - protein, 18 aa, Staphylococcus aureus
EKYGKFYNLSIKGTIDQV

SEQ ID NO: 1599570 - protein, 22 aa, Staphylococcus aureus
ENGKYRFDNLDSGKYKVIFEKP

SEQ ID NO: 1599571 - protein, 28 aa, Staphylococcus aureus
EPLPNRKDFVVSFITGALVGSALGLYFK

SEQ ID NO: 1599572 - protein, 27 aa, Staphylococcus aureus
ESNKDMTLPLMALLALSSIIAFVLPRK

SEQ ID NO: 1599573 - protein, 30 aa, Staphylococcus aureus
ESNTAIMALFIGLILLVVSLVTRFIKLNSH

SEQ ID NO: 1599574 - protein, 29 aa, Staphylococcus aureus
ESNTAIMTLFIGLILLVVSLVTRFIKLNS

SEQ ID NO: 1599575 - protein, 27 aa, Staphylococcus aureus
EVISPTLFVLLMYLLSMITAYIFYSYE

SEQ ID NO: 1599576 - protein, 17 aa, Staphylococcus aureus
EVYSPISPIKIATQDNS

SEQ ID NO: 1599577 - protein, 25 aa, Staphylococcus aureus
FAYFKPHLLYLLIGTAIIFVICKLI

SEQ ID NO: 1599578 - protein, 22 aa, Staphylococcus aureus
FGAMMALLGSLLLFRKRKQDHK

SEQ ID NO: 1599579 - protein, 17 aa, Staphylococcus aureus
FGIIFAVLTLVFVIGII

SEQ ID NO: 1599580 - protein, 17 aa, Staphylococcus aureus
FGLFVAVLGPLVFMFGL

SEQ ID NO: 1599581 - protein, 18 aa, Staphylococcus aureus
FICWIMMTMLFFLLNMAA

SEQ ID NO: 1599582 - protein, 18 aa, Staphylococcus aureus
FIFLVYRIYILFIDYKSV

SEQ ID NO: 1599583 - protein, 19 aa, Staphylococcus aureus
FIFLVYRIYILFIDYKSVN

SEQ ID NO: 1599584 - protein, 20 aa, Staphylococcus aureus
FIHWIWPALPMPAAFAIAAI

SEQ ID NO: 1599585 - protein, 19 aa, Staphylococcus aureus
FIIIFLYFKIRLYSVFLVM

SEQ ID NO: 1599586 - protein, 18 aa, Staphylococcus aureus
FIPLFILGMVFWAIQEQG

SEQ ID NO: 1599587 - protein, 18 aa, Staphylococcus aureus
FIPVIITILLCYFGFQFG

SEQ ID NO: 1599588 - protein, 18 aa, Staphylococcus aureus
FIPYLLFVVIWTALVYSP

SEQ ID NO: 1599589 - protein, 26 aa, Staphylococcus aureus
FIVLCISFFLFPVILLFVFSPEKEEE

SEQ ID NO: 1599590 - protein, 21 aa, Staphylococcus aureus
FKPHLLYLLIGTAIIFVICKL

SEQ ID NO: 1599591 - protein, 17 aa, Staphylococcus aureus
FLFKKLSWPVGPIVAAI

SEQ ID NO: 1599592 - protein, 22 aa, Staphylococcus aureus
FLFLFLVFSWIVSFIPGFELSV

SEQ ID NO: 1599593 - protein, 20 aa, Staphylococcus aureus
FLFLVLVILTLFTYKAPNGM

SEQ ID NO: 1599594 - protein, 20 aa, Staphylococcus aureus
FLLYVKLSCSTMMASSIILT

SEQ ID NO: 1599595 - protein, 21 aa, Staphylococcus aureus
FLQPILFLYFRFIYCRNLFSN

SEQ ID NO: 1599596 - protein, 23 aa, Staphylococcus aureus
FMARYWWIIFPIGGFLSWLIPEL

SEQ ID NO: 1599597 - protein, 23 aa, Staphylococcus aureus
FNIFLIFVLYFNIFLIFLGIGLV

SEQ ID NO: 1599598 - protein, 31 aa, Staphylococcus aureus
FNKGHAPHQNMIFWFALPADQVPVGRTDFVT

SEQ ID NO: 1599599 - protein, 19 aa, Staphylococcus aureus
FQLYVKLSCSTMMAISIIL

SEQ ID NO: 1599600 - protein, 19 aa, Staphylococcus aureus
FQNISPYLPFTYAIDSLRE

SEQ ID NO: 1599601 - protein, 20 aa, Staphylococcus aureus
FRLYVKLSCSTMMATSIILT

SEQ ID NO: 1599602 - protein, 37 aa, Staphylococcus aureus
FRTHLSGYHKNYPYYPNYYYPVQLTWNNGVAFYSNSA

SEQ ID NO: 1599603 - protein, 17 aa, Staphylococcus aureus
FSSIIGIAGLMLLARRR

SEQ ID NO: 1599604 - protein, 17 aa, Staphylococcus aureus
FSVLFWLCILSFFSVLN

SEQ ID NO: 1599605 - protein, 25 aa, Staphylococcus aureus
FTGSDWIVLILATILFFYGGKPFLS

SEQ ID NO: 1599606 - protein, 20 aa, Staphylococcus aureus
FTIIFGAFALFWFVGIHGPS

SEQ ID NO: 1599607 - protein, 19 aa, Staphylococcus aureus
FTYLLIFIYFLILTSRKGS

SEQ ID NO: 1599608 - protein, 24 aa, Staphylococcus aureus
FVIKPIMFAIWQVMQFIWPAVKAL

SEQ ID NO: 1599609 - protein, 21 aa, Staphylococcus aureus
FVLINTYLLRQVKSIGMFLMI

SEQ ID NO: 1599610 - protein, 18 aa, Staphylococcus aureus
FVNPKQRVLGNTWVYIKG

SEQ ID NO: 1599611 - protein, 19 aa, Staphylococcus aureus
FVNPKQRVLGNTWVYIKGY

SEQ ID NO: 1599612 - protein, 17 aa, Staphylococcus aureus
FVVIWTALVYSPVAHWV

SEQ ID NO: 1599613 - protein, 19 aa, Staphylococcus aureus
FYFILFMYNVPMQAYMIGL

SEQ ID NO: 1599614 - protein, 24 aa, Staphylococcus aureus
FYGYDSNFIWRSMSWDNEVAFNNG

SEQ ID NO: 1599615 - protein, 17 aa, Staphylococcus aureus
FYIFRFNVLTYKELTYL

SEQ ID NO: 1599616 - protein, 17 aa, Staphylococcus aureus
FYPVFMSIYWIVGSIYF

SEQ ID NO: 1599617 - protein, 24 aa, Staphylococcus aureus
GALAFIFLIYRIYILFIDYKSVNK

SEQ ID NO: 1599618 - protein, 25 aa, Staphylococcus aureus
GALVGSALGLYFKNKVYQKADDLKV

SEQ ID NO: 1599619 - protein, 20 aa, Staphylococcus aureus
GAMMALLGSLLLFRKRKQDH

SEQ ID NO: 1599620 - protein, 21 aa, Staphylococcus aureus
GAMMALLGSLLLFRKRKQDHK

SEQ ID NO: 1599621 - protein, 22 aa, Staphylococcus aureus
GDLALRSTLYGYNSNIIWRSMS

SEQ ID NO: 1599622 - protein, 21 aa, Staphylococcus aureus
GFLLTVIVIGLIWLIKDKRQS

SEQ ID NO: 1599623 - protein, 18 aa, Staphylococcus aureus
GIGFAFSPGVLGETGLNG

SEQ ID NO: 1599624 - protein, 25 aa, Staphylococcus aureus
GIGGLSNAFGFKLDTYHNTSKPNAA

SEQ ID NO: 1599625 - protein, 25 aa, Staphylococcus aureus
GIGGLSNAFGFKLDTYHNTSTPNAS

SEQ ID NO: 1599626 - protein, 18 aa, Staphylococcus aureus
GIIAAIAFLILCIGIVAV

SEQ ID NO: 1599627 - protein, 17 aa, Staphylococcus aureus
GIKIIALLLVIPGWLTL

SEQ ID NO: 1599628 - protein, 17 aa, Staphylococcus aureus
GKFSLPLFTDRAKAPKS

SEQ ID NO: 1599629 - protein, 18 aa, Staphylococcus aureus
GLIFIFLIGAPISNIFES

SEQ ID NO: 1599630 - protein, 18 aa, Staphylococcus aureus
GLISFIVWMLIQNNVDFA

SEQ ID NO: 1599631 - protein, 21 aa, Staphylococcus aureus
GLPTDGFTYKWNNAATGTNDA

SEQ ID NO: 1599632 - protein, 21 aa, Staphylococcus aureus
GQRAILKYKLKFENGLHQGDF

SEQ ID NO: 1599633 - protein, 19 aa, Staphylococcus aureus
GSALGLYFKNKVYQKADDL

SEQ ID NO: 1599634 - protein, 25 aa, Staphylococcus aureus
GSIEGTKHLPLLFAKRRRKEDEEDA

SEQ ID NO: 1599635 - protein, 26 aa, Staphylococcus aureus
GTIVAIIVILLFLRNIRTTAISIISI

SEQ ID NO: 1599636 - protein, 23 aa, Staphylococcus aureus
GTLFGGLFAALGSLLLFGRRKKQ

SEQ ID NO: 1599637 - protein, 18 aa, Staphylococcus aureus
GVGLFIHWIWPDLPIGAA

SEQ ID NO: 1599638 - protein, 21 aa, Staphylococcus aureus
GVMTLLVGLGLMKRKKKKDEN

SEQ ID NO: 1599639 - protein, 24 aa, Staphylococcus aureus
GWNALFWFTFLLAIMIVIGAYYAL

SEQ ID NO: 1599640 - protein, 17 aa, Staphylococcus aureus
GYNSNIIWRSMSWDNEV

SEQ ID NO: 1599641 - protein, 17 aa, Staphylococcus aureus
HAIRKKSIGVASVLVGT

SEQ ID NO: 1599642 - protein, 17 aa, Staphylococcus aureus
HEEFLKRRFPNNNVPVN

SEQ ID NO: 1599643 - protein, 22 aa, Staphylococcus aureus
HEGQRVVLKYKLKFQDGLKTGD

SEQ ID NO: 1599644 - protein, 18 aa, Staphylococcus aureus
HMRHFSNNFGNVIKNAIG

SEQ ID NO: 1599645 - protein, 26 aa, Staphylococcus aureus
HSRKLRIWLYLVLLAVFIGACGMKKE

SEQ ID NO: 1599646 - protein, 18 aa, Staphylococcus aureus
HWISILPVIIFNKGPRLV

SEQ ID NO: 1599647 - protein, 25 aa, Staphylococcus aureus
HWSLNHKWIVIILSTLILVATVVFG

SEQ ID NO: 1599648 - protein, 42 aa, Staphylococcus aureus
IALAIMILIIFALLFRFIVRLIPIFYIFRVLSIFIFIMGFKM

SEQ ID NO: 1599649 - protein, 23 aa, Staphylococcus aureus
IASYLHLILPIAMLIALTVCLIP

SEQ ID NO: 1599650 - protein, 17 aa, Staphylococcus aureus
ICLFLVLLILNSQFIKN

SEQ ID NO: 1599651 - protein, 18 aa, Staphylococcus aureus
IEGTKHLPLLFAKRRRKE

SEQ ID NO: 1599652 - protein, 17 aa, Staphylococcus aureus
IEVGKTMNPIVLTTTDN

SEQ ID NO: 1599653 - protein, 18 aa, Staphylococcus aureus
IEVGKTMNPIVLTTTDNG

SEQ ID NO: 1599654 - protein, 17 aa, Staphylococcus aureus
IFFFIPMLNWGVPKKFA

SEQ ID NO: 1599655 - protein, 18 aa, Staphylococcus aureus
IFFPAIFYILFTSILDLP

SEQ ID NO: 1599656 - protein, 25 aa, Staphylococcus aureus
IFGIPVFLFLNLIIILLCIIVGSVL

SEQ ID NO: 1599657 - protein, 20 aa, Staphylococcus aureus
IFLFIFFLPFFCIGFFIITL

SEQ ID NO: 1599658 - protein, 17 aa, Staphylococcus aureus
IFLLYFILVINSALFIW

SEQ ID NO: 1599659 - protein, 18 aa, Staphylococcus aureus
IFPYILMSVGAFLTLGFV

SEQ ID NO: 1599660 - protein, 17 aa, Staphylococcus aureus
IFYILFTSILDLPSDVK

SEQ ID NO: 1599661 - protein, 17 aa, Staphylococcus aureus
IFYILFTSILNLPEDVK

SEQ ID NO: 1599662 - protein, 24 aa, Staphylococcus aureus
IGGLSNAFGFKLDTYHNTSKPNAA

SEQ ID NO: 1599663 - protein, 23 aa, Staphylococcus aureus
IGGLSNAFGFKLDTYHNTSKPNS

SEQ ID NO: 1599664 - protein, 24 aa, Staphylococcus aureus
IGGLSNAFGFKLDTYHNTSTPNAS

SEQ ID NO: 1599665 - protein, 17 aa, Staphylococcus aureus
IGGSRLFWRIYRKYLGG

SEQ ID NO: 1599666 - protein, 30 aa, Staphylococcus aureus
IGIKIIALLLVIPGWLTLWIAILSDMGATI

SEQ ID NO: 1599667 - protein, 27 aa, Staphylococcus aureus
IGLILFCVLFFLFPVILMFVFSPEEDK

SEQ ID NO: 1599668 - protein, 28 aa, Staphylococcus aureus
IGTPGIAIIPFSLSIYALSKLILVNKFV

SEQ ID NO: 1599669 - protein, 18 aa, Staphylococcus aureus
IHIKIIYWLVLTTIFFIA

SEQ ID NO: 1599670 - protein, 18 aa, Staphylococcus aureus
IIGNISLRYYPFSKWTIQ

SEQ ID NO: 1599671 - protein, 19 aa, Staphylococcus aureus
IIIANFFMALLTFIFIFYA

SEQ ID NO: 1599672 - protein, 21 aa, Staphylococcus aureus
IIIFLSLLFMIIYIDDIQKWF

SEQ ID NO: 1599673 - protein, 17 aa, Staphylococcus aureus
IIILIIAILMMFAYMSH

SEQ ID NO: 1599674 - protein, 20 aa, Staphylococcus aureus
IIISFLYMAMYKITSYIYAK

SEQ ID NO: 1599675 - protein, 22 aa, Staphylococcus aureus
IIIVYLILVITFKGGLAPFTIL

SEQ ID NO: 1599676 - protein, 17 aa, Staphylococcus aureus
IILFLTLSIMTPYAQAA

SEQ ID NO: 1599677 - protein, 19 aa, Staphylococcus aureus
IILGFIKFFSSLFTGNWRG

SEQ ID NO: 1599678 - protein, 18 aa, Staphylococcus aureus
IISTVLSLPLLMLMFVHL

SEQ ID NO: 1599679 - protein, 17 aa, Staphylococcus aureus
IISTVVLIMVLIGFIFW

SEQ ID NO: 1599680 - protein, 18 aa, Staphylococcus aureus
IISVIFQLLFGKIGLIRN

SEQ ID NO: 1599681 - protein, 21 aa, Staphylococcus aureus
IISWTIGIIGLGFTIAKGFGW

SEQ ID NO: 1599682 - protein, 23 aa, Staphylococcus aureus
IITILLCYFGFQFGLKKRDEMLM

SEQ ID NO: 1599683 - protein, 36 aa, Staphylococcus aureus
IKNALGVVGISGLLASFWFFIAKRRRKEDEEEELEI

SEQ ID NO: 1599684 - protein, 37 aa, Staphylococcus aureus; identical to SEQ ID NO: 1596119

SEQ ID NO: 1599685 - protein, 17 aa, Staphylococcus aureus
ILCVVAFFTFPVIVMFL

SEQ ID NO: 1599686 - protein, 17 aa, Staphylococcus aureus
ILFPVIFYILFTSILNL

SEQ ID NO: 1599687 - protein, 18 aa, Staphylococcus aureus
ILIFICIFTFFLMVIQSQ

SEQ ID NO: 1599688 - protein, 17 aa, Staphylococcus aureus
ILIGSLMYLGTQQEAEA

SEQ ID NO: 1599689 - protein, 17 aa, Staphylococcus aureus
ILIIILIIAILMMFAYM

SEQ ID NO: 1599690 - protein, 18 aa, Staphylococcus aureus
ILLCYFGFQFGLKKRDEM

SEQ ID NO: 1599691 - protein, 19 aa, Staphylococcus aureus
ILLCYFGFQFGLKKRDEML

SEQ ID NO: 1599692 - protein, 17 aa, Staphylococcus aureus
ILLINFGFSFDLIILLR

SEQ ID NO: 1599693 - protein, 24 aa, Staphylococcus aureus
ILPLIFVLIIPILYRFFKRIHLGW

SEQ ID NO: 1599694 - protein, 17 aa, Staphylococcus aureus
ILVTFWTIIILTLLITF

SEQ ID NO: 1599695 - protein, 24 aa, Staphylococcus aureus
IMEGLSLIPLPGMGFLKGAGKSLM

SEQ ID NO: 1599696 - protein, 22 aa, Staphylococcus aureus
IPFIILILLLIPFTSLILGTIS

SEQ ID NO: 1599697 - protein, 24 aa, Staphylococcus aureus
IPIIVVLLLIGGIAWGVYAFFANT

SEQ ID NO: 1599698 - protein, 23 aa, Staphylococcus aureus
IRNDLIDYLDCKVLFIGNLDELN

SEQ ID NO: 1599699 - protein, 17 aa, Staphylococcus aureus
ISIIMVSMLILSLGAFT

SEQ ID NO: 1599700 - protein, 24 aa, Staphylococcus aureus
ISVYYIFWLLAKRKYILVTFWTII

SEQ ID NO: 1599701 - protein, 20 aa, Staphylococcus aureus
ITEQDILAHINLIDQLTAEI

SEQ ID NO: 1599702 - protein, 22 aa, Staphylococcus aureus
ITIPIFVLIMIPLGRIMQKIST

SEQ ID NO: 1599703 - protein, 24 aa, Staphylococcus aureus
ITLVGAFRFLIAPILAVMDFLGPL

SEQ ID NO: 1599704 - protein, 19 aa, Staphylococcus aureus
ITVILFSALISFVLTNVYY

SEQ ID NO: 1599705 - protein, 25 aa, Staphylococcus aureus
IVCSMMVIFSIMLFLFVKRNKKKNK

SEQ ID NO: 1599706 - protein, 18 aa, Staphylococcus aureus
IVMIWSAPFFKNLFLPNG

SEQ ID NO: 1599707 - protein, 28 aa, Staphylococcus aureus
IVQVLTFIVLLALLEKFAWGPLKDVMDK

SEQ ID NO: 1599708 - protein, 28 aa, Staphylococcus aureus
IVQVLTFIVLLALLKKFAWGPLKDIMDK

SEQ ID NO: 1599709 - protein, 20 aa, Staphylococcus aureus
IVYIIPRFFKAIPAPLIAII

SEQ ID NO: 1599710 - protein, 25 aa, Staphylococcus aureus
IYVCRFVWVYFWYKDFYFPKNIQSY

SEQ ID NO: 1599711 - protein, 20 aa, Staphylococcus aureus
KAIFEFILNFVIKPIMFAIW

SEQ ID NO: 1599712 - protein, 19 aa, Staphylococcus aureus
KALYDLWRWDFGKLLIPFR

SEQ ID NO: 1599713 - protein, 22 aa, Staphylococcus aureus
KARNFYSMLYDWRINKNPLYKG

SEQ ID NO: 1599714 - protein, 18 aa, Staphylococcus aureus
KDEDVPLLLAKKKNQKDN

SEQ ID NO: 1599715 - protein, 20 aa, Staphylococcus aureus
KDFLAQWKLYTISAVVLIMV

SEQ ID NO: 1599716 - protein, 22 aa, Staphylococcus aureus
KDFLTQWKLYIISTVVLIMVLI

SEQ ID NO: 1599717 - protein, 25 aa, Staphylococcus aureus
KEKNKFTHVAYVKPLNQFKLGTVTV

SEQ ID NO: 1599718 - protein, 26 aa, Staphylococcus aureus
KEKNKFTHVAYVKPLNQFKLGTVTVS

SEQ ID NO: 1599719 - protein, 24 aa, Staphylococcus aureus
KFNDWIFIIFIISVYYIFWLLAKR

SEQ ID NO: 1599720 - protein, 21 aa, Staphylococcus aureus
KFTIFLMVVLVVLGGVYASAK

SEQ ID NO: 1599721 - protein, 24 aa, Staphylococcus aureus
KGDLALRSTLYGYNSNIIWRSMSW

SEQ ID NO: 1599722 - protein, 23 aa, Staphylococcus aureus
KGIKGVYVILKDSNGKELDRTTT

SEQ ID NO: 1599723 - protein, 28 aa, Staphylococcus aureus
KGSIEGTKHLPLLFAKRRRKEDEEDVEV

SEQ ID NO: 1599724 - protein, 29 aa, Staphylococcus aureus
KGSIEGTKHLPLLFAKRRRKEDEEDVEVT

SEQ ID NO: 1599725 - protein, 17 aa, Staphylococcus aureus
KGTVQLIWNLIQLWFVG

SEQ ID NO: 1599726 - protein, 22 aa, Staphylococcus aureus
KGTVQLIWNLIQLWFVGKILGV

SEQ ID NO: 1599727 - protein, 17 aa, Staphylococcus aureus
KGVYVILKDSNGKELDR

SEQ ID NO: 1599728 - protein, 30 aa, Staphylococcus aureus
KGWFWGCGGCLVLFILIIIGISACTAGITG

SEQ ID NO: 1599729 - protein, 19 aa, Staphylococcus aureus
KGYNYTSVDISYASTYNDT

SEQ ID NO: 1599730 - protein, 19 aa, Staphylococcus aureus
KIMTAIVLWLFGSIASILG

SEQ ID NO: 1599731 - protein, 21 aa, Staphylococcus aureus
KITGYGLKTTAVIGGAFTVNM

SEQ ID NO: 1599732 - protein, 35 aa, Staphylococcus aureus
KKGGMAKVLLPLIAAVLIIGALAIFGGMALNNHNN

SEQ ID NO: 1599733 - protein, 27 aa, Staphylococcus aureus
KKIVVIFYTVLIILTVLLLAAFVRASK

SEQ ID NO: 1599734 - protein, 35 aa, Staphylococcus aureus
KKKSTRKIVLLSLIFSLLMIALVSFVAMSMFGNKY

SEQ ID NO: 1599735 - protein, 19 aa, Staphylococcus aureus
KKNIKLLLILPAICLVVSA

SEQ ID NO: 1599736 - protein, 35 aa, Staphylococcus aureus
KKSKKGWFWGCGGCLLLFILIIIGISACTAGITGN

SEQ ID NO: 1599737 - protein, 21 aa, Staphylococcus aureus
KKWYLIIYLLFILAALLITLT

SEQ ID NO: 1599738 - protein, 34 aa, Staphylococcus aureus
KKYKRRNKWFGFIIIILVILLVALGVKSCSNNDE

SEQ ID NO: 1599739 - protein, 17 aa, Staphylococcus aureus
KLKFQDGLKTGDYFDFT

SEQ ID NO: 1599740 - protein, 24 aa, Staphylococcus aureus
KLLRTTFILLTLVGIGLTVFSFIS

SEQ ID NO: 1599741 - protein, 17 aa, Staphylococcus aureus
KLVVFILLTFGFYVFFA

SEQ ID NO: 1599742 - protein, 20 aa, Staphylococcus aureus
KMTGYGLKTTAVIGGAFTVN

SEQ ID NO: 1599743 - protein, 23 aa, Staphylococcus aureus
KNGKNFFFIDKLEFKPKLTSVYV

SEQ ID NO: 1599744 - protein, 22 aa, Staphylococcus aureus
KNNLRYGIRKHKLGAASVFLGT

SEQ ID NO: 1599745 - protein, 24 aa, Staphylococcus aureus
KNNSRTLIFPYVPDKSVYNAIVKV

SEQ ID NO: 1599746 - protein, 23 aa, Staphylococcus aureus
KNQAYNFLITSSQRWGLNQGINA

SEQ ID NO: 1599747 - protein, 30 aa, Staphylococcus aureus
KPVIVIVIGFFLLIFIMVAYLVGSFTKEIN

SEQ ID NO: 1599748 - protein, 28 aa, Staphylococcus aureus
KQSKLILIFICIFTFFIMIIQSQFLMGQ

SEQ ID NO: 1599749 - protein, 28 aa, Staphylococcus aureus
KQSKLILIFICIFTFLLMVIQSQFLMGQ

SEQ ID NO: 1599750 - protein, 27 aa, Staphylococcus aureus
KQTGDGYQWVIKFNKGHAPHQNMIFWF

SEQ ID NO: 1599751 - protein, 21 aa, Staphylococcus aureus
KRFALYISVMILIFAIAGCGK

SEQ ID NO: 1599752 - protein, 21 aa, Staphylococcus aureus
KRFSLYISVMILIFAIAGCGK

SEQ ID NO: 1599753 - protein, 25 aa, Staphylococcus aureus
KRQNILFLCPFLPVISFVVIFINSQ

SEQ ID NO: 1599754 - protein, 33 aa, Staphylococcus aureus
KSKKGWFWGCGGCLVLFILIIIGISACTAGITG

SEQ ID NO: 1599755 - protein, 33 aa, Staphylococcus aureus
KSKKGWFWGCGGCLVLFILIIIGISACTAGVTG

SEQ ID NO: 1599756 - protein, 23 aa, Staphylococcus aureus
KSPKFLVRFWTLASGTILGLALM

SEQ ID NO: 1599757 - protein, 23 aa, Staphylococcus aureus
KSQKWYLIIILNTINIIQFDTYF

SEQ ID NO: 1599758 - protein, 34 aa, Staphylococcus aureus
KSTRKIVLLSLIFSLLMIALVSFVAMAMFGNKYE

SEQ ID NO: 1599759 - protein, 18 aa, Staphylococcus aureus
KTPKYSLGDYVWYDSNKD

SEQ ID NO: 1599760 - protein, 28 aa, Staphylococcus aureus
KTTAVIGGAFTINMLHDQQAFAASDAPL

SEQ ID NO: 1599761 - protein, 20 aa, Staphylococcus aureus
KTVLVDYEKYGKFYNLSIKG

SEQ ID NO: 1599762 - protein, 22 aa, Staphylococcus aureus
KVMTVTYAGQTWTRNISDWIAK

SEQ ID NO: 1599763 - protein, 29 aa, Staphylococcus aureus
KYIIFGVILVITLLIIGIAYYLISLNNAK

SEQ ID NO: 1599764 - protein, 19 aa, Staphylococcus aureus
KYSIRRFTVGTTSVIVGAT

SEQ ID NO: 1599765 - protein, 22 aa, Staphylococcus aureus
KYYFQAVLNNASFWKEYKFYNA

SEQ ID NO: 1599766 - protein, 21 aa, Staphylococcus aureus
LAFTSLFLVIWFPASPFIIIF

SEQ ID NO: 1599767 - protein, 20 aa, Staphylococcus aureus
LAFTSLFLVIWFPASPFVII

SEQ ID NO: 1599768 - protein, 24 aa, Staphylococcus aureus
LAFTSLFLVIWFPASPFVIIFSAM

SEQ ID NO: 1599769 - protein, 17 aa, Staphylococcus aureus
LALFIWFFKLKYSFGHI

SEQ ID NO: 1599770 - protein, 17 aa, Staphylococcus aureus
LATIIIFLSLLFTFIYI

SEQ ID NO: 1599771 - protein, 27 aa, Staphylococcus aureus
LATKRLNKCMPMKYRKLKLMQIKMLIS

SEQ ID NO: 1599772 - protein, 22 aa, Staphylococcus aureus
LCFLILPFFLITGATADAVANP

SEQ ID NO: 1599773 - protein, 19 aa, Staphylococcus aureus
LCFLILPLCLVMGATAYAV

SEQ ID NO: 1599774 - protein, 20 aa, Staphylococcus aureus
LCGFLFPLAITLIGQIFFCQ

SEQ ID NO: 1599775 - protein, 25 aa, Staphylococcus aureus
LDDTKHLPLLFAKRHRKEEEEDVTV

SEQ ID NO: 1599776 - protein, 31 aa, Staphylococcus aureus
LDFLPNKLNKYSIRRFTVGTASILVGATLIF

SEQ ID NO: 1599777 - protein, 23 aa, Staphylococcus aureus
LDKVKHTPFFLPKRRRKEDEEDV

SEQ ID NO: 1599778 - protein, 22 aa, Staphylococcus aureus
LDKVKHTPFFLPKRRRKEEEED

SEQ ID NO: 1599779 - protein, 18 aa, Staphylococcus aureus
LDPSALVYLVAPTNQTTN

SEQ ID NO: 1599780 - protein, 20 aa, Staphylococcus aureus
LDSGFYKTPKYSLGDYVWYD

SEQ ID NO: 1599781 - protein, 21 aa, Staphylococcus aureus
LDSGFYKTPKYSLGDYVWYDS

SEQ ID NO: 1599782 - protein, 24 aa, Staphylococcus aureus
LEFATWHWLFYINIPIAIIAIILV

SEQ ID NO: 1599783 - protein, 18 aa, Staphylococcus aureus
LFAGPLFNFILALVLFIG

SEQ ID NO: 1599784 - protein, 24 aa, Staphylococcus aureus
LFLVGFLIYLFYSPRLKFDVLENP

SEQ ID NO: 1599785 - protein, 17 aa, Staphylococcus aureus
LFPLVITFLLHRFRPRN

SEQ ID NO: 1599786 - protein, 17 aa, Staphylococcus aureus
LFVAVLGPLVFMFGLFI

SEQ ID NO: 1599787 - protein, 18 aa, Staphylococcus aureus
LFVAVLGPLVFMFGLFIS

SEQ ID NO: 1599788 - protein, 24 aa, Staphylococcus aureus
LGICLVLLIILIVGYVIMTKINSR

SEQ ID NO: 1599789 - protein, 24 aa, Staphylococcus aureus
LGICLVLLIILIVGYVIMTKTNGR

SEQ ID NO: 1599790 - protein, 22 aa, Staphylococcus aureus
LGTVFFLFVFNIGISIFVFLLT

SEQ ID NO: 1599791 - protein, 17 aa, Staphylococcus aureus
LHLIWVLQQSKLKKKWQ

SEQ ID NO: 1599792 - protein, 27 aa, Staphylococcus aureus
LHWSLNHKWIVIILSTLILVTTIVFGG

SEQ ID NO: 1599793 - protein, 18 aa, Staphylococcus aureus
LIIILAYVLMNIPYFKNL

SEQ ID NO: 1599794 - protein, 19 aa, Staphylococcus aureus
LIIPILFFIIAMMLFIRKD

SEQ ID NO: 1599795 - protein, 36 aa, Staphylococcus aureus
LIVFAVLFRFIVRLIPIFYIFRVLSIFIFIMGFKML

SEQ ID NO: 1599796 - protein, 19 aa, Staphylococcus aureus
LKAELDLNLFIDPTTVTKR

SEQ ID NO: 1599797 - protein, 29 aa, Staphylococcus aureus
LKGTVQLIWNLIQLWFIGKILGVVRYFGG

SEQ ID NO: 1599798 - protein, 23 aa, Staphylococcus aureus
LKRFALYISVMILIFAIAGCGKG

SEQ ID NO: 1599799 - protein, 29 aa, Staphylococcus aureus
LKTTAVIGGAFTINMLHDQQAFAASDAPL

SEQ ID NO: 1599800 - protein, 27 aa, Staphylococcus aureus
LLFLFPLGLFLMWKFSKWPSLVRTIIT

SEQ ID NO: 1599801 - protein, 20 aa, Staphylococcus aureus
LLFLIISAIVTFFVLSPKYQ

SEQ ID NO: 1599802 - protein, 19 aa, Staphylococcus aureus
LLGWRWIFIISIVISLIAL

SEQ ID NO: 1599803 - protein, 20 aa, Staphylococcus aureus
LLIIHYFIICYFVFSVHPML

SEQ ID NO: 1599804 - protein, 20 aa, Staphylococcus aureus
LLILFFYLFSDGLRDAFDPK

SEQ ID NO: 1599805 - protein, 19 aa, Staphylococcus aureus
LLIVWYVLYLLITVFKGTK

SEQ ID NO: 1599806 - protein, 22 aa, Staphylococcus aureus
LLIVYIIPRFFKAIPAPLIAII

SEQ ID NO: 1599807 - protein, 17 aa, Staphylococcus aureus
LLRQVKSIGMFLMIAAL

SEQ ID NO: 1599808 - protein, 24 aa, Staphylococcus aureus
LLVFVVFFTAATIIWFSYDKNKYG

SEQ ID NO: 1599809 - protein, 22 aa, Staphylococcus aureus
LLVIMGITVLITLLLWIMLVLI

SEQ ID NO: 1599810 - protein, 18 aa, Staphylococcus aureus
LMIAALGLYFVAMNNLKA

SEQ ID NO: 1599811 - protein, 24 aa, Staphylococcus aureus
LNEIVICISFLFLTIFIGGCGTGK

SEQ ID NO: 1599812 - protein, 21 aa, Staphylococcus aureus
LNFFHGWPWYAVWLVMLGFGG

SEQ ID NO: 1599813 - protein, 22 aa, Staphylococcus aureus
LNIILGFIKFFSSLFTGNWRGV

SEQ ID NO: 1599814 - protein, 17 aa, Staphylococcus aureus
LNLAAIIIISIVVSGGM

SEQ ID NO: 1599815 - protein, 26 aa, Staphylococcus aureus
LPNRKDFVVSFITGALVGSALGLYFK

SEQ ID NO: 1599816 - protein, 27 aa, Staphylococcus aureus
LQLIRLLLHMIKLLLHLIWVLQQSKLK

SEQ ID NO: 1599817 - protein, 19 aa, Staphylococcus aureus
LSNAFGFKLDTYHNTSKPN

SEQ ID NO: 1599818 - protein, 23 aa, Staphylococcus aureus
LSRSYLITIFIILLITILFANFS

SEQ ID NO: 1599819 - protein, 17 aa, Staphylococcus aureus
LSTFFFILLLYITYRKN

SEQ ID NO: 1599820 - protein, 24 aa, Staphylococcus aureus
LSYTPPYYYLLITITIFGIICSII

SEQ ID NO: 1599821 - protein, 17 aa, Staphylococcus aureus
LVIWFPASPFIIIFSAM

SEQ ID NO: 1599822 - protein, 18 aa, Staphylococcus aureus
LVTAIFQLLFGKIGLIRN

SEQ ID NO: 1599823 - protein, 22 aa, Staphylococcus aureus
LYIPIFFLMFYSFNSAGNVIHF

SEQ ID NO: 1599824 - protein, 19 aa, Staphylococcus aureus
LYISIIVLSIFIIGCGKGN

SEQ ID NO: 1599825 - protein, 20 aa, Staphylococcus aureus
LYRIVMVLSVFIIGCDKSSD

SEQ ID NO: 1599826 - protein, 18 aa, Staphylococcus aureus
MSIFLFPFTFLYLLAYHH

SEQ ID NO: 1599827 - protein, 29 aa, Staphylococcus aureus
MSLPKKIFLWVFGILVILAIIAVVYVAAK

SEQ ID NO: 1599828 - protein, 23 aa, Staphylococcus aureus
MSNSIRHFTSLSTSGLMSLSDSN

SEQ ID NO: 1599829 - protein, 17 aa, Staphylococcus aureus
MSPILLAWIVAAVLRIA

SEQ ID NO: 1599830 - protein, 23 aa, Staphylococcus aureus
MVCHPLLFMFFTKIFIQSWRQTH

SEQ ID NO: 1599831 - protein, 21 aa, Staphylococcus aureus
MVFIMLLNIITPLFNKNEAFA

SEQ ID NO: 1599832 - protein, 22 aa, Staphylococcus aureus
MVFIMLLNIITPLFNKNEAFAA

SEQ ID NO: 1599833 - protein, 29 aa, Staphylococcus aureus
MVSLPIIIILLIWLSWRFYKYSKFVKMMN

SEQ ID NO: 1599834 - protein, 21 aa, Staphylococcus aureus
NAILFFLIPFFASAIFNTQFT

SEQ ID NO: 1599835 - protein, 20 aa, Staphylococcus aureus
NAMGAVQQYIDEQHLGVISS

SEQ ID NO: 1599836 - protein, 21 aa, Staphylococcus aureus
NAPALYPNYWGGNKFKVIEEL

SEQ ID NO: 1599837 - protein, 23 aa, Staphylococcus aureus
NEHSPLLFAKRRKDKEEDVETTT

SEQ ID NO: 1599838 - protein, 22 aa, Staphylococcus aureus
NEHSPLLIAKRRKDKEVDVETT

SEQ ID NO: 1599839 - protein, 17 aa, Staphylococcus aureus
NEIALFTLLTTLTIIFL

SEQ ID NO: 1599840 - protein, 30 aa, Staphylococcus aureus
NESNTAIMVLFSGLILLVVSLVTRFIKSNS

SEQ ID NO: 1599841 - protein, 20 aa, Staphylococcus aureus
NFFKMLWLRLKAMKHYKALN

SEQ ID NO: 1599842 - protein, 26 aa, Staphylococcus aureus
NFGFSFDLIILLRKYVKYINFNYNEK

SEQ ID NO: 1599843 - protein, 39 aa, Staphylococcus aureus
NFRTHLSGYHKYYPYYPYYPYYPVQLTWNNGVAFYSNNA

SEQ ID NO: 1599844 - protein, 30 aa, Staphylococcus aureus
NGDTKVMTVKYAGQTWTRNISDWIAKSGTT

SEQ ID NO: 1599845 - protein, 33 aa, Staphylococcus aureus
NGDTKVMTVTYAGQTWTRNISDWIAKSGTTNFS

SEQ ID NO: 1599846 - protein, 22 aa, Staphylococcus aureus
NGFTFFLNVLLPLVFISVLIGI

SEQ ID NO: 1599847 - protein, 21 aa, Staphylococcus aureus
NGILFFLIPFFASGIFNTQFT

SEQ ID NO: 1599848 - protein, 17 aa, Staphylococcus aureus
NIVKSLYIIALAFGVIA

SEQ ID NO: 1599849 - protein, 20 aa, Staphylococcus aureus
NIVKSLYIIALAFGVIATII

SEQ ID NO: 1599850 - protein, 25 aa, Staphylococcus aureus
NKDMTLPLMSLLALSSIIAFVLPRK

SEQ ID NO: 1599851 - protein, 32 aa, Staphylococcus aureus
NKRINFIFGVIIFIFAVLVLRLGYLQIAQGSH

SEQ ID NO: 1599852 - protein, 20 aa, Staphylococcus aureus
NKVLGFYPTNATTNAFRPGG

SEQ ID NO: 1599853 - protein, 18 aa, Staphylococcus aureus
NLRYGIRKHKLGAASVFL

SEQ ID NO: 1599854 - protein, 23 aa, Staphylococcus aureus
NLSLTMIFLILTYFKEVKLYKHF

SEQ ID NO: 1599855 - protein, 18 aa, Staphylococcus aureus
NLWAYVMLIFMTLAAILT

SEQ ID NO: 1599856 - protein, 17 aa, Staphylococcus aureus
NNATLFGGLFAALGSLL

SEQ ID NO: 1599857 - protein, 22 aa, Staphylococcus aureus
NNGMLFGGLFSILGLALLRRNK

SEQ ID NO: 1599858 - protein, 24 aa, Staphylococcus aureus
NNSRTLIFPYIPDKAVYNAIVKVV

SEQ ID NO: 1599859 - protein, 22 aa, Staphylococcus aureus
NNSRTLIFPYVPDKAVYNAIVK

SEQ ID NO: 1599860 - protein, 22 aa, Staphylococcus aureus
NNTRTIIFPYVEGKTLYDAIVK

SEQ ID NO: 1599861 - protein, 17 aa, Staphylococcus aureus
NQALANKLKEIEASNAT

SEQ ID NO: 1599862 - protein, 23 aa, Staphylococcus aureus
NSTYLYINLISILTFIITCFSII

SEQ ID NO: 1599863 - protein, 20 aa, Staphylococcus aureus
NTRTIIFPYVEGKTLYDAIV

SEQ ID NO: 1599864 - protein, 23 aa, Staphylococcus aureus
NTSAPRMRAFSLAAVAADAPAAG

SEQ ID NO: 1599865 - protein, 24 aa, Staphylococcus aureus
NVFTQLAPLFLWVANGLDSLGQKF

SEQ ID NO: 1599866 - protein, 18 aa, Staphylococcus aureus
NVLFGIIFAVLTLVFVIG

SEQ ID NO: 1599867 - protein, 17 aa, Staphylococcus aureus
NYTPFFVILGKPFVPFL

SEQ ID NO: 1599868 - protein, 39 aa, Staphylococcus aureus
PDTGESIKQNGLLGGIMTLLVGLGLMKRKKKKDENDQDD

SEQ ID NO: 1599869 - protein, 22 aa, Staphylococcus aureus
PGAVFWMWIIAFIGAASAFIEA

SEQ ID NO: 1599870 - protein, 23 aa, Staphylococcus aureus
PGAVFWMWVIAFIGAASAFIEAT

SEQ ID NO: 1599871 - protein, 23 aa, Staphylococcus aureus
PGICLVLLIILIGGYVIMTKTNG

SEQ ID NO: 1599872 - protein, 19 aa, Staphylococcus aureus
PIDSLFYIVSLNLSLTMIF

SEQ ID NO: 1599873 - protein, 19 aa, Staphylococcus aureus
PIFFILMFFSMQLVTLPKQ

SEQ ID NO: 1599874 - protein, 25 aa, Staphylococcus aureus
PIGIKFRLLKIGLILFCVLFFLFPV

SEQ ID NO: 1599875 - protein, 20 aa, Staphylococcus aureus
PLFLGLVVALIYIFFKVIFD

SEQ ID NO: 1599876 - protein, 21 aa, Staphylococcus aureus
PLHMRHFSNNFGNVIKNAIGV

SEQ ID NO: 1599877 - protein, 21 aa, Staphylococcus aureus
PLILIVVVVGFGIYFYASKDK

SEQ ID NO: 1599878 - protein, 18 aa, Staphylococcus aureus
PLIPFYKISNFTFSKDMM

SEQ ID NO: 1599879 - protein, 25 aa, Staphylococcus aureus
PMYNGYIFKLVVFASALLTSHGYVE

SEQ ID NO: 1599880 - protein, 26 aa, Staphylococcus aureus
PMYNGYIFKLVVFASALLTSHGYVEI

SEQ ID NO: 1599881 - protein, 17 aa, Staphylococcus aureus
PRFLILPTIILIGILGS

SEQ ID NO: 1599882 - protein, 18 aa, Staphylococcus aureus
PRMRAFSLAAVAADAPAA

SEQ ID NO: 1599883 - protein, 19 aa, Staphylococcus aureus
PVGWVILAGLAMSTVFALG

SEQ ID NO: 1599884 - protein, 18 aa, Staphylococcus aureus
PYALVFIGLIIFISVVIL

SEQ ID NO: 1599885 - protein, 24 aa, Staphylococcus aureus
QEKKIFPYILMSVGALLTLGFVIF

SEQ ID NO: 1599886 - protein, 19 aa, Staphylococcus aureus
QFVFAVKLRWFPVAGWEGI

SEQ ID NO: 1599887 - protein, 17 aa, Staphylococcus aureus
QFVYFNKLSLFHDVQQW

SEQ ID NO: 1599888 - protein, 23 aa, Staphylococcus aureus
QFWGILILLLFIPIVWLFTYNKP

SEQ ID NO: 1599889 - protein, 17 aa, Staphylococcus aureus
QIICVMMGLWIYQLDKH

SEQ ID NO: 1599890 - protein, 20 aa, Staphylococcus aureus
QKGLIFSSIIGIAGLMLLAR

SEQ ID NO: 1599891 - protein, 39 aa, Staphylococcus aureus
QKNWQSASLITLIKQLVIRMYLKFKQLATKRLNKCMPMK

SEQ ID NO: 1599892 - protein, 24 aa, Staphylococcus aureus
QSINPLFILLLAPIISLLWQKLGT

SEQ ID NO: 1599893 - protein, 22 aa, Staphylococcus aureus
QSNYFRFQYFNPLKSERYYRNL

SEQ ID NO: 1599894 - protein, 21 aa, Staphylococcus aureus
QSSEVFSPISPIKIATQDNSG

SEQ ID NO: 1599895 - protein, 26 aa, Staphylococcus aureus
QVGSYFLFFIIIAFLLYANVLFIKQR

SEQ ID NO: 1599896 - protein, 26 aa, Staphylococcus aureus
QVGSYFLFFIIIAFLLYANVLFLKRR

SEQ ID NO: 1599897 - protein, 22 aa, Staphylococcus aureus
QVWPILIFLPFVVIFFLKINKH

SEQ ID NO: 1599898 - protein, 19 aa, Staphylococcus aureus
QYVFAVKLRWFPVAGWEGF

SEQ ID NO: 1599899 - protein, 20 aa, Staphylococcus aureus
RIIDYLILLILICSGLSYSK

SEQ ID NO: 1599900 - protein, 18 aa, Staphylococcus aureus
RILLFYILAIFVIGMLIP

SEQ ID NO: 1599901 - protein, 17 aa, Staphylococcus aureus
RILQPYSAPPKPPNPNY

SEQ ID NO: 1599902 - protein, 33 aa, Staphylococcus aureus
RIQYSVITILVLLIGVILIYMFSPLSKIAHVNI

SEQ ID NO: 1599903 - protein, 17 aa, Staphylococcus aureus
RISAVQIVISDRAKQSS

SEQ ID NO: 1599904 - protein, 24 aa, Staphylococcus aureus
RMMIYLGLFIFSISVLYIIYLFIN

SEQ ID NO: 1599905 - protein, 35 aa, Staphylococcus aureus
RNHRKKIVIIFYTILVLLTILLIASFIRASKANNE

SEQ ID NO: 1599906 - protein, 18 aa, Staphylococcus aureus
RSFYSIRKSTLGVASVIV

SEQ ID NO: 1599907 - protein, 17 aa, Staphylococcus aureus
RSLPFIILLIAIVPFTK

SEQ ID NO: 1599908 - protein, 25 aa, Staphylococcus aureus
RTWKARWQLCIIFSLFALMSNLTGI

SEQ ID NO: 1599909 - protein, 26 aa, Staphylococcus aureus
RVPVTLNVYQFEFPQTIYTTTVGGTL

SEQ ID NO: 1599910 - protein, 24 aa, Staphylococcus aureus
RYSHWFRFVWPVVAFVLIFGGGVL

SEQ ID NO: 1599911 - protein, 22 aa, Staphylococcus aureus
SAYAFMIFILLYIPCVSTVAAI

SEQ ID NO: 1599912 - protein, 30 aa, Staphylococcus aureus
SEFRTFLAVLLMLLLFISISLVIASTHSII

SEQ ID NO: 1599913 - protein, 18 aa, Staphylococcus aureus
SEVYSPISPIKIATQDNS

SEQ ID NO: 1599914 - protein, 21 aa, Staphylococcus aureus
SFFNYLFGYSRYLTYILVLLA

SEQ ID NO: 1599915 - protein, 17 aa, Staphylococcus aureus
SFIGIISLFLWGLGYFG

SEQ ID NO: 1599916 - protein, 22 aa, Staphylococcus aureus
SFTFMLIIVLIIWSFIYTGFNF

SEQ ID NO: 1599917 - protein, 19 aa, Staphylococcus aureus
SGKYKVIFEKPAGLTQTGT

SEQ ID NO: 1599918 - protein, 25 aa, Staphylococcus aureus
SGTTVYPHQAGYVKLNYGFSVPNSA

SEQ ID NO: 1599919 - protein, 23 aa, Staphylococcus aureus
SIEGTKHLPLLFAKRRRKEDEEN

SEQ ID NO: 1599920 - protein, 24 aa, Staphylococcus aureus
SIGMFLMIAALGLYFVAMNNLKAA

SEQ ID NO: 1599921 - protein, 24 aa, Staphylococcus aureus
SIGVASVLVGTLIGFGLLSSKEAD

SEQ ID NO: 1599922 - protein, 18 aa, Staphylococcus aureus
SIIALILCLFLQSNKKAK

SEQ ID NO: 1599923 - protein, 34 aa, Staphylococcus aureus
SIKQNGLLGGVMTLLVGLGLMKRKKKKDENDQDD

SEQ ID NO: 1599924 - protein, 18 aa, Staphylococcus aureus
SIRRFTVGTTSVIVGATI

SEQ ID NO: 1599925 - protein, 20 aa, Staphylococcus aureus
SIVLLFLTFPIMFIFAIAIV

SEQ ID NO: 1599926 - protein, 21 aa, Staphylococcus aureus
SKDEDVPLLLAKKKNQKDNQS

SEQ ID NO: 1599927 - protein, 24 aa, Staphylococcus aureus
SKGDLALRSTLYGYDSRFVWRSMS

SEQ ID NO: 1599928 - protein, 23 aa, Staphylococcus aureus
SKLILIFICIFTFFIMIIQSQFL

SEQ ID NO: 1599929 - protein, 25 aa, Staphylococcus aureus
SKNQAYNFLITSSQRWGLNQGINAN

SEQ ID NO: 1599930 - protein, 24 aa, Staphylococcus aureus
SKWAFYISFLILVISITAGCGIGK

SEQ ID NO: 1599931 - protein, 23 aa, Staphylococcus aureus
SLNHKWIVIILSTLILVATIVFG

SEQ ID NO: 1599932 - protein, 21 aa, Staphylococcus aureus
SNLLYSIILYVIRIIQLHYRR

SEQ ID NO: 1599933 - protein, 17 aa, Staphylococcus aureus
SNNGTLFGGLFAALGSL

SEQ ID NO: 1599934 - protein, 24 aa, Staphylococcus aureus
SNNMLFGIIFAVLTLVFVIGIIMS

SEQ ID NO: 1599935 - protein, 29 aa, Staphylococcus aureus
SSKRVHLKRWHFISILIGTILITAVITVV

SEQ ID NO: 1599936 - protein, 21 aa, Staphylococcus aureus
SSPEAMFVLLAGIGLIATVRR

SEQ ID NO: 1599937 - protein, 17 aa, Staphylococcus aureus
SSSPAAMFVLVAGIGLI

SEQ ID NO: 1599938 - protein, 17 aa, Staphylococcus aureus
SSSPAVMFVLVAGIGLI

SEQ ID NO: 1599939 - protein, 17 aa, Staphylococcus aureus
SSSPVAMFVLVAGIGLI

SEQ ID NO: 1599940 - protein, 23 aa, Staphylococcus aureus
SSTLVTIIVFLPLVFVSGSVGEM

SEQ ID NO: 1599941 - protein, 22 aa, Staphylococcus aureus
SSWTLYYWGWWLSWSPFVGVFI

SEQ ID NO: 1599942 - protein, 17 aa, Staphylococcus aureus
SSYNLKCLLLKLTYRYL

SEQ ID NO: 1599943 - protein, 26 aa, Staphylococcus aureus
STNKGMLFGGLFSILGLALLRRNKKN

SEQ ID NO: 1599944 - protein, 27 aa, Staphylococcus aureus
STNKGMLFGGLFSILGLALLRRNKKNN

SEQ ID NO: 1599945 - protein, 23 aa, Staphylococcus aureus
STQFSRRTFLKMLGIGGASVAIG

SEQ ID NO: 1599946 - protein, 31 aa, Staphylococcus aureus
STRKIVLLSLIFSLLMIALVSFVAMAMFGNK

SEQ ID NO: 1599947 - protein, 33 aa, Staphylococcus aureus
STSTAPVKIRTFSRLAMSTFASAATTSAVTANT

SEQ ID NO: 1599948 - protein, 18 aa, Staphylococcus aureus
SVLAFIFLVYRIYILFID

SEQ ID NO: 1599949 - protein, 23 aa, Staphylococcus aureus
SVWLVLLFSAMGLWHVSNAAEQH

SEQ ID NO: 1599950 - protein, 25 aa, Staphylococcus aureus
TAIMALFIGLILLVVSLVTRFIKLN

SEQ ID NO: 1599951 - protein, 19 aa, Staphylococcus aureus
TAMGTLKHAIADKTNTLAS

SEQ ID NO: 1599952 - protein, 18 aa, Staphylococcus aureus
TEQDILAHINLIDQLSAE

SEQ ID NO: 1599953 - protein, 18 aa, Staphylococcus aureus
TEQDILAHINLIDQLTAE

SEQ ID NO: 1599954 - protein, 23 aa, Staphylococcus aureus
TGKYLFMMFGLPAAAFAIYKNAR

SEQ ID NO: 1599955 - protein, 19 aa, Staphylococcus aureus
TIEVGKTMNPIVLTTTDNG

SEQ ID NO: 1599956 - protein, 17 aa, Staphylococcus aureus
TISAVVLIMVLIGFIFW

SEQ ID NO: 1599957 - protein, 27 aa, Staphylococcus aureus
TITIRPQDYVVFIPPVGKQIRAVVYYN

SEQ ID NO: 1599958 - protein, 28 aa, Staphylococcus aureus
TITIRPQDYVVFIPPVGKQIRAVVYYNK

SEQ ID NO: 1599959 - protein, 18 aa, Staphylococcus aureus
TLCLCIAIALILYALPYL

SEQ ID NO: 1599960 - protein, 32 aa, Staphylococcus aureus
TLEFQTHLFGYYNYYYYNTSNLTWKNGVAFYS

SEQ ID NO: 1599961 - protein, 18 aa, Staphylococcus aureus
TLLLASSLTFTGFSATAN

SEQ ID NO: 1599962 - protein, 18 aa, Staphylococcus aureus
TLTIIFLVVILTMYPLAK

SEQ ID NO: 1599963 - protein, 17 aa, Staphylococcus aureus
TLTWDNGLVLYSNKANG

SEQ ID NO: 1599964 - protein, 23 aa, Staphylococcus aureus
TMATWLAIIFIVAALILGLIGGF

SEQ ID NO: 1599965 - protein, 22 aa, Staphylococcus aureus
TNKGMLFGGLFSILGLALLRRN

SEQ ID NO: 1599966 - protein, 24 aa, Staphylococcus aureus
TNKGMLFGGLFSILGLALLRRNKK

SEQ ID NO: 1599967 - protein, 26 aa, Staphylococcus aureus
TNKGMLFGGLFSILGLALLRRNKKNH

SEQ ID NO: 1599968 - protein, 25 aa, Staphylococcus aureus
TPFYISVLFIAYFCYLLTSFSNSND

SEQ ID NO: 1599969 - protein, 23 aa, Staphylococcus aureus
TQKGLIFSSIIGIAGLMLLARRR

SEQ ID NO: 1599970 - protein, 29 aa, Staphylococcus aureus
TSTAPVKLRTFSRLAMSTFASAATTTAVT

SEQ ID NO: 1599971 - protein, 23 aa, Staphylococcus aureus
TSTLLLIVILVVFAVLLIVNETK

SEQ ID NO: 1599972 - protein, 17 aa, Staphylococcus aureus
TTGKDIIPPKTYSGNVD

SEQ ID NO: 1599973 - protein, 34 aa, Staphylococcus aureus
TTSSQSWWGLYALLGMLALFIPKFRKESKYLTKY

SEQ ID NO: 1599974 - protein, 26 aa, Staphylococcus aureus
TVFVNPKQRVLGNTWVYIKGYQDKIE

SEQ ID NO: 1599975 - protein, 19 aa, Staphylococcus aureus
TVQLIWNLIQLWFVGKILG

SEQ ID NO: 1599976 - protein, 20 aa, Staphylococcus aureus
VAFYPILVPIFIALGYDSIV

SEQ ID NO: 1599977 - protein, 21 aa, Staphylococcus aureus
VALIYLFMLGFYRLPGLVAII

SEQ ID NO: 1599978 - protein, 18 aa, Staphylococcus aureus
VAMFVLVAGIGLIATVRR

SEQ ID NO: 1599979 - protein, 18 aa, Staphylococcus aureus
VCHPLLFMFFTKIFIQSW

SEQ ID NO: 1599980 - protein, 17 aa, Staphylococcus aureus
VEFGLFVAVLGPLVFMF

SEQ ID NO: 1599981 - protein, 20 aa, Staphylococcus aureus
VETLKWARWLPHMTLRSQNI

SEQ ID NO: 1599982 - protein, 17 aa, Staphylococcus aureus
VFDYRRSLLRTDVVLNS

SEQ ID NO: 1599983 - protein, 17 aa, Staphylococcus aureus
VFIIIILILVGIFLKIK

SEQ ID NO: 1599984 - protein, 17 aa, Staphylococcus aureus
VFKLIFLACTLLGLVVL

SEQ ID NO: 1599985 - protein, 18 aa, Staphylococcus aureus
VFRERYFDMLYLKKNNNF

SEQ ID NO: 1599986 - protein, 18 aa, Staphylococcus aureus
VFVIIWFLLGIPVGPGGP

SEQ ID NO: 1599987 - protein, 29 aa, Staphylococcus aureus
VFVNPKQRVLGNTWLYIKGYQDKIEESSG

SEQ ID NO: 1599988 - protein, 17 aa, Staphylococcus aureus
VFYHLKLDEKFASILGL

SEQ ID NO: 1599989 - protein, 29 aa, Staphylococcus aureus
VGHPEQLYKYYYDRGYTLTWDNGLVLYSN

SEQ ID NO: 1599990 - protein, 17 aa, Staphylococcus aureus
VGLFIHWIWPDLPIGAA

SEQ ID NO: 1599991 - protein, 32 aa, Staphylococcus aureus
VIAIRMLFHPFKPYYIFKFRVPFTPGLIPKRR

SEQ ID NO: 1599992 - protein, 28 aa, Staphylococcus aureus
VIAIVIGFFLLIFIMIAYLVGSFTKEIN

SEQ ID NO: 1599993 - protein, 20 aa, Staphylococcus aureus
VIERLLLALILPLVILIIGM

SEQ ID NO: 1599994 - protein, 31 aa, Staphylococcus aureus
VIFSAFALFLFLFLVFSWLLSFLPNLELSVF

SEQ ID NO: 1599995 - protein, 30 aa, Staphylococcus aureus
VIFSAFALILFLFLAFSWLISFIPGFEISV

SEQ ID NO: 1599996 - protein, 26 aa, Staphylococcus aureus
VIHVCVLLFIIISIALIFHRLQTKTH

SEQ ID NO: 1599997 - protein, 17 aa, Staphylococcus aureus
VILIVFAVLFRFIVRLI

SEQ ID NO: 1599998 - protein, 38 aa, Staphylococcus aureus
VILIVFAVLFRFIVRLIPIFYIFRVLSIFIFIMGFKML

SEQ ID NO: 1599999 - protein, 17 aa, Staphylococcus aureus
VILPIFLSIFILTLFVI

SEQ ID NO: 1600000 - protein, 23 aa, Staphylococcus aureus
VKNNLRYGIRKHKLGAASVFLGT

SEQ ID NO: 1600001 - protein, 34 aa, Staphylococcus aureus
VKVVSIATVLLLLGGLVFAIFAYVDHSNKAKERM

SEQ ID NO: 1600002 - protein, 17 aa, Staphylococcus aureus
VLELILAILYFKLGFHY

SEQ ID NO: 1600003 - protein, 28 aa, Staphylococcus aureus
VLHWSLNHKWIVIILSTLILVATIVFGG

SEQ ID NO: 1600004 - protein, 22 aa, Staphylococcus aureus
VLIMVLIGFIFWRQDDYTSRDF

SEQ ID NO: 1600005 - protein, 17 aa, Staphylococcus aureus
VLSLLFLFPLGLFLMWK

SEQ ID NO: 1600006 - protein, 18 aa, Staphylococcus aureus
VNAKIRFAVAQPAAVASN

SEQ ID NO: 1600007 - protein, 24 aa, Staphylococcus aureus
VNPSAPRMRAFSLAAVAADAPAAG

SEQ ID NO: 1600008 - protein, 33 aa, Staphylococcus aureus
VPEILITKLIILTLFGIGFFVVGLILKPVTDPL

SEQ ID NO: 1600009 - protein, 19 aa, Staphylococcus aureus
VQILLVVIIIIFGYKIVQT

SEQ ID NO: 1600010 - protein, 25 aa, Staphylococcus aureus
VSIGKLFMIFLIRTIITLPLISLMA

SEQ ID NO: 1600011 - protein, 19 aa, Staphylococcus aureus
VSWLWFFLLAILGKMIGSI

SEQ ID NO: 1600012 - protein, 19 aa, Staphylococcus aureus
VSWLWFFLLAILGKMVGSI

SEQ ID NO: 1600013 - protein, 18 aa, Staphylococcus aureus
VTFLILWLLIIELLTTGL

SEQ ID NO: 1600014 - protein, 21 aa, Staphylococcus aureus
VTFLILWLLLIELLTTGLLNS

SEQ ID NO: 1600015 - protein, 22 aa, Staphylococcus aureus
VVVGLIFIFLIGAPISNIFESL

SEQ ID NO: 1600016 - protein, 22 aa, Staphylococcus aureus
VVVGLIFIFLIGAPISNIFETL

SEQ ID NO: 1600017 - protein, 18 aa, Staphylococcus aureus
VVVPVIYEILFTLKKRFT

SEQ ID NO: 1600018 - protein, 17 aa, Staphylococcus aureus
WFDIFIAGILRLFGVIA

SEQ ID NO: 1600019 - protein, 18 aa, Staphylococcus aureus
WPALPMPAAFAIAAILCP

SEQ ID NO: 1600020 - protein, 31 aa, Staphylococcus aureus
WPKFLTLFAGPLFNFILALVLFIGLAYYQGT

SEQ ID NO: 1600021 - protein, 24 aa, Staphylococcus aureus
WSLNHKWIVIILSTLILVATIVFG

SEQ ID NO: 1600022 - protein, 25 aa, Staphylococcus aureus
WSLNHKWIVIILSTLILVTTIVFGG

SEQ ID NO: 1600023 - protein, 19 aa, Staphylococcus aureus
WVFGSLLCLFYMIKAFRQI

SEQ ID NO: 1600024 - protein, 34 aa, Staphylococcus aureus
WVKSGIKEIEMFKIMGLPFISHSIVSQDNQSISK

SEQ ID NO: 1600025 - protein, 35 aa, Staphylococcus aureus
WVKSGIKEIEMFKIMGLPFISHSLVSQDNQSISKK

SEQ ID NO: 1600026 - protein, 19 aa, Staphylococcus aureus
WYISILILIVVIAGCGKGN

SEQ ID NO: 1600027 - protein, 20 aa, Staphylococcus aureus
YAFMIFILLYIPCVSTVVAI

SEQ ID NO: 1600028 - protein, 19 aa, Staphylococcus aureus
YAKRFFFFATSCLVLTLVV

SEQ ID NO: 1600029 - protein, 19 aa, Staphylococcus aureus
YDFVYFIDTLVYLFILIFK

SEQ ID NO: 1600030 - protein, 31 aa, Staphylococcus aureus
YDITEMHWTLWKYLILTCLVVLICLYFASRS

SEQ ID NO: 1600031 - protein, 21 aa, Staphylococcus aureus
YELYNLMLLKEEKLFYKCVNN

SEQ ID NO: 1600032 - protein, 23 aa, Staphylococcus aureus
YFKPHLLYLLIGTAIIFVICKLI

SEQ ID NO: 1600033 - protein, 19 aa, Staphylococcus aureus
YFLNVIFLMIILFVLYKKR

SEQ ID NO: 1600034 - protein, 20 aa, Staphylococcus aureus
YFYFMLFFSTTIIGALLLYL

SEQ ID NO: 1600035 - protein, 20 aa, Staphylococcus aureus
YKIFPVFMFLVSTGLGILVI

SEQ ID NO: 1600036 - protein, 19 aa, Staphylococcus aureus
YLLFVVIWTALVYSPVAHW

SEQ ID NO: 1600037 - protein, 17 aa, Staphylococcus aureus
YLTYILVLLATGFITYS

SEQ ID NO: 1600038 - protein, 35 aa, Staphylococcus aureus
YNGDTKVMTVKYAGQTWTRNISDWIAKSGTANFSL

SEQ ID NO: 1600039 - protein, 34 aa, Staphylococcus aureus
YNGDTKVMTVTYAGQTWTRNISDWIAKSGTTNFS

SEQ ID NO: 1600040 - protein, 18 aa, Staphylococcus aureus
YNGHTFASSLPAKFVVKD

SEQ ID NO: 1600041 - protein, 21 aa, Staphylococcus aureus
YNLKCLLLKLTYRYLDNQPLN

SEQ ID NO: 1600042 - protein, 19 aa, Staphylococcus aureus
YRFYFYRLFAIITWILFIG

SEQ ID NO: 1600043 - protein, 17 aa, Staphylococcus aureus
YSRYLTYILVLLATGFI

SEQ ID NO: 1600044 - protein, 18 aa, Staphylococcus aureus
YTLTWDNGLVLYSNKANG

SEQ ID NO: 1600045 - protein, 22 aa, Staphylococcus aureus
YVTFLILWLLLIELLTTGLLNS

SEQ ID NO: 1600046 - protein, 6 aa, Staphylococcus aureus
TPARLT

SEQ ID NO: 1600047 - protein, 9 aa, Staphylococcus aureus
GPSGSGKST

SEQ ID NO: 1600048 - protein, 10 aa, Staphylococcus aureus
FTNAQGEREA

SEQ ID NO: 1600049 - protein, 9 aa, Staphylococcus aureus
YQGQTPQSF

SEQ ID NO: 1600050 - protein, 4 aa, Staphylococcus aureus
ENDH

SEQ ID NO: 1600051 - protein, 4 aa, Staphylococcus aureus
MNPE

SEQ ID NO: 1600052 - protein, 6 aa, Staphylococcus aureus
NKRPDY

SEQ ID NO: 1600053 - protein, 4 aa, Staphylococcus aureus
TPYD

SEQ ID NO: 1600054 - protein, 7 aa, Staphylococcus aureus
DEPTTAL

SEQ ID NO: 1600055 - protein, 9 aa, Staphylococcus aureus
GPSGSGKTT

SEQ ID NO: 1600056 - protein, 4 aa, Staphylococcus aureus
KEEL

SEQ ID NO: 1600057 - protein, 7 aa, Staphylococcus aureus
PPVNTVT

SEQ ID NO: 1600058 - protein, 4 aa, Staphylococcus aureus
PTNH

SEQ ID NO: 1600059 - protein, 5 aa, Staphylococcus aureus
SPEGS

SEQ ID NO: 1600060 - protein, 4 aa, Staphylococcus aureus
STFK

SEQ ID NO: 1600061 - protein, 9 aa, Staphylococcus aureus
TGVGKTELA

SEQ ID NO: 1600062 - protein, 8 aa, Staphylococcus aureus
LSGGEAQR

SEQ ID NO: 1600063 - protein, 4 aa, Staphylococcus aureus
SSDQ

SEQ ID NO: 1600064 - protein, 4 aa, Staphylococcus aureus
AEEV

SEQ ID NO: 1600065 - protein, 4 aa, Staphylococcus aureus
ANFD

SEQ ID NO: 1600066 - protein, 12 aa, Staphylococcus aureus
FSRTGKKGGPFI

SEQ ID NO: 1600067 - protein, 4 aa, Staphylococcus aureus
GNTA

SEQ ID NO: 1600068 - protein, 7 aa, Staphylococcus aureus
SGAGKST

SEQ ID NO: 1600069 - protein, 4 aa, Staphylococcus aureus
DGTY

SEQ ID NO: 1600070 - protein, 4 aa, Staphylococcus aureus
NPSL

SEQ ID NO: 1600071 - protein, 4 aa, Staphylococcus aureus
PGIP

SEQ ID NO: 1600072 - protein, 8 aa, Staphylococcus aureus
TQIKQEME

SEQ ID NO: 1600073 - protein, 5 aa, Staphylococcus aureus
YHANE

SEQ ID NO: 1600074 - protein, 4 aa, Staphylococcus aureus
DEFT

SEQ ID NO: 1600075 - protein, 4 aa, Staphylococcus aureus
DEKY

SEQ ID NO: 1600076 - protein, 5 aa, Staphylococcus aureus
KVDEP

SEQ ID NO: 1600077 - protein, 4 aa, Staphylococcus aureus
ADNV

SEQ ID NO: 1600078 - protein, 4 aa, Staphylococcus aureus
QYGN

SEQ ID NO: 1600079 - protein, 8 aa, Staphylococcus aureus
YVSSETDI

SEQ ID NO: 1600080 - protein, 5 aa, Staphylococcus aureus
EEAGV

SEQ ID NO: 1600081 - protein, 4 aa, Staphylococcus aureus
DDDS

SEQ ID NO: 1600082 - protein, 5 aa, Staphylococcus aureus
HRSYT

SEQ ID NO: 1600083 - protein, 4 aa, Staphylococcus aureus
KGET

SEQ ID NO: 1600084 - protein, 9 aa, Staphylococcus aureus
ESGCGKSTL

SEQ ID NO: 1600085 - protein, 5 aa, Staphylococcus aureus
QIEGT

SEQ ID NO: 1600086 - protein, 4 aa, Staphylococcus aureus
ETDE

SEQ ID NO: 1600087 - protein, 4 aa, Staphylococcus aureus
GIPT

SEQ ID NO: 1600088 - protein, 8 aa, Staphylococcus aureus
NDDTLENP

SEQ ID NO: 1600089 - protein, 9 aa, Staphylococcus aureus
QERNNTTYN

SEQ ID NO: 1600090 - protein, 6 aa, Staphylococcus aureus
EEEAPI

SEQ ID NO: 1600091 - protein, 5 aa, Staphylococcus aureus
IADND

SEQ ID NO: 1600092 - protein, 4 aa, Staphylococcus aureus
PSSI

SEQ ID NO: 1600093 - protein, 15 aa, Staphylococcus aureus
ATAGKKAGEFYTPQQ

SEQ ID NO: 1600094 - protein, 6 aa, Staphylococcus aureus
PTCGSG

SEQ ID NO: 1600095 - protein, 4 aa, Staphylococcus aureus
DEFN

SEQ ID NO: 1600096 - protein, 5 aa, Staphylococcus aureus
RQQDD

SEQ ID NO: 1600097 - protein, 4 aa, Staphylococcus aureus
SSGA

SEQ ID NO: 1600098 - protein, 14 aa, Staphylococcus aureus
SSTRLGNNVKERTA

SEQ ID NO: 1600099 - protein, 13 aa, Staphylococcus aureus
VETSTLGEESEND

SEQ ID NO: 1600100 - protein, 4 aa, Staphylococcus aureus
DEGT

SEQ ID NO: 1600101 - protein, 8 aa, Staphylococcus aureus
RQGKREVD

SEQ ID NO: 1600102 - protein, 4 aa, Staphylococcus aureus
EGNE

SEQ ID NO: 1600103 - protein, 5 aa, Staphylococcus aureus
KNRRS

SEQ ID NO: 1600104 - protein, 14 aa, Staphylococcus aureus
GEKKKTTKPNNGLA

SEQ ID NO: 1600105 - protein, 5 aa, Staphylococcus aureus
KKATV

SEQ ID NO: 1600106 - protein, 4 aa, Staphylococcus aureus
SDED

SEQ ID NO: 1600107 - protein, 5 aa, Staphylococcus aureus
AIEGI

SEQ ID NO: 1600108 - protein, 5 aa, Staphylococcus aureus
RGAQV

SEQ ID NO: 1600109 - protein, 5 aa, Staphylococcus aureus
SLGGR

SEQ ID NO: 1600110 - protein, 6 aa, Staphylococcus aureus
TDGKDK

SEQ ID NO: 1600111 - protein, 12 aa, Staphylococcus aureus
ASAYNGNDTEGL

SEQ ID NO: 1600112 - protein, 4 aa, Staphylococcus aureus
EEQA

SEQ ID NO: 1600113 - protein, 6 aa, Staphylococcus aureus
EKDEIR

SEQ ID NO: 1600114 - protein, 4 aa, Staphylococcus aureus
GLES

SEQ ID NO: 1600115 - protein, 8 aa, Staphylococcus aureus
LRGNMDAS

SEQ ID NO: 1600116 - protein, 4 aa, Staphylococcus aureus
TDQP

SEQ ID NO: 1600117 - protein, 5 aa, Staphylococcus aureus
ERLAD

SEQ ID NO: 1600118 - protein, 4 aa, Staphylococcus aureus
KAKQ

SEQ ID NO: 1600119 - protein, 4 aa, Staphylococcus aureus
SKEA

SEQ ID NO: 1600120 - protein, 4 aa, Staphylococcus aureus
ETAG

SEQ ID NO: 1600121 - protein, 4 aa, Staphylococcus aureus
QGYN

SEQ ID NO: 1600122 - protein, 5 aa, Staphylococcus aureus
QKKGY

SEQ ID NO: 1600123 - protein, 12 aa, Staphylococcus aureus
NEGQIHKHGKRV

SEQ ID NO: 1600124 - protein, 8 aa, Staphylococcus aureus
TFTAKTSI

SEQ ID NO: 1600125 - protein, 8 aa, Staphylococcus aureus
KAYKRSSD

SEQ ID NO: 1600126 - protein, 4 aa, Staphylococcus aureus
LNGN

SEQ ID NO: 1600127 - protein, 6 aa, Staphylococcus aureus
NRQQVK

SEQ ID NO: 1600128 - protein, 4 aa, Staphylococcus aureus
QPET

SEQ ID NO: 1600129 - protein, 10 aa, Staphylococcus aureus
SVSKKSVSKG

SEQ ID NO: 1600130 - protein, 34 aa, Staphylococcus aureus
EEATKVKTEIDTAEDNCISPSTVSRIRTKAANSL

SEQ ID NO: 1600131 - protein, 5 aa, Staphylococcus aureus
KNVTG

SEQ ID NO: 1600132 - protein, 9 aa, Staphylococcus aureus
KPESTRTQI

SEQ ID NO: 1600133 - protein, 8 aa, Staphylococcus aureus
NKDTGKVT

SEQ ID NO: 1600134 - protein, 8 aa, Staphylococcus aureus
TKPGSDEL

SEQ ID NO: 1600135 - protein, 10 aa, Staphylococcus aureus
AGATRIGASA

SEQ ID NO: 1600136 - protein, 6 aa, Staphylococcus aureus
DDGGGE

SEQ ID NO: 1600137 - protein, 14 aa, Staphylococcus aureus
NDFEKGKNQNHLSD

SEQ ID NO: 1600138 - protein, 4 aa, Staphylococcus aureus
EAGI

SEQ ID NO: 1600139 - protein, 4 aa, Staphylococcus aureus
VPED

SEQ ID NO: 1600140 - protein, 4 aa, Staphylococcus aureus
GDPL

SEQ ID NO: 1600141 - protein, 4 aa, Staphylococcus aureus
GTAG

SEQ ID NO: 1600142 - protein, 4 aa, Staphylococcus aureus
AKEE

SEQ ID NO: 1600143 - protein, 4 aa, Staphylococcus aureus
EEEI

SEQ ID NO: 1600144 - protein, 4 aa, Staphylococcus aureus
GAQS

SEQ ID NO: 1600145 - protein, 4 aa, Staphylococcus aureus
TESG

SEQ ID NO: 1600146 - protein, 7 aa, Staphylococcus aureus
DGRFDDV

SEQ ID NO: 1600147 - protein, 4 aa, Staphylococcus aureus
EPVS

SEQ ID NO: 1600148 - protein, 4 aa, Staphylococcus aureus
KGGI

SEQ ID NO: 1600149 - protein, 34 aa, Staphylococcus aureus
ANPPYSAKWTADSKFENDERFSGYGKLAPKSKAD

SEQ ID NO: 1600150 - protein, 4 aa, Staphylococcus aureus
IDTP

SEQ ID NO: 1600151 - protein, 16 aa, Staphylococcus aureus
KAEQEYADALSGEDIT

SEQ ID NO: 1600152 - protein, 4 aa, Staphylococcus aureus
RKRP

SEQ ID NO: 1600153 - protein, 6 aa, Staphylococcus aureus
TVGADV

SEQ ID NO: 1600154 - protein, 5 aa, Staphylococcus aureus
DLEGK

SEQ ID NO: 1600155 - protein, 6 aa, Staphylococcus aureus
NPNTDA

SEQ ID NO: 1600156 - protein, 10 aa, Staphylococcus aureus
YRNKKGPNYT

SEQ ID NO: 1600157 - protein, 4 aa, Staphylococcus aureus
DSSR

SEQ ID NO: 1600158 - protein, 4 aa, Staphylococcus aureus
EAEA

SEQ ID NO: 1600159 - protein, 5 aa, Staphylococcus aureus
PARLT

SEQ ID NO: 1600160 - protein, 4 aa, Staphylococcus aureus
PASL

SEQ ID NO: 1600161 - protein, 9 aa, Staphylococcus aureus
KEPREHTSK

SEQ ID NO: 1600162 - protein, 4 aa, Staphylococcus aureus
QDLK

SEQ ID NO: 1600163 - protein, 5 aa, Staphylococcus aureus
RGASE

SEQ ID NO: 1600164 - protein, 5 aa, Staphylococcus aureus
DEIAP

SEQ ID NO: 1600165 - protein, 4 aa, Staphylococcus aureus
ELEE

SEQ ID NO: 1600166 - protein, 22 aa, Staphylococcus aureus
GASTTATKAFETEDAIQNGADE

SEQ ID NO: 1600167 - protein, 4 aa, Staphylococcus aureus
KQIE

SEQ ID NO: 1600168 - protein, 5 aa, Staphylococcus aureus
LSPND

SEQ ID NO: 1600169 - protein, 4 aa, Staphylococcus aureus
EPFE

SEQ ID NO: 1600170 - protein, 5 aa, Staphylococcus aureus
HKKAY

SEQ ID NO: 1600171 - protein, 7 aa, Staphylococcus aureus
QRDNHSA

SEQ ID NO: 1600172 - protein, 4 aa, Staphylococcus aureus
TETI

SEQ ID NO: 1600173 - protein, 7 aa, Staphylococcus aureus
NSGQRRY

SEQ ID NO: 1600174 - protein, 4 aa, Staphylococcus aureus
RDGK

SEQ ID NO: 1600175 - protein, 14 aa, Staphylococcus aureus
TRYQSINTAKNTLK

SEQ ID NO: 1600176 - protein, 6 aa, Staphylococcus aureus
AAKGHT

SEQ ID NO: 1600177 - protein, 4 aa, Staphylococcus aureus
GKPV

SEQ ID NO: 1600178 - protein, 6 aa, Staphylococcus aureus
DDEGGE

SEQ ID NO: 1600179 - protein, 4 aa, Staphylococcus aureus
GGTE

SEQ ID NO: 1600180 - protein, 4 aa, Staphylococcus aureus
GKTT

SEQ ID NO: 1600181 - protein, 14 aa, Staphylococcus aureus
KRKETIDKYSYSAT

SEQ ID NO: 1600182 - protein, 4 aa, Staphylococcus aureus
EEKA

SEQ ID NO: 1600183 - protein, 5 aa, Staphylococcus aureus
ETKYR

SEQ ID NO: 1600184 - protein, 6 aa, Staphylococcus aureus
GAGKTT

SEQ ID NO: 1600185 - protein, 4 aa, Staphylococcus aureus
IESN

SEQ ID NO: 1600186 - protein, 19 aa, Staphylococcus aureus
KMKRNHERQDGTADAGKGY

SEQ ID NO: 1600187 - protein, 4 aa, Staphylococcus aureus
NEEE

SEQ ID NO: 1600188 - protein, 4 aa, Staphylococcus aureus
RGKI

SEQ ID NO: 1600189 - protein, 7 aa, Staphylococcus aureus
GPNTENF

SEQ ID NO: 1600190 - protein, 4 aa, Staphylococcus aureus
LEPQ

SEQ ID NO: 1600191 - protein, 4 aa, Staphylococcus aureus
NQYE

SEQ ID NO: 1600192 - protein, 9 aa, Staphylococcus aureus
RNGAGKTTT

SEQ ID NO: 1600193 - protein, 4 aa, Staphylococcus aureus
VKDG

SEQ ID NO: 1600194 - protein, 10 aa, Staphylococcus aureus
EKRAKELDEM

SEQ ID NO: 1600195 - protein, 7 aa, Staphylococcus aureus
GSGSTEH

SEQ ID NO: 1600196 - protein, 4 aa, Staphylococcus aureus
LNNS

SEQ ID NO: 1600197 - protein, 9 aa, Staphylococcus aureus
TKPGSDELN

SEQ ID NO: 1600198 - protein, 10 aa, Staphylococcus aureus
VAGGIKPDTI

SEQ ID NO: 1600199 - protein, 6 aa, Staphylococcus aureus
ADLSQS

SEQ ID NO: 1600200 - protein, 8 aa, Staphylococcus aureus
ADTTASER

SEQ ID NO: 1600201 - protein, 4 aa, Staphylococcus aureus
AGNI

SEQ ID NO: 1600202 - protein, 5 aa, Staphylococcus aureus
AKKGF

SEQ ID NO: 1600203 - protein, 7 aa, Staphylococcus aureus
AKKRAPY

SEQ ID NO: 1600204 - protein, 4 aa, Staphylococcus aureus
ANDR

SEQ ID NO: 1600205 - protein, 4 aa, Staphylococcus aureus
AQSH

SEQ ID NO: 1600206 - protein, 4 aa, Staphylococcus aureus
ATEK

SEQ ID NO: 1600207 - protein, 6 aa, Staphylococcus aureus
DCGANP

SEQ ID NO: 1600208 - protein, 4 aa, Staphylococcus aureus
DEAA

SEQ ID NO: 1600209 - protein, 5 aa, Staphylococcus aureus
DISIG

SEQ ID NO: 1600210 - protein, 6 aa, Staphylococcus aureus
DNPYSF

SEQ ID NO: 1600211 - protein, 5 aa, Staphylococcus aureus
DRETV

SEQ ID NO: 1600212 - protein, 5 aa, Staphylococcus aureus
DRGDR

SEQ ID NO: 1600213 - protein, 4 aa, Staphylococcus aureus
DRGK

SEQ ID NO: 1600214 - protein, 7 aa, Staphylococcus aureus
EDEDKTQ

SEQ ID NO: 1600215 - protein, 8 aa, Staphylococcus aureus
EGKEDQVE

SEQ ID NO: 1600216 - protein, 10 aa, Staphylococcus aureus
ENAKEAVSNG

SEQ ID NO: 1600217 - protein, 4 aa, Staphylococcus aureus
ESEY

SEQ ID NO: 1600218 - protein, 7 aa, Staphylococcus aureus
ESTSGNL

SEQ ID NO: 1600219 - protein, 4 aa, Staphylococcus aureus
ETQQ

SEQ ID NO: 1600220 - protein, 11 aa, Staphylococcus aureus
GDEADTTTDYT

SEQ ID NO: 1600221 - protein, 21 aa, Staphylococcus aureus
GESEGKDFKGIYPSSANYTTD

SEQ ID NO: 1600222 - protein, 7 aa, Staphylococcus aureus
GETVPAG

SEQ ID NO: 1600223 - protein, 4 aa, Staphylococcus aureus
GGGL

SEQ ID NO: 1600224 - protein, 5 aa, Staphylococcus aureus
GPFPN

SEQ ID NO: 1600225 - protein, 10 aa, Staphylococcus aureus
GPNGAGKSSL

SEQ ID NO: 1600226 - protein, 4 aa, Staphylococcus aureus
GTQQ

SEQ ID NO: 1600227 - protein, 6 aa, Staphylococcus aureus
GVKPAK

SEQ ID NO: 1600228 - protein, 6 aa, Staphylococcus aureus
HGAGTE

SEQ ID NO: 1600229 - protein, 4 aa, Staphylococcus aureus
HNTY

SEQ ID NO: 1600230 - protein, 4 aa, Staphylococcus aureus
IKAM

SEQ ID NO: 1600231 - protein, 7 aa, Staphylococcus aureus
ISRQDTT

SEQ ID NO: 1600232 - protein, 8 aa, Staphylococcus aureus
ITNTSTKR

SEQ ID NO: 1600233 - protein, 4 aa, Staphylococcus aureus
KEGK

SEQ ID NO: 1600234 - protein, 6 aa, Staphylococcus aureus
KEGTER

SEQ ID NO: 1600235 - protein, 6 aa, Staphylococcus aureus
KGRSGF

SEQ ID NO: 1600236 - protein, 6 aa, Staphylococcus aureus
KISPTN

SEQ ID NO: 1600237 - protein, 7 aa, Staphylococcus aureus
KPPSVSE

SEQ ID NO: 1600238 - protein, 7 aa, Staphylococcus aureus
KTFDTAE

SEQ ID NO: 1600239 - protein, 7 aa, Staphylococcus aureus
KYSSGMR

SEQ ID NO: 1600240 - protein, 4 aa, Staphylococcus aureus
LDKS

SEQ ID NO: 1600241 - protein, 21 aa, Staphylococcus aureus
LKDTQSMQYRESNPPATPETF

SEQ ID NO: 1600242 - protein, 7 aa, Staphylococcus aureus
LKDYGEL

SEQ ID NO: 1600243 - protein, 10 aa, Staphylococcus aureus
LRQDPENGHI

SEQ ID NO: 1600244 - protein, 5 aa, Staphylococcus aureus
NAYQS

SEQ ID NO: 1600245 - protein, 10 aa, Staphylococcus aureus
NEFANKATTL

SEQ ID NO: 1600246 - protein, 6 aa, Staphylococcus aureus
NGGAQT

SEQ ID NO: 1600247 - protein, 10 aa, Staphylococcus aureus
NGSGKSTLSN

SEQ ID NO: 1600248 - protein, 9 aa, Staphylococcus aureus
NPLGQTVEP

SEQ ID NO: 1600249 - protein, 5 aa, Staphylococcus aureus
NQSTN

SEQ ID NO: 1600250 - protein, 10 aa, Staphylococcus aureus
PFNQPGVEAY

SEQ ID NO: 1600251 - protein, 13 aa, Staphylococcus aureus
PINRELPGIGASR

SEQ ID NO: 1600252 - protein, 20 aa, Staphylococcus aureus
PMPEAHKKVNSNSFIETDDE

SEQ ID NO: 1600253 - protein, 9 aa, Staphylococcus aureus
PNKSARDKL

SEQ ID NO: 1600254 - protein, 10 aa, Staphylococcus aureus
PNSEEKGGVI

SEQ ID NO: 1600255 - protein, 4 aa, Staphylococcus aureus
PNYH

SEQ ID NO: 1600256 - protein, 9 aa, Staphylococcus aureus
PRNNEYKEK

SEQ ID NO: 1600257 - protein, 9 aa, Staphylococcus aureus
QCNREKKTI

SEQ ID NO: 1600258 - protein, 10 aa, Staphylococcus aureus
QGASTDSNYV

SEQ ID NO: 1600259 - protein, 10 aa, Staphylococcus aureus
QKKDNHSKQA

SEQ ID NO: 1600260 - protein, 10 aa, Staphylococcus aureus
QLSPYKQTQV

SEQ ID NO: 1600261 - protein, 6 aa, Staphylococcus aureus
QTPTIA

SEQ ID NO: 1600262 - protein, 9 aa, Staphylococcus aureus
QTRDDQVTS

SEQ ID NO: 1600263 - protein, 7 aa, Staphylococcus aureus
QVGDKTY

SEQ ID NO: 1600264 - protein, 6 aa, Staphylococcus aureus
REDEDI

SEQ ID NO: 1600265 - protein, 7 aa, Staphylococcus aureus
RPGKELE

SEQ ID NO: 1600266 - protein, 9 aa, Staphylococcus aureus
SERTSAQAI

SEQ ID NO: 1600267 - protein, 4 aa, Staphylococcus aureus
SKDE

SEQ ID NO: 1600268 - protein, 14 aa, Staphylococcus aureus
SKHDNPSKRNMERA

SEQ ID NO: 1600269 - protein, 7 aa, Staphylococcus aureus
SKSKDTR

SEQ ID NO: 1600270 - protein, 6 aa, Staphylococcus aureus
SLNGGR

SEQ ID NO: 1600271 - protein, 15 aa, Staphylococcus aureus
SLSPTVGKVDRNGEV

SEQ ID NO: 1600272 - protein, 14 aa, Staphylococcus aureus
STDCSDPSQRSNIT

SEQ ID NO: 1600273 - protein, 6 aa, Staphylococcus aureus
TANIDE

SEQ ID NO: 1600274 - protein, 6 aa, Staphylococcus aureus
TDGGVP

SEQ ID NO: 1600275 - protein, 11 aa, Staphylococcus aureus
TIDEVNTKAFE

SEQ ID NO: 1600276 - protein, 9 aa, Staphylococcus aureus
TNAQHASSM

SEQ ID NO: 1600277 - protein, 7 aa, Staphylococcus aureus
TNKERMK

SEQ ID NO: 1600278 - protein, 9 aa, Staphylococcus aureus
TNNGDKNFV

SEQ ID NO: 1600279 - protein, 8 aa, Staphylococcus aureus
TTETRQEA

SEQ ID NO: 1600280 - protein, 6 aa, Staphylococcus aureus
VGDQTF

SEQ ID NO: 1600281 - protein, 7 aa, Staphylococcus aureus
VSTTGSI

SEQ ID NO: 1600282 - protein, 5 aa, Staphylococcus aureus
YDKEE

SEQ ID NO: 1600283 - protein, 6 aa, Staphylococcus aureus
YGSEAW

SEQ ID NO: 1600284 - protein, 4 aa, Staphylococcus aureus
AAEN

SEQ ID NO: 1600285 - protein, 29 aa, Staphylococcus aureus
AANNTGGAVKKREDTHKMAEANKAFAHYR

SEQ ID NO: 1600286 - protein, 9 aa, Staphylococcus aureus
AAQKPGETR

SEQ ID NO: 1600287 - protein, 10 aa, Staphylococcus aureus
ACGGASSGFN

SEQ ID NO: 1600288 - protein, 7 aa, Staphylococcus aureus
ADDPTLR

SEQ ID NO: 1600289 - protein, 6 aa, Staphylococcus aureus
ADFGDV

SEQ ID NO: 1600290 - protein, 8 aa, Staphylococcus aureus
ADGPMPQT

SEQ ID NO: 1600291 - protein, 9 aa, Staphylococcus aureus
ADLKDGAKV

SEQ ID NO: 1600292 - protein, 4 aa, Staphylococcus aureus
ADSL

SEQ ID NO: 1600293 - protein, 7 aa, Staphylococcus aureus
AEAGDNI

SEQ ID NO: 1600294 - protein, 10 aa, Staphylococcus aureus
AEANKASQRV

SEQ ID NO: 1600295 - protein, 8 aa, Staphylococcus aureus
AEAPAKAY

SEQ ID NO: 1600296 - protein, 4 aa, Staphylococcus aureus
AEDE

SEQ ID NO: 1600297 - protein, 8 aa, Staphylococcus aureus
AEEGDDIA

SEQ ID NO: 1600298 - protein, 6 aa, Staphylococcus aureus
AEGQNT

SEQ ID NO: 1600299 - protein, 7 aa, Staphylococcus aureus
AENAERL

SEQ ID NO: 1600300 - protein, 9 aa, Staphylococcus aureus
AEQAQHDHD

SEQ ID NO: 1600301 - protein, 5 aa, Staphylococcus aureus
AETGD

SEQ ID NO: 1600302 - protein, 6 aa, Staphylococcus aureus
AETSDE

SEQ ID NO: 1600303 - protein, 16 aa, Staphylococcus aureus
AETSNPVTSTRSIGGV

SEQ ID NO: 1600304 - protein, 13 aa, Staphylococcus aureus
AFAQRRKTINNNY

SEQ ID NO: 1600305 - protein, 20 aa, Staphylococcus aureus
AFDPKKDQFKEVTQEDLKGS

SEQ ID NO: 1600306 - protein, 6 aa, Staphylococcus aureus
AFSQDK

SEQ ID NO: 1600307 - protein, 8 aa, Staphylococcus aureus
AGDARRGQ

SEQ ID NO: 1600308 - protein, 4 aa, Staphylococcus aureus
AGEL

SEQ ID NO: 1600309 - protein, 10 aa, Staphylococcus aureus
AGEPLTITDP

SEQ ID NO: 1600310 - protein, 6 aa, Staphylococcus aureus
AGFNKS

SEQ ID NO: 1600311 - protein, 6 aa, Staphylococcus aureus
AGGSDL

SEQ ID NO: 1600312 - protein, 8 aa, Staphylococcus aureus
AGGSTGSI

SEQ ID NO: 1600313 - protein, 9 aa, Staphylococcus aureus
AGGTDRNET

SEQ ID NO: 1600314 - protein, 8 aa, Staphylococcus aureus
AGKTTTTE

SEQ ID NO: 1600315 - protein, 14 aa, Staphylococcus aureus
AGLAGGSADAAATL

SEQ ID NO: 1600316 - protein, 10 aa, Staphylococcus aureus
AGLPKRPFKP

SEQ ID NO: 1600317 - protein, 9 aa, Staphylococcus aureus
AGMARDGKT

SEQ ID NO: 1600318 - protein, 5 aa, Staphylococcus aureus
AGPFE

SEQ ID NO: 1600319 - protein, 4 aa, Staphylococcus aureus
AGPN

SEQ ID NO: 1600320 - protein, 10 aa, Staphylococcus aureus
AGQGQNPARI

SEQ ID NO: 1600321 - protein, 7 aa, Staphylococcus aureus
AGTGMRR

SEQ ID NO: 1600322 - protein, 12 aa, Staphylococcus aureus
AGYVETKPYKGV

SEQ ID NO: 1600323 - protein, 9 aa, Staphylococcus aureus
AHASQTGPF

SEQ ID NO: 1600324 - protein, 27 aa, Staphylococcus aureus
AHPLNKGNIRTGETTPYSNIALESNVT

SEQ ID NO: 1600325 - protein, 5 aa, Staphylococcus aureus
AHQTS

SEQ ID NO: 1600326 - protein, 6 aa, Staphylococcus aureus
AIEKGG

SEQ ID NO: 1600327 - protein, 10 aa, Staphylococcus aureus
AIETPDGNGK

SEQ ID NO: 1600328 - protein, 8 aa, Staphylococcus aureus
AIGDGDHG

SEQ ID NO: 1600329 - protein, 9 aa, Staphylococcus aureus
AIKGKRDDL

SEQ ID NO: 1600330 - protein, 5 aa, Staphylococcus aureus
AINEG

SEQ ID NO: 1600331 - protein, 7 aa, Staphylococcus aureus
AKANNEI

SEQ ID NO: 1600332 - protein, 6 aa, Staphylococcus aureus
AKDGVE

SEQ ID NO: 1600333 - protein, 7 aa, Staphylococcus aureus
AKDPQKH

SEQ ID NO: 1600334 - protein, 7 aa, Staphylococcus aureus
AKDRQQE

SEQ ID NO: 1600335 - protein, 5 aa, Staphylococcus aureus
AKEQD

SEQ ID NO: 1600336 - protein, 7 aa, Staphylococcus aureus
AKERPSA

SEQ ID NO: 1600337 - protein, 11 aa, Staphylococcus aureus
AKEVSDQGRIT

SEQ ID NO: 1600338 - protein, 8 aa, Staphylococcus aureus
AKNVTPGY

SEQ ID NO: 1600339 - protein, 7 aa, Staphylococcus aureus
AKPGEIS

SEQ ID NO: 1600340 - protein, 8 aa, Staphylococcus aureus
AKRRNNTQ

SEQ ID NO: 1600341 - protein, 14 aa, Staphylococcus aureus
AKYEAETNYIPNPR

SEQ ID NO: 1600342 - protein, 12 aa, Staphylococcus aureus
ALKAESEVQHDD

SEQ ID NO: 1600343 - protein, 9 aa, Staphylococcus aureus
ALKDKGAKE

SEQ ID NO: 1600344 - protein, 7 aa, Staphylococcus aureus
ALQGGGS

SEQ ID NO: 1600345 - protein, 7 aa, Staphylococcus aureus
ALQKDSS

SEQ ID NO: 1600346 - protein, 21 aa, Staphylococcus aureus
AMEKGSNDRYFQEDKAPKKFV

SEQ ID NO: 1600347 - protein, 5 aa, Staphylococcus aureus
ANAAP

SEQ ID NO: 1600348 - protein, 8 aa, Staphylococcus aureus
ANAKGEVR

SEQ ID NO: 1600349 - protein, 6 aa, Staphylococcus aureus
ANDANV

SEQ ID NO: 1600350 - protein, 6 aa, Staphylococcus aureus
ANERGI

SEQ ID NO: 1600351 - protein, 5 aa, Staphylococcus aureus
ANGEV

SEQ ID NO: 1600352 - protein, 12 aa, Staphylococcus aureus
ANGGRKKTIKRS

SEQ ID NO: 1600353 - protein, 10 aa, Staphylococcus aureus
ANKPASGTQI

SEQ ID NO: 1600354 - protein, 4 aa, Staphylococcus aureus
ANKQ

SEQ ID NO: 1600355 - protein, 11 aa, Staphylococcus aureus
ANSKLDENGRF

SEQ ID NO: 1600356 - protein, 16 aa, Staphylococcus aureus
ANVEHNEDIAGERQAR

SEQ ID NO: 1600357 - protein, 4 aa, Staphylococcus aureus
APFT

SEQ ID NO: 1600358 - protein, 10 aa, Staphylococcus aureus
APGSITPHTE

SEQ ID NO: 1600359 - protein, 5 aa, Staphylococcus aureus
APSGK

SEQ ID NO: 1600360 - protein, 14 aa, Staphylococcus aureus
AQDTRRKNIGLTTS

SEQ ID NO: 1600361 - protein, 7 aa, Staphylococcus aureus
AQIGDEI

SEQ ID NO: 1600362 - protein, 7 aa, Staphylococcus aureus
AQQDHAE

SEQ ID NO: 1600363 - protein, 10 aa, Staphylococcus aureus
AQQKAEEEKL

SEQ ID NO: 1600364 - protein, 11 aa, Staphylococcus aureus
AQSGVEPQTET

SEQ ID NO: 1600365 - protein, 7 aa, Staphylococcus aureus
AQSTKQA

SEQ ID NO: 1600366 - protein, 9 aa, Staphylococcus aureus
AQTNANKLG

SEQ ID NO: 1600367 - protein, 9 aa, Staphylococcus aureus
ARDGEGATK

SEQ ID NO: 1600368 - protein, 6 aa, Staphylococcus aureus
AREAGV

SEQ ID NO: 1600369 - protein, 7 aa, Staphylococcus aureus
AREGGNN

SEQ ID NO: 1600370 - protein, 6 aa, Staphylococcus aureus
ARGELD

SEQ ID NO: 1600371 - protein, 8 aa, Staphylococcus aureus
ARLSSDGK

SEQ ID NO: 1600372 - protein, 5 aa, Staphylococcus aureus
ARPAI

SEQ ID NO: 1600373 - protein, 10 aa, Staphylococcus aureus
ARQKDKTAEM

SEQ ID NO: 1600374 - protein, 7 aa, Staphylococcus aureus
ASEGGMR

SEQ ID NO: 1600375 - protein, 7 aa, Staphylococcus aureus
ASGKTPY

SEQ ID NO: 1600376 - protein, 8 aa, Staphylococcus aureus
ASGQDSEW

SEQ ID NO: 1600377 - protein, 6 aa, Staphylococcus aureus
ASHPQS

SEQ ID NO: 1600378 - protein, 7 aa, Staphylococcus aureus
ASIESNT

SEQ ID NO: 1600379 - protein, 7 aa, Staphylococcus aureus
ASLETES

SEQ ID NO: 1600380 - protein, 5 aa, Staphylococcus aureus
ASLNP

SEQ ID NO: 1600381 - protein, 5 aa, Staphylococcus aureus
ASPDE

SEQ ID NO: 1600382 - protein, 6 aa, Staphylococcus aureus
ASPEKI

SEQ ID NO: 1600383 - protein, 10 aa, Staphylococcus aureus
ASSFKDKAVD

SEQ ID NO: 1600384 - protein, 13 aa, Staphylococcus aureus
ASSKTAQAMKNND

SEQ ID NO: 1600385 - protein, 12 aa, Staphylococcus aureus
ASTITSHDAGYL

SEQ ID NO: 1600386 - protein, 9 aa, Staphylococcus aureus
ATDKESVLS

SEQ ID NO: 1600387 - protein, 5 aa, Staphylococcus aureus
ATDLY

SEQ ID NO: 1600388 - protein, 6 aa, Staphylococcus aureus
ATENID

SEQ ID NO: 1600389 - protein, 6 aa, Staphylococcus aureus
ATGGTM

SEQ ID NO: 1600390 - protein, 7 aa, Staphylococcus aureus
ATGLAQR

SEQ ID NO: 1600391 - protein, 4 aa, Staphylococcus aureus
ATHE

SEQ ID NO: 1600392 - protein, 23 aa, Staphylococcus aureus
ATKGSHEFDENQEVHQNNQPEYL

SEQ ID NO: 1600393 - protein, 6 aa, Staphylococcus aureus
ATLESE

SEQ ID NO: 1600394 - protein, 13 aa, Staphylococcus aureus
ATLGSQLADKDRR

SEQ ID NO: 1600395 - protein, 19 aa, Staphylococcus aureus
ATLTSAGATVVPSGFNKSG

SEQ ID NO: 1600396 - protein, 6 aa, Staphylococcus aureus
ATNQKL

SEQ ID NO: 1600397 - protein, 8 aa, Staphylococcus aureus
ATPDNIPE

SEQ ID NO: 1600398 - protein, 12 aa, Staphylococcus aureus
ATPEETRGSDLG

SEQ ID NO: 1600399 - protein, 10 aa, Staphylococcus aureus
ATPPKSVQDE

SEQ ID NO: 1600400 - protein, 9 aa, Staphylococcus aureus
ATPYSPTTV

SEQ ID NO: 1600401 - protein, 6 aa, Staphylococcus aureus
ATQNKD

SEQ ID NO: 1600402 - protein, 10 aa, Staphylococcus aureus
ATVEGTELEH

SEQ ID NO: 1600403 - protein, 9 aa, Staphylococcus aureus
AVEATPGNL

SEQ ID NO: 1600404 - protein, 16 aa, Staphylococcus aureus
AVNGDANGSIPTSEPM

SEQ ID NO: 1600405 - protein, 8 aa, Staphylococcus aureus
AVPAARQG

SEQ ID NO: 1600406 - protein, 5 aa, Staphylococcus aureus
AYQGY

SEQ ID NO: 1600407 - protein, 8 aa, Staphylococcus aureus
CNERDAEN

SEQ ID NO: 1600408 - protein, 12 aa, Staphylococcus aureus
CPKIKAKPAITQ

SEQ ID NO: 1600409 - protein, 6 aa, Staphylococcus aureus
CSTDQT

SEQ ID NO: 1600410 - protein, 6 aa, Staphylococcus aureus
DADKGW

SEQ ID NO: 1600411 - protein, 7 aa, Staphylococcus aureus
DAHNTEI

SEQ ID NO: 1600412 - protein, 8 aa, Staphylococcus aureus
DAMENGDL

SEQ ID NO: 1600413 - protein, 7 aa, Staphylococcus aureus
DANREAF

SEQ ID NO: 1600414 - protein, 19 aa, Staphylococcus aureus
DAPYLSPHPYRGKRNEPAR

SEQ ID NO: 1600415 - protein, 15 aa, Staphylococcus aureus
DAQTYGSQGQQRTTA

SEQ ID NO: 1600416 - protein, 14 aa, Staphylococcus aureus
DASGGGVTVSGGEP

SEQ ID NO: 1600417 - protein, 7 aa, Staphylococcus aureus
DDAQTMK

SEQ ID NO: 1600418 - protein, 4 aa, Staphylococcus aureus
DDES

SEQ ID NO: 1600419 - protein, 6 aa, Staphylococcus aureus
DDKGHI

SEQ ID NO: 1600420 - protein, 5 aa, Staphylococcus aureus
DDMNR

SEQ ID NO: 1600421 - protein, 9 aa, Staphylococcus aureus
DDMTGRTLK

SEQ ID NO: 1600422 - protein, 12 aa, Staphylococcus aureus
DDNGEEVPTGEI

SEQ ID NO: 1600423 - protein, 10 aa, Staphylococcus aureus
DDSESYENIT

SEQ ID NO: 1600424 - protein, 6 aa, Staphylococcus aureus
DDTEPK

SEQ ID NO: 1600425 - protein, 6 aa, Staphylococcus aureus
DDTNPS

SEQ ID NO: 1600426 - protein, 17 aa, Staphylococcus aureus
DDTSAKVSTLSGGNKRK

SEQ ID NO: 1600427 - protein, 14 aa, Staphylococcus aureus
DDVPQGESDEDNVE

SEQ ID NO: 1600428 - protein, 12 aa, Staphylococcus aureus
DEDRKPSNTKEL

SEQ ID NO: 1600429 - protein, 6 aa, Staphylococcus aureus
DEEISV

SEQ ID NO: 1600430 - protein, 8 aa, Staphylococcus aureus
DEGVRENV

SEQ ID NO: 1600431 - protein, 11 aa, Staphylococcus aureus
DENHNDKGPLA

SEQ ID NO: 1600432 - protein, 5 aa, Staphylococcus aureus
DEPHY

SEQ ID NO: 1600433 - protein, 14 aa, Staphylococcus aureus
DEPTTALDASTQNQ

SEQ ID NO: 1600434 - protein, 11 aa, Staphylococcus aureus
DEQGEPLSEQV

SEQ ID NO: 1600435 - protein, 18 aa, Staphylococcus aureus
DERDEENVREDSYHYEGG

SEQ ID NO: 1600436 - protein, 7 aa, Staphylococcus aureus
DETYYTE

SEQ ID NO: 1600437 - protein, 6 aa, Staphylococcus aureus
DEVETG

SEQ ID NO: 1600438 - protein, 6 aa, Staphylococcus aureus
DEVETP

SEQ ID NO: 1600439 - protein, 10 aa, Staphylococcus aureus
DEVLNPGNTE

SEQ ID NO: 1600440 - protein, 24 aa, Staphylococcus aureus
DEYEERLRGDNKIGTTKKGIGPAY

SEQ ID NO: 1600441 - protein, 11 aa, Staphylococcus aureus
DFIQPPSRKNE

SEQ ID NO: 1600442 - protein, 9 aa, Staphylococcus aureus
DFNNEGDER

SEQ ID NO: 1600443 - protein, 6 aa, Staphylococcus aureus
DFPGDD

SEQ ID NO: 1600444 - protein, 5 aa, Staphylococcus aureus
DGATA

SEQ ID NO: 1600445 - protein, 8 aa, Staphylococcus aureus
DGDTSTND

SEQ ID NO: 1600446 - protein, 10 aa, Staphylococcus aureus
DGEDTAKDMY

SEQ ID NO: 1600447 - protein, 5 aa, Staphylococcus aureus
DGNDA

SEQ ID NO: 1600448 - protein, 6 aa, Staphylococcus aureus
DGPSME

SEQ ID NO: 1600449 - protein, 7 aa, Staphylococcus aureus
DGSDRYM

SEQ ID NO: 1600450 - protein, 8 aa, Staphylococcus aureus
DGSLYTGY

SEQ ID NO: 1600451 - protein, 5 aa, Staphylococcus aureus
DGTAN

SEQ ID NO: 1600452 - protein, 6 aa, Staphylococcus aureus
DGVRVG

SEQ ID NO: 1600453 - protein, 5 aa, Staphylococcus aureus
DHGTE

SEQ ID NO: 1600454 - protein, 6 aa, Staphylococcus aureus
DHKPSD

SEQ ID NO: 1600455 - protein, 11 aa, Staphylococcus aureus
DIEQAGGNHSQ

SEQ ID NO: 1600456 - protein, 7 aa, Staphylococcus aureus
DKAKELN

SEQ ID NO: 1600457 - protein, 11 aa, Staphylococcus aureus
DKAKGAGDENF

SEQ ID NO: 1600458 - protein, 7 aa, Staphylococcus aureus
DKEKLSQ

SEQ ID NO: 1600459 - protein, 5 aa, Staphylococcus aureus
DKENG

SEQ ID NO: 1600460 - protein, 4 aa, Staphylococcus aureus
DKGI

SEQ ID NO: 1600461 - protein, 5 aa, Staphylococcus aureus
DKHNF

SEQ ID NO: 1600462 - protein, 6 aa, Staphylococcus aureus
DKINHS

SEQ ID NO: 1600463 - protein, 6 aa, Staphylococcus aureus
DKQNIH

SEQ ID NO: 1600464 - protein, 7 aa, Staphylococcus aureus
DKSPYDG

SEQ ID NO: 1600465 - protein, 15 aa, Staphylococcus aureus
DKTIREAIENLINEL

SEQ ID NO: 1600466 - protein, 7 aa, Staphylococcus aureus
DKVDYGS

SEQ ID NO: 1600467 - protein, 8 aa, Staphylococcus aureus
DKVETTVS

SEQ ID NO: 1600468 - protein, 18 aa, Staphylococcus aureus
DKYPSELSGGQRQRTSAA

SEQ ID NO: 1600469 - protein, 9 aa, Staphylococcus aureus
DKYTRNRQY

SEQ ID NO: 1600470 - protein, 8 aa, Staphylococcus aureus
DLSGGQRQ

SEQ ID NO: 1600471 - protein, 18 aa, Staphylococcus aureus
DNEKMGSYQYEINYKEIG

SEQ ID NO: 1600472 - protein, 5 aa, Staphylococcus aureus
DNFET

SEQ ID NO: 1600473 - protein, 8 aa, Staphylococcus aureus
DNGAGKST

SEQ ID NO: 1600474 - protein, 18 aa, Staphylococcus aureus
DNGRRGRPVTGPGNRPLK

SEQ ID NO: 1600475 - protein, 7 aa, Staphylococcus aureus
DNKEDRN

SEQ ID NO: 1600476 - protein, 7 aa, Staphylococcus aureus
DNNPDAK

SEQ ID NO: 1600477 - protein, 8 aa, Staphylococcus aureus
DPEKQDKF

SEQ ID NO: 1600478 - protein, 7 aa, Staphylococcus aureus
DPENAKL

SEQ ID NO: 1600479 - protein, 20 aa, Staphylococcus aureus
DPIEGTKPTTKNEMTDLQST

SEQ ID NO: 1600480 - protein, 13 aa, Staphylococcus aureus
DPLDGHKGTNIGS

SEQ ID NO: 1600481 - protein, 7 aa, Staphylococcus aureus
DPNNNVA

SEQ ID NO: 1600482 - protein, 7 aa, Staphylococcus aureus
DQVGDDE

SEQ ID NO: 1600483 - protein, 5 aa, Staphylococcus aureus
DRGSF

SEQ ID NO: 1600484 - protein, 16 aa, Staphylococcus aureus
DSEAEMRKERIKKTKT

SEQ ID NO: 1600485 - protein, 7 aa, Staphylococcus aureus
DSEEAMS

SEQ ID NO: 1600486 - protein, 7 aa, Staphylococcus aureus
DSEQRQI

SEQ ID NO: 1600487 - protein, 7 aa, Staphylococcus aureus
DSETNVK

SEQ ID NO: 1600488 - protein, 11 aa, Staphylococcus aureus
DSIANDGYNDE

SEQ ID NO: 1600489 - protein, 4 aa, Staphylococcus aureus
DSID

SEQ ID NO: 1600490 - protein, 16 aa, Staphylococcus aureus
DSPSTDYAAIEDKKRR

SEQ ID NO: 1600491 - protein, 13 aa, Staphylococcus aureus
DSQCETKVSTYNH

SEQ ID NO: 1600492 - protein, 7 aa, Staphylococcus aureus
DSQELAD

SEQ ID NO: 1600493 - protein, 8 aa, Staphylococcus aureus
DSQRRKVK

SEQ ID NO: 1600494 - protein, 11 aa, Staphylococcus aureus
DTAKSTGKKLT

SEQ ID NO: 1600495 - protein, 9 aa, Staphylococcus aureus
DTEPVVKPE

SEQ ID NO: 1600496 - protein, 5 aa, Staphylococcus aureus
DTGIV

SEQ ID NO: 1600497 - protein, 8 aa, Staphylococcus aureus
DTKEYQAT

SEQ ID NO: 1600498 - protein, 10 aa, Staphylococcus aureus
DTRKNDQQIR

SEQ ID NO: 1600499 - protein, 5 aa, Staphylococcus aureus
DTRVT

SEQ ID NO: 1600500 - protein, 6 aa, Staphylococcus aureus
DTTTTF

SEQ ID NO: 1600501 - protein, 6 aa, Staphylococcus aureus
DTVTES

SEQ ID NO: 1600502 - protein, 5 aa, Staphylococcus aureus
DVKGG

SEQ ID NO: 1600503 - protein, 20 aa, Staphylococcus aureus
DVNARVEKHNRGQGAKYTKV

SEQ ID NO: 1600504 - protein, 5 aa, Staphylococcus aureus
DVPNA

SEQ ID NO: 1600505 - protein, 7 aa, Staphylococcus aureus
DVSNRDD

SEQ ID NO: 1600506 - protein, 8 aa, Staphylococcus aureus
DVTDQKNK

SEQ ID NO: 1600507 - protein, 4 aa, Staphylococcus aureus
DVTF

SEQ ID NO: 1600508 - protein, 10 aa, Staphylococcus aureus
DVTTEHEGEV

SEQ ID NO: 1600509 - protein, 11 aa, Staphylococcus aureus
DYDRPGSNRKP

SEQ ID NO: 1600510 - protein, 6 aa, Staphylococcus aureus
DYEGEI

SEQ ID NO: 1600511 - protein, 10 aa, Staphylococcus aureus
DYINKETLKD

SEQ ID NO: 1600512 - protein, 5 aa, Staphylococcus aureus
DYREY

SEQ ID NO: 1600513 - protein, 5 aa, Staphylococcus aureus
DYTRG

SEQ ID NO: 1600514 - protein, 15 aa, Staphylococcus aureus
EACPKNVAKIHVDEM

SEQ ID NO: 1600515 - protein, 10 aa, Staphylococcus aureus
EAGDFDKSKT

SEQ ID NO: 1600516 - protein, 11 aa, Staphylococcus aureus
EAGQSASTSSF

SEQ ID NO: 1600517 - protein, 9 aa, Staphylococcus aureus
EAGSDLNSV

SEQ ID NO: 1600518 - protein, 6 aa, Staphylococcus aureus
EAGVSV

SEQ ID NO: 1600519 - protein, 12 aa, Staphylococcus aureus
EAHKKLNQNVNP

SEQ ID NO: 1600520 - protein, 6 aa, Staphylococcus aureus
EASKLK

SEQ ID NO: 1600521 - protein, 7 aa, Staphylococcus aureus
EASSKVR

SEQ ID NO: 1600522 - protein, 9 aa, Staphylococcus aureus
EATAGNTGI

SEQ ID NO: 1600523 - protein, 6 aa, Staphylococcus aureus
EATNEY

SEQ ID NO: 1600524 - protein, 5 aa, Staphylococcus aureus
EATQD

SEQ ID NO: 1600525 - protein, 8 aa, Staphylococcus aureus
EDAEIEPL

SEQ ID NO: 1600526 - protein, 7 aa, Staphylococcus aureus
EDCGTDR

SEQ ID NO: 1600527 - protein, 24 aa, Staphylococcus aureus
EDDEAYQRMSQANNPYGDGQASRR

SEQ ID NO: 1600528 - protein, 8 aa, Staphylococcus aureus
EDEKNHRQ

SEQ ID NO: 1600529 - protein, 7 aa, Staphylococcus aureus
EDETLQK

SEQ ID NO: 1600530 - protein, 20 aa, Staphylococcus aureus
EDGSKWQGHQKGNYEEAKRE

SEQ ID NO: 1600531 - protein, 6 aa, Staphylococcus aureus
EDHGAE

SEQ ID NO: 1600532 - protein, 5 aa, Staphylococcus aureus
EDHYR

SEQ ID NO: 1600533 - protein, 12 aa, Staphylococcus aureus
EDKAEQRRNQEQ

SEQ ID NO: 1600534 - protein, 5 aa, Staphylococcus aureus
EDLIP

SEQ ID NO: 1600535 - protein, 25 aa, Staphylococcus aureus
EDNAKVTLTSQGATKIYKTPSNHVE

SEQ ID NO: 1600536 - protein, 6 aa, Staphylococcus aureus
EDNKEI

SEQ ID NO: 1600537 - protein, 19 aa, Staphylococcus aureus
EEDDKSVKEKRADILREHI

SEQ ID NO: 1600538 - protein, 21 aa, Staphylococcus aureus
EEEETQVKDGKAKTTVKKTFP

SEQ ID NO: 1600539 - protein, 5 aa, Staphylococcus aureus
EEERY

SEQ ID NO: 1600540 - protein, 6 aa, Staphylococcus aureus
EELSKT

SEQ ID NO: 1600541 - protein, 10 aa, Staphylococcus aureus
EERAKAQEYS

SEQ ID NO: 1600542 - protein, 16 aa, Staphylococcus aureus
EERNEARKNKDFARAD

SEQ ID NO: 1600543 - protein, 5 aa, Staphylococcus aureus
EERTV

SEQ ID NO: 1600544 - protein, 4 aa, Staphylococcus aureus
EESK

SEQ ID NO: 1600545 - protein, 21 aa, Staphylococcus aureus
EESLSQTKLRAERLDEDSSEL

SEQ ID NO: 1600546 - protein, 7 aa, Staphylococcus aureus
EESNEDV

SEQ ID NO: 1600547 - protein, 6 aa, Staphylococcus aureus
EESSEM

SEQ ID NO: 1600548 - protein, 10 aa, Staphylococcus aureus
EFKYSDNAQY

SEQ ID NO: 1600549 - protein, 9 aa, Staphylococcus aureus
EFSTQSPQL

SEQ ID NO: 1600550 - protein, 14 aa, Staphylococcus aureus
EGAEDHKKLAEEDL

SEQ ID NO: 1600551 - protein, 9 aa, Staphylococcus aureus
EGARDGKTV

SEQ ID NO: 1600552 - protein, 7 aa, Staphylococcus aureus
EGPDFPT

SEQ ID NO: 1600553 - protein, 6 aa, Staphylococcus aureus
EGTYYP

SEQ ID NO: 1600554 - protein, 9 aa, Staphylococcus aureus
EGVSTRHNP

SEQ ID NO: 1600555 - protein, 13 aa, Staphylococcus aureus
EGYPKLERTSQGN

SEQ ID NO: 1600556 - protein, 5 aa, Staphylococcus aureus
EHISE

SEQ ID NO: 1600557 - protein, 7 aa, Staphylococcus aureus
EIENAEP

SEQ ID NO: 1600558 - protein, 5 aa, Staphylococcus aureus
EINPK

SEQ ID NO: 1600559 - protein, 6 aa, Staphylococcus aureus
EIPDGK

SEQ ID NO: 1600560 - protein, 5 aa, Staphylococcus aureus
EITSQ

SEQ ID NO: 1600561 - protein, 8 aa, Staphylococcus aureus
EKASESAG

SEQ ID NO: 1600562 - protein, 14 aa, Staphylococcus aureus
EKDATQAEKDINEI

SEQ ID NO: 1600563 - protein, 5 aa, Staphylococcus aureus
EKGEV

SEQ ID NO: 1600564 - protein, 6 aa, Staphylococcus aureus
EKMSKS

SEQ ID NO: 1600565 - protein, 8 aa, Staphylococcus aureus
EKRGLREA

SEQ ID NO: 1600566 - protein, 9 aa, Staphylococcus aureus
EKTNGKSLA

SEQ ID NO: 1600567 - protein, 8 aa, Staphylococcus aureus
ELDDSRQT

SEQ ID NO: 1600568 - protein, 5 aa, Staphylococcus aureus
ELGTA

SEQ ID NO: 1600569 - protein, 7 aa, Staphylococcus aureus
ELNPTDE

SEQ ID NO: 1600570 - protein, 16 aa, Staphylococcus aureus
ELPEDAGSFLIIHQGE

SEQ ID NO: 1600571 - protein, 7 aa, Staphylococcus aureus
ELPENAR

SEQ ID NO: 1600572 - protein, 4 aa, Staphylococcus aureus
ELQR

SEQ ID NO: 1600573 - protein, 7 aa, Staphylococcus aureus
ELTKDPK

SEQ ID NO: 1600574 - protein, 5 aa, Staphylococcus aureus
EMAER

SEQ ID NO: 1600575 - protein, 6 aa, Staphylococcus aureus
EMTTNA

SEQ ID NO: 1600576 - protein, 8 aa, Staphylococcus aureus
ENAQGKTN

SEQ ID NO: 1600577 - protein, 10 aa, Staphylococcus aureus
ENDSTLTDNG

SEQ ID NO: 1600578 - protein, 7 aa, Staphylococcus aureus
ENEIDVS

SEQ ID NO: 1600579 - protein, 5 aa, Staphylococcus aureus
ENGKH

SEQ ID NO: 1600580 - protein, 12 aa, Staphylococcus aureus
ENGYGKRTPVND

SEQ ID NO: 1600581 - protein, 6 aa, Staphylococcus aureus
ENMSQS

SEQ ID NO: 1600582 - protein, 13 aa, Staphylococcus aureus
ENQQHQHQKEAHK

SEQ ID NO: 1600583 - protein, 4 aa, Staphylococcus aureus
ENTL

SEQ ID NO: 1600584 - protein, 8 aa, Staphylococcus aureus
ENTTSTEV

SEQ ID NO: 1600585 - protein, 4 aa, Staphylococcus aureus
EPEK

SEQ ID NO: 1600586 - protein, 5 aa, Staphylococcus aureus
EPESV

SEQ ID NO: 1600587 - protein, 8 aa, Staphylococcus aureus
EPHKIPPT

SEQ ID NO: 1600588 - protein, 12 aa, Staphylococcus aureus
EPKSKADQDKMT

SEQ ID NO: 1600589 - protein, 9 aa, Staphylococcus aureus
EPQPPSEDF

SEQ ID NO: 1600590 - protein, 14 aa, Staphylococcus aureus
EPTGALDSKSTQDL

SEQ ID NO: 1600591 - protein, 4 aa, Staphylococcus aureus
EPVG

SEQ ID NO: 1600592 - protein, 6 aa, Staphylococcus aureus
EQGKLD

SEQ ID NO: 1600593 - protein, 6 aa, Staphylococcus aureus
EQITKK

SEQ ID NO: 1600594 - protein, 9 aa, Staphylococcus aureus
EQRPEGKAQ

SEQ ID NO: 1600595 - protein, 8 aa, Staphylococcus aureus
EQRSGRDA

SEQ ID NO: 1600596 - protein, 7 aa, Staphylococcus aureus
EQYDDDL

SEQ ID NO: 1600597 - protein, 6 aa, Staphylococcus aureus
ERCELD

SEQ ID NO: 1600598 - protein, 9 aa, Staphylococcus aureus
ERDKEDEPL

SEQ ID NO: 1600599 - protein, 11 aa, Staphylococcus aureus
ERKKLSKRDGQ

SEQ ID NO: 1600600 - protein, 4 aa, Staphylococcus aureus
ERNE

SEQ ID NO: 1600601 - protein, 9 aa, Staphylococcus aureus
ERNEQGPYY

SEQ ID NO: 1600602 - protein, 8 aa, Staphylococcus aureus
ERSTEDER

SEQ ID NO: 1600603 - protein, 8 aa, Staphylococcus aureus
ESEHNPDT

SEQ ID NO: 1600604 - protein, 16 aa, Staphylococcus aureus
ESGGHASHTPETEEYG

SEQ ID NO: 1600605 - protein, 11 aa, Staphylococcus aureus
ESGNYSSIKSD

SEQ ID NO: 1600606 - protein, 12 aa, Staphylococcus aureus
ESGTKTAQTIKS

SEQ ID NO: 1600607 - protein, 18 aa, Staphylococcus aureus
ESVDKDNGYGPYRQSERQ

SEQ ID NO: 1600608 - protein, 6 aa, Staphylococcus aureus
ESVETL

SEQ ID NO: 1600609 - protein, 6 aa, Staphylococcus aureus
ETAPEV

SEQ ID NO: 1600610 - protein, 14 aa, Staphylococcus aureus
ETEEGTVNDIDKDT

SEQ ID NO: 1600611 - protein, 8 aa, Staphylococcus aureus
ETFDTDAS

SEQ ID NO: 1600612 - protein, 10 aa, Staphylococcus aureus
ETKSEALKRE

SEQ ID NO: 1600613 - protein, 5 aa, Staphylococcus aureus
ETKVE

SEQ ID NO: 1600614 - protein, 7 aa, Staphylococcus aureus
ETKVQSL

SEQ ID NO: 1600615 - protein, 8 aa, Staphylococcus aureus
ETPEGPNI

SEQ ID NO: 1600616 - protein, 8 aa, Staphylococcus aureus
ETPPENRF

SEQ ID NO: 1600617 - protein, 8 aa, Staphylococcus aureus
ETSRSHGD

SEQ ID NO: 1600618 - protein, 8 aa, Staphylococcus aureus
ETTARYGE

SEQ ID NO: 1600619 - protein, 5 aa, Staphylococcus aureus
EVGRE

SEQ ID NO: 1600620 - protein, 6 aa, Staphylococcus aureus
EVGTAG

SEQ ID NO: 1600621 - protein, 13 aa, Staphylococcus aureus
EVPELSRQSKGIP

SEQ ID NO: 1600622 - protein, 6 aa, Staphylococcus aureus
EVSGKT

SEQ ID NO: 1600623 - protein, 7 aa, Staphylococcus aureus
EVYEASN

SEQ ID NO: 1600624 - protein, 4 aa, Staphylococcus aureus
EYGT

SEQ ID NO: 1600625 - protein, 5 aa, Staphylococcus aureus
EYPRE

SEQ ID NO: 1600626 - protein, 11 aa, Staphylococcus aureus
FAGISQRRVRG

SEQ ID NO: 1600627 - protein, 9 aa, Staphylococcus aureus
FDGANDDDV

SEQ ID NO: 1600628 - protein, 5 aa, Staphylococcus aureus
FDNGK

SEQ ID NO: 1600629 - protein, 6 aa, Staphylococcus aureus
FEERQN

SEQ ID NO: 1600630 - protein, 15 aa, Staphylococcus aureus
FEPTIESAAEHRSAH

SEQ ID NO: 1600631 - protein, 5 aa, Staphylococcus aureus
FIQPN

SEQ ID NO: 1600632 - protein, 9 aa, Staphylococcus aureus
FKGAAQGDW

SEQ ID NO: 1600633 - protein, 16 aa, Staphylococcus aureus
FKGGHALESDTTFSSI

SEQ ID NO: 1600634 - protein, 7 aa, Staphylococcus aureus
FKGTEAA

SEQ ID NO: 1600635 - protein, 18 aa, Staphylococcus aureus
FKKDGTVTAGNASGINDG

SEQ ID NO: 1600636 - protein, 20 aa, Staphylococcus aureus
FNPSQNKVRQSLTSKVQERP

SEQ ID NO: 1600637 - protein, 5 aa, Staphylococcus aureus
FNTAN

SEQ ID NO: 1600638 - protein, 5 aa, Staphylococcus aureus
FNTTD

SEQ ID NO: 1600639 - protein, 12 aa, Staphylococcus aureus
FNVEPGNSLSKF

SEQ ID NO: 1600640 - protein, 6 aa, Staphylococcus aureus
FPGPGL

SEQ ID NO: 1600641 - protein, 12 aa, Staphylococcus aureus
FPKYGNNDDRVD

SEQ ID NO: 1600642 - protein, 10 aa, Staphylococcus aureus
FPTEKKGPSV

SEQ ID NO: 1600643 - protein, 9 aa, Staphylococcus aureus
FRNSGNKPS

SEQ ID NO: 1600644 - protein, 7 aa, Staphylococcus aureus
FSASKTY

SEQ ID NO: 1600645 - protein, 7 aa, Staphylococcus aureus
FSQKKGD

SEQ ID NO: 1600646 - protein, 6 aa, Staphylococcus aureus
FSTGNH

SEQ ID NO: 1600647 - protein, 5 aa, Staphylococcus aureus
GAEGI

SEQ ID NO: 1600648 - protein, 11 aa, Staphylococcus aureus
GAESVKGHLGE

SEQ ID NO: 1600649 - protein, 4 aa, Staphylococcus aureus
GAIP

SEQ ID NO: 1600650 - protein, 14 aa, Staphylococcus aureus
GANETRSYLASGTS

SEQ ID NO: 1600651 - protein, 7 aa, Staphylococcus aureus
GAQELQD

SEQ ID NO: 1600652 - protein, 19 aa, Staphylococcus aureus
GARKGLADTALKTADSGYL

SEQ ID NO: 1600653 - protein, 15 aa, Staphylococcus aureus
GDANDYVGKGLSGGT

SEQ ID NO: 1600654 - protein, 8 aa, Staphylococcus aureus
GDKVTRKE

SEQ ID NO: 1600655 - protein, 19 aa, Staphylococcus aureus
GDPQFEGQTKTKLGNSEVR

SEQ ID NO: 1600656 - protein, 5 aa, Staphylococcus aureus
GDPTW

SEQ ID NO: 1600657 - protein, 7 aa, Staphylococcus aureus
GDTGADC

SEQ ID NO: 1600658 - protein, 5 aa, Staphylococcus aureus
GDVPL

SEQ ID NO: 1600659 - protein, 10 aa, Staphylococcus aureus
GEAARRIGEG

SEQ ID NO: 1600660 - protein, 15 aa, Staphylococcus aureus
GEDEIGDDDNDKVKA

SEQ ID NO: 1600661 - protein, 9 aa, Staphylococcus aureus
GEDKEKGLT

SEQ ID NO: 1600662 - protein, 9 aa, Staphylococcus aureus
GEEFGGRDH

SEQ ID NO: 1600663 - protein, 4 aa, Staphylococcus aureus
GEEG

SEQ ID NO: 1600664 - protein, 6 aa, Staphylococcus aureus
GEGSQV

SEQ ID NO: 1600665 - protein, 11 aa, Staphylococcus aureus
GENISRPSVPE

SEQ ID NO: 1600666 - protein, 6 aa, Staphylococcus aureus
GEPDEV

SEQ ID NO: 1600667 - protein, 20 aa, Staphylococcus aureus
GEPKYDLEESKNRDATYAAP

SEQ ID NO: 1600668 - protein, 7 aa, Staphylococcus aureus
GEQIPSE

SEQ ID NO: 1600669 - protein, 5 aa, Staphylococcus aureus
GERTN

SEQ ID NO: 1600670 - protein, 12 aa, Staphylococcus aureus
GESGSGKSITAK

SEQ ID NO: 1600671 - protein, 12 aa, Staphylococcus aureus
GESGSGKSTLAK

SEQ ID NO: 1600672 - protein, 9 aa, Staphylococcus aureus
GETHEGASQ

SEQ ID NO: 1600673 - protein, 7 aa, Staphylococcus aureus
GGAAARP

SEQ ID NO: 1600674 - protein, 9 aa, Staphylococcus aureus
GGEYGIPHG

SEQ ID NO: 1600675 - protein, 5 aa, Staphylococcus aureus
GGINP

SEQ ID NO: 1600676 - protein, 4 aa, Staphylococcus aureus
GGPI

SEQ ID NO: 1600677 - protein, 7 aa, Staphylococcus aureus
GGSAMDA

SEQ ID NO: 1600678 - protein, 5 aa, Staphylococcus aureus
GGSIN

SEQ ID NO: 1600679 - protein, 9 aa, Staphylococcus aureus
GGSQPLPSI

SEQ ID NO: 1600680 - protein, 9 aa, Staphylococcus aureus
GGSRGFKAG

SEQ ID NO: 1600681 - protein, 6 aa, Staphylococcus aureus
GGTPLS

SEQ ID NO: 1600682 - protein, 12 aa, Staphylococcus aureus
GGVAGSDITQGL

SEQ ID NO: 1600683 - protein, 6 aa, Staphylococcus aureus
GGVDSS

SEQ ID NO: 1600684 - protein, 11 aa, Staphylococcus aureus
GGVHKGAEHTM

SEQ ID NO: 1600685 - protein, 4 aa, Staphylococcus aureus
GHDD

SEQ ID NO: 1600686 - protein, 12 aa, Staphylococcus aureus
GHGGDSGSIEDL

SEQ ID NO: 1600687 - protein, 13 aa, Staphylococcus aureus
GHGKSSKSESYDL

SEQ ID NO: 1600688 - protein, 6 aa, Staphylococcus aureus
GHSGAT

SEQ ID NO: 1600689 - protein, 16 aa, Staphylococcus aureus
GIAGSDDTAKKPNWPV

SEQ ID NO: 1600690 - protein, 11 aa, Staphylococcus aureus
GIDPRRRGETL

SEQ ID NO: 1600691 - protein, 7 aa, Staphylococcus aureus
GIGSETA

SEQ ID NO: 1600692 - protein, 5 aa, Staphylococcus aureus
GIGST

SEQ ID NO: 1600693 - protein, 6 aa, Staphylococcus aureus
GIGTSQ

SEQ ID NO: 1600694 - protein, 14 aa, Staphylococcus aureus
GIRRAYETGRGSIQ

SEQ ID NO: 1600695 - protein, 8 aa, Staphylococcus aureus
GISEQGDN

SEQ ID NO: 1600696 - protein, 4 aa, Staphylococcus aureus
GISN

SEQ ID NO: 1600697 - protein, 10 aa, Staphylococcus aureus
GKALDQDKSY

SEQ ID NO: 1600698 - protein, 6 aa, Staphylococcus aureus
GKATRN

SEQ ID NO: 1600699 - protein, 10 aa, Staphylococcus aureus
GKEITEYPAN

SEQ ID NO: 1600700 - protein, 4 aa, Staphylococcus aureus
GKEV

SEQ ID NO: 1600701 - protein, 12 aa, Staphylococcus aureus
GKMSKSKGNVVD

SEQ ID NO: 1600702 - protein, 9 aa, Staphylococcus aureus
GKNGSGKST

SEQ ID NO: 1600703 - protein, 7 aa, Staphylococcus aureus
GKQGRFR

SEQ ID NO: 1600704 - protein, 6 aa, Staphylococcus aureus
GKSAQT

SEQ ID NO: 1600705 - protein, 19 aa, Staphylococcus aureus
GKSPKYEYNRSERLSSGTV

SEQ ID NO: 1600706 - protein, 8 aa, Staphylococcus aureus
GKSTRNKL

SEQ ID NO: 1600707 - protein, 12 aa, Staphylococcus aureus
GKVERANEREYG

SEQ ID NO: 1600708 - protein, 11 aa, Staphylococcus aureus
GLNERGIPTSN

SEQ ID NO: 1600709 - protein, 7 aa, Staphylococcus aureus
GLPKERV

SEQ ID NO: 1600710 - protein, 7 aa, Staphylococcus aureus
GMPIPND

SEQ ID NO: 1600711 - protein, 8 aa, Staphylococcus aureus
GMSASDGF

SEQ ID NO: 1600712 - protein, 5 aa, Staphylococcus aureus
GNLTS

SEQ ID NO: 1600713 - protein, 13 aa, Staphylococcus aureus
GNQRNKYAYTAET

SEQ ID NO: 1600714 - protein, 6 aa, Staphylococcus aureus
GNRFPH

SEQ ID NO: 1600715 - protein, 7 aa, Staphylococcus aureus
GNVTTDS

SEQ ID NO: 1600716 - protein, 4 aa, Staphylococcus aureus
GPAM

SEQ ID NO: 1600717 - protein, 13 aa, Staphylococcus aureus
GPDREQTNLLKEL

SEQ ID NO: 1600718 - protein, 8 aa, Staphylococcus aureus
GPERSEEL

SEQ ID NO: 1600719 - protein, 9 aa, Staphylococcus aureus
GPGKTDEEL

SEQ ID NO: 1600720 - protein, 5 aa, Staphylococcus aureus
GPLTN

SEQ ID NO: 1600721 - protein, 14 aa, Staphylococcus aureus
GPTAIATSSEDAVA

SEQ ID NO: 1600722 - protein, 6 aa, Staphylococcus aureus
GQLNPG

SEQ ID NO: 1600723 - protein, 6 aa, Staphylococcus aureus
GQTTTT

SEQ ID NO: 1600724 - protein, 11 aa, Staphylococcus aureus
GQYGGNLTSTS

SEQ ID NO: 1600725 - protein, 6 aa, Staphylococcus aureus
GRALGG

SEQ ID NO: 1600726 - protein, 7 aa, Staphylococcus aureus
GRASRTG

SEQ ID NO: 1600727 - protein, 4 aa, Staphylococcus aureus
GRFS

SEQ ID NO: 1600728 - protein, 7 aa, Staphylococcus aureus
GRHGNKG

SEQ ID NO: 1600729 - protein, 9 aa, Staphylococcus aureus
GRKGGNQGL

SEQ ID NO: 1600730 - protein, 15 aa, Staphylococcus aureus
GRKPKALSGGQRQRV

SEQ ID NO: 1600731 - protein, 5 aa, Staphylococcus aureus
GRPLV

SEQ ID NO: 1600732 - protein, 8 aa, Staphylococcus aureus
GRPTNGMT

SEQ ID NO: 1600733 - protein, 13 aa, Staphylococcus aureus
GSAGAGSKPNPLL

SEQ ID NO: 1600734 - protein, 6 aa, Staphylococcus aureus
GSDSEI

SEQ ID NO: 1600735 - protein, 7 aa, Staphylococcus aureus
GSGKTTV

SEQ ID NO: 1600736 - protein, 4 aa, Staphylococcus aureus
GSGL

SEQ ID NO: 1600737 - protein, 6 aa, Staphylococcus aureus
GSGSER

SEQ ID NO: 1600738 - protein, 5 aa, Staphylococcus aureus
GSGTA

SEQ ID NO: 1600739 - protein, 7 aa, Staphylococcus aureus
GSKEQIA

SEQ ID NO: 1600740 - protein, 12 aa, Staphylococcus aureus
GSRSQKPADWEP

SEQ ID NO: 1600741 - protein, 6 aa, Staphylococcus aureus
GSSIEN

SEQ ID NO: 1600742 - protein, 13 aa, Staphylococcus aureus
GSTITDDVPNDSL

SEQ ID NO: 1600743 - protein, 5 aa, Staphylococcus aureus
GTDGV

SEQ ID NO: 1600744 - protein, 5 aa, Staphylococcus aureus
GTDTT

SEQ ID NO: 1600745 - protein, 10 aa, Staphylococcus aureus
GTEESPGATE

SEQ ID NO: 1600746 - protein, 9 aa, Staphylococcus aureus
GTGGNPGDK

SEQ ID NO: 1600747 - protein, 7 aa, Staphylococcus aureus
GTGSFGN

SEQ ID NO: 1600748 - protein, 6 aa, Staphylococcus aureus
GTRQDL

SEQ ID NO: 1600749 - protein, 5 aa, Staphylococcus aureus
GTTPE

SEQ ID NO: 1600750 - protein, 7 aa, Staphylococcus aureus
GTVDGPG

SEQ ID NO: 1600751 - protein, 8 aa, Staphylococcus aureus
GTVENNTI

SEQ ID NO: 1600752 - protein, 8 aa, Staphylococcus aureus
GVATPQDA

SEQ ID NO: 1600753 - protein, 10 aa, Staphylococcus aureus
GVESTSRAPW

SEQ ID NO: 1600754 - protein, 11 aa, Staphylococcus aureus
GVKGSTRQAVE

SEQ ID NO: 1600755 - protein, 13 aa, Staphylococcus aureus
GVKLTSSVETPER

SEQ ID NO: 1600756 - protein, 7 aa, Staphylococcus aureus
GVSPRTI

SEQ ID NO: 1600757 - protein, 4 aa, Staphylococcus aureus
GVVK

SEQ ID NO: 1600758 - protein, 16 aa, Staphylococcus aureus
GYAPNKHAKQLRGSKI

SEQ ID NO: 1600759 - protein, 15 aa, Staphylococcus aureus
GYDGGTGASPKTSIQ

SEQ ID NO: 1600760 - protein, 5 aa, Staphylococcus aureus
GYGDN

SEQ ID NO: 1600761 - protein, 6 aa, Staphylococcus aureus
GYGKTE

SEQ ID NO: 1600762 - protein, 9 aa, Staphylococcus aureus
GYSDDKDDL

SEQ ID NO: 1600763 - protein, 5 aa, Staphylococcus aureus
GYVSD

SEQ ID NO: 1600764 - protein, 5 aa, Staphylococcus aureus
HACGT

SEQ ID NO: 1600765 - protein, 15 aa, Staphylococcus aureus
HAETDMENAYGSTEG

SEQ ID NO: 1600766 - protein, 5 aa, Staphylococcus aureus
HAETL

SEQ ID NO: 1600767 - protein, 5 aa, Staphylococcus aureus
HANIG

SEQ ID NO: 1600768 - protein, 9 aa, Staphylococcus aureus
HARSTGPYS

SEQ ID NO: 1600769 - protein, 6 aa, Staphylococcus aureus
HDNEDE

SEQ ID NO: 1600770 - protein, 5 aa, Staphylococcus aureus
HEDGL

SEQ ID NO: 1600771 - protein, 11 aa, Staphylococcus aureus
HEETGRGIYED

SEQ ID NO: 1600772 - protein, 4 aa, Staphylococcus aureus
HEPK

SEQ ID NO: 1600773 - protein, 5 aa, Staphylococcus aureus
HGKTT

SEQ ID NO: 1600774 - protein, 7 aa, Staphylococcus aureus
HGKTTLT

SEQ ID NO: 1600775 - protein, 14 aa, Staphylococcus aureus
HGNDPTAPGTDHTR

SEQ ID NO: 1600776 - protein, 9 aa, Staphylococcus aureus
HGYSDKPRH

SEQ ID NO: 1600777 - protein, 8 aa, Staphylococcus aureus
HKHKPEIE

SEQ ID NO: 1600778 - protein, 5 aa, Staphylococcus aureus
HNGNF

SEQ ID NO: 1600779 - protein, 9 aa, Staphylococcus aureus
HNNEAEQSV

SEQ ID NO: 1600780 - protein, 4 aa, Staphylococcus aureus
HPEE

SEQ ID NO: 1600781 - protein, 6 aa, Staphylococcus aureus
HPEEYP

SEQ ID NO: 1600782 - protein, 7 aa, Staphylococcus aureus
HPKYGES

SEQ ID NO: 1600783 - protein, 4 aa, Staphylococcus aureus
HPRS

SEQ ID NO: 1600784 - protein, 6 aa, Staphylococcus aureus
HPSPLS

SEQ ID NO: 1600785 - protein, 7 aa, Staphylococcus aureus
HQMPGES

SEQ ID NO: 1600786 - protein, 8 aa, Staphylococcus aureus
HQPGPGVG

SEQ ID NO: 1600787 - protein, 4 aa, Staphylococcus aureus
HRHG

SEQ ID NO: 1600788 - protein, 5 aa, Staphylococcus aureus
HSDNY

SEQ ID NO: 1600789 - protein, 4 aa, Staphylococcus aureus
HSNK

SEQ ID NO: 1600790 - protein, 9 aa, Staphylococcus aureus
HSPNSIEGT

SEQ ID NO: 1600791 - protein, 8 aa, Staphylococcus aureus
HTDEETGQ

SEQ ID NO: 1600792 - protein, 6 aa, Staphylococcus aureus
HYPDTT

SEQ ID NO: 1600793 - protein, 9 aa, Staphylococcus aureus
IATGSTEDV

SEQ ID NO: 1600794 - protein, 5 aa, Staphylococcus aureus
IATNP

SEQ ID NO: 1600795 - protein, 10 aa, Staphylococcus aureus
IDKNGRENYD

SEQ ID NO: 1600796 - protein, 5 aa, Staphylococcus aureus
IDNDE

SEQ ID NO: 1600797 - protein, 10 aa, Staphylococcus aureus
IDSGKPGKTL

SEQ ID NO: 1600798 - protein, 9 aa, Staphylococcus aureus
IDTTAAGDT

SEQ ID NO: 1600799 - protein, 7 aa, Staphylococcus aureus
IEEAESY

SEQ ID NO: 1600800 - protein, 5 aa, Staphylococcus aureus
IEEPG

SEQ ID NO: 1600801 - protein, 11 aa, Staphylococcus aureus
IEGANGPEIKI

SEQ ID NO: 1600802 - protein, 9 aa, Staphylococcus aureus
IENDSAESV

SEQ ID NO: 1600803 - protein, 7 aa, Staphylococcus aureus
IEQQQKR

SEQ ID NO: 1600804 - protein, 10 aa, Staphylococcus aureus
IETEGQNQKF

SEQ ID NO: 1600805 - protein, 16 aa, Staphylococcus aureus
IETKPQLAEANTLTYG

SEQ ID NO: 1600806 - protein, 13 aa, Staphylococcus aureus
IGGGLGNAALFTR

SEQ ID NO: 1600807 - protein, 8 aa, Staphylococcus aureus
IGKKEGYI

SEQ ID NO: 1600808 - protein, 10 aa, Staphylococcus aureus
IGNDVASDSI

SEQ ID NO: 1600809 - protein, 6 aa, Staphylococcus aureus
IGPDAI

SEQ ID NO: 1600810 - protein, 10 aa, Staphylococcus aureus
IGPNGCGKST

SEQ ID NO: 1600811 - protein, 4 aa, Staphylococcus aureus
IGSE

SEQ ID NO: 1600812 - protein, 9 aa, Staphylococcus aureus
IGSEKDKEM

SEQ ID NO: 1600813 - protein, 9 aa, Staphylococcus aureus
IGTSPATMT

SEQ ID NO: 1600814 - protein, 11 aa, Staphylococcus aureus
IGVGKSSLAHK

SEQ ID NO: 1600815 - protein, 7 aa, Staphylococcus aureus
IIESGGQ

SEQ ID NO: 1600816 - protein, 12 aa, Staphylococcus aureus
IIGGKSPDSGHE

SEQ ID NO: 1600817 - protein, 6 aa, Staphylococcus aureus
IKKRDF

SEQ ID NO: 1600818 - protein, 9 aa, Staphylococcus aureus
IKKRGEDIE

SEQ ID NO: 1600819 - protein, 15 aa, Staphylococcus aureus
IKPNPYQPRKTFDEN

SEQ ID NO: 1600820 - protein, 8 aa, Staphylococcus aureus
IKQQPSPD

SEQ ID NO: 1600821 - protein, 9 aa, Staphylococcus aureus
IMPGGSQEM

SEQ ID NO: 1600822 - protein, 8 aa, Staphylococcus aureus
INETESEK

SEQ ID NO: 1600823 - protein, 10 aa, Staphylococcus aureus
INKAGLADEI

SEQ ID NO: 1600824 - protein, 9 aa, Staphylococcus aureus
INNSTIENG

SEQ ID NO: 1600825 - protein, 5 aa, Staphylococcus aureus
INRNG

SEQ ID NO: 1600826 - protein, 4 aa, Staphylococcus aureus
INSQ

SEQ ID NO: 1600827 - protein, 5 aa, Staphylococcus aureus
INSSE

SEQ ID NO: 1600828 - protein, 6 aa, Staphylococcus aureus
IPGEGE

SEQ ID NO: 1600829 - protein, 7 aa, Staphylococcus aureus
IPGPNHV

SEQ ID NO: 1600830 - protein, 11 aa, Staphylococcus aureus
IPTPERDSDKP

SEQ ID NO: 1600831 - protein, 6 aa, Staphylococcus aureus
IPVPEN

SEQ ID NO: 1600832 - protein, 4 aa, Staphylococcus aureus
IPVS

SEQ ID NO: 1600833 - protein, 18 aa, Staphylococcus aureus
IQATQDNPYGESKLQGEQ

SEQ ID NO: 1600834 - protein, 6 aa, Staphylococcus aureus
IQQPYG

SEQ ID NO: 1600835 - protein, 7 aa, Staphylococcus aureus
IRQATTN

SEQ ID NO: 1600836 - protein, 9 aa, Staphylococcus aureus
ISEPSREVT

SEQ ID NO: 1600837 - protein, 6 aa, Staphylococcus aureus
ISETGS

SEQ ID NO: 1600838 - protein, 9 aa, Staphylococcus aureus
ISKDTDIRA

SEQ ID NO: 1600839 - protein, 6 aa, Staphylococcus aureus
ISNEQR

SEQ ID NO: 1600840 - protein, 10 aa, Staphylococcus aureus
ISQNGRAAQG

SEQ ID NO: 1600841 - protein, 17 aa, Staphylococcus aureus
ISSAPGSVSQVRESTQS

SEQ ID NO: 1600842 - protein, 4 aa, Staphylococcus aureus
ITDQ

SEQ ID NO: 1600843 - protein, 7 aa, Staphylococcus aureus
ITGGEPL

SEQ ID NO: 1600844 - protein, 4 aa, Staphylococcus aureus
ITKS

SEQ ID NO: 1600845 - protein, 5 aa, Staphylococcus aureus
IYEKR

SEQ ID NO: 1600846 - protein, 8 aa, Staphylococcus aureus
KADDSAEF

SEQ ID NO: 1600847 - protein, 19 aa, Staphylococcus aureus
KADGLVSGAAHSTGDTVRP

SEQ ID NO: 1600848 - protein, 19 aa, Staphylococcus aureus
KADMKNNSATPKLDVDPQT

SEQ ID NO: 1600849 - protein, 24 aa, Staphylococcus aureus
KAEREGKIKPGDTIVEPTSGNTGI

SEQ ID NO: 1600850 - protein, 7 aa, Staphylococcus aureus
KAGAPKD

SEQ ID NO: 1600851 - protein, 4 aa, Staphylococcus aureus
KAHP

SEQ ID NO: 1600852 - protein, 17 aa, Staphylococcus aureus
KAKDKIAEEGYDPEYGA

SEQ ID NO: 1600853 - protein, 28 aa, Staphylococcus aureus
KAKDRPRRQHTSKPSHQKPVQKAEDFEK

SEQ ID NO: 1600854 - protein, 6 aa, Staphylococcus aureus
KAKGKV

SEQ ID NO: 1600855 - protein, 11 aa, Staphylococcus aureus
KAKPSSAKGTY

SEQ ID NO: 1600856 - protein, 12 aa, Staphylococcus aureus
KAKPSTLTDGYY

SEQ ID NO: 1600857 - protein, 7 aa, Staphylococcus aureus
KAKSVGA

SEQ ID NO: 1600858 - protein, 10 aa, Staphylococcus aureus
KALKAEDNSM

SEQ ID NO: 1600859 - protein, 4 aa, Staphylococcus aureus
KANP

SEQ ID NO: 1600860 - protein, 9 aa, Staphylococcus aureus
KAPSSTVGD

SEQ ID NO: 1600861 - protein, 11 aa, Staphylococcus aureus
KAQKDKNTSRI

SEQ ID NO: 1600862 - protein, 9 aa, Staphylococcus aureus
KDAKRNKDF

SEQ ID NO: 1600863 - protein, 6 aa, Staphylococcus aureus
KDANAS

SEQ ID NO: 1600864 - protein, 8 aa, Staphylococcus aureus
KDARRRRE

SEQ ID NO: 1600865 - protein, 8 aa, Staphylococcus aureus
KDAVNSIS

SEQ ID NO: 1600866 - protein, 7 aa, Staphylococcus aureus
KDAVNTG

SEQ ID NO: 1600867 - protein, 10 aa, Staphylococcus aureus
KDDEKRSSIE

SEQ ID NO: 1600868 - protein, 5 aa, Staphylococcus aureus
KDDIE

SEQ ID NO: 1600869 - protein, 9 aa, Staphylococcus aureus
KDDPNINPE

SEQ ID NO: 1600870 - protein, 8 aa, Staphylococcus aureus
KDDQEAID

SEQ ID NO: 1600871 - protein, 8 aa, Staphylococcus aureus
KDDSQKDM

SEQ ID NO: 1600872 - protein, 8 aa, Staphylococcus aureus
KDEGGRHT

SEQ ID NO: 1600873 - protein, 5 aa, Staphylococcus aureus
KDGGY

SEQ ID NO: 1600874 - protein, 7 aa, Staphylococcus aureus
KDGKQHK

SEQ ID NO: 1600875 - protein, 6 aa, Staphylococcus aureus
KDNGRL

SEQ ID NO: 1600876 - protein, 9 aa, Staphylococcus aureus
KDNHTSENG

SEQ ID NO: 1600877 - protein, 8 aa, Staphylococcus aureus
KDPKTGKP

SEQ ID NO: 1600878 - protein, 15 aa, Staphylococcus aureus
KDQNLSLNPTKISGA

SEQ ID NO: 1600879 - protein, 8 aa, Staphylococcus aureus
KDSDYITG

SEQ ID NO: 1600880 - protein, 6 aa, Staphylococcus aureus
KDSEID

SEQ ID NO: 1600881 - protein, 4 aa, Staphylococcus aureus
KDSV

SEQ ID NO: 1600882 - protein, 7 aa, Staphylococcus aureus
KDTNVST

SEQ ID NO: 1600883 - protein, 8 aa, Staphylococcus aureus
KEANKDGY

SEQ ID NO: 1600884 - protein, 6 aa, Staphylococcus aureus
KEATGV

SEQ ID NO: 1600885 - protein, 6 aa, Staphylococcus aureus
KEGDMT

SEQ ID NO: 1600886 - protein, 8 aa, Staphylococcus aureus
KEGQIAGP

SEQ ID NO: 1600887 - protein, 5 aa, Staphylococcus aureus
KEGTE

SEQ ID NO: 1600888 - protein, 4 aa, Staphylococcus aureus
KEGY

SEQ ID NO: 1600889 - protein, 8 aa, Staphylococcus aureus
KEHNPTQL

SEQ ID NO: 1600890 - protein, 10 aa, Staphylococcus aureus
KEKLKQPKKL

SEQ ID NO: 1600891 - protein, 4 aa, Staphylococcus aureus
KEKT

SEQ ID NO: 1600892 - protein, 9 aa, Staphylococcus aureus
KEPADLTQD

SEQ ID NO: 1600893 - protein, 13 aa, Staphylococcus aureus
KEQNGAAMSLGRT

SEQ ID NO: 1600894 - protein, 9 aa, Staphylococcus aureus
KEQSQDNPV

SEQ ID NO: 1600895 - protein, 6 aa, Staphylococcus aureus
KETNST

SEQ ID NO: 1600896 - protein, 13 aa, Staphylococcus aureus
KEVEGTIRVHTVE

SEQ ID NO: 1600897 - protein, 5 aa, Staphylococcus aureus
KEYPN

SEQ ID NO: 1600898 - protein, 15 aa, Staphylococcus aureus
KEYQKHLEEVDIRMD

SEQ ID NO: 1600899 - protein, 9 aa, Staphylococcus aureus
KGAFNEENP

SEQ ID NO: 1600900 - protein, 8 aa, Staphylococcus aureus
KGASGQAI

SEQ ID NO: 1600901 - protein, 10 aa, Staphylococcus aureus
KGASKGEGLG

SEQ ID NO: 1600902 - protein, 5 aa, Staphylococcus aureus
KGATY

SEQ ID NO: 1600903 - protein, 8 aa, Staphylococcus aureus
KGGHQTFE

SEQ ID NO: 1600904 - protein, 8 aa, Staphylococcus aureus
KGHDPSYV

SEQ ID NO: 1600905 - protein, 7 aa, Staphylococcus aureus
KGIHREE

SEQ ID NO: 1600906 - protein, 6 aa, Staphylococcus aureus
KGKQVK

SEQ ID NO: 1600907 - protein, 7 aa, Staphylococcus aureus
KGLTDGE

SEQ ID NO: 1600908 - protein, 5 aa, Staphylococcus aureus
KGNPL

SEQ ID NO: 1600909 - protein, 14 aa, Staphylococcus aureus
KGRGGHGAKPHETI

SEQ ID NO: 1600910 - protein, 7 aa, Staphylococcus aureus
KGSPQIR

SEQ ID NO: 1600911 - protein, 8 aa, Staphylococcus aureus
KGTRMKSK

SEQ ID NO: 1600912 - protein, 5 aa, Staphylococcus aureus
KGVPQ

SEQ ID NO: 1600913 - protein, 6 aa, Staphylococcus aureus
KHESSD

SEQ ID NO: 1600914 - protein, 24 aa, Staphylococcus aureus
KHPKLGQSTGFDYTRTKNPTRSTF

SEQ ID NO: 1600915 - protein, 6 aa, Staphylococcus aureus
KHPQID

SEQ ID NO: 1600916 - protein, 6 aa, Staphylococcus aureus
KHQEEK

SEQ ID NO: 1600917 - protein, 7 aa, Staphylococcus aureus
KIAEDKI

SEQ ID NO: 1600918 - protein, 10 aa, Staphylococcus aureus
KIEDDPSHPE

SEQ ID NO: 1600919 - protein, 6 aa, Staphylococcus aureus
KITDAG

SEQ ID NO: 1600920 - protein, 8 aa, Staphylococcus aureus
KKAEPGYG

SEQ ID NO: 1600921 - protein, 15 aa, Staphylococcus aureus
KKALEKAQENISAAG

SEQ ID NO: 1600922 - protein, 9 aa, Staphylococcus aureus
KKHESELTE

SEQ ID NO: 1600923 - protein, 8 aa, Staphylococcus aureus
KKPETKLT

SEQ ID NO: 1600924 - protein, 8 aa, Staphylococcus aureus
KKPIEEIA

SEQ ID NO: 1600925 - protein, 8 aa, Staphylococcus aureus
KKSAEIAK

SEQ ID NO: 1600926 - protein, 7 aa, Staphylococcus aureus
KKSDVLE

SEQ ID NO: 1600927 - protein, 8 aa, Staphylococcus aureus
KKTIETKY

SEQ ID NO: 1600928 - protein, 6 aa, Staphylococcus aureus
KLEQPL

SEQ ID NO: 1600929 - protein, 12 aa, Staphylococcus aureus
KLETDGKLLTGK

SEQ ID NO: 1600930 - protein, 8 aa, Staphylococcus aureus
KLMGQKSE

SEQ ID NO: 1600931 - protein, 13 aa, Staphylococcus aureus
KLPPEKVNVKGGA

SEQ ID NO: 1600932 - protein, 9 aa, Staphylococcus aureus
KLTDGKEVK

SEQ ID NO: 1600933 - protein, 4 aa, Staphylococcus aureus
KLTE

SEQ ID NO: 1600934 - protein, 6 aa, Staphylococcus aureus
KLTEPA

SEQ ID NO: 1600935 - protein, 5 aa, Staphylococcus aureus
KMGRP

SEQ ID NO: 1600936 - protein, 6 aa, Staphylococcus aureus
KMKEPP

SEQ ID NO: 1600937 - protein, 5 aa, Staphylococcus aureus
KMNPK

SEQ ID NO: 1600938 - protein, 7 aa, Staphylococcus aureus
KNDPNLI

SEQ ID NO: 1600939 - protein, 7 aa, Staphylococcus aureus
KNENNDV

SEQ ID NO: 1600940 - protein, 6 aa, Staphylococcus aureus
KNEQRY

SEQ ID NO: 1600941 - protein, 8 aa, Staphylococcus aureus
KNKPLSED

SEQ ID NO: 1600942 - protein, 6 aa, Staphylococcus aureus
KNKQQI

SEQ ID NO: 1600943 - protein, 5 aa, Staphylococcus aureus
KNNDN

SEQ ID NO: 1600944 - protein, 5 aa, Staphylococcus aureus
KNNPH

SEQ ID NO: 1600945 - protein, 4 aa, Staphylococcus aureus
KNNY

SEQ ID NO: 1600946 - protein, 12 aa, Staphylococcus aureus
KNSRDQNRLDQE

SEQ ID NO: 1600947 - protein, 5 aa, Staphylococcus aureus
KNTST

SEQ ID NO: 1600948 - protein, 10 aa, Staphylococcus aureus
KPESQHTGYG

SEQ ID NO: 1600949 - protein, 7 aa, Staphylococcus aureus
KPIRNEE

SEQ ID NO: 1600950 - protein, 8 aa, Staphylococcus aureus
KPITTELT

SEQ ID NO: 1600951 - protein, 4 aa, Staphylococcus aureus
KPPS

SEQ ID NO: 1600952 - protein, 5 aa, Staphylococcus aureus
KPQST

SEQ ID NO: 1600953 - protein, 5 aa, Staphylococcus aureus
KPRTK

SEQ ID NO: 1600954 - protein, 4 aa, Staphylococcus aureus
KPSQ

SEQ ID NO: 1600955 - protein, 5 aa, Staphylococcus aureus
KQIQQ

SEQ ID NO: 1600956 - protein, 9 aa, Staphylococcus aureus
KQKADQKLE

SEQ ID NO: 1600957 - protein, 6 aa, Staphylococcus aureus
KQRDRS

SEQ ID NO: 1600958 - protein, 8 aa, Staphylococcus aureus
KQSYQTKV

SEQ ID NO: 1600959 - protein, 17 aa, Staphylococcus aureus
KQTRSDLKQLRKSGKVP

SEQ ID NO: 1600960 - protein, 6 aa, Staphylococcus aureus
KQTSWT

SEQ ID NO: 1600961 - protein, 9 aa, Staphylococcus aureus
KRLSKSRPY

SEQ ID NO: 1600962 - protein, 6 aa, Staphylococcus aureus
KRQSEK

SEQ ID NO: 1600963 - protein, 10 aa, Staphylococcus aureus
KRSNSGTCYN

SEQ ID NO: 1600964 - protein, 7 aa, Staphylococcus aureus
KSAPTTL

SEQ ID NO: 1600965 - protein, 9 aa, Staphylococcus aureus
KSDDTVGRV

SEQ ID NO: 1600966 - protein, 11 aa, Staphylococcus aureus
KSDNNKATDEF

SEQ ID NO: 1600967 - protein, 8 aa, Staphylococcus aureus
KSEDPEKF

SEQ ID NO: 1600968 - protein, 25 aa, Staphylococcus aureus
KSKQKKQRKRTKAISNAEKIKSYQD

SEQ ID NO: 1600969 - protein, 16 aa, Staphylococcus aureus
KSLDDISENKPRTRIP

SEQ ID NO: 1600970 - protein, 7 aa, Staphylococcus aureus
KSNYDNK

SEQ ID NO: 1600971 - protein, 8 aa, Staphylococcus aureus
KSPADVQK

SEQ ID NO: 1600972 - protein, 8 aa, Staphylococcus aureus
KSVTADTG

SEQ ID NO: 1600973 - protein, 7 aa, Staphylococcus aureus
KSYTESM

SEQ ID NO: 1600974 - protein, 7 aa, Staphylococcus aureus
KSYYDYE

SEQ ID NO: 1600975 - protein, 7 aa, Staphylococcus aureus
KTDEGLD

SEQ ID NO: 1600976 - protein, 9 aa, Staphylococcus aureus
KTGVGTIAS

SEQ ID NO: 1600977 - protein, 12 aa, Staphylococcus aureus
KTGVSGAGRSLS

SEQ ID NO: 1600978 - protein, 7 aa, Staphylococcus aureus
KTPPAPV

SEQ ID NO: 1600979 - protein, 12 aa, Staphylococcus aureus
KTRLRPGGKEAT

SEQ ID NO: 1600980 - protein, 10 aa, Staphylococcus aureus
KTVGSLPSHD

SEQ ID NO: 1600981 - protein, 5 aa, Staphylococcus aureus
KTYPE

SEQ ID NO: 1600982 - protein, 10 aa, Staphylococcus aureus
KVKNEKDAAV

SEQ ID NO: 1600983 - protein, 7 aa, Staphylococcus aureus
KWGTPRE

SEQ ID NO: 1600984 - protein, 19 aa, Staphylococcus aureus
KYEKTAKPVAEVESQTEVT

SEQ ID NO: 1600985 - protein, 5 aa, Staphylococcus aureus
KYGDE

SEQ ID NO: 1600986 - protein, 5 aa, Staphylococcus aureus
KYPGQ

SEQ ID NO: 1600987 - protein, 11 aa, Staphylococcus aureus
KYSAEGPQGLL

SEQ ID NO: 1600988 - protein, 30 aa, Staphylococcus aureus
LADNTKDMVATKGRAAYFGEESKGYIDPGA

SEQ ID NO: 1600989 - protein, 10 aa, Staphylococcus aureus
LAGPTEATSK

SEQ ID NO: 1600990 - protein, 11 aa, Staphylococcus aureus
LAPGDTKAITE

SEQ ID NO: 1600991 - protein, 4 aa, Staphylococcus aureus
LAPY

SEQ ID NO: 1600992 - protein, 6 aa, Staphylococcus aureus
LAQGKK

SEQ ID NO: 1600993 - protein, 7 aa, Staphylococcus aureus
LDEETEK

SEQ ID NO: 1600994 - protein, 6 aa, Staphylococcus aureus
LDEGAN

SEQ ID NO: 1600995 - protein, 10 aa, Staphylococcus aureus
LDEVKNGDAH

SEQ ID NO: 1600996 - protein, 4 aa, Staphylococcus aureus
LDSN

SEQ ID NO: 1600997 - protein, 7 aa, Staphylococcus aureus
LDSSPFK

SEQ ID NO: 1600998 - protein, 7 aa, Staphylococcus aureus
LDTEKAH

SEQ ID NO: 1600999 - protein, 22 aa, Staphylococcus aureus
LDTSGVDGRRQGRSLYGTKKPK

SEQ ID NO: 1601000 - protein, 6 aa, Staphylococcus aureus
LEEPPA

SEQ ID NO: 1601001 - protein, 11 aa, Staphylococcus aureus
LEKDGTENTEQ

SEQ ID NO: 1601002 - protein, 9 aa, Staphylococcus aureus
LEKSEEQIK

SEQ ID NO: 1601003 - protein, 14 aa, Staphylococcus aureus
LEKTRNGEIQDDYI

SEQ ID NO: 1601004 - protein, 10 aa, Staphylococcus aureus
LESATGQRLT

SEQ ID NO: 1601005 - protein, 6 aa, Staphylococcus aureus
LGEPFS

SEQ ID NO: 1601006 - protein, 16 aa, Staphylococcus aureus
LGGTGKERGKRHPDIG

SEQ ID NO: 1601007 - protein, 8 aa, Staphylococcus aureus
LGPAPEPN

SEQ ID NO: 1601008 - protein, 8 aa, Staphylococcus aureus
LGQTAGQK

SEQ ID NO: 1601009 - protein, 7 aa, Staphylococcus aureus
LGSGKTT

SEQ ID NO: 1601010 - protein, 10 aa, Staphylococcus aureus
LGVPSKNYGY

SEQ ID NO: 1601011 - protein, 6 aa, Staphylococcus aureus
LITTTE

SEQ ID NO: 1601012 - protein, 4 aa, Staphylococcus aureus
LKEA

SEQ ID NO: 1601013 - protein, 8 aa, Staphylococcus aureus
LKEQGKIK

SEQ ID NO: 1601014 - protein, 7 aa, Staphylococcus aureus
LKPEKDG

SEQ ID NO: 1601015 - protein, 16 aa, Staphylococcus aureus
LKPNRKKIASKGIKSV

SEQ ID NO: 1601016 - protein, 11 aa, Staphylococcus aureus
LKTRKEEEVKD

SEQ ID NO: 1601017 - protein, 13 aa, Staphylococcus aureus
LLTGDSPLASNEL

SEQ ID NO: 1601018 - protein, 14 aa, Staphylococcus aureus
LNPKDGKPVVTPSQ

SEQ ID NO: 1601019 - protein, 7 aa, Staphylococcus aureus
LPAYQGP

SEQ ID NO: 1601020 - protein, 5 aa, Staphylococcus aureus
LPDGR

SEQ ID NO: 1601021 - protein, 8 aa, Staphylococcus aureus
LPDGSIGT

SEQ ID NO: 1601022 - protein, 4 aa, Staphylococcus aureus
LPDI

SEQ ID NO: 1601023 - protein, 8 aa, Staphylococcus aureus
LPSGGGLA

SEQ ID NO: 1601024 - protein, 6 aa, Staphylococcus aureus
LPTAKN

SEQ ID NO: 1601025 - protein, 12 aa, Staphylococcus aureus
LQAEGQSPLESL

SEQ ID NO: 1601026 - protein, 4 aa, Staphylococcus aureus
LQGN

SEQ ID NO: 1601027 - protein, 14 aa, Staphylococcus aureus
LQQNDAPETQKEVT

SEQ ID NO: 1601028 - protein, 9 aa, Staphylococcus aureus
LQRTGPTVS

SEQ ID NO: 1601029 - protein, 6 aa, Staphylococcus aureus
LREGDE

SEQ ID NO: 1601030 - protein, 5 aa, Staphylococcus aureus
LRGPL

SEQ ID NO: 1601031 - protein, 12 aa, Staphylococcus aureus
LRPLGRTATGVK

SEQ ID NO: 1601032 - protein, 6 aa, Staphylococcus aureus
LRPLPD

SEQ ID NO: 1601033 - protein, 13 aa, Staphylococcus aureus
LRQKGSAGGHNGM

SEQ ID NO: 1601034 - protein, 4 aa, Staphylococcus aureus
LSEE

SEQ ID NO: 1601035 - protein, 20 aa, Staphylococcus aureus
LSEEENEQMKANLTKMLSSL

SEQ ID NO: 1601036 - protein, 5 aa, Staphylococcus aureus
LSEQY

SEQ ID NO: 1601037 - protein, 9 aa, Staphylococcus aureus
LSGGQRQRV

SEQ ID NO: 1601038 - protein, 5 aa, Staphylococcus aureus
LSGKN

SEQ ID NO: 1601039 - protein, 12 aa, Staphylococcus aureus
LSGPAKERIENS

SEQ ID NO: 1601040 - protein, 7 aa, Staphylococcus aureus
LSHPDKV

SEQ ID NO: 1601041 - protein, 19 aa, Staphylococcus aureus
LSNRGGKGIKTATITERNG

SEQ ID NO: 1601042 - protein, 5 aa, Staphylococcus aureus
LSPKV

SEQ ID NO: 1601043 - protein, 4 aa, Staphylococcus aureus
LSQK

SEQ ID NO: 1601044 - protein, 6 aa, Staphylococcus aureus
LSRPSV

SEQ ID NO: 1601045 - protein, 24 aa, Staphylococcus aureus
LSSTSPEIGTVKEEVDANDVEGGS

SEQ ID NO: 1601046 - protein, 5 aa, Staphylococcus aureus
LSTKP

SEQ ID NO: 1601047 - protein, 9 aa, Staphylococcus aureus
LTDSATAGF

SEQ ID NO: 1601048 - protein, 5 aa, Staphylococcus aureus
LTLGK

SEQ ID NO: 1601049 - protein, 22 aa, Staphylococcus aureus
LTPDQAKSIDEIKDDMQKSRPM

SEQ ID NO: 1601050 - protein, 6 aa, Staphylococcus aureus
LTTGPE

SEQ ID NO: 1601051 - protein, 5 aa, Staphylococcus aureus
LVNDD

SEQ ID NO: 1601052 - protein, 36 aa, Staphylococcus aureus
LVSENKTLAHPASVDSITSSANQEDHVSMGTTAARH

SEQ ID NO: 1601053 - protein, 13 aa, Staphylococcus aureus
LYDGSYHDVDSSE

SEQ ID NO: 1601054 - protein, 4 aa, Staphylococcus aureus
LYNQ

SEQ ID NO: 1601055 - protein, 11 aa, Staphylococcus aureus
MDEQENEDYKS

SEQ ID NO: 1601056 - protein, 4 aa, Staphylococcus aureus
MDLP

SEQ ID NO: 1601057 - protein, 6 aa, Staphylococcus aureus
MDQQSK

SEQ ID NO: 1601058 - protein, 12 aa, Staphylococcus aureus
MPDAEKDKRGID

SEQ ID NO: 1601059 - protein, 6 aa, Staphylococcus aureus
MPPPNV

SEQ ID NO: 1601060 - protein, 6 aa, Staphylococcus aureus
MSQERR

SEQ ID NO: 1601061 - protein, 5 aa, Staphylococcus aureus
MTAPQ

SEQ ID NO: 1601062 - protein, 5 aa, Staphylococcus aureus
MTMTP

SEQ ID NO: 1601063 - protein, 6 aa, Staphylococcus aureus
NAAVGD

SEQ ID NO: 1601064 - protein, 6 aa, Staphylococcus aureus
NAETID

SEQ ID NO: 1601065 - protein, 7 aa, Staphylococcus aureus
NAGYTVD

SEQ ID NO: 1601066 - protein, 9 aa, Staphylococcus aureus
NAKQPKEVA

SEQ ID NO: 1601067 - protein, 4 aa, Staphylococcus aureus
NALG

SEQ ID NO: 1601068 - protein, 6 aa, Staphylococcus aureus
NAQQSR

SEQ ID NO: 1601069 - protein, 8 aa, Staphylococcus aureus
NARTQDQA

SEQ ID NO: 1601070 - protein, 6 aa, Staphylococcus aureus
NASGRL

SEQ ID NO: 1601071 - protein, 5 aa, Staphylococcus aureus
NATES

SEQ ID NO: 1601072 - protein, 14 aa, Staphylococcus aureus
NATSQAGVEGNPGL

SEQ ID NO: 1601073 - protein, 16 aa, Staphylococcus aureus
NDATEALGEPDIQNDI

SEQ ID NO: 1601074 - protein, 8 aa, Staphylococcus aureus
NDDSNRAL

SEQ ID NO: 1601075 - protein, 8 aa, Staphylococcus aureus
NDEAEAKQ

SEQ ID NO: 1601076 - protein, 7 aa, Staphylococcus aureus
NDHQGYT

SEQ ID NO: 1601077 - protein, 5 aa, Staphylococcus aureus
NDNGW

SEQ ID NO: 1601078 - protein, 9 aa, Staphylococcus aureus
NEAENVKET

SEQ ID NO: 1601079 - protein, 8 aa, Staphylococcus aureus
NEDSTRTF

SEQ ID NO: 1601080 - protein, 20 aa, Staphylococcus aureus
NEEGAKAAALKLSSDGTKAI

SEQ ID NO: 1601081 - protein, 11 aa, Staphylococcus aureus
NEHASKDNAKG

SEQ ID NO: 1601082 - protein, 8 aa, Staphylococcus aureus
NELGPDSD

SEQ ID NO: 1601083 - protein, 12 aa, Staphylococcus aureus
NENREYNITNLY

SEQ ID NO: 1601084 - protein, 15 aa, Staphylococcus aureus
NEPTQENLERKTPNR

SEQ ID NO: 1601085 - protein, 6 aa, Staphylococcus aureus
NEQDYE

SEQ ID NO: 1601086 - protein, 6 aa, Staphylococcus aureus
NERQYT

SEQ ID NO: 1601087 - protein, 6 aa, Staphylococcus aureus
NETEAE

SEQ ID NO: 1601088 - protein, 6 aa, Staphylococcus aureus
NEVPHY

SEQ ID NO: 1601089 - protein, 8 aa, Staphylococcus aureus
NEYQGGQL

SEQ ID NO: 1601090 - protein, 6 aa, Staphylococcus aureus
NGASGI

SEQ ID NO: 1601091 - protein, 6 aa, Staphylococcus aureus
NGDASL

SEQ ID NO: 1601092 - protein, 11 aa, Staphylococcus aureus
NGDEDVPNEEG

SEQ ID NO: 1601093 - protein, 12 aa, Staphylococcus aureus
NGFSKSLGEHRM

SEQ ID NO: 1601094 - protein, 14 aa, Staphylococcus aureus
NGHAGQSLAAYAPK

SEQ ID NO: 1601095 - protein, 7 aa, Staphylococcus aureus
NGKHMPS

SEQ ID NO: 1601096 - protein, 7 aa, Staphylococcus aureus
NGKSKIK

SEQ ID NO: 1601097 - protein, 6 aa, Staphylococcus aureus
NGNTAQ

SEQ ID NO: 1601098 - protein, 7 aa, Staphylococcus aureus
NGRTEIG

SEQ ID NO: 1601099 - protein, 7 aa, Staphylococcus aureus
NGSSGEN

SEQ ID NO: 1601100 - protein, 12 aa, Staphylococcus aureus
NHKYETTEPLNR

SEQ ID NO: 1601101 - protein, 5 aa, Staphylococcus aureus
NIKED

SEQ ID NO: 1601102 - protein, 5 aa, Staphylococcus aureus
NIQPG

SEQ ID NO: 1601103 - protein, 4 aa, Staphylococcus aureus
NKKD

SEQ ID NO: 1601104 - protein, 13 aa, Staphylococcus aureus
NKKERFDKVMFTI

SEQ ID NO: 1601105 - protein, 4 aa, Staphylococcus aureus
NKMP

SEQ ID NO: 1601106 - protein, 9 aa, Staphylococcus aureus
NKPAETAKA

SEQ ID NO: 1601107 - protein, 8 aa, Staphylococcus aureus
NKSQDNLA

SEQ ID NO: 1601108 - protein, 10 aa, Staphylococcus aureus
NKTSEKDTEY

SEQ ID NO: 1601109 - protein, 10 aa, Staphylococcus aureus
NLDEEQGKDV

SEQ ID NO: 1601110 - protein, 7 aa, Staphylococcus aureus
NLEGEST

SEQ ID NO: 1601111 - protein, 5 aa, Staphylococcus aureus
NLGDT

SEQ ID NO: 1601112 - protein, 7 aa, Staphylococcus aureus
NLGISSP

SEQ ID NO: 1601113 - protein, 8 aa, Staphylococcus aureus
NLGSTPPF

SEQ ID NO: 1601114 - protein, 13 aa, Staphylococcus aureus
NLPPSRGLGSSAA

SEQ ID NO: 1601115 - protein, 16 aa, Staphylococcus aureus
NLSQTYQHTKSIILDN

SEQ ID NO: 1601116 - protein, 9 aa, Staphylococcus aureus
NMQREKERG

SEQ ID NO: 1601117 - protein, 8 aa, Staphylococcus aureus
NNETGEIT

SEQ ID NO: 1601118 - protein, 5 aa, Staphylococcus aureus
NNFSV

SEQ ID NO: 1601119 - protein, 6 aa, Staphylococcus aureus
NNGDTY

SEQ ID NO: 1601120 - protein, 10 aa, Staphylococcus aureus
NPAPAKALPN

SEQ ID NO: 1601121 - protein, 6 aa, Staphylococcus aureus
NPDTWG

SEQ ID NO: 1601122 - protein, 9 aa, Staphylococcus aureus
NPELDSQGL

SEQ ID NO: 1601123 - protein, 4 aa, Staphylococcus aureus
NPFI

SEQ ID NO: 1601124 - protein, 5 aa, Staphylococcus aureus
NPTEI

SEQ ID NO: 1601125 - protein, 4 aa, Staphylococcus aureus
NQEK

SEQ ID NO: 1601126 - protein, 5 aa, Staphylococcus aureus
NQEQG

SEQ ID NO: 1601127 - protein, 17 aa, Staphylococcus aureus
NQIEGKKVTVDHDGKEF

SEQ ID NO: 1601128 - protein, 7 aa, Staphylococcus aureus
NQMDTSN

SEQ ID NO: 1601129 - protein, 5 aa, Staphylococcus aureus
NQPNE

SEQ ID NO: 1601130 - protein, 4 aa, Staphylococcus aureus
NRDY

SEQ ID NO: 1601131 - protein, 13 aa, Staphylococcus aureus
NREEGDDTLSPGV

SEQ ID NO: 1601132 - protein, 8 aa, Staphylococcus aureus
NSDDKTYY

SEQ ID NO: 1601133 - protein, 4 aa, Staphylococcus aureus
NSEK

SEQ ID NO: 1601134 - protein, 9 aa, Staphylococcus aureus
NSEPVAASE

SEQ ID NO: 1601135 - protein, 6 aa, Staphylococcus aureus
NSFGRQ

SEQ ID NO: 1601136 - protein, 8 aa, Staphylococcus aureus
NSGNTSEL

SEQ ID NO: 1601137 - protein, 5 aa, Staphylococcus aureus
NSGYA

SEQ ID NO: 1601138 - protein, 10 aa, Staphylococcus aureus
NSPVNDLSRG

SEQ ID NO: 1601139 - protein, 8 aa, Staphylococcus aureus
NSRQEIDT

SEQ ID NO: 1601140 - protein, 9 aa, Staphylococcus aureus
NSTQKPDKL

SEQ ID NO: 1601141 - protein, 16 aa, Staphylococcus aureus
NTNELNASYAADGYAR

SEQ ID NO: 1601142 - protein, 6 aa, Staphylococcus aureus
NTTEPQ

SEQ ID NO: 1601143 - protein, 7 aa, Staphylococcus aureus
NTTLEEA

SEQ ID NO: 1601144 - protein, 5 aa, Staphylococcus aureus
NVGKS

SEQ ID NO: 1601145 - protein, 14 aa, Staphylococcus aureus
NYEAEQMAHEIITI

SEQ ID NO: 1601146 - protein, 4 aa, Staphylococcus aureus
NYRS

SEQ ID NO: 1601147 - protein, 6 aa, Staphylococcus aureus
PAGDGR

SEQ ID NO: 1601148 - protein, 18 aa, Staphylococcus aureus
PAGKANPAPPVGPALGQA

SEQ ID NO: 1601149 - protein, 6 aa, Staphylococcus aureus
PAPVSK

SEQ ID NO: 1601150 - protein, 5 aa, Staphylococcus aureus
PAQQK

SEQ ID NO: 1601151 - protein, 7 aa, Staphylococcus aureus
PDAYGRG

SEQ ID NO: 1601152 - protein, 4 aa, Staphylococcus aureus
PDDY

SEQ ID NO: 1601153 - protein, 22 aa, Staphylococcus aureus
PDEEAVRRARKAVDTPIDGIEK

SEQ ID NO: 1601154 - protein, 8 aa, Staphylococcus aureus
PDFPGDKI

SEQ ID NO: 1601155 - protein, 8 aa, Staphylococcus aureus
PDHEATAD

SEQ ID NO: 1601156 - protein, 9 aa, Staphylococcus aureus
PDHGGVTRA

SEQ ID NO: 1601157 - protein, 7 aa, Staphylococcus aureus
PDITDDL

SEQ ID NO: 1601158 - protein, 8 aa, Staphylococcus aureus
PDLPKSDQ

SEQ ID NO: 1601159 - protein, 8 aa, Staphylococcus aureus
PDNTIKAA

SEQ ID NO: 1601160 - protein, 4 aa, Staphylococcus aureus
PDSH

SEQ ID NO: 1601161 - protein, 8 aa, Staphylococcus aureus
PEAEKVQR

SEQ ID NO: 1601162 - protein, 18 aa, Staphylococcus aureus
PEASPVLSGGEPGPHKLQ

SEQ ID NO: 1601163 - protein, 8 aa, Staphylococcus aureus
PEGEDERV

SEQ ID NO: 1601164 - protein, 14 aa, Staphylococcus aureus
PEGIEGRTAYKGAL

SEQ ID NO: 1601165 - protein, 6 aa, Staphylococcus aureus
PEGKSG

SEQ ID NO: 1601166 - protein, 4 aa, Staphylococcus aureus
PEIE

SEQ ID NO: 1601167 - protein, 4 aa, Staphylococcus aureus
PEMY

SEQ ID NO: 1601168 - protein, 9 aa, Staphylococcus aureus
PERNKAISQ

SEQ ID NO: 1601169 - protein, 4 aa, Staphylococcus aureus
PGAK

SEQ ID NO: 1601170 - protein, 7 aa, Staphylococcus aureus
PGGAGSL

SEQ ID NO: 1601171 - protein, 8 aa, Staphylococcus aureus
PGGESTTL

SEQ ID NO: 1601172 - protein, 7 aa, Staphylococcus aureus
PGSTGAV

SEQ ID NO: 1601173 - protein, 10 aa, Staphylococcus aureus
PGYSKTGEAF

SEQ ID NO: 1601174 - protein, 4 aa, Staphylococcus aureus
PHYN

SEQ ID NO: 1601175 - protein, 13 aa, Staphylococcus aureus
PKETRVGAKQMGT

SEQ ID NO: 1601176 - protein, 16 aa, Staphylococcus aureus
PKGDDSVTQLILPIRT

SEQ ID NO: 1601177 - protein, 6 aa, Staphylococcus aureus
PKKGGE

SEQ ID NO: 1601178 - protein, 62 aa, Staphylococcus aureus
PKNAQQNGGQRQQNEFQDYGQGFGGQQSGQNNSYNNSSNTKQSDNPFANANGPIDISDDDLP

SEQ ID NO: 1601179 - protein, 5 aa, Staphylococcus aureus
PKREQ

SEQ ID NO: 1601180 - protein, 9 aa, Staphylococcus aureus
PNAKFPPSL

SEQ ID NO: 1601181 - protein, 10 aa, Staphylococcus aureus
PNDDEGRTTT

SEQ ID NO: 1601182 - protein, 9 aa, Staphylococcus aureus
PNGTGKSQS

SEQ ID NO: 1601183 - protein, 6 aa, Staphylococcus aureus
PNYPGH

SEQ ID NO: 1601184 - protein, 8 aa, Staphylococcus aureus
PPIRAGKE

SEQ ID NO: 1601185 - protein, 4 aa, Staphylococcus aureus
PQGL

SEQ ID NO: 1601186 - protein, 10 aa, Staphylococcus aureus
PQSPEVADGL

SEQ ID NO: 1601187 - protein, 12 aa, Staphylococcus aureus
PRIPTKEEITTA

SEQ ID NO: 1601188 - protein, 4 aa, Staphylococcus aureus
PRKN

SEQ ID NO: 1601189 - protein, 11 aa, Staphylococcus aureus
PRQDPKSQYSG

SEQ ID NO: 1601190 - protein, 7 aa, Staphylococcus aureus
PSDDPIT

SEQ ID NO: 1601191 - protein, 11 aa, Staphylococcus aureus
PSDIRAAGGVA

SEQ ID NO: 1601192 - protein, 12 aa, Staphylococcus aureus
PSEISGGQKQRV

SEQ ID NO: 1601193 - protein, 5 aa, Staphylococcus aureus
PSKDE

SEQ ID NO: 1601194 - protein, 16 aa, Staphylococcus aureus
PSNGERYLSTPLYSFD

SEQ ID NO: 1601195 - protein, 4 aa, Staphylococcus aureus
PSNP

SEQ ID NO: 1601196 - protein, 5 aa, Staphylococcus aureus
PSNPK

SEQ ID NO: 1601197 - protein, 16 aa, Staphylococcus aureus
PTENTTFEQRAATSAL

SEQ ID NO: 1601198 - protein, 4 aa, Staphylococcus aureus
PTKD

SEQ ID NO: 1601199 - protein, 4 aa, Staphylococcus aureus
PTPL

SEQ ID NO: 1601200 - protein, 4 aa, Staphylococcus aureus
PTPN

SEQ ID NO: 1601201 - protein, 11 aa, Staphylococcus aureus
PTPNNDDQYRS

SEQ ID NO: 1601202 - protein, 11 aa, Staphylococcus aureus
PVASLDPLTTK

SEQ ID NO: 1601203 - protein, 5 aa, Staphylococcus aureus
PYTEH

SEQ ID NO: 1601204 - protein, 7 aa, Staphylococcus aureus
QAGSSCN

SEQ ID NO: 1601205 - protein, 7 aa, Staphylococcus aureus
QAPATKG

SEQ ID NO: 1601206 - protein, 6 aa, Staphylococcus aureus
QDNNMK

SEQ ID NO: 1601207 - protein, 8 aa, Staphylococcus aureus
QDSQWKDE

SEQ ID NO: 1601208 - protein, 9 aa, Staphylococcus aureus
QDTESITPQ

SEQ ID NO: 1601209 - protein, 7 aa, Staphylococcus aureus
QEEDPTF

SEQ ID NO: 1601210 - protein, 4 aa, Staphylococcus aureus
QEPD

SEQ ID NO: 1601211 - protein, 9 aa, Staphylococcus aureus
QEQDRGITI

SEQ ID NO: 1601212 - protein, 5 aa, Staphylococcus aureus
QETGV

SEQ ID NO: 1601213 - protein, 9 aa, Staphylococcus aureus
QGGSDRNDT

SEQ ID NO: 1601214 - protein, 13 aa, Staphylococcus aureus
QGKGGHGSSPHMA

SEQ ID NO: 1601215 - protein, 7 aa, Staphylococcus aureus
QGLTPEG

SEQ ID NO: 1601216 - protein, 4 aa, Staphylococcus aureus
QGNA

SEQ ID NO: 1601217 - protein, 10 aa, Staphylococcus aureus
QGQRERPGRG

SEQ ID NO: 1601218 - protein, 4 aa, Staphylococcus aureus
QGSG

SEQ ID NO: 1601219 - protein, 8 aa, Staphylococcus aureus
QGSHSELQ

SEQ ID NO: 1601220 - protein, 12 aa, Staphylococcus aureus
QGSLGASGDLAP

SEQ ID NO: 1601221 - protein, 14 aa, Staphylococcus aureus
QGTYFATKNQSQHI

SEQ ID NO: 1601222 - protein, 5 aa, Staphylococcus aureus
QHNNP

SEQ ID NO: 1601223 - protein, 9 aa, Staphylococcus aureus
QHNRDGQPI

SEQ ID NO: 1601224 - protein, 7 aa, Staphylococcus aureus
QIKGQPQ

SEQ ID NO: 1601225 - protein, 6 aa, Staphylococcus aureus
QIPNGA

SEQ ID NO: 1601226 - protein, 4 aa, Staphylococcus aureus
QKEK

SEQ ID NO: 1601227 - protein, 9 aa, Staphylococcus aureus
QKKSEGYLE

SEQ ID NO: 1601228 - protein, 7 aa, Staphylococcus aureus
QKRIEQA

SEQ ID NO: 1601229 - protein, 9 aa, Staphylococcus aureus
QKYSPFPEE

SEQ ID NO: 1601230 - protein, 8 aa, Staphylococcus aureus
QMTERDLE

SEQ ID NO: 1601231 - protein, 6 aa, Staphylococcus aureus
QNQTYS

SEQ ID NO: 1601232 - protein, 6 aa, Staphylococcus aureus
QNQYEE

SEQ ID NO: 1601233 - protein, 5 aa, Staphylococcus aureus
QNSND

SEQ ID NO: 1601234 - protein, 4 aa, Staphylococcus aureus
QNYD

SEQ ID NO: 1601235 - protein, 6 aa, Staphylococcus aureus
QPEDSW

SEQ ID NO: 1601236 - protein, 9 aa, Staphylococcus aureus
QPKKTLPTT

SEQ ID NO: 1601237 - protein, 10 aa, Staphylococcus aureus
QQANAKTAGI

SEQ ID NO: 1601238 - protein, 12 aa, Staphylococcus aureus
QQDIGSDSSTAI

SEQ ID NO: 1601239 - protein, 23 aa, Staphylococcus aureus
QQLNSTADAVQEQDQQLSNNFGL

SEQ ID NO: 1601240 - protein, 14 aa, Staphylococcus aureus
QQPLGGKAQFGGQR

SEQ ID NO: 1601241 - protein, 6 aa, Staphylococcus aureus
QQQQTM

SEQ ID NO: 1601242 - protein, 8 aa, Staphylococcus aureus
QRMTQGQS

SEQ ID NO: 1601243 - protein, 8 aa, Staphylococcus aureus
QRNGPTGT

SEQ ID NO: 1601244 - protein, 5 aa, Staphylococcus aureus
QRPSV

SEQ ID NO: 1601245 - protein, 5 aa, Staphylococcus aureus
QRVGD

SEQ ID NO: 1601246 - protein, 4 aa, Staphylococcus aureus
QSHR

SEQ ID NO: 1601247 - protein, 9 aa, Staphylococcus aureus
QSIGEPGTQ

SEQ ID NO: 1601248 - protein, 7 aa, Staphylococcus aureus
QSPLTNH

SEQ ID NO: 1601249 - protein, 4 aa, Staphylococcus aureus
QSQY

SEQ ID NO: 1601250 - protein, 5 aa, Staphylococcus aureus
QSTYT

SEQ ID NO: 1601251 - protein, 10 aa, Staphylococcus aureus
QTGREINNSM

SEQ ID NO: 1601252 - protein, 5 aa, Staphylococcus aureus
QTHET

SEQ ID NO: 1601253 - protein, 7 aa, Staphylococcus aureus
QTNDTDT

SEQ ID NO: 1601254 - protein, 12 aa, Staphylococcus aureus
QTNQKRGMQSSA

SEQ ID NO: 1601255 - protein, 7 aa, Staphylococcus aureus
QTPLQTS

SEQ ID NO: 1601256 - protein, 6 aa, Staphylococcus aureus
QTSSPS

SEQ ID NO: 1601257 - protein, 11 aa, Staphylococcus aureus
QVDGSNKVSAI

SEQ ID NO: 1601258 - protein, 5 aa, Staphylococcus aureus
QVENS

SEQ ID NO: 1601259 - protein, 5 aa, Staphylococcus aureus
QVNSG

SEQ ID NO: 1601260 - protein, 18 aa, Staphylococcus aureus
QYGGESGAKEAGRQRLEG

SEQ ID NO: 1601261 - protein, 14 aa, Staphylococcus aureus
RAKSQSYGQGSDQI

SEQ ID NO: 1601262 - protein, 9 aa, Staphylococcus aureus
RALKPGEAL

SEQ ID NO: 1601263 - protein, 4 aa, Staphylococcus aureus
RAQY

SEQ ID NO: 1601264 - protein, 6 aa, Staphylococcus aureus
RASAAT

SEQ ID NO: 1601265 - protein, 9 aa, Staphylococcus aureus
RASNPEEEV

SEQ ID NO: 1601266 - protein, 8 aa, Staphylococcus aureus
RDDTERVK

SEQ ID NO: 1601267 - protein, 16 aa, Staphylococcus aureus
RDIPNVSESALKNLDD

SEQ ID NO: 1601268 - protein, 10 aa, Staphylococcus aureus
RDKAAKPELA

SEQ ID NO: 1601269 - protein, 4 aa, Staphylococcus aureus
RDPL

SEQ ID NO: 1601270 - protein, 7 aa, Staphylococcus aureus
REDVQRG

SEQ ID NO: 1601271 - protein, 4 aa, Staphylococcus aureus
REEH

SEQ ID NO: 1601272 - protein, 11 aa, Staphylococcus aureus
REENIDNEKNF

SEQ ID NO: 1601273 - protein, 5 aa, Staphylococcus aureus
REERL

SEQ ID NO: 1601274 - protein, 16 aa, Staphylococcus aureus
REGGRTVGSGVVTEII

SEQ ID NO: 1601275 - protein, 20 aa, Staphylococcus aureus
REKSIDVTNTPKASTNATAD

SEQ ID NO: 1601276 - protein, 18 aa, Staphylococcus aureus
REMAEGYQYGEDTAEQTT

SEQ ID NO: 1601277 - protein, 6 aa, Staphylococcus aureus
RENIGE

SEQ ID NO: 1601278 - protein, 11 aa, Staphylococcus aureus
REPGGVPTGEE

SEQ ID NO: 1601279 - protein, 10 aa, Staphylococcus aureus
RESGSIEQDA

SEQ ID NO: 1601280 - protein, 8 aa, Staphylococcus aureus
RESYGDDY

SEQ ID NO: 1601281 - protein, 13 aa, Staphylococcus aureus
RETRRGKKLEHQD

SEQ ID NO: 1601282 - protein, 12 aa, Staphylococcus aureus
REYGTTTGRPRR

SEQ ID NO: 1601283 - protein, 10 aa, Staphylococcus aureus
RFEPGDKKEV

SEQ ID NO: 1601284 - protein, 6 aa, Staphylococcus aureus
RFSDGE

SEQ ID NO: 1601285 - protein, 9 aa, Staphylococcus aureus
RGEKTMEDR

SEQ ID NO: 1601286 - protein, 4 aa, Staphylococcus aureus
RGPI

SEQ ID NO: 1601287 - protein, 9 aa, Staphylococcus aureus
RGPSGIGKT

SEQ ID NO: 1601288 - protein, 25 aa, Staphylococcus aureus
RGRNAKSHTKAKNTDVQTYRKSSAI

SEQ ID NO: 1601289 - protein, 11 aa, Staphylococcus aureus
RHGEKKAETLL

SEQ ID NO: 1601290 - protein, 9 aa, Staphylococcus aureus
RKATSNPRV

SEQ ID NO: 1601291 - protein, 6 aa, Staphylococcus aureus
RKGEGD

SEQ ID NO: 1601292 - protein, 8 aa, Staphylococcus aureus
RKQFGKPI

SEQ ID NO: 1601293 - protein, 4 aa, Staphylococcus aureus
RKRF

SEQ ID NO: 1601294 - protein, 7 aa, Staphylococcus aureus
RKRRNYA

SEQ ID NO: 1601295 - protein, 6 aa, Staphylococcus aureus
RKTETF

SEQ ID NO: 1601296 - protein, 7 aa, Staphylococcus aureus
RLTENGL

SEQ ID NO: 1601297 - protein, 16 aa, Staphylococcus aureus
RPDEKRVTERAYENPR

SEQ ID NO: 1601298 - protein, 7 aa, Staphylococcus aureus
RPERRTT

SEQ ID NO: 1601299 - protein, 8 aa, Staphylococcus aureus
RPGAQLGA

SEQ ID NO: 1601300 - protein, 11 aa, Staphylococcus aureus
RPGEPPTVENA

SEQ ID NO: 1601301 - protein, 5 aa, Staphylococcus aureus
RPGSV

SEQ ID NO: 1601302 - protein, 7 aa, Staphylococcus aureus
RPSVGKT

SEQ ID NO: 1601303 - protein, 10 aa, Staphylococcus aureus
RQGEANSHRD

SEQ ID NO: 1601304 - protein, 7 aa, Staphylococcus aureus
RRGYKSM

SEQ ID NO: 1601305 - protein, 7 aa, Staphylococcus aureus
RRPRPNV

SEQ ID NO: 1601306 - protein, 9 aa, Staphylococcus aureus
RRVGGSNYQ

SEQ ID NO: 1601307 - protein, 10 aa, Staphylococcus aureus
RRVTGTSAKY

SEQ ID NO: 1601308 - protein, 13 aa, Staphylococcus aureus
RSEAGSAGRDTRG

SEQ ID NO: 1601309 - protein, 5 aa, Staphylococcus aureus
RSTIT

SEQ ID NO: 1601310 - protein, 9 aa, Staphylococcus aureus
RSTNVPGST

SEQ ID NO: 1601311 - protein, 14 aa, Staphylococcus aureus
RTRSELVESGEQDL

SEQ ID NO: 1601312 - protein, 13 aa, Staphylococcus aureus
RTSDATHLMNLLF

SEQ ID NO: 1601313 - protein, 16 aa, Staphylococcus aureus
RVAAKKAREVTRRKSA

SEQ ID NO: 1601314 - protein, 8 aa, Staphylococcus aureus
RVGRSSRI

SEQ ID NO: 1601315 - protein, 4 aa, Staphylococcus aureus
RYER

SEQ ID NO: 1601316 - protein, 6 aa, Staphylococcus aureus
SADLGK

SEQ ID NO: 1601317 - protein, 11 aa, Staphylococcus aureus
SAKKRTKSIAY

SEQ ID NO: 1601318 - protein, 10 aa, Staphylococcus aureus
SAKTGEGGKL

SEQ ID NO: 1601319 - protein, 8 aa, Staphylococcus aureus
SARSGLER

SEQ ID NO: 1601320 - protein, 20 aa, Staphylococcus aureus
SAYSTGKPALGVGPGNVPSY

SEQ ID NO: 1601321 - protein, 7 aa, Staphylococcus aureus
SDFTKTE

SEQ ID NO: 1601322 - protein, 6 aa, Staphylococcus aureus
SDNEED

SEQ ID NO: 1601323 - protein, 9 aa, Staphylococcus aureus
SDRPPKEIA

SEQ ID NO: 1601324 - protein, 8 aa, Staphylococcus aureus
SDSQAMGR

SEQ ID NO: 1601325 - protein, 10 aa, Staphylococcus aureus
SDTSAGAGMQ

SEQ ID NO: 1601326 - protein, 16 aa, Staphylococcus aureus
SDVDQYTDTPSYKRTS

SEQ ID NO: 1601327 - protein, 5 aa, Staphylococcus aureus
SDYED

SEQ ID NO: 1601328 - protein, 11 aa, Staphylococcus aureus
SEAVNKNRTDH

SEQ ID NO: 1601329 - protein, 7 aa, Staphylococcus aureus
SEGQGMS

SEQ ID NO: 1601330 - protein, 12 aa, Staphylococcus aureus
SEKPGAGKSTVV

SEQ ID NO: 1601331 - protein, 8 aa, Staphylococcus aureus
SENKEKEY

SEQ ID NO: 1601332 - protein, 6 aa, Staphylococcus aureus
SETDPI

SEQ ID NO: 1601333 - protein, 5 aa, Staphylococcus aureus
SETGE

SEQ ID NO: 1601334 - protein, 7 aa, Staphylococcus aureus
SFDGKGQ

SEQ ID NO: 1601335 - protein, 13 aa, Staphylococcus aureus
SFNNPTFTEEQNK

SEQ ID NO: 1601336 - protein, 10 aa, Staphylococcus aureus
SFTGSTDVGY

SEQ ID NO: 1601337 - protein, 8 aa, Staphylococcus aureus
SGAGKSTL

SEQ ID NO: 1601338 - protein, 15 aa, Staphylococcus aureus
SGAKSISDARKIGKT

SEQ ID NO: 1601339 - protein, 11 aa, Staphylococcus aureus
SGARGNASNFT

SEQ ID NO: 1601340 - protein, 14 aa, Staphylococcus aureus
SGAYYGGETLKPTK

SEQ ID NO: 1601341 - protein, 8 aa, Staphylococcus aureus
SGCGKSTT

SEQ ID NO: 1601342 - protein, 5 aa, Staphylococcus aureus
SGEEE

SEQ ID NO: 1601343 - protein, 12 aa, Staphylococcus aureus
SGGIQEEAPTFG

SEQ ID NO: 1601344 - protein, 10 aa, Staphylococcus aureus
SGGPNSVYEE

SEQ ID NO: 1601345 - protein, 10 aa, Staphylococcus aureus
SGLKGVNNPS

SEQ ID NO: 1601346 - protein, 7 aa, Staphylococcus aureus
SGNPSAC

SEQ ID NO: 1601347 - protein, 4 aa, Staphylococcus aureus
SGQT

SEQ ID NO: 1601348 - protein, 7 aa, Staphylococcus aureus
SGSSQPL

SEQ ID NO: 1601349 - protein, 8 aa, Staphylococcus aureus
SGTLSEES

SEQ ID NO: 1601350 - protein, 9 aa, Staphylococcus aureus
SGTTGSPKG

SEQ ID NO: 1601351 - protein, 15 aa, Staphylococcus aureus
SGYENKVKKNLEKRV

SEQ ID NO: 1601352 - protein, 9 aa, Staphylococcus aureus
SHRTSNDKE

SEQ ID NO: 1601353 - protein, 7 aa, Staphylococcus aureus
SHTNSTR

SEQ ID NO: 1601354 - protein, 7 aa, Staphylococcus aureus
SITKAHG

SEQ ID NO: 1601355 - protein, 4 aa, Staphylococcus aureus
SITS

SEQ ID NO: 1601356 - protein, 6 aa, Staphylococcus aureus
SKAGIT

SEQ ID NO: 1601357 - protein, 7 aa, Staphylococcus aureus
SKAGTVG

SEQ ID NO: 1601358 - protein, 8 aa, Staphylococcus aureus
SKEAQAEA

SEQ ID NO: 1601359 - protein, 8 aa, Staphylococcus aureus
SKEEATEV

SEQ ID NO: 1601360 - protein, 9 aa, Staphylococcus aureus
SKEERERGG

SEQ ID NO: 1601361 - protein, 23 aa, Staphylococcus aureus
SKGSLAGVDGRLQSRNYENQEGR

SEQ ID NO: 1601362 - protein, 7 aa, Staphylococcus aureus
SKNPDIS

SEQ ID NO: 1601363 - protein, 8 aa, Staphylococcus aureus
SKPGITKG

SEQ ID NO: 1601364 - protein, 4 aa, Staphylococcus aureus
SKRD

SEQ ID NO: 1601365 - protein, 13 aa, Staphylococcus aureus
SLGKEPEDQNRNL

SEQ ID NO: 1601366 - protein, 17 aa, Staphylococcus aureus
SLPGKLADCSSKSPEEC

SEQ ID NO: 1601367 - protein, 5 aa, Staphylococcus aureus
SLTQN

SEQ ID NO: 1601368 - protein, 6 aa, Staphylococcus aureus
SNANSE

SEQ ID NO: 1601369 - protein, 7 aa, Staphylococcus aureus
SNEETPI

SEQ ID NO: 1601370 - protein, 7 aa, Staphylococcus aureus
SNFNPEN

SEQ ID NO: 1601371 - protein, 5 aa, Staphylococcus aureus
SNQQI

SEQ ID NO: 1601372 - protein, 8 aa, Staphylococcus aureus
SPEGEEEI

SEQ ID NO: 1601373 - protein, 8 aa, Staphylococcus aureus
SPEPGLQS

SEQ ID NO: 1601374 - protein, 9 aa, Staphylococcus aureus
SPFGEGRPG

SEQ ID NO: 1601375 - protein, 10 aa, Staphylococcus aureus
SPKPKDAPGF

SEQ ID NO: 1601376 - protein, 11 aa, Staphylococcus aureus
SPMDGIGPEDI

SEQ ID NO: 1601377 - protein, 6 aa, Staphylococcus aureus
SPPPHH

SEQ ID NO: 1601378 - protein, 7 aa, Staphylococcus aureus
SPQHTYT

SEQ ID NO: 1601379 - protein, 6 aa, Staphylococcus aureus
SPRTTY

SEQ ID NO: 1601380 - protein, 4 aa, Staphylococcus aureus
SPSI

SEQ ID NO: 1601381 - protein, 13 aa, Staphylococcus aureus
SQGVSEEELNESI

SEQ ID NO: 1601382 - protein, 9 aa, Staphylococcus aureus
SQMKPKQAI

SEQ ID NO: 1601383 - protein, 7 aa, Staphylococcus aureus
SRLDRTL

SEQ ID NO: 1601384 - protein, 7 aa, Staphylococcus aureus
SRNIRSE

SEQ ID NO: 1601385 - protein, 6 aa, Staphylococcus aureus
SRNKKH

SEQ ID NO: 1601386 - protein, 14 aa, Staphylococcus aureus
SRTNRVEKESKPFG

SEQ ID NO: 1601387 - protein, 9 aa, Staphylococcus aureus
SSKATNEES

SEQ ID NO: 1601388 - protein, 12 aa, Staphylococcus aureus
SSKSYDERFTPD

SEQ ID NO: 1601389 - protein, 8 aa, Staphylococcus aureus
SSNPIAGN

SEQ ID NO: 1601390 - protein, 7 aa, Staphylococcus aureus
SSPDALN

SEQ ID NO: 1601391 - protein, 7 aa, Staphylococcus aureus
SSRETVR

SEQ ID NO: 1601392 - protein, 11 aa, Staphylococcus aureus
SSSRESDGFKD

SEQ ID NO: 1601393 - protein, 6 aa, Staphylococcus aureus
SSTDHT

SEQ ID NO: 1601394 - protein, 6 aa, Staphylococcus aureus
SSYSNT

SEQ ID NO: 1601395 - protein, 9 aa, Staphylococcus aureus
STANNPVAQ

SEQ ID NO: 1601396 - protein, 14 aa, Staphylococcus aureus
STEGTLNEAGGPQY

SEQ ID NO: 1601397 - protein, 5 aa, Staphylococcus aureus
STEMS

SEQ ID NO: 1601398 - protein, 4 aa, Staphylococcus aureus
STIE

SEQ ID NO: 1601399 - protein, 15 aa, Staphylococcus aureus
STKGSAKSDDVTKVQ

SEQ ID NO: 1601400 - protein, 12 aa, Staphylococcus aureus
STSWGKTVLKWI

SEQ ID NO: 1601401 - protein, 5 aa, Staphylococcus aureus
STVTG

SEQ ID NO: 1601402 - protein, 6 aa, Staphylococcus aureus
SVDREQ

SEQ ID NO: 1601403 - protein, 8 aa, Staphylococcus aureus
SVVESGTV

SEQ ID NO: 1601404 - protein, 18 aa, Staphylococcus aureus
SVVNGGSRAYTPYSPQVR

SEQ ID NO: 1601405 - protein, 10 aa, Staphylococcus aureus
SYDKITDKKR

SEQ ID NO: 1601406 - protein, 4 aa, Staphylococcus aureus
TAAQ

SEQ ID NO: 1601407 - protein, 8 aa, Staphylococcus aureus
TADEEDSY

SEQ ID NO: 1601408 - protein, 5 aa, Staphylococcus aureus
TAGAT

SEQ ID NO: 1601409 - protein, 11 aa, Staphylococcus aureus
TAGQKGTGKWT

SEQ ID NO: 1601410 - protein, 9 aa, Staphylococcus aureus
TAKESRIER

SEQ ID NO: 1601411 - protein, 9 aa, Staphylococcus aureus
TASAAMGRT

SEQ ID NO: 1601412 - protein, 13 aa, Staphylococcus aureus
TATVRSSKSGDQA

SEQ ID NO: 1601413 - protein, 14 aa, Staphylococcus aureus
TDAPHGIVKFPEHF

SEQ ID NO: 1601414 - protein, 5 aa, Staphylococcus aureus
TDNPH

SEQ ID NO: 1601415 - protein, 4 aa, Staphylococcus aureus
TDRD

SEQ ID NO: 1601416 - protein, 4 aa, Staphylococcus aureus
TDYA

SEQ ID NO: 1601417 - protein, 11 aa, Staphylococcus aureus
TEANNATDYRN

SEQ ID NO: 1601418 - protein, 5 aa, Staphylococcus aureus
TEDGL

SEQ ID NO: 1601419 - protein, 18 aa, Staphylococcus aureus
TEGISTTKIKQELYGKDA

SEQ ID NO: 1601420 - protein, 9 aa, Staphylococcus aureus
TEGSIEPKN

SEQ ID NO: 1601421 - protein, 17 aa, Staphylococcus aureus
TEISPLAKKNPEDPRFT

SEQ ID NO: 1601422 - protein, 4 aa, Staphylococcus aureus
TENL

SEQ ID NO: 1601423 - protein, 5 aa, Staphylococcus aureus
TERIT

SEQ ID NO: 1601424 - protein, 5 aa, Staphylococcus aureus
TGDLS

SEQ ID NO: 1601425 - protein, 5 aa, Staphylococcus aureus
TGEMK

SEQ ID NO: 1601426 - protein, 7 aa, Staphylococcus aureus
TGEVKEQ

SEQ ID NO: 1601427 - protein, 11 aa, Staphylococcus aureus
TGKGQATNPTA

SEQ ID NO: 1601428 - protein, 4 aa, Staphylococcus aureus
TGKK

SEQ ID NO: 1601429 - protein, 8 aa, Staphylococcus aureus
TGLNPSEI

SEQ ID NO: 1601430 - protein, 5 aa, Staphylococcus aureus
TGNTK

SEQ ID NO: 1601431 - protein, 14 aa, Staphylococcus aureus
TGPNRKEEKEREIG

SEQ ID NO: 1601432 - protein, 4 aa, Staphylococcus aureus
TGQK

SEQ ID NO: 1601433 - protein, 6 aa, Staphylococcus aureus
TGTNRD

SEQ ID NO: 1601434 - protein, 4 aa, Staphylococcus aureus
THAR

SEQ ID NO: 1601435 - protein, 5 aa, Staphylococcus aureus
TIEDN

SEQ ID NO: 1601436 - protein, 12 aa, Staphylococcus aureus
TIETNGSAINEQ

SEQ ID NO: 1601437 - protein, 14 aa, Staphylococcus aureus
TKDPEYRTTPSGVS

SEQ ID NO: 1601438 - protein, 6 aa, Staphylococcus aureus
TKEDDA

SEQ ID NO: 1601439 - protein, 9 aa, Staphylococcus aureus
TKEKETADS

SEQ ID NO: 1601440 - protein, 10 aa, Staphylococcus aureus
TKENPPIPGH

SEQ ID NO: 1601441 - protein, 10 aa, Staphylococcus aureus
TKGEPGTGNI

SEQ ID NO: 1601442 - protein, 5 aa, Staphylococcus aureus
TKLLP

SEQ ID NO: 1601443 - protein, 8 aa, Staphylococcus aureus
TKNKTSTV

SEQ ID NO: 1601444 - protein, 6 aa, Staphylococcus aureus
TKPFST

SEQ ID NO: 1601445 - protein, 10 aa, Staphylococcus aureus
TKRGKGKAGF

SEQ ID NO: 1601446 - protein, 6 aa, Staphylococcus aureus
TKTLRK

SEQ ID NO: 1601447 - protein, 16 aa, Staphylococcus aureus
TLADTKKCGEVATQSA

SEQ ID NO: 1601448 - protein, 6 aa, Staphylococcus aureus
TLAENS

SEQ ID NO: 1601449 - protein, 8 aa, Staphylococcus aureus
TLDDEDKE

SEQ ID NO: 1601450 - protein, 7 aa, Staphylococcus aureus
TLGEGGL

SEQ ID NO: 1601451 - protein, 4 aa, Staphylococcus aureus
TLSD

SEQ ID NO: 1601452 - protein, 5 aa, Staphylococcus aureus
TMKQH

SEQ ID NO: 1601453 - protein, 19 aa, Staphylococcus aureus
TMTSGSYVKNSTKGKRERV

SEQ ID NO: 1601454 - protein, 11 aa, Staphylococcus aureus
TMYGTGQLPKF

SEQ ID NO: 1601455 - protein, 5 aa, Staphylococcus aureus
TNAPL

SEQ ID NO: 1601456 - protein, 17 aa, Staphylococcus aureus
TNEHGYEIESKRGGGGY

SEQ ID NO: 1601457 - protein, 11 aa, Staphylococcus aureus
TNEISTKEEIQ

SEQ ID NO: 1601458 - protein, 7 aa, Staphylococcus aureus
TNEQGHT

SEQ ID NO: 1601459 - protein, 5 aa, Staphylococcus aureus
TNFEI

SEQ ID NO: 1601460 - protein, 7 aa, Staphylococcus aureus
TNPPIDA

SEQ ID NO: 1601461 - protein, 8 aa, Staphylococcus aureus
TNVPTTRN

SEQ ID NO: 1601462 - protein, 8 aa, Staphylococcus aureus
TPDRGQVS

SEQ ID NO: 1601463 - protein, 12 aa, Staphylococcus aureus
TPENSKRKPMSI

SEQ ID NO: 1601464 - protein, 6 aa, Staphylococcus aureus
TPGVTG

SEQ ID NO: 1601465 - protein, 5 aa, Staphylococcus aureus
TPLSG

SEQ ID NO: 1601466 - protein, 11 aa, Staphylococcus aureus
TPMGGSADSYI

SEQ ID NO: 1601467 - protein, 6 aa, Staphylococcus aureus
TPPDYE

SEQ ID NO: 1601468 - protein, 6 aa, Staphylococcus aureus
TPREIY

SEQ ID NO: 1601469 - protein, 17 aa, Staphylococcus aureus
TPRFPENSSQDGRTTAD

SEQ ID NO: 1601470 - protein, 8 aa, Staphylococcus aureus
TPSAVGGI

SEQ ID NO: 1601471 - protein, 10 aa, Staphylococcus aureus
TPTTNPTSTT

SEQ ID NO: 1601472 - protein, 4 aa, Staphylococcus aureus
TPVI

SEQ ID NO: 1601473 - protein, 6 aa, Staphylococcus aureus
TQAMTA

SEQ ID NO: 1601474 - protein, 6 aa, Staphylococcus aureus
TQGKQK

SEQ ID NO: 1601475 - protein, 6 aa, Staphylococcus aureus
TQKANI

SEQ ID NO: 1601476 - protein, 6 aa, Staphylococcus aureus
TQLQAT

SEQ ID NO: 1601477 - protein, 5 aa, Staphylococcus aureus
TQNKT

SEQ ID NO: 1601478 - protein, 6 aa, Staphylococcus aureus
TQPLGR

SEQ ID NO: 1601479 - protein, 5 aa, Staphylococcus aureus
TQQEV

SEQ ID NO: 1601480 - protein, 7 aa, Staphylococcus aureus
TRAQGEI

SEQ ID NO: 1601481 - protein, 8 aa, Staphylococcus aureus
TRGSTPGI

SEQ ID NO: 1601482 - protein, 6 aa, Staphylococcus aureus
TRKNEN

SEQ ID NO: 1601483 - protein, 9 aa, Staphylococcus aureus
TSAATTAAW

SEQ ID NO: 1601484 - protein, 9 aa, Staphylococcus aureus
TSDTKKGVE

SEQ ID NO: 1601485 - protein, 6 aa, Staphylococcus aureus
TSDTPV

SEQ ID NO: 1601486 - protein, 5 aa, Staphylococcus aureus
TSGQE

SEQ ID NO: 1601487 - protein, 4 aa, Staphylococcus aureus
TSIY

SEQ ID NO: 1601488 - protein, 8 aa, Staphylococcus aureus
TSKTTVTG

SEQ ID NO: 1601489 - protein, 11 aa, Staphylococcus aureus
TSLTKDEKGIN

SEQ ID NO: 1601490 - protein, 7 aa, Staphylococcus aureus
TSPYTRS

SEQ ID NO: 1601491 - protein, 9 aa, Staphylococcus aureus
TSRTSSYSR

SEQ ID NO: 1601492 - protein, 11 aa, Staphylococcus aureus
TSRVGDGPFPT

SEQ ID NO: 1601493 - protein, 9 aa, Staphylococcus aureus
TSSVRDETQ

SEQ ID NO: 1601494 - protein, 9 aa, Staphylococcus aureus
TSTERPEVL

SEQ ID NO: 1601495 - protein, 5 aa, Staphylococcus aureus
TSVDG

SEQ ID NO: 1601496 - protein, 10 aa, Staphylococcus aureus
TTEGNYKPKR

SEQ ID NO: 1601497 - protein, 11 aa, Staphylococcus aureus
TTETVQEAQTR

SEQ ID NO: 1601498 - protein, 6 aa, Staphylococcus aureus
TTHTDS

SEQ ID NO: 1601499 - protein, 9 aa, Staphylococcus aureus
TTIASKKDD

SEQ ID NO: 1601500 - protein, 7 aa, Staphylococcus aureus
TTNGAYA

SEQ ID NO: 1601501 - protein, 14 aa, Staphylococcus aureus
TTPNQDNPLTEGKT

SEQ ID NO: 1601502 - protein, 6 aa, Staphylococcus aureus
TTQHGY

SEQ ID NO: 1601503 - protein, 10 aa, Staphylococcus aureus
TTSGTGSEVT

SEQ ID NO: 1601504 - protein, 4 aa, Staphylococcus aureus
TTVQ

SEQ ID NO: 1601505 - protein, 12 aa, Staphylococcus aureus
TTVSTTGKTGVE

SEQ ID NO: 1601506 - protein, 4 aa, Staphylococcus aureus
TTYG

SEQ ID NO: 1601507 - protein, 8 aa, Staphylococcus aureus
TYDNNNTV

SEQ ID NO: 1601508 - protein, 5 aa, Staphylococcus aureus
TYDTF

SEQ ID NO: 1601509 - protein, 11 aa, Staphylococcus aureus
TYEGGTHEDGF

SEQ ID NO: 1601510 - protein, 8 aa, Staphylococcus aureus
TYGTDDYP

SEQ ID NO: 1601511 - protein, 5 aa, Staphylococcus aureus
TYINQ

SEQ ID NO: 1601512 - protein, 5 aa, Staphylococcus aureus
TYTSM

SEQ ID NO: 1601513 - protein, 5 aa, Staphylococcus aureus
VAASY

SEQ ID NO: 1601514 - protein, 13 aa, Staphylococcus aureus
VADGGGLSRTDEK

SEQ ID NO: 1601515 - protein, 9 aa, Staphylococcus aureus
VAKAGSDVK

SEQ ID NO: 1601516 - protein, 6 aa, Staphylococcus aureus
VAKSHG

SEQ ID NO: 1601517 - protein, 7 aa, Staphylococcus aureus
VATPLDD

SEQ ID NO: 1601518 - protein, 5 aa, Staphylococcus aureus
VCSAG

SEQ ID NO: 1601519 - protein, 7 aa, Staphylococcus aureus
VDEADRL

SEQ ID NO: 1601520 - protein, 6 aa, Staphylococcus aureus
VDEYNQ

SEQ ID NO: 1601521 - protein, 4 aa, Staphylococcus aureus
VDGA

SEQ ID NO: 1601522 - protein, 8 aa, Staphylococcus aureus
VDGQGPIG

SEQ ID NO: 1601523 - protein, 7 aa, Staphylococcus aureus
VDKEKIY

SEQ ID NO: 1601524 - protein, 6 aa, Staphylococcus aureus
VDPNDG

SEQ ID NO: 1601525 - protein, 17 aa, Staphylococcus aureus
VDPRYGGGKVNTRTTDD

SEQ ID NO: 1601526 - protein, 5 aa, Staphylococcus aureus
VDQDG

SEQ ID NO: 1601527 - protein, 11 aa, Staphylococcus aureus
VDSQGASGQNR

SEQ ID NO: 1601528 - protein, 6 aa, Staphylococcus aureus
VDYSGR

SEQ ID NO: 1601529 - protein, 7 aa, Staphylococcus aureus
VEDAPKK

SEQ ID NO: 1601530 - protein, 8 aa, Staphylococcus aureus
VEKEITDK

SEQ ID NO: 1601531 - protein, 4 aa, Staphylococcus aureus
VETG

SEQ ID NO: 1601532 - protein, 8 aa, Staphylococcus aureus
VGGASGPL

SEQ ID NO: 1601533 - protein, 11 aa, Staphylococcus aureus
VGSTEQIKANH

SEQ ID NO: 1601534 - protein, 10 aa, Staphylococcus aureus
VGTGGTLSGV

SEQ ID NO: 1601535 - protein, 6 aa, Staphylococcus aureus
VHGPNH

SEQ ID NO: 1601536 - protein, 6 aa, Staphylococcus aureus
VIDAGK

SEQ ID NO: 1601537 - protein, 7 aa, Staphylococcus aureus
VITESEV

SEQ ID NO: 1601538 - protein, 5 aa, Staphylococcus aureus
VKDGD

SEQ ID NO: 1601539 - protein, 7 aa, Staphylococcus aureus
VKGSGVD

SEQ ID NO: 1601540 - protein, 8 aa, Staphylococcus aureus
VKKPETIN

SEQ ID NO: 1601541 - protein, 6 aa, Staphylococcus aureus
VKKSDK

SEQ ID NO: 1601542 - protein, 6 aa, Staphylococcus aureus
VKPEVD

SEQ ID NO: 1601543 - protein, 4 aa, Staphylococcus aureus
VKQQ

SEQ ID NO: 1601544 - protein, 10 aa, Staphylococcus aureus
VLTPADEEYH

SEQ ID NO: 1601545 - protein, 8 aa, Staphylococcus aureus
VNGRGVPQ

SEQ ID NO: 1601546 - protein, 8 aa, Staphylococcus aureus
VNNEQRDV

SEQ ID NO: 1601547 - protein, 7 aa, Staphylococcus aureus
VNTETGE

SEQ ID NO: 1601548 - protein, 5 aa, Staphylococcus aureus
VPEEI

SEQ ID NO: 1601549 - protein, 13 aa, Staphylococcus aureus
VPEKLDPAAASSI

SEQ ID NO: 1601550 - protein, 12 aa, Staphylococcus aureus
VPKDTKNGDYAT

SEQ ID NO: 1601551 - protein, 5 aa, Staphylococcus aureus
VQTQE

SEQ ID NO: 1601552 - protein, 15 aa, Staphylococcus aureus
VRRARAGLKDPKRPI

SEQ ID NO: 1601553 - protein, 11 aa, Staphylococcus aureus
VRTSRQSPFAQ

SEQ ID NO: 1601554 - protein, 5 aa, Staphylococcus aureus
VSIED

SEQ ID NO: 1601555 - protein, 6 aa, Staphylococcus aureus
VSPQTK

SEQ ID NO: 1601556 - protein, 11 aa, Staphylococcus aureus
VSSPKMKNMPD

SEQ ID NO: 1601557 - protein, 5 aa, Staphylococcus aureus
VTGEE

SEQ ID NO: 1601558 - protein, 9 aa, Staphylococcus aureus
VTGKPANAY

SEQ ID NO: 1601559 - protein, 7 aa, Staphylococcus aureus
VTGSVHD

SEQ ID NO: 1601560 - protein, 11 aa, Staphylococcus aureus
VTNEQSMKDNA

SEQ ID NO: 1601561 - protein, 6 aa, Staphylococcus aureus
VTNVST

SEQ ID NO: 1601562 - protein, 12 aa, Staphylococcus aureus
VTPKGVTELTAE

SEQ ID NO: 1601563 - protein, 18 aa, Staphylococcus aureus
VTSRRGRVDGMEPRGNAQ

SEQ ID NO: 1601564 - protein, 6 aa, Staphylococcus aureus
VVETGT

SEQ ID NO: 1601565 - protein, 7 aa, Staphylococcus aureus
WDNKDRP

SEQ ID NO: 1601566 - protein, 4 aa, Staphylococcus aureus
WPTI

SEQ ID NO: 1601567 - protein, 8 aa, Staphylococcus aureus
YAAQEDSE

SEQ ID NO: 1601568 - protein, 5 aa, Staphylococcus aureus
YAPAI

SEQ ID NO: 1601569 - protein, 12 aa, Staphylococcus aureus
YAQLSDEQKSIL

SEQ ID NO: 1601570 - protein, 19 aa, Staphylococcus aureus
YDGEGVTEAVRTKSNMDGM

SEQ ID NO: 1601571 - protein, 10 aa, Staphylococcus aureus
YDGNEREPSV

SEQ ID NO: 1601572 - protein, 11 aa, Staphylococcus aureus
YDGPASEATDD

SEQ ID NO: 1601573 - protein, 7 aa, Staphylococcus aureus
YDKGELT

SEQ ID NO: 1601574 - protein, 6 aa, Staphylococcus aureus
YEATTN

SEQ ID NO: 1601575 - protein, 5 aa, Staphylococcus aureus
YEGAL

SEQ ID NO: 1601576 - protein, 6 aa, Staphylococcus aureus
YEPGSF

SEQ ID NO: 1601577 - protein, 10 aa, Staphylococcus aureus
YESISATGVS

SEQ ID NO: 1601578 - protein, 6 aa, Staphylococcus aureus
YGERTT

SEQ ID NO: 1601579 - protein, 5 aa, Staphylococcus aureus
YGGTY

SEQ ID NO: 1601580 - protein, 11 aa, Staphylococcus aureus
YHGGTESTGEV

SEQ ID NO: 1601581 - protein, 12 aa, Staphylococcus aureus
YHSNQSILNDDK

SEQ ID NO: 1601582 - protein, 5 aa, Staphylococcus aureus
YIGGH

SEQ ID NO: 1601583 - protein, 4 aa, Staphylococcus aureus
YKGT

SEQ ID NO: 1601584 - protein, 15 aa, Staphylococcus aureus
YKYTEEELNVLLESL

SEQ ID NO: 1601585 - protein, 6 aa, Staphylococcus aureus
YNHGAG

SEQ ID NO: 1601586 - protein, 8 aa, Staphylococcus aureus
YNKTSNQH

SEQ ID NO: 1601587 - protein, 16 aa, Staphylococcus aureus
YNQRSDELSGGQQQRI

SEQ ID NO: 1601588 - protein, 6 aa, Staphylococcus aureus
YNTDKS

SEQ ID NO: 1601589 - protein, 10 aa, Staphylococcus aureus
YQNEDGTVTI

SEQ ID NO: 1601590 - protein, 8 aa, Staphylococcus aureus
YQPKPGTD

SEQ ID NO: 1601591 - protein, 4 aa, Staphylococcus aureus
YRAD

SEQ ID NO: 1601592 - protein, 4 aa, Staphylococcus aureus
YREQ

SEQ ID NO: 1601593 - protein, 4 aa, Staphylococcus aureus
YRIS

SEQ ID NO: 1601594 - protein, 13 aa, Staphylococcus aureus
YSNKEARENGWDS

SEQ ID NO: 1601595 - protein, 5 aa, Staphylococcus aureus
YSSKS

SEQ ID NO: 1601596 - protein, 6 aa, Staphylococcus aureus
YTKEDE

SEQ ID NO: 1601597 - protein, 6 aa, Staphylococcus aureus
YTTPIE

SEQ ID NO: 1601598 - protein, 20 aa, Staphylococcus aureus
YVETGNEKITQSYEYNSDNT

SEQ ID NO: 1601599 - protein, 16 aa, Staphylococcus aureus
YVGEPGNFTRTSNRHD

SEQ ID NO: 1601600 - protein, 26 aa, Staphylococcus aureus
YYNRGGDEDDDDDGGFEPQTNDENGE

SEQ ID NO: 1601601 - protein, 4 aa, Staphylococcus aureus
YYPS

SEQ ID NO: 1601602 - protein, 5 aa, Staphylococcus aureus
YYRPR

SEQ ID NO: 1601603 - protein, 7 aa, Staphylococcus aureus
AADGVEA

SEQ ID NO: 1601604 - protein, 7 aa, Staphylococcus aureus
AADIRDV

SEQ ID NO: 1601605 - protein, 12 aa, Staphylococcus aureus
AAEDSGKAEDYK

SEQ ID NO: 1601606 - protein, 13 aa, Staphylococcus aureus
AAENENCGGPGTF

SEQ ID NO: 1601607 - protein, 7 aa, Staphylococcus aureus
AAGGDEA

SEQ ID NO: 1601608 - protein, 9 aa, Staphylococcus aureus
AAKESDAQI

SEQ ID NO: 1601609 - protein, 5 aa, Staphylococcus aureus
AANEK

SEQ ID NO: 1601610 - protein, 7 aa, Staphylococcus aureus
AARKPLI

SEQ ID NO: 1601611 - protein, 9 aa, Staphylococcus aureus
AAVEGDEAK

SEQ ID NO: 1601612 - protein, 7 aa, Staphylococcus aureus
ADATGVD

SEQ ID NO: 1601613 - protein, 8 aa, Staphylococcus aureus
ADDEEDQN

SEQ ID NO: 1601614 - protein, 4 aa, Staphylococcus aureus
ADEF

SEQ ID NO: 1601615 - protein, 8 aa, Staphylococcus aureus
ADGKQPMS

SEQ ID NO: 1601616 - protein, 5 aa, Staphylococcus aureus
ADIEE

SEQ ID NO: 1601617 - protein, 19 aa, Staphylococcus aureus
ADKGKKALEALSKKSQEEI

SEQ ID NO: 1601618 - protein, 9 aa, Staphylococcus aureus
ADPEYGKGV

SEQ ID NO: 1601619 - protein, 14 aa, Staphylococcus aureus
ADQSESQMIPKDSK

SEQ ID NO: 1601620 - protein, 6 aa, Staphylococcus aureus
ADSFPE

SEQ ID NO: 1601621 - protein, 6 aa, Staphylococcus aureus
ADTDRG

SEQ ID NO: 1601622 - protein, 7 aa, Staphylococcus aureus
ADTTDEA

SEQ ID NO: 1601623 - protein, 10 aa, Staphylococcus aureus
AEAIDGQAAE

SEQ ID NO: 1601624 - protein, 13 aa, Staphylococcus aureus
AEDGYKSLEEGQK

SEQ ID NO: 1601625 - protein, 11 aa, Staphylococcus aureus
AEEAKERGEGL

SEQ ID NO: 1601626 - protein, 7 aa, Staphylococcus aureus
AEEAKEY

SEQ ID NO: 1601627 - protein, 7 aa, Staphylococcus aureus
AEEFSER

SEQ ID NO: 1601628 - protein, 8 aa, Staphylococcus aureus
AEEKRTLT

SEQ ID NO: 1601629 - protein, 8 aa, Staphylococcus aureus
AEKTNSVG

SEQ ID NO: 1601630 - protein, 13 aa, Staphylococcus aureus
AEPAQIASSPNTD

SEQ ID NO: 1601631 - protein, 4 aa, Staphylococcus aureus
AERH

SEQ ID NO: 1601632 - protein, 4 aa, Staphylococcus aureus
AEYD

SEQ ID NO: 1601633 - protein, 18 aa, Staphylococcus aureus
AFSTGSSIMPQKKNPDMA

SEQ ID NO: 1601634 - protein, 16 aa, Staphylococcus aureus
AGAAGGADAAAEKTEF

SEQ ID NO: 1601635 - protein, 6 aa, Staphylococcus aureus
AGDETA

SEQ ID NO: 1601636 - protein, 13 aa, Staphylococcus aureus
AGDGFQGAEISPY

SEQ ID NO: 1601637 - protein, 7 aa, Staphylococcus aureus
AGEAFDN

SEQ ID NO: 1601638 - protein, 7 aa, Staphylococcus aureus
AGGAAHL

SEQ ID NO: 1601639 - protein, 4 aa, Staphylococcus aureus
AGID

SEQ ID NO: 1601640 - protein, 9 aa, Staphylococcus aureus
AGITNDKEA

SEQ ID NO: 1601641 - protein, 12 aa, Staphylococcus aureus
AGKSDEDPYENP

SEQ ID NO: 1601642 - protein, 4 aa, Staphylococcus aureus
AGLT

SEQ ID NO: 1601643 - protein, 7 aa, Staphylococcus aureus
AGNTYTN

SEQ ID NO: 1601644 - protein, 7 aa, Staphylococcus aureus
AGPAGMT

SEQ ID NO: 1601645 - protein, 6 aa, Staphylococcus aureus
AGPGGY

SEQ ID NO: 1601646 - protein, 10 aa, Staphylococcus aureus
AGPGNPNYLT

SEQ ID NO: 1601647 - protein, 6 aa, Staphylococcus aureus
AGQSAV

SEQ ID NO: 1601648 - protein, 9 aa, Staphylococcus aureus
AGTKSDKDV

SEQ ID NO: 1601649 - protein, 4 aa, Staphylococcus aureus
AGVG

SEQ ID NO: 1601650 - protein, 8 aa, Staphylococcus aureus
AGYKPGEE

SEQ ID NO: 1601651 - protein, 5 aa, Staphylococcus aureus
AGYTA

SEQ ID NO: 1601652 - protein, 6 aa, Staphylococcus aureus
AHEESK

SEQ ID NO: 1601653 - protein, 5 aa, Staphylococcus aureus
AIENN

SEQ ID NO: 1601654 - protein, 11 aa, Staphylococcus aureus
AIGAAGAKNAG

SEQ ID NO: 1601655 - protein, 5 aa, Staphylococcus aureus
AIGSQ

SEQ ID NO: 1601656 - protein, 5 aa, Staphylococcus aureus
AIKNN

SEQ ID NO: 1601657 - protein, 9 aa, Staphylococcus aureus
AISTNKPDA

SEQ ID NO: 1601658 - protein, 12 aa, Staphylococcus aureus
AKARTTKQQARI

SEQ ID NO: 1601659 - protein, 6 aa, Staphylococcus aureus
AKEAGF

SEQ ID NO: 1601660 - protein, 7 aa, Staphylococcus aureus
AKGATHQ

SEQ ID NO: 1601661 - protein, 7 aa, Staphylococcus aureus
AKGVGGF

SEQ ID NO: 1601662 - protein, 6 aa, Staphylococcus aureus
AKNEDW

SEQ ID NO: 1601663 - protein, 7 aa, Staphylococcus aureus
AKPEEVV

SEQ ID NO: 1601664 - protein, 9 aa, Staphylococcus aureus
AKRQNEIKE

SEQ ID NO: 1601665 - protein, 6 aa, Staphylococcus aureus
AKSGEI

SEQ ID NO: 1601666 - protein, 8 aa, Staphylococcus aureus
AKSGETRE

SEQ ID NO: 1601667 - protein, 6 aa, Staphylococcus aureus
AKVSDK

SEQ ID NO: 1601668 - protein, 20 aa, Staphylococcus aureus
ALENGKPARSIDFNEEDQKW

SEQ ID NO: 1601669 - protein, 15 aa, Staphylococcus aureus
ALESMEGRNTRPTMD

SEQ ID NO: 1601670 - protein, 6 aa, Staphylococcus aureus
ALGPYS

SEQ ID NO: 1601671 - protein, 7 aa, Staphylococcus aureus
ALHDPNG

SEQ ID NO: 1601672 - protein, 9 aa, Staphylococcus aureus
ALPAGYAAR

SEQ ID NO: 1601673 - protein, 5 aa, Staphylococcus aureus
ALQNK

SEQ ID NO: 1601674 - protein, 9 aa, Staphylococcus aureus
AMKKNGAKA

SEQ ID NO: 1601675 - protein, 17 aa, Staphylococcus aureus
ANAKSPEQVESFLAETF

SEQ ID NO: 1601676 - protein, 10 aa, Staphylococcus aureus
ANDKNEATLE

SEQ ID NO: 1601677 - protein, 6 aa, Staphylococcus aureus
ANGTHK

SEQ ID NO: 1601678 - protein, 7 aa, Staphylococcus aureus
ANKRQIP

SEQ ID NO: 1601679 - protein, 8 aa, Staphylococcus aureus
ANLPRNSD

SEQ ID NO: 1601680 - protein, 6 aa, Staphylococcus aureus
ANPTGD

SEQ ID NO: 1601681 - protein, 10 aa, Staphylococcus aureus
ANRGANGIDG

SEQ ID NO: 1601682 - protein, 11 aa, Staphylococcus aureus
ANRVHPNSNIG

SEQ ID NO: 1601683 - protein, 10 aa, Staphylococcus aureus
ANSGPNTNGS

SEQ ID NO: 1601684 - protein, 4 aa, Staphylococcus aureus
ANSV

SEQ ID NO: 1601685 - protein, 10 aa, Staphylococcus aureus
ANVKKEGNDI

SEQ ID NO: 1601686 - protein, 4 aa, Staphylococcus aureus
APEK

SEQ ID NO: 1601687 - protein, 4 aa, Staphylococcus aureus
APGA

SEQ ID NO: 1601688 - protein, 12 aa, Staphylococcus aureus
APGKRHDNDIKT

SEQ ID NO: 1601689 - protein, 6 aa, Staphylococcus aureus
APGQEL

SEQ ID NO: 1601690 - protein, 6 aa, Staphylococcus aureus
APHIEE

SEQ ID NO: 1601691 - protein, 5 aa, Staphylococcus aureus
APHQG

SEQ ID NO: 1601692 - protein, 7 aa, Staphylococcus aureus
APLKDDS

SEQ ID NO: 1601693 - protein, 11 aa, Staphylococcus aureus
APNHKQASEQM

SEQ ID NO: 1601694 - protein, 10 aa, Staphylococcus aureus
APRPHNSGHY

SEQ ID NO: 1601695 - protein, 10 aa, Staphylococcus aureus
APYDESDHPV

SEQ ID NO: 1601696 - protein, 5 aa, Staphylococcus aureus
APYRE

SEQ ID NO: 1601697 - protein, 7 aa, Staphylococcus aureus
AQATSPY

SEQ ID NO: 1601698 - protein, 5 aa, Staphylococcus aureus
AQEQG

SEQ ID NO: 1601699 - protein, 4 aa, Staphylococcus aureus
AQGV

SEQ ID NO: 1601700 - protein, 8 aa, Staphylococcus aureus
AQKPQGSR

SEQ ID NO: 1601701 - protein, 7 aa, Staphylococcus aureus
AQNEAAR

SEQ ID NO: 1601702 - protein, 6 aa, Staphylococcus aureus
AQNSPI

SEQ ID NO: 1601703 - protein, 8 aa, Staphylococcus aureus
AQRQAGVG

SEQ ID NO: 1601704 - protein, 5 aa, Staphylococcus aureus
AQSEL

SEQ ID NO: 1601705 - protein, 5 aa, Staphylococcus aureus
AQSPG

SEQ ID NO: 1601706 - protein, 13 aa, Staphylococcus aureus
AQTDQIKTSTKRR

SEQ ID NO: 1601707 - protein, 4 aa, Staphylococcus aureus
AQTG

SEQ ID NO: 1601708 - protein, 12 aa, Staphylococcus aureus
ARARQTTKEGYR

SEQ ID NO: 1601709 - protein, 6 aa, Staphylococcus aureus
ARATYD

SEQ ID NO: 1601710 - protein, 6 aa, Staphylococcus aureus
ARIPEW

SEQ ID NO: 1601711 - protein, 4 aa, Staphylococcus aureus
ARKD

SEQ ID NO: 1601712 - protein, 6 aa, Staphylococcus aureus
ARPGSI

SEQ ID NO: 1601713 - protein, 7 aa, Staphylococcus aureus
ARPNNDV

SEQ ID NO: 1601714 - protein, 14 aa, Staphylococcus aureus
ARQDRKARSREPIT

SEQ ID NO: 1601715 - protein, 8 aa, Staphylococcus aureus
ARYTSDGQ

SEQ ID NO: 1601716 - protein, 8 aa, Staphylococcus aureus
ASAKGLDT

SEQ ID NO: 1601717 - protein, 6 aa, Staphylococcus aureus
ASATDK

SEQ ID NO: 1601718 - protein, 8 aa, Staphylococcus aureus
ASDKPSKL

SEQ ID NO: 1601719 - protein, 12 aa, Staphylococcus aureus
ASGHPYGASGAQ

SEQ ID NO: 1601720 - protein, 6 aa, Staphylococcus aureus
ASGSIT

SEQ ID NO: 1601721 - protein, 8 aa, Staphylococcus aureus
ASGVSPSE

SEQ ID NO: 1601722 - protein, 10 aa, Staphylococcus aureus
ASHPRSRNDS

SEQ ID NO: 1601723 - protein, 7 aa, Staphylococcus aureus
ASINDEI

SEQ ID NO: 1601724 - protein, 10 aa, Staphylococcus aureus
ASKQLPTDET

SEQ ID NO: 1601725 - protein, 5 aa, Staphylococcus aureus
ASLEA

SEQ ID NO: 1601726 - protein, 7 aa, Staphylococcus aureus
ASMKPDD

SEQ ID NO: 1601727 - protein, 5 aa, Staphylococcus aureus
ASRAN

SEQ ID NO: 1601728 - protein, 15 aa, Staphylococcus aureus
ASSDKGKEKLRNSDT

SEQ ID NO: 1601729 - protein, 6 aa, Staphylococcus aureus
ASTRVV

SEQ ID NO: 1601730 - protein, 7 aa, Staphylococcus aureus
ASVHGDE

SEQ ID NO: 1601731 - protein, 7 aa, Staphylococcus aureus
ATAEKNP

SEQ ID NO: 1601732 - protein, 10 aa, Staphylococcus aureus
ATASLSSGDH

SEQ ID NO: 1601733 - protein, 4 aa, Staphylococcus aureus
ATES

SEQ ID NO: 1601734 - protein, 8 aa, Staphylococcus aureus
ATGSRPIE

SEQ ID NO: 1601735 - protein, 6 aa, Staphylococcus aureus
ATHGKK

SEQ ID NO: 1601736 - protein, 17 aa, Staphylococcus aureus
ATKEARDRAVAGEGPTL

SEQ ID NO: 1601737 - protein, 10 aa, Staphylococcus aureus
ATKEEGPIGK

SEQ ID NO: 1601738 - protein, 10 aa, Staphylococcus aureus
ATNIENQQTY

SEQ ID NO: 1601739 - protein, 8 aa, Staphylococcus aureus
ATPGPYEI

SEQ ID NO: 1601740 - protein, 13 aa, Staphylococcus aureus
ATPQGAKDTKMPS

SEQ ID NO: 1601741 - protein, 6 aa, Staphylococcus aureus
ATQLTD

SEQ ID NO: 1601742 - protein, 11 aa, Staphylococcus aureus
ATSALDPATTA

SEQ ID NO: 1601743 - protein, 12 aa, Staphylococcus aureus
ATSALDPQTTDE

SEQ ID NO: 1601744 - protein, 8 aa, Staphylococcus aureus
AVNPQGKV

SEQ ID NO: 1601745 - protein, 9 aa, Staphylococcus aureus
AYADDQSDK

SEQ ID NO: 1601746 - protein, 10 aa, Staphylococcus aureus
AYEPQYGARP

SEQ ID NO: 1601747 - protein, 16 aa, Staphylococcus aureus
AYKNKQVDGFTTNPSL

SEQ ID NO: 1601748 - protein, 13 aa, Staphylococcus aureus
AYLANGKSPKEAV

SEQ ID NO: 1601749 - protein, 4 aa, Staphylococcus aureus
CAKA

SEQ ID NO: 1601750 - protein, 15 aa, Staphylococcus aureus
CATQEEVIELVNNYV

SEQ ID NO: 1601751 - protein, 8 aa, Staphylococcus aureus
CPLGPRPI

SEQ ID NO: 1601752 - protein, 8 aa, Staphylococcus aureus
CRSPLAES

SEQ ID NO: 1601753 - protein, 14 aa, Staphylococcus aureus
CSLSGTKAGADMKD

SEQ ID NO: 1601754 - protein, 9 aa, Staphylococcus aureus
CTGKGNDQV

SEQ ID NO: 1601755 - protein, 6 aa, Staphylococcus aureus
DAEKAV

SEQ ID NO: 1601756 - protein, 18 aa, Staphylococcus aureus
DAFNRRRGMTDEEIGTQL

SEQ ID NO: 1601757 - protein, 4 aa, Staphylococcus aureus
DAFR

SEQ ID NO: 1601758 - protein, 23 aa, Staphylococcus aureus
DAGSVASPNRETESMKDGSDAVG

SEQ ID NO: 1601759 - protein, 8 aa, Staphylococcus aureus
DALSDKER

SEQ ID NO: 1601760 - protein, 6 aa, Staphylococcus aureus
DAMDQH

SEQ ID NO: 1601761 - protein, 8 aa, Staphylococcus aureus
DAPDAEDM

SEQ ID NO: 1601762 - protein, 4 aa, Staphylococcus aureus
DAPS

SEQ ID NO: 1601763 - protein, 4 aa, Staphylococcus aureus
DAPY

SEQ ID NO: 1601764 - protein, 10 aa, Staphylococcus aureus
DAQATSAVRT

SEQ ID NO: 1601765 - protein, 7 aa, Staphylococcus aureus
DATRQVS

SEQ ID NO: 1601766 - protein, 6 aa, Staphylococcus aureus
DATTSL

SEQ ID NO: 1601767 - protein, 8 aa, Staphylococcus aureus
DATTTKNI

SEQ ID NO: 1601768 - protein, 7 aa, Staphylococcus aureus
DAVDEQF

SEQ ID NO: 1601769 - protein, 10 aa, Staphylococcus aureus
DDDDQRNGSE

SEQ ID NO: 1601770 - protein, 7 aa, Staphylococcus aureus
DDDEIKP

SEQ ID NO: 1601771 - protein, 9 aa, Staphylococcus aureus
DDEAIREGS

SEQ ID NO: 1601772 - protein, 7 aa, Staphylococcus aureus
DDGPDAV

SEQ ID NO: 1601773 - protein, 8 aa, Staphylococcus aureus
DDGSGKSY

SEQ ID NO: 1601774 - protein, 12 aa, Staphylococcus aureus
DDRKGSIKVNKD

SEQ ID NO: 1601775 - protein, 5 aa, Staphylococcus aureus
DDRYH

SEQ ID NO: 1601776 - protein, 5 aa, Staphylococcus aureus
DDSHY

SEQ ID NO: 1601777 - protein, 7 aa, Staphylococcus aureus
DDSKETI

SEQ ID NO: 1601778 - protein, 4 aa, Staphylococcus aureus
DDTL

SEQ ID NO: 1601779 - protein, 11 aa, Staphylococcus aureus
DDYTDPAPATA

SEQ ID NO: 1601780 - protein, 9 aa, Staphylococcus aureus
DEDGSDSAI

SEQ ID NO: 1601781 - protein, 9 aa, Staphylococcus aureus
DEDLATRDA

SEQ ID NO: 1601782 - protein, 6 aa, Staphylococcus aureus
DEEEGT

SEQ ID NO: 1601783 - protein, 4 aa, Staphylococcus aureus
DEEI

SEQ ID NO: 1601784 - protein, 4 aa, Staphylococcus aureus
DEKL

SEQ ID NO: 1601785 - protein, 7 aa, Staphylococcus aureus
DENENIS

SEQ ID NO: 1601786 - protein, 9 aa, Staphylococcus aureus
DENRVNEYS

SEQ ID NO: 1601787 - protein, 6 aa, Staphylococcus aureus
DEPKGF

SEQ ID NO: 1601788 - protein, 5 aa, Staphylococcus aureus
DEPSV

SEQ ID NO: 1601789 - protein, 6 aa, Staphylococcus aureus
DERAKA

SEQ ID NO: 1601790 - protein, 8 aa, Staphylococcus aureus
DESGHLPN

SEQ ID NO: 1601791 - protein, 8 aa, Staphylococcus aureus
DETQRRRE

SEQ ID NO: 1601792 - protein, 4 aa, Staphylococcus aureus
DEVQ

SEQ ID NO: 1601793 - protein, 6 aa, Staphylococcus aureus
DFPTTN

SEQ ID NO: 1601794 - protein, 7 aa, Staphylococcus aureus
DFSNQQI

SEQ ID NO: 1601795 - protein, 7 aa, Staphylococcus aureus
DFTPSNK

SEQ ID NO: 1601796 - protein, 6 aa, Staphylococcus aureus
DGEAPD

SEQ ID NO: 1601797 - protein, 8 aa, Staphylococcus aureus
DGEITNDN

SEQ ID NO: 1601798 - protein, 5 aa, Staphylococcus aureus
DGIPT

SEQ ID NO: 1601799 - protein, 8 aa, Staphylococcus aureus
DGKTSVTE

SEQ ID NO: 1601800 - protein, 7 aa, Staphylococcus aureus
DGLAAGK

SEQ ID NO: 1601801 - protein, 6 aa, Staphylococcus aureus
DGREIP

SEQ ID NO: 1601802 - protein, 7 aa, Staphylococcus aureus
DGRRAPF

SEQ ID NO: 1601803 - protein, 9 aa, Staphylococcus aureus
DGSERAERR

SEQ ID NO: 1601804 - protein, 6 aa, Staphylococcus aureus
DGSPYK

SEQ ID NO: 1601805 - protein, 12 aa, Staphylococcus aureus
DGTPNKGKLGAN

SEQ ID NO: 1601806 - protein, 7 aa, Staphylococcus aureus
DGTVKTF

SEQ ID NO: 1601807 - protein, 5 aa, Staphylococcus aureus
DGTVN

SEQ ID NO: 1601808 - protein, 4 aa, Staphylococcus aureus
DGVA

SEQ ID NO: 1601809 - protein, 5 aa, Staphylococcus aureus
DHEAY

SEQ ID NO: 1601810 - protein, 5 aa, Staphylococcus aureus
DHPNA

SEQ ID NO: 1601811 - protein, 14 aa, Staphylococcus aureus
DIRPDDSKEQLEEK

SEQ ID NO: 1601812 - protein, 6 aa, Staphylococcus aureus
DISQTY

SEQ ID NO: 1601813 - protein, 8 aa, Staphylococcus aureus
DKDRAGRM

SEQ ID NO: 1601814 - protein, 5 aa, Staphylococcus aureus
DKESH

SEQ ID NO: 1601815 - protein, 15 aa, Staphylococcus aureus
DKETLRYGENPQQSA

SEQ ID NO: 1601816 - protein, 5 aa, Staphylococcus aureus
DKEVK

SEQ ID NO: 1601817 - protein, 6 aa, Staphylococcus aureus
DKGETM

SEQ ID NO: 1601818 - protein, 7 aa, Staphylococcus aureus
DKGPRRV

SEQ ID NO: 1601819 - protein, 8 aa, Staphylococcus aureus
DKKEARRM

SEQ ID NO: 1601820 - protein, 9 aa, Staphylococcus aureus
DKKIKGGTD

SEQ ID NO: 1601821 - protein, 4 aa, Staphylococcus aureus
DKLE

SEQ ID NO: 1601822 - protein, 5 aa, Staphylococcus aureus
DKMSV

SEQ ID NO: 1601823 - protein, 10 aa, Staphylococcus aureus
DKPDVDTIEG

SEQ ID NO: 1601824 - protein, 7 aa, Staphylococcus aureus
DKPNLNI

SEQ ID NO: 1601825 - protein, 10 aa, Staphylococcus aureus
DKPSARPEGV

SEQ ID NO: 1601826 - protein, 8 aa, Staphylococcus aureus
DKQSRTSI

SEQ ID NO: 1601827 - protein, 9 aa, Staphylococcus aureus
DKTNYPKTE

SEQ ID NO: 1601828 - protein, 10 aa, Staphylococcus aureus
DKYSPFPEEV

SEQ ID NO: 1601829 - protein, 7 aa, Staphylococcus aureus
DLGPAES

SEQ ID NO: 1601830 - protein, 9 aa, Staphylococcus aureus
DLSPQDGEL

SEQ ID NO: 1601831 - protein, 7 aa, Staphylococcus aureus
DLSSTDM

SEQ ID NO: 1601832 - protein, 15 aa, Staphylococcus aureus
DLTERRESKQPLEYP

SEQ ID NO: 1601833 - protein, 4 aa, Staphylococcus aureus
DMSE

SEQ ID NO: 1601834 - protein, 6 aa, Staphylococcus aureus
DNGYET

SEQ ID NO: 1601835 - protein, 6 aa, Staphylococcus aureus
DNHPEY

SEQ ID NO: 1601836 - protein, 14 aa, Staphylococcus aureus
DNIEREKTTEFGEA

SEQ ID NO: 1601837 - protein, 6 aa, Staphylococcus aureus
DNISPM

SEQ ID NO: 1601838 - protein, 8 aa, Staphylococcus aureus
DNKHQGRD

SEQ ID NO: 1601839 - protein, 8 aa, Staphylococcus aureus
DNKNEEAV

SEQ ID NO: 1601840 - protein, 6 aa, Staphylococcus aureus
DNPNAI

SEQ ID NO: 1601841 - protein, 8 aa, Staphylococcus aureus
DNRLSEGI

SEQ ID NO: 1601842 - protein, 14 aa, Staphylococcus aureus
DNSYSMPEDGYNGK

SEQ ID NO: 1601843 - protein, 5 aa, Staphylococcus aureus
DNTEA

SEQ ID NO: 1601844 - protein, 5 aa, Staphylococcus aureus
DNTPF

SEQ ID NO: 1601845 - protein, 23 aa, Staphylococcus aureus
DPDVVNDSDKLRKYSKEQADLQK

SEQ ID NO: 1601846 - protein, 5 aa, Staphylococcus aureus
DPETL

SEQ ID NO: 1601847 - protein, 7 aa, Staphylococcus aureus
DPETNYP

SEQ ID NO: 1601848 - protein, 9 aa, Staphylococcus aureus
DPGPTGLEK

SEQ ID NO: 1601849 - protein, 7 aa, Staphylococcus aureus
DPSQTIT

SEQ ID NO: 1601850 - protein, 5 aa, Staphylococcus aureus
DPSTV

SEQ ID NO: 1601851 - protein, 9 aa, Staphylococcus aureus
DPYHGPNQA

SEQ ID NO: 1601852 - protein, 8 aa, Staphylococcus aureus
DQGSASTY

SEQ ID NO: 1601853 - protein, 7 aa, Staphylococcus aureus
DQQVGAN

SEQ ID NO: 1601854 - protein, 10 aa, Staphylococcus aureus
DQSHDASRNP

SEQ ID NO: 1601855 - protein, 6 aa, Staphylococcus aureus
DQTGKF

SEQ ID NO: 1601856 - protein, 11 aa, Staphylococcus aureus
DQTSAHDPLNG

SEQ ID NO: 1601857 - protein, 6 aa, Staphylococcus aureus
DRAEGI

SEQ ID NO: 1601858 - protein, 6 aa, Staphylococcus aureus
DREDGK

SEQ ID NO: 1601859 - protein, 14 aa, Staphylococcus aureus
DREKAKNKKGKIGV

SEQ ID NO: 1601860 - protein, 5 aa, Staphylococcus aureus
DRGRQ

SEQ ID NO: 1601861 - protein, 9 aa, Staphylococcus aureus
DRNKPQHLN

SEQ ID NO: 1601862 - protein, 7 aa, Staphylococcus aureus
DRPHELR

SEQ ID NO: 1601863 - protein, 9 aa, Staphylococcus aureus
DRQTGKTTI

SEQ ID NO: 1601864 - protein, 8 aa, Staphylococcus aureus
DRVSSGEL

SEQ ID NO: 1601865 - protein, 26 aa, Staphylococcus aureus
DRYSDERTAQTVANRQRKKINMNYIG

SEQ ID NO: 1601866 - protein, 5 aa, Staphylococcus aureus
DSDEF

SEQ ID NO: 1601867 - protein, 6 aa, Staphylococcus aureus
DSENPE

SEQ ID NO: 1601868 - protein, 5 aa, Staphylococcus aureus
DSFGT

SEQ ID NO: 1601869 - protein, 4 aa, Staphylococcus aureus
DSHR

SEQ ID NO: 1601870 - protein, 14 aa, Staphylococcus aureus
DSKTIDAKHKPAVV

SEQ ID NO: 1601871 - protein, 6 aa, Staphylococcus aureus
DSMNDK

SEQ ID NO: 1601872 - protein, 8 aa, Staphylococcus aureus
DSNLQGHR

SEQ ID NO: 1601873 - protein, 8 aa, Staphylococcus aureus
DSRGNPTV

SEQ ID NO: 1601874 - protein, 8 aa, Staphylococcus aureus
DSRPTMSG

SEQ ID NO: 1601875 - protein, 6 aa, Staphylococcus aureus
DSSEYS

SEQ ID NO: 1601876 - protein, 4 aa, Staphylococcus aureus
DSSI

SEQ ID NO: 1601877 - protein, 5 aa, Staphylococcus aureus
DSTGA

SEQ ID NO: 1601878 - protein, 7 aa, Staphylococcus aureus
DSTISNI

SEQ ID NO: 1601879 - protein, 10 aa, Staphylococcus aureus
DSVNGATAAI

SEQ ID NO: 1601880 - protein, 10 aa, Staphylococcus aureus
DTEPPIPGDL

SEQ ID NO: 1601881 - protein, 6 aa, Staphylococcus aureus
DTGSRM

SEQ ID NO: 1601882 - protein, 10 aa, Staphylococcus aureus
DTKNRKYPKD

SEQ ID NO: 1601883 - protein, 6 aa, Staphylococcus aureus
DTLGTK

SEQ ID NO: 1601884 - protein, 7 aa, Staphylococcus aureus
DTPEGKV

SEQ ID NO: 1601885 - protein, 7 aa, Staphylococcus aureus
DTTQTYT

SEQ ID NO: 1601886 - protein, 8 aa, Staphylococcus aureus
DTTSFPTP

SEQ ID NO: 1601887 - protein, 19 aa, Staphylococcus aureus
DTYRSSGAGGQHVNTTDSA

SEQ ID NO: 1601888 - protein, 10 aa, Staphylococcus aureus
DVLDQGGNAM

SEQ ID NO: 1601889 - protein, 7 aa, Staphylococcus aureus
DVRDKGL

SEQ ID NO: 1601890 - protein, 18 aa, Staphylococcus aureus
DVTGQDTTDWSKSTSQKL

SEQ ID NO: 1601891 - protein, 4 aa, Staphylococcus aureus
DYVQ

SEQ ID NO: 1601892 - protein, 4 aa, Staphylococcus aureus
EAAR

SEQ ID NO: 1601893 - protein, 12 aa, Staphylococcus aureus
EADAYEKPNPKV

SEQ ID NO: 1601894 - protein, 10 aa, Staphylococcus aureus
EAKGRPSDNP

SEQ ID NO: 1601895 - protein, 10 aa, Staphylococcus aureus
EALTARPGEY

SEQ ID NO: 1601896 - protein, 7 aa, Staphylococcus aureus
EAPTSGE

SEQ ID NO: 1601897 - protein, 11 aa, Staphylococcus aureus
EASESDHGGYK

SEQ ID NO: 1601898 - protein, 7 aa, Staphylococcus aureus
EASGKHV

SEQ ID NO: 1601899 - protein, 12 aa, Staphylococcus aureus
EASMDKKIAQNQ

SEQ ID NO: 1601900 - protein, 8 aa, Staphylococcus aureus
EASTGKRL

SEQ ID NO: 1601901 - protein, 5 aa, Staphylococcus aureus
EAVGD

SEQ ID NO: 1601902 - protein, 5 aa, Staphylococcus aureus
EDASI

SEQ ID NO: 1601903 - protein, 6 aa, Staphylococcus aureus
EDLSKE

SEQ ID NO: 1601904 - protein, 9 aa, Staphylococcus aureus
EDMKQQASQ

SEQ ID NO: 1601905 - protein, 6 aa, Staphylococcus aureus
EDNGIN

SEQ ID NO: 1601906 - protein, 6 aa, Staphylococcus aureus
EDNPEH

SEQ ID NO: 1601907 - protein, 11 aa, Staphylococcus aureus
EDPDLKKNHPK

SEQ ID NO: 1601908 - protein, 5 aa, Staphylococcus aureus
EDPHN

SEQ ID NO: 1601909 - protein, 12 aa, Staphylococcus aureus
EDQITDKMNTSR

SEQ ID NO: 1601910 - protein, 4 aa, Staphylococcus aureus
EDQQ

SEQ ID NO: 1601911 - protein, 5 aa, Staphylococcus aureus
EDSTD

SEQ ID NO: 1601912 - protein, 5 aa, Staphylococcus aureus
EDTED

SEQ ID NO: 1601913 - protein, 5 aa, Staphylococcus aureus
EDTRI

SEQ ID NO: 1601914 - protein, 7 aa, Staphylococcus aureus
EDVSENK

SEQ ID NO: 1601915 - protein, 6 aa, Staphylococcus aureus
EDYPDT

SEQ ID NO: 1601916 - protein, 7 aa, Staphylococcus aureus
EEDEATV

SEQ ID NO: 1601917 - protein, 6 aa, Staphylococcus aureus
EEDESH

SEQ ID NO: 1601918 - protein, 9 aa, Staphylococcus aureus
EEEAESIAS

SEQ ID NO: 1601919 - protein, 11 aa, Staphylococcus aureus
EEEQQGPVTEQ

SEQ ID NO: 1601920 - protein, 7 aa, Staphylococcus aureus
EEFGNGR

SEQ ID NO: 1601921 - protein, 5 aa, Staphylococcus aureus
EELGH

SEQ ID NO: 1601922 - protein, 6 aa, Staphylococcus aureus
EENGDD

SEQ ID NO: 1601923 - protein, 17 aa, Staphylococcus aureus
EENRRLKQQIHKLQQRE

SEQ ID NO: 1601924 - protein, 7 aa, Staphylococcus aureus
EEPDAHG

SEQ ID NO: 1601925 - protein, 13 aa, Staphylococcus aureus
EEQAKNHKDNPFD

SEQ ID NO: 1601926 - protein, 7 aa, Staphylococcus aureus
EETEAKF

SEQ ID NO: 1601927 - protein, 5 aa, Staphylococcus aureus
EEVGE

SEQ ID NO: 1601928 - protein, 8 aa, Staphylococcus aureus
EEVPEEEY

SEQ ID NO: 1601929 - protein, 7 aa, Staphylococcus aureus
EFEPDKE

SEQ ID NO: 1601930 - protein, 7 aa, Staphylococcus aureus
EFGTRGL

SEQ ID NO: 1601931 - protein, 5 aa, Staphylococcus aureus
EGAAR

SEQ ID NO: 1601932 - protein, 8 aa, Staphylococcus aureus
EGAKGSTL

SEQ ID NO: 1601933 - protein, 7 aa, Staphylococcus aureus
EGASPIV

SEQ ID NO: 1601934 - protein, 6 aa, Staphylococcus aureus
EGDAPE

SEQ ID NO: 1601935 - protein, 8 aa, Staphylococcus aureus
EGDGVGGL

SEQ ID NO: 1601936 - protein, 13 aa, Staphylococcus aureus
EGDRGEQAANVVK

SEQ ID NO: 1601937 - protein, 5 aa, Staphylococcus aureus
EGEPY

SEQ ID NO: 1601938 - protein, 5 aa, Staphylococcus aureus
EGIHE

SEQ ID NO: 1601939 - protein, 13 aa, Staphylococcus aureus
EGNEVDEAEEEAK

SEQ ID NO: 1601940 - protein, 6 aa, Staphylococcus aureus
EGQRRY

SEQ ID NO: 1601941 - protein, 12 aa, Staphylococcus aureus
EGQTNPPTLNSE

SEQ ID NO: 1601942 - protein, 7 aa, Staphylococcus aureus
EGRGVAK

SEQ ID NO: 1601943 - protein, 9 aa, Staphylococcus aureus
EGTEPTVPN

SEQ ID NO: 1601944 - protein, 6 aa, Staphylococcus aureus
EGTMPQ

SEQ ID NO: 1601945 - protein, 7 aa, Staphylococcus aureus
EGYEPQQ

SEQ ID NO: 1601946 - protein, 5 aa, Staphylococcus aureus
EGYFE

SEQ ID NO: 1601947 - protein, 8 aa, Staphylococcus aureus
EHGTIEPG

SEQ ID NO: 1601948 - protein, 10 aa, Staphylococcus aureus
EHLEKGKKSI

SEQ ID NO: 1601949 - protein, 11 aa, Staphylococcus aureus
EIAQSEAHNHA

SEQ ID NO: 1601950 - protein, 10 aa, Staphylococcus aureus
EIPSPVSGTV

SEQ ID NO: 1601951 - protein, 5 aa, Staphylococcus aureus
EIQDT

SEQ ID NO: 1601952 - protein, 5 aa, Staphylococcus aureus
EIQGN

SEQ ID NO: 1601953 - protein, 12 aa, Staphylococcus aureus
EIRGEQKEIGWG

SEQ ID NO: 1601954 - protein, 5 aa, Staphylococcus aureus
EKELA

SEQ ID NO: 1601955 - protein, 11 aa, Staphylococcus aureus
EKGESALKGND

SEQ ID NO: 1601956 - protein, 7 aa, Staphylococcus aureus
EKIDKAS

SEQ ID NO: 1601957 - protein, 7 aa, Staphylococcus aureus
EKLEECE

SEQ ID NO: 1601958 - protein, 23 aa, Staphylococcus aureus
EKLNDKAYITPGLGDAGDRLFGT

SEQ ID NO: 1601959 - protein, 8 aa, Staphylococcus aureus
EKSAQTYN

SEQ ID NO: 1601960 - protein, 6 aa, Staphylococcus aureus
EKVRGD

SEQ ID NO: 1601961 - protein, 7 aa, Staphylococcus aureus
ELGAPLS

SEQ ID NO: 1601962 - protein, 8 aa, Staphylococcus aureus
ELIGKPPK

SEQ ID NO: 1601963 - protein, 7 aa, Staphylococcus aureus
ELPEGAK

SEQ ID NO: 1601964 - protein, 6 aa, Staphylococcus aureus
ELPGPI

SEQ ID NO: 1601965 - protein, 6 aa, Staphylococcus aureus
ELRDEN

SEQ ID NO: 1601966 - protein, 8 aa, Staphylococcus aureus
ELRESRSD

SEQ ID NO: 1601967 - protein, 8 aa, Staphylococcus aureus
ELSEADQV

SEQ ID NO: 1601968 - protein, 9 aa, Staphylococcus aureus
ELSGGQQKR

SEQ ID NO: 1601969 - protein, 10 aa, Staphylococcus aureus
EMPKPDKTKL

SEQ ID NO: 1601970 - protein, 6 aa, Staphylococcus aureus
ENDPDV

SEQ ID NO: 1601971 - protein, 18 aa, Staphylococcus aureus
ENEDKAKQYKQARGMGGH

SEQ ID NO: 1601972 - protein, 5 aa, Staphylococcus aureus
ENGAH

SEQ ID NO: 1601973 - protein, 8 aa, Staphylococcus aureus
ENKDATGY

SEQ ID NO: 1601974 - protein, 16 aa, Staphylococcus aureus
ENKGKRSGGYSSGAHL

SEQ ID NO: 1601975 - protein, 8 aa, Staphylococcus aureus
ENNDLKEK

SEQ ID NO: 1601976 - protein, 10 aa, Staphylococcus aureus
ENRKARHDYN

SEQ ID NO: 1601977 - protein, 7 aa, Staphylococcus aureus
ENTFSGK

SEQ ID NO: 1601978 - protein, 5 aa, Staphylococcus aureus
EPEGI

SEQ ID NO: 1601979 - protein, 23 aa, Staphylococcus aureus
EPEGSVLNGGPAHAHDTEGIGSE

SEQ ID NO: 1601980 - protein, 21 aa, Staphylococcus aureus
EPEHGSDVAGGLETVAERQGD

SEQ ID NO: 1601981 - protein, 20 aa, Staphylococcus aureus
EPEKYKNRKPDELSGGQRQR

SEQ ID NO: 1601982 - protein, 11 aa, Staphylococcus aureus
EPGVGKTAIAE

SEQ ID NO: 1601983 - protein, 8 aa, Staphylococcus aureus
EPLPDKMP

SEQ ID NO: 1601984 - protein, 5 aa, Staphylococcus aureus
EQARE

SEQ ID NO: 1601985 - protein, 10 aa, Staphylococcus aureus
EQARIAEEAG

SEQ ID NO: 1601986 - protein, 11 aa, Staphylococcus aureus
EQDNQRTFKTE

SEQ ID NO: 1601987 - protein, 5 aa, Staphylococcus aureus
EQEDF

SEQ ID NO: 1601988 - protein, 15 aa, Staphylococcus aureus
EQGMTPDKSYKKSAR

SEQ ID NO: 1601989 - protein, 16 aa, Staphylococcus aureus
EQGVPEESEIDEYESE

SEQ ID NO: 1601990 - protein, 6 aa, Staphylococcus aureus
EQPEAY

SEQ ID NO: 1601991 - protein, 13 aa, Staphylococcus aureus
EQPEDMTGESLIK

SEQ ID NO: 1601992 - protein, 17 aa, Staphylococcus aureus
EQQSEEYKESVIPSSVT

SEQ ID NO: 1601993 - protein, 16 aa, Staphylococcus aureus
ERLNQTVKEDFSNATE

SEQ ID NO: 1601994 - protein, 6 aa, Staphylococcus aureus
ERLPQA

SEQ ID NO: 1601995 - protein, 8 aa, Staphylococcus aureus
ERPELGNE

SEQ ID NO: 1601996 - protein, 14 aa, Staphylococcus aureus
ERTTESKRLKNNPI

SEQ ID NO: 1601997 - protein, 7 aa, Staphylococcus aureus
ERYDGNP

SEQ ID NO: 1601998 - protein, 5 aa, Staphylococcus aureus
ESAEV

SEQ ID NO: 1601999 - protein, 6 aa, Staphylococcus aureus
ESAKAG

SEQ ID NO: 1602000 - protein, 9 aa, Staphylococcus aureus
ESAQARGAN

SEQ ID NO: 1602001 - protein, 8 aa, Staphylococcus aureus
ESASGPFN

SEQ ID NO: 1602002 - protein, 9 aa, Staphylococcus aureus
ESEHASPSM

SEQ ID NO: 1602003 - protein, 5 aa, Staphylococcus aureus
ESGAF

SEQ ID NO: 1602004 - protein, 4 aa, Staphylococcus aureus
ESGE

SEQ ID NO: 1602005 - protein, 7 aa, Staphylococcus aureus
ESGKLEN

SEQ ID NO: 1602006 - protein, 8 aa, Staphylococcus aureus
ESHPEGGF

SEQ ID NO: 1602007 - protein, 10 aa, Staphylococcus aureus
ESLSGTVTPQ

SEQ ID NO: 1602008 - protein, 6 aa, Staphylococcus aureus
ESNATE

SEQ ID NO: 1602009 - protein, 8 aa, Staphylococcus aureus
ESNSNETI

SEQ ID NO: 1602010 - protein, 8 aa, Staphylococcus aureus
ESSGAKVT

SEQ ID NO: 1602011 - protein, 9 aa, Staphylococcus aureus
ESTNGINDD

SEQ ID NO: 1602012 - protein, 7 aa, Staphylococcus aureus
ESTPPLD

SEQ ID NO: 1602013 - protein, 4 aa, Staphylococcus aureus
ESVY

SEQ ID NO: 1602014 - protein, 8 aa, Staphylococcus aureus
ETATEEEV

SEQ ID NO: 1602015 - protein, 16 aa, Staphylococcus aureus
ETDDEINEGDTFGSVE

SEQ ID NO: 1602016 - protein, 18 aa, Staphylococcus aureus
ETDEERESGKANDVVGEQ

SEQ ID NO: 1602017 - protein, 18 aa, Staphylococcus aureus
ETEEEFDKRIESYEEVDN

SEQ ID NO: 1602018 - protein, 5 aa, Staphylococcus aureus
ETESY

SEQ ID NO: 1602019 - protein, 15 aa, Staphylococcus aureus
ETKIGEGTNVTLNIP

SEQ ID NO: 1602020 - protein, 5 aa, Staphylococcus aureus
ETPDT

SEQ ID NO: 1602021 - protein, 5 aa, Staphylococcus aureus
ETPVT

SEQ ID NO: 1602022 - protein, 7 aa, Staphylococcus aureus
ETQGSKF

SEQ ID NO: 1602023 - protein, 8 aa, Staphylococcus aureus
ETRGEKLE

SEQ ID NO: 1602024 - protein, 12 aa, Staphylococcus aureus
ETSTTPEERERA

SEQ ID NO: 1602025 - protein, 6 aa, Staphylococcus aureus
ETSYTS

SEQ ID NO: 1602026 - protein, 5 aa, Staphylococcus aureus
ETTQT

SEQ ID NO: 1602027 - protein, 12 aa, Staphylococcus aureus
EVEGAKEALETY

SEQ ID NO: 1602028 - protein, 7 aa, Staphylococcus aureus
EVGPKGV

SEQ ID NO: 1602029 - protein, 6 aa, Staphylococcus aureus
EVPEPV

SEQ ID NO: 1602030 - protein, 5 aa, Staphylococcus aureus
EVPKI

SEQ ID NO: 1602031 - protein, 7 aa, Staphylococcus aureus
EVQNDKS

SEQ ID NO: 1602032 - protein, 5 aa, Staphylococcus aureus
EVRDE

SEQ ID NO: 1602033 - protein, 8 aa, Staphylococcus aureus
EVSKSLTE

SEQ ID NO: 1602034 - protein, 5 aa, Staphylococcus aureus
EVSTK

SEQ ID NO: 1602035 - protein, 5 aa, Staphylococcus aureus
EVTDT

SEQ ID NO: 1602036 - protein, 9 aa, Staphylococcus aureus
EVTKRREDG

SEQ ID NO: 1602037 - protein, 7 aa, Staphylococcus aureus
EYEEDQE

SEQ ID NO: 1602038 - protein, 8 aa, Staphylococcus aureus
EYENRKDD

SEQ ID NO: 1602039 - protein, 18 aa, Staphylococcus aureus
EYKEDLKKSYEKQLDKLS

SEQ ID NO: 1602040 - protein, 7 aa, Staphylococcus aureus
EYPDSGE

SEQ ID NO: 1602041 - protein, 9 aa, Staphylococcus aureus
FAAADGRVE

SEQ ID NO: 1602042 - protein, 10 aa, Staphylococcus aureus
FAPEMSDPSM

SEQ ID NO: 1602043 - protein, 8 aa, Staphylococcus aureus
FAPGVSAP

SEQ ID NO: 1602044 - protein, 8 aa, Staphylococcus aureus
FEERRGDD

SEQ ID NO: 1602045 - protein, 5 aa, Staphylococcus aureus
FEKAT

SEQ ID NO: 1602046 - protein, 9 aa, Staphylococcus aureus
FENPANPEV

SEQ ID NO: 1602047 - protein, 11 aa, Staphylococcus aureus
FEPQGDQPQAI

SEQ ID NO: 1602048 - protein, 6 aa, Staphylococcus aureus
FETPIN

SEQ ID NO: 1602049 - protein, 6 aa, Staphylococcus aureus
FGDPEA

SEQ ID NO: 1602050 - protein, 18 aa, Staphylococcus aureus
FGQTGPKVGSFDAGYGSG

SEQ ID NO: 1602051 - protein, 11 aa, Staphylococcus aureus
FGYGSTDTGNV

SEQ ID NO: 1602052 - protein, 6 aa, Staphylococcus aureus
FKSNTE

SEQ ID NO: 1602053 - protein, 22 aa, Staphylococcus aureus
FKSSAQVQGKFSRQSGGRGQYG

SEQ ID NO: 1602054 - protein, 4 aa, Staphylococcus aureus
FNTD

SEQ ID NO: 1602055 - protein, 4 aa, Staphylococcus aureus
FPDD

SEQ ID NO: 1602056 - protein, 6 aa, Staphylococcus aureus
FPEGTT

SEQ ID NO: 1602057 - protein, 4 aa, Staphylococcus aureus
FPKG

SEQ ID NO: 1602058 - protein, 9 aa, Staphylococcus aureus
FQPSNSSDY

SEQ ID NO: 1602059 - protein, 7 aa, Staphylococcus aureus
FRPGQEE

SEQ ID NO: 1602060 - protein, 8 aa, Staphylococcus aureus
FSSSSTYS

SEQ ID NO: 1602061 - protein, 21 aa, Staphylococcus aureus
FTLPTNGKRADFLTPNRELAE

SEQ ID NO: 1602062 - protein, 8 aa, Staphylococcus aureus
GADEVDPS

SEQ ID NO: 1602063 - protein, 4 aa, Staphylococcus aureus
GAGL

SEQ ID NO: 1602064 - protein, 9 aa, Staphylococcus aureus
GAKATGMSR

SEQ ID NO: 1602065 - protein, 9 aa, Staphylococcus aureus
GAKDETISK

SEQ ID NO: 1602066 - protein, 8 aa, Staphylococcus aureus
GAKGKRFA

SEQ ID NO: 1602067 - protein, 10 aa, Staphylococcus aureus
GAKGPNGATV

SEQ ID NO: 1602068 - protein, 5 aa, Staphylococcus aureus
GANGI

SEQ ID NO: 1602069 - protein, 10 aa, Staphylococcus aureus
GANGSGKTTL

SEQ ID NO: 1602070 - protein, 7 aa, Staphylococcus aureus
GAQAAPH

SEQ ID NO: 1602071 - protein, 5 aa, Staphylococcus aureus
GAQGI

SEQ ID NO: 1602072 - protein, 9 aa, Staphylococcus aureus
GARSDGADN

SEQ ID NO: 1602073 - protein, 8 aa, Staphylococcus aureus
GASAPGDL

SEQ ID NO: 1602074 - protein, 7 aa, Staphylococcus aureus
GASGGVG

SEQ ID NO: 1602075 - protein, 9 aa, Staphylococcus aureus
GASGSGKTT

SEQ ID NO: 1602076 - protein, 10 aa, Staphylococcus aureus
GASPIVSGEL

SEQ ID NO: 1602077 - protein, 6 aa, Staphylococcus aureus
GASTYR

SEQ ID NO: 1602078 - protein, 4 aa, Staphylococcus aureus
GATF

SEQ ID NO: 1602079 - protein, 9 aa, Staphylococcus aureus
GATGTGKTF

SEQ ID NO: 1602080 - protein, 7 aa, Staphylococcus aureus
GAYGGEV

SEQ ID NO: 1602081 - protein, 4 aa, Staphylococcus aureus
GCGE

SEQ ID NO: 1602082 - protein, 9 aa, Staphylococcus aureus
GCNESPEEV

SEQ ID NO: 1602083 - protein, 6 aa, Staphylococcus aureus
GDENKA

SEQ ID NO: 1602084 - protein, 4 aa, Staphylococcus aureus
GDGA

SEQ ID NO: 1602085 - protein, 14 aa, Staphylococcus aureus
GDGAGVGNPLSEHP

SEQ ID NO: 1602086 - protein, 6 aa, Staphylococcus aureus
GDGGKL

SEQ ID NO: 1602087 - protein, 11 aa, Staphylococcus aureus
GDIPDRKTGLE

SEQ ID NO: 1602088 - protein, 9 aa, Staphylococcus aureus
GDIPDYQAS

SEQ ID NO: 1602089 - protein, 4 aa, Staphylococcus aureus
GDLV

SEQ ID NO: 1602090 - protein, 8 aa, Staphylococcus aureus
GDPGIGKS

SEQ ID NO: 1602091 - protein, 9 aa, Staphylococcus aureus
GDRSTSSLK

SEQ ID NO: 1602092 - protein, 8 aa, Staphylococcus aureus
GDRVTSET

SEQ ID NO: 1602093 - protein, 8 aa, Staphylococcus aureus
GDSAVEEG

SEQ ID NO: 1602094 - protein, 11 aa, Staphylococcus aureus
GDSGIGKSETA

SEQ ID NO: 1602095 - protein, 8 aa, Staphylococcus aureus
GDTGRIKK

SEQ ID NO: 1602096 - protein, 7 aa, Staphylococcus aureus
GDTIEED

SEQ ID NO: 1602097 - protein, 16 aa, Staphylococcus aureus
GEDQQFEGKLKTGQTV

SEQ ID NO: 1602098 - protein, 19 aa, Staphylococcus aureus
GEEGLSKPIKNADISRPGL

SEQ ID NO: 1602099 - protein, 18 aa, Staphylococcus aureus
GEFKDSDKIGKEFYTDGP

SEQ ID NO: 1602100 - protein, 8 aa, Staphylococcus aureus
GEGELPDQ

SEQ ID NO: 1602101 - protein, 5 aa, Staphylococcus aureus
GEGKD

SEQ ID NO: 1602102 - protein, 10 aa, Staphylococcus aureus
GEIGKNTYAV

SEQ ID NO: 1602103 - protein, 8 aa, Staphylococcus aureus
GEKAPSIL

SEQ ID NO: 1602104 - protein, 12 aa, Staphylococcus aureus
GEKIPRKGGQGM

SEQ ID NO: 1602105 - protein, 12 aa, Staphylococcus aureus
GERDLTKTPEMG

SEQ ID NO: 1602106 - protein, 8 aa, Staphylococcus aureus
GERTREGN

SEQ ID NO: 1602107 - protein, 13 aa, Staphylococcus aureus
GESGCGKSTTGKS

SEQ ID NO: 1602108 - protein, 6 aa, Staphylococcus aureus
GESTDY

SEQ ID NO: 1602109 - protein, 4 aa, Staphylococcus aureus
GETH

SEQ ID NO: 1602110 - protein, 8 aa, Staphylococcus aureus
GETTLEDI

SEQ ID NO: 1602111 - protein, 4 aa, Staphylococcus aureus
GETV

SEQ ID NO: 1602112 - protein, 16 aa, Staphylococcus aureus
GEYDPSVTSASKQLEE

SEQ ID NO: 1602113 - protein, 13 aa, Staphylococcus aureus
GFGGSSDGQDYET

SEQ ID NO: 1602114 - protein, 10 aa, Staphylococcus aureus
GFGNTTTSIP

SEQ ID NO: 1602115 - protein, 11 aa, Staphylococcus aureus
GFSGGEKKRNE

SEQ ID NO: 1602116 - protein, 5 aa, Staphylococcus aureus
GGDGT

SEQ ID NO: 1602117 - protein, 9 aa, Staphylococcus aureus
GGGDSAAAA

SEQ ID NO: 1602118 - protein, 4 aa, Staphylococcus aureus
GGGG

SEQ ID NO: 1602119 - protein, 12 aa, Staphylococcus aureus
GGHAAKPEQCND

SEQ ID NO: 1602120 - protein, 10 aa, Staphylococcus aureus
GGINSPESAL

SEQ ID NO: 1602121 - protein, 8 aa, Staphylococcus aureus
GGKGSQVA

SEQ ID NO: 1602122 - protein, 9 aa, Staphylococcus aureus
GGKSKGEAI

SEQ ID NO: 1602123 - protein, 8 aa, Staphylococcus aureus
GGKTEGAI

SEQ ID NO: 1602124 - protein, 7 aa, Staphylococcus aureus
GGLRTPL

SEQ ID NO: 1602125 - protein, 10 aa, Staphylococcus aureus
GGPASGSAAI

SEQ ID NO: 1602126 - protein, 10 aa, Staphylococcus aureus
GGPGKPEGLE

SEQ ID NO: 1602127 - protein, 15 aa, Staphylococcus aureus
GGPPASAIKAGKQGV

SEQ ID NO: 1602128 - protein, 4 aa, Staphylococcus aureus
GGPT

SEQ ID NO: 1602129 - protein, 7 aa, Staphylococcus aureus
GGQDSTT

SEQ ID NO: 1602130 - protein, 7 aa, Staphylococcus aureus
GGRGRRA

SEQ ID NO: 1602131 - protein, 9 aa, Staphylococcus aureus
GGRGSQSAI

SEQ ID NO: 1602132 - protein, 12 aa, Staphylococcus aureus
GGRNEEFKGERR

SEQ ID NO: 1602133 - protein, 4 aa, Staphylococcus aureus
GGRY

SEQ ID NO: 1602134 - protein, 8 aa, Staphylococcus aureus
GGSHSDAP

SEQ ID NO: 1602135 - protein, 7 aa, Staphylococcus aureus
GGSLAGS

SEQ ID NO: 1602136 - protein, 7 aa, Staphylococcus aureus
GGSREHE

SEQ ID NO: 1602137 - protein, 5 aa, Staphylococcus aureus
GGSRI

SEQ ID NO: 1602138 - protein, 4 aa, Staphylococcus aureus
GGTL

SEQ ID NO: 1602139 - protein, 4 aa, Staphylococcus aureus
GGVH

SEQ ID NO: 1602140 - protein, 10 aa, Staphylococcus aureus
GHIGDSAETL

SEQ ID NO: 1602141 - protein, 4 aa, Staphylococcus aureus
GHSD

SEQ ID NO: 1602142 - protein, 4 aa, Staphylococcus aureus
GHSE

SEQ ID NO: 1602143 - protein, 5 aa, Staphylococcus aureus
GHSLG

SEQ ID NO: 1602144 - protein, 5 aa, Staphylococcus aureus
GIGGY

SEQ ID NO: 1602145 - protein, 6 aa, Staphylococcus aureus
GKAARN

SEQ ID NO: 1602146 - protein, 5 aa, Staphylococcus aureus
GKDAE

SEQ ID NO: 1602147 - protein, 7 aa, Staphylococcus aureus
GKDISDN

SEQ ID NO: 1602148 - protein, 12 aa, Staphylococcus aureus
GKELPGIKAINN

SEQ ID NO: 1602149 - protein, 4 aa, Staphylococcus aureus
GKEY

SEQ ID NO: 1602150 - protein, 18 aa, Staphylococcus aureus
GKFGGGGYKVSGGLHGVG

SEQ ID NO: 1602151 - protein, 9 aa, Staphylococcus aureus
GKFRDSVHS

SEQ ID NO: 1602152 - protein, 9 aa, Staphylococcus aureus
GKGSKHKPR

SEQ ID NO: 1602153 - protein, 5 aa, Staphylococcus aureus
GKHGI

SEQ ID NO: 1602154 - protein, 10 aa, Staphylococcus aureus
GKIADTPEEA

SEQ ID NO: 1602155 - protein, 37 aa, Staphylococcus aureus
GKKTGNTPDGRKAGEPFAPGANPMHGRDQKGALSSLS

SEQ ID NO: 1602156 - protein, 17 aa, Staphylococcus aureus
GKLDGGAQRVPVATGSL

SEQ ID NO: 1602157 - protein, 5 aa, Staphylococcus aureus
GKLKS

SEQ ID NO: 1602158 - protein, 5 aa, Staphylococcus aureus
GKNKD

SEQ ID NO: 1602159 - protein, 7 aa, Staphylococcus aureus
GKPFDSS

SEQ ID NO: 1602160 - protein, 4 aa, Staphylococcus aureus
GKRP

SEQ ID NO: 1602161 - protein, 8 aa, Staphylococcus aureus
GKRYNRET

SEQ ID NO: 1602162 - protein, 9 aa, Staphylococcus aureus
GKSDKKRVQ

SEQ ID NO: 1602163 - protein, 8 aa, Staphylococcus aureus
GKTDENEM

SEQ ID NO: 1602164 - protein, 8 aa, Staphylococcus aureus
GKTGSGKT

SEQ ID NO: 1602165 - protein, 5 aa, Staphylococcus aureus
GKTYE

SEQ ID NO: 1602166 - protein, 5 aa, Staphylococcus aureus
GKVSK

SEQ ID NO: 1602167 - protein, 6 aa, Staphylococcus aureus
GKYGNY

SEQ ID NO: 1602168 - protein, 5 aa, Staphylococcus aureus
GLDTS

SEQ ID NO: 1602169 - protein, 7 aa, Staphylococcus aureus
GLHPGRT

SEQ ID NO: 1602170 - protein, 12 aa, Staphylococcus aureus
GLMPNPKTGTVT

SEQ ID NO: 1602171 - protein, 14 aa, Staphylococcus aureus
GLNKDDARKEFGEE

SEQ ID NO: 1602172 - protein, 5 aa, Staphylococcus aureus
GLPLT

SEQ ID NO: 1602173 - protein, 5 aa, Staphylococcus aureus
GLPNE

SEQ ID NO: 1602174 - protein, 7 aa, Staphylococcus aureus
GLSETQD

SEQ ID NO: 1602175 - protein, 8 aa, Staphylococcus aureus
GLSGEELK

SEQ ID NO: 1602176 - protein, 13 aa, Staphylococcus aureus
GLTSKEAAAQHYD

SEQ ID NO: 1602177 - protein, 8 aa, Staphylococcus aureus
GMDENDWD

SEQ ID NO: 1602178 - protein, 6 aa, Staphylococcus aureus
GNAGNI

SEQ ID NO: 1602179 - protein, 7 aa, Staphylococcus aureus
GNDTAME

SEQ ID NO: 1602180 - protein, 14 aa, Staphylococcus aureus
GNESKGITAPHHNP

SEQ ID NO: 1602181 - protein, 7 aa, Staphylococcus aureus
GNETYKT

SEQ ID NO: 1602182 - protein, 9 aa, Staphylococcus aureus
GNGGTEVEK

SEQ ID NO: 1602183 - protein, 7 aa, Staphylococcus aureus
GNKDHVA

SEQ ID NO: 1602184 - protein, 6 aa, Staphylococcus aureus
GNKNNR

SEQ ID NO: 1602185 - protein, 19 aa, Staphylococcus aureus
GNPASWDKATNALKESNGL

SEQ ID NO: 1602186 - protein, 23 aa, Staphylococcus aureus
GNPEMSNKNAQASKSNNTPTLDS

SEQ ID NO: 1602187 - protein, 8 aa, Staphylococcus aureus
GNQFPEGV

SEQ ID NO: 1602188 - protein, 6 aa, Staphylococcus aureus
GNWTPT

SEQ ID NO: 1602189 - protein, 4 aa, Staphylococcus aureus
GNYA

SEQ ID NO: 1602190 - protein, 5 aa, Staphylococcus aureus
GNYQI

SEQ ID NO: 1602191 - protein, 5 aa, Staphylococcus aureus
GPFIG

SEQ ID NO: 1602192 - protein, 21 aa, Staphylococcus aureus
GPGAGEHGGQIVSSGTPQKVM

SEQ ID NO: 1602193 - protein, 7 aa, Staphylococcus aureus
GPHDANN

SEQ ID NO: 1602194 - protein, 5 aa, Staphylococcus aureus
GPHKG

SEQ ID NO: 1602195 - protein, 6 aa, Staphylococcus aureus
GPIDES

SEQ ID NO: 1602196 - protein, 12 aa, Staphylococcus aureus
GPNGTGKSTLSS

SEQ ID NO: 1602197 - protein, 11 aa, Staphylococcus aureus
GPNKDIPAPDV

SEQ ID NO: 1602198 - protein, 12 aa, Staphylococcus aureus
GPNKQAAQIEGS

SEQ ID NO: 1602199 - protein, 7 aa, Staphylococcus aureus
GQSLPNS

SEQ ID NO: 1602200 - protein, 8 aa, Staphylococcus aureus
GQSPTLSA

SEQ ID NO: 1602201 - protein, 16 aa, Staphylococcus aureus
GQSQRRVGGIGTGGGM

SEQ ID NO: 1602202 - protein, 7 aa, Staphylococcus aureus
GRARRGE

SEQ ID NO: 1602203 - protein, 9 aa, Staphylococcus aureus
GRFSETSRE

SEQ ID NO: 1602204 - protein, 12 aa, Staphylococcus aureus
GRITGAGTDTIT

SEQ ID NO: 1602205 - protein, 14 aa, Staphylococcus aureus
GRNPKYNFEREEKF

SEQ ID NO: 1602206 - protein, 15 aa, Staphylococcus aureus
GRPTQFGISEDEVDD

SEQ ID NO: 1602207 - protein, 6 aa, Staphylococcus aureus
GRPYRA

SEQ ID NO: 1602208 - protein, 7 aa, Staphylococcus aureus
GRRGYEH

SEQ ID NO: 1602209 - protein, 9 aa, Staphylococcus aureus
GRSGSGKTT

SEQ ID NO: 1602210 - protein, 9 aa, Staphylococcus aureus
GRSSTRKEE

SEQ ID NO: 1602211 - protein, 11 aa, Staphylococcus aureus
GSDEAGSGDYF

SEQ ID NO: 1602212 - protein, 9 aa, Staphylococcus aureus
GSDGTGGKH

SEQ ID NO: 1602213 - protein, 8 aa, Staphylococcus aureus
GSESKKLN

SEQ ID NO: 1602214 - protein, 6 aa, Staphylococcus aureus
GSGKTT

SEQ ID NO: 1602215 - protein, 13 aa, Staphylococcus aureus
GSGNKATQTVTSG

SEQ ID NO: 1602216 - protein, 5 aa, Staphylococcus aureus
GSHDG

SEQ ID NO: 1602217 - protein, 10 aa, Staphylococcus aureus
GSHGRDRSTA

SEQ ID NO: 1602218 - protein, 23 aa, Staphylococcus aureus
GSKTINMTNEEVEVSKSIGKQDF

SEQ ID NO: 1602219 - protein, 5 aa, Staphylococcus aureus
GSNFE

SEQ ID NO: 1602220 - protein, 8 aa, Staphylococcus aureus
GSQGEPMA

SEQ ID NO: 1602221 - protein, 6 aa, Staphylococcus aureus
GSRPIE

SEQ ID NO: 1602222 - protein, 6 aa, Staphylococcus aureus
GSSFEK

SEQ ID NO: 1602223 - protein, 11 aa, Staphylococcus aureus
GSSRSGSKDFQ

SEQ ID NO: 1602224 - protein, 10 aa, Staphylococcus aureus
GSSSGAALQG

SEQ ID NO: 1602225 - protein, 10 aa, Staphylococcus aureus
GSSSSRTQRL

SEQ ID NO: 1602226 - protein, 5 aa, Staphylococcus aureus
GSSTL

SEQ ID NO: 1602227 - protein, 5 aa, Staphylococcus aureus
GSTLP

SEQ ID NO: 1602228 - protein, 8 aa, Staphylococcus aureus
GSTTTEPI

SEQ ID NO: 1602229 - protein, 10 aa, Staphylococcus aureus
GSVNNPETSS

SEQ ID NO: 1602230 - protein, 13 aa, Staphylococcus aureus
GSYGRNSISHNVS

SEQ ID NO: 1602231 - protein, 8 aa, Staphylococcus aureus
GTCPSSTI

SEQ ID NO: 1602232 - protein, 10 aa, Staphylococcus aureus
GTDPTGGAGV

SEQ ID NO: 1602233 - protein, 5 aa, Staphylococcus aureus
GTDTF

SEQ ID NO: 1602234 - protein, 9 aa, Staphylococcus aureus
GTGIPTKDI

SEQ ID NO: 1602235 - protein, 5 aa, Staphylococcus aureus
GTGSG

SEQ ID NO: 1602236 - protein, 5 aa, Staphylococcus aureus
GTGTS

SEQ ID NO: 1602237 - protein, 5 aa, Staphylococcus aureus
GTGVV

SEQ ID NO: 1602238 - protein, 17 aa, Staphylococcus aureus
GTNTQNYQDGFKKESQR

SEQ ID NO: 1602239 - protein, 6 aa, Staphylococcus aureus
GTSGRL

SEQ ID NO: 1602240 - protein, 5 aa, Staphylococcus aureus
GTTAS

SEQ ID NO: 1602241 - protein, 10 aa, Staphylococcus aureus
GTYKGKKVSV

SEQ ID NO: 1602242 - protein, 5 aa, Staphylococcus aureus
GVDQN

SEQ ID NO: 1602243 - protein, 12 aa, Staphylococcus aureus
GVGSDYPLSREK

SEQ ID NO: 1602244 - protein, 4 aa, Staphylococcus aureus
GVNG

SEQ ID NO: 1602245 - protein, 4 aa, Staphylococcus aureus
GVRS

SEQ ID NO: 1602246 - protein, 10 aa, Staphylococcus aureus
GVSGSGKSSL

SEQ ID NO: 1602247 - protein, 9 aa, Staphylococcus aureus
GVTDEELKE

SEQ ID NO: 1602248 - protein, 7 aa, Staphylococcus aureus
GYGNKEI

SEQ ID NO: 1602249 - protein, 10 aa, Staphylococcus aureus
HADKETQYAQ

SEQ ID NO: 1602250 - protein, 4 aa, Staphylococcus aureus
HAKT

SEQ ID NO: 1602251 - protein, 6 aa, Staphylococcus aureus
HDADNH

SEQ ID NO: 1602252 - protein, 13 aa, Staphylococcus aureus
HDSARKAGRIPSG

SEQ ID NO: 1602253 - protein, 7 aa, Staphylococcus aureus
HDSPYSI

SEQ ID NO: 1602254 - protein, 8 aa, Staphylococcus aureus
HDTSGNGL

SEQ ID NO: 1602255 - protein, 8 aa, Staphylococcus aureus
HDVKGDVY

SEQ ID NO: 1602256 - protein, 6 aa, Staphylococcus aureus
HEDGDA

SEQ ID NO: 1602257 - protein, 5 aa, Staphylococcus aureus
HEEAP

SEQ ID NO: 1602258 - protein, 4 aa, Staphylococcus aureus
HEEG

SEQ ID NO: 1602259 - protein, 4 aa, Staphylococcus aureus
HEHG

SEQ ID NO: 1602260 - protein, 5 aa, Staphylococcus aureus
HFSDE

SEQ ID NO: 1602261 - protein, 7 aa, Staphylococcus aureus
HGETGVE

SEQ ID NO: 1602262 - protein, 12 aa, Staphylococcus aureus
HGGTKSIANQES

SEQ ID NO: 1602263 - protein, 7 aa, Staphylococcus aureus
HGHSKGV

SEQ ID NO: 1602264 - protein, 6 aa, Staphylococcus aureus
HGLTKN

SEQ ID NO: 1602265 - protein, 5 aa, Staphylococcus aureus
HGQDH

SEQ ID NO: 1602266 - protein, 10 aa, Staphylococcus aureus
HGTSTPVGDL

SEQ ID NO: 1602267 - protein, 5 aa, Staphylococcus aureus
HKETY

SEQ ID NO: 1602268 - protein, 12 aa, Staphylococcus aureus
HKGQIPGVKKSS

SEQ ID NO: 1602269 - protein, 6 aa, Staphylococcus aureus
HKPARS

SEQ ID NO: 1602270 - protein, 9 aa, Staphylococcus aureus
HLEDKEGTT

SEQ ID NO: 1602271 - protein, 4 aa, Staphylococcus aureus
HLPE

SEQ ID NO: 1602272 - protein, 12 aa, Staphylococcus aureus
HNAEEVKKRPHF

SEQ ID NO: 1602273 - protein, 7 aa, Staphylococcus aureus
HNRENDL

SEQ ID NO: 1602274 - protein, 18 aa, Staphylococcus aureus
HNYKTAREKALSNNHIPE

SEQ ID NO: 1602275 - protein, 18 aa, Staphylococcus aureus
HPQSDYAKQLISEVAVIA

SEQ ID NO: 1602276 - protein, 4 aa, Staphylococcus aureus
HQDL

SEQ ID NO: 1602277 - protein, 22 aa, Staphylococcus aureus
HQELDGSETVVSGASCTTNSLA

SEQ ID NO: 1602278 - protein, 4 aa, Staphylococcus aureus
HQMK

SEQ ID NO: 1602279 - protein, 9 aa, Staphylococcus aureus
HQSASIPDD

SEQ ID NO: 1602280 - protein, 4 aa, Staphylococcus aureus
HREN

SEQ ID NO: 1602281 - protein, 9 aa, Staphylococcus aureus
HRRQSPEKV

SEQ ID NO: 1602282 - protein, 11 aa, Staphylococcus aureus
HRSGETEDTTI

SEQ ID NO: 1602283 - protein, 11 aa, Staphylococcus aureus
HRTRKENERSY

SEQ ID NO: 1602284 - protein, 4 aa, Staphylococcus aureus
HSDA

SEQ ID NO: 1602285 - protein, 7 aa, Staphylococcus aureus
HSFTKAQ

SEQ ID NO: 1602286 - protein, 13 aa, Staphylococcus aureus
HSGCATGGSCNCS

SEQ ID NO: 1602287 - protein, 8 aa, Staphylococcus aureus
HSLEGAKT

SEQ ID NO: 1602288 - protein, 8 aa, Staphylococcus aureus
HSSQPQEI

SEQ ID NO: 1602289 - protein, 12 aa, Staphylococcus aureus
HTRRSDAFPESF

SEQ ID NO: 1602290 - protein, 7 aa, Staphylococcus aureus
HTRTTRA

SEQ ID NO: 1602291 - protein, 10 aa, Staphylococcus aureus
HTSKQKKFIP

SEQ ID NO: 1602292 - protein, 15 aa, Staphylococcus aureus
HTTDDYTGAVTTPIY

SEQ ID NO: 1602293 - protein, 14 aa, Staphylococcus aureus
HVRSKNEDESSPII

SEQ ID NO: 1602294 - protein, 7 aa, Staphylococcus aureus
HYSPNTP

SEQ ID NO: 1602295 - protein, 7 aa, Staphylococcus aureus
IAEPGDT

SEQ ID NO: 1602296 - protein, 6 aa, Staphylococcus aureus
IAGQPL

SEQ ID NO: 1602297 - protein, 5 aa, Staphylococcus aureus
IAGSG

SEQ ID NO: 1602298 - protein, 20 aa, Staphylococcus aureus
IANADDPVEAAKQCRAAIEG

SEQ ID NO: 1602299 - protein, 6 aa, Staphylococcus aureus
IAPKTM

SEQ ID NO: 1602300 - protein, 6 aa, Staphylococcus aureus
IAQDQG

SEQ ID NO: 1602301 - protein, 9 aa, Staphylococcus aureus
IAQNNDKEM

SEQ ID NO: 1602302 - protein, 8 aa, Staphylococcus aureus
IDDEGKLN

SEQ ID NO: 1602303 - protein, 6 aa, Staphylococcus aureus
IDDGSR

SEQ ID NO: 1602304 - protein, 5 aa, Staphylococcus aureus
IDDLT

SEQ ID NO: 1602305 - protein, 10 aa, Staphylococcus aureus
IDGATGQNAM

SEQ ID NO: 1602306 - protein, 6 aa, Staphylococcus aureus
IDPKSQ

SEQ ID NO: 1602307 - protein, 15 aa, Staphylococcus aureus
IDQKTTSKNPRSTVA

SEQ ID NO: 1602308 - protein, 5 aa, Staphylococcus aureus
IDSSQ

SEQ ID NO: 1602309 - protein, 6 aa, Staphylococcus aureus
IDTEPY

SEQ ID NO: 1602310 - protein, 4 aa, Staphylococcus aureus
IDTQ

SEQ ID NO: 1602311 - protein, 6 aa, Staphylococcus aureus
IEGKSV

SEQ ID NO: 1602312 - protein, 4 aa, Staphylococcus aureus
IEGS

SEQ ID NO: 1602313 - protein, 6 aa, Staphylococcus aureus
IEGTLT

SEQ ID NO: 1602314 - protein, 17 aa, Staphylococcus aureus
IEKGDQFGHVNESKGQN

SEQ ID NO: 1602315 - protein, 6 aa, Staphylococcus aureus
IENGIG

SEQ ID NO: 1602316 - protein, 11 aa, Staphylococcus aureus
IETKSNPNDLV

SEQ ID NO: 1602317 - protein, 12 aa, Staphylococcus aureus
IETKVGKGYMAH

SEQ ID NO: 1602318 - protein, 11 aa, Staphylococcus aureus
IFSTNQENELR

SEQ ID NO: 1602319 - protein, 10 aa, Staphylococcus aureus
IGDKVEEGES

SEQ ID NO: 1602320 - protein, 18 aa, Staphylococcus aureus
IGEAPDAADFKDEGSHTL

SEQ ID NO: 1602321 - protein, 6 aa, Staphylococcus aureus
IGGDKE

SEQ ID NO: 1602322 - protein, 8 aa, Staphylococcus aureus
IGGETAEM

SEQ ID NO: 1602323 - protein, 10 aa, Staphylococcus aureus
IGGGNSGVEA

SEQ ID NO: 1602324 - protein, 6 aa, Staphylococcus aureus
IGTGST

SEQ ID NO: 1602325 - protein, 4 aa, Staphylococcus aureus
IHAR

SEQ ID NO: 1602326 - protein, 12 aa, Staphylococcus aureus
IHTSGHGSQGDQ

SEQ ID NO: 1602327 - protein, 6 aa, Staphylococcus aureus
IKDNDT

SEQ ID NO: 1602328 - protein, 4 aa, Staphylococcus aureus
IKEI

SEQ ID NO: 1602329 - protein, 7 aa, Staphylococcus aureus
IKKSDSH

SEQ ID NO: 1602330 - protein, 9 aa, Staphylococcus aureus
IKNTKNGTV

SEQ ID NO: 1602331 - protein, 17 aa, Staphylococcus aureus
INETKTKGANTTPETVS

SEQ ID NO: 1602332 - protein, 5 aa, Staphylococcus aureus
INRPE

SEQ ID NO: 1602333 - protein, 6 aa, Staphylococcus aureus
IPEAEQ

SEQ ID NO: 1602334 - protein, 10 aa, Staphylococcus aureus
IPEEDDETKY

SEQ ID NO: 1602335 - protein, 5 aa, Staphylococcus aureus
IPENK

SEQ ID NO: 1602336 - protein, 6 aa, Staphylococcus aureus
IPGEEQ

SEQ ID NO: 1602337 - protein, 4 aa, Staphylococcus aureus
IPQG

SEQ ID NO: 1602338 - protein, 14 aa, Staphylococcus aureus
IPQPDPESERSRKR

SEQ ID NO: 1602339 - protein, 9 aa, Staphylococcus aureus
IPSDKVSSV

SEQ ID NO: 1602340 - protein, 6 aa, Staphylococcus aureus
IQGAET

SEQ ID NO: 1602341 - protein, 15 aa, Staphylococcus aureus
IQNAPGVRKANSELH

SEQ ID NO: 1602342 - protein, 4 aa, Staphylococcus aureus
IQNP

SEQ ID NO: 1602343 - protein, 11 aa, Staphylococcus aureus
IQPDANAEGYV

SEQ ID NO: 1602344 - protein, 12 aa, Staphylococcus aureus
IQQFGTPTDIYD

SEQ ID NO: 1602345 - protein, 16 aa, Staphylococcus aureus
IQTTKSKNDAALYGCL

SEQ ID NO: 1602346 - protein, 8 aa, Staphylococcus aureus
IRKEEGYD

SEQ ID NO: 1602347 - protein, 10 aa, Staphylococcus aureus
IRNTKESGYR

SEQ ID NO: 1602348 - protein, 14 aa, Staphylococcus aureus
ISAQENERKRISRE

SEQ ID NO: 1602349 - protein, 4 aa, Staphylococcus aureus
ISAT

SEQ ID NO: 1602350 - protein, 7 aa, Staphylococcus aureus
ISEEEAT

SEQ ID NO: 1602351 - protein, 6 aa, Staphylococcus aureus
ISEGEK

SEQ ID NO: 1602352 - protein, 11 aa, Staphylococcus aureus
ISEPDENGNRT

SEQ ID NO: 1602353 - protein, 6 aa, Staphylococcus aureus
ISPIEQ

SEQ ID NO: 1602354 - protein, 14 aa, Staphylococcus aureus
ISPKPPSSTMTPDL

SEQ ID NO: 1602355 - protein, 9 aa, Staphylococcus aureus
ISQQDSEQI

SEQ ID NO: 1602356 - protein, 4 aa, Staphylococcus aureus
ISST

SEQ ID NO: 1602357 - protein, 9 aa, Staphylococcus aureus
ISTGGGASL

SEQ ID NO: 1602358 - protein, 6 aa, Staphylococcus aureus
ITDGGF

SEQ ID NO: 1602359 - protein, 8 aa, Staphylococcus aureus
ITGAPKLN

SEQ ID NO: 1602360 - protein, 10 aa, Staphylococcus aureus
ITPVPGGVGP

SEQ ID NO: 1602361 - protein, 9 aa, Staphylococcus aureus
ITQKGNART

SEQ ID NO: 1602362 - protein, 4 aa, Staphylococcus aureus
ITSG

SEQ ID NO: 1602363 - protein, 12 aa, Staphylococcus aureus
KAAEELEKDGYS

SEQ ID NO: 1602364 - protein, 7 aa, Staphylococcus aureus
KAAKDFK

SEQ ID NO: 1602365 - protein, 10 aa, Staphylococcus aureus
KAAVGAPPMS

SEQ ID NO: 1602366 - protein, 6 aa, Staphylococcus aureus
KAAYPI

SEQ ID NO: 1602367 - protein, 5 aa, Staphylococcus aureus
KAGYT

SEQ ID NO: 1602368 - protein, 7 aa, Staphylococcus aureus
KAHNEPS

SEQ ID NO: 1602369 - protein, 4 aa, Staphylococcus aureus
KAHT

SEQ ID NO: 1602370 - protein, 11 aa, Staphylococcus aureus
KALEGDAQYEE

SEQ ID NO: 1602371 - protein, 16 aa, Staphylococcus aureus
KARDGKLTADEMKGAT

SEQ ID NO: 1602372 - protein, 8 aa, Staphylococcus aureus
KAREVRDT

SEQ ID NO: 1602373 - protein, 7 aa, Staphylococcus aureus
KARTTAI

SEQ ID NO: 1602374 - protein, 8 aa, Staphylococcus aureus
KASEHATR

SEQ ID NO: 1602375 - protein, 8 aa, Staphylococcus aureus
KASNDSNL

SEQ ID NO: 1602376 - protein, 7 aa, Staphylococcus aureus
KASYEAK

SEQ ID NO: 1602377 - protein, 7 aa, Staphylococcus aureus
KAVEAEP

SEQ ID NO: 1602378 - protein, 6 aa, Staphylococcus aureus
KCRPIE

SEQ ID NO: 1602379 - protein, 7 aa, Staphylococcus aureus
KDDNGQV

SEQ ID NO: 1602380 - protein, 4 aa, Staphylococcus aureus
KDEN

SEQ ID NO: 1602381 - protein, 11 aa, Staphylococcus aureus
KDESGKVTPTF

SEQ ID NO: 1602382 - protein, 7 aa, Staphylococcus aureus
KDETETY

SEQ ID NO: 1602383 - protein, 10 aa, Staphylococcus aureus
KDGNRNIEAV

SEQ ID NO: 1602384 - protein, 7 aa, Staphylococcus aureus
KDGREDE

SEQ ID NO: 1602385 - protein, 17 aa, Staphylococcus aureus
KDIDNYRTVEESYRQGQ

SEQ ID NO: 1602386 - protein, 7 aa, Staphylococcus aureus
KDIEGND

SEQ ID NO: 1602387 - protein, 7 aa, Staphylococcus aureus
KDKETLH

SEQ ID NO: 1602388 - protein, 8 aa, Staphylococcus aureus
KDKTEDQL

SEQ ID NO: 1602389 - protein, 9 aa, Staphylococcus aureus
KDMQEDKEG

SEQ ID NO: 1602390 - protein, 8 aa, Staphylococcus aureus
KDMSDQEW

SEQ ID NO: 1602391 - protein, 6 aa, Staphylococcus aureus
KDNDDI

SEQ ID NO: 1602392 - protein, 8 aa, Staphylococcus aureus
KDNDNLTD

SEQ ID NO: 1602393 - protein, 6 aa, Staphylococcus aureus
KDNTDI

SEQ ID NO: 1602394 - protein, 8 aa, Staphylococcus aureus
KDPNDDKD

SEQ ID NO: 1602395 - protein, 7 aa, Staphylococcus aureus
KDQADKV

SEQ ID NO: 1602396 - protein, 5 aa, Staphylococcus aureus
KDQEA

SEQ ID NO: 1602397 - protein, 6 aa, Staphylococcus aureus
KDQHPY

SEQ ID NO: 1602398 - protein, 7 aa, Staphylococcus aureus
KDSALER

SEQ ID NO: 1602399 - protein, 12 aa, Staphylococcus aureus
KDSDKTDDLTYS

SEQ ID NO: 1602400 - protein, 12 aa, Staphylococcus aureus
KDSDPDSELAET

SEQ ID NO: 1602401 - protein, 24 aa, Staphylococcus aureus
KDSEDKLTSIKRQTESRRGGKGSR

SEQ ID NO: 1602402 - protein, 7 aa, Staphylococcus aureus
KDSGANK

SEQ ID NO: 1602403 - protein, 10 aa, Staphylococcus aureus
KDTGKLKMNG

SEQ ID NO: 1602404 - protein, 16 aa, Staphylococcus aureus
KDTKHNQAVVLQQLLN

SEQ ID NO: 1602405 - protein, 6 aa, Staphylococcus aureus
KDVGNI

SEQ ID NO: 1602406 - protein, 6 aa, Staphylococcus aureus
KDYDTT

SEQ ID NO: 1602407 - protein, 8 aa, Staphylococcus aureus
KEATGLGL

SEQ ID NO: 1602408 - protein, 10 aa, Staphylococcus aureus
KEDGTLASTN

SEQ ID NO: 1602409 - protein, 7 aa, Staphylococcus aureus
KEEATRR

SEQ ID NO: 1602410 - protein, 7 aa, Staphylococcus aureus
KEEKDNL

SEQ ID NO: 1602411 - protein, 5 aa, Staphylococcus aureus
KEELP

SEQ ID NO: 1602412 - protein, 7 aa, Staphylococcus aureus
KEESGTG

SEQ ID NO: 1602413 - protein, 5 aa, Staphylococcus aureus
KEEYG

SEQ ID NO: 1602414 - protein, 6 aa, Staphylococcus aureus
KEFSDE

SEQ ID NO: 1602415 - protein, 6 aa, Staphylococcus aureus
KEGFLR

SEQ ID NO: 1602416 - protein, 10 aa, Staphylococcus aureus
KEHKDATHNC

SEQ ID NO: 1602417 - protein, 6 aa, Staphylococcus aureus
KEIPDA

SEQ ID NO: 1602418 - protein, 5 aa, Staphylococcus aureus
KELEE

SEQ ID NO: 1602419 - protein, 5 aa, Staphylococcus aureus
KELNT

SEQ ID NO: 1602420 - protein, 11 aa, Staphylococcus aureus
KELQPDIPTKS

SEQ ID NO: 1602421 - protein, 7 aa, Staphylococcus aureus
KENGYAV

SEQ ID NO: 1602422 - protein, 7 aa, Staphylococcus aureus
KENIDKN

SEQ ID NO: 1602423 - protein, 7 aa, Staphylococcus aureus
KENSGEL

SEQ ID NO: 1602424 - protein, 6 aa, Staphylococcus aureus
KEPYFS

SEQ ID NO: 1602425 - protein, 7 aa, Staphylococcus aureus
KEPYPNY

SEQ ID NO: 1602426 - protein, 8 aa, Staphylococcus aureus
KEPYTKSD

SEQ ID NO: 1602427 - protein, 4 aa, Staphylococcus aureus
KEQF

SEQ ID NO: 1602428 - protein, 4 aa, Staphylococcus aureus
KERR

SEQ ID NO: 1602429 - protein, 8 aa, Staphylococcus aureus
KERSRKEL

SEQ ID NO: 1602430 - protein, 8 aa, Staphylococcus aureus
KEVTSSDS

SEQ ID NO: 1602431 - protein, 6 aa, Staphylococcus aureus
KGDYPK

SEQ ID NO: 1602432 - protein, 8 aa, Staphylococcus aureus
KGESTEDY

SEQ ID NO: 1602433 - protein, 7 aa, Staphylococcus aureus
KGGGGAL

SEQ ID NO: 1602434 - protein, 6 aa, Staphylococcus aureus
KGIEEG

SEQ ID NO: 1602435 - protein, 6 aa, Staphylococcus aureus
KGKALA

SEQ ID NO: 1602436 - protein, 11 aa, Staphylococcus aureus
KGKKGEVKEVP

SEQ ID NO: 1602437 - protein, 8 aa, Staphylococcus aureus
KGKVGAHG

SEQ ID NO: 1602438 - protein, 9 aa, Staphylococcus aureus
KGLKTSKEV

SEQ ID NO: 1602439 - protein, 5 aa, Staphylococcus aureus
KGLRT

SEQ ID NO: 1602440 - protein, 8 aa, Staphylococcus aureus
KGNNNYGK

SEQ ID NO: 1602441 - protein, 7 aa, Staphylococcus aureus
KGPETFD

SEQ ID NO: 1602442 - protein, 11 aa, Staphylococcus aureus
KGRTLQDGDEI

SEQ ID NO: 1602443 - protein, 7 aa, Staphylococcus aureus
KGSSNYP

SEQ ID NO: 1602444 - protein, 5 aa, Staphylococcus aureus
KGTGN

SEQ ID NO: 1602445 - protein, 12 aa, Staphylococcus aureus
KGTIQIKRDGTP

SEQ ID NO: 1602446 - protein, 5 aa, Staphylococcus aureus
KGTNG

SEQ ID NO: 1602447 - protein, 9 aa, Staphylococcus aureus
KGTTDPYQD

SEQ ID NO: 1602448 - protein, 6 aa, Staphylococcus aureus
KHDSIG

SEQ ID NO: 1602449 - protein, 15 aa, Staphylococcus aureus
KHPKQGDLHNPTETE

SEQ ID NO: 1602450 - protein, 4 aa, Staphylococcus aureus
KHVS

SEQ ID NO: 1602451 - protein, 4 aa, Staphylococcus aureus
KIGT

SEQ ID NO: 1602452 - protein, 18 aa, Staphylococcus aureus
KIIPEEKVRTKKRAIQTL

SEQ ID NO: 1602453 - protein, 20 aa, Staphylococcus aureus
KILAESPNLAISSSSRGNIE

SEQ ID NO: 1602454 - protein, 5 aa, Staphylococcus aureus
KINDQ

SEQ ID NO: 1602455 - protein, 18 aa, Staphylococcus aureus
KISNSTKNKKASSNEAEK

SEQ ID NO: 1602456 - protein, 8 aa, Staphylococcus aureus
KISYQGLP

SEQ ID NO: 1602457 - protein, 5 aa, Staphylococcus aureus
KITRS

SEQ ID NO: 1602458 - protein, 11 aa, Staphylococcus aureus
KKAKELKEEHG

SEQ ID NO: 1602459 - protein, 9 aa, Staphylococcus aureus
KKFTSGDYT

SEQ ID NO: 1602460 - protein, 6 aa, Staphylococcus aureus
KKIESG

SEQ ID NO: 1602461 - protein, 4 aa, Staphylococcus aureus
KKIP

SEQ ID NO: 1602462 - protein, 7 aa, Staphylococcus aureus
KKPFSPR

SEQ ID NO: 1602463 - protein, 6 aa, Staphylococcus aureus
KKQGVE

SEQ ID NO: 1602464 - protein, 5 aa, Staphylococcus aureus
KKRAA

SEQ ID NO: 1602465 - protein, 9 aa, Staphylococcus aureus
KKSISNKNT

SEQ ID NO: 1602466 - protein, 6 aa, Staphylococcus aureus
KKSYER

SEQ ID NO: 1602467 - protein, 11 aa, Staphylococcus aureus
KKTNVKHESPQ

SEQ ID NO: 1602468 - protein, 8 aa, Staphylococcus aureus
KKTSEKDA

SEQ ID NO: 1602469 - protein, 7 aa, Staphylococcus aureus
KLATTGG

SEQ ID NO: 1602470 - protein, 8 aa, Staphylococcus aureus
KLSGGEQK

SEQ ID NO: 1602471 - protein, 8 aa, Staphylococcus aureus
KLSPKELK

SEQ ID NO: 1602472 - protein, 10 aa, Staphylococcus aureus
KNATDNATEL

SEQ ID NO: 1602473 - protein, 7 aa, Staphylococcus aureus
KNDEDAL

SEQ ID NO: 1602474 - protein, 7 aa, Staphylococcus aureus
KNDTQQL

SEQ ID NO: 1602475 - protein, 6 aa, Staphylococcus aureus
KNEPKR

SEQ ID NO: 1602476 - protein, 11 aa, Staphylococcus aureus
KNKNVMSNEDY

SEQ ID NO: 1602477 - protein, 6 aa, Staphylococcus aureus
KNNVIT

SEQ ID NO: 1602478 - protein, 7 aa, Staphylococcus aureus
KNTFGEA

SEQ ID NO: 1602479 - protein, 8 aa, Staphylococcus aureus
KNTRFDSD

SEQ ID NO: 1602480 - protein, 18 aa, Staphylococcus aureus
KNVREKEAKRIKQMMQEN

SEQ ID NO: 1602481 - protein, 4 aa, Staphylococcus aureus
KNYK

SEQ ID NO: 1602482 - protein, 5 aa, Staphylococcus aureus
KPEQI

SEQ ID NO: 1602483 - protein, 6 aa, Staphylococcus aureus
KPIVKD

SEQ ID NO: 1602484 - protein, 4 aa, Staphylococcus aureus
KPKV

SEQ ID NO: 1602485 - protein, 7 aa, Staphylococcus aureus
KPKYENS

SEQ ID NO: 1602486 - protein, 7 aa, Staphylococcus aureus
KPMDSEE

SEQ ID NO: 1602487 - protein, 20 aa, Staphylococcus aureus
KPMPNNYEKPLKVERVSFNE

SEQ ID NO: 1602488 - protein, 12 aa, Staphylococcus aureus
KPNRRKADIEAK

SEQ ID NO: 1602489 - protein, 8 aa, Staphylococcus aureus
KPSEETPF

SEQ ID NO: 1602490 - protein, 16 aa, Staphylococcus aureus
KPSEQAERSWDEVPEE

SEQ ID NO: 1602491 - protein, 7 aa, Staphylococcus aureus
KQDFPKT

SEQ ID NO: 1602492 - protein, 6 aa, Staphylococcus aureus
KQEIDS

SEQ ID NO: 1602493 - protein, 12 aa, Staphylococcus aureus
KQGPLSEGTVSG

SEQ ID NO: 1602494 - protein, 5 aa, Staphylococcus aureus
KQHQY

SEQ ID NO: 1602495 - protein, 8 aa, Staphylococcus aureus
KQLTKDAD

SEQ ID NO: 1602496 - protein, 8 aa, Staphylococcus aureus
KQPNKEHM

SEQ ID NO: 1602497 - protein, 6 aa, Staphylococcus aureus
KQQESY

SEQ ID NO: 1602498 - protein, 6 aa, Staphylococcus aureus
KQQIEN

SEQ ID NO: 1602499 - protein, 5 aa, Staphylococcus aureus
KQQQE

SEQ ID NO: 1602500 - protein, 6 aa, Staphylococcus aureus
KQVEYE

SEQ ID NO: 1602501 - protein, 4 aa, Staphylococcus aureus
KQVK

SEQ ID NO: 1602502 - protein, 9 aa, Staphylococcus aureus
KQYSDNPKA

SEQ ID NO: 1602503 - protein, 5 aa, Staphylococcus aureus
KREEL

SEQ ID NO: 1602504 - protein, 6 aa, Staphylococcus aureus
KRKNAT

SEQ ID NO: 1602505 - protein, 9 aa, Staphylococcus aureus
KRKPASKQD

SEQ ID NO: 1602506 - protein, 5 aa, Staphylococcus aureus
KRLAG

SEQ ID NO: 1602507 - protein, 6 aa, Staphylococcus aureus
KRQGKS

SEQ ID NO: 1602508 - protein, 8 aa, Staphylococcus aureus
KRTAAKQT

SEQ ID NO: 1602509 - protein, 11 aa, Staphylococcus aureus
KRWEREEKAYN

SEQ ID NO: 1602510 - protein, 7 aa, Staphylococcus aureus
KRYRTVD

SEQ ID NO: 1602511 - protein, 5 aa, Staphylococcus aureus
KSANA

SEQ ID NO: 1602512 - protein, 8 aa, Staphylococcus aureus
KSDRARLK

SEQ ID NO: 1602513 - protein, 10 aa, Staphylococcus aureus
KSELNPTPKW

SEQ ID NO: 1602514 - protein, 5 aa, Staphylococcus aureus
KSEPN

SEQ ID NO: 1602515 - protein, 28 aa, Staphylococcus aureus
KSETIRPELSNASDKVASASSLSQDEVK

SEQ ID NO: 1602516 - protein, 11 aa, Staphylococcus aureus
KSFFSSKEDPE

SEQ ID NO: 1602517 - protein, 8 aa, Staphylococcus aureus
KSGEKIPK

SEQ ID NO: 1602518 - protein, 8 aa, Staphylococcus aureus
KSHPARDM

SEQ ID NO: 1602519 - protein, 20 aa, Staphylococcus aureus
KSIRRGSANLKDSYAQVKNG

SEQ ID NO: 1602520 - protein, 6 aa, Staphylococcus aureus
KSKGAT

SEQ ID NO: 1602521 - protein, 9 aa, Staphylococcus aureus
KSKTIEPFR

SEQ ID NO: 1602522 - protein, 5 aa, Staphylococcus aureus
KSNAH

SEQ ID NO: 1602523 - protein, 5 aa, Staphylococcus aureus
KSNAL

SEQ ID NO: 1602524 - protein, 9 aa, Staphylococcus aureus
KSQTPKRIQ

SEQ ID NO: 1602525 - protein, 5 aa, Staphylococcus aureus
KSQYV

SEQ ID NO: 1602526 - protein, 9 aa, Staphylococcus aureus
KSVEDKGEY

SEQ ID NO: 1602527 - protein, 5 aa, Staphylococcus aureus
KSYDD

SEQ ID NO: 1602528 - protein, 6 aa, Staphylococcus aureus
KTGSGA

SEQ ID NO: 1602529 - protein, 10 aa, Staphylococcus aureus
KTKDKSFDEA

SEQ ID NO: 1602530 - protein, 21 aa, Staphylococcus aureus
KTKHQTNVRSATKDQTQTMNR

SEQ ID NO: 1602531 - protein, 4 aa, Staphylococcus aureus
KTKK

SEQ ID NO: 1602532 - protein, 7 aa, Staphylococcus aureus
KTMTLPN

SEQ ID NO: 1602533 - protein, 10 aa, Staphylococcus aureus
KTPVKYASSE

SEQ ID NO: 1602534 - protein, 7 aa, Staphylococcus aureus
KTQEHDT

SEQ ID NO: 1602535 - protein, 15 aa, Staphylococcus aureus
KTRINRKSRDRGDQE

SEQ ID NO: 1602536 - protein, 6 aa, Staphylococcus aureus
KTSQDP

SEQ ID NO: 1602537 - protein, 5 aa, Staphylococcus aureus
KTTSL

SEQ ID NO: 1602538 - protein, 7 aa, Staphylococcus aureus
KTVQEAK

SEQ ID NO: 1602539 - protein, 5 aa, Staphylococcus aureus
KTYSV

SEQ ID NO: 1602540 - protein, 7 aa, Staphylococcus aureus
KVGRTTG

SEQ ID NO: 1602541 - protein, 8 aa, Staphylococcus aureus
KVRDAHPE

SEQ ID NO: 1602542 - protein, 7 aa, Staphylococcus aureus
KVSKVSE

SEQ ID NO: 1602543 - protein, 11 aa, Staphylococcus aureus
KVTAKAQNDYH

SEQ ID NO: 1602544 - protein, 4 aa, Staphylococcus aureus
KVTG

SEQ ID NO: 1602545 - protein, 8 aa, Staphylococcus aureus
KVTSKANR

SEQ ID NO: 1602546 - protein, 5 aa, Staphylococcus aureus
KYEQG

SEQ ID NO: 1602547 - protein, 6 aa, Staphylococcus aureus
KYRPEL

SEQ ID NO: 1602548 - protein, 11 aa, Staphylococcus aureus
KYTNDGKNPIQ

SEQ ID NO: 1602549 - protein, 21 aa, Staphylococcus aureus
LAKARAESHLENDDDNTDIHR

SEQ ID NO: 1602550 - protein, 6 aa, Staphylococcus aureus
LANGDK

SEQ ID NO: 1602551 - protein, 6 aa, Staphylococcus aureus
LASPNN

SEQ ID NO: 1602552 - protein, 12 aa, Staphylococcus aureus
LATDGYENARET

SEQ ID NO: 1602553 - protein, 7 aa, Staphylococcus aureus
LATNLDE

SEQ ID NO: 1602554 - protein, 4 aa, Staphylococcus aureus
LDDE

SEQ ID NO: 1602555 - protein, 8 aa, Staphylococcus aureus
LDEQSVIT

SEQ ID NO: 1602556 - protein, 7 aa, Staphylococcus aureus
LDKQEDK

SEQ ID NO: 1602557 - protein, 5 aa, Staphylococcus aureus
LDNRP

SEQ ID NO: 1602558 - protein, 4 aa, Staphylococcus aureus
LDTP

SEQ ID NO: 1602559 - protein, 7 aa, Staphylococcus aureus
LDTTTKN

SEQ ID NO: 1602560 - protein, 10 aa, Staphylococcus aureus
LEEESRSEVT

SEQ ID NO: 1602561 - protein, 7 aa, Staphylococcus aureus
LEGEDQL

SEQ ID NO: 1602562 - protein, 6 aa, Staphylococcus aureus
LEGGFS

SEQ ID NO: 1602563 - protein, 8 aa, Staphylococcus aureus
LEKEHPEG

SEQ ID NO: 1602564 - protein, 5 aa, Staphylococcus aureus
LEKQG

SEQ ID NO: 1602565 - protein, 9 aa, Staphylococcus aureus
LENNKTEND

SEQ ID NO: 1602566 - protein, 5 aa, Staphylococcus aureus
LEPVE

SEQ ID NO: 1602567 - protein, 6 aa, Staphylococcus aureus
LEQRTN

SEQ ID NO: 1602568 - protein, 11 aa, Staphylococcus aureus
LERQTDKLKTY

SEQ ID NO: 1602569 - protein, 7 aa, Staphylococcus aureus
LESGDAP

SEQ ID NO: 1602570 - protein, 10 aa, Staphylococcus aureus
LETNETTTYE

SEQ ID NO: 1602571 - protein, 5 aa, Staphylococcus aureus
LGEAE

SEQ ID NO: 1602572 - protein, 14 aa, Staphylococcus aureus
LGEEEQQVINGEQV

SEQ ID NO: 1602573 - protein, 4 aa, Staphylococcus aureus
LGEM

SEQ ID NO: 1602574 - protein, 4 aa, Staphylococcus aureus
LGFG

SEQ ID NO: 1602575 - protein, 11 aa, Staphylococcus aureus
LGGAQGQATEI

SEQ ID NO: 1602576 - protein, 6 aa, Staphylococcus aureus
LGGKSA

SEQ ID NO: 1602577 - protein, 7 aa, Staphylococcus aureus
LGPEEKI

SEQ ID NO: 1602578 - protein, 6 aa, Staphylococcus aureus
LGSGGL

SEQ ID NO: 1602579 - protein, 4 aa, Staphylococcus aureus
LGSK

SEQ ID NO: 1602580 - protein, 16 aa, Staphylococcus aureus
LGSTADASEFENKEPY

SEQ ID NO: 1602581 - protein, 6 aa, Staphylococcus aureus
LGSTPY

SEQ ID NO: 1602582 - protein, 11 aa, Staphylococcus aureus
LGTVGGQEDDV

SEQ ID NO: 1602583 - protein, 9 aa, Staphylococcus aureus
LHKRSTGKS

SEQ ID NO: 1602584 - protein, 6 aa, Staphylococcus aureus
LHPGAK

SEQ ID NO: 1602585 - protein, 12 aa, Staphylococcus aureus
LIGPNGAGKSTL

SEQ ID NO: 1602586 - protein, 11 aa, Staphylococcus aureus
LKDKLDDSSMQ

SEQ ID NO: 1602587 - protein, 9 aa, Staphylococcus aureus
LKGQSPFDR

SEQ ID NO: 1602588 - protein, 8 aa, Staphylococcus aureus
LKKETDDA

SEQ ID NO: 1602589 - protein, 8 aa, Staphylococcus aureus
LKKRGAKN

SEQ ID NO: 1602590 - protein, 4 aa, Staphylococcus aureus
LKNR

SEQ ID NO: 1602591 - protein, 4 aa, Staphylococcus aureus
LKQQ

SEQ ID NO: 1602592 - protein, 6 aa, Staphylococcus aureus
LKSEDY

SEQ ID NO: 1602593 - protein, 7 aa, Staphylococcus aureus
LKSKPEL

SEQ ID NO: 1602594 - protein, 25 aa, Staphylococcus aureus
LKTAYENTRPKIDKSVRNDLKETYE

SEQ ID NO: 1602595 - protein, 11 aa, Staphylococcus aureus
LKTNDKSQYLE

SEQ ID NO: 1602596 - protein, 7 aa, Staphylococcus aureus
LKYPDGD

SEQ ID NO: 1602597 - protein, 8 aa, Staphylococcus aureus
LNAPSDIE

SEQ ID NO: 1602598 - protein, 10 aa, Staphylococcus aureus
LNDDLGGGSI

SEQ ID NO: 1602599 - protein, 4 aa, Staphylococcus aureus
LNDN

SEQ ID NO: 1602600 - protein, 5 aa, Staphylococcus aureus
LNDPL

SEQ ID NO: 1602601 - protein, 5 aa, Staphylococcus aureus
LNDQG

SEQ ID NO: 1602602 - protein, 8 aa, Staphylococcus aureus
LNEPERVA

SEQ ID NO: 1602603 - protein, 9 aa, Staphylococcus aureus
LNGRDGYKK

SEQ ID NO: 1602604 - protein, 8 aa, Staphylococcus aureus
LNKNESEL

SEQ ID NO: 1602605 - protein, 8 aa, Staphylococcus aureus
LNNDDSVS

SEQ ID NO: 1602606 - protein, 5 aa, Staphylococcus aureus
LNPSL

SEQ ID NO: 1602607 - protein, 5 aa, Staphylococcus aureus
LNQEE

SEQ ID NO: 1602608 - protein, 6 aa, Staphylococcus aureus
LNQNKD

SEQ ID NO: 1602609 - protein, 5 aa, Staphylococcus aureus
LNQPE

SEQ ID NO: 1602610 - protein, 5 aa, Staphylococcus aureus
LNSGY

SEQ ID NO: 1602611 - protein, 6 aa, Staphylococcus aureus
LNSQQT

SEQ ID NO: 1602612 - protein, 13 aa, Staphylococcus aureus
LPGKDVKLSTNEQ

SEQ ID NO: 1602613 - protein, 17 aa, Staphylococcus aureus
LPHAPSAQLAEVQGDQI

SEQ ID NO: 1602614 - protein, 5 aa, Staphylococcus aureus
LPNHD

SEQ ID NO: 1602615 - protein, 4 aa, Staphylococcus aureus
LPQI

SEQ ID NO: 1602616 - protein, 9 aa, Staphylococcus aureus
LQKSKLTES

SEQ ID NO: 1602617 - protein, 7 aa, Staphylococcus aureus
LQPGDEV

SEQ ID NO: 1602618 - protein, 7 aa, Staphylococcus aureus
LQPPEEL

SEQ ID NO: 1602619 - protein, 7 aa, Staphylococcus aureus
LQSNGSN

SEQ ID NO: 1602620 - protein, 9 aa, Staphylococcus aureus
LQTLSDDEK

SEQ ID NO: 1602621 - protein, 7 aa, Staphylococcus aureus
LQTPTSG

SEQ ID NO: 1602622 - protein, 5 aa, Staphylococcus aureus
LRQAG

SEQ ID NO: 1602623 - protein, 11 aa, Staphylococcus aureus
LRSNTQGRGTY

SEQ ID NO: 1602624 - protein, 4 aa, Staphylococcus aureus
LRSY

SEQ ID NO: 1602625 - protein, 9 aa, Staphylococcus aureus
LSEAEQDTF

SEQ ID NO: 1602626 - protein, 8 aa, Staphylococcus aureus
LSEGTTSY

SEQ ID NO: 1602627 - protein, 15 aa, Staphylococcus aureus
LSEQTDKLKELNNGE

SEQ ID NO: 1602628 - protein, 10 aa, Staphylococcus aureus
LSEQTTHNGP

SEQ ID NO: 1602629 - protein, 7 aa, Staphylococcus aureus
LSGEDGG

SEQ ID NO: 1602630 - protein, 8 aa, Staphylococcus aureus
LSGGEKQR

SEQ ID NO: 1602631 - protein, 13 aa, Staphylococcus aureus
LSGKSSHPTDNKH

SEQ ID NO: 1602632 - protein, 5 aa, Staphylococcus aureus
LSGRN

SEQ ID NO: 1602633 - protein, 9 aa, Staphylococcus aureus
LSGSGKSSL

SEQ ID NO: 1602634 - protein, 11 aa, Staphylococcus aureus
LSKITDLTDRS

SEQ ID NO: 1602635 - protein, 7 aa, Staphylococcus aureus
LSKRGGL

SEQ ID NO: 1602636 - protein, 11 aa, Staphylococcus aureus
LSKTEIDQKVT

SEQ ID NO: 1602637 - protein, 6 aa, Staphylococcus aureus
LSPEKN

SEQ ID NO: 1602638 - protein, 5 aa, Staphylococcus aureus
LSPYD

SEQ ID NO: 1602639 - protein, 4 aa, Staphylococcus aureus
LTDD

SEQ ID NO: 1602640 - protein, 8 aa, Staphylococcus aureus
LTDSKTSV

SEQ ID NO: 1602641 - protein, 11 aa, Staphylococcus aureus
LTDTGTKSADD

SEQ ID NO: 1602642 - protein, 15 aa, Staphylococcus aureus
LTEETPKQLPFDIPT

SEQ ID NO: 1602643 - protein, 13 aa, Staphylococcus aureus
LTEKETLKSAGTK

SEQ ID NO: 1602644 - protein, 12 aa, Staphylococcus aureus
LTGEVKVEGAKN

SEQ ID NO: 1602645 - protein, 6 aa, Staphylococcus aureus
LTGGCP

SEQ ID NO: 1602646 - protein, 7 aa, Staphylococcus aureus
LTGKPNT

SEQ ID NO: 1602647 - protein, 7 aa, Staphylococcus aureus
LTKKGSK

SEQ ID NO: 1602648 - protein, 8 aa, Staphylococcus aureus
LTNGNEQL

SEQ ID NO: 1602649 - protein, 9 aa, Staphylococcus aureus
LTSKSERAQ

SEQ ID NO: 1602650 - protein, 17 aa, Staphylococcus aureus
LTSNGKIDRKKIAEVIN

SEQ ID NO: 1602651 - protein, 9 aa, Staphylococcus aureus
LTSSYEPPI

SEQ ID NO: 1602652 - protein, 6 aa, Staphylococcus aureus
MDPKHR

SEQ ID NO: 1602653 - protein, 4 aa, Staphylococcus aureus
MEGL

SEQ ID NO: 1602654 - protein, 9 aa, Staphylococcus aureus
MGPSSSGGI

SEQ ID NO: 1602655 - protein, 5 aa, Staphylococcus aureus
MKNEP

SEQ ID NO: 1602656 - protein, 6 aa, Staphylococcus aureus
MNDDES

SEQ ID NO: 1602657 - protein, 8 aa, Staphylococcus aureus
MPPGESGL

SEQ ID NO: 1602658 - protein, 9 aa, Staphylococcus aureus
MPQQKDITT

SEQ ID NO: 1602659 - protein, 15 aa, Staphylococcus aureus
MPSNSVKDVTGAGDS

SEQ ID NO: 1602660 - protein, 15 aa, Staphylococcus aureus
MQETQVDNDAYDDNE

SEQ ID NO: 1602661 - protein, 4 aa, Staphylococcus aureus
MREH

SEQ ID NO: 1602662 - protein, 7 aa, Staphylococcus aureus
MRKPTQN

SEQ ID NO: 1602663 - protein, 5 aa, Staphylococcus aureus
MRQEI

SEQ ID NO: 1602664 - protein, 6 aa, Staphylococcus aureus
MSDNER

SEQ ID NO: 1602665 - protein, 8 aa, Staphylococcus aureus
MSNQSRKR

SEQ ID NO: 1602666 - protein, 8 aa, Staphylococcus aureus
MSTSGKTG

SEQ ID NO: 1602667 - protein, 8 aa, Staphylococcus aureus
NAAKEPEV

SEQ ID NO: 1602668 - protein, 7 aa, Staphylococcus aureus
NAGFTAG

SEQ ID NO: 1602669 - protein, 10 aa, Staphylococcus aureus
NAGKKNEVRA

SEQ ID NO: 1602670 - protein, 10 aa, Staphylococcus aureus
NAIAAPGPLS

SEQ ID NO: 1602671 - protein, 9 aa, Staphylococcus aureus
NAKREEGQE

SEQ ID NO: 1602672 - protein, 11 aa, Staphylococcus aureus
NAMEGVTDDVK

SEQ ID NO: 1602673 - protein, 6 aa, Staphylococcus aureus
NAPDEQ

SEQ ID NO: 1602674 - protein, 11 aa, Staphylococcus aureus
NATRETSEDDL

SEQ ID NO: 1602675 - protein, 10 aa, Staphylococcus aureus
NAVGYKNYPD

SEQ ID NO: 1602676 - protein, 8 aa, Staphylococcus aureus
NDDEFKTA

SEQ ID NO: 1602677 - protein, 7 aa, Staphylococcus aureus
NDDERAA

SEQ ID NO: 1602678 - protein, 7 aa, Staphylococcus aureus
NDDETHI

SEQ ID NO: 1602679 - protein, 13 aa, Staphylococcus aureus
NDEKQPFWTENYT

SEQ ID NO: 1602680 - protein, 5 aa, Staphylococcus aureus
NDEQL

SEQ ID NO: 1602681 - protein, 5 aa, Staphylococcus aureus
NDGGG

SEQ ID NO: 1602682 - protein, 6 aa, Staphylococcus aureus
NDLSPQ

SEQ ID NO: 1602683 - protein, 5 aa, Staphylococcus aureus
NDPHK

SEQ ID NO: 1602684 - protein, 7 aa, Staphylococcus aureus
NDQKTAE

SEQ ID NO: 1602685 - protein, 7 aa, Staphylococcus aureus
NDRQNQD

SEQ ID NO: 1602686 - protein, 9 aa, Staphylococcus aureus
NDRTTRKKL

SEQ ID NO: 1602687 - protein, 6 aa, Staphylococcus aureus
NDTKYG

SEQ ID NO: 1602688 - protein, 6 aa, Staphylococcus aureus
NDTQSK

SEQ ID NO: 1602689 - protein, 7 aa, Staphylococcus aureus
NDTTNRS

SEQ ID NO: 1602690 - protein, 5 aa, Staphylococcus aureus
NDVGV

SEQ ID NO: 1602691 - protein, 10 aa, Staphylococcus aureus
NEANDERALQ

SEQ ID NO: 1602692 - protein, 11 aa, Staphylococcus aureus
NEDAEKHDIQD

SEQ ID NO: 1602693 - protein, 14 aa, Staphylococcus aureus
NEEFTQDSHYSQTM

SEQ ID NO: 1602694 - protein, 7 aa, Staphylococcus aureus
NEEQYGS

SEQ ID NO: 1602695 - protein, 8 aa, Staphylococcus aureus
NEGEGVNP

SEQ ID NO: 1602696 - protein, 8 aa, Staphylococcus aureus
NEINEDSV

SEQ ID NO: 1602697 - protein, 11 aa, Staphylococcus aureus
NEIRQDGNTGE

SEQ ID NO: 1602698 - protein, 14 aa, Staphylococcus aureus
NELSESEKQKADQE

SEQ ID NO: 1602699 - protein, 7 aa, Staphylococcus aureus
NEPPGAR

SEQ ID NO: 1602700 - protein, 4 aa, Staphylococcus aureus
NEQF

SEQ ID NO: 1602701 - protein, 9 aa, Staphylococcus aureus
NERRANKDM

SEQ ID NO: 1602702 - protein, 8 aa, Staphylococcus aureus
NESHAEGL

SEQ ID NO: 1602703 - protein, 8 aa, Staphylococcus aureus
NESTESLR

SEQ ID NO: 1602704 - protein, 9 aa, Staphylococcus aureus
NESTSDTIP

SEQ ID NO: 1602705 - protein, 7 aa, Staphylococcus aureus
NESYEPR

SEQ ID NO: 1602706 - protein, 8 aa, Staphylococcus aureus
NGESTEEF

SEQ ID NO: 1602707 - protein, 5 aa, Staphylococcus aureus
NGFKT

SEQ ID NO: 1602708 - protein, 6 aa, Staphylococcus aureus
NGITET

SEQ ID NO: 1602709 - protein, 9 aa, Staphylococcus aureus
NGLKDPDTA

SEQ ID NO: 1602710 - protein, 8 aa, Staphylococcus aureus
NGNKALSN

SEQ ID NO: 1602711 - protein, 9 aa, Staphylococcus aureus
NGNKAQAKQ

SEQ ID NO: 1602712 - protein, 5 aa, Staphylococcus aureus
NGNVV

SEQ ID NO: 1602713 - protein, 6 aa, Staphylococcus aureus
NGPANQ

SEQ ID NO: 1602714 - protein, 6 aa, Staphylococcus aureus
NGQTPI

SEQ ID NO: 1602715 - protein, 8 aa, Staphylococcus aureus
NGSVYNRD

SEQ ID NO: 1602716 - protein, 7 aa, Staphylococcus aureus
NGTATDY

SEQ ID NO: 1602717 - protein, 7 aa, Staphylococcus aureus
NGTGKST

SEQ ID NO: 1602718 - protein, 9 aa, Staphylococcus aureus
NHDGKERLN

SEQ ID NO: 1602719 - protein, 7 aa, Staphylococcus aureus
NIEAGGS

SEQ ID NO: 1602720 - protein, 8 aa, Staphylococcus aureus
NIGSAGGQ

SEQ ID NO: 1602721 - protein, 4 aa, Staphylococcus aureus
NIGT

SEQ ID NO: 1602722 - protein, 4 aa, Staphylococcus aureus
NIHS

SEQ ID NO: 1602723 - protein, 11 aa, Staphylococcus aureus
NIKGAGTSTIK

SEQ ID NO: 1602724 - protein, 13 aa, Staphylococcus aureus
NKDKGYYILRSIK

SEQ ID NO: 1602725 - protein, 5 aa, Staphylococcus aureus
NKELT

SEQ ID NO: 1602726 - protein, 4 aa, Staphylococcus aureus
NKGD

SEQ ID NO: 1602727 - protein, 6 aa, Staphylococcus aureus
NKGETS

SEQ ID NO: 1602728 - protein, 8 aa, Staphylococcus aureus
NKGGCPKC

SEQ ID NO: 1602729 - protein, 9 aa, Staphylococcus aureus
NKGTEDFKE

SEQ ID NO: 1602730 - protein, 7 aa, Staphylococcus aureus
NKIPSTE

SEQ ID NO: 1602731 - protein, 13 aa, Staphylococcus aureus
NKKEIEQKVNEAA

SEQ ID NO: 1602732 - protein, 15 aa, Staphylococcus aureus
NKNEHDFDRRPNDEA

SEQ ID NO: 1602733 - protein, 9 aa, Staphylococcus aureus
NKPKTDDFP

SEQ ID NO: 1602734 - protein, 8 aa, Staphylococcus aureus
NKQLAEET

SEQ ID NO: 1602735 - protein, 8 aa, Staphylococcus aureus
NKQTVGIG

SEQ ID NO: 1602736 - protein, 8 aa, Staphylococcus aureus
NKSIEDGD

SEQ ID NO: 1602737 - protein, 17 aa, Staphylococcus aureus
NKSRHISSLSGGETFQS

SEQ ID NO: 1602738 - protein, 8 aa, Staphylococcus aureus
NKTTERKH

SEQ ID NO: 1602739 - protein, 12 aa, Staphylococcus aureus
NKYGNTSAASIP

SEQ ID NO: 1602740 - protein, 15 aa, Staphylococcus aureus
NLDDSNGHKYGLGSS

SEQ ID NO: 1602741 - protein, 7 aa, Staphylococcus aureus
NLDPDKQ

SEQ ID NO: 1602742 - protein, 6 aa, Staphylococcus aureus
NLEESN

SEQ ID NO: 1602743 - protein, 11 aa, Staphylococcus aureus
NLQKSGRITGA

SEQ ID NO: 1602744 - protein, 11 aa, Staphylococcus aureus
NLSNSEKQKHV

SEQ ID NO: 1602745 - protein, 9 aa, Staphylococcus aureus
NNAEVQLGA

SEQ ID NO: 1602746 - protein, 8 aa, Staphylococcus aureus
NNDKSINS

SEQ ID NO: 1602747 - protein, 7 aa, Staphylococcus aureus
NNETNHA

SEQ ID NO: 1602748 - protein, 4 aa, Staphylococcus aureus
NNGI

SEQ ID NO: 1602749 - protein, 9 aa, Staphylococcus aureus
NNGTQSEMQ

SEQ ID NO: 1602750 - protein, 5 aa, Staphylococcus aureus
NNIKG

SEQ ID NO: 1602751 - protein, 12 aa, Staphylococcus aureus
NNSTKTPEQVTE

SEQ ID NO: 1602752 - protein, 9 aa, Staphylococcus aureus
NNTESTTHR

SEQ ID NO: 1602753 - protein, 11 aa, Staphylococcus aureus
NPEYEGKGYGS

SEQ ID NO: 1602754 - protein, 8 aa, Staphylococcus aureus
NPINDTTI

SEQ ID NO: 1602755 - protein, 13 aa, Staphylococcus aureus
NPNVEKKKKNARE

SEQ ID NO: 1602756 - protein, 6 aa, Staphylococcus aureus
NPPYID

SEQ ID NO: 1602757 - protein, 5 aa, Staphylococcus aureus
NPRAQ

SEQ ID NO: 1602758 - protein, 5 aa, Staphylococcus aureus
NPTED

SEQ ID NO: 1602759 - protein, 7 aa, Staphylococcus aureus
NQDNTYN

SEQ ID NO: 1602760 - protein, 5 aa, Staphylococcus aureus
NQGEA

SEQ ID NO: 1602761 - protein, 5 aa, Staphylococcus aureus
NQIND

SEQ ID NO: 1602762 - protein, 11 aa, Staphylococcus aureus
NQITEDNAHDI

SEQ ID NO: 1602763 - protein, 13 aa, Staphylococcus aureus
NQNERSQIKNREA

SEQ ID NO: 1602764 - protein, 6 aa, Staphylococcus aureus
NQPELT

SEQ ID NO: 1602765 - protein, 7 aa, Staphylococcus aureus
NQPKGVG

SEQ ID NO: 1602766 - protein, 7 aa, Staphylococcus aureus
NQQPLPN

SEQ ID NO: 1602767 - protein, 16 aa, Staphylococcus aureus
NRATATYKFAGGKGIN

SEQ ID NO: 1602768 - protein, 7 aa, Staphylococcus aureus
NRGERAY

SEQ ID NO: 1602769 - protein, 9 aa, Staphylococcus aureus
NRPEHDKEF

SEQ ID NO: 1602770 - protein, 7 aa, Staphylococcus aureus
NRQDVDD

SEQ ID NO: 1602771 - protein, 13 aa, Staphylococcus aureus
NRYRLQPENSTME

SEQ ID NO: 1602772 - protein, 5 aa, Staphylococcus aureus
NSAIQ

SEQ ID NO: 1602773 - protein, 6 aa, Staphylococcus aureus
NSDPER

SEQ ID NO: 1602774 - protein, 8 aa, Staphylococcus aureus
NSEENKGK

SEQ ID NO: 1602775 - protein, 8 aa, Staphylococcus aureus
NSEKPEEN

SEQ ID NO: 1602776 - protein, 13 aa, Staphylococcus aureus
NSGGHAANNAKTY

SEQ ID NO: 1602777 - protein, 6 aa, Staphylococcus aureus
NSKHKE

SEQ ID NO: 1602778 - protein, 9 aa, Staphylococcus aureus
NSKKEGTFS

SEQ ID NO: 1602779 - protein, 7 aa, Staphylococcus aureus
NSKTATH

SEQ ID NO: 1602780 - protein, 7 aa, Staphylococcus aureus
NSNSEMT

SEQ ID NO: 1602781 - protein, 4 aa, Staphylococcus aureus
NSNV

SEQ ID NO: 1602782 - protein, 10 aa, Staphylococcus aureus
NSPFAGREGD

SEQ ID NO: 1602783 - protein, 5 aa, Staphylococcus aureus
NSPGF

SEQ ID NO: 1602784 - protein, 15 aa, Staphylococcus aureus
NSQGIPTKYISPKEA

SEQ ID NO: 1602785 - protein, 7 aa, Staphylococcus aureus
NSREKQG

SEQ ID NO: 1602786 - protein, 11 aa, Staphylococcus aureus
NSTGGILGPQD

SEQ ID NO: 1602787 - protein, 16 aa, Staphylococcus aureus
NSWPDSIDTSCSRGEW

SEQ ID NO: 1602788 - protein, 4 aa, Staphylococcus aureus
NTDG

SEQ ID NO: 1602789 - protein, 8 aa, Staphylococcus aureus
NTKGESTI

SEQ ID NO: 1602790 - protein, 10 aa, Staphylococcus aureus
NTKVGPQDKP

SEQ ID NO: 1602791 - protein, 12 aa, Staphylococcus aureus
NTPNVLTETTAE

SEQ ID NO: 1602792 - protein, 8 aa, Staphylococcus aureus
NTQNEDDM

SEQ ID NO: 1602793 - protein, 11 aa, Staphylococcus aureus
NTVGSGDSTVA

SEQ ID NO: 1602794 - protein, 5 aa, Staphylococcus aureus
NTYFE

SEQ ID NO: 1602795 - protein, 8 aa, Staphylococcus aureus
NVDATTSK

SEQ ID NO: 1602796 - protein, 26 aa, Staphylococcus aureus
NVEGRSAKLEGKSQLQGAQVKATDLR

SEQ ID NO: 1602797 - protein, 5 aa, Staphylococcus aureus
NVGRN

SEQ ID NO: 1602798 - protein, 21 aa, Staphylococcus aureus
NVHTNANVKPKADKSNPSHIG

SEQ ID NO: 1602799 - protein, 10 aa, Staphylococcus aureus
NVKKGVKDSK

SEQ ID NO: 1602800 - protein, 13 aa, Staphylococcus aureus
NVNTENQIASAKA

SEQ ID NO: 1602801 - protein, 7 aa, Staphylococcus aureus
NVSETTY

SEQ ID NO: 1602802 - protein, 13 aa, Staphylococcus aureus
NYAASKEKDDNDL

SEQ ID NO: 1602803 - protein, 8 aa, Staphylococcus aureus
NYPQSRVT

SEQ ID NO: 1602804 - protein, 7 aa, Staphylococcus aureus
PAADNKF

SEQ ID NO: 1602805 - protein, 4 aa, Staphylococcus aureus
PADK

SEQ ID NO: 1602806 - protein, 7 aa, Staphylococcus aureus
PATSELK

SEQ ID NO: 1602807 - protein, 5 aa, Staphylococcus aureus
PDERS

SEQ ID NO: 1602808 - protein, 6 aa, Staphylococcus aureus
PDEWDS

SEQ ID NO: 1602809 - protein, 10 aa, Staphylococcus aureus
PDLSTTNDTP

SEQ ID NO: 1602810 - protein, 11 aa, Staphylococcus aureus
PDNPANDDPKM

SEQ ID NO: 1602811 - protein, 5 aa, Staphylococcus aureus
PDPIH

SEQ ID NO: 1602812 - protein, 8 aa, Staphylococcus aureus
PDSTIAGK

SEQ ID NO: 1602813 - protein, 7 aa, Staphylococcus aureus
PEEARNV

SEQ ID NO: 1602814 - protein, 6 aa, Staphylococcus aureus
PEERGL

SEQ ID NO: 1602815 - protein, 7 aa, Staphylococcus aureus
PEGDTKL

SEQ ID NO: 1602816 - protein, 5 aa, Staphylococcus aureus
PEGVE

SEQ ID NO: 1602817 - protein, 5 aa, Staphylococcus aureus
PEKEF

SEQ ID NO: 1602818 - protein, 5 aa, Staphylococcus aureus
PEMSA

SEQ ID NO: 1602819 - protein, 5 aa, Staphylococcus aureus
PERDM

SEQ ID NO: 1602820 - protein, 9 aa, Staphylococcus aureus
PEREDNHHL

SEQ ID NO: 1602821 - protein, 10 aa, Staphylococcus aureus
PETGSPTLKA

SEQ ID NO: 1602822 - protein, 7 aa, Staphylococcus aureus
PETSDYP

SEQ ID NO: 1602823 - protein, 11 aa, Staphylococcus aureus
PFDSSGRRHTS

SEQ ID NO: 1602824 - protein, 6 aa, Staphylococcus aureus
PFQEGR

SEQ ID NO: 1602825 - protein, 10 aa, Staphylococcus aureus
PGAGGTESQD

SEQ ID NO: 1602826 - protein, 14 aa, Staphylococcus aureus
PGASYKNFNPSESD

SEQ ID NO: 1602827 - protein, 19 aa, Staphylococcus aureus
PGDADNSQSVKTELGRQAG

SEQ ID NO: 1602828 - protein, 6 aa, Staphylococcus aureus
PGGITI

SEQ ID NO: 1602829 - protein, 6 aa, Staphylococcus aureus
PGMGSL

SEQ ID NO: 1602830 - protein, 5 aa, Staphylococcus aureus
PGSIG

SEQ ID NO: 1602831 - protein, 9 aa, Staphylococcus aureus
PHPGFPTDM

SEQ ID NO: 1602832 - protein, 7 aa, Staphylococcus aureus
PIAGKKA

SEQ ID NO: 1602833 - protein, 12 aa, Staphylococcus aureus
PIGNLPPNKRKV

SEQ ID NO: 1602834 - protein, 4 aa, Staphylococcus aureus
PISV

SEQ ID NO: 1602835 - protein, 8 aa, Staphylococcus aureus
PITDIGKT

SEQ ID NO: 1602836 - protein, 7 aa, Staphylococcus aureus
PKDERDA

SEQ ID NO: 1602837 - protein, 5 aa, Staphylococcus aureus
PKHLD

SEQ ID NO: 1602838 - protein, 7 aa, Staphylococcus aureus
PKQVSEQ

SEQ ID NO: 1602839 - protein, 4 aa, Staphylococcus aureus
PKSK

SEQ ID NO: 1602840 - protein, 4 aa, Staphylococcus aureus
PLAD

SEQ ID NO: 1602841 - protein, 4 aa, Staphylococcus aureus
PMGE

SEQ ID NO: 1602842 - protein, 6 aa, Staphylococcus aureus
PNEAQD

SEQ ID NO: 1602843 - protein, 5 aa, Staphylococcus aureus
PNKDE

SEQ ID NO: 1602844 - protein, 8 aa, Staphylococcus aureus
PNNPTGTY

SEQ ID NO: 1602845 - protein, 5 aa, Staphylococcus aureus
PNPLR

SEQ ID NO: 1602846 - protein, 5 aa, Staphylococcus aureus
PNPNI

SEQ ID NO: 1602847 - protein, 14 aa, Staphylococcus aureus
PNSSLSAASGYAEE

SEQ ID NO: 1602848 - protein, 6 aa, Staphylococcus aureus
PNVDAG

SEQ ID NO: 1602849 - protein, 6 aa, Staphylococcus aureus
PPYQTV

SEQ ID NO: 1602850 - protein, 5 aa, Staphylococcus aureus
PQEAQ

SEQ ID NO: 1602851 - protein, 4 aa, Staphylococcus aureus
PQFN

SEQ ID NO: 1602852 - protein, 8 aa, Staphylococcus aureus
PQYKPDER

SEQ ID NO: 1602853 - protein, 6 aa, Staphylococcus aureus
PRPETE

SEQ ID NO: 1602854 - protein, 11 aa, Staphylococcus aureus
PSGASTGEHEA

SEQ ID NO: 1602855 - protein, 7 aa, Staphylococcus aureus
PSGCGKS

SEQ ID NO: 1602856 - protein, 7 aa, Staphylococcus aureus
PSGCGKT

SEQ ID NO: 1602857 - protein, 4 aa, Staphylococcus aureus
PSHQ

SEQ ID NO: 1602858 - protein, 4 aa, Staphylococcus aureus
PSIL

SEQ ID NO: 1602859 - protein, 6 aa, Staphylococcus aureus
PSSETN

SEQ ID NO: 1602860 - protein, 6 aa, Staphylococcus aureus
PSYPPI

SEQ ID NO: 1602861 - protein, 7 aa, Staphylococcus aureus
PTDLDEN

SEQ ID NO: 1602862 - protein, 5 aa, Staphylococcus aureus
PTDRT

SEQ ID NO: 1602863 - protein, 12 aa, Staphylococcus aureus
PTEPDSGGMYIK

SEQ ID NO: 1602864 - protein, 4 aa, Staphylococcus aureus
PTIA

SEQ ID NO: 1602865 - protein, 10 aa, Staphylococcus aureus
PTLPDSKEVE

SEQ ID NO: 1602866 - protein, 7 aa, Staphylococcus aureus
PTLPHAN

SEQ ID NO: 1602867 - protein, 6 aa, Staphylococcus aureus
PTNPTG

SEQ ID NO: 1602868 - protein, 10 aa, Staphylococcus aureus
PTTFNNPRRM

SEQ ID NO: 1602869 - protein, 15 aa, Staphylococcus aureus
PTVSSSKIASFSGTK

SEQ ID NO: 1602870 - protein, 5 aa, Staphylococcus aureus
PTYQR

SEQ ID NO: 1602871 - protein, 11 aa, Staphylococcus aureus
PVERGGAGGGI

SEQ ID NO: 1602872 - protein, 10 aa, Staphylococcus aureus
PVGDDQKQHI

SEQ ID NO: 1602873 - protein, 7 aa, Staphylococcus aureus
PVGGEGI

SEQ ID NO: 1602874 - protein, 7 aa, Staphylococcus aureus
PVTPPNN

SEQ ID NO: 1602875 - protein, 9 aa, Staphylococcus aureus
PYAAPPEDA

SEQ ID NO: 1602876 - protein, 8 aa, Staphylococcus aureus
PYGGGKGG

SEQ ID NO: 1602877 - protein, 5 aa, Staphylococcus aureus
PYKEQ

SEQ ID NO: 1602878 - protein, 5 aa, Staphylococcus aureus
PYNKG

SEQ ID NO: 1602879 - protein, 6 aa, Staphylococcus aureus
PYPATA

SEQ ID NO: 1602880 - protein, 6 aa, Staphylococcus aureus
PYPDKP

SEQ ID NO: 1602881 - protein, 13 aa, Staphylococcus aureus
QADDDYKDKMGEK

SEQ ID NO: 1602882 - protein, 6 aa, Staphylococcus aureus
QADGHT

SEQ ID NO: 1602883 - protein, 6 aa, Staphylococcus aureus
QAEEKM

SEQ ID NO: 1602884 - protein, 4 aa, Staphylococcus aureus
QAEV

SEQ ID NO: 1602885 - protein, 4 aa, Staphylococcus aureus
QAFT

SEQ ID NO: 1602886 - protein, 5 aa, Staphylococcus aureus
QAPEN

SEQ ID NO: 1602887 - protein, 8 aa, Staphylococcus aureus
QAPVADTD

SEQ ID NO: 1602888 - protein, 12 aa, Staphylococcus aureus
QAQKARSYYETK

SEQ ID NO: 1602889 - protein, 7 aa, Staphylococcus aureus
QATDESA

SEQ ID NO: 1602890 - protein, 6 aa, Staphylococcus aureus
QCANKE

SEQ ID NO: 1602891 - protein, 11 aa, Staphylococcus aureus
QCTTANPKEAL

SEQ ID NO: 1602892 - protein, 4 aa, Staphylococcus aureus
QDGI

SEQ ID NO: 1602893 - protein, 8 aa, Staphylococcus aureus
QDLASEGI

SEQ ID NO: 1602894 - protein, 7 aa, Staphylococcus aureus
QDPGNLG

SEQ ID NO: 1602895 - protein, 16 aa, Staphylococcus aureus
QDPTRKMSKSDDNAKN

SEQ ID NO: 1602896 - protein, 16 aa, Staphylococcus aureus
QDQDTTNDKYTGMESR

SEQ ID NO: 1602897 - protein, 9 aa, Staphylococcus aureus
QDQNKPLPV

SEQ ID NO: 1602898 - protein, 9 aa, Staphylococcus aureus
QDRRQYDQS

SEQ ID NO: 1602899 - protein, 6 aa, Staphylococcus aureus
QDSEKD

SEQ ID NO: 1602900 - protein, 5 aa, Staphylococcus aureus
QEEAL

SEQ ID NO: 1602901 - protein, 25 aa, Staphylococcus aureus
QEEQQKYASQRKSAVGTGDRSERIR

SEQ ID NO: 1602902 - protein, 9 aa, Staphylococcus aureus
QEEVEGRPE

SEQ ID NO: 1602903 - protein, 5 aa, Staphylococcus aureus
QEHGG

SEQ ID NO: 1602904 - protein, 8 aa, Staphylococcus aureus
QFSGGQRQ

SEQ ID NO: 1602905 - protein, 14 aa, Staphylococcus aureus
QGAKPGEGGQLPGT

SEQ ID NO: 1602906 - protein, 5 aa, Staphylococcus aureus
QGASE

SEQ ID NO: 1602907 - protein, 7 aa, Staphylococcus aureus
QGDDDKH

SEQ ID NO: 1602908 - protein, 8 aa, Staphylococcus aureus
QGGGRGSQ

SEQ ID NO: 1602909 - protein, 13 aa, Staphylococcus aureus
QGGKTSDSERPLT

SEQ ID NO: 1602910 - protein, 4 aa, Staphylococcus aureus
QGHD

SEQ ID NO: 1602911 - protein, 5 aa, Staphylococcus aureus
QGKEI

SEQ ID NO: 1602912 - protein, 8 aa, Staphylococcus aureus
QGKLPQGK

SEQ ID NO: 1602913 - protein, 9 aa, Staphylococcus aureus
QGKMTTSGE

SEQ ID NO: 1602914 - protein, 16 aa, Staphylococcus aureus
QGPYIKEGNTTKTNAK

SEQ ID NO: 1602915 - protein, 5 aa, Staphylococcus aureus
QGVSN

SEQ ID NO: 1602916 - protein, 15 aa, Staphylococcus aureus
QHKIDQTSINLIGRK

SEQ ID NO: 1602917 - protein, 7 aa, Staphylococcus aureus
QIDNGDA

SEQ ID NO: 1602918 - protein, 15 aa, Staphylococcus aureus
QIDTPEGFKNNPQSE

SEQ ID NO: 1602919 - protein, 8 aa, Staphylococcus aureus
QIGGRRNG

SEQ ID NO: 1602920 - protein, 8 aa, Staphylococcus aureus
QIQNKETK

SEQ ID NO: 1602921 - protein, 9 aa, Staphylococcus aureus
QKDSTVRAN

SEQ ID NO: 1602922 - protein, 7 aa, Staphylococcus aureus
QKEFGED

SEQ ID NO: 1602923 - protein, 8 aa, Staphylococcus aureus
QKESATDY

SEQ ID NO: 1602924 - protein, 13 aa, Staphylococcus aureus
QKINKSKVKPGLY

SEQ ID NO: 1602925 - protein, 23 aa, Staphylococcus aureus
QKKRAKQERQQEIEDAKALKETL

SEQ ID NO: 1602926 - protein, 4 aa, Staphylococcus aureus
QKRR

SEQ ID NO: 1602927 - protein, 12 aa, Staphylococcus aureus
QKSRDNSRTPMQ

SEQ ID NO: 1602928 - protein, 15 aa, Staphylococcus aureus
QLETNSGGPGKPRNV

SEQ ID NO: 1602929 - protein, 4 aa, Staphylococcus aureus
QLGE

SEQ ID NO: 1602930 - protein, 9 aa, Staphylococcus aureus
QLPQGDEDV

SEQ ID NO: 1602931 - protein, 5 aa, Staphylococcus aureus
QLPTR

SEQ ID NO: 1602932 - protein, 5 aa, Staphylococcus aureus
QLQSG

SEQ ID NO: 1602933 - protein, 6 aa, Staphylococcus aureus
QLRHTN

SEQ ID NO: 1602934 - protein, 5 aa, Staphylococcus aureus
QLSEG

SEQ ID NO: 1602935 - protein, 9 aa, Staphylococcus aureus
QLTKDYQGK

SEQ ID NO: 1602936 - protein, 9 aa, Staphylococcus aureus
QMPTEEEQF

SEQ ID NO: 1602937 - protein, 17 aa, Staphylococcus aureus
QNGTLEDKNGWRVVVPK

SEQ ID NO: 1602938 - protein, 5 aa, Staphylococcus aureus
QPLGR

SEQ ID NO: 1602939 - protein, 5 aa, Staphylococcus aureus
QPPQA

SEQ ID NO: 1602940 - protein, 11 aa, Staphylococcus aureus
QPSHDSPANKI

SEQ ID NO: 1602941 - protein, 5 aa, Staphylococcus aureus
QPSRK

SEQ ID NO: 1602942 - protein, 6 aa, Staphylococcus aureus
QQAPVE

SEQ ID NO: 1602943 - protein, 14 aa, Staphylococcus aureus
QQATTLSGGEAQRV

SEQ ID NO: 1602944 - protein, 5 aa, Staphylococcus aureus
QQDVE

SEQ ID NO: 1602945 - protein, 4 aa, Staphylococcus aureus
QQGE

SEQ ID NO: 1602946 - protein, 8 aa, Staphylococcus aureus
QQGESVAK

SEQ ID NO: 1602947 - protein, 8 aa, Staphylococcus aureus
QQQSGGIS

SEQ ID NO: 1602948 - protein, 6 aa, Staphylococcus aureus
QQRFED

SEQ ID NO: 1602949 - protein, 13 aa, Staphylococcus aureus
QQRFTKEDASIQG

SEQ ID NO: 1602950 - protein, 6 aa, Staphylococcus aureus
QQRKKI

SEQ ID NO: 1602951 - protein, 4 aa, Staphylococcus aureus
QQTK

SEQ ID NO: 1602952 - protein, 6 aa, Staphylococcus aureus
QQYVSG

SEQ ID NO: 1602953 - protein, 7 aa, Staphylococcus aureus
QRHDTEI

SEQ ID NO: 1602954 - protein, 9 aa, Staphylococcus aureus
QRQGGTRKR

SEQ ID NO: 1602955 - protein, 8 aa, Staphylococcus aureus
QRVQEAAK

SEQ ID NO: 1602956 - protein, 13 aa, Staphylococcus aureus
QRYYTGSRDENVL

SEQ ID NO: 1602957 - protein, 6 aa, Staphylococcus aureus
QSDEEV

SEQ ID NO: 1602958 - protein, 6 aa, Staphylococcus aureus
QSEEQI

SEQ ID NO: 1602959 - protein, 16 aa, Staphylococcus aureus
QSPIGRTPRSNPATYT

SEQ ID NO: 1602960 - protein, 5 aa, Staphylococcus aureus
QTDGR

SEQ ID NO: 1602961 - protein, 7 aa, Staphylococcus aureus
QTETTID

SEQ ID NO: 1602962 - protein, 7 aa, Staphylococcus aureus
QTINDKT

SEQ ID NO: 1602963 - protein, 12 aa, Staphylococcus aureus
QTNEAKIRGYQK

SEQ ID NO: 1602964 - protein, 8 aa, Staphylococcus aureus
QTNTYGAN

SEQ ID NO: 1602965 - protein, 6 aa, Staphylococcus aureus
QTSENE

SEQ ID NO: 1602966 - protein, 6 aa, Staphylococcus aureus
QTYRND

SEQ ID NO: 1602967 - protein, 6 aa, Staphylococcus aureus
QTYTDK

SEQ ID NO: 1602968 - protein, 7 aa, Staphylococcus aureus
QVEVGKT

SEQ ID NO: 1602969 - protein, 29 aa, Staphylococcus aureus
QVPEGAPFGGYKKSGIGRETYKGALSNYQ

SEQ ID NO: 1602970 - protein, 4 aa, Staphylococcus aureus
QYES

SEQ ID NO: 1602971 - protein, 14 aa, Staphylococcus aureus
QYKDKAQKAVEGIP

SEQ ID NO: 1602972 - protein, 9 aa, Staphylococcus aureus
RAEERNDDL

SEQ ID NO: 1602973 - protein, 11 aa, Staphylococcus aureus
RAGIKDPNRPI

SEQ ID NO: 1602974 - protein, 8 aa, Staphylococcus aureus
RAGQHANV

SEQ ID NO: 1602975 - protein, 4 aa, Staphylococcus aureus
RAHN

SEQ ID NO: 1602976 - protein, 13 aa, Staphylococcus aureus
RAKSEAEKSFGNS

SEQ ID NO: 1602977 - protein, 7 aa, Staphylococcus aureus
RARDDQN

SEQ ID NO: 1602978 - protein, 7 aa, Staphylococcus aureus
RARESGG

SEQ ID NO: 1602979 - protein, 16 aa, Staphylococcus aureus
RASGAGGQHINKTESA

SEQ ID NO: 1602980 - protein, 13 aa, Staphylococcus aureus
RASGTLSGGEAQR

SEQ ID NO: 1602981 - protein, 5 aa, Staphylococcus aureus
RASQG

SEQ ID NO: 1602982 - protein, 9 aa, Staphylococcus aureus
RAYSEQSDQ

SEQ ID NO: 1602983 - protein, 4 aa, Staphylococcus aureus
RDDH

SEQ ID NO: 1602984 - protein, 8 aa, Staphylococcus aureus
RDNKPGIT

SEQ ID NO: 1602985 - protein, 6 aa, Staphylococcus aureus
RDNPMD

SEQ ID NO: 1602986 - protein, 22 aa, Staphylococcus aureus
RDSGGGSMPSGLTTVPNPMVTY

SEQ ID NO: 1602987 - protein, 4 aa, Staphylococcus aureus
RDSM

SEQ ID NO: 1602988 - protein, 8 aa, Staphylococcus aureus
RDTGGGAV

SEQ ID NO: 1602989 - protein, 9 aa, Staphylococcus aureus
RDTHKDGKV

SEQ ID NO: 1602990 - protein, 8 aa, Staphylococcus aureus
RDVDQKSA

SEQ ID NO: 1602991 - protein, 8 aa, Staphylococcus aureus
RDYGTGQM

SEQ ID NO: 1602992 - protein, 5 aa, Staphylococcus aureus
RDYTA

SEQ ID NO: 1602993 - protein, 5 aa, Staphylococcus aureus
REMTH

SEQ ID NO: 1602994 - protein, 7 aa, Staphylococcus aureus
RENAQHH

SEQ ID NO: 1602995 - protein, 9 aa, Staphylococcus aureus
RERHKGSMP

SEQ ID NO: 1602996 - protein, 15 aa, Staphylococcus aureus
RETGGLPDAEKFDTA

SEQ ID NO: 1602997 - protein, 6 aa, Staphylococcus aureus
RETGGT

SEQ ID NO: 1602998 - protein, 18 aa, Staphylococcus aureus
RGDKVTGKVRKPKDNEKY

SEQ ID NO: 1602999 - protein, 5 aa, Staphylococcus aureus
RGIPK

SEQ ID NO: 1603000 - protein, 28 aa, Staphylococcus aureus
RGKKKYDKRQALKEKAVKRDVARDMKAR

SEQ ID NO: 1603001 - protein, 5 aa, Staphylococcus aureus
RGLAG

SEQ ID NO: 1603002 - protein, 4 aa, Staphylococcus aureus
RGSK

SEQ ID NO: 1603003 - protein, 7 aa, Staphylococcus aureus
RGSLSVK

SEQ ID NO: 1603004 - protein, 5 aa, Staphylococcus aureus
RHGHS

SEQ ID NO: 1603005 - protein, 5 aa, Staphylococcus aureus
RISSN

SEQ ID NO: 1603006 - protein, 12 aa, Staphylococcus aureus
RITSTTKGSVTS

SEQ ID NO: 1603007 - protein, 13 aa, Staphylococcus aureus
RKDGKYGLIQTSE

SEQ ID NO: 1603008 - protein, 9 aa, Staphylococcus aureus
RKEKEKSAV

SEQ ID NO: 1603009 - protein, 6 aa, Staphylococcus aureus
RKEMSK

SEQ ID NO: 1603010 - protein, 10 aa, Staphylococcus aureus
RKGGISKKTV

SEQ ID NO: 1603011 - protein, 4 aa, Staphylococcus aureus
RKGL

SEQ ID NO: 1603012 - protein, 8 aa, Staphylococcus aureus
RKNKRRTH

SEQ ID NO: 1603013 - protein, 6 aa, Staphylococcus aureus
RKYPEY

SEQ ID NO: 1603014 - protein, 7 aa, Staphylococcus aureus
RLNNDGH

SEQ ID NO: 1603015 - protein, 12 aa, Staphylococcus aureus
RLQEGKDDSLEG

SEQ ID NO: 1603016 - protein, 8 aa, Staphylococcus aureus
RLTKEDDI

SEQ ID NO: 1603017 - protein, 7 aa, Staphylococcus aureus
RLTSPNP

SEQ ID NO: 1603018 - protein, 5 aa, Staphylococcus aureus
RNHSD

SEQ ID NO: 1603019 - protein, 7 aa, Staphylococcus aureus
RNITSEM

SEQ ID NO: 1603020 - protein, 10 aa, Staphylococcus aureus
RNNAEKHQSQ

SEQ ID NO: 1603021 - protein, 4 aa, Staphylococcus aureus
RNPR

SEQ ID NO: 1603022 - protein, 11 aa, Staphylococcus aureus
RNTKAEEEPTI

SEQ ID NO: 1603023 - protein, 7 aa, Staphylococcus aureus
RNTKKPA

SEQ ID NO: 1603024 - protein, 16 aa, Staphylococcus aureus
RNYITTKNKRNNPERI

SEQ ID NO: 1603025 - protein, 8 aa, Staphylococcus aureus
RPANDPAL

SEQ ID NO: 1603026 - protein, 8 aa, Staphylococcus aureus
RPEEVTDL

SEQ ID NO: 1603027 - protein, 4 aa, Staphylococcus aureus
RPET

SEQ ID NO: 1603028 - protein, 10 aa, Staphylococcus aureus
RPPGREAYPG

SEQ ID NO: 1603029 - protein, 14 aa, Staphylococcus aureus
RQINGLSKNEMTEL

SEQ ID NO: 1603030 - protein, 8 aa, Staphylococcus aureus
RQRGEGER

SEQ ID NO: 1603031 - protein, 35 aa, Staphylococcus aureus
RQSKIKKSDSPALNKGFNSKKKKFTDLNSPQKRGV

SEQ ID NO: 1603032 - protein, 9 aa, Staphylococcus aureus
RRPNTDELG

SEQ ID NO: 1603033 - protein, 7 aa, Staphylococcus aureus
RRTKNNP

SEQ ID NO: 1603034 - protein, 8 aa, Staphylococcus aureus
RRTYGNAE

SEQ ID NO: 1603035 - protein, 4 aa, Staphylococcus aureus
RRVN

SEQ ID NO: 1603036 - protein, 7 aa, Staphylococcus aureus
RSASIEE

SEQ ID NO: 1603037 - protein, 5 aa, Staphylococcus aureus
RSNDP

SEQ ID NO: 1603038 - protein, 6 aa, Staphylococcus aureus
RTKNKE

SEQ ID NO: 1603039 - protein, 11 aa, Staphylococcus aureus
RTREEKDERNL

SEQ ID NO: 1603040 - protein, 7 aa, Staphylococcus aureus
RTTEERH

SEQ ID NO: 1603041 - protein, 6 aa, Staphylococcus aureus
RVGKEP

SEQ ID NO: 1603042 - protein, 7 aa, Staphylococcus aureus
RVKKSRA

SEQ ID NO: 1603043 - protein, 8 aa, Staphylococcus aureus
RVNTQTHE

SEQ ID NO: 1603044 - protein, 16 aa, Staphylococcus aureus
RVPETESGGRIHTSTA

SEQ ID NO: 1603045 - protein, 6 aa, Staphylococcus aureus
RVPHGA

SEQ ID NO: 1603046 - protein, 6 aa, Staphylococcus aureus
RWTPEY

SEQ ID NO: 1603047 - protein, 18 aa, Staphylococcus aureus
RYEDLDGKKESKNDPELG

SEQ ID NO: 1603048 - protein, 8 aa, Staphylococcus aureus
RYQPATPT

SEQ ID NO: 1603049 - protein, 10 aa, Staphylococcus aureus
SAGCANDTKA

SEQ ID NO: 1603050 - protein, 5 aa, Staphylococcus aureus
SAGGV

SEQ ID NO: 1603051 - protein, 6 aa, Staphylococcus aureus
SAGTLN

SEQ ID NO: 1603052 - protein, 17 aa, Staphylococcus aureus
SALKNESDNASKQRLQE

SEQ ID NO: 1603053 - protein, 6 aa, Staphylococcus aureus
SAQYES

SEQ ID NO: 1603054 - protein, 14 aa, Staphylococcus aureus
SASAYGKKTRSVKS

SEQ ID NO: 1603055 - protein, 15 aa, Staphylococcus aureus
SASEFQKGEHKNVEG

SEQ ID NO: 1603056 - protein, 7 aa, Staphylococcus aureus
SASEPSP

SEQ ID NO: 1603057 - protein, 10 aa, Staphylococcus aureus
SASKSPEEIK

SEQ ID NO: 1603058 - protein, 8 aa, Staphylococcus aureus
SASVTTRD

SEQ ID NO: 1603059 - protein, 8 aa, Staphylococcus aureus
SDAPSDDD

SEQ ID NO: 1603060 - protein, 6 aa, Staphylococcus aureus
SDGDGI

SEQ ID NO: 1603061 - protein, 10 aa, Staphylococcus aureus
SDIKSPNTEI

SEQ ID NO: 1603062 - protein, 8 aa, Staphylococcus aureus
SDMGGDYD

SEQ ID NO: 1603063 - protein, 9 aa, Staphylococcus aureus
SDQTNDNIN

SEQ ID NO: 1603064 - protein, 8 aa, Staphylococcus aureus
SDSHPFYT

SEQ ID NO: 1603065 - protein, 7 aa, Staphylococcus aureus
SDSMRTK

SEQ ID NO: 1603066 - protein, 25 aa, Staphylococcus aureus
SEAEMGSPTRGGRPSTHAVKADDGY

SEQ ID NO: 1603067 - protein, 7 aa, Staphylococcus aureus
SEAQQTQ

SEQ ID NO: 1603068 - protein, 16 aa, Staphylococcus aureus
SEELTEESESKRPSVQ

SEQ ID NO: 1603069 - protein, 9 aa, Staphylococcus aureus
SEEQREKIA

SEQ ID NO: 1603070 - protein, 6 aa, Staphylococcus aureus
SEGIPE

SEQ ID NO: 1603071 - protein, 4 aa, Staphylococcus aureus
SEGQ

SEQ ID NO: 1603072 - protein, 6 aa, Staphylococcus aureus
SEITGV

SEQ ID NO: 1603073 - protein, 5 aa, Staphylococcus aureus
SELGG

SEQ ID NO: 1603074 - protein, 6 aa, Staphylococcus aureus
SENEGD

SEQ ID NO: 1603075 - protein, 6 aa, Staphylococcus aureus
SEQYEE

SEQ ID NO: 1603076 - protein, 10 aa, Staphylococcus aureus
SETDDKEEVE

SEQ ID NO: 1603077 - protein, 6 aa, Staphylococcus aureus
SETEQL

SEQ ID NO: 1603078 - protein, 4 aa, Staphylococcus aureus
SEVI

SEQ ID NO: 1603079 - protein, 4 aa, Staphylococcus aureus
SEWN

SEQ ID NO: 1603080 - protein, 12 aa, Staphylococcus aureus
SFNDTTGNGIGD

SEQ ID NO: 1603081 - protein, 5 aa, Staphylococcus aureus
SFYNS

SEQ ID NO: 1603082 - protein, 5 aa, Staphylococcus aureus
SGAAL

SEQ ID NO: 1603083 - protein, 5 aa, Staphylococcus aureus
SGAGP

SEQ ID NO: 1603084 - protein, 4 aa, Staphylococcus aureus
SGAL

SEQ ID NO: 1603085 - protein, 6 aa, Staphylococcus aureus
SGDKEI

SEQ ID NO: 1603086 - protein, 13 aa, Staphylococcus aureus
SGDPKDIERADEE

SEQ ID NO: 1603087 - protein, 5 aa, Staphylococcus aureus
SGGDA

SEQ ID NO: 1603088 - protein, 19 aa, Staphylococcus aureus
SGGDQKKRGHGGYVGEDQI

SEQ ID NO: 1603089 - protein, 11 aa, Staphylococcus aureus
SGGGSGHEPAH

SEQ ID NO: 1603090 - protein, 5 aa, Staphylococcus aureus
SGGLS

SEQ ID NO: 1603091 - protein, 5 aa, Staphylococcus aureus
SGGMK

SEQ ID NO: 1603092 - protein, 9 aa, Staphylococcus aureus
SGGNNAGHT

SEQ ID NO: 1603093 - protein, 7 aa, Staphylococcus aureus
SGGNPAL

SEQ ID NO: 1603094 - protein, 7 aa, Staphylococcus aureus
SGGNSSM

SEQ ID NO: 1603095 - protein, 6 aa, Staphylococcus aureus
SGIGGG

SEQ ID NO: 1603096 - protein, 6 aa, Staphylococcus aureus
SGKSEE

SEQ ID NO: 1603097 - protein, 11 aa, Staphylococcus aureus
SGLTSQPSANS

SEQ ID NO: 1603098 - protein, 7 aa, Staphylococcus aureus
SGNKPNI

SEQ ID NO: 1603099 - protein, 16 aa, Staphylococcus aureus
SGQQQTDFNTPVIQQY

SEQ ID NO: 1603100 - protein, 15 aa, Staphylococcus aureus
SGQTLSEITSKSITQ

SEQ ID NO: 1603101 - protein, 11 aa, Staphylococcus aureus
SGSTGEPKGVQ

SEQ ID NO: 1603102 - protein, 10 aa, Staphylococcus aureus
SGSTKTSSEM

SEQ ID NO: 1603103 - protein, 11 aa, Staphylococcus aureus
SGTTGNPKGTL

SEQ ID NO: 1603104 - protein, 18 aa, Staphylococcus aureus
SGVDGAIGSTYNVNGRRA

SEQ ID NO: 1603105 - protein, 8 aa, Staphylococcus aureus
SHISPKTK

SEQ ID NO: 1603106 - protein, 9 aa, Staphylococcus aureus
SHKSDDEWR

SEQ ID NO: 1603107 - protein, 19 aa, Staphylococcus aureus
SHNHPSAIEPYQGAATGVG

SEQ ID NO: 1603108 - protein, 5 aa, Staphylococcus aureus
SHQSI

SEQ ID NO: 1603109 - protein, 5 aa, Staphylococcus aureus
SIDAS

SEQ ID NO: 1603110 - protein, 6 aa, Staphylococcus aureus
SIEAGT

SEQ ID NO: 1603111 - protein, 4 aa, Staphylococcus aureus
SIED

SEQ ID NO: 1603112 - protein, 5 aa, Staphylococcus aureus
SIEDM

SEQ ID NO: 1603113 - protein, 6 aa, Staphylococcus aureus
SIEPGK

SEQ ID NO: 1603114 - protein, 4 aa, Staphylococcus aureus
SISG

SEQ ID NO: 1603115 - protein, 8 aa, Staphylococcus aureus
SKAPTFEE

SEQ ID NO: 1603116 - protein, 7 aa, Staphylococcus aureus
SKDMASY

SEQ ID NO: 1603117 - protein, 7 aa, Staphylococcus aureus
SKDNKLH

SEQ ID NO: 1603118 - protein, 10 aa, Staphylococcus aureus
SKDQSDDETI

SEQ ID NO: 1603119 - protein, 7 aa, Staphylococcus aureus
SKDVDPV

SEQ ID NO: 1603120 - protein, 5 aa, Staphylococcus aureus
SKEQE

SEQ ID NO: 1603121 - protein, 7 aa, Staphylococcus aureus
SKETVLE

SEQ ID NO: 1603122 - protein, 6 aa, Staphylococcus aureus
SKFDSD

SEQ ID NO: 1603123 - protein, 13 aa, Staphylococcus aureus
SKGEIEAVPGRTM

SEQ ID NO: 1603124 - protein, 8 aa, Staphylococcus aureus
SKGREPYQ

SEQ ID NO: 1603125 - protein, 7 aa, Staphylococcus aureus
SKHTAPH

SEQ ID NO: 1603126 - protein, 10 aa, Staphylococcus aureus
SKIGNDGKDW

SEQ ID NO: 1603127 - protein, 8 aa, Staphylococcus aureus
SKKLTNAD

SEQ ID NO: 1603128 - protein, 8 aa, Staphylococcus aureus
SKKVPSRY

SEQ ID NO: 1603129 - protein, 26 aa, Staphylococcus aureus
SKRGLETAVGDEGGFAPKFEGTEDAV

SEQ ID NO: 1603130 - protein, 9 aa, Staphylococcus aureus
SKRTPDGEF

SEQ ID NO: 1603131 - protein, 8 aa, Staphylococcus aureus
SKSHSATG

SEQ ID NO: 1603132 - protein, 9 aa, Staphylococcus aureus
SLDRGTKTL

SEQ ID NO: 1603133 - protein, 5 aa, Staphylococcus aureus
SLEHQ

SEQ ID NO: 1603134 - protein, 7 aa, Staphylococcus aureus
SLGDKQG

SEQ ID NO: 1603135 - protein, 11 aa, Staphylococcus aureus
SLNKDDDIDQE

SEQ ID NO: 1603136 - protein, 18 aa, Staphylococcus aureus
SLTQKEQQRIEKALSNGE

SEQ ID NO: 1603137 - protein, 5 aa, Staphylococcus aureus
SLYEK

SEQ ID NO: 1603138 - protein, 10 aa, Staphylococcus aureus
SNASGEGNQL

SEQ ID NO: 1603139 - protein, 6 aa, Staphylococcus aureus
SNEYDM

SEQ ID NO: 1603140 - protein, 8 aa, Staphylococcus aureus
SNKPSSPI

SEQ ID NO: 1603141 - protein, 15 aa, Staphylococcus aureus
SNKTHQLPSNSIDSF

SEQ ID NO: 1603142 - protein, 5 aa, Staphylococcus aureus
SNLSS

SEQ ID NO: 1603143 - protein, 8 aa, Staphylococcus aureus
SPGGSVTA

SEQ ID NO: 1603144 - protein, 9 aa, Staphylococcus aureus
SPGSRSTPL

SEQ ID NO: 1603145 - protein, 12 aa, Staphylococcus aureus
SPIGNDVKTTWE

SEQ ID NO: 1603146 - protein, 7 aa, Staphylococcus aureus
SPRGKAD

SEQ ID NO: 1603147 - protein, 7 aa, Staphylococcus aureus
SQDEEEM

SEQ ID NO: 1603148 - protein, 8 aa, Staphylococcus aureus
SQDEEIAK

SEQ ID NO: 1603149 - protein, 5 aa, Staphylococcus aureus
SQIET

SEQ ID NO: 1603150 - protein, 5 aa, Staphylococcus aureus
SQIID

SEQ ID NO: 1603151 - protein, 4 aa, Staphylococcus aureus
SQKK

SEQ ID NO: 1603152 - protein, 9 aa, Staphylococcus aureus
SQNHIEGNT

SEQ ID NO: 1603153 - protein, 6 aa, Staphylococcus aureus
SQPREV

SEQ ID NO: 1603154 - protein, 7 aa, Staphylococcus aureus
SQTGETF

SEQ ID NO: 1603155 - protein, 6 aa, Staphylococcus aureus
SQTKNN

SEQ ID NO: 1603156 - protein, 8 aa, Staphylococcus aureus
SRKNSDVN

SEQ ID NO: 1603157 - protein, 15 aa, Staphylococcus aureus
SRLDTPKQRAQHYPL

SEQ ID NO: 1603158 - protein, 9 aa, Staphylococcus aureus
SRNQPKLRE

SEQ ID NO: 1603159 - protein, 5 aa, Staphylococcus aureus
SRRTI

SEQ ID NO: 1603160 - protein, 23 aa, Staphylococcus aureus
SSATNGKLSQKSYEDLEEQTGMP

SEQ ID NO: 1603161 - protein, 6 aa, Staphylococcus aureus
SSDTTT

SEQ ID NO: 1603162 - protein, 5 aa, Staphylococcus aureus
SSFTE

SEQ ID NO: 1603163 - protein, 6 aa, Staphylococcus aureus
SSGGFG

SEQ ID NO: 1603164 - protein, 18 aa, Staphylococcus aureus
SSGVTGENIHVDSGFHAI

SEQ ID NO: 1603165 - protein, 14 aa, Staphylococcus aureus
SSISYAGGKDLKSL

SEQ ID NO: 1603166 - protein, 17 aa, Staphylococcus aureus
SSKQGIGTSRPIVYERL

SEQ ID NO: 1603167 - protein, 12 aa, Staphylococcus aureus
SSLDDTTKDESI

SEQ ID NO: 1603168 - protein, 6 aa, Staphylococcus aureus
SSLNPR

SEQ ID NO: 1603169 - protein, 5 aa, Staphylococcus aureus
SSNEF

SEQ ID NO: 1603170 - protein, 6 aa, Staphylococcus aureus
SSNNYA

SEQ ID NO: 1603171 - protein, 14 aa, Staphylococcus aureus
SSPIPGNTKSINRT

SEQ ID NO: 1603172 - protein, 8 aa, Staphylococcus aureus
SSSAKGQE

SEQ ID NO: 1603173 - protein, 6 aa, Staphylococcus aureus
SSSDTE

SEQ ID NO: 1603174 - protein, 6 aa, Staphylococcus aureus
SSTARA

SEQ ID NO: 1603175 - protein, 6 aa, Staphylococcus aureus
SSTEQL

SEQ ID NO: 1603176 - protein, 22 aa, Staphylococcus aureus
SSTQERASDTLENVAPNQSYQR

SEQ ID NO: 1603177 - protein, 6 aa, Staphylococcus aureus
SSTYTK

SEQ ID NO: 1603178 - protein, 12 aa, Staphylococcus aureus
STAKQLSKIGGG

SEQ ID NO: 1603179 - protein, 4 aa, Staphylococcus aureus
STCN

SEQ ID NO: 1603180 - protein, 6 aa, Staphylococcus aureus
STGDDV

SEQ ID NO: 1603181 - protein, 17 aa, Staphylococcus aureus
STGNTSASAAAYAARAG

SEQ ID NO: 1603182 - protein, 4 aa, Staphylococcus aureus
STGR

SEQ ID NO: 1603183 - protein, 13 aa, Staphylococcus aureus
STPSGSTAYNKAL

SEQ ID NO: 1603184 - protein, 10 aa, Staphylococcus aureus
STRDNPVAQA

SEQ ID NO: 1603185 - protein, 6 aa, Staphylococcus aureus
STTTPL

SEQ ID NO: 1603186 - protein, 11 aa, Staphylococcus aureus
SVETDEDISKE

SEQ ID NO: 1603187 - protein, 5 aa, Staphylococcus aureus
SVGAT

SEQ ID NO: 1603188 - protein, 8 aa, Staphylococcus aureus
SVNQDNPS

SEQ ID NO: 1603189 - protein, 11 aa, Staphylococcus aureus
SVSNSGGLGTI

SEQ ID NO: 1603190 - protein, 6 aa, Staphylococcus aureus
TAAGGS

SEQ ID NO: 1603191 - protein, 5 aa, Staphylococcus aureus
TADGM

SEQ ID NO: 1603192 - protein, 11 aa, Staphylococcus aureus
TAEEAGKPEAW

SEQ ID NO: 1603193 - protein, 19 aa, Staphylococcus aureus
TAEELDQNSGQTPGIPTGY

SEQ ID NO: 1603194 - protein, 9 aa, Staphylococcus aureus
TAEKPGDIM

SEQ ID NO: 1603195 - protein, 9 aa, Staphylococcus aureus
TAETITSYD

SEQ ID NO: 1603196 - protein, 5 aa, Staphylococcus aureus
TAGEI

SEQ ID NO: 1603197 - protein, 10 aa, Staphylococcus aureus
TAHREHASNV

SEQ ID NO: 1603198 - protein, 6 aa, Staphylococcus aureus
TAKEKG

SEQ ID NO: 1603199 - protein, 6 aa, Staphylococcus aureus
TALSSK

SEQ ID NO: 1603200 - protein, 6 aa, Staphylococcus aureus
TANEAG

SEQ ID NO: 1603201 - protein, 6 aa, Staphylococcus aureus
TAQPEG

SEQ ID NO: 1603202 - protein, 6 aa, Staphylococcus aureus
TAQTGA

SEQ ID NO: 1603203 - protein, 5 aa, Staphylococcus aureus
TASPE

SEQ ID NO: 1603204 - protein, 5 aa, Staphylococcus aureus
TDAAP

SEQ ID NO: 1603205 - protein, 8 aa, Staphylococcus aureus
TDARTAEM

SEQ ID NO: 1603206 - protein, 9 aa, Staphylococcus aureus
TDDSTGAIA

SEQ ID NO: 1603207 - protein, 25 aa, Staphylococcus aureus
TDEAKEGRDAFKEKRDPDFDQFPKF

SEQ ID NO: 1603208 - protein, 8 aa, Staphylococcus aureus
TDEDHPTQ

SEQ ID NO: 1603209 - protein, 8 aa, Staphylococcus aureus
TDEEINKK

SEQ ID NO: 1603210 - protein, 13 aa, Staphylococcus aureus
TDKDKAQAHIEAG

SEQ ID NO: 1603211 - protein, 9 aa, Staphylococcus aureus
TDRDSSQRD

SEQ ID NO: 1603212 - protein, 12 aa, Staphylococcus aureus
TDRKAQSEQDQA

SEQ ID NO: 1603213 - protein, 11 aa, Staphylococcus aureus
TDYNPGSSVTN

SEQ ID NO: 1603214 - protein, 8 aa, Staphylococcus aureus
TEARKHGK

SEQ ID NO: 1603215 - protein, 18 aa, Staphylococcus aureus
TEDGTDEIISTRSKTYQK

SEQ ID NO: 1603216 - protein, 7 aa, Staphylococcus aureus
TEKMAGQ

SEQ ID NO: 1603217 - protein, 12 aa, Staphylococcus aureus
TEMGSNPTELDQ

SEQ ID NO: 1603218 - protein, 18 aa, Staphylococcus aureus
TENRKKRIDSLSKGNQQK

SEQ ID NO: 1603219 - protein, 5 aa, Staphylococcus aureus
TEPDI

SEQ ID NO: 1603220 - protein, 6 aa, Staphylococcus aureus
TEQASK

SEQ ID NO: 1603221 - protein, 7 aa, Staphylococcus aureus
TERQTKD

SEQ ID NO: 1603222 - protein, 6 aa, Staphylococcus aureus
TGDMPF

SEQ ID NO: 1603223 - protein, 6 aa, Staphylococcus aureus
TGDTEV

SEQ ID NO: 1603224 - protein, 9 aa, Staphylococcus aureus
TGEDIHPTT

SEQ ID NO: 1603225 - protein, 7 aa, Staphylococcus aureus
TGFGTGG

SEQ ID NO: 1603226 - protein, 9 aa, Staphylococcus aureus
TGGATSTAS

SEQ ID NO: 1603227 - protein, 10 aa, Staphylococcus aureus
TGGSEWTKNI

SEQ ID NO: 1603228 - protein, 6 aa, Staphylococcus aureus
TGIGGD

SEQ ID NO: 1603229 - protein, 8 aa, Staphylococcus aureus
TGISEPVP

SEQ ID NO: 1603230 - protein, 9 aa, Staphylococcus aureus
TGLSNPMKS

SEQ ID NO: 1603231 - protein, 14 aa, Staphylococcus aureus
TGQAIGRPKTGTYA

SEQ ID NO: 1603232 - protein, 5 aa, Staphylococcus aureus
TGQPD

SEQ ID NO: 1603233 - protein, 5 aa, Staphylococcus aureus
TGQTV

SEQ ID NO: 1603234 - protein, 7 aa, Staphylococcus aureus
TGRDGIH

SEQ ID NO: 1603235 - protein, 10 aa, Staphylococcus aureus
TGSPASSPHF

SEQ ID NO: 1603236 - protein, 4 aa, Staphylococcus aureus
TGTV

SEQ ID NO: 1603237 - protein, 9 aa, Staphylococcus aureus
TGYSAAQSL

SEQ ID NO: 1603238 - protein, 4 aa, Staphylococcus aureus
THDD

SEQ ID NO: 1603239 - protein, 6 aa, Staphylococcus aureus
THDEDA

SEQ ID NO: 1603240 - protein, 6 aa, Staphylococcus aureus
THNSND

SEQ ID NO: 1603241 - protein, 7 aa, Staphylococcus aureus
THSHPAS

SEQ ID NO: 1603242 - protein, 6 aa, Staphylococcus aureus
TIAENG

SEQ ID NO: 1603243 - protein, 8 aa, Staphylococcus aureus
TIETHQQG

SEQ ID NO: 1603244 - protein, 8 aa, Staphylococcus aureus
TIQGEGRV

SEQ ID NO: 1603245 - protein, 4 aa, Staphylococcus aureus
TITY

SEQ ID NO: 1603246 - protein, 8 aa, Staphylococcus aureus
TKAGGLPV

SEQ ID NO: 1603247 - protein, 9 aa, Staphylococcus aureus
TKDDFGGSQ

SEQ ID NO: 1603248 - protein, 7 aa, Staphylococcus aureus
TKEEKET

SEQ ID NO: 1603249 - protein, 6 aa, Staphylococcus aureus
TKEELH

SEQ ID NO: 1603250 - protein, 8 aa, Staphylococcus aureus
TKFEAGTP

SEQ ID NO: 1603251 - protein, 9 aa, Staphylococcus aureus
TKGGEEASL

SEQ ID NO: 1603252 - protein, 7 aa, Staphylococcus aureus
TKGTAKD

SEQ ID NO: 1603253 - protein, 9 aa, Staphylococcus aureus
TKKAEVGSE

SEQ ID NO: 1603254 - protein, 7 aa, Staphylococcus aureus
TKQAAAY

SEQ ID NO: 1603255 - protein, 4 aa, Staphylococcus aureus
TKYF

SEQ ID NO: 1603256 - protein, 8 aa, Staphylococcus aureus
TKYRGEFE

SEQ ID NO: 1603257 - protein, 9 aa, Staphylococcus aureus
TLDQETLET

SEQ ID NO: 1603258 - protein, 5 aa, Staphylococcus aureus
TLENN

SEQ ID NO: 1603259 - protein, 9 aa, Staphylococcus aureus
TMKTENGST

SEQ ID NO: 1603260 - protein, 17 aa, Staphylococcus aureus
TNAGQIKTGSLSRTDRI

SEQ ID NO: 1603261 - protein, 6 aa, Staphylococcus aureus
TNANFD

SEQ ID NO: 1603262 - protein, 5 aa, Staphylococcus aureus
TNGQV

SEQ ID NO: 1603263 - protein, 10 aa, Staphylococcus aureus
TNISQDQMQE

SEQ ID NO: 1603264 - protein, 6 aa, Staphylococcus aureus
TNKAEK

SEQ ID NO: 1603265 - protein, 5 aa, Staphylococcus aureus
TNKIG

SEQ ID NO: 1603266 - protein, 4 aa, Staphylococcus aureus
TNKR

SEQ ID NO: 1603267 - protein, 7 aa, Staphylococcus aureus
TNNLETI

SEQ ID NO: 1603268 - protein, 6 aa, Staphylococcus aureus
TNNVDN

SEQ ID NO: 1603269 - protein, 7 aa, Staphylococcus aureus
TNQDANE

SEQ ID NO: 1603270 - protein, 7 aa, Staphylococcus aureus
TNRKRGE

SEQ ID NO: 1603271 - protein, 5 aa, Staphylococcus aureus
TNTFP

SEQ ID NO: 1603272 - protein, 7 aa, Staphylococcus aureus
TNTSGIP

SEQ ID NO: 1603273 - protein, 9 aa, Staphylococcus aureus
TPAKKEISD

SEQ ID NO: 1603274 - protein, 5 aa, Staphylococcus aureus
TPAKV

SEQ ID NO: 1603275 - protein, 7 aa, Staphylococcus aureus
TPEISSD

SEQ ID NO: 1603276 - protein, 4 aa, Staphylococcus aureus
TPEQ

SEQ ID NO: 1603277 - protein, 10 aa, Staphylococcus aureus
TPGHADFGGE

SEQ ID NO: 1603278 - protein, 14 aa, Staphylococcus aureus
TPKEIKQTKEGLKT

SEQ ID NO: 1603279 - protein, 15 aa, Staphylococcus aureus
TPLSHDTKQEISTPY

SEQ ID NO: 1603280 - protein, 9 aa, Staphylococcus aureus
TPNETGAGF

SEQ ID NO: 1603281 - protein, 14 aa, Staphylococcus aureus
TPNHSQYIESQGVN

SEQ ID NO: 1603282 - protein, 6 aa, Staphylococcus aureus
TPNHTE

SEQ ID NO: 1603283 - protein, 6 aa, Staphylococcus aureus
TPNRAD

SEQ ID NO: 1603284 - protein, 6 aa, Staphylococcus aureus
TPRGGI

SEQ ID NO: 1603285 - protein, 4 aa, Staphylococcus aureus
TPRP

SEQ ID NO: 1603286 - protein, 4 aa, Staphylococcus aureus
TPTG

SEQ ID NO: 1603287 - protein, 8 aa, Staphylococcus aureus
TQPERQEL

SEQ ID NO: 1603288 - protein, 6 aa, Staphylococcus aureus
TRMEDE

SEQ ID NO: 1603289 - protein, 6 aa, Staphylococcus aureus
TRNQYG

SEQ ID NO: 1603290 - protein, 5 aa, Staphylococcus aureus
TRNTS

SEQ ID NO: 1603291 - protein, 7 aa, Staphylococcus aureus
TRQRKRA

SEQ ID NO: 1603292 - protein, 9 aa, Staphylococcus aureus
TRQSGDTFK

SEQ ID NO: 1603293 - protein, 8 aa, Staphylococcus aureus
TSAGSSKI

SEQ ID NO: 1603294 - protein, 12 aa, Staphylococcus aureus
TSGQLTDRQYKT

SEQ ID NO: 1603295 - protein, 6 aa, Staphylococcus aureus
TSKEGL

SEQ ID NO: 1603296 - protein, 11 aa, Staphylococcus aureus
TSLLGADDKAG

SEQ ID NO: 1603297 - protein, 6 aa, Staphylococcus aureus
TSNELS

SEQ ID NO: 1603298 - protein, 17 aa, Staphylococcus aureus
TSPVQARTMESRHGQGP

SEQ ID NO: 1603299 - protein, 10 aa, Staphylococcus aureus
TSQDSNASEL

SEQ ID NO: 1603300 - protein, 5 aa, Staphylococcus aureus
TSTEH

SEQ ID NO: 1603301 - protein, 15 aa, Staphylococcus aureus
TSTGFAGGGATAEDV

SEQ ID NO: 1603302 - protein, 5 aa, Staphylococcus aureus
TSTHN

SEQ ID NO: 1603303 - protein, 6 aa, Staphylococcus aureus
TSYGVK

SEQ ID NO: 1603304 - protein, 4 aa, Staphylococcus aureus
TTAE

SEQ ID NO: 1603305 - protein, 14 aa, Staphylococcus aureus
TTDPVSTKQLAQDV

SEQ ID NO: 1603306 - protein, 5 aa, Staphylococcus aureus
TTGAE

SEQ ID NO: 1603307 - protein, 6 aa, Staphylococcus aureus
TTPSEF

SEQ ID NO: 1603308 - protein, 5 aa, Staphylococcus aureus
TVGKG

SEQ ID NO: 1603309 - protein, 8 aa, Staphylococcus aureus
TYADQQGN

SEQ ID NO: 1603310 - protein, 12 aa, Staphylococcus aureus
TYHTGDKAKFEN

SEQ ID NO: 1603311 - protein, 9 aa, Staphylococcus aureus
TYSNSATKI

SEQ ID NO: 1603312 - protein, 10 aa, Staphylococcus aureus
TYTKTGGNAD

SEQ ID NO: 1603313 - protein, 11 aa, Staphylococcus aureus
VAGASSNTNHP

SEQ ID NO: 1603314 - protein, 14 aa, Staphylococcus aureus
VAGNQSVDKNTTNA

SEQ ID NO: 1603315 - protein, 9 aa, Staphylococcus aureus
VAKASTGAI

SEQ ID NO: 1603316 - protein, 7 aa, Staphylococcus aureus
VAPTDEQ

SEQ ID NO: 1603317 - protein, 5 aa, Staphylococcus aureus
VASEA

SEQ ID NO: 1603318 - protein, 8 aa, Staphylococcus aureus
VDDNYKSN

SEQ ID NO: 1603319 - protein, 6 aa, Staphylococcus aureus
VDEEEV

SEQ ID NO: 1603320 - protein, 15 aa, Staphylococcus aureus
VDERAMDSNDIERER

SEQ ID NO: 1603321 - protein, 6 aa, Staphylococcus aureus
VDKATE

SEQ ID NO: 1603322 - protein, 5 aa, Staphylococcus aureus
VDKGT

SEQ ID NO: 1603323 - protein, 6 aa, Staphylococcus aureus
VEEIKA

SEQ ID NO: 1603324 - protein, 7 aa, Staphylococcus aureus
VEKTGRA

SEQ ID NO: 1603325 - protein, 12 aa, Staphylococcus aureus
VENELGKEEQFK

SEQ ID NO: 1603326 - protein, 6 aa, Staphylococcus aureus
VEPKVS

SEQ ID NO: 1603327 - protein, 10 aa, Staphylococcus aureus
VEPNPSTNTV

SEQ ID NO: 1603328 - protein, 12 aa, Staphylococcus aureus
VEQTNTPGSLNP

SEQ ID NO: 1603329 - protein, 5 aa, Staphylococcus aureus
VETER

SEQ ID NO: 1603330 - protein, 5 aa, Staphylococcus aureus
VETGD

SEQ ID NO: 1603331 - protein, 5 aa, Staphylococcus aureus
VFEKG

SEQ ID NO: 1603332 - protein, 5 aa, Staphylococcus aureus
VFNKG

SEQ ID NO: 1603333 - protein, 7 aa, Staphylococcus aureus
VGAPQAI

SEQ ID NO: 1603334 - protein, 11 aa, Staphylococcus aureus
VGESTTPAIKS

SEQ ID NO: 1603335 - protein, 7 aa, Staphylococcus aureus
VGKPANI

SEQ ID NO: 1603336 - protein, 10 aa, Staphylococcus aureus
VGPNGAGKTT

SEQ ID NO: 1603337 - protein, 12 aa, Staphylococcus aureus
VGQSGNLTPADK

SEQ ID NO: 1603338 - protein, 10 aa, Staphylococcus aureus
VGSGKTGQEI

SEQ ID NO: 1603339 - protein, 8 aa, Staphylococcus aureus
VGTGVGPT

SEQ ID NO: 1603340 - protein, 12 aa, Staphylococcus aureus
VHGPYKGEPKLG

SEQ ID NO: 1603341 - protein, 9 aa, Staphylococcus aureus
VHPGSAKNA

SEQ ID NO: 1603342 - protein, 24 aa, Staphylococcus aureus
VIDPEGNDVTPEKIKEIQQKRDNK

SEQ ID NO: 1603343 - protein, 7 aa, Staphylococcus aureus
VISEETA

SEQ ID NO: 1603344 - protein, 10 aa, Staphylococcus aureus
VKNDNAQGEY

SEQ ID NO: 1603345 - protein, 5 aa, Staphylococcus aureus
VKPNN

SEQ ID NO: 1603346 - protein, 4 aa, Staphylococcus aureus
VKQP

SEQ ID NO: 1603347 - protein, 4 aa, Staphylococcus aureus
VKQV

SEQ ID NO: 1603348 - protein, 14 aa, Staphylococcus aureus
VKRDPRTNMRDAQN

SEQ ID NO: 1603349 - protein, 13 aa, Staphylococcus aureus
VKSTIKQGKVHTF

SEQ ID NO: 1603350 - protein, 5 aa, Staphylococcus aureus
VNEHG

SEQ ID NO: 1603351 - protein, 5 aa, Staphylococcus aureus
VNEPN

SEQ ID NO: 1603352 - protein, 8 aa, Staphylococcus aureus
VNTGTKEF

SEQ ID NO: 1603353 - protein, 5 aa, Staphylococcus aureus
VPGDT

SEQ ID NO: 1603354 - protein, 6 aa, Staphylococcus aureus
VPKASS

SEQ ID NO: 1603355 - protein, 5 aa, Staphylococcus aureus
VPLPD

SEQ ID NO: 1603356 - protein, 8 aa, Staphylococcus aureus
VPQENAGA

SEQ ID NO: 1603357 - protein, 10 aa, Staphylococcus aureus
VPRRRAKQKA

SEQ ID NO: 1603358 - protein, 5 aa, Staphylococcus aureus
VPSNH

SEQ ID NO: 1603359 - protein, 10 aa, Staphylococcus aureus
VPSSIPSDAY

SEQ ID NO: 1603360 - protein, 5 aa, Staphylococcus aureus
VPVRS

SEQ ID NO: 1603361 - protein, 8 aa, Staphylococcus aureus
VQEETGRT

SEQ ID NO: 1603362 - protein, 7 aa, Staphylococcus aureus
VQEPDEG

SEQ ID NO: 1603363 - protein, 8 aa, Staphylococcus aureus
VQNEDEAK

SEQ ID NO: 1603364 - protein, 11 aa, Staphylococcus aureus
VQQDKSYNMTQ

SEQ ID NO: 1603365 - protein, 4 aa, Staphylococcus aureus
VQRR

SEQ ID NO: 1603366 - protein, 7 aa, Staphylococcus aureus
VRERNPF

SEQ ID NO: 1603367 - protein, 15 aa, Staphylococcus aureus
VRLKSDDDGQQSPIL

SEQ ID NO: 1603368 - protein, 5 aa, Staphylococcus aureus
VSDEK

SEQ ID NO: 1603369 - protein, 15 aa, Staphylococcus aureus
VSDRENSMTAGPRGP

SEQ ID NO: 1603370 - protein, 8 aa, Staphylococcus aureus
VSEPDVED

SEQ ID NO: 1603371 - protein, 9 aa, Staphylococcus aureus
VSGKGGTNF

SEQ ID NO: 1603372 - protein, 8 aa, Staphylococcus aureus
VSGNGAYS

SEQ ID NO: 1603373 - protein, 7 aa, Staphylococcus aureus
VSHNGNA

SEQ ID NO: 1603374 - protein, 9 aa, Staphylococcus aureus
VSKSEAKSM

SEQ ID NO: 1603375 - protein, 9 aa, Staphylococcus aureus
VSNTDSPDT

SEQ ID NO: 1603376 - protein, 8 aa, Staphylococcus aureus
VSQPEDVS

SEQ ID NO: 1603377 - protein, 6 aa, Staphylococcus aureus
VSRDDA

SEQ ID NO: 1603378 - protein, 9 aa, Staphylococcus aureus
VSTSETRPV

SEQ ID NO: 1603379 - protein, 17 aa, Staphylococcus aureus
VTAKTKAGNSCGKCKPQ

SEQ ID NO: 1603380 - protein, 6 aa, Staphylococcus aureus
VTEPGY

SEQ ID NO: 1603381 - protein, 6 aa, Staphylococcus aureus
VTGGST

SEQ ID NO: 1603382 - protein, 7 aa, Staphylococcus aureus
VTGRPRG

SEQ ID NO: 1603383 - protein, 7 aa, Staphylococcus aureus
VTHSKDG

SEQ ID NO: 1603384 - protein, 4 aa, Staphylococcus aureus
VTLT

SEQ ID NO: 1603385 - protein, 10 aa, Staphylococcus aureus
VTQQPFDTSR

SEQ ID NO: 1603386 - protein, 10 aa, Staphylococcus aureus
VTSKNKTEEK

SEQ ID NO: 1603387 - protein, 10 aa, Staphylococcus aureus
VTTTTSGKEA

SEQ ID NO: 1603388 - protein, 10 aa, Staphylococcus aureus
VTTVDGPKLS

SEQ ID NO: 1603389 - protein, 10 aa, Staphylococcus aureus
VTYKKDENAV

SEQ ID NO: 1603390 - protein, 9 aa, Staphylococcus aureus
VYRNNTGSL

SEQ ID NO: 1603391 - protein, 7 aa, Staphylococcus aureus
WDNPEVR

SEQ ID NO: 1603392 - protein, 8 aa, Staphylococcus aureus
WEDQEHYK

SEQ ID NO: 1603393 - protein, 6 aa, Staphylococcus aureus
WGQSTV

SEQ ID NO: 1603394 - protein, 10 aa, Staphylococcus aureus
WQGPPRLQNG

SEQ ID NO: 1603395 - protein, 9 aa, Staphylococcus aureus
WYGEDKVKS

SEQ ID NO: 1603396 - protein, 13 aa, Staphylococcus aureus
YAARRSNSAGMQV

SEQ ID NO: 1603397 - protein, 12 aa, Staphylococcus aureus
YANAKDGLKGTS

SEQ ID NO: 1603398 - protein, 7 aa, Staphylococcus aureus
YAQPGET

SEQ ID NO: 1603399 - protein, 7 aa, Staphylococcus aureus
YAREKGV

SEQ ID NO: 1603400 - protein, 11 aa, Staphylococcus aureus
YATSGNKGIEN

SEQ ID NO: 1603401 - protein, 5 aa, Staphylococcus aureus
YDDEG

SEQ ID NO: 1603402 - protein, 5 aa, Staphylococcus aureus
YDETM

SEQ ID NO: 1603403 - protein, 5 aa, Staphylococcus aureus
YDGGG

SEQ ID NO: 1603404 - protein, 8 aa, Staphylococcus aureus
YEGDERTV

SEQ ID NO: 1603405 - protein, 13 aa, Staphylococcus aureus
YERLSETNNFPDF

SEQ ID NO: 1603406 - protein, 16 aa, Staphylococcus aureus
YESEARDTKLGPEEIT

SEQ ID NO: 1603407 - protein, 9 aa, Staphylococcus aureus
YFRSSGHDG

SEQ ID NO: 1603408 - protein, 4 aa, Staphylococcus aureus
YGAD

SEQ ID NO: 1603409 - protein, 11 aa, Staphylococcus aureus
YGDANVEEGDE

SEQ ID NO: 1603410 - protein, 10 aa, Staphylococcus aureus
YGEKGGTPWL

SEQ ID NO: 1603411 - protein, 6 aa, Staphylococcus aureus
YGNPKH

SEQ ID NO: 1603412 - protein, 8 aa, Staphylococcus aureus
YGPSESTV

SEQ ID NO: 1603413 - protein, 6 aa, Staphylococcus aureus
YGPSPM

SEQ ID NO: 1603414 - protein, 4 aa, Staphylococcus aureus
YGSP

SEQ ID NO: 1603415 - protein, 9 aa, Staphylococcus aureus
YGSPEKKEI

SEQ ID NO: 1603416 - protein, 7 aa, Staphylococcus aureus
YGTTGDA

SEQ ID NO: 1603417 - protein, 7 aa, Staphylococcus aureus
YGVEPND

SEQ ID NO: 1603418 - protein, 23 aa, Staphylococcus aureus
YHADEQVNEAAKEKQRQGEAQLN

SEQ ID NO: 1603419 - protein, 10 aa, Staphylococcus aureus
YHEAKGSQLP

SEQ ID NO: 1603420 - protein, 6 aa, Staphylococcus aureus
YKDSYR

SEQ ID NO: 1603421 - protein, 11 aa, Staphylococcus aureus
YKSSKKAPFKT

SEQ ID NO: 1603422 - protein, 5 aa, Staphylococcus aureus
YLGGH

SEQ ID NO: 1603423 - protein, 5 aa, Staphylococcus aureus
YNDNI

SEQ ID NO: 1603424 - protein, 10 aa, Staphylococcus aureus
YNETKGTSIF

SEQ ID NO: 1603425 - protein, 6 aa, Staphylococcus aureus
YNGKKV

SEQ ID NO: 1603426 - protein, 11 aa, Staphylococcus aureus
YNGNENTTNVP

SEQ ID NO: 1603427 - protein, 10 aa, Staphylococcus aureus
YNNIKDADAT

SEQ ID NO: 1603428 - protein, 5 aa, Staphylococcus aureus
YNQGL

SEQ ID NO: 1603429 - protein, 8 aa, Staphylococcus aureus
YNQLETQD

SEQ ID NO: 1603430 - protein, 14 aa, Staphylococcus aureus
YPALNTSFNEEAGE

SEQ ID NO: 1603431 - protein, 4 aa, Staphylococcus aureus
YPEV

SEQ ID NO: 1603432 - protein, 8 aa, Staphylococcus aureus
YPTGTIHS

SEQ ID NO: 1603433 - protein, 11 aa, Staphylococcus aureus
YPYMTKNEKKI

SEQ ID NO: 1603434 - protein, 9 aa, Staphylococcus aureus
YPYPDSNKK

SEQ ID NO: 1603435 - protein, 16 aa, Staphylococcus aureus
YQDGRSSERLVRNLFG

SEQ ID NO: 1603436 - protein, 10 aa, Staphylococcus aureus
YQNPGGSVKD

SEQ ID NO: 1603437 - protein, 8 aa, Staphylococcus aureus
YSKGEKDI

SEQ ID NO: 1603438 - protein, 14 aa, Staphylococcus aureus
YSQPAQDTGNVTNE

SEQ ID NO: 1603439 - protein, 11 aa, Staphylococcus aureus
YSSQKQDLNED

SEQ ID NO: 1603440 - protein, 9 aa, Staphylococcus aureus
YSTGGTKRI

SEQ ID NO: 1603441 - protein, 8 aa, Staphylococcus aureus
YTEDPQRD

SEQ ID NO: 1603442 - protein, 12 aa, Staphylococcus aureus
YTGDGGSSQGDF

SEQ ID NO: 1603443 - protein, 12 aa, Staphylococcus aureus
YTKEGKDGTVDC

SEQ ID NO: 1603444 - protein, 5 aa, Staphylococcus aureus
YTTSE

SEQ ID NO: 1603445 - protein, 9 aa, Staphylococcus aureus
YVAPSTDTE

SEQ ID NO: 1603446 - protein, 6 aa, Staphylococcus aureus
YVQSGD

SEQ ID NO: 1603447 - protein, 10 aa, Staphylococcus aureus
YVRKNPGEVC

SEQ ID NO: 1603448 - protein, 11 aa, Staphylococcus aureus
AAAGYTKLTGK

SEQ ID NO: 1603449 - protein, 5 aa, Staphylococcus aureus
AADDG

SEQ ID NO: 1603450 - protein, 4 aa, Staphylococcus aureus
AADL

SEQ ID NO: 1603451 - protein, 10 aa, Staphylococcus aureus
AADPGATNTD

SEQ ID NO: 1603452 - protein, 7 aa, Staphylococcus aureus
AAEKGAE

SEQ ID NO: 1603453 - protein, 13 aa, Staphylococcus aureus
AAGEDFNINSPKQ

SEQ ID NO: 1603454 - protein, 8 aa, Staphylococcus aureus
AAGSGKTA

SEQ ID NO: 1603455 - protein, 5 aa, Staphylococcus aureus
AAGSP

SEQ ID NO: 1603456 - protein, 4 aa, Staphylococcus aureus
AAGT

SEQ ID NO: 1603457 - protein, 6 aa, Staphylococcus aureus
AAKAGD

SEQ ID NO: 1603458 - protein, 6 aa, Staphylococcus aureus
AAKNKG

SEQ ID NO: 1603459 - protein, 8 aa, Staphylococcus aureus
AAKTPEKI

SEQ ID NO: 1603460 - protein, 6 aa, Staphylococcus aureus
AAMESG

SEQ ID NO: 1603461 - protein, 9 aa, Staphylococcus aureus
AAQAGDFAK

SEQ ID NO: 1603462 - protein, 9 aa, Staphylococcus aureus
AASETELKE

SEQ ID NO: 1603463 - protein, 10 aa, Staphylococcus aureus
AASGGGGKGI

SEQ ID NO: 1603464 - protein, 9 aa, Staphylococcus aureus
AASLDSEQM

SEQ ID NO: 1603465 - protein, 6 aa, Staphylococcus aureus
AASNGQ

SEQ ID NO: 1603466 - protein, 6 aa, Staphylococcus aureus
AASSHH

SEQ ID NO: 1603467 - protein, 9 aa, Staphylococcus aureus
AASTNSNYV

SEQ ID NO: 1603468 - protein, 6 aa, Staphylococcus aureus
AASYGA

SEQ ID NO: 1603469 - protein, 8 aa, Staphylococcus aureus
AATHNKGV

SEQ ID NO: 1603470 - protein, 5 aa, Staphylococcus aureus
ACPTC

SEQ ID NO: 1603471 - protein, 10 aa, Staphylococcus aureus
ADDPKGGCSG

SEQ ID NO: 1603472 - protein, 9 aa, Staphylococcus aureus
ADDRRTKLN

SEQ ID NO: 1603473 - protein, 5 aa, Staphylococcus aureus
ADDSG

SEQ ID NO: 1603474 - protein, 4 aa, Staphylococcus aureus
ADEC

SEQ ID NO: 1603475 - protein, 9 aa, Staphylococcus aureus
ADEKSIKGI

SEQ ID NO: 1603476 - protein, 6 aa, Staphylococcus aureus
ADEQSF

SEQ ID NO: 1603477 - protein, 7 aa, Staphylococcus aureus
ADGGWPQ

SEQ ID NO: 1603478 - protein, 7 aa, Staphylococcus aureus
ADHGEYG

SEQ ID NO: 1603479 - protein, 17 aa, Staphylococcus aureus
ADKAAREAVKKGSKGLA

SEQ ID NO: 1603480 - protein, 9 aa, Staphylococcus aureus
ADKDGGEMI

SEQ ID NO: 1603481 - protein, 25 aa, Staphylococcus aureus
ADLAGSNKSNVNDATDYSSETPEGK

SEQ ID NO: 1603482 - protein, 4 aa, Staphylococcus aureus
ADLR

SEQ ID NO: 1603483 - protein, 8 aa, Staphylococcus aureus
ADLTSTTD

SEQ ID NO: 1603484 - protein, 7 aa, Staphylococcus aureus
ADPTADS

SEQ ID NO: 1603485 - protein, 14 aa, Staphylococcus aureus
ADQEHSDLTGSEQE

SEQ ID NO: 1603486 - protein, 7 aa, Staphylococcus aureus
ADTDGAH

SEQ ID NO: 1603487 - protein, 7 aa, Staphylococcus aureus
ADTKIGQ

SEQ ID NO: 1603488 - protein, 7 aa, Staphylococcus aureus
ADVGTAT

SEQ ID NO: 1603489 - protein, 9 aa, Staphylococcus aureus
ADVKREGED

SEQ ID NO: 1603490 - protein, 4 aa, Staphylococcus aureus
ADWG

SEQ ID NO: 1603491 - protein, 7 aa, Staphylococcus aureus
ADYEGKA

SEQ ID NO: 1603492 - protein, 16 aa, Staphylococcus aureus
ADYEPNALSGGQKQRV

SEQ ID NO: 1603493 - protein, 13 aa, Staphylococcus aureus
ADYNDTEQPIAPG

SEQ ID NO: 1603494 - protein, 5 aa, Staphylococcus aureus
AEAAE

SEQ ID NO: 1603495 - protein, 7 aa, Staphylococcus aureus
AEAAQDY

SEQ ID NO: 1603496 - protein, 9 aa, Staphylococcus aureus
AEADTTYGK

SEQ ID NO: 1603497 - protein, 17 aa, Staphylococcus aureus
AEDGRKMSKSLGNGVDP

SEQ ID NO: 1603498 - protein, 7 aa, Staphylococcus aureus
AEDLEKA

SEQ ID NO: 1603499 - protein, 6 aa, Staphylococcus aureus
AEEKGH

SEQ ID NO: 1603500 - protein, 10 aa, Staphylococcus aureus
AEETGGGANR

SEQ ID NO: 1603501 - protein, 4 aa, Staphylococcus aureus
AEGH

SEQ ID NO: 1603502 - protein, 8 aa, Staphylococcus aureus
AEHNYDMN

SEQ ID NO: 1603503 - protein, 12 aa, Staphylococcus aureus
AEIDESSTTSMK

SEQ ID NO: 1603504 - protein, 15 aa, Staphylococcus aureus
AEKHPEIKDYSEEAR

SEQ ID NO: 1603505 - protein, 18 aa, Staphylococcus aureus
AEKIEATDEDIDKELEKM

SEQ ID NO: 1603506 - protein, 9 aa, Staphylococcus aureus
AEKNRDDNN

SEQ ID NO: 1603507 - protein, 9 aa, Staphylococcus aureus
AEKPNRPKL

SEQ ID NO: 1603508 - protein, 5 aa, Staphylococcus aureus
AENSQ

SEQ ID NO: 1603509 - protein, 9 aa, Staphylococcus aureus
AEQNNTSDL

SEQ ID NO: 1603510 - protein, 12 aa, Staphylococcus aureus
AEQTSETKTPSQ

SEQ ID NO: 1603511 - protein, 12 aa, Staphylococcus aureus
AEREQIESKLHE

SEQ ID NO: 1603512 - protein, 6 aa, Staphylococcus aureus
AESRYQ

SEQ ID NO: 1603513 - protein, 4 aa, Staphylococcus aureus
AETL

SEQ ID NO: 1603514 - protein, 7 aa, Staphylococcus aureus
AETYPEL

SEQ ID NO: 1603515 - protein, 21 aa, Staphylococcus aureus
AEVNAEADKKRREEVDLRNEA

SEQ ID NO: 1603516 - protein, 9 aa, Staphylococcus aureus
AFKPTSKDS

SEQ ID NO: 1603517 - protein, 5 aa, Staphylococcus aureus
AFNPD

SEQ ID NO: 1603518 - protein, 5 aa, Staphylococcus aureus
AFNTP

SEQ ID NO: 1603519 - protein, 12 aa, Staphylococcus aureus
AFSSGNNVTQGV

SEQ ID NO: 1603520 - protein, 7 aa, Staphylococcus aureus
AGADQSI

SEQ ID NO: 1603521 - protein, 7 aa, Staphylococcus aureus
AGASGYV

SEQ ID NO: 1603522 - protein, 9 aa, Staphylococcus aureus
AGASTTDKS

SEQ ID NO: 1603523 - protein, 8 aa, Staphylococcus aureus
AGDFTEEK

SEQ ID NO: 1603524 - protein, 15 aa, Staphylococcus aureus
AGEGSPGVNGGPAGD

SEQ ID NO: 1603525 - protein, 10 aa, Staphylococcus aureus
AGERSIDEQA

SEQ ID NO: 1603526 - protein, 10 aa, Staphylococcus aureus
AGGAEGAIDA

SEQ ID NO: 1603527 - protein, 8 aa, Staphylococcus aureus
AGGGTSEH

SEQ ID NO: 1603528 - protein, 5 aa, Staphylococcus aureus
AGGPV

SEQ ID NO: 1603529 - protein, 8 aa, Staphylococcus aureus
AGGVGSIA

SEQ ID NO: 1603530 - protein, 7 aa, Staphylococcus aureus
AGHEPGY

SEQ ID NO: 1603531 - protein, 5 aa, Staphylococcus aureus
AGIHT

SEQ ID NO: 1603532 - protein, 5 aa, Staphylococcus aureus
AGITR

SEQ ID NO: 1603533 - protein, 7 aa, Staphylococcus aureus
AGKDGEH

SEQ ID NO: 1603534 - protein, 19 aa, Staphylococcus aureus
AGKDKALPMNTGAEAVETA

SEQ ID NO: 1603535 - protein, 11 aa, Staphylococcus aureus
AGKDKGKEGKV

SEQ ID NO: 1603536 - protein, 7 aa, Staphylococcus aureus
AGKGAVE

SEQ ID NO: 1603537 - protein, 10 aa, Staphylococcus aureus
AGKGTEIGRS

SEQ ID NO: 1603538 - protein, 5 aa, Staphylococcus aureus
AGKST

SEQ ID NO: 1603539 - protein, 9 aa, Staphylococcus aureus
AGLESTGIA

SEQ ID NO: 1603540 - protein, 10 aa, Staphylococcus aureus
AGNAGDDVSE

SEQ ID NO: 1603541 - protein, 6 aa, Staphylococcus aureus
AGNDAN

SEQ ID NO: 1603542 - protein, 8 aa, Staphylococcus aureus
AGPTTTSE

SEQ ID NO: 1603543 - protein, 6 aa, Staphylococcus aureus
AGQGKV

SEQ ID NO: 1603544 - protein, 5 aa, Staphylococcus aureus
AGQRS

SEQ ID NO: 1603545 - protein, 8 aa, Staphylococcus aureus
AGSGKTRV

SEQ ID NO: 1603546 - protein, 20 aa, Staphylococcus aureus
AGSGPSQLGSPDSAGVPESV

SEQ ID NO: 1603547 - protein, 11 aa, Staphylococcus aureus
AGTEVKRDNET

SEQ ID NO: 1603548 - protein, 8 aa, Staphylococcus aureus
AGTKEGIT

SEQ ID NO: 1603549 - protein, 15 aa, Staphylococcus aureus
AGTKLGLEKEQVEES

SEQ ID NO: 1603550 - protein, 9 aa, Staphylococcus aureus
AGTQTGKQF

SEQ ID NO: 1603551 - protein, 6 aa, Staphylococcus aureus
AGTSSM

SEQ ID NO: 1603552 - protein, 6 aa, Staphylococcus aureus
AGVETA

SEQ ID NO: 1603553 - protein, 6 aa, Staphylococcus aureus
AGVGKT

SEQ ID NO: 1603554 - protein, 8 aa, Staphylococcus aureus
AGVGRKTA

SEQ ID NO: 1603555 - protein, 7 aa, Staphylococcus aureus
AGYTDKN

SEQ ID NO: 1603556 - protein, 4 aa, Staphylococcus aureus
AHDE

SEQ ID NO: 1603557 - protein, 5 aa, Staphylococcus aureus
AHGIP

SEQ ID NO: 1603558 - protein, 9 aa, Staphylococcus aureus
AHGSSNAKA

SEQ ID NO: 1603559 - protein, 8 aa, Staphylococcus aureus
AHHGDGTQ

SEQ ID NO: 1603560 - protein, 14 aa, Staphylococcus aureus
AHHNKKVDAPSGTL

SEQ ID NO: 1603561 - protein, 6 aa, Staphylococcus aureus
AHKENK

SEQ ID NO: 1603562 - protein, 7 aa, Staphylococcus aureus
AHPGLPD

SEQ ID NO: 1603563 - protein, 9 aa, Staphylococcus aureus
AHPNGPNTI

SEQ ID NO: 1603564 - protein, 6 aa, Staphylococcus aureus
AHSCDQ

SEQ ID NO: 1603565 - protein, 14 aa, Staphylococcus aureus
AHTGQGAIGLVVLK

SEQ ID NO: 1603566 - protein, 7 aa, Staphylococcus aureus
AIATNEV

SEQ ID NO: 1603567 - protein, 10 aa, Staphylococcus aureus
AIDENGEMNR

SEQ ID NO: 1603568 - protein, 5 aa, Staphylococcus aureus
AIESG

SEQ ID NO: 1603569 - protein, 6 aa, Staphylococcus aureus
AIKPGQ

SEQ ID NO: 1603570 - protein, 6 aa, Staphylococcus aureus
AISPNT

SEQ ID NO: 1603571 - protein, 7 aa, Staphylococcus aureus
AISQTTN

SEQ ID NO: 1603572 - protein, 13 aa, Staphylococcus aureus
AITTAKSQEGPTI

SEQ ID NO: 1603573 - protein, 10 aa, Staphylococcus aureus
AKAISGSTQY

SEQ ID NO: 1603574 - protein, 7 aa, Staphylococcus aureus
AKAQSKK

SEQ ID NO: 1603575 - protein, 7 aa, Staphylococcus aureus
AKDEVRS

SEQ ID NO: 1603576 - protein, 11 aa, Staphylococcus aureus
AKDLEKQGKSV

SEQ ID NO: 1603577 - protein, 6 aa, Staphylococcus aureus
AKDREI

SEQ ID NO: 1603578 - protein, 9 aa, Staphylococcus aureus
AKEAQGDDI

SEQ ID NO: 1603579 - protein, 7 aa, Staphylococcus aureus
AKEAYEA

SEQ ID NO: 1603580 - protein, 9 aa, Staphylococcus aureus
AKELGKGKT

SEQ ID NO: 1603581 - protein, 11 aa, Staphylococcus aureus
AKENKSDKQMK

SEQ ID NO: 1603582 - protein, 5 aa, Staphylococcus aureus
AKENN

SEQ ID NO: 1603583 - protein, 7 aa, Staphylococcus aureus
AKEPFNQ

SEQ ID NO: 1603584 - protein, 10 aa, Staphylococcus aureus
AKERGGYHNG

SEQ ID NO: 1603585 - protein, 9 aa, Staphylococcus aureus
AKERQRTGI

SEQ ID NO: 1603586 - protein, 13 aa, Staphylococcus aureus
AKESGSAAAPTAG

SEQ ID NO: 1603587 - protein, 11 aa, Staphylococcus aureus
AKETKNKTSFP

SEQ ID NO: 1603588 - protein, 33 aa, Staphylococcus aureus
AKGGRGGRGNSRFATPRNPAPDFSEKGEPGEEL

SEQ ID NO: 1603589 - protein, 7 aa, Staphylococcus aureus
AKGKTLI

SEQ ID NO: 1603590 - protein, 6 aa, Staphylococcus aureus
AKGRPG

SEQ ID NO: 1603591 - protein, 8 aa, Staphylococcus aureus
AKHISDDD

SEQ ID NO: 1603592 - protein, 9 aa, Staphylococcus aureus
AKHQDSSEY

SEQ ID NO: 1603593 - protein, 12 aa, Staphylococcus aureus
AKKNTQGIETEP

SEQ ID NO: 1603594 - protein, 7 aa, Staphylococcus aureus
AKKPENE

SEQ ID NO: 1603595 - protein, 15 aa, Staphylococcus aureus
AKNPSILASENGKDV

SEQ ID NO: 1603596 - protein, 7 aa, Staphylococcus aureus
AKNTDKK

SEQ ID NO: 1603597 - protein, 13 aa, Staphylococcus aureus
AKNVADQIGATTH

SEQ ID NO: 1603598 - protein, 6 aa, Staphylococcus aureus
AKPETL

SEQ ID NO: 1603599 - protein, 9 aa, Staphylococcus aureus
AKPETTNYR

SEQ ID NO: 1603600 - protein, 12 aa, Staphylococcus aureus
AKQAIASMSQAQ

SEQ ID NO: 1603601 - protein, 10 aa, Staphylococcus aureus
AKQALENNDE

SEQ ID NO: 1603602 - protein, 7 aa, Staphylococcus aureus
AKQYSLN

SEQ ID NO: 1603603 - protein, 9 aa, Staphylococcus aureus
AKREVSEQL

SEQ ID NO: 1603604 - protein, 8 aa, Staphylococcus aureus
AKRKDIEQ

SEQ ID NO: 1603605 - protein, 7 aa, Staphylococcus aureus
AKRQGQS

SEQ ID NO: 1603606 - protein, 17 aa, Staphylococcus aureus
AKRSQSDHKLNREKDTA

SEQ ID NO: 1603607 - protein, 15 aa, Staphylococcus aureus
AKSAEEIKQVFEEAD

SEQ ID NO: 1603608 - protein, 6 aa, Staphylococcus aureus
AKSGPW

SEQ ID NO: 1603609 - protein, 9 aa, Staphylococcus aureus
AKSKETSVE

SEQ ID NO: 1603610 - protein, 6 aa, Staphylococcus aureus
AKSSIN

SEQ ID NO: 1603611 - protein, 5 aa, Staphylococcus aureus
AKVGD

SEQ ID NO: 1603612 - protein, 5 aa, Staphylococcus aureus
ALAVG

SEQ ID NO: 1603613 - protein, 13 aa, Staphylococcus aureus
ALDTGNDPREFTK

SEQ ID NO: 1603614 - protein, 5 aa, Staphylococcus aureus
ALNDA

SEQ ID NO: 1603615 - protein, 4 aa, Staphylococcus aureus
ALPS

SEQ ID NO: 1603616 - protein, 10 aa, Staphylococcus aureus
ALRESEEYKA

SEQ ID NO: 1603617 - protein, 11 aa, Staphylococcus aureus
ALSPKVKGQLK

SEQ ID NO: 1603618 - protein, 5 aa, Staphylococcus aureus
ALSRG

SEQ ID NO: 1603619 - protein, 15 aa, Staphylococcus aureus
ALTPKAEIEGEMGDT

SEQ ID NO: 1603620 - protein, 8 aa, Staphylococcus aureus
AMSGNGRF

SEQ ID NO: 1603621 - protein, 9 aa, Staphylococcus aureus
ANADAKPEH

SEQ ID NO: 1603622 - protein, 18 aa, Staphylococcus aureus
ANASKSKQATSRKKQLEK

SEQ ID NO: 1603623 - protein, 4 aa, Staphylococcus aureus
ANDK

SEQ ID NO: 1603624 - protein, 5 aa, Staphylococcus aureus
ANDQL

SEQ ID NO: 1603625 - protein, 8 aa, Staphylococcus aureus
ANDTDYGL

SEQ ID NO: 1603626 - protein, 5 aa, Staphylococcus aureus
ANEDG

SEQ ID NO: 1603627 - protein, 4 aa, Staphylococcus aureus
ANEG

SEQ ID NO: 1603628 - protein, 5 aa, Staphylococcus aureus
ANEQL

SEQ ID NO: 1603629 - protein, 5 aa, Staphylococcus aureus
ANEYK

SEQ ID NO: 1603630 - protein, 11 aa, Staphylococcus aureus
ANGYASGFEES

SEQ ID NO: 1603631 - protein, 9 aa, Staphylococcus aureus
ANHQITPDS

SEQ ID NO: 1603632 - protein, 8 aa, Staphylococcus aureus
ANIQPSDD

SEQ ID NO: 1603633 - protein, 7 aa, Staphylococcus aureus
ANKPNFD

SEQ ID NO: 1603634 - protein, 6 aa, Staphylococcus aureus
ANKRDV

SEQ ID NO: 1603635 - protein, 9 aa, Staphylococcus aureus
ANLNKTVSA

SEQ ID NO: 1603636 - protein, 5 aa, Staphylococcus aureus
ANNVT

SEQ ID NO: 1603637 - protein, 10 aa, Staphylococcus aureus
ANQQKALNGD

SEQ ID NO: 1603638 - protein, 9 aa, Staphylococcus aureus
ANSGTELPM

SEQ ID NO: 1603639 - protein, 8 aa, Staphylococcus aureus
ANTDEEAR

SEQ ID NO: 1603640 - protein, 7 aa, Staphylococcus aureus
APADNKA

SEQ ID NO: 1603641 - protein, 6 aa, Staphylococcus aureus
APDELE

SEQ ID NO: 1603642 - protein, 9 aa, Staphylococcus aureus
APEDEQTET

SEQ ID NO: 1603643 - protein, 5 aa, Staphylococcus aureus
APEYG

SEQ ID NO: 1603644 - protein, 5 aa, Staphylococcus aureus
APGAE

SEQ ID NO: 1603645 - protein, 6 aa, Staphylococcus aureus
APGGYG

SEQ ID NO: 1603646 - protein, 12 aa, Staphylococcus aureus
APGIGKEAGASL

SEQ ID NO: 1603647 - protein, 9 aa, Staphylococcus aureus
APHNISANE

SEQ ID NO: 1603648 - protein, 10 aa, Staphylococcus aureus
APIDNSDEPL

SEQ ID NO: 1603649 - protein, 8 aa, Staphylococcus aureus
APIPGTSR

SEQ ID NO: 1603650 - protein, 11 aa, Staphylococcus aureus
APITEATLGKK

SEQ ID NO: 1603651 - protein, 8 aa, Staphylococcus aureus
APKDGPKI

SEQ ID NO: 1603652 - protein, 5 aa, Staphylococcus aureus
APKGA

SEQ ID NO: 1603653 - protein, 5 aa, Staphylococcus aureus
APKPC

SEQ ID NO: 1603654 - protein, 4 aa, Staphylococcus aureus
APLD

SEQ ID NO: 1603655 - protein, 14 aa, Staphylococcus aureus
APLQSEDKNKPGFV

SEQ ID NO: 1603656 - protein, 4 aa, Staphylococcus aureus
APMS

SEQ ID NO: 1603657 - protein, 17 aa, Staphylococcus aureus
APQRVERRKARRIESKQ

SEQ ID NO: 1603658 - protein, 5 aa, Staphylococcus aureus
APRLQ

SEQ ID NO: 1603659 - protein, 8 aa, Staphylococcus aureus
APSDTTIK

SEQ ID NO: 1603660 - protein, 7 aa, Staphylococcus aureus
APTDAED

SEQ ID NO: 1603661 - protein, 16 aa, Staphylococcus aureus
APTGRASKRLQESTGL

SEQ ID NO: 1603662 - protein, 20 aa, Staphylococcus aureus
APTYATAKEGVEASYNEGLT

SEQ ID NO: 1603663 - protein, 5 aa, Staphylococcus aureus
APVYG

SEQ ID NO: 1603664 - protein, 8 aa, Staphylococcus aureus
APYDAQGG

SEQ ID NO: 1603665 - protein, 5 aa, Staphylococcus aureus
APYKY

SEQ ID NO: 1603666 - protein, 4 aa, Staphylococcus aureus
AQEK

SEQ ID NO: 1603667 - protein, 7 aa, Staphylococcus aureus
AQGGDVD

SEQ ID NO: 1603668 - protein, 11 aa, Staphylococcus aureus
AQGTSSRSTKL

SEQ ID NO: 1603669 - protein, 9 aa, Staphylococcus aureus
AQHGDRNTI

SEQ ID NO: 1603670 - protein, 4 aa, Staphylococcus aureus
AQMT

SEQ ID NO: 1603671 - protein, 7 aa, Staphylococcus aureus
AQPPRSY

SEQ ID NO: 1603672 - protein, 14 aa, Staphylococcus aureus
AQQNPLRDYQNEGH

SEQ ID NO: 1603673 - protein, 4 aa, Staphylococcus aureus
AQQQ

SEQ ID NO: 1603674 - protein, 8 aa, Staphylococcus aureus
AQQSGLDI

SEQ ID NO: 1603675 - protein, 17 aa, Staphylococcus aureus
AQSEVYKNNADRALKAL

SEQ ID NO: 1603676 - protein, 7 aa, Staphylococcus aureus
AQTEEQV

SEQ ID NO: 1603677 - protein, 6 aa, Staphylococcus aureus
AQTSSA

SEQ ID NO: 1603678 - protein, 10 aa, Staphylococcus aureus
AREAGDRSKI

SEQ ID NO: 1603679 - protein, 7 aa, Staphylococcus aureus
AREGKKV

SEQ ID NO: 1603680 - protein, 5 aa, Staphylococcus aureus
AREGY

SEQ ID NO: 1603681 - protein, 12 aa, Staphylococcus aureus
AREREIEQSKAN

SEQ ID NO: 1603682 - protein, 5 aa, Staphylococcus aureus
ARGFS

SEQ ID NO: 1603683 - protein, 6 aa, Staphylococcus aureus
ARGNSG

SEQ ID NO: 1603684 - protein, 12 aa, Staphylococcus aureus
ARIPDNDDFQPI

SEQ ID NO: 1603685 - protein, 6 aa, Staphylococcus aureus
ARKSIR

SEQ ID NO: 1603686 - protein, 11 aa, Staphylococcus aureus
ARRSVNPPKDT

SEQ ID NO: 1603687 - protein, 8 aa, Staphylococcus aureus
ARSPRDGR

SEQ ID NO: 1603688 - protein, 16 aa, Staphylococcus aureus
ARSVTGTIQKVNGAWY

SEQ ID NO: 1603689 - protein, 8 aa, Staphylococcus aureus
ARTQNSSI

SEQ ID NO: 1603690 - protein, 9 aa, Staphylococcus aureus
ASDEKARHK

SEQ ID NO: 1603691 - protein, 13 aa, Staphylococcus aureus
ASDGYKTLEEGQK

SEQ ID NO: 1603692 - protein, 12 aa, Staphylococcus aureus
ASETASKSAMEH

SEQ ID NO: 1603693 - protein, 10 aa, Staphylococcus aureus
ASGGDGDGYA

SEQ ID NO: 1603694 - protein, 8 aa, Staphylococcus aureus
ASGKSTVS

SEQ ID NO: 1603695 - protein, 4 aa, Staphylococcus aureus
ASGY

SEQ ID NO: 1603696 - protein, 8 aa, Staphylococcus aureus
ASHKEGKW

SEQ ID NO: 1603697 - protein, 7 aa, Staphylococcus aureus
ASHTRSD

SEQ ID NO: 1603698 - protein, 6 aa, Staphylococcus aureus
ASKEAN

SEQ ID NO: 1603699 - protein, 8 aa, Staphylococcus aureus
ASKEQLDP

SEQ ID NO: 1603700 - protein, 10 aa, Staphylococcus aureus
ASKGQANPQL

SEQ ID NO: 1603701 - protein, 6 aa, Staphylococcus aureus
ASKLEE

SEQ ID NO: 1603702 - protein, 11 aa, Staphylococcus aureus
ASKSETTSHTY

SEQ ID NO: 1603703 - protein, 16 aa, Staphylococcus aureus
ASLDGKQANDNGQSQW

SEQ ID NO: 1603704 - protein, 17 aa, Staphylococcus aureus
ASPGAERPIKKEQDFQN

SEQ ID NO: 1603705 - protein, 8 aa, Staphylococcus aureus
ASQEENAP

SEQ ID NO: 1603706 - protein, 6 aa, Staphylococcus aureus
ASQGNQ

SEQ ID NO: 1603707 - protein, 5 aa, Staphylococcus aureus
ASQLG

SEQ ID NO: 1603708 - protein, 13 aa, Staphylococcus aureus
ASRALSTNDDIET

SEQ ID NO: 1603709 - protein, 16 aa, Staphylococcus aureus
ASRATAMQNSLNAIIA

SEQ ID NO: 1603710 - protein, 7 aa, Staphylococcus aureus
ASSQGNF

SEQ ID NO: 1603711 - protein, 7 aa, Staphylococcus aureus
ASTGAAI

SEQ ID NO: 1603712 - protein, 8 aa, Staphylococcus aureus
ASTGTDAV

SEQ ID NO: 1603713 - protein, 7 aa, Staphylococcus aureus
ASVIPGS

SEQ ID NO: 1603714 - protein, 7 aa, Staphylococcus aureus
ATAKTMD

SEQ ID NO: 1603715 - protein, 16 aa, Staphylococcus aureus
ATESDLQGSTGYGYDD

SEQ ID NO: 1603716 - protein, 17 aa, Staphylococcus aureus
ATESGSTARTISKYRPH

SEQ ID NO: 1603717 - protein, 5 aa, Staphylococcus aureus
ATETE

SEQ ID NO: 1603718 - protein, 6 aa, Staphylococcus aureus
ATFEDQ

SEQ ID NO: 1603719 - protein, 6 aa, Staphylococcus aureus
ATGGTI

SEQ ID NO: 1603720 - protein, 6 aa, Staphylococcus aureus
ATGYYP

SEQ ID NO: 1603721 - protein, 13 aa, Staphylococcus aureus
ATIETARKKYPHK

SEQ ID NO: 1603722 - protein, 4 aa, Staphylococcus aureus
ATIR

SEQ ID NO: 1603723 - protein, 6 aa, Staphylococcus aureus
ATLSPI

SEQ ID NO: 1603724 - protein, 5 aa, Staphylococcus aureus
ATPDQ

SEQ ID NO: 1603725 - protein, 6 aa, Staphylococcus aureus
ATPQML

SEQ ID NO: 1603726 - protein, 8 aa, Staphylococcus aureus
ATSDDKLA

SEQ ID NO: 1603727 - protein, 8 aa, Staphylococcus aureus
ATSEGDPV

SEQ ID NO: 1603728 - protein, 10 aa, Staphylococcus aureus
ATSGTANKLA

SEQ ID NO: 1603729 - protein, 13 aa, Staphylococcus aureus
ATSLTEAGYVGDD

SEQ ID NO: 1603730 - protein, 9 aa, Staphylococcus aureus
ATTQDEYRN

SEQ ID NO: 1603731 - protein, 12 aa, Staphylococcus aureus
ATYTKEDAFNQD

SEQ ID NO: 1603732 - protein, 5 aa, Staphylococcus aureus
AVDAG

SEQ ID NO: 1603733 - protein, 7 aa, Staphylococcus aureus
AVEAGES

SEQ ID NO: 1603734 - protein, 12 aa, Staphylococcus aureus
AVEGTDLESKSI

SEQ ID NO: 1603735 - protein, 14 aa, Staphylococcus aureus
AVEQEENDAKKDQL

SEQ ID NO: 1603736 - protein, 11 aa, Staphylococcus aureus
AVGNPGQANYV

SEQ ID NO: 1603737 - protein, 6 aa, Staphylococcus aureus
AVNKAK

SEQ ID NO: 1603738 - protein, 8 aa, Staphylococcus aureus
AVNYENAG

SEQ ID NO: 1603739 - protein, 14 aa, Staphylococcus aureus
AVPGGSSGGSAAAV

SEQ ID NO: 1603740 - protein, 14 aa, Staphylococcus aureus
AVSSSQTVEALVSQ

SEQ ID NO: 1603741 - protein, 5 aa, Staphylococcus aureus
AYGLG

SEQ ID NO: 1603742 - protein, 12 aa, Staphylococcus aureus
AYHSGDTITGST

SEQ ID NO: 1603743 - protein, 12 aa, Staphylococcus aureus
AYKEAKADPEFQ

SEQ ID NO: 1603744 - protein, 11 aa, Staphylococcus aureus
AYQTDKGTGIK

SEQ ID NO: 1603745 - protein, 7 aa, Staphylococcus aureus
AYRETSA

SEQ ID NO: 1603746 - protein, 8 aa, Staphylococcus aureus
AYTGEGKQ

SEQ ID NO: 1603747 - protein, 5 aa, Staphylococcus aureus
AYTKR

SEQ ID NO: 1603748 - protein, 6 aa, Staphylococcus aureus
AYTPKL

SEQ ID NO: 1603749 - protein, 6 aa, Staphylococcus aureus
CDEPKD

SEQ ID NO: 1603750 - protein, 13 aa, Staphylococcus aureus
CDTTLKNAEKKVN

SEQ ID NO: 1603751 - protein, 9 aa, Staphylococcus aureus
CGQSNGRPI

SEQ ID NO: 1603752 - protein, 6 aa, Staphylococcus aureus
CKDESN

SEQ ID NO: 1603753 - protein, 7 aa, Staphylococcus aureus
CKQSGAR

SEQ ID NO: 1603754 - protein, 8 aa, Staphylococcus aureus
CNHAPKRQ

SEQ ID NO: 1603755 - protein, 5 aa, Staphylococcus aureus
CNSEA

SEQ ID NO: 1603756 - protein, 25 aa, Staphylococcus aureus
CPHEQAKQQKESKVKEISARRIFSF

SEQ ID NO: 1603757 - protein, 7 aa, Staphylococcus aureus
CRSDDEE

SEQ ID NO: 1603758 - protein, 8 aa, Staphylococcus aureus
CSAPGGKA

SEQ ID NO: 1603759 - protein, 4 aa, Staphylococcus aureus
CSSE

SEQ ID NO: 1603760 - protein, 8 aa, Staphylococcus aureus
DAAESGVP

SEQ ID NO: 1603761 - protein, 17 aa, Staphylococcus aureus
DADINSMKTAVLQQLKG

SEQ ID NO: 1603762 - protein, 4 aa, Staphylococcus aureus
DADK

SEQ ID NO: 1603763 - protein, 4 aa, Staphylococcus aureus
DADS

SEQ ID NO: 1603764 - protein, 11 aa, Staphylococcus aureus
DAEGHFENNGR

SEQ ID NO: 1603765 - protein, 7 aa, Staphylococcus aureus
DAEQAVT

SEQ ID NO: 1603766 - protein, 6 aa, Staphylococcus aureus
DAESFT

SEQ ID NO: 1603767 - protein, 4 aa, Staphylococcus aureus
DAEV

SEQ ID NO: 1603768 - protein, 12 aa, Staphylococcus aureus
DAGGSATREKVT

SEQ ID NO: 1603769 - protein, 7 aa, Staphylococcus aureus
DAGREGE

SEQ ID NO: 1603770 - protein, 9 aa, Staphylococcus aureus
DAHAAAEKH

SEQ ID NO: 1603771 - protein, 6 aa, Staphylococcus aureus
DAHQRG

SEQ ID NO: 1603772 - protein, 8 aa, Staphylococcus aureus
DAKKSTPI

SEQ ID NO: 1603773 - protein, 7 aa, Staphylococcus aureus
DANNDKD

SEQ ID NO: 1603774 - protein, 14 aa, Staphylococcus aureus
DAPIGRNKNDRQSM

SEQ ID NO: 1603775 - protein, 7 aa, Staphylococcus aureus
DASERGM

SEQ ID NO: 1603776 - protein, 8 aa, Staphylococcus aureus
DASSDSPF

SEQ ID NO: 1603777 - protein, 4 aa, Staphylococcus aureus
DATN

SEQ ID NO: 1603778 - protein, 9 aa, Staphylococcus aureus
DAYDNNPGL

SEQ ID NO: 1603779 - protein, 6 aa, Staphylococcus aureus
DAYPNK

SEQ ID NO: 1603780 - protein, 6 aa, Staphylococcus aureus
DDDALK

SEQ ID NO: 1603781 - protein, 11 aa, Staphylococcus aureus
DDDEDNDKPDL

SEQ ID NO: 1603782 - protein, 6 aa, Staphylococcus aureus
DDDTKL

SEQ ID NO: 1603783 - protein, 7 aa, Staphylococcus aureus
DDEDQKL

SEQ ID NO: 1603784 - protein, 6 aa, Staphylococcus aureus
DDEETA

SEQ ID NO: 1603785 - protein, 4 aa, Staphylococcus aureus
DDEG

SEQ ID NO: 1603786 - protein, 7 aa, Staphylococcus aureus
DDGKEAV

SEQ ID NO: 1603787 - protein, 9 aa, Staphylococcus aureus
DDGPTNETE

SEQ ID NO: 1603788 - protein, 9 aa, Staphylococcus aureus
DDGRTRTLE

SEQ ID NO: 1603789 - protein, 8 aa, Staphylococcus aureus
DDKETVNH

SEQ ID NO: 1603790 - protein, 7 aa, Staphylococcus aureus
DDKTPLG

SEQ ID NO: 1603791 - protein, 8 aa, Staphylococcus aureus
DDLVSGKS

SEQ ID NO: 1603792 - protein, 5 aa, Staphylococcus aureus
DDNGE

SEQ ID NO: 1603793 - protein, 7 aa, Staphylococcus aureus
DDNNEVG

SEQ ID NO: 1603794 - protein, 8 aa, Staphylococcus aureus
DDQDYRDE

SEQ ID NO: 1603795 - protein, 6 aa, Staphylococcus aureus
DDQSMR

SEQ ID NO: 1603796 - protein, 7 aa, Staphylococcus aureus
DDRLTDE

SEQ ID NO: 1603797 - protein, 6 aa, Staphylococcus aureus
DDRNFG

SEQ ID NO: 1603798 - protein, 16 aa, Staphylococcus aureus
DDTADQETVEKNNYIK

SEQ ID NO: 1603799 - protein, 16 aa, Staphylococcus aureus
DDTDENGVCTATEDYN

SEQ ID NO: 1603800 - protein, 6 aa, Staphylococcus aureus
DDTGAI

SEQ ID NO: 1603801 - protein, 7 aa, Staphylococcus aureus
DDTSNYE

SEQ ID NO: 1603802 - protein, 4 aa, Staphylococcus aureus
DDYR

SEQ ID NO: 1603803 - protein, 6 aa, Staphylococcus aureus
DEAAEL

SEQ ID NO: 1603804 - protein, 9 aa, Staphylococcus aureus
DEADTENGV

SEQ ID NO: 1603805 - protein, 15 aa, Staphylococcus aureus
DEAGESHRLISADID

SEQ ID NO: 1603806 - protein, 20 aa, Staphylococcus aureus
DEAKLGKKVGSDLENNKSTY

SEQ ID NO: 1603807 - protein, 6 aa, Staphylococcus aureus
DEANSL

SEQ ID NO: 1603808 - protein, 6 aa, Staphylococcus aureus
DEAQNA

SEQ ID NO: 1603809 - protein, 8 aa, Staphylococcus aureus
DEATAARK

SEQ ID NO: 1603810 - protein, 12 aa, Staphylococcus aureus
DEATTPEERQNS

SEQ ID NO: 1603811 - protein, 8 aa, Staphylococcus aureus
DEEDPENE

SEQ ID NO: 1603812 - protein, 11 aa, Staphylococcus aureus
DEEGNSLDAAR

SEQ ID NO: 1603813 - protein, 12 aa, Staphylococcus aureus
DEEGVEGSKDAR

SEQ ID NO: 1603814 - protein, 8 aa, Staphylococcus aureus
DEENERVS

SEQ ID NO: 1603815 - protein, 8 aa, Staphylococcus aureus
DEERSNHS

SEQ ID NO: 1603816 - protein, 13 aa, Staphylococcus aureus
DEGHTEVSSRDIG

SEQ ID NO: 1603817 - protein, 7 aa, Staphylococcus aureus
DEIWEGK

SEQ ID NO: 1603818 - protein, 11 aa, Staphylococcus aureus
DEKDDPEAIER

SEQ ID NO: 1603819 - protein, 4 aa, Staphylococcus aureus
DEKG

SEQ ID NO: 1603820 - protein, 8 aa, Staphylococcus aureus
DEKIEEPN

SEQ ID NO: 1603821 - protein, 7 aa, Staphylococcus aureus
DELTPYA

SEQ ID NO: 1603822 - protein, 6 aa, Staphylococcus aureus
DENAIT

SEQ ID NO: 1603823 - protein, 9 aa, Staphylococcus aureus
DENPSTAAK

SEQ ID NO: 1603824 - protein, 6 aa, Staphylococcus aureus
DEQGKL

SEQ ID NO: 1603825 - protein, 5 aa, Staphylococcus aureus
DEQMT

SEQ ID NO: 1603826 - protein, 11 aa, Staphylococcus aureus
DEQSPDIAQGV

SEQ ID NO: 1603827 - protein, 7 aa, Staphylococcus aureus
DERGYNA

SEQ ID NO: 1603828 - protein, 10 aa, Staphylococcus aureus
DESKTTTRVN

SEQ ID NO: 1603829 - protein, 23 aa, Staphylococcus aureus
DEVTAGNGAKKDTMAGKGRLNNQ

SEQ ID NO: 1603830 - protein, 7 aa, Staphylococcus aureus
DFDRTEK

SEQ ID NO: 1603831 - protein, 15 aa, Staphylococcus aureus
DFGGGGHPNASGVSV

SEQ ID NO: 1603832 - protein, 12 aa, Staphylococcus aureus
DFSNNSKHVSEG

SEQ ID NO: 1603833 - protein, 10 aa, Staphylococcus aureus
DFTENSEDYG

SEQ ID NO: 1603834 - protein, 9 aa, Staphylococcus aureus
DGAKPTDTV

SEQ ID NO: 1603835 - protein, 5 aa, Staphylococcus aureus
DGANV

SEQ ID NO: 1603836 - protein, 9 aa, Staphylococcus aureus
DGAVDDSYG

SEQ ID NO: 1603837 - protein, 6 aa, Staphylococcus aureus
DGDGDR

SEQ ID NO: 1603838 - protein, 4 aa, Staphylococcus aureus
DGEI

SEQ ID NO: 1603839 - protein, 10 aa, Staphylococcus aureus
DGEPSAFNYS

SEQ ID NO: 1603840 - protein, 7 aa, Staphylococcus aureus
DGETKRI

SEQ ID NO: 1603841 - protein, 5 aa, Staphylococcus aureus
DGFTT

SEQ ID NO: 1603842 - protein, 8 aa, Staphylococcus aureus
DGGEGTTD

SEQ ID NO: 1603843 - protein, 5 aa, Staphylococcus aureus
DGHEN

SEQ ID NO: 1603844 - protein, 14 aa, Staphylococcus aureus
DGHYQGAKDLGRSI

SEQ ID NO: 1603845 - protein, 7 aa, Staphylococcus aureus
DGHYTTD

SEQ ID NO: 1603846 - protein, 13 aa, Staphylococcus aureus
DGINPTYDSYDES

SEQ ID NO: 1603847 - protein, 6 aa, Staphylococcus aureus
DGLTGP

SEQ ID NO: 1603848 - protein, 9 aa, Staphylococcus aureus
DGPKESGGL

SEQ ID NO: 1603849 - protein, 8 aa, Staphylococcus aureus
DGPSETGI

SEQ ID NO: 1603850 - protein, 9 aa, Staphylococcus aureus
DGQASTTGY

SEQ ID NO: 1603851 - protein, 8 aa, Staphylococcus aureus
DGQKAAVA

SEQ ID NO: 1603852 - protein, 8 aa, Staphylococcus aureus
DGQYGGHK

SEQ ID NO: 1603853 - protein, 5 aa, Staphylococcus aureus
DGQYK

SEQ ID NO: 1603854 - protein, 6 aa, Staphylococcus aureus
DGREGV

SEQ ID NO: 1603855 - protein, 13 aa, Staphylococcus aureus
DGRETPKKPRIVN

SEQ ID NO: 1603856 - protein, 10 aa, Staphylococcus aureus
DGSDESDAIQ

SEQ ID NO: 1603857 - protein, 7 aa, Staphylococcus aureus
DGSLDYD

SEQ ID NO: 1603858 - protein, 7 aa, Staphylococcus aureus
DGSVGSS

SEQ ID NO: 1603859 - protein, 8 aa, Staphylococcus aureus
DGTMSSKI

SEQ ID NO: 1603860 - protein, 18 aa, Staphylococcus aureus
DGTPIRLTGQDSERGTFS

SEQ ID NO: 1603861 - protein, 4 aa, Staphylococcus aureus
DGVR

SEQ ID NO: 1603862 - protein, 8 aa, Staphylococcus aureus
DGYGQTES

SEQ ID NO: 1603863 - protein, 5 aa, Staphylococcus aureus
DGYTG

SEQ ID NO: 1603864 - protein, 6 aa, Staphylococcus aureus
DHAKKE

SEQ ID NO: 1603865 - protein, 17 aa, Staphylococcus aureus
DHDEDELSHYSNATTDI

SEQ ID NO: 1603866 - protein, 6 aa, Staphylococcus aureus
DHDGTK

SEQ ID NO: 1603867 - protein, 24 aa, Staphylococcus aureus
DHGNSDQVLTDDDQPMTTHTTNPV

SEQ ID NO: 1603868 - protein, 4 aa, Staphylococcus aureus
DHIP

SEQ ID NO: 1603869 - protein, 8 aa, Staphylococcus aureus
DHPRYGKQ

SEQ ID NO: 1603870 - protein, 8 aa, Staphylococcus aureus
DHRRPSGV

SEQ ID NO: 1603871 - protein, 6 aa, Staphylococcus aureus
DIDNAD

SEQ ID NO: 1603872 - protein, 5 aa, Staphylococcus aureus
DIEHS

SEQ ID NO: 1603873 - protein, 7 aa, Staphylococcus aureus
DIENEMG

SEQ ID NO: 1603874 - protein, 4 aa, Staphylococcus aureus
DIKE

SEQ ID NO: 1603875 - protein, 14 aa, Staphylococcus aureus
DIKGTKSKDPKRRI

SEQ ID NO: 1603876 - protein, 5 aa, Staphylococcus aureus
DIKRQ

SEQ ID NO: 1603877 - protein, 4 aa, Staphylococcus aureus
DIPG

SEQ ID NO: 1603878 - protein, 8 aa, Staphylococcus aureus
DIQPSSRR

SEQ ID NO: 1603879 - protein, 4 aa, Staphylococcus aureus
DIQR

SEQ ID NO: 1603880 - protein, 4 aa, Staphylococcus aureus
DIQS

SEQ ID NO: 1603881 - protein, 10 aa, Staphylococcus aureus
DISTPQGFTA

SEQ ID NO: 1603882 - protein, 5 aa, Staphylococcus aureus
DISTT

SEQ ID NO: 1603883 - protein, 4 aa, Staphylococcus aureus
DITP

SEQ ID NO: 1603884 - protein, 4 aa, Staphylococcus aureus
DKAD

SEQ ID NO: 1603885 - protein, 9 aa, Staphylococcus aureus
DKAIKGIPQ

SEQ ID NO: 1603886 - protein, 7 aa, Staphylococcus aureus
DKAPEIG

SEQ ID NO: 1603887 - protein, 7 aa, Staphylococcus aureus
DKDNFTN

SEQ ID NO: 1603888 - protein, 5 aa, Staphylococcus aureus
DKDTE

SEQ ID NO: 1603889 - protein, 6 aa, Staphylococcus aureus
DKEAPD

SEQ ID NO: 1603890 - protein, 8 aa, Staphylococcus aureus
DKEGKTKH

SEQ ID NO: 1603891 - protein, 12 aa, Staphylococcus aureus
DKEIETTLSQNK

SEQ ID NO: 1603892 - protein, 8 aa, Staphylococcus aureus
DKEIQETA

SEQ ID NO: 1603893 - protein, 8 aa, Staphylococcus aureus
DKENDANW

SEQ ID NO: 1603894 - protein, 11 aa, Staphylococcus aureus
DKETPSYESQI

SEQ ID NO: 1603895 - protein, 9 aa, Staphylococcus aureus
DKEVRTTHG

SEQ ID NO: 1603896 - protein, 9 aa, Staphylococcus aureus
DKGLAGAYS

SEQ ID NO: 1603897 - protein, 8 aa, Staphylococcus aureus
DKGPRGTR

SEQ ID NO: 1603898 - protein, 9 aa, Staphylococcus aureus
DKGTSFGAS

SEQ ID NO: 1603899 - protein, 11 aa, Staphylococcus aureus
DKITTHDDPTY

SEQ ID NO: 1603900 - protein, 32 aa, Staphylococcus aureus
DKKAYKKDAKSNKYANKPAEGHAKKADAAPKR

SEQ ID NO: 1603901 - protein, 9 aa, Staphylococcus aureus
DKKLSNENF

SEQ ID NO: 1603902 - protein, 9 aa, Staphylococcus aureus
DKKNDKQGV

SEQ ID NO: 1603903 - protein, 7 aa, Staphylococcus aureus
DKKSRMA

SEQ ID NO: 1603904 - protein, 8 aa, Staphylococcus aureus
DKMAETKK

SEQ ID NO: 1603905 - protein, 4 aa, Staphylococcus aureus
DKMP

SEQ ID NO: 1603906 - protein, 5 aa, Staphylococcus aureus
DKNDN

SEQ ID NO: 1603907 - protein, 12 aa, Staphylococcus aureus
DKNEKVTDVEGE

SEQ ID NO: 1603908 - protein, 19 aa, Staphylococcus aureus
DKNGRVGFGTGKAQEVPEA

SEQ ID NO: 1603909 - protein, 4 aa, Staphylococcus aureus
DKPG

SEQ ID NO: 1603910 - protein, 4 aa, Staphylococcus aureus
DKPR

SEQ ID NO: 1603911 - protein, 5 aa, Staphylococcus aureus
DKQEM

SEQ ID NO: 1603912 - protein, 5 aa, Staphylococcus aureus
DKQNV

SEQ ID NO: 1603913 - protein, 11 aa, Staphylococcus aureus
DKSDKRRGKLT

SEQ ID NO: 1603914 - protein, 7 aa, Staphylococcus aureus
DKSGEIE

SEQ ID NO: 1603915 - protein, 8 aa, Staphylococcus aureus
DKTYSGET

SEQ ID NO: 1603916 - protein, 4 aa, Staphylococcus aureus
DKVA

SEQ ID NO: 1603917 - protein, 6 aa, Staphylococcus aureus
DKVEPM

SEQ ID NO: 1603918 - protein, 9 aa, Staphylococcus aureus
DKVKQTNSY

SEQ ID NO: 1603919 - protein, 7 aa, Staphylococcus aureus
DKYGVSD

SEQ ID NO: 1603920 - protein, 6 aa, Staphylococcus aureus
DKYVSR

SEQ ID NO: 1603921 - protein, 5 aa, Staphylococcus aureus
DLAEE

SEQ ID NO: 1603922 - protein, 8 aa, Staphylococcus aureus
DLANGEAE

SEQ ID NO: 1603923 - protein, 10 aa, Staphylococcus aureus
DLDSQTEEEF

SEQ ID NO: 1603924 - protein, 6 aa, Staphylococcus aureus
DLENQG

SEQ ID NO: 1603925 - protein, 6 aa, Staphylococcus aureus
DLETAV

SEQ ID NO: 1603926 - protein, 19 aa, Staphylococcus aureus
DLGGKTKKDKTHITYRTLF

SEQ ID NO: 1603927 - protein, 5 aa, Staphylococcus aureus
DLGPE

SEQ ID NO: 1603928 - protein, 6 aa, Staphylococcus aureus
DLKGRT

SEQ ID NO: 1603929 - protein, 6 aa, Staphylococcus aureus
DLKKAE

SEQ ID NO: 1603930 - protein, 11 aa, Staphylococcus aureus
DLKNAASDQFQ

SEQ ID NO: 1603931 - protein, 5 aa, Staphylococcus aureus
DLPEK

SEQ ID NO: 1603932 - protein, 7 aa, Staphylococcus aureus
DLPGRSL

SEQ ID NO: 1603933 - protein, 12 aa, Staphylococcus aureus
DLPTTEEDDEEM

SEQ ID NO: 1603934 - protein, 8 aa, Staphylococcus aureus
DLPYKGSL

SEQ ID NO: 1603935 - protein, 20 aa, Staphylococcus aureus
DLRQGYEYSRTANPTRSSVE

SEQ ID NO: 1603936 - protein, 6 aa, Staphylococcus aureus
DLSKSF

SEQ ID NO: 1603937 - protein, 4 aa, Staphylococcus aureus
DLSN

SEQ ID NO: 1603938 - protein, 7 aa, Staphylococcus aureus
DLTPGLA

SEQ ID NO: 1603939 - protein, 10 aa, Staphylococcus aureus
DMASRKEYNE

SEQ ID NO: 1603940 - protein, 5 aa, Staphylococcus aureus
DMGYQ

SEQ ID NO: 1603941 - protein, 4 aa, Staphylococcus aureus
DMQS

SEQ ID NO: 1603942 - protein, 5 aa, Staphylococcus aureus
DMSGV

SEQ ID NO: 1603943 - protein, 6 aa, Staphylococcus aureus
DMSNLN

SEQ ID NO: 1603944 - protein, 10 aa, Staphylococcus aureus
DNAADGRDTS

SEQ ID NO: 1603945 - protein, 5 aa, Staphylococcus aureus
DNAPD

SEQ ID NO: 1603946 - protein, 6 aa, Staphylococcus aureus
DNAPNL

SEQ ID NO: 1603947 - protein, 12 aa, Staphylococcus aureus
DNCGDPAEKEVT

SEQ ID NO: 1603948 - protein, 4 aa, Staphylococcus aureus
DNDA

SEQ ID NO: 1603949 - protein, 7 aa, Staphylococcus aureus
DNDTTGE

SEQ ID NO: 1603950 - protein, 8 aa, Staphylococcus aureus
DNEDYEGE

SEQ ID NO: 1603951 - protein, 6 aa, Staphylococcus aureus
DNENAG

SEQ ID NO: 1603952 - protein, 6 aa, Staphylococcus aureus
DNEQQH

SEQ ID NO: 1603953 - protein, 14 aa, Staphylococcus aureus
DNERHMHKQPQIIQ

SEQ ID NO: 1603954 - protein, 7 aa, Staphylococcus aureus
DNETVSL

SEQ ID NO: 1603955 - protein, 23 aa, Staphylococcus aureus
DNHRLSNESNNETRILIVATASY

SEQ ID NO: 1603956 - protein, 6 aa, Staphylococcus aureus
DNIENN

SEQ ID NO: 1603957 - protein, 6 aa, Staphylococcus aureus
DNIKKS

SEQ ID NO: 1603958 - protein, 9 aa, Staphylococcus aureus
DNIPDNGSV

SEQ ID NO: 1603959 - protein, 24 aa, Staphylococcus aureus
DNKGVTLAQASSKDSDIATTATKV

SEQ ID NO: 1603960 - protein, 7 aa, Staphylococcus aureus
DNKNGFK

SEQ ID NO: 1603961 - protein, 5 aa, Staphylococcus aureus
DNNEI

SEQ ID NO: 1603962 - protein, 7 aa, Staphylococcus aureus
DNNRKSV

SEQ ID NO: 1603963 - protein, 4 aa, Staphylococcus aureus
DNNV

SEQ ID NO: 1603964 - protein, 8 aa, Staphylococcus aureus
DNPAIRGQ

SEQ ID NO: 1603965 - protein, 10 aa, Staphylococcus aureus
DNPSVPDSEY

SEQ ID NO: 1603966 - protein, 5 aa, Staphylococcus aureus
DNQTK

SEQ ID NO: 1603967 - protein, 7 aa, Staphylococcus aureus
DNRAAKY

SEQ ID NO: 1603968 - protein, 6 aa, Staphylococcus aureus
DNRTVR

SEQ ID NO: 1603969 - protein, 7 aa, Staphylococcus aureus
DNSGARE

SEQ ID NO: 1603970 - protein, 5 aa, Staphylococcus aureus
DNTNI

SEQ ID NO: 1603971 - protein, 6 aa, Staphylococcus aureus
DNYPKN

SEQ ID NO: 1603972 - protein, 18 aa, Staphylococcus aureus
DPAIVNENANKDSDTFST

SEQ ID NO: 1603973 - protein, 7 aa, Staphylococcus aureus
DPDCSPQ

SEQ ID NO: 1603974 - protein, 6 aa, Staphylococcus aureus
DPHAAK

SEQ ID NO: 1603975 - protein, 8 aa, Staphylococcus aureus
DPITEDVE

SEQ ID NO: 1603976 - protein, 15 aa, Staphylococcus aureus
DPKNRRIAAGPEIQS

SEQ ID NO: 1603977 - protein, 10 aa, Staphylococcus aureus
DPRQRQNDEN

SEQ ID NO: 1603978 - protein, 5 aa, Staphylococcus aureus
DPSEI

SEQ ID NO: 1603979 - protein, 9 aa, Staphylococcus aureus
DPTDDQGQF

SEQ ID NO: 1603980 - protein, 8 aa, Staphylococcus aureus
DPTDQKSV

SEQ ID NO: 1603981 - protein, 5 aa, Staphylococcus aureus
DPTLH

SEQ ID NO: 1603982 - protein, 6 aa, Staphylococcus aureus
DQADRY

SEQ ID NO: 1603983 - protein, 5 aa, Staphylococcus aureus
DQAEW

SEQ ID NO: 1603984 - protein, 12 aa, Staphylococcus aureus
DQEAQSPSDHAA

SEQ ID NO: 1603985 - protein, 10 aa, Staphylococcus aureus
DQLPSVGPGQ

SEQ ID NO: 1603986 - protein, 10 aa, Staphylococcus aureus
DQNELKGERG

SEQ ID NO: 1603987 - protein, 6 aa, Staphylococcus aureus
DQQYYE

SEQ ID NO: 1603988 - protein, 9 aa, Staphylococcus aureus
DQSASGQTL

SEQ ID NO: 1603989 - protein, 7 aa, Staphylococcus aureus
DRDEVDL

SEQ ID NO: 1603990 - protein, 6 aa, Staphylococcus aureus
DRGNEF

SEQ ID NO: 1603991 - protein, 9 aa, Staphylococcus aureus
DRGPQPDKI

SEQ ID NO: 1603992 - protein, 13 aa, Staphylococcus aureus
DRLASKPDAFAPN

SEQ ID NO: 1603993 - protein, 5 aa, Staphylococcus aureus
DRNTT

SEQ ID NO: 1603994 - protein, 9 aa, Staphylococcus aureus
DRQERAGVK

SEQ ID NO: 1603995 - protein, 9 aa, Staphylococcus aureus
DRRDQNGQL

SEQ ID NO: 1603996 - protein, 4 aa, Staphylococcus aureus
DRRP

SEQ ID NO: 1603997 - protein, 5 aa, Staphylococcus aureus
DRSLS

SEQ ID NO: 1603998 - protein, 14 aa, Staphylococcus aureus
DSAHGTNPASASFA

SEQ ID NO: 1603999 - protein, 10 aa, Staphylococcus aureus
DSAKEKSNEG

SEQ ID NO: 1604000 - protein, 7 aa, Staphylococcus aureus
DSDQSIY

SEQ ID NO: 1604001 - protein, 6 aa, Staphylococcus aureus
DSEEKI

SEQ ID NO: 1604002 - protein, 4 aa, Staphylococcus aureus
DSEK

SEQ ID NO: 1604003 - protein, 11 aa, Staphylococcus aureus
DSETGNESTIQ

SEQ ID NO: 1604004 - protein, 6 aa, Staphylococcus aureus
DSFSDT

SEQ ID NO: 1604005 - protein, 14 aa, Staphylococcus aureus
DSGVSGQAAQKMAE

SEQ ID NO: 1604006 - protein, 7 aa, Staphylococcus aureus
DSIQSRL

SEQ ID NO: 1604007 - protein, 9 aa, Staphylococcus aureus
DSKKQNKKN

SEQ ID NO: 1604008 - protein, 7 aa, Staphylococcus aureus
DSKVESG

SEQ ID NO: 1604009 - protein, 9 aa, Staphylococcus aureus
DSNLAENNQ

SEQ ID NO: 1604010 - protein, 7 aa, Staphylococcus aureus
DSPGMNA

SEQ ID NO: 1604011 - protein, 8 aa, Staphylococcus aureus
DSRFSATT

SEQ ID NO: 1604012 - protein, 17 aa, Staphylococcus aureus
DSSVGGKVGINSKQGKN

SEQ ID NO: 1604013 - protein, 15 aa, Staphylococcus aureus
DSTEAEKPGYNTPEN

SEQ ID NO: 1604014 - protein, 10 aa, Staphylococcus aureus
DSYANPEALE

SEQ ID NO: 1604015 - protein, 5 aa, Staphylococcus aureus
DTATE

SEQ ID NO: 1604016 - protein, 4 aa, Staphylococcus aureus
DTDQ

SEQ ID NO: 1604017 - protein, 6 aa, Staphylococcus aureus
DTEKDG

SEQ ID NO: 1604018 - protein, 6 aa, Staphylococcus aureus
DTFRAG

SEQ ID NO: 1604019 - protein, 8 aa, Staphylococcus aureus
DTGAQGKI

SEQ ID NO: 1604020 - protein, 6 aa, Staphylococcus aureus
DTGRTH

SEQ ID NO: 1604021 - protein, 8 aa, Staphylococcus aureus
DTHQADDG

SEQ ID NO: 1604022 - protein, 7 aa, Staphylococcus aureus
DTKRQGS

SEQ ID NO: 1604023 - protein, 6 aa, Staphylococcus aureus
DTLENR

SEQ ID NO: 1604024 - protein, 7 aa, Staphylococcus aureus
DTNNDEA

SEQ ID NO: 1604025 - protein, 4 aa, Staphylococcus aureus
DTNR

SEQ ID NO: 1604026 - protein, 14 aa, Staphylococcus aureus
DTQDIADELKNRRA

SEQ ID NO: 1604027 - protein, 6 aa, Staphylococcus aureus
DTQPFG

SEQ ID NO: 1604028 - protein, 7 aa, Staphylococcus aureus
DTRVSGE

SEQ ID NO: 1604029 - protein, 12 aa, Staphylococcus aureus
DTSEDLDGYMFY

SEQ ID NO: 1604030 - protein, 8 aa, Staphylococcus aureus
DTSGRELY

SEQ ID NO: 1604031 - protein, 6 aa, Staphylococcus aureus
DTSNIE

SEQ ID NO: 1604032 - protein, 14 aa, Staphylococcus aureus
DTSYETKDKSSEAV

SEQ ID NO: 1604033 - protein, 13 aa, Staphylococcus aureus
DTTPGGGTDAGSI

SEQ ID NO: 1604034 - protein, 8 aa, Staphylococcus aureus
DTTTGISA

SEQ ID NO: 1604035 - protein, 6 aa, Staphylococcus aureus
DTTTNQ

SEQ ID NO: 1604036 - protein, 9 aa, Staphylococcus aureus
DTYTKNDTS

SEQ ID NO: 1604037 - protein, 5 aa, Staphylococcus aureus
DVEAT

SEQ ID NO: 1604038 - protein, 6 aa, Staphylococcus aureus
DVKIDG

SEQ ID NO: 1604039 - protein, 7 aa, Staphylococcus aureus
DVNGNKV

SEQ ID NO: 1604040 - protein, 10 aa, Staphylococcus aureus
DVPDQPSFKS

SEQ ID NO: 1604041 - protein, 6 aa, Staphylococcus aureus
DVPESL

SEQ ID NO: 1604042 - protein, 7 aa, Staphylococcus aureus
DVPQAGD

SEQ ID NO: 1604043 - protein, 7 aa, Staphylococcus aureus
DVQGSVE

SEQ ID NO: 1604044 - protein, 5 aa, Staphylococcus aureus
DVTPF

SEQ ID NO: 1604045 - protein, 8 aa, Staphylococcus aureus
DWPKPGVS

SEQ ID NO: 1604046 - protein, 6 aa, Staphylococcus aureus
DYAESL

SEQ ID NO: 1604047 - protein, 6 aa, Staphylococcus aureus
DYAGKK

SEQ ID NO: 1604048 - protein, 4 aa, Staphylococcus aureus
DYAT

SEQ ID NO: 1604049 - protein, 4 aa, Staphylococcus aureus
DYDT

SEQ ID NO: 1604050 - protein, 7 aa, Staphylococcus aureus
DYGFSDK

SEQ ID NO: 1604051 - protein, 17 aa, Staphylococcus aureus
DYGMGSSRDWAAKGTNL

SEQ ID NO: 1604052 - protein, 6 aa, Staphylococcus aureus
DYGSNI

SEQ ID NO: 1604053 - protein, 9 aa, Staphylococcus aureus
DYPGIGPEH

SEQ ID NO: 1604054 - protein, 4 aa, Staphylococcus aureus
DYTD

SEQ ID NO: 1604055 - protein, 9 aa, Staphylococcus aureus
DYTSPSGSL

SEQ ID NO: 1604056 - protein, 18 aa, Staphylococcus aureus
EAAAGLPEDVKAYFTSRF

SEQ ID NO: 1604057 - protein, 6 aa, Staphylococcus aureus
EAAEQS

SEQ ID NO: 1604058 - protein, 6 aa, Staphylococcus aureus
EAEGHA

SEQ ID NO: 1604059 - protein, 13 aa, Staphylococcus aureus
EAERSPNEKYIPN

SEQ ID NO: 1604060 - protein, 5 aa, Staphylococcus aureus
EAGAK

SEQ ID NO: 1604061 - protein, 15 aa, Staphylococcus aureus
EAGEPLTPTRMNEEY

SEQ ID NO: 1604062 - protein, 6 aa, Staphylococcus aureus
EAGERD

SEQ ID NO: 1604063 - protein, 5 aa, Staphylococcus aureus
EAGGV

SEQ ID NO: 1604064 - protein, 8 aa, Staphylococcus aureus
EAGRTKKP

SEQ ID NO: 1604065 - protein, 12 aa, Staphylococcus aureus
EAINTVPSNGYL

SEQ ID NO: 1604066 - protein, 6 aa, Staphylococcus aureus
EAIREA

SEQ ID NO: 1604067 - protein, 6 aa, Staphylococcus aureus
EAITER

SEQ ID NO: 1604068 - protein, 9 aa, Staphylococcus aureus
EAKEQSGSH

SEQ ID NO: 1604069 - protein, 5 aa, Staphylococcus aureus
EAKNY

SEQ ID NO: 1604070 - protein, 7 aa, Staphylococcus aureus
EAKPEDY

SEQ ID NO: 1604071 - protein, 6 aa, Staphylococcus aureus
EAKTGA

SEQ ID NO: 1604072 - protein, 7 aa, Staphylococcus aureus
EALTQED

SEQ ID NO: 1604073 - protein, 19 aa, Staphylococcus aureus
EANGVSPDDADDWVGEENG

SEQ ID NO: 1604074 - protein, 8 aa, Staphylococcus aureus
EAPKTKEF

SEQ ID NO: 1604075 - protein, 10 aa, Staphylococcus aureus
EAQHGGQGTL

SEQ ID NO: 1604076 - protein, 8 aa, Staphylococcus aureus
EAQKSSVN

SEQ ID NO: 1604077 - protein, 15 aa, Staphylococcus aureus
EASLGRALKDNGVDR

SEQ ID NO: 1604078 - protein, 11 aa, Staphylococcus aureus
EASLSGPKRPQ

SEQ ID NO: 1604079 - protein, 11 aa, Staphylococcus aureus
EASNPYGDGFA

SEQ ID NO: 1604080 - protein, 9 aa, Staphylococcus aureus
EATKDAAKP

SEQ ID NO: 1604081 - protein, 6 aa, Staphylococcus aureus
EATTAA

SEQ ID NO: 1604082 - protein, 8 aa, Staphylococcus aureus
EAVENTDA

SEQ ID NO: 1604083 - protein, 12 aa, Staphylococcus aureus
EDAGKSTHKGEY

SEQ ID NO: 1604084 - protein, 4 aa, Staphylococcus aureus
EDAK

SEQ ID NO: 1604085 - protein, 5 aa, Staphylococcus aureus
EDAKR

SEQ ID NO: 1604086 - protein, 8 aa, Staphylococcus aureus
EDANGRKM

SEQ ID NO: 1604087 - protein, 6 aa, Staphylococcus aureus
EDDNNK

SEQ ID NO: 1604088 - protein, 16 aa, Staphylococcus aureus
EDEREQQAIYNAVELN

SEQ ID NO: 1604089 - protein, 8 aa, Staphylococcus aureus
EDETTQTA

SEQ ID NO: 1604090 - protein, 7 aa, Staphylococcus aureus
EDGEIKN

SEQ ID NO: 1604091 - protein, 4 aa, Staphylococcus aureus
EDLR

SEQ ID NO: 1604092 - protein, 8 aa, Staphylococcus aureus
EDLSKKLD

SEQ ID NO: 1604093 - protein, 8 aa, Staphylococcus aureus
EDMKRQSK

SEQ ID NO: 1604094 - protein, 4 aa, Staphylococcus aureus
EDNN

SEQ ID NO: 1604095 - protein, 7 aa, Staphylococcus aureus
EDPEIYE

SEQ ID NO: 1604096 - protein, 6 aa, Staphylococcus aureus
EDQDLN

SEQ ID NO: 1604097 - protein, 5 aa, Staphylococcus aureus
EDSNY

SEQ ID NO: 1604098 - protein, 4 aa, Staphylococcus aureus
EDTI

SEQ ID NO: 1604099 - protein, 12 aa, Staphylococcus aureus
EDVEQVKPDPEL

SEQ ID NO: 1604100 - protein, 8 aa, Staphylococcus aureus
EDVSGHEA

SEQ ID NO: 1604101 - protein, 5 aa, Staphylococcus aureus
EDVTN

SEQ ID NO: 1604102 - protein, 10 aa, Staphylococcus aureus
EEAERKGNHI

SEQ ID NO: 1604103 - protein, 10 aa, Staphylococcus aureus
EEAKDGELSN

SEQ ID NO: 1604104 - protein, 10 aa, Staphylococcus aureus
EEAKNETGAT

SEQ ID NO: 1604105 - protein, 14 aa, Staphylococcus aureus
EEAPTDIENWQQDE

SEQ ID NO: 1604106 - protein, 6 aa, Staphylococcus aureus
EEAQAG

SEQ ID NO: 1604107 - protein, 6 aa, Staphylococcus aureus
EEDEGV

SEQ ID NO: 1604108 - protein, 5 aa, Staphylococcus aureus
EEDLD

SEQ ID NO: 1604109 - protein, 12 aa, Staphylococcus aureus
EEEYNENIRLNY

SEQ ID NO: 1604110 - protein, 8 aa, Staphylococcus aureus
EEFEPGNQ

SEQ ID NO: 1604111 - protein, 11 aa, Staphylococcus aureus
EEGLTTAATQL

SEQ ID NO: 1604112 - protein, 6 aa, Staphylococcus aureus
EEGPAH

SEQ ID NO: 1604113 - protein, 5 aa, Staphylococcus aureus
EEGVE

SEQ ID NO: 1604114 - protein, 7 aa, Staphylococcus aureus
EEIGRGD

SEQ ID NO: 1604115 - protein, 7 aa, Staphylococcus aureus
EEISEQA

SEQ ID NO: 1604116 - protein, 10 aa, Staphylococcus aureus
EEKEKNDEQL

SEQ ID NO: 1604117 - protein, 5 aa, Staphylococcus aureus
EEKLT

SEQ ID NO: 1604118 - protein, 8 aa, Staphylococcus aureus
EEKQEYLK

SEQ ID NO: 1604119 - protein, 9 aa, Staphylococcus aureus
EELEDSPEF

SEQ ID NO: 1604120 - protein, 7 aa, Staphylococcus aureus
EENHATN

SEQ ID NO: 1604121 - protein, 4 aa, Staphylococcus aureus
EEQH

SEQ ID NO: 1604122 - protein, 7 aa, Staphylococcus aureus
EEQHGHQ

SEQ ID NO: 1604123 - protein, 10 aa, Staphylococcus aureus
EERDTNIKSY

SEQ ID NO: 1604124 - protein, 4 aa, Staphylococcus aureus
EERL

SEQ ID NO: 1604125 - protein, 6 aa, Staphylococcus aureus
EESEFE

SEQ ID NO: 1604126 - protein, 6 aa, Staphylococcus aureus
EESGLI

SEQ ID NO: 1604127 - protein, 6 aa, Staphylococcus aureus
EESGVQ

SEQ ID NO: 1604128 - protein, 8 aa, Staphylococcus aureus
EESKAYYE

SEQ ID NO: 1604129 - protein, 11 aa, Staphylococcus aureus
EESKGKNIHPT

SEQ ID NO: 1604130 - protein, 11 aa, Staphylococcus aureus
EETGYQKPNPE

SEQ ID NO: 1604131 - protein, 6 aa, Staphylococcus aureus
EETITD

SEQ ID NO: 1604132 - protein, 5 aa, Staphylococcus aureus
EETNT

SEQ ID NO: 1604133 - protein, 10 aa, Staphylococcus aureus
EEVSQVEAGE

SEQ ID NO: 1604134 - protein, 7 aa, Staphylococcus aureus
EEYKEAN

SEQ ID NO: 1604135 - protein, 10 aa, Staphylococcus aureus
EFEPESSQAL

SEQ ID NO: 1604136 - protein, 9 aa, Staphylococcus aureus
EFESSTPYY

SEQ ID NO: 1604137 - protein, 5 aa, Staphylococcus aureus
EFKNL

SEQ ID NO: 1604138 - protein, 12 aa, Staphylococcus aureus
EFQQSSDTIASA

SEQ ID NO: 1604139 - protein, 5 aa, Staphylococcus aureus
EFSRV

SEQ ID NO: 1604140 - protein, 9 aa, Staphylococcus aureus
EGASDGVGL

SEQ ID NO: 1604141 - protein, 5 aa, Staphylococcus aureus
EGAYS

SEQ ID NO: 1604142 - protein, 5 aa, Staphylococcus aureus
EGDES

SEQ ID NO: 1604143 - protein, 13 aa, Staphylococcus aureus
EGDRGPQAANVVK

SEQ ID NO: 1604144 - protein, 7 aa, Staphylococcus aureus
EGGLSEN

SEQ ID NO: 1604145 - protein, 4 aa, Staphylococcus aureus
EGGN

SEQ ID NO: 1604146 - protein, 9 aa, Staphylococcus aureus
EGGPSKNYN

SEQ ID NO: 1604147 - protein, 6 aa, Staphylococcus aureus
EGHAEA

SEQ ID NO: 1604148 - protein, 4 aa, Staphylococcus aureus
EGHS

SEQ ID NO: 1604149 - protein, 16 aa, Staphylococcus aureus
EGINGTLSGTKEETEQ

SEQ ID NO: 1604150 - protein, 12 aa, Staphylococcus aureus
EGKDAQKALQDS

SEQ ID NO: 1604151 - protein, 11 aa, Staphylococcus aureus
EGKDPSEISRK

SEQ ID NO: 1604152 - protein, 7 aa, Staphylococcus aureus
EGKRTEF

SEQ ID NO: 1604153 - protein, 7 aa, Staphylococcus aureus
EGLEAPK

SEQ ID NO: 1604154 - protein, 8 aa, Staphylococcus aureus
EGPGSYTG

SEQ ID NO: 1604155 - protein, 10 aa, Staphylococcus aureus
EGPKGGPGMP

SEQ ID NO: 1604156 - protein, 7 aa, Staphylococcus aureus
EGQEETF

SEQ ID NO: 1604157 - protein, 11 aa, Staphylococcus aureus
EGQGPEHSSAR

SEQ ID NO: 1604158 - protein, 23 aa, Staphylococcus aureus
EGQNSETLGNDEAREGDATDDMT

SEQ ID NO: 1604159 - protein, 5 aa, Staphylococcus aureus
EGRGI

SEQ ID NO: 1604160 - protein, 5 aa, Staphylococcus aureus
EGRKI

SEQ ID NO: 1604161 - protein, 22 aa, Staphylococcus aureus
EGRTRAAQDDTQRAGAPTTDHH

SEQ ID NO: 1604162 - protein, 7 aa, Staphylococcus aureus
EGSDDYR

SEQ ID NO: 1604163 - protein, 7 aa, Staphylococcus aureus
EGSKLTD

SEQ ID NO: 1604164 - protein, 11 aa, Staphylococcus aureus
EGSTDEEAARD

SEQ ID NO: 1604165 - protein, 5 aa, Staphylococcus aureus
EGTQH

SEQ ID NO: 1604166 - protein, 15 aa, Staphylococcus aureus
EGTTPHTITGRYGSG

SEQ ID NO: 1604167 - protein, 4 aa, Staphylococcus aureus
EGYN

SEQ ID NO: 1604168 - protein, 16 aa, Staphylococcus aureus
EGYPPTINSPKLRTQI

SEQ ID NO: 1604169 - protein, 14 aa, Staphylococcus aureus
EHESTYKQEDYPRY

SEQ ID NO: 1604170 - protein, 8 aa, Staphylococcus aureus
EHGLDEEA

SEQ ID NO: 1604171 - protein, 15 aa, Staphylococcus aureus
EHPHAAQQPENYELR

SEQ ID NO: 1604172 - protein, 14 aa, Staphylococcus aureus
EHRERYRNKRNQNQ

SEQ ID NO: 1604173 - protein, 20 aa, Staphylococcus aureus
EIEQSESFSQKVKEGKSYPR

SEQ ID NO: 1604174 - protein, 4 aa, Staphylococcus aureus
EIGE

SEQ ID NO: 1604175 - protein, 8 aa, Staphylococcus aureus
EIKEKYSE

SEQ ID NO: 1604176 - protein, 6 aa, Staphylococcus aureus
EIKEPQ

SEQ ID NO: 1604177 - protein, 4 aa, Staphylococcus aureus
EINP

SEQ ID NO: 1604178 - protein, 4 aa, Staphylococcus aureus
EIQE

SEQ ID NO: 1604179 - protein, 7 aa, Staphylococcus aureus
EITASAT

SEQ ID NO: 1604180 - protein, 11 aa, Staphylococcus aureus
EITKDAFGKTI

SEQ ID NO: 1604181 - protein, 6 aa, Staphylococcus aureus
EKAGAN

SEQ ID NO: 1604182 - protein, 14 aa, Staphylococcus aureus
EKAKTLNNENGQSF

SEQ ID NO: 1604183 - protein, 9 aa, Staphylococcus aureus
EKAYNGEKR

SEQ ID NO: 1604184 - protein, 4 aa, Staphylococcus aureus
EKDF

SEQ ID NO: 1604185 - protein, 8 aa, Staphylococcus aureus
EKDKVGEA

SEQ ID NO: 1604186 - protein, 6 aa, Staphylococcus aureus
EKDLQE

SEQ ID NO: 1604187 - protein, 4 aa, Staphylococcus aureus
EKEE

SEQ ID NO: 1604188 - protein, 5 aa, Staphylococcus aureus
EKEEE

SEQ ID NO: 1604189 - protein, 5 aa, Staphylococcus aureus
EKEGR

SEQ ID NO: 1604190 - protein, 4 aa, Staphylococcus aureus
EKEK

SEQ ID NO: 1604191 - protein, 4 aa, Staphylococcus aureus
EKFN

SEQ ID NO: 1604192 - protein, 6 aa, Staphylococcus aureus
EKFSKQ

SEQ ID NO: 1604193 - protein, 15 aa, Staphylococcus aureus
EKGEPTLELNDDGGY

SEQ ID NO: 1604194 - protein, 11 aa, Staphylococcus aureus
EKGKGKTKRVE

SEQ ID NO: 1604195 - protein, 8 aa, Staphylococcus aureus
EKGLDGSR

SEQ ID NO: 1604196 - protein, 14 aa, Staphylococcus aureus
EKGQTGRMLAFIGQ

SEQ ID NO: 1604197 - protein, 9 aa, Staphylococcus aureus
EKHQSKPSL

SEQ ID NO: 1604198 - protein, 6 aa, Staphylococcus aureus
EKIAPT

SEQ ID NO: 1604199 - protein, 4 aa, Staphylococcus aureus
EKIP

SEQ ID NO: 1604200 - protein, 8 aa, Staphylococcus aureus
EKLPDDFQ

SEQ ID NO: 1604201 - protein, 11 aa, Staphylococcus aureus
EKNNDPYPQEL

SEQ ID NO: 1604202 - protein, 7 aa, Staphylococcus aureus
EKPDKGC

SEQ ID NO: 1604203 - protein, 8 aa, Staphylococcus aureus
EKQNINTE

SEQ ID NO: 1604204 - protein, 5 aa, Staphylococcus aureus
EKQSL

SEQ ID NO: 1604205 - protein, 6 aa, Staphylococcus aureus
EKRGRN

SEQ ID NO: 1604206 - protein, 8 aa, Staphylococcus aureus
EKRNRNEI

SEQ ID NO: 1604207 - protein, 6 aa, Staphylococcus aureus
EKRPVR

SEQ ID NO: 1604208 - protein, 8 aa, Staphylococcus aureus
EKSNYVPS

SEQ ID NO: 1604209 - protein, 8 aa, Staphylococcus aureus
EKSSDEAI

SEQ ID NO: 1604210 - protein, 7 aa, Staphylococcus aureus
EKTGATG

SEQ ID NO: 1604211 - protein, 16 aa, Staphylococcus aureus
EKTGMKGRRETNTMPQ

SEQ ID NO: 1604212 - protein, 6 aa, Staphylococcus aureus
EKTHSF

SEQ ID NO: 1604213 - protein, 11 aa, Staphylococcus aureus
EKTPSFTVSED

SEQ ID NO: 1604214 - protein, 6 aa, Staphylococcus aureus
EKTSPY

SEQ ID NO: 1604215 - protein, 7 aa, Staphylococcus aureus
EKVGNDG

SEQ ID NO: 1604216 - protein, 7 aa, Staphylococcus aureus
ELDPENN

SEQ ID NO: 1604217 - protein, 4 aa, Staphylococcus aureus
ELER

SEQ ID NO: 1604218 - protein, 5 aa, Staphylococcus aureus
ELGET

SEQ ID NO: 1604219 - protein, 5 aa, Staphylococcus aureus
ELGGE

SEQ ID NO: 1604220 - protein, 6 aa, Staphylococcus aureus
ELGGGS

SEQ ID NO: 1604221 - protein, 9 aa, Staphylococcus aureus
ELNEEKEQL

SEQ ID NO: 1604222 - protein, 20 aa, Staphylococcus aureus
ELPADFQPQVATTQLREKYQ

SEQ ID NO: 1604223 - protein, 5 aa, Staphylococcus aureus
ELPEN

SEQ ID NO: 1604224 - protein, 7 aa, Staphylococcus aureus
ELPTQDV

SEQ ID NO: 1604225 - protein, 8 aa, Staphylococcus aureus
ELQKANDA

SEQ ID NO: 1604226 - protein, 9 aa, Staphylococcus aureus
ELSEGNRSM

SEQ ID NO: 1604227 - protein, 13 aa, Staphylococcus aureus
ELSGKSRDEVRAQ

SEQ ID NO: 1604228 - protein, 8 aa, Staphylococcus aureus
ELTDTHKQ

SEQ ID NO: 1604229 - protein, 13 aa, Staphylococcus aureus
EMDEPSITNPVPY

SEQ ID NO: 1604230 - protein, 12 aa, Staphylococcus aureus
EMQTGEGKTLTA

SEQ ID NO: 1604231 - protein, 6 aa, Staphylococcus aureus
EMRGPG

SEQ ID NO: 1604232 - protein, 11 aa, Staphylococcus aureus
ENAAHGKGLTE

SEQ ID NO: 1604233 - protein, 9 aa, Staphylococcus aureus
ENAAKEPEI

SEQ ID NO: 1604234 - protein, 7 aa, Staphylococcus aureus
ENAGLEG

SEQ ID NO: 1604235 - protein, 7 aa, Staphylococcus aureus
ENAPPEI

SEQ ID NO: 1604236 - protein, 9 aa, Staphylococcus aureus
ENASDTQAM

SEQ ID NO: 1604237 - protein, 4 aa, Staphylococcus aureus
ENDG

SEQ ID NO: 1604238 - protein, 4 aa, Staphylococcus aureus
ENEI

SEQ ID NO: 1604239 - protein, 7 aa, Staphylococcus aureus
ENENQEI

SEQ ID NO: 1604240 - protein, 6 aa, Staphylococcus aureus
ENFPGQ

SEQ ID NO: 1604241 - protein, 4 aa, Staphylococcus aureus
ENFR

SEQ ID NO: 1604242 - protein, 5 aa, Staphylococcus aureus
ENGFT

SEQ ID NO: 1604243 - protein, 9 aa, Staphylococcus aureus
ENGITSPSA

SEQ ID NO: 1604244 - protein, 6 aa, Staphylococcus aureus
ENGQPD

SEQ ID NO: 1604245 - protein, 5 aa, Staphylococcus aureus
ENKEA

SEQ ID NO: 1604246 - protein, 5 aa, Staphylococcus aureus
ENKTI

SEQ ID NO: 1604247 - protein, 4 aa, Staphylococcus aureus
ENLQ

SEQ ID NO: 1604248 - protein, 6 aa, Staphylococcus aureus
ENNDID

SEQ ID NO: 1604249 - protein, 7 aa, Staphylococcus aureus
ENNEKLK

SEQ ID NO: 1604250 - protein, 9 aa, Staphylococcus aureus
ENNGEGHRD

SEQ ID NO: 1604251 - protein, 16 aa, Staphylococcus aureus
ENPTYEQVKSGTSGHL

SEQ ID NO: 1604252 - protein, 7 aa, Staphylococcus aureus
ENQEGID

SEQ ID NO: 1604253 - protein, 5 aa, Staphylococcus aureus
ENQSR

SEQ ID NO: 1604254 - protein, 21 aa, Staphylococcus aureus
ENRASYENKIDEYPSSQGQKG

SEQ ID NO: 1604255 - protein, 12 aa, Staphylococcus aureus
ENRDFEPTEQKI

SEQ ID NO: 1604256 - protein, 6 aa, Staphylococcus aureus
ENSNVE

SEQ ID NO: 1604257 - protein, 9 aa, Staphylococcus aureus
ENTGDRPIQ

SEQ ID NO: 1604258 - protein, 11 aa, Staphylococcus aureus
ENTLESRSRLE

SEQ ID NO: 1604259 - protein, 6 aa, Staphylococcus aureus
ENTQQQ

SEQ ID NO: 1604260 - protein, 8 aa, Staphylococcus aureus
ENTRDKVK

SEQ ID NO: 1604261 - protein, 12 aa, Staphylococcus aureus
ENTRVGQSSDFD

SEQ ID NO: 1604262 - protein, 7 aa, Staphylococcus aureus
ENTYEGV

SEQ ID NO: 1604263 - protein, 6 aa, Staphylococcus aureus
ENVNVD

SEQ ID NO: 1604264 - protein, 6 aa, Staphylococcus aureus
ENVQPH

SEQ ID NO: 1604265 - protein, 9 aa, Staphylococcus aureus
ENWSRPESE

SEQ ID NO: 1604266 - protein, 12 aa, Staphylococcus aureus
ENYEQSTSQLRE

SEQ ID NO: 1604267 - protein, 18 aa, Staphylococcus aureus
ENYQNAKKQIYKNQTEED

SEQ ID NO: 1604268 - protein, 10 aa, Staphylococcus aureus
ENYTKYDGTP

SEQ ID NO: 1604269 - protein, 5 aa, Staphylococcus aureus
EPDDP

SEQ ID NO: 1604270 - protein, 11 aa, Staphylococcus aureus
EPDESGDGGKL

SEQ ID NO: 1604271 - protein, 4 aa, Staphylococcus aureus
EPFK

SEQ ID NO: 1604272 - protein, 9 aa, Staphylococcus aureus
EPGQKAEDI

SEQ ID NO: 1604273 - protein, 9 aa, Staphylococcus aureus
EPGRTIPGV

SEQ ID NO: 1604274 - protein, 7 aa, Staphylococcus aureus
EPGVGKT

SEQ ID NO: 1604275 - protein, 8 aa, Staphylococcus aureus
EPNQQQID

SEQ ID NO: 1604276 - protein, 15 aa, Staphylococcus aureus
EPSNENWHDELSRLQ

SEQ ID NO: 1604277 - protein, 6 aa, Staphylococcus aureus
EPSPEK

SEQ ID NO: 1604278 - protein, 7 aa, Staphylococcus aureus
EPSYRDN

SEQ ID NO: 1604279 - protein, 13 aa, Staphylococcus aureus
EPTAGLDPQSKRQ

SEQ ID NO: 1604280 - protein, 14 aa, Staphylococcus aureus
EPTGALDSKSANDL

SEQ ID NO: 1604281 - protein, 7 aa, Staphylococcus aureus
EPTGSGI

SEQ ID NO: 1604282 - protein, 5 aa, Staphylococcus aureus
EPTKK

SEQ ID NO: 1604283 - protein, 8 aa, Staphylococcus aureus
EPTNGIDA

SEQ ID NO: 1604284 - protein, 8 aa, Staphylococcus aureus
EPVSLQPS

SEQ ID NO: 1604285 - protein, 4 aa, Staphylococcus aureus
EPVT

SEQ ID NO: 1604286 - protein, 14 aa, Staphylococcus aureus
EQADLTKKEAGSAV

SEQ ID NO: 1604287 - protein, 5 aa, Staphylococcus aureus
EQDDI

SEQ ID NO: 1604288 - protein, 6 aa, Staphylococcus aureus
EQDENV

SEQ ID NO: 1604289 - protein, 5 aa, Staphylococcus aureus
EQGDS

SEQ ID NO: 1604290 - protein, 11 aa, Staphylococcus aureus
EQGGVDDKQNN

SEQ ID NO: 1604291 - protein, 12 aa, Staphylococcus aureus
EQGPEIDNQEAA

SEQ ID NO: 1604292 - protein, 4 aa, Staphylococcus aureus
EQHD

SEQ ID NO: 1604293 - protein, 14 aa, Staphylococcus aureus
EQHIRRDKATSNIC

SEQ ID NO: 1604294 - protein, 7 aa, Staphylococcus aureus
EQPIDTK

SEQ ID NO: 1604295 - protein, 8 aa, Staphylococcus aureus
EQPKSDRL

SEQ ID NO: 1604296 - protein, 4 aa, Staphylococcus aureus
EQQE

SEQ ID NO: 1604297 - protein, 4 aa, Staphylococcus aureus
EQQI

SEQ ID NO: 1604298 - protein, 6 aa, Staphylococcus aureus
EQQKAQ

SEQ ID NO: 1604299 - protein, 6 aa, Staphylococcus aureus
EQRPHD

SEQ ID NO: 1604300 - protein, 6 aa, Staphylococcus aureus
EQTGMR

SEQ ID NO: 1604301 - protein, 9 aa, Staphylococcus aureus
EQTKGRGRF

SEQ ID NO: 1604302 - protein, 9 aa, Staphylococcus aureus
EQVDGNDPL

SEQ ID NO: 1604303 - protein, 8 aa, Staphylococcus aureus
EQVREEGK

SEQ ID NO: 1604304 - protein, 5 aa, Staphylococcus aureus
EQYEQ

SEQ ID NO: 1604305 - protein, 36 aa, Staphylococcus aureus
ERAARKGRNPQTGKEIDIPASKVPAFKAGKALKDAV

SEQ ID NO: 1604306 - protein, 5 aa, Staphylococcus aureus
ERDPF

SEQ ID NO: 1604307 - protein, 4 aa, Staphylococcus aureus
ERFQ

SEQ ID NO: 1604308 - protein, 4 aa, Staphylococcus aureus
ERGR

SEQ ID NO: 1604309 - protein, 11 aa, Staphylococcus aureus
ERKERDHRKIG

SEQ ID NO: 1604310 - protein, 11 aa, Staphylococcus aureus
ERLKEDKKQLE

SEQ ID NO: 1604311 - protein, 12 aa, Staphylococcus aureus
ERPMAADNKTLG

SEQ ID NO: 1604312 - protein, 7 aa, Staphylococcus aureus
ERRNRSK

SEQ ID NO: 1604313 - protein, 7 aa, Staphylococcus aureus
ERRTKTQ

SEQ ID NO: 1604314 - protein, 6 aa, Staphylococcus aureus
ERSAVS

SEQ ID NO: 1604315 - protein, 4 aa, Staphylococcus aureus
ERTL

SEQ ID NO: 1604316 - protein, 7 aa, Staphylococcus aureus
ERTQAIG

SEQ ID NO: 1604317 - protein, 10 aa, Staphylococcus aureus
ERYGKEEAQK

SEQ ID NO: 1604318 - protein, 6 aa, Staphylococcus aureus
ESARPY

SEQ ID NO: 1604319 - protein, 8 aa, Staphylococcus aureus
ESDDPMKQ

SEQ ID NO: 1604320 - protein, 10 aa, Staphylococcus aureus
ESEAPGFEKG

SEQ ID NO: 1604321 - protein, 5 aa, Staphylococcus aureus
ESELE

SEQ ID NO: 1604322 - protein, 8 aa, Staphylococcus aureus
ESESTPTS

SEQ ID NO: 1604323 - protein, 9 aa, Staphylococcus aureus
ESGAEADIK

SEQ ID NO: 1604324 - protein, 11 aa, Staphylococcus aureus
ESHPNMPSTVT

SEQ ID NO: 1604325 - protein, 23 aa, Staphylococcus aureus
ESIEQAVERAGTKAGNKGAEAAV

SEQ ID NO: 1604326 - protein, 9 aa, Staphylococcus aureus
ESKETGNKE

SEQ ID NO: 1604327 - protein, 10 aa, Staphylococcus aureus
ESKGYGKEFG

SEQ ID NO: 1604328 - protein, 8 aa, Staphylococcus aureus
ESKPRRNQ

SEQ ID NO: 1604329 - protein, 8 aa, Staphylococcus aureus
ESKTNRLT

SEQ ID NO: 1604330 - protein, 11 aa, Staphylococcus aureus
ESLSRDEIAND

SEQ ID NO: 1604331 - protein, 12 aa, Staphylococcus aureus
ESNGSSSQASIC

SEQ ID NO: 1604332 - protein, 5 aa, Staphylococcus aureus
ESPSF

SEQ ID NO: 1604333 - protein, 5 aa, Staphylococcus aureus
ESPTS

SEQ ID NO: 1604334 - protein, 5 aa, Staphylococcus aureus
ESQTV

SEQ ID NO: 1604335 - protein, 15 aa, Staphylococcus aureus
ESRDGKIKVTSKGKQ

SEQ ID NO: 1604336 - protein, 6 aa, Staphylococcus aureus
ESTDDL

SEQ ID NO: 1604337 - protein, 6 aa, Staphylococcus aureus
ESTLPN

SEQ ID NO: 1604338 - protein, 10 aa, Staphylococcus aureus
ESTQNDDGND

SEQ ID NO: 1604339 - protein, 6 aa, Staphylococcus aureus
ESYESS

SEQ ID NO: 1604340 - protein, 4 aa, Staphylococcus aureus
ETDD

SEQ ID NO: 1604341 - protein, 5 aa, Staphylococcus aureus
ETDRR

SEQ ID NO: 1604342 - protein, 12 aa, Staphylococcus aureus
ETEERAGFVSKT

SEQ ID NO: 1604343 - protein, 4 aa, Staphylococcus aureus
ETGA

SEQ ID NO: 1604344 - protein, 7 aa, Staphylococcus aureus
ETGAQNK

SEQ ID NO: 1604345 - protein, 10 aa, Staphylococcus aureus
ETGLTQPGKT

SEQ ID NO: 1604346 - protein, 6 aa, Staphylococcus aureus
ETGRTH

SEQ ID NO: 1604347 - protein, 6 aa, Staphylococcus aureus
ETIAQP

SEQ ID NO: 1604348 - protein, 6 aa, Staphylococcus aureus
ETISNK

SEQ ID NO: 1604349 - protein, 5 aa, Staphylococcus aureus
ETMEK

SEQ ID NO: 1604350 - protein, 14 aa, Staphylococcus aureus
ETNLEKVSRKNLSR

SEQ ID NO: 1604351 - protein, 6 aa, Staphylococcus aureus
ETNQST

SEQ ID NO: 1604352 - protein, 4 aa, Staphylococcus aureus
ETNY

SEQ ID NO: 1604353 - protein, 12 aa, Staphylococcus aureus
ETPIGEEDDSHL

SEQ ID NO: 1604354 - protein, 8 aa, Staphylococcus aureus
ETRPLSAT

SEQ ID NO: 1604355 - protein, 5 aa, Staphylococcus aureus
ETSAI

SEQ ID NO: 1604356 - protein, 4 aa, Staphylococcus aureus
ETST

SEQ ID NO: 1604357 - protein, 4 aa, Staphylococcus aureus
ETTC

SEQ ID NO: 1604358 - protein, 7 aa, Staphylococcus aureus
ETTGLPD

SEQ ID NO: 1604359 - protein, 7 aa, Staphylococcus aureus
ETTGNQL

SEQ ID NO: 1604360 - protein, 7 aa, Staphylococcus aureus
ETTSEKY

SEQ ID NO: 1604361 - protein, 7 aa, Staphylococcus aureus
ETTVQGN

SEQ ID NO: 1604362 - protein, 10 aa, Staphylococcus aureus
ETVPGPNAGL

SEQ ID NO: 1604363 - protein, 12 aa, Staphylococcus aureus
ETYEAITKSGET

SEQ ID NO: 1604364 - protein, 11 aa, Staphylococcus aureus
ETYENGRQAQQ

SEQ ID NO: 1604365 - protein, 8 aa, Staphylococcus aureus
EVANEQNI

SEQ ID NO: 1604366 - protein, 5 aa, Staphylococcus aureus
EVANN

SEQ ID NO: 1604367 - protein, 12 aa, Staphylococcus aureus
EVATNAGVKDVE

SEQ ID NO: 1604368 - protein, 15 aa, Staphylococcus aureus
EVDEGTATIKPSTLH

SEQ ID NO: 1604369 - protein, 8 aa, Staphylococcus aureus
EVEQQREN

SEQ ID NO: 1604370 - protein, 5 aa, Staphylococcus aureus
EVEQS

SEQ ID NO: 1604371 - protein, 9 aa, Staphylococcus aureus
EVGEEQASH

SEQ ID NO: 1604372 - protein, 8 aa, Staphylococcus aureus
EVGEKQAA

SEQ ID NO: 1604373 - protein, 12 aa, Staphylococcus aureus
EVKGVRTNIGTE

SEQ ID NO: 1604374 - protein, 6 aa, Staphylococcus aureus
EVNTQD

SEQ ID NO: 1604375 - protein, 9 aa, Staphylococcus aureus
EVNTTDPEY

SEQ ID NO: 1604376 - protein, 7 aa, Staphylococcus aureus
EVPETLK

SEQ ID NO: 1604377 - protein, 10 aa, Staphylococcus aureus
EVSPKTNDVV

SEQ ID NO: 1604378 - protein, 9 aa, Staphylococcus aureus
EWRGDKQLR

SEQ ID NO: 1604379 - protein, 7 aa, Staphylococcus aureus
EYDANTE

SEQ ID NO: 1604380 - protein, 10 aa, Staphylococcus aureus
EYEDGESDLL

SEQ ID NO: 1604381 - protein, 13 aa, Staphylococcus aureus
EYEQSKNKDTEQL

SEQ ID NO: 1604382 - protein, 8 aa, Staphylococcus aureus
EYGGRGMS

SEQ ID NO: 1604383 - protein, 8 aa, Staphylococcus aureus
EYQRKRDE

SEQ ID NO: 1604384 - protein, 8 aa, Staphylococcus aureus
EYQTDKRH

SEQ ID NO: 1604385 - protein, 4 aa, Staphylococcus aureus
EYTR

SEQ ID NO: 1604386 - protein, 6 aa, Staphylococcus aureus
FAEGKN

SEQ ID NO: 1604387 - protein, 4 aa, Staphylococcus aureus
FAEQ

SEQ ID NO: 1604388 - protein, 7 aa, Staphylococcus aureus
FAKSGKM

SEQ ID NO: 1604389 - protein, 6 aa, Staphylococcus aureus
FAPTRT

SEQ ID NO: 1604390 - protein, 6 aa, Staphylococcus aureus
FASSHE

SEQ ID NO: 1604391 - protein, 4 aa, Staphylococcus aureus
FATD

SEQ ID NO: 1604392 - protein, 60 aa, Staphylococcus aureus
FDDKPTSHGRKSGSTGFGTSVNTSSNATSKDESFTSNSSNAQATDSVSERTHTTKEDDIP

SEQ ID NO: 1604393 - protein, 9 aa, Staphylococcus aureus
FDEENETGA

SEQ ID NO: 1604394 - protein, 4 aa, Staphylococcus aureus
FDTP

SEQ ID NO: 1604395 - protein, 10 aa, Staphylococcus aureus
FDTQKERGQM

SEQ ID NO: 1604396 - protein, 5 aa, Staphylococcus aureus
FDYAG

SEQ ID NO: 1604397 - protein, 17 aa, Staphylococcus aureus
FEAGDLPVPEGKTYAPA

SEQ ID NO: 1604398 - protein, 6 aa, Staphylococcus aureus
FEENST

SEQ ID NO: 1604399 - protein, 14 aa, Staphylococcus aureus
FEGEHGAKRTAAEQ

SEQ ID NO: 1604400 - protein, 9 aa, Staphylococcus aureus
FEGREKNDA

SEQ ID NO: 1604401 - protein, 7 aa, Staphylococcus aureus
FEKGNGD

SEQ ID NO: 1604402 - protein, 8 aa, Staphylococcus aureus
FEKPTEIQ

SEQ ID NO: 1604403 - protein, 4 aa, Staphylococcus aureus
FEPQ

SEQ ID NO: 1604404 - protein, 10 aa, Staphylococcus aureus
FGDDTSEEMR

SEQ ID NO: 1604405 - protein, 4 aa, Staphylococcus aureus
FGGP

SEQ ID NO: 1604406 - protein, 8 aa, Staphylococcus aureus
FGPSTNGV

SEQ ID NO: 1604407 - protein, 16 aa, Staphylococcus aureus
FGTEIPDEEAEKINTV

SEQ ID NO: 1604408 - protein, 4 aa, Staphylococcus aureus
FGTG

SEQ ID NO: 1604409 - protein, 9 aa, Staphylococcus aureus
FHGGSATNI

SEQ ID NO: 1604410 - protein, 9 aa, Staphylococcus aureus
FKEETETDL

SEQ ID NO: 1604411 - protein, 6 aa, Staphylococcus aureus
FKEGLS

SEQ ID NO: 1604412 - protein, 7 aa, Staphylococcus aureus
FKGSMSK

SEQ ID NO: 1604413 - protein, 6 aa, Staphylococcus aureus
FKPLGQ

SEQ ID NO: 1604414 - protein, 9 aa, Staphylococcus aureus
FKPRTSPYD

SEQ ID NO: 1604415 - protein, 5 aa, Staphylococcus aureus
FNEDD

SEQ ID NO: 1604416 - protein, 7 aa, Staphylococcus aureus
FNEQGEK

SEQ ID NO: 1604417 - protein, 5 aa, Staphylococcus aureus
FNETT

SEQ ID NO: 1604418 - protein, 8 aa, Staphylococcus aureus
FNKEEQET

SEQ ID NO: 1604419 - protein, 7 aa, Staphylococcus aureus
FNQSEEQ

SEQ ID NO: 1604420 - protein, 7 aa, Staphylococcus aureus
FNSDPAV

SEQ ID NO: 1604421 - protein, 5 aa, Staphylococcus aureus
FNSQQ

SEQ ID NO: 1604422 - protein, 11 aa, Staphylococcus aureus
FPASSTGSFKS

SEQ ID NO: 1604423 - protein, 12 aa, Staphylococcus aureus
FPGVGKASKKVM

SEQ ID NO: 1604424 - protein, 8 aa, Staphylococcus aureus
FPKDNSEF

SEQ ID NO: 1604425 - protein, 13 aa, Staphylococcus aureus
FPNYESGTNGPLE

SEQ ID NO: 1604426 - protein, 4 aa, Staphylococcus aureus
FQMT

SEQ ID NO: 1604427 - protein, 12 aa, Staphylococcus aureus
FQNGHQRLEEAG

SEQ ID NO: 1604428 - protein, 7 aa, Staphylococcus aureus
FQQTEDK

SEQ ID NO: 1604429 - protein, 8 aa, Staphylococcus aureus
FRDEKRPR

SEQ ID NO: 1604430 - protein, 18 aa, Staphylococcus aureus
FSASAAEAIDAKGGAHEV

SEQ ID NO: 1604431 - protein, 9 aa, Staphylococcus aureus
FSEELGPKG

SEQ ID NO: 1604432 - protein, 8 aa, Staphylococcus aureus
FSGEANGI

SEQ ID NO: 1604433 - protein, 4 aa, Staphylococcus aureus
FSPE

SEQ ID NO: 1604434 - protein, 4 aa, Staphylococcus aureus
FSPV

SEQ ID NO: 1604435 - protein, 9 aa, Staphylococcus aureus
FSQPDENGH

SEQ ID NO: 1604436 - protein, 6 aa, Staphylococcus aureus
FSTTSL

SEQ ID NO: 1604437 - protein, 5 aa, Staphylococcus aureus
FTDND

SEQ ID NO: 1604438 - protein, 16 aa, Staphylococcus aureus
FTGPHGGGGPGSGPVG

SEQ ID NO: 1604439 - protein, 4 aa, Staphylococcus aureus
FTPA

SEQ ID NO: 1604440 - protein, 7 aa, Staphylococcus aureus
FTRGSRK

SEQ ID NO: 1604441 - protein, 21 aa, Staphylococcus aureus
FYEKPSVKRKKKSEAARKRKF

SEQ ID NO: 1604442 - protein, 10 aa, Staphylococcus aureus
GAAEQYTRKD

SEQ ID NO: 1604443 - protein, 10 aa, Staphylococcus aureus
GADAKDLDDA

SEQ ID NO: 1604444 - protein, 8 aa, Staphylococcus aureus
GADGPSFD

SEQ ID NO: 1604445 - protein, 11 aa, Staphylococcus aureus
GAEEAPGENDE

SEQ ID NO: 1604446 - protein, 6 aa, Staphylococcus aureus
GAGAAG

SEQ ID NO: 1604447 - protein, 9 aa, Staphylococcus aureus
GAGKGTDGQ

SEQ ID NO: 1604448 - protein, 10 aa, Staphylococcus aureus
GAGKTTTAGK

SEQ ID NO: 1604449 - protein, 11 aa, Staphylococcus aureus
GAGTDPSEGAA

SEQ ID NO: 1604450 - protein, 6 aa, Staphylococcus aureus
GAIEYS

SEQ ID NO: 1604451 - protein, 6 aa, Staphylococcus aureus
GAITSA

SEQ ID NO: 1604452 - protein, 13 aa, Staphylococcus aureus
GAITSQSDKETVR

SEQ ID NO: 1604453 - protein, 8 aa, Staphylococcus aureus
GAKAPRLV

SEQ ID NO: 1604454 - protein, 4 aa, Staphylococcus aureus
GAKD

SEQ ID NO: 1604455 - protein, 7 aa, Staphylococcus aureus
GAKGARV

SEQ ID NO: 1604456 - protein, 8 aa, Staphylococcus aureus
GAKPPKLV

SEQ ID NO: 1604457 - protein, 8 aa, Staphylococcus aureus
GAKRPGHF

SEQ ID NO: 1604458 - protein, 10 aa, Staphylococcus aureus
GALPANEGRG

SEQ ID NO: 1604459 - protein, 17 aa, Staphylococcus aureus
GANAAKDIITDEDKKKI

SEQ ID NO: 1604460 - protein, 7 aa, Staphylococcus aureus
GANPVSC

SEQ ID NO: 1604461 - protein, 10 aa, Staphylococcus aureus
GAPLSPAEIQ

SEQ ID NO: 1604462 - protein, 23 aa, Staphylococcus aureus
GAPPGYVGHDDGGQLTEKVRRKP

SEQ ID NO: 1604463 - protein, 10 aa, Staphylococcus aureus
GAPQKPGETR

SEQ ID NO: 1604464 - protein, 7 aa, Staphylococcus aureus
GAPTPVQ

SEQ ID NO: 1604465 - protein, 6 aa, Staphylococcus aureus
GAQKVG

SEQ ID NO: 1604466 - protein, 8 aa, Staphylococcus aureus
GASEITEQ

SEQ ID NO: 1604467 - protein, 9 aa, Staphylococcus aureus
GASPGASTA

SEQ ID NO: 1604468 - protein, 16 aa, Staphylococcus aureus
GATDASSFLGDNKDNV

SEQ ID NO: 1604469 - protein, 5 aa, Staphylococcus aureus
GATDT

SEQ ID NO: 1604470 - protein, 10 aa, Staphylococcus aureus
GATESNNTAI

SEQ ID NO: 1604471 - protein, 8 aa, Staphylococcus aureus
GATGSGKS

SEQ ID NO: 1604472 - protein, 6 aa, Staphylococcus aureus
GAVGSS

SEQ ID NO: 1604473 - protein, 10 aa, Staphylococcus aureus
GAVPKAVQQK

SEQ ID NO: 1604474 - protein, 7 aa, Staphylococcus aureus
GDARSVS

SEQ ID NO: 1604475 - protein, 14 aa, Staphylococcus aureus
GDAVESIYDASVNK

SEQ ID NO: 1604476 - protein, 8 aa, Staphylococcus aureus
GDEGKGKI

SEQ ID NO: 1604477 - protein, 7 aa, Staphylococcus aureus
GDEGSHC

SEQ ID NO: 1604478 - protein, 4 aa, Staphylococcus aureus
GDEI

SEQ ID NO: 1604479 - protein, 8 aa, Staphylococcus aureus
GDEKVPYA

SEQ ID NO: 1604480 - protein, 10 aa, Staphylococcus aureus
GDFEATEKGF

SEQ ID NO: 1604481 - protein, 15 aa, Staphylococcus aureus
GDGSYRGAQRISEEC

SEQ ID NO: 1604482 - protein, 4 aa, Staphylococcus aureus
GDII

SEQ ID NO: 1604483 - protein, 8 aa, Staphylococcus aureus
GDINGRPK

SEQ ID NO: 1604484 - protein, 12 aa, Staphylococcus aureus
GDINVSSLAQAE

SEQ ID NO: 1604485 - protein, 11 aa, Staphylococcus aureus
GDKAVKSESGL

SEQ ID NO: 1604486 - protein, 4 aa, Staphylococcus aureus
GDPM

SEQ ID NO: 1604487 - protein, 5 aa, Staphylococcus aureus
GDPSS

SEQ ID NO: 1604488 - protein, 14 aa, Staphylococcus aureus
GDSAGGSAKLGRDR

SEQ ID NO: 1604489 - protein, 8 aa, Staphylococcus aureus
GDSDNDRA

SEQ ID NO: 1604490 - protein, 4 aa, Staphylococcus aureus
GDSR

SEQ ID NO: 1604491 - protein, 8 aa, Staphylococcus aureus
GDSVEKGE

SEQ ID NO: 1604492 - protein, 18 aa, Staphylococcus aureus
GDTTQSELAKSLGKSQSF

SEQ ID NO: 1604493 - protein, 4 aa, Staphylococcus aureus
GDVE

SEQ ID NO: 1604494 - protein, 8 aa, Staphylococcus aureus
GDVGSGKT

SEQ ID NO: 1604495 - protein, 7 aa, Staphylococcus aureus
GDYSPSI

SEQ ID NO: 1604496 - protein, 17 aa, Staphylococcus aureus
GEAIDETDIKPVAQPEV

SEQ ID NO: 1604497 - protein, 10 aa, Staphylococcus aureus
GEALAGEKGF

SEQ ID NO: 1604498 - protein, 8 aa, Staphylococcus aureus
GEARQQVE

SEQ ID NO: 1604499 - protein, 21 aa, Staphylococcus aureus
GEAYGQDDPAEEMYPGGENER

SEQ ID NO: 1604500 - protein, 8 aa, Staphylococcus aureus
GEGGNGGQ

SEQ ID NO: 1604501 - protein, 10 aa, Staphylococcus aureus
GEGPSGPNTE

SEQ ID NO: 1604502 - protein, 9 aa, Staphylococcus aureus
GEGSEKTRL

SEQ ID NO: 1604503 - protein, 6 aa, Staphylococcus aureus
GEGTFD

SEQ ID NO: 1604504 - protein, 5 aa, Staphylococcus aureus
GEHKE

SEQ ID NO: 1604505 - protein, 9 aa, Staphylococcus aureus
GEIPQTHKE

SEQ ID NO: 1604506 - protein, 9 aa, Staphylococcus aureus
GEKVKTVQD

SEQ ID NO: 1604507 - protein, 12 aa, Staphylococcus aureus
GELNYNKKGNVV

SEQ ID NO: 1604508 - protein, 6 aa, Staphylococcus aureus
GEPGIY

SEQ ID NO: 1604509 - protein, 6 aa, Staphylococcus aureus
GEQETG

SEQ ID NO: 1604510 - protein, 10 aa, Staphylococcus aureus
GEQVVSGNAD

SEQ ID NO: 1604511 - protein, 11 aa, Staphylococcus aureus
GERFNTKPRGL

SEQ ID NO: 1604512 - protein, 7 aa, Staphylococcus aureus
GERGSGK

SEQ ID NO: 1604513 - protein, 6 aa, Staphylococcus aureus
GERIPT

SEQ ID NO: 1604514 - protein, 10 aa, Staphylococcus aureus
GERMGQGKEN

SEQ ID NO: 1604515 - protein, 7 aa, Staphylococcus aureus
GESAPKI

SEQ ID NO: 1604516 - protein, 10 aa, Staphylococcus aureus
GESGSGKSTL

SEQ ID NO: 1604517 - protein, 6 aa, Staphylococcus aureus
GESNQD

SEQ ID NO: 1604518 - protein, 7 aa, Staphylococcus aureus
GESNQKI

SEQ ID NO: 1604519 - protein, 12 aa, Staphylococcus aureus
GETAAGLYPEEA

SEQ ID NO: 1604520 - protein, 10 aa, Staphylococcus aureus
GETAKGVGIK

SEQ ID NO: 1604521 - protein, 7 aa, Staphylococcus aureus
GETASDE

SEQ ID NO: 1604522 - protein, 7 aa, Staphylococcus aureus
GEVIAPD

SEQ ID NO: 1604523 - protein, 6 aa, Staphylococcus aureus
GEVTNE

SEQ ID NO: 1604524 - protein, 9 aa, Staphylococcus aureus
GEYQPNAHN

SEQ ID NO: 1604525 - protein, 6 aa, Staphylococcus aureus
GFAPDS

SEQ ID NO: 1604526 - protein, 4 aa, Staphylococcus aureus
GFTE

SEQ ID NO: 1604527 - protein, 8 aa, Staphylococcus aureus
GGASKGIA

SEQ ID NO: 1604528 - protein, 18 aa, Staphylococcus aureus
GGEIGQETRRFDESTGKT

SEQ ID NO: 1604529 - protein, 9 aa, Staphylococcus aureus
GGFKDGSFE

SEQ ID NO: 1604530 - protein, 5 aa, Staphylococcus aureus
GGGAI

SEQ ID NO: 1604531 - protein, 8 aa, Staphylococcus aureus
GGGATGDF

SEQ ID NO: 1604532 - protein, 9 aa, Staphylococcus aureus
GGHKAGEVA

SEQ ID NO: 1604533 - protein, 6 aa, Staphylococcus aureus
GGIETG

SEQ ID NO: 1604534 - protein, 5 aa, Staphylococcus aureus
GGINE

SEQ ID NO: 1604535 - protein, 4 aa, Staphylococcus aureus
GGIP

SEQ ID NO: 1604536 - protein, 5 aa, Staphylococcus aureus
GGIQS

SEQ ID NO: 1604537 - protein, 7 aa, Staphylococcus aureus
GGKNPNI

SEQ ID NO: 1604538 - protein, 6 aa, Staphylococcus aureus
GGKSPV

SEQ ID NO: 1604539 - protein, 5 aa, Staphylococcus aureus
GGKTT

SEQ ID NO: 1604540 - protein, 4 aa, Staphylococcus aureus
GGMA

SEQ ID NO: 1604541 - protein, 7 aa, Staphylococcus aureus
GGNNDIN

SEQ ID NO: 1604542 - protein, 15 aa, Staphylococcus aureus
GGPKWTDPNNRPEQG

SEQ ID NO: 1604543 - protein, 11 aa, Staphylococcus aureus
GGPQGDAGLTG

SEQ ID NO: 1604544 - protein, 5 aa, Staphylococcus aureus
GGPSE

SEQ ID NO: 1604545 - protein, 6 aa, Staphylococcus aureus
GGQGHL

SEQ ID NO: 1604546 - protein, 5 aa, Staphylococcus aureus
GGQLT

SEQ ID NO: 1604547 - protein, 11 aa, Staphylococcus aureus
GGQTMNPSTED

SEQ ID NO: 1604548 - protein, 7 aa, Staphylococcus aureus
GGQVADT

SEQ ID NO: 1604549 - protein, 10 aa, Staphylococcus aureus
GGRCEACKGD

SEQ ID NO: 1604550 - protein, 9 aa, Staphylococcus aureus
GGRISKTKG

SEQ ID NO: 1604551 - protein, 8 aa, Staphylococcus aureus
GGSAGSVL

SEQ ID NO: 1604552 - protein, 7 aa, Staphylococcus aureus
GGSERVD

SEQ ID NO: 1604553 - protein, 10 aa, Staphylococcus aureus
GGSGRKTANI

SEQ ID NO: 1604554 - protein, 9 aa, Staphylococcus aureus
GGSPEASGH

SEQ ID NO: 1604555 - protein, 6 aa, Staphylococcus aureus
GGSTNT

SEQ ID NO: 1604556 - protein, 9 aa, Staphylococcus aureus
GGTAEEEAA

SEQ ID NO: 1604557 - protein, 6 aa, Staphylococcus aureus
GGTAGY

SEQ ID NO: 1604558 - protein, 7 aa, Staphylococcus aureus
GGTFGKF

SEQ ID NO: 1604559 - protein, 6 aa, Staphylococcus aureus
GGTSNA

SEQ ID NO: 1604560 - protein, 6 aa, Staphylococcus aureus
GGTVGD

SEQ ID NO: 1604561 - protein, 8 aa, Staphylococcus aureus
GGVNTDTA

SEQ ID NO: 1604562 - protein, 8 aa, Staphylococcus aureus
GGYNGSVA

SEQ ID NO: 1604563 - protein, 7 aa, Staphylococcus aureus
GHESEHN

SEQ ID NO: 1604564 - protein, 4 aa, Staphylococcus aureus
GHKD

SEQ ID NO: 1604565 - protein, 9 aa, Staphylococcus aureus
GHNGSGAEI

SEQ ID NO: 1604566 - protein, 10 aa, Staphylococcus aureus
GHNGSGKSTI

SEQ ID NO: 1604567 - protein, 12 aa, Staphylococcus aureus
GHSNIDLEEYSA

SEQ ID NO: 1604568 - protein, 7 aa, Staphylococcus aureus
GIDPDKA

SEQ ID NO: 1604569 - protein, 18 aa, Staphylococcus aureus
GIDQSKVREKHKISNPSI

SEQ ID NO: 1604570 - protein, 5 aa, Staphylococcus aureus
GIGPE

SEQ ID NO: 1604571 - protein, 7 aa, Staphylococcus aureus
GIGPKSA

SEQ ID NO: 1604572 - protein, 9 aa, Staphylococcus aureus
GIKADKDYL

SEQ ID NO: 1604573 - protein, 9 aa, Staphylococcus aureus
GIKNDSTNV

SEQ ID NO: 1604574 - protein, 5 aa, Staphylococcus aureus
GIKTG

SEQ ID NO: 1604575 - protein, 15 aa, Staphylococcus aureus
GIPAKARRKGGHPAK

SEQ ID NO: 1604576 - protein, 4 aa, Staphylococcus aureus
GIQQ

SEQ ID NO: 1604577 - protein, 7 aa, Staphylococcus aureus
GIRETED

SEQ ID NO: 1604578 - protein, 7 aa, Staphylococcus aureus
GISKEGE

SEQ ID NO: 1604579 - protein, 11 aa, Staphylococcus aureus
GISSEQQATEM

SEQ ID NO: 1604580 - protein, 13 aa, Staphylococcus aureus
GITPKPQPGNPQP

SEQ ID NO: 1604581 - protein, 8 aa, Staphylococcus aureus
GKAGRSRW

SEQ ID NO: 1604582 - protein, 8 aa, Staphylococcus aureus
GKATDATI

SEQ ID NO: 1604583 - protein, 10 aa, Staphylococcus aureus
GKDGAEDKLT

SEQ ID NO: 1604584 - protein, 8 aa, Staphylococcus aureus
GKDQDQVK

SEQ ID NO: 1604585 - protein, 9 aa, Staphylococcus aureus
GKEKTASME

SEQ ID NO: 1604586 - protein, 5 aa, Staphylococcus aureus
GKGEI

SEQ ID NO: 1604587 - protein, 17 aa, Staphylococcus aureus
GKGGKKLKEVGKRARRD

SEQ ID NO: 1604588 - protein, 6 aa, Staphylococcus aureus
GKGPVV

SEQ ID NO: 1604589 - protein, 9 aa, Staphylococcus aureus
GKGSESGNA

SEQ ID NO: 1604590 - protein, 8 aa, Staphylococcus aureus
GKGTQASE

SEQ ID NO: 1604591 - protein, 13 aa, Staphylococcus aureus
GKIGTKTSYQTMQ

SEQ ID NO: 1604592 - protein, 4 aa, Staphylococcus aureus
GKIN

SEQ ID NO: 1604593 - protein, 20 aa, Staphylococcus aureus
GKIPGGFKKREGRPGDDATL

SEQ ID NO: 1604594 - protein, 7 aa, Staphylococcus aureus
GKIQSQV

SEQ ID NO: 1604595 - protein, 7 aa, Staphylococcus aureus
GKITRNA

SEQ ID NO: 1604596 - protein, 17 aa, Staphylococcus aureus
GKKAETNRITGISSKPP

SEQ ID NO: 1604597 - protein, 7 aa, Staphylococcus aureus
GKKDAQQ

SEQ ID NO: 1604598 - protein, 9 aa, Staphylococcus aureus
GKKDPIGAM

SEQ ID NO: 1604599 - protein, 7 aa, Staphylococcus aureus
GKKEKDV

SEQ ID NO: 1604600 - protein, 8 aa, Staphylococcus aureus
GKKGYGYN

SEQ ID NO: 1604601 - protein, 11 aa, Staphylococcus aureus
GKLPKNYKDEL

SEQ ID NO: 1604602 - protein, 7 aa, Staphylococcus aureus
GKNAAEA

SEQ ID NO: 1604603 - protein, 13 aa, Staphylococcus aureus
GKNGGYQIQQAQS

SEQ ID NO: 1604604 - protein, 20 aa, Staphylococcus aureus
GKNNKQNDYLTNKKAKKTHT

SEQ ID NO: 1604605 - protein, 7 aa, Staphylococcus aureus
GKNRSPL

SEQ ID NO: 1604606 - protein, 7 aa, Staphylococcus aureus
GKPGQNI

SEQ ID NO: 1604607 - protein, 5 aa, Staphylococcus aureus
GKPIN

SEQ ID NO: 1604608 - protein, 5 aa, Staphylococcus aureus
GKPKK

SEQ ID NO: 1604609 - protein, 14 aa, Staphylococcus aureus
GKPWDEAVGDAAEG

SEQ ID NO: 1604610 - protein, 12 aa, Staphylococcus aureus
GKQFNSVPDEAS

SEQ ID NO: 1604611 - protein, 7 aa, Staphylococcus aureus
GKQTVEK

SEQ ID NO: 1604612 - protein, 9 aa, Staphylococcus aureus
GKRGQNARL

SEQ ID NO: 1604613 - protein, 9 aa, Staphylococcus aureus
GKRLYSDNG

SEQ ID NO: 1604614 - protein, 7 aa, Staphylococcus aureus
GKTETGQ

SEQ ID NO: 1604615 - protein, 6 aa, Staphylococcus aureus
GKTRST

SEQ ID NO: 1604616 - protein, 4 aa, Staphylococcus aureus
GKVT

SEQ ID NO: 1604617 - protein, 18 aa, Staphylococcus aureus
GKYDGGRHQIRVDMLNKM

SEQ ID NO: 1604618 - protein, 7 aa, Staphylococcus aureus
GKYGNDA

SEQ ID NO: 1604619 - protein, 8 aa, Staphylococcus aureus
GLAEEQNG

SEQ ID NO: 1604620 - protein, 12 aa, Staphylococcus aureus
GLEDPKTGKRPY

SEQ ID NO: 1604621 - protein, 19 aa, Staphylococcus aureus
GLEPGPKYQEVKSHDTFEH

SEQ ID NO: 1604622 - protein, 9 aa, Staphylococcus aureus
GLGKDRTTA

SEQ ID NO: 1604623 - protein, 4 aa, Staphylococcus aureus
GLHP

SEQ ID NO: 1604624 - protein, 9 aa, Staphylococcus aureus
GLKYTDKRK

SEQ ID NO: 1604625 - protein, 6 aa, Staphylococcus aureus
GLNVPN

SEQ ID NO: 1604626 - protein, 12 aa, Staphylococcus aureus
GLPIGGYGGRQD

SEQ ID NO: 1604627 - protein, 9 aa, Staphylococcus aureus
GLPRHTSTH

SEQ ID NO: 1604628 - protein, 6 aa, Staphylococcus aureus
GLPTPN

SEQ ID NO: 1604629 - protein, 7 aa, Staphylococcus aureus
GLSGQLT

SEQ ID NO: 1604630 - protein, 5 aa, Staphylococcus aureus
GLSKA

SEQ ID NO: 1604631 - protein, 10 aa, Staphylococcus aureus
GLSSNTIGAY

SEQ ID NO: 1604632 - protein, 5 aa, Staphylococcus aureus
GLTDT

SEQ ID NO: 1604633 - protein, 13 aa, Staphylococcus aureus
GMGGGTGTGAAPV

SEQ ID NO: 1604634 - protein, 6 aa, Staphylococcus aureus
GMSTAG

SEQ ID NO: 1604635 - protein, 4 aa, Staphylococcus aureus
GMTE

SEQ ID NO: 1604636 - protein, 6 aa, Staphylococcus aureus
GNAGIK

SEQ ID NO: 1604637 - protein, 14 aa, Staphylococcus aureus
GNFNENHGREKVQS

SEQ ID NO: 1604638 - protein, 8 aa, Staphylococcus aureus
GNGQLNSQ

SEQ ID NO: 1604639 - protein, 8 aa, Staphylococcus aureus
GNIESYDD

SEQ ID NO: 1604640 - protein, 5 aa, Staphylococcus aureus
GNIQG

SEQ ID NO: 1604641 - protein, 9 aa, Staphylococcus aureus
GNLTDGQGN

SEQ ID NO: 1604642 - protein, 7 aa, Staphylococcus aureus
GNNERQV

SEQ ID NO: 1604643 - protein, 10 aa, Staphylococcus aureus
GNNNSATIND

SEQ ID NO: 1604644 - protein, 5 aa, Staphylococcus aureus
GNPMD

SEQ ID NO: 1604645 - protein, 6 aa, Staphylococcus aureus
GNPVGT

SEQ ID NO: 1604646 - protein, 6 aa, Staphylococcus aureus
GNRNFE

SEQ ID NO: 1604647 - protein, 4 aa, Staphylococcus aureus
GNRR

SEQ ID NO: 1604648 - protein, 8 aa, Staphylococcus aureus
GNSGPLLP

SEQ ID NO: 1604649 - protein, 4 aa, Staphylococcus aureus
GNSR

SEQ ID NO: 1604650 - protein, 16 aa, Staphylococcus aureus
GNTPDENGKLKGDVDY

SEQ ID NO: 1604651 - protein, 14 aa, Staphylococcus aureus
GNTRNDRTNTGTIS

SEQ ID NO: 1604652 - protein, 52 aa, Staphylococcus aureus
GNVKETVGNVTDNKNLENEGKEDKASGKAKEFVENAKEKATDFIDKVKGNKG

SEQ ID NO: 1604653 - protein, 7 aa, Staphylococcus aureus
GNYPEVT

SEQ ID NO: 1604654 - protein, 8 aa, Staphylococcus aureus
GPAGTGKT

SEQ ID NO: 1604655 - protein, 18 aa, Staphylococcus aureus
GPATTNKASYNGPKGPTG

SEQ ID NO: 1604656 - protein, 8 aa, Staphylococcus aureus
GPDFPTGG

SEQ ID NO: 1604657 - protein, 4 aa, Staphylococcus aureus
GPDN

SEQ ID NO: 1604658 - protein, 30 aa, Staphylococcus aureus
GPEGGSGGGTIVATGTPEDIAQTKSSYTGK

SEQ ID NO: 1604659 - protein, 18 aa, Staphylococcus aureus
GPEMKSTGEVMGKDTTLE

SEQ ID NO: 1604660 - protein, 10 aa, Staphylococcus aureus
GPESSGKTTV

SEQ ID NO: 1604661 - protein, 5 aa, Staphylococcus aureus
GPKGI

SEQ ID NO: 1604662 - protein, 13 aa, Staphylococcus aureus
GPMKAGLSAHGKA

SEQ ID NO: 1604663 - protein, 9 aa, Staphylococcus aureus
GPNGEDGTI

SEQ ID NO: 1604664 - protein, 5 aa, Staphylococcus aureus
GPQAV

SEQ ID NO: 1604665 - protein, 6 aa, Staphylococcus aureus
GPQDDI

SEQ ID NO: 1604666 - protein, 10 aa, Staphylococcus aureus
GPSGCGKSTY

SEQ ID NO: 1604667 - protein, 7 aa, Staphylococcus aureus
GPSPAAL

SEQ ID NO: 1604668 - protein, 13 aa, Staphylococcus aureus
GPSTSSSYEINDD

SEQ ID NO: 1604669 - protein, 8 aa, Staphylococcus aureus
GPTAPTTA

SEQ ID NO: 1604670 - protein, 9 aa, Staphylococcus aureus
GPTGSGKST

SEQ ID NO: 1604671 - protein, 5 aa, Staphylococcus aureus
GPTHE

SEQ ID NO: 1604672 - protein, 8 aa, Staphylococcus aureus
GPTPRSYA

SEQ ID NO: 1604673 - protein, 6 aa, Staphylococcus aureus
GPVNNG

SEQ ID NO: 1604674 - protein, 5 aa, Staphylococcus aureus
GQDKA

SEQ ID NO: 1604675 - protein, 9 aa, Staphylococcus aureus
GQDKEATAT

SEQ ID NO: 1604676 - protein, 7 aa, Staphylococcus aureus
GQDTDIA

SEQ ID NO: 1604677 - protein, 17 aa, Staphylococcus aureus
GQEVAVKGTKIENVEKA

SEQ ID NO: 1604678 - protein, 15 aa, Staphylococcus aureus
GQGNFGSMDGDGAAA

SEQ ID NO: 1604679 - protein, 16 aa, Staphylococcus aureus
GQGTRLGYKGPKGSFE

SEQ ID NO: 1604680 - protein, 5 aa, Staphylococcus aureus
GQIGS

SEQ ID NO: 1604681 - protein, 16 aa, Staphylococcus aureus
GQINGTSGYEEAAGQG

SEQ ID NO: 1604682 - protein, 13 aa, Staphylococcus aureus
GQKFNKNEFDNKI

SEQ ID NO: 1604683 - protein, 7 aa, Staphylococcus aureus
GQKKGDV

SEQ ID NO: 1604684 - protein, 5 aa, Staphylococcus aureus
GQKKV

SEQ ID NO: 1604685 - protein, 6 aa, Staphylococcus aureus
GQKQAI

SEQ ID NO: 1604686 - protein, 8 aa, Staphylococcus aureus
GQLEETAR

SEQ ID NO: 1604687 - protein, 7 aa, Staphylococcus aureus
GQNDERV

SEQ ID NO: 1604688 - protein, 5 aa, Staphylococcus aureus
GQPVD

SEQ ID NO: 1604689 - protein, 7 aa, Staphylococcus aureus
GQPVGSK

SEQ ID NO: 1604690 - protein, 6 aa, Staphylococcus aureus
GQQDIN

SEQ ID NO: 1604691 - protein, 12 aa, Staphylococcus aureus
GQQRGKDTKDNI

SEQ ID NO: 1604692 - protein, 6 aa, Staphylococcus aureus
GQQTEI

SEQ ID NO: 1604693 - protein, 10 aa, Staphylococcus aureus
GQTGSGKSTL

SEQ ID NO: 1604694 - protein, 17 aa, Staphylococcus aureus
GQTNSTALGTKAFQETN

SEQ ID NO: 1604695 - protein, 4 aa, Staphylococcus aureus
GQTP

SEQ ID NO: 1604696 - protein, 4 aa, Staphylococcus aureus
GQYV

SEQ ID NO: 1604697 - protein, 10 aa, Staphylococcus aureus
GRAGRDGELS

SEQ ID NO: 1604698 - protein, 8 aa, Staphylococcus aureus
GRAPGTDM

SEQ ID NO: 1604699 - protein, 12 aa, Staphylococcus aureus
GRGPSDKEVDHI

SEQ ID NO: 1604700 - protein, 9 aa, Staphylococcus aureus
GRGTSTYDG

SEQ ID NO: 1604701 - protein, 6 aa, Staphylococcus aureus
GRKESF

SEQ ID NO: 1604702 - protein, 13 aa, Staphylococcus aureus
GRKRQTQAAAGVE

SEQ ID NO: 1604703 - protein, 7 aa, Staphylococcus aureus
GRLQNKT

SEQ ID NO: 1604704 - protein, 12 aa, Staphylococcus aureus
GRLTDSKGRSVD

SEQ ID NO: 1604705 - protein, 25 aa, Staphylococcus aureus
GRNLPASLRETGLGGLAGTPTGEAI

SEQ ID NO: 1604706 - protein, 11 aa, Staphylococcus aureus
GRPSTYAPTID

SEQ ID NO: 1604707 - protein, 6 aa, Staphylococcus aureus
GRRNMT

SEQ ID NO: 1604708 - protein, 6 aa, Staphylococcus aureus
GRSHSE

SEQ ID NO: 1604709 - protein, 9 aa, Staphylococcus aureus
GRSQPEYRK

SEQ ID NO: 1604710 - protein, 11 aa, Staphylococcus aureus
GSATNDGGTGM

SEQ ID NO: 1604711 - protein, 6 aa, Staphylococcus aureus
GSEEPI

SEQ ID NO: 1604712 - protein, 4 aa, Staphylococcus aureus
GSEQ

SEQ ID NO: 1604713 - protein, 7 aa, Staphylococcus aureus
GSEVGDV

SEQ ID NO: 1604714 - protein, 17 aa, Staphylococcus aureus
GSEVTVDNPAQMPDRDK

SEQ ID NO: 1604715 - protein, 4 aa, Staphylococcus aureus
GSFD

SEQ ID NO: 1604716 - protein, 6 aa, Staphylococcus aureus
GSGIGD

SEQ ID NO: 1604717 - protein, 11 aa, Staphylococcus aureus
GSGSGKTTVTN

SEQ ID NO: 1604718 - protein, 7 aa, Staphylococcus aureus
GSGSVGE

SEQ ID NO: 1604719 - protein, 9 aa, Staphylococcus aureus
GSHASRHNR

SEQ ID NO: 1604720 - protein, 4 aa, Staphylococcus aureus
GSHP

SEQ ID NO: 1604721 - protein, 11 aa, Staphylococcus aureus
GSISAEAHETL

SEQ ID NO: 1604722 - protein, 9 aa, Staphylococcus aureus
GSITPQESV

SEQ ID NO: 1604723 - protein, 7 aa, Staphylococcus aureus
GSNSTDF

SEQ ID NO: 1604724 - protein, 9 aa, Staphylococcus aureus
GSRATGTRI

SEQ ID NO: 1604725 - protein, 15 aa, Staphylococcus aureus
GSRGMKLEEVVNALI

SEQ ID NO: 1604726 - protein, 12 aa, Staphylococcus aureus
GSRTVKKEAEKL

SEQ ID NO: 1604727 - protein, 10 aa, Staphylococcus aureus
GSSGDDKEIS

SEQ ID NO: 1604728 - protein, 11 aa, Staphylococcus aureus
GSSRSGSKDFE

SEQ ID NO: 1604729 - protein, 16 aa, Staphylococcus aureus
GSTGISAGYATDIPPH

SEQ ID NO: 1604730 - protein, 7 aa, Staphylococcus aureus
GSTMQPR

SEQ ID NO: 1604731 - protein, 6 aa, Staphylococcus aureus
GSTPPC

SEQ ID NO: 1604732 - protein, 4 aa, Staphylococcus aureus
GSYA

SEQ ID NO: 1604733 - protein, 5 aa, Staphylococcus aureus
GTASI

SEQ ID NO: 1604734 - protein, 8 aa, Staphylococcus aureus
GTAVGTGI

SEQ ID NO: 1604735 - protein, 6 aa, Staphylococcus aureus
GTCMTS

SEQ ID NO: 1604736 - protein, 7 aa, Staphylococcus aureus
GTDNDIT

SEQ ID NO: 1604737 - protein, 5 aa, Staphylococcus aureus
GTENK

SEQ ID NO: 1604738 - protein, 7 aa, Staphylococcus aureus
GTETIPK

SEQ ID NO: 1604739 - protein, 9 aa, Staphylococcus aureus
GTGDHPTTS

SEQ ID NO: 1604740 - protein, 14 aa, Staphylococcus aureus
GTGKTTLSADPHRK

SEQ ID NO: 1604741 - protein, 10 aa, Staphylococcus aureus
GTGKVSEGQL

SEQ ID NO: 1604742 - protein, 5 aa, Staphylococcus aureus
GTGSL

SEQ ID NO: 1604743 - protein, 10 aa, Staphylococcus aureus
GTIDDPLDET

SEQ ID NO: 1604744 - protein, 9 aa, Staphylococcus aureus
GTINTGDKA

SEQ ID NO: 1604745 - protein, 11 aa, Staphylococcus aureus
GTLDDKGPTIA

SEQ ID NO: 1604746 - protein, 7 aa, Staphylococcus aureus
GTLPTGV

SEQ ID NO: 1604747 - protein, 10 aa, Staphylococcus aureus
GTNGKTTTSN

SEQ ID NO: 1604748 - protein, 8 aa, Staphylococcus aureus
GTNRSVGN

SEQ ID NO: 1604749 - protein, 19 aa, Staphylococcus aureus
GTNRTNKYYNDSKATNTLA

SEQ ID NO: 1604750 - protein, 7 aa, Staphylococcus aureus
GTPGYEE

SEQ ID NO: 1604751 - protein, 5 aa, Staphylococcus aureus
GTQDR

SEQ ID NO: 1604752 - protein, 6 aa, Staphylococcus aureus
GTRAEE

SEQ ID NO: 1604753 - protein, 7 aa, Staphylococcus aureus
GTRPDCL

SEQ ID NO: 1604754 - protein, 6 aa, Staphylococcus aureus
GTSGLN

SEQ ID NO: 1604755 - protein, 7 aa, Staphylococcus aureus
GTSTAQK

SEQ ID NO: 1604756 - protein, 18 aa, Staphylococcus aureus
GTTASVPPQGGRKHPNQE

SEQ ID NO: 1604757 - protein, 5 aa, Staphylococcus aureus
GTVTD

SEQ ID NO: 1604758 - protein, 20 aa, Staphylococcus aureus
GTVTKRDPETVNPKIKTGQV

SEQ ID NO: 1604759 - protein, 14 aa, Staphylococcus aureus
GVAKDNLKEENVEA

SEQ ID NO: 1604760 - protein, 9 aa, Staphylococcus aureus
GVANQELTP

SEQ ID NO: 1604761 - protein, 8 aa, Staphylococcus aureus
GVDQGKRG

SEQ ID NO: 1604762 - protein, 8 aa, Staphylococcus aureus
GVEGERSK

SEQ ID NO: 1604763 - protein, 9 aa, Staphylococcus aureus
GVGDSTDVV

SEQ ID NO: 1604764 - protein, 5 aa, Staphylococcus aureus
GVGTD

SEQ ID NO: 1604765 - protein, 4 aa, Staphylococcus aureus
GVGY

SEQ ID NO: 1604766 - protein, 7 aa, Staphylococcus aureus
GVHSGDS

SEQ ID NO: 1604767 - protein, 6 aa, Staphylococcus aureus
GVNGGG

SEQ ID NO: 1604768 - protein, 13 aa, Staphylococcus aureus
GVQNGVPTPGFSS

SEQ ID NO: 1604769 - protein, 6 aa, Staphylococcus aureus
GVSEND

SEQ ID NO: 1604770 - protein, 8 aa, Staphylococcus aureus
GVSPSTVS

SEQ ID NO: 1604771 - protein, 8 aa, Staphylococcus aureus
GVTEDSTN

SEQ ID NO: 1604772 - protein, 11 aa, Staphylococcus aureus
GVTPGKGGQVV

SEQ ID NO: 1604773 - protein, 9 aa, Staphylococcus aureus
GVVENGDTV

SEQ ID NO: 1604774 - protein, 6 aa, Staphylococcus aureus
GWEEDT

SEQ ID NO: 1604775 - protein, 10 aa, Staphylococcus aureus
GWTGGKYGVG

SEQ ID NO: 1604776 - protein, 25 aa, Staphylococcus aureus
GYARHGGGCFSGKDPTKVDRSAAYA

SEQ ID NO: 1604777 - protein, 7 aa, Staphylococcus aureus
GYDQPAL

SEQ ID NO: 1604778 - protein, 4 aa, Staphylococcus aureus
GYNM

SEQ ID NO: 1604779 - protein, 12 aa, Staphylococcus aureus
GYRNEGVSESCH

SEQ ID NO: 1604780 - protein, 7 aa, Staphylococcus aureus
GYTQDTM

SEQ ID NO: 1604781 - protein, 14 aa, Staphylococcus aureus
HADKLEGNPLTDKE

SEQ ID NO: 1604782 - protein, 5 aa, Staphylococcus aureus
HAKEE

SEQ ID NO: 1604783 - protein, 15 aa, Staphylococcus aureus
HAQGSTGYNYGGEHF

SEQ ID NO: 1604784 - protein, 8 aa, Staphylococcus aureus
HAQPGRAS

SEQ ID NO: 1604785 - protein, 4 aa, Staphylococcus aureus
HASP

SEQ ID NO: 1604786 - protein, 4 aa, Staphylococcus aureus
HATA

SEQ ID NO: 1604787 - protein, 7 aa, Staphylococcus aureus
HDDRDYE

SEQ ID NO: 1604788 - protein, 7 aa, Staphylococcus aureus
HDEQETQ

SEQ ID NO: 1604789 - protein, 5 aa, Staphylococcus aureus
HDGHT

SEQ ID NO: 1604790 - protein, 5 aa, Staphylococcus aureus
HDGMK

SEQ ID NO: 1604791 - protein, 8 aa, Staphylococcus aureus
HDPETNEK

SEQ ID NO: 1604792 - protein, 7 aa, Staphylococcus aureus
HDRASAI

SEQ ID NO: 1604793 - protein, 6 aa, Staphylococcus aureus
HEEENS

SEQ ID NO: 1604794 - protein, 5 aa, Staphylococcus aureus
HEESI

SEQ ID NO: 1604795 - protein, 11 aa, Staphylococcus aureus
HEFSGGQRQRI

SEQ ID NO: 1604796 - protein, 7 aa, Staphylococcus aureus
HEGELGK

SEQ ID NO: 1604797 - protein, 14 aa, Staphylococcus aureus
HEGGQPIYQYFFSV

SEQ ID NO: 1604798 - protein, 9 aa, Staphylococcus aureus
HEHNKDKQT

SEQ ID NO: 1604799 - protein, 4 aa, Staphylococcus aureus
HEHP

SEQ ID NO: 1604800 - protein, 4 aa, Staphylococcus aureus
HEQY

SEQ ID NO: 1604801 - protein, 10 aa, Staphylococcus aureus
HETDTGSPEV

SEQ ID NO: 1604802 - protein, 8 aa, Staphylococcus aureus
HEVAPGQH

SEQ ID NO: 1604803 - protein, 4 aa, Staphylococcus aureus
HGET

SEQ ID NO: 1604804 - protein, 12 aa, Staphylococcus aureus
HGKRPSEEELQD

SEQ ID NO: 1604805 - protein, 16 aa, Staphylococcus aureus
HGLPHDPFKSSTVPRP

SEQ ID NO: 1604806 - protein, 17 aa, Staphylococcus aureus
HGPYTTVDDEQLNPFLH

SEQ ID NO: 1604807 - protein, 4 aa, Staphylococcus aureus
HGSF

SEQ ID NO: 1604808 - protein, 5 aa, Staphylococcus aureus
HGSTF

SEQ ID NO: 1604809 - protein, 18 aa, Staphylococcus aureus
HKDKDHEDYYEIKIRIYK

SEQ ID NO: 1604810 - protein, 7 aa, Staphylococcus aureus
HKGDSKV

SEQ ID NO: 1604811 - protein, 4 aa, Staphylococcus aureus
HKGH

SEQ ID NO: 1604812 - protein, 8 aa, Staphylococcus aureus
HKNDKKVY

SEQ ID NO: 1604813 - protein, 7 aa, Staphylococcus aureus
HKNDPGV

SEQ ID NO: 1604814 - protein, 12 aa, Staphylococcus aureus
HKPAKAKKGTDI

SEQ ID NO: 1604815 - protein, 5 aa, Staphylococcus aureus
HKRDD

SEQ ID NO: 1604816 - protein, 9 aa, Staphylococcus aureus
HKRGVYSGG

SEQ ID NO: 1604817 - protein, 4 aa, Staphylococcus aureus
HNDE

SEQ ID NO: 1604818 - protein, 8 aa, Staphylococcus aureus
HNTARQND

SEQ ID NO: 1604819 - protein, 6 aa, Staphylococcus aureus
HPATYD

SEQ ID NO: 1604820 - protein, 8 aa, Staphylococcus aureus
HPDDTWGQ

SEQ ID NO: 1604821 - protein, 5 aa, Staphylococcus aureus
HPEGY

SEQ ID NO: 1604822 - protein, 8 aa, Staphylococcus aureus
HPNGTSEI

SEQ ID NO: 1604823 - protein, 5 aa, Staphylococcus aureus
HPNPV

SEQ ID NO: 1604824 - protein, 4 aa, Staphylococcus aureus
HPRE

SEQ ID NO: 1604825 - protein, 6 aa, Staphylococcus aureus
HPYEGK

SEQ ID NO: 1604826 - protein, 4 aa, Staphylococcus aureus
HQED

SEQ ID NO: 1604827 - protein, 10 aa, Staphylococcus aureus
HQEDDGSNIL

SEQ ID NO: 1604828 - protein, 12 aa, Staphylococcus aureus
HQENKNTDAQDK

SEQ ID NO: 1604829 - protein, 17 aa, Staphylococcus aureus
HQKKAAEFKKQQLNEQG

SEQ ID NO: 1604830 - protein, 7 aa, Staphylococcus aureus
HQKQNAA

SEQ ID NO: 1604831 - protein, 6 aa, Staphylococcus aureus
HQPGGS

SEQ ID NO: 1604832 - protein, 6 aa, Staphylococcus aureus
HQPNDY

SEQ ID NO: 1604833 - protein, 9 aa, Staphylococcus aureus
HQTEEPTVA

SEQ ID NO: 1604834 - protein, 4 aa, Staphylococcus aureus
HRGE

SEQ ID NO: 1604835 - protein, 8 aa, Staphylococcus aureus
HRGQEGAG

SEQ ID NO: 1604836 - protein, 9 aa, Staphylococcus aureus
HRGRRMSAS

SEQ ID NO: 1604837 - protein, 11 aa, Staphylococcus aureus
HRTNEETGKVD

SEQ ID NO: 1604838 - protein, 9 aa, Staphylococcus aureus
HSDEDERYI

SEQ ID NO: 1604839 - protein, 8 aa, Staphylococcus aureus
HSDRQNEN

SEQ ID NO: 1604840 - protein, 8 aa, Staphylococcus aureus
HSDYPEQQ

SEQ ID NO: 1604841 - protein, 7 aa, Staphylococcus aureus
HSIETTD

SEQ ID NO: 1604842 - protein, 5 aa, Staphylococcus aureus
HSIPD

SEQ ID NO: 1604843 - protein, 5 aa, Staphylococcus aureus
HSKSF

SEQ ID NO: 1604844 - protein, 9 aa, Staphylococcus aureus
HSNNGLSDQ

SEQ ID NO: 1604845 - protein, 15 aa, Staphylococcus aureus
HSNNQRHTNETEQIL

SEQ ID NO: 1604846 - protein, 12 aa, Staphylococcus aureus
HSPFEENVATTK

SEQ ID NO: 1604847 - protein, 16 aa, Staphylococcus aureus
HSQPTKGTQIQFTIPI

SEQ ID NO: 1604848 - protein, 6 aa, Staphylococcus aureus
HSTGRK

SEQ ID NO: 1604849 - protein, 7 aa, Staphylococcus aureus
HTHPTAD

SEQ ID NO: 1604850 - protein, 4 aa, Staphylococcus aureus
HTNG

SEQ ID NO: 1604851 - protein, 8 aa, Staphylococcus aureus
HTNGQGKA

SEQ ID NO: 1604852 - protein, 5 aa, Staphylococcus aureus
HTSDE

SEQ ID NO: 1604853 - protein, 7 aa, Staphylococcus aureus
HTTNERM

SEQ ID NO: 1604854 - protein, 7 aa, Staphylococcus aureus
HVPRPPA

SEQ ID NO: 1604855 - protein, 7 aa, Staphylococcus aureus
HVQTPEE

SEQ ID NO: 1604856 - protein, 6 aa, Staphylococcus aureus
HYGAQT

SEQ ID NO: 1604857 - protein, 4 aa, Staphylococcus aureus
IADE

SEQ ID NO: 1604858 - protein, 7 aa, Staphylococcus aureus
IADIGSD

SEQ ID NO: 1604859 - protein, 5 aa, Staphylococcus aureus
IAELE

SEQ ID NO: 1604860 - protein, 4 aa, Staphylococcus aureus
IAHQ

SEQ ID NO: 1604861 - protein, 12 aa, Staphylococcus aureus
IANGQGIGRGSV

SEQ ID NO: 1604862 - protein, 17 aa, Staphylococcus aureus
IANSGYTSRRKAETLIS

SEQ ID NO: 1604863 - protein, 8 aa, Staphylococcus aureus
IAPSSSYS

SEQ ID NO: 1604864 - protein, 5 aa, Staphylococcus aureus
IARTG

SEQ ID NO: 1604865 - protein, 6 aa, Staphylococcus aureus
IATNNA

SEQ ID NO: 1604866 - protein, 7 aa, Staphylococcus aureus
IATRTAK

SEQ ID NO: 1604867 - protein, 6 aa, Staphylococcus aureus
IAYPNR

SEQ ID NO: 1604868 - protein, 5 aa, Staphylococcus aureus
IDASY

SEQ ID NO: 1604869 - protein, 7 aa, Staphylococcus aureus
IDDKTYQ

SEQ ID NO: 1604870 - protein, 6 aa, Staphylococcus aureus
IDDNGE

SEQ ID NO: 1604871 - protein, 9 aa, Staphylococcus aureus
IDDRNEKMG

SEQ ID NO: 1604872 - protein, 10 aa, Staphylococcus aureus
IDESTRGHYD

SEQ ID NO: 1604873 - protein, 8 aa, Staphylococcus aureus
IDETANEY

SEQ ID NO: 1604874 - protein, 11 aa, Staphylococcus aureus
IDKPTSNPDRV

SEQ ID NO: 1604875 - protein, 15 aa, Staphylococcus aureus
IDKQGRVNASHRALE

SEQ ID NO: 1604876 - protein, 11 aa, Staphylococcus aureus
IDNKDSKIRYR

SEQ ID NO: 1604877 - protein, 11 aa, Staphylococcus aureus
IDNKKGEDTIS

SEQ ID NO: 1604878 - protein, 10 aa, Staphylococcus aureus
IDPKDQKINE

SEQ ID NO: 1604879 - protein, 8 aa, Staphylococcus aureus
IDPYGGTK

SEQ ID NO: 1604880 - protein, 5 aa, Staphylococcus aureus
IDTDM

SEQ ID NO: 1604881 - protein, 4 aa, Staphylococcus aureus
IEAE

SEQ ID NO: 1604882 - protein, 8 aa, Staphylococcus aureus
IEAGKGND

SEQ ID NO: 1604883 - protein, 5 aa, Staphylococcus aureus
IEDAK

SEQ ID NO: 1604884 - protein, 4 aa, Staphylococcus aureus
IEDF

SEQ ID NO: 1604885 - protein, 5 aa, Staphylococcus aureus
IEDGM

SEQ ID NO: 1604886 - protein, 6 aa, Staphylococcus aureus
IEDTTV

SEQ ID NO: 1604887 - protein, 4 aa, Staphylococcus aureus
IEEG

SEQ ID NO: 1604888 - protein, 10 aa, Staphylococcus aureus
IEENDNVGTM

SEQ ID NO: 1604889 - protein, 12 aa, Staphylococcus aureus
IEFTGNKETDKV

SEQ ID NO: 1604890 - protein, 11 aa, Staphylococcus aureus
IEGDDETFKSL

SEQ ID NO: 1604891 - protein, 10 aa, Staphylococcus aureus
IEGKSYTPQE

SEQ ID NO: 1604892 - protein, 11 aa, Staphylococcus aureus
IEKDQQKTGLK

SEQ ID NO: 1604893 - protein, 5 aa, Staphylococcus aureus
IEKGD

SEQ ID NO: 1604894 - protein, 7 aa, Staphylococcus aureus
IENDGKK

SEQ ID NO: 1604895 - protein, 8 aa, Staphylococcus aureus
IENGDEAL

SEQ ID NO: 1604896 - protein, 4 aa, Staphylococcus aureus
IENY

SEQ ID NO: 1604897 - protein, 4 aa, Staphylococcus aureus
IEPN

SEQ ID NO: 1604898 - protein, 4 aa, Staphylococcus aureus
IEQD

SEQ ID NO: 1604899 - protein, 12 aa, Staphylococcus aureus
IEQDAKDKKTFR

SEQ ID NO: 1604900 - protein, 14 aa, Staphylococcus aureus
IEQESGASTATISR

SEQ ID NO: 1604901 - protein, 14 aa, Staphylococcus aureus
IEQGDEVAKSRLAE

SEQ ID NO: 1604902 - protein, 10 aa, Staphylococcus aureus
IEREEDDKGY

SEQ ID NO: 1604903 - protein, 9 aa, Staphylococcus aureus
IEREQRDAR

SEQ ID NO: 1604904 - protein, 8 aa, Staphylococcus aureus
IERRNDEQ

SEQ ID NO: 1604905 - protein, 8 aa, Staphylococcus aureus
IESGTSAQ

SEQ ID NO: 1604906 - protein, 5 aa, Staphylococcus aureus
IESND

SEQ ID NO: 1604907 - protein, 12 aa, Staphylococcus aureus
IETGQLAKQANG

SEQ ID NO: 1604908 - protein, 12 aa, Staphylococcus aureus
IETTEARAKEVR

SEQ ID NO: 1604909 - protein, 5 aa, Staphylococcus aureus
IEYGN

SEQ ID NO: 1604910 - protein, 6 aa, Staphylococcus aureus
IGDDSN

SEQ ID NO: 1604911 - protein, 7 aa, Staphylococcus aureus
IGENSVE

SEQ ID NO: 1604912 - protein, 4 aa, Staphylococcus aureus
IGGP

SEQ ID NO: 1604913 - protein, 15 aa, Staphylococcus aureus
IGGSIDDALAEIKQS

SEQ ID NO: 1604914 - protein, 9 aa, Staphylococcus aureus
IGKGSPGVL

SEQ ID NO: 1604915 - protein, 4 aa, Staphylococcus aureus
IGPD

SEQ ID NO: 1604916 - protein, 9 aa, Staphylococcus aureus
IGPTGSGKT

SEQ ID NO: 1604917 - protein, 9 aa, Staphylococcus aureus
IGQDVTPDK

SEQ ID NO: 1604918 - protein, 5 aa, Staphylococcus aureus
IGRDC

SEQ ID NO: 1604919 - protein, 7 aa, Staphylococcus aureus
IGRNDSK

SEQ ID NO: 1604920 - protein, 6 aa, Staphylococcus aureus
IGRTDL

SEQ ID NO: 1604921 - protein, 11 aa, Staphylococcus aureus
IGSEKKTAQMI

SEQ ID NO: 1604922 - protein, 6 aa, Staphylococcus aureus
IGSGNA

SEQ ID NO: 1604923 - protein, 6 aa, Staphylococcus aureus
IGTLDD

SEQ ID NO: 1604924 - protein, 13 aa, Staphylococcus aureus
IGTPGEVLEPGQQ

SEQ ID NO: 1604925 - protein, 6 aa, Staphylococcus aureus
IGTSGA

SEQ ID NO: 1604926 - protein, 4 aa, Staphylococcus aureus
IHTA

SEQ ID NO: 1604927 - protein, 10 aa, Staphylococcus aureus
IIDEEDSSQV

SEQ ID NO: 1604928 - protein, 11 aa, Staphylococcus aureus
IISGGGSDGSI

SEQ ID NO: 1604929 - protein, 4 aa, Staphylococcus aureus
IKAN

SEQ ID NO: 1604930 - protein, 14 aa, Staphylococcus aureus
IKEAQHGNNQPAVK

SEQ ID NO: 1604931 - protein, 6 aa, Staphylococcus aureus
IKEDGR

SEQ ID NO: 1604932 - protein, 16 aa, Staphylococcus aureus
IKEGDKVTGEVQQVED

SEQ ID NO: 1604933 - protein, 12 aa, Staphylococcus aureus
IKGETKVIDVTM

SEQ ID NO: 1604934 - protein, 17 aa, Staphylococcus aureus
IKGGHTNNKIRVSTTPV

SEQ ID NO: 1604935 - protein, 14 aa, Staphylococcus aureus
IKKATKKDKAEEKR

SEQ ID NO: 1604936 - protein, 4 aa, Staphylococcus aureus
IKPG

SEQ ID NO: 1604937 - protein, 17 aa, Staphylococcus aureus
IKQANKLKKKRERDKTG

SEQ ID NO: 1604938 - protein, 9 aa, Staphylococcus aureus
IKQKQIRDQ

SEQ ID NO: 1604939 - protein, 7 aa, Staphylococcus aureus
IKSQHPQ

SEQ ID NO: 1604940 - protein, 10 aa, Staphylococcus aureus
IKTKENKGKL

SEQ ID NO: 1604941 - protein, 9 aa, Staphylococcus aureus
IKTTDSYGT

SEQ ID NO: 1604942 - protein, 7 aa, Staphylococcus aureus
IKVEEGQ

SEQ ID NO: 1604943 - protein, 10 aa, Staphylococcus aureus
INAKDKAEIE

SEQ ID NO: 1604944 - protein, 6 aa, Staphylococcus aureus
INDQRA

SEQ ID NO: 1604945 - protein, 9 aa, Staphylococcus aureus
INGETKDVS

SEQ ID NO: 1604946 - protein, 4 aa, Staphylococcus aureus
INNE

SEQ ID NO: 1604947 - protein, 14 aa, Staphylococcus aureus
INNYNEELDSSNIP

SEQ ID NO: 1604948 - protein, 7 aa, Staphylococcus aureus
INQMRGE

SEQ ID NO: 1604949 - protein, 10 aa, Staphylococcus aureus
INTKDDDEID

SEQ ID NO: 1604950 - protein, 5 aa, Staphylococcus aureus
INTVP

SEQ ID NO: 1604951 - protein, 9 aa, Staphylococcus aureus
IPANTGNIA

SEQ ID NO: 1604952 - protein, 9 aa, Staphylococcus aureus
IPDGPTPQG

SEQ ID NO: 1604953 - protein, 19 aa, Staphylococcus aureus
IPENEPGSSIMPGKVNPTQ

SEQ ID NO: 1604954 - protein, 9 aa, Staphylococcus aureus
IPETLQPNG

SEQ ID NO: 1604955 - protein, 12 aa, Staphylococcus aureus
IPGRHNDDSPTI

SEQ ID NO: 1604956 - protein, 11 aa, Staphylococcus aureus
IPGTDGPIKSY

SEQ ID NO: 1604957 - protein, 23 aa, Staphylococcus aureus
IPKDNVGPFKDKLSENGLAQEGN

SEQ ID NO: 1604958 - protein, 9 aa, Staphylococcus aureus
IPNTVGKAM

SEQ ID NO: 1604959 - protein, 11 aa, Staphylococcus aureus
IPPAERGKPQI

SEQ ID NO: 1604960 - protein, 5 aa, Staphylococcus aureus
IPPEI

SEQ ID NO: 1604961 - protein, 5 aa, Staphylococcus aureus
IPSEY

SEQ ID NO: 1604962 - protein, 4 aa, Staphylococcus aureus
IPSG

SEQ ID NO: 1604963 - protein, 6 aa, Staphylococcus aureus
IPTSED

SEQ ID NO: 1604964 - protein, 11 aa, Staphylococcus aureus
IPTSTGAAKAL

SEQ ID NO: 1604965 - protein, 8 aa, Staphylococcus aureus
IPYSSRNP

SEQ ID NO: 1604966 - protein, 6 aa, Staphylococcus aureus
IQEQAA

SEQ ID NO: 1604967 - protein, 4 aa, Staphylococcus aureus
IQGD

SEQ ID NO: 1604968 - protein, 5 aa, Staphylococcus aureus
IQGGP

SEQ ID NO: 1604969 - protein, 6 aa, Staphylococcus aureus
IQNSEK

SEQ ID NO: 1604970 - protein, 8 aa, Staphylococcus aureus
IQPNEASQ

SEQ ID NO: 1604971 - protein, 8 aa, Staphylococcus aureus
IQQSPDYG

SEQ ID NO: 1604972 - protein, 5 aa, Staphylococcus aureus
IRPDQ

SEQ ID NO: 1604973 - protein, 4 aa, Staphylococcus aureus
IRPT

SEQ ID NO: 1604974 - protein, 4 aa, Staphylococcus aureus
IRQH

SEQ ID NO: 1604975 - protein, 11 aa, Staphylococcus aureus
IRREQGSDIDA

SEQ ID NO: 1604976 - protein, 10 aa, Staphylococcus aureus
ISAGRANSNL

SEQ ID NO: 1604977 - protein, 9 aa, Staphylococcus aureus
ISDNPKYRT

SEQ ID NO: 1604978 - protein, 7 aa, Staphylococcus aureus
ISEQLNG

SEQ ID NO: 1604979 - protein, 8 aa, Staphylococcus aureus
ISGGGRCN

SEQ ID NO: 1604980 - protein, 16 aa, Staphylococcus aureus
ISGKLKNAEYTKDSTF

SEQ ID NO: 1604981 - protein, 6 aa, Staphylococcus aureus
ISHQDD

SEQ ID NO: 1604982 - protein, 8 aa, Staphylococcus aureus
ISISDDEL

SEQ ID NO: 1604983 - protein, 6 aa, Staphylococcus aureus
ISKPGL

SEQ ID NO: 1604984 - protein, 14 aa, Staphylococcus aureus
ISKTKKGPQNKVKE

SEQ ID NO: 1604985 - protein, 9 aa, Staphylococcus aureus
ISNQSNSIY

SEQ ID NO: 1604986 - protein, 11 aa, Staphylococcus aureus
ISPEETEEMAN

SEQ ID NO: 1604987 - protein, 11 aa, Staphylococcus aureus
ISQQPEGYTSH

SEQ ID NO: 1604988 - protein, 6 aa, Staphylococcus aureus
ISRETA

SEQ ID NO: 1604989 - protein, 4 aa, Staphylococcus aureus
ISSG

SEQ ID NO: 1604990 - protein, 11 aa, Staphylococcus aureus
ISSGPLPTQSA

SEQ ID NO: 1604991 - protein, 6 aa, Staphylococcus aureus
ISSPNI

SEQ ID NO: 1604992 - protein, 13 aa, Staphylococcus aureus
ISSQADNSTPFTP

SEQ ID NO: 1604993 - protein, 5 aa, Staphylococcus aureus
ISTTT

SEQ ID NO: 1604994 - protein, 8 aa, Staphylococcus aureus
ITDKGYYQ

SEQ ID NO: 1604995 - protein, 5 aa, Staphylococcus aureus
ITDRR

SEQ ID NO: 1604996 - protein, 6 aa, Staphylococcus aureus
ITEDTG

SEQ ID NO: 1604997 - protein, 6 aa, Staphylococcus aureus
ITEPPQ

SEQ ID NO: 1604998 - protein, 6 aa, Staphylococcus aureus
ITGSGP

SEQ ID NO: 1604999 - protein, 5 aa, Staphylococcus aureus
ITKES

SEQ ID NO: 1605000 - protein, 8 aa, Staphylococcus aureus
ITKKTKRA

SEQ ID NO: 1605001 - protein, 7 aa, Staphylococcus aureus
ITNPYTG

SEQ ID NO: 1605002 - protein, 5 aa, Staphylococcus aureus
ITPAS

SEQ ID NO: 1605003 - protein, 9 aa, Staphylococcus aureus
ITPDGTELE

SEQ ID NO: 1605004 - protein, 15 aa, Staphylococcus aureus
ITRASTSGMAKSRRK

SEQ ID NO: 1605005 - protein, 5 aa, Staphylococcus aureus
ITRDT

SEQ ID NO: 1605006 - protein, 13 aa, Staphylococcus aureus
ITSYASPRDAWLY

SEQ ID NO: 1605007 - protein, 4 aa, Staphylococcus aureus
ITTE

SEQ ID NO: 1605008 - protein, 17 aa, Staphylococcus aureus
ITYDSGGYSIKTKNGMA

SEQ ID NO: 1605009 - protein, 6 aa, Staphylococcus aureus
IVGPGN

SEQ ID NO: 1605010 - protein, 4 aa, Staphylococcus aureus
IVTS

SEQ ID NO: 1605011 - protein, 11 aa, Staphylococcus aureus
KAADAPNHGMR

SEQ ID NO: 1605012 - protein, 13 aa, Staphylococcus aureus
KAAHITDYSNASR

SEQ ID NO: 1605013 - protein, 7 aa, Staphylococcus aureus
KAAQSNL

SEQ ID NO: 1605014 - protein, 8 aa, Staphylococcus aureus
KAAREMKE

SEQ ID NO: 1605015 - protein, 6 aa, Staphylococcus aureus
KAATQS

SEQ ID NO: 1605016 - protein, 7 aa, Staphylococcus aureus
KADDTFS

SEQ ID NO: 1605017 - protein, 11 aa, Staphylococcus aureus
KAFPSQNDNIT

SEQ ID NO: 1605018 - protein, 4 aa, Staphylococcus aureus
KAGD

SEQ ID NO: 1605019 - protein, 7 aa, Staphylococcus aureus
KAGKRHQ

SEQ ID NO: 1605020 - protein, 22 aa, Staphylococcus aureus
KAGYETSAYATEKIGDATLEAE

SEQ ID NO: 1605021 - protein, 7 aa, Staphylococcus aureus
KAIEETA

SEQ ID NO: 1605022 - protein, 8 aa, Staphylococcus aureus
KAIGQQKN

SEQ ID NO: 1605023 - protein, 11 aa, Staphylococcus aureus
KAIKSKDSVLE

SEQ ID NO: 1605024 - protein, 7 aa, Staphylococcus aureus
KAIRTND

SEQ ID NO: 1605025 - protein, 9 aa, Staphylococcus aureus
KAKGARSNI

SEQ ID NO: 1605026 - protein, 5 aa, Staphylococcus aureus
KAKGF

SEQ ID NO: 1605027 - protein, 8 aa, Staphylococcus aureus
KAKKSGYV

SEQ ID NO: 1605028 - protein, 7 aa, Staphylococcus aureus
KAKPKIG

SEQ ID NO: 1605029 - protein, 10 aa, Staphylococcus aureus
KAKPVKPEGC

SEQ ID NO: 1605030 - protein, 17 aa, Staphylococcus aureus
KAKYITGQTIHVNGGMY

SEQ ID NO: 1605031 - protein, 7 aa, Staphylococcus aureus
KALGTGL

SEQ ID NO: 1605032 - protein, 5 aa, Staphylococcus aureus
KANPQ

SEQ ID NO: 1605033 - protein, 5 aa, Staphylococcus aureus
KAQDE

SEQ ID NO: 1605034 - protein, 6 aa, Staphylococcus aureus
KAQDII

SEQ ID NO: 1605035 - protein, 8 aa, Staphylococcus aureus
KAREKKLG

SEQ ID NO: 1605036 - protein, 8 aa, Staphylococcus aureus
KARGNGTV

SEQ ID NO: 1605037 - protein, 6 aa, Staphylococcus aureus
KARNID

SEQ ID NO: 1605038 - protein, 9 aa, Staphylococcus aureus
KARTQSKKI

SEQ ID NO: 1605039 - protein, 19 aa, Staphylococcus aureus
KASKGENGQSSNMHGKNAE

SEQ ID NO: 1605040 - protein, 15 aa, Staphylococcus aureus
KATKAAEDAPYPSVE

SEQ ID NO: 1605041 - protein, 20 aa, Staphylococcus aureus
KAVAGTIKRSQDEDEDTKNV

SEQ ID NO: 1605042 - protein, 7 aa, Staphylococcus aureus
KAVEKGL

SEQ ID NO: 1605043 - protein, 11 aa, Staphylococcus aureus
KCNGSGQEFEE

SEQ ID NO: 1605044 - protein, 5 aa, Staphylococcus aureus
KDAMG

SEQ ID NO: 1605045 - protein, 10 aa, Staphylococcus aureus
KDDAKEVAKG

SEQ ID NO: 1605046 - protein, 6 aa, Staphylococcus aureus
KDDIAK

SEQ ID NO: 1605047 - protein, 6 aa, Staphylococcus aureus
KDETEK

SEQ ID NO: 1605048 - protein, 5 aa, Staphylococcus aureus
KDFNT

SEQ ID NO: 1605049 - protein, 10 aa, Staphylococcus aureus
KDGQDKLSQH

SEQ ID NO: 1605050 - protein, 4 aa, Staphylococcus aureus
KDGT

SEQ ID NO: 1605051 - protein, 6 aa, Staphylococcus aureus
KDHKTR

SEQ ID NO: 1605052 - protein, 13 aa, Staphylococcus aureus
KDILSEEDNYSAV

SEQ ID NO: 1605053 - protein, 7 aa, Staphylococcus aureus
KDIPPHS

SEQ ID NO: 1605054 - protein, 10 aa, Staphylococcus aureus
KDKDNESKLG

SEQ ID NO: 1605055 - protein, 17 aa, Staphylococcus aureus
KDKGDRSITLRPEGTAA

SEQ ID NO: 1605056 - protein, 8 aa, Staphylococcus aureus
KDKTADDI

SEQ ID NO: 1605057 - protein, 5 aa, Staphylococcus aureus
KDKTD

SEQ ID NO: 1605058 - protein, 9 aa, Staphylococcus aureus
KDLEGKDLS

SEQ ID NO: 1605059 - protein, 24 aa, Staphylococcus aureus
KDLGTNKEQRITIQSSSSLSDEEI

SEQ ID NO: 1605060 - protein, 12 aa, Staphylococcus aureus
KDLGYQTTLTNK

SEQ ID NO: 1605061 - protein, 10 aa, Staphylococcus aureus
KDNTLAQKAN

SEQ ID NO: 1605062 - protein, 6 aa, Staphylococcus aureus
KDPDYI

SEQ ID NO: 1605063 - protein, 6 aa, Staphylococcus aureus
KDQIQG

SEQ ID NO: 1605064 - protein, 8 aa, Staphylococcus aureus
KDQSQVEK

SEQ ID NO: 1605065 - protein, 8 aa, Staphylococcus aureus
KDSDGTRH

SEQ ID NO: 1605066 - protein, 8 aa, Staphylococcus aureus
KDSENEKV

SEQ ID NO: 1605067 - protein, 11 aa, Staphylococcus aureus
KDTEDSKGNLQ

SEQ ID NO: 1605068 - protein, 6 aa, Staphylococcus aureus
KDTELV

SEQ ID NO: 1605069 - protein, 9 aa, Staphylococcus aureus
KDVEKELGQ

SEQ ID NO: 1605070 - protein, 8 aa, Staphylococcus aureus
KDVNSESI

SEQ ID NO: 1605071 - protein, 6 aa, Staphylococcus aureus
KDVSPY

SEQ ID NO: 1605072 - protein, 7 aa, Staphylococcus aureus
KDYPDPE

SEQ ID NO: 1605073 - protein, 7 aa, Staphylococcus aureus
KDYPEAN

SEQ ID NO: 1605074 - protein, 6 aa, Staphylococcus aureus
KEASEQ

SEQ ID NO: 1605075 - protein, 6 aa, Staphylococcus aureus
KEATLE

SEQ ID NO: 1605076 - protein, 7 aa, Staphylococcus aureus
KEDPNYT

SEQ ID NO: 1605077 - protein, 9 aa, Staphylococcus aureus
KEDYPDKGV

SEQ ID NO: 1605078 - protein, 14 aa, Staphylococcus aureus
KEEAEDVKNDESTD

SEQ ID NO: 1605079 - protein, 11 aa, Staphylococcus aureus
KEEGLKAANDL

SEQ ID NO: 1605080 - protein, 9 aa, Staphylococcus aureus
KEEHIEDDA

SEQ ID NO: 1605081 - protein, 7 aa, Staphylococcus aureus
KEEKEHV

SEQ ID NO: 1605082 - protein, 6 aa, Staphylococcus aureus
KEEKPN

SEQ ID NO: 1605083 - protein, 6 aa, Staphylococcus aureus
KEERFH

SEQ ID NO: 1605084 - protein, 16 aa, Staphylococcus aureus
KEETELGKEAKSYMDR

SEQ ID NO: 1605085 - protein, 7 aa, Staphylococcus aureus
KEETGAK

SEQ ID NO: 1605086 - protein, 7 aa, Staphylococcus aureus
KEFKQTY

SEQ ID NO: 1605087 - protein, 5 aa, Staphylococcus aureus
KEGAK

SEQ ID NO: 1605088 - protein, 7 aa, Staphylococcus aureus
KEGEQCG

SEQ ID NO: 1605089 - protein, 5 aa, Staphylococcus aureus
KEGIK

SEQ ID NO: 1605090 - protein, 4 aa, Staphylococcus aureus
KEGR

SEQ ID NO: 1605091 - protein, 7 aa, Staphylococcus aureus
KEGRLPD

SEQ ID NO: 1605092 - protein, 7 aa, Staphylococcus aureus
KEGTTEV

SEQ ID NO: 1605093 - protein, 4 aa, Staphylococcus aureus
KEHD

SEQ ID NO: 1605094 - protein, 6 aa, Staphylococcus aureus
KEHQGD

SEQ ID NO: 1605095 - protein, 5 aa, Staphylococcus aureus
KEHRE

SEQ ID NO: 1605096 - protein, 4 aa, Staphylococcus aureus
KEIQ

SEQ ID NO: 1605097 - protein, 9 aa, Staphylococcus aureus
KEKASQYGG

SEQ ID NO: 1605098 - protein, 8 aa, Staphylococcus aureus
KEKDIDKR

SEQ ID NO: 1605099 - protein, 7 aa, Staphylococcus aureus
KEKKIPR

SEQ ID NO: 1605100 - protein, 6 aa, Staphylococcus aureus
KEKVDP

SEQ ID NO: 1605101 - protein, 10 aa, Staphylococcus aureus
KELAKTGVKV

SEQ ID NO: 1605102 - protein, 5 aa, Staphylococcus aureus
KELGD

SEQ ID NO: 1605103 - protein, 9 aa, Staphylococcus aureus
KELVDGAPK

SEQ ID NO: 1605104 - protein, 14 aa, Staphylococcus aureus
KENAIKKAQELDEL

SEQ ID NO: 1605105 - protein, 6 aa, Staphylococcus aureus
KENDPI

SEQ ID NO: 1605106 - protein, 6 aa, Staphylococcus aureus
KENEVP

SEQ ID NO: 1605107 - protein, 4 aa, Staphylococcus aureus
KENG

SEQ ID NO: 1605108 - protein, 17 aa, Staphylococcus aureus
KENGAIAGKLTGAGRGG

SEQ ID NO: 1605109 - protein, 13 aa, Staphylococcus aureus
KENLKNEGHDISD

SEQ ID NO: 1605110 - protein, 4 aa, Staphylococcus aureus
KEPD

SEQ ID NO: 1605111 - protein, 10 aa, Staphylococcus aureus
KEPGGGTTDY

SEQ ID NO: 1605112 - protein, 6 aa, Staphylococcus aureus
KEPTER

SEQ ID NO: 1605113 - protein, 7 aa, Staphylococcus aureus
KEPVKQY

SEQ ID NO: 1605114 - protein, 7 aa, Staphylococcus aureus
KEQAQEQ

SEQ ID NO: 1605115 - protein, 13 aa, Staphylococcus aureus
KEQHTAKPKMETV

SEQ ID NO: 1605116 - protein, 6 aa, Staphylococcus aureus
KEQSNH

SEQ ID NO: 1605117 - protein, 8 aa, Staphylococcus aureus
KEQTGGLD

SEQ ID NO: 1605118 - protein, 14 aa, Staphylococcus aureus
KEQYGAPSKSLADS

SEQ ID NO: 1605119 - protein, 4 aa, Staphylococcus aureus
KERG

SEQ ID NO: 1605120 - protein, 8 aa, Staphylococcus aureus
KERQPING

SEQ ID NO: 1605121 - protein, 7 aa, Staphylococcus aureus
KESEDRV

SEQ ID NO: 1605122 - protein, 6 aa, Staphylococcus aureus
KESGCT

SEQ ID NO: 1605123 - protein, 6 aa, Staphylococcus aureus
KESYEG

SEQ ID NO: 1605124 - protein, 6 aa, Staphylococcus aureus
KETDDV

SEQ ID NO: 1605125 - protein, 6 aa, Staphylococcus aureus
KETFKN

SEQ ID NO: 1605126 - protein, 6 aa, Staphylococcus aureus
KETGAS

SEQ ID NO: 1605127 - protein, 7 aa, Staphylococcus aureus
KETNTQV

SEQ ID NO: 1605128 - protein, 4 aa, Staphylococcus aureus
KETP

SEQ ID NO: 1605129 - protein, 7 aa, Staphylococcus aureus
KETSGTK

SEQ ID NO: 1605130 - protein, 10 aa, Staphylococcus aureus
KETVDKEKGI

SEQ ID NO: 1605131 - protein, 8 aa, Staphylococcus aureus
KEVENNQV

SEQ ID NO: 1605132 - protein, 14 aa, Staphylococcus aureus
KFDPKMDEGEREKL

SEQ ID NO: 1605133 - protein, 9 aa, Staphylococcus aureus
KFEDGTEVT

SEQ ID NO: 1605134 - protein, 6 aa, Staphylococcus aureus
KFKSER

SEQ ID NO: 1605135 - protein, 7 aa, Staphylococcus aureus
KFNKEGY

SEQ ID NO: 1605136 - protein, 8 aa, Staphylococcus aureus
KGAAKVEK

SEQ ID NO: 1605137 - protein, 7 aa, Staphylococcus aureus
KGADGAA

SEQ ID NO: 1605138 - protein, 15 aa, Staphylococcus aureus
KGAIQEGSNRLNQQG

SEQ ID NO: 1605139 - protein, 11 aa, Staphylococcus aureus
KGAVDKTFNTS

SEQ ID NO: 1605140 - protein, 19 aa, Staphylococcus aureus
KGAYPGKAAEERGQSESIA

SEQ ID NO: 1605141 - protein, 8 aa, Staphylococcus aureus
KGDEARSI

SEQ ID NO: 1605142 - protein, 17 aa, Staphylococcus aureus
KGEETNRVEGFESGADD

SEQ ID NO: 1605143 - protein, 6 aa, Staphylococcus aureus
KGERVN

SEQ ID NO: 1605144 - protein, 5 aa, Staphylococcus aureus
KGEYD

SEQ ID NO: 1605145 - protein, 9 aa, Staphylococcus aureus
KGGATGGGY

SEQ ID NO: 1605146 - protein, 7 aa, Staphylococcus aureus
KGGDPAI

SEQ ID NO: 1605147 - protein, 4 aa, Staphylococcus aureus
KGGN

SEQ ID NO: 1605148 - protein, 8 aa, Staphylococcus aureus
KGGSEIEK

SEQ ID NO: 1605149 - protein, 4 aa, Staphylococcus aureus
KGHE

SEQ ID NO: 1605150 - protein, 10 aa, Staphylococcus aureus
KGHVTNKGVA

SEQ ID NO: 1605151 - protein, 8 aa, Staphylococcus aureus
KGIGATRA

SEQ ID NO: 1605152 - protein, 5 aa, Staphylococcus aureus
KGIKN

SEQ ID NO: 1605153 - protein, 6 aa, Staphylococcus aureus
KGIQDT

SEQ ID NO: 1605154 - protein, 7 aa, Staphylococcus aureus
KGKGTNF

SEQ ID NO: 1605155 - protein, 8 aa, Staphylococcus aureus
KGKSLGAK

SEQ ID NO: 1605156 - protein, 9 aa, Staphylococcus aureus
KGKTNKEIA

SEQ ID NO: 1605157 - protein, 6 aa, Staphylococcus aureus
KGLDDE

SEQ ID NO: 1605158 - protein, 9 aa, Staphylococcus aureus
KGLSAGRVQ

SEQ ID NO: 1605159 - protein, 5 aa, Staphylococcus aureus
KGNLP

SEQ ID NO: 1605160 - protein, 16 aa, Staphylococcus aureus
KGPIGKGNAKATVDGQ

SEQ ID NO: 1605161 - protein, 7 aa, Staphylococcus aureus
KGQFRKN

SEQ ID NO: 1605162 - protein, 7 aa, Staphylococcus aureus
KGQLSKS

SEQ ID NO: 1605163 - protein, 7 aa, Staphylococcus aureus
KGQQLEA

SEQ ID NO: 1605164 - protein, 9 aa, Staphylococcus aureus
KGQSLGAVD

SEQ ID NO: 1605165 - protein, 19 aa, Staphylococcus aureus
KGSSDETIEVTNPATGETL

SEQ ID NO: 1605166 - protein, 6 aa, Staphylococcus aureus
KGSTYY

SEQ ID NO: 1605167 - protein, 9 aa, Staphylococcus aureus
KGTGPRYCP

SEQ ID NO: 1605168 - protein, 13 aa, Staphylococcus aureus
KGTNFSPQDPNYD

SEQ ID NO: 1605169 - protein, 6 aa, Staphylococcus aureus
KGTVNG

SEQ ID NO: 1605170 - protein, 15 aa, Staphylococcus aureus
KGVKTHPNDLKESNT

SEQ ID NO: 1605171 - protein, 7 aa, Staphylococcus aureus
KGVTDVD

SEQ ID NO: 1605172 - protein, 4 aa, Staphylococcus aureus
KGWG

SEQ ID NO: 1605173 - protein, 12 aa, Staphylococcus aureus
KGWGQKEDDVEK

SEQ ID NO: 1605174 - protein, 4 aa, Staphylococcus aureus
KGYN

SEQ ID NO: 1605175 - protein, 8 aa, Staphylococcus aureus
KGYSTGGS

SEQ ID NO: 1605176 - protein, 8 aa, Staphylococcus aureus
KHADTNKM

SEQ ID NO: 1605177 - protein, 8 aa, Staphylococcus aureus
KHNPDSRR

SEQ ID NO: 1605178 - protein, 7 aa, Staphylococcus aureus
KHQDDEL

SEQ ID NO: 1605179 - protein, 14 aa, Staphylococcus aureus
KHSEVEKEARDKAA

SEQ ID NO: 1605180 - protein, 5 aa, Staphylococcus aureus
KHSKV

SEQ ID NO: 1605181 - protein, 7 aa, Staphylococcus aureus
KIAGEQN

SEQ ID NO: 1605182 - protein, 8 aa, Staphylococcus aureus
KIASGGEL

SEQ ID NO: 1605183 - protein, 8 aa, Staphylococcus aureus
KIESKEDG

SEQ ID NO: 1605184 - protein, 7 aa, Staphylococcus aureus
KIGGEND

SEQ ID NO: 1605185 - protein, 11 aa, Staphylococcus aureus
KIGYESEEAKD

SEQ ID NO: 1605186 - protein, 10 aa, Staphylococcus aureus
KIKNEGQPAV

SEQ ID NO: 1605187 - protein, 7 aa, Staphylococcus aureus
KIKPSDV

SEQ ID NO: 1605188 - protein, 5 aa, Staphylococcus aureus
KISSF

SEQ ID NO: 1605189 - protein, 6 aa, Staphylococcus aureus
KITERH

SEQ ID NO: 1605190 - protein, 9 aa, Staphylococcus aureus
KKAANKDTY

SEQ ID NO: 1605191 - protein, 8 aa, Staphylococcus aureus
KKAPYDER

SEQ ID NO: 1605192 - protein, 5 aa, Staphylococcus aureus
KKDGI

SEQ ID NO: 1605193 - protein, 5 aa, Staphylococcus aureus
KKDKS

SEQ ID NO: 1605194 - protein, 9 aa, Staphylococcus aureus
KKDNNDELH

SEQ ID NO: 1605195 - protein, 8 aa, Staphylococcus aureus
KKDNQKYE

SEQ ID NO: 1605196 - protein, 10 aa, Staphylococcus aureus
KKENGVDLSQ

SEQ ID NO: 1605197 - protein, 6 aa, Staphylococcus aureus
KKERPD

SEQ ID NO: 1605198 - protein, 6 aa, Staphylococcus aureus
KKETNI

SEQ ID NO: 1605199 - protein, 6 aa, Staphylococcus aureus
KKGDKV

SEQ ID NO: 1605200 - protein, 9 aa, Staphylococcus aureus
KKGGSVSPV

SEQ ID NO: 1605201 - protein, 23 aa, Staphylococcus aureus
KKGKGSNDTLNREEGDAVGQSQA

SEQ ID NO: 1605202 - protein, 17 aa, Staphylococcus aureus
KKGNRPGFSNSKNPDQA

SEQ ID NO: 1605203 - protein, 7 aa, Staphylococcus aureus
KKGPFAP

SEQ ID NO: 1605204 - protein, 10 aa, Staphylococcus aureus
KKGRKSTDAL

SEQ ID NO: 1605205 - protein, 9 aa, Staphylococcus aureus
KKGRTPNPD

SEQ ID NO: 1605206 - protein, 8 aa, Staphylococcus aureus
KKGTIRTN

SEQ ID NO: 1605207 - protein, 15 aa, Staphylococcus aureus
KKIGVPGEQELGGRG

SEQ ID NO: 1605208 - protein, 8 aa, Staphylococcus aureus
KKLTEEGC

SEQ ID NO: 1605209 - protein, 4 aa, Staphylococcus aureus
KKLY

SEQ ID NO: 1605210 - protein, 7 aa, Staphylococcus aureus
KKMGKHS

SEQ ID NO: 1605211 - protein, 9 aa, Staphylococcus aureus
KKNAENGQY

SEQ ID NO: 1605212 - protein, 7 aa, Staphylococcus aureus
KKNEGRT

SEQ ID NO: 1605213 - protein, 6 aa, Staphylococcus aureus
KKNFAE

SEQ ID NO: 1605214 - protein, 6 aa, Staphylococcus aureus
KKNPHR

SEQ ID NO: 1605215 - protein, 6 aa, Staphylococcus aureus
KKPANG

SEQ ID NO: 1605216 - protein, 7 aa, Staphylococcus aureus
KKPTSHF

SEQ ID NO: 1605217 - protein, 4 aa, Staphylococcus aureus
KKQF

SEQ ID NO: 1605218 - protein, 7 aa, Staphylococcus aureus
KKQKYAV

SEQ ID NO: 1605219 - protein, 6 aa, Staphylococcus aureus
KKQMSD

SEQ ID NO: 1605220 - protein, 8 aa, Staphylococcus aureus
KKQPPLKA

SEQ ID NO: 1605221 - protein, 23 aa, Staphylococcus aureus
KKRLDDHYEAKSIKQNVQKQKYD

SEQ ID NO: 1605222 - protein, 6 aa, Staphylococcus aureus
KKRLKE

SEQ ID NO: 1605223 - protein, 9 aa, Staphylococcus aureus
KKRSEREAY

SEQ ID NO: 1605224 - protein, 7 aa, Staphylococcus aureus
KKRTEKE

SEQ ID NO: 1605225 - protein, 6 aa, Staphylococcus aureus
KKSDID

SEQ ID NO: 1605226 - protein, 14 aa, Staphylococcus aureus
KKTGFTNADELSHH

SEQ ID NO: 1605227 - protein, 10 aa, Staphylococcus aureus
KKTGKAEGDY

SEQ ID NO: 1605228 - protein, 7 aa, Staphylococcus aureus
KKTKSRL

SEQ ID NO: 1605229 - protein, 8 aa, Staphylococcus aureus
KKTNSSVV

SEQ ID NO: 1605230 - protein, 10 aa, Staphylococcus aureus
KKTQGNYNNE

SEQ ID NO: 1605231 - protein, 10 aa, Staphylococcus aureus
KKVKTGLQAQ

SEQ ID NO: 1605232 - protein, 7 aa, Staphylococcus aureus
KKYKLDK

SEQ ID NO: 1605233 - protein, 6 aa, Staphylococcus aureus
KKYPQS

SEQ ID NO: 1605234 - protein, 6 aa, Staphylococcus aureus
KKYSMG

SEQ ID NO: 1605235 - protein, 17 aa, Staphylococcus aureus
KLDSKDVSRIGSTFGKT

SEQ ID NO: 1605236 - protein, 11 aa, Staphylococcus aureus
KLEDNPKKPQL

SEQ ID NO: 1605237 - protein, 7 aa, Staphylococcus aureus
KLEGKTK

SEQ ID NO: 1605238 - protein, 4 aa, Staphylococcus aureus
KLEH

SEQ ID NO: 1605239 - protein, 9 aa, Staphylococcus aureus
KLPKSTIEA

SEQ ID NO: 1605240 - protein, 10 aa, Staphylococcus aureus
KLSDEQENEI

SEQ ID NO: 1605241 - protein, 6 aa, Staphylococcus aureus
KLSGEA

SEQ ID NO: 1605242 - protein, 7 aa, Staphylococcus aureus
KLSTTYG

SEQ ID NO: 1605243 - protein, 11 aa, Staphylococcus aureus
KMRGKGKLTEA

SEQ ID NO: 1605244 - protein, 17 aa, Staphylococcus aureus
KNAKTAVSNNADNKNEL

SEQ ID NO: 1605245 - protein, 4 aa, Staphylococcus aureus
KNDV

SEQ ID NO: 1605246 - protein, 18 aa, Staphylococcus aureus
KNELKTPADAQKEATDYH

SEQ ID NO: 1605247 - protein, 6 aa, Staphylococcus aureus
KNENEK

SEQ ID NO: 1605248 - protein, 5 aa, Staphylococcus aureus
KNEQD

SEQ ID NO: 1605249 - protein, 6 aa, Staphylococcus aureus
KNEQHK

SEQ ID NO: 1605250 - protein, 30 aa, Staphylococcus aureus
KNGGSPSSGLVKKGKTKKTGTKVTFKPDDT

SEQ ID NO: 1605251 - protein, 6 aa, Staphylococcus aureus
KNGIER

SEQ ID NO: 1605252 - protein, 6 aa, Staphylococcus aureus
KNGKGI

SEQ ID NO: 1605253 - protein, 14 aa, Staphylococcus aureus
KNGRELSSNEMKQT

SEQ ID NO: 1605254 - protein, 11 aa, Staphylococcus aureus
KNIPTSKEETV

SEQ ID NO: 1605255 - protein, 8 aa, Staphylococcus aureus
KNITQDQD

SEQ ID NO: 1605256 - protein, 5 aa, Staphylococcus aureus
KNKER

SEQ ID NO: 1605257 - protein, 4 aa, Staphylococcus aureus
KNNK

SEQ ID NO: 1605258 - protein, 9 aa, Staphylococcus aureus
KNNKNFQPM

SEQ ID NO: 1605259 - protein, 8 aa, Staphylococcus aureus
KNPAGMNA

SEQ ID NO: 1605260 - protein, 5 aa, Staphylococcus aureus
KNPDF

SEQ ID NO: 1605261 - protein, 5 aa, Staphylococcus aureus
KNPDV

SEQ ID NO: 1605262 - protein, 9 aa, Staphylococcus aureus
KNPGGGLAK

SEQ ID NO: 1605263 - protein, 8 aa, Staphylococcus aureus
KNPVTEPN

SEQ ID NO: 1605264 - protein, 7 aa, Staphylococcus aureus
KNQQVNG

SEQ ID NO: 1605265 - protein, 6 aa, Staphylococcus aureus
KNRIEK

SEQ ID NO: 1605266 - protein, 7 aa, Staphylococcus aureus
KNRSNAA

SEQ ID NO: 1605267 - protein, 6 aa, Staphylococcus aureus
KNSAID

SEQ ID NO: 1605268 - protein, 4 aa, Staphylococcus aureus
KNSQ

SEQ ID NO: 1605269 - protein, 8 aa, Staphylococcus aureus
KNTLGNTD

SEQ ID NO: 1605270 - protein, 7 aa, Staphylococcus aureus
KNTTSED

SEQ ID NO: 1605271 - protein, 16 aa, Staphylococcus aureus
KNVSSKSETDKVDITK

SEQ ID NO: 1605272 - protein, 7 aa, Staphylococcus aureus
KPEFSSA

SEQ ID NO: 1605273 - protein, 13 aa, Staphylococcus aureus
KPEGFADVLLNMW

SEQ ID NO: 1605274 - protein, 9 aa, Staphylococcus aureus
KPEHSRSNK

SEQ ID NO: 1605275 - protein, 7 aa, Staphylococcus aureus
KPFSPRE

SEQ ID NO: 1605276 - protein, 6 aa, Staphylococcus aureus
KPHSYR

SEQ ID NO: 1605277 - protein, 4 aa, Staphylococcus aureus
KPKG

SEQ ID NO: 1605278 - protein, 19 aa, Staphylococcus aureus
KPKKKRMGRYQGYTNKRRK

SEQ ID NO: 1605279 - protein, 8 aa, Staphylococcus aureus
KPLETDGS

SEQ ID NO: 1605280 - protein, 11 aa, Staphylococcus aureus
KPLQEAPQKYV

SEQ ID NO: 1605281 - protein, 5 aa, Staphylococcus aureus
KPLSR

SEQ ID NO: 1605282 - protein, 12 aa, Staphylococcus aureus
KPLVTKAKKSIA

SEQ ID NO: 1605283 - protein, 6 aa, Staphylococcus aureus
KPMGKA

SEQ ID NO: 1605284 - protein, 5 aa, Staphylococcus aureus
KPNQY

SEQ ID NO: 1605285 - protein, 8 aa, Staphylococcus aureus
KPNVGKSS

SEQ ID NO: 1605286 - protein, 6 aa, Staphylococcus aureus
KPRKVN

SEQ ID NO: 1605287 - protein, 7 aa, Staphylococcus aureus
KPRTDYK

SEQ ID NO: 1605288 - protein, 6 aa, Staphylococcus aureus
KPTGSH

SEQ ID NO: 1605289 - protein, 5 aa, Staphylococcus aureus
KPTPV

SEQ ID NO: 1605290 - protein, 7 aa, Staphylococcus aureus
KPTSDID

SEQ ID NO: 1605291 - protein, 5 aa, Staphylococcus aureus
KQAGA

SEQ ID NO: 1605292 - protein, 4 aa, Staphylococcus aureus
KQAR

SEQ ID NO: 1605293 - protein, 11 aa, Staphylococcus aureus
KQDRSSNIEKG

SEQ ID NO: 1605294 - protein, 8 aa, Staphylococcus aureus
KQESKDGT

SEQ ID NO: 1605295 - protein, 14 aa, Staphylococcus aureus
KQFDPQKKVSKEDF

SEQ ID NO: 1605296 - protein, 7 aa, Staphylococcus aureus
KQFSDDD

SEQ ID NO: 1605297 - protein, 8 aa, Staphylococcus aureus
KQGDKEVT

SEQ ID NO: 1605298 - protein, 5 aa, Staphylococcus aureus
KQGKT

SEQ ID NO: 1605299 - protein, 8 aa, Staphylococcus aureus
KQGSHATL

SEQ ID NO: 1605300 - protein, 6 aa, Staphylococcus aureus
KQKGAD

SEQ ID NO: 1605301 - protein, 17 aa, Staphylococcus aureus
KQKKKTRATEAKRKGLE

SEQ ID NO: 1605302 - protein, 10 aa, Staphylococcus aureus
KQLPKGRKPI

SEQ ID NO: 1605303 - protein, 6 aa, Staphylococcus aureus
KQLSHA

SEQ ID NO: 1605304 - protein, 13 aa, Staphylococcus aureus
KQNDSADTEGVEP

SEQ ID NO: 1605305 - protein, 5 aa, Staphylococcus aureus
KQPNV

SEQ ID NO: 1605306 - protein, 12 aa, Staphylococcus aureus
KQQGYEQTFRDK

SEQ ID NO: 1605307 - protein, 10 aa, Staphylococcus aureus
KQQRDENLDN

SEQ ID NO: 1605308 - protein, 4 aa, Staphylococcus aureus
KQRQ

SEQ ID NO: 1605309 - protein, 5 aa, Staphylococcus aureus
KQSAE

SEQ ID NO: 1605310 - protein, 9 aa, Staphylococcus aureus
KQSRGPSKG

SEQ ID NO: 1605311 - protein, 8 aa, Staphylococcus aureus
KQTESNID

SEQ ID NO: 1605312 - protein, 6 aa, Staphylococcus aureus
KQVEEL

SEQ ID NO: 1605313 - protein, 9 aa, Staphylococcus aureus
KRAEQDQNY

SEQ ID NO: 1605314 - protein, 17 aa, Staphylococcus aureus
KRERVEAKYRKMILEAK

SEQ ID NO: 1605315 - protein, 7 aa, Staphylococcus aureus
KRGASRA

SEQ ID NO: 1605316 - protein, 28 aa, Staphylococcus aureus
KRGELAQKIGEEKLKQGTRIYDPQREKE

SEQ ID NO: 1605317 - protein, 5 aa, Staphylococcus aureus
KRGGT

SEQ ID NO: 1605318 - protein, 7 aa, Staphylococcus aureus
KRGKNAV

SEQ ID NO: 1605319 - protein, 12 aa, Staphylococcus aureus
KRGVGPSSVEKV

SEQ ID NO: 1605320 - protein, 6 aa, Staphylococcus aureus
KRIDTN

SEQ ID NO: 1605321 - protein, 5 aa, Staphylococcus aureus
KRIKV

SEQ ID NO: 1605322 - protein, 6 aa, Staphylococcus aureus
KRKEEV

SEQ ID NO: 1605323 - protein, 4 aa, Staphylococcus aureus
KRLQ

SEQ ID NO: 1605324 - protein, 7 aa, Staphylococcus aureus
KRMKSKT

SEQ ID NO: 1605325 - protein, 6 aa, Staphylococcus aureus
KRQGRQ

SEQ ID NO: 1605326 - protein, 7 aa, Staphylococcus aureus
KRQNPSP

SEQ ID NO: 1605327 - protein, 7 aa, Staphylococcus aureus
KRQSEVN

SEQ ID NO: 1605328 - protein, 22 aa, Staphylococcus aureus
KRQTPKKYPRKPGTPNKTPLLE

SEQ ID NO: 1605329 - protein, 13 aa, Staphylococcus aureus
KRSLDNQKTDDRI

SEQ ID NO: 1605330 - protein, 9 aa, Staphylococcus aureus
KRSRGTPRV

SEQ ID NO: 1605331 - protein, 5 aa, Staphylococcus aureus
KRTQR

SEQ ID NO: 1605332 - protein, 9 aa, Staphylococcus aureus
KRTSVSRKI

SEQ ID NO: 1605333 - protein, 12 aa, Staphylococcus aureus
KRVAGYAHEQGK

SEQ ID NO: 1605334 - protein, 16 aa, Staphylococcus aureus
KRVKRTASGQLKRSRA

SEQ ID NO: 1605335 - protein, 9 aa, Staphylococcus aureus
KSAEEHQQH

SEQ ID NO: 1605336 - protein, 6 aa, Staphylococcus aureus
KSAYES

SEQ ID NO: 1605337 - protein, 6 aa, Staphylococcus aureus
KSCEVP

SEQ ID NO: 1605338 - protein, 10 aa, Staphylococcus aureus
KSDKVNANEY

SEQ ID NO: 1605339 - protein, 8 aa, Staphylococcus aureus
KSDTYDKV

SEQ ID NO: 1605340 - protein, 6 aa, Staphylococcus aureus
KSEPGL

SEQ ID NO: 1605341 - protein, 6 aa, Staphylococcus aureus
KSEQPV

SEQ ID NO: 1605342 - protein, 8 aa, Staphylococcus aureus
KSEQYTNG

SEQ ID NO: 1605343 - protein, 7 aa, Staphylococcus aureus
KSFKEEE

SEQ ID NO: 1605344 - protein, 6 aa, Staphylococcus aureus
KSFSDG

SEQ ID NO: 1605345 - protein, 11 aa, Staphylococcus aureus
KSGVRRNDGSY

SEQ ID NO: 1605346 - protein, 5 aa, Staphylococcus aureus
KSGYR

SEQ ID NO: 1605347 - protein, 6 aa, Staphylococcus aureus
KSHQET

SEQ ID NO: 1605348 - protein, 6 aa, Staphylococcus aureus
KSIPQG

SEQ ID NO: 1605349 - protein, 13 aa, Staphylococcus aureus
KSISTNKDLSAFI

SEQ ID NO: 1605350 - protein, 7 aa, Staphylococcus aureus
KSKEEYE

SEQ ID NO: 1605351 - protein, 4 aa, Staphylococcus aureus
KSKF

SEQ ID NO: 1605352 - protein, 16 aa, Staphylococcus aureus
KSKGIDRVNSKAISDA

SEQ ID NO: 1605353 - protein, 5 aa, Staphylococcus aureus
KSKKP

SEQ ID NO: 1605354 - protein, 8 aa, Staphylococcus aureus
KSKNPNAK

SEQ ID NO: 1605355 - protein, 7 aa, Staphylococcus aureus
KSLAQET

SEQ ID NO: 1605356 - protein, 6 aa, Staphylococcus aureus
KSLDDG

SEQ ID NO: 1605357 - protein, 12 aa, Staphylococcus aureus
KSPNDDNGYDIS

SEQ ID NO: 1605358 - protein, 10 aa, Staphylococcus aureus
KSQANQKKLS

SEQ ID NO: 1605359 - protein, 6 aa, Staphylococcus aureus
KSRLDE

SEQ ID NO: 1605360 - protein, 10 aa, Staphylococcus aureus
KSSGLTDTKG

SEQ ID NO: 1605361 - protein, 12 aa, Staphylococcus aureus
KSSKDDRTTTQV

SEQ ID NO: 1605362 - protein, 9 aa, Staphylococcus aureus
KSSKDNPKR

SEQ ID NO: 1605363 - protein, 7 aa, Staphylococcus aureus
KSSPEAI

SEQ ID NO: 1605364 - protein, 11 aa, Staphylococcus aureus
KSSPLTTQEDR

SEQ ID NO: 1605365 - protein, 8 aa, Staphylococcus aureus
KSSQNTGT

SEQ ID NO: 1605366 - protein, 7 aa, Staphylococcus aureus
KSYDRPY

SEQ ID NO: 1605367 - protein, 16 aa, Staphylococcus aureus
KTARARVKDLEYTNHL

SEQ ID NO: 1605368 - protein, 9 aa, Staphylococcus aureus
KTDRDGARI

SEQ ID NO: 1605369 - protein, 5 aa, Staphylococcus aureus
KTEDF

SEQ ID NO: 1605370 - protein, 7 aa, Staphylococcus aureus
KTELKND

SEQ ID NO: 1605371 - protein, 7 aa, Staphylococcus aureus
KTIDGEK

SEQ ID NO: 1605372 - protein, 12 aa, Staphylococcus aureus
KTILPDDHPYSI

SEQ ID NO: 1605373 - protein, 7 aa, Staphylococcus aureus
KTIQTRD

SEQ ID NO: 1605374 - protein, 10 aa, Staphylococcus aureus
KTKHTHGTGC

SEQ ID NO: 1605375 - protein, 22 aa, Staphylococcus aureus
KTLQAGESVSYGATYTATDPTT

SEQ ID NO: 1605376 - protein, 7 aa, Staphylococcus aureus
KTNGQAR

SEQ ID NO: 1605377 - protein, 6 aa, Staphylococcus aureus
KTPKIL

SEQ ID NO: 1605378 - protein, 5 aa, Staphylococcus aureus
KTRKE

SEQ ID NO: 1605379 - protein, 13 aa, Staphylococcus aureus
KTSDIEGHPEFSG

SEQ ID NO: 1605380 - protein, 7 aa, Staphylococcus aureus
KTSIRNT

SEQ ID NO: 1605381 - protein, 7 aa, Staphylococcus aureus
KTSKQFK

SEQ ID NO: 1605382 - protein, 9 aa, Staphylococcus aureus
KTTNHDHNG

SEQ ID NO: 1605383 - protein, 7 aa, Staphylococcus aureus
KTVDGED

SEQ ID NO: 1605384 - protein, 13 aa, Staphylococcus aureus
KTVISSGLETARE

SEQ ID NO: 1605385 - protein, 4 aa, Staphylococcus aureus
KTVM

SEQ ID NO: 1605386 - protein, 10 aa, Staphylococcus aureus
KTYGAAPYDK

SEQ ID NO: 1605387 - protein, 5 aa, Staphylococcus aureus
KTYVA

SEQ ID NO: 1605388 - protein, 5 aa, Staphylococcus aureus
KVDAT

SEQ ID NO: 1605389 - protein, 6 aa, Staphylococcus aureus
KVDEEK

SEQ ID NO: 1605390 - protein, 6 aa, Staphylococcus aureus
KVGDEA

SEQ ID NO: 1605391 - protein, 7 aa, Staphylococcus aureus
KVGKEDF

SEQ ID NO: 1605392 - protein, 7 aa, Staphylococcus aureus
KVPEPVN

SEQ ID NO: 1605393 - protein, 7 aa, Staphylococcus aureus
KVQPRRE

SEQ ID NO: 1605394 - protein, 10 aa, Staphylococcus aureus
KVVDSRHADE

SEQ ID NO: 1605395 - protein, 5 aa, Staphylococcus aureus
KYEDD

SEQ ID NO: 1605396 - protein, 6 aa, Staphylococcus aureus
KYEGIQ

SEQ ID NO: 1605397 - protein, 6 aa, Staphylococcus aureus
KYEGQT

SEQ ID NO: 1605398 - protein, 13 aa, Staphylococcus aureus
KYPEVNAEIDGDD

SEQ ID NO: 1605399 - protein, 4 aa, Staphylococcus aureus
KYPP

SEQ ID NO: 1605400 - protein, 10 aa, Staphylococcus aureus
KYPTTQIEAS

SEQ ID NO: 1605401 - protein, 7 aa, Staphylococcus aureus
KYRGEFE

SEQ ID NO: 1605402 - protein, 8 aa, Staphylococcus aureus
KYRGGAPI

SEQ ID NO: 1605403 - protein, 18 aa, Staphylococcus aureus
KYSKKYKTHDENNSAKLG

SEQ ID NO: 1605404 - protein, 5 aa, Staphylococcus aureus
KYSND

SEQ ID NO: 1605405 - protein, 5 aa, Staphylococcus aureus
KYTDE

SEQ ID NO: 1605406 - protein, 5 aa, Staphylococcus aureus
LADKK

SEQ ID NO: 1605407 - protein, 5 aa, Staphylococcus aureus
LAKDE

SEQ ID NO: 1605408 - protein, 8 aa, Staphylococcus aureus
LAKNPDES

SEQ ID NO: 1605409 - protein, 7 aa, Staphylococcus aureus
LAREEGV

SEQ ID NO: 1605410 - protein, 5 aa, Staphylococcus aureus
LARPA

SEQ ID NO: 1605411 - protein, 17 aa, Staphylococcus aureus
LARRNSYQGLRYKSKVK

SEQ ID NO: 1605412 - protein, 9 aa, Staphylococcus aureus
LASARRGAK

SEQ ID NO: 1605413 - protein, 10 aa, Staphylococcus aureus
LASPNAGQRT

SEQ ID NO: 1605414 - protein, 8 aa, Staphylococcus aureus
LASSSTVH

SEQ ID NO: 1605415 - protein, 7 aa, Staphylococcus aureus
LATNTTD

SEQ ID NO: 1605416 - protein, 4 aa, Staphylococcus aureus
LATQ

SEQ ID NO: 1605417 - protein, 7 aa, Staphylococcus aureus
LATRPNE

SEQ ID NO: 1605418 - protein, 8 aa, Staphylococcus aureus
LDATEERV

SEQ ID NO: 1605419 - protein, 5 aa, Staphylococcus aureus
LDDKA

SEQ ID NO: 1605420 - protein, 8 aa, Staphylococcus aureus
LDDPDRYQ

SEQ ID NO: 1605421 - protein, 4 aa, Staphylococcus aureus
LDGE

SEQ ID NO: 1605422 - protein, 4 aa, Staphylococcus aureus
LDKE

SEQ ID NO: 1605423 - protein, 10 aa, Staphylococcus aureus
LDKSRGPSAS

SEQ ID NO: 1605424 - protein, 9 aa, Staphylococcus aureus
LDKTDKDEK

SEQ ID NO: 1605425 - protein, 8 aa, Staphylococcus aureus
LDMDPDDT

SEQ ID NO: 1605426 - protein, 18 aa, Staphylococcus aureus
LDNNEQSVEDYKNGKGKA

SEQ ID NO: 1605427 - protein, 6 aa, Staphylococcus aureus
LDPEYA

SEQ ID NO: 1605428 - protein, 5 aa, Staphylococcus aureus
LDPLE

SEQ ID NO: 1605429 - protein, 9 aa, Staphylococcus aureus
LDRRGNEVN

SEQ ID NO: 1605430 - protein, 9 aa, Staphylococcus aureus
LDSETDPKK

SEQ ID NO: 1605431 - protein, 15 aa, Staphylococcus aureus
LDTGGQYQDRGPQYQ

SEQ ID NO: 1605432 - protein, 5 aa, Staphylococcus aureus
LEAGE

SEQ ID NO: 1605433 - protein, 5 aa, Staphylococcus aureus
LEDDD

SEQ ID NO: 1605434 - protein, 8 aa, Staphylococcus aureus
LEDPYENM

SEQ ID NO: 1605435 - protein, 14 aa, Staphylococcus aureus
LEEEDPKEIEASKH

SEQ ID NO: 1605436 - protein, 6 aa, Staphylococcus aureus
LEEPNI

SEQ ID NO: 1605437 - protein, 5 aa, Staphylococcus aureus
LENKG

SEQ ID NO: 1605438 - protein, 5 aa, Staphylococcus aureus
LEPEI

SEQ ID NO: 1605439 - protein, 4 aa, Staphylococcus aureus
LEPL

SEQ ID NO: 1605440 - protein, 4 aa, Staphylococcus aureus
LEQQ

SEQ ID NO: 1605441 - protein, 11 aa, Staphylococcus aureus
LEREKSSSTYI

SEQ ID NO: 1605442 - protein, 5 aa, Staphylococcus aureus
LESED

SEQ ID NO: 1605443 - protein, 10 aa, Staphylococcus aureus
LESEQQKAHY

SEQ ID NO: 1605444 - protein, 15 aa, Staphylococcus aureus
LESVGKSPINWCESE

SEQ ID NO: 1605445 - protein, 13 aa, Staphylococcus aureus
LETENDETYENFE

SEQ ID NO: 1605446 - protein, 9 aa, Staphylococcus aureus
LETGKEKRD

SEQ ID NO: 1605447 - protein, 9 aa, Staphylococcus aureus
LEYGSPKLP

SEQ ID NO: 1605448 - protein, 6 aa, Staphylococcus aureus
LEYYTP

SEQ ID NO: 1605449 - protein, 8 aa, Staphylococcus aureus
LGAGKTTL

SEQ ID NO: 1605450 - protein, 11 aa, Staphylococcus aureus
LGDGQASDEYT

SEQ ID NO: 1605451 - protein, 4 aa, Staphylococcus aureus
LGDR

SEQ ID NO: 1605452 - protein, 8 aa, Staphylococcus aureus
LGEDNNPY

SEQ ID NO: 1605453 - protein, 8 aa, Staphylococcus aureus
LGENSKEM

SEQ ID NO: 1605454 - protein, 4 aa, Staphylococcus aureus
LGGI

SEQ ID NO: 1605455 - protein, 8 aa, Staphylococcus aureus
LGGNKGIT

SEQ ID NO: 1605456 - protein, 13 aa, Staphylococcus aureus
LGGPTNGVPREDG

SEQ ID NO: 1605457 - protein, 11 aa, Staphylococcus aureus
LGGRATTGKNV

SEQ ID NO: 1605458 - protein, 6 aa, Staphylococcus aureus
LGGTET

SEQ ID NO: 1605459 - protein, 21 aa, Staphylococcus aureus
LGISDGDVEETEDAPKSLFDE

SEQ ID NO: 1605460 - protein, 16 aa, Staphylococcus aureus
LGLSPSASFSNDGPRL

SEQ ID NO: 1605461 - protein, 12 aa, Staphylococcus aureus
LGNGFDADTEMG

SEQ ID NO: 1605462 - protein, 8 aa, Staphylococcus aureus
LGNTTDRR

SEQ ID NO: 1605463 - protein, 7 aa, Staphylococcus aureus
LGPDPFP

SEQ ID NO: 1605464 - protein, 7 aa, Staphylococcus aureus
LGPEEEK

SEQ ID NO: 1605465 - protein, 28 aa, Staphylococcus aureus
LGQPIDGQGPINTTKTRPVEKKATGVMD

SEQ ID NO: 1605466 - protein, 9 aa, Staphylococcus aureus
LHAETRNSS

SEQ ID NO: 1605467 - protein, 8 aa, Staphylococcus aureus
LHAKGEKF

SEQ ID NO: 1605468 - protein, 10 aa, Staphylococcus aureus
LHSDAGSQHV

SEQ ID NO: 1605469 - protein, 13 aa, Staphylococcus aureus
LITDEEKKYFEQQ

SEQ ID NO: 1605470 - protein, 12 aa, Staphylococcus aureus
LKAKIVKKNQID

SEQ ID NO: 1605471 - protein, 11 aa, Staphylococcus aureus
LKANPKNRAVG

SEQ ID NO: 1605472 - protein, 10 aa, Staphylococcus aureus
LKAQQTKHAE

SEQ ID NO: 1605473 - protein, 9 aa, Staphylococcus aureus
LKDPTNLEK

SEQ ID NO: 1605474 - protein, 6 aa, Staphylococcus aureus
LKEASV

SEQ ID NO: 1605475 - protein, 5 aa, Staphylococcus aureus
LKEKE

SEQ ID NO: 1605476 - protein, 7 aa, Staphylococcus aureus
LKENGYA

SEQ ID NO: 1605477 - protein, 13 aa, Staphylococcus aureus
LKEQTGSEAKAEE

SEQ ID NO: 1605478 - protein, 6 aa, Staphylococcus aureus
LKESLK

SEQ ID NO: 1605479 - protein, 6 aa, Staphylococcus aureus
LKKGRQ

SEQ ID NO: 1605480 - protein, 11 aa, Staphylococcus aureus
LKNGKAVEVPT

SEQ ID NO: 1605481 - protein, 6 aa, Staphylococcus aureus
LKPEDT

SEQ ID NO: 1605482 - protein, 24 aa, Staphylococcus aureus
LKPGKGGQIARSAGASAQVLGKEG

SEQ ID NO: 1605483 - protein, 7 aa, Staphylococcus aureus
LKPYDRD

SEQ ID NO: 1605484 - protein, 5 aa, Staphylococcus aureus
LKSGR

SEQ ID NO: 1605485 - protein, 8 aa, Staphylococcus aureus
LKTGEKLR

SEQ ID NO: 1605486 - protein, 10 aa, Staphylococcus aureus
LNDEPYENEI

SEQ ID NO: 1605487 - protein, 10 aa, Staphylococcus aureus
LNDTKSKGHR

SEQ ID NO: 1605488 - protein, 10 aa, Staphylococcus aureus
LNEKRQPQDI

SEQ ID NO: 1605489 - protein, 7 aa, Staphylococcus aureus
LNESESL

SEQ ID NO: 1605490 - protein, 12 aa, Staphylococcus aureus
LNIPEESPSGNI

SEQ ID NO: 1605491 - protein, 5 aa, Staphylococcus aureus
LNKDQ

SEQ ID NO: 1605492 - protein, 5 aa, Staphylococcus aureus
LNNEI

SEQ ID NO: 1605493 - protein, 4 aa, Staphylococcus aureus
LNNP

SEQ ID NO: 1605494 - protein, 6 aa, Staphylococcus aureus
LNQNDK

SEQ ID NO: 1605495 - protein, 9 aa, Staphylococcus aureus
LNSTRAAVE

SEQ ID NO: 1605496 - protein, 5 aa, Staphylococcus aureus
LPAEE

SEQ ID NO: 1605497 - protein, 7 aa, Staphylococcus aureus
LPDGHPK

SEQ ID NO: 1605498 - protein, 5 aa, Staphylococcus aureus
LPDKD

SEQ ID NO: 1605499 - protein, 9 aa, Staphylococcus aureus
LPEDDSRIK

SEQ ID NO: 1605500 - protein, 6 aa, Staphylococcus aureus
LPEDSK

SEQ ID NO: 1605501 - protein, 18 aa, Staphylococcus aureus
LPEGPKYYPDDQISDHPE

SEQ ID NO: 1605502 - protein, 11 aa, Staphylococcus aureus
LPEGQMGNSEV

SEQ ID NO: 1605503 - protein, 15 aa, Staphylococcus aureus
LPEKTVINHKRYKIV

SEQ ID NO: 1605504 - protein, 14 aa, Staphylococcus aureus
LPFGGVGASGMGRY

SEQ ID NO: 1605505 - protein, 5 aa, Staphylococcus aureus
LPGED

SEQ ID NO: 1605506 - protein, 8 aa, Staphylococcus aureus
LPGNAQSI

SEQ ID NO: 1605507 - protein, 4 aa, Staphylococcus aureus
LPKG

SEQ ID NO: 1605508 - protein, 4 aa, Staphylococcus aureus
LPKN

SEQ ID NO: 1605509 - protein, 6 aa, Staphylococcus aureus
LPNETG

SEQ ID NO: 1605510 - protein, 8 aa, Staphylococcus aureus
LPPASPQI

SEQ ID NO: 1605511 - protein, 5 aa, Staphylococcus aureus
LPPYK

SEQ ID NO: 1605512 - protein, 9 aa, Staphylococcus aureus
LPQGATATD

SEQ ID NO: 1605513 - protein, 11 aa, Staphylococcus aureus
LPRDSSPTRLT

SEQ ID NO: 1605514 - protein, 4 aa, Staphylococcus aureus
LPSI

SEQ ID NO: 1605515 - protein, 7 aa, Staphylococcus aureus
LPSLSGL

SEQ ID NO: 1605516 - protein, 4 aa, Staphylococcus aureus
LPTD

SEQ ID NO: 1605517 - protein, 10 aa, Staphylococcus aureus
LPTKERNTQA

SEQ ID NO: 1605518 - protein, 5 aa, Staphylococcus aureus
LPTSF

SEQ ID NO: 1605519 - protein, 26 aa, Staphylococcus aureus
LPVRGQKTKNNARTRKGPVKTVANKK

SEQ ID NO: 1605520 - protein, 16 aa, Staphylococcus aureus
LPYTSTGKLQRNKLYR

SEQ ID NO: 1605521 - protein, 7 aa, Staphylococcus aureus
LQDGTMD

SEQ ID NO: 1605522 - protein, 9 aa, Staphylococcus aureus
LQGDSTVDS

SEQ ID NO: 1605523 - protein, 6 aa, Staphylococcus aureus
LQGPDG

SEQ ID NO: 1605524 - protein, 10 aa, Staphylococcus aureus
LQPAAGAHGE

SEQ ID NO: 1605525 - protein, 5 aa, Staphylococcus aureus
LQQEK

SEQ ID NO: 1605526 - protein, 14 aa, Staphylococcus aureus
LQQSSYKLTPQREA

SEQ ID NO: 1605527 - protein, 8 aa, Staphylococcus aureus
LQSGNYSD

SEQ ID NO: 1605528 - protein, 10 aa, Staphylococcus aureus
LRADRQPEFT

SEQ ID NO: 1605529 - protein, 12 aa, Staphylococcus aureus
LRGNSGAKAYRL

SEQ ID NO: 1605530 - protein, 5 aa, Staphylococcus aureus
LRGVA

SEQ ID NO: 1605531 - protein, 14 aa, Staphylococcus aureus
LRKRNTKKVKKNGV

SEQ ID NO: 1605532 - protein, 8 aa, Staphylococcus aureus
LRSETDER

SEQ ID NO: 1605533 - protein, 12 aa, Staphylococcus aureus
LRTEPKLSLPTA

SEQ ID NO: 1605534 - protein, 19 aa, Staphylococcus aureus
LRTGAIQEKTFRAGEKVEP

SEQ ID NO: 1605535 - protein, 7 aa, Staphylococcus aureus
LRTTGGR

SEQ ID NO: 1605536 - protein, 9 aa, Staphylococcus aureus
LSADEKDEV

SEQ ID NO: 1605537 - protein, 14 aa, Staphylococcus aureus
LSDPEFNEQYKEQM

SEQ ID NO: 1605538 - protein, 7 aa, Staphylococcus aureus
LSEAKKD

SEQ ID NO: 1605539 - protein, 6 aa, Staphylococcus aureus
LSENGA

SEQ ID NO: 1605540 - protein, 6 aa, Staphylococcus aureus
LSGDGI

SEQ ID NO: 1605541 - protein, 18 aa, Staphylococcus aureus
LSGGGEARLHGQSSIGVG

SEQ ID NO: 1605542 - protein, 11 aa, Staphylococcus aureus
LSGRSNVGKST

SEQ ID NO: 1605543 - protein, 29 aa, Staphylococcus aureus
LSGTGKELEKRPYAPGQHGPNQRKKLSEY

SEQ ID NO: 1605544 - protein, 5 aa, Staphylococcus aureus
LSKDA

SEQ ID NO: 1605545 - protein, 9 aa, Staphylococcus aureus
LSKEKEPQI

SEQ ID NO: 1605546 - protein, 7 aa, Staphylococcus aureus
LSKVGGK

SEQ ID NO: 1605547 - protein, 10 aa, Staphylococcus aureus
LSNDSDSVKV

SEQ ID NO: 1605548 - protein, 15 aa, Staphylococcus aureus
LSNNAEKVTTPGKKN

SEQ ID NO: 1605549 - protein, 17 aa, Staphylococcus aureus
LSNPEQIQRYIQQLEDL

SEQ ID NO: 1605550 - protein, 9 aa, Staphylococcus aureus
LSPKKNAQL

SEQ ID NO: 1605551 - protein, 5 aa, Staphylococcus aureus
LSPSQ

SEQ ID NO: 1605552 - protein, 4 aa, Staphylococcus aureus
LSPT

SEQ ID NO: 1605553 - protein, 13 aa, Staphylococcus aureus
LSQEDSSKGHGHL

SEQ ID NO: 1605554 - protein, 6 aa, Staphylococcus aureus
LSQKST

SEQ ID NO: 1605555 - protein, 9 aa, Staphylococcus aureus
LSRQEKAER

SEQ ID NO: 1605556 - protein, 4 aa, Staphylococcus aureus
LSRS

SEQ ID NO: 1605557 - protein, 7 aa, Staphylococcus aureus
LSSADSF

SEQ ID NO: 1605558 - protein, 6 aa, Staphylococcus aureus
LSTEDQ

SEQ ID NO: 1605559 - protein, 7 aa, Staphylococcus aureus
LSTKELN

SEQ ID NO: 1605560 - protein, 6 aa, Staphylococcus aureus
LSTQSD

SEQ ID NO: 1605561 - protein, 13 aa, Staphylococcus aureus
LSTTGKYTHVSNQ

SEQ ID NO: 1605562 - protein, 43 aa, Staphylococcus aureus
LTDLGENIGEEDKKSAEEKKDALKTALEGQDIEDIKSKKEELE

SEQ ID NO: 1605563 - protein, 7 aa, Staphylococcus aureus
LTDREEN

SEQ ID NO: 1605564 - protein, 12 aa, Staphylococcus aureus
LTEERRKERVKD

SEQ ID NO: 1605565 - protein, 13 aa, Staphylococcus aureus
LTEKYRSDEWMFR

SEQ ID NO: 1605566 - protein, 11 aa, Staphylococcus aureus
LTGSGVEVKDH

SEQ ID NO: 1605567 - protein, 8 aa, Staphylococcus aureus
LTKGDTGL

SEQ ID NO: 1605568 - protein, 10 aa, Staphylococcus aureus
LTNTNARIEP

SEQ ID NO: 1605569 - protein, 8 aa, Staphylococcus aureus
LTSQTPDL

SEQ ID NO: 1605570 - protein, 6 aa, Staphylococcus aureus
LTSSIR

SEQ ID NO: 1605571 - protein, 7 aa, Staphylococcus aureus
LTSTTED

SEQ ID NO: 1605572 - protein, 11 aa, Staphylococcus aureus
LTTPKQAPYLS

SEQ ID NO: 1605573 - protein, 7 aa, Staphylococcus aureus
LTTTQGI

SEQ ID NO: 1605574 - protein, 6 aa, Staphylococcus aureus
LTYATE

SEQ ID NO: 1605575 - protein, 19 aa, Staphylococcus aureus
LVRGRGGPRCMSQPLFRED

SEQ ID NO: 1605576 - protein, 10 aa, Staphylococcus aureus
LVTESDGRTW

SEQ ID NO: 1605577 - protein, 10 aa, Staphylococcus aureus
LYSTDKGDQL

SEQ ID NO: 1605578 - protein, 9 aa, Staphylococcus aureus
MAGSTTPKL

SEQ ID NO: 1605579 - protein, 10 aa, Staphylococcus aureus
MATNKDGKMF

SEQ ID NO: 1605580 - protein, 14 aa, Staphylococcus aureus
MDDVGGDITKINPE

SEQ ID NO: 1605581 - protein, 5 aa, Staphylococcus aureus
MDQGG

SEQ ID NO: 1605582 - protein, 10 aa, Staphylococcus aureus
MEDPKQTKGM

SEQ ID NO: 1605583 - protein, 12 aa, Staphylococcus aureus
MEESDVPDPYYT

SEQ ID NO: 1605584 - protein, 10 aa, Staphylococcus aureus
METPNGNGGV

SEQ ID NO: 1605585 - protein, 4 aa, Staphylococcus aureus
MGGK

SEQ ID NO: 1605586 - protein, 8 aa, Staphylococcus aureus
MGGTGGGI

SEQ ID NO: 1605587 - protein, 4 aa, Staphylococcus aureus
MGGY

SEQ ID NO: 1605588 - protein, 4 aa, Staphylococcus aureus
MHPK

SEQ ID NO: 1605589 - protein, 4 aa, Staphylococcus aureus
MHRQ

SEQ ID NO: 1605590 - protein, 17 aa, Staphylococcus aureus
MKGTMPRGKTEAEDQQY

SEQ ID NO: 1605591 - protein, 9 aa, Staphylococcus aureus
MNDDKSRAK

SEQ ID NO: 1605592 - protein, 4 aa, Staphylococcus aureus
MNPN

SEQ ID NO: 1605593 - protein, 52 aa, Staphylococcus aureus
MNPNDHPHGGGEGRAPIGRPSPMSPWGKPTLGKKTRRGKKSSDKLIVRGRKK

SEQ ID NO: 1605594 - protein, 11 aa, Staphylococcus aureus
MNPTPTDKGRR

SEQ ID NO: 1605595 - protein, 5 aa, Staphylococcus aureus
MNRPN

SEQ ID NO: 1605596 - protein, 7 aa, Staphylococcus aureus
MPSPGKI

SEQ ID NO: 1605597 - protein, 4 aa, Staphylococcus aureus
MPTD

SEQ ID NO: 1605598 - protein, 7 aa, Staphylococcus aureus
MQGEPVE

SEQ ID NO: 1605599 - protein, 9 aa, Staphylococcus aureus
MQGNPNQPI

SEQ ID NO: 1605600 - protein, 9 aa, Staphylococcus aureus
MQKSIESLS

SEQ ID NO: 1605601 - protein, 8 aa, Staphylococcus aureus
MQQNPQDF

SEQ ID NO: 1605602 - protein, 4 aa, Staphylococcus aureus
MREQ

SEQ ID NO: 1605603 - protein, 6 aa, Staphylococcus aureus
MRKPTQ

SEQ ID NO: 1605604 - protein, 8 aa, Staphylococcus aureus
MRQDGTRD

SEQ ID NO: 1605605 - protein, 8 aa, Staphylococcus aureus
MSKTEIQQ

SEQ ID NO: 1605606 - protein, 6 aa, Staphylococcus aureus
MSNQGS

SEQ ID NO: 1605607 - protein, 5 aa, Staphylococcus aureus
MTEGA

SEQ ID NO: 1605608 - protein, 7 aa, Staphylococcus aureus
MTEHTAS

SEQ ID NO: 1605609 - protein, 7 aa, Staphylococcus aureus
MTRNEAS

SEQ ID NO: 1605610 - protein, 11 aa, Staphylococcus aureus
MYEQPQANSVE

SEQ ID NO: 1605611 - protein, 5 aa, Staphylococcus aureus
NADDT

SEQ ID NO: 1605612 - protein, 17 aa, Staphylococcus aureus
NADETTQERLRSGYEDA

SEQ ID NO: 1605613 - protein, 8 aa, Staphylococcus aureus
NADPTFND

SEQ ID NO: 1605614 - protein, 16 aa, Staphylococcus aureus
NAEEGDEITEYLNEVI

SEQ ID NO: 1605615 - protein, 16 aa, Staphylococcus aureus
NAENPEKKFQPTPGKV

SEQ ID NO: 1605616 - protein, 6 aa, Staphylococcus aureus
NAETHK

SEQ ID NO: 1605617 - protein, 6 aa, Staphylococcus aureus
NAKDQK

SEQ ID NO: 1605618 - protein, 5 aa, Staphylococcus aureus
NAKEE

SEQ ID NO: 1605619 - protein, 4 aa, Staphylococcus aureus
NALN

SEQ ID NO: 1605620 - protein, 5 aa, Staphylococcus aureus
NAMPG

SEQ ID NO: 1605621 - protein, 14 aa, Staphylococcus aureus
NANVTSPKSIQTAS

SEQ ID NO: 1605622 - protein, 5 aa, Staphylococcus aureus
NAQSR

SEQ ID NO: 1605623 - protein, 23 aa, Staphylococcus aureus
NASVAGATGGCQAEVGSASAMAA

SEQ ID NO: 1605624 - protein, 12 aa, Staphylococcus aureus
NATPNNASQESS

SEQ ID NO: 1605625 - protein, 8 aa, Staphylococcus aureus
NAVPPATG

SEQ ID NO: 1605626 - protein, 11 aa, Staphylococcus aureus
NCGNDNPKTVD

SEQ ID NO: 1605627 - protein, 12 aa, Staphylococcus aureus
NDEDVKTSQPAI

SEQ ID NO: 1605628 - protein, 10 aa, Staphylococcus aureus
NDELGKPKID

SEQ ID NO: 1605629 - protein, 6 aa, Staphylococcus aureus
NDENCM

SEQ ID NO: 1605630 - protein, 19 aa, Staphylococcus aureus
NDGASQSYVRSKKKAAEKI

SEQ ID NO: 1605631 - protein, 4 aa, Staphylococcus aureus
NDGY

SEQ ID NO: 1605632 - protein, 7 aa, Staphylococcus aureus
NDGYDAS

SEQ ID NO: 1605633 - protein, 6 aa, Staphylococcus aureus
NDIQGH

SEQ ID NO: 1605634 - protein, 8 aa, Staphylococcus aureus
NDKGELNG

SEQ ID NO: 1605635 - protein, 8 aa, Staphylococcus aureus
NDKQFKGQ

SEQ ID NO: 1605636 - protein, 10 aa, Staphylococcus aureus
NDLKNKVENL

SEQ ID NO: 1605637 - protein, 6 aa, Staphylococcus aureus
NDNERL

SEQ ID NO: 1605638 - protein, 10 aa, Staphylococcus aureus
NDPIDQKGRF

SEQ ID NO: 1605639 - protein, 8 aa, Staphylococcus aureus
NDPKECSE

SEQ ID NO: 1605640 - protein, 14 aa, Staphylococcus aureus
NDQPQTLQSFLQEN

SEQ ID NO: 1605641 - protein, 6 aa, Staphylococcus aureus
NDQYNI

SEQ ID NO: 1605642 - protein, 7 aa, Staphylococcus aureus
NDSIETL

SEQ ID NO: 1605643 - protein, 16 aa, Staphylococcus aureus
NDSKNDRGAQKDRHEN

SEQ ID NO: 1605644 - protein, 9 aa, Staphylococcus aureus
NDSLDESYR

SEQ ID NO: 1605645 - protein, 7 aa, Staphylococcus aureus
NDSNDDL

SEQ ID NO: 1605646 - protein, 7 aa, Staphylococcus aureus
NDSREQR

SEQ ID NO: 1605647 - protein, 10 aa, Staphylococcus aureus
NDTGNKYSPT

SEQ ID NO: 1605648 - protein, 11 aa, Staphylococcus aureus
NDYPEATWPGE

SEQ ID NO: 1605649 - protein, 10 aa, Staphylococcus aureus
NEAQQGRQVT

SEQ ID NO: 1605650 - protein, 7 aa, Staphylococcus aureus
NEDDETK

SEQ ID NO: 1605651 - protein, 5 aa, Staphylococcus aureus
NEDER

SEQ ID NO: 1605652 - protein, 12 aa, Staphylococcus aureus
NEDGSPSEIAES

SEQ ID NO: 1605653 - protein, 4 aa, Staphylococcus aureus
NEDN

SEQ ID NO: 1605654 - protein, 8 aa, Staphylococcus aureus
NEDTQKDD

SEQ ID NO: 1605655 - protein, 5 aa, Staphylococcus aureus
NEEIK

SEQ ID NO: 1605656 - protein, 7 aa, Staphylococcus aureus
NEEIQVN

SEQ ID NO: 1605657 - protein, 7 aa, Staphylococcus aureus
NEEQIEE

SEQ ID NO: 1605658 - protein, 5 aa, Staphylococcus aureus
NEERD

SEQ ID NO: 1605659 - protein, 8 aa, Staphylococcus aureus
NEGANMAA

SEQ ID NO: 1605660 - protein, 6 aa, Staphylococcus aureus
NEIEKA

SEQ ID NO: 1605661 - protein, 10 aa, Staphylococcus aureus
NEKADNNLGQ

SEQ ID NO: 1605662 - protein, 6 aa, Staphylococcus aureus
NEKARK

SEQ ID NO: 1605663 - protein, 25 aa, Staphylococcus aureus
NEKDSSDTDEKLNPSDLSAPPGVKI

SEQ ID NO: 1605664 - protein, 9 aa, Staphylococcus aureus
NEKRQQIDA

SEQ ID NO: 1605665 - protein, 11 aa, Staphylococcus aureus
NENRVGLSPSG

SEQ ID NO: 1605666 - protein, 6 aa, Staphylococcus aureus
NENSDA

SEQ ID NO: 1605667 - protein, 6 aa, Staphylococcus aureus
NEPTAA

SEQ ID NO: 1605668 - protein, 6 aa, Staphylococcus aureus
NEPTFT

SEQ ID NO: 1605669 - protein, 7 aa, Staphylococcus aureus
NEQPGIF

SEQ ID NO: 1605670 - protein, 6 aa, Staphylococcus aureus
NERTKY

SEQ ID NO: 1605671 - protein, 4 aa, Staphylococcus aureus
NESD

SEQ ID NO: 1605672 - protein, 8 aa, Staphylococcus aureus
NESNVSSI

SEQ ID NO: 1605673 - protein, 5 aa, Staphylococcus aureus
NFANE

SEQ ID NO: 1605674 - protein, 9 aa, Staphylococcus aureus
NFRTSSEAE

SEQ ID NO: 1605675 - protein, 7 aa, Staphylococcus aureus
NGAEEVK

SEQ ID NO: 1605676 - protein, 9 aa, Staphylococcus aureus
NGAGKSTTI

SEQ ID NO: 1605677 - protein, 7 aa, Staphylococcus aureus
NGDKKTS

SEQ ID NO: 1605678 - protein, 6 aa, Staphylococcus aureus
NGEFAD

SEQ ID NO: 1605679 - protein, 8 aa, Staphylococcus aureus
NGGFTNGE

SEQ ID NO: 1605680 - protein, 7 aa, Staphylococcus aureus
NGGGCTG

SEQ ID NO: 1605681 - protein, 8 aa, Staphylococcus aureus
NGGKTIEQ

SEQ ID NO: 1605682 - protein, 7 aa, Staphylococcus aureus
NGLEPTE

SEQ ID NO: 1605683 - protein, 5 aa, Staphylococcus aureus
NGLGY

SEQ ID NO: 1605684 - protein, 6 aa, Staphylococcus aureus
NGLTPN

SEQ ID NO: 1605685 - protein, 8 aa, Staphylococcus aureus
NGPYQGQT

SEQ ID NO: 1605686 - protein, 6 aa, Staphylococcus aureus
NGQIVD

SEQ ID NO: 1605687 - protein, 7 aa, Staphylococcus aureus
NGQPVAT

SEQ ID NO: 1605688 - protein, 12 aa, Staphylococcus aureus
NGRWAKKRKMPR

SEQ ID NO: 1605689 - protein, 8 aa, Staphylococcus aureus
NGSGIEAE

SEQ ID NO: 1605690 - protein, 8 aa, Staphylococcus aureus
NGSGNVRA

SEQ ID NO: 1605691 - protein, 4 aa, Staphylococcus aureus
NGSN

SEQ ID NO: 1605692 - protein, 10 aa, Staphylococcus aureus
NGTASRETEQ

SEQ ID NO: 1605693 - protein, 6 aa, Staphylococcus aureus
NGYTLG

SEQ ID NO: 1605694 - protein, 15 aa, Staphylococcus aureus
NHDPLSSKISSNWPD

SEQ ID NO: 1605695 - protein, 5 aa, Staphylococcus aureus
NHDTP

SEQ ID NO: 1605696 - protein, 4 aa, Staphylococcus aureus
NHGA

SEQ ID NO: 1605697 - protein, 5 aa, Staphylococcus aureus
NHGSL

SEQ ID NO: 1605698 - protein, 12 aa, Staphylococcus aureus
NHLGGLEGGMSN

SEQ ID NO: 1605699 - protein, 5 aa, Staphylococcus aureus
NHNNV

SEQ ID NO: 1605700 - protein, 6 aa, Staphylococcus aureus
NHSKDN

SEQ ID NO: 1605701 - protein, 5 aa, Staphylococcus aureus
NHTNV

SEQ ID NO: 1605702 - protein, 9 aa, Staphylococcus aureus
NIGGRTSHS

SEQ ID NO: 1605703 - protein, 7 aa, Staphylococcus aureus
NIHPKNE

SEQ ID NO: 1605704 - protein, 7 aa, Staphylococcus aureus
NIKTTNG

SEQ ID NO: 1605705 - protein, 9 aa, Staphylococcus aureus
NINTSENYH

SEQ ID NO: 1605706 - protein, 6 aa, Staphylococcus aureus
NIPGNG

SEQ ID NO: 1605707 - protein, 6 aa, Staphylococcus aureus
NIQTSI

SEQ ID NO: 1605708 - protein, 5 aa, Staphylococcus aureus
NISPC

SEQ ID NO: 1605709 - protein, 4 aa, Staphylococcus aureus
NISQ

SEQ ID NO: 1605710 - protein, 7 aa, Staphylococcus aureus
NKASSPV

SEQ ID NO: 1605711 - protein, 27 aa, Staphylococcus aureus
NKDGSISIEDNGRGMPTGIHKSGKPTV

SEQ ID NO: 1605712 - protein, 17 aa, Staphylococcus aureus
NKDGSLSKRGSQVADEA

SEQ ID NO: 1605713 - protein, 18 aa, Staphylococcus aureus
NKDHSYTPLPNKNIDTGM

SEQ ID NO: 1605714 - protein, 9 aa, Staphylococcus aureus
NKEKVQPLT

SEQ ID NO: 1605715 - protein, 8 aa, Staphylococcus aureus
NKETYETN

SEQ ID NO: 1605716 - protein, 4 aa, Staphylococcus aureus
NKEV

SEQ ID NO: 1605717 - protein, 9 aa, Staphylococcus aureus
NKGADGYEM

SEQ ID NO: 1605718 - protein, 8 aa, Staphylococcus aureus
NKGRGYAL

SEQ ID NO: 1605719 - protein, 5 aa, Staphylococcus aureus
NKGVT

SEQ ID NO: 1605720 - protein, 5 aa, Staphylococcus aureus
NKHPK

SEQ ID NO: 1605721 - protein, 10 aa, Staphylococcus aureus
NKKAFDEQEF

SEQ ID NO: 1605722 - protein, 8 aa, Staphylococcus aureus
NKKGKTTQ

SEQ ID NO: 1605723 - protein, 9 aa, Staphylococcus aureus
NKMTSAQDF

SEQ ID NO: 1605724 - protein, 19 aa, Staphylococcus aureus
NKNEGLDNNPFKDALKNLN

SEQ ID NO: 1605725 - protein, 5 aa, Staphylococcus aureus
NKNFG

SEQ ID NO: 1605726 - protein, 8 aa, Staphylococcus aureus
NKNKEIKY

SEQ ID NO: 1605727 - protein, 6 aa, Staphylococcus aureus
NKNNSS

SEQ ID NO: 1605728 - protein, 8 aa, Staphylococcus aureus
NKNSQVRK

SEQ ID NO: 1605729 - protein, 8 aa, Staphylococcus aureus
NKPAKQVS

SEQ ID NO: 1605730 - protein, 6 aa, Staphylococcus aureus
NKPAQG

SEQ ID NO: 1605731 - protein, 4 aa, Staphylococcus aureus
NKPI

SEQ ID NO: 1605732 - protein, 7 aa, Staphylococcus aureus
NKREQRT

SEQ ID NO: 1605733 - protein, 7 aa, Staphylococcus aureus
NKRSSGK

SEQ ID NO: 1605734 - protein, 8 aa, Staphylococcus aureus
NKSNEQAL

SEQ ID NO: 1605735 - protein, 11 aa, Staphylococcus aureus
NKSTKQKRQLR

SEQ ID NO: 1605736 - protein, 5 aa, Staphylococcus aureus
NKTGY

SEQ ID NO: 1605737 - protein, 7 aa, Staphylococcus aureus
NKVNPSS

SEQ ID NO: 1605738 - protein, 11 aa, Staphylococcus aureus
NKVTYTPHVDT

SEQ ID NO: 1605739 - protein, 4 aa, Staphylococcus aureus
NLEK

SEQ ID NO: 1605740 - protein, 5 aa, Staphylococcus aureus
NLGPL

SEQ ID NO: 1605741 - protein, 6 aa, Staphylococcus aureus
NLQHED

SEQ ID NO: 1605742 - protein, 6 aa, Staphylococcus aureus
NLRNDE

SEQ ID NO: 1605743 - protein, 4 aa, Staphylococcus aureus
NLSE

SEQ ID NO: 1605744 - protein, 5 aa, Staphylococcus aureus
NLSEP

SEQ ID NO: 1605745 - protein, 14 aa, Staphylococcus aureus
NMARTSQQPGKTQT

SEQ ID NO: 1605746 - protein, 9 aa, Staphylococcus aureus
NMDKQLEEY

SEQ ID NO: 1605747 - protein, 5 aa, Staphylococcus aureus
NMPPY

SEQ ID NO: 1605748 - protein, 4 aa, Staphylococcus aureus
NMRD

SEQ ID NO: 1605749 - protein, 5 aa, Staphylococcus aureus
NNDGI

SEQ ID NO: 1605750 - protein, 5 aa, Staphylococcus aureus
NNEGL

SEQ ID NO: 1605751 - protein, 5 aa, Staphylococcus aureus
NNEGV

SEQ ID NO: 1605752 - protein, 4 aa, Staphylococcus aureus
NNEN

SEQ ID NO: 1605753 - protein, 5 aa, Staphylococcus aureus
NNKFW

SEQ ID NO: 1605754 - protein, 10 aa, Staphylococcus aureus
NNKGDLNERV

SEQ ID NO: 1605755 - protein, 4 aa, Staphylococcus aureus
NNLP

SEQ ID NO: 1605756 - protein, 8 aa, Staphylococcus aureus
NNLSPTNT

SEQ ID NO: 1605757 - protein, 8 aa, Staphylococcus aureus
NNNESRVA

SEQ ID NO: 1605758 - protein, 4 aa, Staphylococcus aureus
NNNR

SEQ ID NO: 1605759 - protein, 7 aa, Staphylococcus aureus
NNNTERG

SEQ ID NO: 1605760 - protein, 5 aa, Staphylococcus aureus
NNPSH

SEQ ID NO: 1605761 - protein, 7 aa, Staphylococcus aureus
NNQQADA

SEQ ID NO: 1605762 - protein, 9 aa, Staphylococcus aureus
NNQTEQEMR

SEQ ID NO: 1605763 - protein, 7 aa, Staphylococcus aureus
NNSFNKD

SEQ ID NO: 1605764 - protein, 9 aa, Staphylococcus aureus
NNSKNKQSI

SEQ ID NO: 1605765 - protein, 5 aa, Staphylococcus aureus
NPATI

SEQ ID NO: 1605766 - protein, 5 aa, Staphylococcus aureus
NPAYE

SEQ ID NO: 1605767 - protein, 7 aa, Staphylococcus aureus
NPDNFPE

SEQ ID NO: 1605768 - protein, 8 aa, Staphylococcus aureus
NPENNEYP

SEQ ID NO: 1605769 - protein, 10 aa, Staphylococcus aureus
NPETTPGGRA

SEQ ID NO: 1605770 - protein, 8 aa, Staphylococcus aureus
NPGTPISQ

SEQ ID NO: 1605771 - protein, 4 aa, Staphylococcus aureus
NPHR

SEQ ID NO: 1605772 - protein, 6 aa, Staphylococcus aureus
NPIPGD

SEQ ID NO: 1605773 - protein, 7 aa, Staphylococcus aureus
NPKESDF

SEQ ID NO: 1605774 - protein, 11 aa, Staphylococcus aureus
NPKKDDQRELA

SEQ ID NO: 1605775 - protein, 5 aa, Staphylococcus aureus
NPQAT

SEQ ID NO: 1605776 - protein, 6 aa, Staphylococcus aureus
NPRIQT

SEQ ID NO: 1605777 - protein, 12 aa, Staphylococcus aureus
NPRNAAAGSLRQ

SEQ ID NO: 1605778 - protein, 8 aa, Staphylococcus aureus
NPRSSRTV

SEQ ID NO: 1605779 - protein, 12 aa, Staphylococcus aureus
NPTKSPSANAQY

SEQ ID NO: 1605780 - protein, 7 aa, Staphylococcus aureus
NPTPKTV

SEQ ID NO: 1605781 - protein, 12 aa, Staphylococcus aureus
NPYFSTDTTAAL

SEQ ID NO: 1605782 - protein, 6 aa, Staphylococcus aureus
NPYKPT

SEQ ID NO: 1605783 - protein, 13 aa, Staphylococcus aureus
NQDGYKSLEEGQA

SEQ ID NO: 1605784 - protein, 8 aa, Staphylococcus aureus
NQDYKTSK

SEQ ID NO: 1605785 - protein, 9 aa, Staphylococcus aureus
NQGTAEVPE

SEQ ID NO: 1605786 - protein, 6 aa, Staphylococcus aureus
NQKINY

SEQ ID NO: 1605787 - protein, 6 aa, Staphylococcus aureus
NQLPEP

SEQ ID NO: 1605788 - protein, 8 aa, Staphylococcus aureus
NQNSEDNM

SEQ ID NO: 1605789 - protein, 5 aa, Staphylococcus aureus
NQPEL

SEQ ID NO: 1605790 - protein, 5 aa, Staphylococcus aureus
NQPGI

SEQ ID NO: 1605791 - protein, 6 aa, Staphylococcus aureus
NQPIDE

SEQ ID NO: 1605792 - protein, 24 aa, Staphylococcus aureus
NQQTDYPSCGPDMPEYEPRGCPRG

SEQ ID NO: 1605793 - protein, 6 aa, Staphylococcus aureus
NQRQKN

SEQ ID NO: 1605794 - protein, 6 aa, Staphylococcus aureus
NQSLSK

SEQ ID NO: 1605795 - protein, 11 aa, Staphylococcus aureus
NQTGGFKTVSS

SEQ ID NO: 1605796 - protein, 8 aa, Staphylococcus aureus
NQTPDGKY

SEQ ID NO: 1605797 - protein, 9 aa, Staphylococcus aureus
NRESEHGNA

SEQ ID NO: 1605798 - protein, 16 aa, Staphylococcus aureus
NRGKKGYEVTNGPGKW

SEQ ID NO: 1605799 - protein, 9 aa, Staphylococcus aureus
NRKKRSKNI

SEQ ID NO: 1605800 - protein, 8 aa, Staphylococcus aureus
NRKTGANV

SEQ ID NO: 1605801 - protein, 4 aa, Staphylococcus aureus
NRLA

SEQ ID NO: 1605802 - protein, 5 aa, Staphylococcus aureus
NRPES

SEQ ID NO: 1605803 - protein, 4 aa, Staphylococcus aureus
NRRD

SEQ ID NO: 1605804 - protein, 8 aa, Staphylococcus aureus
NRSSEKTD

SEQ ID NO: 1605805 - protein, 6 aa, Staphylococcus aureus
NRTEVS

SEQ ID NO: 1605806 - protein, 11 aa, Staphylococcus aureus
NRTYRDKDKVT

SEQ ID NO: 1605807 - protein, 8 aa, Staphylococcus aureus
NRVNQQAL

SEQ ID NO: 1605808 - protein, 7 aa, Staphylococcus aureus
NRVSSEA

SEQ ID NO: 1605809 - protein, 7 aa, Staphylococcus aureus
NSDRTVG

SEQ ID NO: 1605810 - protein, 8 aa, Staphylococcus aureus
NSEQTEKL

SEQ ID NO: 1605811 - protein, 4 aa, Staphylococcus aureus
NSGG

SEQ ID NO: 1605812 - protein, 7 aa, Staphylococcus aureus
NSGRKGP

SEQ ID NO: 1605813 - protein, 10 aa, Staphylococcus aureus
NSKDDIGTGA

SEQ ID NO: 1605814 - protein, 5 aa, Staphylococcus aureus
NSKID

SEQ ID NO: 1605815 - protein, 7 aa, Staphylococcus aureus
NSLEDKR

SEQ ID NO: 1605816 - protein, 9 aa, Staphylococcus aureus
NSNIQGVDP

SEQ ID NO: 1605817 - protein, 6 aa, Staphylococcus aureus
NSPEYI

SEQ ID NO: 1605818 - protein, 9 aa, Staphylococcus aureus
NSRVARSNY

SEQ ID NO: 1605819 - protein, 21 aa, Staphylococcus aureus
NSRVDRQLRGRSGRQGDPGSS

SEQ ID NO: 1605820 - protein, 5 aa, Staphylococcus aureus
NSSMY

SEQ ID NO: 1605821 - protein, 7 aa, Staphylococcus aureus
NSTNKDE

SEQ ID NO: 1605822 - protein, 11 aa, Staphylococcus aureus
NSVGDVRGKGL

SEQ ID NO: 1605823 - protein, 5 aa, Staphylococcus aureus
NTEFD

SEQ ID NO: 1605824 - protein, 5 aa, Staphylococcus aureus
NTLNE

SEQ ID NO: 1605825 - protein, 9 aa, Staphylococcus aureus
NTNAQVGHS

SEQ ID NO: 1605826 - protein, 9 aa, Staphylococcus aureus
NTNRPQDKG

SEQ ID NO: 1605827 - protein, 8 aa, Staphylococcus aureus
NTPEEFSG

SEQ ID NO: 1605828 - protein, 9 aa, Staphylococcus aureus
NTPTEKDDV

SEQ ID NO: 1605829 - protein, 9 aa, Staphylococcus aureus
NTRSENRVA

SEQ ID NO: 1605830 - protein, 4 aa, Staphylococcus aureus
NTSE

SEQ ID NO: 1605831 - protein, 8 aa, Staphylococcus aureus
NTTDTEEI

SEQ ID NO: 1605832 - protein, 7 aa, Staphylococcus aureus
NTTGDGL

SEQ ID NO: 1605833 - protein, 14 aa, Staphylococcus aureus
NTTIPTSKSQIYST

SEQ ID NO: 1605834 - protein, 8 aa, Staphylococcus aureus
NTTKPETF

SEQ ID NO: 1605835 - protein, 10 aa, Staphylococcus aureus
NTTPKYYEKR

SEQ ID NO: 1605836 - protein, 10 aa, Staphylococcus aureus
NVDDSRVGDT

SEQ ID NO: 1605837 - protein, 8 aa, Staphylococcus aureus
NVDKDRAR

SEQ ID NO: 1605838 - protein, 6 aa, Staphylococcus aureus
NVESSE

SEQ ID NO: 1605839 - protein, 7 aa, Staphylococcus aureus
NVGEKGD

SEQ ID NO: 1605840 - protein, 5 aa, Staphylococcus aureus
NVHAQ

SEQ ID NO: 1605841 - protein, 4 aa, Staphylococcus aureus
NVKI

SEQ ID NO: 1605842 - protein, 10 aa, Staphylococcus aureus
NVKSQQQDHD

SEQ ID NO: 1605843 - protein, 9 aa, Staphylococcus aureus
NVNEKNGSI

SEQ ID NO: 1605844 - protein, 8 aa, Staphylococcus aureus
NVPGPKKG

SEQ ID NO: 1605845 - protein, 17 aa, Staphylococcus aureus
NVSADTRVKDLTDDELG

SEQ ID NO: 1605846 - protein, 5 aa, Staphylococcus aureus
NVTPV

SEQ ID NO: 1605847 - protein, 5 aa, Staphylococcus aureus
NYITS

SEQ ID NO: 1605848 - protein, 11 aa, Staphylococcus aureus
PAAEPERVKQE

SEQ ID NO: 1605849 - protein, 8 aa, Staphylococcus aureus
PAAPGTGV

SEQ ID NO: 1605850 - protein, 8 aa, Staphylococcus aureus
PADGNETR

SEQ ID NO: 1605851 - protein, 7 aa, Staphylococcus aureus
PAEDTPY

SEQ ID NO: 1605852 - protein, 8 aa, Staphylococcus aureus
PAKAEEKQ

SEQ ID NO: 1605853 - protein, 7 aa, Staphylococcus aureus
PALGPTF

SEQ ID NO: 1605854 - protein, 11 aa, Staphylococcus aureus
PAPDGDPEAPL

SEQ ID NO: 1605855 - protein, 6 aa, Staphylococcus aureus
PAQPGD

SEQ ID NO: 1605856 - protein, 8 aa, Staphylococcus aureus
PASESEEM

SEQ ID NO: 1605857 - protein, 11 aa, Staphylococcus aureus
PAVDQSVQSLK

SEQ ID NO: 1605858 - protein, 6 aa, Staphylococcus aureus
PDCRNT

SEQ ID NO: 1605859 - protein, 4 aa, Staphylococcus aureus
PDDP

SEQ ID NO: 1605860 - protein, 17 aa, Staphylococcus aureus
PDGEYTTATLGTDIQNG

SEQ ID NO: 1605861 - protein, 18 aa, Staphylococcus aureus
PDGSDNPDFNPNKPQYKG

SEQ ID NO: 1605862 - protein, 4 aa, Staphylococcus aureus
PDSD

SEQ ID NO: 1605863 - protein, 10 aa, Staphylococcus aureus
PDTVGMPSAN

SEQ ID NO: 1605864 - protein, 6 aa, Staphylococcus aureus
PDVKEN

SEQ ID NO: 1605865 - protein, 11 aa, Staphylococcus aureus
PEANPGPSDSN

SEQ ID NO: 1605866 - protein, 6 aa, Staphylococcus aureus
PEAYAR

SEQ ID NO: 1605867 - protein, 8 aa, Staphylococcus aureus
PEGGSNKV

SEQ ID NO: 1605868 - protein, 8 aa, Staphylococcus aureus
PEGRNTNE

SEQ ID NO: 1605869 - protein, 4 aa, Staphylococcus aureus
PEGY

SEQ ID NO: 1605870 - protein, 8 aa, Staphylococcus aureus
PEKSGTYG

SEQ ID NO: 1605871 - protein, 5 aa, Staphylococcus aureus
PEQLA

SEQ ID NO: 1605872 - protein, 11 aa, Staphylococcus aureus
PERNRSIAKNP

SEQ ID NO: 1605873 - protein, 12 aa, Staphylococcus aureus
PESKEEATKIKP

SEQ ID NO: 1605874 - protein, 8 aa, Staphylococcus aureus
PESLGVTE

SEQ ID NO: 1605875 - protein, 8 aa, Staphylococcus aureus
PETTGTIN

SEQ ID NO: 1605876 - protein, 11 aa, Staphylococcus aureus
PEYDDVEDATT

SEQ ID NO: 1605877 - protein, 9 aa, Staphylococcus aureus
PFDEAYESI

SEQ ID NO: 1605878 - protein, 15 aa, Staphylococcus aureus
PFGGPAGGDGGKGAS

SEQ ID NO: 1605879 - protein, 15 aa, Staphylococcus aureus
PFGSDLKSAEALNNQ

SEQ ID NO: 1605880 - protein, 24 aa, Staphylococcus aureus
PFTSPKEADIAKLGTAPEEAEANA

SEQ ID NO: 1605881 - protein, 4 aa, Staphylococcus aureus
PGAR

SEQ ID NO: 1605882 - protein, 10 aa, Staphylococcus aureus
PGAVPRTSTL

SEQ ID NO: 1605883 - protein, 9 aa, Staphylococcus aureus
PGDEEESYQ

SEQ ID NO: 1605884 - protein, 8 aa, Staphylococcus aureus
PGDPKEIG

SEQ ID NO: 1605885 - protein, 6 aa, Staphylococcus aureus
PGFGGQ

SEQ ID NO: 1605886 - protein, 11 aa, Staphylococcus aureus
PGITEKDAEDI

SEQ ID NO: 1605887 - protein, 8 aa, Staphylococcus aureus
PGKNDEVQ

SEQ ID NO: 1605888 - protein, 13 aa, Staphylococcus aureus
PGRSFDKAKEDGF

SEQ ID NO: 1605889 - protein, 7 aa, Staphylococcus aureus
PGRSNAF

SEQ ID NO: 1605890 - protein, 14 aa, Staphylococcus aureus
PGSNKQGRRYSPFT

SEQ ID NO: 1605891 - protein, 11 aa, Staphylococcus aureus
PGTHGSTFGGN

SEQ ID NO: 1605892 - protein, 12 aa, Staphylococcus aureus
PGTIDNDINGTD

SEQ ID NO: 1605893 - protein, 4 aa, Staphylococcus aureus
PHDF

SEQ ID NO: 1605894 - protein, 11 aa, Staphylococcus aureus
PHGTDEAKTNV

SEQ ID NO: 1605895 - protein, 10 aa, Staphylococcus aureus
PHNPSGKQFD

SEQ ID NO: 1605896 - protein, 4 aa, Staphylococcus aureus
PHRS

SEQ ID NO: 1605897 - protein, 10 aa, Staphylococcus aureus
PIEKNLPPKL

SEQ ID NO: 1605898 - protein, 5 aa, Staphylococcus aureus
PIEST

SEQ ID NO: 1605899 - protein, 5 aa, Staphylococcus aureus
PIPER

SEQ ID NO: 1605900 - protein, 4 aa, Staphylococcus aureus
PIPR

SEQ ID NO: 1605901 - protein, 5 aa, Staphylococcus aureus
PIQQV

SEQ ID NO: 1605902 - protein, 4 aa, Staphylococcus aureus
PIQS

SEQ ID NO: 1605903 - protein, 4 aa, Staphylococcus aureus
PIRI

SEQ ID NO: 1605904 - protein, 7 aa, Staphylococcus aureus
PKARTAL

SEQ ID NO: 1605905 - protein, 6 aa, Staphylococcus aureus
PKDKPR

SEQ ID NO: 1605906 - protein, 4 aa, Staphylococcus aureus
PKDQ

SEQ ID NO: 1605907 - protein, 7 aa, Staphylococcus aureus
PKEEGTI

SEQ ID NO: 1605908 - protein, 7 aa, Staphylococcus aureus
PKENIAK

SEQ ID NO: 1605909 - protein, 8 aa, Staphylococcus aureus
PKESVNKA

SEQ ID NO: 1605910 - protein, 16 aa, Staphylococcus aureus
PKGDKSIVTKPDTTIQ

SEQ ID NO: 1605911 - protein, 4 aa, Staphylococcus aureus
PKGH

SEQ ID NO: 1605912 - protein, 20 aa, Staphylococcus aureus
PKGIVSTKSKVIKKAKSLNT

SEQ ID NO: 1605913 - protein, 6 aa, Staphylococcus aureus
PKGPGH

SEQ ID NO: 1605914 - protein, 4 aa, Staphylococcus aureus
PKHD

SEQ ID NO: 1605915 - protein, 7 aa, Staphylococcus aureus
PKHPYTQ

SEQ ID NO: 1605916 - protein, 6 aa, Staphylococcus aureus
PKMPNT

SEQ ID NO: 1605917 - protein, 9 aa, Staphylococcus aureus
PKSNSAMSA

SEQ ID NO: 1605918 - protein, 6 aa, Staphylococcus aureus
PKTFTR

SEQ ID NO: 1605919 - protein, 16 aa, Staphylococcus aureus
PKTPEERQKLKQPRSS

SEQ ID NO: 1605920 - protein, 12 aa, Staphylococcus aureus
PLAGTTDDQADA

SEQ ID NO: 1605921 - protein, 8 aa, Staphylococcus aureus
PLDESLES

SEQ ID NO: 1605922 - protein, 12 aa, Staphylococcus aureus
PLDGSPAVTPRN

SEQ ID NO: 1605923 - protein, 15 aa, Staphylococcus aureus
PLKGEIEVPGDKSMT

SEQ ID NO: 1605924 - protein, 9 aa, Staphylococcus aureus
PLPEKSSFT

SEQ ID NO: 1605925 - protein, 15 aa, Staphylococcus aureus
PLPNGGEMNVKIVNI

SEQ ID NO: 1605926 - protein, 6 aa, Staphylococcus aureus
PLPNGS

SEQ ID NO: 1605927 - protein, 7 aa, Staphylococcus aureus
PLTPDLN

SEQ ID NO: 1605928 - protein, 10 aa, Staphylococcus aureus
PLTTPIGGGI

SEQ ID NO: 1605929 - protein, 5 aa, Staphylococcus aureus
PMGEG

SEQ ID NO: 1605930 - protein, 9 aa, Staphylococcus aureus
PNAAPLPGK

SEQ ID NO: 1605931 - protein, 8 aa, Staphylococcus aureus
PNAKPPVA

SEQ ID NO: 1605932 - protein, 5 aa, Staphylococcus aureus
PNCST

SEQ ID NO: 1605933 - protein, 4 aa, Staphylococcus aureus
PNFK

SEQ ID NO: 1605934 - protein, 4 aa, Staphylococcus aureus
PNFS

SEQ ID NO: 1605935 - protein, 6 aa, Staphylococcus aureus
PNGESF

SEQ ID NO: 1605936 - protein, 7 aa, Staphylococcus aureus
PNGIGKS

SEQ ID NO: 1605937 - protein, 8 aa, Staphylococcus aureus
PNHAPTSD

SEQ ID NO: 1605938 - protein, 7 aa, Staphylococcus aureus
PNKENNH

SEQ ID NO: 1605939 - protein, 9 aa, Staphylococcus aureus
PNKGEPLKS

SEQ ID NO: 1605940 - protein, 9 aa, Staphylococcus aureus
PNMSGKSTY

SEQ ID NO: 1605941 - protein, 13 aa, Staphylococcus aureus
PNNPTGSTATKEV

SEQ ID NO: 1605942 - protein, 29 aa, Staphylococcus aureus
PNPEIIPDDAKAAGARVVGTGRSDYPNQI

SEQ ID NO: 1605943 - protein, 8 aa, Staphylococcus aureus
PNPENEET

SEQ ID NO: 1605944 - protein, 7 aa, Staphylococcus aureus
PNPFPKS

SEQ ID NO: 1605945 - protein, 5 aa, Staphylococcus aureus
PNPSM

SEQ ID NO: 1605946 - protein, 12 aa, Staphylococcus aureus
PNQPGAVPRTST

SEQ ID NO: 1605947 - protein, 7 aa, Staphylococcus aureus
PNQTYAK

SEQ ID NO: 1605948 - protein, 10 aa, Staphylococcus aureus
PNSEEKGTVV

SEQ ID NO: 1605949 - protein, 7 aa, Staphylococcus aureus
PNVEAGQ

SEQ ID NO: 1605950 - protein, 6 aa, Staphylococcus aureus
PNVGKS

SEQ ID NO: 1605951 - protein, 5 aa, Staphylococcus aureus
PNVKA

SEQ ID NO: 1605952 - protein, 5 aa, Staphylococcus aureus
PNVVA

SEQ ID NO: 1605953 - protein, 6 aa, Staphylococcus aureus
PNYDGA

SEQ ID NO: 1605954 - protein, 4 aa, Staphylococcus aureus
PNYG

SEQ ID NO: 1605955 - protein, 4 aa, Staphylococcus aureus
PPAD

SEQ ID NO: 1605956 - protein, 8 aa, Staphylococcus aureus
PPGIGKTS

SEQ ID NO: 1605957 - protein, 7 aa, Staphylococcus aureus
PPGTGDV

SEQ ID NO: 1605958 - protein, 5 aa, Staphylococcus aureus
PPMKG

SEQ ID NO: 1605959 - protein, 4 aa, Staphylococcus aureus
PPMP

SEQ ID NO: 1605960 - protein, 17 aa, Staphylococcus aureus
PPNLKEAKKRGKQEVRY

SEQ ID NO: 1605961 - protein, 6 aa, Staphylococcus aureus
PPREYS

SEQ ID NO: 1605962 - protein, 8 aa, Staphylococcus aureus
PPRKGCDE

SEQ ID NO: 1605963 - protein, 17 aa, Staphylococcus aureus
PPSGRTLSGGLDPASLH

SEQ ID NO: 1605964 - protein, 9 aa, Staphylococcus aureus
PQAENKKSS

SEQ ID NO: 1605965 - protein, 9 aa, Staphylococcus aureus
PQDDNRDGV

SEQ ID NO: 1605966 - protein, 8 aa, Staphylococcus aureus
PQDLNDSP

SEQ ID NO: 1605967 - protein, 7 aa, Staphylococcus aureus
PQFTTQR

SEQ ID NO: 1605968 - protein, 8 aa, Staphylococcus aureus
PQRKGEPI

SEQ ID NO: 1605969 - protein, 5 aa, Staphylococcus aureus
PQSPQ

SEQ ID NO: 1605970 - protein, 5 aa, Staphylococcus aureus
PRTAG

SEQ ID NO: 1605971 - protein, 6 aa, Staphylococcus aureus
PRVEGG

SEQ ID NO: 1605972 - protein, 18 aa, Staphylococcus aureus
PRVSRSSALASKATGYPI

SEQ ID NO: 1605973 - protein, 9 aa, Staphylococcus aureus
PSAKQVEAA

SEQ ID NO: 1605974 - protein, 20 aa, Staphylococcus aureus
PSCKTKKNVQRKTNARCPNC

SEQ ID NO: 1605975 - protein, 18 aa, Staphylococcus aureus
PSDKKRMMDRKKHSKVNV

SEQ ID NO: 1605976 - protein, 6 aa, Staphylococcus aureus
PSGTEP

SEQ ID NO: 1605977 - protein, 6 aa, Staphylococcus aureus
PSLTAT

SEQ ID NO: 1605978 - protein, 7 aa, Staphylococcus aureus
PSPGHYT

SEQ ID NO: 1605979 - protein, 5 aa, Staphylococcus aureus
PSQEG

SEQ ID NO: 1605980 - protein, 9 aa, Staphylococcus aureus
PSSFNSQST

SEQ ID NO: 1605981 - protein, 8 aa, Staphylococcus aureus
PSSPAHDL

SEQ ID NO: 1605982 - protein, 11 aa, Staphylococcus aureus
PSSPVPTTSNT

SEQ ID NO: 1605983 - protein, 9 aa, Staphylococcus aureus
PSSRTDRGV

SEQ ID NO: 1605984 - protein, 11 aa, Staphylococcus aureus
PSTRLGEKQGK

SEQ ID NO: 1605985 - protein, 9 aa, Staphylococcus aureus
PSVGGPAKG

SEQ ID NO: 1605986 - protein, 9 aa, Staphylococcus aureus
PSYSPETIA

SEQ ID NO: 1605987 - protein, 15 aa, Staphylococcus aureus
PTCTQQDVKAAEELK

SEQ ID NO: 1605988 - protein, 9 aa, Staphylococcus aureus
PTETESKET

SEQ ID NO: 1605989 - protein, 20 aa, Staphylococcus aureus
PTGNGDVIDGAREQWNDGSN

SEQ ID NO: 1605990 - protein, 7 aa, Staphylococcus aureus
PTGSGKS

SEQ ID NO: 1605991 - protein, 10 aa, Staphylococcus aureus
PTGSMTKDER

SEQ ID NO: 1605992 - protein, 19 aa, Staphylococcus aureus
PTGSRTSQEGAPLKRGAST

SEQ ID NO: 1605993 - protein, 11 aa, Staphylococcus aureus
PTGTVSGAPKL

SEQ ID NO: 1605994 - protein, 11 aa, Staphylococcus aureus
PTNGMDPDGSI

SEQ ID NO: 1605995 - protein, 10 aa, Staphylococcus aureus
PTPDKAEDNA

SEQ ID NO: 1605996 - protein, 4 aa, Staphylococcus aureus
PTRI

SEQ ID NO: 1605997 - protein, 8 aa, Staphylococcus aureus
PTSALDPE

SEQ ID NO: 1605998 - protein, 9 aa, Staphylococcus aureus
PTSALDPEV

SEQ ID NO: 1605999 - protein, 7 aa, Staphylococcus aureus
PTTAGEI

SEQ ID NO: 1606000 - protein, 12 aa, Staphylococcus aureus
PVGSGDSTVAGI

SEQ ID NO: 1606001 - protein, 10 aa, Staphylococcus aureus
PVKNGADKFK

SEQ ID NO: 1606002 - protein, 5 aa, Staphylococcus aureus
PVKPE

SEQ ID NO: 1606003 - protein, 10 aa, Staphylococcus aureus
PVNPPKRKHV

SEQ ID NO: 1606004 - protein, 11 aa, Staphylococcus aureus
PVPDGDTGTNM

SEQ ID NO: 1606005 - protein, 7 aa, Staphylococcus aureus
PVYTTSS

SEQ ID NO: 1606006 - protein, 20 aa, Staphylococcus aureus
PWGGYKQSGIGRELGKEGLE

SEQ ID NO: 1606007 - protein, 4 aa, Staphylococcus aureus
PWPT

SEQ ID NO: 1606008 - protein, 12 aa, Staphylococcus aureus
PYLSDSVDNHTE

SEQ ID NO: 1606009 - protein, 10 aa, Staphylococcus aureus
PYQPEISQGE

SEQ ID NO: 1606010 - protein, 4 aa, Staphylococcus aureus
PYTE

SEQ ID NO: 1606011 - protein, 6 aa, Staphylococcus aureus
QAASIV

SEQ ID NO: 1606012 - protein, 10 aa, Staphylococcus aureus
QAEDQSNVTI

SEQ ID NO: 1606013 - protein, 6 aa, Staphylococcus aureus
QAFKKK

SEQ ID NO: 1606014 - protein, 8 aa, Staphylococcus aureus
QAKAEGMK

SEQ ID NO: 1606015 - protein, 7 aa, Staphylococcus aureus
QAKDNSL

SEQ ID NO: 1606016 - protein, 18 aa, Staphylococcus aureus
QANEGEKMTTLDDTEREL

SEQ ID NO: 1606017 - protein, 5 aa, Staphylococcus aureus
QAPAR

SEQ ID NO: 1606018 - protein, 8 aa, Staphylococcus aureus
QAQSPQDI

SEQ ID NO: 1606019 - protein, 10 aa, Staphylococcus aureus
QAREDDIKEK

SEQ ID NO: 1606020 - protein, 20 aa, Staphylococcus aureus
QARNEIESAGYEQLTTAEDV

SEQ ID NO: 1606021 - protein, 6 aa, Staphylococcus aureus
QASEDE

SEQ ID NO: 1606022 - protein, 10 aa, Staphylococcus aureus
QASSIDDELD

SEQ ID NO: 1606023 - protein, 8 aa, Staphylococcus aureus
QATEAIPN

SEQ ID NO: 1606024 - protein, 9 aa, Staphylococcus aureus
QATKQAPNY

SEQ ID NO: 1606025 - protein, 9 aa, Staphylococcus aureus
QATNEGKLK

SEQ ID NO: 1606026 - protein, 7 aa, Staphylococcus aureus
QATVSRD

SEQ ID NO: 1606027 - protein, 7 aa, Staphylococcus aureus
QDAADED

SEQ ID NO: 1606028 - protein, 8 aa, Staphylococcus aureus
QDATPIKL

SEQ ID NO: 1606029 - protein, 7 aa, Staphylococcus aureus
QDDAAGT

SEQ ID NO: 1606030 - protein, 6 aa, Staphylococcus aureus
QDEAAE

SEQ ID NO: 1606031 - protein, 11 aa, Staphylococcus aureus
QDEGYDVEKDH

SEQ ID NO: 1606032 - protein, 6 aa, Staphylococcus aureus
QDFEKR

SEQ ID NO: 1606033 - protein, 15 aa, Staphylococcus aureus
QDGEQIGVKSKREAL

SEQ ID NO: 1606034 - protein, 8 aa, Staphylococcus aureus
QDGERQSK

SEQ ID NO: 1606035 - protein, 4 aa, Staphylococcus aureus
QDIT

SEQ ID NO: 1606036 - protein, 13 aa, Staphylococcus aureus
QDKNNNSKPLRPE

SEQ ID NO: 1606037 - protein, 17 aa, Staphylococcus aureus
QDLGSREGIAKAKSEIT

SEQ ID NO: 1606038 - protein, 9 aa, Staphylococcus aureus
QDPSSVPED

SEQ ID NO: 1606039 - protein, 9 aa, Staphylococcus aureus
QDQAIAKED

SEQ ID NO: 1606040 - protein, 6 aa, Staphylococcus aureus
QDTIEN

SEQ ID NO: 1606041 - protein, 8 aa, Staphylococcus aureus
QDTKPEDI

SEQ ID NO: 1606042 - protein, 16 aa, Staphylococcus aureus
QDTPGVDSNVASHQSI

SEQ ID NO: 1606043 - protein, 10 aa, Staphylococcus aureus
QDVERAEEEM

SEQ ID NO: 1606044 - protein, 7 aa, Staphylococcus aureus
QEAQTGY

SEQ ID NO: 1606045 - protein, 6 aa, Staphylococcus aureus
QEDGYS

SEQ ID NO: 1606046 - protein, 6 aa, Staphylococcus aureus
QEENTI

SEQ ID NO: 1606047 - protein, 8 aa, Staphylococcus aureus
QEEPKNQG

SEQ ID NO: 1606048 - protein, 5 aa, Staphylococcus aureus
QEESV

SEQ ID NO: 1606049 - protein, 16 aa, Staphylococcus aureus
QEEVGLRGAKASAEMI

SEQ ID NO: 1606050 - protein, 4 aa, Staphylococcus aureus
QEGE

SEQ ID NO: 1606051 - protein, 4 aa, Staphylococcus aureus
QEGI

SEQ ID NO: 1606052 - protein, 8 aa, Staphylococcus aureus
QEKAKKSL

SEQ ID NO: 1606053 - protein, 8 aa, Staphylococcus aureus
QEKTNRRV

SEQ ID NO: 1606054 - protein, 9 aa, Staphylococcus aureus
QELGKSPAQ

SEQ ID NO: 1606055 - protein, 10 aa, Staphylococcus aureus
QENAEYKGMG

SEQ ID NO: 1606056 - protein, 9 aa, Staphylococcus aureus
QENGTEPPF

SEQ ID NO: 1606057 - protein, 6 aa, Staphylococcus aureus
QENHAS

SEQ ID NO: 1606058 - protein, 11 aa, Staphylococcus aureus
QENPELPRPVG

SEQ ID NO: 1606059 - protein, 5 aa, Staphylococcus aureus
QENPI

SEQ ID NO: 1606060 - protein, 5 aa, Staphylococcus aureus
QEQPG

SEQ ID NO: 1606061 - protein, 7 aa, Staphylococcus aureus
QERGISV

SEQ ID NO: 1606062 - protein, 4 aa, Staphylococcus aureus
QERH

SEQ ID NO: 1606063 - protein, 6 aa, Staphylococcus aureus
QERPTT

SEQ ID NO: 1606064 - protein, 9 aa, Staphylococcus aureus
QESKQDVQY

SEQ ID NO: 1606065 - protein, 4 aa, Staphylococcus aureus
QETA

SEQ ID NO: 1606066 - protein, 9 aa, Staphylococcus aureus
QEVNLTPKE

SEQ ID NO: 1606067 - protein, 10 aa, Staphylococcus aureus
QEYESQQAEI

SEQ ID NO: 1606068 - protein, 14 aa, Staphylococcus aureus
QFGKDGNEGEVPFK

SEQ ID NO: 1606069 - protein, 4 aa, Staphylococcus aureus
QFSQ

SEQ ID NO: 1606070 - protein, 5 aa, Staphylococcus aureus
QGDKF

SEQ ID NO: 1606071 - protein, 6 aa, Staphylococcus aureus
QGDTTG

SEQ ID NO: 1606072 - protein, 9 aa, Staphylococcus aureus
QGEKAKDDI

SEQ ID NO: 1606073 - protein, 7 aa, Staphylococcus aureus
QGGNTQS

SEQ ID NO: 1606074 - protein, 15 aa, Staphylococcus aureus
QGHTEKWNEHNQSKY

SEQ ID NO: 1606075 - protein, 6 aa, Staphylococcus aureus
QGIEAQ

SEQ ID NO: 1606076 - protein, 5 aa, Staphylococcus aureus
QGIKP

SEQ ID NO: 1606077 - protein, 4 aa, Staphylococcus aureus
QGLN

SEQ ID NO: 1606078 - protein, 7 aa, Staphylococcus aureus
QGNPSLR

SEQ ID NO: 1606079 - protein, 16 aa, Staphylococcus aureus
QGPRRGDGAESVIIEL

SEQ ID NO: 1606080 - protein, 8 aa, Staphylococcus aureus
QGQSAKSI

SEQ ID NO: 1606081 - protein, 10 aa, Staphylococcus aureus
QGQTGVNPPV

SEQ ID NO: 1606082 - protein, 4 aa, Staphylococcus aureus
QGRI

SEQ ID NO: 1606083 - protein, 7 aa, Staphylococcus aureus
QGRIEED

SEQ ID NO: 1606084 - protein, 4 aa, Staphylococcus aureus
QGYR

SEQ ID NO: 1606085 - protein, 15 aa, Staphylococcus aureus
QHRPKTTGRSKGGNY

SEQ ID NO: 1606086 - protein, 9 aa, Staphylococcus aureus
QHTDNEVEE

SEQ ID NO: 1606087 - protein, 6 aa, Staphylococcus aureus
QIDGKN

SEQ ID NO: 1606088 - protein, 5 aa, Staphylococcus aureus
QIECE

SEQ ID NO: 1606089 - protein, 7 aa, Staphylococcus aureus
QINPLDN

SEQ ID NO: 1606090 - protein, 4 aa, Staphylococcus aureus
QIPT

SEQ ID NO: 1606091 - protein, 9 aa, Staphylococcus aureus
QIRTKNGQN

SEQ ID NO: 1606092 - protein, 10 aa, Staphylococcus aureus
QITKDAGREE

SEQ ID NO: 1606093 - protein, 11 aa, Staphylococcus aureus
QITPEEAFTHP

SEQ ID NO: 1606094 - protein, 15 aa, Staphylococcus aureus
QKAFGGGKGANQAIA

SEQ ID NO: 1606095 - protein, 8 aa, Staphylococcus aureus
QKDEEGRF

SEQ ID NO: 1606096 - protein, 4 aa, Staphylococcus aureus
QKET

SEQ ID NO: 1606097 - protein, 10 aa, Staphylococcus aureus
QKGNEKARER

SEQ ID NO: 1606098 - protein, 9 aa, Staphylococcus aureus
QKGYSGQQI

SEQ ID NO: 1606099 - protein, 22 aa, Staphylococcus aureus
QKIRQNAKVNVERAQEIEQETR

SEQ ID NO: 1606100 - protein, 17 aa, Staphylococcus aureus
QKKSLVQDEATAKANEK

SEQ ID NO: 1606101 - protein, 13 aa, Staphylococcus aureus
QKMPGRMGGNTVT

SEQ ID NO: 1606102 - protein, 10 aa, Staphylococcus aureus
QKQDSEQKLE

SEQ ID NO: 1606103 - protein, 6 aa, Staphylococcus aureus
QKRYKD

SEQ ID NO: 1606104 - protein, 14 aa, Staphylococcus aureus
QKSAEESTKTGRPI

SEQ ID NO: 1606105 - protein, 10 aa, Staphylococcus aureus
QKTETREVEE

SEQ ID NO: 1606106 - protein, 6 aa, Staphylococcus aureus
QKVSGD

SEQ ID NO: 1606107 - protein, 7 aa, Staphylococcus aureus
QKYKPTV

SEQ ID NO: 1606108 - protein, 10 aa, Staphylococcus aureus
QLAPGTEGGF

SEQ ID NO: 1606109 - protein, 11 aa, Staphylococcus aureus
QLASEGDTVEV

SEQ ID NO: 1606110 - protein, 22 aa, Staphylococcus aureus
QLDELAKQQEQDDSESRQVDPR

SEQ ID NO: 1606111 - protein, 10 aa, Staphylococcus aureus
QLETEKSYSY

SEQ ID NO: 1606112 - protein, 13 aa, Staphylococcus aureus
QLGPKEDDVELQK

SEQ ID NO: 1606113 - protein, 11 aa, Staphylococcus aureus
QLHTPRRNQPR

SEQ ID NO: 1606114 - protein, 6 aa, Staphylococcus aureus
QLNENQ

SEQ ID NO: 1606115 - protein, 5 aa, Staphylococcus aureus
QLPPS

SEQ ID NO: 1606116 - protein, 7 aa, Staphylococcus aureus
QLQDEEK

SEQ ID NO: 1606117 - protein, 7 aa, Staphylococcus aureus
QLSNNEG

SEQ ID NO: 1606118 - protein, 10 aa, Staphylococcus aureus
QLSSDRSDDQ

SEQ ID NO: 1606119 - protein, 5 aa, Staphylococcus aureus
QLTKE

SEQ ID NO: 1606120 - protein, 4 aa, Staphylococcus aureus
QLTN

SEQ ID NO: 1606121 - protein, 11 aa, Staphylococcus aureus
QMYEDKEELPD

SEQ ID NO: 1606122 - protein, 7 aa, Staphylococcus aureus
QNDAKRK

SEQ ID NO: 1606123 - protein, 9 aa, Staphylococcus aureus
QNDGVNDGD

SEQ ID NO: 1606124 - protein, 5 aa, Staphylococcus aureus
QNDKY

SEQ ID NO: 1606125 - protein, 14 aa, Staphylococcus aureus
QNEPIGKGNDGEDV

SEQ ID NO: 1606126 - protein, 6 aa, Staphylococcus aureus
QNFEPS

SEQ ID NO: 1606127 - protein, 5 aa, Staphylococcus aureus
QNGNF

SEQ ID NO: 1606128 - protein, 8 aa, Staphylococcus aureus
QNGRTVQQ

SEQ ID NO: 1606129 - protein, 11 aa, Staphylococcus aureus
QNISSDDFEQI

SEQ ID NO: 1606130 - protein, 9 aa, Staphylococcus aureus
QNKGKDTGA

SEQ ID NO: 1606131 - protein, 6 aa, Staphylococcus aureus
QNNNYY

SEQ ID NO: 1606132 - protein, 17 aa, Staphylococcus aureus
QNPNKKDDMTILIIKRV

SEQ ID NO: 1606133 - protein, 4 aa, Staphylococcus aureus
QNSS

SEQ ID NO: 1606134 - protein, 13 aa, Staphylococcus aureus
QPDASTHTFTAPE

SEQ ID NO: 1606135 - protein, 9 aa, Staphylococcus aureus
QPDHGEQGL

SEQ ID NO: 1606136 - protein, 8 aa, Staphylococcus aureus
QPDRPVGR

SEQ ID NO: 1606137 - protein, 11 aa, Staphylococcus aureus
QPEKLSGSEEL

SEQ ID NO: 1606138 - protein, 5 aa, Staphylococcus aureus
QPELT

SEQ ID NO: 1606139 - protein, 6 aa, Staphylococcus aureus
QPFNPE

SEQ ID NO: 1606140 - protein, 27 aa, Staphylococcus aureus
QPFSEGDEVKISKTNIREHETTPPEYF

SEQ ID NO: 1606141 - protein, 6 aa, Staphylococcus aureus
QPLSRS

SEQ ID NO: 1606142 - protein, 6 aa, Staphylococcus aureus
QPNSFK

SEQ ID NO: 1606143 - protein, 7 aa, Staphylococcus aureus
QPQTSIS

SEQ ID NO: 1606144 - protein, 9 aa, Staphylococcus aureus
QPRNVTKKQ

SEQ ID NO: 1606145 - protein, 5 aa, Staphylococcus aureus
QPVSN

SEQ ID NO: 1606146 - protein, 6 aa, Staphylococcus aureus
QPYGNV

SEQ ID NO: 1606147 - protein, 6 aa, Staphylococcus aureus
QQAIKQ

SEQ ID NO: 1606148 - protein, 4 aa, Staphylococcus aureus
QQAR

SEQ ID NO: 1606149 - protein, 8 aa, Staphylococcus aureus
QQDDHYDL

SEQ ID NO: 1606150 - protein, 5 aa, Staphylococcus aureus
QQEEQ

SEQ ID NO: 1606151 - protein, 7 aa, Staphylococcus aureus
QQFDQNA

SEQ ID NO: 1606152 - protein, 4 aa, Staphylococcus aureus
QQGL

SEQ ID NO: 1606153 - protein, 7 aa, Staphylococcus aureus
QQLPEDD

SEQ ID NO: 1606154 - protein, 8 aa, Staphylococcus aureus
QQNKGDVT

SEQ ID NO: 1606155 - protein, 6 aa, Staphylococcus aureus
QQPIAS

SEQ ID NO: 1606156 - protein, 7 aa, Staphylococcus aureus
QQQNQNY

SEQ ID NO: 1606157 - protein, 6 aa, Staphylococcus aureus
QQREPD

SEQ ID NO: 1606158 - protein, 10 aa, Staphylococcus aureus
QQRQESKNVS

SEQ ID NO: 1606159 - protein, 7 aa, Staphylococcus aureus
QQSRQKL

SEQ ID NO: 1606160 - protein, 6 aa, Staphylococcus aureus
QQTLEG

SEQ ID NO: 1606161 - protein, 7 aa, Staphylococcus aureus
QRELEEE

SEQ ID NO: 1606162 - protein, 17 aa, Staphylococcus aureus
QRGGPSTGLPTKQEQSD

SEQ ID NO: 1606163 - protein, 11 aa, Staphylococcus aureus
QRGGSPTGADR

SEQ ID NO: 1606164 - protein, 7 aa, Staphylococcus aureus
QRGSGRK

SEQ ID NO: 1606165 - protein, 5 aa, Staphylococcus aureus
QRGSL

SEQ ID NO: 1606166 - protein, 6 aa, Staphylococcus aureus
QRNDAC

SEQ ID NO: 1606167 - protein, 15 aa, Staphylococcus aureus
QRNPRATRAEASDVA

SEQ ID NO: 1606168 - protein, 5 aa, Staphylococcus aureus
QRPGA

SEQ ID NO: 1606169 - protein, 10 aa, Staphylococcus aureus
QSADNQTAVQ

SEQ ID NO: 1606170 - protein, 6 aa, Staphylococcus aureus
QSDRMG

SEQ ID NO: 1606171 - protein, 11 aa, Staphylococcus aureus
QSEAVKTTEGP

SEQ ID NO: 1606172 - protein, 4 aa, Staphylococcus aureus
QSED

SEQ ID NO: 1606173 - protein, 5 aa, Staphylococcus aureus
QSGNN

SEQ ID NO: 1606174 - protein, 7 aa, Staphylococcus aureus
QSGSDTV

SEQ ID NO: 1606175 - protein, 4 aa, Staphylococcus aureus
QSGY

SEQ ID NO: 1606176 - protein, 7 aa, Staphylococcus aureus
QSHGADT

SEQ ID NO: 1606177 - protein, 6 aa, Staphylococcus aureus
QSILDN

SEQ ID NO: 1606178 - protein, 11 aa, Staphylococcus aureus
QSKDVGPIGDT

SEQ ID NO: 1606179 - protein, 6 aa, Staphylococcus aureus
QSLNQE

SEQ ID NO: 1606180 - protein, 6 aa, Staphylococcus aureus
QSLSEL

SEQ ID NO: 1606181 - protein, 7 aa, Staphylococcus aureus
QSLTTKN

SEQ ID NO: 1606182 - protein, 4 aa, Staphylococcus aureus
QSPF

SEQ ID NO: 1606183 - protein, 9 aa, Staphylococcus aureus
QSTRKSYEQ

SEQ ID NO: 1606184 - protein, 5 aa, Staphylococcus aureus
QSYNK

SEQ ID NO: 1606185 - protein, 4 aa, Staphylococcus aureus
QSYT

SEQ ID NO: 1606186 - protein, 5 aa, Staphylococcus aureus
QTDAY

SEQ ID NO: 1606187 - protein, 8 aa, Staphylococcus aureus
QTDEQGIE

SEQ ID NO: 1606188 - protein, 5 aa, Staphylococcus aureus
QTEDE

SEQ ID NO: 1606189 - protein, 6 aa, Staphylococcus aureus
QTEEEE

SEQ ID NO: 1606190 - protein, 11 aa, Staphylococcus aureus
QTEERQDGTFP

SEQ ID NO: 1606191 - protein, 4 aa, Staphylococcus aureus
QTHL

SEQ ID NO: 1606192 - protein, 9 aa, Staphylococcus aureus
QTHQGHGTD

SEQ ID NO: 1606193 - protein, 6 aa, Staphylococcus aureus
QTIGGY

SEQ ID NO: 1606194 - protein, 5 aa, Staphylococcus aureus
QTISS

SEQ ID NO: 1606195 - protein, 7 aa, Staphylococcus aureus
QTKKNKI

SEQ ID NO: 1606196 - protein, 9 aa, Staphylococcus aureus
QTRPPRPLN

SEQ ID NO: 1606197 - protein, 9 aa, Staphylococcus aureus
QTRQKTGLK

SEQ ID NO: 1606198 - protein, 7 aa, Staphylococcus aureus
QTSDSNV

SEQ ID NO: 1606199 - protein, 10 aa, Staphylococcus aureus
QTTGAEPTAS

SEQ ID NO: 1606200 - protein, 8 aa, Staphylococcus aureus
QTVNPQPY

SEQ ID NO: 1606201 - protein, 16 aa, Staphylococcus aureus
QTVQDSAQSNNEKSYT

SEQ ID NO: 1606202 - protein, 9 aa, Staphylococcus aureus
QVGTGTQKV

SEQ ID NO: 1606203 - protein, 4 aa, Staphylococcus aureus
QVKR

SEQ ID NO: 1606204 - protein, 6 aa, Staphylococcus aureus
QVNEDE

SEQ ID NO: 1606205 - protein, 7 aa, Staphylococcus aureus
QVPNDGQ

SEQ ID NO: 1606206 - protein, 7 aa, Staphylococcus aureus
QVSENGM

SEQ ID NO: 1606207 - protein, 9 aa, Staphylococcus aureus
QVTKDINDA

SEQ ID NO: 1606208 - protein, 7 aa, Staphylococcus aureus
QYEHYGE

SEQ ID NO: 1606209 - protein, 4 aa, Staphylococcus aureus
QYGD

SEQ ID NO: 1606210 - protein, 4 aa, Staphylococcus aureus
QYNQ

SEQ ID NO: 1606211 - protein, 5 aa, Staphylococcus aureus
QYPTT

SEQ ID NO: 1606212 - protein, 14 aa, Staphylococcus aureus
RAAHGYGGKITPKV

SEQ ID NO: 1606213 - protein, 9 aa, Staphylococcus aureus
RAARNDKGE

SEQ ID NO: 1606214 - protein, 8 aa, Staphylococcus aureus
RAATPTQA

SEQ ID NO: 1606215 - protein, 10 aa, Staphylococcus aureus
RAGATYDDIE

SEQ ID NO: 1606216 - protein, 7 aa, Staphylococcus aureus
RAKKRNI

SEQ ID NO: 1606217 - protein, 6 aa, Staphylococcus aureus
RALNSQ

SEQ ID NO: 1606218 - protein, 6 aa, Staphylococcus aureus
RANGQT

SEQ ID NO: 1606219 - protein, 6 aa, Staphylococcus aureus
RASEGI

SEQ ID NO: 1606220 - protein, 6 aa, Staphylococcus aureus
RASERT

SEQ ID NO: 1606221 - protein, 4 aa, Staphylococcus aureus
RATI

SEQ ID NO: 1606222 - protein, 7 aa, Staphylococcus aureus
RAVAERA

SEQ ID NO: 1606223 - protein, 17 aa, Staphylococcus aureus
RAVESAQKRVEGNNFDA

SEQ ID NO: 1606224 - protein, 7 aa, Staphylococcus aureus
RAYEDLE

SEQ ID NO: 1606225 - protein, 6 aa, Staphylococcus aureus
RDDSLE

SEQ ID NO: 1606226 - protein, 7 aa, Staphylococcus aureus
RDESRTI

SEQ ID NO: 1606227 - protein, 8 aa, Staphylococcus aureus
RDETDRTG

SEQ ID NO: 1606228 - protein, 11 aa, Staphylococcus aureus
RDGEEKTKAAR

SEQ ID NO: 1606229 - protein, 20 aa, Staphylococcus aureus
RDGKNAADVMTGKDLGSQAG

SEQ ID NO: 1606230 - protein, 7 aa, Staphylococcus aureus
RDIEPGI

SEQ ID NO: 1606231 - protein, 4 aa, Staphylococcus aureus
RDKE

SEQ ID NO: 1606232 - protein, 7 aa, Staphylococcus aureus
RDLTQLA

SEQ ID NO: 1606233 - protein, 5 aa, Staphylococcus aureus
RDQYT

SEQ ID NO: 1606234 - protein, 8 aa, Staphylococcus aureus
RDTASSHA

SEQ ID NO: 1606235 - protein, 4 aa, Staphylococcus aureus
RDYY

SEQ ID NO: 1606236 - protein, 9 aa, Staphylococcus aureus
REAEDPFTC

SEQ ID NO: 1606237 - protein, 11 aa, Staphylococcus aureus
REAEVGQTYQA

SEQ ID NO: 1606238 - protein, 17 aa, Staphylococcus aureus
REAGTVKGKKTGKFATS

SEQ ID NO: 1606239 - protein, 6 aa, Staphylococcus aureus
REDGSD

SEQ ID NO: 1606240 - protein, 10 aa, Staphylococcus aureus
REDGSEFDKD

SEQ ID NO: 1606241 - protein, 5 aa, Staphylococcus aureus
REDSY

SEQ ID NO: 1606242 - protein, 29 aa, Staphylococcus aureus
REEEFSPLKNKEGKDSVATATEDLRRMGL

SEQ ID NO: 1606243 - protein, 5 aa, Staphylococcus aureus
REESE

SEQ ID NO: 1606244 - protein, 9 aa, Staphylococcus aureus
REFEPASSG

SEQ ID NO: 1606245 - protein, 6 aa, Staphylococcus aureus
RELSRD

SEQ ID NO: 1606246 - protein, 7 aa, Staphylococcus aureus
RENAENK

SEQ ID NO: 1606247 - protein, 7 aa, Staphylococcus aureus
RENTGAL

SEQ ID NO: 1606248 - protein, 14 aa, Staphylococcus aureus
REQNHAKGSARSID

SEQ ID NO: 1606249 - protein, 6 aa, Staphylococcus aureus
REQTER

SEQ ID NO: 1606250 - protein, 8 aa, Staphylococcus aureus
RERGCKNG

SEQ ID NO: 1606251 - protein, 14 aa, Staphylococcus aureus
RETAPFPRLLNRLY

SEQ ID NO: 1606252 - protein, 7 aa, Staphylococcus aureus
RETDGTS

SEQ ID NO: 1606253 - protein, 7 aa, Staphylococcus aureus
RETEKYG

SEQ ID NO: 1606254 - protein, 8 aa, Staphylococcus aureus
RFSGATRG

SEQ ID NO: 1606255 - protein, 5 aa, Staphylococcus aureus
RGAHA

SEQ ID NO: 1606256 - protein, 8 aa, Staphylococcus aureus
RGAKGGYQ

SEQ ID NO: 1606257 - protein, 5 aa, Staphylococcus aureus
RGESY

SEQ ID NO: 1606258 - protein, 5 aa, Staphylococcus aureus
RGFTN

SEQ ID NO: 1606259 - protein, 13 aa, Staphylococcus aureus
RGGYYTEGPAADF

SEQ ID NO: 1606260 - protein, 5 aa, Staphylococcus aureus
RGHDS

SEQ ID NO: 1606261 - protein, 5 aa, Staphylococcus aureus
RGIGR

SEQ ID NO: 1606262 - protein, 16 aa, Staphylococcus aureus
RGKTGSDLGMDRGTAD

SEQ ID NO: 1606263 - protein, 9 aa, Staphylococcus aureus
RGLGSSASA

SEQ ID NO: 1606264 - protein, 5 aa, Staphylococcus aureus
RGLTS

SEQ ID NO: 1606265 - protein, 8 aa, Staphylococcus aureus
RGNGHGTA

SEQ ID NO: 1606266 - protein, 14 aa, Staphylococcus aureus
RGNNGSEGKDEFYR

SEQ ID NO: 1606267 - protein, 5 aa, Staphylococcus aureus
RGRGI

SEQ ID NO: 1606268 - protein, 8 aa, Staphylococcus aureus
RGSGHGTA

SEQ ID NO: 1606269 - protein, 16 aa, Staphylococcus aureus
RGVAERNHSFPTPEVE

SEQ ID NO: 1606270 - protein, 9 aa, Staphylococcus aureus
RGYGTTLGN

SEQ ID NO: 1606271 - protein, 7 aa, Staphylococcus aureus
RGYTGRN

SEQ ID NO: 1606272 - protein, 7 aa, Staphylococcus aureus
RHDPSKV

SEQ ID NO: 1606273 - protein, 9 aa, Staphylococcus aureus
RHEPFNKED

SEQ ID NO: 1606274 - protein, 4 aa, Staphylococcus aureus
RHET

SEQ ID NO: 1606275 - protein, 11 aa, Staphylococcus aureus
RHGQSRGPMSH

SEQ ID NO: 1606276 - protein, 9 aa, Staphylococcus aureus
RHNEEQHRN

SEQ ID NO: 1606277 - protein, 9 aa, Staphylococcus aureus
RHNKETALG

SEQ ID NO: 1606278 - protein, 13 aa, Staphylococcus aureus
RHPSRSKRLKDFM

SEQ ID NO: 1606279 - protein, 13 aa, Staphylococcus aureus
RIAKKSGEEIKSN

SEQ ID NO: 1606280 - protein, 4 aa, Staphylococcus aureus
RIES

SEQ ID NO: 1606281 - protein, 10 aa, Staphylococcus aureus
RISEDDAKKG

SEQ ID NO: 1606282 - protein, 16 aa, Staphylococcus aureus
RISEEQGVKAREMANE

SEQ ID NO: 1606283 - protein, 9 aa, Staphylococcus aureus
RKASEDNEW

SEQ ID NO: 1606284 - protein, 7 aa, Staphylococcus aureus
RKEDLEK

SEQ ID NO: 1606285 - protein, 8 aa, Staphylococcus aureus
RKEEINPK

SEQ ID NO: 1606286 - protein, 8 aa, Staphylococcus aureus
RKEGKLPR

SEQ ID NO: 1606287 - protein, 9 aa, Staphylococcus aureus
RKGDKHAEV

SEQ ID NO: 1606288 - protein, 8 aa, Staphylococcus aureus
RKGKGLTE

SEQ ID NO: 1606289 - protein, 13 aa, Staphylococcus aureus
RKGLQISAETAKE

SEQ ID NO: 1606290 - protein, 7 aa, Staphylococcus aureus
RKGSHEK

SEQ ID NO: 1606291 - protein, 12 aa, Staphylococcus aureus
RKIAGSAQTRQK

SEQ ID NO: 1606292 - protein, 6 aa, Staphylococcus aureus
RKKEQF

SEQ ID NO: 1606293 - protein, 4 aa, Staphylococcus aureus
RKNI

SEQ ID NO: 1606294 - protein, 7 aa, Staphylococcus aureus
RKPLEPQ

SEQ ID NO: 1606295 - protein, 8 aa, Staphylococcus aureus
RKQKGRYR

SEQ ID NO: 1606296 - protein, 8 aa, Staphylococcus aureus
RKTKNNPV

SEQ ID NO: 1606297 - protein, 7 aa, Staphylococcus aureus
RKYGKDI

SEQ ID NO: 1606298 - protein, 5 aa, Staphylococcus aureus
RLANE

SEQ ID NO: 1606299 - protein, 6 aa, Staphylococcus aureus
RLDDDG

SEQ ID NO: 1606300 - protein, 4 aa, Staphylococcus aureus
RLES

SEQ ID NO: 1606301 - protein, 4 aa, Staphylococcus aureus
RLQR

SEQ ID NO: 1606302 - protein, 9 aa, Staphylococcus aureus
RLTGDSEEV

SEQ ID NO: 1606303 - protein, 7 aa, Staphylococcus aureus
RLTGRLS

SEQ ID NO: 1606304 - protein, 15 aa, Staphylococcus aureus
RMKSKSSGKVSRKEM

SEQ ID NO: 1606305 - protein, 9 aa, Staphylococcus aureus
RMKTREREL

SEQ ID NO: 1606306 - protein, 6 aa, Staphylococcus aureus
RNEEDY

SEQ ID NO: 1606307 - protein, 7 aa, Staphylococcus aureus
RNFRDDP

SEQ ID NO: 1606308 - protein, 5 aa, Staphylococcus aureus
RNIPG

SEQ ID NO: 1606309 - protein, 9 aa, Staphylococcus aureus
RNKDGINAK

SEQ ID NO: 1606310 - protein, 13 aa, Staphylococcus aureus
RNRAGFDDGNRPI

SEQ ID NO: 1606311 - protein, 8 aa, Staphylococcus aureus
RNVGDVRG

SEQ ID NO: 1606312 - protein, 16 aa, Staphylococcus aureus
RNYITTKNKRNNPERV

SEQ ID NO: 1606313 - protein, 4 aa, Staphylococcus aureus
RPAE

SEQ ID NO: 1606314 - protein, 6 aa, Staphylococcus aureus
RPDGKV

SEQ ID NO: 1606315 - protein, 10 aa, Staphylococcus aureus
RPDPDAYGSQ

SEQ ID NO: 1606316 - protein, 4 aa, Staphylococcus aureus
RPFA

SEQ ID NO: 1606317 - protein, 5 aa, Staphylococcus aureus
RPGDM

SEQ ID NO: 1606318 - protein, 7 aa, Staphylococcus aureus
RPKGQRV

SEQ ID NO: 1606319 - protein, 6 aa, Staphylococcus aureus
RPLRTQ

SEQ ID NO: 1606320 - protein, 6 aa, Staphylococcus aureus
RPNDNI

SEQ ID NO: 1606321 - protein, 4 aa, Staphylococcus aureus
RPNT

SEQ ID NO: 1606322 - protein, 16 aa, Staphylococcus aureus
RPRAQGRASAINKRTS

SEQ ID NO: 1606323 - protein, 16 aa, Staphylococcus aureus
RPSDSKEDRTNHGTTR

SEQ ID NO: 1606324 - protein, 8 aa, Staphylococcus aureus
RPTINKQD

SEQ ID NO: 1606325 - protein, 14 aa, Staphylococcus aureus
RPTKPGKVKSFLKW

SEQ ID NO: 1606326 - protein, 5 aa, Staphylococcus aureus
RPTVR

SEQ ID NO: 1606327 - protein, 6 aa, Staphylococcus aureus
RPVDDE

SEQ ID NO: 1606328 - protein, 13 aa, Staphylococcus aureus
RQDTSDSKPYEET

SEQ ID NO: 1606329 - protein, 6 aa, Staphylococcus aureus
RQEEQT

SEQ ID NO: 1606330 - protein, 5 aa, Staphylococcus aureus
RQNPD

SEQ ID NO: 1606331 - protein, 6 aa, Staphylococcus aureus
RQPQKD

SEQ ID NO: 1606332 - protein, 6 aa, Staphylococcus aureus
RQQQST

SEQ ID NO: 1606333 - protein, 8 aa, Staphylococcus aureus
RQTGGRGV

SEQ ID NO: 1606334 - protein, 6 aa, Staphylococcus aureus
RQTQSI

SEQ ID NO: 1606335 - protein, 13 aa, Staphylococcus aureus
RQYGSQDQETVEK

SEQ ID NO: 1606336 - protein, 6 aa, Staphylococcus aureus
RRAQEI

SEQ ID NO: 1606337 - protein, 9 aa, Staphylococcus aureus
RRDGYKPNI

SEQ ID NO: 1606338 - protein, 7 aa, Staphylococcus aureus
RRERERK

SEQ ID NO: 1606339 - protein, 8 aa, Staphylococcus aureus
RRESLTPF

SEQ ID NO: 1606340 - protein, 6 aa, Staphylococcus aureus
RRGTTL

SEQ ID NO: 1606341 - protein, 13 aa, Staphylococcus aureus
RRKGKATEEQAQE

SEQ ID NO: 1606342 - protein, 9 aa, Staphylococcus aureus
RRKPRTNDE

SEQ ID NO: 1606343 - protein, 10 aa, Staphylococcus aureus
RRKVKRELYD

SEQ ID NO: 1606344 - protein, 5 aa, Staphylococcus aureus
RRNNV

SEQ ID NO: 1606345 - protein, 7 aa, Staphylococcus aureus
RRNSAIP

SEQ ID NO: 1606346 - protein, 7 aa, Staphylococcus aureus
RRTNQDT

SEQ ID NO: 1606347 - protein, 8 aa, Staphylococcus aureus
RSEGFGKE

SEQ ID NO: 1606348 - protein, 6 aa, Staphylococcus aureus
RSEPHE

SEQ ID NO: 1606349 - protein, 6 aa, Staphylococcus aureus
RSGTLT

SEQ ID NO: 1606350 - protein, 16 aa, Staphylococcus aureus
RSIAQTGNKPGVTKQQ

SEQ ID NO: 1606351 - protein, 12 aa, Staphylococcus aureus
RSKGYDQRPSIP

SEQ ID NO: 1606352 - protein, 8 aa, Staphylococcus aureus
RSNNEVDY

SEQ ID NO: 1606353 - protein, 11 aa, Staphylococcus aureus
RSRDPEKVVEQ

SEQ ID NO: 1606354 - protein, 10 aa, Staphylococcus aureus
RSSNEIGSDG

SEQ ID NO: 1606355 - protein, 10 aa, Staphylococcus aureus
RSTKDIKITE

SEQ ID NO: 1606356 - protein, 6 aa, Staphylococcus aureus
RTAEGF

SEQ ID NO: 1606357 - protein, 13 aa, Staphylococcus aureus
RTAMNTPIQGSAA

SEQ ID NO: 1606358 - protein, 7 aa, Staphylococcus aureus
RTCAGTN

SEQ ID NO: 1606359 - protein, 7 aa, Staphylococcus aureus
RTDENEM

SEQ ID NO: 1606360 - protein, 12 aa, Staphylococcus aureus
RTDHFGDDDEFE

SEQ ID NO: 1606361 - protein, 8 aa, Staphylococcus aureus
RTEAKLNK

SEQ ID NO: 1606362 - protein, 6 aa, Staphylococcus aureus
RTIEQA

SEQ ID NO: 1606363 - protein, 4 aa, Staphylococcus aureus
RTIN

SEQ ID NO: 1606364 - protein, 10 aa, Staphylococcus aureus
RTKDGGTHEV

SEQ ID NO: 1606365 - protein, 15 aa, Staphylococcus aureus
RTMSKQGQISEEAAS

SEQ ID NO: 1606366 - protein, 10 aa, Staphylococcus aureus
RTPSTTDYNG

SEQ ID NO: 1606367 - protein, 15 aa, Staphylococcus aureus
RTQSTTVEQSEPHAR

SEQ ID NO: 1606368 - protein, 7 aa, Staphylococcus aureus
RTRRQAR

SEQ ID NO: 1606369 - protein, 8 aa, Staphylococcus aureus
RTSKTPLS

SEQ ID NO: 1606370 - protein, 6 aa, Staphylococcus aureus
RTVDSY

SEQ ID NO: 1606371 - protein, 8 aa, Staphylococcus aureus
RVAPSVAR

SEQ ID NO: 1606372 - protein, 4 aa, Staphylococcus aureus
RVKG

SEQ ID NO: 1606373 - protein, 6 aa, Staphylococcus aureus
RVNKTQ

SEQ ID NO: 1606374 - protein, 15 aa, Staphylococcus aureus
RVQEVSKTAGGKGLN

SEQ ID NO: 1606375 - protein, 12 aa, Staphylococcus aureus
RYEDNEKPVIES

SEQ ID NO: 1606376 - protein, 9 aa, Staphylococcus aureus
RYEQNNKEY

SEQ ID NO: 1606377 - protein, 7 aa, Staphylococcus aureus
RYNTEDI

SEQ ID NO: 1606378 - protein, 5 aa, Staphylococcus aureus
RYQPR

SEQ ID NO: 1606379 - protein, 10 aa, Staphylococcus aureus
RYTERQGGYT

SEQ ID NO: 1606380 - protein, 8 aa, Staphylococcus aureus
SAADEEIG

SEQ ID NO: 1606381 - protein, 6 aa, Staphylococcus aureus
SAASSM

SEQ ID NO: 1606382 - protein, 7 aa, Staphylococcus aureus
SAGKSSL

SEQ ID NO: 1606383 - protein, 5 aa, Staphylococcus aureus
SAGNM

SEQ ID NO: 1606384 - protein, 7 aa, Staphylococcus aureus
SAIQTGY

SEQ ID NO: 1606385 - protein, 6 aa, Staphylococcus aureus
SAITTD

SEQ ID NO: 1606386 - protein, 10 aa, Staphylococcus aureus
SAQDKMNTVD

SEQ ID NO: 1606387 - protein, 4 aa, Staphylococcus aureus
SAQV

SEQ ID NO: 1606388 - protein, 15 aa, Staphylococcus aureus
SASSQNVGHAPREVT

SEQ ID NO: 1606389 - protein, 4 aa, Staphylococcus aureus
SATM

SEQ ID NO: 1606390 - protein, 8 aa, Staphylococcus aureus
SCGSGTAS

SEQ ID NO: 1606391 - protein, 8 aa, Staphylococcus aureus
SCTNTSNP

SEQ ID NO: 1606392 - protein, 30 aa, Staphylococcus aureus
SDDNKRASYDQFGHDGPQGFGGQGFNGSDF

SEQ ID NO: 1606393 - protein, 5 aa, Staphylococcus aureus
SDDQR

SEQ ID NO: 1606394 - protein, 8 aa, Staphylococcus aureus
SDEGGVHK

SEQ ID NO: 1606395 - protein, 5 aa, Staphylococcus aureus
SDIGQ

SEQ ID NO: 1606396 - protein, 7 aa, Staphylococcus aureus
SDLSKEY

SEQ ID NO: 1606397 - protein, 7 aa, Staphylococcus aureus
SDNDQAL

SEQ ID NO: 1606398 - protein, 9 aa, Staphylococcus aureus
SDPDREGEA

SEQ ID NO: 1606399 - protein, 5 aa, Staphylococcus aureus
SDRDD

SEQ ID NO: 1606400 - protein, 4 aa, Staphylococcus aureus
SDRT

SEQ ID NO: 1606401 - protein, 6 aa, Staphylococcus aureus
SDTAGL

SEQ ID NO: 1606402 - protein, 8 aa, Staphylococcus aureus
SDTGSASV

SEQ ID NO: 1606403 - protein, 6 aa, Staphylococcus aureus
SDTPAK

SEQ ID NO: 1606404 - protein, 7 aa, Staphylococcus aureus
SDVPSHR

SEQ ID NO: 1606405 - protein, 11 aa, Staphylococcus aureus
SEASVGKDTMT

SEQ ID NO: 1606406 - protein, 6 aa, Staphylococcus aureus
SEEERF

SEQ ID NO: 1606407 - protein, 11 aa, Staphylococcus aureus
SEGDQVKPQQI

SEQ ID NO: 1606408 - protein, 7 aa, Staphylococcus aureus
SEGTDFP

SEQ ID NO: 1606409 - protein, 11 aa, Staphylococcus aureus
SEGTKEDAERA

SEQ ID NO: 1606410 - protein, 6 aa, Staphylococcus aureus
SEHLED

SEQ ID NO: 1606411 - protein, 13 aa, Staphylococcus aureus
SEIEEQIKSSKEE

SEQ ID NO: 1606412 - protein, 6 aa, Staphylococcus aureus
SEITPL

SEQ ID NO: 1606413 - protein, 9 aa, Staphylococcus aureus
SEKFNSSSL

SEQ ID NO: 1606414 - protein, 6 aa, Staphylococcus aureus
SEKQAQ

SEQ ID NO: 1606415 - protein, 5 aa, Staphylococcus aureus
SELAD

SEQ ID NO: 1606416 - protein, 7 aa, Staphylococcus aureus
SENLDLE

SEQ ID NO: 1606417 - protein, 4 aa, Staphylococcus aureus
SENV

SEQ ID NO: 1606418 - protein, 10 aa, Staphylococcus aureus
SEPHDSATTI

SEQ ID NO: 1606419 - protein, 10 aa, Staphylococcus aureus
SEQDAQASIK

SEQ ID NO: 1606420 - protein, 11 aa, Staphylococcus aureus
SEQGKRKANEI

SEQ ID NO: 1606421 - protein, 6 aa, Staphylococcus aureus
SEQLEE

SEQ ID NO: 1606422 - protein, 5 aa, Staphylococcus aureus
SEQTY

SEQ ID NO: 1606423 - protein, 13 aa, Staphylococcus aureus
SERPDINYDDNGG

SEQ ID NO: 1606424 - protein, 6 aa, Staphylococcus aureus
SERYPA

SEQ ID NO: 1606425 - protein, 21 aa, Staphylococcus aureus
SESREGMTSDTYTKVDDSQPA

SEQ ID NO: 1606426 - protein, 7 aa, Staphylococcus aureus
SETLGEE

SEQ ID NO: 1606427 - protein, 7 aa, Staphylococcus aureus
SETQAHM

SEQ ID NO: 1606428 - protein, 8 aa, Staphylococcus aureus
SEVETAKR

SEQ ID NO: 1606429 - protein, 6 aa, Staphylococcus aureus
SEVETN

SEQ ID NO: 1606430 - protein, 11 aa, Staphylococcus aureus
SEWSSRQDALA

SEQ ID NO: 1606431 - protein, 7 aa, Staphylococcus aureus
SEYTTES

SEQ ID NO: 1606432 - protein, 8 aa, Staphylococcus aureus
SFASQNKG

SEQ ID NO: 1606433 - protein, 12 aa, Staphylococcus aureus
SFDEKENTDDLS

SEQ ID NO: 1606434 - protein, 11 aa, Staphylococcus aureus
SFEQTELSSDY

SEQ ID NO: 1606435 - protein, 6 aa, Staphylococcus aureus
SFGKES

SEQ ID NO: 1606436 - protein, 11 aa, Staphylococcus aureus
SFGRADKINNG

SEQ ID NO: 1606437 - protein, 13 aa, Staphylococcus aureus
SFNDSNHDGIGDL

SEQ ID NO: 1606438 - protein, 7 aa, Staphylococcus aureus
SFNSPGR

SEQ ID NO: 1606439 - protein, 8 aa, Staphylococcus aureus
SFVTEGKN

SEQ ID NO: 1606440 - protein, 10 aa, Staphylococcus aureus
SGAISKSNTT

SEQ ID NO: 1606441 - protein, 4 aa, Staphylococcus aureus
SGAV

SEQ ID NO: 1606442 - protein, 8 aa, Staphylococcus aureus
SGDEVNVG

SEQ ID NO: 1606443 - protein, 7 aa, Staphylococcus aureus
SGDTSDY

SEQ ID NO: 1606444 - protein, 9 aa, Staphylococcus aureus
SGEASKHGI

SEQ ID NO: 1606445 - protein, 13 aa, Staphylococcus aureus
SGELKNKKGVNLP

SEQ ID NO: 1606446 - protein, 7 aa, Staphylococcus aureus
SGERPRI

SEQ ID NO: 1606447 - protein, 5 aa, Staphylococcus aureus
SGERY

SEQ ID NO: 1606448 - protein, 4 aa, Staphylococcus aureus
SGET

SEQ ID NO: 1606449 - protein, 9 aa, Staphylococcus aureus
SGETGSGKS

SEQ ID NO: 1606450 - protein, 9 aa, Staphylococcus aureus
SGFEGRVTK

SEQ ID NO: 1606451 - protein, 7 aa, Staphylococcus aureus
SGGARMQ

SEQ ID NO: 1606452 - protein, 8 aa, Staphylococcus aureus
SGGGGNAQ

SEQ ID NO: 1606453 - protein, 5 aa, Staphylococcus aureus
SGGKR

SEQ ID NO: 1606454 - protein, 7 aa, Staphylococcus aureus
SGGKRVR

SEQ ID NO: 1606455 - protein, 5 aa, Staphylococcus aureus
SGGLG

SEQ ID NO: 1606456 - protein, 9 aa, Staphylococcus aureus
SGGSSEKYN

SEQ ID NO: 1606457 - protein, 6 aa, Staphylococcus aureus
SGGTDN

SEQ ID NO: 1606458 - protein, 5 aa, Staphylococcus aureus
SGICP

SEQ ID NO: 1606459 - protein, 5 aa, Staphylococcus aureus
SGIGY

SEQ ID NO: 1606460 - protein, 7 aa, Staphylococcus aureus
SGIHSNG

SEQ ID NO: 1606461 - protein, 6 aa, Staphylococcus aureus
SGKIAR

SEQ ID NO: 1606462 - protein, 9 aa, Staphylococcus aureus
SGKNNKNLT

SEQ ID NO: 1606463 - protein, 5 aa, Staphylococcus aureus
SGLEP

SEQ ID NO: 1606464 - protein, 4 aa, Staphylococcus aureus
SGLG

SEQ ID NO: 1606465 - protein, 4 aa, Staphylococcus aureus
SGLP

SEQ ID NO: 1606466 - protein, 9 aa, Staphylococcus aureus
SGMDPDEYI

SEQ ID NO: 1606467 - protein, 5 aa, Staphylococcus aureus
SGMSS

SEQ ID NO: 1606468 - protein, 6 aa, Staphylococcus aureus
SGNQYA

SEQ ID NO: 1606469 - protein, 8 aa, Staphylococcus aureus
SGPGVSNL

SEQ ID NO: 1606470 - protein, 7 aa, Staphylococcus aureus
SGPRAGL

SEQ ID NO: 1606471 - protein, 10 aa, Staphylococcus aureus
SGRGDKDMET

SEQ ID NO: 1606472 - protein, 9 aa, Staphylococcus aureus
SGRPTEGMI

SEQ ID NO: 1606473 - protein, 8 aa, Staphylococcus aureus
SGRSDIDK

SEQ ID NO: 1606474 - protein, 20 aa, Staphylococcus aureus
SGRTYTGQEPKYLNSPETPI

SEQ ID NO: 1606475 - protein, 14 aa, Staphylococcus aureus
SGSACTAGSTQPSH

SEQ ID NO: 1606476 - protein, 10 aa, Staphylococcus aureus
SGSEGREPIE

SEQ ID NO: 1606477 - protein, 9 aa, Staphylococcus aureus
SGSNPKYNA

SEQ ID NO: 1606478 - protein, 16 aa, Staphylococcus aureus
SGTAAANYTPAIAESQ

SEQ ID NO: 1606479 - protein, 9 aa, Staphylococcus aureus
SGTATAGIP

SEQ ID NO: 1606480 - protein, 11 aa, Staphylococcus aureus
SGTDAKTGSPD

SEQ ID NO: 1606481 - protein, 10 aa, Staphylococcus aureus
SGTNGKDAHI

SEQ ID NO: 1606482 - protein, 9 aa, Staphylococcus aureus
SGTTGMPKG

SEQ ID NO: 1606483 - protein, 13 aa, Staphylococcus aureus
SGTTGPQKAVPQT

SEQ ID NO: 1606484 - protein, 7 aa, Staphylococcus aureus
SGVEYAQ

SEQ ID NO: 1606485 - protein, 6 aa, Staphylococcus aureus
SGVPNA

SEQ ID NO: 1606486 - protein, 4 aa, Staphylococcus aureus
SHIR

SEQ ID NO: 1606487 - protein, 4 aa, Staphylococcus aureus
SHPG

SEQ ID NO: 1606488 - protein, 9 aa, Staphylococcus aureus
SIDRDTERI

SEQ ID NO: 1606489 - protein, 11 aa, Staphylococcus aureus
SIEADKDGSTV

SEQ ID NO: 1606490 - protein, 7 aa, Staphylococcus aureus
SIERTTR

SEQ ID NO: 1606491 - protein, 6 aa, Staphylococcus aureus
SIGETA

SEQ ID NO: 1606492 - protein, 6 aa, Staphylococcus aureus
SITEGT

SEQ ID NO: 1606493 - protein, 6 aa, Staphylococcus aureus
SIYGKG

SEQ ID NO: 1606494 - protein, 7 aa, Staphylococcus aureus
SKAAHPN

SEQ ID NO: 1606495 - protein, 8 aa, Staphylococcus aureus
SKADNTPF

SEQ ID NO: 1606496 - protein, 10 aa, Staphylococcus aureus
SKAGNSGQIP

SEQ ID NO: 1606497 - protein, 33 aa, Staphylococcus aureus
SKAPEKVINEEKRKKQDYQEKYDGVKARIEQLK

SEQ ID NO: 1606498 - protein, 8 aa, Staphylococcus aureus
SKATMEEN

SEQ ID NO: 1606499 - protein, 17 aa, Staphylococcus aureus
SKATQGNINVDLNVNVV

SEQ ID NO: 1606500 - protein, 11 aa, Staphylococcus aureus
SKAYQSTTGIA

SEQ ID NO: 1606501 - protein, 9 aa, Staphylococcus aureus
SKDATQKYQ

SEQ ID NO: 1606502 - protein, 8 aa, Staphylococcus aureus
SKDGLSPE

SEQ ID NO: 1606503 - protein, 6 aa, Staphylococcus aureus
SKDPYY

SEQ ID NO: 1606504 - protein, 8 aa, Staphylococcus aureus
SKDSGIDV

SEQ ID NO: 1606505 - protein, 7 aa, Staphylococcus aureus
SKEAHSL

SEQ ID NO: 1606506 - protein, 5 aa, Staphylococcus aureus
SKEKV

SEQ ID NO: 1606507 - protein, 7 aa, Staphylococcus aureus
SKEKYDE

SEQ ID NO: 1606508 - protein, 7 aa, Staphylococcus aureus
SKEPGTI

SEQ ID NO: 1606509 - protein, 11 aa, Staphylococcus aureus
SKESDYAANIE

SEQ ID NO: 1606510 - protein, 10 aa, Staphylococcus aureus
SKFENGDEAF

SEQ ID NO: 1606511 - protein, 9 aa, Staphylococcus aureus
SKHSYGPSR

SEQ ID NO: 1606512 - protein, 8 aa, Staphylococcus aureus
SKIDERNT

SEQ ID NO: 1606513 - protein, 11 aa, Staphylococcus aureus
SKISSTNQRIR

SEQ ID NO: 1606514 - protein, 10 aa, Staphylococcus aureus
SKKNRAVLES

SEQ ID NO: 1606515 - protein, 11 aa, Staphylococcus aureus
SKKTVSAIKNN

SEQ ID NO: 1606516 - protein, 17 aa, Staphylococcus aureus
SKLAGTERGVTEPEPSF

SEQ ID NO: 1606517 - protein, 7 aa, Staphylococcus aureus
SKLQDSV

SEQ ID NO: 1606518 - protein, 7 aa, Staphylococcus aureus
SKLTAKR

SEQ ID NO: 1606519 - protein, 20 aa, Staphylococcus aureus
SKMFSPSPAHFGAEPNSNTN

SEQ ID NO: 1606520 - protein, 7 aa, Staphylococcus aureus
SKNDGDK

SEQ ID NO: 1606521 - protein, 8 aa, Staphylococcus aureus
SKNRSQTV

SEQ ID NO: 1606522 - protein, 9 aa, Staphylococcus aureus
SKNTMSEEE

SEQ ID NO: 1606523 - protein, 17 aa, Staphylococcus aureus
SKPPHVLTPEERKKPME

SEQ ID NO: 1606524 - protein, 7 aa, Staphylococcus aureus
SKPSDLI

SEQ ID NO: 1606525 - protein, 6 aa, Staphylococcus aureus
SKQTMQ

SEQ ID NO: 1606526 - protein, 5 aa, Staphylococcus aureus
SKQYQ

SEQ ID NO: 1606527 - protein, 4 aa, Staphylococcus aureus
SKRE

SEQ ID NO: 1606528 - protein, 7 aa, Staphylococcus aureus
SKREQRL

SEQ ID NO: 1606529 - protein, 8 aa, Staphylococcus aureus
SKRIKENS

SEQ ID NO: 1606530 - protein, 5 aa, Staphylococcus aureus
SKRNP

SEQ ID NO: 1606531 - protein, 7 aa, Staphylococcus aureus
SKSGFGP

SEQ ID NO: 1606532 - protein, 8 aa, Staphylococcus aureus
SKSNEEHG

SEQ ID NO: 1606533 - protein, 7 aa, Staphylococcus aureus
SKTAQYC

SEQ ID NO: 1606534 - protein, 9 aa, Staphylococcus aureus
SKTDRASKV

SEQ ID NO: 1606535 - protein, 8 aa, Staphylococcus aureus
SKYKDGKV

SEQ ID NO: 1606536 - protein, 17 aa, Staphylococcus aureus
SLAGKTGTINYTSAFEK

SEQ ID NO: 1606537 - protein, 8 aa, Staphylococcus aureus
SLAPGSKV

SEQ ID NO: 1606538 - protein, 13 aa, Staphylococcus aureus
SLATEAREKLSEV

SEQ ID NO: 1606539 - protein, 5 aa, Staphylococcus aureus
SLDKP

SEQ ID NO: 1606540 - protein, 7 aa, Staphylococcus aureus
SLGQQLE

SEQ ID NO: 1606541 - protein, 7 aa, Staphylococcus aureus
SLGSKKL

SEQ ID NO: 1606542 - protein, 8 aa, Staphylococcus aureus
SLGSNTPI

SEQ ID NO: 1606543 - protein, 7 aa, Staphylococcus aureus
SLKEDET

SEQ ID NO: 1606544 - protein, 15 aa, Staphylococcus aureus
SLPNLPDKAQLSIFD

SEQ ID NO: 1606545 - protein, 6 aa, Staphylococcus aureus
SLPNTK

SEQ ID NO: 1606546 - protein, 5 aa, Staphylococcus aureus
SLQTP

SEQ ID NO: 1606547 - protein, 6 aa, Staphylococcus aureus
SLSARG

SEQ ID NO: 1606548 - protein, 5 aa, Staphylococcus aureus
SLTGA

SEQ ID NO: 1606549 - protein, 7 aa, Staphylococcus aureus
SLTPGQQ

SEQ ID NO: 1606550 - protein, 9 aa, Staphylococcus aureus
SMLDPDARQ

SEQ ID NO: 1606551 - protein, 7 aa, Staphylococcus aureus
SMTDATG

SEQ ID NO: 1606552 - protein, 6 aa, Staphylococcus aureus
SNATQI

SEQ ID NO: 1606553 - protein, 5 aa, Staphylococcus aureus
SNELR

SEQ ID NO: 1606554 - protein, 5 aa, Staphylococcus aureus
SNENV

SEQ ID NO: 1606555 - protein, 22 aa, Staphylococcus aureus
SNHPGGIKSITAGELRRTNPER

SEQ ID NO: 1606556 - protein, 4 aa, Staphylococcus aureus
SNHQ

SEQ ID NO: 1606557 - protein, 7 aa, Staphylococcus aureus
SNKKTVG

SEQ ID NO: 1606558 - protein, 6 aa, Staphylococcus aureus
SNKNRT

SEQ ID NO: 1606559 - protein, 7 aa, Staphylococcus aureus
SNPHERL

SEQ ID NO: 1606560 - protein, 4 aa, Staphylococcus aureus
SNRQ

SEQ ID NO: 1606561 - protein, 12 aa, Staphylococcus aureus
SNSDNDPEKEKE

SEQ ID NO: 1606562 - protein, 9 aa, Staphylococcus aureus
SNSFVDGEG

SEQ ID NO: 1606563 - protein, 8 aa, Staphylococcus aureus
SNSSRFNA

SEQ ID NO: 1606564 - protein, 6 aa, Staphylococcus aureus
SNTEDL

SEQ ID NO: 1606565 - protein, 6 aa, Staphylococcus aureus
SNYESA

SEQ ID NO: 1606566 - protein, 4 aa, Staphylococcus aureus
SPDA

SEQ ID NO: 1606567 - protein, 6 aa, Staphylococcus aureus
SPDEEH

SEQ ID NO: 1606568 - protein, 9 aa, Staphylococcus aureus
SPEDATRTE

SEQ ID NO: 1606569 - protein, 5 aa, Staphylococcus aureus
SPENL

SEQ ID NO: 1606570 - protein, 11 aa, Staphylococcus aureus
SPFGGGVHTPE

SEQ ID NO: 1606571 - protein, 11 aa, Staphylococcus aureus
SPFKSKSHISP

SEQ ID NO: 1606572 - protein, 11 aa, Staphylococcus aureus
SPGGTDGGEIH

SEQ ID NO: 1606573 - protein, 7 aa, Staphylococcus aureus
SPGVAEP

SEQ ID NO: 1606574 - protein, 10 aa, Staphylococcus aureus
SPIPDTESKI

SEQ ID NO: 1606575 - protein, 8 aa, Staphylococcus aureus
SPKTETGI

SEQ ID NO: 1606576 - protein, 5 aa, Staphylococcus aureus
SPLPQ

SEQ ID NO: 1606577 - protein, 5 aa, Staphylococcus aureus
SPLSE

SEQ ID NO: 1606578 - protein, 4 aa, Staphylococcus aureus
SPNT

SEQ ID NO: 1606579 - protein, 9 aa, Staphylococcus aureus
SPNTEIYSD

SEQ ID NO: 1606580 - protein, 11 aa, Staphylococcus aureus
SPSFKNAESKL

SEQ ID NO: 1606581 - protein, 6 aa, Staphylococcus aureus
SPTEAV

SEQ ID NO: 1606582 - protein, 5 aa, Staphylococcus aureus
SPTNQ

SEQ ID NO: 1606583 - protein, 14 aa, Staphylococcus aureus
SPTPAGEGKSTVTV

SEQ ID NO: 1606584 - protein, 4 aa, Staphylococcus aureus
SPYD

SEQ ID NO: 1606585 - protein, 7 aa, Staphylococcus aureus
SQCHEDA

SEQ ID NO: 1606586 - protein, 6 aa, Staphylococcus aureus
SQGPKR

SEQ ID NO: 1606587 - protein, 6 aa, Staphylococcus aureus
SQHQEV

SEQ ID NO: 1606588 - protein, 8 aa, Staphylococcus aureus
SQIDPERD

SEQ ID NO: 1606589 - protein, 12 aa, Staphylococcus aureus
SQKAPEGESYED

SEQ ID NO: 1606590 - protein, 9 aa, Staphylococcus aureus
SQKETGERI

SEQ ID NO: 1606591 - protein, 9 aa, Staphylococcus aureus
SQNVRTNYE

SEQ ID NO: 1606592 - protein, 13 aa, Staphylococcus aureus
SQPGNPLNRSTLP

SEQ ID NO: 1606593 - protein, 9 aa, Staphylococcus aureus
SQQQEEGKF

SEQ ID NO: 1606594 - protein, 5 aa, Staphylococcus aureus
SQQSI

SEQ ID NO: 1606595 - protein, 11 aa, Staphylococcus aureus
SQQSYTSSQIE

SEQ ID NO: 1606596 - protein, 7 aa, Staphylococcus aureus
SQQVGAP

SEQ ID NO: 1606597 - protein, 13 aa, Staphylococcus aureus
SQSAEAKSTTYNA

SEQ ID NO: 1606598 - protein, 10 aa, Staphylococcus aureus
SQSEGSDPAA

SEQ ID NO: 1606599 - protein, 6 aa, Staphylococcus aureus
SQSNVS

SEQ ID NO: 1606600 - protein, 10 aa, Staphylococcus aureus
SQSYSTLPYK

SEQ ID NO: 1606601 - protein, 6 aa, Staphylococcus aureus
SQTLQQ

SEQ ID NO: 1606602 - protein, 7 aa, Staphylococcus aureus
SQTSGTV

SEQ ID NO: 1606603 - protein, 6 aa, Staphylococcus aureus
SQYTKS

SEQ ID NO: 1606604 - protein, 7 aa, Staphylococcus aureus
SRAGSNA

SEQ ID NO: 1606605 - protein, 5 aa, Staphylococcus aureus
SRDED

SEQ ID NO: 1606606 - protein, 8 aa, Staphylococcus aureus
SRDQEHKE

SEQ ID NO: 1606607 - protein, 4 aa, Staphylococcus aureus
SRED

SEQ ID NO: 1606608 - protein, 12 aa, Staphylococcus aureus
SRENKQTLHRET

SEQ ID NO: 1606609 - protein, 4 aa, Staphylococcus aureus
SRFE

SEQ ID NO: 1606610 - protein, 5 aa, Staphylococcus aureus
SRGQT

SEQ ID NO: 1606611 - protein, 8 aa, Staphylococcus aureus
SRGSVGSS

SEQ ID NO: 1606612 - protein, 10 aa, Staphylococcus aureus
SRISGVNPAD

SEQ ID NO: 1606613 - protein, 42 aa, Staphylococcus aureus
SRKERNRVGRGVATGNGKTSGRGHKGQKARSGGGVRPGFEGG

SEQ ID NO: 1606614 - protein, 14 aa, Staphylococcus aureus
SRNDVRGQQASQKL

SEQ ID NO: 1606615 - protein, 7 aa, Staphylococcus aureus
SRNEENF

SEQ ID NO: 1606616 - protein, 6 aa, Staphylococcus aureus
SRNHTE

SEQ ID NO: 1606617 - protein, 5 aa, Staphylococcus aureus
SRNSL

SEQ ID NO: 1606618 - protein, 7 aa, Staphylococcus aureus
SRPYSSL

SEQ ID NO: 1606619 - protein, 7 aa, Staphylococcus aureus
SRQQVRD

SEQ ID NO: 1606620 - protein, 9 aa, Staphylococcus aureus
SRRTKNNPI

SEQ ID NO: 1606621 - protein, 6 aa, Staphylococcus aureus
SRSPIR

SEQ ID NO: 1606622 - protein, 9 aa, Staphylococcus aureus
SRTNMTIEP

SEQ ID NO: 1606623 - protein, 7 aa, Staphylococcus aureus
SRTYSSY

SEQ ID NO: 1606624 - protein, 9 aa, Staphylococcus aureus
SRYDKGEAA

SEQ ID NO: 1606625 - protein, 20 aa, Staphylococcus aureus
SSANGSKPRDVYVTEADLNK

SEQ ID NO: 1606626 - protein, 7 aa, Staphylococcus aureus
SSDETTY

SEQ ID NO: 1606627 - protein, 5 aa, Staphylococcus aureus
SSDIK

SEQ ID NO: 1606628 - protein, 10 aa, Staphylococcus aureus
SSEASSNLSR

SEQ ID NO: 1606629 - protein, 7 aa, Staphylococcus aureus
SSEEEKD

SEQ ID NO: 1606630 - protein, 5 aa, Staphylococcus aureus
SSEPV

SEQ ID NO: 1606631 - protein, 7 aa, Staphylococcus aureus
SSEREPM

SEQ ID NO: 1606632 - protein, 8 aa, Staphylococcus aureus
SSGTEATL

SEQ ID NO: 1606633 - protein, 12 aa, Staphylococcus aureus
SSHPEYRTQYDT

SEQ ID NO: 1606634 - protein, 8 aa, Staphylococcus aureus
SSKAGTGC

SEQ ID NO: 1606635 - protein, 4 aa, Staphylococcus aureus
SSLS

SEQ ID NO: 1606636 - protein, 9 aa, Staphylococcus aureus
SSNGTIGEV

SEQ ID NO: 1606637 - protein, 7 aa, Staphylococcus aureus
SSNIPSI

SEQ ID NO: 1606638 - protein, 21 aa, Staphylococcus aureus
SSNKSHGKQNQIEGAKSEGKK

SEQ ID NO: 1606639 - protein, 4 aa, Staphylococcus aureus
SSPG

SEQ ID NO: 1606640 - protein, 9 aa, Staphylococcus aureus
SSPNTENLQ

SEQ ID NO: 1606641 - protein, 7 aa, Staphylococcus aureus
SSPSTLE

SEQ ID NO: 1606642 - protein, 7 aa, Staphylococcus aureus
SSPVESK

SEQ ID NO: 1606643 - protein, 9 aa, Staphylococcus aureus
SSQTRYQQQ

SEQ ID NO: 1606644 - protein, 4 aa, Staphylococcus aureus
SSSL

SEQ ID NO: 1606645 - protein, 5 aa, Staphylococcus aureus
SSSSN

SEQ ID NO: 1606646 - protein, 8 aa, Staphylococcus aureus
SSTSAEVT

SEQ ID NO: 1606647 - protein, 6 aa, Staphylococcus aureus
SSVSDF

SEQ ID NO: 1606648 - protein, 5 aa, Staphylococcus aureus
STANL

SEQ ID NO: 1606649 - protein, 7 aa, Staphylococcus aureus
STDGDDI

SEQ ID NO: 1606650 - protein, 12 aa, Staphylococcus aureus
STDLQKSENEKH

SEQ ID NO: 1606651 - protein, 8 aa, Staphylococcus aureus
STEEDKKE

SEQ ID NO: 1606652 - protein, 4 aa, Staphylococcus aureus
STGE

SEQ ID NO: 1606653 - protein, 9 aa, Staphylococcus aureus
STGGSSVTA

SEQ ID NO: 1606654 - protein, 7 aa, Staphylococcus aureus
STGVSPQ

SEQ ID NO: 1606655 - protein, 6 aa, Staphylococcus aureus
STKVDI

SEQ ID NO: 1606656 - protein, 6 aa, Staphylococcus aureus
STLPEA

SEQ ID NO: 1606657 - protein, 4 aa, Staphylococcus aureus
STPM

SEQ ID NO: 1606658 - protein, 8 aa, Staphylococcus aureus
STPSESLT

SEQ ID NO: 1606659 - protein, 6 aa, Staphylococcus aureus
STPYDA

SEQ ID NO: 1606660 - protein, 6 aa, Staphylococcus aureus
STQQFE

SEQ ID NO: 1606661 - protein, 7 aa, Staphylococcus aureus
STRIPAV

SEQ ID NO: 1606662 - protein, 6 aa, Staphylococcus aureus
STSEGF

SEQ ID NO: 1606663 - protein, 14 aa, Staphylococcus aureus
STSPGIKEEANQLE

SEQ ID NO: 1606664 - protein, 8 aa, Staphylococcus aureus
SVASGVPD

SEQ ID NO: 1606665 - protein, 7 aa, Staphylococcus aureus
SVGEPKP

SEQ ID NO: 1606666 - protein, 9 aa, Staphylococcus aureus
SVKGTEHDP

SEQ ID NO: 1606667 - protein, 6 aa, Staphylococcus aureus
SVPANI

SEQ ID NO: 1606668 - protein, 16 aa, Staphylococcus aureus
SVRPPEPYKGKGIRYQ

SEQ ID NO: 1606669 - protein, 15 aa, Staphylococcus aureus
SVTEGHPDKIADQVS

SEQ ID NO: 1606670 - protein, 11 aa, Staphylococcus aureus
SVTEGTDAQAE

SEQ ID NO: 1606671 - protein, 11 aa, Staphylococcus aureus
SVTNDTLNNQI

SEQ ID NO: 1606672 - protein, 8 aa, Staphylococcus aureus
SYETPSKL

SEQ ID NO: 1606673 - protein, 9 aa, Staphylococcus aureus
SYGSRRGNH

SEQ ID NO: 1606674 - protein, 6 aa, Staphylococcus aureus
SYLSAD

SEQ ID NO: 1606675 - protein, 5 aa, Staphylococcus aureus
SYMKE

SEQ ID NO: 1606676 - protein, 6 aa, Staphylococcus aureus
SYSEKE

SEQ ID NO: 1606677 - protein, 16 aa, Staphylococcus aureus
TAAKRAREIDEQPETE

SEQ ID NO: 1606678 - protein, 6 aa, Staphylococcus aureus
TADGEP

SEQ ID NO: 1606679 - protein, 8 aa, Staphylococcus aureus
TADPFDEL

SEQ ID NO: 1606680 - protein, 5 aa, Staphylococcus aureus
TAEGK

SEQ ID NO: 1606681 - protein, 11 aa, Staphylococcus aureus
TAEVPSTISGT

SEQ ID NO: 1606682 - protein, 8 aa, Staphylococcus aureus
TAFGKYGG

SEQ ID NO: 1606683 - protein, 6 aa, Staphylococcus aureus
TAGSSK

SEQ ID NO: 1606684 - protein, 7 aa, Staphylococcus aureus
TAITSNQ

SEQ ID NO: 1606685 - protein, 7 aa, Staphylococcus aureus
TAKELGT

SEQ ID NO: 1606686 - protein, 9 aa, Staphylococcus aureus
TAKKQDGDL

SEQ ID NO: 1606687 - protein, 4 aa, Staphylococcus aureus
TANA

SEQ ID NO: 1606688 - protein, 9 aa, Staphylococcus aureus
TANGKRTSI

SEQ ID NO: 1606689 - protein, 5 aa, Staphylococcus aureus
TANNA

SEQ ID NO: 1606690 - protein, 5 aa, Staphylococcus aureus
TANWT

SEQ ID NO: 1606691 - protein, 7 aa, Staphylococcus aureus
TAPPHLQ

SEQ ID NO: 1606692 - protein, 12 aa, Staphylococcus aureus
TAPVSTQTLQRD

SEQ ID NO: 1606693 - protein, 7 aa, Staphylococcus aureus
TAQKGFV

SEQ ID NO: 1606694 - protein, 10 aa, Staphylococcus aureus
TARDSNRGGC

SEQ ID NO: 1606695 - protein, 24 aa, Staphylococcus aureus
TARNVTKTHTSNTNTFQSPNHGPL

SEQ ID NO: 1606696 - protein, 5 aa, Staphylococcus aureus
TARQT

SEQ ID NO: 1606697 - protein, 17 aa, Staphylococcus aureus
TARYGLNSGGEPTQGAG

SEQ ID NO: 1606698 - protein, 8 aa, Staphylococcus aureus
TASAGPGL

SEQ ID NO: 1606699 - protein, 9 aa, Staphylococcus aureus
TASRQETTE

SEQ ID NO: 1606700 - protein, 5 aa, Staphylococcus aureus
TATAF

SEQ ID NO: 1606701 - protein, 7 aa, Staphylococcus aureus
TATAQTT

SEQ ID NO: 1606702 - protein, 12 aa, Staphylococcus aureus
TATASKEPRDGD

SEQ ID NO: 1606703 - protein, 13 aa, Staphylococcus aureus
TAVKEGKAQGLEI

SEQ ID NO: 1606704 - protein, 6 aa, Staphylococcus aureus
TAYEQK

SEQ ID NO: 1606705 - protein, 11 aa, Staphylococcus aureus
TCTDNANGNEI

SEQ ID NO: 1606706 - protein, 7 aa, Staphylococcus aureus
TDAGQIY

SEQ ID NO: 1606707 - protein, 6 aa, Staphylococcus aureus
TDAHHT

SEQ ID NO: 1606708 - protein, 7 aa, Staphylococcus aureus
TDALQGK

SEQ ID NO: 1606709 - protein, 12 aa, Staphylococcus aureus
TDCPNIKNETER

SEQ ID NO: 1606710 - protein, 5 aa, Staphylococcus aureus
TDCSG

SEQ ID NO: 1606711 - protein, 5 aa, Staphylococcus aureus
TDDAR

SEQ ID NO: 1606712 - protein, 5 aa, Staphylococcus aureus
TDDEA

SEQ ID NO: 1606713 - protein, 6 aa, Staphylococcus aureus
TDDKRI

SEQ ID NO: 1606714 - protein, 7 aa, Staphylococcus aureus
TDDVTED

SEQ ID NO: 1606715 - protein, 8 aa, Staphylococcus aureus
TDEDIEST

SEQ ID NO: 1606716 - protein, 9 aa, Staphylococcus aureus
TDEEPHMGG

SEQ ID NO: 1606717 - protein, 5 aa, Staphylococcus aureus
TDEES

SEQ ID NO: 1606718 - protein, 8 aa, Staphylococcus aureus
TDENRSLV

SEQ ID NO: 1606719 - protein, 5 aa, Staphylococcus aureus
TDETI

SEQ ID NO: 1606720 - protein, 7 aa, Staphylococcus aureus
TDGPGFM

SEQ ID NO: 1606721 - protein, 17 aa, Staphylococcus aureus
TDGQALNLSKAESKIQI

SEQ ID NO: 1606722 - protein, 14 aa, Staphylococcus aureus
TDGTPFEGDPRANL

SEQ ID NO: 1606723 - protein, 5 aa, Staphylococcus aureus
TDGYG

SEQ ID NO: 1606724 - protein, 13 aa, Staphylococcus aureus
TDIEKDRQRCNAQ

SEQ ID NO: 1606725 - protein, 10 aa, Staphylococcus aureus
TDKDSKTPLE

SEQ ID NO: 1606726 - protein, 7 aa, Staphylococcus aureus
TDKRVSP

SEQ ID NO: 1606727 - protein, 6 aa, Staphylococcus aureus
TDNNGT

SEQ ID NO: 1606728 - protein, 8 aa, Staphylococcus aureus
TDNNKGIT

SEQ ID NO: 1606729 - protein, 8 aa, Staphylococcus aureus
TDNPKAVQ

SEQ ID NO: 1606730 - protein, 9 aa, Staphylococcus aureus
TDQSRNTDH

SEQ ID NO: 1606731 - protein, 6 aa, Staphylococcus aureus
TDTLEE

SEQ ID NO: 1606732 - protein, 11 aa, Staphylococcus aureus
TEADEKEMFGR

SEQ ID NO: 1606733 - protein, 21 aa, Staphylococcus aureus
TEEGIGQTTAVGIGGDPVNGT

SEQ ID NO: 1606734 - protein, 6 aa, Staphylococcus aureus
TEEVEQ

SEQ ID NO: 1606735 - protein, 6 aa, Staphylococcus aureus
TEFEQG

SEQ ID NO: 1606736 - protein, 9 aa, Staphylococcus aureus
TEGEAFDPN

SEQ ID NO: 1606737 - protein, 14 aa, Staphylococcus aureus
TEGQRGDQAVNVQT

SEQ ID NO: 1606738 - protein, 8 aa, Staphylococcus aureus
TEGYGPNE

SEQ ID NO: 1606739 - protein, 7 aa, Staphylococcus aureus
TEHRNKI

SEQ ID NO: 1606740 - protein, 5 aa, Staphylococcus aureus
TEIPG

SEQ ID NO: 1606741 - protein, 4 aa, Staphylococcus aureus
TEMP

SEQ ID NO: 1606742 - protein, 13 aa, Staphylococcus aureus
TENSGLSFIFTLQ

SEQ ID NO: 1606743 - protein, 8 aa, Staphylococcus aureus
TEPENKDI

SEQ ID NO: 1606744 - protein, 6 aa, Staphylococcus aureus
TERDEA

SEQ ID NO: 1606745 - protein, 9 aa, Staphylococcus aureus
TESGGQFPR

SEQ ID NO: 1606746 - protein, 9 aa, Staphylococcus aureus
TESITPYEG

SEQ ID NO: 1606747 - protein, 7 aa, Staphylococcus aureus
TESKFDR

SEQ ID NO: 1606748 - protein, 7 aa, Staphylococcus aureus
TESKKRE

SEQ ID NO: 1606749 - protein, 7 aa, Staphylococcus aureus
TESPSYQ

SEQ ID NO: 1606750 - protein, 6 aa, Staphylococcus aureus
TETARD

SEQ ID NO: 1606751 - protein, 7 aa, Staphylococcus aureus
TFEERGE

SEQ ID NO: 1606752 - protein, 8 aa, Staphylococcus aureus
TFEKDGPR

SEQ ID NO: 1606753 - protein, 12 aa, Staphylococcus aureus
TGAAASNHFEGG

SEQ ID NO: 1606754 - protein, 9 aa, Staphylococcus aureus
TGAGSGIGE

SEQ ID NO: 1606755 - protein, 5 aa, Staphylococcus aureus
TGATK

SEQ ID NO: 1606756 - protein, 7 aa, Staphylococcus aureus
TGDEHNG

SEQ ID NO: 1606757 - protein, 20 aa, Staphylococcus aureus
TGDQTQIDLPKGVKSGLKEA

SEQ ID NO: 1606758 - protein, 7 aa, Staphylococcus aureus
TGDYPAG

SEQ ID NO: 1606759 - protein, 7 aa, Staphylococcus aureus
TGEQQTV

SEQ ID NO: 1606760 - protein, 5 aa, Staphylococcus aureus
TGGDE

SEQ ID NO: 1606761 - protein, 7 aa, Staphylococcus aureus
TGGEPMF

SEQ ID NO: 1606762 - protein, 4 aa, Staphylococcus aureus
TGGG

SEQ ID NO: 1606763 - protein, 12 aa, Staphylococcus aureus
TGGLQQCGNSQN

SEQ ID NO: 1606764 - protein, 8 aa, Staphylococcus aureus
TGGQPNQL

SEQ ID NO: 1606765 - protein, 17 aa, Staphylococcus aureus
TGGTSVPQTGSTGDGYK

SEQ ID NO: 1606766 - protein, 5 aa, Staphylococcus aureus
TGGYN

SEQ ID NO: 1606767 - protein, 13 aa, Staphylococcus aureus
TGITEGDEVKRTG

SEQ ID NO: 1606768 - protein, 9 aa, Staphylococcus aureus
TGKFNHGDK

SEQ ID NO: 1606769 - protein, 8 aa, Staphylococcus aureus
TGKGPAVR

SEQ ID NO: 1606770 - protein, 11 aa, Staphylococcus aureus
TGKKQGRGAYV

SEQ ID NO: 1606771 - protein, 8 aa, Staphylococcus aureus
TGKSTIGK

SEQ ID NO: 1606772 - protein, 7 aa, Staphylococcus aureus
TGKSTVI

SEQ ID NO: 1606773 - protein, 8 aa, Staphylococcus aureus
TGNDYEAK

SEQ ID NO: 1606774 - protein, 9 aa, Staphylococcus aureus
TGNSGTTTR

SEQ ID NO: 1606775 - protein, 5 aa, Staphylococcus aureus
TGPLG

SEQ ID NO: 1606776 - protein, 9 aa, Staphylococcus aureus
TGQQYGRET

SEQ ID NO: 1606777 - protein, 4 aa, Staphylococcus aureus
TGRP

SEQ ID NO: 1606778 - protein, 7 aa, Staphylococcus aureus
TGRPYTE

SEQ ID NO: 1606779 - protein, 11 aa, Staphylococcus aureus
TGSAGALDESL

SEQ ID NO: 1606780 - protein, 7 aa, Staphylococcus aureus
TGSGKTE

SEQ ID NO: 1606781 - protein, 10 aa, Staphylococcus aureus
TGSGKTLTSF

SEQ ID NO: 1606782 - protein, 10 aa, Staphylococcus aureus
TGSGTQSNMN

SEQ ID NO: 1606783 - protein, 7 aa, Staphylococcus aureus
TGSKEHN

SEQ ID NO: 1606784 - protein, 8 aa, Staphylococcus aureus
TGSSPAEL

SEQ ID NO: 1606785 - protein, 9 aa, Staphylococcus aureus
TGSSPGHDL

SEQ ID NO: 1606786 - protein, 4 aa, Staphylococcus aureus
TGTD

SEQ ID NO: 1606787 - protein, 10 aa, Staphylococcus aureus
TGTNGKTTVT

SEQ ID NO: 1606788 - protein, 9 aa, Staphylococcus aureus
TGVGKTEIA

SEQ ID NO: 1606789 - protein, 12 aa, Staphylococcus aureus
TGVKRTTGQHPG

SEQ ID NO: 1606790 - protein, 4 aa, Staphylococcus aureus
THAP

SEQ ID NO: 1606791 - protein, 10 aa, Staphylococcus aureus
THDVDNDKSL

SEQ ID NO: 1606792 - protein, 11 aa, Staphylococcus aureus
THGEGEPPDNA

SEQ ID NO: 1606793 - protein, 11 aa, Staphylococcus aureus
THGTAPKYAGL

SEQ ID NO: 1606794 - protein, 10 aa, Staphylococcus aureus
THPNNPHKGY

SEQ ID NO: 1606795 - protein, 11 aa, Staphylococcus aureus
THSYKDRTDTI

SEQ ID NO: 1606796 - protein, 7 aa, Staphylococcus aureus
THYPKST

SEQ ID NO: 1606797 - protein, 5 aa, Staphylococcus aureus
TIDPT

SEQ ID NO: 1606798 - protein, 11 aa, Staphylococcus aureus
TIDSKPKDEVN

SEQ ID NO: 1606799 - protein, 12 aa, Staphylococcus aureus
TIETDKTSKQGL

SEQ ID NO: 1606800 - protein, 8 aa, Staphylococcus aureus
TIGPKGRN

SEQ ID NO: 1606801 - protein, 4 aa, Staphylococcus aureus
TINP

SEQ ID NO: 1606802 - protein, 8 aa, Staphylococcus aureus
TINTEYGK

SEQ ID NO: 1606803 - protein, 6 aa, Staphylococcus aureus
TISEQI

SEQ ID NO: 1606804 - protein, 11 aa, Staphylococcus aureus
TITTDSGKEIR

SEQ ID NO: 1606805 - protein, 10 aa, Staphylococcus aureus
TKDKHPDADK

SEQ ID NO: 1606806 - protein, 5 aa, Staphylococcus aureus
TKEAF

SEQ ID NO: 1606807 - protein, 10 aa, Staphylococcus aureus
TKEIQSNISE

SEQ ID NO: 1606808 - protein, 8 aa, Staphylococcus aureus
TKENEQYQ

SEQ ID NO: 1606809 - protein, 6 aa, Staphylococcus aureus
TKFGSM

SEQ ID NO: 1606810 - protein, 6 aa, Staphylococcus aureus
TKGDRI

SEQ ID NO: 1606811 - protein, 5 aa, Staphylococcus aureus
TKGGK

SEQ ID NO: 1606812 - protein, 6 aa, Staphylococcus aureus
TKGIGA

SEQ ID NO: 1606813 - protein, 10 aa, Staphylococcus aureus
TKGKEVERDG

SEQ ID NO: 1606814 - protein, 11 aa, Staphylococcus aureus
TKGQTSPSSAV

SEQ ID NO: 1606815 - protein, 8 aa, Staphylococcus aureus
TKGTNEPY

SEQ ID NO: 1606816 - protein, 7 aa, Staphylococcus aureus
TKIDGVE

SEQ ID NO: 1606817 - protein, 16 aa, Staphylococcus aureus
TKIYPGENVGRGGDDT

SEQ ID NO: 1606818 - protein, 8 aa, Staphylococcus aureus
TKKYGEEA

SEQ ID NO: 1606819 - protein, 5 aa, Staphylococcus aureus
TKLEP

SEQ ID NO: 1606820 - protein, 7 aa, Staphylococcus aureus
TKLPPTP

SEQ ID NO: 1606821 - protein, 5 aa, Staphylococcus aureus
TKNGQ

SEQ ID NO: 1606822 - protein, 6 aa, Staphylococcus aureus
TKNQSV

SEQ ID NO: 1606823 - protein, 9 aa, Staphylococcus aureus
TKPCSNERV

SEQ ID NO: 1606824 - protein, 9 aa, Staphylococcus aureus
TKREGEHMS

SEQ ID NO: 1606825 - protein, 7 aa, Staphylococcus aureus
TKRVENF

SEQ ID NO: 1606826 - protein, 15 aa, Staphylococcus aureus
TKSDGKKFGKSESGA

SEQ ID NO: 1606827 - protein, 8 aa, Staphylococcus aureus
TKSGSIEL

SEQ ID NO: 1606828 - protein, 5 aa, Staphylococcus aureus
TKTGA

SEQ ID NO: 1606829 - protein, 7 aa, Staphylococcus aureus
TKTPMGA

SEQ ID NO: 1606830 - protein, 5 aa, Staphylococcus aureus
TKTQY

SEQ ID NO: 1606831 - protein, 8 aa, Staphylococcus aureus
TKTTPEKS

SEQ ID NO: 1606832 - protein, 7 aa, Staphylococcus aureus
TKYSESM

SEQ ID NO: 1606833 - protein, 5 aa, Staphylococcus aureus
TLEQP

SEQ ID NO: 1606834 - protein, 8 aa, Staphylococcus aureus
TLESISSS

SEQ ID NO: 1606835 - protein, 7 aa, Staphylococcus aureus
TLGGQTG

SEQ ID NO: 1606836 - protein, 9 aa, Staphylococcus aureus
TLKEKEDKF

SEQ ID NO: 1606837 - protein, 7 aa, Staphylococcus aureus
TLQGNLD

SEQ ID NO: 1606838 - protein, 9 aa, Staphylococcus aureus
TLSGGEQQR

SEQ ID NO: 1606839 - protein, 5 aa, Staphylococcus aureus
TLSNA

SEQ ID NO: 1606840 - protein, 4 aa, Staphylococcus aureus
TLTE

SEQ ID NO: 1606841 - protein, 11 aa, Staphylococcus aureus
TMIGTDEKEIN

SEQ ID NO: 1606842 - protein, 12 aa, Staphylococcus aureus
TMTPKKPNSALR

SEQ ID NO: 1606843 - protein, 11 aa, Staphylococcus aureus
TNDNDQEQNLA

SEQ ID NO: 1606844 - protein, 5 aa, Staphylococcus aureus
TNDNN

SEQ ID NO: 1606845 - protein, 21 aa, Staphylococcus aureus
TNDQKNIDNPHKDLRRARSCN

SEQ ID NO: 1606846 - protein, 6 aa, Staphylococcus aureus
TNELAD

SEQ ID NO: 1606847 - protein, 7 aa, Staphylococcus aureus
TNENYTI

SEQ ID NO: 1606848 - protein, 7 aa, Staphylococcus aureus
TNETETY

SEQ ID NO: 1606849 - protein, 5 aa, Staphylococcus aureus
TNGEA

SEQ ID NO: 1606850 - protein, 7 aa, Staphylococcus aureus
TNGKSRA

SEQ ID NO: 1606851 - protein, 9 aa, Staphylococcus aureus
TNGTNQDEH

SEQ ID NO: 1606852 - protein, 5 aa, Staphylococcus aureus
TNIEQ

SEQ ID NO: 1606853 - protein, 7 aa, Staphylococcus aureus
TNIGTGM

SEQ ID NO: 1606854 - protein, 15 aa, Staphylococcus aureus
TNKETNGYKGSTTFT

SEQ ID NO: 1606855 - protein, 10 aa, Staphylococcus aureus
TNKLTEIEQS

SEQ ID NO: 1606856 - protein, 8 aa, Staphylococcus aureus
TNQNQQMQ

SEQ ID NO: 1606857 - protein, 7 aa, Staphylococcus aureus
TNQRETT

SEQ ID NO: 1606858 - protein, 12 aa, Staphylococcus aureus
TNTNPQLVNWFS

SEQ ID NO: 1606859 - protein, 4 aa, Staphylococcus aureus
TNVE

SEQ ID NO: 1606860 - protein, 7 aa, Staphylococcus aureus
TNVGKST

SEQ ID NO: 1606861 - protein, 7 aa, Staphylococcus aureus
TPEDQDD

SEQ ID NO: 1606862 - protein, 5 aa, Staphylococcus aureus
TPETY

SEQ ID NO: 1606863 - protein, 5 aa, Staphylococcus aureus
TPGHA

SEQ ID NO: 1606864 - protein, 12 aa, Staphylococcus aureus
TPGHEDFSEDTY

SEQ ID NO: 1606865 - protein, 9 aa, Staphylococcus aureus
TPGHSPGSL

SEQ ID NO: 1606866 - protein, 11 aa, Staphylococcus aureus
TPGSEAMKGAI

SEQ ID NO: 1606867 - protein, 6 aa, Staphylococcus aureus
TPHPTA

SEQ ID NO: 1606868 - protein, 5 aa, Staphylococcus aureus
TPLAE

SEQ ID NO: 1606869 - protein, 6 aa, Staphylococcus aureus
TPLAES

SEQ ID NO: 1606870 - protein, 4 aa, Staphylococcus aureus
TPQS

SEQ ID NO: 1606871 - protein, 9 aa, Staphylococcus aureus
TPSEETARQ

SEQ ID NO: 1606872 - protein, 7 aa, Staphylococcus aureus
TPSGDIQ

SEQ ID NO: 1606873 - protein, 12 aa, Staphylococcus aureus
TPTAGSSGTIPG

SEQ ID NO: 1606874 - protein, 8 aa, Staphylococcus aureus
TPYTKKPL

SEQ ID NO: 1606875 - protein, 6 aa, Staphylococcus aureus
TQDQPY

SEQ ID NO: 1606876 - protein, 14 aa, Staphylococcus aureus
TQEELAERTDLSKG

SEQ ID NO: 1606877 - protein, 7 aa, Staphylococcus aureus
TQITEDT

SEQ ID NO: 1606878 - protein, 7 aa, Staphylococcus aureus
TQNKPND

SEQ ID NO: 1606879 - protein, 8 aa, Staphylococcus aureus
TQQSLSNY

SEQ ID NO: 1606880 - protein, 13 aa, Staphylococcus aureus
TQRQGVNKAAVSR

SEQ ID NO: 1606881 - protein, 9 aa, Staphylococcus aureus
TQWSEPIDA

SEQ ID NO: 1606882 - protein, 8 aa, Staphylococcus aureus
TQYGQSGY

SEQ ID NO: 1606883 - protein, 7 aa, Staphylococcus aureus
TRADINR

SEQ ID NO: 1606884 - protein, 4 aa, Staphylococcus aureus
TRDN

SEQ ID NO: 1606885 - protein, 9 aa, Staphylococcus aureus
TRDRKPVTV

SEQ ID NO: 1606886 - protein, 14 aa, Staphylococcus aureus
TRGDGTTGEDITEN

SEQ ID NO: 1606887 - protein, 7 aa, Staphylococcus aureus
TRGQTQA

SEQ ID NO: 1606888 - protein, 6 aa, Staphylococcus aureus
TRPDTI

SEQ ID NO: 1606889 - protein, 10 aa, Staphylococcus aureus
TRQNRQTIKT

SEQ ID NO: 1606890 - protein, 6 aa, Staphylococcus aureus
TRRSTI

SEQ ID NO: 1606891 - protein, 6 aa, Staphylococcus aureus
TRVERN

SEQ ID NO: 1606892 - protein, 12 aa, Staphylococcus aureus
TSACSSKRNKLN

SEQ ID NO: 1606893 - protein, 7 aa, Staphylococcus aureus
TSDDGTL

SEQ ID NO: 1606894 - protein, 7 aa, Staphylococcus aureus
TSDDSDY

SEQ ID NO: 1606895 - protein, 7 aa, Staphylococcus aureus
TSDYSVK

SEQ ID NO: 1606896 - protein, 9 aa, Staphylococcus aureus
TSEQTPSSV

SEQ ID NO: 1606897 - protein, 4 aa, Staphylococcus aureus
TSFK

SEQ ID NO: 1606898 - protein, 4 aa, Staphylococcus aureus
TSFQ

SEQ ID NO: 1606899 - protein, 7 aa, Staphylococcus aureus
TSGEQRI

SEQ ID NO: 1606900 - protein, 5 aa, Staphylococcus aureus
TSGLG

SEQ ID NO: 1606901 - protein, 9 aa, Staphylococcus aureus
TSGPGATNV

SEQ ID NO: 1606902 - protein, 9 aa, Staphylococcus aureus
TSGSGKTTA

SEQ ID NO: 1606903 - protein, 11 aa, Staphylococcus aureus
TSGTTGNPKAV

SEQ ID NO: 1606904 - protein, 6 aa, Staphylococcus aureus
TSIPED

SEQ ID NO: 1606905 - protein, 9 aa, Staphylococcus aureus
TSKDNQTID

SEQ ID NO: 1606906 - protein, 8 aa, Staphylococcus aureus
TSKLDQDE

SEQ ID NO: 1606907 - protein, 14 aa, Staphylococcus aureus
TSKTIQPKPGESVG

SEQ ID NO: 1606908 - protein, 8 aa, Staphylococcus aureus
TSKTSSTL

SEQ ID NO: 1606909 - protein, 6 aa, Staphylococcus aureus
TSLPEH

SEQ ID NO: 1606910 - protein, 8 aa, Staphylococcus aureus
TSNGQTPF

SEQ ID NO: 1606911 - protein, 5 aa, Staphylococcus aureus
TSNPK

SEQ ID NO: 1606912 - protein, 8 aa, Staphylococcus aureus
TSNQPDDA

SEQ ID NO: 1606913 - protein, 4 aa, Staphylococcus aureus
TSPI

SEQ ID NO: 1606914 - protein, 7 aa, Staphylococcus aureus
TSQYHDS

SEQ ID NO: 1606915 - protein, 8 aa, Staphylococcus aureus
TSRNQYQP

SEQ ID NO: 1606916 - protein, 14 aa, Staphylococcus aureus
TSRPKKIGGERAKY

SEQ ID NO: 1606917 - protein, 24 aa, Staphylococcus aureus
TSRPQDNKSFSSNNTTTNTSSNNV

SEQ ID NO: 1606918 - protein, 8 aa, Staphylococcus aureus
TSSLRRGA

SEQ ID NO: 1606919 - protein, 10 aa, Staphylococcus aureus
TSTGCDGVHP

SEQ ID NO: 1606920 - protein, 5 aa, Staphylococcus aureus
TSYPG

SEQ ID NO: 1606921 - protein, 4 aa, Staphylococcus aureus
TTAI

SEQ ID NO: 1606922 - protein, 5 aa, Staphylococcus aureus
TTAQG

SEQ ID NO: 1606923 - protein, 6 aa, Staphylococcus aureus
TTDEFK

SEQ ID NO: 1606924 - protein, 7 aa, Staphylococcus aureus
TTDVAGE

SEQ ID NO: 1606925 - protein, 6 aa, Staphylococcus aureus
TTEDPL

SEQ ID NO: 1606926 - protein, 10 aa, Staphylococcus aureus
TTEDQLKTEQ

SEQ ID NO: 1606927 - protein, 8 aa, Staphylococcus aureus
TTGLSNQY

SEQ ID NO: 1606928 - protein, 6 aa, Staphylococcus aureus
TTHGKY

SEQ ID NO: 1606929 - protein, 5 aa, Staphylococcus aureus
TTKTT

SEQ ID NO: 1606930 - protein, 12 aa, Staphylococcus aureus
TTRAGSLTGPLR

SEQ ID NO: 1606931 - protein, 5 aa, Staphylococcus aureus
TTRQL

SEQ ID NO: 1606932 - protein, 21 aa, Staphylococcus aureus
TTSAKDIADAVRKTSRGESVF

SEQ ID NO: 1606933 - protein, 13 aa, Staphylococcus aureus
TTSKKKNAEDEKG

SEQ ID NO: 1606934 - protein, 7 aa, Staphylococcus aureus
TTSNPYH

SEQ ID NO: 1606935 - protein, 8 aa, Staphylococcus aureus
TTSTTVRA

SEQ ID NO: 1606936 - protein, 12 aa, Staphylococcus aureus
TTTHKTLRGPRG

SEQ ID NO: 1606937 - protein, 7 aa, Staphylococcus aureus
TTVGQSK

SEQ ID NO: 1606938 - protein, 4 aa, Staphylococcus aureus
TTVT

SEQ ID NO: 1606939 - protein, 16 aa, Staphylococcus aureus
TVEKDSKTMKKFEDEV

SEQ ID NO: 1606940 - protein, 4 aa, Staphylococcus aureus
TVEN

SEQ ID NO: 1606941 - protein, 8 aa, Staphylococcus aureus
TVENDGEI

SEQ ID NO: 1606942 - protein, 7 aa, Staphylococcus aureus
TVSKGGH

SEQ ID NO: 1606943 - protein, 7 aa, Staphylococcus aureus
TWSANDR

SEQ ID NO: 1606944 - protein, 11 aa, Staphylococcus aureus
TYAYDGGGYQL

SEQ ID NO: 1606945 - protein, 6 aa, Staphylococcus aureus
TYDGSR

SEQ ID NO: 1606946 - protein, 10 aa, Staphylococcus aureus
TYEKATRNTL

SEQ ID NO: 1606947 - protein, 17 aa, Staphylococcus aureus
TYERKDKEGVFHTQWIE

SEQ ID NO: 1606948 - protein, 10 aa, Staphylococcus aureus
TYGDSSSRFD

SEQ ID NO: 1606949 - protein, 13 aa, Staphylococcus aureus
TYNPTSANAPEIK

SEQ ID NO: 1606950 - protein, 13 aa, Staphylococcus aureus
TYNQLSKQPNQIN

SEQ ID NO: 1606951 - protein, 10 aa, Staphylococcus aureus
TYPRTDSNYL

SEQ ID NO: 1606952 - protein, 10 aa, Staphylococcus aureus
TYSKSSVNER

SEQ ID NO: 1606953 - protein, 7 aa, Staphylococcus aureus
VADADEV

SEQ ID NO: 1606954 - protein, 7 aa, Staphylococcus aureus
VAEDKQI

SEQ ID NO: 1606955 - protein, 11 aa, Staphylococcus aureus
VAEYNDGKFEE

SEQ ID NO: 1606956 - protein, 8 aa, Staphylococcus aureus
VAGDQQAA

SEQ ID NO: 1606957 - protein, 14 aa, Staphylococcus aureus
VAGERGAADAERDI

SEQ ID NO: 1606958 - protein, 12 aa, Staphylococcus aureus
VAKRATIPVLIV

SEQ ID NO: 1606959 - protein, 8 aa, Staphylococcus aureus
VAKRNDAK

SEQ ID NO: 1606960 - protein, 7 aa, Staphylococcus aureus
VANPDVT

SEQ ID NO: 1606961 - protein, 5 aa, Staphylococcus aureus
VAPPF

SEQ ID NO: 1606962 - protein, 8 aa, Staphylococcus aureus
VAPSSVDA

SEQ ID NO: 1606963 - protein, 4 aa, Staphylococcus aureus
VARD

SEQ ID NO: 1606964 - protein, 12 aa, Staphylococcus aureus
VASDGKYAKTSY

SEQ ID NO: 1606965 - protein, 31 aa, Staphylococcus aureus
VASEDKTPKLNKLGGSEWKKTKAKVQQSVED

SEQ ID NO: 1606966 - protein, 18 aa, Staphylococcus aureus
VATNNHNSGQDVSRQGVQ

SEQ ID NO: 1606967 - protein, 13 aa, Staphylococcus aureus
VATPGIGKDAFQE

SEQ ID NO: 1606968 - protein, 7 aa, Staphylococcus aureus
VAVGNTK

SEQ ID NO: 1606969 - protein, 4 aa, Staphylococcus aureus
VAYT

SEQ ID NO: 1606970 - protein, 11 aa, Staphylococcus aureus
VDGEKTAFPDT

SEQ ID NO: 1606971 - protein, 7 aa, Staphylococcus aureus
VDGGAVK

SEQ ID NO: 1606972 - protein, 6 aa, Staphylococcus aureus
VDIPGS

SEQ ID NO: 1606973 - protein, 8 aa, Staphylococcus aureus
VDNNKDQT

SEQ ID NO: 1606974 - protein, 14 aa, Staphylococcus aureus
VDPDYEPEISIEDS

SEQ ID NO: 1606975 - protein, 16 aa, Staphylococcus aureus
VDPQDVYDKTMKLTDL

SEQ ID NO: 1606976 - protein, 5 aa, Staphylococcus aureus
VDQAK

SEQ ID NO: 1606977 - protein, 7 aa, Staphylococcus aureus
VDSGGKG

SEQ ID NO: 1606978 - protein, 5 aa, Staphylococcus aureus
VDSQR

SEQ ID NO: 1606979 - protein, 12 aa, Staphylococcus aureus
VDSSYGATWYDA

SEQ ID NO: 1606980 - protein, 4 aa, Staphylococcus aureus
VEAG

SEQ ID NO: 1606981 - protein, 7 aa, Staphylococcus aureus
VEDDKQG

SEQ ID NO: 1606982 - protein, 8 aa, Staphylococcus aureus
VEEEESVG

SEQ ID NO: 1606983 - protein, 10 aa, Staphylococcus aureus
VEEETLRNGR

SEQ ID NO: 1606984 - protein, 8 aa, Staphylococcus aureus
VEGTPEKF

SEQ ID NO: 1606985 - protein, 7 aa, Staphylococcus aureus
VEIPEKA

SEQ ID NO: 1606986 - protein, 4 aa, Staphylococcus aureus
VEKA

SEQ ID NO: 1606987 - protein, 8 aa, Staphylococcus aureus
VELSPTSD

SEQ ID NO: 1606988 - protein, 6 aa, Staphylococcus aureus
VENKKS

SEQ ID NO: 1606989 - protein, 4 aa, Staphylococcus aureus
VEPN

SEQ ID NO: 1606990 - protein, 9 aa, Staphylococcus aureus
VEPSGASSM

SEQ ID NO: 1606991 - protein, 7 aa, Staphylococcus aureus
VEQDPGA

SEQ ID NO: 1606992 - protein, 7 aa, Staphylococcus aureus
VEQQSTP

SEQ ID NO: 1606993 - protein, 10 aa, Staphylococcus aureus
VEQTTKGPQI

SEQ ID NO: 1606994 - protein, 10 aa, Staphylococcus aureus
VERSRKALSQ

SEQ ID NO: 1606995 - protein, 7 aa, Staphylococcus aureus
VESATAN

SEQ ID NO: 1606996 - protein, 5 aa, Staphylococcus aureus
VFSTE

SEQ ID NO: 1606997 - protein, 12 aa, Staphylococcus aureus
VGEGASGKEAIA

SEQ ID NO: 1606998 - protein, 5 aa, Staphylococcus aureus
VGENF

SEQ ID NO: 1606999 - protein, 8 aa, Staphylococcus aureus
VGEQLEGE

SEQ ID NO: 1607000 - protein, 16 aa, Staphylococcus aureus
VGETGPVRAPGRREIG

SEQ ID NO: 1607001 - protein, 4 aa, Staphylococcus aureus
VGGL

SEQ ID NO: 1607002 - protein, 12 aa, Staphylococcus aureus
VGGRKGHVYTDD

SEQ ID NO: 1607003 - protein, 10 aa, Staphylococcus aureus
VGGSDQWGNI

SEQ ID NO: 1607004 - protein, 11 aa, Staphylococcus aureus
VGGTNGKGSTV

SEQ ID NO: 1607005 - protein, 9 aa, Staphylococcus aureus
VGKKTAQNI

SEQ ID NO: 1607006 - protein, 5 aa, Staphylococcus aureus
VGKST

SEQ ID NO: 1607007 - protein, 14 aa, Staphylococcus aureus
VGNPREDGTQVGPI

SEQ ID NO: 1607008 - protein, 8 aa, Staphylococcus aureus
VGPNGDPL

SEQ ID NO: 1607009 - protein, 9 aa, Staphylococcus aureus
VGQDDAKVK

SEQ ID NO: 1607010 - protein, 12 aa, Staphylococcus aureus
VGQTQDDEGNRG

SEQ ID NO: 1607011 - protein, 8 aa, Staphylococcus aureus
VGRGPLAG

SEQ ID NO: 1607012 - protein, 7 aa, Staphylococcus aureus
VGSKEGV

SEQ ID NO: 1607013 - protein, 7 aa, Staphylococcus aureus
VGTRNEV

SEQ ID NO: 1607014 - protein, 23 aa, Staphylococcus aureus
VGTSTIKDAEELKVKETNRIDTT

SEQ ID NO: 1607015 - protein, 6 aa, Staphylococcus aureus
VGYNED

SEQ ID NO: 1607016 - protein, 15 aa, Staphylococcus aureus
VHDENEGAIEVKPYA

SEQ ID NO: 1607017 - protein, 5 aa, Staphylococcus aureus
VHEGT

SEQ ID NO: 1607018 - protein, 6 aa, Staphylococcus aureus
VINDPD

SEQ ID NO: 1607019 - protein, 7 aa, Staphylococcus aureus
VISPEGA

SEQ ID NO: 1607020 - protein, 9 aa, Staphylococcus aureus
VKANEESKK

SEQ ID NO: 1607021 - protein, 8 aa, Staphylococcus aureus
VKASPEHP

SEQ ID NO: 1607022 - protein, 7 aa, Staphylococcus aureus
VKGDENF

SEQ ID NO: 1607023 - protein, 11 aa, Staphylococcus aureus
VKGPGPGRESA

SEQ ID NO: 1607024 - protein, 8 aa, Staphylococcus aureus
VKKNIENG

SEQ ID NO: 1607025 - protein, 6 aa, Staphylococcus aureus
VKNNQP

SEQ ID NO: 1607026 - protein, 9 aa, Staphylococcus aureus
VKPGKGSAF

SEQ ID NO: 1607027 - protein, 20 aa, Staphylococcus aureus
VKQTEDRVRQKTGPEKVKAQ

SEQ ID NO: 1607028 - protein, 6 aa, Staphylococcus aureus
VKRPEV

SEQ ID NO: 1607029 - protein, 6 aa, Staphylococcus aureus
VKSESD

SEQ ID NO: 1607030 - protein, 10 aa, Staphylococcus aureus
VKSKNVSKKV

SEQ ID NO: 1607031 - protein, 12 aa, Staphylococcus aureus
VKTAATPSEIGS

SEQ ID NO: 1607032 - protein, 6 aa, Staphylococcus aureus
VKTAKN

SEQ ID NO: 1607033 - protein, 5 aa, Staphylococcus aureus
VKTGY

SEQ ID NO: 1607034 - protein, 16 aa, Staphylococcus aureus
VNASTGKYTGRSPKDK

SEQ ID NO: 1607035 - protein, 10 aa, Staphylococcus aureus
VNDETPGNAI

SEQ ID NO: 1607036 - protein, 7 aa, Staphylococcus aureus
VNEGDTF

SEQ ID NO: 1607037 - protein, 16 aa, Staphylococcus aureus
VNEKRGIKEPESEVPE

SEQ ID NO: 1607038 - protein, 5 aa, Staphylococcus aureus
VNENT

SEQ ID NO: 1607039 - protein, 9 aa, Staphylococcus aureus
VNEQRSQQL

SEQ ID NO: 1607040 - protein, 7 aa, Staphylococcus aureus
VNESPYE

SEQ ID NO: 1607041 - protein, 5 aa, Staphylococcus aureus
VNGKR

SEQ ID NO: 1607042 - protein, 7 aa, Staphylococcus aureus
VNGNDEH

SEQ ID NO: 1607043 - protein, 6 aa, Staphylococcus aureus
VNPDEV

SEQ ID NO: 1607044 - protein, 6 aa, Staphylococcus aureus
VNPERM

SEQ ID NO: 1607045 - protein, 4 aa, Staphylococcus aureus
VNPF

SEQ ID NO: 1607046 - protein, 5 aa, Staphylococcus aureus
VNSGN

SEQ ID NO: 1607047 - protein, 16 aa, Staphylococcus aureus
VNSPSRSYKAVGGGAP

SEQ ID NO: 1607048 - protein, 8 aa, Staphylococcus aureus
VNSYGKDL

SEQ ID NO: 1607049 - protein, 6 aa, Staphylococcus aureus
VNTRYG

SEQ ID NO: 1607050 - protein, 14 aa, Staphylococcus aureus
VPAEGVASFNQKGH

SEQ ID NO: 1607051 - protein, 4 aa, Staphylococcus aureus
VPDV

SEQ ID NO: 1607052 - protein, 4 aa, Staphylococcus aureus
VPEE

SEQ ID NO: 1607053 - protein, 4 aa, Staphylococcus aureus
VPIS

SEQ ID NO: 1607054 - protein, 11 aa, Staphylococcus aureus
VPNAKAIRSTM

SEQ ID NO: 1607055 - protein, 4 aa, Staphylococcus aureus
VPRT

SEQ ID NO: 1607056 - protein, 10 aa, Staphylococcus aureus
VPTGETGTTN

SEQ ID NO: 1607057 - protein, 5 aa, Staphylococcus aureus
VQDRT

SEQ ID NO: 1607058 - protein, 6 aa, Staphylococcus aureus
VQDSHS

SEQ ID NO: 1607059 - protein, 10 aa, Staphylococcus aureus
VQPHSGSQAN

SEQ ID NO: 1607060 - protein, 5 aa, Staphylococcus aureus
VQPKQ

SEQ ID NO: 1607061 - protein, 6 aa, Staphylococcus aureus
VQPPHY

SEQ ID NO: 1607062 - protein, 4 aa, Staphylococcus aureus
VQQG

SEQ ID NO: 1607063 - protein, 5 aa, Staphylococcus aureus
VQRSM

SEQ ID NO: 1607064 - protein, 7 aa, Staphylococcus aureus
VQSNGGV

SEQ ID NO: 1607065 - protein, 5 aa, Staphylococcus aureus
VQTPT

SEQ ID NO: 1607066 - protein, 20 aa, Staphylococcus aureus
VRDDAKASEDAPVGPGPRKA

SEQ ID NO: 1607067 - protein, 8 aa, Staphylococcus aureus
VRQSDQLN

SEQ ID NO: 1607068 - protein, 7 aa, Staphylococcus aureus
VRRGAPN

SEQ ID NO: 1607069 - protein, 9 aa, Staphylococcus aureus
VRSEESNSH

SEQ ID NO: 1607070 - protein, 5 aa, Staphylococcus aureus
VRTNK

SEQ ID NO: 1607071 - protein, 6 aa, Staphylococcus aureus
VSAETQ

SEQ ID NO: 1607072 - protein, 8 aa, Staphylococcus aureus
VSAGEPLN

SEQ ID NO: 1607073 - protein, 17 aa, Staphylococcus aureus
VSDELTAELERSPSISE

SEQ ID NO: 1607074 - protein, 8 aa, Staphylococcus aureus
VSDKDGDM

SEQ ID NO: 1607075 - protein, 16 aa, Staphylococcus aureus
VSDRTQAAIYAMENKL

SEQ ID NO: 1607076 - protein, 7 aa, Staphylococcus aureus
VSEQQML

SEQ ID NO: 1607077 - protein, 9 aa, Staphylococcus aureus
VSGNDTQAD

SEQ ID NO: 1607078 - protein, 6 aa, Staphylococcus aureus
VSGNEP

SEQ ID NO: 1607079 - protein, 11 aa, Staphylococcus aureus
VSGPSLERPGD

SEQ ID NO: 1607080 - protein, 7 aa, Staphylococcus aureus
VSIGKRP

SEQ ID NO: 1607081 - protein, 4 aa, Staphylococcus aureus
VSKG

SEQ ID NO: 1607082 - protein, 11 aa, Staphylococcus aureus
VSKNPMDGSQV

SEQ ID NO: 1607083 - protein, 16 aa, Staphylococcus aureus
VSKSDMKRVKQLLAYK

SEQ ID NO: 1607084 - protein, 9 aa, Staphylococcus aureus
VSKTQREKF

SEQ ID NO: 1607085 - protein, 8 aa, Staphylococcus aureus
VSNEESYQ

SEQ ID NO: 1607086 - protein, 5 aa, Staphylococcus aureus
VSNQY

SEQ ID NO: 1607087 - protein, 7 aa, Staphylococcus aureus
VSPATIR

SEQ ID NO: 1607088 - protein, 13 aa, Staphylococcus aureus
VSRDEAKELFSND

SEQ ID NO: 1607089 - protein, 4 aa, Staphylococcus aureus
VSRE

SEQ ID NO: 1607090 - protein, 20 aa, Staphylococcus aureus
VSSGENRAVEAAKKAISSPL

SEQ ID NO: 1607091 - protein, 5 aa, Staphylococcus aureus
VSTDD

SEQ ID NO: 1607092 - protein, 8 aa, Staphylococcus aureus
VTASTDSV

SEQ ID NO: 1607093 - protein, 11 aa, Staphylococcus aureus
VTDTNENSGVG

SEQ ID NO: 1607094 - protein, 12 aa, Staphylococcus aureus
VTEARNSEGTFI

SEQ ID NO: 1607095 - protein, 7 aa, Staphylococcus aureus
VTEGPGL

SEQ ID NO: 1607096 - protein, 6 aa, Staphylococcus aureus
VTEGQE

SEQ ID NO: 1607097 - protein, 13 aa, Staphylococcus aureus
VTGSNGKTTTKDM

SEQ ID NO: 1607098 - protein, 7 aa, Staphylococcus aureus
VTGTAQL

SEQ ID NO: 1607099 - protein, 12 aa, Staphylococcus aureus
VTNTGDKKSRQI

SEQ ID NO: 1607100 - protein, 7 aa, Staphylococcus aureus
VTNTKKD

SEQ ID NO: 1607101 - protein, 4 aa, Staphylococcus aureus
VTQK

SEQ ID NO: 1607102 - protein, 7 aa, Staphylococcus aureus
VTRENDG

SEQ ID NO: 1607103 - protein, 10 aa, Staphylococcus aureus
VTSASAAVAT

SEQ ID NO: 1607104 - protein, 5 aa, Staphylococcus aureus
VTSTP

SEQ ID NO: 1607105 - protein, 22 aa, Staphylococcus aureus
VTTNPIAGTIQRGETTQIDNEN

SEQ ID NO: 1607106 - protein, 12 aa, Staphylococcus aureus
VTTSEEDTKSLG

SEQ ID NO: 1607107 - protein, 7 aa, Staphylococcus aureus
VVETESD

SEQ ID NO: 1607108 - protein, 7 aa, Staphylococcus aureus
VVPGSDG

SEQ ID NO: 1607109 - protein, 12 aa, Staphylococcus aureus
VVQGEKRGRTIG

SEQ ID NO: 1607110 - protein, 6 aa, Staphylococcus aureus
VYPTQS

SEQ ID NO: 1607111 - protein, 7 aa, Staphylococcus aureus
WAEPEGM

SEQ ID NO: 1607112 - protein, 14 aa, Staphylococcus aureus
WATTEENLNKLLEL

SEQ ID NO: 1607113 - protein, 8 aa, Staphylococcus aureus
WNGNQSPQ

SEQ ID NO: 1607114 - protein, 6 aa, Staphylococcus aureus
WPPSGD

SEQ ID NO: 1607115 - protein, 21 aa, Staphylococcus aureus
WSDTNDDSVRANRPRIDTARN

SEQ ID NO: 1607116 - protein, 19 aa, Staphylococcus aureus
WSSAGALGFKGSKKSTPFA

SEQ ID NO: 1607117 - protein, 4 aa, Staphylococcus aureus
WYGP

SEQ ID NO: 1607118 - protein, 11 aa, Staphylococcus aureus
YADGSDNPEGH

SEQ ID NO: 1607119 - protein, 6 aa, Staphylococcus aureus
YAETDK

SEQ ID NO: 1607120 - protein, 8 aa, Staphylococcus aureus
YAGSDKDT

SEQ ID NO: 1607121 - protein, 8 aa, Staphylococcus aureus
YANEGPTL

SEQ ID NO: 1607122 - protein, 10 aa, Staphylococcus aureus
YAQNDESPLV

SEQ ID NO: 1607123 - protein, 5 aa, Staphylococcus aureus
YATSE

SEQ ID NO: 1607124 - protein, 12 aa, Staphylococcus aureus
YDDGKDPKGLPK

SEQ ID NO: 1607125 - protein, 9 aa, Staphylococcus aureus
YDENDNPVR

SEQ ID NO: 1607126 - protein, 9 aa, Staphylococcus aureus
YDGDTSKVE

SEQ ID NO: 1607127 - protein, 6 aa, Staphylococcus aureus
YDGENK

SEQ ID NO: 1607128 - protein, 19 aa, Staphylococcus aureus
YDLGPGPRMPEKKRQTAYE

SEQ ID NO: 1607129 - protein, 7 aa, Staphylococcus aureus
YDNKSGL

SEQ ID NO: 1607130 - protein, 28 aa, Staphylococcus aureus
YDNQTGVNEKEREERQKQQEQNQEPQFK

SEQ ID NO: 1607131 - protein, 5 aa, Staphylococcus aureus
YDPYR

SEQ ID NO: 1607132 - protein, 5 aa, Staphylococcus aureus
YDQIS

SEQ ID NO: 1607133 - protein, 4 aa, Staphylococcus aureus
YDRN

SEQ ID NO: 1607134 - protein, 17 aa, Staphylococcus aureus
YDSRRQAFDDSGDLKPY

SEQ ID NO: 1607135 - protein, 18 aa, Staphylococcus aureus
YDTPGMSGQTSDSKLGGG

SEQ ID NO: 1607136 - protein, 4 aa, Staphylococcus aureus
YEDK

SEQ ID NO: 1607137 - protein, 4 aa, Staphylococcus aureus
YEDN

SEQ ID NO: 1607138 - protein, 5 aa, Staphylococcus aureus
YEEGQ

SEQ ID NO: 1607139 - protein, 6 aa, Staphylococcus aureus
YEENEN

SEQ ID NO: 1607140 - protein, 4 aa, Staphylococcus aureus
YELQ

SEQ ID NO: 1607141 - protein, 9 aa, Staphylococcus aureus
YESEDRPKS

SEQ ID NO: 1607142 - protein, 11 aa, Staphylococcus aureus
YEVNGESKTIH

SEQ ID NO: 1607143 - protein, 7 aa, Staphylococcus aureus
YGDGAAD

SEQ ID NO: 1607144 - protein, 4 aa, Staphylococcus aureus
YGED

SEQ ID NO: 1607145 - protein, 23 aa, Staphylococcus aureus
YGGKRKNYYGEGEDAMVMWVNLN

SEQ ID NO: 1607146 - protein, 5 aa, Staphylococcus aureus
YGKRP

SEQ ID NO: 1607147 - protein, 12 aa, Staphylococcus aureus
YGLPASDARNKD

SEQ ID NO: 1607148 - protein, 10 aa, Staphylococcus aureus
YGLRSNADNF

SEQ ID NO: 1607149 - protein, 11 aa, Staphylococcus aureus
YGNGSPSNLVG

SEQ ID NO: 1607150 - protein, 5 aa, Staphylococcus aureus
YGNVN

SEQ ID NO: 1607151 - protein, 6 aa, Staphylococcus aureus
YGPDRI

SEQ ID NO: 1607152 - protein, 10 aa, Staphylococcus aureus
YGPPKDRRAG

SEQ ID NO: 1607153 - protein, 6 aa, Staphylococcus aureus
YGQKGE

SEQ ID NO: 1607154 - protein, 7 aa, Staphylococcus aureus
YGSEETP

SEQ ID NO: 1607155 - protein, 17 aa, Staphylococcus aureus
YGSQGHAHAQNLKDNGY

SEQ ID NO: 1607156 - protein, 9 aa, Staphylococcus aureus
YHDADATAF

SEQ ID NO: 1607157 - protein, 5 aa, Staphylococcus aureus
YHDKE

SEQ ID NO: 1607158 - protein, 4 aa, Staphylococcus aureus
YHGH

SEQ ID NO: 1607159 - protein, 6 aa, Staphylococcus aureus
YHKTPA

SEQ ID NO: 1607160 - protein, 6 aa, Staphylococcus aureus
YHQDYY

SEQ ID NO: 1607161 - protein, 15 aa, Staphylococcus aureus
YIGETNRKYIPLEER

SEQ ID NO: 1607162 - protein, 9 aa, Staphylococcus aureus
YKAKKEELA

SEQ ID NO: 1607163 - protein, 14 aa, Staphylococcus aureus
YKDENRDNSRTPMQ

SEQ ID NO: 1607164 - protein, 13 aa, Staphylococcus aureus
YKDSNKKAEMSKR

SEQ ID NO: 1607165 - protein, 7 aa, Staphylococcus aureus
YKEDGTG

SEQ ID NO: 1607166 - protein, 4 aa, Staphylococcus aureus
YKGP

SEQ ID NO: 1607167 - protein, 5 aa, Staphylococcus aureus
YKHDG

SEQ ID NO: 1607168 - protein, 6 aa, Staphylococcus aureus
YKKDID

SEQ ID NO: 1607169 - protein, 10 aa, Staphylococcus aureus
YKKTDKGQFT

SEQ ID NO: 1607170 - protein, 8 aa, Staphylococcus aureus
YKNNDLSK

SEQ ID NO: 1607171 - protein, 9 aa, Staphylococcus aureus
YKRSSGVDF

SEQ ID NO: 1607172 - protein, 7 aa, Staphylococcus aureus
YKRTRTY

SEQ ID NO: 1607173 - protein, 7 aa, Staphylococcus aureus
YKTPEDY

SEQ ID NO: 1607174 - protein, 26 aa, Staphylococcus aureus
YLGPAREAIKETVKGKIKEFGTSNRA

SEQ ID NO: 1607175 - protein, 9 aa, Staphylococcus aureus
YNASPTSMR

SEQ ID NO: 1607176 - protein, 6 aa, Staphylococcus aureus
YNQNGD

SEQ ID NO: 1607177 - protein, 9 aa, Staphylococcus aureus
YPADDQNSA

SEQ ID NO: 1607178 - protein, 7 aa, Staphylococcus aureus
YPDEMGT

SEQ ID NO: 1607179 - protein, 9 aa, Staphylococcus aureus
YPDNPKAYQ

SEQ ID NO: 1607180 - protein, 8 aa, Staphylococcus aureus
YPGGPQVD

SEQ ID NO: 1607181 - protein, 8 aa, Staphylococcus aureus
YPKRSKAV

SEQ ID NO: 1607182 - protein, 10 aa, Staphylococcus aureus
YPNESEEQFE

SEQ ID NO: 1607183 - protein, 15 aa, Staphylococcus aureus
YPPAQDRCCDNDSNI

SEQ ID NO: 1607184 - protein, 6 aa, Staphylococcus aureus
YPPHTP

SEQ ID NO: 1607185 - protein, 13 aa, Staphylococcus aureus
YPQARPLGKPNPF

SEQ ID NO: 1607186 - protein, 12 aa, Staphylococcus aureus
YPSEISGGQKQR

SEQ ID NO: 1607187 - protein, 12 aa, Staphylococcus aureus
YPVRPETLDEGD

SEQ ID NO: 1607188 - protein, 4 aa, Staphylococcus aureus
YPYN

SEQ ID NO: 1607189 - protein, 5 aa, Staphylococcus aureus
YQAEV

SEQ ID NO: 1607190 - protein, 6 aa, Staphylococcus aureus
YQDEST

SEQ ID NO: 1607191 - protein, 16 aa, Staphylococcus aureus
YQDGRSSERLVKDLFR

SEQ ID NO: 1607192 - protein, 9 aa, Staphylococcus aureus
YQDTNKAQY

SEQ ID NO: 1607193 - protein, 8 aa, Staphylococcus aureus
YQDTNRVQ

SEQ ID NO: 1607194 - protein, 8 aa, Staphylococcus aureus
YQHTTAAT

SEQ ID NO: 1607195 - protein, 7 aa, Staphylococcus aureus
YQNRGYA

SEQ ID NO: 1607196 - protein, 6 aa, Staphylococcus aureus
YQQTNG

SEQ ID NO: 1607197 - protein, 7 aa, Staphylococcus aureus
YQTHTNA

SEQ ID NO: 1607198 - protein, 7 aa, Staphylococcus aureus
YQTRRNI

SEQ ID NO: 1607199 - protein, 7 aa, Staphylococcus aureus
YRGMGNE

SEQ ID NO: 1607200 - protein, 6 aa, Staphylococcus aureus
YRKQNY

SEQ ID NO: 1607201 - protein, 9 aa, Staphylococcus aureus
YRNGKNDHV

SEQ ID NO: 1607202 - protein, 4 aa, Staphylococcus aureus
YRQD

SEQ ID NO: 1607203 - protein, 6 aa, Staphylococcus aureus
YRSTKT

SEQ ID NO: 1607204 - protein, 8 aa, Staphylococcus aureus
YRTNEANT

SEQ ID NO: 1607205 - protein, 6 aa, Staphylococcus aureus
YRVEEN

SEQ ID NO: 1607206 - protein, 7 aa, Staphylococcus aureus
YRVETDT

SEQ ID NO: 1607207 - protein, 6 aa, Staphylococcus aureus
YSDPTI

SEQ ID NO: 1607208 - protein, 7 aa, Staphylococcus aureus
YSDQDEV

SEQ ID NO: 1607209 - protein, 7 aa, Staphylococcus aureus
YSEMEQD

SEQ ID NO: 1607210 - protein, 8 aa, Staphylococcus aureus
YSGNDDNV

SEQ ID NO: 1607211 - protein, 9 aa, Staphylococcus aureus
YSKGQSHHE

SEQ ID NO: 1607212 - protein, 12 aa, Staphylococcus aureus
YSKSITAHKEAI

SEQ ID NO: 1607213 - protein, 9 aa, Staphylococcus aureus
YSLSGGQQQ

SEQ ID NO: 1607214 - protein, 8 aa, Staphylococcus aureus
YSNQEIAS

SEQ ID NO: 1607215 - protein, 19 aa, Staphylococcus aureus
YSNSRGSLKIKSKDPFEKP

SEQ ID NO: 1607216 - protein, 4 aa, Staphylococcus aureus
YSRG

SEQ ID NO: 1607217 - protein, 12 aa, Staphylococcus aureus
YTEADVRQALED

SEQ ID NO: 1607218 - protein, 4 aa, Staphylococcus aureus
YTGR

SEQ ID NO: 1607219 - protein, 5 aa, Staphylococcus aureus
YTPNG

SEQ ID NO: 1607220 - protein, 4 aa, Staphylococcus aureus
YTRE

SEQ ID NO: 1607221 - protein, 14 aa, Staphylococcus aureus
YTREINTMKYYNLL

SEQ ID NO: 1607222 - protein, 5 aa, Staphylococcus aureus
YTRES

SEQ ID NO: 1607223 - protein, 4 aa, Staphylococcus aureus
YTSE

SEQ ID NO: 1607224 - protein, 5 aa, Staphylococcus aureus
YTTTA

SEQ ID NO: 1607225 - protein, 19 aa, Staphylococcus aureus
YVGYDDNSNTLTEKVRRNP

SEQ ID NO: 1607226 - protein, 30 aa, Staphylococcus aureus
YYDADNPAFKPKKRPDKHERLTQREESQIT

SEQ ID NO: 1607227 - protein, 12 aa, Staphylococcus aureus
AAAGKSTIAKRV

SEQ ID NO: 1607228 - protein, 8 aa, Staphylococcus aureus
AAAPDIYD

SEQ ID NO: 1607229 - protein, 4 aa, Staphylococcus aureus
AADE

SEQ ID NO: 1607230 - protein, 13 aa, Staphylococcus aureus
AADKITDSIEDTI

SEQ ID NO: 1607231 - protein, 13 aa, Staphylococcus aureus
AAFGKNGGNMGVS

SEQ ID NO: 1607232 - protein, 19 aa, Staphylococcus aureus
AAGLTSSSSEMAAKGGSGL

SEQ ID NO: 1607233 - protein, 8 aa, Staphylococcus aureus
AAKKAKDW

SEQ ID NO: 1607234 - protein, 7 aa, Staphylococcus aureus
AANTIKP

SEQ ID NO: 1607235 - protein, 5 aa, Staphylococcus aureus
AAQER

SEQ ID NO: 1607236 - protein, 14 aa, Staphylococcus aureus
AAQIAKKAHKEGLT

SEQ ID NO: 1607237 - protein, 9 aa, Staphylococcus aureus
AASNNGVDE

SEQ ID NO: 1607238 - protein, 7 aa, Staphylococcus aureus
AAYPGQG

SEQ ID NO: 1607239 - protein, 9 aa, Staphylococcus aureus
AAYQSQKDI

SEQ ID NO: 1607240 - protein, 6 aa, Staphylococcus aureus
ADGEKC

SEQ ID NO: 1607241 - protein, 9 aa, Staphylococcus aureus
ADPEYRGSL

SEQ ID NO: 1607242 - protein, 7 aa, Staphylococcus aureus
ADQTNVQ

SEQ ID NO: 1607243 - protein, 7 aa, Staphylococcus aureus
ADTGVDP

SEQ ID NO: 1607244 - protein, 18 aa, Staphylococcus aureus
AEAAGGKGYTIKSASEVD

SEQ ID NO: 1607245 - protein, 7 aa, Staphylococcus aureus
AEAGVAP

SEQ ID NO: 1607246 - protein, 8 aa, Staphylococcus aureus
AEAQANQM

SEQ ID NO: 1607247 - protein, 6 aa, Staphylococcus aureus
AEEYGN

SEQ ID NO: 1607248 - protein, 9 aa, Staphylococcus aureus
AEKQEQHAL

SEQ ID NO: 1607249 - protein, 7 aa, Staphylococcus aureus
AEPASDF

SEQ ID NO: 1607250 - protein, 8 aa, Staphylococcus aureus
AESREEVA

SEQ ID NO: 1607251 - protein, 10 aa, Staphylococcus aureus
AGAGQKGAVT

SEQ ID NO: 1607252 - protein, 11 aa, Staphylococcus aureus
AGDGGNGITAY

SEQ ID NO: 1607253 - protein, 7 aa, Staphylococcus aureus
AGENGPL

SEQ ID NO: 1607254 - protein, 8 aa, Staphylococcus aureus
AGGDGTLN

SEQ ID NO: 1607255 - protein, 4 aa, Staphylococcus aureus
AGGM

SEQ ID NO: 1607256 - protein, 12 aa, Staphylococcus aureus
AGLEKSRQNFQE

SEQ ID NO: 1607257 - protein, 7 aa, Staphylococcus aureus
AGLGRSG

SEQ ID NO: 1607258 - protein, 6 aa, Staphylococcus aureus
AGNQIT

SEQ ID NO: 1607259 - protein, 6 aa, Staphylococcus aureus
AGVEAG

SEQ ID NO: 1607260 - protein, 13 aa, Staphylococcus aureus
AGYHKTPDVNGFR

SEQ ID NO: 1607261 - protein, 14 aa, Staphylococcus aureus
AHGEYDEVATSTAK

SEQ ID NO: 1607262 - protein, 4 aa, Staphylococcus aureus
AHPS

SEQ ID NO: 1607263 - protein, 8 aa, Staphylococcus aureus
AHQRPEDQ

SEQ ID NO: 1607264 - protein, 9 aa, Staphylococcus aureus
AHTKEDIEK

SEQ ID NO: 1607265 - protein, 5 aa, Staphylococcus aureus
AIAKA

SEQ ID NO: 1607266 - protein, 11 aa, Staphylococcus aureus
AIETATENERG

SEQ ID NO: 1607267 - protein, 17 aa, Staphylococcus aureus
AINAGQSVSRVGGSAQI

SEQ ID NO: 1607268 - protein, 10 aa, Staphylococcus aureus
AISDEGSFTE

SEQ ID NO: 1607269 - protein, 7 aa, Staphylococcus aureus
AISPRTT

SEQ ID NO: 1607270 - protein, 5 aa, Staphylococcus aureus
AITPG

SEQ ID NO: 1607271 - protein, 11 aa, Staphylococcus aureus
AKEIAKAEKAY

SEQ ID NO: 1607272 - protein, 25 aa, Staphylococcus aureus
AKFAKLGNSQGKSVIEANNVEDAVD

SEQ ID NO: 1607273 - protein, 7 aa, Staphylococcus aureus
AKGDEQS

SEQ ID NO: 1607274 - protein, 28 aa, Staphylococcus aureus
AKGIKTQVSGRLGGADIARAEQYSEGTV

SEQ ID NO: 1607275 - protein, 8 aa, Staphylococcus aureus
AKKGKGSG

SEQ ID NO: 1607276 - protein, 15 aa, Staphylococcus aureus
AKLEESGIADGTEEI

SEQ ID NO: 1607277 - protein, 8 aa, Staphylococcus aureus
AKNKKLQS

SEQ ID NO: 1607278 - protein, 5 aa, Staphylococcus aureus
AKPSL

SEQ ID NO: 1607279 - protein, 18 aa, Staphylococcus aureus
AKRKNLNDTSLNNRCEEN

SEQ ID NO: 1607280 - protein, 11 aa, Staphylococcus aureus
AKRSETRQKRV

SEQ ID NO: 1607281 - protein, 7 aa, Staphylococcus aureus
AKRSGTT

SEQ ID NO: 1607282 - protein, 12 aa, Staphylococcus aureus
AKSAEETDNGVK

SEQ ID NO: 1607283 - protein, 4 aa, Staphylococcus aureus
AKVS

SEQ ID NO: 1607284 - protein, 5 aa, Staphylococcus aureus
ALDDD

SEQ ID NO: 1607285 - protein, 23 aa, Staphylococcus aureus
ALPKEEAEKLKEQLEEVGATVEL

SEQ ID NO: 1607286 - protein, 4 aa, Staphylococcus aureus
ALQQ

SEQ ID NO: 1607287 - protein, 10 aa, Staphylococcus aureus
ALTETDGDID

SEQ ID NO: 1607288 - protein, 25 aa, Staphylococcus aureus
AMEGEQQTEEPEVVGESKEDEEKTE

SEQ ID NO: 1607289 - protein, 10 aa, Staphylococcus aureus
AMPRTTNGNI

SEQ ID NO: 1607290 - protein, 14 aa, Staphylococcus aureus
ANASKATKQDVEDA

SEQ ID NO: 1607291 - protein, 8 aa, Staphylococcus aureus
ANGAGKST

SEQ ID NO: 1607292 - protein, 7 aa, Staphylococcus aureus
ANKAVTD

SEQ ID NO: 1607293 - protein, 7 aa, Staphylococcus aureus
ANNVQST

SEQ ID NO: 1607294 - protein, 9 aa, Staphylococcus aureus
ANPGSLGPV

SEQ ID NO: 1607295 - protein, 6 aa, Staphylococcus aureus
ANTEKD

SEQ ID NO: 1607296 - protein, 14 aa, Staphylococcus aureus
APAPEGEGGSRAMQ

SEQ ID NO: 1607297 - protein, 8 aa, Staphylococcus aureus
APGFGDRR

SEQ ID NO: 1607298 - protein, 5 aa, Staphylococcus aureus
APYEP

SEQ ID NO: 1607299 - protein, 5 aa, Staphylococcus aureus
AQGAF

SEQ ID NO: 1607300 - protein, 4 aa, Staphylococcus aureus
AQMQ

SEQ ID NO: 1607301 - protein, 7 aa, Staphylococcus aureus
AQNTTHA

SEQ ID NO: 1607302 - protein, 4 aa, Staphylococcus aureus
AQPD

SEQ ID NO: 1607303 - protein, 7 aa, Staphylococcus aureus
AQQRQGR

SEQ ID NO: 1607304 - protein, 8 aa, Staphylococcus aureus
AQRSAGFD

SEQ ID NO: 1607305 - protein, 10 aa, Staphylococcus aureus
ARKSKDNPYR

SEQ ID NO: 1607306 - protein, 8 aa, Staphylococcus aureus
ARNPKGQA

SEQ ID NO: 1607307 - protein, 7 aa, Staphylococcus aureus
ARRKKTI

SEQ ID NO: 1607308 - protein, 8 aa, Staphylococcus aureus
ARSKEGKL

SEQ ID NO: 1607309 - protein, 9 aa, Staphylococcus aureus
ASAPEGTSE

SEQ ID NO: 1607310 - protein, 10 aa, Staphylococcus aureus
ASKVDRTQHY

SEQ ID NO: 1607311 - protein, 5 aa, Staphylococcus aureus
ASPHE

SEQ ID NO: 1607312 - protein, 18 aa, Staphylococcus aureus
ASVGEKDVVTTSRFPGTT

SEQ ID NO: 1607313 - protein, 9 aa, Staphylococcus aureus
ATDEDAERF

SEQ ID NO: 1607314 - protein, 6 aa, Staphylococcus aureus
ATEKEL

SEQ ID NO: 1607315 - protein, 7 aa, Staphylococcus aureus
ATGTGKT

SEQ ID NO: 1607316 - protein, 10 aa, Staphylococcus aureus
ATIGNNEGMT

SEQ ID NO: 1607317 - protein, 23 aa, Staphylococcus aureus
ATLEENKAQMADSVNNVKSGSLT

SEQ ID NO: 1607318 - protein, 6 aa, Staphylococcus aureus
ATPAGS

SEQ ID NO: 1607319 - protein, 8 aa, Staphylococcus aureus
ATPERSDE

SEQ ID NO: 1607320 - protein, 9 aa, Staphylococcus aureus
ATSGKNGAS

SEQ ID NO: 1607321 - protein, 13 aa, Staphylococcus aureus
ATTGQNALSQARN

SEQ ID NO: 1607322 - protein, 15 aa, Staphylococcus aureus
AVAAQRAVTDTTNDL

SEQ ID NO: 1607323 - protein, 10 aa, Staphylococcus aureus
AVAGLSEDQL

SEQ ID NO: 1607324 - protein, 6 aa, Staphylococcus aureus
AVGGGQ

SEQ ID NO: 1607325 - protein, 6 aa, Staphylococcus aureus
AVGTNG

SEQ ID NO: 1607326 - protein, 6 aa, Staphylococcus aureus
AVNKGA

SEQ ID NO: 1607327 - protein, 7 aa, Staphylococcus aureus
AYSKEKN

SEQ ID NO: 1607328 - protein, 8 aa, Staphylococcus aureus
AYVPSTDT

SEQ ID NO: 1607329 - protein, 4 aa, Staphylococcus aureus
CDEG

SEQ ID NO: 1607330 - protein, 15 aa, Staphylococcus aureus
CNQHGYGTQTTVSNN

SEQ ID NO: 1607331 - protein, 12 aa, Staphylococcus aureus
CPYGPRPGEQVK

SEQ ID NO: 1607332 - protein, 4 aa, Staphylococcus aureus
CSPV

SEQ ID NO: 1607333 - protein, 6 aa, Staphylococcus aureus
DAEEIN

SEQ ID NO: 1607334 - protein, 14 aa, Staphylococcus aureus
DAERQATKDAGKIA

SEQ ID NO: 1607335 - protein, 10 aa, Staphylococcus aureus
DAKPLDKSYE

SEQ ID NO: 1607336 - protein, 8 aa, Staphylococcus aureus
DALSDELK

SEQ ID NO: 1607337 - protein, 7 aa, Staphylococcus aureus
DALTENL

SEQ ID NO: 1607338 - protein, 7 aa, Staphylococcus aureus
DANSKSE

SEQ ID NO: 1607339 - protein, 4 aa, Staphylococcus aureus
DANT

SEQ ID NO: 1607340 - protein, 5 aa, Staphylococcus aureus
DAPEV

SEQ ID NO: 1607341 - protein, 7 aa, Staphylococcus aureus
DAPFQTQ

SEQ ID NO: 1607342 - protein, 7 aa, Staphylococcus aureus
DAQKNND

SEQ ID NO: 1607343 - protein, 6 aa, Staphylococcus aureus
DAVSDR

SEQ ID NO: 1607344 - protein, 7 aa, Staphylococcus aureus
DDDGNSF

SEQ ID NO: 1607345 - protein, 10 aa, Staphylococcus aureus
DDDQDYKKTP

SEQ ID NO: 1607346 - protein, 8 aa, Staphylococcus aureus
DDIGTNID

SEQ ID NO: 1607347 - protein, 7 aa, Staphylococcus aureus
DDIPGNN

SEQ ID NO: 1607348 - protein, 6 aa, Staphylococcus aureus
DDNAAD

SEQ ID NO: 1607349 - protein, 6 aa, Staphylococcus aureus
DDNPDL

SEQ ID NO: 1607350 - protein, 27 aa, Staphylococcus aureus
DDRRDKSRKMNDKLTSVQKHLENSGEN

SEQ ID NO: 1607351 - protein, 8 aa, Staphylococcus aureus
DDSTPIES

SEQ ID NO: 1607352 - protein, 5 aa, Staphylococcus aureus
DDTTL

SEQ ID NO: 1607353 - protein, 11 aa, Staphylococcus aureus
DEAHDEKLEEI

SEQ ID NO: 1607354 - protein, 8 aa, Staphylococcus aureus
DEAQWTRQ

SEQ ID NO: 1607355 - protein, 4 aa, Staphylococcus aureus
DEDF

SEQ ID NO: 1607356 - protein, 10 aa, Staphylococcus aureus
DEESKQEISP

SEQ ID NO: 1607357 - protein, 14 aa, Staphylococcus aureus
DEPTASLDADRATK

SEQ ID NO: 1607358 - protein, 9 aa, Staphylococcus aureus
DEQTGETYT

SEQ ID NO: 1607359 - protein, 7 aa, Staphylococcus aureus
DETYSRF

SEQ ID NO: 1607360 - protein, 11 aa, Staphylococcus aureus
DEVRSSKRVTT

SEQ ID NO: 1607361 - protein, 5 aa, Staphylococcus aureus
DEVTE

SEQ ID NO: 1607362 - protein, 6 aa, Staphylococcus aureus
DFKENI

SEQ ID NO: 1607363 - protein, 8 aa, Staphylococcus aureus
DFKSENEG

SEQ ID NO: 1607364 - protein, 18 aa, Staphylococcus aureus
DGDTTSEKYITEIWMPVK

SEQ ID NO: 1607365 - protein, 5 aa, Staphylococcus aureus
DGFLD

SEQ ID NO: 1607366 - protein, 9 aa, Staphylococcus aureus
DGMTQPAEV

SEQ ID NO: 1607367 - protein, 4 aa, Staphylococcus aureus
DGRV

SEQ ID NO: 1607368 - protein, 10 aa, Staphylococcus aureus
DGTMPQPVTA

SEQ ID NO: 1607369 - protein, 6 aa, Staphylococcus aureus
DIDTEK

SEQ ID NO: 1607370 - protein, 5 aa, Staphylococcus aureus
DKAGI

SEQ ID NO: 1607371 - protein, 8 aa, Staphylococcus aureus
DKANKADI

SEQ ID NO: 1607372 - protein, 9 aa, Staphylococcus aureus
DKDTERINY

SEQ ID NO: 1607373 - protein, 9 aa, Staphylococcus aureus
DKEFKTTQK

SEQ ID NO: 1607374 - protein, 8 aa, Staphylococcus aureus
DKEVYDPR

SEQ ID NO: 1607375 - protein, 8 aa, Staphylococcus aureus
DKGINESV

SEQ ID NO: 1607376 - protein, 17 aa, Staphylococcus aureus
DKKDQFPDELSGGQKQR

SEQ ID NO: 1607377 - protein, 6 aa, Staphylococcus aureus
DKKSFA

SEQ ID NO: 1607378 - protein, 7 aa, Staphylococcus aureus
DKNDDEL

SEQ ID NO: 1607379 - protein, 5 aa, Staphylococcus aureus
DKTIE

SEQ ID NO: 1607380 - protein, 7 aa, Staphylococcus aureus
DKVNKGD

SEQ ID NO: 1607381 - protein, 13 aa, Staphylococcus aureus
DLAEAKAAIQDKD

SEQ ID NO: 1607382 - protein, 12 aa, Staphylococcus aureus
DLNGNHEKAEEI

SEQ ID NO: 1607383 - protein, 7 aa, Staphylococcus aureus
DLQAGET

SEQ ID NO: 1607384 - protein, 34 aa, Staphylococcus aureus
DLQGQQANKEADKQRLSQQIQQYKGKRHQLDNDV

SEQ ID NO: 1607385 - protein, 11 aa, Staphylococcus aureus
DLTPSDTAQLN

SEQ ID NO: 1607386 - protein, 6 aa, Staphylococcus aureus
DNLPDD

SEQ ID NO: 1607387 - protein, 6 aa, Staphylococcus aureus
DPEGNG

SEQ ID NO: 1607388 - protein, 6 aa, Staphylococcus aureus
DPGYTD

SEQ ID NO: 1607389 - protein, 6 aa, Staphylococcus aureus
DPNRID

SEQ ID NO: 1607390 - protein, 8 aa, Staphylococcus aureus
DPRTNDQE

SEQ ID NO: 1607391 - protein, 6 aa, Staphylococcus aureus
DPVADG

SEQ ID NO: 1607392 - protein, 6 aa, Staphylococcus aureus
DPYSGF

SEQ ID NO: 1607393 - protein, 5 aa, Staphylococcus aureus
DQART

SEQ ID NO: 1607394 - protein, 6 aa, Staphylococcus aureus
DQETPI

SEQ ID NO: 1607395 - protein, 5 aa, Staphylococcus aureus
DQQLE

SEQ ID NO: 1607396 - protein, 6 aa, Staphylococcus aureus
DQSDMT

SEQ ID NO: 1607397 - protein, 11 aa, Staphylococcus aureus
DQSRGDQIDNA

SEQ ID NO: 1607398 - protein, 12 aa, Staphylococcus aureus
DRDKEAIKTAPR

SEQ ID NO: 1607399 - protein, 14 aa, Staphylococcus aureus
DREKEAAKINERNR

SEQ ID NO: 1607400 - protein, 11 aa, Staphylococcus aureus
DRENPGPSTLK

SEQ ID NO: 1607401 - protein, 8 aa, Staphylococcus aureus
DRLGDMSK

SEQ ID NO: 1607402 - protein, 4 aa, Staphylococcus aureus
DRVG

SEQ ID NO: 1607403 - protein, 7 aa, Staphylococcus aureus
DSENRTL

SEQ ID NO: 1607404 - protein, 8 aa, Staphylococcus aureus
DSGQQHVE

SEQ ID NO: 1607405 - protein, 5 aa, Staphylococcus aureus
DSLTG

SEQ ID NO: 1607406 - protein, 7 aa, Staphylococcus aureus
DSNEEEF

SEQ ID NO: 1607407 - protein, 10 aa, Staphylococcus aureus
DSVSKEERQL

SEQ ID NO: 1607408 - protein, 6 aa, Staphylococcus aureus
DTAKRM

SEQ ID NO: 1607409 - protein, 10 aa, Staphylococcus aureus
DTDNLTTSKA

SEQ ID NO: 1607410 - protein, 7 aa, Staphylococcus aureus
DTGDNNV

SEQ ID NO: 1607411 - protein, 7 aa, Staphylococcus aureus
DTKAETV

SEQ ID NO: 1607412 - protein, 8 aa, Staphylococcus aureus
DTQGQTLT

SEQ ID NO: 1607413 - protein, 7 aa, Staphylococcus aureus
DTVSNET

SEQ ID NO: 1607414 - protein, 6 aa, Staphylococcus aureus
DTYENE

SEQ ID NO: 1607415 - protein, 13 aa, Staphylococcus aureus
DTYGKDNKPKITN

SEQ ID NO: 1607416 - protein, 5 aa, Staphylococcus aureus
DVEDN

SEQ ID NO: 1607417 - protein, 6 aa, Staphylococcus aureus
DVHQSV

SEQ ID NO: 1607418 - protein, 16 aa, Staphylococcus aureus
DVNQTEQDMYAKFEGS

SEQ ID NO: 1607419 - protein, 7 aa, Staphylococcus aureus
DVSEELR

SEQ ID NO: 1607420 - protein, 10 aa, Staphylococcus aureus
DVSRQKRKQV

SEQ ID NO: 1607421 - protein, 4 aa, Staphylococcus aureus
DWEN

SEQ ID NO: 1607422 - protein, 7 aa, Staphylococcus aureus
DYEEDAE

SEQ ID NO: 1607423 - protein, 6 aa, Staphylococcus aureus
DYGESD

SEQ ID NO: 1607424 - protein, 5 aa, Staphylococcus aureus
EAARP

SEQ ID NO: 1607425 - protein, 7 aa, Staphylococcus aureus
EAESQFE

SEQ ID NO: 1607426 - protein, 7 aa, Staphylococcus aureus
EAFEKYT

SEQ ID NO: 1607427 - protein, 5 aa, Staphylococcus aureus
EAGAD

SEQ ID NO: 1607428 - protein, 11 aa, Staphylococcus aureus
EAGQGKKGAQH

SEQ ID NO: 1607429 - protein, 11 aa, Staphylococcus aureus
EAGYNDNIDEE

SEQ ID NO: 1607430 - protein, 16 aa, Staphylococcus aureus
EAKEGVQIQNESKTMA

SEQ ID NO: 1607431 - protein, 7 aa, Staphylococcus aureus
EAKKQGI

SEQ ID NO: 1607432 - protein, 5 aa, Staphylococcus aureus
EANAS

SEQ ID NO: 1607433 - protein, 4 aa, Staphylococcus aureus
EAPF

SEQ ID NO: 1607434 - protein, 8 aa, Staphylococcus aureus
EAPPTQHK

SEQ ID NO: 1607435 - protein, 7 aa, Staphylococcus aureus
EARQVDP

SEQ ID NO: 1607436 - protein, 9 aa, Staphylococcus aureus
EASGTEIKY

SEQ ID NO: 1607437 - protein, 5 aa, Staphylococcus aureus
EASKS

SEQ ID NO: 1607438 - protein, 7 aa, Staphylococcus aureus
EAVKDAQ

SEQ ID NO: 1607439 - protein, 4 aa, Staphylococcus aureus
EDAV

SEQ ID NO: 1607440 - protein, 16 aa, Staphylococcus aureus
EDEEKVETIKTYIEVV

SEQ ID NO: 1607441 - protein, 6 aa, Staphylococcus aureus
EDGQRA

SEQ ID NO: 1607442 - protein, 5 aa, Staphylococcus aureus
EDKQI

SEQ ID NO: 1607443 - protein, 12 aa, Staphylococcus aureus
EDLKNGNAHNGY

SEQ ID NO: 1607444 - protein, 4 aa, Staphylococcus aureus
EDNA

SEQ ID NO: 1607445 - protein, 5 aa, Staphylococcus aureus
EDPDL

SEQ ID NO: 1607446 - protein, 7 aa, Staphylococcus aureus
EDSDEDL

SEQ ID NO: 1607447 - protein, 7 aa, Staphylococcus aureus
EDSKENR

SEQ ID NO: 1607448 - protein, 6 aa, Staphylococcus aureus
EEAEAL

SEQ ID NO: 1607449 - protein, 19 aa, Staphylococcus aureus
EEDFNKPINDFSGGQKTRL

SEQ ID NO: 1607450 - protein, 4 aa, Staphylococcus aureus
EEGG

SEQ ID NO: 1607451 - protein, 4 aa, Staphylococcus aureus
EEGY

SEQ ID NO: 1607452 - protein, 8 aa, Staphylococcus aureus
EEIEDDKE

SEQ ID NO: 1607453 - protein, 14 aa, Staphylococcus aureus
EEIGYGANASIDSK

SEQ ID NO: 1607454 - protein, 13 aa, Staphylococcus aureus
EEIRNKTKQFQTE

SEQ ID NO: 1607455 - protein, 7 aa, Staphylococcus aureus
EEKNGQL

SEQ ID NO: 1607456 - protein, 8 aa, Staphylococcus aureus
EEQEASPK

SEQ ID NO: 1607457 - protein, 16 aa, Staphylococcus aureus
EERAERRYKDNQLRGI

SEQ ID NO: 1607458 - protein, 9 aa, Staphylococcus aureus
EERQNNYPV

SEQ ID NO: 1607459 - protein, 4 aa, Staphylococcus aureus
EERR

SEQ ID NO: 1607460 - protein, 6 aa, Staphylococcus aureus
EESGQK

SEQ ID NO: 1607461 - protein, 7 aa, Staphylococcus aureus
EETDPTI

SEQ ID NO: 1607462 - protein, 9 aa, Staphylococcus aureus
EETGSTFEE

SEQ ID NO: 1607463 - protein, 7 aa, Staphylococcus aureus
EETYEKD

SEQ ID NO: 1607464 - protein, 9 aa, Staphylococcus aureus
EGAQSDEDD

SEQ ID NO: 1607465 - protein, 10 aa, Staphylococcus aureus
EGASGSQRQL

SEQ ID NO: 1607466 - protein, 6 aa, Staphylococcus aureus
EGGALQ

SEQ ID NO: 1607467 - protein, 8 aa, Staphylococcus aureus
EGGSGGAL

SEQ ID NO: 1607468 - protein, 11 aa, Staphylococcus aureus
EGKAYVGTTDT

SEQ ID NO: 1607469 - protein, 4 aa, Staphylococcus aureus
EGKE

SEQ ID NO: 1607470 - protein, 8 aa, Staphylococcus aureus
EGLTQSDE

SEQ ID NO: 1607471 - protein, 6 aa, Staphylococcus aureus
EGTDLT

SEQ ID NO: 1607472 - protein, 7 aa, Staphylococcus aureus
EGVQPYA

SEQ ID NO: 1607473 - protein, 5 aa, Staphylococcus aureus
EHDEL

SEQ ID NO: 1607474 - protein, 9 aa, Staphylococcus aureus
EHENDDGDL

SEQ ID NO: 1607475 - protein, 20 aa, Staphylococcus aureus
EHNEEGKPSESASNRQQQME

SEQ ID NO: 1607476 - protein, 5 aa, Staphylococcus aureus
EIAKT

SEQ ID NO: 1607477 - protein, 5 aa, Staphylococcus aureus
EIEKK

SEQ ID NO: 1607478 - protein, 32 aa, Staphylococcus aureus
EKAKEVEEKLKDKKEEKTEDINQTKQDIQDTL

SEQ ID NO: 1607479 - protein, 4 aa, Staphylococcus aureus
EKHG

SEQ ID NO: 1607480 - protein, 6 aa, Staphylococcus aureus
EKINDN

SEQ ID NO: 1607481 - protein, 9 aa, Staphylococcus aureus
EKKDSRIPM

SEQ ID NO: 1607482 - protein, 12 aa, Staphylococcus aureus
EKQKAGKAKMKA

SEQ ID NO: 1607483 - protein, 5 aa, Staphylococcus aureus
ELKSL

SEQ ID NO: 1607484 - protein, 5 aa, Staphylococcus aureus
ELSDE

SEQ ID NO: 1607485 - protein, 8 aa, Staphylococcus aureus
ELSGGQQQ

SEQ ID NO: 1607486 - protein, 13 aa, Staphylococcus aureus
EMRTGEGKTLTAT

SEQ ID NO: 1607487 - protein, 4 aa, Staphylococcus aureus
ENDI

SEQ ID NO: 1607488 - protein, 10 aa, Staphylococcus aureus
ENDSDEKKPH

SEQ ID NO: 1607489 - protein, 10 aa, Staphylococcus aureus
ENEGKISSED

SEQ ID NO: 1607490 - protein, 12 aa, Staphylococcus aureus
ENEIRNVRAQMQ

SEQ ID NO: 1607491 - protein, 17 aa, Staphylococcus aureus
ENEKNYPDAIETGKEGL

SEQ ID NO: 1607492 - protein, 9 aa, Staphylococcus aureus
ENEVSDPKE

SEQ ID NO: 1607493 - protein, 6 aa, Staphylococcus aureus
ENLERQ

SEQ ID NO: 1607494 - protein, 5 aa, Staphylococcus aureus
ENNQL

SEQ ID NO: 1607495 - protein, 5 aa, Staphylococcus aureus
EPLNP

SEQ ID NO: 1607496 - protein, 12 aa, Staphylococcus aureus
EPTGALDPKTGQ

SEQ ID NO: 1607497 - protein, 4 aa, Staphylococcus aureus
EQGH

SEQ ID NO: 1607498 - protein, 13 aa, Staphylococcus aureus
EQLKQGQEIVGNR

SEQ ID NO: 1607499 - protein, 4 aa, Staphylococcus aureus
EQNI

SEQ ID NO: 1607500 - protein, 5 aa, Staphylococcus aureus
EQQRK

SEQ ID NO: 1607501 - protein, 6 aa, Staphylococcus aureus
EQRQKI

SEQ ID NO: 1607502 - protein, 14 aa, Staphylococcus aureus
EQTTKNAEKLFNLN

SEQ ID NO: 1607503 - protein, 11 aa, Staphylococcus aureus
ERIGDNASSIA

SEQ ID NO: 1607504 - protein, 16 aa, Staphylococcus aureus
ERKGRDKKQVSVYAVA

SEQ ID NO: 1607505 - protein, 6 aa, Staphylococcus aureus
ERNQQS

SEQ ID NO: 1607506 - protein, 8 aa, Staphylococcus aureus
ERSELPAE

SEQ ID NO: 1607507 - protein, 9 aa, Staphylococcus aureus
ERTFPNNEE

SEQ ID NO: 1607508 - protein, 12 aa, Staphylococcus aureus
ERTPRGRKATPL

SEQ ID NO: 1607509 - protein, 10 aa, Staphylococcus aureus
ESEKTVHDDA

SEQ ID NO: 1607510 - protein, 8 aa, Staphylococcus aureus
ESEPPAQK

SEQ ID NO: 1607511 - protein, 4 aa, Staphylococcus aureus
ESET

SEQ ID NO: 1607512 - protein, 9 aa, Staphylococcus aureus
ESGRWGAYG

SEQ ID NO: 1607513 - protein, 5 aa, Staphylococcus aureus
ESGVT

SEQ ID NO: 1607514 - protein, 5 aa, Staphylococcus aureus
ESLDF

SEQ ID NO: 1607515 - protein, 8 aa, Staphylococcus aureus
ESVTSSNE

SEQ ID NO: 1607516 - protein, 10 aa, Staphylococcus aureus
ETDESWDPNH

SEQ ID NO: 1607517 - protein, 7 aa, Staphylococcus aureus
ETHDQTD

SEQ ID NO: 1607518 - protein, 5 aa, Staphylococcus aureus
ETKKL

SEQ ID NO: 1607519 - protein, 17 aa, Staphylococcus aureus
ETNDISKSLNRGKHTTR

SEQ ID NO: 1607520 - protein, 7 aa, Staphylococcus aureus
ETRTMKA

SEQ ID NO: 1607521 - protein, 4 aa, Staphylococcus aureus
ETSE

SEQ ID NO: 1607522 - protein, 4 aa, Staphylococcus aureus
EVEN

SEQ ID NO: 1607523 - protein, 6 aa, Staphylococcus aureus
EVIEPE

SEQ ID NO: 1607524 - protein, 4 aa, Staphylococcus aureus
EVNP

SEQ ID NO: 1607525 - protein, 7 aa, Staphylococcus aureus
EVQGSDI

SEQ ID NO: 1607526 - protein, 11 aa, Staphylococcus aureus
EYAKRQGKSLA

SEQ ID NO: 1607527 - protein, 5 aa, Staphylococcus aureus
EYKMS

SEQ ID NO: 1607528 - protein, 8 aa, Staphylococcus aureus
EYSDTTAV

SEQ ID NO: 1607529 - protein, 12 aa, Staphylococcus aureus
FDCPNRDGTVAH

SEQ ID NO: 1607530 - protein, 4 aa, Staphylococcus aureus
FDEK

SEQ ID NO: 1607531 - protein, 7 aa, Staphylococcus aureus
FDEPPEH

SEQ ID NO: 1607532 - protein, 11 aa, Staphylococcus aureus
FDNSKINDTVG

SEQ ID NO: 1607533 - protein, 15 aa, Staphylococcus aureus
FETSTSSVSKGESLY

SEQ ID NO: 1607534 - protein, 4 aa, Staphylococcus aureus
FGGG

SEQ ID NO: 1607535 - protein, 13 aa, Staphylococcus aureus
FKADPEVDGTKSE

SEQ ID NO: 1607536 - protein, 9 aa, Staphylococcus aureus
FKNGKGHEM

SEQ ID NO: 1607537 - protein, 7 aa, Staphylococcus aureus
FKPGQQE

SEQ ID NO: 1607538 - protein, 6 aa, Staphylococcus aureus
FKPSNK

SEQ ID NO: 1607539 - protein, 7 aa, Staphylococcus aureus
FNNSTQS

SEQ ID NO: 1607540 - protein, 4 aa, Staphylococcus aureus
FNQP

SEQ ID NO: 1607541 - protein, 16 aa, Staphylococcus aureus
FNTDESLKSHIPKDNF

SEQ ID NO: 1607542 - protein, 12 aa, Staphylococcus aureus
FPTGTHERQDHP

SEQ ID NO: 1607543 - protein, 6 aa, Staphylococcus aureus
FSNGNY

SEQ ID NO: 1607544 - protein, 15 aa, Staphylococcus aureus
FSPDHLRGDTEGRYG

SEQ ID NO: 1607545 - protein, 6 aa, Staphylococcus aureus
FSRGQG

SEQ ID NO: 1607546 - protein, 12 aa, Staphylococcus aureus
FSSNEADKYDEQ

SEQ ID NO: 1607547 - protein, 18 aa, Staphylococcus aureus
FTEAGTKHGRLGLMAGHK

SEQ ID NO: 1607548 - protein, 25 aa, Staphylococcus aureus
FTGGGKGKKGKRNQMQNMLKGMNLP

SEQ ID NO: 1607549 - protein, 10 aa, Staphylococcus aureus
FTGQKGSYVP

SEQ ID NO: 1607550 - protein, 6 aa, Staphylococcus aureus
FTGTSG

SEQ ID NO: 1607551 - protein, 11 aa, Staphylococcus aureus
GAANKTDPTRF

SEQ ID NO: 1607552 - protein, 16 aa, Staphylococcus aureus
GAFGDSTPKVNTPQVT

SEQ ID NO: 1607553 - protein, 7 aa, Staphylococcus aureus
GAFGGKK

SEQ ID NO: 1607554 - protein, 6 aa, Staphylococcus aureus
GAGVDA

SEQ ID NO: 1607555 - protein, 9 aa, Staphylococcus aureus
GAKQVRKKF

SEQ ID NO: 1607556 - protein, 10 aa, Staphylococcus aureus
GALKSPTDMN

SEQ ID NO: 1607557 - protein, 7 aa, Staphylococcus aureus
GAPGFEE

SEQ ID NO: 1607558 - protein, 11 aa, Staphylococcus aureus
GASPASNVTSH

SEQ ID NO: 1607559 - protein, 6 aa, Staphylococcus aureus
GATGGR

SEQ ID NO: 1607560 - protein, 5 aa, Staphylococcus aureus
GDARS

SEQ ID NO: 1607561 - protein, 8 aa, Staphylococcus aureus
GDEGLDEK

SEQ ID NO: 1607562 - protein, 7 aa, Staphylococcus aureus
GDGRNNI

SEQ ID NO: 1607563 - protein, 6 aa, Staphylococcus aureus
GDNQTV

SEQ ID NO: 1607564 - protein, 9 aa, Staphylococcus aureus
GDSAYKDED

SEQ ID NO: 1607565 - protein, 24 aa, Staphylococcus aureus
GDSVTTDHISPAGAIGKDTPAGKY

SEQ ID NO: 1607566 - protein, 11 aa, Staphylococcus aureus
GEAEKSTSLYT

SEQ ID NO: 1607567 - protein, 13 aa, Staphylococcus aureus
GEDAGSKLTKAQS

SEQ ID NO: 1607568 - protein, 12 aa, Staphylococcus aureus
GEEEEDPYDEDT

SEQ ID NO: 1607569 - protein, 14 aa, Staphylococcus aureus
GEEGHGHDIDTSKG

SEQ ID NO: 1607570 - protein, 10 aa, Staphylococcus aureus
GEGKKMSKSL

SEQ ID NO: 1607571 - protein, 9 aa, Staphylococcus aureus
GELATTGST

SEQ ID NO: 1607572 - protein, 5 aa, Staphylococcus aureus
GENTF

SEQ ID NO: 1607573 - protein, 6 aa, Staphylococcus aureus
GEPFSH

SEQ ID NO: 1607574 - protein, 8 aa, Staphylococcus aureus
GEQEKKEM

SEQ ID NO: 1607575 - protein, 4 aa, Staphylococcus aureus
GERL

SEQ ID NO: 1607576 - protein, 7 aa, Staphylococcus aureus
GERQQDV

SEQ ID NO: 1607577 - protein, 9 aa, Staphylococcus aureus
GESGAGKSL

SEQ ID NO: 1607578 - protein, 7 aa, Staphylococcus aureus
GETGASM

SEQ ID NO: 1607579 - protein, 13 aa, Staphylococcus aureus
GEYEDLREQSAKD

SEQ ID NO: 1607580 - protein, 21 aa, Staphylococcus aureus
GFDPVPLKKDKSASKHSHKHN

SEQ ID NO: 1607581 - protein, 4 aa, Staphylococcus aureus
GFEP

SEQ ID NO: 1607582 - protein, 7 aa, Staphylococcus aureus
GFGSDLG

SEQ ID NO: 1607583 - protein, 10 aa, Staphylococcus aureus
GFSGFGGGGF

SEQ ID NO: 1607584 - protein, 10 aa, Staphylococcus aureus
GFTDRKEDID

SEQ ID NO: 1607585 - protein, 10 aa, Staphylococcus aureus
GGARSNSTFQ

SEQ ID NO: 1607586 - protein, 9 aa, Staphylococcus aureus
GGDNLAATF

SEQ ID NO: 1607587 - protein, 6 aa, Staphylococcus aureus
GGERAL

SEQ ID NO: 1607588 - protein, 4 aa, Staphylococcus aureus
GGES

SEQ ID NO: 1607589 - protein, 8 aa, Staphylococcus aureus
GGFTGQAQ

SEQ ID NO: 1607590 - protein, 11 aa, Staphylococcus aureus
GGGQAGTNAAK

SEQ ID NO: 1607591 - protein, 6 aa, Staphylococcus aureus
GGIQPA

SEQ ID NO: 1607592 - protein, 23 aa, Staphylococcus aureus
GGKGGGRPDMAQGGGTQPENISK

SEQ ID NO: 1607593 - protein, 30 aa, Staphylococcus aureus
GGNVEEAAYTGEGKHINSGELDGLENEAAI

SEQ ID NO: 1607594 - protein, 9 aa, Staphylococcus aureus
GGPGTGKTT

SEQ ID NO: 1607595 - protein, 9 aa, Staphylococcus aureus
GGPNAERKR

SEQ ID NO: 1607596 - protein, 14 aa, Staphylococcus aureus
GGQEPGSGEEAAQN

SEQ ID NO: 1607597 - protein, 17 aa, Staphylococcus aureus
GGRQRDPNAPQKGDDLQ

SEQ ID NO: 1607598 - protein, 7 aa, Staphylococcus aureus
GGTEMTV

SEQ ID NO: 1607599 - protein, 14 aa, Staphylococcus aureus
GGTVTAANSCMKND

SEQ ID NO: 1607600 - protein, 23 aa, Staphylococcus aureus
GHGKSLSRLGGGIGTRGPGETKL

SEQ ID NO: 1607601 - protein, 6 aa, Staphylococcus aureus
GHSVAN

SEQ ID NO: 1607602 - protein, 7 aa, Staphylococcus aureus
GIAGSYA

SEQ ID NO: 1607603 - protein, 18 aa, Staphylococcus aureus
GIANNQTGLYPSDSPGGW

SEQ ID NO: 1607604 - protein, 6 aa, Staphylococcus aureus
GIEPQT

SEQ ID NO: 1607605 - protein, 8 aa, Staphylococcus aureus
GIGPKTAQ

SEQ ID NO: 1607606 - protein, 12 aa, Staphylococcus aureus
GINSPSGDTEEA

SEQ ID NO: 1607607 - protein, 9 aa, Staphylococcus aureus
GISKEQVGA

SEQ ID NO: 1607608 - protein, 4 aa, Staphylococcus aureus
GITV

SEQ ID NO: 1607609 - protein, 13 aa, Staphylococcus aureus
GKAAMAGDGQVTL

SEQ ID NO: 1607610 - protein, 7 aa, Staphylococcus aureus
GKAANII

SEQ ID NO: 1607611 - protein, 6 aa, Staphylococcus aureus
GKDQQV

SEQ ID NO: 1607612 - protein, 17 aa, Staphylococcus aureus
GKERKSIEQIDAFLAQY

SEQ ID NO: 1607613 - protein, 4 aa, Staphylococcus aureus
GKFD

SEQ ID NO: 1607614 - protein, 16 aa, Staphylococcus aureus
GKFGQGGYKTSGGLHG

SEQ ID NO: 1607615 - protein, 16 aa, Staphylococcus aureus
GKGSYLYDTNGNKYLD

SEQ ID NO: 1607616 - protein, 21 aa, Staphylococcus aureus
GKKKIATATVGEGSSNQGDFH

SEQ ID NO: 1607617 - protein, 8 aa, Staphylococcus aureus
GKLNITDE

SEQ ID NO: 1607618 - protein, 12 aa, Staphylococcus aureus
GKPVLDREGEHN

SEQ ID NO: 1607619 - protein, 6 aa, Staphylococcus aureus
GKPVPL

SEQ ID NO: 1607620 - protein, 10 aa, Staphylococcus aureus
GKPVTPEEQK

SEQ ID NO: 1607621 - protein, 8 aa, Staphylococcus aureus
GKSNSAVP

SEQ ID NO: 1607622 - protein, 7 aa, Staphylococcus aureus
GKTTFRH

SEQ ID NO: 1607623 - protein, 13 aa, Staphylococcus aureus
GLGPTTPIDTITE

SEQ ID NO: 1607624 - protein, 12 aa, Staphylococcus aureus
GLKGKDAAGELE

SEQ ID NO: 1607625 - protein, 5 aa, Staphylococcus aureus
GLQGT

SEQ ID NO: 1607626 - protein, 7 aa, Staphylococcus aureus
GLTDQAG

SEQ ID NO: 1607627 - protein, 14 aa, Staphylococcus aureus
GMRKKGKVYESTEK

SEQ ID NO: 1607628 - protein, 10 aa, Staphylococcus aureus
GMSNESIAKQ

SEQ ID NO: 1607629 - protein, 11 aa, Staphylococcus aureus
GMTATGKLGES

SEQ ID NO: 1607630 - protein, 13 aa, Staphylococcus aureus
GMTGTAKTEEEEF

SEQ ID NO: 1607631 - protein, 9 aa, Staphylococcus aureus
GMTSANPLD

SEQ ID NO: 1607632 - protein, 9 aa, Staphylococcus aureus
GNDDDRKKI

SEQ ID NO: 1607633 - protein, 7 aa, Staphylococcus aureus
GNDPVEN

SEQ ID NO: 1607634 - protein, 9 aa, Staphylococcus aureus
GNGNRDEPV

SEQ ID NO: 1607635 - protein, 6 aa, Staphylococcus aureus
GNGPQI

SEQ ID NO: 1607636 - protein, 5 aa, Staphylococcus aureus
GNGRV

SEQ ID NO: 1607637 - protein, 6 aa, Staphylococcus aureus
GNIASF

SEQ ID NO: 1607638 - protein, 8 aa, Staphylococcus aureus
GNNKTKHE

SEQ ID NO: 1607639 - protein, 6 aa, Staphylococcus aureus
GNTTDQ

SEQ ID NO: 1607640 - protein, 4 aa, Staphylococcus aureus
GNVD

SEQ ID NO: 1607641 - protein, 6 aa, Staphylococcus aureus
GPHVTT

SEQ ID NO: 1607642 - protein, 6 aa, Staphylococcus aureus
GPIGDG

SEQ ID NO: 1607643 - protein, 9 aa, Staphylococcus aureus
GPNGAGKST

SEQ ID NO: 1607644 - protein, 10 aa, Staphylococcus aureus
GPRGTGKTSI

SEQ ID NO: 1607645 - protein, 10 aa, Staphylococcus aureus
GPSGVGKGTV

SEQ ID NO: 1607646 - protein, 5 aa, Staphylococcus aureus
GQARN

SEQ ID NO: 1607647 - protein, 6 aa, Staphylococcus aureus
GQGHYQ

SEQ ID NO: 1607648 - protein, 5 aa, Staphylococcus aureus
GQKLY

SEQ ID NO: 1607649 - protein, 10 aa, Staphylococcus aureus
GQQQSKKSPF

SEQ ID NO: 1607650 - protein, 8 aa, Staphylococcus aureus
GQSGVGKS

SEQ ID NO: 1607651 - protein, 11 aa, Staphylococcus aureus
GQTAPPGKRMG

SEQ ID NO: 1607652 - protein, 14 aa, Staphylococcus aureus
GQTTADLGGKLNTT

SEQ ID NO: 1607653 - protein, 5 aa, Staphylococcus aureus
GQVYQ

SEQ ID NO: 1607654 - protein, 11 aa, Staphylococcus aureus
GRDPAPEEIGE

SEQ ID NO: 1607655 - protein, 9 aa, Staphylococcus aureus
GRNGAGKST

SEQ ID NO: 1607656 - protein, 8 aa, Staphylococcus aureus
GRTEAGGD

SEQ ID NO: 1607657 - protein, 8 aa, Staphylococcus aureus
GRTMPGRR

SEQ ID NO: 1607658 - protein, 6 aa, Staphylococcus aureus
GSDQYR

SEQ ID NO: 1607659 - protein, 14 aa, Staphylococcus aureus
GSEPLDNTSIHPES

SEQ ID NO: 1607660 - protein, 8 aa, Staphylococcus aureus
GSESGNAM

SEQ ID NO: 1607661 - protein, 10 aa, Staphylococcus aureus
GSGGNTGADK

SEQ ID NO: 1607662 - protein, 10 aa, Staphylococcus aureus
GSKEYKGAAT

SEQ ID NO: 1607663 - protein, 12 aa, Staphylococcus aureus
GSPNRQGSNATY

SEQ ID NO: 1607664 - protein, 8 aa, Staphylococcus aureus
GSVKGKKR

SEQ ID NO: 1607665 - protein, 13 aa, Staphylococcus aureus
GSYSEQKLSKAAT

SEQ ID NO: 1607666 - protein, 10 aa, Staphylococcus aureus
GTAVSERRTQ

SEQ ID NO: 1607667 - protein, 8 aa, Staphylococcus aureus
GTEGPSVS

SEQ ID NO: 1607668 - protein, 8 aa, Staphylococcus aureus
GTGMGLPE

SEQ ID NO: 1607669 - protein, 8 aa, Staphylococcus aureus
GTIEDHGD

SEQ ID NO: 1607670 - protein, 8 aa, Staphylococcus aureus
GTLSQNKK

SEQ ID NO: 1607671 - protein, 4 aa, Staphylococcus aureus
GTMG

SEQ ID NO: 1607672 - protein, 6 aa, Staphylococcus aureus
GTQTNQ

SEQ ID NO: 1607673 - protein, 5 aa, Staphylococcus aureus
GTSLE

SEQ ID NO: 1607674 - protein, 9 aa, Staphylococcus aureus
GTTSTRTLE

SEQ ID NO: 1607675 - protein, 9 aa, Staphylococcus aureus
GVFTEEGGQ

SEQ ID NO: 1607676 - protein, 7 aa, Staphylococcus aureus
GVGPYTQ

SEQ ID NO: 1607677 - protein, 11 aa, Staphylococcus aureus
GVSERGGHPVY

SEQ ID NO: 1607678 - protein, 14 aa, Staphylococcus aureus
GVTETQKRRLNQTP

SEQ ID NO: 1607679 - protein, 5 aa, Staphylococcus aureus
GWVTG

SEQ ID NO: 1607680 - protein, 4 aa, Staphylococcus aureus
GYDA

SEQ ID NO: 1607681 - protein, 9 aa, Staphylococcus aureus
GYEPTDELK

SEQ ID NO: 1607682 - protein, 13 aa, Staphylococcus aureus
GYQETISDPSYTG

SEQ ID NO: 1607683 - protein, 6 aa, Staphylococcus aureus
GYQPTL

SEQ ID NO: 1607684 - protein, 9 aa, Staphylococcus aureus
HAEHSGEDF

SEQ ID NO: 1607685 - protein, 13 aa, Staphylococcus aureus
HANDYDSDTYKTH

SEQ ID NO: 1607686 - protein, 8 aa, Staphylococcus aureus
HDASEYAS

SEQ ID NO: 1607687 - protein, 6 aa, Staphylococcus aureus
HDPTQD

SEQ ID NO: 1607688 - protein, 14 aa, Staphylococcus aureus
HEDARNKVNQPKIE

SEQ ID NO: 1607689 - protein, 13 aa, Staphylococcus aureus
HEDISDSTKYEDE

SEQ ID NO: 1607690 - protein, 7 aa, Staphylococcus aureus
HEIPRDQ

SEQ ID NO: 1607691 - protein, 7 aa, Staphylococcus aureus
HGDPEKV

SEQ ID NO: 1607692 - protein, 14 aa, Staphylococcus aureus
HGTNVEYDQVLVRI

SEQ ID NO: 1607693 - protein, 10 aa, Staphylococcus aureus
HGYDNTVKDP

SEQ ID NO: 1607694 - protein, 5 aa, Staphylococcus aureus
HKDTV

SEQ ID NO: 1607695 - protein, 5 aa, Staphylococcus aureus
HKGTE

SEQ ID NO: 1607696 - protein, 16 aa, Staphylococcus aureus
HKKDAKLSKVTSYIVV

SEQ ID NO: 1607697 - protein, 11 aa, Staphylococcus aureus
HKPSGAKPGFV

SEQ ID NO: 1607698 - protein, 9 aa, Staphylococcus aureus
HNKKTSEDY

SEQ ID NO: 1607699 - protein, 8 aa, Staphylococcus aureus
HNPPMEDA

SEQ ID NO: 1607700 - protein, 7 aa, Staphylococcus aureus
HNTENMK

SEQ ID NO: 1607701 - protein, 16 aa, Staphylococcus aureus
HPDPSVALSDAGQQMD

SEQ ID NO: 1607702 - protein, 14 aa, Staphylococcus aureus
HPTPKSASGFSEAD

SEQ ID NO: 1607703 - protein, 10 aa, Staphylococcus aureus
HQTGPEGKEI

SEQ ID NO: 1607704 - protein, 10 aa, Staphylococcus aureus
HRRDKPGYAQ

SEQ ID NO: 1607705 - protein, 8 aa, Staphylococcus aureus
HRSAASTY

SEQ ID NO: 1607706 - protein, 11 aa, Staphylococcus aureus
HRYSAKAWDNR

SEQ ID NO: 1607707 - protein, 8 aa, Staphylococcus aureus
HSDAQKGI

SEQ ID NO: 1607708 - protein, 8 aa, Staphylococcus aureus
HSKGDNTH

SEQ ID NO: 1607709 - protein, 19 aa, Staphylococcus aureus
HTPSQDKFTISRDDDGAYV

SEQ ID NO: 1607710 - protein, 21 aa, Staphylococcus aureus
HTYGEKKKKDSEEANTIKAEL

SEQ ID NO: 1607711 - protein, 5 aa, Staphylococcus aureus
HVKEE

SEQ ID NO: 1607712 - protein, 10 aa, Staphylococcus aureus
HVTTDAGTGC

SEQ ID NO: 1607713 - protein, 10 aa, Staphylococcus aureus
HYANSNDFAN

SEQ ID NO: 1607714 - protein, 10 aa, Staphylococcus aureus
HYGEHQGKPF

SEQ ID NO: 1607715 - protein, 5 aa, Staphylococcus aureus
IAGPT

SEQ ID NO: 1607716 - protein, 10 aa, Staphylococcus aureus
IAPGANINYE

SEQ ID NO: 1607717 - protein, 4 aa, Staphylococcus aureus
IAQH

SEQ ID NO: 1607718 - protein, 20 aa, Staphylococcus aureus
IARKSENTSITRDVSGEGVQ

SEQ ID NO: 1607719 - protein, 17 aa, Staphylococcus aureus
IDDRGFARQTVKNDKHI

SEQ ID NO: 1607720 - protein, 4 aa, Staphylococcus aureus
IDGD

SEQ ID NO: 1607721 - protein, 5 aa, Staphylococcus aureus
IDGMT

SEQ ID NO: 1607722 - protein, 16 aa, Staphylococcus aureus
IDSPSEVVKEGDEVEA

SEQ ID NO: 1607723 - protein, 7 aa, Staphylococcus aureus
IEEDAKK

SEQ ID NO: 1607724 - protein, 6 aa, Staphylococcus aureus
IEGTPA

SEQ ID NO: 1607725 - protein, 9 aa, Staphylococcus aureus
IELGDRGEI

SEQ ID NO: 1607726 - protein, 14 aa, Staphylococcus aureus
IENYDSTDKQLATK

SEQ ID NO: 1607727 - protein, 8 aa, Staphylococcus aureus
IEQKRKGI

SEQ ID NO: 1607728 - protein, 10 aa, Staphylococcus aureus
IHTQSTKEIA

SEQ ID NO: 1607729 - protein, 7 aa, Staphylococcus aureus
IKAEQSK

SEQ ID NO: 1607730 - protein, 22 aa, Staphylococcus aureus
IKEAAKATTGKVVNNTGQVCTA

SEQ ID NO: 1607731 - protein, 7 aa, Staphylococcus aureus
IKEDDVT

SEQ ID NO: 1607732 - protein, 8 aa, Staphylococcus aureus
IKETGQHN

SEQ ID NO: 1607733 - protein, 9 aa, Staphylococcus aureus
IKHETTPRV

SEQ ID NO: 1607734 - protein, 12 aa, Staphylococcus aureus
IKNNSERKPKGL

SEQ ID NO: 1607735 - protein, 4 aa, Staphylococcus aureus
INDD

SEQ ID NO: 1607736 - protein, 6 aa, Staphylococcus aureus
INGYRD

SEQ ID NO: 1607737 - protein, 4 aa, Staphylococcus aureus
INNQ

SEQ ID NO: 1607738 - protein, 6 aa, Staphylococcus aureus
INNTRQ

SEQ ID NO: 1607739 - protein, 8 aa, Staphylococcus aureus
INPTEGEV

SEQ ID NO: 1607740 - protein, 7 aa, Staphylococcus aureus
INPTRSG

SEQ ID NO: 1607741 - protein, 7 aa, Staphylococcus aureus
INQPDND

SEQ ID NO: 1607742 - protein, 6 aa, Staphylococcus aureus
IPDGEN

SEQ ID NO: 1607743 - protein, 12 aa, Staphylococcus aureus
IPELPDERKAKY

SEQ ID NO: 1607744 - protein, 9 aa, Staphylococcus aureus
IPERRPEDA

SEQ ID NO: 1607745 - protein, 22 aa, Staphylococcus aureus
IPQAHQSLTNKEWNRNAFKGTE

SEQ ID NO: 1607746 - protein, 14 aa, Staphylococcus aureus
IPSKEGKVSASDVE

SEQ ID NO: 1607747 - protein, 10 aa, Staphylococcus aureus
IQHPKENGYR

SEQ ID NO: 1607748 - protein, 13 aa, Staphylococcus aureus
IQLGKKESVEDTA

SEQ ID NO: 1607749 - protein, 10 aa, Staphylococcus aureus
IQPGTRGTTV

SEQ ID NO: 1607750 - protein, 7 aa, Staphylococcus aureus
IQQPTTM

SEQ ID NO: 1607751 - protein, 5 aa, Staphylococcus aureus
IRGEG

SEQ ID NO: 1607752 - protein, 6 aa, Staphylococcus aureus
ISDGNF

SEQ ID NO: 1607753 - protein, 12 aa, Staphylococcus aureus
ISGGGAVYHDTG

SEQ ID NO: 1607754 - protein, 6 aa, Staphylococcus aureus
ISKDGI

SEQ ID NO: 1607755 - protein, 7 aa, Staphylococcus aureus
ISKRTAN

SEQ ID NO: 1607756 - protein, 11 aa, Staphylococcus aureus
ISQSNETITDL

SEQ ID NO: 1607757 - protein, 4 aa, Staphylococcus aureus
ITAK

SEQ ID NO: 1607758 - protein, 7 aa, Staphylococcus aureus
ITDKGTA

SEQ ID NO: 1607759 - protein, 4 aa, Staphylococcus aureus
ITEG

SEQ ID NO: 1607760 - protein, 5 aa, Staphylococcus aureus
ITRLQ

SEQ ID NO: 1607761 - protein, 8 aa, Staphylococcus aureus
ITYSTNNE

SEQ ID NO: 1607762 - protein, 8 aa, Staphylococcus aureus
IYHTGDTG

SEQ ID NO: 1607763 - protein, 6 aa, Staphylococcus aureus
IYNSKN

SEQ ID NO: 1607764 - protein, 13 aa, Staphylococcus aureus
IYYPTSKGETTNN

SEQ ID NO: 1607765 - protein, 11 aa, Staphylococcus aureus
KAAEKPGSEIQ

SEQ ID NO: 1607766 - protein, 5 aa, Staphylococcus aureus
KAAEL

SEQ ID NO: 1607767 - protein, 5 aa, Staphylococcus aureus
KACGA

SEQ ID NO: 1607768 - protein, 6 aa, Staphylococcus aureus
KADKGQ

SEQ ID NO: 1607769 - protein, 12 aa, Staphylococcus aureus
KAKDAEGKQPRV

SEQ ID NO: 1607770 - protein, 8 aa, Staphylococcus aureus
KAKEQGKK

SEQ ID NO: 1607771 - protein, 6 aa, Staphylococcus aureus
KAKGYR

SEQ ID NO: 1607772 - protein, 11 aa, Staphylococcus aureus
KANKKSIPKFP

SEQ ID NO: 1607773 - protein, 4 aa, Staphylococcus aureus
KAQD

SEQ ID NO: 1607774 - protein, 6 aa, Staphylococcus aureus
KARGIE

SEQ ID NO: 1607775 - protein, 7 aa, Staphylococcus aureus
KASPFTG

SEQ ID NO: 1607776 - protein, 9 aa, Staphylococcus aureus
KAYESGKGR

SEQ ID NO: 1607777 - protein, 6 aa, Staphylococcus aureus
KDEGDI

SEQ ID NO: 1607778 - protein, 10 aa, Staphylococcus aureus
KDGKMSGPNF

SEQ ID NO: 1607779 - protein, 8 aa, Staphylococcus aureus
KDGTLDPV

SEQ ID NO: 1607780 - protein, 9 aa, Staphylococcus aureus
KDGTREQFS

SEQ ID NO: 1607781 - protein, 4 aa, Staphylococcus aureus
KDKF

SEQ ID NO: 1607782 - protein, 6 aa, Staphylococcus aureus
KDKKGV

SEQ ID NO: 1607783 - protein, 7 aa, Staphylococcus aureus
KDLTHQQ

SEQ ID NO: 1607784 - protein, 5 aa, Staphylococcus aureus
KDPDV

SEQ ID NO: 1607785 - protein, 6 aa, Staphylococcus aureus
KDQQQF

SEQ ID NO: 1607786 - protein, 15 aa, Staphylococcus aureus
KDQRPHALSGGQQQR

SEQ ID NO: 1607787 - protein, 10 aa, Staphylococcus aureus
KDSEYSGGFV

SEQ ID NO: 1607788 - protein, 7 aa, Staphylococcus aureus
KDYPEYG

SEQ ID NO: 1607789 - protein, 14 aa, Staphylococcus aureus
KEASDEIKSRIFNL

SEQ ID NO: 1607790 - protein, 7 aa, Staphylococcus aureus
KEDAENI

SEQ ID NO: 1607791 - protein, 9 aa, Staphylococcus aureus
KEDAGRGYR

SEQ ID NO: 1607792 - protein, 4 aa, Staphylococcus aureus
KEDI

SEQ ID NO: 1607793 - protein, 8 aa, Staphylococcus aureus
KEEDQKEK

SEQ ID NO: 1607794 - protein, 6 aa, Staphylococcus aureus
KEEHNA

SEQ ID NO: 1607795 - protein, 6 aa, Staphylococcus aureus
KEEQPD

SEQ ID NO: 1607796 - protein, 6 aa, Staphylococcus aureus
KEGGVD

SEQ ID NO: 1607797 - protein, 8 aa, Staphylococcus aureus
KEGSISKE

SEQ ID NO: 1607798 - protein, 9 aa, Staphylococcus aureus
KEGYETDGP

SEQ ID NO: 1607799 - protein, 8 aa, Staphylococcus aureus
KEIKDNPA

SEQ ID NO: 1607800 - protein, 5 aa, Staphylococcus aureus
KEKHD

SEQ ID NO: 1607801 - protein, 4 aa, Staphylococcus aureus
KELG

SEQ ID NO: 1607802 - protein, 10 aa, Staphylococcus aureus
KELSNTTIQK

SEQ ID NO: 1607803 - protein, 14 aa, Staphylococcus aureus
KEPERTAKAQTGKY

SEQ ID NO: 1607804 - protein, 8 aa, Staphylococcus aureus
KEPHESEY

SEQ ID NO: 1607805 - protein, 6 aa, Staphylococcus aureus
KEPIKN

SEQ ID NO: 1607806 - protein, 5 aa, Staphylococcus aureus
KEPNC

SEQ ID NO: 1607807 - protein, 5 aa, Staphylococcus aureus
KEREN

SEQ ID NO: 1607808 - protein, 9 aa, Staphylococcus aureus
KESDFTKAE

SEQ ID NO: 1607809 - protein, 9 aa, Staphylococcus aureus
KEVEKSRNE

SEQ ID NO: 1607810 - protein, 5 aa, Staphylococcus aureus
KFKGA

SEQ ID NO: 1607811 - protein, 7 aa, Staphylococcus aureus
KFKVPED

SEQ ID NO: 1607812 - protein, 6 aa, Staphylococcus aureus
KGIGKG

SEQ ID NO: 1607813 - protein, 7 aa, Staphylococcus aureus
KGKVPRP

SEQ ID NO: 1607814 - protein, 10 aa, Staphylococcus aureus
KGLGYASAEA

SEQ ID NO: 1607815 - protein, 13 aa, Staphylococcus aureus
KGLKDAQVKKSGY

SEQ ID NO: 1607816 - protein, 12 aa, Staphylococcus aureus
KGTGALQKGVQQ

SEQ ID NO: 1607817 - protein, 29 aa, Staphylococcus aureus
KGTTGDGVESVTGYTGHDAAKLRDYNETH

SEQ ID NO: 1607818 - protein, 23 aa, Staphylococcus aureus
KHIQTPGSEITDTRGGSHNAPTR

SEQ ID NO: 1607819 - protein, 8 aa, Staphylococcus aureus
KHKAGQPV

SEQ ID NO: 1607820 - protein, 6 aa, Staphylococcus aureus
KHQPTT

SEQ ID NO: 1607821 - protein, 6 aa, Staphylococcus aureus
KHRDVD

SEQ ID NO: 1607822 - protein, 6 aa, Staphylococcus aureus
KHTSKP

SEQ ID NO: 1607823 - protein, 15 aa, Staphylococcus aureus
KIRPDGRKPDEIRPL

SEQ ID NO: 1607824 - protein, 6 aa, Staphylococcus aureus
KITEEG

SEQ ID NO: 1607825 - protein, 17 aa, Staphylococcus aureus
KKGESADSLGLDGTEEI

SEQ ID NO: 1607826 - protein, 7 aa, Staphylococcus aureus
KKGLGRK

SEQ ID NO: 1607827 - protein, 19 aa, Staphylococcus aureus
KKIPKRMPQQDYKQKRWFG

SEQ ID NO: 1607828 - protein, 31 aa, Staphylococcus aureus
KKKRRQESQNIDNDHDSLLPQNNDIYSRPRG

SEQ ID NO: 1607829 - protein, 6 aa, Staphylococcus aureus
KKLGNA

SEQ ID NO: 1607830 - protein, 20 aa, Staphylococcus aureus
KKNPERYAEEQKIRQEYKNK

SEQ ID NO: 1607831 - protein, 16 aa, Staphylococcus aureus
KKQAQESVKSEAERAG

SEQ ID NO: 1607832 - protein, 11 aa, Staphylococcus aureus
KKQGDTFVTSG

SEQ ID NO: 1607833 - protein, 7 aa, Staphylococcus aureus
KKSQKVR

SEQ ID NO: 1607834 - protein, 6 aa, Staphylococcus aureus
KKYNLN

SEQ ID NO: 1607835 - protein, 7 aa, Staphylococcus aureus
KLAGEGT

SEQ ID NO: 1607836 - protein, 5 aa, Staphylococcus aureus
KLDDT

SEQ ID NO: 1607837 - protein, 9 aa, Staphylococcus aureus
KLPKTRSGK

SEQ ID NO: 1607838 - protein, 9 aa, Staphylococcus aureus
KLPSSVKRG

SEQ ID NO: 1607839 - protein, 8 aa, Staphylococcus aureus
KLRGERSE

SEQ ID NO: 1607840 - protein, 6 aa, Staphylococcus aureus
KLSKQQ

SEQ ID NO: 1607841 - protein, 8 aa, Staphylococcus aureus
KLSSKGIK

SEQ ID NO: 1607842 - protein, 6 aa, Staphylococcus aureus
KLTDAG

SEQ ID NO: 1607843 - protein, 14 aa, Staphylococcus aureus
KLYQREDDNPETVA

SEQ ID NO: 1607844 - protein, 4 aa, Staphylococcus aureus
KMEE

SEQ ID NO: 1607845 - protein, 7 aa, Staphylococcus aureus
KMEEGSL

SEQ ID NO: 1607846 - protein, 6 aa, Staphylococcus aureus
KMTKED

SEQ ID NO: 1607847 - protein, 8 aa, Staphylococcus aureus
KNAGYGTK

SEQ ID NO: 1607848 - protein, 4 aa, Staphylococcus aureus
KNDQ

SEQ ID NO: 1607849 - protein, 5 aa, Staphylococcus aureus
KNEYE

SEQ ID NO: 1607850 - protein, 6 aa, Staphylococcus aureus
KNFNET

SEQ ID NO: 1607851 - protein, 7 aa, Staphylococcus aureus
KNHEREA

SEQ ID NO: 1607852 - protein, 8 aa, Staphylococcus aureus
KNKKTSIK

SEQ ID NO: 1607853 - protein, 9 aa, Staphylococcus aureus
KNNEPKQFT

SEQ ID NO: 1607854 - protein, 6 aa, Staphylococcus aureus
KNNGDL

SEQ ID NO: 1607855 - protein, 18 aa, Staphylococcus aureus
KNPTLSQTIQGNTYDNPI

SEQ ID NO: 1607856 - protein, 6 aa, Staphylococcus aureus
KNQAND

SEQ ID NO: 1607857 - protein, 10 aa, Staphylococcus aureus
KNRGINTEQD

SEQ ID NO: 1607858 - protein, 26 aa, Staphylococcus aureus
KNSKDEEKLQQAKERVAKLTAEYPLY

SEQ ID NO: 1607859 - protein, 4 aa, Staphylococcus aureus
KPDT

SEQ ID NO: 1607860 - protein, 4 aa, Staphylococcus aureus
KPEH

SEQ ID NO: 1607861 - protein, 12 aa, Staphylococcus aureus
KPEIDGKGATVV

SEQ ID NO: 1607862 - protein, 5 aa, Staphylococcus aureus
KPIDR

SEQ ID NO: 1607863 - protein, 5 aa, Staphylococcus aureus
KPSQI

SEQ ID NO: 1607864 - protein, 8 aa, Staphylococcus aureus
KPTTGTVT

SEQ ID NO: 1607865 - protein, 9 aa, Staphylococcus aureus
KQAEFKSSK

SEQ ID NO: 1607866 - protein, 21 aa, Staphylococcus aureus
KQASEVQDTKKEIVAALRKLN

SEQ ID NO: 1607867 - protein, 5 aa, Staphylococcus aureus
KQDIH

SEQ ID NO: 1607868 - protein, 8 aa, Staphylococcus aureus
KQETNIQK

SEQ ID NO: 1607869 - protein, 7 aa, Staphylococcus aureus
KQKDTET

SEQ ID NO: 1607870 - protein, 29 aa, Staphylococcus aureus
KQMQGEEIAEEDLQKAQEQAQAIEKDENI

SEQ ID NO: 1607871 - protein, 7 aa, Staphylococcus aureus
KQNNRIN

SEQ ID NO: 1607872 - protein, 12 aa, Staphylococcus aureus
KQPDLNWGNPEV

SEQ ID NO: 1607873 - protein, 9 aa, Staphylococcus aureus
KQTGVPQST

SEQ ID NO: 1607874 - protein, 19 aa, Staphylococcus aureus
KQYDQEVKSGAFPSEEYTY

SEQ ID NO: 1607875 - protein, 10 aa, Staphylococcus aureus
KRATAEKNKV

SEQ ID NO: 1607876 - protein, 27 aa, Staphylococcus aureus
KRENKITLDRSDSGLLPTNVEGTTRST

SEQ ID NO: 1607877 - protein, 4 aa, Staphylococcus aureus
KRGN

SEQ ID NO: 1607878 - protein, 8 aa, Staphylococcus aureus
KRGPATNP

SEQ ID NO: 1607879 - protein, 7 aa, Staphylococcus aureus
KRGSNSV

SEQ ID NO: 1607880 - protein, 18 aa, Staphylococcus aureus
KRKAESLNKLDQTEDNLT

SEQ ID NO: 1607881 - protein, 7 aa, Staphylococcus aureus
KRKHSEQ

SEQ ID NO: 1607882 - protein, 7 aa, Staphylococcus aureus
KRKKEQA

SEQ ID NO: 1607883 - protein, 9 aa, Staphylococcus aureus
KRLSKSPAF

SEQ ID NO: 1607884 - protein, 20 aa, Staphylococcus aureus
KRNQGKLEVKPNVKVTNKEE

SEQ ID NO: 1607885 - protein, 7 aa, Staphylococcus aureus
KRRGKVR

SEQ ID NO: 1607886 - protein, 14 aa, Staphylococcus aureus
KSDEEAKALAKEHG

SEQ ID NO: 1607887 - protein, 5 aa, Staphylococcus aureus
KSDQL

SEQ ID NO: 1607888 - protein, 4 aa, Staphylococcus aureus
KSDY

SEQ ID NO: 1607889 - protein, 7 aa, Staphylococcus aureus
KSGKTLN

SEQ ID NO: 1607890 - protein, 8 aa, Staphylococcus aureus
KSGPFANQ

SEQ ID NO: 1607891 - protein, 5 aa, Staphylococcus aureus
KSHQT

SEQ ID NO: 1607892 - protein, 11 aa, Staphylococcus aureus
KSINPADTSQV

SEQ ID NO: 1607893 - protein, 6 aa, Staphylococcus aureus
KSIYEQ

SEQ ID NO: 1607894 - protein, 5 aa, Staphylococcus aureus
KSLSQ

SEQ ID NO: 1607895 - protein, 10 aa, Staphylococcus aureus
KSPSPDEEAY

SEQ ID NO: 1607896 - protein, 13 aa, Staphylococcus aureus
KSQIPVGKNEQNE

SEQ ID NO: 1607897 - protein, 6 aa, Staphylococcus aureus
KSQMKL

SEQ ID NO: 1607898 - protein, 9 aa, Staphylococcus aureus
KSSEGSATL

SEQ ID NO: 1607899 - protein, 5 aa, Staphylococcus aureus
KSSYM

SEQ ID NO: 1607900 - protein, 5 aa, Staphylococcus aureus
KSTGG

SEQ ID NO: 1607901 - protein, 5 aa, Staphylococcus aureus
KTADV

SEQ ID NO: 1607902 - protein, 5 aa, Staphylococcus aureus
KTDDV

SEQ ID NO: 1607903 - protein, 6 aa, Staphylococcus aureus
KTEEGH

SEQ ID NO: 1607904 - protein, 5 aa, Staphylococcus aureus
KTFST

SEQ ID NO: 1607905 - protein, 18 aa, Staphylococcus aureus
KTGQETEINAPGPHITST

SEQ ID NO: 1607906 - protein, 6 aa, Staphylococcus aureus
KTHNQG

SEQ ID NO: 1607907 - protein, 13 aa, Staphylococcus aureus
KTHSSSGRSPSQL

SEQ ID NO: 1607908 - protein, 14 aa, Staphylococcus aureus
KTIKEVQKETGIKG

SEQ ID NO: 1607909 - protein, 14 aa, Staphylococcus aureus
KTMLSTNGSGRTNE

SEQ ID NO: 1607910 - protein, 8 aa, Staphylococcus aureus
KTNAEGQQ

SEQ ID NO: 1607911 - protein, 6 aa, Staphylococcus aureus
KTPFNQ

SEQ ID NO: 1607912 - protein, 6 aa, Staphylococcus aureus
KVAPEY

SEQ ID NO: 1607913 - protein, 12 aa, Staphylococcus aureus
KVISKNNKEVTL

SEQ ID NO: 1607914 - protein, 6 aa, Staphylococcus aureus
KVREGN

SEQ ID NO: 1607915 - protein, 6 aa, Staphylococcus aureus
KVTEDF

SEQ ID NO: 1607916 - protein, 14 aa, Staphylococcus aureus
KVTTPYTEISENVS

SEQ ID NO: 1607917 - protein, 9 aa, Staphylococcus aureus
KYAAKDPTV

SEQ ID NO: 1607918 - protein, 17 aa, Staphylococcus aureus
LAAPSANLSGRPSPTTF

SEQ ID NO: 1607919 - protein, 4 aa, Staphylococcus aureus
LADE

SEQ ID NO: 1607920 - protein, 7 aa, Staphylococcus aureus
LAGNDYA

SEQ ID NO: 1607921 - protein, 10 aa, Staphylococcus aureus
LAQKAKAEDV

SEQ ID NO: 1607922 - protein, 11 aa, Staphylococcus aureus
LATEGAKATLK

SEQ ID NO: 1607923 - protein, 7 aa, Staphylococcus aureus
LATNEGY

SEQ ID NO: 1607924 - protein, 7 aa, Staphylococcus aureus
LATQEEE

SEQ ID NO: 1607925 - protein, 9 aa, Staphylococcus aureus
LDDQATAYE

SEQ ID NO: 1607926 - protein, 10 aa, Staphylococcus aureus
LDNGSIQGIN

SEQ ID NO: 1607927 - protein, 8 aa, Staphylococcus aureus
LDNKQNQR

SEQ ID NO: 1607928 - protein, 15 aa, Staphylococcus aureus
LDQQDEMGFTQKSPR

SEQ ID NO: 1607929 - protein, 4 aa, Staphylococcus aureus
LEEY

SEQ ID NO: 1607930 - protein, 7 aa, Staphylococcus aureus
LEKTGKQ

SEQ ID NO: 1607931 - protein, 4 aa, Staphylococcus aureus
LEQG

SEQ ID NO: 1607932 - protein, 10 aa, Staphylococcus aureus
LETETQNYST

SEQ ID NO: 1607933 - protein, 21 aa, Staphylococcus aureus
LEYRDKDSEEEIEATGAGDQG

SEQ ID NO: 1607934 - protein, 4 aa, Staphylococcus aureus
LGAD

SEQ ID NO: 1607935 - protein, 6 aa, Staphylococcus aureus
LGEMNP

SEQ ID NO: 1607936 - protein, 11 aa, Staphylococcus aureus
LGEPPHEGTQK

SEQ ID NO: 1607937 - protein, 9 aa, Staphylococcus aureus
LGKGSKERF

SEQ ID NO: 1607938 - protein, 10 aa, Staphylococcus aureus
LGKNKVEAYA

SEQ ID NO: 1607939 - protein, 11 aa, Staphylococcus aureus
LGNDAGITGAA

SEQ ID NO: 1607940 - protein, 12 aa, Staphylococcus aureus
LGTPAATTRGFD

SEQ ID NO: 1607941 - protein, 12 aa, Staphylococcus aureus
LIEKGKKEGHLS

SEQ ID NO: 1607942 - protein, 8 aa, Staphylococcus aureus
LKDGRQYN

SEQ ID NO: 1607943 - protein, 7 aa, Staphylococcus aureus
LKKGPQI

SEQ ID NO: 1607944 - protein, 19 aa, Staphylococcus aureus
LKNAEDVAKLRGKTVEELY

SEQ ID NO: 1607945 - protein, 6 aa, Staphylococcus aureus
LKQDGT

SEQ ID NO: 1607946 - protein, 18 aa, Staphylococcus aureus
LKSGADGALMSGSGPTVY

SEQ ID NO: 1607947 - protein, 6 aa, Staphylococcus aureus
LKSTDL

SEQ ID NO: 1607948 - protein, 13 aa, Staphylococcus aureus
LKSTSSQNSDGTI

SEQ ID NO: 1607949 - protein, 6 aa, Staphylococcus aureus
LMDGDT

SEQ ID NO: 1607950 - protein, 5 aa, Staphylococcus aureus
LNANG

SEQ ID NO: 1607951 - protein, 16 aa, Staphylococcus aureus
LNENPNSKKNKSKLNQ

SEQ ID NO: 1607952 - protein, 11 aa, Staphylococcus aureus
LNPKAGKDNHE

SEQ ID NO: 1607953 - protein, 9 aa, Staphylococcus aureus
LNPNGQRDI

SEQ ID NO: 1607954 - protein, 10 aa, Staphylococcus aureus
LNPNSPDGKR

SEQ ID NO: 1607955 - protein, 15 aa, Staphylococcus aureus
LNSDNNLTFNVEKIH

SEQ ID NO: 1607956 - protein, 4 aa, Staphylococcus aureus
LNSE

SEQ ID NO: 1607957 - protein, 11 aa, Staphylococcus aureus
LNSPNIKTRKR

SEQ ID NO: 1607958 - protein, 4 aa, Staphylococcus aureus
LPGA

SEQ ID NO: 1607959 - protein, 8 aa, Staphylococcus aureus
LPKKPAAL

SEQ ID NO: 1607960 - protein, 11 aa, Staphylococcus aureus
LPTNRTARFTN

SEQ ID NO: 1607961 - protein, 9 aa, Staphylococcus aureus
LQDKRYPNF

SEQ ID NO: 1607962 - protein, 4 aa, Staphylococcus aureus
LQPS

SEQ ID NO: 1607963 - protein, 8 aa, Staphylococcus aureus
LRRDDESE

SEQ ID NO: 1607964 - protein, 10 aa, Staphylococcus aureus
LRSGKERQEH

SEQ ID NO: 1607965 - protein, 8 aa, Staphylococcus aureus
LSDEKSEQ

SEQ ID NO: 1607966 - protein, 20 aa, Staphylococcus aureus
LSEQGINEATRAGEKVRENN

SEQ ID NO: 1607967 - protein, 5 aa, Staphylococcus aureus
LSETS

SEQ ID NO: 1607968 - protein, 10 aa, Staphylococcus aureus
LSKEADKAGF

SEQ ID NO: 1607969 - protein, 5 aa, Staphylococcus aureus
LSKGK

SEQ ID NO: 1607970 - protein, 5 aa, Staphylococcus aureus
LSKQR

SEQ ID NO: 1607971 - protein, 11 aa, Staphylococcus aureus
LSKVRSSKDER

SEQ ID NO: 1607972 - protein, 15 aa, Staphylococcus aureus
LSSKNDKYVSYKETQ

SEQ ID NO: 1607973 - protein, 8 aa, Staphylococcus aureus
LTDGSNQY

SEQ ID NO: 1607974 - protein, 8 aa, Staphylococcus aureus
LTEERRQQ

SEQ ID NO: 1607975 - protein, 19 aa, Staphylococcus aureus
LTEERSKRLEKTRKALEDY

SEQ ID NO: 1607976 - protein, 8 aa, Staphylococcus aureus
LTEKAENH

SEQ ID NO: 1607977 - protein, 9 aa, Staphylococcus aureus
LTGSDANDG

SEQ ID NO: 1607978 - protein, 8 aa, Staphylococcus aureus
LTISTNET

SEQ ID NO: 1607979 - protein, 4 aa, Staphylococcus aureus
LTPP

SEQ ID NO: 1607980 - protein, 17 aa, Staphylococcus aureus
MAGRGTDIKLGEGVEEL

SEQ ID NO: 1607981 - protein, 11 aa, Staphylococcus aureus
MAKTTAEAQKM

SEQ ID NO: 1607982 - protein, 10 aa, Staphylococcus aureus
MATLQSGDEL

SEQ ID NO: 1607983 - protein, 5 aa, Staphylococcus aureus
MDATE

SEQ ID NO: 1607984 - protein, 8 aa, Staphylococcus aureus
MDKTGNPN

SEQ ID NO: 1607985 - protein, 7 aa, Staphylococcus aureus
MKETTYQ

SEQ ID NO: 1607986 - protein, 12 aa, Staphylococcus aureus
MNPTYDADNRTA

SEQ ID NO: 1607987 - protein, 5 aa, Staphylococcus aureus
MSEKQ

SEQ ID NO: 1607988 - protein, 4 aa, Staphylococcus aureus
MSGK

SEQ ID NO: 1607989 - protein, 14 aa, Staphylococcus aureus
MSNGETLTDDEQMK

SEQ ID NO: 1607990 - protein, 4 aa, Staphylococcus aureus
MSQE

SEQ ID NO: 1607991 - protein, 8 aa, Staphylococcus aureus
MSTKNGRK

SEQ ID NO: 1607992 - protein, 7 aa, Staphylococcus aureus
MTPYEAR

SEQ ID NO: 1607993 - protein, 8 aa, Staphylococcus aureus
NAEADAAN

SEQ ID NO: 1607994 - protein, 13 aa, Staphylococcus aureus
NAGDGSGQHPTQS

SEQ ID NO: 1607995 - protein, 7 aa, Staphylococcus aureus
NAGEGRV

SEQ ID NO: 1607996 - protein, 9 aa, Staphylococcus aureus
NAGIGSGFS

SEQ ID NO: 1607997 - protein, 10 aa, Staphylococcus aureus
NAISKEKQSH

SEQ ID NO: 1607998 - protein, 20 aa, Staphylococcus aureus
NAKETEDGQFKVPTIMNEED

SEQ ID NO: 1607999 - protein, 5 aa, Staphylococcus aureus
NALTD

SEQ ID NO: 1608000 - protein, 7 aa, Staphylococcus aureus
NAPNLVS

SEQ ID NO: 1608001 - protein, 7 aa, Staphylococcus aureus
NAPTSKD

SEQ ID NO: 1608002 - protein, 6 aa, Staphylococcus aureus
NCDPDE

SEQ ID NO: 1608003 - protein, 5 aa, Staphylococcus aureus
NDDAI

SEQ ID NO: 1608004 - protein, 8 aa, Staphylococcus aureus
NDDTVTYD

SEQ ID NO: 1608005 - protein, 5 aa, Staphylococcus aureus
NDEID

SEQ ID NO: 1608006 - protein, 8 aa, Staphylococcus aureus
NDLKPRDI

SEQ ID NO: 1608007 - protein, 6 aa, Staphylococcus aureus
NDNEAV

SEQ ID NO: 1608008 - protein, 8 aa, Staphylococcus aureus
NDPEGNGI

SEQ ID NO: 1608009 - protein, 4 aa, Staphylococcus aureus
NDTE

SEQ ID NO: 1608010 - protein, 18 aa, Staphylococcus aureus
NEAVKNGAKYVTTSYDKL

SEQ ID NO: 1608011 - protein, 5 aa, Staphylococcus aureus
NEESI

SEQ ID NO: 1608012 - protein, 4 aa, Staphylococcus aureus
NEGE

SEQ ID NO: 1608013 - protein, 7 aa, Staphylococcus aureus
NEIDDSL

SEQ ID NO: 1608014 - protein, 8 aa, Staphylococcus aureus
NEIEPNLE

SEQ ID NO: 1608015 - protein, 12 aa, Staphylococcus aureus
NEINEQDKLDGE

SEQ ID NO: 1608016 - protein, 7 aa, Staphylococcus aureus
NEMSDPQ

SEQ ID NO: 1608017 - protein, 6 aa, Staphylococcus aureus
NENNYN

SEQ ID NO: 1608018 - protein, 8 aa, Staphylococcus aureus
NENPYDEQ

SEQ ID NO: 1608019 - protein, 7 aa, Staphylococcus aureus
NFDGDTK

SEQ ID NO: 1608020 - protein, 10 aa, Staphylococcus aureus
NFEEGTSVKS

SEQ ID NO: 1608021 - protein, 6 aa, Staphylococcus aureus
NFSEQT

SEQ ID NO: 1608022 - protein, 9 aa, Staphylococcus aureus
NGFSSAASF

SEQ ID NO: 1608023 - protein, 18 aa, Staphylococcus aureus
NGKVSELSGFAKKTEQNI

SEQ ID NO: 1608024 - protein, 9 aa, Staphylococcus aureus
NGLDPKAVR

SEQ ID NO: 1608025 - protein, 5 aa, Staphylococcus aureus
NGLKG

SEQ ID NO: 1608026 - protein, 11 aa, Staphylococcus aureus
NGMDEATLSGD

SEQ ID NO: 1608027 - protein, 7 aa, Staphylococcus aureus
NGREPLM

SEQ ID NO: 1608028 - protein, 11 aa, Staphylococcus aureus
NGTDSRGSFPQ

SEQ ID NO: 1608029 - protein, 6 aa, Staphylococcus aureus
NHDPLR

SEQ ID NO: 1608030 - protein, 4 aa, Staphylococcus aureus
NHEE

SEQ ID NO: 1608031 - protein, 10 aa, Staphylococcus aureus
NHEPNTTPIT

SEQ ID NO: 1608032 - protein, 7 aa, Staphylococcus aureus
NHETGKE

SEQ ID NO: 1608033 - protein, 7 aa, Staphylococcus aureus
NHGGRTY

SEQ ID NO: 1608034 - protein, 6 aa, Staphylococcus aureus
NHGSNG

SEQ ID NO: 1608035 - protein, 18 aa, Staphylococcus aureus
NIAALGEKHKGAGEGADD

SEQ ID NO: 1608036 - protein, 7 aa, Staphylococcus aureus
NINKTQS

SEQ ID NO: 1608037 - protein, 8 aa, Staphylococcus aureus
NIRREDER

SEQ ID NO: 1608038 - protein, 8 aa, Staphylococcus aureus
NISGEQEK

SEQ ID NO: 1608039 - protein, 20 aa, Staphylococcus aureus
NKAYEDKLNTYASVEGDNIQ

SEQ ID NO: 1608040 - protein, 7 aa, Staphylococcus aureus
NKEIKQL

SEQ ID NO: 1608041 - protein, 5 aa, Staphylococcus aureus
NKESK

SEQ ID NO: 1608042 - protein, 5 aa, Staphylococcus aureus
NKGTD

SEQ ID NO: 1608043 - protein, 17 aa, Staphylococcus aureus
NKKLSNEDAYKRARPSH

SEQ ID NO: 1608044 - protein, 4 aa, Staphylococcus aureus
NKKP

SEQ ID NO: 1608045 - protein, 6 aa, Staphylococcus aureus
NKNEKV

SEQ ID NO: 1608046 - protein, 8 aa, Staphylococcus aureus
NKNVRSNC

SEQ ID NO: 1608047 - protein, 6 aa, Staphylococcus aureus
NKRPDL

SEQ ID NO: 1608048 - protein, 5 aa, Staphylococcus aureus
NKSKY

SEQ ID NO: 1608049 - protein, 7 aa, Staphylococcus aureus
NKSNYSI

SEQ ID NO: 1608050 - protein, 7 aa, Staphylococcus aureus
NKTNQRG

SEQ ID NO: 1608051 - protein, 7 aa, Staphylococcus aureus
NKVTPKV

SEQ ID NO: 1608052 - protein, 12 aa, Staphylococcus aureus
NLDKAEIKSYFE

SEQ ID NO: 1608053 - protein, 4 aa, Staphylococcus aureus
NLGR

SEQ ID NO: 1608054 - protein, 5 aa, Staphylococcus aureus
NLSSP

SEQ ID NO: 1608055 - protein, 9 aa, Staphylococcus aureus
NLTQEARDG

SEQ ID NO: 1608056 - protein, 12 aa, Staphylococcus aureus
NNAKEKTANNTG

SEQ ID NO: 1608057 - protein, 9 aa, Staphylococcus aureus
NNKEDADKV

SEQ ID NO: 1608058 - protein, 10 aa, Staphylococcus aureus
NNKQKRDPNV

SEQ ID NO: 1608059 - protein, 7 aa, Staphylococcus aureus
NNNPTTI

SEQ ID NO: 1608060 - protein, 5 aa, Staphylococcus aureus
NNPKC

SEQ ID NO: 1608061 - protein, 7 aa, Staphylococcus aureus
NNTAGGS

SEQ ID NO: 1608062 - protein, 9 aa, Staphylococcus aureus
NNTGTFGSV

SEQ ID NO: 1608063 - protein, 11 aa, Staphylococcus aureus
NNVNRTASDVR

SEQ ID NO: 1608064 - protein, 4 aa, Staphylococcus aureus
NPPH

SEQ ID NO: 1608065 - protein, 8 aa, Staphylococcus aureus
NPQSKDYF

SEQ ID NO: 1608066 - protein, 5 aa, Staphylococcus aureus
NPSGN

SEQ ID NO: 1608067 - protein, 5 aa, Staphylococcus aureus
NPWEG

SEQ ID NO: 1608068 - protein, 9 aa, Staphylococcus aureus
NQDASVNAA

SEQ ID NO: 1608069 - protein, 8 aa, Staphylococcus aureus
NQGAQEEA

SEQ ID NO: 1608070 - protein, 7 aa, Staphylococcus aureus
NQNTIEE

SEQ ID NO: 1608071 - protein, 6 aa, Staphylococcus aureus
NREEET

SEQ ID NO: 1608072 - protein, 9 aa, Staphylococcus aureus
NRNKSFETY

SEQ ID NO: 1608073 - protein, 5 aa, Staphylococcus aureus
NRSVS

SEQ ID NO: 1608074 - protein, 15 aa, Staphylococcus aureus
NSDEPEEGLPIALLQ

SEQ ID NO: 1608075 - protein, 8 aa, Staphylococcus aureus
NSEDIRAE

SEQ ID NO: 1608076 - protein, 4 aa, Staphylococcus aureus
NSIH

SEQ ID NO: 1608077 - protein, 7 aa, Staphylococcus aureus
NSKDNEK

SEQ ID NO: 1608078 - protein, 8 aa, Staphylococcus aureus
NSKETDTV

SEQ ID NO: 1608079 - protein, 6 aa, Staphylococcus aureus
NSQGKQ

SEQ ID NO: 1608080 - protein, 13 aa, Staphylococcus aureus
NSTGFDGNTEYAG

SEQ ID NO: 1608081 - protein, 7 aa, Staphylococcus aureus
NSTRTRA

SEQ ID NO: 1608082 - protein, 9 aa, Staphylococcus aureus
NTDEGSRRL

SEQ ID NO: 1608083 - protein, 16 aa, Staphylococcus aureus
NTMQAATKPGITTKEL

SEQ ID NO: 1608084 - protein, 20 aa, Staphylococcus aureus
NVDGKIKSVATKHKKSYPQS

SEQ ID NO: 1608085 - protein, 7 aa, Staphylococcus aureus
NVGGLPE

SEQ ID NO: 1608086 - protein, 22 aa, Staphylococcus aureus
NVKTIDDSRKIREKFNKPKMTH

SEQ ID NO: 1608087 - protein, 7 aa, Staphylococcus aureus
NVLPSEV

SEQ ID NO: 1608088 - protein, 8 aa, Staphylococcus aureus
NVTSRSPY

SEQ ID NO: 1608089 - protein, 4 aa, Staphylococcus aureus
NYPG

SEQ ID NO: 1608090 - protein, 11 aa, Staphylococcus aureus
NYSEDAQRKMT

SEQ ID NO: 1608091 - protein, 5 aa, Staphylococcus aureus
PALPV

SEQ ID NO: 1608092 - protein, 9 aa, Staphylococcus aureus
PDDSPISNR

SEQ ID NO: 1608093 - protein, 24 aa, Staphylococcus aureus
PDEKAPENMSDKEIEQVKEKEGQR

SEQ ID NO: 1608094 - protein, 7 aa, Staphylococcus aureus
PDLPASK

SEQ ID NO: 1608095 - protein, 6 aa, Staphylococcus aureus
PDQVPE

SEQ ID NO: 1608096 - protein, 14 aa, Staphylococcus aureus
PEDIEKNYRSNRGA

SEQ ID NO: 1608097 - protein, 7 aa, Staphylococcus aureus
PEQLEEQ

SEQ ID NO: 1608098 - protein, 6 aa, Staphylococcus aureus
PERVAQ

SEQ ID NO: 1608099 - protein, 13 aa, Staphylococcus aureus
PFKLKTKKDVEKI

SEQ ID NO: 1608100 - protein, 18 aa, Staphylococcus aureus
PGASITTTSSVQGYNPSP

SEQ ID NO: 1608101 - protein, 9 aa, Staphylococcus aureus
PGGVNSPVR

SEQ ID NO: 1608102 - protein, 5 aa, Staphylococcus aureus
PGYTT

SEQ ID NO: 1608103 - protein, 4 aa, Staphylococcus aureus
PHDY

SEQ ID NO: 1608104 - protein, 5 aa, Staphylococcus aureus
PIEPG

SEQ ID NO: 1608105 - protein, 12 aa, Staphylococcus aureus
PIQASTKKDELQ

SEQ ID NO: 1608106 - protein, 7 aa, Staphylococcus aureus
PKDKTLL

SEQ ID NO: 1608107 - protein, 10 aa, Staphylococcus aureus
PKDLKRNERI

SEQ ID NO: 1608108 - protein, 5 aa, Staphylococcus aureus
PKQLT

SEQ ID NO: 1608109 - protein, 13 aa, Staphylococcus aureus
PNIVDGTGKSLED

SEQ ID NO: 1608110 - protein, 7 aa, Staphylococcus aureus
PNKDGKF

SEQ ID NO: 1608111 - protein, 8 aa, Staphylococcus aureus
PNLPEGNL

SEQ ID NO: 1608112 - protein, 13 aa, Staphylococcus aureus
PNNPTGYTPTHKE

SEQ ID NO: 1608113 - protein, 4 aa, Staphylococcus aureus
PPGI

SEQ ID NO: 1608114 - protein, 8 aa, Staphylococcus aureus
PPGLGKTT

SEQ ID NO: 1608115 - protein, 4 aa, Staphylococcus aureus
PPGT

SEQ ID NO: 1608116 - protein, 5 aa, Staphylococcus aureus
PQESS

SEQ ID NO: 1608117 - protein, 13 aa, Staphylococcus aureus
PQHERTQNFLARV

SEQ ID NO: 1608118 - protein, 21 aa, Staphylococcus aureus
PRIGTPAARMDDQIDEEIKNE

SEQ ID NO: 1608119 - protein, 10 aa, Staphylococcus aureus
PRKERNAIAE

SEQ ID NO: 1608120 - protein, 5 aa, Staphylococcus aureus
PSEDY

SEQ ID NO: 1608121 - protein, 10 aa, Staphylococcus aureus
PSEEQDAQEV

SEQ ID NO: 1608122 - protein, 12 aa, Staphylococcus aureus
PSETFKRDGDDI

SEQ ID NO: 1608123 - protein, 8 aa, Staphylococcus aureus
PSFRPGDT

SEQ ID NO: 1608124 - protein, 9 aa, Staphylococcus aureus
PSPVKRPQD

SEQ ID NO: 1608125 - protein, 9 aa, Staphylococcus aureus
PSQETAEDK

SEQ ID NO: 1608126 - protein, 7 aa, Staphylococcus aureus
PSQTLSD

SEQ ID NO: 1608127 - protein, 8 aa, Staphylococcus aureus
PSYSPNSI

SEQ ID NO: 1608128 - protein, 8 aa, Staphylococcus aureus
PVGAGKTQ

SEQ ID NO: 1608129 - protein, 5 aa, Staphylococcus aureus
PVPES

SEQ ID NO: 1608130 - protein, 11 aa, Staphylococcus aureus
PVQAEKADTDL

SEQ ID NO: 1608131 - protein, 9 aa, Staphylococcus aureus
PYEEEAQQA

SEQ ID NO: 1608132 - protein, 18 aa, Staphylococcus aureus
QAAFSTQANAAHYGASKA

SEQ ID NO: 1608133 - protein, 8 aa, Staphylococcus aureus
QAQSTSNF

SEQ ID NO: 1608134 - protein, 9 aa, Staphylococcus aureus
QATETGNNG

SEQ ID NO: 1608135 - protein, 6 aa, Staphylococcus aureus
QCQKYE

SEQ ID NO: 1608136 - protein, 7 aa, Staphylococcus aureus
QDKTAEL

SEQ ID NO: 1608137 - protein, 7 aa, Staphylococcus aureus
QDPQQFK

SEQ ID NO: 1608138 - protein, 10 aa, Staphylococcus aureus
QDRPNDKTVE

SEQ ID NO: 1608139 - protein, 9 aa, Staphylococcus aureus
QEGRSKQAF

SEQ ID NO: 1608140 - protein, 6 aa, Staphylococcus aureus
QENGGD

SEQ ID NO: 1608141 - protein, 6 aa, Staphylococcus aureus
QEPPYT

SEQ ID NO: 1608142 - protein, 5 aa, Staphylococcus aureus
QESGV

SEQ ID NO: 1608143 - protein, 13 aa, Staphylococcus aureus
QETNANAIKAEGA

SEQ ID NO: 1608144 - protein, 11 aa, Staphylococcus aureus
QETPPNQCPNC

SEQ ID NO: 1608145 - protein, 6 aa, Staphylococcus aureus
QEVTER

SEQ ID NO: 1608146 - protein, 5 aa, Staphylococcus aureus
QGASS

SEQ ID NO: 1608147 - protein, 6 aa, Staphylococcus aureus
QGDGGL

SEQ ID NO: 1608148 - protein, 5 aa, Staphylococcus aureus
QGEMK

SEQ ID NO: 1608149 - protein, 4 aa, Staphylococcus aureus
QGFG

SEQ ID NO: 1608150 - protein, 6 aa, Staphylococcus aureus
QGKPFE

SEQ ID NO: 1608151 - protein, 11 aa, Staphylococcus aureus
QHRDKNEDAGG

SEQ ID NO: 1608152 - protein, 14 aa, Staphylococcus aureus
QIPTNKPVQRNDKS

SEQ ID NO: 1608153 - protein, 6 aa, Staphylococcus aureus
QKDQGT

SEQ ID NO: 1608154 - protein, 12 aa, Staphylococcus aureus
QKFKQREYKRAA

SEQ ID NO: 1608155 - protein, 6 aa, Staphylococcus aureus
QKQTKI

SEQ ID NO: 1608156 - protein, 4 aa, Staphylococcus aureus
QLDA

SEQ ID NO: 1608157 - protein, 5 aa, Staphylococcus aureus
QLYNE

SEQ ID NO: 1608158 - protein, 6 aa, Staphylococcus aureus
QNDPEL

SEQ ID NO: 1608159 - protein, 7 aa, Staphylococcus aureus
QNHDDNG

SEQ ID NO: 1608160 - protein, 11 aa, Staphylococcus aureus
QNKTNYKTSST

SEQ ID NO: 1608161 - protein, 12 aa, Staphylococcus aureus
QNSNSESSNDTN

SEQ ID NO: 1608162 - protein, 7 aa, Staphylococcus aureus
QPAKDMT

SEQ ID NO: 1608163 - protein, 5 aa, Staphylococcus aureus
QPDFP

SEQ ID NO: 1608164 - protein, 5 aa, Staphylococcus aureus
QPLNE

SEQ ID NO: 1608165 - protein, 7 aa, Staphylococcus aureus
QPPGKKL

SEQ ID NO: 1608166 - protein, 5 aa, Staphylococcus aureus
QPTND

SEQ ID NO: 1608167 - protein, 7 aa, Staphylococcus aureus
QQAAGEL

SEQ ID NO: 1608168 - protein, 8 aa, Staphylococcus aureus
QQASSAQL

SEQ ID NO: 1608169 - protein, 4 aa, Staphylococcus aureus
QQEV

SEQ ID NO: 1608170 - protein, 5 aa, Staphylococcus aureus
QQIPH

SEQ ID NO: 1608171 - protein, 43 aa, Staphylococcus aureus
QQLKKPRDPEEEERLRKRHEERKRRKEEQDRKLKEKLEKRKAQ

SEQ ID NO: 1608172 - protein, 10 aa, Staphylococcus aureus
QQSNKNKPIK

SEQ ID NO: 1608173 - protein, 4 aa, Staphylococcus aureus
QQTI

SEQ ID NO: 1608174 - protein, 4 aa, Staphylococcus aureus
QREN

SEQ ID NO: 1608175 - protein, 7 aa, Staphylococcus aureus
QRIPTGT

SEQ ID NO: 1608176 - protein, 10 aa, Staphylococcus aureus
QRKPTPENDD

SEQ ID NO: 1608177 - protein, 7 aa, Staphylococcus aureus
QRLEDRP

SEQ ID NO: 1608178 - protein, 27 aa, Staphylococcus aureus
QSAEKIVETAKRSGADVSGPIPLPTEK

SEQ ID NO: 1608179 - protein, 11 aa, Staphylococcus aureus
QSEGNTGTPWL

SEQ ID NO: 1608180 - protein, 7 aa, Staphylococcus aureus
QSTLQPI

SEQ ID NO: 1608181 - protein, 5 aa, Staphylococcus aureus
QTEAL

SEQ ID NO: 1608182 - protein, 7 aa, Staphylococcus aureus
QTESFEQ

SEQ ID NO: 1608183 - protein, 9 aa, Staphylococcus aureus
QTGQEDSKF

SEQ ID NO: 1608184 - protein, 9 aa, Staphylococcus aureus
QTKEEELES

SEQ ID NO: 1608185 - protein, 9 aa, Staphylococcus aureus
QTPLKDRDH

SEQ ID NO: 1608186 - protein, 10 aa, Staphylococcus aureus
QTSHQKTNKL

SEQ ID NO: 1608187 - protein, 16 aa, Staphylococcus aureus
RAGGKRKDTALNIERT

SEQ ID NO: 1608188 - protein, 11 aa, Staphylococcus aureus
RALETARNEKV

SEQ ID NO: 1608189 - protein, 9 aa, Staphylococcus aureus
RANEDESQW

SEQ ID NO: 1608190 - protein, 8 aa, Staphylococcus aureus
RAQENNKL

SEQ ID NO: 1608191 - protein, 5 aa, Staphylococcus aureus
RAQSF

SEQ ID NO: 1608192 - protein, 6 aa, Staphylococcus aureus
RARQSC

SEQ ID NO: 1608193 - protein, 8 aa, Staphylococcus aureus
RDGDAKDV

SEQ ID NO: 1608194 - protein, 6 aa, Staphylococcus aureus
RDGENG

SEQ ID NO: 1608195 - protein, 10 aa, Staphylococcus aureus
RDKKGNFQDA

SEQ ID NO: 1608196 - protein, 8 aa, Staphylococcus aureus
RDKNELKP

SEQ ID NO: 1608197 - protein, 8 aa, Staphylococcus aureus
RDQRDQRK

SEQ ID NO: 1608198 - protein, 10 aa, Staphylococcus aureus
RDRPSSSWEW

SEQ ID NO: 1608199 - protein, 10 aa, Staphylococcus aureus
RDSQSVETAM

SEQ ID NO: 1608200 - protein, 8 aa, Staphylococcus aureus
REAEEKVR

SEQ ID NO: 1608201 - protein, 5 aa, Staphylococcus aureus
REDNF

SEQ ID NO: 1608202 - protein, 5 aa, Staphylococcus aureus
REGSK

SEQ ID NO: 1608203 - protein, 7 aa, Staphylococcus aureus
RELESDE

SEQ ID NO: 1608204 - protein, 4 aa, Staphylococcus aureus
REQS

SEQ ID NO: 1608205 - protein, 10 aa, Staphylococcus aureus
RERLSPSEVT

SEQ ID NO: 1608206 - protein, 23 aa, Staphylococcus aureus
RGANHPVKNLETGKVDITSQNHG

SEQ ID NO: 1608207 - protein, 4 aa, Staphylococcus aureus
RGGL

SEQ ID NO: 1608208 - protein, 21 aa, Staphylococcus aureus
RGSDKSKGVLSPWSKREAEDY

SEQ ID NO: 1608209 - protein, 14 aa, Staphylococcus aureus
RGTTVERSDREGLK

SEQ ID NO: 1608210 - protein, 7 aa, Staphylococcus aureus
RHKDNGV

SEQ ID NO: 1608211 - protein, 8 aa, Staphylococcus aureus
RKGGVSQH

SEQ ID NO: 1608212 - protein, 9 aa, Staphylococcus aureus
RKKKNSVHY

SEQ ID NO: 1608213 - protein, 5 aa, Staphylococcus aureus
RKNSV

SEQ ID NO: 1608214 - protein, 14 aa, Staphylococcus aureus
RNALQAEDKGIDQL

SEQ ID NO: 1608215 - protein, 9 aa, Staphylococcus aureus
RNDPRAEEN

SEQ ID NO: 1608216 - protein, 12 aa, Staphylococcus aureus
RNETVSDEEYQS

SEQ ID NO: 1608217 - protein, 6 aa, Staphylococcus aureus
RNTGND

SEQ ID NO: 1608218 - protein, 9 aa, Staphylococcus aureus
RNYKDENGE

SEQ ID NO: 1608219 - protein, 4 aa, Staphylococcus aureus
RPAL

SEQ ID NO: 1608220 - protein, 15 aa, Staphylococcus aureus
RPDSGAKRAAEAENV

SEQ ID NO: 1608221 - protein, 8 aa, Staphylococcus aureus
RPNVGKSS

SEQ ID NO: 1608222 - protein, 9 aa, Staphylococcus aureus
RQMREGEVD

SEQ ID NO: 1608223 - protein, 9 aa, Staphylococcus aureus
RRGGGVSET

SEQ ID NO: 1608224 - protein, 25 aa, Staphylococcus aureus
RRQSYGSTGQSSVKQQLDVAKQLLS

SEQ ID NO: 1608225 - protein, 26 aa, Staphylococcus aureus
RRYEDDGQLVSRKESDAVITDTDEAL

SEQ ID NO: 1608226 - protein, 8 aa, Staphylococcus aureus
RSGESEYY

SEQ ID NO: 1608227 - protein, 16 aa, Staphylococcus aureus
RSKSTYWDKNKGDYSN

SEQ ID NO: 1608228 - protein, 6 aa, Staphylococcus aureus
RSTDRF

SEQ ID NO: 1608229 - protein, 8 aa, Staphylococcus aureus
RTHNTEDI

SEQ ID NO: 1608230 - protein, 6 aa, Staphylococcus aureus
RTKDEI

SEQ ID NO: 1608231 - protein, 10 aa, Staphylococcus aureus
RTPTDSGLEE

SEQ ID NO: 1608232 - protein, 10 aa, Staphylococcus aureus
RTTDKGPKIY

SEQ ID NO: 1608233 - protein, 8 aa, Staphylococcus aureus
RVGKTESI

SEQ ID NO: 1608234 - protein, 6 aa, Staphylococcus aureus
RVNQDE

SEQ ID NO: 1608235 - protein, 4 aa, Staphylococcus aureus
RWNP

SEQ ID NO: 1608236 - protein, 5 aa, Staphylococcus aureus
SADGH

SEQ ID NO: 1608237 - protein, 12 aa, Staphylococcus aureus
SADQELREQLPQ

SEQ ID NO: 1608238 - protein, 5 aa, Staphylococcus aureus
SADTG

SEQ ID NO: 1608239 - protein, 9 aa, Staphylococcus aureus
SADVETTSK

SEQ ID NO: 1608240 - protein, 8 aa, Staphylococcus aureus
SAHAAPRE

SEQ ID NO: 1608241 - protein, 17 aa, Staphylococcus aureus
SAPQSESYATRVDSTEG

SEQ ID NO: 1608242 - protein, 5 aa, Staphylococcus aureus
SAQEL

SEQ ID NO: 1608243 - protein, 6 aa, Staphylococcus aureus
SAYSRT

SEQ ID NO: 1608244 - protein, 5 aa, Staphylococcus aureus
SCENY

SEQ ID NO: 1608245 - protein, 6 aa, Staphylococcus aureus
SDEDMT

SEQ ID NO: 1608246 - protein, 8 aa, Staphylococcus aureus
SDKLPYRA

SEQ ID NO: 1608247 - protein, 7 aa, Staphylococcus aureus
SEAFKED

SEQ ID NO: 1608248 - protein, 4 aa, Staphylococcus aureus
SEAG

SEQ ID NO: 1608249 - protein, 9 aa, Staphylococcus aureus
SEDGPPTNW

SEQ ID NO: 1608250 - protein, 6 aa, Staphylococcus aureus
SEEELR

SEQ ID NO: 1608251 - protein, 9 aa, Staphylococcus aureus
SEEGGTEIE

SEQ ID NO: 1608252 - protein, 5 aa, Staphylococcus aureus
SEETD

SEQ ID NO: 1608253 - protein, 23 aa, Staphylococcus aureus
SEGVITDKEARKRNVGGEIIAYV

SEQ ID NO: 1608254 - protein, 5 aa, Staphylococcus aureus
SEHTM

SEQ ID NO: 1608255 - protein, 8 aa, Staphylococcus aureus
SEKDGRQA

SEQ ID NO: 1608256 - protein, 7 aa, Staphylococcus aureus
SEKGYGE

SEQ ID NO: 1608257 - protein, 4 aa, Staphylococcus aureus
SEKL

SEQ ID NO: 1608258 - protein, 10 aa, Staphylococcus aureus
SELSKTDGPI

SEQ ID NO: 1608259 - protein, 11 aa, Staphylococcus aureus
SENDINVNEDG

SEQ ID NO: 1608260 - protein, 8 aa, Staphylococcus aureus
SENQTDEA

SEQ ID NO: 1608261 - protein, 6 aa, Staphylococcus aureus
SEPLGT

SEQ ID NO: 1608262 - protein, 11 aa, Staphylococcus aureus
SERKAEPRLGE

SEQ ID NO: 1608263 - protein, 7 aa, Staphylococcus aureus
SESYEPG

SEQ ID NO: 1608264 - protein, 5 aa, Staphylococcus aureus
SETGK

SEQ ID NO: 1608265 - protein, 5 aa, Staphylococcus aureus
SEVDE

SEQ ID NO: 1608266 - protein, 6 aa, Staphylococcus aureus
SFDGED

SEQ ID NO: 1608267 - protein, 10 aa, Staphylococcus aureus
SFDKKTKQGV

SEQ ID NO: 1608268 - protein, 6 aa, Staphylococcus aureus
SGDKLH

SEQ ID NO: 1608269 - protein, 24 aa, Staphylococcus aureus
SGGEIGALTGPSLMPGGQEEAYNK

SEQ ID NO: 1608270 - protein, 6 aa, Staphylococcus aureus
SGIGKV

SEQ ID NO: 1608271 - protein, 6 aa, Staphylococcus aureus
SGKGTY

SEQ ID NO: 1608272 - protein, 9 aa, Staphylococcus aureus
SGNKKAVDD

SEQ ID NO: 1608273 - protein, 18 aa, Staphylococcus aureus
SGNTHDKNFRKSAKTVGD

SEQ ID NO: 1608274 - protein, 11 aa, Staphylococcus aureus
SGPIPPNPSEL

SEQ ID NO: 1608275 - protein, 6 aa, Staphylococcus aureus
SGSPEI

SEQ ID NO: 1608276 - protein, 8 aa, Staphylococcus aureus
SGSSHRGV

SEQ ID NO: 1608277 - protein, 7 aa, Staphylococcus aureus
SGSSRKI

SEQ ID NO: 1608278 - protein, 5 aa, Staphylococcus aureus
SHLNK

SEQ ID NO: 1608279 - protein, 7 aa, Staphylococcus aureus
SINPNLK

SEQ ID NO: 1608280 - protein, 18 aa, Staphylococcus aureus
SIPEKNNDQPNMGGMPGM

SEQ ID NO: 1608281 - protein, 8 aa, Staphylococcus aureus
SIQQAEDR

SEQ ID NO: 1608282 - protein, 5 aa, Staphylococcus aureus
SITTV

SEQ ID NO: 1608283 - protein, 6 aa, Staphylococcus aureus
SKANDP

SEQ ID NO: 1608284 - protein, 16 aa, Staphylococcus aureus
SKDASKDEIKKAYRKL

SEQ ID NO: 1608285 - protein, 6 aa, Staphylococcus aureus
SKDFED

SEQ ID NO: 1608286 - protein, 12 aa, Staphylococcus aureus
SKDFRGESKQGP

SEQ ID NO: 1608287 - protein, 7 aa, Staphylococcus aureus
SKEPVRS

SEQ ID NO: 1608288 - protein, 6 aa, Staphylococcus aureus
SKFEEL

SEQ ID NO: 1608289 - protein, 10 aa, Staphylococcus aureus
SKSGQNKDEF

SEQ ID NO: 1608290 - protein, 6 aa, Staphylococcus aureus
SKSREW

SEQ ID NO: 1608291 - protein, 11 aa, Staphylococcus aureus
SKTMNQQGEPY

SEQ ID NO: 1608292 - protein, 25 aa, Staphylococcus aureus
SKVEVTKDNTTVVDGDGDENSIDAR

SEQ ID NO: 1608293 - protein, 5 aa, Staphylococcus aureus
SLIED

SEQ ID NO: 1608294 - protein, 6 aa, Staphylococcus aureus
SLKANG

SEQ ID NO: 1608295 - protein, 5 aa, Staphylococcus aureus
SLNRQ

SEQ ID NO: 1608296 - protein, 42 aa, Staphylococcus aureus
SLRQGTHAVKNRSAVSGGGRKPWKQKGTGRARQGTIRAPQWR

SEQ ID NO: 1608297 - protein, 5 aa, Staphylococcus aureus
SLSET

SEQ ID NO: 1608298 - protein, 9 aa, Staphylococcus aureus
SLSSDDKII

SEQ ID NO: 1608299 - protein, 9 aa, Staphylococcus aureus
SLTEEKGLK

SEQ ID NO: 1608300 - protein, 4 aa, Staphylococcus aureus
SMAA

SEQ ID NO: 1608301 - protein, 17 aa, Staphylococcus aureus
SMAGRGTDIKLGEGVEA

SEQ ID NO: 1608302 - protein, 9 aa, Staphylococcus aureus
SMGKPLPGI

SEQ ID NO: 1608303 - protein, 15 aa, Staphylococcus aureus
SNENLYGPSPKVKEA

SEQ ID NO: 1608304 - protein, 9 aa, Staphylococcus aureus
SNGPGNPEV

SEQ ID NO: 1608305 - protein, 8 aa, Staphylococcus aureus
SNKGVKGK

SEQ ID NO: 1608306 - protein, 7 aa, Staphylococcus aureus
SNLTSNA

SEQ ID NO: 1608307 - protein, 7 aa, Staphylococcus aureus
SNNDSEL

SEQ ID NO: 1608308 - protein, 12 aa, Staphylococcus aureus
SPASDQNYRYAN

SEQ ID NO: 1608309 - protein, 4 aa, Staphylococcus aureus
SPDD

SEQ ID NO: 1608310 - protein, 4 aa, Staphylococcus aureus
SPEQ

SEQ ID NO: 1608311 - protein, 9 aa, Staphylococcus aureus
SPEVAPEDT

SEQ ID NO: 1608312 - protein, 8 aa, Staphylococcus aureus
SPQSGTIS

SEQ ID NO: 1608313 - protein, 8 aa, Staphylococcus aureus
SPTTKFKT

SEQ ID NO: 1608314 - protein, 9 aa, Staphylococcus aureus
SQDPINGVS

SEQ ID NO: 1608315 - protein, 7 aa, Staphylococcus aureus
SQEEAEK

SEQ ID NO: 1608316 - protein, 9 aa, Staphylococcus aureus
SQFNPKQCK

SEQ ID NO: 1608317 - protein, 9 aa, Staphylococcus aureus
SQGYRPGDF

SEQ ID NO: 1608318 - protein, 8 aa, Staphylococcus aureus
SQKHNTLK

SEQ ID NO: 1608319 - protein, 13 aa, Staphylococcus aureus
SQPADTEEGRIEQ

SEQ ID NO: 1608320 - protein, 5 aa, Staphylococcus aureus
SQPTL

SEQ ID NO: 1608321 - protein, 4 aa, Staphylococcus aureus
SQSG

SEQ ID NO: 1608322 - protein, 5 aa, Staphylococcus aureus
SQSHT

SEQ ID NO: 1608323 - protein, 5 aa, Staphylococcus aureus
SQVEA

SEQ ID NO: 1608324 - protein, 7 aa, Staphylococcus aureus
SREDINL

SEQ ID NO: 1608325 - protein, 7 aa, Staphylococcus aureus
SRKRGEG

SEQ ID NO: 1608326 - protein, 8 aa, Staphylococcus aureus
SRPAENFK

SEQ ID NO: 1608327 - protein, 5 aa, Staphylococcus aureus
SRQGN

SEQ ID NO: 1608328 - protein, 13 aa, Staphylococcus aureus
SRYYPDKAELKQT

SEQ ID NO: 1608329 - protein, 6 aa, Staphylococcus aureus
SSGVGV

SEQ ID NO: 1608330 - protein, 15 aa, Staphylococcus aureus
SSINTKNEARDNHLK

SEQ ID NO: 1608331 - protein, 11 aa, Staphylococcus aureus
SSKNKRDAKEN

SEQ ID NO: 1608332 - protein, 15 aa, Staphylococcus aureus
SSKYSEEVQDPESLS

SEQ ID NO: 1608333 - protein, 6 aa, Staphylococcus aureus
SSLPSN

SEQ ID NO: 1608334 - protein, 7 aa, Staphylococcus aureus
SSVDQLK

SEQ ID NO: 1608335 - protein, 12 aa, Staphylococcus aureus
STGPISKSGVNH

SEQ ID NO: 1608336 - protein, 7 aa, Staphylococcus aureus
STGTTGT

SEQ ID NO: 1608337 - protein, 6 aa, Staphylococcus aureus
STINNY

SEQ ID NO: 1608338 - protein, 4 aa, Staphylococcus aureus
STIS

SEQ ID NO: 1608339 - protein, 5 aa, Staphylococcus aureus
STKSH

SEQ ID NO: 1608340 - protein, 6 aa, Staphylococcus aureus
STPKTK

SEQ ID NO: 1608341 - protein, 8 aa, Staphylococcus aureus
STRDGNSS

SEQ ID NO: 1608342 - protein, 6 aa, Staphylococcus aureus
STSERG

SEQ ID NO: 1608343 - protein, 9 aa, Staphylococcus aureus
SVEDTYKAR

SEQ ID NO: 1608344 - protein, 7 aa, Staphylococcus aureus
SVQSEEM

SEQ ID NO: 1608345 - protein, 5 aa, Staphylococcus aureus
SWQGN

SEQ ID NO: 1608346 - protein, 17 aa, Staphylococcus aureus
SYGPSQGKTFECKDGRK

SEQ ID NO: 1608347 - protein, 6 aa, Staphylococcus aureus
SYIDDK

SEQ ID NO: 1608348 - protein, 6 aa, Staphylococcus aureus
SYNREG

SEQ ID NO: 1608349 - protein, 7 aa, Staphylococcus aureus
SYQADKV

SEQ ID NO: 1608350 - protein, 9 aa, Staphylococcus aureus
SYQSAAMTE

SEQ ID NO: 1608351 - protein, 14 aa, Staphylococcus aureus
TADEKTNETTEEIQ

SEQ ID NO: 1608352 - protein, 18 aa, Staphylococcus aureus
TADRATVKAELKDKYGIT

SEQ ID NO: 1608353 - protein, 12 aa, Staphylococcus aureus
TAGDNKLGGDDF

SEQ ID NO: 1608354 - protein, 7 aa, Staphylococcus aureus
TCGNGND

SEQ ID NO: 1608355 - protein, 7 aa, Staphylococcus aureus
TDARASE

SEQ ID NO: 1608356 - protein, 7 aa, Staphylococcus aureus
TDDAERN

SEQ ID NO: 1608357 - protein, 7 aa, Staphylococcus aureus
TDNDIQD

SEQ ID NO: 1608358 - protein, 6 aa, Staphylococcus aureus
TDNPYE

SEQ ID NO: 1608359 - protein, 4 aa, Staphylococcus aureus
TDTN

SEQ ID NO: 1608360 - protein, 9 aa, Staphylococcus aureus
TDTSDSTGY

SEQ ID NO: 1608361 - protein, 10 aa, Staphylococcus aureus
TEGAGALPTA

SEQ ID NO: 1608362 - protein, 5 aa, Staphylococcus aureus
TEKFN

SEQ ID NO: 1608363 - protein, 5 aa, Staphylococcus aureus
TELDG

SEQ ID NO: 1608364 - protein, 12 aa, Staphylococcus aureus
TEQEAQTAFGNG

SEQ ID NO: 1608365 - protein, 4 aa, Staphylococcus aureus
TEQI

SEQ ID NO: 1608366 - protein, 27 aa, Staphylococcus aureus
TERHESRRIDDQLRGRSGRQGDKGDSR

SEQ ID NO: 1608367 - protein, 6 aa, Staphylococcus aureus
TETKRH

SEQ ID NO: 1608368 - protein, 6 aa, Staphylococcus aureus
TFADTR

SEQ ID NO: 1608369 - protein, 15 aa, Staphylococcus aureus
TFPDGTKLITVHHPI

SEQ ID NO: 1608370 - protein, 7 aa, Staphylococcus aureus
TFPTTKE

SEQ ID NO: 1608371 - protein, 6 aa, Staphylococcus aureus
TGADGA

SEQ ID NO: 1608372 - protein, 7 aa, Staphylococcus aureus
TGKTAEQ

SEQ ID NO: 1608373 - protein, 7 aa, Staphylococcus aureus
TGLGGGI

SEQ ID NO: 1608374 - protein, 18 aa, Staphylococcus aureus
TGSEISKQYGEAGLPENT

SEQ ID NO: 1608375 - protein, 22 aa, Staphylococcus aureus
TGTDEHGQKIQEKAQKAGKTEI

SEQ ID NO: 1608376 - protein, 7 aa, Staphylococcus aureus
THHTTTA

SEQ ID NO: 1608377 - protein, 10 aa, Staphylococcus aureus
THKTKDKYIR

SEQ ID NO: 1608378 - protein, 42 aa, Staphylococcus aureus
TKDDSDSEKENKLPKLEQGDKVTATQIEPAQHYTQPPPRYTE

SEQ ID NO: 1608379 - protein, 11 aa, Staphylococcus aureus
TKEEKDKRAKE

SEQ ID NO: 1608380 - protein, 12 aa, Staphylococcus aureus
TKESEIKPKKVF

SEQ ID NO: 1608381 - protein, 6 aa, Staphylococcus aureus
TKGDKC

SEQ ID NO: 1608382 - protein, 10 aa, Staphylococcus aureus
TKKYDNPFNP

SEQ ID NO: 1608383 - protein, 9 aa, Staphylococcus aureus
TKLKNGRKF

SEQ ID NO: 1608384 - protein, 6 aa, Staphylococcus aureus
TKNNTK

SEQ ID NO: 1608385 - protein, 6 aa, Staphylococcus aureus
TKRSMT

SEQ ID NO: 1608386 - protein, 5 aa, Staphylococcus aureus
TKTDH

SEQ ID NO: 1608387 - protein, 8 aa, Staphylococcus aureus
TKTDNDAF

SEQ ID NO: 1608388 - protein, 12 aa, Staphylococcus aureus
TKTTPKGNIEKN

SEQ ID NO: 1608389 - protein, 7 aa, Staphylococcus aureus
TLPTPFE

SEQ ID NO: 1608390 - protein, 8 aa, Staphylococcus aureus
TMTTVPEE

SEQ ID NO: 1608391 - protein, 8 aa, Staphylococcus aureus
TNAGSGSF

SEQ ID NO: 1608392 - protein, 8 aa, Staphylococcus aureus
TNASSTSE

SEQ ID NO: 1608393 - protein, 23 aa, Staphylococcus aureus
TNEDLKSAAKAAIDTHGVGAGAV

SEQ ID NO: 1608394 - protein, 6 aa, Staphylococcus aureus
TNGEQV

SEQ ID NO: 1608395 - protein, 8 aa, Staphylococcus aureus
TNKDIDDK

SEQ ID NO: 1608396 - protein, 11 aa, Staphylococcus aureus
TPEIGRGRGPV

SEQ ID NO: 1608397 - protein, 5 aa, Staphylococcus aureus
TPFTN

SEQ ID NO: 1608398 - protein, 4 aa, Staphylococcus aureus
TPGI

SEQ ID NO: 1608399 - protein, 9 aa, Staphylococcus aureus
TPPGYDSEQ

SEQ ID NO: 1608400 - protein, 15 aa, Staphylococcus aureus
TPVKEINGEDPIKAD

SEQ ID NO: 1608401 - protein, 9 aa, Staphylococcus aureus
TQERYPKKS

SEQ ID NO: 1608402 - protein, 5 aa, Staphylococcus aureus
TQIEK

SEQ ID NO: 1608403 - protein, 17 aa, Staphylococcus aureus
TQINDKSEKNNFSTKPN

SEQ ID NO: 1608404 - protein, 8 aa, Staphylococcus aureus
TQNRDRVD

SEQ ID NO: 1608405 - protein, 16 aa, Staphylococcus aureus
TRIKDKKERYEAQANR

SEQ ID NO: 1608406 - protein, 12 aa, Staphylococcus aureus
TRLNDHNKAKHS

SEQ ID NO: 1608407 - protein, 6 aa, Staphylococcus aureus
TRPELS

SEQ ID NO: 1608408 - protein, 7 aa, Staphylococcus aureus
TRVDNQN

SEQ ID NO: 1608409 - protein, 15 aa, Staphylococcus aureus
TSANTGGVMQVPENL

SEQ ID NO: 1608410 - protein, 9 aa, Staphylococcus aureus
TSDQTTKEV

SEQ ID NO: 1608411 - protein, 8 aa, Staphylococcus aureus
TSEIGKDI

SEQ ID NO: 1608412 - protein, 7 aa, Staphylococcus aureus
TSETVGF

SEQ ID NO: 1608413 - protein, 7 aa, Staphylococcus aureus
TSPSNYI

SEQ ID NO: 1608414 - protein, 9 aa, Staphylococcus aureus
TSQQSSEDL

SEQ ID NO: 1608415 - protein, 9 aa, Staphylococcus aureus
TSQRESLPY

SEQ ID NO: 1608416 - protein, 14 aa, Staphylococcus aureus
TSTEKKLGKPVGSD

SEQ ID NO: 1608417 - protein, 5 aa, Staphylococcus aureus
TTENE

SEQ ID NO: 1608418 - protein, 5 aa, Staphylococcus aureus
TTGRE

SEQ ID NO: 1608419 - protein, 10 aa, Staphylococcus aureus
TTGRQQMTKT

SEQ ID NO: 1608420 - protein, 10 aa, Staphylococcus aureus
TTIKTPGIKD

SEQ ID NO: 1608421 - protein, 6 aa, Staphylococcus aureus
TTNLER

SEQ ID NO: 1608422 - protein, 12 aa, Staphylococcus aureus
TTPAGMAGNNES

SEQ ID NO: 1608423 - protein, 9 aa, Staphylococcus aureus
TTSATPDEI

SEQ ID NO: 1608424 - protein, 5 aa, Staphylococcus aureus
TTSSR

SEQ ID NO: 1608425 - protein, 7 aa, Staphylococcus aureus
TTTDNGL

SEQ ID NO: 1608426 - protein, 8 aa, Staphylococcus aureus
TVEEKEVS

SEQ ID NO: 1608427 - protein, 7 aa, Staphylococcus aureus
TVEGEQA

SEQ ID NO: 1608428 - protein, 12 aa, Staphylococcus aureus
TVKGPKGELSRT

SEQ ID NO: 1608429 - protein, 6 aa, Staphylococcus aureus
TVNQDD

SEQ ID NO: 1608430 - protein, 5 aa, Staphylococcus aureus
TYTDE

SEQ ID NO: 1608431 - protein, 13 aa, Staphylococcus aureus
TYTRQKKLRLIKE

SEQ ID NO: 1608432 - protein, 4 aa, Staphylococcus aureus
VAIT

SEQ ID NO: 1608433 - protein, 17 aa, Staphylococcus aureus
VANKTNEIAGDGTTTAT

SEQ ID NO: 1608434 - protein, 7 aa, Staphylococcus aureus
VDDDDVV

SEQ ID NO: 1608435 - protein, 16 aa, Staphylococcus aureus
VDDEGNSVPANTKGNI

SEQ ID NO: 1608436 - protein, 10 aa, Staphylococcus aureus
VDDTEKLSAD

SEQ ID NO: 1608437 - protein, 4 aa, Staphylococcus aureus
VDEI

SEQ ID NO: 1608438 - protein, 7 aa, Staphylococcus aureus
VDKNREQ

SEQ ID NO: 1608439 - protein, 16 aa, Staphylococcus aureus
VDKRREEFHPQGSRSH

SEQ ID NO: 1608440 - protein, 7 aa, Staphylococcus aureus
VDNQPSV

SEQ ID NO: 1608441 - protein, 6 aa, Staphylococcus aureus
VDPEPL

SEQ ID NO: 1608442 - protein, 4 aa, Staphylococcus aureus
VDPQ

SEQ ID NO: 1608443 - protein, 13 aa, Staphylococcus aureus
VDSDETVQYTQKD

SEQ ID NO: 1608444 - protein, 12 aa, Staphylococcus aureus
VDTEYDGQDGLD

SEQ ID NO: 1608445 - protein, 5 aa, Staphylococcus aureus
VDTGD

SEQ ID NO: 1608446 - protein, 10 aa, Staphylococcus aureus
VEAPDDEAVK

SEQ ID NO: 1608447 - protein, 10 aa, Staphylococcus aureus
VEGDLRRETN

SEQ ID NO: 1608448 - protein, 4 aa, Staphylococcus aureus
VEIP

SEQ ID NO: 1608449 - protein, 6 aa, Staphylococcus aureus
VENASY

SEQ ID NO: 1608450 - protein, 14 aa, Staphylococcus aureus
VENDENNDKAQTVI

SEQ ID NO: 1608451 - protein, 4 aa, Staphylococcus aureus
VEPE

SEQ ID NO: 1608452 - protein, 10 aa, Staphylococcus aureus
VEPESVEKQI

SEQ ID NO: 1608453 - protein, 7 aa, Staphylococcus aureus
VERPSTA

SEQ ID NO: 1608454 - protein, 10 aa, Staphylococcus aureus
VETARDKGVR

SEQ ID NO: 1608455 - protein, 9 aa, Staphylococcus aureus
VGGGGNNAV

SEQ ID NO: 1608456 - protein, 11 aa, Staphylococcus aureus
VGLSEQDSQNM

SEQ ID NO: 1608457 - protein, 12 aa, Staphylococcus aureus
VGPGRGSSAGSL

SEQ ID NO: 1608458 - protein, 13 aa, Staphylococcus aureus
VGPNGSGKSNITD

SEQ ID NO: 1608459 - protein, 7 aa, Staphylococcus aureus
VGSAGTD

SEQ ID NO: 1608460 - protein, 16 aa, Staphylococcus aureus
VGSDQVSAYKPNPEGI

SEQ ID NO: 1608461 - protein, 14 aa, Staphylococcus aureus
VGYSEAQAKEEGLA

SEQ ID NO: 1608462 - protein, 15 aa, Staphylococcus aureus
VIENNDLKGAIAGEL

SEQ ID NO: 1608463 - protein, 17 aa, Staphylococcus aureus
VKDTGKEISVPVGDETL

SEQ ID NO: 1608464 - protein, 5 aa, Staphylococcus aureus
VKGEH

SEQ ID NO: 1608465 - protein, 8 aa, Staphylococcus aureus
VKNEKSGI

SEQ ID NO: 1608466 - protein, 6 aa, Staphylococcus aureus
VKTGER

SEQ ID NO: 1608467 - protein, 22 aa, Staphylococcus aureus
VKVNGTTVTELGTKVKPSDTIE

SEQ ID NO: 1608468 - protein, 14 aa, Staphylococcus aureus
VKYRSKEEQQAENH

SEQ ID NO: 1608469 - protein, 17 aa, Staphylococcus aureus
VLGDHERKDTVKNAEET

SEQ ID NO: 1608470 - protein, 10 aa, Staphylococcus aureus
VNGRKSPYTL

SEQ ID NO: 1608471 - protein, 27 aa, Staphylococcus aureus
VNPGGSMTGGGARKSKSILSQKDELTT

SEQ ID NO: 1608472 - protein, 4 aa, Staphylococcus aureus
VNSG

SEQ ID NO: 1608473 - protein, 7 aa, Staphylococcus aureus
VNTASSS

SEQ ID NO: 1608474 - protein, 6 aa, Staphylococcus aureus
VPDAPH

SEQ ID NO: 1608475 - protein, 14 aa, Staphylococcus aureus
VPGSGGLPVGTGGK

SEQ ID NO: 1608476 - protein, 4 aa, Staphylococcus aureus
VPKS

SEQ ID NO: 1608477 - protein, 6 aa, Staphylococcus aureus
VPPQNH

SEQ ID NO: 1608478 - protein, 18 aa, Staphylococcus aureus
VPSDSIPADQEGMDIGPN

SEQ ID NO: 1608479 - protein, 10 aa, Staphylococcus aureus
VPTREPGISP

SEQ ID NO: 1608480 - protein, 5 aa, Staphylococcus aureus
VQEGQ

SEQ ID NO: 1608481 - protein, 6 aa, Staphylococcus aureus
VQEIET

SEQ ID NO: 1608482 - protein, 16 aa, Staphylococcus aureus
VSDERSGYMTRGHNNS

SEQ ID NO: 1608483 - protein, 7 aa, Staphylococcus aureus
VSDQRRE

SEQ ID NO: 1608484 - protein, 6 aa, Staphylococcus aureus
VSEDGG

SEQ ID NO: 1608485 - protein, 4 aa, Staphylococcus aureus
VSPE

SEQ ID NO: 1608486 - protein, 5 aa, Staphylococcus aureus
VSQEQ

SEQ ID NO: 1608487 - protein, 7 aa, Staphylococcus aureus
VSTPDQR

SEQ ID NO: 1608488 - protein, 4 aa, Staphylococcus aureus
VTEQ

SEQ ID NO: 1608489 - protein, 10 aa, Staphylococcus aureus
VTKAPNGQNL

SEQ ID NO: 1608490 - protein, 10 aa, Staphylococcus aureus
VTPAHDPNDF

SEQ ID NO: 1608491 - protein, 8 aa, Staphylococcus aureus
VTPGSEEA

SEQ ID NO: 1608492 - protein, 7 aa, Staphylococcus aureus
VTPPDGL

SEQ ID NO: 1608493 - protein, 8 aa, Staphylococcus aureus
VTPSSKVV

SEQ ID NO: 1608494 - protein, 7 aa, Staphylococcus aureus
VTSEPRI

SEQ ID NO: 1608495 - protein, 5 aa, Staphylococcus aureus
VYPNG

SEQ ID NO: 1608496 - protein, 12 aa, Staphylococcus aureus
WDKGDAKLSVTH

SEQ ID NO: 1608497 - protein, 17 aa, Staphylococcus aureus
WEEGAKTLQPGLDLVGK

SEQ ID NO: 1608498 - protein, 4 aa, Staphylococcus aureus
WQAI

SEQ ID NO: 1608499 - protein, 8 aa, Staphylococcus aureus
WRNSESDT

SEQ ID NO: 1608500 - protein, 7 aa, Staphylococcus aureus
WSAEDEY

SEQ ID NO: 1608501 - protein, 5 aa, Staphylococcus aureus
YADGE

SEQ ID NO: 1608502 - protein, 8 aa, Staphylococcus aureus
YAKEADEE

SEQ ID NO: 1608503 - protein, 7 aa, Staphylococcus aureus
YAKEGAD

SEQ ID NO: 1608504 - protein, 6 aa, Staphylococcus aureus
YAQSNQ

SEQ ID NO: 1608505 - protein, 8 aa, Staphylococcus aureus
YATDPRLL

SEQ ID NO: 1608506 - protein, 5 aa, Staphylococcus aureus
YAYED

SEQ ID NO: 1608507 - protein, 6 aa, Staphylococcus aureus
YDESNE

SEQ ID NO: 1608508 - protein, 29 aa, Staphylococcus aureus
YDGESEITHNATGDKGGSKYQLKGVGQRE

SEQ ID NO: 1608509 - protein, 14 aa, Staphylococcus aureus
YDGKPYKLGNTKRV

SEQ ID NO: 1608510 - protein, 4 aa, Staphylococcus aureus
YDKP

SEQ ID NO: 1608511 - protein, 8 aa, Staphylococcus aureus
YDKTSVAD

SEQ ID NO: 1608512 - protein, 9 aa, Staphylococcus aureus
YEAQTIPAV

SEQ ID NO: 1608513 - protein, 8 aa, Staphylococcus aureus
YEDKKEKI

SEQ ID NO: 1608514 - protein, 7 aa, Staphylococcus aureus
YEEGNRF

SEQ ID NO: 1608515 - protein, 9 aa, Staphylococcus aureus
YEKGPEVPR

SEQ ID NO: 1608516 - protein, 9 aa, Staphylococcus aureus
YGEVNPKGV

SEQ ID NO: 1608517 - protein, 8 aa, Staphylococcus aureus
YGMNPTKD

SEQ ID NO: 1608518 - protein, 10 aa, Staphylococcus aureus
YKDQQKHYDG

SEQ ID NO: 1608519 - protein, 6 aa, Staphylococcus aureus
YKKTKQ

SEQ ID NO: 1608520 - protein, 5 aa, Staphylococcus aureus
YKTDA

SEQ ID NO: 1608521 - protein, 7 aa, Staphylococcus aureus
YLPTGEG

SEQ ID NO: 1608522 - protein, 6 aa, Staphylococcus aureus
YNQSEV

SEQ ID NO: 1608523 - protein, 5 aa, Staphylococcus aureus
YPDES

SEQ ID NO: 1608524 - protein, 14 aa, Staphylococcus aureus
YPFDPSNPEDVRAA

SEQ ID NO: 1608525 - protein, 9 aa, Staphylococcus aureus
YQKGTPYQH

SEQ ID NO: 1608526 - protein, 5 aa, Staphylococcus aureus
YQYES

SEQ ID NO: 1608527 - protein, 4 aa, Staphylococcus aureus
YRAS

SEQ ID NO: 1608528 - protein, 5 aa, Staphylococcus aureus
YRQKD

SEQ ID NO: 1608529 - protein, 12 aa, Staphylococcus aureus
YRTGKRENIKSL

SEQ ID NO: 1608530 - protein, 17 aa, Staphylococcus aureus
YSEYKGGRQKTPPELSE

SEQ ID NO: 1608531 - protein, 7 aa, Staphylococcus aureus
YSTNPLG

SEQ ID NO: 1608532 - protein, 6 aa, Staphylococcus aureus
YTDETI

SEQ ID NO: 1608533 - protein, 4 aa, Staphylococcus aureus
YTNA

SEQ ID NO: 1608534 - protein, 6 aa, Staphylococcus aureus
YTRPRE

SEQ ID NO: 1608535 - protein, 8 aa, Staphylococcus aureus
YTYEADGA

SEQ ID NO: 1608536 - protein, 7 aa, Staphylococcus aureus
YWDSEAR

SEQ ID NO: 1608537 - protein, 5 aa, Staphylococcus aureus
AAKPF

SEQ ID NO: 1608538 - protein, 6 aa, Staphylococcus aureus
AAKVSG

SEQ ID NO: 1608539 - protein, 7 aa, Staphylococcus aureus
ACTPENV

SEQ ID NO: 1608540 - protein, 7 aa, Staphylococcus aureus
ADDHFPG

SEQ ID NO: 1608541 - protein, 7 aa, Staphylococcus aureus
ADSAEGK

SEQ ID NO: 1608542 - protein, 7 aa, Staphylococcus aureus
ADSRDLN

SEQ ID NO: 1608543 - protein, 16 aa, Staphylococcus aureus
ADTETIGCSPDGYNIN

SEQ ID NO: 1608544 - protein, 15 aa, Staphylococcus aureus
AEEGGENGSAKASYV

SEQ ID NO: 1608545 - protein, 6 aa, Staphylococcus aureus
AEHNGK

SEQ ID NO: 1608546 - protein, 7 aa, Staphylococcus aureus
AELENNQ

SEQ ID NO: 1608547 - protein, 10 aa, Staphylococcus aureus
AENDDEAQYL

SEQ ID NO: 1608548 - protein, 7 aa, Staphylococcus aureus
AESQGFK

SEQ ID NO: 1608549 - protein, 7 aa, Staphylococcus aureus
AETFGKG

SEQ ID NO: 1608550 - protein, 6 aa, Staphylococcus aureus
AFTPKT

SEQ ID NO: 1608551 - protein, 12 aa, Staphylococcus aureus
AGGVNRNRTGPH

SEQ ID NO: 1608552 - protein, 41 aa, Staphylococcus aureus
AGIEKGSGEPNKTKVATVTKDQVREIANSKMQDLNAADEEA

SEQ ID NO: 1608553 - protein, 7 aa, Staphylococcus aureus
AGTPAKV

SEQ ID NO: 1608554 - protein, 9 aa, Staphylococcus aureus
AHDAKTTRL

SEQ ID NO: 1608555 - protein, 5 aa, Staphylococcus aureus
AHEIS

SEQ ID NO: 1608556 - protein, 14 aa, Staphylococcus aureus
AHGKPSGIDTQTIV

SEQ ID NO: 1608557 - protein, 8 aa, Staphylococcus aureus
AIAANKDS

SEQ ID NO: 1608558 - protein, 4 aa, Staphylococcus aureus
AIPD

SEQ ID NO: 1608559 - protein, 8 aa, Staphylococcus aureus
AKGSGAFG

SEQ ID NO: 1608560 - protein, 8 aa, Staphylococcus aureus
AKNAGIKS

SEQ ID NO: 1608561 - protein, 12 aa, Staphylococcus aureus
AKSNSDTTPAMP

SEQ ID NO: 1608562 - protein, 9 aa, Staphylococcus aureus
AKTRNEEAE

SEQ ID NO: 1608563 - protein, 11 aa, Staphylococcus aureus
AKYEGEGYGKF

SEQ ID NO: 1608564 - protein, 14 aa, Staphylococcus aureus
ALERANNRLRVAEL

SEQ ID NO: 1608565 - protein, 7 aa, Staphylococcus aureus
ALSQVTT

SEQ ID NO: 1608566 - protein, 9 aa, Staphylococcus aureus
ALTGDDSVN

SEQ ID NO: 1608567 - protein, 4 aa, Staphylococcus aureus
ANDP

SEQ ID NO: 1608568 - protein, 7 aa, Staphylococcus aureus
APATGDL

SEQ ID NO: 1608569 - protein, 6 aa, Staphylococcus aureus
APKVEL

SEQ ID NO: 1608570 - protein, 7 aa, Staphylococcus aureus
APPQGIE

SEQ ID NO: 1608571 - protein, 11 aa, Staphylococcus aureus
APQNTRRKSIE

SEQ ID NO: 1608572 - protein, 5 aa, Staphylococcus aureus
APSTE

SEQ ID NO: 1608573 - protein, 6 aa, Staphylococcus aureus
AQGADA

SEQ ID NO: 1608574 - protein, 7 aa, Staphylococcus aureus
AQINPQT

SEQ ID NO: 1608575 - protein, 4 aa, Staphylococcus aureus
AQLG

SEQ ID NO: 1608576 - protein, 8 aa, Staphylococcus aureus
AQMPGSVT

SEQ ID NO: 1608577 - protein, 15 aa, Staphylococcus aureus
AQNKIAKNEDLKRDL

SEQ ID NO: 1608578 - protein, 12 aa, Staphylococcus aureus
ARGLASKKTTTV

SEQ ID NO: 1608579 - protein, 12 aa, Staphylococcus aureus
ARRQPEQTETYV

SEQ ID NO: 1608580 - protein, 8 aa, Staphylococcus aureus
ARRRKARG

SEQ ID NO: 1608581 - protein, 6 aa, Staphylococcus aureus
ASAGVS

SEQ ID NO: 1608582 - protein, 9 aa, Staphylococcus aureus
ASARGKGIA

SEQ ID NO: 1608583 - protein, 4 aa, Staphylococcus aureus
ASAV

SEQ ID NO: 1608584 - protein, 10 aa, Staphylococcus aureus
ASKLERGKRT

SEQ ID NO: 1608585 - protein, 9 aa, Staphylococcus aureus
ASPEIDGKQ

SEQ ID NO: 1608586 - protein, 8 aa, Staphylococcus aureus
ATKENAND

SEQ ID NO: 1608587 - protein, 5 aa, Staphylococcus aureus
ATTIA

SEQ ID NO: 1608588 - protein, 11 aa, Staphylococcus aureus
ATTYKDQARPL

SEQ ID NO: 1608589 - protein, 11 aa, Staphylococcus aureus
ATVEQKPKMDG

SEQ ID NO: 1608590 - protein, 21 aa, Staphylococcus aureus
ATVSAEVNQNDRRDIQKNHSA

SEQ ID NO: 1608591 - protein, 10 aa, Staphylococcus aureus
AVRNNGGGHL

SEQ ID NO: 1608592 - protein, 6 aa, Staphylococcus aureus
CGPGRR

SEQ ID NO: 1608593 - protein, 7 aa, Staphylococcus aureus
DAEDQYH

SEQ ID NO: 1608594 - protein, 7 aa, Staphylococcus aureus
DAGIQPE

SEQ ID NO: 1608595 - protein, 8 aa, Staphylococcus aureus
DAKDAREN

SEQ ID NO: 1608596 - protein, 6 aa, Staphylococcus aureus
DAKLDD

SEQ ID NO: 1608597 - protein, 5 aa, Staphylococcus aureus
DANGR

SEQ ID NO: 1608598 - protein, 12 aa, Staphylococcus aureus
DASVGANTKVGP

SEQ ID NO: 1608599 - protein, 8 aa, Staphylococcus aureus
DAVQNSKV

SEQ ID NO: 1608600 - protein, 8 aa, Staphylococcus aureus
DDEHGWNK

SEQ ID NO: 1608601 - protein, 13 aa, Staphylococcus aureus
DDITTDSRTAREG

SEQ ID NO: 1608602 - protein, 12 aa, Staphylococcus aureus
DDKGPAARQGYG

SEQ ID NO: 1608603 - protein, 10 aa, Staphylococcus aureus
DDNDVKQASH

SEQ ID NO: 1608604 - protein, 6 aa, Staphylococcus aureus
DDYPAL

SEQ ID NO: 1608605 - protein, 4 aa, Staphylococcus aureus
DEER

SEQ ID NO: 1608606 - protein, 7 aa, Staphylococcus aureus
DEGQISR

SEQ ID NO: 1608607 - protein, 7 aa, Staphylococcus aureus
DEKVPVR

SEQ ID NO: 1608608 - protein, 5 aa, Staphylococcus aureus
DENEA

SEQ ID NO: 1608609 - protein, 7 aa, Staphylococcus aureus
DENSGNI

SEQ ID NO: 1608610 - protein, 9 aa, Staphylococcus aureus
DEQDNEIEM

SEQ ID NO: 1608611 - protein, 6 aa, Staphylococcus aureus
DERAYG

SEQ ID NO: 1608612 - protein, 4 aa, Staphylococcus aureus
DERM

SEQ ID NO: 1608613 - protein, 5 aa, Staphylococcus aureus
DESIT

SEQ ID NO: 1608614 - protein, 15 aa, Staphylococcus aureus
DEVITSTKDLTENDQ

SEQ ID NO: 1608615 - protein, 8 aa, Staphylococcus aureus
DGSAKGDI

SEQ ID NO: 1608616 - protein, 7 aa, Staphylococcus aureus
DGSGGAL

SEQ ID NO: 1608617 - protein, 13 aa, Staphylococcus aureus
DITNDLNSEDIEN

SEQ ID NO: 1608618 - protein, 7 aa, Staphylococcus aureus
DKEAPNH

SEQ ID NO: 1608619 - protein, 6 aa, Staphylococcus aureus
DKGERQ

SEQ ID NO: 1608620 - protein, 15 aa, Staphylococcus aureus
DKKKNKGFKFPKESQ

SEQ ID NO: 1608621 - protein, 5 aa, Staphylococcus aureus
DKSYP

SEQ ID NO: 1608622 - protein, 9 aa, Staphylococcus aureus
DKTKISQTT

SEQ ID NO: 1608623 - protein, 8 aa, Staphylococcus aureus
DLSSHNAR

SEQ ID NO: 1608624 - protein, 24 aa, Staphylococcus aureus
DLSSKEVSEATRIQYGGSVKPNNI

SEQ ID NO: 1608625 - protein, 5 aa, Staphylococcus aureus
DLYDT

SEQ ID NO: 1608626 - protein, 18 aa, Staphylococcus aureus
DMDDLRAKAKEAVESGQY

SEQ ID NO: 1608627 - protein, 11 aa, Staphylococcus aureus
DMLESEKEEAL

SEQ ID NO: 1608628 - protein, 8 aa, Staphylococcus aureus
DMSSASDL

SEQ ID NO: 1608629 - protein, 15 aa, Staphylococcus aureus
DNDAKQQIAEQIQAQ

SEQ ID NO: 1608630 - protein, 6 aa, Staphylococcus aureus
DNPELS

SEQ ID NO: 1608631 - protein, 6 aa, Staphylococcus aureus
DPERQN

SEQ ID NO: 1608632 - protein, 8 aa, Staphylococcus aureus
DQGEASYQ

SEQ ID NO: 1608633 - protein, 4 aa, Staphylococcus aureus
DQLA

SEQ ID NO: 1608634 - protein, 4 aa, Staphylococcus aureus
DRKV

SEQ ID NO: 1608635 - protein, 8 aa, Staphylococcus aureus
DRNPENLP

SEQ ID NO: 1608636 - protein, 16 aa, Staphylococcus aureus
DSAGGSTKSGRDSRTQ

SEQ ID NO: 1608637 - protein, 5 aa, Staphylococcus aureus
DSNIH

SEQ ID NO: 1608638 - protein, 8 aa, Staphylococcus aureus
DSRPNLSG

SEQ ID NO: 1608639 - protein, 6 aa, Staphylococcus aureus
DSTRTR

SEQ ID NO: 1608640 - protein, 7 aa, Staphylococcus aureus
DSVAPIN

SEQ ID NO: 1608641 - protein, 16 aa, Staphylococcus aureus
DTDKKRNLEDGETSQF

SEQ ID NO: 1608642 - protein, 7 aa, Staphylococcus aureus
DTKPTTF

SEQ ID NO: 1608643 - protein, 14 aa, Staphylococcus aureus
DTRAEQQSTSGTSF

SEQ ID NO: 1608644 - protein, 8 aa, Staphylococcus aureus
DVDTTVEN

SEQ ID NO: 1608645 - protein, 10 aa, Staphylococcus aureus
DVQTAKQQSL

SEQ ID NO: 1608646 - protein, 9 aa, Staphylococcus aureus
DVTAASQLP

SEQ ID NO: 1608647 - protein, 9 aa, Staphylococcus aureus
DWGATPSAL

SEQ ID NO: 1608648 - protein, 6 aa, Staphylococcus aureus
DYVPKK

SEQ ID NO: 1608649 - protein, 11 aa, Staphylococcus aureus
EADHTSSDAQE

SEQ ID NO: 1608650 - protein, 14 aa, Staphylococcus aureus
EAKNIEGHDVLLWK

SEQ ID NO: 1608651 - protein, 6 aa, Staphylococcus aureus
EAPGFT

SEQ ID NO: 1608652 - protein, 11 aa, Staphylococcus aureus
EARSHDPERIK

SEQ ID NO: 1608653 - protein, 16 aa, Staphylococcus aureus
EASENHKKRVQSSTLN

SEQ ID NO: 1608654 - protein, 6 aa, Staphylococcus aureus
EASQLT

SEQ ID NO: 1608655 - protein, 11 aa, Staphylococcus aureus
EDKIPKGKVQK

SEQ ID NO: 1608656 - protein, 8 aa, Staphylococcus aureus
EDPSTSYK

SEQ ID NO: 1608657 - protein, 10 aa, Staphylococcus aureus
EEEQKAIKKE

SEQ ID NO: 1608658 - protein, 10 aa, Staphylococcus aureus
EEGVRKGAYT

SEQ ID NO: 1608659 - protein, 8 aa, Staphylococcus aureus
EERAPLKR

SEQ ID NO: 1608660 - protein, 14 aa, Staphylococcus aureus
EEVKKKASVLSGGE

SEQ ID NO: 1608661 - protein, 10 aa, Staphylococcus aureus
EFGSKARENI

SEQ ID NO: 1608662 - protein, 5 aa, Staphylococcus aureus
EGAQL

SEQ ID NO: 1608663 - protein, 11 aa, Staphylococcus aureus
EGAREKAENGD

SEQ ID NO: 1608664 - protein, 4 aa, Staphylococcus aureus
EGDV

SEQ ID NO: 1608665 - protein, 14 aa, Staphylococcus aureus
EGKKVSEKDQTYQN

SEQ ID NO: 1608666 - protein, 18 aa, Staphylococcus aureus
EGQTKSKLGTSEARSAVD

SEQ ID NO: 1608667 - protein, 5 aa, Staphylococcus aureus
EGRDI

SEQ ID NO: 1608668 - protein, 18 aa, Staphylococcus aureus
EGRGQFKPVGEANPTIGQ

SEQ ID NO: 1608669 - protein, 17 aa, Staphylococcus aureus
EGTNESVPQDDTQATFA

SEQ ID NO: 1608670 - protein, 6 aa, Staphylococcus aureus
EGVYDE

SEQ ID NO: 1608671 - protein, 22 aa, Staphylococcus aureus
EHGATTYDFGGTDNDPDKDSEH

SEQ ID NO: 1608672 - protein, 7 aa, Staphylococcus aureus
EHNLDTP

SEQ ID NO: 1608673 - protein, 8 aa, Staphylococcus aureus
EIQTPNSY

SEQ ID NO: 1608674 - protein, 14 aa, Staphylococcus aureus
EKAGAAHTWIENLG

SEQ ID NO: 1608675 - protein, 8 aa, Staphylococcus aureus
EKANDGTI

SEQ ID NO: 1608676 - protein, 11 aa, Staphylococcus aureus
EKCGSTHPEKL

SEQ ID NO: 1608677 - protein, 17 aa, Staphylococcus aureus
EKGTVAKEGKAEGTTEE

SEQ ID NO: 1608678 - protein, 9 aa, Staphylococcus aureus
EKISGKELR

SEQ ID NO: 1608679 - protein, 8 aa, Staphylococcus aureus
EKSDYANG

SEQ ID NO: 1608680 - protein, 4 aa, Staphylococcus aureus
EKYP

SEQ ID NO: 1608681 - protein, 56 aa, Staphylococcus aureus
ELANEKEKQAALQSRVESEKEKIANLQEKRAQLDESRQALEDAQTNNNLEKAAELQ

SEQ ID NO: 1608682 - protein, 15 aa, Staphylococcus aureus
ELQQKLSEKLQQLNM

SEQ ID NO: 1608683 - protein, 4 aa, Staphylococcus aureus
ENES

SEQ ID NO: 1608684 - protein, 7 aa, Staphylococcus aureus
ENGAQGI

SEQ ID NO: 1608685 - protein, 8 aa, Staphylococcus aureus
ENNDWKDT

SEQ ID NO: 1608686 - protein, 12 aa, Staphylococcus aureus
ENSEHGYGNESE

SEQ ID NO: 1608687 - protein, 7 aa, Staphylococcus aureus
ENYESEM

SEQ ID NO: 1608688 - protein, 4 aa, Staphylococcus aureus
EPMY

SEQ ID NO: 1608689 - protein, 6 aa, Staphylococcus aureus
EPPDNT

SEQ ID NO: 1608690 - protein, 10 aa, Staphylococcus aureus
EPQVKDGSVP

SEQ ID NO: 1608691 - protein, 7 aa, Staphylococcus aureus
EPTNGLD

SEQ ID NO: 1608692 - protein, 10 aa, Staphylococcus aureus
EPTSGLDPLA

SEQ ID NO: 1608693 - protein, 8 aa, Staphylococcus aureus
EQSDVNND

SEQ ID NO: 1608694 - protein, 11 aa, Staphylococcus aureus
EQTDVPESSDW

SEQ ID NO: 1608695 - protein, 7 aa, Staphylococcus aureus
ERDSQKG

SEQ ID NO: 1608696 - protein, 6 aa, Staphylococcus aureus
ERLGIS

SEQ ID NO: 1608697 - protein, 4 aa, Staphylococcus aureus
ERPE

SEQ ID NO: 1608698 - protein, 8 aa, Staphylococcus aureus
ESAKSALS

SEQ ID NO: 1608699 - protein, 6 aa, Staphylococcus aureus
ESIDSK

SEQ ID NO: 1608700 - protein, 4 aa, Staphylococcus aureus
ESQV

SEQ ID NO: 1608701 - protein, 9 aa, Staphylococcus aureus
ETAAAQDDL

SEQ ID NO: 1608702 - protein, 5 aa, Staphylococcus aureus
ETDAK

SEQ ID NO: 1608703 - protein, 4 aa, Staphylococcus aureus
ETEG

SEQ ID NO: 1608704 - protein, 4 aa, Staphylococcus aureus
ETGR

SEQ ID NO: 1608705 - protein, 20 aa, Staphylococcus aureus
ETGYPRNDKLSHKRNDTEYI

SEQ ID NO: 1608706 - protein, 7 aa, Staphylococcus aureus
ETKGNDA

SEQ ID NO: 1608707 - protein, 10 aa, Staphylococcus aureus
ETRQSPNISS

SEQ ID NO: 1608708 - protein, 7 aa, Staphylococcus aureus
EVGINNS

SEQ ID NO: 1608709 - protein, 5 aa, Staphylococcus aureus
EVKQD

SEQ ID NO: 1608710 - protein, 8 aa, Staphylococcus aureus
EYPTDNEG

SEQ ID NO: 1608711 - protein, 4 aa, Staphylococcus aureus
FASE

SEQ ID NO: 1608712 - protein, 6 aa, Staphylococcus aureus
FEEKTK

SEQ ID NO: 1608713 - protein, 9 aa, Staphylococcus aureus
FSGGQRQRV

SEQ ID NO: 1608714 - protein, 7 aa, Staphylococcus aureus
FSGYPDC

SEQ ID NO: 1608715 - protein, 5 aa, Staphylococcus aureus
GAEAG

SEQ ID NO: 1608716 - protein, 14 aa, Staphylococcus aureus
GANAALNAFDYIIR

SEQ ID NO: 1608717 - protein, 4 aa, Staphylococcus aureus
GASL

SEQ ID NO: 1608718 - protein, 9 aa, Staphylococcus aureus
GATTTKEDI

SEQ ID NO: 1608719 - protein, 7 aa, Staphylococcus aureus
GDDTSHN

SEQ ID NO: 1608720 - protein, 10 aa, Staphylococcus aureus
GDFPETTEKI

SEQ ID NO: 1608721 - protein, 4 aa, Staphylococcus aureus
GDGG

SEQ ID NO: 1608722 - protein, 8 aa, Staphylococcus aureus
GDNQNTEI

SEQ ID NO: 1608723 - protein, 7 aa, Staphylococcus aureus
GDSPLTE

SEQ ID NO: 1608724 - protein, 6 aa, Staphylococcus aureus
GEAESS

SEQ ID NO: 1608725 - protein, 7 aa, Staphylococcus aureus
GEAYGYA

SEQ ID NO: 1608726 - protein, 10 aa, Staphylococcus aureus
GEGNITVNNR

SEQ ID NO: 1608727 - protein, 4 aa, Staphylococcus aureus
GEGR

SEQ ID NO: 1608728 - protein, 6 aa, Staphylococcus aureus
GEKWTN

SEQ ID NO: 1608729 - protein, 5 aa, Staphylococcus aureus
GFDRD

SEQ ID NO: 1608730 - protein, 6 aa, Staphylococcus aureus
GGDANN

SEQ ID NO: 1608731 - protein, 9 aa, Staphylococcus aureus
GGGDAELQL

SEQ ID NO: 1608732 - protein, 7 aa, Staphylococcus aureus
GGGSNAI

SEQ ID NO: 1608733 - protein, 14 aa, Staphylococcus aureus
GIAKAAKKADRIAA

SEQ ID NO: 1608734 - protein, 7 aa, Staphylococcus aureus
GIEPNKA

SEQ ID NO: 1608735 - protein, 9 aa, Staphylococcus aureus
GIGKKTARQ

SEQ ID NO: 1608736 - protein, 4 aa, Staphylococcus aureus
GIIE

SEQ ID NO: 1608737 - protein, 7 aa, Staphylococcus aureus
GIQSEDG

SEQ ID NO: 1608738 - protein, 15 aa, Staphylococcus aureus
GISPSKRQAREDVNN

SEQ ID NO: 1608739 - protein, 13 aa, Staphylococcus aureus
GKGGGTKLADELN

SEQ ID NO: 1608740 - protein, 5 aa, Staphylococcus aureus
GKQGV

SEQ ID NO: 1608741 - protein, 10 aa, Staphylococcus aureus
GKVNTHSAHH

SEQ ID NO: 1608742 - protein, 7 aa, Staphylococcus aureus
GLDPDQY

SEQ ID NO: 1608743 - protein, 7 aa, Staphylococcus aureus
GLSPSAK

SEQ ID NO: 1608744 - protein, 7 aa, Staphylococcus aureus
GMQQSNV

SEQ ID NO: 1608745 - protein, 7 aa, Staphylococcus aureus
GNAEQLP

SEQ ID NO: 1608746 - protein, 4 aa, Staphylococcus aureus
GNKR

SEQ ID NO: 1608747 - protein, 10 aa, Staphylococcus aureus
GNRSVLSDSN

SEQ ID NO: 1608748 - protein, 8 aa, Staphylococcus aureus
GPLTTETL

SEQ ID NO: 1608749 - protein, 7 aa, Staphylococcus aureus
GPPYANG

SEQ ID NO: 1608750 - protein, 7 aa, Staphylococcus aureus
GPTPVPD

SEQ ID NO: 1608751 - protein, 5 aa, Staphylococcus aureus
GPYQR

SEQ ID NO: 1608752 - protein, 9 aa, Staphylococcus aureus
GQAKISGNA

SEQ ID NO: 1608753 - protein, 16 aa, Staphylococcus aureus
GQQVADKINAREAKNR

SEQ ID NO: 1608754 - protein, 7 aa, Staphylococcus aureus
GRFATSD

SEQ ID NO: 1608755 - protein, 9 aa, Staphylococcus aureus
GRINTPSDV

SEQ ID NO: 1608756 - protein, 6 aa, Staphylococcus aureus
GRLKDA

SEQ ID NO: 1608757 - protein, 9 aa, Staphylococcus aureus
GRSEGAKVS

SEQ ID NO: 1608758 - protein, 10 aa, Staphylococcus aureus
GRTGRGNYKG

SEQ ID NO: 1608759 - protein, 13 aa, Staphylococcus aureus
GRYSKETIRHPET

SEQ ID NO: 1608760 - protein, 4 aa, Staphylococcus aureus
GSAN

SEQ ID NO: 1608761 - protein, 9 aa, Staphylococcus aureus
GSENTVQQK

SEQ ID NO: 1608762 - protein, 5 aa, Staphylococcus aureus
GSEVS

SEQ ID NO: 1608763 - protein, 14 aa, Staphylococcus aureus
GSGGNYALSAGRAL

SEQ ID NO: 1608764 - protein, 9 aa, Staphylococcus aureus
GSGPTGSKI

SEQ ID NO: 1608765 - protein, 7 aa, Staphylococcus aureus
GSSPESF

SEQ ID NO: 1608766 - protein, 9 aa, Staphylococcus aureus
GSTHSNSTM

SEQ ID NO: 1608767 - protein, 4 aa, Staphylococcus aureus
GTAT

SEQ ID NO: 1608768 - protein, 9 aa, Staphylococcus aureus
GTLSGNPLA

SEQ ID NO: 1608769 - protein, 5 aa, Staphylococcus aureus
GTVGS

SEQ ID NO: 1608770 - protein, 9 aa, Staphylococcus aureus
GVDPSIKTF

SEQ ID NO: 1608771 - protein, 4 aa, Staphylococcus aureus
GVGI

SEQ ID NO: 1608772 - protein, 5 aa, Staphylococcus aureus
GVGVQ

SEQ ID NO: 1608773 - protein, 12 aa, Staphylococcus aureus
GVLARNGHTEAA

SEQ ID NO: 1608774 - protein, 9 aa, Staphylococcus aureus
GVNPTSDGE

SEQ ID NO: 1608775 - protein, 6 aa, Staphylococcus aureus
GVSEYE

SEQ ID NO: 1608776 - protein, 6 aa, Staphylococcus aureus
GVTEQA

SEQ ID NO: 1608777 - protein, 4 aa, Staphylococcus aureus
GYDE

SEQ ID NO: 1608778 - protein, 11 aa, Staphylococcus aureus
HDATKPYDKTY

SEQ ID NO: 1608779 - protein, 7 aa, Staphylococcus aureus
HDGSTNK

SEQ ID NO: 1608780 - protein, 7 aa, Staphylococcus aureus
HDGTTYP

SEQ ID NO: 1608781 - protein, 4 aa, Staphylococcus aureus
HDIR

SEQ ID NO: 1608782 - protein, 7 aa, Staphylococcus aureus
HETHQTY

SEQ ID NO: 1608783 - protein, 9 aa, Staphylococcus aureus
HKDPESLNP

SEQ ID NO: 1608784 - protein, 9 aa, Staphylococcus aureus
HKTYRDSEH

SEQ ID NO: 1608785 - protein, 8 aa, Staphylococcus aureus
HQKTPIFD

SEQ ID NO: 1608786 - protein, 4 aa, Staphylococcus aureus
HSHP

SEQ ID NO: 1608787 - protein, 6 aa, Staphylococcus aureus
HTEYGN

SEQ ID NO: 1608788 - protein, 4 aa, Staphylococcus aureus
HTGD

SEQ ID NO: 1608789 - protein, 5 aa, Staphylococcus aureus
HYDNG

SEQ ID NO: 1608790 - protein, 8 aa, Staphylococcus aureus
IAAENGGN

SEQ ID NO: 1608791 - protein, 4 aa, Staphylococcus aureus
IAND

SEQ ID NO: 1608792 - protein, 17 aa, Staphylococcus aureus
IATQAKVEAKLNEQGIT

SEQ ID NO: 1608793 - protein, 5 aa, Staphylococcus aureus
IDEKS

SEQ ID NO: 1608794 - protein, 4 aa, Staphylococcus aureus
IDHP

SEQ ID NO: 1608795 - protein, 6 aa, Staphylococcus aureus
IDKAEK

SEQ ID NO: 1608796 - protein, 11 aa, Staphylococcus aureus
IEGHPDNVAPT

SEQ ID NO: 1608797 - protein, 6 aa, Staphylococcus aureus
IEGKGD

SEQ ID NO: 1608798 - protein, 14 aa, Staphylococcus aureus
IENRKKHKQPSTLN

SEQ ID NO: 1608799 - protein, 5 aa, Staphylococcus aureus
IETPY

SEQ ID NO: 1608800 - protein, 10 aa, Staphylococcus aureus
IEVNGRKDIE

SEQ ID NO: 1608801 - protein, 11 aa, Staphylococcus aureus
IGNGKLSEKQL

SEQ ID NO: 1608802 - protein, 8 aa, Staphylococcus aureus
IGQPVNGF

SEQ ID NO: 1608803 - protein, 9 aa, Staphylococcus aureus
IGSDEVTLS

SEQ ID NO: 1608804 - protein, 10 aa, Staphylococcus aureus
IGSENKDKLY

SEQ ID NO: 1608805 - protein, 6 aa, Staphylococcus aureus
IKQQTD

SEQ ID NO: 1608806 - protein, 12 aa, Staphylococcus aureus
ILPTESKQASQL

SEQ ID NO: 1608807 - protein, 10 aa, Staphylococcus aureus
INEPEAAARE

SEQ ID NO: 1608808 - protein, 4 aa, Staphylococcus aureus
INKR

SEQ ID NO: 1608809 - protein, 4 aa, Staphylococcus aureus
IPKQ

SEQ ID NO: 1608810 - protein, 15 aa, Staphylococcus aureus
IQEEDEQSARLATEK

SEQ ID NO: 1608811 - protein, 6 aa, Staphylococcus aureus
IQNDGT

SEQ ID NO: 1608812 - protein, 6 aa, Staphylococcus aureus
IQPDGY

SEQ ID NO: 1608813 - protein, 11 aa, Staphylococcus aureus
IQRRDDLEKRL

SEQ ID NO: 1608814 - protein, 6 aa, Staphylococcus aureus
IQTENL

SEQ ID NO: 1608815 - protein, 10 aa, Staphylococcus aureus
IREKNDVQET

SEQ ID NO: 1608816 - protein, 7 aa, Staphylococcus aureus
IRKETIA

SEQ ID NO: 1608817 - protein, 9 aa, Staphylococcus aureus
ISGGGNTAL

SEQ ID NO: 1608818 - protein, 18 aa, Staphylococcus aureus
ISGKKLKEKLQNSKEDAL

SEQ ID NO: 1608819 - protein, 11 aa, Staphylococcus aureus
ISYDKNDITQE

SEQ ID NO: 1608820 - protein, 8 aa, Staphylococcus aureus
ITGKRLSG

SEQ ID NO: 1608821 - protein, 6 aa, Staphylococcus aureus
ITNEET

SEQ ID NO: 1608822 - protein, 10 aa, Staphylococcus aureus
ITTDSKQNHS

SEQ ID NO: 1608823 - protein, 11 aa, Staphylococcus aureus
ITTSVATRGVS

SEQ ID NO: 1608824 - protein, 11 aa, Staphylococcus aureus
IVSQTSPKELF

SEQ ID NO: 1608825 - protein, 9 aa, Staphylococcus aureus
KAANEAYKS

SEQ ID NO: 1608826 - protein, 19 aa, Staphylococcus aureus
KAEGATIAVGGKRPDRDDL

SEQ ID NO: 1608827 - protein, 8 aa, Staphylococcus aureus
KAIKSYES

SEQ ID NO: 1608828 - protein, 8 aa, Staphylococcus aureus
KAISTEEA

SEQ ID NO: 1608829 - protein, 13 aa, Staphylococcus aureus
KAKATTNEINGKD

SEQ ID NO: 1608830 - protein, 10 aa, Staphylococcus aureus
KALNQESLKE

SEQ ID NO: 1608831 - protein, 6 aa, Staphylococcus aureus
KATKDD

SEQ ID NO: 1608832 - protein, 16 aa, Staphylococcus aureus
KCNDGDVVERKSKKNR

SEQ ID NO: 1608833 - protein, 5 aa, Staphylococcus aureus
KDDDG

SEQ ID NO: 1608834 - protein, 9 aa, Staphylococcus aureus
KDDKGVVDA

SEQ ID NO: 1608835 - protein, 21 aa, Staphylococcus aureus
KDEIQEAQKYYTQKRSKKHEN

SEQ ID NO: 1608836 - protein, 7 aa, Staphylococcus aureus
KDGKPEV

SEQ ID NO: 1608837 - protein, 8 aa, Staphylococcus aureus
KDKDENQL

SEQ ID NO: 1608838 - protein, 9 aa, Staphylococcus aureus
KDKPSAHTL

SEQ ID NO: 1608839 - protein, 5 aa, Staphylococcus aureus
KDLGR

SEQ ID NO: 1608840 - protein, 8 aa, Staphylococcus aureus
KDNEIADG

SEQ ID NO: 1608841 - protein, 7 aa, Staphylococcus aureus
KDNSVET

SEQ ID NO: 1608842 - protein, 4 aa, Staphylococcus aureus
KDQR

SEQ ID NO: 1608843 - protein, 7 aa, Staphylococcus aureus
KDSIPGV

SEQ ID NO: 1608844 - protein, 9 aa, Staphylococcus aureus
KEATVDIET

SEQ ID NO: 1608845 - protein, 7 aa, Staphylococcus aureus
KEDQQVP

SEQ ID NO: 1608846 - protein, 4 aa, Staphylococcus aureus
KEIS

SEQ ID NO: 1608847 - protein, 12 aa, Staphylococcus aureus
KEIYENPKHPYT

SEQ ID NO: 1608848 - protein, 6 aa, Staphylococcus aureus
KEKEQV

SEQ ID NO: 1608849 - protein, 4 aa, Staphylococcus aureus
KEPK

SEQ ID NO: 1608850 - protein, 7 aa, Staphylococcus aureus
KEQHKDS

SEQ ID NO: 1608851 - protein, 13 aa, Staphylococcus aureus
KEQVRNNGERVEI

SEQ ID NO: 1608852 - protein, 10 aa, Staphylococcus aureus
KETGTYTHTE

SEQ ID NO: 1608853 - protein, 17 aa, Staphylococcus aureus
KFPYAANGRALSLDDTN

SEQ ID NO: 1608854 - protein, 11 aa, Staphylococcus aureus
KFTEDAEDAGV

SEQ ID NO: 1608855 - protein, 4 aa, Staphylococcus aureus
KGAI

SEQ ID NO: 1608856 - protein, 8 aa, Staphylococcus aureus
KGDNPEIT

SEQ ID NO: 1608857 - protein, 14 aa, Staphylococcus aureus
KGEEKTGGRTRPSL

SEQ ID NO: 1608858 - protein, 9 aa, Staphylococcus aureus
KGLGTGPTI

SEQ ID NO: 1608859 - protein, 5 aa, Staphylococcus aureus
KGQTF

SEQ ID NO: 1608860 - protein, 8 aa, Staphylococcus aureus
KGSAEETI

SEQ ID NO: 1608861 - protein, 6 aa, Staphylococcus aureus
KGVSVE

SEQ ID NO: 1608862 - protein, 5 aa, Staphylococcus aureus
KIEGE

SEQ ID NO: 1608863 - protein, 6 aa, Staphylococcus aureus
KIHASS

SEQ ID NO: 1608864 - protein, 7 aa, Staphylococcus aureus
KINETAN

SEQ ID NO: 1608865 - protein, 7 aa, Staphylococcus aureus
KKALSSS

SEQ ID NO: 1608866 - protein, 9 aa, Staphylococcus aureus
KKLRKSRQQ

SEQ ID NO: 1608867 - protein, 6 aa, Staphylococcus aureus
KKLRNR

SEQ ID NO: 1608868 - protein, 6 aa, Staphylococcus aureus
KKQFEL

SEQ ID NO: 1608869 - protein, 10 aa, Staphylococcus aureus
KKWPTDKSFN

SEQ ID NO: 1608870 - protein, 7 aa, Staphylococcus aureus
KLGSGQQ

SEQ ID NO: 1608871 - protein, 8 aa, Staphylococcus aureus
KLKEEDHG

SEQ ID NO: 1608872 - protein, 8 aa, Staphylococcus aureus
KLSDGSGV

SEQ ID NO: 1608873 - protein, 6 aa, Staphylococcus aureus
KLSTGH

SEQ ID NO: 1608874 - protein, 5 aa, Staphylococcus aureus
KLTQA

SEQ ID NO: 1608875 - protein, 7 aa, Staphylococcus aureus
KNDKNEV

SEQ ID NO: 1608876 - protein, 6 aa, Staphylococcus aureus
KNGYYD

SEQ ID NO: 1608877 - protein, 8 aa, Staphylococcus aureus
KNYDSARN

SEQ ID NO: 1608878 - protein, 4 aa, Staphylococcus aureus
KPAG

SEQ ID NO: 1608879 - protein, 9 aa, Staphylococcus aureus
KPDEHQSNF

SEQ ID NO: 1608880 - protein, 18 aa, Staphylococcus aureus
KPSTYPPLSYTFDHIIIK

SEQ ID NO: 1608881 - protein, 10 aa, Staphylococcus aureus
KQGRNITLTS

SEQ ID NO: 1608882 - protein, 7 aa, Staphylococcus aureus
KQLHGKQ

SEQ ID NO: 1608883 - protein, 4 aa, Staphylococcus aureus
KQQR

SEQ ID NO: 1608884 - protein, 9 aa, Staphylococcus aureus
KRNKENADD

SEQ ID NO: 1608885 - protein, 6 aa, Staphylococcus aureus
KSAEDQ

SEQ ID NO: 1608886 - protein, 11 aa, Staphylococcus aureus
KSEDDHEMQEE

SEQ ID NO: 1608887 - protein, 8 aa, Staphylococcus aureus
KSEDDSAV

SEQ ID NO: 1608888 - protein, 11 aa, Staphylococcus aureus
KSGEPNPESNQ

SEQ ID NO: 1608889 - protein, 7 aa, Staphylococcus aureus
KSLSDEP

SEQ ID NO: 1608890 - protein, 7 aa, Staphylococcus aureus
KSNTREE

SEQ ID NO: 1608891 - protein, 6 aa, Staphylococcus aureus
KSSDPV

SEQ ID NO: 1608892 - protein, 9 aa, Staphylococcus aureus
KSTKKMKQI

SEQ ID NO: 1608893 - protein, 4 aa, Staphylococcus aureus
KSVD

SEQ ID NO: 1608894 - protein, 9 aa, Staphylococcus aureus
KSVDEPLQT

SEQ ID NO: 1608895 - protein, 9 aa, Staphylococcus aureus
KSVSKVKQT

SEQ ID NO: 1608896 - protein, 7 aa, Staphylococcus aureus
KTDRNRI

SEQ ID NO: 1608897 - protein, 6 aa, Staphylococcus aureus
KTGEFG

SEQ ID NO: 1608898 - protein, 12 aa, Staphylococcus aureus
KTGYDVNAKGRL

SEQ ID NO: 1608899 - protein, 9 aa, Staphylococcus aureus
KTIPVRPGR

SEQ ID NO: 1608900 - protein, 9 aa, Staphylococcus aureus
KTKTGYSTA

SEQ ID NO: 1608901 - protein, 4 aa, Staphylococcus aureus
KTNH

SEQ ID NO: 1608902 - protein, 4 aa, Staphylococcus aureus
KTSY

SEQ ID NO: 1608903 - protein, 15 aa, Staphylococcus aureus
KVGEAIAKKAADKGI

SEQ ID NO: 1608904 - protein, 7 aa, Staphylococcus aureus
KVKENDD

SEQ ID NO: 1608905 - protein, 8 aa, Staphylococcus aureus
KYAPSESK

SEQ ID NO: 1608906 - protein, 6 aa, Staphylococcus aureus
KYIDET

SEQ ID NO: 1608907 - protein, 5 aa, Staphylococcus aureus
KYNKS

SEQ ID NO: 1608908 - protein, 5 aa, Staphylococcus aureus
KYSSI

SEQ ID NO: 1608909 - protein, 4 aa, Staphylococcus aureus
LDEA

SEQ ID NO: 1608910 - protein, 4 aa, Staphylococcus aureus
LDQA

SEQ ID NO: 1608911 - protein, 6 aa, Staphylococcus aureus
LDTCPE

SEQ ID NO: 1608912 - protein, 4 aa, Staphylococcus aureus
LDYG

SEQ ID NO: 1608913 - protein, 15 aa, Staphylococcus aureus
LEKKQKEKVKPTKMV

SEQ ID NO: 1608914 - protein, 6 aa, Staphylococcus aureus
LGATEE

SEQ ID NO: 1608915 - protein, 9 aa, Staphylococcus aureus
LGGMGGAQP

SEQ ID NO: 1608916 - protein, 4 aa, Staphylococcus aureus
LGGY

SEQ ID NO: 1608917 - protein, 5 aa, Staphylococcus aureus
LGPTA

SEQ ID NO: 1608918 - protein, 6 aa, Staphylococcus aureus
LKDEGV

SEQ ID NO: 1608919 - protein, 13 aa, Staphylococcus aureus
LKDTGTGDTLCGE

SEQ ID NO: 1608920 - protein, 8 aa, Staphylococcus aureus
LNDVAPAR

SEQ ID NO: 1608921 - protein, 10 aa, Staphylococcus aureus
LNEKYGTKYE

SEQ ID NO: 1608922 - protein, 5 aa, Staphylococcus aureus
LNEMG

SEQ ID NO: 1608923 - protein, 11 aa, Staphylococcus aureus
LNGTDSNKETR

SEQ ID NO: 1608924 - protein, 10 aa, Staphylococcus aureus
LNREKSPLEG

SEQ ID NO: 1608925 - protein, 6 aa, Staphylococcus aureus
LPKEEI

SEQ ID NO: 1608926 - protein, 8 aa, Staphylococcus aureus
LPNAPEEK

SEQ ID NO: 1608927 - protein, 4 aa, Staphylococcus aureus
LPNV

SEQ ID NO: 1608928 - protein, 4 aa, Staphylococcus aureus
LRDE

SEQ ID NO: 1608929 - protein, 8 aa, Staphylococcus aureus
LRKAKDRA

SEQ ID NO: 1608930 - protein, 12 aa, Staphylococcus aureus
LSDEDKQTVERA

SEQ ID NO: 1608931 - protein, 9 aa, Staphylococcus aureus
LSEQDQAIA

SEQ ID NO: 1608932 - protein, 7 aa, Staphylococcus aureus
LSGAGKS

SEQ ID NO: 1608933 - protein, 7 aa, Staphylococcus aureus
LSKADKV

SEQ ID NO: 1608934 - protein, 8 aa, Staphylococcus aureus
LSNRQVKD

SEQ ID NO: 1608935 - protein, 17 aa, Staphylococcus aureus
LSPTRRDKLQKMYNRTL

SEQ ID NO: 1608936 - protein, 10 aa, Staphylococcus aureus
LTTPDEQEAL

SEQ ID NO: 1608937 - protein, 5 aa, Staphylococcus aureus
LYGKQ

SEQ ID NO: 1608938 - protein, 4 aa, Staphylococcus aureus
LYPD

SEQ ID NO: 1608939 - protein, 7 aa, Staphylococcus aureus
MAEPGEF

SEQ ID NO: 1608940 - protein, 19 aa, Staphylococcus aureus
MDPFNGGEISPGPEVQTDE

SEQ ID NO: 1608941 - protein, 18 aa, Staphylococcus aureus
MEPTRQAMKDAGLTNSDI

SEQ ID NO: 1608942 - protein, 16 aa, Staphylococcus aureus
MGRKAHKLTEDERNTF

SEQ ID NO: 1608943 - protein, 12 aa, Staphylococcus aureus
MNPGGSMKDRPA

SEQ ID NO: 1608944 - protein, 9 aa, Staphylococcus aureus
MPDITKDKY

SEQ ID NO: 1608945 - protein, 20 aa, Staphylococcus aureus
MPGGQYSNLSQQAKSLGLGE

SEQ ID NO: 1608946 - protein, 5 aa, Staphylococcus aureus
MPREK

SEQ ID NO: 1608947 - protein, 4 aa, Staphylococcus aureus
MTKA

SEQ ID NO: 1608948 - protein, 6 aa, Staphylococcus aureus
MTQCNS

SEQ ID NO: 1608949 - protein, 7 aa, Staphylococcus aureus
NAAATAY

SEQ ID NO: 1608950 - protein, 24 aa, Staphylococcus aureus
NAEPHKTEEIKATSINNAEKLATT

SEQ ID NO: 1608951 - protein, 6 aa, Staphylococcus aureus
NAGQTC

SEQ ID NO: 1608952 - protein, 4 aa, Staphylococcus aureus
NAGV

SEQ ID NO: 1608953 - protein, 8 aa, Staphylococcus aureus
NAKHTIAG

SEQ ID NO: 1608954 - protein, 8 aa, Staphylococcus aureus
NANKDADI

SEQ ID NO: 1608955 - protein, 10 aa, Staphylococcus aureus
NAQGETDKEV

SEQ ID NO: 1608956 - protein, 11 aa, Staphylococcus aureus
NARSQSEALDE

SEQ ID NO: 1608957 - protein, 12 aa, Staphylococcus aureus
NCSGAESYKEGV

SEQ ID NO: 1608958 - protein, 5 aa, Staphylococcus aureus
NDAFG

SEQ ID NO: 1608959 - protein, 4 aa, Staphylococcus aureus
NDVK

SEQ ID NO: 1608960 - protein, 4 aa, Staphylococcus aureus
NEGV

SEQ ID NO: 1608961 - protein, 6 aa, Staphylococcus aureus
NEMPDG

SEQ ID NO: 1608962 - protein, 9 aa, Staphylococcus aureus
NEPSAKDTV

SEQ ID NO: 1608963 - protein, 5 aa, Staphylococcus aureus
NFRSR

SEQ ID NO: 1608964 - protein, 10 aa, Staphylococcus aureus
NGEKHAINQQ

SEQ ID NO: 1608965 - protein, 14 aa, Staphylococcus aureus
NGQQAVEKLYDAFN

SEQ ID NO: 1608966 - protein, 4 aa, Staphylococcus aureus
NHEA

SEQ ID NO: 1608967 - protein, 7 aa, Staphylococcus aureus
NHQAKEG

SEQ ID NO: 1608968 - protein, 21 aa, Staphylococcus aureus
NIDGSKDISDVTKDVIDILDH

SEQ ID NO: 1608969 - protein, 5 aa, Staphylococcus aureus
NIPPH

SEQ ID NO: 1608970 - protein, 16 aa, Staphylococcus aureus
NITSKGGTTQAGLDTL

SEQ ID NO: 1608971 - protein, 6 aa, Staphylococcus aureus
NKAQDV

SEQ ID NO: 1608972 - protein, 5 aa, Staphylococcus aureus
NKEAL

SEQ ID NO: 1608973 - protein, 7 aa, Staphylococcus aureus
NKKLNGI

SEQ ID NO: 1608974 - protein, 8 aa, Staphylococcus aureus
NKLQSEQV

SEQ ID NO: 1608975 - protein, 7 aa, Staphylococcus aureus
NKNPIDQ

SEQ ID NO: 1608976 - protein, 13 aa, Staphylococcus aureus
NLENGNPEVHPGP

SEQ ID NO: 1608977 - protein, 11 aa, Staphylococcus aureus
NMQTRTKNKLE

SEQ ID NO: 1608978 - protein, 11 aa, Staphylococcus aureus
NNDKTSYSHNK

SEQ ID NO: 1608979 - protein, 8 aa, Staphylococcus aureus
NNDSINGV

SEQ ID NO: 1608980 - protein, 4 aa, Staphylococcus aureus
NNGD

SEQ ID NO: 1608981 - protein, 12 aa, Staphylococcus aureus
NNKERDLSNSAP

SEQ ID NO: 1608982 - protein, 8 aa, Staphylococcus aureus
NNSPQARL

SEQ ID NO: 1608983 - protein, 5 aa, Staphylococcus aureus
NPECN

SEQ ID NO: 1608984 - protein, 7 aa, Staphylococcus aureus
NPKINEK

SEQ ID NO: 1608985 - protein, 5 aa, Staphylococcus aureus
NPLAE

SEQ ID NO: 1608986 - protein, 6 aa, Staphylococcus aureus
NPYEGG

SEQ ID NO: 1608987 - protein, 5 aa, Staphylococcus aureus
NQIVS

SEQ ID NO: 1608988 - protein, 6 aa, Staphylococcus aureus
NQQQRQ

SEQ ID NO: 1608989 - protein, 4 aa, Staphylococcus aureus
NQRS

SEQ ID NO: 1608990 - protein, 11 aa, Staphylococcus aureus
NQYNDDQDDVD

SEQ ID NO: 1608991 - protein, 8 aa, Staphylococcus aureus
NRGEKEKV

SEQ ID NO: 1608992 - protein, 6 aa, Staphylococcus aureus
NRNGDK

SEQ ID NO: 1608993 - protein, 10 aa, Staphylococcus aureus
NSEITKENGQ

SEQ ID NO: 1608994 - protein, 8 aa, Staphylococcus aureus
NTRPVPDS

SEQ ID NO: 1608995 - protein, 6 aa, Staphylococcus aureus
NTVQSL

SEQ ID NO: 1608996 - protein, 5 aa, Staphylococcus aureus
NVSER

SEQ ID NO: 1608997 - protein, 6 aa, Staphylococcus aureus
PATEEV

SEQ ID NO: 1608998 - protein, 13 aa, Staphylococcus aureus
PDAENESDENRYE

SEQ ID NO: 1608999 - protein, 10 aa, Staphylococcus aureus
PDIRSPKEAY

SEQ ID NO: 1609000 - protein, 4 aa, Staphylococcus aureus
PDKP

SEQ ID NO: 1609001 - protein, 15 aa, Staphylococcus aureus
PDNAIKTGATRPGSM

SEQ ID NO: 1609002 - protein, 5 aa, Staphylococcus aureus
PDYAE

SEQ ID NO: 1609003 - protein, 11 aa, Staphylococcus aureus
PEEQGDTEGTL

SEQ ID NO: 1609004 - protein, 5 aa, Staphylococcus aureus
PETQE

SEQ ID NO: 1609005 - protein, 5 aa, Staphylococcus aureus
PEYEA

SEQ ID NO: 1609006 - protein, 6 aa, Staphylococcus aureus
PIGASG

SEQ ID NO: 1609007 - protein, 5 aa, Staphylococcus aureus
PIGNQ

SEQ ID NO: 1609008 - protein, 18 aa, Staphylococcus aureus
PIKQAKELSSDKKSNEKL

SEQ ID NO: 1609009 - protein, 5 aa, Staphylococcus aureus
PINES

SEQ ID NO: 1609010 - protein, 20 aa, Staphylococcus aureus
PITQSDNPVESYHKIKESWL

SEQ ID NO: 1609011 - protein, 5 aa, Staphylococcus aureus
PKLCT

SEQ ID NO: 1609012 - protein, 10 aa, Staphylococcus aureus
PKNENMLADP

SEQ ID NO: 1609013 - protein, 6 aa, Staphylococcus aureus
PNAEKR

SEQ ID NO: 1609014 - protein, 6 aa, Staphylococcus aureus
PNEDLG

SEQ ID NO: 1609015 - protein, 14 aa, Staphylococcus aureus
PPAQADGKATNPEQ

SEQ ID NO: 1609016 - protein, 9 aa, Staphylococcus aureus
PSSSHTAGA

SEQ ID NO: 1609017 - protein, 7 aa, Staphylococcus aureus
PTIEATR

SEQ ID NO: 1609018 - protein, 22 aa, Staphylococcus aureus
PTTEVTDNAEMTKNIKNDLKSR

SEQ ID NO: 1609019 - protein, 5 aa, Staphylococcus aureus
QAGDI

SEQ ID NO: 1609020 - protein, 4 aa, Staphylococcus aureus
QAKQ

SEQ ID NO: 1609021 - protein, 12 aa, Staphylococcus aureus
QAQTGTGKTGAF

SEQ ID NO: 1609022 - protein, 10 aa, Staphylococcus aureus
QASAEKGEYV

SEQ ID NO: 1609023 - protein, 8 aa, Staphylococcus aureus
QATTDINT

SEQ ID NO: 1609024 - protein, 7 aa, Staphylococcus aureus
QDNGIST

SEQ ID NO: 1609025 - protein, 8 aa, Staphylococcus aureus
QEKYQREN

SEQ ID NO: 1609026 - protein, 10 aa, Staphylococcus aureus
QEQKDGTVEV

SEQ ID NO: 1609027 - protein, 8 aa, Staphylococcus aureus
QESARNLG

SEQ ID NO: 1609028 - protein, 9 aa, Staphylococcus aureus
QGATKEAAE

SEQ ID NO: 1609029 - protein, 7 aa, Staphylococcus aureus
QGDDADI

SEQ ID NO: 1609030 - protein, 7 aa, Staphylococcus aureus
QGEDAAR

SEQ ID NO: 1609031 - protein, 5 aa, Staphylococcus aureus
QGENG

SEQ ID NO: 1609032 - protein, 4 aa, Staphylococcus aureus
QGEV

SEQ ID NO: 1609033 - protein, 22 aa, Staphylococcus aureus
QGQIKTTKKEYQQTNKELSAVD

SEQ ID NO: 1609034 - protein, 6 aa, Staphylococcus aureus
QHETQS

SEQ ID NO: 1609035 - protein, 25 aa, Staphylococcus aureus
QIQQTSTEKIATEKTSYLINYMNAV

SEQ ID NO: 1609036 - protein, 6 aa, Staphylococcus aureus
QKRNPE

SEQ ID NO: 1609037 - protein, 10 aa, Staphylococcus aureus
QLKNEKALKE

SEQ ID NO: 1609038 - protein, 4 aa, Staphylococcus aureus
QLNG

SEQ ID NO: 1609039 - protein, 4 aa, Staphylococcus aureus
QLSQ

SEQ ID NO: 1609040 - protein, 5 aa, Staphylococcus aureus
QMNRV

SEQ ID NO: 1609041 - protein, 14 aa, Staphylococcus aureus
QMTQPVKKGMKEKG

SEQ ID NO: 1609042 - protein, 7 aa, Staphylococcus aureus
QNELDER

SEQ ID NO: 1609043 - protein, 4 aa, Staphylococcus aureus
QNPH

SEQ ID NO: 1609044 - protein, 9 aa, Staphylococcus aureus
QNPNNAEHL

SEQ ID NO: 1609045 - protein, 5 aa, Staphylococcus aureus
QNQDM

SEQ ID NO: 1609046 - protein, 9 aa, Staphylococcus aureus
QNYESGRDY

SEQ ID NO: 1609047 - protein, 14 aa, Staphylococcus aureus
QPGGSIKDQDSIDM

SEQ ID NO: 1609048 - protein, 11 aa, Staphylococcus aureus
QPIPPQPDNKL

SEQ ID NO: 1609049 - protein, 8 aa, Staphylococcus aureus
QPQSKETF

SEQ ID NO: 1609050 - protein, 8 aa, Staphylococcus aureus
QPSSSTPL

SEQ ID NO: 1609051 - protein, 11 aa, Staphylococcus aureus
QQGFGRTGTWS

SEQ ID NO: 1609052 - protein, 5 aa, Staphylococcus aureus
QQLPD

SEQ ID NO: 1609053 - protein, 6 aa, Staphylococcus aureus
QQQGYN

SEQ ID NO: 1609054 - protein, 4 aa, Staphylococcus aureus
QQSI

SEQ ID NO: 1609055 - protein, 8 aa, Staphylococcus aureus
QQVDQSKF

SEQ ID NO: 1609056 - protein, 16 aa, Staphylococcus aureus
QRDGTPAAKMKDNVPL

SEQ ID NO: 1609057 - protein, 4 aa, Staphylococcus aureus
QREM

SEQ ID NO: 1609058 - protein, 8 aa, Staphylococcus aureus
QRNGKKYQ

SEQ ID NO: 1609059 - protein, 12 aa, Staphylococcus aureus
QRTDLRKAKETL

SEQ ID NO: 1609060 - protein, 23 aa, Staphylococcus aureus
QRTKEKEAQGSKRQKSSARKNTR

SEQ ID NO: 1609061 - protein, 8 aa, Staphylococcus aureus
QSEGQPID

SEQ ID NO: 1609062 - protein, 13 aa, Staphylococcus aureus
QSHHKTPDDTNSH

SEQ ID NO: 1609063 - protein, 5 aa, Staphylococcus aureus
QSPLT

SEQ ID NO: 1609064 - protein, 4 aa, Staphylococcus aureus
QSQL

SEQ ID NO: 1609065 - protein, 5 aa, Staphylococcus aureus
QSRKV

SEQ ID NO: 1609066 - protein, 4 aa, Staphylococcus aureus
QSTF

SEQ ID NO: 1609067 - protein, 5 aa, Staphylococcus aureus
QTQEL

SEQ ID NO: 1609068 - protein, 6 aa, Staphylococcus aureus
QTTVTE

SEQ ID NO: 1609069 - protein, 7 aa, Staphylococcus aureus
QVPEETP

SEQ ID NO: 1609070 - protein, 9 aa, Staphylococcus aureus
RAANYRSAG

SEQ ID NO: 1609071 - protein, 5 aa, Staphylococcus aureus
RADEQ

SEQ ID NO: 1609072 - protein, 9 aa, Staphylococcus aureus
RAEKSKTRR

SEQ ID NO: 1609073 - protein, 15 aa, Staphylococcus aureus
RAQHNDAVGPTKGGV

SEQ ID NO: 1609074 - protein, 9 aa, Staphylococcus aureus
RCTNYTSND

SEQ ID NO: 1609075 - protein, 26 aa, Staphylococcus aureus
RDITNDDFRNQVKSSIQKHVKDTNKI

SEQ ID NO: 1609076 - protein, 14 aa, Staphylococcus aureus
RDNANDLARSLNEA

SEQ ID NO: 1609077 - protein, 10 aa, Staphylococcus aureus
RDSVSSEEDI

SEQ ID NO: 1609078 - protein, 19 aa, Staphylococcus aureus
REAAGEKTFNPVEDRFVIK

SEQ ID NO: 1609079 - protein, 7 aa, Staphylococcus aureus
REQAKYE

SEQ ID NO: 1609080 - protein, 9 aa, Staphylococcus aureus
RFNNKSKVG

SEQ ID NO: 1609081 - protein, 16 aa, Staphylococcus aureus
RGDADAMITGGTEAPI

SEQ ID NO: 1609082 - protein, 10 aa, Staphylococcus aureus
RGEEKDSDDV

SEQ ID NO: 1609083 - protein, 4 aa, Staphylococcus aureus
RGGE

SEQ ID NO: 1609084 - protein, 14 aa, Staphylococcus aureus
RGLTDATKATIEKE

SEQ ID NO: 1609085 - protein, 6 aa, Staphylococcus aureus
RGRGLY

SEQ ID NO: 1609086 - protein, 4 aa, Staphylococcus aureus
RKHG

SEQ ID NO: 1609087 - protein, 8 aa, Staphylococcus aureus
RKNKDDLE

SEQ ID NO: 1609088 - protein, 15 aa, Staphylococcus aureus
RKPKYHENIKLMEEG

SEQ ID NO: 1609089 - protein, 9 aa, Staphylococcus aureus
RLGEPETEI

SEQ ID NO: 1609090 - protein, 9 aa, Staphylococcus aureus
RLGTGKVAS

SEQ ID NO: 1609091 - protein, 9 aa, Staphylococcus aureus
RLSNKAANV

SEQ ID NO: 1609092 - protein, 6 aa, Staphylococcus aureus
RLTGKP

SEQ ID NO: 1609093 - protein, 7 aa, Staphylococcus aureus
RNEDKGF

SEQ ID NO: 1609094 - protein, 8 aa, Staphylococcus aureus
RNGAGKTT

SEQ ID NO: 1609095 - protein, 4 aa, Staphylococcus aureus
RNVD

SEQ ID NO: 1609096 - protein, 14 aa, Staphylococcus aureus
RPGMTGAEADAISR

SEQ ID NO: 1609097 - protein, 5 aa, Staphylococcus aureus
RPGPM

SEQ ID NO: 1609098 - protein, 24 aa, Staphylococcus aureus
RRKNSKRKKGHRQPYTKLTIDKIN

SEQ ID NO: 1609099 - protein, 12 aa, Staphylococcus aureus
RRYGSDKPDTRF

SEQ ID NO: 1609100 - protein, 10 aa, Staphylococcus aureus
RTDEGWQGMP

SEQ ID NO: 1609101 - protein, 11 aa, Staphylococcus aureus
RTGCSASTIRR

SEQ ID NO: 1609102 - protein, 4 aa, Staphylococcus aureus
RTMS

SEQ ID NO: 1609103 - protein, 5 aa, Staphylococcus aureus
RVGPF

SEQ ID NO: 1609104 - protein, 6 aa, Staphylococcus aureus
RYQNGK

SEQ ID NO: 1609105 - protein, 4 aa, Staphylococcus aureus
SAGV

SEQ ID NO: 1609106 - protein, 9 aa, Staphylococcus aureus
SATEEPDKL

SEQ ID NO: 1609107 - protein, 13 aa, Staphylococcus aureus
SCPSGAMYKRDED

SEQ ID NO: 1609108 - protein, 23 aa, Staphylococcus aureus
SDEAKSKGITCASAGNHAQGVAY

SEQ ID NO: 1609109 - protein, 4 aa, Staphylococcus aureus
SDEQ

SEQ ID NO: 1609110 - protein, 7 aa, Staphylococcus aureus
SDIDAQT

SEQ ID NO: 1609111 - protein, 8 aa, Staphylococcus aureus
SDKSIEGS

SEQ ID NO: 1609112 - protein, 5 aa, Staphylococcus aureus
SDYNS

SEQ ID NO: 1609113 - protein, 5 aa, Staphylococcus aureus
SEDGK

SEQ ID NO: 1609114 - protein, 6 aa, Staphylococcus aureus
SEPSFN

SEQ ID NO: 1609115 - protein, 6 aa, Staphylococcus aureus
SERATY

SEQ ID NO: 1609116 - protein, 8 aa, Staphylococcus aureus
SESEDVQQ

SEQ ID NO: 1609117 - protein, 10 aa, Staphylococcus aureus
SESEPTISQK

SEQ ID NO: 1609118 - protein, 11 aa, Staphylococcus aureus
SESNEISSKEI

SEQ ID NO: 1609119 - protein, 5 aa, Staphylococcus aureus
SETDM

SEQ ID NO: 1609120 - protein, 6 aa, Staphylococcus aureus
SETQGR

SEQ ID NO: 1609121 - protein, 5 aa, Staphylococcus aureus
SFSNG

SEQ ID NO: 1609122 - protein, 8 aa, Staphylococcus aureus
SGGQDSTL

SEQ ID NO: 1609123 - protein, 9 aa, Staphylococcus aureus
SGKSKGKFF

SEQ ID NO: 1609124 - protein, 4 aa, Staphylococcus aureus
SGNL

SEQ ID NO: 1609125 - protein, 7 aa, Staphylococcus aureus
SGNQPFT

SEQ ID NO: 1609126 - protein, 9 aa, Staphylococcus aureus
SGSTGQPKG

SEQ ID NO: 1609127 - protein, 4 aa, Staphylococcus aureus
SHNI

SEQ ID NO: 1609128 - protein, 12 aa, Staphylococcus aureus
SHYHTNKPGTYV

SEQ ID NO: 1609129 - protein, 7 aa, Staphylococcus aureus
SIAKEAN

SEQ ID NO: 1609130 - protein, 8 aa, Staphylococcus aureus
SIGGAATD

SEQ ID NO: 1609131 - protein, 5 aa, Staphylococcus aureus
SIGTD

SEQ ID NO: 1609132 - protein, 5 aa, Staphylococcus aureus
SITDE

SEQ ID NO: 1609133 - protein, 8 aa, Staphylococcus aureus
SKDEIGDT

SEQ ID NO: 1609134 - protein, 11 aa, Staphylococcus aureus
SKDVAKVSRRD

SEQ ID NO: 1609135 - protein, 5 aa, Staphylococcus aureus
SKGLT

SEQ ID NO: 1609136 - protein, 15 aa, Staphylococcus aureus
SKLRRAEKNTKQFTP

SEQ ID NO: 1609137 - protein, 7 aa, Staphylococcus aureus
SKRDMAE

SEQ ID NO: 1609138 - protein, 6 aa, Staphylococcus aureus
SLPDNE

SEQ ID NO: 1609139 - protein, 6 aa, Staphylococcus aureus
SLPQDY

SEQ ID NO: 1609140 - protein, 10 aa, Staphylococcus aureus
SLRGNALTNG

SEQ ID NO: 1609141 - protein, 5 aa, Staphylococcus aureus
SNGLH

SEQ ID NO: 1609142 - protein, 10 aa, Staphylococcus aureus
SNKEREEAQN

SEQ ID NO: 1609143 - protein, 10 aa, Staphylococcus aureus
SNSYTTDEVK

SEQ ID NO: 1609144 - protein, 4 aa, Staphylococcus aureus
SPEL

SEQ ID NO: 1609145 - protein, 14 aa, Staphylococcus aureus
SPFGSSSPLNDPHF

SEQ ID NO: 1609146 - protein, 12 aa, Staphylococcus aureus
SPHRKDAYRANE

SEQ ID NO: 1609147 - protein, 4 aa, Staphylococcus aureus
SPMR

SEQ ID NO: 1609148 - protein, 5 aa, Staphylococcus aureus
SPPLT

SEQ ID NO: 1609149 - protein, 12 aa, Staphylococcus aureus
SPSEAKVSYNDR

SEQ ID NO: 1609150 - protein, 4 aa, Staphylococcus aureus
SPTG

SEQ ID NO: 1609151 - protein, 6 aa, Staphylococcus aureus
SQDEHW

SEQ ID NO: 1609152 - protein, 12 aa, Staphylococcus aureus
SQGTQTQENADV

SEQ ID NO: 1609153 - protein, 4 aa, Staphylococcus aureus
SQHA

SEQ ID NO: 1609154 - protein, 4 aa, Staphylococcus aureus
SRAI

SEQ ID NO: 1609155 - protein, 14 aa, Staphylococcus aureus
SRMISKNPDQPIDY

SEQ ID NO: 1609156 - protein, 6 aa, Staphylococcus aureus
SRNRYT

SEQ ID NO: 1609157 - protein, 6 aa, Staphylococcus aureus
SRPRSG

SEQ ID NO: 1609158 - protein, 18 aa, Staphylococcus aureus
SRVPDDLDDFNREIVKQL

SEQ ID NO: 1609159 - protein, 8 aa, Staphylococcus aureus
SSEGLAQE

SEQ ID NO: 1609160 - protein, 5 aa, Staphylococcus aureus
SSELN

SEQ ID NO: 1609161 - protein, 6 aa, Staphylococcus aureus
SSETES

SEQ ID NO: 1609162 - protein, 6 aa, Staphylococcus aureus
SSEYEQ

SEQ ID NO: 1609163 - protein, 5 aa, Staphylococcus aureus
SSIKQ

SEQ ID NO: 1609164 - protein, 9 aa, Staphylococcus aureus
SSPQLDIPE

SEQ ID NO: 1609165 - protein, 23 aa, Staphylococcus aureus
SSVEGKLDEKNTIPHTFLHLIRK

SEQ ID NO: 1609166 - protein, 5 aa, Staphylococcus aureus
STPEF

SEQ ID NO: 1609167 - protein, 26 aa, Staphylococcus aureus
SVKVGAPTVEGATVTATVNKQGRGKK

SEQ ID NO: 1609168 - protein, 13 aa, Staphylococcus aureus
SVNPNELNTDKPS

SEQ ID NO: 1609169 - protein, 11 aa, Staphylococcus aureus
SVSYGGTGQTY

SEQ ID NO: 1609170 - protein, 7 aa, Staphylococcus aureus
SYDNQNL

SEQ ID NO: 1609171 - protein, 19 aa, Staphylococcus aureus
SYLNETEVGQGIEASGIDR

SEQ ID NO: 1609172 - protein, 7 aa, Staphylococcus aureus
SYQQRAN

SEQ ID NO: 1609173 - protein, 9 aa, Staphylococcus aureus
SYQQYSKDH

SEQ ID NO: 1609174 - protein, 9 aa, Staphylococcus aureus
TAGASGGVT

SEQ ID NO: 1609175 - protein, 4 aa, Staphylococcus aureus
TASG

SEQ ID NO: 1609176 - protein, 4 aa, Staphylococcus aureus
TCTG

SEQ ID NO: 1609177 - protein, 6 aa, Staphylococcus aureus
TDDAEV

SEQ ID NO: 1609178 - protein, 7 aa, Staphylococcus aureus
TDNTAQD

SEQ ID NO: 1609179 - protein, 4 aa, Staphylococcus aureus
TDSG

SEQ ID NO: 1609180 - protein, 4 aa, Staphylococcus aureus
TEEH

SEQ ID NO: 1609181 - protein, 10 aa, Staphylococcus aureus
TENAIKKEQV

SEQ ID NO: 1609182 - protein, 12 aa, Staphylococcus aureus
TEQGKAIKSPLA

SEQ ID NO: 1609183 - protein, 25 aa, Staphylococcus aureus
TETEPGIKGDTATGATKSATVETGY

SEQ ID NO: 1609184 - protein, 7 aa, Staphylococcus aureus
TGKSTKM

SEQ ID NO: 1609185 - protein, 5 aa, Staphylococcus aureus
TGLSE

SEQ ID NO: 1609186 - protein, 8 aa, Staphylococcus aureus
TGNSSDVR

SEQ ID NO: 1609187 - protein, 12 aa, Staphylococcus aureus
TGRMDGMNESGL

SEQ ID NO: 1609188 - protein, 26 aa, Staphylococcus aureus
TGTPPRVNSKTIDYSKTEIQPGDDVG

SEQ ID NO: 1609189 - protein, 10 aa, Staphylococcus aureus
TGTQSKLSGI

SEQ ID NO: 1609190 - protein, 10 aa, Staphylococcus aureus
TGVGKTELAK

SEQ ID NO: 1609191 - protein, 7 aa, Staphylococcus aureus
TIEEGEV

SEQ ID NO: 1609192 - protein, 6 aa, Staphylococcus aureus
TISGPN

SEQ ID NO: 1609193 - protein, 7 aa, Staphylococcus aureus
TKDGPKV

SEQ ID NO: 1609194 - protein, 15 aa, Staphylococcus aureus
TKIDRDAKKVETNQG

SEQ ID NO: 1609195 - protein, 16 aa, Staphylococcus aureus
TKKGVDRKKMSTAEFR

SEQ ID NO: 1609196 - protein, 11 aa, Staphylococcus aureus
TKTLNEEAPYE

SEQ ID NO: 1609197 - protein, 14 aa, Staphylococcus aureus
TLDEYRKNIEKDAA

SEQ ID NO: 1609198 - protein, 8 aa, Staphylococcus aureus
TLEEAKGA

SEQ ID NO: 1609199 - protein, 10 aa, Staphylococcus aureus
TLKGQGPKDL

SEQ ID NO: 1609200 - protein, 8 aa, Staphylococcus aureus
TLLGAPSG

SEQ ID NO: 1609201 - protein, 12 aa, Staphylococcus aureus
TLPNGKSVDERI

SEQ ID NO: 1609202 - protein, 16 aa, Staphylococcus aureus
TNDEQAKKLKSAGVDR

SEQ ID NO: 1609203 - protein, 11 aa, Staphylococcus aureus
TPDEEIGRGPH

SEQ ID NO: 1609204 - protein, 6 aa, Staphylococcus aureus
TPGDTI

SEQ ID NO: 1609205 - protein, 4 aa, Staphylococcus aureus
TPGR

SEQ ID NO: 1609206 - protein, 6 aa, Staphylococcus aureus
TPNTNH

SEQ ID NO: 1609207 - protein, 10 aa, Staphylococcus aureus
TPQDKRLKSD

SEQ ID NO: 1609208 - protein, 15 aa, Staphylococcus aureus
TPVPHNGCRPPKRRR

SEQ ID NO: 1609209 - protein, 4 aa, Staphylococcus aureus
TRKI

SEQ ID NO: 1609210 - protein, 21 aa, Staphylococcus aureus
TSGREEVENNLSKNIGELGKT

SEQ ID NO: 1609211 - protein, 6 aa, Staphylococcus aureus
TSHTKE

SEQ ID NO: 1609212 - protein, 8 aa, Staphylococcus aureus
TSPETQFE

SEQ ID NO: 1609213 - protein, 9 aa, Staphylococcus aureus
TSPSFSPDK

SEQ ID NO: 1609214 - protein, 7 aa, Staphylococcus aureus
TSSAHYR

SEQ ID NO: 1609215 - protein, 4 aa, Staphylococcus aureus
TSSI

SEQ ID NO: 1609216 - protein, 8 aa, Staphylococcus aureus
TSSIQYEN

SEQ ID NO: 1609217 - protein, 5 aa, Staphylococcus aureus
TTADG

SEQ ID NO: 1609218 - protein, 5 aa, Staphylococcus aureus
TTTDN

SEQ ID NO: 1609219 - protein, 4 aa, Staphylococcus aureus
TVEK

SEQ ID NO: 1609220 - protein, 11 aa, Staphylococcus aureus
TVKSNERGEVD

SEQ ID NO: 1609221 - protein, 12 aa, Staphylococcus aureus
TYEAKGEEKTIE

SEQ ID NO: 1609222 - protein, 8 aa, Staphylococcus aureus
TYGPTEAT

SEQ ID NO: 1609223 - protein, 9 aa, Staphylococcus aureus
TYWKDKNDD

SEQ ID NO: 1609224 - protein, 8 aa, Staphylococcus aureus
VAEPAGAL

SEQ ID NO: 1609225 - protein, 8 aa, Staphylococcus aureus
VATTDERP

SEQ ID NO: 1609226 - protein, 9 aa, Staphylococcus aureus
VDMTTPEPI

SEQ ID NO: 1609227 - protein, 4 aa, Staphylococcus aureus
VEEI

SEQ ID NO: 1609228 - protein, 5 aa, Staphylococcus aureus
VEGDA

SEQ ID NO: 1609229 - protein, 9 aa, Staphylococcus aureus
VEHSDGEAF

SEQ ID NO: 1609230 - protein, 4 aa, Staphylococcus aureus
VERR

SEQ ID NO: 1609231 - protein, 5 aa, Staphylococcus aureus
VGKNN

SEQ ID NO: 1609232 - protein, 9 aa, Staphylococcus aureus
VGTTDKTGT

SEQ ID NO: 1609233 - protein, 11 aa, Staphylococcus aureus
VKDDKAKTREL

SEQ ID NO: 1609234 - protein, 5 aa, Staphylococcus aureus
VKEKA

SEQ ID NO: 1609235 - protein, 23 aa, Staphylococcus aureus
VKQGTGKYFGPYPNAYSAQETKK

SEQ ID NO: 1609236 - protein, 12 aa, Staphylococcus aureus
VKSTPENLAEQI

SEQ ID NO: 1609237 - protein, 10 aa, Staphylococcus aureus
VNIKGEKTTP

SEQ ID NO: 1609238 - protein, 13 aa, Staphylococcus aureus
VNNDVKDAQKEAL

SEQ ID NO: 1609239 - protein, 7 aa, Staphylococcus aureus
VNQGHRH

SEQ ID NO: 1609240 - protein, 8 aa, Staphylococcus aureus
VNTNLGRD

SEQ ID NO: 1609241 - protein, 4 aa, Staphylococcus aureus
VRPE

SEQ ID NO: 1609242 - protein, 8 aa, Staphylococcus aureus
VRQGKMDP

SEQ ID NO: 1609243 - protein, 5 aa, Staphylococcus aureus
VRQVE

SEQ ID NO: 1609244 - protein, 4 aa, Staphylococcus aureus
VSEE

SEQ ID NO: 1609245 - protein, 12 aa, Staphylococcus aureus
VSGGAHNSINDA

SEQ ID NO: 1609246 - protein, 11 aa, Staphylococcus aureus
VSPTKDAETSL

SEQ ID NO: 1609247 - protein, 7 aa, Staphylococcus aureus
VSSTAGN

SEQ ID NO: 1609248 - protein, 7 aa, Staphylococcus aureus
VTSEATF

SEQ ID NO: 1609249 - protein, 14 aa, Staphylococcus aureus
VVPNSNINKVEPGK

SEQ ID NO: 1609250 - protein, 19 aa, Staphylococcus aureus
WKQKHEKNNENNNQERQGL

SEQ ID NO: 1609251 - protein, 11 aa, Staphylococcus aureus
WNEDKENEVIE

SEQ ID NO: 1609252 - protein, 4 aa, Staphylococcus aureus
WPEV

SEQ ID NO: 1609253 - protein, 12 aa, Staphylococcus aureus
WQGGRNNVGNVQ

SEQ ID NO: 1609254 - protein, 10 aa, Staphylococcus aureus
YAEGYPGRRY

SEQ ID NO: 1609255 - protein, 11 aa, Staphylococcus aureus
YAGSKEKAEAV

SEQ ID NO: 1609256 - protein, 8 aa, Staphylococcus aureus
YDEELGAR

SEQ ID NO: 1609257 - protein, 6 aa, Staphylococcus aureus
YDTTNI

SEQ ID NO: 1609258 - protein, 5 aa, Staphylococcus aureus
YDTVT

SEQ ID NO: 1609259 - protein, 37 aa, Staphylococcus aureus
YEQAAQQQQQAQGANAGQNNDSTVEDAEFKEVKDDDK

SEQ ID NO: 1609260 - protein, 16 aa, Staphylococcus aureus
YIEGSEKQDKMPNGSN

SEQ ID NO: 1609261 - protein, 7 aa, Staphylococcus aureus
YKETRRA

SEQ ID NO: 1609262 - protein, 4 aa, Staphylococcus aureus
YPQI

SEQ ID NO: 1609263 - protein, 6 aa, Staphylococcus aureus
YRPNAV

SEQ ID NO: 1609264 - protein, 13 aa, Staphylococcus aureus
YRRPGTGAYPLRG

SEQ ID NO: 1609265 - protein, 8 aa, Staphylococcus aureus
YSEREIQQ

SEQ ID NO: 1609266 - protein, 7 aa, Staphylococcus aureus
YSFSDDQ

SEQ ID NO: 1609267 - protein, 15 aa, Staphylococcus aureus
YSTESILEKWLNLFN

SEQ ID NO: 1609268 - protein, 10 aa, Staphylococcus aureus
YTTGYSNKSQ

SEQ ID NO: 1609269 - protein, 14 aa, Staphylococcus aureus
AAGSGDFAGNRADS

SEQ ID NO: 1609270 - protein, 22 aa, Staphylococcus aureus
AAIKATAEKFEREKAKGLKPRA

SEQ ID NO: 1609271 - protein, 9 aa, Staphylococcus aureus
AALSGTTYP

SEQ ID NO: 1609272 - protein, 5 aa, Staphylococcus aureus
AAPGW

SEQ ID NO: 1609273 - protein, 6 aa, Staphylococcus aureus
AASATA

SEQ ID NO: 1609274 - protein, 15 aa, Staphylococcus aureus
AASPHGTPGDRRLKS

SEQ ID NO: 1609275 - protein, 8 aa, Staphylococcus aureus
ADANPQSI

SEQ ID NO: 1609276 - protein, 5 aa, Staphylococcus aureus
ADELG

SEQ ID NO: 1609277 - protein, 12 aa, Staphylococcus aureus
ADESFDGDALKF

SEQ ID NO: 1609278 - protein, 6 aa, Staphylococcus aureus
ADFDGD

SEQ ID NO: 1609279 - protein, 9 aa, Staphylococcus aureus
ADNDKDGYR

SEQ ID NO: 1609280 - protein, 17 aa, Staphylococcus aureus
AEEVSTSAFADELIKNL

SEQ ID NO: 1609281 - protein, 12 aa, Staphylococcus aureus
AEGNLINNSKTS

SEQ ID NO: 1609282 - protein, 10 aa, Staphylococcus aureus
AELTGRNDIQ

SEQ ID NO: 1609283 - protein, 5 aa, Staphylococcus aureus
AENAQ

SEQ ID NO: 1609284 - protein, 6 aa, Staphylococcus aureus
AETLEE

SEQ ID NO: 1609285 - protein, 6 aa, Staphylococcus aureus
AEVDKG

SEQ ID NO: 1609286 - protein, 5 aa, Staphylococcus aureus
AGALA

SEQ ID NO: 1609287 - protein, 11 aa, Staphylococcus aureus
AGEKTKTFEQY

SEQ ID NO: 1609288 - protein, 6 aa, Staphylococcus aureus
AGGKRI

SEQ ID NO: 1609289 - protein, 17 aa, Staphylococcus aureus
AGTTRDAIDTEYSYDGQ

SEQ ID NO: 1609290 - protein, 4 aa, Staphylococcus aureus
AGYQ

SEQ ID NO: 1609291 - protein, 10 aa, Staphylococcus aureus
AHPPGPSKRI

SEQ ID NO: 1609292 - protein, 16 aa, Staphylococcus aureus
AISEKAIERKTGARGL

SEQ ID NO: 1609293 - protein, 12 aa, Staphylococcus aureus
AKHGKNLKKVEA

SEQ ID NO: 1609294 - protein, 8 aa, Staphylococcus aureus
AKNNDKKS

SEQ ID NO: 1609295 - protein, 6 aa, Staphylococcus aureus
ALDGDQ

SEQ ID NO: 1609296 - protein, 4 aa, Staphylococcus aureus
ALGE

SEQ ID NO: 1609297 - protein, 5 aa, Staphylococcus aureus
ALSTD

SEQ ID NO: 1609298 - protein, 6 aa, Staphylococcus aureus
ANAAGL

SEQ ID NO: 1609299 - protein, 9 aa, Staphylococcus aureus
ANATDEEAV

SEQ ID NO: 1609300 - protein, 8 aa, Staphylococcus aureus
ANGAGKTT

SEQ ID NO: 1609301 - protein, 10 aa, Staphylococcus aureus
ANGPTTPEAT

SEQ ID NO: 1609302 - protein, 11 aa, Staphylococcus aureus
APLGSGEAYGF

SEQ ID NO: 1609303 - protein, 10 aa, Staphylococcus aureus
APNPGSDAAI

SEQ ID NO: 1609304 - protein, 6 aa, Staphylococcus aureus
APTMSK

SEQ ID NO: 1609305 - protein, 5 aa, Staphylococcus aureus
APTTY

SEQ ID NO: 1609306 - protein, 8 aa, Staphylococcus aureus
ARSYAEKY

SEQ ID NO: 1609307 - protein, 11 aa, Staphylococcus aureus
ASHSHNNPHHA

SEQ ID NO: 1609308 - protein, 4 aa, Staphylococcus aureus
ASMH

SEQ ID NO: 1609309 - protein, 5 aa, Staphylococcus aureus
ASNTN

SEQ ID NO: 1609310 - protein, 9 aa, Staphylococcus aureus
ATDVNDDEE

SEQ ID NO: 1609311 - protein, 15 aa, Staphylococcus aureus
ATGTPAGVGAGMQPP

SEQ ID NO: 1609312 - protein, 6 aa, Staphylococcus aureus
ATPFPR

SEQ ID NO: 1609313 - protein, 12 aa, Staphylococcus aureus
ATTDKEKGALKQ

SEQ ID NO: 1609314 - protein, 10 aa, Staphylococcus aureus
ATTGQNGAFH

SEQ ID NO: 1609315 - protein, 16 aa, Staphylococcus aureus
AVSGSGKNGRITKEDV

SEQ ID NO: 1609316 - protein, 27 aa, Staphylococcus aureus
AVSGSGMKGKKDLAEGVNGKAPEAYPH

SEQ ID NO: 1609317 - protein, 11 aa, Staphylococcus aureus
DAGNELPPNRM

SEQ ID NO: 1609318 - protein, 5 aa, Staphylococcus aureus
DAMHS

SEQ ID NO: 1609319 - protein, 12 aa, Staphylococcus aureus
DAVKESFKNPRE

SEQ ID NO: 1609320 - protein, 5 aa, Staphylococcus aureus
DDGKA

SEQ ID NO: 1609321 - protein, 10 aa, Staphylococcus aureus
DDKNLPTNQN

SEQ ID NO: 1609322 - protein, 13 aa, Staphylococcus aureus
DDSYKPKASDEAY

SEQ ID NO: 1609323 - protein, 6 aa, Staphylococcus aureus
DDYHSN

SEQ ID NO: 1609324 - protein, 6 aa, Staphylococcus aureus
DEANNH

SEQ ID NO: 1609325 - protein, 16 aa, Staphylococcus aureus
DEEGKLGETENTQPAL

SEQ ID NO: 1609326 - protein, 7 aa, Staphylococcus aureus
DEIDGAK

SEQ ID NO: 1609327 - protein, 7 aa, Staphylococcus aureus
DENGYKA

SEQ ID NO: 1609328 - protein, 8 aa, Staphylococcus aureus
DEPTTALD

SEQ ID NO: 1609329 - protein, 8 aa, Staphylococcus aureus
DEYAKSDL

SEQ ID NO: 1609330 - protein, 5 aa, Staphylococcus aureus
DEYEQ

SEQ ID NO: 1609331 - protein, 13 aa, Staphylococcus aureus
DFNPDTDSIPESE

SEQ ID NO: 1609332 - protein, 8 aa, Staphylococcus aureus
DGEYGGKL

SEQ ID NO: 1609333 - protein, 5 aa, Staphylococcus aureus
DGRPK

SEQ ID NO: 1609334 - protein, 10 aa, Staphylococcus aureus
DGRQTSPREA

SEQ ID NO: 1609335 - protein, 8 aa, Staphylococcus aureus
DGSQYGEL

SEQ ID NO: 1609336 - protein, 11 aa, Staphylococcus aureus
DGSVGSGFDLP

SEQ ID NO: 1609337 - protein, 7 aa, Staphylococcus aureus
DGTAKGG

SEQ ID NO: 1609338 - protein, 7 aa, Staphylococcus aureus
DGTLHPD

SEQ ID NO: 1609339 - protein, 13 aa, Staphylococcus aureus
DGTRVTPEVKEGD

SEQ ID NO: 1609340 - protein, 7 aa, Staphylococcus aureus
DIDGTGH

SEQ ID NO: 1609341 - protein, 6 aa, Staphylococcus aureus
DITDAI

SEQ ID NO: 1609342 - protein, 9 aa, Staphylococcus aureus
DITEDDIDT

SEQ ID NO: 1609343 - protein, 9 aa, Staphylococcus aureus
DKAQTTRNK

SEQ ID NO: 1609344 - protein, 6 aa, Staphylococcus aureus
DKELEN

SEQ ID NO: 1609345 - protein, 5 aa, Staphylococcus aureus
DKESV

SEQ ID NO: 1609346 - protein, 23 aa, Staphylococcus aureus
DKGDSFDYETTKSKIGPYDKDEN

SEQ ID NO: 1609347 - protein, 13 aa, Staphylococcus aureus
DKIEQGIKRGKKH

SEQ ID NO: 1609348 - protein, 5 aa, Staphylococcus aureus
DKKSY

SEQ ID NO: 1609349 - protein, 8 aa, Staphylococcus aureus
DKLDDMTK

SEQ ID NO: 1609350 - protein, 5 aa, Staphylococcus aureus
DKSKY

SEQ ID NO: 1609351 - protein, 7 aa, Staphylococcus aureus
DKTCETC

SEQ ID NO: 1609352 - protein, 6 aa, Staphylococcus aureus
DKVPDI

SEQ ID NO: 1609353 - protein, 7 aa, Staphylococcus aureus
DKYEFGE

SEQ ID NO: 1609354 - protein, 4 aa, Staphylococcus aureus
DLKE

SEQ ID NO: 1609355 - protein, 8 aa, Staphylococcus aureus
DLNHTGAH

SEQ ID NO: 1609356 - protein, 11 aa, Staphylococcus aureus
DLTEKGTQVDK

SEQ ID NO: 1609357 - protein, 5 aa, Staphylococcus aureus
DNDET

SEQ ID NO: 1609358 - protein, 4 aa, Staphylococcus aureus
DNEQ

SEQ ID NO: 1609359 - protein, 6 aa, Staphylococcus aureus
DNIANK

SEQ ID NO: 1609360 - protein, 5 aa, Staphylococcus aureus
DNSLN

SEQ ID NO: 1609361 - protein, 6 aa, Staphylococcus aureus
DPAELR

SEQ ID NO: 1609362 - protein, 10 aa, Staphylococcus aureus
DPKTNEPTRV

SEQ ID NO: 1609363 - protein, 12 aa, Staphylococcus aureus
DQPRTELSAYAP

SEQ ID NO: 1609364 - protein, 12 aa, Staphylococcus aureus
DRGGYYESSGAL

SEQ ID NO: 1609365 - protein, 7 aa, Staphylococcus aureus
DRTRASL

SEQ ID NO: 1609366 - protein, 7 aa, Staphylococcus aureus
DSASDQD

SEQ ID NO: 1609367 - protein, 5 aa, Staphylococcus aureus
DSDQM

SEQ ID NO: 1609368 - protein, 9 aa, Staphylococcus aureus
DTIEEAVEG

SEQ ID NO: 1609369 - protein, 10 aa, Staphylococcus aureus
DTINNKEDLR

SEQ ID NO: 1609370 - protein, 11 aa, Staphylococcus aureus
DVIDDDNKLQD

SEQ ID NO: 1609371 - protein, 8 aa, Staphylococcus aureus
DVQSQEGN

SEQ ID NO: 1609372 - protein, 11 aa, Staphylococcus aureus
DVSEAKKIAKK

SEQ ID NO: 1609373 - protein, 9 aa, Staphylococcus aureus
DVTETKGNY

SEQ ID NO: 1609374 - protein, 4 aa, Staphylococcus aureus
DYDG

SEQ ID NO: 1609375 - protein, 5 aa, Staphylococcus aureus
DYDPH

SEQ ID NO: 1609376 - protein, 5 aa, Staphylococcus aureus
EAHQH

SEQ ID NO: 1609377 - protein, 8 aa, Staphylococcus aureus
EAKDGNTY

SEQ ID NO: 1609378 - protein, 6 aa, Staphylococcus aureus
EALPSD

SEQ ID NO: 1609379 - protein, 15 aa, Staphylococcus aureus
EAMKNASNESFGYTE

SEQ ID NO: 1609380 - protein, 12 aa, Staphylococcus aureus
EASAGKKSSISN

SEQ ID NO: 1609381 - protein, 13 aa, Staphylococcus aureus
EATQSNSNVQIAS

SEQ ID NO: 1609382 - protein, 12 aa, Staphylococcus aureus
EDDHKKPLASST

SEQ ID NO: 1609383 - protein, 20 aa, Staphylococcus aureus
EDEDELDEDEEVFEDEEDFN

SEQ ID NO: 1609384 - protein, 8 aa, Staphylococcus aureus
EDENATQR

SEQ ID NO: 1609385 - protein, 14 aa, Staphylococcus aureus
EDNQVTVRDRDSME

SEQ ID NO: 1609386 - protein, 10 aa, Staphylococcus aureus
EDTPGVTRDR

SEQ ID NO: 1609387 - protein, 24 aa, Staphylococcus aureus
EEAPSPILDDETRREMGNAAVRAA

SEQ ID NO: 1609388 - protein, 13 aa, Staphylococcus aureus
EEISDSVRRDPIH

SEQ ID NO: 1609389 - protein, 11 aa, Staphylococcus aureus
EGANPTGSFKD

SEQ ID NO: 1609390 - protein, 6 aa, Staphylococcus aureus
EGFGPF

SEQ ID NO: 1609391 - protein, 10 aa, Staphylococcus aureus
EGKAQGKETI

SEQ ID NO: 1609392 - protein, 32 aa, Staphylococcus aureus
EGQQGVSNEEVAAEQNIDLDEKEKSEETEATE

SEQ ID NO: 1609393 - protein, 7 aa, Staphylococcus aureus
EGYDTPE

SEQ ID NO: 1609394 - protein, 9 aa, Staphylococcus aureus
EHRKAQNYA

SEQ ID NO: 1609395 - protein, 4 aa, Staphylococcus aureus
EHYE

SEQ ID NO: 1609396 - protein, 6 aa, Staphylococcus aureus
EIDSTD

SEQ ID NO: 1609397 - protein, 5 aa, Staphylococcus aureus
EIYEA

SEQ ID NO: 1609398 - protein, 14 aa, Staphylococcus aureus
EKDDYVDGSEVKEG

SEQ ID NO: 1609399 - protein, 16 aa, Staphylococcus aureus
EKDLTDTKKAQNEYEE

SEQ ID NO: 1609400 - protein, 4 aa, Staphylococcus aureus
EKEI

SEQ ID NO: 1609401 - protein, 15 aa, Staphylococcus aureus
EKGERELGTQMKATG

SEQ ID NO: 1609402 - protein, 6 aa, Staphylococcus aureus
EKGTEI

SEQ ID NO: 1609403 - protein, 24 aa, Staphylococcus aureus
EKTLNKNKYDSVDEAVKAGLQLVV

SEQ ID NO: 1609404 - protein, 6 aa, Staphylococcus aureus
ELEPND

SEQ ID NO: 1609405 - protein, 12 aa, Staphylococcus aureus
ELPSPSNPPQGC

SEQ ID NO: 1609406 - protein, 12 aa, Staphylococcus aureus
ELSADGPIRPPY

SEQ ID NO: 1609407 - protein, 7 aa, Staphylococcus aureus
ELSGGQL

SEQ ID NO: 1609408 - protein, 8 aa, Staphylococcus aureus
EMQNNNEP

SEQ ID NO: 1609409 - protein, 7 aa, Staphylococcus aureus
ENDDTQK

SEQ ID NO: 1609410 - protein, 4 aa, Staphylococcus aureus
ENFK

SEQ ID NO: 1609411 - protein, 8 aa, Staphylococcus aureus
ENLGQVAS

SEQ ID NO: 1609412 - protein, 5 aa, Staphylococcus aureus
ENMGQ

SEQ ID NO: 1609413 - protein, 7 aa, Staphylococcus aureus
EPLESEY

SEQ ID NO: 1609414 - protein, 8 aa, Staphylococcus aureus
EPPSASPV

SEQ ID NO: 1609415 - protein, 6 aa, Staphylococcus aureus
EQIEQD

SEQ ID NO: 1609416 - protein, 8 aa, Staphylococcus aureus
EQKKLSPQ

SEQ ID NO: 1609417 - protein, 9 aa, Staphylococcus aureus
EQKNQKTQH

SEQ ID NO: 1609418 - protein, 11 aa, Staphylococcus aureus
ERDKKAEKDYS

SEQ ID NO: 1609419 - protein, 13 aa, Staphylococcus aureus
ERHQDKQKNKYKI

SEQ ID NO: 1609420 - protein, 18 aa, Staphylococcus aureus
ERTGQSIEKIQKDTDRDN

SEQ ID NO: 1609421 - protein, 9 aa, Staphylococcus aureus
ESFAENQSA

SEQ ID NO: 1609422 - protein, 7 aa, Staphylococcus aureus
ESQWQEE

SEQ ID NO: 1609423 - protein, 6 aa, Staphylococcus aureus
ETEGIT

SEQ ID NO: 1609424 - protein, 5 aa, Staphylococcus aureus
ETGEV

SEQ ID NO: 1609425 - protein, 15 aa, Staphylococcus aureus
EVLTGSTRLKSGTAQ

SEQ ID NO: 1609426 - protein, 4 aa, Staphylococcus aureus
FAEE

SEQ ID NO: 1609427 - protein, 5 aa, Staphylococcus aureus
FDQSI

SEQ ID NO: 1609428 - protein, 9 aa, Staphylococcus aureus
FDSTSNVRA

SEQ ID NO: 1609429 - protein, 5 aa, Staphylococcus aureus
FEDGQ

SEQ ID NO: 1609430 - protein, 10 aa, Staphylococcus aureus
FENGHGTAEL

SEQ ID NO: 1609431 - protein, 7 aa, Staphylococcus aureus
FGAPHET

SEQ ID NO: 1609432 - protein, 9 aa, Staphylococcus aureus
FGDDRRTEI

SEQ ID NO: 1609433 - protein, 8 aa, Staphylococcus aureus
FGEATRRA

SEQ ID NO: 1609434 - protein, 12 aa, Staphylococcus aureus
FGKDEQTSEQTY

SEQ ID NO: 1609435 - protein, 7 aa, Staphylococcus aureus
FKKHSSG

SEQ ID NO: 1609436 - protein, 12 aa, Staphylococcus aureus
FKPSEDKSKETY

SEQ ID NO: 1609437 - protein, 5 aa, Staphylococcus aureus
FPTSG

SEQ ID NO: 1609438 - protein, 14 aa, Staphylococcus aureus
FQPKENLAEVLDKH

SEQ ID NO: 1609439 - protein, 4 aa, Staphylococcus aureus
FQSG

SEQ ID NO: 1609440 - protein, 4 aa, Staphylococcus aureus
FRDA

SEQ ID NO: 1609441 - protein, 5 aa, Staphylococcus aureus
GAGAM

SEQ ID NO: 1609442 - protein, 21 aa, Staphylococcus aureus
GALGRKTKQGFYKKDKETKAR

SEQ ID NO: 1609443 - protein, 18 aa, Staphylococcus aureus
GDAGGKLHTGRSRNDQVA

SEQ ID NO: 1609444 - protein, 18 aa, Staphylococcus aureus
GDEPKVIQNPEGSRTTPS

SEQ ID NO: 1609445 - protein, 6 aa, Staphylococcus aureus
GDGQDN

SEQ ID NO: 1609446 - protein, 12 aa, Staphylococcus aureus
GDNFGKQVIKVT

SEQ ID NO: 1609447 - protein, 10 aa, Staphylococcus aureus
GDQLSRTTGF

SEQ ID NO: 1609448 - protein, 5 aa, Staphylococcus aureus
GDSHF

SEQ ID NO: 1609449 - protein, 10 aa, Staphylococcus aureus
GDVDDIRESP

SEQ ID NO: 1609450 - protein, 4 aa, Staphylococcus aureus
GDYE

SEQ ID NO: 1609451 - protein, 5 aa, Staphylococcus aureus
GEGRV

SEQ ID NO: 1609452 - protein, 15 aa, Staphylococcus aureus
GEGVADDVKEAVQNA

SEQ ID NO: 1609453 - protein, 10 aa, Staphylococcus aureus
GETVTPHDHQ

SEQ ID NO: 1609454 - protein, 15 aa, Staphylococcus aureus
GGHVTGPKDPNIQKI

SEQ ID NO: 1609455 - protein, 7 aa, Staphylococcus aureus
GGLPETV

SEQ ID NO: 1609456 - protein, 8 aa, Staphylococcus aureus
GGMTNASK

SEQ ID NO: 1609457 - protein, 6 aa, Staphylococcus aureus
GGNPAN

SEQ ID NO: 1609458 - protein, 9 aa, Staphylococcus aureus
GGRKAAERI

SEQ ID NO: 1609459 - protein, 6 aa, Staphylococcus aureus
GIDNPK

SEQ ID NO: 1609460 - protein, 9 aa, Staphylococcus aureus
GIHKPKHKL

SEQ ID NO: 1609461 - protein, 5 aa, Staphylococcus aureus
GIQGH

SEQ ID NO: 1609462 - protein, 19 aa, Staphylococcus aureus
GKEEGKLEQGGGTDDSKGY

SEQ ID NO: 1609463 - protein, 6 aa, Staphylococcus aureus
GKEGLS

SEQ ID NO: 1609464 - protein, 34 aa, Staphylococcus aureus
GKKDDVNSGGKQMPSHFSSRAKNILSQSSPVATQ

SEQ ID NO: 1609465 - protein, 9 aa, Staphylococcus aureus
GKTDGAMDA

SEQ ID NO: 1609466 - protein, 14 aa, Staphylococcus aureus
GNAGYMTDTEPGSL

SEQ ID NO: 1609467 - protein, 9 aa, Staphylococcus aureus
GNEALAQEV

SEQ ID NO: 1609468 - protein, 4 aa, Staphylococcus aureus
GPDL

SEQ ID NO: 1609469 - protein, 4 aa, Staphylococcus aureus
GPER

SEQ ID NO: 1609470 - protein, 8 aa, Staphylococcus aureus
GPGEGAGV

SEQ ID NO: 1609471 - protein, 11 aa, Staphylococcus aureus
GQDKEATQRAR

SEQ ID NO: 1609472 - protein, 10 aa, Staphylococcus aureus
GQEERDKEAQ

SEQ ID NO: 1609473 - protein, 6 aa, Staphylococcus aureus
GQQKFR

SEQ ID NO: 1609474 - protein, 10 aa, Staphylococcus aureus
GQSQTGTGKS

SEQ ID NO: 1609475 - protein, 4 aa, Staphylococcus aureus
GRQS

SEQ ID NO: 1609476 - protein, 19 aa, Staphylococcus aureus
GSAESDAFNGKISNESPMA

SEQ ID NO: 1609477 - protein, 13 aa, Staphylococcus aureus
GSDREQALATKEL

SEQ ID NO: 1609478 - protein, 11 aa, Staphylococcus aureus
GSDTGGSIRQP

SEQ ID NO: 1609479 - protein, 25 aa, Staphylococcus aureus
GSKTPGHPEYRHTDGVEVTTGPLGQ

SEQ ID NO: 1609480 - protein, 10 aa, Staphylococcus aureus
GSLPKGLNQD

SEQ ID NO: 1609481 - protein, 12 aa, Staphylococcus aureus
GSRAFDPSTTVG

SEQ ID NO: 1609482 - protein, 17 aa, Staphylococcus aureus
GTVSGEIADGKYGENGF

SEQ ID NO: 1609483 - protein, 7 aa, Staphylococcus aureus
HAEPTTF

SEQ ID NO: 1609484 - protein, 12 aa, Staphylococcus aureus
HAGGRGKAGGVK

SEQ ID NO: 1609485 - protein, 10 aa, Staphylococcus aureus
HANNELNDKT

SEQ ID NO: 1609486 - protein, 10 aa, Staphylococcus aureus
HDAGYNVKED

SEQ ID NO: 1609487 - protein, 4 aa, Staphylococcus aureus
HDFD

SEQ ID NO: 1609488 - protein, 6 aa, Staphylococcus aureus
HDQGAN

SEQ ID NO: 1609489 - protein, 7 aa, Staphylococcus aureus
HFNPSQG

SEQ ID NO: 1609490 - protein, 10 aa, Staphylococcus aureus
HGAGSPCGKA

SEQ ID NO: 1609491 - protein, 6 aa, Staphylococcus aureus
HGENIN

SEQ ID NO: 1609492 - protein, 13 aa, Staphylococcus aureus
HGSHEEHKGRIDT

SEQ ID NO: 1609493 - protein, 8 aa, Staphylococcus aureus
HKKINRKD

SEQ ID NO: 1609494 - protein, 29 aa, Staphylococcus aureus
HNKSYSQPSNQQQRLATDDDIGNGESIFD

SEQ ID NO: 1609495 - protein, 7 aa, Staphylococcus aureus
HNPVADN

SEQ ID NO: 1609496 - protein, 6 aa, Staphylococcus aureus
HPKTTI

SEQ ID NO: 1609497 - protein, 14 aa, Staphylococcus aureus
HQKPTQLNPEGGIL

SEQ ID NO: 1609498 - protein, 7 aa, Staphylococcus aureus
HQLSGGM

SEQ ID NO: 1609499 - protein, 16 aa, Staphylococcus aureus
HRGETVTEGSSSNAYA

SEQ ID NO: 1609500 - protein, 8 aa, Staphylococcus aureus
HRLQGSKK

SEQ ID NO: 1609501 - protein, 10 aa, Staphylococcus aureus
HRTKTEKAND

SEQ ID NO: 1609502 - protein, 8 aa, Staphylococcus aureus
HSEGVDLT

SEQ ID NO: 1609503 - protein, 8 aa, Staphylococcus aureus
HTAGDDTL

SEQ ID NO: 1609504 - protein, 41 aa, Staphylococcus aureus
HVSAEDGKEKVKPKPIVKGDQVGRNDDCPCGSGKKFKNCHG

SEQ ID NO: 1609505 - protein, 7 aa, Staphylococcus aureus
IADPKKR

SEQ ID NO: 1609506 - protein, 9 aa, Staphylococcus aureus
IAGNGSDEL

SEQ ID NO: 1609507 - protein, 5 aa, Staphylococcus aureus
IAKQQ

SEQ ID NO: 1609508 - protein, 6 aa, Staphylococcus aureus
IARTTF

SEQ ID NO: 1609509 - protein, 5 aa, Staphylococcus aureus
IDSPV

SEQ ID NO: 1609510 - protein, 5 aa, Staphylococcus aureus
IDTDI

SEQ ID NO: 1609511 - protein, 5 aa, Staphylococcus aureus
IDTLN

SEQ ID NO: 1609512 - protein, 9 aa, Staphylococcus aureus
IDTNPKNIG

SEQ ID NO: 1609513 - protein, 11 aa, Staphylococcus aureus
IGEITRNEDIY

SEQ ID NO: 1609514 - protein, 4 aa, Staphylococcus aureus
IGGQ

SEQ ID NO: 1609515 - protein, 10 aa, Staphylococcus aureus
IGIPNKGDWT

SEQ ID NO: 1609516 - protein, 7 aa, Staphylococcus aureus
IGNNDEH

SEQ ID NO: 1609517 - protein, 8 aa, Staphylococcus aureus
IGPGGKKI

SEQ ID NO: 1609518 - protein, 9 aa, Staphylococcus aureus
IGSNAGGIK

SEQ ID NO: 1609519 - protein, 4 aa, Staphylococcus aureus
IGTF

SEQ ID NO: 1609520 - protein, 7 aa, Staphylococcus aureus
INTDPEY

SEQ ID NO: 1609521 - protein, 4 aa, Staphylococcus aureus
IPKS

SEQ ID NO: 1609522 - protein, 17 aa, Staphylococcus aureus
IPSNHRPVTSDKNSKLI

SEQ ID NO: 1609523 - protein, 11 aa, Staphylococcus aureus
ISDDQSPSHIN

SEQ ID NO: 1609524 - protein, 7 aa, Staphylococcus aureus
ISDEEIN

SEQ ID NO: 1609525 - protein, 9 aa, Staphylococcus aureus
ISKEELDQT

SEQ ID NO: 1609526 - protein, 5 aa, Staphylococcus aureus
ISPDT

SEQ ID NO: 1609527 - protein, 6 aa, Staphylococcus aureus
ITDPGF

SEQ ID NO: 1609528 - protein, 9 aa, Staphylococcus aureus
ITKVPTTDV

SEQ ID NO: 1609529 - protein, 9 aa, Staphylococcus aureus
ITTEQPLKS

SEQ ID NO: 1609530 - protein, 5 aa, Staphylococcus aureus
KADNG

SEQ ID NO: 1609531 - protein, 4 aa, Staphylococcus aureus
KAFP

SEQ ID NO: 1609532 - protein, 11 aa, Staphylococcus aureus
KAFSENTKARF

SEQ ID NO: 1609533 - protein, 9 aa, Staphylococcus aureus
KARVPAGGA

SEQ ID NO: 1609534 - protein, 6 aa, Staphylococcus aureus
KDHEPV

SEQ ID NO: 1609535 - protein, 7 aa, Staphylococcus aureus
KDKIKQV

SEQ ID NO: 1609536 - protein, 4 aa, Staphylococcus aureus
KDLP

SEQ ID NO: 1609537 - protein, 6 aa, Staphylococcus aureus
KDPKRI

SEQ ID NO: 1609538 - protein, 8 aa, Staphylococcus aureus
KDSKVAPT

SEQ ID NO: 1609539 - protein, 11 aa, Staphylococcus aureus
KDYEENTPLEE

SEQ ID NO: 1609540 - protein, 15 aa, Staphylococcus aureus
KEALTDDNVEGVAGY

SEQ ID NO: 1609541 - protein, 10 aa, Staphylococcus aureus
KEDGSVEKFP

SEQ ID NO: 1609542 - protein, 7 aa, Staphylococcus aureus
KEEEAVS

SEQ ID NO: 1609543 - protein, 7 aa, Staphylococcus aureus
KEQPDAL

SEQ ID NO: 1609544 - protein, 6 aa, Staphylococcus aureus
KERTRL

SEQ ID NO: 1609545 - protein, 8 aa, Staphylococcus aureus
KGIGTQVD

SEQ ID NO: 1609546 - protein, 6 aa, Staphylococcus aureus
KGKNTL

SEQ ID NO: 1609547 - protein, 4 aa, Staphylococcus aureus
KGNL

SEQ ID NO: 1609548 - protein, 10 aa, Staphylococcus aureus
KGQMKQADRL

SEQ ID NO: 1609549 - protein, 4 aa, Staphylococcus aureus
KGRP

SEQ ID NO: 1609550 - protein, 4 aa, Staphylococcus aureus
KGTE

SEQ ID NO: 1609551 - protein, 11 aa, Staphylococcus aureus
KGVSKVNDQTN

SEQ ID NO: 1609552 - protein, 6 aa, Staphylococcus aureus
KGYMPD

SEQ ID NO: 1609553 - protein, 12 aa, Staphylococcus aureus
KGYQHKDQDFKR

SEQ ID NO: 1609554 - protein, 8 aa, Staphylococcus aureus
KHKGKDTY

SEQ ID NO: 1609555 - protein, 4 aa, Staphylococcus aureus
KIAA

SEQ ID NO: 1609556 - protein, 6 aa, Staphylococcus aureus
KIGNKT

SEQ ID NO: 1609557 - protein, 10 aa, Staphylococcus aureus
KIKYNTPKSV

SEQ ID NO: 1609558 - protein, 8 aa, Staphylococcus aureus
KKEASDKV

SEQ ID NO: 1609559 - protein, 7 aa, Staphylococcus aureus
KKEGQGC

SEQ ID NO: 1609560 - protein, 4 aa, Staphylococcus aureus
KKFT

SEQ ID NO: 1609561 - protein, 9 aa, Staphylococcus aureus
KKRSKDKPL

SEQ ID NO: 1609562 - protein, 11 aa, Staphylococcus aureus
KKTQTQSQDEL

SEQ ID NO: 1609563 - protein, 17 aa, Staphylococcus aureus
KKYAQTLKQTGGIGTVA

SEQ ID NO: 1609564 - protein, 5 aa, Staphylococcus aureus
KKYDR

SEQ ID NO: 1609565 - protein, 12 aa, Staphylococcus aureus
KLEYGDQLPSNL

SEQ ID NO: 1609566 - protein, 8 aa, Staphylococcus aureus
KNAEPGVG

SEQ ID NO: 1609567 - protein, 6 aa, Staphylococcus aureus
KNDEFD

SEQ ID NO: 1609568 - protein, 4 aa, Staphylococcus aureus
KNGR

SEQ ID NO: 1609569 - protein, 4 aa, Staphylococcus aureus
KNMN

SEQ ID NO: 1609570 - protein, 8 aa, Staphylococcus aureus
KNTESAKQ

SEQ ID NO: 1609571 - protein, 5 aa, Staphylococcus aureus
KNTFN

SEQ ID NO: 1609572 - protein, 4 aa, Staphylococcus aureus
KPYC

SEQ ID NO: 1609573 - protein, 8 aa, Staphylococcus aureus
KQKELAAE

SEQ ID NO: 1609574 - protein, 4 aa, Staphylococcus aureus
KQSG

SEQ ID NO: 1609575 - protein, 4 aa, Staphylococcus aureus
KRGI

SEQ ID NO: 1609576 - protein, 5 aa, Staphylococcus aureus
KRGLI

SEQ ID NO: 1609577 - protein, 7 aa, Staphylococcus aureus
KRNPREI

SEQ ID NO: 1609578 - protein, 15 aa, Staphylococcus aureus
KRQYETEESGTSYER

SEQ ID NO: 1609579 - protein, 8 aa, Staphylococcus aureus
KRSKNNED

SEQ ID NO: 1609580 - protein, 5 aa, Staphylococcus aureus
KRTPY

SEQ ID NO: 1609581 - protein, 6 aa, Staphylococcus aureus
KSAEHE

SEQ ID NO: 1609582 - protein, 6 aa, Staphylococcus aureus
KSGYEA

SEQ ID NO: 1609583 - protein, 8 aa, Staphylococcus aureus
KSKTEIKQ

SEQ ID NO: 1609584 - protein, 20 aa, Staphylococcus aureus
KSLNSIEESFDDNPETSWQA

SEQ ID NO: 1609585 - protein, 4 aa, Staphylococcus aureus
KTPF

SEQ ID NO: 1609586 - protein, 6 aa, Staphylococcus aureus
KTRKFK

SEQ ID NO: 1609587 - protein, 20 aa, Staphylococcus aureus
KTTEKAEARNISQKSAMRTA

SEQ ID NO: 1609588 - protein, 12 aa, Staphylococcus aureus
KVKPGTKLSNIG

SEQ ID NO: 1609589 - protein, 15 aa, Staphylococcus aureus
KVTPEKLNEGSTEIE

SEQ ID NO: 1609590 - protein, 4 aa, Staphylococcus aureus
KYEE

SEQ ID NO: 1609591 - protein, 9 aa, Staphylococcus aureus
KYKSAPSLP

SEQ ID NO: 1609592 - protein, 6 aa, Staphylococcus aureus
LASRGI

SEQ ID NO: 1609593 - protein, 5 aa, Staphylococcus aureus
LDKKA

SEQ ID NO: 1609594 - protein, 9 aa, Staphylococcus aureus
LEETPDTAD

SEQ ID NO: 1609595 - protein, 9 aa, Staphylococcus aureus
LEKNKGNET

SEQ ID NO: 1609596 - protein, 8 aa, Staphylococcus aureus
LENTPAAR

SEQ ID NO: 1609597 - protein, 14 aa, Staphylococcus aureus
LEQAIKDNEALSTG

SEQ ID NO: 1609598 - protein, 8 aa, Staphylococcus aureus
LERETKKI

SEQ ID NO: 1609599 - protein, 4 aa, Staphylococcus aureus
LGEN

SEQ ID NO: 1609600 - protein, 5 aa, Staphylococcus aureus
LKDNV

SEQ ID NO: 1609601 - protein, 6 aa, Staphylococcus aureus
LNENDQ

SEQ ID NO: 1609602 - protein, 4 aa, Staphylococcus aureus
LPDR

SEQ ID NO: 1609603 - protein, 4 aa, Staphylococcus aureus
LPGT

SEQ ID NO: 1609604 - protein, 5 aa, Staphylococcus aureus
LQGRK

SEQ ID NO: 1609605 - protein, 11 aa, Staphylococcus aureus
LQKNDKHQTSE

SEQ ID NO: 1609606 - protein, 7 aa, Staphylococcus aureus
LQTDENK

SEQ ID NO: 1609607 - protein, 4 aa, Staphylococcus aureus
LREE

SEQ ID NO: 1609608 - protein, 7 aa, Staphylococcus aureus
LRQNLEK

SEQ ID NO: 1609609 - protein, 10 aa, Staphylococcus aureus
LRRDSERKEF

SEQ ID NO: 1609610 - protein, 4 aa, Staphylococcus aureus
LSHG

SEQ ID NO: 1609611 - protein, 9 aa, Staphylococcus aureus
LSSKGNKNY

SEQ ID NO: 1609612 - protein, 4 aa, Staphylococcus aureus
LTMK

SEQ ID NO: 1609613 - protein, 4 aa, Staphylococcus aureus
LYGD

SEQ ID NO: 1609614 - protein, 4 aa, Staphylococcus aureus
MEEE

SEQ ID NO: 1609615 - protein, 4 aa, Staphylococcus aureus
MGPI

SEQ ID NO: 1609616 - protein, 8 aa, Staphylococcus aureus
MKADPLGD

SEQ ID NO: 1609617 - protein, 13 aa, Staphylococcus aureus
MRSRKYDKDGQTH

SEQ ID NO: 1609618 - protein, 8 aa, Staphylococcus aureus
MTTGEGIA

SEQ ID NO: 1609619 - protein, 6 aa, Staphylococcus aureus
NADGEI

SEQ ID NO: 1609620 - protein, 4 aa, Staphylococcus aureus
NAQE

SEQ ID NO: 1609621 - protein, 12 aa, Staphylococcus aureus
NATPGGVVKKGD

SEQ ID NO: 1609622 - protein, 4 aa, Staphylococcus aureus
NDDG

SEQ ID NO: 1609623 - protein, 6 aa, Staphylococcus aureus
NDDSIV

SEQ ID NO: 1609624 - protein, 4 aa, Staphylococcus aureus
NDEV

SEQ ID NO: 1609625 - protein, 4 aa, Staphylococcus aureus
NDPF

SEQ ID NO: 1609626 - protein, 14 aa, Staphylococcus aureus
NDTKKPSKQSVSEL

SEQ ID NO: 1609627 - protein, 7 aa, Staphylococcus aureus
NDVRADQ

SEQ ID NO: 1609628 - protein, 10 aa, Staphylococcus aureus
NEDEMTSEDY

SEQ ID NO: 1609629 - protein, 9 aa, Staphylococcus aureus
NENIDSKKF

SEQ ID NO: 1609630 - protein, 4 aa, Staphylococcus aureus
NEVQ

SEQ ID NO: 1609631 - protein, 5 aa, Staphylococcus aureus
NGDSV

SEQ ID NO: 1609632 - protein, 11 aa, Staphylococcus aureus
NGQLKQRPYPA

SEQ ID NO: 1609633 - protein, 10 aa, Staphylococcus aureus
NHKQVSKTEM

SEQ ID NO: 1609634 - protein, 12 aa, Staphylococcus aureus
NKEAKAFLEQYP

SEQ ID NO: 1609635 - protein, 8 aa, Staphylococcus aureus
NKGEKHPR

SEQ ID NO: 1609636 - protein, 4 aa, Staphylococcus aureus
NKLD

SEQ ID NO: 1609637 - protein, 8 aa, Staphylococcus aureus
NKLTKSEV

SEQ ID NO: 1609638 - protein, 11 aa, Staphylococcus aureus
NKTDHTQAPVG

SEQ ID NO: 1609639 - protein, 18 aa, Staphylococcus aureus
NKYPSELSGGQQQRTAAA

SEQ ID NO: 1609640 - protein, 4 aa, Staphylococcus aureus
NLDS

SEQ ID NO: 1609641 - protein, 6 aa, Staphylococcus aureus
NNATIK

SEQ ID NO: 1609642 - protein, 5 aa, Staphylococcus aureus
NNDGP

SEQ ID NO: 1609643 - protein, 9 aa, Staphylococcus aureus
NNKAETGFS

SEQ ID NO: 1609644 - protein, 6 aa, Staphylococcus aureus
NNKIQE

SEQ ID NO: 1609645 - protein, 8 aa, Staphylococcus aureus
NNPSKFEG

SEQ ID NO: 1609646 - protein, 9 aa, Staphylococcus aureus
NPNDERYKD

SEQ ID NO: 1609647 - protein, 15 aa, Staphylococcus aureus
NQDGTVITNDTLKGK

SEQ ID NO: 1609648 - protein, 9 aa, Staphylococcus aureus
NQKRNGYFE

SEQ ID NO: 1609649 - protein, 9 aa, Staphylococcus aureus
NREKEWKKR

SEQ ID NO: 1609650 - protein, 4 aa, Staphylococcus aureus
NRPT

SEQ ID NO: 1609651 - protein, 8 aa, Staphylococcus aureus
NSSTSGSP

SEQ ID NO: 1609652 - protein, 9 aa, Staphylococcus aureus
NSTDGEPCN

SEQ ID NO: 1609653 - protein, 7 aa, Staphylococcus aureus
NSTRTKC

SEQ ID NO: 1609654 - protein, 5 aa, Staphylococcus aureus
NSTSV

SEQ ID NO: 1609655 - protein, 5 aa, Staphylococcus aureus
NTDQT

SEQ ID NO: 1609656 - protein, 5 aa, Staphylococcus aureus
NTEKA

SEQ ID NO: 1609657 - protein, 5 aa, Staphylococcus aureus
NTLSE

SEQ ID NO: 1609658 - protein, 20 aa, Staphylococcus aureus
NVTVNDGKDLSQDAHAKDLE

SEQ ID NO: 1609659 - protein, 7 aa, Staphylococcus aureus
NYQGQGI

SEQ ID NO: 1609660 - protein, 11 aa, Staphylococcus aureus
PAEKVNKALDQ

SEQ ID NO: 1609661 - protein, 9 aa, Staphylococcus aureus
PDDDNVLNQ

SEQ ID NO: 1609662 - protein, 6 aa, Staphylococcus aureus
PEDQRK

SEQ ID NO: 1609663 - protein, 6 aa, Staphylococcus aureus
PEKAHG

SEQ ID NO: 1609664 - protein, 10 aa, Staphylococcus aureus
PEVPSEEDLS

SEQ ID NO: 1609665 - protein, 11 aa, Staphylococcus aureus
PGKPFGENGNR

SEQ ID NO: 1609666 - protein, 4 aa, Staphylococcus aureus
PINE

SEQ ID NO: 1609667 - protein, 6 aa, Staphylococcus aureus
PKECQE

SEQ ID NO: 1609668 - protein, 5 aa, Staphylococcus aureus
PKNQL

SEQ ID NO: 1609669 - protein, 11 aa, Staphylococcus aureus
PKPDGSEPNNW

SEQ ID NO: 1609670 - protein, 17 aa, Staphylococcus aureus
PKYVSSEQVSEEEINHE

SEQ ID NO: 1609671 - protein, 7 aa, Staphylococcus aureus
PLLGENG

SEQ ID NO: 1609672 - protein, 68 aa, Staphylococcus aureus
PLSRKGRNGKPSGSRNRNSKRGNPKFDSKSKRSKGYSSKKKSTKKFDRKEKSSGGSRPMKGRTFADHQ

SEQ ID NO: 1609673 - protein, 7 aa, Staphylococcus aureus
PLYGDST

SEQ ID NO: 1609674 - protein, 5 aa, Staphylococcus aureus
PNEEE

SEQ ID NO: 1609675 - protein, 4 aa, Staphylococcus aureus
PNEG

SEQ ID NO: 1609676 - protein, 7 aa, Staphylococcus aureus
PNPYSTS

SEQ ID NO: 1609677 - protein, 4 aa, Staphylococcus aureus
PNRT

SEQ ID NO: 1609678 - protein, 8 aa, Staphylococcus aureus
PSGESEKI

SEQ ID NO: 1609679 - protein, 7 aa, Staphylococcus aureus
PSRTISD

SEQ ID NO: 1609680 - protein, 10 aa, Staphylococcus aureus
PTDSGLAQIG

SEQ ID NO: 1609681 - protein, 10 aa, Staphylococcus aureus
PTKLTDRQKE

SEQ ID NO: 1609682 - protein, 5 aa, Staphylococcus aureus
PTMTS

SEQ ID NO: 1609683 - protein, 5 aa, Staphylococcus aureus
PTTGL

SEQ ID NO: 1609684 - protein, 4 aa, Staphylococcus aureus
QANV

SEQ ID NO: 1609685 - protein, 7 aa, Staphylococcus aureus
QASDKFG

SEQ ID NO: 1609686 - protein, 7 aa, Staphylococcus aureus
QATTTSW

SEQ ID NO: 1609687 - protein, 15 aa, Staphylococcus aureus
QDVKTHSEEQRVTAK

SEQ ID NO: 1609688 - protein, 6 aa, Staphylococcus aureus
QDVPAG

SEQ ID NO: 1609689 - protein, 7 aa, Staphylococcus aureus
QEEDAEF

SEQ ID NO: 1609690 - protein, 14 aa, Staphylococcus aureus
QEGIKSNKTKVGDR

SEQ ID NO: 1609691 - protein, 8 aa, Staphylococcus aureus
QFTEKSKH

SEQ ID NO: 1609692 - protein, 20 aa, Staphylococcus aureus
QGGTIETIRPTTISDPVYEE

SEQ ID NO: 1609693 - protein, 13 aa, Staphylococcus aureus
QGLVTAKKKDSTG

SEQ ID NO: 1609694 - protein, 6 aa, Staphylococcus aureus
QGMENG

SEQ ID NO: 1609695 - protein, 5 aa, Staphylococcus aureus
QGRTI

SEQ ID NO: 1609696 - protein, 6 aa, Staphylococcus aureus
QGYSVE

SEQ ID NO: 1609697 - protein, 13 aa, Staphylococcus aureus
QKANAFNSGFPAS

SEQ ID NO: 1609698 - protein, 11 aa, Staphylococcus aureus
QLGAKKDRYPI

SEQ ID NO: 1609699 - protein, 6 aa, Staphylococcus aureus
QLTPET

SEQ ID NO: 1609700 - protein, 9 aa, Staphylococcus aureus
QNAIDTEGR

SEQ ID NO: 1609701 - protein, 7 aa, Staphylococcus aureus
QNINDSH

SEQ ID NO: 1609702 - protein, 6 aa, Staphylococcus aureus
QNQTIK

SEQ ID NO: 1609703 - protein, 8 aa, Staphylococcus aureus
QQSSDTTY

SEQ ID NO: 1609704 - protein, 6 aa, Staphylococcus aureus
QRGGQG

SEQ ID NO: 1609705 - protein, 6 aa, Staphylococcus aureus
QRLSQS

SEQ ID NO: 1609706 - protein, 9 aa, Staphylococcus aureus
QSPFQMSGG

SEQ ID NO: 1609707 - protein, 4 aa, Staphylococcus aureus
QSSD

SEQ ID NO: 1609708 - protein, 8 aa, Staphylococcus aureus
QYGKETDG

SEQ ID NO: 1609709 - protein, 4 aa, Staphylococcus aureus
QYTQ

SEQ ID NO: 1609710 - protein, 5 aa, Staphylococcus aureus
RALDG

SEQ ID NO: 1609711 - protein, 14 aa, Staphylococcus aureus
RALNEAQEVTKSLP

SEQ ID NO: 1609712 - protein, 7 aa, Staphylococcus aureus
RAQSKDI

SEQ ID NO: 1609713 - protein, 4 aa, Staphylococcus aureus
RARL

SEQ ID NO: 1609714 - protein, 13 aa, Staphylococcus aureus
RDKSPAVRRTAGD

SEQ ID NO: 1609715 - protein, 24 aa, Staphylococcus aureus
RDPRMKERKKPGLKAARRSPQFSK

SEQ ID NO: 1609716 - protein, 9 aa, Staphylococcus aureus
RDRRQRKRD

SEQ ID NO: 1609717 - protein, 9 aa, Staphylococcus aureus
RDTSKLEKV

SEQ ID NO: 1609718 - protein, 6 aa, Staphylococcus aureus
REHKQT

SEQ ID NO: 1609719 - protein, 7 aa, Staphylococcus aureus
RETTVQS

SEQ ID NO: 1609720 - protein, 11 aa, Staphylococcus aureus
RGKERSRRPED

SEQ ID NO: 1609721 - protein, 4 aa, Staphylococcus aureus
RHGR

SEQ ID NO: 1609722 - protein, 4 aa, Staphylococcus aureus
RKDN

SEQ ID NO: 1609723 - protein, 8 aa, Staphylococcus aureus
RKIGPKDR

SEQ ID NO: 1609724 - protein, 6 aa, Staphylococcus aureus
RKQTRQ

SEQ ID NO: 1609725 - protein, 8 aa, Staphylococcus aureus
RKRDNKSF

SEQ ID NO: 1609726 - protein, 8 aa, Staphylococcus aureus
RLKEQGAN

SEQ ID NO: 1609727 - protein, 8 aa, Staphylococcus aureus
RLKSDPSF

SEQ ID NO: 1609728 - protein, 10 aa, Staphylococcus aureus
RNEEADDSVT

SEQ ID NO: 1609729 - protein, 5 aa, Staphylococcus aureus
RNEIT

SEQ ID NO: 1609730 - protein, 4 aa, Staphylococcus aureus
RPGY

SEQ ID NO: 1609731 - protein, 5 aa, Staphylococcus aureus
RPPGH

SEQ ID NO: 1609732 - protein, 6 aa, Staphylococcus aureus
RQNNYE

SEQ ID NO: 1609733 - protein, 4 aa, Staphylococcus aureus
RQQM

SEQ ID NO: 1609734 - protein, 9 aa, Staphylococcus aureus
RQYISSNTE

SEQ ID NO: 1609735 - protein, 16 aa, Staphylococcus aureus
RRIQKENEINKTYQAQ

SEQ ID NO: 1609736 - protein, 13 aa, Staphylococcus aureus
RSGDYARNNKKLR

SEQ ID NO: 1609737 - protein, 12 aa, Staphylococcus aureus
RSRHKDAEADFN

SEQ ID NO: 1609738 - protein, 11 aa, Staphylococcus aureus
RSVSKSGTIQE

SEQ ID NO: 1609739 - protein, 7 aa, Staphylococcus aureus
RTAGVSE

SEQ ID NO: 1609740 - protein, 6 aa, Staphylococcus aureus
RVEKSI

SEQ ID NO: 1609741 - protein, 9 aa, Staphylococcus aureus
RVGRSDQQS

SEQ ID NO: 1609742 - protein, 9 aa, Staphylococcus aureus
RVTNQEELE

SEQ ID NO: 1609743 - protein, 4 aa, Staphylococcus aureus
SATG

SEQ ID NO: 1609744 - protein, 9 aa, Staphylococcus aureus
SDALSAVED

SEQ ID NO: 1609745 - protein, 4 aa, Staphylococcus aureus
SDNF

SEQ ID NO: 1609746 - protein, 6 aa, Staphylococcus aureus
SDQEYE

SEQ ID NO: 1609747 - protein, 12 aa, Staphylococcus aureus
SDQYQSSTRFKR

SEQ ID NO: 1609748 - protein, 12 aa, Staphylococcus aureus
SEAPGAGKSTIA

SEQ ID NO: 1609749 - protein, 5 aa, Staphylococcus aureus
SEEVA

SEQ ID NO: 1609750 - protein, 9 aa, Staphylococcus aureus
SEGTAYRAI

SEQ ID NO: 1609751 - protein, 8 aa, Staphylococcus aureus
SEIRKHDP

SEQ ID NO: 1609752 - protein, 4 aa, Staphylococcus aureus
SEKQ

SEQ ID NO: 1609753 - protein, 4 aa, Staphylococcus aureus
SEMT

SEQ ID NO: 1609754 - protein, 8 aa, Staphylococcus aureus
SEREASDI

SEQ ID NO: 1609755 - protein, 9 aa, Staphylococcus aureus
SESGTGAGV

SEQ ID NO: 1609756 - protein, 4 aa, Staphylococcus aureus
SETQ

SEQ ID NO: 1609757 - protein, 6 aa, Staphylococcus aureus
SEWQED

SEQ ID NO: 1609758 - protein, 12 aa, Staphylococcus aureus
SGAQNTLVGKKL

SEQ ID NO: 1609759 - protein, 15 aa, Staphylococcus aureus
SGEYSMTKAAAQNGW

SEQ ID NO: 1609760 - protein, 11 aa, Staphylococcus aureus
SGKGGVGKSTV

SEQ ID NO: 1609761 - protein, 6 aa, Staphylococcus aureus
SGLAPE

SEQ ID NO: 1609762 - protein, 4 aa, Staphylococcus aureus
SGWE

SEQ ID NO: 1609763 - protein, 8 aa, Staphylococcus aureus
SHESGIHQ

SEQ ID NO: 1609764 - protein, 5 aa, Staphylococcus aureus
SHIPD

SEQ ID NO: 1609765 - protein, 7 aa, Staphylococcus aureus
SHRGQGM

SEQ ID NO: 1609766 - protein, 5 aa, Staphylococcus aureus
SINNE

SEQ ID NO: 1609767 - protein, 6 aa, Staphylococcus aureus
SKETGV

SEQ ID NO: 1609768 - protein, 10 aa, Staphylococcus aureus
SKKETLAKEP

SEQ ID NO: 1609769 - protein, 11 aa, Staphylococcus aureus
SKNQPVGRRSL

SEQ ID NO: 1609770 - protein, 7 aa, Staphylococcus aureus
SKRHQTI

SEQ ID NO: 1609771 - protein, 18 aa, Staphylococcus aureus
SKSENIEKTVNRFKDFFN

SEQ ID NO: 1609772 - protein, 7 aa, Staphylococcus aureus
SKTHTDP

SEQ ID NO: 1609773 - protein, 10 aa, Staphylococcus aureus
SMDNKEVKRW

SEQ ID NO: 1609774 - protein, 7 aa, Staphylococcus aureus
SMSTQEI

SEQ ID NO: 1609775 - protein, 8 aa, Staphylococcus aureus
SNIGSEFS

SEQ ID NO: 1609776 - protein, 15 aa, Staphylococcus aureus
SNKADRIKSQLMTAN

SEQ ID NO: 1609777 - protein, 18 aa, Staphylococcus aureus
SNRPKQSHLTKKERLADE

SEQ ID NO: 1609778 - protein, 10 aa, Staphylococcus aureus
SPEAASGGPI

SEQ ID NO: 1609779 - protein, 11 aa, Staphylococcus aureus
SPKSEKADELI

SEQ ID NO: 1609780 - protein, 9 aa, Staphylococcus aureus
SPKSQNNEI

SEQ ID NO: 1609781 - protein, 18 aa, Staphylococcus aureus
SPNPTTAATTEISYGDES

SEQ ID NO: 1609782 - protein, 7 aa, Staphylococcus aureus
SPVNDEL

SEQ ID NO: 1609783 - protein, 5 aa, Staphylococcus aureus
SQTTV

SEQ ID NO: 1609784 - protein, 4 aa, Staphylococcus aureus
SRGY

SEQ ID NO: 1609785 - protein, 6 aa, Staphylococcus aureus
SSKPLI

SEQ ID NO: 1609786 - protein, 9 aa, Staphylococcus aureus
SSQIEQQEK

SEQ ID NO: 1609787 - protein, 8 aa, Staphylococcus aureus
SSRGLSTR

SEQ ID NO: 1609788 - protein, 8 aa, Staphylococcus aureus
SSSQYGGC

SEQ ID NO: 1609789 - protein, 11 aa, Staphylococcus aureus
SSYGSTHKADA

SEQ ID NO: 1609790 - protein, 4 aa, Staphylococcus aureus
SVGK

SEQ ID NO: 1609791 - protein, 10 aa, Staphylococcus aureus
SVPNKQNIQD

SEQ ID NO: 1609792 - protein, 8 aa, Staphylococcus aureus
SWNKPGRQ

SEQ ID NO: 1609793 - protein, 6 aa, Staphylococcus aureus
SYPPET

SEQ ID NO: 1609794 - protein, 4 aa, Staphylococcus aureus
TAET

SEQ ID NO: 1609795 - protein, 8 aa, Staphylococcus aureus
TANTNGEK

SEQ ID NO: 1609796 - protein, 11 aa, Staphylococcus aureus
TARESNPKHQE

SEQ ID NO: 1609797 - protein, 5 aa, Staphylococcus aureus
TDEDW

SEQ ID NO: 1609798 - protein, 9 aa, Staphylococcus aureus
TDIEKTDEA

SEQ ID NO: 1609799 - protein, 7 aa, Staphylococcus aureus
TDLGENC

SEQ ID NO: 1609800 - protein, 7 aa, Staphylococcus aureus
TDQAPVL

SEQ ID NO: 1609801 - protein, 17 aa, Staphylococcus aureus
TEEDKQQIATLEESNSQ

SEQ ID NO: 1609802 - protein, 7 aa, Staphylococcus aureus
TEINGSH

SEQ ID NO: 1609803 - protein, 14 aa, Staphylococcus aureus
TGDPSKVGHLPGAT

SEQ ID NO: 1609804 - protein, 14 aa, Staphylococcus aureus
TGDVTDTDLIMEKE

SEQ ID NO: 1609805 - protein, 9 aa, Staphylococcus aureus
TGGYGQDLK

SEQ ID NO: 1609806 - protein, 8 aa, Staphylococcus aureus
TGIKQSKH

SEQ ID NO: 1609807 - protein, 11 aa, Staphylococcus aureus
TGKSSTSEDAN

SEQ ID NO: 1609808 - protein, 6 aa, Staphylococcus aureus
TGSQRV

SEQ ID NO: 1609809 - protein, 8 aa, Staphylococcus aureus
THPHYKPS

SEQ ID NO: 1609810 - protein, 6 aa, Staphylococcus aureus
TIDDVS

SEQ ID NO: 1609811 - protein, 10 aa, Staphylococcus aureus
TIETNEDFDT

SEQ ID NO: 1609812 - protein, 12 aa, Staphylococcus aureus
TINEETEPELYD

SEQ ID NO: 1609813 - protein, 6 aa, Staphylococcus aureus
TKADSY

SEQ ID NO: 1609814 - protein, 4 aa, Staphylococcus aureus
TKDA

SEQ ID NO: 1609815 - protein, 4 aa, Staphylococcus aureus
TKSI

SEQ ID NO: 1609816 - protein, 8 aa, Staphylococcus aureus
TKSMPERN

SEQ ID NO: 1609817 - protein, 7 aa, Staphylococcus aureus
TLTGSDG

SEQ ID NO: 1609818 - protein, 8 aa, Staphylococcus aureus
TNDGHTKK

SEQ ID NO: 1609819 - protein, 5 aa, Staphylococcus aureus
TNHTE

SEQ ID NO: 1609820 - protein, 10 aa, Staphylococcus aureus
TNNEDGIPNT

SEQ ID NO: 1609821 - protein, 5 aa, Staphylococcus aureus
TPNKV

SEQ ID NO: 1609822 - protein, 7 aa, Staphylococcus aureus
TPPGSFG

SEQ ID NO: 1609823 - protein, 10 aa, Staphylococcus aureus
TQGVTAQGKD

SEQ ID NO: 1609824 - protein, 10 aa, Staphylococcus aureus
TREKDKDDKR

SEQ ID NO: 1609825 - protein, 7 aa, Staphylococcus aureus
TRGTEKE

SEQ ID NO: 1609826 - protein, 6 aa, Staphylococcus aureus
TSQYEA

SEQ ID NO: 1609827 - protein, 7 aa, Staphylococcus aureus
TSRPSYI

SEQ ID NO: 1609828 - protein, 6 aa, Staphylococcus aureus
TSTINS

SEQ ID NO: 1609829 - protein, 5 aa, Staphylococcus aureus
TTDEL

SEQ ID NO: 1609830 - protein, 9 aa, Staphylococcus aureus
TTERAPYPY

SEQ ID NO: 1609831 - protein, 16 aa, Staphylococcus aureus
TTPNQDNPLTEGKTPI

SEQ ID NO: 1609832 - protein, 6 aa, Staphylococcus aureus
TTTSEI

SEQ ID NO: 1609833 - protein, 12 aa, Staphylococcus aureus
TTYQQRIRIQEV

SEQ ID NO: 1609834 - protein, 14 aa, Staphylococcus aureus
VAETGAGQHGVASA

SEQ ID NO: 1609835 - protein, 7 aa, Staphylococcus aureus
VAGGGTA

SEQ ID NO: 1609836 - protein, 11 aa, Staphylococcus aureus
VASNKGLRQSL

SEQ ID NO: 1609837 - protein, 6 aa, Staphylococcus aureus
VDADKA

SEQ ID NO: 1609838 - protein, 5 aa, Staphylococcus aureus
VDITN

SEQ ID NO: 1609839 - protein, 8 aa, Staphylococcus aureus
VDPAANPY

SEQ ID NO: 1609840 - protein, 6 aa, Staphylococcus aureus
VDSNKL

SEQ ID NO: 1609841 - protein, 7 aa, Staphylococcus aureus
VEAGRYE

SEQ ID NO: 1609842 - protein, 4 aa, Staphylococcus aureus
VEPG

SEQ ID NO: 1609843 - protein, 5 aa, Staphylococcus aureus
VGGRY

SEQ ID NO: 1609844 - protein, 10 aa, Staphylococcus aureus
VKSSDDNTTV

SEQ ID NO: 1609845 - protein, 6 aa, Staphylococcus aureus
VNAAGP

SEQ ID NO: 1609846 - protein, 10 aa, Staphylococcus aureus
VNQDTDNIGA

SEQ ID NO: 1609847 - protein, 6 aa, Staphylococcus aureus
VPAAIK

SEQ ID NO: 1609848 - protein, 19 aa, Staphylococcus aureus
VPRGTGRVRNMPTAAHTKD

SEQ ID NO: 1609849 - protein, 11 aa, Staphylococcus aureus
VPTLDKNKNHT

SEQ ID NO: 1609850 - protein, 5 aa, Staphylococcus aureus
VQDPL

SEQ ID NO: 1609851 - protein, 4 aa, Staphylococcus aureus
VSGI

SEQ ID NO: 1609852 - protein, 14 aa, Staphylococcus aureus
VSKDGKDNLAPYSQ

SEQ ID NO: 1609853 - protein, 12 aa, Staphylococcus aureus
VSTQQVAQSGRY

SEQ ID NO: 1609854 - protein, 6 aa, Staphylococcus aureus
YDSRDY

SEQ ID NO: 1609855 - protein, 4 aa, Staphylococcus aureus
YEGY

SEQ ID NO: 1609856 - protein, 5 aa, Staphylococcus aureus
YEVTK

SEQ ID NO: 1609857 - protein, 4 aa, Staphylococcus aureus
YGNP

SEQ ID NO: 1609858 - protein, 5 aa, Staphylococcus aureus
YKDKS

SEQ ID NO: 1609859 - protein, 12 aa, Staphylococcus aureus
YNPNSPHKAGLQ

SEQ ID NO: 1609860 - protein, 5 aa, Staphylococcus aureus
YPESQ

SEQ ID NO: 1609861 - protein, 11 aa, Staphylococcus aureus
YPPQTLTEDEL

SEQ ID NO: 1609862 - protein, 7 aa, Staphylococcus aureus
YQNAAEH

SEQ ID NO: 1609863 - protein, 12 aa, Staphylococcus aureus
YRRDSDDATHSH

SEQ ID NO: 1609864 - protein, 13 aa, Staphylococcus aureus
YSDNIKTYESHGD

SEQ ID NO: 1609865 - protein, 4 aa, Staphylococcus aureus
YSET

SEQ ID NO: 1609866 - protein, 6 aa, Staphylococcus aureus
YSKREL

SEQ ID NO: 1609867 - protein, 9 aa, Staphylococcus aureus
YWRGDSNNK

SEQ ID NO: 1609868 - protein, 4 aa, Staphylococcus aureus
AASL

SEQ ID NO: 1609869 - protein, 4 aa, Staphylococcus aureus
ADEQ

SEQ ID NO: 1609870 - protein, 16 aa, Staphylococcus aureus
ADKVSLNSSALKNPQL

SEQ ID NO: 1609871 - protein, 6 aa, Staphylococcus aureus
AEENNL

SEQ ID NO: 1609872 - protein, 18 aa, Staphylococcus aureus
AEYKHTHKHRGTSKGADV

SEQ ID NO: 1609873 - protein, 5 aa, Staphylococcus aureus
AGKEN

SEQ ID NO: 1609874 - protein, 10 aa, Staphylococcus aureus
AGTTVSRASL

SEQ ID NO: 1609875 - protein, 14 aa, Staphylococcus aureus
AHGSGVMGKGAGTV

SEQ ID NO: 1609876 - protein, 13 aa, Staphylococcus aureus
AKAEYNDQHSQFP

SEQ ID NO: 1609877 - protein, 8 aa, Staphylococcus aureus
AKDEGVTS

SEQ ID NO: 1609878 - protein, 5 aa, Staphylococcus aureus
AKEAE

SEQ ID NO: 1609879 - protein, 6 aa, Staphylococcus aureus
AKIPTH

SEQ ID NO: 1609880 - protein, 7 aa, Staphylococcus aureus
AKQLDTA

SEQ ID NO: 1609881 - protein, 6 aa, Staphylococcus aureus
AKQLPQ

SEQ ID NO: 1609882 - protein, 6 aa, Staphylococcus aureus
AKSNIG

SEQ ID NO: 1609883 - protein, 5 aa, Staphylococcus aureus
AKTMG

SEQ ID NO: 1609884 - protein, 7 aa, Staphylococcus aureus
ALKSQGM

SEQ ID NO: 1609885 - protein, 10 aa, Staphylococcus aureus
ALSQLTSSSL

SEQ ID NO: 1609886 - protein, 9 aa, Staphylococcus aureus
ANYPLNEGQ

SEQ ID NO: 1609887 - protein, 9 aa, Staphylococcus aureus
APDRNRVDG

SEQ ID NO: 1609888 - protein, 16 aa, Staphylococcus aureus
APQKKPVQIEREIEKL

SEQ ID NO: 1609889 - protein, 6 aa, Staphylococcus aureus
ARHNRQ

SEQ ID NO: 1609890 - protein, 13 aa, Staphylococcus aureus
ARRQPEEKRQDIR

SEQ ID NO: 1609891 - protein, 4 aa, Staphylococcus aureus
ASDE

SEQ ID NO: 1609892 - protein, 9 aa, Staphylococcus aureus
ASLNGTELE

SEQ ID NO: 1609893 - protein, 4 aa, Staphylococcus aureus
ASLS

SEQ ID NO: 1609894 - protein, 15 aa, Staphylococcus aureus
ASQGAKVTSSVTKNT

SEQ ID NO: 1609895 - protein, 8 aa, Staphylococcus aureus
ASTVEAQE

SEQ ID NO: 1609896 - protein, 6 aa, Staphylococcus aureus
AYRIPN

SEQ ID NO: 1609897 - protein, 11 aa, Staphylococcus aureus
CHGKGTENKTV

SEQ ID NO: 1609898 - protein, 7 aa, Staphylococcus aureus
CNNQSPK

SEQ ID NO: 1609899 - protein, 18 aa, Staphylococcus aureus
DANQVNYAASQKEALQTA

SEQ ID NO: 1609900 - protein, 7 aa, Staphylococcus aureus
DDERASQ

SEQ ID NO: 1609901 - protein, 6 aa, Staphylococcus aureus
DDNNKV

SEQ ID NO: 1609902 - protein, 6 aa, Staphylococcus aureus
DEDNDI

SEQ ID NO: 1609903 - protein, 7 aa, Staphylococcus aureus
DEESDWK

SEQ ID NO: 1609904 - protein, 7 aa, Staphylococcus aureus
DEKEQGV

SEQ ID NO: 1609905 - protein, 7 aa, Staphylococcus aureus
DEVTKEV

SEQ ID NO: 1609906 - protein, 13 aa, Staphylococcus aureus
DFGDPFGGGFGFF

SEQ ID NO: 1609907 - protein, 9 aa, Staphylococcus aureus
DGDGTGRRI

SEQ ID NO: 1609908 - protein, 7 aa, Staphylococcus aureus
DGHTLTT

SEQ ID NO: 1609909 - protein, 6 aa, Staphylococcus aureus
DGNHDQ

SEQ ID NO: 1609910 - protein, 7 aa, Staphylococcus aureus
DGTDYSS

SEQ ID NO: 1609911 - protein, 6 aa, Staphylococcus aureus
DGVMPQ

SEQ ID NO: 1609912 - protein, 7 aa, Staphylococcus aureus
DKEVENT

SEQ ID NO: 1609913 - protein, 5 aa, Staphylococcus aureus
DKEYS

SEQ ID NO: 1609914 - protein, 4 aa, Staphylococcus aureus
DKGT

SEQ ID NO: 1609915 - protein, 6 aa, Staphylococcus aureus
DKLKED

SEQ ID NO: 1609916 - protein, 15 aa, Staphylococcus aureus
DMNEIEKQLKIKFFS

SEQ ID NO: 1609917 - protein, 8 aa, Staphylococcus aureus
DNDSRDSF

SEQ ID NO: 1609918 - protein, 8 aa, Staphylococcus aureus
DNIPKDSK

SEQ ID NO: 1609919 - protein, 7 aa, Staphylococcus aureus
DNKRSHD

SEQ ID NO: 1609920 - protein, 5 aa, Staphylococcus aureus
DNPNI

SEQ ID NO: 1609921 - protein, 7 aa, Staphylococcus aureus
DNYGAGQ

SEQ ID NO: 1609922 - protein, 6 aa, Staphylococcus aureus
DNYRGY

SEQ ID NO: 1609923 - protein, 7 aa, Staphylococcus aureus
DPAARST

SEQ ID NO: 1609924 - protein, 8 aa, Staphylococcus aureus
DPFKKADQ

SEQ ID NO: 1609925 - protein, 6 aa, Staphylococcus aureus
DPGNYK

SEQ ID NO: 1609926 - protein, 4 aa, Staphylococcus aureus
DPTL

SEQ ID NO: 1609927 - protein, 10 aa, Staphylococcus aureus
DSLSQEQEVT

SEQ ID NO: 1609928 - protein, 6 aa, Staphylococcus aureus
DTVKSK

SEQ ID NO: 1609929 - protein, 7 aa, Staphylococcus aureus
DYQPNQF

SEQ ID NO: 1609930 - protein, 9 aa, Staphylococcus aureus
DYVPVSQPQ

SEQ ID NO: 1609931 - protein, 8 aa, Staphylococcus aureus
EAEAVPDH

SEQ ID NO: 1609932 - protein, 14 aa, Staphylococcus aureus
EAGNLDQYDISGQG

SEQ ID NO: 1609933 - protein, 10 aa, Staphylococcus aureus
EAQEGSEKKQ

SEQ ID NO: 1609934 - protein, 9 aa, Staphylococcus aureus
EASNGQEAY

SEQ ID NO: 1609935 - protein, 5 aa, Staphylococcus aureus
EASQY

SEQ ID NO: 1609936 - protein, 4 aa, Staphylococcus aureus
EASV

SEQ ID NO: 1609937 - protein, 9 aa, Staphylococcus aureus
EDLQQYPKI

SEQ ID NO: 1609938 - protein, 7 aa, Staphylococcus aureus
EDTDTKV

SEQ ID NO: 1609939 - protein, 18 aa, Staphylococcus aureus
EDVTPKDFGRVGAQAAKQ

SEQ ID NO: 1609940 - protein, 11 aa, Staphylococcus aureus
EEADQYKGTIH

SEQ ID NO: 1609941 - protein, 9 aa, Staphylococcus aureus
EEPPISVKD

SEQ ID NO: 1609942 - protein, 18 aa, Staphylococcus aureus
EESEESFEDIAEDLIDFD

SEQ ID NO: 1609943 - protein, 5 aa, Staphylococcus aureus
EEVPE

SEQ ID NO: 1609944 - protein, 6 aa, Staphylococcus aureus
EFEPSD

SEQ ID NO: 1609945 - protein, 11 aa, Staphylococcus aureus
EGAGGGHAPDL

SEQ ID NO: 1609946 - protein, 7 aa, Staphylococcus aureus
EGKPAVD

SEQ ID NO: 1609947 - protein, 21 aa, Staphylococcus aureus
EGKTPETLKKTFDSQRKRNIN

SEQ ID NO: 1609948 - protein, 7 aa, Staphylococcus aureus
EGKYSES

SEQ ID NO: 1609949 - protein, 5 aa, Staphylococcus aureus
EIKQF

SEQ ID NO: 1609950 - protein, 7 aa, Staphylococcus aureus
EISQPNI

SEQ ID NO: 1609951 - protein, 8 aa, Staphylococcus aureus
EKEYTGKE

SEQ ID NO: 1609952 - protein, 7 aa, Staphylococcus aureus
EKGQSQM

SEQ ID NO: 1609953 - protein, 7 aa, Staphylococcus aureus
EKLDPDA

SEQ ID NO: 1609954 - protein, 12 aa, Staphylococcus aureus
EKPPIPGRTNST

SEQ ID NO: 1609955 - protein, 17 aa, Staphylococcus aureus
ELKTKDKNLDGNDIREG

SEQ ID NO: 1609956 - protein, 6 aa, Staphylococcus aureus
ELSGGM

SEQ ID NO: 1609957 - protein, 21 aa, Staphylococcus aureus
EMQQQRDRARQARQNSQSMQV

SEQ ID NO: 1609958 - protein, 4 aa, Staphylococcus aureus
EMSE

SEQ ID NO: 1609959 - protein, 9 aa, Staphylococcus aureus
ENASTGSYT

SEQ ID NO: 1609960 - protein, 14 aa, Staphylococcus aureus
ENDYEDNKDPEFRR

SEQ ID NO: 1609961 - protein, 9 aa, Staphylococcus aureus
ENEDKVPYY

SEQ ID NO: 1609962 - protein, 6 aa, Staphylococcus aureus
ENEDVN

SEQ ID NO: 1609963 - protein, 10 aa, Staphylococcus aureus
EPYPISGSHG

SEQ ID NO: 1609964 - protein, 5 aa, Staphylococcus aureus
EQGAV

SEQ ID NO: 1609965 - protein, 4 aa, Staphylococcus aureus
EQGI

SEQ ID NO: 1609966 - protein, 8 aa, Staphylococcus aureus
ERAGNAPI

SEQ ID NO: 1609967 - protein, 6 aa, Staphylococcus aureus
ERSVEA

SEQ ID NO: 1609968 - protein, 6 aa, Staphylococcus aureus
ESAASG

SEQ ID NO: 1609969 - protein, 6 aa, Staphylococcus aureus
ESDLKE

SEQ ID NO: 1609970 - protein, 6 aa, Staphylococcus aureus
ESFGAK

SEQ ID NO: 1609971 - protein, 6 aa, Staphylococcus aureus
ESGENK

SEQ ID NO: 1609972 - protein, 14 aa, Staphylococcus aureus
ESLKESQDKNDVDL

SEQ ID NO: 1609973 - protein, 5 aa, Staphylococcus aureus
ESSHA

SEQ ID NO: 1609974 - protein, 4 aa, Staphylococcus aureus
EVHP

SEQ ID NO: 1609975 - protein, 15 aa, Staphylococcus aureus
EWATPNKIVEALEEL

SEQ ID NO: 1609976 - protein, 7 aa, Staphylococcus aureus
FGGPKGV

SEQ ID NO: 1609977 - protein, 8 aa, Staphylococcus aureus
FGGYDGKG

SEQ ID NO: 1609978 - protein, 27 aa, Staphylococcus aureus
FGNKASSLTVQKHGAQASIPLLEEVNQ

SEQ ID NO: 1609979 - protein, 18 aa, Staphylococcus aureus
FGQKQEHSAREMTNEEIE

SEQ ID NO: 1609980 - protein, 8 aa, Staphylococcus aureus
FRNSNEYP

SEQ ID NO: 1609981 - protein, 10 aa, Staphylococcus aureus
FSDEDGIRAA

SEQ ID NO: 1609982 - protein, 6 aa, Staphylococcus aureus
FSTNGD

SEQ ID NO: 1609983 - protein, 4 aa, Staphylococcus aureus
GAEY

SEQ ID NO: 1609984 - protein, 14 aa, Staphylococcus aureus
GASVYSASEIARDE

SEQ ID NO: 1609985 - protein, 15 aa, Staphylococcus aureus
GDTANDMKTASNANL

SEQ ID NO: 1609986 - protein, 4 aa, Staphylococcus aureus
GDTK

SEQ ID NO: 1609987 - protein, 5 aa, Staphylococcus aureus
GEDKT

SEQ ID NO: 1609988 - protein, 10 aa, Staphylococcus aureus
GESGSGKSIT

SEQ ID NO: 1609989 - protein, 5 aa, Staphylococcus aureus
GGNTN

SEQ ID NO: 1609990 - protein, 12 aa, Staphylococcus aureus
GGNTNYQDTIRR

SEQ ID NO: 1609991 - protein, 4 aa, Staphylococcus aureus
GGQF

SEQ ID NO: 1609992 - protein, 7 aa, Staphylococcus aureus
GGVDSSV

SEQ ID NO: 1609993 - protein, 40 aa, Staphylococcus aureus
GHDDDSSSKEEPAKEEAPAEQAPVATQTEEVDENRTVKAM

SEQ ID NO: 1609994 - protein, 4 aa, Staphylococcus aureus
GHGS

SEQ ID NO: 1609995 - protein, 5 aa, Staphylococcus aureus
GIEET

SEQ ID NO: 1609996 - protein, 10 aa, Staphylococcus aureus
GINQSKSNQL

SEQ ID NO: 1609997 - protein, 14 aa, Staphylococcus aureus
GISGSYQSSYQAGE

SEQ ID NO: 1609998 - protein, 7 aa, Staphylococcus aureus
GKAREVI

SEQ ID NO: 1609999 - protein, 9 aa, Staphylococcus aureus
GKDQSSRRD

SEQ ID NO: 1610000 - protein, 4 aa, Staphylococcus aureus
GKEA

SEQ ID NO: 1610001 - protein, 10 aa, Staphylococcus aureus
GKGLNATTAL

SEQ ID NO: 1610002 - protein, 8 aa, Staphylococcus aureus
GKGQVGRV

SEQ ID NO: 1610003 - protein, 10 aa, Staphylococcus aureus
GKGQVQDAGA

SEQ ID NO: 1610004 - protein, 4 aa, Staphylococcus aureus
GKIE

SEQ ID NO: 1610005 - protein, 8 aa, Staphylococcus aureus
GKPAKIDD

SEQ ID NO: 1610006 - protein, 9 aa, Staphylococcus aureus
GKVEYRAEK

SEQ ID NO: 1610007 - protein, 6 aa, Staphylococcus aureus
GNDLEE

SEQ ID NO: 1610008 - protein, 7 aa, Staphylococcus aureus
GNGSHTI

SEQ ID NO: 1610009 - protein, 6 aa, Staphylococcus aureus
GNPEEY

SEQ ID NO: 1610010 - protein, 5 aa, Staphylococcus aureus
GPDME

SEQ ID NO: 1610011 - protein, 9 aa, Staphylococcus aureus
GQGQEATQI

SEQ ID NO: 1610012 - protein, 9 aa, Staphylococcus aureus
GRLSPSSLG

SEQ ID NO: 1610013 - protein, 4 aa, Staphylococcus aureus
GRQH

SEQ ID NO: 1610014 - protein, 7 aa, Staphylococcus aureus
GRSDEQL

SEQ ID NO: 1610015 - protein, 8 aa, Staphylococcus aureus
GRYSGRID

SEQ ID NO: 1610016 - protein, 4 aa, Staphylococcus aureus
GSFK

SEQ ID NO: 1610017 - protein, 5 aa, Staphylococcus aureus
GSSAL

SEQ ID NO: 1610018 - protein, 17 aa, Staphylococcus aureus
GSVDGEEFEGGQAEGYD

SEQ ID NO: 1610019 - protein, 6 aa, Staphylococcus aureus
GTDSHT

SEQ ID NO: 1610020 - protein, 4 aa, Staphylococcus aureus
GTQL

SEQ ID NO: 1610021 - protein, 9 aa, Staphylococcus aureus
GTYKGKEVS

SEQ ID NO: 1610022 - protein, 7 aa, Staphylococcus aureus
GVSKSTV

SEQ ID NO: 1610023 - protein, 13 aa, Staphylococcus aureus
GYGPTENTTFTTT

SEQ ID NO: 1610024 - protein, 8 aa, Staphylococcus aureus
HASYTEHP

SEQ ID NO: 1610025 - protein, 5 aa, Staphylococcus aureus
HDING

SEQ ID NO: 1610026 - protein, 9 aa, Staphylococcus aureus
HESPSEYTR

SEQ ID NO: 1610027 - protein, 17 aa, Staphylococcus aureus
HGDGAKPGTSKKTCSYC

SEQ ID NO: 1610028 - protein, 4 aa, Staphylococcus aureus
HGDT

SEQ ID NO: 1610029 - protein, 5 aa, Staphylococcus aureus
HHNQN

SEQ ID NO: 1610030 - protein, 8 aa, Staphylococcus aureus
HPEGYTAT

SEQ ID NO: 1610031 - protein, 8 aa, Staphylococcus aureus
HPKSKEDL

SEQ ID NO: 1610032 - protein, 6 aa, Staphylococcus aureus
HQPYLE

SEQ ID NO: 1610033 - protein, 4 aa, Staphylococcus aureus
HQRL

SEQ ID NO: 1610034 - protein, 4 aa, Staphylococcus aureus
HRSS

SEQ ID NO: 1610035 - protein, 8 aa, Staphylococcus aureus
HSEQPGIS

SEQ ID NO: 1610036 - protein, 8 aa, Staphylococcus aureus
IDGCPTDS

SEQ ID NO: 1610037 - protein, 5 aa, Staphylococcus aureus
IEQIT

SEQ ID NO: 1610038 - protein, 4 aa, Staphylococcus aureus
IETR

SEQ ID NO: 1610039 - protein, 7 aa, Staphylococcus aureus
IETRTAK

SEQ ID NO: 1610040 - protein, 5 aa, Staphylococcus aureus
IGNDR

SEQ ID NO: 1610041 - protein, 4 aa, Staphylococcus aureus
IGPC

SEQ ID NO: 1610042 - protein, 5 aa, Staphylococcus aureus
IGPRI

SEQ ID NO: 1610043 - protein, 12 aa, Staphylococcus aureus
IKEADNTEKQTV

SEQ ID NO: 1610044 - protein, 12 aa, Staphylococcus aureus
IKETEESLTVES

SEQ ID NO: 1610045 - protein, 8 aa, Staphylococcus aureus
IKKTLTPH

SEQ ID NO: 1610046 - protein, 7 aa, Staphylococcus aureus
IKLSTSG

SEQ ID NO: 1610047 - protein, 8 aa, Staphylococcus aureus
IKNNRDRI

SEQ ID NO: 1610048 - protein, 14 aa, Staphylococcus aureus
INFKDGSKATMKTG

SEQ ID NO: 1610049 - protein, 7 aa, Staphylococcus aureus
INNDPRG

SEQ ID NO: 1610050 - protein, 6 aa, Staphylococcus aureus
IPLDEN

SEQ ID NO: 1610051 - protein, 8 aa, Staphylococcus aureus
IPNETTGE

SEQ ID NO: 1610052 - protein, 9 aa, Staphylococcus aureus
ISKDLKEDP

SEQ ID NO: 1610053 - protein, 8 aa, Staphylococcus aureus
ISSERAAE

SEQ ID NO: 1610054 - protein, 13 aa, Staphylococcus aureus
ITEDTFNALTEQF

SEQ ID NO: 1610055 - protein, 7 aa, Staphylococcus aureus
IYGTSVK

SEQ ID NO: 1610056 - protein, 5 aa, Staphylococcus aureus
IYKQT

SEQ ID NO: 1610057 - protein, 8 aa, Staphylococcus aureus
KAGEYSDC

SEQ ID NO: 1610058 - protein, 9 aa, Staphylococcus aureus
KANANPVIT

SEQ ID NO: 1610059 - protein, 12 aa, Staphylococcus aureus
KAQGNDEAHEMD

SEQ ID NO: 1610060 - protein, 17 aa, Staphylococcus aureus
KDAAEKAKKDLSGVSQT

SEQ ID NO: 1610061 - protein, 16 aa, Staphylococcus aureus
KDAAQAAIEKANNTED

SEQ ID NO: 1610062 - protein, 7 aa, Staphylococcus aureus
KDAINND

SEQ ID NO: 1610063 - protein, 8 aa, Staphylococcus aureus
KDASPTVT

SEQ ID NO: 1610064 - protein, 15 aa, Staphylococcus aureus
KDKDQLSVDKLRAFG

SEQ ID NO: 1610065 - protein, 5 aa, Staphylococcus aureus
KDSFT

SEQ ID NO: 1610066 - protein, 13 aa, Staphylococcus aureus
KDVEVETNVGPRG

SEQ ID NO: 1610067 - protein, 6 aa, Staphylococcus aureus
KELTEP

SEQ ID NO: 1610068 - protein, 6 aa, Staphylococcus aureus
KENDSI

SEQ ID NO: 1610069 - protein, 6 aa, Staphylococcus aureus
KENDYA

SEQ ID NO: 1610070 - protein, 6 aa, Staphylococcus aureus
KENGWD

SEQ ID NO: 1610071 - protein, 10 aa, Staphylococcus aureus
KESSSGQPYD

SEQ ID NO: 1610072 - protein, 15 aa, Staphylococcus aureus
KFHSNKRRVSPTGQR

SEQ ID NO: 1610073 - protein, 7 aa, Staphylococcus aureus
KGDKKAF

SEQ ID NO: 1610074 - protein, 9 aa, Staphylococcus aureus
KGEKVSYEQ

SEQ ID NO: 1610075 - protein, 6 aa, Staphylococcus aureus
KGFNPE

SEQ ID NO: 1610076 - protein, 9 aa, Staphylococcus aureus
KGPNGENVK

SEQ ID NO: 1610077 - protein, 15 aa, Staphylococcus aureus
KGPTGSGKTKLAETL

SEQ ID NO: 1610078 - protein, 5 aa, Staphylococcus aureus
KGYLD

SEQ ID NO: 1610079 - protein, 7 aa, Staphylococcus aureus
KKEAYDL

SEQ ID NO: 1610080 - protein, 16 aa, Staphylococcus aureus
KKEIGKEPNKGVNPDE

SEQ ID NO: 1610081 - protein, 15 aa, Staphylococcus aureus
KKGDLASRRNAAKTL

SEQ ID NO: 1610082 - protein, 28 aa, Staphylococcus aureus
KKGVSSTKNGRDSESKRLGAKRADGQFV

SEQ ID NO: 1610083 - protein, 14 aa, Staphylococcus aureus
KKKGIKTAKEAYNY

SEQ ID NO: 1610084 - protein, 7 aa, Staphylococcus aureus
KKRDDNF

SEQ ID NO: 1610085 - protein, 4 aa, Staphylococcus aureus
KKSV

SEQ ID NO: 1610086 - protein, 16 aa, Staphylococcus aureus
KKYLTVQDSKNNDVPA

SEQ ID NO: 1610087 - protein, 13 aa, Staphylococcus aureus
KLGYDTGESETPI

SEQ ID NO: 1610088 - protein, 8 aa, Staphylococcus aureus
KNENDQIN

SEQ ID NO: 1610089 - protein, 4 aa, Staphylococcus aureus
KNGE

SEQ ID NO: 1610090 - protein, 8 aa, Staphylococcus aureus
KNVKGEYE

SEQ ID NO: 1610091 - protein, 6 aa, Staphylococcus aureus
KPAEYI

SEQ ID NO: 1610092 - protein, 9 aa, Staphylococcus aureus
KPERTEGQK

SEQ ID NO: 1610093 - protein, 7 aa, Staphylococcus aureus
KQIDHDQ

SEQ ID NO: 1610094 - protein, 15 aa, Staphylococcus aureus
KQKIENKAAKQKKHP

SEQ ID NO: 1610095 - protein, 10 aa, Staphylococcus aureus
KQTVQSKNNL

SEQ ID NO: 1610096 - protein, 9 aa, Staphylococcus aureus
KSHTTPNNL

SEQ ID NO: 1610097 - protein, 11 aa, Staphylococcus aureus
KSNEGKWGGVD

SEQ ID NO: 1610098 - protein, 7 aa, Staphylococcus aureus
KTGTEHI

SEQ ID NO: 1610099 - protein, 9 aa, Staphylococcus aureus
KVKSNSDFT

SEQ ID NO: 1610100 - protein, 5 aa, Staphylococcus aureus
KVTGC

SEQ ID NO: 1610101 - protein, 13 aa, Staphylococcus aureus
KVYGNEEQVGAGI

SEQ ID NO: 1610102 - protein, 6 aa, Staphylococcus aureus
KYGTVN

SEQ ID NO: 1610103 - protein, 18 aa, Staphylococcus aureus
LAQKMAQEQNKKKEEKMK

SEQ ID NO: 1610104 - protein, 9 aa, Staphylococcus aureus
LDKQGRINI

SEQ ID NO: 1610105 - protein, 6 aa, Staphylococcus aureus
LEDDPE

SEQ ID NO: 1610106 - protein, 5 aa, Staphylococcus aureus
LESTN

SEQ ID NO: 1610107 - protein, 5 aa, Staphylococcus aureus
LGKEA

SEQ ID NO: 1610108 - protein, 8 aa, Staphylococcus aureus
LGNTVDNT

SEQ ID NO: 1610109 - protein, 8 aa, Staphylococcus aureus
LKGSNRKK

SEQ ID NO: 1610110 - protein, 6 aa, Staphylococcus aureus
LKSKKG

SEQ ID NO: 1610111 - protein, 7 aa, Staphylococcus aureus
LNPDEGR

SEQ ID NO: 1610112 - protein, 9 aa, Staphylococcus aureus
LPMTKKDAR

SEQ ID NO: 1610113 - protein, 6 aa, Staphylococcus aureus
LQTEDY

SEQ ID NO: 1610114 - protein, 10 aa, Staphylococcus aureus
LREKDPKKYV

SEQ ID NO: 1610115 - protein, 6 aa, Staphylococcus aureus
LRKKGV

SEQ ID NO: 1610116 - protein, 6 aa, Staphylococcus aureus
LTNHPA

SEQ ID NO: 1610117 - protein, 9 aa, Staphylococcus aureus
LVKEAQEQT

SEQ ID NO: 1610118 - protein, 5 aa, Staphylococcus aureus
LVKSD

SEQ ID NO: 1610119 - protein, 4 aa, Staphylococcus aureus
MENR

SEQ ID NO: 1610120 - protein, 7 aa, Staphylococcus aureus
MKTNQDT

SEQ ID NO: 1610121 - protein, 4 aa, Staphylococcus aureus
MNEV

SEQ ID NO: 1610122 - protein, 4 aa, Staphylococcus aureus
MNGE

SEQ ID NO: 1610123 - protein, 6 aa, Staphylococcus aureus
MNPETR

SEQ ID NO: 1610124 - protein, 8 aa, Staphylococcus aureus
MQDAGQLP

SEQ ID NO: 1610125 - protein, 5 aa, Staphylococcus aureus
NAYQQ

SEQ ID NO: 1610126 - protein, 4 aa, Staphylococcus aureus
NDHE

SEQ ID NO: 1610127 - protein, 12 aa, Staphylococcus aureus
NEFPTKHNTALK

SEQ ID NO: 1610128 - protein, 11 aa, Staphylococcus aureus
NENIEKDINNH

SEQ ID NO: 1610129 - protein, 5 aa, Staphylococcus aureus
NERDY

SEQ ID NO: 1610130 - protein, 9 aa, Staphylococcus aureus
NFPDEAPGI

SEQ ID NO: 1610131 - protein, 4 aa, Staphylococcus aureus
NGFP

SEQ ID NO: 1610132 - protein, 8 aa, Staphylococcus aureus
NGKKVNDL

SEQ ID NO: 1610133 - protein, 10 aa, Staphylococcus aureus
NGNPSDTFKD

SEQ ID NO: 1610134 - protein, 4 aa, Staphylococcus aureus
NGQV

SEQ ID NO: 1610135 - protein, 5 aa, Staphylococcus aureus
NGSGL

SEQ ID NO: 1610136 - protein, 12 aa, Staphylococcus aureus
NGSVSKKTSEKL

SEQ ID NO: 1610137 - protein, 6 aa, Staphylococcus aureus
NGVKAN

SEQ ID NO: 1610138 - protein, 5 aa, Staphylococcus aureus
NGYEK

SEQ ID NO: 1610139 - protein, 7 aa, Staphylococcus aureus
NGYYADT

SEQ ID NO: 1610140 - protein, 5 aa, Staphylococcus aureus
NHNGT

SEQ ID NO: 1610141 - protein, 6 aa, Staphylococcus aureus
NKAKNI

SEQ ID NO: 1610142 - protein, 9 aa, Staphylococcus aureus
NKDSAIGNL

SEQ ID NO: 1610143 - protein, 5 aa, Staphylococcus aureus
NKPII

SEQ ID NO: 1610144 - protein, 13 aa, Staphylococcus aureus
NKTFKTNDNLGQK

SEQ ID NO: 1610145 - protein, 19 aa, Staphylococcus aureus
NLKPEQEEEYNELETQNGK

SEQ ID NO: 1610146 - protein, 8 aa, Staphylococcus aureus
NNAGTGHS

SEQ ID NO: 1610147 - protein, 9 aa, Staphylococcus aureus
NNKQFDKEI

SEQ ID NO: 1610148 - protein, 14 aa, Staphylococcus aureus
NNSDYTKGTIHTRS

SEQ ID NO: 1610149 - protein, 18 aa, Staphylococcus aureus
NNTPYSISKNSGVPRQTV

SEQ ID NO: 1610150 - protein, 6 aa, Staphylococcus aureus
NPEKYK

SEQ ID NO: 1610151 - protein, 10 aa, Staphylococcus aureus
NPKKKDTREI

SEQ ID NO: 1610152 - protein, 5 aa, Staphylococcus aureus
NPNII

SEQ ID NO: 1610153 - protein, 7 aa, Staphylococcus aureus
NRRDDVT

SEQ ID NO: 1610154 - protein, 7 aa, Staphylococcus aureus
NSNDAVD

SEQ ID NO: 1610155 - protein, 11 aa, Staphylococcus aureus
NTPKATTPYQQ

SEQ ID NO: 1610156 - protein, 4 aa, Staphylococcus aureus
NYED

SEQ ID NO: 1610157 - protein, 11 aa, Staphylococcus aureus
NYRQKKGDIQQ

SEQ ID NO: 1610158 - protein, 7 aa, Staphylococcus aureus
PAYPQQD

SEQ ID NO: 1610159 - protein, 4 aa, Staphylococcus aureus
PDNQ

SEQ ID NO: 1610160 - protein, 5 aa, Staphylococcus aureus
PDSHQ

SEQ ID NO: 1610161 - protein, 4 aa, Staphylococcus aureus
PESI

SEQ ID NO: 1610162 - protein, 5 aa, Staphylococcus aureus
PESNV

SEQ ID NO: 1610163 - protein, 4 aa, Staphylococcus aureus
PFDN

SEQ ID NO: 1610164 - protein, 21 aa, Staphylococcus aureus
PGAPPDLLHPPKGDAFARRSQ

SEQ ID NO: 1610165 - protein, 12 aa, Staphylococcus aureus
PGHGEDQSSMDE

SEQ ID NO: 1610166 - protein, 12 aa, Staphylococcus aureus
PGSHGSTFGGNP

SEQ ID NO: 1610167 - protein, 8 aa, Staphylococcus aureus
PLAESGIG

SEQ ID NO: 1610168 - protein, 7 aa, Staphylococcus aureus
PLSPTLT

SEQ ID NO: 1610169 - protein, 14 aa, Staphylococcus aureus
PNDTSNGTYHSSQY

SEQ ID NO: 1610170 - protein, 16 aa, Staphylococcus aureus
PNKLKGAPKSVRGDRR

SEQ ID NO: 1610171 - protein, 4 aa, Staphylococcus aureus
PNKY

SEQ ID NO: 1610172 - protein, 6 aa, Staphylococcus aureus
PQEVQD

SEQ ID NO: 1610173 - protein, 5 aa, Staphylococcus aureus
PSTAK

SEQ ID NO: 1610174 - protein, 8 aa, Staphylococcus aureus
QAARVSDK

SEQ ID NO: 1610175 - protein, 4 aa, Staphylococcus aureus
QDDT

SEQ ID NO: 1610176 - protein, 5 aa, Staphylococcus aureus
QDIEE

SEQ ID NO: 1610177 - protein, 4 aa, Staphylococcus aureus
QDLE

SEQ ID NO: 1610178 - protein, 7 aa, Staphylococcus aureus
QEDPKQY

SEQ ID NO: 1610179 - protein, 7 aa, Staphylococcus aureus
QELENNK

SEQ ID NO: 1610180 - protein, 4 aa, Staphylococcus aureus
QFIP

SEQ ID NO: 1610181 - protein, 7 aa, Staphylococcus aureus
QGKKETV

SEQ ID NO: 1610182 - protein, 5 aa, Staphylococcus aureus
QHSEN

SEQ ID NO: 1610183 - protein, 8 aa, Staphylococcus aureus
QKAFDTTG

SEQ ID NO: 1610184 - protein, 6 aa, Staphylococcus aureus
QNKGIG

SEQ ID NO: 1610185 - protein, 4 aa, Staphylococcus aureus
QNLD

SEQ ID NO: 1610186 - protein, 6 aa, Staphylococcus aureus
QPETLR

SEQ ID NO: 1610187 - protein, 6 aa, Staphylococcus aureus
QQPPYT

SEQ ID NO: 1610188 - protein, 6 aa, Staphylococcus aureus
QQQQEL

SEQ ID NO: 1610189 - protein, 13 aa, Staphylococcus aureus
QRKNQTKKKKAQI

SEQ ID NO: 1610190 - protein, 8 aa, Staphylococcus aureus
RADKNFPM

SEQ ID NO: 1610191 - protein, 14 aa, Staphylococcus aureus
RAFDHDEGPNTGGM

SEQ ID NO: 1610192 - protein, 4 aa, Staphylococcus aureus
RAGI

SEQ ID NO: 1610193 - protein, 7 aa, Staphylococcus aureus
RATSEYE

SEQ ID NO: 1610194 - protein, 5 aa, Staphylococcus aureus
RDRSE

SEQ ID NO: 1610195 - protein, 9 aa, Staphylococcus aureus
REERVNPEQ

SEQ ID NO: 1610196 - protein, 6 aa, Staphylococcus aureus
REVGQN

SEQ ID NO: 1610197 - protein, 4 aa, Staphylococcus aureus
RGEY

SEQ ID NO: 1610198 - protein, 5 aa, Staphylococcus aureus
RKPVE

SEQ ID NO: 1610199 - protein, 8 aa, Staphylococcus aureus
RPNVGKST

SEQ ID NO: 1610200 - protein, 5 aa, Staphylococcus aureus
RQGTP

SEQ ID NO: 1610201 - protein, 7 aa, Staphylococcus aureus
RSFNDSS

SEQ ID NO: 1610202 - protein, 11 aa, Staphylococcus aureus
RSFQGGEQKPL

SEQ ID NO: 1610203 - protein, 4 aa, Staphylococcus aureus
RYEV

SEQ ID NO: 1610204 - protein, 7 aa, Staphylococcus aureus
RYRSNND

SEQ ID NO: 1610205 - protein, 12 aa, Staphylococcus aureus
SDFKKSKGYERS

SEQ ID NO: 1610206 - protein, 4 aa, Staphylococcus aureus
SDLT

SEQ ID NO: 1610207 - protein, 9 aa, Staphylococcus aureus
SDSLESAER

SEQ ID NO: 1610208 - protein, 5 aa, Staphylococcus aureus
SDSYP

SEQ ID NO: 1610209 - protein, 7 aa, Staphylococcus aureus
SDTPDKI

SEQ ID NO: 1610210 - protein, 9 aa, Staphylococcus aureus
SDVRKDGTL

SEQ ID NO: 1610211 - protein, 6 aa, Staphylococcus aureus
SEEARA

SEQ ID NO: 1610212 - protein, 6 aa, Staphylococcus aureus
SEHEHQ

SEQ ID NO: 1610213 - protein, 8 aa, Staphylococcus aureus
SEQEIKGE

SEQ ID NO: 1610214 - protein, 11 aa, Staphylococcus aureus
SGDQSQNKDNY

SEQ ID NO: 1610215 - protein, 11 aa, Staphylococcus aureus
SGHRGALPHGV

SEQ ID NO: 1610216 - protein, 5 aa, Staphylococcus aureus
SGTEA

SEQ ID NO: 1610217 - protein, 10 aa, Staphylococcus aureus
SHKEKHTRQI

SEQ ID NO: 1610218 - protein, 20 aa, Staphylococcus aureus
SKGEHKGKIEGEVKSIEKHS

SEQ ID NO: 1610219 - protein, 11 aa, Staphylococcus aureus
SKGYQLNTSQY

SEQ ID NO: 1610220 - protein, 9 aa, Staphylococcus aureus
SKPSMSAGV

SEQ ID NO: 1610221 - protein, 7 aa, Staphylococcus aureus
SKQYQQF

SEQ ID NO: 1610222 - protein, 4 aa, Staphylococcus aureus
SKSA

SEQ ID NO: 1610223 - protein, 7 aa, Staphylococcus aureus
SKYGSNV

SEQ ID NO: 1610224 - protein, 8 aa, Staphylococcus aureus
SKYTRSKL

SEQ ID NO: 1610225 - protein, 7 aa, Staphylococcus aureus
SLAKGEK

SEQ ID NO: 1610226 - protein, 4 aa, Staphylococcus aureus
SLKQ

SEQ ID NO: 1610227 - protein, 14 aa, Staphylococcus aureus
SLSAKELKDGFKDV

SEQ ID NO: 1610228 - protein, 5 aa, Staphylococcus aureus
SLSKA

SEQ ID NO: 1610229 - protein, 6 aa, Staphylococcus aureus
SNMPPN

SEQ ID NO: 1610230 - protein, 7 aa, Staphylococcus aureus
SNPITTE

SEQ ID NO: 1610231 - protein, 6 aa, Staphylococcus aureus
SNRTVR

SEQ ID NO: 1610232 - protein, 8 aa, Staphylococcus aureus
SPAAQGVH

SEQ ID NO: 1610233 - protein, 6 aa, Staphylococcus aureus
SPEAAN

SEQ ID NO: 1610234 - protein, 11 aa, Staphylococcus aureus
SPVQGSEQGGV

SEQ ID NO: 1610235 - protein, 10 aa, Staphylococcus aureus
SSDKYETAKD

SEQ ID NO: 1610236 - protein, 7 aa, Staphylococcus aureus
SSHGINN

SEQ ID NO: 1610237 - protein, 6 aa, Staphylococcus aureus
SSHPNR

SEQ ID NO: 1610238 - protein, 12 aa, Staphylococcus aureus
SSKEEAEEAGVE

SEQ ID NO: 1610239 - protein, 7 aa, Staphylococcus aureus
SSTSAQS

SEQ ID NO: 1610240 - protein, 12 aa, Staphylococcus aureus
STNDVEAKETDT

SEQ ID NO: 1610241 - protein, 9 aa, Staphylococcus aureus
STPTSSSLM

SEQ ID NO: 1610242 - protein, 18 aa, Staphylococcus aureus
SVEKGDKVSREKMHNAST

SEQ ID NO: 1610243 - protein, 8 aa, Staphylococcus aureus
SVNPGGGM

SEQ ID NO: 1610244 - protein, 12 aa, Staphylococcus aureus
TAMGKEETLSTA

SEQ ID NO: 1610245 - protein, 9 aa, Staphylococcus aureus
TAPGHGEDD

SEQ ID NO: 1610246 - protein, 13 aa, Staphylococcus aureus
TDEKAKSLSITKA

SEQ ID NO: 1610247 - protein, 9 aa, Staphylococcus aureus
TDKRDRKKR

SEQ ID NO: 1610248 - protein, 9 aa, Staphylococcus aureus
TDSALQENE

SEQ ID NO: 1610249 - protein, 4 aa, Staphylococcus aureus
TDVV

SEQ ID NO: 1610250 - protein, 7 aa, Staphylococcus aureus
TEGRNRQ

SEQ ID NO: 1610251 - protein, 8 aa, Staphylococcus aureus
TENATTAR

SEQ ID NO: 1610252 - protein, 7 aa, Staphylococcus aureus
TGHPDFS

SEQ ID NO: 1610253 - protein, 10 aa, Staphylococcus aureus
TGQTYTSGIK

SEQ ID NO: 1610254 - protein, 4 aa, Staphylococcus aureus
THPE

SEQ ID NO: 1610255 - protein, 13 aa, Staphylococcus aureus
TIDRTSDGKGRIA

SEQ ID NO: 1610256 - protein, 19 aa, Staphylococcus aureus
TIDTQSDPKSTTTPSTEKQ

SEQ ID NO: 1610257 - protein, 12 aa, Staphylococcus aureus
TIEQQKQVDTIS

SEQ ID NO: 1610258 - protein, 11 aa, Staphylococcus aureus
TILGADDKAGL

SEQ ID NO: 1610259 - protein, 6 aa, Staphylococcus aureus
TIPSRN

SEQ ID NO: 1610260 - protein, 11 aa, Staphylococcus aureus
TITEDNRSDLG

SEQ ID NO: 1610261 - protein, 11 aa, Staphylococcus aureus
TITKPRPGHAD

SEQ ID NO: 1610262 - protein, 7 aa, Staphylococcus aureus
TKETKQD

SEQ ID NO: 1610263 - protein, 9 aa, Staphylococcus aureus
TKNDMATIK

SEQ ID NO: 1610264 - protein, 9 aa, Staphylococcus aureus
TKSTPEGAR

SEQ ID NO: 1610265 - protein, 8 aa, Staphylococcus aureus
TLADYKKG

SEQ ID NO: 1610266 - protein, 13 aa, Staphylococcus aureus
TLDTGKTLEESYA

SEQ ID NO: 1610267 - protein, 7 aa, Staphylococcus aureus
TLTGSNG

SEQ ID NO: 1610268 - protein, 5 aa, Staphylococcus aureus
TMDEG

SEQ ID NO: 1610269 - protein, 6 aa, Staphylococcus aureus
TPDPEC

SEQ ID NO: 1610270 - protein, 5 aa, Staphylococcus aureus
TPNAL

SEQ ID NO: 1610271 - protein, 11 aa, Staphylococcus aureus
TPRMEGANEEI

SEQ ID NO: 1610272 - protein, 4 aa, Staphylococcus aureus
TPYT

SEQ ID NO: 1610273 - protein, 4 aa, Staphylococcus aureus
TQET

SEQ ID NO: 1610274 - protein, 8 aa, Staphylococcus aureus
TQKPIGET

SEQ ID NO: 1610275 - protein, 28 aa, Staphylococcus aureus
TRGLGAGANPEIGKKAAEESREQIEDAI

SEQ ID NO: 1610276 - protein, 4 aa, Staphylococcus aureus
TSDE

SEQ ID NO: 1610277 - protein, 9 aa, Staphylococcus aureus
TSLQSAKNT

SEQ ID NO: 1610278 - protein, 7 aa, Staphylococcus aureus
TTDGFEL

SEQ ID NO: 1610279 - protein, 5 aa, Staphylococcus aureus
TTELP

SEQ ID NO: 1610280 - protein, 19 aa, Staphylococcus aureus
TTEPIDARSTTYSTDVAKG

SEQ ID NO: 1610281 - protein, 14 aa, Staphylococcus aureus
TTQETQIKNDHEEF

SEQ ID NO: 1610282 - protein, 10 aa, Staphylococcus aureus
TVKGPDDYKS

SEQ ID NO: 1610283 - protein, 4 aa, Staphylococcus aureus
TYEN

SEQ ID NO: 1610284 - protein, 12 aa, Staphylococcus aureus
TYETENESIVTD

SEQ ID NO: 1610285 - protein, 7 aa, Staphylococcus aureus
TYGKKHT

SEQ ID NO: 1610286 - protein, 15 aa, Staphylococcus aureus
TYRAQNRGGRGVQGM

SEQ ID NO: 1610287 - protein, 4 aa, Staphylococcus aureus
VAGS

SEQ ID NO: 1610288 - protein, 10 aa, Staphylococcus aureus
VDGKGAMPTT

SEQ ID NO: 1610289 - protein, 9 aa, Staphylococcus aureus
VGDASNGNV

SEQ ID NO: 1610290 - protein, 4 aa, Staphylococcus aureus
VGKT

SEQ ID NO: 1610291 - protein, 5 aa, Staphylococcus aureus
VGRGL

SEQ ID NO: 1610292 - protein, 6 aa, Staphylococcus aureus
VGTGSG

SEQ ID NO: 1610293 - protein, 6 aa, Staphylococcus aureus
VGYPKR

SEQ ID NO: 1610294 - protein, 5 aa, Staphylococcus aureus
VKGGR

SEQ ID NO: 1610295 - protein, 10 aa, Staphylococcus aureus
VKKEGLKGGG

SEQ ID NO: 1610296 - protein, 16 aa, Staphylococcus aureus
VNGNQNVKAETKNKVN

SEQ ID NO: 1610297 - protein, 9 aa, Staphylococcus aureus
VNSLGDDVK

SEQ ID NO: 1610298 - protein, 4 aa, Staphylococcus aureus
VQGT

SEQ ID NO: 1610299 - protein, 10 aa, Staphylococcus aureus
VQPARGPKKD

SEQ ID NO: 1610300 - protein, 6 aa, Staphylococcus aureus
VQSYQG

SEQ ID NO: 1610301 - protein, 9 aa, Staphylococcus aureus
VSDDRGRTV

SEQ ID NO: 1610302 - protein, 10 aa, Staphylococcus aureus
VSSQSDQLTT

SEQ ID NO: 1610303 - protein, 7 aa, Staphylococcus aureus
WYTPSYK

SEQ ID NO: 1610304 - protein, 12 aa, Staphylococcus aureus
YAGENKSDEANI

SEQ ID NO: 1610305 - protein, 13 aa, Staphylococcus aureus
YGNNDEDKKEGIH

SEQ ID NO: 1610306 - protein, 8 aa, Staphylococcus aureus
YKRVETQR

SEQ ID NO: 1610307 - protein, 6 aa, Staphylococcus aureus
YKSEGL

SEQ ID NO: 1610308 - protein, 10 aa, Staphylococcus aureus
YNANERNQIN

SEQ ID NO: 1610309 - protein, 11 aa, Staphylococcus aureus
YNNEKYQKGKN

SEQ ID NO: 1610310 - protein, 11 aa, Staphylococcus aureus
YNRARQAEITQ

SEQ ID NO: 1610311 - protein, 8 aa, Staphylococcus aureus
YPLAKGAS

SEQ ID NO: 1610312 - protein, 6 aa, Staphylococcus aureus
YPPSYS

SEQ ID NO: 1610313 - protein, 5 aa, Staphylococcus aureus
YPSGA

SEQ ID NO: 1610314 - protein, 6 aa, Staphylococcus aureus
YQTRRN

SEQ ID NO: 1610315 - protein, 9 aa, Staphylococcus aureus
YRETGESQY

SEQ ID NO: 1610316 - protein, 6 aa, Staphylococcus aureus
YSTEKV

SEQ ID NO: 1610317 - protein, 8 aa, Staphylococcus aureus
YTNAGKSS

SEQ ID NO: 1610318 - protein, 6 aa, Staphylococcus aureus
YVSPND

SEQ ID NO: 1610319 - protein, 7 aa, Staphylococcus aureus
AASGNRN

SEQ ID NO: 1610320 - protein, 6 aa, Staphylococcus aureus
AEEISA

SEQ ID NO: 1610321 - protein, 8 aa, Staphylococcus aureus
AEKAGIEG

SEQ ID NO: 1610322 - protein, 8 aa, Staphylococcus aureus
AERKQHQL

SEQ ID NO: 1610323 - protein, 5 aa, Staphylococcus aureus
AGIPS

SEQ ID NO: 1610324 - protein, 7 aa, Staphylococcus aureus
AGPQHRE

SEQ ID NO: 1610325 - protein, 6 aa, Staphylococcus aureus
AKTIEG

SEQ ID NO: 1610326 - protein, 18 aa, Staphylococcus aureus
ALQQKREEHKNEEQDAIQ

SEQ ID NO: 1610327 - protein, 11 aa, Staphylococcus aureus
APDGNTISATE

SEQ ID NO: 1610328 - protein, 8 aa, Staphylococcus aureus
APEDKIDG

SEQ ID NO: 1610329 - protein, 5 aa, Staphylococcus aureus
APGDF

SEQ ID NO: 1610330 - protein, 11 aa, Staphylococcus aureus
APSIYQSDDRL

SEQ ID NO: 1610331 - protein, 5 aa, Staphylococcus aureus
AQAGY

SEQ ID NO: 1610332 - protein, 8 aa, Staphylococcus aureus
AQNNDQQG

SEQ ID NO: 1610333 - protein, 5 aa, Staphylococcus aureus
AQRTA

SEQ ID NO: 1610334 - protein, 5 aa, Staphylococcus aureus
ASGVD

SEQ ID NO: 1610335 - protein, 20 aa, Staphylococcus aureus
ASTGNRRSHALNSTKRRWNA

SEQ ID NO: 1610336 - protein, 7 aa, Staphylococcus aureus
AVEAAKK

SEQ ID NO: 1610337 - protein, 14 aa, Staphylococcus aureus
CSVQRKNQKLIEES

SEQ ID NO: 1610338 - protein, 8 aa, Staphylococcus aureus
DAGIEPKD

SEQ ID NO: 1610339 - protein, 6 aa, Staphylococcus aureus
DDNPIH

SEQ ID NO: 1610340 - protein, 4 aa, Staphylococcus aureus
DDTE

SEQ ID NO: 1610341 - protein, 8 aa, Staphylococcus aureus
DDYHESKH

SEQ ID NO: 1610342 - protein, 9 aa, Staphylococcus aureus
DENRENEGD

SEQ ID NO: 1610343 - protein, 5 aa, Staphylococcus aureus
DENVM

SEQ ID NO: 1610344 - protein, 9 aa, Staphylococcus aureus
DEPYETLGE

SEQ ID NO: 1610345 - protein, 5 aa, Staphylococcus aureus
DESKD

SEQ ID NO: 1610346 - protein, 7 aa, Staphylococcus aureus
DETGTDV

SEQ ID NO: 1610347 - protein, 4 aa, Staphylococcus aureus
DFND

SEQ ID NO: 1610348 - protein, 13 aa, Staphylococcus aureus
DGEGEDGGSSGTI

SEQ ID NO: 1610349 - protein, 10 aa, Staphylococcus aureus
DGKNFTESNE

SEQ ID NO: 1610350 - protein, 10 aa, Staphylococcus aureus
DGRTGEPFDN

SEQ ID NO: 1610351 - protein, 9 aa, Staphylococcus aureus
DIGKAQRVA

SEQ ID NO: 1610352 - protein, 9 aa, Staphylococcus aureus
DKCDQAEQH

SEQ ID NO: 1610353 - protein, 15 aa, Staphylococcus aureus
DKLQSGQISIEEPGL

SEQ ID NO: 1610354 - protein, 5 aa, Staphylococcus aureus
DLGYQ

SEQ ID NO: 1610355 - protein, 5 aa, Staphylococcus aureus
DNAYQ

SEQ ID NO: 1610356 - protein, 5 aa, Staphylococcus aureus
DNHTA

SEQ ID NO: 1610357 - protein, 9 aa, Staphylococcus aureus
DNVKKQNDY

SEQ ID NO: 1610358 - protein, 6 aa, Staphylococcus aureus
DQHGTA

SEQ ID NO: 1610359 - protein, 6 aa, Staphylococcus aureus
DTDDGR

SEQ ID NO: 1610360 - protein, 6 aa, Staphylococcus aureus
DYSNSV

SEQ ID NO: 1610361 - protein, 6 aa, Staphylococcus aureus
DYYGYS

SEQ ID NO: 1610362 - protein, 7 aa, Staphylococcus aureus
EAGEIYT

SEQ ID NO: 1610363 - protein, 6 aa, Staphylococcus aureus
EASLTY

SEQ ID NO: 1610364 - protein, 4 aa, Staphylococcus aureus
EDYQ

SEQ ID NO: 1610365 - protein, 9 aa, Staphylococcus aureus
EEAHKNNKQ

SEQ ID NO: 1610366 - protein, 4 aa, Staphylococcus aureus
EEFG

SEQ ID NO: 1610367 - protein, 5 aa, Staphylococcus aureus
EELTS

SEQ ID NO: 1610368 - protein, 11 aa, Staphylococcus aureus
EFADKAAARFG

SEQ ID NO: 1610369 - protein, 7 aa, Staphylococcus aureus
EHGDTEL

SEQ ID NO: 1610370 - protein, 4 aa, Staphylococcus aureus
EIAS

SEQ ID NO: 1610371 - protein, 8 aa, Staphylococcus aureus
EINKRAEH

SEQ ID NO: 1610372 - protein, 4 aa, Staphylococcus aureus
EITE

SEQ ID NO: 1610373 - protein, 6 aa, Staphylococcus aureus
EKEDRK

SEQ ID NO: 1610374 - protein, 8 aa, Staphylococcus aureus
EKLPEKRY

SEQ ID NO: 1610375 - protein, 6 aa, Staphylococcus aureus
EKNGKN

SEQ ID NO: 1610376 - protein, 4 aa, Staphylococcus aureus
ELSK

SEQ ID NO: 1610377 - protein, 4 aa, Staphylococcus aureus
ENEY

SEQ ID NO: 1610378 - protein, 4 aa, Staphylococcus aureus
ENVP

SEQ ID NO: 1610379 - protein, 8 aa, Staphylococcus aureus
EPDLPEAE

SEQ ID NO: 1610380 - protein, 7 aa, Staphylococcus aureus
EPTAGQD

SEQ ID NO: 1610381 - protein, 5 aa, Staphylococcus aureus
EQKKQ

SEQ ID NO: 1610382 - protein, 4 aa, Staphylococcus aureus
EQLS

SEQ ID NO: 1610383 - protein, 10 aa, Staphylococcus aureus
EQPSWNPKDF

SEQ ID NO: 1610384 - protein, 5 aa, Staphylococcus aureus
EQTQV

SEQ ID NO: 1610385 - protein, 4 aa, Staphylococcus aureus
ERQV

SEQ ID NO: 1610386 - protein, 7 aa, Staphylococcus aureus
ESGCGKS

SEQ ID NO: 1610387 - protein, 6 aa, Staphylococcus aureus
ESKIPE

SEQ ID NO: 1610388 - protein, 6 aa, Staphylococcus aureus
ESLDDT

SEQ ID NO: 1610389 - protein, 10 aa, Staphylococcus aureus
EVKASGGVRN

SEQ ID NO: 1610390 - protein, 11 aa, Staphylococcus aureus
EVQQARENNQP

SEQ ID NO: 1610391 - protein, 13 aa, Staphylococcus aureus
EYSSPKEALENAG

SEQ ID NO: 1610392 - protein, 17 aa, Staphylococcus aureus
FGKPQKVITDQAPSTKV

SEQ ID NO: 1610393 - protein, 8 aa, Staphylococcus aureus
FNEKDQER

SEQ ID NO: 1610394 - protein, 25 aa, Staphylococcus aureus
FSNKDKNSITNESHWTNEDEPGLSV

SEQ ID NO: 1610395 - protein, 8 aa, Staphylococcus aureus
FTKVDPPI

SEQ ID NO: 1610396 - protein, 9 aa, Staphylococcus aureus
GAGSVSDKL

SEQ ID NO: 1610397 - protein, 8 aa, Staphylococcus aureus
GAKSLSNT

SEQ ID NO: 1610398 - protein, 15 aa, Staphylococcus aureus
GASPAMSEAPEEAEE

SEQ ID NO: 1610399 - protein, 4 aa, Staphylococcus aureus
GGLG

SEQ ID NO: 1610400 - protein, 6 aa, Staphylococcus aureus
GGVTDA

SEQ ID NO: 1610401 - protein, 5 aa, Staphylococcus aureus
GIKPG

SEQ ID NO: 1610402 - protein, 7 aa, Staphylococcus aureus
GKRGTAQ

SEQ ID NO: 1610403 - protein, 17 aa, Staphylococcus aureus
GLGATSATRYGDNRTNY

SEQ ID NO: 1610404 - protein, 12 aa, Staphylococcus aureus
GLPGALSNSAGT

SEQ ID NO: 1610405 - protein, 4 aa, Staphylococcus aureus
GNEL

SEQ ID NO: 1610406 - protein, 6 aa, Staphylococcus aureus
GNPGIS

SEQ ID NO: 1610407 - protein, 4 aa, Staphylococcus aureus
GPCG

SEQ ID NO: 1610408 - protein, 6 aa, Staphylococcus aureus
GRLPGG

SEQ ID NO: 1610409 - protein, 24 aa, Staphylococcus aureus
GRSQSGWDKTEGSYSSTVAEDGGV

SEQ ID NO: 1610410 - protein, 6 aa, Staphylococcus aureus
GSGVAT

SEQ ID NO: 1610411 - protein, 5 aa, Staphylococcus aureus
GSKTR

SEQ ID NO: 1610412 - protein, 17 aa, Staphylococcus aureus
GYEKRNINEMSGGQKQR

SEQ ID NO: 1610413 - protein, 6 aa, Staphylococcus aureus
HEETKS

SEQ ID NO: 1610414 - protein, 11 aa, Staphylococcus aureus
HEGKRSKELGI

SEQ ID NO: 1610415 - protein, 6 aa, Staphylococcus aureus
HEQDSL

SEQ ID NO: 1610416 - protein, 14 aa, Staphylococcus aureus
HFKNREKAQKILKP

SEQ ID NO: 1610417 - protein, 10 aa, Staphylococcus aureus
HNGAGKSTLA

SEQ ID NO: 1610418 - protein, 4 aa, Staphylococcus aureus
HQSI

SEQ ID NO: 1610419 - protein, 5 aa, Staphylococcus aureus
HRVTD

SEQ ID NO: 1610420 - protein, 9 aa, Staphylococcus aureus
IANKQITTL

SEQ ID NO: 1610421 - protein, 4 aa, Staphylococcus aureus
IEDQ

SEQ ID NO: 1610422 - protein, 11 aa, Staphylococcus aureus
IETRGRDRHGI

SEQ ID NO: 1610423 - protein, 9 aa, Staphylococcus aureus
IGDRESQLN

SEQ ID NO: 1610424 - protein, 9 aa, Staphylococcus aureus
IKTQQQTID

SEQ ID NO: 1610425 - protein, 9 aa, Staphylococcus aureus
IKVTENNGV

SEQ ID NO: 1610426 - protein, 7 aa, Staphylococcus aureus
ILSQQDD

SEQ ID NO: 1610427 - protein, 8 aa, Staphylococcus aureus
INNDGPAI

SEQ ID NO: 1610428 - protein, 5 aa, Staphylococcus aureus
INSPT

SEQ ID NO: 1610429 - protein, 14 aa, Staphylococcus aureus
IPGGQMANTEEVEN

SEQ ID NO: 1610430 - protein, 13 aa, Staphylococcus aureus
ISGGKGTAEEKIK

SEQ ID NO: 1610431 - protein, 7 aa, Staphylococcus aureus
ITQPSDV

SEQ ID NO: 1610432 - protein, 5 aa, Staphylococcus aureus
ITRPV

SEQ ID NO: 1610433 - protein, 6 aa, Staphylococcus aureus
ITTPSI

SEQ ID NO: 1610434 - protein, 11 aa, Staphylococcus aureus
KAENNYSKQDA

SEQ ID NO: 1610435 - protein, 10 aa, Staphylococcus aureus
KDAAKSCELN

SEQ ID NO: 1610436 - protein, 9 aa, Staphylococcus aureus
KDHKQPKQL

SEQ ID NO: 1610437 - protein, 4 aa, Staphylococcus aureus
KDTN

SEQ ID NO: 1610438 - protein, 5 aa, Staphylococcus aureus
KDVPA

SEQ ID NO: 1610439 - protein, 4 aa, Staphylococcus aureus
KELT

SEQ ID NO: 1610440 - protein, 7 aa, Staphylococcus aureus
KFEGEGC

SEQ ID NO: 1610441 - protein, 4 aa, Staphylococcus aureus
KGKN

SEQ ID NO: 1610442 - protein, 6 aa, Staphylococcus aureus
KGSKIY

SEQ ID NO: 1610443 - protein, 13 aa, Staphylococcus aureus
KGYISATEDHHSK

SEQ ID NO: 1610444 - protein, 7 aa, Staphylococcus aureus
KHAKDEL

SEQ ID NO: 1610445 - protein, 12 aa, Staphylococcus aureus
KHNLKDYEETYN

SEQ ID NO: 1610446 - protein, 7 aa, Staphylococcus aureus
KKAIQQG

SEQ ID NO: 1610447 - protein, 5 aa, Staphylococcus aureus
KLNNE

SEQ ID NO: 1610448 - protein, 4 aa, Staphylococcus aureus
KLTG

SEQ ID NO: 1610449 - protein, 8 aa, Staphylococcus aureus
KNIPKDET

SEQ ID NO: 1610450 - protein, 5 aa, Staphylococcus aureus
KQSKP

SEQ ID NO: 1610451 - protein, 6 aa, Staphylococcus aureus
KRAQRG

SEQ ID NO: 1610452 - protein, 6 aa, Staphylococcus aureus
KRRVDE

SEQ ID NO: 1610453 - protein, 13 aa, Staphylococcus aureus
KSISKGKYTRASE

SEQ ID NO: 1610454 - protein, 8 aa, Staphylococcus aureus
KSKPNKLH

SEQ ID NO: 1610455 - protein, 25 aa, Staphylococcus aureus
KTEASRRALPQKLTHSEAVKSSAIS

SEQ ID NO: 1610456 - protein, 10 aa, Staphylococcus aureus
KTKDGRTFYG

SEQ ID NO: 1610457 - protein, 5 aa, Staphylococcus aureus
KTQSD

SEQ ID NO: 1610458 - protein, 8 aa, Staphylococcus aureus
KYDSETDE

SEQ ID NO: 1610459 - protein, 8 aa, Staphylococcus aureus
LADENEEK

SEQ ID NO: 1610460 - protein, 9 aa, Staphylococcus aureus
LASYPGNYE

SEQ ID NO: 1610461 - protein, 10 aa, Staphylococcus aureus
LDADNEDIPF

SEQ ID NO: 1610462 - protein, 14 aa, Staphylococcus aureus
LDPEKYKNANEEEL

SEQ ID NO: 1610463 - protein, 5 aa, Staphylococcus aureus
LENVN

SEQ ID NO: 1610464 - protein, 4 aa, Staphylococcus aureus
LNEQ

SEQ ID NO: 1610465 - protein, 5 aa, Staphylococcus aureus
LPLPE

SEQ ID NO: 1610466 - protein, 5 aa, Staphylococcus aureus
LREAG

SEQ ID NO: 1610467 - protein, 10 aa, Staphylococcus aureus
LTETQKQQFQ

SEQ ID NO: 1610468 - protein, 8 aa, Staphylococcus aureus
LTGAKPAG

SEQ ID NO: 1610469 - protein, 11 aa, Staphylococcus aureus
LTNAAGSGKIE

SEQ ID NO: 1610470 - protein, 6 aa, Staphylococcus aureus
MTGQDA

SEQ ID NO: 1610471 - protein, 4 aa, Staphylococcus aureus
NDLE

SEQ ID NO: 1610472 - protein, 5 aa, Staphylococcus aureus
NEDAL

SEQ ID NO: 1610473 - protein, 5 aa, Staphylococcus aureus
NENDR

SEQ ID NO: 1610474 - protein, 6 aa, Staphylococcus aureus
NENNYG

SEQ ID NO: 1610475 - protein, 14 aa, Staphylococcus aureus
NEVNQQYKDDKGEL

SEQ ID NO: 1610476 - protein, 4 aa, Staphylococcus aureus
NKPE

SEQ ID NO: 1610477 - protein, 10 aa, Staphylococcus aureus
NMKNKSKALY

SEQ ID NO: 1610478 - protein, 14 aa, Staphylococcus aureus
NNNFDNRQPGSNEE

SEQ ID NO: 1610479 - protein, 8 aa, Staphylococcus aureus
NNNNGARF

SEQ ID NO: 1610480 - protein, 7 aa, Staphylococcus aureus
NNPQNNI

SEQ ID NO: 1610481 - protein, 9 aa, Staphylococcus aureus
NNQASTYTK

SEQ ID NO: 1610482 - protein, 10 aa, Staphylococcus aureus
NSAQTEEMGE

SEQ ID NO: 1610483 - protein, 10 aa, Staphylococcus aureus
NSKDSKSNIG

SEQ ID NO: 1610484 - protein, 8 aa, Staphylococcus aureus
NSVGKGEV

SEQ ID NO: 1610485 - protein, 21 aa, Staphylococcus aureus
NYDQEDAEVQNEMIKGLDTRR

SEQ ID NO: 1610486 - protein, 13 aa, Staphylococcus aureus
PDDETFSSAGTLA

SEQ ID NO: 1610487 - protein, 6 aa, Staphylococcus aureus
PDRAAQ

SEQ ID NO: 1610488 - protein, 4 aa, Staphylococcus aureus
PDVR

SEQ ID NO: 1610489 - protein, 4 aa, Staphylococcus aureus
PELT

SEQ ID NO: 1610490 - protein, 5 aa, Staphylococcus aureus
PGQTA

SEQ ID NO: 1610491 - protein, 6 aa, Staphylococcus aureus
PLNNQP

SEQ ID NO: 1610492 - protein, 14 aa, Staphylococcus aureus
PMVPSGKSNHEMEG

SEQ ID NO: 1610493 - protein, 8 aa, Staphylococcus aureus
PNKVPNRI

SEQ ID NO: 1610494 - protein, 4 aa, Staphylococcus aureus
PPEN

SEQ ID NO: 1610495 - protein, 4 aa, Staphylococcus aureus
PQAV

SEQ ID NO: 1610496 - protein, 8 aa, Staphylococcus aureus
PRYNKDGN

SEQ ID NO: 1610497 - protein, 8 aa, Staphylococcus aureus
PTLSKDSY

SEQ ID NO: 1610498 - protein, 4 aa, Staphylococcus aureus
QEYK

SEQ ID NO: 1610499 - protein, 6 aa, Staphylococcus aureus
QGSITV

SEQ ID NO: 1610500 - protein, 8 aa, Staphylococcus aureus
QGVSTEGA

SEQ ID NO: 1610501 - protein, 4 aa, Staphylococcus aureus
QGYQ

SEQ ID NO: 1610502 - protein, 4 aa, Staphylococcus aureus
QHQI

SEQ ID NO: 1610503 - protein, 6 aa, Staphylococcus aureus
QIESTE

SEQ ID NO: 1610504 - protein, 6 aa, Staphylococcus aureus
QNGELQ

SEQ ID NO: 1610505 - protein, 4 aa, Staphylococcus aureus
QQRP

SEQ ID NO: 1610506 - protein, 4 aa, Staphylococcus aureus
QSPN

SEQ ID NO: 1610507 - protein, 14 aa, Staphylococcus aureus
QTEEQVDKNIEGIS

SEQ ID NO: 1610508 - protein, 4 aa, Staphylococcus aureus
QVMK

SEQ ID NO: 1610509 - protein, 7 aa, Staphylococcus aureus
QYHPSYK

SEQ ID NO: 1610510 - protein, 6 aa, Staphylococcus aureus
QYNVNG

SEQ ID NO: 1610511 - protein, 5 aa, Staphylococcus aureus
RATPL

SEQ ID NO: 1610512 - protein, 7 aa, Staphylococcus aureus
RDVTDEA

SEQ ID NO: 1610513 - protein, 8 aa, Staphylococcus aureus
REKKLSQI

SEQ ID NO: 1610514 - protein, 23 aa, Staphylococcus aureus
REPGGEYKETIETGTKAAARGGF

SEQ ID NO: 1610515 - protein, 7 aa, Staphylococcus aureus
RGMKESD

SEQ ID NO: 1610516 - protein, 16 aa, Staphylococcus aureus
RKAAQSLELDERPLDE

SEQ ID NO: 1610517 - protein, 14 aa, Staphylococcus aureus
RPQDLSGGQKQRVS

SEQ ID NO: 1610518 - protein, 8 aa, Staphylococcus aureus
RSKWGERS

SEQ ID NO: 1610519 - protein, 8 aa, Staphylococcus aureus
RYTKRSQL

SEQ ID NO: 1610520 - protein, 14 aa, Staphylococcus aureus
SASNLNELKKSSIN

SEQ ID NO: 1610521 - protein, 5 aa, Staphylococcus aureus
SDEQG

SEQ ID NO: 1610522 - protein, 9 aa, Staphylococcus aureus
SENEQRKLR

SEQ ID NO: 1610523 - protein, 4 aa, Staphylococcus aureus
SEPQ

SEQ ID NO: 1610524 - protein, 4 aa, Staphylococcus aureus
SERS

SEQ ID NO: 1610525 - protein, 10 aa, Staphylococcus aureus
SETSNKQPSI

SEQ ID NO: 1610526 - protein, 6 aa, Staphylococcus aureus
SFTHEN

SEQ ID NO: 1610527 - protein, 12 aa, Staphylococcus aureus
SGGIQEEAPSFN

SEQ ID NO: 1610528 - protein, 5 aa, Staphylococcus aureus
SGNGF

SEQ ID NO: 1610529 - protein, 4 aa, Staphylococcus aureus
SGPD

SEQ ID NO: 1610530 - protein, 7 aa, Staphylococcus aureus
SINETSS

SEQ ID NO: 1610531 - protein, 8 aa, Staphylococcus aureus
SIQNDNQT

SEQ ID NO: 1610532 - protein, 9 aa, Staphylococcus aureus
SKDIPDNGF

SEQ ID NO: 1610533 - protein, 8 aa, Staphylococcus aureus
SLEDAKAR

SEQ ID NO: 1610534 - protein, 4 aa, Staphylococcus aureus
SPVN

SEQ ID NO: 1610535 - protein, 5 aa, Staphylococcus aureus
SQNNP

SEQ ID NO: 1610536 - protein, 5 aa, Staphylococcus aureus
SREKF

SEQ ID NO: 1610537 - protein, 5 aa, Staphylococcus aureus
SRPTI

SEQ ID NO: 1610538 - protein, 28 aa, Staphylococcus aureus
SSFENSVTAPAGNQGHGLDKSEFDKKAE

SEQ ID NO: 1610539 - protein, 10 aa, Staphylococcus aureus
SSGSNPKYNQ

SEQ ID NO: 1610540 - protein, 6 aa, Staphylococcus aureus
STDKRG

SEQ ID NO: 1610541 - protein, 13 aa, Staphylococcus aureus
STPYFLSGENFRN

SEQ ID NO: 1610542 - protein, 8 aa, Staphylococcus aureus
SVKEAIKD

SEQ ID NO: 1610543 - protein, 6 aa, Staphylococcus aureus
SVKERQ

SEQ ID NO: 1610544 - protein, 9 aa, Staphylococcus aureus
SYEQSYTKE

SEQ ID NO: 1610545 - protein, 6 aa, Staphylococcus aureus
SYPEHQ

SEQ ID NO: 1610546 - protein, 20 aa, Staphylococcus aureus
TAGGGGKGIRVARDEKELET

SEQ ID NO: 1610547 - protein, 16 aa, Staphylococcus aureus
TATSVDEAIANEKAGM

SEQ ID NO: 1610548 - protein, 6 aa, Staphylococcus aureus
TDGKSL

SEQ ID NO: 1610549 - protein, 5 aa, Staphylococcus aureus
TEGAE

SEQ ID NO: 1610550 - protein, 7 aa, Staphylococcus aureus
TEKPKPW

SEQ ID NO: 1610551 - protein, 7 aa, Staphylococcus aureus
TEKVQAA

SEQ ID NO: 1610552 - protein, 8 aa, Staphylococcus aureus
TEQQKLDV

SEQ ID NO: 1610553 - protein, 5 aa, Staphylococcus aureus
TGLPA

SEQ ID NO: 1610554 - protein, 9 aa, Staphylococcus aureus
TGTTLKANG

SEQ ID NO: 1610555 - protein, 8 aa, Staphylococcus aureus
TKPGVSRT

SEQ ID NO: 1610556 - protein, 10 aa, Staphylococcus aureus
TNPETAESKV

SEQ ID NO: 1610557 - protein, 8 aa, Staphylococcus aureus
TPIGRNGI

SEQ ID NO: 1610558 - protein, 6 aa, Staphylococcus aureus
TTAYQS

SEQ ID NO: 1610559 - protein, 15 aa, Staphylococcus aureus
TTTMGPGVKIDTASF

SEQ ID NO: 1610560 - protein, 17 aa, Staphylococcus aureus
VAKGNKADVDKAVEAAD

SEQ ID NO: 1610561 - protein, 9 aa, Staphylococcus aureus
VAPSNDKQG

SEQ ID NO: 1610562 - protein, 4 aa, Staphylococcus aureus
VDNK

SEQ ID NO: 1610563 - protein, 12 aa, Staphylococcus aureus
VDQGESLNAPTL

SEQ ID NO: 1610564 - protein, 9 aa, Staphylococcus aureus
VEEKPYNEP

SEQ ID NO: 1610565 - protein, 10 aa, Staphylococcus aureus
VEKRPKPDYE

SEQ ID NO: 1610566 - protein, 9 aa, Staphylococcus aureus
VEPKEDVDI

SEQ ID NO: 1610567 - protein, 11 aa, Staphylococcus aureus
VFSEPASNASI

SEQ ID NO: 1610568 - protein, 9 aa, Staphylococcus aureus
VGETVKANQ

SEQ ID NO: 1610569 - protein, 8 aa, Staphylococcus aureus
VGKTTTIG

SEQ ID NO: 1610570 - protein, 7 aa, Staphylococcus aureus
VGTGASD

SEQ ID NO: 1610571 - protein, 7 aa, Staphylococcus aureus
VHPDDDY

SEQ ID NO: 1610572 - protein, 9 aa, Staphylococcus aureus
VKSGGPELA

SEQ ID NO: 1610573 - protein, 5 aa, Staphylococcus aureus
VQSTL

SEQ ID NO: 1610574 - protein, 5 aa, Staphylococcus aureus
VRRNP

SEQ ID NO: 1610575 - protein, 9 aa, Staphylococcus aureus
VYGQTDTGM

SEQ ID NO: 1610576 - protein, 15 aa, Staphylococcus aureus
YARNNETVERPKRKV

SEQ ID NO: 1610577 - protein, 11 aa, Staphylococcus aureus
YDGNANTPAKL

SEQ ID NO: 1610578 - protein, 6 aa, Staphylococcus aureus
YDIQKG

SEQ ID NO: 1610579 - protein, 11 aa, Staphylococcus aureus
YGSDASAALHA

SEQ ID NO: 1610580 - protein, 13 aa, Staphylococcus aureus
YPKQQFANSSDYR

SEQ ID NO: 1610581 - protein, 8 aa, Staphylococcus aureus
YQSDASFT

SEQ ID NO: 1610582 - protein, 10 aa, Staphylococcus aureus
YVSAKSQAQT

SEQ ID NO: 1610583 - protein, 4 aa, Staphylococcus aureus
AAGY

SEQ ID NO: 1610584 - protein, 4 aa, Staphylococcus aureus
AEEI

SEQ ID NO: 1610585 - protein, 13 aa, Staphylococcus aureus
AENQGIKGKDATP

SEQ ID NO: 1610586 - protein, 9 aa, Staphylococcus aureus
AESIENPQV

SEQ ID NO: 1610587 - protein, 7 aa, Staphylococcus aureus
AESKRTA

SEQ ID NO: 1610588 - protein, 8 aa, Staphylococcus aureus
AGGDKKVN

SEQ ID NO: 1610589 - protein, 17 aa, Staphylococcus aureus
ANIYTPKGLHNSKLDTQ

SEQ ID NO: 1610590 - protein, 5 aa, Staphylococcus aureus
ANKES

SEQ ID NO: 1610591 - protein, 10 aa, Staphylococcus aureus
APKEKSDDGL

SEQ ID NO: 1610592 - protein, 7 aa, Staphylococcus aureus
APPETFI

SEQ ID NO: 1610593 - protein, 5 aa, Staphylococcus aureus
APRSV

SEQ ID NO: 1610594 - protein, 6 aa, Staphylococcus aureus
AQKSAN

SEQ ID NO: 1610595 - protein, 7 aa, Staphylococcus aureus
AQYKKGG

SEQ ID NO: 1610596 - protein, 13 aa, Staphylococcus aureus
ARGERERVKQRAN

SEQ ID NO: 1610597 - protein, 9 aa, Staphylococcus aureus
ASEIPESDL

SEQ ID NO: 1610598 - protein, 4 aa, Staphylococcus aureus
ASGR

SEQ ID NO: 1610599 - protein, 5 aa, Staphylococcus aureus
ATNDF

SEQ ID NO: 1610600 - protein, 6 aa, Staphylococcus aureus
AVKGSL

SEQ ID NO: 1610601 - protein, 7 aa, Staphylococcus aureus
DAKSANI

SEQ ID NO: 1610602 - protein, 12 aa, Staphylococcus aureus
DAVEKTTGANRQ

SEQ ID NO: 1610603 - protein, 17 aa, Staphylococcus aureus
DDEGKPKHVPGVYPEDD

SEQ ID NO: 1610604 - protein, 7 aa, Staphylococcus aureus
DDMTTSV

SEQ ID NO: 1610605 - protein, 5 aa, Staphylococcus aureus
DDSFS

SEQ ID NO: 1610606 - protein, 10 aa, Staphylococcus aureus
DDTNYQTNNE

SEQ ID NO: 1610607 - protein, 5 aa, Staphylococcus aureus
DGGMS

SEQ ID NO: 1610608 - protein, 6 aa, Staphylococcus aureus
DGTVEG

SEQ ID NO: 1610609 - protein, 11 aa, Staphylococcus aureus
DHASNRPASDL

SEQ ID NO: 1610610 - protein, 4 aa, Staphylococcus aureus
DHPQ

SEQ ID NO: 1610611 - protein, 12 aa, Staphylococcus aureus
DIPSNDLGGKVG

SEQ ID NO: 1610612 - protein, 6 aa, Staphylococcus aureus
DKDIDK

SEQ ID NO: 1610613 - protein, 10 aa, Staphylococcus aureus
DKKSLTGQYL

SEQ ID NO: 1610614 - protein, 5 aa, Staphylococcus aureus
DLTPR

SEQ ID NO: 1610615 - protein, 5 aa, Staphylococcus aureus
DNISN

SEQ ID NO: 1610616 - protein, 8 aa, Staphylococcus aureus
DNNGLKSP

SEQ ID NO: 1610617 - protein, 10 aa, Staphylococcus aureus
DPNYPSDRQE

SEQ ID NO: 1610618 - protein, 16 aa, Staphylococcus aureus
DQINGQQETRTRLSDE

SEQ ID NO: 1610619 - protein, 4 aa, Staphylococcus aureus
DQKL

SEQ ID NO: 1610620 - protein, 8 aa, Staphylococcus aureus
DRAEEARA

SEQ ID NO: 1610621 - protein, 7 aa, Staphylococcus aureus
DRLENSE

SEQ ID NO: 1610622 - protein, 5 aa, Staphylococcus aureus
DSIDE

SEQ ID NO: 1610623 - protein, 9 aa, Staphylococcus aureus
DSSKNETQI

SEQ ID NO: 1610624 - protein, 16 aa, Staphylococcus aureus
DTAEAERTTLKGEIKD

SEQ ID NO: 1610625 - protein, 4 aa, Staphylococcus aureus
DVQA

SEQ ID NO: 1610626 - protein, 5 aa, Staphylococcus aureus
DWGKR

SEQ ID NO: 1610627 - protein, 10 aa, Staphylococcus aureus
EAKKAAQLGE

SEQ ID NO: 1610628 - protein, 10 aa, Staphylococcus aureus
EARDDGPFLS

SEQ ID NO: 1610629 - protein, 6 aa, Staphylococcus aureus
EARERG

SEQ ID NO: 1610630 - protein, 8 aa, Staphylococcus aureus
EEKSNEMI

SEQ ID NO: 1610631 - protein, 13 aa, Staphylococcus aureus
EELAGKEATFKTK

SEQ ID NO: 1610632 - protein, 6 aa, Staphylococcus aureus
EELGMT

SEQ ID NO: 1610633 - protein, 4 aa, Staphylococcus aureus
EETE

SEQ ID NO: 1610634 - protein, 7 aa, Staphylococcus aureus
EGDITAP

SEQ ID NO: 1610635 - protein, 8 aa, Staphylococcus aureus
EGQKTGSF

SEQ ID NO: 1610636 - protein, 9 aa, Staphylococcus aureus
EHDNEQWDD

SEQ ID NO: 1610637 - protein, 13 aa, Staphylococcus aureus
EIDSIKDDLKKIN

SEQ ID NO: 1610638 - protein, 5 aa, Staphylococcus aureus
EIKNI

SEQ ID NO: 1610639 - protein, 11 aa, Staphylococcus aureus
EIKRGGQSYTY

SEQ ID NO: 1610640 - protein, 6 aa, Staphylococcus aureus
EKFTGQ

SEQ ID NO: 1610641 - protein, 4 aa, Staphylococcus aureus
EKQV

SEQ ID NO: 1610642 - protein, 7 aa, Staphylococcus aureus
EKSFGSN

SEQ ID NO: 1610643 - protein, 11 aa, Staphylococcus aureus
ELDKDKDAEVQ

SEQ ID NO: 1610644 - protein, 13 aa, Staphylococcus aureus
ELTTAQSKSLNEA

SEQ ID NO: 1610645 - protein, 10 aa, Staphylococcus aureus
EMEDEPVRAI

SEQ ID NO: 1610646 - protein, 7 aa, Staphylococcus aureus
ENEDKRQ

SEQ ID NO: 1610647 - protein, 64 aa, Staphylococcus aureus
ENENVEQSADTISDEKEQYHRDYRKQSHDSRSQKRHRRRRNQTTEEQNYSEQRGNSKISQQSIK

SEQ ID NO: 1610648 - protein, 6 aa, Staphylococcus aureus
EPGSNE

SEQ ID NO: 1610649 - protein, 15 aa, Staphylococcus aureus
EQEELEQKRDTYKKR

SEQ ID NO: 1610650 - protein, 9 aa, Staphylococcus aureus
ERQKAEKAF

SEQ ID NO: 1610651 - protein, 7 aa, Staphylococcus aureus
ERYQVSK

SEQ ID NO: 1610652 - protein, 7 aa, Staphylococcus aureus
ESESEIN

SEQ ID NO: 1610653 - protein, 14 aa, Staphylococcus aureus
ESFNPPTLKINSDK

SEQ ID NO: 1610654 - protein, 5 aa, Staphylococcus aureus
ETCPI

SEQ ID NO: 1610655 - protein, 4 aa, Staphylococcus aureus
EVEQ

SEQ ID NO: 1610656 - protein, 8 aa, Staphylococcus aureus
EYATTRCQ

SEQ ID NO: 1610657 - protein, 17 aa, Staphylococcus aureus
FGGNDLGSDALKAKLNS

SEQ ID NO: 1610658 - protein, 6 aa, Staphylococcus aureus
FNNESP

SEQ ID NO: 1610659 - protein, 5 aa, Staphylococcus aureus
GASAI

SEQ ID NO: 1610660 - protein, 10 aa, Staphylococcus aureus
GASGSGKSTF

SEQ ID NO: 1610661 - protein, 22 aa, Staphylococcus aureus
GATASGLSNKQLESLKATKPTR

SEQ ID NO: 1610662 - protein, 4 aa, Staphylococcus aureus
GATL

SEQ ID NO: 1610663 - protein, 4 aa, Staphylococcus aureus
GATT

SEQ ID NO: 1610664 - protein, 4 aa, Staphylococcus aureus
GEPN

SEQ ID NO: 1610665 - protein, 4 aa, Staphylococcus aureus
GEYQ

SEQ ID NO: 1610666 - protein, 15 aa, Staphylococcus aureus
GGDPTATGMGGESIY

SEQ ID NO: 1610667 - protein, 5 aa, Staphylococcus aureus
GIAPD

SEQ ID NO: 1610668 - protein, 4 aa, Staphylococcus aureus
GIET

SEQ ID NO: 1610669 - protein, 12 aa, Staphylococcus aureus
GINTDGDALKKR

SEQ ID NO: 1610670 - protein, 20 aa, Staphylococcus aureus
GIPQINGQQTDYVSDYDNGR

SEQ ID NO: 1610671 - protein, 9 aa, Staphylococcus aureus
GKGVQAKQL

SEQ ID NO: 1610672 - protein, 5 aa, Staphylococcus aureus
GMGTS

SEQ ID NO: 1610673 - protein, 8 aa, Staphylococcus aureus
GMGYTGSH

SEQ ID NO: 1610674 - protein, 8 aa, Staphylococcus aureus
GNGGNIAR

SEQ ID NO: 1610675 - protein, 9 aa, Staphylococcus aureus
GPENDKGKR

SEQ ID NO: 1610676 - protein, 6 aa, Staphylococcus aureus
GPNGAG

SEQ ID NO: 1610677 - protein, 10 aa, Staphylococcus aureus
GRAPKEKQSI

SEQ ID NO: 1610678 - protein, 6 aa, Staphylococcus aureus
GRATMS

SEQ ID NO: 1610679 - protein, 10 aa, Staphylococcus aureus
GRHDDKGRLA

SEQ ID NO: 1610680 - protein, 7 aa, Staphylococcus aureus
GRKGFSS

SEQ ID NO: 1610681 - protein, 7 aa, Staphylococcus aureus
GRKSLEE

SEQ ID NO: 1610682 - protein, 18 aa, Staphylococcus aureus
GSSGQHSSYFERYLYPIK

SEQ ID NO: 1610683 - protein, 5 aa, Staphylococcus aureus
GVNGV

SEQ ID NO: 1610684 - protein, 9 aa, Staphylococcus aureus
HEVSIEEKA

SEQ ID NO: 1610685 - protein, 6 aa, Staphylococcus aureus
HGDANE

SEQ ID NO: 1610686 - protein, 12 aa, Staphylococcus aureus
HGREERQLAEKE

SEQ ID NO: 1610687 - protein, 6 aa, Staphylococcus aureus
HNSESI

SEQ ID NO: 1610688 - protein, 8 aa, Staphylococcus aureus
HNTNEEDL

SEQ ID NO: 1610689 - protein, 11 aa, Staphylococcus aureus
HPTTGGVSASF

SEQ ID NO: 1610690 - protein, 9 aa, Staphylococcus aureus
IASGLNDSN

SEQ ID NO: 1610691 - protein, 6 aa, Staphylococcus aureus
IASQHN

SEQ ID NO: 1610692 - protein, 7 aa, Staphylococcus aureus
IDDNVAN

SEQ ID NO: 1610693 - protein, 9 aa, Staphylococcus aureus
IEKPTARKT

SEQ ID NO: 1610694 - protein, 5 aa, Staphylococcus aureus
IGNEH

SEQ ID NO: 1610695 - protein, 4 aa, Staphylococcus aureus
IPGF

SEQ ID NO: 1610696 - protein, 4 aa, Staphylococcus aureus
IREN

SEQ ID NO: 1610697 - protein, 5 aa, Staphylococcus aureus
ITGTS

SEQ ID NO: 1610698 - protein, 13 aa, Staphylococcus aureus
KAETFEKEMPQTK

SEQ ID NO: 1610699 - protein, 9 aa, Staphylococcus aureus
KAPNTSSTI

SEQ ID NO: 1610700 - protein, 6 aa, Staphylococcus aureus
KDNTDA

SEQ ID NO: 1610701 - protein, 11 aa, Staphylococcus aureus
KDPDRRKPIDM

SEQ ID NO: 1610702 - protein, 15 aa, Staphylococcus aureus
KEARDRAISGQGSTL

SEQ ID NO: 1610703 - protein, 12 aa, Staphylococcus aureus
KEDLNKKAGLSQ

SEQ ID NO: 1610704 - protein, 5 aa, Staphylococcus aureus
KEKGF

SEQ ID NO: 1610705 - protein, 10 aa, Staphylococcus aureus
KFGTTDGTIT

SEQ ID NO: 1610706 - protein, 5 aa, Staphylococcus aureus
KGETR

SEQ ID NO: 1610707 - protein, 5 aa, Staphylococcus aureus
KGNAS

SEQ ID NO: 1610708 - protein, 15 aa, Staphylococcus aureus
KGNNVRDGYSTNSRI

SEQ ID NO: 1610709 - protein, 7 aa, Staphylococcus aureus
KGNTTEA

SEQ ID NO: 1610710 - protein, 9 aa, Staphylococcus aureus
KGYDGTTLD

SEQ ID NO: 1610711 - protein, 12 aa, Staphylococcus aureus
KIGHTGTLDPEV

SEQ ID NO: 1610712 - protein, 25 aa, Staphylococcus aureus
KIKDTTNKPVDTSRPTVVSPKYKDI

SEQ ID NO: 1610713 - protein, 15 aa, Staphylococcus aureus
KITSVPQVFQDILAT

SEQ ID NO: 1610714 - protein, 7 aa, Staphylococcus aureus
KKEKPDL

SEQ ID NO: 1610715 - protein, 6 aa, Staphylococcus aureus
KKPELR

SEQ ID NO: 1610716 - protein, 4 aa, Staphylococcus aureus
KKPV

SEQ ID NO: 1610717 - protein, 6 aa, Staphylococcus aureus
KKTYSD

SEQ ID NO: 1610718 - protein, 6 aa, Staphylococcus aureus
KLRRPD

SEQ ID NO: 1610719 - protein, 5 aa, Staphylococcus aureus
KNETT

SEQ ID NO: 1610720 - protein, 13 aa, Staphylococcus aureus
KNPRNKGVLDNGS

SEQ ID NO: 1610721 - protein, 6 aa, Staphylococcus aureus
KNQELN

SEQ ID NO: 1610722 - protein, 7 aa, Staphylococcus aureus
KPIVERT

SEQ ID NO: 1610723 - protein, 10 aa, Staphylococcus aureus
KPNSKSNKKI

SEQ ID NO: 1610724 - protein, 6 aa, Staphylococcus aureus
KPRLTK

SEQ ID NO: 1610725 - protein, 11 aa, Staphylococcus aureus
KQKIMSSDKTI

SEQ ID NO: 1610726 - protein, 8 aa, Staphylococcus aureus
KRKKDSSM

SEQ ID NO: 1610727 - protein, 10 aa, Staphylococcus aureus
KSSGYNSYKA

SEQ ID NO: 1610728 - protein, 4 aa, Staphylococcus aureus
KTEF

SEQ ID NO: 1610729 - protein, 5 aa, Staphylococcus aureus
KTKKK

SEQ ID NO: 1610730 - protein, 12 aa, Staphylococcus aureus
KTSDYKTDKDGI

SEQ ID NO: 1610731 - protein, 36 aa, Staphylococcus aureus
KVNQPKNEGSSGNYQKRGSYYGQRNRISKEKTPKWL

SEQ ID NO: 1610732 - protein, 9 aa, Staphylococcus aureus
KVSGKELEK

SEQ ID NO: 1610733 - protein, 9 aa, Staphylococcus aureus
KVSSTKSMT

SEQ ID NO: 1610734 - protein, 4 aa, Staphylococcus aureus
KYQA

SEQ ID NO: 1610735 - protein, 14 aa, Staphylococcus aureus
LEQSTYKNMTIYDF

SEQ ID NO: 1610736 - protein, 16 aa, Staphylococcus aureus
LESKNRKNVPFTAPAE

SEQ ID NO: 1610737 - protein, 6 aa, Staphylococcus aureus
LGDRFQ

SEQ ID NO: 1610738 - protein, 28 aa, Staphylococcus aureus
LGNDEPTTIDTANSKPAKAVKKPLPSKD

SEQ ID NO: 1610739 - protein, 4 aa, Staphylococcus aureus
LGRT

SEQ ID NO: 1610740 - protein, 7 aa, Staphylococcus aureus
LKGNNIN

SEQ ID NO: 1610741 - protein, 10 aa, Staphylococcus aureus
LNQPDAADEL

SEQ ID NO: 1610742 - protein, 6 aa, Staphylococcus aureus
LSEVET

SEQ ID NO: 1610743 - protein, 23 aa, Staphylococcus aureus
LSGTSSDLRDLSEEAESGKARSQ

SEQ ID NO: 1610744 - protein, 5 aa, Staphylococcus aureus
LSTDN

SEQ ID NO: 1610745 - protein, 8 aa, Staphylococcus aureus
LSVGGDLE

SEQ ID NO: 1610746 - protein, 12 aa, Staphylococcus aureus
LTDKEVEAYFIN

SEQ ID NO: 1610747 - protein, 4 aa, Staphylococcus aureus
MDGY

SEQ ID NO: 1610748 - protein, 9 aa, Staphylococcus aureus
MNDVEPKNR

SEQ ID NO: 1610749 - protein, 17 aa, Staphylococcus aureus
MPKDKSASYYAYYGTDE

SEQ ID NO: 1610750 - protein, 39 aa, Staphylococcus aureus
NAANLRDKQTKLEKQYEEAKNEWKNAQNGMSTSLSEEDI

SEQ ID NO: 1610751 - protein, 10 aa, Staphylococcus aureus
NATPEQYDKN

SEQ ID NO: 1610752 - protein, 6 aa, Staphylococcus aureus
NDLKEG

SEQ ID NO: 1610753 - protein, 5 aa, Staphylococcus aureus
NDSLT

SEQ ID NO: 1610754 - protein, 8 aa, Staphylococcus aureus
NEENNELG

SEQ ID NO: 1610755 - protein, 5 aa, Staphylococcus aureus
NETIS

SEQ ID NO: 1610756 - protein, 11 aa, Staphylococcus aureus
NGAFTGETSPV

SEQ ID NO: 1610757 - protein, 11 aa, Staphylococcus aureus
NHSKKLSVDEN

SEQ ID NO: 1610758 - protein, 8 aa, Staphylococcus aureus
NKCNQRSI

SEQ ID NO: 1610759 - protein, 17 aa, Staphylococcus aureus
NKKQRGSNYDTKLLENR

SEQ ID NO: 1610760 - protein, 5 aa, Staphylococcus aureus
NKVTA

SEQ ID NO: 1610761 - protein, 6 aa, Staphylococcus aureus
NLTPKD

SEQ ID NO: 1610762 - protein, 4 aa, Staphylococcus aureus
NLTV

SEQ ID NO: 1610763 - protein, 7 aa, Staphylococcus aureus
NNPTCGD

SEQ ID NO: 1610764 - protein, 4 aa, Staphylococcus aureus
NPDI

SEQ ID NO: 1610765 - protein, 6 aa, Staphylococcus aureus
NPERSN

SEQ ID NO: 1610766 - protein, 8 aa, Staphylococcus aureus
NPETKEIK

SEQ ID NO: 1610767 - protein, 5 aa, Staphylococcus aureus
NQDAT

SEQ ID NO: 1610768 - protein, 12 aa, Staphylococcus aureus
NQKGDPKKIYDY

SEQ ID NO: 1610769 - protein, 9 aa, Staphylococcus aureus
NRGGDGGIP

SEQ ID NO: 1610770 - protein, 5 aa, Staphylococcus aureus
NRQNH

SEQ ID NO: 1610771 - protein, 5 aa, Staphylococcus aureus
NSLFK

SEQ ID NO: 1610772 - protein, 8 aa, Staphylococcus aureus
NTNENYTG

SEQ ID NO: 1610773 - protein, 25 aa, Staphylococcus aureus
NVGTPEGVRELENAGADATKVGIGP

SEQ ID NO: 1610774 - protein, 15 aa, Staphylococcus aureus
NYGKQNALEQSEHTI

SEQ ID NO: 1610775 - protein, 11 aa, Staphylococcus aureus
PAGEERPLPTT

SEQ ID NO: 1610776 - protein, 6 aa, Staphylococcus aureus
PEDGSL

SEQ ID NO: 1610777 - protein, 7 aa, Staphylococcus aureus
PNEGRSV

SEQ ID NO: 1610778 - protein, 12 aa, Staphylococcus aureus
PPVNRDENGYRI

SEQ ID NO: 1610779 - protein, 7 aa, Staphylococcus aureus
PRPDTGL

SEQ ID NO: 1610780 - protein, 14 aa, Staphylococcus aureus
PSFARNKKRTFSVQ

SEQ ID NO: 1610781 - protein, 7 aa, Staphylococcus aureus
PTAATKV

SEQ ID NO: 1610782 - protein, 5 aa, Staphylococcus aureus
PTRDE

SEQ ID NO: 1610783 - protein, 8 aa, Staphylococcus aureus
PTSALDPI

SEQ ID NO: 1610784 - protein, 20 aa, Staphylococcus aureus
QDDNPDFESGEITQELQKGY

SEQ ID NO: 1610785 - protein, 9 aa, Staphylococcus aureus
QDKKAKLNP

SEQ ID NO: 1610786 - protein, 5 aa, Staphylococcus aureus
QPVGQ

SEQ ID NO: 1610787 - protein, 9 aa, Staphylococcus aureus
QQHQAISEE

SEQ ID NO: 1610788 - protein, 7 aa, Staphylococcus aureus
QQNAEGA

SEQ ID NO: 1610789 - protein, 5 aa, Staphylococcus aureus
QRINN

SEQ ID NO: 1610790 - protein, 9 aa, Staphylococcus aureus
QRQLSRNEA

SEQ ID NO: 1610791 - protein, 7 aa, Staphylococcus aureus
QSNVDNI

SEQ ID NO: 1610792 - protein, 8 aa, Staphylococcus aureus
QYTDEKYK

SEQ ID NO: 1610793 - protein, 10 aa, Staphylococcus aureus
RAAPAEGDGE

SEQ ID NO: 1610794 - protein, 15 aa, Staphylococcus aureus
RAKSEYTSDESIDAL

SEQ ID NO: 1610795 - protein, 8 aa, Staphylococcus aureus
RALTTKYD

SEQ ID NO: 1610796 - protein, 9 aa, Staphylococcus aureus
RDGEQTPGV

SEQ ID NO: 1610797 - protein, 10 aa, Staphylococcus aureus
REEAYDKVQP

SEQ ID NO: 1610798 - protein, 7 aa, Staphylococcus aureus
REEREAV

SEQ ID NO: 1610799 - protein, 8 aa, Staphylococcus aureus
RERSEVDQ

SEQ ID NO: 1610800 - protein, 8 aa, Staphylococcus aureus
RGKKPIQR

SEQ ID NO: 1610801 - protein, 5 aa, Staphylococcus aureus
RGMAE

SEQ ID NO: 1610802 - protein, 4 aa, Staphylococcus aureus
RGVE

SEQ ID NO: 1610803 - protein, 9 aa, Staphylococcus aureus
RLSEDKDKE

SEQ ID NO: 1610804 - protein, 4 aa, Staphylococcus aureus
RNVK

SEQ ID NO: 1610805 - protein, 8 aa, Staphylococcus aureus
RNVNDNSE

SEQ ID NO: 1610806 - protein, 4 aa, Staphylococcus aureus
RPFH

SEQ ID NO: 1610807 - protein, 8 aa, Staphylococcus aureus
RPSGTEPK

SEQ ID NO: 1610808 - protein, 9 aa, Staphylococcus aureus
RQPQMGETI

SEQ ID NO: 1610809 - protein, 9 aa, Staphylococcus aureus
RQQTGLHNQ

SEQ ID NO: 1610810 - protein, 5 aa, Staphylococcus aureus
RQVNR

SEQ ID NO: 1610811 - protein, 14 aa, Staphylococcus aureus
SASKLNFEPKEGDE

SEQ ID NO: 1610812 - protein, 7 aa, Staphylococcus aureus
SCDETSV

SEQ ID NO: 1610813 - protein, 4 aa, Staphylococcus aureus
SDDE

SEQ ID NO: 1610814 - protein, 4 aa, Staphylococcus aureus
SDIR

SEQ ID NO: 1610815 - protein, 8 aa, Staphylococcus aureus
SEDSYLRS

SEQ ID NO: 1610816 - protein, 10 aa, Staphylococcus aureus
SEGDKDALHT

SEQ ID NO: 1610817 - protein, 15 aa, Staphylococcus aureus
SEKISEAMDANDPIP

SEQ ID NO: 1610818 - protein, 11 aa, Staphylococcus aureus
SELRSGKRKVN

SEQ ID NO: 1610819 - protein, 6 aa, Staphylococcus aureus
SESKCY

SEQ ID NO: 1610820 - protein, 6 aa, Staphylococcus aureus
SFDSNG

SEQ ID NO: 1610821 - protein, 6 aa, Staphylococcus aureus
SFEGQG

SEQ ID NO: 1610822 - protein, 8 aa, Staphylococcus aureus
SGENELKY

SEQ ID NO: 1610823 - protein, 4 aa, Staphylococcus aureus
SGGQ

SEQ ID NO: 1610824 - protein, 11 aa, Staphylococcus aureus
SGQYGDKVSPK

SEQ ID NO: 1610825 - protein, 14 aa, Staphylococcus aureus
SGTTGLPKAYYRDE

SEQ ID NO: 1610826 - protein, 6 aa, Staphylococcus aureus
SNDDIS

SEQ ID NO: 1610827 - protein, 5 aa, Staphylococcus aureus
SNLDA

SEQ ID NO: 1610828 - protein, 6 aa, Staphylococcus aureus
SNTVKG

SEQ ID NO: 1610829 - protein, 10 aa, Staphylococcus aureus
SSTDSAHLAA

SEQ ID NO: 1610830 - protein, 6 aa, Staphylococcus aureus
SSVKEA

SEQ ID NO: 1610831 - protein, 7 aa, Staphylococcus aureus
STLQDRR

SEQ ID NO: 1610832 - protein, 6 aa, Staphylococcus aureus
SVGQTP

SEQ ID NO: 1610833 - protein, 6 aa, Staphylococcus aureus
SVSTND

SEQ ID NO: 1610834 - protein, 11 aa, Staphylococcus aureus
TAGMDVSGREE

SEQ ID NO: 1610835 - protein, 6 aa, Staphylococcus aureus
TDDPSL

SEQ ID NO: 1610836 - protein, 6 aa, Staphylococcus aureus
TEADAS

SEQ ID NO: 1610837 - protein, 4 aa, Staphylococcus aureus
TEYP

SEQ ID NO: 1610838 - protein, 6 aa, Staphylococcus aureus
TGGSGM

SEQ ID NO: 1610839 - protein, 9 aa, Staphylococcus aureus
TGLKEVSEA

SEQ ID NO: 1610840 - protein, 5 aa, Staphylococcus aureus
TGTVS

SEQ ID NO: 1610841 - protein, 6 aa, Staphylococcus aureus
TKGETL

SEQ ID NO: 1610842 - protein, 12 aa, Staphylococcus aureus
TLPERARNLTED

SEQ ID NO: 1610843 - protein, 18 aa, Staphylococcus aureus
TRKSSLRDTYFNINQRGD

SEQ ID NO: 1610844 - protein, 11 aa, Staphylococcus aureus
TSVSLKRHSDA

SEQ ID NO: 1610845 - protein, 4 aa, Staphylococcus aureus
TVFN

SEQ ID NO: 1610846 - protein, 11 aa, Staphylococcus aureus
VGEDGPTHEPI

SEQ ID NO: 1610847 - protein, 7 aa, Staphylococcus aureus
VGGYPKG

SEQ ID NO: 1610848 - protein, 4 aa, Staphylococcus aureus
VKSN

SEQ ID NO: 1610849 - protein, 10 aa, Staphylococcus aureus
VPKEASSNEA

SEQ ID NO: 1610850 - protein, 6 aa, Staphylococcus aureus
VQEQNY

SEQ ID NO: 1610851 - protein, 6 aa, Staphylococcus aureus
VSQDAK

SEQ ID NO: 1610852 - protein, 8 aa, Staphylococcus aureus
VTATGKAV

SEQ ID NO: 1610853 - protein, 5 aa, Staphylococcus aureus
VVADT

SEQ ID NO: 1610854 - protein, 5 aa, Staphylococcus aureus
YDGIP

SEQ ID NO: 1610855 - protein, 4 aa, Staphylococcus aureus
YDSD

SEQ ID NO: 1610856 - protein, 8 aa, Staphylococcus aureus
YESGVTAG

SEQ ID NO: 1610857 - protein, 4 aa, Staphylococcus aureus
YQGY

SEQ ID NO: 1610858 - protein, 9 aa, Staphylococcus aureus
YQKGEKRNI

SEQ ID NO: 1610859 - protein, 4 aa, Staphylococcus aureus
YQRP

SEQ ID NO: 1610860 - protein, 17 aa, Staphylococcus aureus
AATMAEGAQKIVKLVKE

SEQ ID NO: 1610861 - protein, 10 aa, Staphylococcus aureus
ADGLAKSSRN

SEQ ID NO: 1610862 - protein, 7 aa, Staphylococcus aureus
ADISPGT

SEQ ID NO: 1610863 - protein, 21 aa, Staphylococcus aureus
AEDGSVDFEDNRYTENTRAAY

SEQ ID NO: 1610864 - protein, 10 aa, Staphylococcus aureus
AELSGGQQQR

SEQ ID NO: 1610865 - protein, 7 aa, Staphylococcus aureus
AGQDAKE

SEQ ID NO: 1610866 - protein, 8 aa, Staphylococcus aureus
AGRTISEE

SEQ ID NO: 1610867 - protein, 8 aa, Staphylococcus aureus
AHGRERKG

SEQ ID NO: 1610868 - protein, 4 aa, Staphylococcus aureus
AIEP

SEQ ID NO: 1610869 - protein, 7 aa, Staphylococcus aureus
AKEFSND

SEQ ID NO: 1610870 - protein, 20 aa, Staphylococcus aureus
AKKKKEVGLTQEEAKEQTAL

SEQ ID NO: 1610871 - protein, 8 aa, Staphylococcus aureus
ALATQDHN

SEQ ID NO: 1610872 - protein, 8 aa, Staphylococcus aureus
APANGTVE

SEQ ID NO: 1610873 - protein, 4 aa, Staphylococcus aureus
AQAG

SEQ ID NO: 1610874 - protein, 21 aa, Staphylococcus aureus
AQQDVDQEKAKDLEKKMRESS

SEQ ID NO: 1610875 - protein, 6 aa, Staphylococcus aureus
ARGDAN

SEQ ID NO: 1610876 - protein, 7 aa, Staphylococcus aureus
ARKYGLE

SEQ ID NO: 1610877 - protein, 5 aa, Staphylococcus aureus
ARQHE

SEQ ID NO: 1610878 - protein, 6 aa, Staphylococcus aureus
ARQTIQ

SEQ ID NO: 1610879 - protein, 5 aa, Staphylococcus aureus
ATQEE

SEQ ID NO: 1610880 - protein, 4 aa, Staphylococcus aureus
AYEG

SEQ ID NO: 1610881 - protein, 4 aa, Staphylococcus aureus
DALI

SEQ ID NO: 1610882 - protein, 7 aa, Staphylococcus aureus
DAYPRQI

SEQ ID NO: 1610883 - protein, 12 aa, Staphylococcus aureus
DDLRDAGSNVYA

SEQ ID NO: 1610884 - protein, 5 aa, Staphylococcus aureus
DEDID

SEQ ID NO: 1610885 - protein, 14 aa, Staphylococcus aureus
DEGQVNESSMVREP

SEQ ID NO: 1610886 - protein, 7 aa, Staphylococcus aureus
DENGEME

SEQ ID NO: 1610887 - protein, 6 aa, Staphylococcus aureus
DLPEQQ

SEQ ID NO: 1610888 - protein, 9 aa, Staphylococcus aureus
DNEETEEDV

SEQ ID NO: 1610889 - protein, 5 aa, Staphylococcus aureus
DNFDG

SEQ ID NO: 1610890 - protein, 8 aa, Staphylococcus aureus
DPGWLGPK

SEQ ID NO: 1610891 - protein, 5 aa, Staphylococcus aureus
DQDPH

SEQ ID NO: 1610892 - protein, 19 aa, Staphylococcus aureus
DSKVAKHTKANTDLTTEDL

SEQ ID NO: 1610893 - protein, 6 aa, Staphylococcus aureus
DTSFNV

SEQ ID NO: 1610894 - protein, 4 aa, Staphylococcus aureus
DVDS

SEQ ID NO: 1610895 - protein, 12 aa, Staphylococcus aureus
EAARESTKEQLR

SEQ ID NO: 1610896 - protein, 5 aa, Staphylococcus aureus
EARSL

SEQ ID NO: 1610897 - protein, 8 aa, Staphylococcus aureus
EEVNEKLR

SEQ ID NO: 1610898 - protein, 7 aa, Staphylococcus aureus
EKDIPRN

SEQ ID NO: 1610899 - protein, 9 aa, Staphylococcus aureus
EKDSDDLDG

SEQ ID NO: 1610900 - protein, 8 aa, Staphylococcus aureus
EKENGEIA

SEQ ID NO: 1610901 - protein, 4 aa, Staphylococcus aureus
EKPD

SEQ ID NO: 1610902 - protein, 5 aa, Staphylococcus aureus
EKSAQ

SEQ ID NO: 1610903 - protein, 8 aa, Staphylococcus aureus
EKSEVRRI

SEQ ID NO: 1610904 - protein, 21 aa, Staphylococcus aureus
ENSTYTFGQPKEFKESELREE

SEQ ID NO: 1610905 - protein, 4 aa, Staphylococcus aureus
ENTV

SEQ ID NO: 1610906 - protein, 11 aa, Staphylococcus aureus
EPTAALDTENA

SEQ ID NO: 1610907 - protein, 4 aa, Staphylococcus aureus
EQSK

SEQ ID NO: 1610908 - protein, 6 aa, Staphylococcus aureus
FEGNET

SEQ ID NO: 1610909 - protein, 15 aa, Staphylococcus aureus
FEQQKKEKEMKKKQK

SEQ ID NO: 1610910 - protein, 7 aa, Staphylococcus aureus
FRSSGYD

SEQ ID NO: 1610911 - protein, 5 aa, Staphylococcus aureus
GEDEP

SEQ ID NO: 1610912 - protein, 9 aa, Staphylococcus aureus
GGNTKMDGG

SEQ ID NO: 1610913 - protein, 22 aa, Staphylococcus aureus
GIGGAYKNNQGHIDNGELHKAN

SEQ ID NO: 1610914 - protein, 9 aa, Staphylococcus aureus
GKGIPGSSV

SEQ ID NO: 1610915 - protein, 6 aa, Staphylococcus aureus
GKSTLA

SEQ ID NO: 1610916 - protein, 8 aa, Staphylococcus aureus
GNNPGTTM

SEQ ID NO: 1610917 - protein, 5 aa, Staphylococcus aureus
GNTHH

SEQ ID NO: 1610918 - protein, 9 aa, Staphylococcus aureus
HREQQPITT

SEQ ID NO: 1610919 - protein, 12 aa, Staphylococcus aureus
IADKKKSVSDRD

SEQ ID NO: 1610920 - protein, 7 aa, Staphylococcus aureus
IDWPGED

SEQ ID NO: 1610921 - protein, 27 aa, Staphylococcus aureus
IEEQIPTSALHKSDNAYTRELIEKQLS

SEQ ID NO: 1610922 - protein, 11 aa, Staphylococcus aureus
IGIEPGRSIVG

SEQ ID NO: 1610923 - protein, 4 aa, Staphylococcus aureus
IGRD

SEQ ID NO: 1610924 - protein, 12 aa, Staphylococcus aureus
IIPNSTGAAKAI

SEQ ID NO: 1610925 - protein, 12 aa, Staphylococcus aureus
ITDRFDDNDKEH

SEQ ID NO: 1610926 - protein, 6 aa, Staphylococcus aureus
ITDRRK

SEQ ID NO: 1610927 - protein, 8 aa, Staphylococcus aureus
ITQGTNSD

SEQ ID NO: 1610928 - protein, 16 aa, Staphylococcus aureus
KAEKAGKKVEMKKTEE

SEQ ID NO: 1610929 - protein, 8 aa, Staphylococcus aureus
KANLDRND

SEQ ID NO: 1610930 - protein, 8 aa, Staphylococcus aureus
KDHANELN

SEQ ID NO: 1610931 - protein, 6 aa, Staphylococcus aureus
KEDDVD

SEQ ID NO: 1610932 - protein, 9 aa, Staphylococcus aureus
KESADIDKE

SEQ ID NO: 1610933 - protein, 4 aa, Staphylococcus aureus
KETM

SEQ ID NO: 1610934 - protein, 4 aa, Staphylococcus aureus
KFQN

SEQ ID NO: 1610935 - protein, 8 aa, Staphylococcus aureus
KGPQPIQR

SEQ ID NO: 1610936 - protein, 7 aa, Staphylococcus aureus
KKEGKSQ

SEQ ID NO: 1610937 - protein, 9 aa, Staphylococcus aureus
KKSGETKPV

SEQ ID NO: 1610938 - protein, 6 aa, Staphylococcus aureus
KLTERQ

SEQ ID NO: 1610939 - protein, 6 aa, Staphylococcus aureus
KNDKEQ

SEQ ID NO: 1610940 - protein, 9 aa, Staphylococcus aureus
KNQGGDETV

SEQ ID NO: 1610941 - protein, 4 aa, Staphylococcus aureus
LAGQ

SEQ ID NO: 1610942 - protein, 5 aa, Staphylococcus aureus
LDNAE

SEQ ID NO: 1610943 - protein, 16 aa, Staphylococcus aureus
LDRKDNSSKDKSNYKV

SEQ ID NO: 1610944 - protein, 10 aa, Staphylococcus aureus
LEAGTQYRGA

SEQ ID NO: 1610945 - protein, 4 aa, Staphylococcus aureus
LGEG

SEQ ID NO: 1610946 - protein, 9 aa, Staphylococcus aureus
LGKKGSVSG

SEQ ID NO: 1610947 - protein, 14 aa, Staphylococcus aureus
LLATPNEDEKPEEI

SEQ ID NO: 1610948 - protein, 10 aa, Staphylococcus aureus
LPQEKSGVIA

SEQ ID NO: 1610949 - protein, 8 aa, Staphylococcus aureus
LPSDFPEN

SEQ ID NO: 1610950 - protein, 6 aa, Staphylococcus aureus
LPTLTE

SEQ ID NO: 1610951 - protein, 16 aa, Staphylococcus aureus
LRPYGQEKFGTKAELK

SEQ ID NO: 1610952 - protein, 12 aa, Staphylococcus aureus
LSRDDNFKQFDE

SEQ ID NO: 1610953 - protein, 12 aa, Staphylococcus aureus
LSSEAEYQRGYG

SEQ ID NO: 1610954 - protein, 12 aa, Staphylococcus aureus
LTAENVKNGNIS

SEQ ID NO: 1610955 - protein, 6 aa, Staphylococcus aureus
LTNNNE

SEQ ID NO: 1610956 - protein, 7 aa, Staphylococcus aureus
MEKDGNY

SEQ ID NO: 1610957 - protein, 10 aa, Staphylococcus aureus
MGRRAENNRI

SEQ ID NO: 1610958 - protein, 4 aa, Staphylococcus aureus
MNRQ

SEQ ID NO: 1610959 - protein, 8 aa, Staphylococcus aureus
NADTDGLA

SEQ ID NO: 1610960 - protein, 5 aa, Staphylococcus aureus
NAKAE

SEQ ID NO: 1610961 - protein, 23 aa, Staphylococcus aureus
NDQNYTARFSRSNPLAGDPENAY

SEQ ID NO: 1610962 - protein, 4 aa, Staphylococcus aureus
NEKQ

SEQ ID NO: 1610963 - protein, 4 aa, Staphylococcus aureus
NEQH

SEQ ID NO: 1610964 - protein, 5 aa, Staphylococcus aureus
NGRDI

SEQ ID NO: 1610965 - protein, 4 aa, Staphylococcus aureus
NKQR

SEQ ID NO: 1610966 - protein, 4 aa, Staphylococcus aureus
NKSK

SEQ ID NO: 1610967 - protein, 9 aa, Staphylococcus aureus
NLDPATGHE

SEQ ID NO: 1610968 - protein, 6 aa, Staphylococcus aureus
NPNPTN

SEQ ID NO: 1610969 - protein, 9 aa, Staphylococcus aureus
NSTPGMKTR

SEQ ID NO: 1610970 - protein, 7 aa, Staphylococcus aureus
NTNEEVD

SEQ ID NO: 1610971 - protein, 9 aa, Staphylococcus aureus
NVNKSLKGL

SEQ ID NO: 1610972 - protein, 8 aa, Staphylococcus aureus
NVSNERAK

SEQ ID NO: 1610973 - protein, 11 aa, Staphylococcus aureus
NYERKKEKQSV

SEQ ID NO: 1610974 - protein, 9 aa, Staphylococcus aureus
PKRKRTTYL

SEQ ID NO: 1610975 - protein, 14 aa, Staphylococcus aureus
PNEDDRDGEVPYHS

SEQ ID NO: 1610976 - protein, 11 aa, Staphylococcus aureus
PNLGVPSEQDI

SEQ ID NO: 1610977 - protein, 5 aa, Staphylococcus aureus
PPNVT

SEQ ID NO: 1610978 - protein, 4 aa, Staphylococcus aureus
PTIT

SEQ ID NO: 1610979 - protein, 6 aa, Staphylococcus aureus
PTQNTS

SEQ ID NO: 1610980 - protein, 8 aa, Staphylococcus aureus
PYKRPLSN

SEQ ID NO: 1610981 - protein, 11 aa, Staphylococcus aureus
QAEQSEEGLES

SEQ ID NO: 1610982 - protein, 13 aa, Staphylococcus aureus
QGEGGVNIPPKGY

SEQ ID NO: 1610983 - protein, 9 aa, Staphylococcus aureus
QITKEDVKR

SEQ ID NO: 1610984 - protein, 11 aa, Staphylococcus aureus
QKGKGAGRTAQ

SEQ ID NO: 1610985 - protein, 7 aa, Staphylococcus aureus
QNNSYES

SEQ ID NO: 1610986 - protein, 8 aa, Staphylococcus aureus
QPFTTEDY

SEQ ID NO: 1610987 - protein, 4 aa, Staphylococcus aureus
QRIQ

SEQ ID NO: 1610988 - protein, 4 aa, Staphylococcus aureus
QTSH

SEQ ID NO: 1610989 - protein, 4 aa, Staphylococcus aureus
QTSQ

SEQ ID NO: 1610990 - protein, 5 aa, Staphylococcus aureus
QVINP

SEQ ID NO: 1610991 - protein, 16 aa, Staphylococcus aureus
RAPGSVGMASDASRVF

SEQ ID NO: 1610992 - protein, 12 aa, Staphylococcus aureus
RELAYTRYTWPK

SEQ ID NO: 1610993 - protein, 4 aa, Staphylococcus aureus
RERG

SEQ ID NO: 1610994 - protein, 6 aa, Staphylococcus aureus
RGNKQM

SEQ ID NO: 1610995 - protein, 8 aa, Staphylococcus aureus
RKGVQNAI

SEQ ID NO: 1610996 - protein, 39 aa, Staphylococcus aureus
RNGLEEQKQYTDDQLSDLSNNPEIKASIEQANQEAQEAL

SEQ ID NO: 1610997 - protein, 4 aa, Staphylococcus aureus
RPLD

SEQ ID NO: 1610998 - protein, 5 aa, Staphylococcus aureus
RRTGD

SEQ ID NO: 1610999 - protein, 10 aa, Staphylococcus aureus
RTKEISEKNK

SEQ ID NO: 1611000 - protein, 5 aa, Staphylococcus aureus
SDDEI

SEQ ID NO: 1611001 - protein, 4 aa, Staphylococcus aureus
SEIP

SEQ ID NO: 1611002 - protein, 6 aa, Staphylococcus aureus
SIKGLS

SEQ ID NO: 1611003 - protein, 8 aa, Staphylococcus aureus
SQATPTLQ

SEQ ID NO: 1611004 - protein, 8 aa, Staphylococcus aureus
SSSAKGKI

SEQ ID NO: 1611005 - protein, 6 aa, Staphylococcus aureus
SYNPFV

SEQ ID NO: 1611006 - protein, 5 aa, Staphylococcus aureus
TASQL

SEQ ID NO: 1611007 - protein, 8 aa, Staphylococcus aureus
TDDTTVTV

SEQ ID NO: 1611008 - protein, 4 aa, Staphylococcus aureus
TDTP

SEQ ID NO: 1611009 - protein, 10 aa, Staphylococcus aureus
TDVEENHTET

SEQ ID NO: 1611010 - protein, 7 aa, Staphylococcus aureus
TEKPFKR

SEQ ID NO: 1611011 - protein, 14 aa, Staphylococcus aureus
THPGSPNGTFTKET

SEQ ID NO: 1611012 - protein, 4 aa, Staphylococcus aureus
TLPA

SEQ ID NO: 1611013 - protein, 8 aa, Staphylococcus aureus
TNEPRVNE

SEQ ID NO: 1611014 - protein, 11 aa, Staphylococcus aureus
TPYKESDIEPY

SEQ ID NO: 1611015 - protein, 9 aa, Staphylococcus aureus
TSGGGGKGM

SEQ ID NO: 1611016 - protein, 6 aa, Staphylococcus aureus
TSQETA

SEQ ID NO: 1611017 - protein, 4 aa, Staphylococcus aureus
TTEH

SEQ ID NO: 1611018 - protein, 8 aa, Staphylococcus aureus
TYKTTPEL

SEQ ID NO: 1611019 - protein, 7 aa, Staphylococcus aureus
VDEPEDV

SEQ ID NO: 1611020 - protein, 6 aa, Staphylococcus aureus
VGTQTM

SEQ ID NO: 1611021 - protein, 7 aa, Staphylococcus aureus
VKKVDEA

SEQ ID NO: 1611022 - protein, 10 aa, Staphylococcus aureus
VPKATDDFRD

SEQ ID NO: 1611023 - protein, 6 aa, Staphylococcus aureus
VPSDQW

SEQ ID NO: 1611024 - protein, 7 aa, Staphylococcus aureus
VSDTVDS

SEQ ID NO: 1611025 - protein, 10 aa, Staphylococcus aureus
VTKSKVRRER

SEQ ID NO: 1611026 - protein, 11 aa, Staphylococcus aureus
YDDEKALNQLG

SEQ ID NO: 1611027 - protein, 6 aa, Staphylococcus aureus
YQTAGT

SEQ ID NO: 1611028 - protein, 7 aa, Staphylococcus aureus
YSSAGSF

SEQ ID NO: 1611029 - protein, 15 aa, Staphylococcus aureus
YTTKELTQKAKTLKL

SEQ ID NO: 1611030 - protein, 12 aa, Staphylococcus aureus
AAIDGGKSIDTS

SEQ ID NO: 1611031 - protein, 11 aa, Staphylococcus aureus
AAKGGNAKQIM

SEQ ID NO: 1611032 - protein, 9 aa, Staphylococcus aureus
AAKRRNMQI

SEQ ID NO: 1611033 - protein, 4 aa, Staphylococcus aureus
ADDL

SEQ ID NO: 1611034 - protein, 7 aa, Staphylococcus aureus
AETGKER

SEQ ID NO: 1611035 - protein, 8 aa, Staphylococcus aureus
AFETSDKS

SEQ ID NO: 1611036 - protein, 5 aa, Staphylococcus aureus
AGGEN

SEQ ID NO: 1611037 - protein, 5 aa, Staphylococcus aureus
AGGRE

SEQ ID NO: 1611038 - protein, 12 aa, Staphylococcus aureus
AKEGMEVSTDKS

SEQ ID NO: 1611039 - protein, 7 aa, Staphylococcus aureus
AKEINAD

SEQ ID NO: 1611040 - protein, 6 aa, Staphylococcus aureus
AKTFEQ

SEQ ID NO: 1611041 - protein, 5 aa, Staphylococcus aureus
ANDEV

SEQ ID NO: 1611042 - protein, 5 aa, Staphylococcus aureus
ANKSH

SEQ ID NO: 1611043 - protein, 7 aa, Staphylococcus aureus
ANSERTI

SEQ ID NO: 1611044 - protein, 6 aa, Staphylococcus aureus
ANSGKY

SEQ ID NO: 1611045 - protein, 6 aa, Staphylococcus aureus
AQGDID

SEQ ID NO: 1611046 - protein, 11 aa, Staphylococcus aureus
ASRPASEPLQG

SEQ ID NO: 1611047 - protein, 16 aa, Staphylococcus aureus
ASRRGKLTSVDKENVL

SEQ ID NO: 1611048 - protein, 14 aa, Staphylococcus aureus
ATDDQRVPSSKGVI

SEQ ID NO: 1611049 - protein, 6 aa, Staphylococcus aureus
DDTPLG

SEQ ID NO: 1611050 - protein, 12 aa, Staphylococcus aureus
DEETGIKATHEE

SEQ ID NO: 1611051 - protein, 4 aa, Staphylococcus aureus
DFNE

SEQ ID NO: 1611052 - protein, 9 aa, Staphylococcus aureus
DGETALHPS

SEQ ID NO: 1611053 - protein, 6 aa, Staphylococcus aureus
DGLTDY

SEQ ID NO: 1611054 - protein, 5 aa, Staphylococcus aureus
DIDQY

SEQ ID NO: 1611055 - protein, 9 aa, Staphylococcus aureus
DIEARDQYD

SEQ ID NO: 1611056 - protein, 7 aa, Staphylococcus aureus
DKGRAYL

SEQ ID NO: 1611057 - protein, 6 aa, Staphylococcus aureus
DQGLGD

SEQ ID NO: 1611058 - protein, 6 aa, Staphylococcus aureus
DRRGPH

SEQ ID NO: 1611059 - protein, 12 aa, Staphylococcus aureus
DSQNIDNHDLLE

SEQ ID NO: 1611060 - protein, 9 aa, Staphylococcus aureus
DTPKLESDG

SEQ ID NO: 1611061 - protein, 9 aa, Staphylococcus aureus
EASGAVSGL

SEQ ID NO: 1611062 - protein, 19 aa, Staphylococcus aureus
EESSYTTGQVFGVSGGVQI

SEQ ID NO: 1611063 - protein, 5 aa, Staphylococcus aureus
EGSIP

SEQ ID NO: 1611064 - protein, 8 aa, Staphylococcus aureus
ELGGKSPY

SEQ ID NO: 1611065 - protein, 12 aa, Staphylococcus aureus
ELSGPVATSYTV

SEQ ID NO: 1611066 - protein, 5 aa, Staphylococcus aureus
EQPAT

SEQ ID NO: 1611067 - protein, 7 aa, Staphylococcus aureus
EQQGQRD

SEQ ID NO: 1611068 - protein, 15 aa, Staphylococcus aureus
ESKSGYGLDRENELK

SEQ ID NO: 1611069 - protein, 5 aa, Staphylococcus aureus
ETGNP

SEQ ID NO: 1611070 - protein, 9 aa, Staphylococcus aureus
ETLQQPTAH

SEQ ID NO: 1611071 - protein, 7 aa, Staphylococcus aureus
FESDTDT

SEQ ID NO: 1611072 - protein, 6 aa, Staphylococcus aureus
FETEQE

SEQ ID NO: 1611073 - protein, 4 aa, Staphylococcus aureus
FHEP

SEQ ID NO: 1611074 - protein, 7 aa, Staphylococcus aureus
FMPREDQ

SEQ ID NO: 1611075 - protein, 9 aa, Staphylococcus aureus
FTPSNAGKL

SEQ ID NO: 1611076 - protein, 15 aa, Staphylococcus aureus
GAHNNTLGATLAGEV

SEQ ID NO: 1611077 - protein, 9 aa, Staphylococcus aureus
GANSNITYG

SEQ ID NO: 1611078 - protein, 6 aa, Staphylococcus aureus
GFGPSG

SEQ ID NO: 1611079 - protein, 4 aa, Staphylococcus aureus
GGHQ

SEQ ID NO: 1611080 - protein, 8 aa, Staphylococcus aureus
GGIRTHGD

SEQ ID NO: 1611081 - protein, 7 aa, Staphylococcus aureus
GGQMAKT

SEQ ID NO: 1611082 - protein, 11 aa, Staphylococcus aureus
GIHQDGTKKNI

SEQ ID NO: 1611083 - protein, 7 aa, Staphylococcus aureus
GKPLPNR

SEQ ID NO: 1611084 - protein, 8 aa, Staphylococcus aureus
GKSLSELA

SEQ ID NO: 1611085 - protein, 5 aa, Staphylococcus aureus
GKTTL

SEQ ID NO: 1611086 - protein, 8 aa, Staphylococcus aureus
GKVKTGES

SEQ ID NO: 1611087 - protein, 4 aa, Staphylococcus aureus
GLKN

SEQ ID NO: 1611088 - protein, 7 aa, Staphylococcus aureus
GNNAENN

SEQ ID NO: 1611089 - protein, 6 aa, Staphylococcus aureus
GNQSSI

SEQ ID NO: 1611090 - protein, 5 aa, Staphylococcus aureus
GSKEQ

SEQ ID NO: 1611091 - protein, 19 aa, Staphylococcus aureus
HEESPGETVELDGKQYKEY

SEQ ID NO: 1611092 - protein, 5 aa, Staphylococcus aureus
HSWGA

SEQ ID NO: 1611093 - protein, 6 aa, Staphylococcus aureus
IDAQEA

SEQ ID NO: 1611094 - protein, 5 aa, Staphylococcus aureus
IDPKN

SEQ ID NO: 1611095 - protein, 8 aa, Staphylococcus aureus
IGPKETLN

SEQ ID NO: 1611096 - protein, 8 aa, Staphylococcus aureus
INTPKQLP

SEQ ID NO: 1611097 - protein, 7 aa, Staphylococcus aureus
IQGPKAR

SEQ ID NO: 1611098 - protein, 5 aa, Staphylococcus aureus
IQPKT

SEQ ID NO: 1611099 - protein, 4 aa, Staphylococcus aureus
IRQQ

SEQ ID NO: 1611100 - protein, 11 aa, Staphylococcus aureus
ISGDSKKKHQN

SEQ ID NO: 1611101 - protein, 12 aa, Staphylococcus aureus
ISPVSGGDVNEA

SEQ ID NO: 1611102 - protein, 12 aa, Staphylococcus aureus
ITEKSSEAMAED

SEQ ID NO: 1611103 - protein, 8 aa, Staphylococcus aureus
ITPRENKG

SEQ ID NO: 1611104 - protein, 17 aa, Staphylococcus aureus
KARDEKVSEYGIEQADG

SEQ ID NO: 1611105 - protein, 9 aa, Staphylococcus aureus
KDNKGKETV

SEQ ID NO: 1611106 - protein, 5 aa, Staphylococcus aureus
KEHGT

SEQ ID NO: 1611107 - protein, 11 aa, Staphylococcus aureus
KERNERSDKGQ

SEQ ID NO: 1611108 - protein, 7 aa, Staphylococcus aureus
KGFEQTR

SEQ ID NO: 1611109 - protein, 7 aa, Staphylococcus aureus
KGPEIRT

SEQ ID NO: 1611110 - protein, 11 aa, Staphylococcus aureus
KKKASQTNNPL

SEQ ID NO: 1611111 - protein, 10 aa, Staphylococcus aureus
KKTLEESGVD

SEQ ID NO: 1611112 - protein, 12 aa, Staphylococcus aureus
KNIEQSLKAGHT

SEQ ID NO: 1611113 - protein, 4 aa, Staphylococcus aureus
KPRE

SEQ ID NO: 1611114 - protein, 8 aa, Staphylococcus aureus
KRLEEQGL

SEQ ID NO: 1611115 - protein, 8 aa, Staphylococcus aureus
KRSLQDER

SEQ ID NO: 1611116 - protein, 9 aa, Staphylococcus aureus
KSQMSDDEI

SEQ ID NO: 1611117 - protein, 16 aa, Staphylococcus aureus
KSVNQIPGSGAAGGMG

SEQ ID NO: 1611118 - protein, 14 aa, Staphylococcus aureus
LAQTGRLSSVDPNL

SEQ ID NO: 1611119 - protein, 4 aa, Staphylococcus aureus
LEQA

SEQ ID NO: 1611120 - protein, 11 aa, Staphylococcus aureus
LEQSLKEGYSQ

SEQ ID NO: 1611121 - protein, 10 aa, Staphylococcus aureus
LESMTPETAT

SEQ ID NO: 1611122 - protein, 14 aa, Staphylococcus aureus
LNTTEKLYEYANKV

SEQ ID NO: 1611123 - protein, 5 aa, Staphylococcus aureus
LPKKD

SEQ ID NO: 1611124 - protein, 7 aa, Staphylococcus aureus
LRRDQHD

SEQ ID NO: 1611125 - protein, 10 aa, Staphylococcus aureus
LTPPGNPQNF

SEQ ID NO: 1611126 - protein, 7 aa, Staphylococcus aureus
MAEQDGQ

SEQ ID NO: 1611127 - protein, 5 aa, Staphylococcus aureus
NAKSD

SEQ ID NO: 1611128 - protein, 8 aa, Staphylococcus aureus
NDKVRLDK

SEQ ID NO: 1611129 - protein, 10 aa, Staphylococcus aureus
NEEEIKNHAP

SEQ ID NO: 1611130 - protein, 13 aa, Staphylococcus aureus
NEEYQAKQNADVN

SEQ ID NO: 1611131 - protein, 6 aa, Staphylococcus aureus
NGANDY

SEQ ID NO: 1611132 - protein, 9 aa, Staphylococcus aureus
NGLSSKEIS

SEQ ID NO: 1611133 - protein, 5 aa, Staphylococcus aureus
NNNHE

SEQ ID NO: 1611134 - protein, 25 aa, Staphylococcus aureus
NRNYTKESKERLARTISQTNDNLDM

SEQ ID NO: 1611135 - protein, 8 aa, Staphylococcus aureus
NSRDEALK

SEQ ID NO: 1611136 - protein, 10 aa, Staphylococcus aureus
NTQQTKDISF

SEQ ID NO: 1611137 - protein, 4 aa, Staphylococcus aureus
NTQS

SEQ ID NO: 1611138 - protein, 7 aa, Staphylococcus aureus
PDNGSLS

SEQ ID NO: 1611139 - protein, 5 aa, Staphylococcus aureus
PEREI

SEQ ID NO: 1611140 - protein, 8 aa, Staphylococcus aureus
PGVGSDRR

SEQ ID NO: 1611141 - protein, 6 aa, Staphylococcus aureus
PGVPKG

SEQ ID NO: 1611142 - protein, 14 aa, Staphylococcus aureus
PLPKKAGRNNQGKL

SEQ ID NO: 1611143 - protein, 7 aa, Staphylococcus aureus
PNSTYIQ

SEQ ID NO: 1611144 - protein, 9 aa, Staphylococcus aureus
PSEVSGGQL

SEQ ID NO: 1611145 - protein, 5 aa, Staphylococcus aureus
PVNSD

SEQ ID NO: 1611146 - protein, 4 aa, Staphylococcus aureus
QEKI

SEQ ID NO: 1611147 - protein, 5 aa, Staphylococcus aureus
QIARG

SEQ ID NO: 1611148 - protein, 12 aa, Staphylococcus aureus
QKIKAGHESVAG

SEQ ID NO: 1611149 - protein, 7 aa, Staphylococcus aureus
QNATSSV

SEQ ID NO: 1611150 - protein, 11 aa, Staphylococcus aureus
QNNKQKHPFKL

SEQ ID NO: 1611151 - protein, 7 aa, Staphylococcus aureus
QNSEQNL

SEQ ID NO: 1611152 - protein, 11 aa, Staphylococcus aureus
QSDIEQREGFE

SEQ ID NO: 1611153 - protein, 6 aa, Staphylococcus aureus
QSNKVG

SEQ ID NO: 1611154 - protein, 11 aa, Staphylococcus aureus
QYTNDNRQLDQ

SEQ ID NO: 1611155 - protein, 6 aa, Staphylococcus aureus
RDKVTQ

SEQ ID NO: 1611156 - protein, 7 aa, Staphylococcus aureus
RGHDGPI

SEQ ID NO: 1611157 - protein, 5 aa, Staphylococcus aureus
RISNP

SEQ ID NO: 1611158 - protein, 15 aa, Staphylococcus aureus
RKKRIAKGSGRSLQE

SEQ ID NO: 1611159 - protein, 4 aa, Staphylococcus aureus
RNPQ

SEQ ID NO: 1611160 - protein, 5 aa, Staphylococcus aureus
RTHGS

SEQ ID NO: 1611161 - protein, 16 aa, Staphylococcus aureus
RTLNGEVNISGAKNSA

SEQ ID NO: 1611162 - protein, 10 aa, Staphylococcus aureus
SAGGASGEAY

SEQ ID NO: 1611163 - protein, 8 aa, Staphylococcus aureus
SEDAKERI

SEQ ID NO: 1611164 - protein, 8 aa, Staphylococcus aureus
SGCGKTTT

SEQ ID NO: 1611165 - protein, 9 aa, Staphylococcus aureus
SIAENEGVN

SEQ ID NO: 1611166 - protein, 9 aa, Staphylococcus aureus
SKEHANRYP

SEQ ID NO: 1611167 - protein, 8 aa, Staphylococcus aureus
SKQNTSYI

SEQ ID NO: 1611168 - protein, 9 aa, Staphylococcus aureus
SLAGISGKK

SEQ ID NO: 1611169 - protein, 4 aa, Staphylococcus aureus
SNRD

SEQ ID NO: 1611170 - protein, 7 aa, Staphylococcus aureus
SNTAEFG

SEQ ID NO: 1611171 - protein, 4 aa, Staphylococcus aureus
SQGK

SEQ ID NO: 1611172 - protein, 8 aa, Staphylococcus aureus
SRGEHTKH

SEQ ID NO: 1611173 - protein, 7 aa, Staphylococcus aureus
TEGEDIS

SEQ ID NO: 1611174 - protein, 6 aa, Staphylococcus aureus
TENESK

SEQ ID NO: 1611175 - protein, 12 aa, Staphylococcus aureus
TGAHGKTSTTGL

SEQ ID NO: 1611176 - protein, 15 aa, Staphylococcus aureus
TGKTLRENNEGKEIK

SEQ ID NO: 1611177 - protein, 4 aa, Staphylococcus aureus
TIDH

SEQ ID NO: 1611178 - protein, 11 aa, Staphylococcus aureus
TIPENQKYGAF

SEQ ID NO: 1611179 - protein, 24 aa, Staphylococcus aureus
TKKEKTRNPANPFTTSTLQQEAAR

SEQ ID NO: 1611180 - protein, 10 aa, Staphylococcus aureus
TKSSTIYSAT

SEQ ID NO: 1611181 - protein, 5 aa, Staphylococcus aureus
TLKTD

SEQ ID NO: 1611182 - protein, 14 aa, Staphylococcus aureus
TPAERNNPDTLNVS

SEQ ID NO: 1611183 - protein, 6 aa, Staphylococcus aureus
TSNPDV

SEQ ID NO: 1611184 - protein, 5 aa, Staphylococcus aureus
VEMRD

SEQ ID NO: 1611185 - protein, 9 aa, Staphylococcus aureus
VGTGEQKIN

SEQ ID NO: 1611186 - protein, 14 aa, Staphylococcus aureus
VKRRGDMEEDPSYK

SEQ ID NO: 1611187 - protein, 11 aa, Staphylococcus aureus
VPEGVDNEQQI

SEQ ID NO: 1611188 - protein, 11 aa, Staphylococcus aureus
VTLRETGRLGD

SEQ ID NO: 1611189 - protein, 5 aa, Staphylococcus aureus
YAPSL

SEQ ID NO: 1611190 - protein, 6 aa, Staphylococcus aureus
YEGETI

SEQ ID NO: 1611191 - protein, 6 aa, Staphylococcus aureus
YEGGDI

SEQ ID NO: 1611192 - protein, 5 aa, Staphylococcus aureus
YEQQY

SEQ ID NO: 1611193 - protein, 6 aa, Staphylococcus aureus
YSKLNK

SEQ ID NO: 1611194 - protein, 5 aa, Staphylococcus aureus
YTKSS

SEQ ID NO: 1611195 - protein, 6 aa, Staphylococcus aureus
ADYGKI

SEQ ID NO: 1611196 - protein, 8 aa, Staphylococcus aureus
AEPDAQLD

SEQ ID NO: 1611197 - protein, 6 aa, Staphylococcus aureus
AERDAH

SEQ ID NO: 1611198 - protein, 12 aa, Staphylococcus aureus
ASAHPSNFRQQK

SEQ ID NO: 1611199 - protein, 7 aa, Staphylococcus aureus
ATPPKQL

SEQ ID NO: 1611200 - protein, 12 aa, Staphylococcus aureus
AVTDDYYKEKSY

SEQ ID NO: 1611201 - protein, 5 aa, Staphylococcus aureus
AYQQS

SEQ ID NO: 1611202 - protein, 4 aa, Staphylococcus aureus
DIRD

SEQ ID NO: 1611203 - protein, 9 aa, Staphylococcus aureus
DKDFYDSET

SEQ ID NO: 1611204 - protein, 9 aa, Staphylococcus aureus
DNGASDKLL

SEQ ID NO: 1611205 - protein, 8 aa, Staphylococcus aureus
DPELNGSL

SEQ ID NO: 1611206 - protein, 4 aa, Staphylococcus aureus
DPTS

SEQ ID NO: 1611207 - protein, 12 aa, Staphylococcus aureus
DQSVDETDERSI

SEQ ID NO: 1611208 - protein, 8 aa, Staphylococcus aureus
DRPNAKMP

SEQ ID NO: 1611209 - protein, 9 aa, Staphylococcus aureus
DVSEENPDE

SEQ ID NO: 1611210 - protein, 18 aa, Staphylococcus aureus
DVSPSMVDGNGRLKSDTN

SEQ ID NO: 1611211 - protein, 5 aa, Staphylococcus aureus
EEKGY

SEQ ID NO: 1611212 - protein, 8 aa, Staphylococcus aureus
EFQRQNSN

SEQ ID NO: 1611213 - protein, 8 aa, Staphylococcus aureus
EGVSTSEI

SEQ ID NO: 1611214 - protein, 4 aa, Staphylococcus aureus
EKGY

SEQ ID NO: 1611215 - protein, 6 aa, Staphylococcus aureus
ELSESD

SEQ ID NO: 1611216 - protein, 8 aa, Staphylococcus aureus
ENKPTSRQ

SEQ ID NO: 1611217 - protein, 7 aa, Staphylococcus aureus
ERAEKFR

SEQ ID NO: 1611218 - protein, 7 aa, Staphylococcus aureus
ESQGDKA

SEQ ID NO: 1611219 - protein, 9 aa, Staphylococcus aureus
FNNNEDGIG

SEQ ID NO: 1611220 - protein, 9 aa, Staphylococcus aureus
FSGQKCSAC

SEQ ID NO: 1611221 - protein, 9 aa, Staphylococcus aureus
GAENPSVDA

SEQ ID NO: 1611222 - protein, 5 aa, Staphylococcus aureus
GAGKT

SEQ ID NO: 1611223 - protein, 7 aa, Staphylococcus aureus
GEDERQH

SEQ ID NO: 1611224 - protein, 5 aa, Staphylococcus aureus
GEVKI

SEQ ID NO: 1611225 - protein, 6 aa, Staphylococcus aureus
GEYDEE

SEQ ID NO: 1611226 - protein, 6 aa, Staphylococcus aureus
GIRHQQ

SEQ ID NO: 1611227 - protein, 14 aa, Staphylococcus aureus
GKDFGEENVVGPND

SEQ ID NO: 1611228 - protein, 26 aa, Staphylococcus aureus
GKEGQVGKSDQIDTQTPMNPTTNYGI

SEQ ID NO: 1611229 - protein, 5 aa, Staphylococcus aureus
GKIEE

SEQ ID NO: 1611230 - protein, 9 aa, Staphylococcus aureus
GKSGCGKST

SEQ ID NO: 1611231 - protein, 16 aa, Staphylococcus aureus
GMSPKTREAAEKGLPN

SEQ ID NO: 1611232 - protein, 15 aa, Staphylococcus aureus
GNGSSPDEWKDEVPS

SEQ ID NO: 1611233 - protein, 11 aa, Staphylococcus aureus
GNYNLGGEQSG

SEQ ID NO: 1611234 - protein, 10 aa, Staphylococcus aureus
GPQKGADAKM

SEQ ID NO: 1611235 - protein, 13 aa, Staphylococcus aureus
GPVTNFEQANKSD

SEQ ID NO: 1611236 - protein, 13 aa, Staphylococcus aureus
GQLSKNGLRAKRQ

SEQ ID NO: 1611237 - protein, 6 aa, Staphylococcus aureus
GSATYQ

SEQ ID NO: 1611238 - protein, 16 aa, Staphylococcus aureus
GSTNPSEASPGSIRGD

SEQ ID NO: 1611239 - protein, 14 aa, Staphylococcus aureus
HDQPRRVSTWGDDD

SEQ ID NO: 1611240 - protein, 8 aa, Staphylococcus aureus
HQDEQQEK

SEQ ID NO: 1611241 - protein, 27 aa, Staphylococcus aureus
IAEGKGKTKKESEQRAAESAYKQLKQI

SEQ ID NO: 1611242 - protein, 5 aa, Staphylococcus aureus
IEETN

SEQ ID NO: 1611243 - protein, 4 aa, Staphylococcus aureus
IEHG

SEQ ID NO: 1611244 - protein, 5 aa, Staphylococcus aureus
IGDSE

SEQ ID NO: 1611245 - protein, 13 aa, Staphylococcus aureus
INESDVTLANASN

SEQ ID NO: 1611246 - protein, 4 aa, Staphylococcus aureus
INSV

SEQ ID NO: 1611247 - protein, 9 aa, Staphylococcus aureus
IQPKSVTAK

SEQ ID NO: 1611248 - protein, 10 aa, Staphylococcus aureus
IRRDPTKPRA

SEQ ID NO: 1611249 - protein, 6 aa, Staphylococcus aureus
KANPAA

SEQ ID NO: 1611250 - protein, 6 aa, Staphylococcus aureus
KDHLSA

SEQ ID NO: 1611251 - protein, 6 aa, Staphylococcus aureus
KDQPQT

SEQ ID NO: 1611252 - protein, 7 aa, Staphylococcus aureus
KEYPYQT

SEQ ID NO: 1611253 - protein, 5 aa, Staphylococcus aureus
KGIDP

SEQ ID NO: 1611254 - protein, 7 aa, Staphylococcus aureus
KHAKKAK

SEQ ID NO: 1611255 - protein, 9 aa, Staphylococcus aureus
KIASDETIK

SEQ ID NO: 1611256 - protein, 6 aa, Staphylococcus aureus
KIMTDS

SEQ ID NO: 1611257 - protein, 9 aa, Staphylococcus aureus
KKIGEEAKV

SEQ ID NO: 1611258 - protein, 12 aa, Staphylococcus aureus
KRGKSPLNPNNF

SEQ ID NO: 1611259 - protein, 11 aa, Staphylococcus aureus
KSAARELASRG

SEQ ID NO: 1611260 - protein, 9 aa, Staphylococcus aureus
KSITQEVKQ

SEQ ID NO: 1611261 - protein, 9 aa, Staphylococcus aureus
KTFDTAEEL

SEQ ID NO: 1611262 - protein, 6 aa, Staphylococcus aureus
KTITPR

SEQ ID NO: 1611263 - protein, 9 aa, Staphylococcus aureus
KVLGGSSSI

SEQ ID NO: 1611264 - protein, 5 aa, Staphylococcus aureus
KYREN

SEQ ID NO: 1611265 - protein, 8 aa, Staphylococcus aureus
LAGSEAAY

SEQ ID NO: 1611266 - protein, 5 aa, Staphylococcus aureus
LAIEP

SEQ ID NO: 1611267 - protein, 11 aa, Staphylococcus aureus
LEETKKTSDLI

SEQ ID NO: 1611268 - protein, 9 aa, Staphylococcus aureus
LKKGLDSLN

SEQ ID NO: 1611269 - protein, 7 aa, Staphylococcus aureus
LTKETHH

SEQ ID NO: 1611270 - protein, 7 aa, Staphylococcus aureus
LVERSER

SEQ ID NO: 1611271 - protein, 8 aa, Staphylococcus aureus
NATQPHLN

SEQ ID NO: 1611272 - protein, 5 aa, Staphylococcus aureus
NDGTM

SEQ ID NO: 1611273 - protein, 5 aa, Staphylococcus aureus
NEAEV

SEQ ID NO: 1611274 - protein, 5 aa, Staphylococcus aureus
NEDVA

SEQ ID NO: 1611275 - protein, 8 aa, Staphylococcus aureus
NGTKLSTE

SEQ ID NO: 1611276 - protein, 28 aa, Staphylococcus aureus
NKVKPPAQKAVGKSASKITVGSKAPYNL

SEQ ID NO: 1611277 - protein, 26 aa, Staphylococcus aureus
NNVQGCSDMGSMPDKITGYQSIEADD

SEQ ID NO: 1611278 - protein, 13 aa, Staphylococcus aureus
NSAIDGGKKTAAF

SEQ ID NO: 1611279 - protein, 4 aa, Staphylococcus aureus
PALR

SEQ ID NO: 1611280 - protein, 8 aa, Staphylococcus aureus
PDNQPIFG

SEQ ID NO: 1611281 - protein, 4 aa, Staphylococcus aureus
PNGD

SEQ ID NO: 1611282 - protein, 10 aa, Staphylococcus aureus
PRKSRASLQK

SEQ ID NO: 1611283 - protein, 6 aa, Staphylococcus aureus
PTKKTM

SEQ ID NO: 1611284 - protein, 16 aa, Staphylococcus aureus
PVNENTPKLTLNEGNT

SEQ ID NO: 1611285 - protein, 8 aa, Staphylococcus aureus
QAKDQMDG

SEQ ID NO: 1611286 - protein, 4 aa, Staphylococcus aureus
QMPN

SEQ ID NO: 1611287 - protein, 6 aa, Staphylococcus aureus
QNSIKS

SEQ ID NO: 1611288 - protein, 6 aa, Staphylococcus aureus
QQLETD

SEQ ID NO: 1611289 - protein, 4 aa, Staphylococcus aureus
QSPK

SEQ ID NO: 1611290 - protein, 4 aa, Staphylococcus aureus
RDLS

SEQ ID NO: 1611291 - protein, 10 aa, Staphylococcus aureus
REDKADNRAI

SEQ ID NO: 1611292 - protein, 8 aa, Staphylococcus aureus
REDTPNTL

SEQ ID NO: 1611293 - protein, 10 aa, Staphylococcus aureus
RILPKGTGYI

SEQ ID NO: 1611294 - protein, 4 aa, Staphylococcus aureus
RSMQ

SEQ ID NO: 1611295 - protein, 16 aa, Staphylococcus aureus
SATEEMKARRNKVSEE

SEQ ID NO: 1611296 - protein, 26 aa, Staphylococcus aureus
SDTGWEVSEQTEYDGLRTTSWTSYQT

SEQ ID NO: 1611297 - protein, 11 aa, Staphylococcus aureus
SELTKAAGADF

SEQ ID NO: 1611298 - protein, 7 aa, Staphylococcus aureus
SFQETTR

SEQ ID NO: 1611299 - protein, 4 aa, Staphylococcus aureus
SGNK

SEQ ID NO: 1611300 - protein, 18 aa, Staphylococcus aureus
SGNVDSNRLRTGTMTEED

SEQ ID NO: 1611301 - protein, 18 aa, Staphylococcus aureus
SIQNNKQQQIWNLIEPYI

SEQ ID NO: 1611302 - protein, 7 aa, Staphylococcus aureus
SIRGSDV

SEQ ID NO: 1611303 - protein, 11 aa, Staphylococcus aureus
SKINDSDPTGT

SEQ ID NO: 1611304 - protein, 9 aa, Staphylococcus aureus
SLPSSFKNL

SEQ ID NO: 1611305 - protein, 4 aa, Staphylococcus aureus
SNKQ

SEQ ID NO: 1611306 - protein, 4 aa, Staphylococcus aureus
STTV

SEQ ID NO: 1611307 - protein, 14 aa, Staphylococcus aureus
SYATHTRSSIGGFK

SEQ ID NO: 1611308 - protein, 8 aa, Staphylococcus aureus
TDPDADRL

SEQ ID NO: 1611309 - protein, 15 aa, Staphylococcus aureus
TISMSQDQSNKVVTN

SEQ ID NO: 1611310 - protein, 14 aa, Staphylococcus aureus
TTRGDGLSDYPKNA

SEQ ID NO: 1611311 - protein, 7 aa, Staphylococcus aureus
VPTGVPR

SEQ ID NO: 1611312 - protein, 7 aa, Staphylococcus aureus
VRKGTKA

SEQ ID NO: 1611313 - protein, 9 aa, Staphylococcus aureus
VSNEDAGHA

SEQ ID NO: 1611314 - protein, 12 aa, Staphylococcus aureus
VTQARDEVGKSI

SEQ ID NO: 1611315 - protein, 8 aa, Staphylococcus aureus
YEETGAKV

SEQ ID NO: 1611316 - protein, 9 aa, Staphylococcus aureus
YKEAGAEIV

SEQ ID NO: 1611317 - protein, 5 aa, Staphylococcus aureus
YPMPS

SEQ ID NO: 1611318 - protein, 13 aa, Staphylococcus aureus
YRDPEDKEKYFDD

SEQ ID NO: 1611319 - protein, 10 aa, Staphylococcus aureus
AEEVPPGGAK

SEQ ID NO: 1611320 - protein, 5 aa, Staphylococcus aureus
AKDRD

SEQ ID NO: 1611321 - protein, 5 aa, Staphylococcus aureus
AKNDE

SEQ ID NO: 1611322 - protein, 8 aa, Staphylococcus aureus
ANDSEYGL

SEQ ID NO: 1611323 - protein, 6 aa, Staphylococcus aureus
ANLTSD

SEQ ID NO: 1611324 - protein, 5 aa, Staphylococcus aureus
APSMP

SEQ ID NO: 1611325 - protein, 14 aa, Staphylococcus aureus
ASSQTIPTTSQPAI

SEQ ID NO: 1611326 - protein, 7 aa, Staphylococcus aureus
ATLPTQL

SEQ ID NO: 1611327 - protein, 12 aa, Staphylococcus aureus
AVESRGKVTLNE

SEQ ID NO: 1611328 - protein, 18 aa, Staphylococcus aureus
AVNGTASLDPEKQDDNLQ

SEQ ID NO: 1611329 - protein, 10 aa, Staphylococcus aureus
DALKSDPTLS

SEQ ID NO: 1611330 - protein, 5 aa, Staphylococcus aureus
DDEDK

SEQ ID NO: 1611331 - protein, 5 aa, Staphylococcus aureus
DDKVD

SEQ ID NO: 1611332 - protein, 6 aa, Staphylococcus aureus
DDTMRA

SEQ ID NO: 1611333 - protein, 5 aa, Staphylococcus aureus
DGHDD

SEQ ID NO: 1611334 - protein, 7 aa, Staphylococcus aureus
DGQESYT

SEQ ID NO: 1611335 - protein, 11 aa, Staphylococcus aureus
DLEKRESLNLD

SEQ ID NO: 1611336 - protein, 4 aa, Staphylococcus aureus
DLEP

SEQ ID NO: 1611337 - protein, 7 aa, Staphylococcus aureus
DMSTGEE

SEQ ID NO: 1611338 - protein, 7 aa, Staphylococcus aureus
DPEGNKY

SEQ ID NO: 1611339 - protein, 5 aa, Staphylococcus aureus
DRGGE

SEQ ID NO: 1611340 - protein, 16 aa, Staphylococcus aureus
DTTPVERDEVTAATTA

SEQ ID NO: 1611341 - protein, 13 aa, Staphylococcus aureus
EASIADPANAHLK

SEQ ID NO: 1611342 - protein, 7 aa, Staphylococcus aureus
EASKEIN

SEQ ID NO: 1611343 - protein, 16 aa, Staphylococcus aureus
EDMPKAPRKNRNLITL

SEQ ID NO: 1611344 - protein, 6 aa, Staphylococcus aureus
EDTRRE

SEQ ID NO: 1611345 - protein, 64 aa, Staphylococcus aureus
EEEVEVPDKQQQVNEAPAKEQSQQTTKQNAIKSVPQKSASRYTTTSEERNNRMSNYSKNNSRNV

SEQ ID NO: 1611346 - protein, 11 aa, Staphylococcus aureus
EKEMKQAAKDL

SEQ ID NO: 1611347 - protein, 19 aa, Staphylococcus aureus
EKITSNAATELPLTQRYFL

SEQ ID NO: 1611348 - protein, 11 aa, Staphylococcus aureus
ELDQEKSTIAQ

SEQ ID NO: 1611349 - protein, 10 aa, Staphylococcus aureus
EPELQDEQPI

SEQ ID NO: 1611350 - protein, 9 aa, Staphylococcus aureus
FEDGPGDHD

SEQ ID NO: 1611351 - protein, 15 aa, Staphylococcus aureus
FENKDANGQQHAPGW

SEQ ID NO: 1611352 - protein, 6 aa, Staphylococcus aureus
FKEQEV

SEQ ID NO: 1611353 - protein, 8 aa, Staphylococcus aureus
FPETSGIG

SEQ ID NO: 1611354 - protein, 4 aa, Staphylococcus aureus
GAVK

SEQ ID NO: 1611355 - protein, 20 aa, Staphylococcus aureus
GEGAYRGSQPLKPLNDSNLR

SEQ ID NO: 1611356 - protein, 13 aa, Staphylococcus aureus
GEGYKATNFPDAK

SEQ ID NO: 1611357 - protein, 4 aa, Staphylococcus aureus
GGAI

SEQ ID NO: 1611358 - protein, 6 aa, Staphylococcus aureus
GGNAGV

SEQ ID NO: 1611359 - protein, 9 aa, Staphylococcus aureus
GKPKDLQYE

SEQ ID NO: 1611360 - protein, 13 aa, Staphylococcus aureus
GNEQSHQDDSFSD

SEQ ID NO: 1611361 - protein, 7 aa, Staphylococcus aureus
GPTLNDC

SEQ ID NO: 1611362 - protein, 6 aa, Staphylococcus aureus
GRFSPE

SEQ ID NO: 1611363 - protein, 12 aa, Staphylococcus aureus
GTGGDKSNSFNI

SEQ ID NO: 1611364 - protein, 9 aa, Staphylococcus aureus
GYAPSSPSF

SEQ ID NO: 1611365 - protein, 11 aa, Staphylococcus aureus
HAITNDSAFEQ

SEQ ID NO: 1611366 - protein, 21 aa, Staphylococcus aureus
HNEKGRKKTKIYTQHRKYFKK

SEQ ID NO: 1611367 - protein, 8 aa, Staphylococcus aureus
HPEAANKN

SEQ ID NO: 1611368 - protein, 7 aa, Staphylococcus aureus
HSGGHSF

SEQ ID NO: 1611369 - protein, 5 aa, Staphylococcus aureus
IDEPR

SEQ ID NO: 1611370 - protein, 9 aa, Staphylococcus aureus
IGKPDPVRG

SEQ ID NO: 1611371 - protein, 6 aa, Staphylococcus aureus
INGSAG

SEQ ID NO: 1611372 - protein, 4 aa, Staphylococcus aureus
INRQ

SEQ ID NO: 1611373 - protein, 8 aa, Staphylococcus aureus
IRRSKDSI

SEQ ID NO: 1611374 - protein, 7 aa, Staphylococcus aureus
ISGQGTL

SEQ ID NO: 1611375 - protein, 5 aa, Staphylococcus aureus
ITTMK

SEQ ID NO: 1611376 - protein, 5 aa, Staphylococcus aureus
KAEEE

SEQ ID NO: 1611377 - protein, 10 aa, Staphylococcus aureus
KAFAEVNGET

SEQ ID NO: 1611378 - protein, 14 aa, Staphylococcus aureus
KASANIFETDEETM

SEQ ID NO: 1611379 - protein, 6 aa, Staphylococcus aureus
KEEEPD

SEQ ID NO: 1611380 - protein, 7 aa, Staphylococcus aureus
KETSIAN

SEQ ID NO: 1611381 - protein, 9 aa, Staphylococcus aureus
KKFSDKGSR

SEQ ID NO: 1611382 - protein, 6 aa, Staphylococcus aureus
KKQGTI

SEQ ID NO: 1611383 - protein, 18 aa, Staphylococcus aureus
KMKAEKAKQQDNNESAVD

SEQ ID NO: 1611384 - protein, 8 aa, Staphylococcus aureus
KNDPYKIT

SEQ ID NO: 1611385 - protein, 5 aa, Staphylococcus aureus
KNGKA

SEQ ID NO: 1611386 - protein, 7 aa, Staphylococcus aureus
KPNEHTQ

SEQ ID NO: 1611387 - protein, 15 aa, Staphylococcus aureus
KQAPKSYVDEAANRN

SEQ ID NO: 1611388 - protein, 10 aa, Staphylococcus aureus
KSETDAREAG

SEQ ID NO: 1611389 - protein, 5 aa, Staphylococcus aureus
KVHPN

SEQ ID NO: 1611390 - protein, 10 aa, Staphylococcus aureus
LDGDTRGGAA

SEQ ID NO: 1611391 - protein, 10 aa, Staphylococcus aureus
LKGGNKEPYR

SEQ ID NO: 1611392 - protein, 6 aa, Staphylococcus aureus
LQQLEQ

SEQ ID NO: 1611393 - protein, 5 aa, Staphylococcus aureus
LTENY

SEQ ID NO: 1611394 - protein, 9 aa, Staphylococcus aureus
LTETAEDRL

SEQ ID NO: 1611395 - protein, 7 aa, Staphylococcus aureus
LTSPYNG

SEQ ID NO: 1611396 - protein, 13 aa, Staphylococcus aureus
MTKKERQKTIDNI

SEQ ID NO: 1611397 - protein, 11 aa, Staphylococcus aureus
NAISADPKGVP

SEQ ID NO: 1611398 - protein, 7 aa, Staphylococcus aureus
NDTVRAE

SEQ ID NO: 1611399 - protein, 25 aa, Staphylococcus aureus
NKKAFDKGTTTEDIAQSISPGLRKK

SEQ ID NO: 1611400 - protein, 6 aa, Staphylococcus aureus
NQPTIT

SEQ ID NO: 1611401 - protein, 36 aa, Staphylococcus aureus
NSASSSIKSAVETCNNVSKPDKDESTTVSGNNNAHS

SEQ ID NO: 1611402 - protein, 14 aa, Staphylococcus aureus
NSKTTEEKREAYAQ

SEQ ID NO: 1611403 - protein, 9 aa, Staphylococcus aureus
NSQGLTSDT

SEQ ID NO: 1611404 - protein, 10 aa, Staphylococcus aureus
NTKSVETRDM

SEQ ID NO: 1611405 - protein, 13 aa, Staphylococcus aureus
PADIPAVNKIMTE

SEQ ID NO: 1611406 - protein, 7 aa, Staphylococcus aureus
QCGSGLE

SEQ ID NO: 1611407 - protein, 4 aa, Staphylococcus aureus
QDSF

SEQ ID NO: 1611408 - protein, 7 aa, Staphylococcus aureus
QEQKDKI

SEQ ID NO: 1611409 - protein, 11 aa, Staphylococcus aureus
QHQVPGISGSV

SEQ ID NO: 1611410 - protein, 4 aa, Staphylococcus aureus
QRKA

SEQ ID NO: 1611411 - protein, 6 aa, Staphylococcus aureus
QSSSID

SEQ ID NO: 1611412 - protein, 6 aa, Staphylococcus aureus
QVPRED

SEQ ID NO: 1611413 - protein, 10 aa, Staphylococcus aureus
QYEVGEQASP

SEQ ID NO: 1611414 - protein, 12 aa, Staphylococcus aureus
RAHNETDIADNA

SEQ ID NO: 1611415 - protein, 5 aa, Staphylococcus aureus
RKREW

SEQ ID NO: 1611416 - protein, 11 aa, Staphylococcus aureus
RNESTTQQQYK

SEQ ID NO: 1611417 - protein, 7 aa, Staphylococcus aureus
RVKPGAD

SEQ ID NO: 1611418 - protein, 14 aa, Staphylococcus aureus
RYSRSIKGTKPIFK

SEQ ID NO: 1611419 - protein, 8 aa, Staphylococcus aureus
SAVNKGYT

SEQ ID NO: 1611420 - protein, 5 aa, Staphylococcus aureus
SHRPL

SEQ ID NO: 1611421 - protein, 13 aa, Staphylococcus aureus
SKRKSLPFTENDE

SEQ ID NO: 1611422 - protein, 21 aa, Staphylococcus aureus
SMQPPATEEEKEEIPSKPQID

SEQ ID NO: 1611423 - protein, 6 aa, Staphylococcus aureus
SREEAV

SEQ ID NO: 1611424 - protein, 7 aa, Staphylococcus aureus
SRNKAPK

SEQ ID NO: 1611425 - protein, 12 aa, Staphylococcus aureus
SVSTDGASPKLT

SEQ ID NO: 1611426 - protein, 8 aa, Staphylococcus aureus
TDDDLKEA

SEQ ID NO: 1611427 - protein, 6 aa, Staphylococcus aureus
TDEETA

SEQ ID NO: 1611428 - protein, 4 aa, Staphylococcus aureus
TKEE

SEQ ID NO: 1611429 - protein, 9 aa, Staphylococcus aureus
TVTRGNNNQ

SEQ ID NO: 1611430 - protein, 22 aa, Staphylococcus aureus
VGDPQDEATQMGSQTGKDQLDK

SEQ ID NO: 1611431 - protein, 30 aa, Staphylococcus aureus
VNRKPITATEEDLDDNNRARSAKLRVAEIL

SEQ ID NO: 1611432 - protein, 4 aa, Staphylococcus aureus
VSDE

SEQ ID NO: 1611433 - protein, 7 aa, Staphylococcus aureus
VTSTDDK

SEQ ID NO: 1611434 - protein, 14 aa, Staphylococcus aureus
WADDDQDTSDLAYE

SEQ ID NO: 1611435 - protein, 13 aa, Staphylococcus aureus
WVGAGTKRGLPKA

SEQ ID NO: 1611436 - protein, 9 aa, Staphylococcus aureus
YGATGGKAF

SEQ ID NO: 1611437 - protein, 7 aa, Staphylococcus aureus
YGQKKRV

SEQ ID NO: 1611438 - protein, 12 aa, Staphylococcus aureus
YKDSREQFEQRT

SEQ ID NO: 1611439 - protein, 13 aa, Staphylococcus aureus
YQENGKTSFEPAD

SEQ ID NO: 1611440 - protein, 7 aa, Staphylococcus aureus
YYDPERK

SEQ ID NO: 1611441 - protein, 5 aa, Staphylococcus aureus
ADLQA

SEQ ID NO: 1611442 - protein, 7 aa, Staphylococcus aureus
AEKGEAV

SEQ ID NO: 1611443 - protein, 4 aa, Staphylococcus aureus
AKEG

SEQ ID NO: 1611444 - protein, 4 aa, Staphylococcus aureus
AKEL

SEQ ID NO: 1611445 - protein, 8 aa, Staphylococcus aureus
DADGVTST

SEQ ID NO: 1611446 - protein, 20 aa, Staphylococcus aureus
DAPEGTRLSEYREKKTIERL

SEQ ID NO: 1611447 - protein, 7 aa, Staphylococcus aureus
DGGYQGE

SEQ ID NO: 1611448 - protein, 11 aa, Staphylococcus aureus
DGKPDKKNYRK

SEQ ID NO: 1611449 - protein, 8 aa, Staphylococcus aureus
DNGTPIKT

SEQ ID NO: 1611450 - protein, 8 aa, Staphylococcus aureus
DNQGKAQP

SEQ ID NO: 1611451 - protein, 13 aa, Staphylococcus aureus
DPKYGPKKTLDIG

SEQ ID NO: 1611452 - protein, 11 aa, Staphylococcus aureus
DQGIHKRGAEI

SEQ ID NO: 1611453 - protein, 13 aa, Staphylococcus aureus
DSNPTQTAEQRRE

SEQ ID NO: 1611454 - protein, 55 aa, Staphylococcus aureus
DSTRISDTAKAEAKQYITDKYGESYTSKRKASGKQGDQDAHEAIRPSSTMRTPDD

SEQ ID NO: 1611455 - protein, 4 aa, Staphylococcus aureus
DVPV

SEQ ID NO: 1611456 - protein, 13 aa, Staphylococcus aureus
DVSRTSQSEGMHG

SEQ ID NO: 1611457 - protein, 5 aa, Staphylococcus aureus
EDIEQ

SEQ ID NO: 1611458 - protein, 25 aa, Staphylococcus aureus
EEATFGGGKSIRDGMAQNPRVTRDD

SEQ ID NO: 1611459 - protein, 10 aa, Staphylococcus aureus
EKGGKGGVDL

SEQ ID NO: 1611460 - protein, 15 aa, Staphylococcus aureus
EKQARRIGESRHEAS

SEQ ID NO: 1611461 - protein, 11 aa, Staphylococcus aureus
ENTEIKGRHDL

SEQ ID NO: 1611462 - protein, 17 aa, Staphylococcus aureus
EPESFDQPVDKLIIYQS

SEQ ID NO: 1611463 - protein, 5 aa, Staphylococcus aureus
ESKKT

SEQ ID NO: 1611464 - protein, 9 aa, Staphylococcus aureus
ETKTLEANE

SEQ ID NO: 1611465 - protein, 11 aa, Staphylococcus aureus
FAGSEATLKTG

SEQ ID NO: 1611466 - protein, 7 aa, Staphylococcus aureus
FDKAYTD

SEQ ID NO: 1611467 - protein, 11 aa, Staphylococcus aureus
FEPTKRSQMYQ

SEQ ID NO: 1611468 - protein, 9 aa, Staphylococcus aureus
FGDSGNDEA

SEQ ID NO: 1611469 - protein, 9 aa, Staphylococcus aureus
GANGSTSSL

SEQ ID NO: 1611470 - protein, 6 aa, Staphylococcus aureus
GARKGE

SEQ ID NO: 1611471 - protein, 20 aa, Staphylococcus aureus
GEPQAPGQIDVTDLKAQVTL

SEQ ID NO: 1611472 - protein, 5 aa, Staphylococcus aureus
GEVPH

SEQ ID NO: 1611473 - protein, 10 aa, Staphylococcus aureus
GHSQLPSDGL

SEQ ID NO: 1611474 - protein, 13 aa, Staphylococcus aureus
GICGSDTSRYKKM

SEQ ID NO: 1611475 - protein, 8 aa, Staphylococcus aureus
GSSSVKTI

SEQ ID NO: 1611476 - protein, 6 aa, Staphylococcus aureus
HRAQTS

SEQ ID NO: 1611477 - protein, 25 aa, Staphylococcus aureus
HTMAGDDPTRYRTSDEDAEWEKKDP

SEQ ID NO: 1611478 - protein, 11 aa, Staphylococcus aureus
IEVGGGIRTKS

SEQ ID NO: 1611479 - protein, 8 aa, Staphylococcus aureus
IGHSNGKQ

SEQ ID NO: 1611480 - protein, 7 aa, Staphylococcus aureus
IKDGANV

SEQ ID NO: 1611481 - protein, 11 aa, Staphylococcus aureus
IQPEDVENAPT

SEQ ID NO: 1611482 - protein, 6 aa, Staphylococcus aureus
ITDDNF

SEQ ID NO: 1611483 - protein, 9 aa, Staphylococcus aureus
KAAANIGDK

SEQ ID NO: 1611484 - protein, 20 aa, Staphylococcus aureus
KAHNQRQARMRKDDHLTNQV

SEQ ID NO: 1611485 - protein, 7 aa, Staphylococcus aureus
KAMTGYQ

SEQ ID NO: 1611486 - protein, 5 aa, Staphylococcus aureus
KATMT

SEQ ID NO: 1611487 - protein, 8 aa, Staphylococcus aureus
KDSSIEAG

SEQ ID NO: 1611488 - protein, 6 aa, Staphylococcus aureus
KEAYEE

SEQ ID NO: 1611489 - protein, 4 aa, Staphylococcus aureus
KELD

SEQ ID NO: 1611490 - protein, 20 aa, Staphylococcus aureus
KGYTSYAPQYEGHAAPPEEI

SEQ ID NO: 1611491 - protein, 7 aa, Staphylococcus aureus
KKQKSGA

SEQ ID NO: 1611492 - protein, 17 aa, Staphylococcus aureus
KLGALTDRNGLRPGRYT

SEQ ID NO: 1611493 - protein, 4 aa, Staphylococcus aureus
KNIS

SEQ ID NO: 1611494 - protein, 6 aa, Staphylococcus aureus
KNPETI

SEQ ID NO: 1611495 - protein, 6 aa, Staphylococcus aureus
KQIRQK

SEQ ID NO: 1611496 - protein, 13 aa, Staphylococcus aureus
KSVTKDCESRSEN

SEQ ID NO: 1611497 - protein, 13 aa, Staphylococcus aureus
KTGSLTGFGGTIN

SEQ ID NO: 1611498 - protein, 5 aa, Staphylococcus aureus
KTNKS

SEQ ID NO: 1611499 - protein, 12 aa, Staphylococcus aureus
KVSSSSTIISAT

SEQ ID NO: 1611500 - protein, 8 aa, Staphylococcus aureus
LAADNDLK

SEQ ID NO: 1611501 - protein, 7 aa, Staphylococcus aureus
LEEAHKD

SEQ ID NO: 1611502 - protein, 10 aa, Staphylococcus aureus
LKVSTTPEAS

SEQ ID NO: 1611503 - protein, 12 aa, Staphylococcus aureus
LPNEEKPAFGQK

SEQ ID NO: 1611504 - protein, 8 aa, Staphylococcus aureus
LQESDNIS

SEQ ID NO: 1611505 - protein, 5 aa, Staphylococcus aureus
LSEAA

SEQ ID NO: 1611506 - protein, 10 aa, Staphylococcus aureus
LTPRERKQQM

SEQ ID NO: 1611507 - protein, 9 aa, Staphylococcus aureus
MDKSSSTGQ

SEQ ID NO: 1611508 - protein, 6 aa, Staphylococcus aureus
MDPSIG

SEQ ID NO: 1611509 - protein, 11 aa, Staphylococcus aureus
MSNKDENVKQL

SEQ ID NO: 1611510 - protein, 4 aa, Staphylococcus aureus
MSNN

SEQ ID NO: 1611511 - protein, 6 aa, Staphylococcus aureus
MSSTTI

SEQ ID NO: 1611512 - protein, 17 aa, Staphylococcus aureus
NAIQTKEATAEAQQTAI

SEQ ID NO: 1611513 - protein, 5 aa, Staphylococcus aureus
NALSN

SEQ ID NO: 1611514 - protein, 13 aa, Staphylococcus aureus
NDEEQSKFAHSAK

SEQ ID NO: 1611515 - protein, 7 aa, Staphylococcus aureus
NIGPEAS

SEQ ID NO: 1611516 - protein, 9 aa, Staphylococcus aureus
NIGTPNDLP

SEQ ID NO: 1611517 - protein, 6 aa, Staphylococcus aureus
NPLSGE

SEQ ID NO: 1611518 - protein, 7 aa, Staphylococcus aureus
PDGKERF

SEQ ID NO: 1611519 - protein, 5 aa, Staphylococcus aureus
PEYEP

SEQ ID NO: 1611520 - protein, 6 aa, Staphylococcus aureus
PKVATY

SEQ ID NO: 1611521 - protein, 11 aa, Staphylococcus aureus
QAGGRNAITPE

SEQ ID NO: 1611522 - protein, 10 aa, Staphylococcus aureus
QAPKSKKITI

SEQ ID NO: 1611523 - protein, 9 aa, Staphylococcus aureus
QDASGQARN

SEQ ID NO: 1611524 - protein, 4 aa, Staphylococcus aureus
QKMG

SEQ ID NO: 1611525 - protein, 7 aa, Staphylococcus aureus
QKSTYKF

SEQ ID NO: 1611526 - protein, 7 aa, Staphylococcus aureus
QPIGENG

SEQ ID NO: 1611527 - protein, 9 aa, Staphylococcus aureus
QQKEKEGLS

SEQ ID NO: 1611528 - protein, 7 aa, Staphylococcus aureus
QRTEQPQ

SEQ ID NO: 1611529 - protein, 14 aa, Staphylococcus aureus
QSMETKEQNSKEKF

SEQ ID NO: 1611530 - protein, 6 aa, Staphylococcus aureus
QTFGNT

SEQ ID NO: 1611531 - protein, 16 aa, Staphylococcus aureus
QYGTPLPVKEAKDDEY

SEQ ID NO: 1611532 - protein, 8 aa, Staphylococcus aureus
RASNGNKK

SEQ ID NO: 1611533 - protein, 13 aa, Staphylococcus aureus
REGQKRYKASLKE

SEQ ID NO: 1611534 - protein, 10 aa, Staphylococcus aureus
REVEGKYTAD

SEQ ID NO: 1611535 - protein, 12 aa, Staphylococcus aureus
RGEYKENPQSGK

SEQ ID NO: 1611536 - protein, 4 aa, Staphylococcus aureus
RGLT

SEQ ID NO: 1611537 - protein, 13 aa, Staphylococcus aureus
RQSRVEVNTPLSK

SEQ ID NO: 1611538 - protein, 4 aa, Staphylococcus aureus
RRGE

SEQ ID NO: 1611539 - protein, 8 aa, Staphylococcus aureus
RRSTEALY

SEQ ID NO: 1611540 - protein, 9 aa, Staphylococcus aureus
RTSHEDDDL

SEQ ID NO: 1611541 - protein, 12 aa, Staphylococcus aureus
SNNEKEALEEKV

SEQ ID NO: 1611542 - protein, 5 aa, Staphylococcus aureus
SPGFA

SEQ ID NO: 1611543 - protein, 4 aa, Staphylococcus aureus
SSEN

SEQ ID NO: 1611544 - protein, 6 aa, Staphylococcus aureus
SSGHDS

SEQ ID NO: 1611545 - protein, 10 aa, Staphylococcus aureus
STKFAQTVEE

SEQ ID NO: 1611546 - protein, 16 aa, Staphylococcus aureus
STLEDVQNKNVPPTYS

SEQ ID NO: 1611547 - protein, 4 aa, Staphylococcus aureus
STRE

SEQ ID NO: 1611548 - protein, 14 aa, Staphylococcus aureus
TCENKENKNDVSRA

SEQ ID NO: 1611549 - protein, 16 aa, Staphylococcus aureus
TDEIKPSGTGESPLAN

SEQ ID NO: 1611550 - protein, 6 aa, Staphylococcus aureus
TDPGMG

SEQ ID NO: 1611551 - protein, 5 aa, Staphylococcus aureus
TSEGK

SEQ ID NO: 1611552 - protein, 7 aa, Staphylococcus aureus
TSPTPDK

SEQ ID NO: 1611553 - protein, 16 aa, Staphylococcus aureus
TWQSNQARQNNAQSYG

SEQ ID NO: 1611554 - protein, 9 aa, Staphylococcus aureus
VATAEATKD

SEQ ID NO: 1611555 - protein, 5 aa, Staphylococcus aureus
VEDGE

SEQ ID NO: 1611556 - protein, 4 aa, Staphylococcus aureus
VPEG

SEQ ID NO: 1611557 - protein, 6 aa, Staphylococcus aureus
VPGPVD

SEQ ID NO: 1611558 - protein, 6 aa, Staphylococcus aureus
VPTSFS

SEQ ID NO: 1611559 - protein, 10 aa, Staphylococcus aureus
VSEDKAFPRL

SEQ ID NO: 1611560 - protein, 5 aa, Staphylococcus aureus
WPQPG

SEQ ID NO: 1611561 - protein, 11 aa, Staphylococcus aureus
YNKNRKKYTQQ

SEQ ID NO: 1611562 - protein, 18 aa, Staphylococcus aureus
AARDSGAAITAKHRGRVE

SEQ ID NO: 1611563 - protein, 6 aa, Staphylococcus aureus
AEPPVH

SEQ ID NO: 1611564 - protein, 10 aa, Staphylococcus aureus
AEWDPEYGDR

SEQ ID NO: 1611565 - protein, 6 aa, Staphylococcus aureus
AGVTDY

SEQ ID NO: 1611566 - protein, 10 aa, Staphylococcus aureus
AKMGPASDPM

SEQ ID NO: 1611567 - protein, 11 aa, Staphylococcus aureus
ALTENDNPEEV

SEQ ID NO: 1611568 - protein, 17 aa, Staphylococcus aureus
APPGYIGHDEGGQLTEA

SEQ ID NO: 1611569 - protein, 12 aa, Staphylococcus aureus
AQKGRDLPLEGR

SEQ ID NO: 1611570 - protein, 7 aa, Staphylococcus aureus
ASFAGHN

SEQ ID NO: 1611571 - protein, 24 aa, Staphylococcus aureus
ASSLTGDNATIPNHKDITDQLDYE

SEQ ID NO: 1611572 - protein, 9 aa, Staphylococcus aureus
ATRTSREKL

SEQ ID NO: 1611573 - protein, 6 aa, Staphylococcus aureus
DENAFN

SEQ ID NO: 1611574 - protein, 8 aa, Staphylococcus aureus
DKELNGLK

SEQ ID NO: 1611575 - protein, 7 aa, Staphylococcus aureus
DKELNQN

SEQ ID NO: 1611576 - protein, 14 aa, Staphylococcus aureus
DKFKYDNDIKNSIG

SEQ ID NO: 1611577 - protein, 5 aa, Staphylococcus aureus
DLNDW

SEQ ID NO: 1611578 - protein, 9 aa, Staphylococcus aureus
DLSGGEKAR

SEQ ID NO: 1611579 - protein, 14 aa, Staphylococcus aureus
DNGEALKKYHQMRG

SEQ ID NO: 1611580 - protein, 4 aa, Staphylococcus aureus
EELN

SEQ ID NO: 1611581 - protein, 9 aa, Staphylococcus aureus
EGQTLGRLS

SEQ ID NO: 1611582 - protein, 6 aa, Staphylococcus aureus
ENTPSF

SEQ ID NO: 1611583 - protein, 6 aa, Staphylococcus aureus
ESFDDQ

SEQ ID NO: 1611584 - protein, 5 aa, Staphylococcus aureus
ETEKY

SEQ ID NO: 1611585 - protein, 14 aa, Staphylococcus aureus
FKSASAFPLPNTEY

SEQ ID NO: 1611586 - protein, 5 aa, Staphylococcus aureus
FPQDT

SEQ ID NO: 1611587 - protein, 6 aa, Staphylococcus aureus
GAGFPS

SEQ ID NO: 1611588 - protein, 14 aa, Staphylococcus aureus
GAQTERSKRNFPVG

SEQ ID NO: 1611589 - protein, 9 aa, Staphylococcus aureus
GAYKEAEKL

SEQ ID NO: 1611590 - protein, 6 aa, Staphylococcus aureus
GEWEEK

SEQ ID NO: 1611591 - protein, 9 aa, Staphylococcus aureus
GGTYGPDIE

SEQ ID NO: 1611592 - protein, 8 aa, Staphylococcus aureus
GIARPAAS

SEQ ID NO: 1611593 - protein, 5 aa, Staphylococcus aureus
GIPLT

SEQ ID NO: 1611594 - protein, 9 aa, Staphylococcus aureus
GLKKHTRDA

SEQ ID NO: 1611595 - protein, 9 aa, Staphylococcus aureus
GPNTGGKTV

SEQ ID NO: 1611596 - protein, 4 aa, Staphylococcus aureus
GRLQ

SEQ ID NO: 1611597 - protein, 8 aa, Staphylococcus aureus
GRYKTNKK

SEQ ID NO: 1611598 - protein, 5 aa, Staphylococcus aureus
GTTDE

SEQ ID NO: 1611599 - protein, 6 aa, Staphylococcus aureus
GTYDKV

SEQ ID NO: 1611600 - protein, 7 aa, Staphylococcus aureus
HGLSKGD

SEQ ID NO: 1611601 - protein, 4 aa, Staphylococcus aureus
IALT

SEQ ID NO: 1611602 - protein, 9 aa, Staphylococcus aureus
IASNDKFNA

SEQ ID NO: 1611603 - protein, 4 aa, Staphylococcus aureus
IDDT

SEQ ID NO: 1611604 - protein, 19 aa, Staphylococcus aureus
IEDTKGKVTLKKEKETEII

SEQ ID NO: 1611605 - protein, 5 aa, Staphylococcus aureus
IGRHN

SEQ ID NO: 1611606 - protein, 5 aa, Staphylococcus aureus
IGTSK

SEQ ID NO: 1611607 - protein, 30 aa, Staphylococcus aureus
IKAQQAREAARKAREDARSGKKNKRKDTLL

SEQ ID NO: 1611608 - protein, 4 aa, Staphylococcus aureus
IQGS

SEQ ID NO: 1611609 - protein, 10 aa, Staphylococcus aureus
IRDNEGEAFR

SEQ ID NO: 1611610 - protein, 9 aa, Staphylococcus aureus
ISKKEKEQL

SEQ ID NO: 1611611 - protein, 5 aa, Staphylococcus aureus
ISTIG

SEQ ID NO: 1611612 - protein, 5 aa, Staphylococcus aureus
ITPEL

SEQ ID NO: 1611613 - protein, 15 aa, Staphylococcus aureus
KAKKQELEDLESADQ

SEQ ID NO: 1611614 - protein, 22 aa, Staphylococcus aureus
KARTKDIEIPRDKIAKARHAVM

SEQ ID NO: 1611615 - protein, 12 aa, Staphylococcus aureus
KDQKENGAPRRT

SEQ ID NO: 1611616 - protein, 4 aa, Staphylococcus aureus
KIDR

SEQ ID NO: 1611617 - protein, 14 aa, Staphylococcus aureus
KKFETNFSTDTTNE

SEQ ID NO: 1611618 - protein, 21 aa, Staphylococcus aureus
KKVAEERQLKTNEVYNIYHQI

SEQ ID NO: 1611619 - protein, 5 aa, Staphylococcus aureus
KMDDD

SEQ ID NO: 1611620 - protein, 6 aa, Staphylococcus aureus
KSGEGI

SEQ ID NO: 1611621 - protein, 13 aa, Staphylococcus aureus
KTAHASTPKEGVS

SEQ ID NO: 1611622 - protein, 12 aa, Staphylococcus aureus
KYAAQGKFAEGS

SEQ ID NO: 1611623 - protein, 6 aa, Staphylococcus aureus
LESTDA

SEQ ID NO: 1611624 - protein, 9 aa, Staphylococcus aureus
LPNGETSTR

SEQ ID NO: 1611625 - protein, 7 aa, Staphylococcus aureus
LSAENEI

SEQ ID NO: 1611626 - protein, 6 aa, Staphylococcus aureus
MREAET

SEQ ID NO: 1611627 - protein, 5 aa, Staphylococcus aureus
NEEQP

SEQ ID NO: 1611628 - protein, 7 aa, Staphylococcus aureus
NEFGTAP

SEQ ID NO: 1611629 - protein, 4 aa, Staphylococcus aureus
NEQQ

SEQ ID NO: 1611630 - protein, 16 aa, Staphylococcus aureus
NVDGVYSADPKVNKDA

SEQ ID NO: 1611631 - protein, 6 aa, Staphylococcus aureus
PDKQDV

SEQ ID NO: 1611632 - protein, 6 aa, Staphylococcus aureus
PDTDAI

SEQ ID NO: 1611633 - protein, 13 aa, Staphylococcus aureus
PLASTSRALEPSI

SEQ ID NO: 1611634 - protein, 6 aa, Staphylococcus aureus
PQIQKN

SEQ ID NO: 1611635 - protein, 5 aa, Staphylococcus aureus
PTKEP

SEQ ID NO: 1611636 - protein, 6 aa, Staphylococcus aureus
PTNQTS

SEQ ID NO: 1611637 - protein, 18 aa, Staphylococcus aureus
QASEINADGIGRDASTLA

SEQ ID NO: 1611638 - protein, 8 aa, Staphylococcus aureus
QDGLTQND

SEQ ID NO: 1611639 - protein, 4 aa, Staphylococcus aureus
QDSN

SEQ ID NO: 1611640 - protein, 7 aa, Staphylococcus aureus
QIKTNLK

SEQ ID NO: 1611641 - protein, 7 aa, Staphylococcus aureus
QKHSRDP

SEQ ID NO: 1611642 - protein, 9 aa, Staphylococcus aureus
QPKSPISEK

SEQ ID NO: 1611643 - protein, 4 aa, Staphylococcus aureus
QRTV

SEQ ID NO: 1611644 - protein, 6 aa, Staphylococcus aureus
QSFGTP

SEQ ID NO: 1611645 - protein, 12 aa, Staphylococcus aureus
RASTSEKSKRLY

SEQ ID NO: 1611646 - protein, 10 aa, Staphylococcus aureus
RDTKERGRSM

SEQ ID NO: 1611647 - protein, 8 aa, Staphylococcus aureus
RKKRTRSS

SEQ ID NO: 1611648 - protein, 5 aa, Staphylococcus aureus
RLSRE

SEQ ID NO: 1611649 - protein, 10 aa, Staphylococcus aureus
RLTAEDKKEI

SEQ ID NO: 1611650 - protein, 5 aa, Staphylococcus aureus
RTPDY

SEQ ID NO: 1611651 - protein, 5 aa, Staphylococcus aureus
SASFY

SEQ ID NO: 1611652 - protein, 4 aa, Staphylococcus aureus
SECG

SEQ ID NO: 1611653 - protein, 4 aa, Staphylococcus aureus
SIAE

SEQ ID NO: 1611654 - protein, 13 aa, Staphylococcus aureus
SLKAQGAKVDSWG

SEQ ID NO: 1611655 - protein, 10 aa, Staphylococcus aureus
SNDLDEETIT

SEQ ID NO: 1611656 - protein, 8 aa, Staphylococcus aureus
SQVPGTDA

SEQ ID NO: 1611657 - protein, 9 aa, Staphylococcus aureus
SRVRARKKV

SEQ ID NO: 1611658 - protein, 8 aa, Staphylococcus aureus
STLTTRQA

SEQ ID NO: 1611659 - protein, 5 aa, Staphylococcus aureus
SYPST

SEQ ID NO: 1611660 - protein, 15 aa, Staphylococcus aureus
TGMIGDPSGKSEERV

SEQ ID NO: 1611661 - protein, 14 aa, Staphylococcus aureus
TKGQAGTNSITRPS

SEQ ID NO: 1611662 - protein, 7 aa, Staphylococcus aureus
TKSLKGI

SEQ ID NO: 1611663 - protein, 8 aa, Staphylococcus aureus
TNTGELSV

SEQ ID NO: 1611664 - protein, 6 aa, Staphylococcus aureus
TPGRQH

SEQ ID NO: 1611665 - protein, 7 aa, Staphylococcus aureus
TRNGANL

SEQ ID NO: 1611666 - protein, 9 aa, Staphylococcus aureus
TSIEGELPE

SEQ ID NO: 1611667 - protein, 14 aa, Staphylococcus aureus
TSNAQARKIFEVEK

SEQ ID NO: 1611668 - protein, 8 aa, Staphylococcus aureus
TSTERGKI

SEQ ID NO: 1611669 - protein, 19 aa, Staphylococcus aureus
TVHSPSPVDVKAGEYEDCK

SEQ ID NO: 1611670 - protein, 7 aa, Staphylococcus aureus
VEQDDMK

SEQ ID NO: 1611671 - protein, 4 aa, Staphylococcus aureus
VGKN

SEQ ID NO: 1611672 - protein, 4 aa, Staphylococcus aureus
VKRN

SEQ ID NO: 1611673 - protein, 9 aa, Staphylococcus aureus
VNQEQQNNL

SEQ ID NO: 1611674 - protein, 9 aa, Staphylococcus aureus
VNSGTADTP

SEQ ID NO: 1611675 - protein, 14 aa, Staphylococcus aureus
VTSGTQSPSSGKSI

SEQ ID NO: 1611676 - protein, 4 aa, Staphylococcus aureus
YDQD

SEQ ID NO: 1611677 - protein, 6 aa, Staphylococcus aureus
AHPEFG

SEQ ID NO: 1611678 - protein, 9 aa, Staphylococcus aureus
AKAKDGASC

SEQ ID NO: 1611679 - protein, 8 aa, Staphylococcus aureus
AKAKTIEK

SEQ ID NO: 1611680 - protein, 12 aa, Staphylococcus aureus
ANVDDATKEHLE

SEQ ID NO: 1611681 - protein, 7 aa, Staphylococcus aureus
AQKEKYD

SEQ ID NO: 1611682 - protein, 10 aa, Staphylococcus aureus
ARDSTSYTQQ

SEQ ID NO: 1611683 - protein, 9 aa, Staphylococcus aureus
ATISDQKEI

SEQ ID NO: 1611684 - protein, 4 aa, Staphylococcus aureus
ATPK

SEQ ID NO: 1611685 - protein, 10 aa, Staphylococcus aureus
AVGDETETKE

SEQ ID NO: 1611686 - protein, 11 aa, Staphylococcus aureus
DADKPSSPCGA

SEQ ID NO: 1611687 - protein, 8 aa, Staphylococcus aureus
DDEAQSQF

SEQ ID NO: 1611688 - protein, 10 aa, Staphylococcus aureus
DDNTPKDQAV

SEQ ID NO: 1611689 - protein, 4 aa, Staphylococcus aureus
DETI

SEQ ID NO: 1611690 - protein, 8 aa, Staphylococcus aureus
DGAYPDEI

SEQ ID NO: 1611691 - protein, 4 aa, Staphylococcus aureus
DGEF

SEQ ID NO: 1611692 - protein, 4 aa, Staphylococcus aureus
DGGF

SEQ ID NO: 1611693 - protein, 6 aa, Staphylococcus aureus
DGLKPV

SEQ ID NO: 1611694 - protein, 8 aa, Staphylococcus aureus
DNTPTCTT

SEQ ID NO: 1611695 - protein, 6 aa, Staphylococcus aureus
DQCPTS

SEQ ID NO: 1611696 - protein, 5 aa, Staphylococcus aureus
DTPAA

SEQ ID NO: 1611697 - protein, 15 aa, Staphylococcus aureus
DYEKENSEHFNVEIA

SEQ ID NO: 1611698 - protein, 6 aa, Staphylococcus aureus
EDETAK

SEQ ID NO: 1611699 - protein, 5 aa, Staphylococcus aureus
EGETY

SEQ ID NO: 1611700 - protein, 23 aa, Staphylococcus aureus
EGKRYRKKGFRTKREANSAGLDK

SEQ ID NO: 1611701 - protein, 10 aa, Staphylococcus aureus
ELDDTPLAKR

SEQ ID NO: 1611702 - protein, 6 aa, Staphylococcus aureus
ELNESA

SEQ ID NO: 1611703 - protein, 6 aa, Staphylococcus aureus
ENEQHL

SEQ ID NO: 1611704 - protein, 5 aa, Staphylococcus aureus
ERNYY

SEQ ID NO: 1611705 - protein, 10 aa, Staphylococcus aureus
ESMSDKELEQ

SEQ ID NO: 1611706 - protein, 7 aa, Staphylococcus aureus
EVKESDG

SEQ ID NO: 1611707 - protein, 25 aa, Staphylococcus aureus
FAKGQKGSSAMPHKRNPIGSENITG

SEQ ID NO: 1611708 - protein, 11 aa, Staphylococcus aureus
FKKPTTNYNGS

SEQ ID NO: 1611709 - protein, 12 aa, Staphylococcus aureus
FRTGSEGAPEIK

SEQ ID NO: 1611710 - protein, 10 aa, Staphylococcus aureus
FSDGANAANL

SEQ ID NO: 1611711 - protein, 4 aa, Staphylococcus aureus
GDGP

SEQ ID NO: 1611712 - protein, 13 aa, Staphylococcus aureus
GESGSGKSVTTKA

SEQ ID NO: 1611713 - protein, 5 aa, Staphylococcus aureus
GEVQA

SEQ ID NO: 1611714 - protein, 4 aa, Staphylococcus aureus
GEYG

SEQ ID NO: 1611715 - protein, 6 aa, Staphylococcus aureus
GKHAFS

SEQ ID NO: 1611716 - protein, 9 aa, Staphylococcus aureus
GKTPHSSHK

SEQ ID NO: 1611717 - protein, 48 aa, Staphylococcus aureus
GNVKETVGNVTDNKELEKEGQQDKATGKAKEVVENAKNKITDAIDKLK

SEQ ID NO: 1611718 - protein, 6 aa, Staphylococcus aureus
GQPKPI

SEQ ID NO: 1611719 - protein, 10 aa, Staphylococcus aureus
GQRTDITSEQ

SEQ ID NO: 1611720 - protein, 11 aa, Staphylococcus aureus
GRPETQRKTVE

SEQ ID NO: 1611721 - protein, 15 aa, Staphylococcus aureus
GSIGLTGKEAEETLD

SEQ ID NO: 1611722 - protein, 19 aa, Staphylococcus aureus
GVEEQADEVQKVKRSENGV

SEQ ID NO: 1611723 - protein, 6 aa, Staphylococcus aureus
HTYGQR

SEQ ID NO: 1611724 - protein, 4 aa, Staphylococcus aureus
IPET

SEQ ID NO: 1611725 - protein, 12 aa, Staphylococcus aureus
KAAHQASFWEGL

SEQ ID NO: 1611726 - protein, 11 aa, Staphylococcus aureus
KASHKEEKNPY

SEQ ID NO: 1611727 - protein, 6 aa, Staphylococcus aureus
KEDKIK

SEQ ID NO: 1611728 - protein, 6 aa, Staphylococcus aureus
KEGQDI

SEQ ID NO: 1611729 - protein, 6 aa, Staphylococcus aureus
KGYQVT

SEQ ID NO: 1611730 - protein, 6 aa, Staphylococcus aureus
KIKEAN

SEQ ID NO: 1611731 - protein, 22 aa, Staphylococcus aureus
KNDGYTSDKSRQTLSEKETHLE

SEQ ID NO: 1611732 - protein, 8 aa, Staphylococcus aureus
KNKELKGI

SEQ ID NO: 1611733 - protein, 6 aa, Staphylococcus aureus
KPISDY

SEQ ID NO: 1611734 - protein, 5 aa, Staphylococcus aureus
KQAEG

SEQ ID NO: 1611735 - protein, 13 aa, Staphylococcus aureus
KQHDAANAWGSWN

SEQ ID NO: 1611736 - protein, 4 aa, Staphylococcus aureus
KQPK

SEQ ID NO: 1611737 - protein, 6 aa, Staphylococcus aureus
KSKDRI

SEQ ID NO: 1611738 - protein, 10 aa, Staphylococcus aureus
KTPYVSTGKD

SEQ ID NO: 1611739 - protein, 8 aa, Staphylococcus aureus
MAQQAGGY

SEQ ID NO: 1611740 - protein, 6 aa, Staphylococcus aureus
NAQNGI

SEQ ID NO: 1611741 - protein, 4 aa, Staphylococcus aureus
NDKS

SEQ ID NO: 1611742 - protein, 10 aa, Staphylococcus aureus
NDNKEISSYT

SEQ ID NO: 1611743 - protein, 12 aa, Staphylococcus aureus
NGTMGQRWEEGK

SEQ ID NO: 1611744 - protein, 7 aa, Staphylococcus aureus
NIQSSTL

SEQ ID NO: 1611745 - protein, 6 aa, Staphylococcus aureus
NRNIKA

SEQ ID NO: 1611746 - protein, 15 aa, Staphylococcus aureus
PNNQNCTPSREHPHE

SEQ ID NO: 1611747 - protein, 4 aa, Staphylococcus aureus
PTQS

SEQ ID NO: 1611748 - protein, 5 aa, Staphylococcus aureus
PTTVV

SEQ ID NO: 1611749 - protein, 10 aa, Staphylococcus aureus
QEQANNYGHS

SEQ ID NO: 1611750 - protein, 6 aa, Staphylococcus aureus
QETGGL

SEQ ID NO: 1611751 - protein, 17 aa, Staphylococcus aureus
QKMETSEKQAKKAQNMI

SEQ ID NO: 1611752 - protein, 8 aa, Staphylococcus aureus
QKTEVESK

SEQ ID NO: 1611753 - protein, 10 aa, Staphylococcus aureus
QKYSKEQLRT

SEQ ID NO: 1611754 - protein, 10 aa, Staphylococcus aureus
QLGQRPGAGA

SEQ ID NO: 1611755 - protein, 5 aa, Staphylococcus aureus
QLPES

SEQ ID NO: 1611756 - protein, 11 aa, Staphylococcus aureus
RAKERFKEVTT

SEQ ID NO: 1611757 - protein, 6 aa, Staphylococcus aureus
RECENC

SEQ ID NO: 1611758 - protein, 7 aa, Staphylococcus aureus
RKHNQHT

SEQ ID NO: 1611759 - protein, 6 aa, Staphylococcus aureus
RNDRYG

SEQ ID NO: 1611760 - protein, 4 aa, Staphylococcus aureus
RRDI

SEQ ID NO: 1611761 - protein, 19 aa, Staphylococcus aureus
SENNNKDEVKKGKELIEAT

SEQ ID NO: 1611762 - protein, 8 aa, Staphylococcus aureus
SNLDSGEY

SEQ ID NO: 1611763 - protein, 10 aa, Staphylococcus aureus
SNRTLKSKEV

SEQ ID NO: 1611764 - protein, 5 aa, Staphylococcus aureus
SPAQI

SEQ ID NO: 1611765 - protein, 8 aa, Staphylococcus aureus
SPKYDKKL

SEQ ID NO: 1611766 - protein, 28 aa, Staphylococcus aureus
SPRLSLSEKSLKRTPSFSVNRPGEETGV

SEQ ID NO: 1611767 - protein, 8 aa, Staphylococcus aureus
SQGVKKGD

SEQ ID NO: 1611768 - protein, 4 aa, Staphylococcus aureus
SQKP

SEQ ID NO: 1611769 - protein, 18 aa, Staphylococcus aureus
SQMTQNSDFNEEKKVSTK

SEQ ID NO: 1611770 - protein, 5 aa, Staphylococcus aureus
STNSL

SEQ ID NO: 1611771 - protein, 19 aa, Staphylococcus aureus
TAKPYAPGKFEKKTTSEAL

SEQ ID NO: 1611772 - protein, 7 aa, Staphylococcus aureus
TGRSDEH

SEQ ID NO: 1611773 - protein, 5 aa, Staphylococcus aureus
TKEDV

SEQ ID NO: 1611774 - protein, 7 aa, Staphylococcus aureus
TNWSRDN

SEQ ID NO: 1611775 - protein, 4 aa, Staphylococcus aureus
TRTG

SEQ ID NO: 1611776 - protein, 11 aa, Staphylococcus aureus
TSRTGTTGQTQ

SEQ ID NO: 1611777 - protein, 6 aa, Staphylococcus aureus
TSTKSV

SEQ ID NO: 1611778 - protein, 4 aa, Staphylococcus aureus
TVKS

SEQ ID NO: 1611779 - protein, 6 aa, Staphylococcus aureus
VAPGEH

SEQ ID NO: 1611780 - protein, 13 aa, Staphylococcus aureus
VDKHSTGGVGDTT

SEQ ID NO: 1611781 - protein, 9 aa, Staphylococcus aureus
VEGDSPEEL

SEQ ID NO: 1611782 - protein, 21 aa, Staphylococcus aureus
VGKKGGVFGTTQGLQQQYGED

SEQ ID NO: 1611783 - protein, 11 aa, Staphylococcus aureus
VKEESDKAKLT

SEQ ID NO: 1611784 - protein, 5 aa, Staphylococcus aureus
VKNKD

SEQ ID NO: 1611785 - protein, 11 aa, Staphylococcus aureus
VNASTKEGYIT

SEQ ID NO: 1611786 - protein, 5 aa, Staphylococcus aureus
YRSID

SEQ ID NO: 1611787 - protein, 12 aa, Staphylococcus aureus
YTEVAKESGLDV

SEQ ID NO: 1611788 - protein, 7 aa, Staphylococcus aureus
AATTKAF

SEQ ID NO: 1611789 - protein, 8 aa, Staphylococcus aureus
ADEEYRED

SEQ ID NO: 1611790 - protein, 7 aa, Staphylococcus aureus
ADTPGFS

SEQ ID NO: 1611791 - protein, 6 aa, Staphylococcus aureus
AQYPPQ

SEQ ID NO: 1611792 - protein, 8 aa, Staphylococcus aureus
ARVTESNL

SEQ ID NO: 1611793 - protein, 8 aa, Staphylococcus aureus
ASPKHTEG

SEQ ID NO: 1611794 - protein, 7 aa, Staphylococcus aureus
ATGGFAK

SEQ ID NO: 1611795 - protein, 8 aa, Staphylococcus aureus
ATVQEEVG

SEQ ID NO: 1611796 - protein, 14 aa, Staphylococcus aureus
AVKQTLKSQSHNNI

SEQ ID NO: 1611797 - protein, 7 aa, Staphylococcus aureus
DAVPNNA

SEQ ID NO: 1611798 - protein, 14 aa, Staphylococcus aureus
DDGEIKIKISLSTK

SEQ ID NO: 1611799 - protein, 11 aa, Staphylococcus aureus
DDVKKEIKSLP

SEQ ID NO: 1611800 - protein, 5 aa, Staphylococcus aureus
DESSK

SEQ ID NO: 1611801 - protein, 8 aa, Staphylococcus aureus
DFKNPSQF

SEQ ID NO: 1611802 - protein, 6 aa, Staphylococcus aureus
DGTEDI

SEQ ID NO: 1611803 - protein, 4 aa, Staphylococcus aureus
DGTR

SEQ ID NO: 1611804 - protein, 7 aa, Staphylococcus aureus
DLKPENL

SEQ ID NO: 1611805 - protein, 8 aa, Staphylococcus aureus
DNKGLDAT

SEQ ID NO: 1611806 - protein, 7 aa, Staphylococcus aureus
DPKANEI

SEQ ID NO: 1611807 - protein, 8 aa, Staphylococcus aureus
DQGVKGSD

SEQ ID NO: 1611808 - protein, 6 aa, Staphylococcus aureus
DRDEAM

SEQ ID NO: 1611809 - protein, 4 aa, Staphylococcus aureus
DTAK

SEQ ID NO: 1611810 - protein, 8 aa, Staphylococcus aureus
DVQAQTKQ

SEQ ID NO: 1611811 - protein, 7 aa, Staphylococcus aureus
EAEQAGY

SEQ ID NO: 1611812 - protein, 8 aa, Staphylococcus aureus
EASKNGKT

SEQ ID NO: 1611813 - protein, 32 aa, Staphylococcus aureus
EDEMDDDDDIPAQTDDQEELNDPEDEQVEEEI

SEQ ID NO: 1611814 - protein, 8 aa, Staphylococcus aureus
EDYADARG

SEQ ID NO: 1611815 - protein, 4 aa, Staphylococcus aureus
EGKI

SEQ ID NO: 1611816 - protein, 5 aa, Staphylococcus aureus
EKGAK

SEQ ID NO: 1611817 - protein, 6 aa, Staphylococcus aureus
ENVDGH

SEQ ID NO: 1611818 - protein, 7 aa, Staphylococcus aureus
EQIETQD

SEQ ID NO: 1611819 - protein, 4 aa, Staphylococcus aureus
EQPL

SEQ ID NO: 1611820 - protein, 8 aa, Staphylococcus aureus
ERKNKMAE

SEQ ID NO: 1611821 - protein, 14 aa, Staphylococcus aureus
ESHPLQDEDQVQGS

SEQ ID NO: 1611822 - protein, 8 aa, Staphylococcus aureus
ETKSQPEK

SEQ ID NO: 1611823 - protein, 12 aa, Staphylococcus aureus
FDQMTKKSNPDY

SEQ ID NO: 1611824 - protein, 16 aa, Staphylococcus aureus
FDTDTLEGIQSSNTDV

SEQ ID NO: 1611825 - protein, 5 aa, Staphylococcus aureus
FPQGV

SEQ ID NO: 1611826 - protein, 11 aa, Staphylococcus aureus
FSPEPSYMPGY

SEQ ID NO: 1611827 - protein, 9 aa, Staphylococcus aureus
GAKLANPDK

SEQ ID NO: 1611828 - protein, 8 aa, Staphylococcus aureus
GAVDPNAI

SEQ ID NO: 1611829 - protein, 7 aa, Staphylococcus aureus
GENVAEP

SEQ ID NO: 1611830 - protein, 7 aa, Staphylococcus aureus
GESVQQG

SEQ ID NO: 1611831 - protein, 4 aa, Staphylococcus aureus
GGNA

SEQ ID NO: 1611832 - protein, 14 aa, Staphylococcus aureus
GKPTSYKTLPNRYK

SEQ ID NO: 1611833 - protein, 9 aa, Staphylococcus aureus
GNGSLDKKL

SEQ ID NO: 1611834 - protein, 17 aa, Staphylococcus aureus
GRRATGVTYKKNGKLHT

SEQ ID NO: 1611835 - protein, 5 aa, Staphylococcus aureus
GTGIA

SEQ ID NO: 1611836 - protein, 8 aa, Staphylococcus aureus
GTQEQVKA

SEQ ID NO: 1611837 - protein, 13 aa, Staphylococcus aureus
HEYQDVSSTNSNL

SEQ ID NO: 1611838 - protein, 8 aa, Staphylococcus aureus
HPKDKNFK

SEQ ID NO: 1611839 - protein, 16 aa, Staphylococcus aureus
HRGGVGADGITGDGAG

SEQ ID NO: 1611840 - protein, 7 aa, Staphylococcus aureus
IGSTLPE

SEQ ID NO: 1611841 - protein, 6 aa, Staphylococcus aureus
IIGDGN

SEQ ID NO: 1611842 - protein, 5 aa, Staphylococcus aureus
ISESE

SEQ ID NO: 1611843 - protein, 6 aa, Staphylococcus aureus
KAEFPE

SEQ ID NO: 1611844 - protein, 4 aa, Staphylococcus aureus
KDIT

SEQ ID NO: 1611845 - protein, 5 aa, Staphylococcus aureus
KEDKM

SEQ ID NO: 1611846 - protein, 8 aa, Staphylococcus aureus
KESNGQFG

SEQ ID NO: 1611847 - protein, 5 aa, Staphylococcus aureus
KKSVR

SEQ ID NO: 1611848 - protein, 18 aa, Staphylococcus aureus
KNARKELKNWTKTKNVDT

SEQ ID NO: 1611849 - protein, 9 aa, Staphylococcus aureus
KNYDQISSI

SEQ ID NO: 1611850 - protein, 10 aa, Staphylococcus aureus
KPNRPSRNKL

SEQ ID NO: 1611851 - protein, 7 aa, Staphylococcus aureus
KQAASEE

SEQ ID NO: 1611852 - protein, 11 aa, Staphylococcus aureus
KQGMPSAKKRM

SEQ ID NO: 1611853 - protein, 6 aa, Staphylococcus aureus
KQTSDV

SEQ ID NO: 1611854 - protein, 8 aa, Staphylococcus aureus
KVQYNGET

SEQ ID NO: 1611855 - protein, 4 aa, Staphylococcus aureus
KVSD

SEQ ID NO: 1611856 - protein, 14 aa, Staphylococcus aureus
KVTFSSKAQKQLKQ

SEQ ID NO: 1611857 - protein, 7 aa, Staphylococcus aureus
KWDQTTA

SEQ ID NO: 1611858 - protein, 5 aa, Staphylococcus aureus
KYQDT

SEQ ID NO: 1611859 - protein, 8 aa, Staphylococcus aureus
LLAPAGNL

SEQ ID NO: 1611860 - protein, 7 aa, Staphylococcus aureus
LTESQQQ

SEQ ID NO: 1611861 - protein, 9 aa, Staphylococcus aureus
NEATFQPKS

SEQ ID NO: 1611862 - protein, 26 aa, Staphylococcus aureus
NEYDDTDKIFSNPSNKKTEDYISGRF

SEQ ID NO: 1611863 - protein, 15 aa, Staphylococcus aureus
NGKEVKMSKRTGNAI

SEQ ID NO: 1611864 - protein, 9 aa, Staphylococcus aureus
NGKPIRETT

SEQ ID NO: 1611865 - protein, 17 aa, Staphylococcus aureus
NKNNDISEEKAEALIDA

SEQ ID NO: 1611866 - protein, 8 aa, Staphylococcus aureus
NKPSLTER

SEQ ID NO: 1611867 - protein, 13 aa, Staphylococcus aureus
NLDSEIQRGEVTP

SEQ ID NO: 1611868 - protein, 7 aa, Staphylococcus aureus
NNNTNVP

SEQ ID NO: 1611869 - protein, 5 aa, Staphylococcus aureus
NPCPE

SEQ ID NO: 1611870 - protein, 4 aa, Staphylococcus aureus
NPGL

SEQ ID NO: 1611871 - protein, 4 aa, Staphylococcus aureus
NQER

SEQ ID NO: 1611872 - protein, 4 aa, Staphylococcus aureus
NRNE

SEQ ID NO: 1611873 - protein, 7 aa, Staphylococcus aureus
NTKTRTK

SEQ ID NO: 1611874 - protein, 5 aa, Staphylococcus aureus
NTYRH

SEQ ID NO: 1611875 - protein, 10 aa, Staphylococcus aureus
NVSNGKPEYI

SEQ ID NO: 1611876 - protein, 13 aa, Staphylococcus aureus
PDVEVDKGTDALQ

SEQ ID NO: 1611877 - protein, 7 aa, Staphylococcus aureus
PEEYKTI

SEQ ID NO: 1611878 - protein, 6 aa, Staphylococcus aureus
PEQDGV

SEQ ID NO: 1611879 - protein, 8 aa, Staphylococcus aureus
PLTPKTKG

SEQ ID NO: 1611880 - protein, 13 aa, Staphylococcus aureus
PSKFEDAEDIAKE

SEQ ID NO: 1611881 - protein, 6 aa, Staphylococcus aureus
PTTGNH

SEQ ID NO: 1611882 - protein, 6 aa, Staphylococcus aureus
QDTDGQ

SEQ ID NO: 1611883 - protein, 10 aa, Staphylococcus aureus
QDVTEGPSVT

SEQ ID NO: 1611884 - protein, 8 aa, Staphylococcus aureus
QHGGSRLK

SEQ ID NO: 1611885 - protein, 4 aa, Staphylococcus aureus
QIES

SEQ ID NO: 1611886 - protein, 7 aa, Staphylococcus aureus
QNQLPQG

SEQ ID NO: 1611887 - protein, 7 aa, Staphylococcus aureus
QSTGSIT

SEQ ID NO: 1611888 - protein, 8 aa, Staphylococcus aureus
RDKIEAEY

SEQ ID NO: 1611889 - protein, 13 aa, Staphylococcus aureus
REENGAIKHNKEL

SEQ ID NO: 1611890 - protein, 8 aa, Staphylococcus aureus
RMHAPDGM

SEQ ID NO: 1611891 - protein, 10 aa, Staphylococcus aureus
RQGGYGRGRR

SEQ ID NO: 1611892 - protein, 9 aa, Staphylococcus aureus
RSNNGETET

SEQ ID NO: 1611893 - protein, 7 aa, Staphylococcus aureus
SAERLGL

SEQ ID NO: 1611894 - protein, 9 aa, Staphylococcus aureus
SDDRKLRES

SEQ ID NO: 1611895 - protein, 22 aa, Staphylococcus aureus
SEASSTTSVDLANRSRSLTEEN

SEQ ID NO: 1611896 - protein, 5 aa, Staphylococcus aureus
SEGRG

SEQ ID NO: 1611897 - protein, 6 aa, Staphylococcus aureus
SGTSVL

SEQ ID NO: 1611898 - protein, 4 aa, Staphylococcus aureus
SIEG

SEQ ID NO: 1611899 - protein, 28 aa, Staphylococcus aureus
SINEKDGKVGSVTLTSTKDGSEETHEAD

SEQ ID NO: 1611900 - protein, 4 aa, Staphylococcus aureus
SKEE

SEQ ID NO: 1611901 - protein, 17 aa, Staphylococcus aureus
SNEDKSSLHRYKADESY

SEQ ID NO: 1611902 - protein, 6 aa, Staphylococcus aureus
SPEFPR

SEQ ID NO: 1611903 - protein, 9 aa, Staphylococcus aureus
SPITKQNYQ

SEQ ID NO: 1611904 - protein, 8 aa, Staphylococcus aureus
SSKKAQFS

SEQ ID NO: 1611905 - protein, 11 aa, Staphylococcus aureus
TEGTIKSEAYR

SEQ ID NO: 1611906 - protein, 17 aa, Staphylococcus aureus
TERPEGVEAGTSRVIGT

SEQ ID NO: 1611907 - protein, 8 aa, Staphylococcus aureus
TEYDTSSQ

SEQ ID NO: 1611908 - protein, 5 aa, Staphylococcus aureus
TIDEL

SEQ ID NO: 1611909 - protein, 9 aa, Staphylococcus aureus
TKPGSDDLN

SEQ ID NO: 1611910 - protein, 32 aa, Staphylococcus aureus
TNDKVDTTRLPNPSPIQQSNKVYSEPSNEIEQ

SEQ ID NO: 1611911 - protein, 5 aa, Staphylococcus aureus
TQPKN

SEQ ID NO: 1611912 - protein, 8 aa, Staphylococcus aureus
TTGEKEKL

SEQ ID NO: 1611913 - protein, 6 aa, Staphylococcus aureus
TVEVDG

SEQ ID NO: 1611914 - protein, 6 aa, Staphylococcus aureus
TVQGEN

SEQ ID NO: 1611915 - protein, 9 aa, Staphylococcus aureus
TYSDSGMNG

SEQ ID NO: 1611916 - protein, 7 aa, Staphylococcus aureus
VAGTTRD

SEQ ID NO: 1611917 - protein, 4 aa, Staphylococcus aureus
VDVE

SEQ ID NO: 1611918 - protein, 7 aa, Staphylococcus aureus
VENTEHT

SEQ ID NO: 1611919 - protein, 6 aa, Staphylococcus aureus
VESGTP

SEQ ID NO: 1611920 - protein, 7 aa, Staphylococcus aureus
VNERNEV

SEQ ID NO: 1611921 - protein, 5 aa, Staphylococcus aureus
VNGKK

SEQ ID NO: 1611922 - protein, 8 aa, Staphylococcus aureus
VSDDAKAW

SEQ ID NO: 1611923 - protein, 5 aa, Staphylococcus aureus
VTSGY

SEQ ID NO: 1611924 - protein, 4 aa, Staphylococcus aureus
WPES

SEQ ID NO: 1611925 - protein, 9 aa, Staphylococcus aureus
YAADPDNFK

SEQ ID NO: 1611926 - protein, 6 aa, Staphylococcus aureus
YKKNGI

SEQ ID NO: 1611927 - protein, 11 aa, Staphylococcus aureus
AAGQGEDTDKH

SEQ ID NO: 1611928 - protein, 4 aa, Staphylococcus aureus
APHF

SEQ ID NO: 1611929 - protein, 4 aa, Staphylococcus aureus
ARAD

SEQ ID NO: 1611930 - protein, 7 aa, Staphylococcus aureus
ARRQGDN

SEQ ID NO: 1611931 - protein, 5 aa, Staphylococcus aureus
ASQGL

SEQ ID NO: 1611932 - protein, 11 aa, Staphylococcus aureus
ATQNEHRPTNT

SEQ ID NO: 1611933 - protein, 6 aa, Staphylococcus aureus
ATTQGV

SEQ ID NO: 1611934 - protein, 14 aa, Staphylococcus aureus
ATYGKDPETKGQYW

SEQ ID NO: 1611935 - protein, 17 aa, Staphylococcus aureus
CDQQTRKFNSEASKEEG

SEQ ID NO: 1611936 - protein, 6 aa, Staphylococcus aureus
DDNPRQ

SEQ ID NO: 1611937 - protein, 11 aa, Staphylococcus aureus
DDSFPKQEKLT

SEQ ID NO: 1611938 - protein, 8 aa, Staphylococcus aureus
DESDEDTL

SEQ ID NO: 1611939 - protein, 36 aa, Staphylococcus aureus
DMNDQLKKDEKNGDITEDELRSGTEDVQKATDNSIK

SEQ ID NO: 1611940 - protein, 13 aa, Staphylococcus aureus
DVPEIGQPMEPNV

SEQ ID NO: 1611941 - protein, 5 aa, Staphylococcus aureus
EEDPT

SEQ ID NO: 1611942 - protein, 5 aa, Staphylococcus aureus
EEIDD

SEQ ID NO: 1611943 - protein, 8 aa, Staphylococcus aureus
EERGGGRQ

SEQ ID NO: 1611944 - protein, 7 aa, Staphylococcus aureus
EETGDIS

SEQ ID NO: 1611945 - protein, 5 aa, Staphylococcus aureus
EHGTR

SEQ ID NO: 1611946 - protein, 8 aa, Staphylococcus aureus
EMEPDEGS

SEQ ID NO: 1611947 - protein, 7 aa, Staphylococcus aureus
ENAGPSW

SEQ ID NO: 1611948 - protein, 10 aa, Staphylococcus aureus
ENGQVNEQGL

SEQ ID NO: 1611949 - protein, 14 aa, Staphylococcus aureus
ENVDGRSGSIYKGR

SEQ ID NO: 1611950 - protein, 16 aa, Staphylococcus aureus
EQERNESKRRQAQGIQ

SEQ ID NO: 1611951 - protein, 6 aa, Staphylococcus aureus
ETSNER

SEQ ID NO: 1611952 - protein, 6 aa, Staphylococcus aureus
EVEGAD

SEQ ID NO: 1611953 - protein, 9 aa, Staphylococcus aureus
FGPSGKENY

SEQ ID NO: 1611954 - protein, 8 aa, Staphylococcus aureus
FPKSVTDD

SEQ ID NO: 1611955 - protein, 11 aa, Staphylococcus aureus
GAPTRAVEQAG

SEQ ID NO: 1611956 - protein, 4 aa, Staphylococcus aureus
GATK

SEQ ID NO: 1611957 - protein, 8 aa, Staphylococcus aureus
GDESFPIE

SEQ ID NO: 1611958 - protein, 21 aa, Staphylococcus aureus
GHHPWNQANEQPEYQEHQDNF

SEQ ID NO: 1611959 - protein, 6 aa, Staphylococcus aureus
GIGPKK

SEQ ID NO: 1611960 - protein, 6 aa, Staphylococcus aureus
GIPKKN

SEQ ID NO: 1611961 - protein, 6 aa, Staphylococcus aureus
GNGLSE

SEQ ID NO: 1611962 - protein, 14 aa, Staphylococcus aureus
GQQTEETRNFIQNM

SEQ ID NO: 1611963 - protein, 5 aa, Staphylococcus aureus
GSDNL

SEQ ID NO: 1611964 - protein, 10 aa, Staphylococcus aureus
GSGPAGLTAA

SEQ ID NO: 1611965 - protein, 9 aa, Staphylococcus aureus
GTGIDEESA

SEQ ID NO: 1611966 - protein, 4 aa, Staphylococcus aureus
GTSV

SEQ ID NO: 1611967 - protein, 9 aa, Staphylococcus aureus
GYAYESGGD

SEQ ID NO: 1611968 - protein, 24 aa, Staphylococcus aureus
HKSVSDFRGGMPSEGGFGVTVATL

SEQ ID NO: 1611969 - protein, 26 aa, Staphylococcus aureus
HQTPKQYRGDRPAITENQQSAQHNYH

SEQ ID NO: 1611970 - protein, 6 aa, Staphylococcus aureus
IAQEHN

SEQ ID NO: 1611971 - protein, 13 aa, Staphylococcus aureus
IDPSSEAKDFNRP

SEQ ID NO: 1611972 - protein, 11 aa, Staphylococcus aureus
IEEEKLDIPPE

SEQ ID NO: 1611973 - protein, 16 aa, Staphylococcus aureus
IEKQETELSDDELQEA

SEQ ID NO: 1611974 - protein, 11 aa, Staphylococcus aureus
IETPNVKTAQE

SEQ ID NO: 1611975 - protein, 8 aa, Staphylococcus aureus
IPEEEHKD

SEQ ID NO: 1611976 - protein, 6 aa, Staphylococcus aureus
IPFSND

SEQ ID NO: 1611977 - protein, 6 aa, Staphylococcus aureus
KDEEKN

SEQ ID NO: 1611978 - protein, 7 aa, Staphylococcus aureus
KFAGKAT

SEQ ID NO: 1611979 - protein, 5 aa, Staphylococcus aureus
KPIKG

SEQ ID NO: 1611980 - protein, 6 aa, Staphylococcus aureus
KQAGAE

SEQ ID NO: 1611981 - protein, 8 aa, Staphylococcus aureus
KRISPING

SEQ ID NO: 1611982 - protein, 30 aa, Staphylococcus aureus
KRLAEQKATDAENVEKEEAITKATDNTTID

SEQ ID NO: 1611983 - protein, 8 aa, Staphylococcus aureus
LASSGNYD

SEQ ID NO: 1611984 - protein, 4 aa, Staphylococcus aureus
LEQD

SEQ ID NO: 1611985 - protein, 4 aa, Staphylococcus aureus
LRQT

SEQ ID NO: 1611986 - protein, 16 aa, Staphylococcus aureus
LSDSPKISKSLGTRHR

SEQ ID NO: 1611987 - protein, 17 aa, Staphylococcus aureus
LTEEQRQQFEAEGRQPS

SEQ ID NO: 1611988 - protein, 11 aa, Staphylococcus aureus
NAPEEKERGIT

SEQ ID NO: 1611989 - protein, 7 aa, Staphylococcus aureus
NDDFETS

SEQ ID NO: 1611990 - protein, 10 aa, Staphylococcus aureus
NDMYEKEGAK
